United States Patent 7,314,750 (ADDRESSABLE OLIGONUCLEOTIDE ARRAY OF THE RAT GENOME) - sequence listing, part 6

SEQ ID NO: 189311 - DNA, 25 bp, Rattus norvegicus
atgactgaccccagctgtaaaactg

SEQ ID NO: 189312 - DNA, 25 bp, Rattus norvegicus
atgactgacccctgctgtaaaactg

SEQ ID NO: 189313 - DNA, 25 bp, Rattus norvegicus
atgactgaccctacatattcagaag

SEQ ID NO: 189314 - DNA, 25 bp, Rattus norvegicus
atgactgacccttcatattcagaag

SEQ ID NO: 189315 - DNA, 25 bp, Rattus norvegicus
atgactgactcacttctttctgact

SEQ ID NO: 189316 - DNA, 25 bp, Rattus norvegicus
atgactgactcagttctttctgact

SEQ ID NO: 189317 - DNA, 25 bp, Rattus norvegicus
atgactgactgacatgtcctctcct

SEQ ID NO: 189318 - DNA, 25 bp, Rattus norvegicus
atgactgactgagatgtcctctcct

SEQ ID NO: 189319 - DNA, 25 bp, Rattus norvegicus
atgactgagagaaccgagaccccaa

SEQ ID NO: 189320 - DNA, 25 bp, Rattus norvegicus
atgactgagagatccgagaccccaa

SEQ ID NO: 189321 - DNA, 25 bp, Rattus norvegicus
atgactgagcacaagggtttcagag

SEQ ID NO: 189322 - DNA, 25 bp, Rattus norvegicus
atgactgagcactagggtttcagag

SEQ ID NO: 189323 - DNA, 25 bp, Rattus norvegicus
atgactgagcgaccgagtgactccc

SEQ ID NO: 189324 - DNA, 25 bp, Rattus norvegicus
atgactgagcgagcgagtgactccc

SEQ ID NO: 189325 - DNA, 25 bp, Rattus norvegicus
atgactgatgcccttgtcattccct

SEQ ID NO: 189326 - DNA, 25 bp, Rattus norvegicus
atgactgatgccgttgtcattccct

SEQ ID NO: 189327 - DNA, 25 bp, Rattus norvegicus
atgactgatggtcactgccggatcc

SEQ ID NO: 189328 - DNA, 25 bp, Rattus norvegicus
atgactgatggtgactgccggatcc

SEQ ID NO: 189329 - DNA, 25 bp, Rattus norvegicus
atgactgatgtcactaagctattta

SEQ ID NO: 189330 - DNA, 25 bp, Rattus norvegicus
atgactgatgtctctaagctattta

SEQ ID NO: 189331 - DNA, 25 bp, Rattus norvegicus
atgactgattctcaggacccacgtg

SEQ ID NO: 189332 - DNA, 25 bp, Rattus norvegicus
atgactgattctgaggacccacgtg

SEQ ID NO: 189333 - DNA, 25 bp, Rattus norvegicus
atgactgcaaatccttttctaccaa

SEQ ID NO: 189334 - DNA, 25 bp, Rattus norvegicus
atgactgcaaatgcttttctaccaa

SEQ ID NO: 189335 - DNA, 25 bp, Rattus norvegicus
atgactgcaccgcttgtgggctctt

SEQ ID NO: 189336 - DNA, 25 bp, Rattus norvegicus
atgactgcaccggttgtgggctctt

SEQ ID NO: 189337 - DNA, 25 bp, Rattus norvegicus
atgactgcaggtcgcattacccagc

SEQ ID NO: 189338 - DNA, 25 bp, Rattus norvegicus
atgactgcaggtggcattacccagc

SEQ ID NO: 189339 - DNA, 25 bp, Rattus norvegicus
atgactgcagtgacattcaagcggg

SEQ ID NO: 189340 - DNA, 25 bp, Rattus norvegicus
atgactgcagtgtcattcaagcggg

SEQ ID NO: 189341 - DNA, 25 bp, Rattus norvegicus
atgactgcatttcttgcaccatgtc

SEQ ID NO: 189342 - DNA, 25 bp, Rattus norvegicus
atgactgcatttgttgcaccatgtc

SEQ ID NO: 189343 - DNA, 25 bp, Rattus norvegicus
atgactgccaagacgctagtcctgc

SEQ ID NO: 189344 - DNA, 25 bp, Rattus norvegicus
atgactgccaagtcgctagtcctgc

SEQ ID NO: 189345 - DNA, 25 bp, Rattus norvegicus
atgactgccagaagtcttgtcttcc

SEQ ID NO: 189346 - DNA, 25 bp, Rattus norvegicus
atgactgccagatgtcttgtcttcc

SEQ ID NO: 189347 - DNA, 25 bp, Rattus norvegicus
atgactgcccctaagtaacgcagac

SEQ ID NO: 189348 - DNA, 25 bp, Rattus norvegicus
atgactgccccttagtaacgcagac

SEQ ID NO: 189349 - DNA, 25 bp, Rattus norvegicus
atgactgccctaccgagattccggc

SEQ ID NO: 189350 - DNA, 25 bp, Rattus norvegicus
atgactgccctagcgagattccggc

SEQ ID NO: 189351 - DNA, 25 bp, Rattus norvegicus
atgactgccctccagtgaggctctg

SEQ ID NO: 189352 - DNA, 25 bp, Rattus norvegicus
atgactgccctcgagtgaggctctg

SEQ ID NO: 189353 - DNA, 25 bp, Rattus norvegicus
atgactgccgtcaatggacacacca

SEQ ID NO: 189354 - DNA, 25 bp, Rattus norvegicus
atgactgccgtctatggacacacca

SEQ ID NO: 189355 - DNA, 25 bp, Rattus norvegicus
atgactgcctttaacctttttggag

SEQ ID NO: 189356 - DNA, 25 bp, Rattus norvegicus
atgactgccttttacctttttggag

SEQ ID NO: 189357 - DNA, 25 bp, Rattus norvegicus
atgactgctacacactttaactcgt

SEQ ID NO: 189358 - DNA, 25 bp, Rattus norvegicus
atgactgctacagactttaactcgt

SEQ ID NO: 189359 - DNA, 25 bp, Rattus norvegicus
atgactgctatcaccgattcaaatc

SEQ ID NO: 189360 - DNA, 25 bp, Rattus norvegicus
atgactgctatctccgattcaaatc

SEQ ID NO: 189361 - DNA, 25 bp, Rattus norvegicus
atgactgctcggcaatgctctggac

SEQ ID NO: 189362 - DNA, 25 bp, Rattus norvegicus
atgactgctcgggaatgctctggac

SEQ ID NO: 189363 - DNA, 25 bp, Rattus norvegicus
atgactgctctcaagtgtgtactta

SEQ ID NO: 189364 - DNA, 25 bp, Rattus norvegicus
atgactgctctctagtgtgtactta

SEQ ID NO: 189365 - DNA, 25 bp, Rattus norvegicus
atgactgctctgatggtggatgcaa

SEQ ID NO: 189366 - DNA, 25 bp, Rattus norvegicus
atgactgctctgttggtggatgcaa

SEQ ID NO: 189367 - DNA, 25 bp, Rattus norvegicus
atgactgctggtctgtttcctggca

SEQ ID NO: 189368 - DNA, 25 bp, Rattus norvegicus
atgactgctggtgtgtttcctggca

SEQ ID NO: 189369 - DNA, 25 bp, Rattus norvegicus
atgactgctttaccaacggagctgt

SEQ ID NO: 189370 - DNA, 25 bp, Rattus norvegicus
atgactgctttagcaacggagctgt

SEQ ID NO: 189371 - DNA, 25 bp, Rattus norvegicus
atgactgctttgatctggacaacgg

SEQ ID NO: 189372 - DNA, 25 bp, Rattus norvegicus
atgactgctttgttctggacaacgg

SEQ ID NO: 189373 - DNA, 25 bp, Rattus norvegicus
atgactggacatcccagcagcacag

SEQ ID NO: 189374 - DNA, 25 bp, Rattus norvegicus
atgactggacatgccagcagcacag

SEQ ID NO: 189375 - DNA, 25 bp, Rattus norvegicus
atgactggaggcatcgtgagttaga

SEQ ID NO: 189376 - DNA, 25 bp, Rattus norvegicus
atgactggaggcttcgtgagttaga

SEQ ID NO: 189377 - DNA, 25 bp, Rattus norvegicus
atgactggagtacctgcaacacctg

SEQ ID NO: 189378 - DNA, 25 bp, Rattus norvegicus
atgactggagtagctgcaacacctg

SEQ ID NO: 189379 - DNA, 25 bp, Rattus norvegicus
atgactggcatcctgtctgagcaca

SEQ ID NO: 189380 - DNA, 25 bp, Rattus norvegicus
atgactggcatcgtgtctgagcaca

SEQ ID NO: 189381 - DNA, 25 bp, Rattus norvegicus
atgactggcattctgcttcttaggc

SEQ ID NO: 189382 - DNA, 25 bp, Rattus norvegicus
atgactggcattgtgcttcttaggc

SEQ ID NO: 189383 - DNA, 25 bp, Rattus norvegicus
atgactgggactactgcgagcacca

SEQ ID NO: 189384 - DNA, 25 bp, Rattus norvegicus
atgactgggacttctgcgagcacca

SEQ ID NO: 189385 - DNA, 25 bp, Rattus norvegicus
atgactgggcacacctgttagggat

SEQ ID NO: 189386 - DNA, 25 bp, Rattus norvegicus
atgactgggcactcctgttagggat

SEQ ID NO: 189387 - DNA, 25 bp, Rattus norvegicus
atgactgggtatcgcagcacacggc

SEQ ID NO: 189388 - DNA, 25 bp, Rattus norvegicus
atgactgggtatggcagcacacggc

SEQ ID NO: 189389 - DNA, 25 bp, Rattus norvegicus
atgactgggtggagacctgcagcta

SEQ ID NO: 189390 - DNA, 25 bp, Rattus norvegicus
atgactgggtggtgacctgcagcta

SEQ ID NO: 189391 - DNA, 25 bp, Rattus norvegicus
atgactgggtgtacatgtgcttctt

SEQ ID NO: 189392 - DNA, 25 bp, Rattus norvegicus
atgactgggtgttcatgtgcttctt

SEQ ID NO: 189393 - DNA, 25 bp, Rattus norvegicus
atgactggtgcccatgatcaggcaa

SEQ ID NO: 189394 - DNA, 25 bp, Rattus norvegicus
atgactggtgccgatgatcaggcaa

SEQ ID NO: 189395 - DNA, 25 bp, Rattus norvegicus
atgactgtaactatccactagggcc

SEQ ID NO: 189396 - DNA, 25 bp, Rattus norvegicus
atgactgtaactcctgtaacctcaa

SEQ ID NO: 189397 - DNA, 25 bp, Rattus norvegicus
atgactgtaactgctgtaacctcaa

SEQ ID NO: 189398 - DNA, 25 bp, Rattus norvegicus
atgactgtaactttccactagggcc

SEQ ID NO: 189399 - DNA, 25 bp, Rattus norvegicus
atgactgtatcccagccagaggaat

SEQ ID NO: 189400 - DNA, 25 bp, Rattus norvegicus
atgactgtatccctgctttttaagc

SEQ ID NO: 189401 - DNA, 25 bp, Rattus norvegicus
atgactgtatccgagccagaggaat

SEQ ID NO: 189402 - DNA, 25 bp, Rattus norvegicus
atgactgtatccgtgctttttaagc

SEQ ID NO: 189403 - DNA, 25 bp, Rattus norvegicus
atgactgtatggaggtgcctcactt

SEQ ID NO: 189404 - DNA, 25 bp, Rattus norvegicus
atgactgtatggtggtgcctcactt

SEQ ID NO: 189405 - DNA, 25 bp, Rattus norvegicus
atgactgtcataagatctgggctac

SEQ ID NO: 189406 - DNA, 25 bp, Rattus norvegicus
atgactgtcatatgatctgggctac

SEQ ID NO: 189407 - DNA, 25 bp, Rattus norvegicus
atgactgtcatccatgggacggtaa

SEQ ID NO: 189408 - DNA, 25 bp, Rattus norvegicus
atgactgtcatcgatgggacggtaa

SEQ ID NO: 189409 - DNA, 25 bp, Rattus norvegicus
atgactgtcccaaaagttacttgaa

SEQ ID NO: 189410 - DNA, 25 bp, Rattus norvegicus
atgactgtcccataagttacttgaa

SEQ ID NO: 189411 - DNA, 25 bp, Rattus norvegicus
atgactgtctaaaataaaccttcct

SEQ ID NO: 189412 - DNA, 25 bp, Rattus norvegicus
atgactgtctaatataaaccttcct

SEQ ID NO: 189413 - DNA, 25 bp, Rattus norvegicus
atgactgtcttcagccattagtctc

SEQ ID NO: 189414 - DNA, 25 bp, Rattus norvegicus
atgactgtcttctgccattagtctc

SEQ ID NO: 189415 - DNA, 25 bp, Rattus norvegicus
atgactgtgaagctgactccctcat

SEQ ID NO: 189416 - DNA, 25 bp, Rattus norvegicus
atgactgtgaaggtgactccctcat

SEQ ID NO: 189417 - DNA, 25 bp, Rattus norvegicus
atgactgtgctgagtatttatcaaa

SEQ ID NO: 189418 - DNA, 25 bp, Rattus norvegicus
atgactgtgctgtgtatttatcaaa

SEQ ID NO: 189419 - DNA, 25 bp, Rattus norvegicus
atgactgtggagagctactgaagaa

SEQ ID NO: 189420 - DNA, 25 bp, Rattus norvegicus
atgactgtggagtgctactgaagaa

SEQ ID NO: 189421 - DNA, 25 bp, Rattus norvegicus
atgactgtggctctgttcctctggg

SEQ ID NO: 189422 - DNA, 25 bp, Rattus norvegicus
atgactgtggctgtgttcctctggg

SEQ ID NO: 189423 - DNA, 25 bp, Rattus norvegicus
atgactgtgggcagcatgtgtaaga

SEQ ID NO: 189424 - DNA, 25 bp, Rattus norvegicus
atgactgtgggctgcatgtgtaaga

SEQ ID NO: 189425 - DNA, 25 bp, Rattus norvegicus
atgactgtgtacacatgcaggatgt

SEQ ID NO: 189426 - DNA, 25 bp, Rattus norvegicus
atgactgtgtactcatgcaggatgt

SEQ ID NO: 189427 - DNA, 25 bp, Rattus norvegicus
atgactgttagaaccctcaatgtgc

SEQ ID NO: 189428 - DNA, 25 bp, Rattus norvegicus
atgactgttagatccctcaatgtgc

SEQ ID NO: 189429 - DNA, 25 bp, Rattus norvegicus
atgactgttctgagccaggagactt

SEQ ID NO: 189430 - DNA, 25 bp, Rattus norvegicus
atgactgttctgtgccaggagactt

SEQ ID NO: 189431 - DNA, 25 bp, Rattus norvegicus
atgactgttgccagcaaaagaaaaa

SEQ ID NO: 189432 - DNA, 25 bp, Rattus norvegicus
atgactgttgcctgcaaaagaaaaa

SEQ ID NO: 189433 - DNA, 25 bp, Rattus norvegicus
atgactgttggtattattctgtgaa

SEQ ID NO: 189434 - DNA, 25 bp, Rattus norvegicus
atgactgttggttttattctgtgaa

SEQ ID NO: 189435 - DNA, 25 bp, Rattus norvegicus
atgactgtttccaatgctagtggcc

SEQ ID NO: 189436 - DNA, 25 bp, Rattus norvegicus
atgactgtttcctatgctagtggcc

SEQ ID NO: 189437 - DNA, 25 bp, Rattus norvegicus
atgactgtttctatttgtgcctcac

SEQ ID NO: 189438 - DNA, 25 bp, Rattus norvegicus
atgactgtttctttttgtgcctcac

SEQ ID NO: 189439 - DNA, 25 bp, Rattus norvegicus
atgactgtttgcaggtttttaaatg

SEQ ID NO: 189440 - DNA, 25 bp, Rattus norvegicus
atgactgtttgctggtttttaaatg

SEQ ID NO: 189441 - DNA, 25 bp, Rattus norvegicus
atgacttaactcctttggtccctag

SEQ ID NO: 189442 - DNA, 25 bp, Rattus norvegicus
atgacttaactcgtttggtccctag

SEQ ID NO: 189443 - DNA, 25 bp, Rattus norvegicus
atgacttaattcacgccaaccgttt

SEQ ID NO: 189444 - DNA, 25 bp, Rattus norvegicus
atgacttaattctcgccaaccgttt

SEQ ID NO: 189445 - DNA, 25 bp, Rattus norvegicus
atgacttaattgcttttcttggtgt

SEQ ID NO: 189446 - DNA, 25 bp, Rattus norvegicus
atgacttaattggttttcttggtgt

SEQ ID NO: 189447 - DNA, 25 bp, Rattus norvegicus
atgacttacagaatgttttgttcag

SEQ ID NO: 189448 - DNA, 25 bp, Rattus norvegicus
atgacttacagattgttttgttcag

SEQ ID NO: 189449 - DNA, 25 bp, Rattus norvegicus
atgacttacattccactgctgggag

SEQ ID NO: 189450 - DNA, 25 bp, Rattus norvegicus
atgacttacattgcactgctgggag

SEQ ID NO: 189451 - DNA, 25 bp, Rattus norvegicus
atgacttaccacagtgcaccatttt

SEQ ID NO: 189452 - DNA, 25 bp, Rattus norvegicus
atgacttaccactgtgcaccatttt

SEQ ID NO: 189453 - DNA, 25 bp, Rattus norvegicus
atgacttacctgaattgggagtgac

SEQ ID NO: 189454 - DNA, 25 bp, Rattus norvegicus
atgacttacctgaggatctgcttcg

SEQ ID NO: 189455 - DNA, 25 bp, Rattus norvegicus
atgacttacctgtattgggagtgac

SEQ ID NO: 189456 - DNA, 25 bp, Rattus norvegicus
atgacttacctgtggatctgcttcg

SEQ ID NO: 189457 - DNA, 25 bp, Rattus norvegicus
atgacttacgatcgtgtccgactct

SEQ ID NO: 189458 - DNA, 25 bp, Rattus norvegicus
atgacttacgatggtgtccgactct

SEQ ID NO: 189459 - DNA, 25 bp, Rattus norvegicus
atgacttacgctagagtcctggatc

SEQ ID NO: 189460 - DNA, 25 bp, Rattus norvegicus
atgacttacgcttgagtcctggatc

SEQ ID NO: 189461 - DNA, 25 bp, Rattus norvegicus
atgacttagcatcttttacctgtaa

SEQ ID NO: 189462 - DNA, 25 bp, Rattus norvegicus
atgacttagcatgttttacctgtaa

SEQ ID NO: 189463 - DNA, 25 bp, Rattus norvegicus
atgacttatatacacccacacaggt

SEQ ID NO: 189464 - DNA, 25 bp, Rattus norvegicus
atgacttatatagacccacacaggt

SEQ ID NO: 189465 - DNA, 25 bp, Rattus norvegicus
atgacttcaaatattgtccagtgtt

SEQ ID NO: 189466 - DNA, 25 bp, Rattus norvegicus
atgacttcaaattttgtccagtgtt

SEQ ID NO: 189467 - DNA, 25 bp, Rattus norvegicus
atgacttcaccacaaggactgtacc

SEQ ID NO: 189468 - DNA, 25 bp, Rattus norvegicus
atgacttcaccagaaggactgtacc

SEQ ID NO: 189469 - DNA, 25 bp, Rattus norvegicus
atgacttcacctaactcatgcattt

SEQ ID NO: 189470 - DNA, 25 bp, Rattus norvegicus
atgacttcaccttactcatgcattt

SEQ ID NO: 189471 - DNA, 25 bp, Rattus norvegicus
atgacttcacgtctgcattttgtcc

SEQ ID NO: 189472 - DNA, 25 bp, Rattus norvegicus
atgacttcacgtgtgcattttgtcc

SEQ ID NO: 189473 - DNA, 25 bp, Rattus norvegicus
atgacttcagaaatgcctgcggctg

SEQ ID NO: 189474 - DNA, 25 bp, Rattus norvegicus
atgacttcagaattgcctgcggctg

SEQ ID NO: 189475 - DNA, 25 bp, Rattus norvegicus
atgacttcagcaactggagcatcct

SEQ ID NO: 189476 - DNA, 25 bp, Rattus norvegicus
atgacttcagcatctggagcatcct

SEQ ID NO: 189477 - DNA, 25 bp, Rattus norvegicus
atgacttcagctccaagggatcctt

SEQ ID NO: 189478 - DNA, 25 bp, Rattus norvegicus
atgacttcagctgcaagggatcctt

SEQ ID NO: 189479 - DNA, 25 bp, Rattus norvegicus
atgacttcaggaagctagacttggt

SEQ ID NO: 189480 - DNA, 25 bp, Rattus norvegicus
atgacttcaggatgctagacttggt

SEQ ID NO: 189481 - DNA, 25 bp, Rattus norvegicus
atgacttccataacttacagcttcc

SEQ ID NO: 189482 - DNA, 25 bp, Rattus norvegicus
atgacttccatatcttacagcttcc

SEQ ID NO: 189483 - DNA, 25 bp, Rattus norvegicus
atgacttccatcacggactgcagtt

SEQ ID NO: 189484 - DNA, 25 bp, Rattus norvegicus
atgacttccatctcggactgcagtt

SEQ ID NO: 189485 - DNA, 25 bp, Rattus norvegicus
atgacttccccaatgtgctggttgg

SEQ ID NO: 189486 - DNA, 25 bp, Rattus norvegicus
atgacttccccattgtgctggttgg

SEQ ID NO: 189487 - DNA, 25 bp, Rattus norvegicus
atgacttcccgacttaccggagtgt

SEQ ID NO: 189488 - DNA, 25 bp, Rattus norvegicus
atgacttcccgagttaccggagtgt

SEQ ID NO: 189489 - DNA, 25 bp, Rattus norvegicus
atgacttccgagaagcagcctgcgg

SEQ ID NO: 189490 - DNA, 25 bp, Rattus norvegicus
atgacttccgagtagcagcctgcgg

SEQ ID NO: 189491 - DNA, 25 bp, Rattus norvegicus
atgacttccggtatatcttccccga

SEQ ID NO: 189492 - DNA, 25 bp, Rattus norvegicus
atgacttccggtatgactccaggtt

SEQ ID NO: 189493 - DNA, 25 bp, Rattus norvegicus
atgacttccggtttatcttccccga

SEQ ID NO: 189494 - DNA, 25 bp, Rattus norvegicus
atgacttccggtttgactccaggtt

SEQ ID NO: 189495 - DNA, 25 bp, Rattus norvegicus
atgacttcctggacctactgaagcc

SEQ ID NO: 189496 - DNA, 25 bp, Rattus norvegicus
atgacttcctggtcctactgaagcc

SEQ ID NO: 189497 - DNA, 25 bp, Rattus norvegicus
atgacttccttcaagctgatttggc

SEQ ID NO: 189498 - DNA, 25 bp, Rattus norvegicus
atgacttccttctagctgatttggc

SEQ ID NO: 189499 - DNA, 25 bp, Rattus norvegicus
atgacttcgcttctgctggaagcat

SEQ ID NO: 189500 - DNA, 25 bp, Rattus norvegicus
atgacttcgcttgtgctggaagcat

SEQ ID NO: 189501 - DNA, 25 bp, Rattus norvegicus
atgacttcgggcaagtctcttttat

SEQ ID NO: 189502 - DNA, 25 bp, Rattus norvegicus
atgacttcgggctagtctcttttat

SEQ ID NO: 189503 - DNA, 25 bp, Rattus norvegicus
atgacttctacacggccactgagag

SEQ ID NO: 189504 - DNA, 25 bp, Rattus norvegicus
atgacttctacagggccactgagag

SEQ ID NO: 189505 - DNA, 25 bp, Rattus norvegicus
atgacttctagtcctcttttaatgc

SEQ ID NO: 189506 - DNA, 25 bp, Rattus norvegicus
atgacttctagtgctcttttaatgc

SEQ ID NO: 189507 - DNA, 25 bp, Rattus norvegicus
atgacttctcctcggatctggaaaa

SEQ ID NO: 189508 - DNA, 25 bp, Rattus norvegicus
atgacttctcctgggatctggaaaa

SEQ ID NO: 189509 - DNA, 25 bp, Rattus norvegicus
atgacttctgaaacctttcacccag

SEQ ID NO: 189510 - DNA, 25 bp, Rattus norvegicus
atgacttctgaatcctttcacccag

SEQ ID NO: 189511 - DNA, 25 bp, Rattus norvegicus
atgacttgaatacttgcccattttg

SEQ ID NO: 189512 - DNA, 25 bp, Rattus norvegicus
atgacttgaatagttgcccattttg

SEQ ID NO: 189513 - DNA, 25 bp, Rattus norvegicus
atgacttgaccacccactgaagtga

SEQ ID NO: 189514 - DNA, 25 bp, Rattus norvegicus
atgacttgaccagccactgaagtga

SEQ ID NO: 189515 - DNA, 25 bp, Rattus norvegicus
atgacttgacctctgacctcagaac

SEQ ID NO: 189516 - DNA, 25 bp, Rattus norvegicus
atgacttgacctgtgacctcagaac

SEQ ID NO: 189517 - DNA, 25 bp, Rattus norvegicus
atgacttgcattaaacactaaccgt

SEQ ID NO: 189518 - DNA, 25 bp, Rattus norvegicus
atgacttgcatttaacactaaccgt

SEQ ID NO: 189519 - DNA, 25 bp, Rattus norvegicus
atgacttgctcaaggtggatcctga

SEQ ID NO: 189520 - DNA, 25 bp, Rattus norvegicus
atgacttgctcatggtggatcctga

SEQ ID NO: 189521 - DNA, 25 bp, Rattus norvegicus
atgacttgctccattgtccgctgct

SEQ ID NO: 189522 - DNA, 25 bp, Rattus norvegicus
atgacttgctcctttgtccgctgct

SEQ ID NO: 189523 - DNA, 25 bp, Rattus norvegicus
atgacttggagtagttggacttccc

SEQ ID NO: 189524 - DNA, 25 bp, Rattus norvegicus
atgacttggagttgttggacttccc

SEQ ID NO: 189525 - DNA, 25 bp, Rattus norvegicus
atgacttggataagttttcttgata

SEQ ID NO: 189526 - DNA, 25 bp, Rattus norvegicus
atgacttggatatgttttcttgata

SEQ ID NO: 189527 - DNA, 25 bp, Rattus norvegicus
atgacttgggaaaggcacaaaacat

SEQ ID NO: 189528 - DNA, 25 bp, Rattus norvegicus
atgacttgggaatggcacaaaacat

SEQ ID NO: 189529 - DNA, 25 bp, Rattus norvegicus
atgacttgtcagaaatctacatgaa

SEQ ID NO: 189530 - DNA, 25 bp, Rattus norvegicus
atgacttgtcagtaatctacatgaa

SEQ ID NO: 189531 - DNA, 25 bp, Rattus norvegicus
atgacttgtggccaaatcctcttta

SEQ ID NO: 189532 - DNA, 25 bp, Rattus norvegicus
atgacttgtggcgaaatcctcttta

SEQ ID NO: 189533 - DNA, 25 bp, Rattus norvegicus
atgactttaattccaagcactcaaa

SEQ ID NO: 189534 - DNA, 25 bp, Rattus norvegicus
atgactttaattgcaagcactcaaa

SEQ ID NO: 189535 - DNA, 25 bp, Rattus norvegicus
atgactttaccacccaattaatcag

SEQ ID NO: 189536 - DNA, 25 bp, Rattus norvegicus
atgactttaccagccaattaatcag

SEQ ID NO: 189537 - DNA, 25 bp, Rattus norvegicus
atgactttatccagaagatctttaa

SEQ ID NO: 189538 - DNA, 25 bp, Rattus norvegicus
atgactttatcctgaagatctttaa

SEQ ID NO: 189539 - DNA, 25 bp, Rattus norvegicus
atgactttatgactttggggtgaga

SEQ ID NO: 189540 - DNA, 25 bp, Rattus norvegicus
atgactttatgagtttggggtgaga

SEQ ID NO: 189541 - DNA, 25 bp, Rattus norvegicus
atgactttcagtatgccgagcttga

SEQ ID NO: 189542 - DNA, 25 bp, Rattus norvegicus
atgactttcagtcgccttgtacaaa

SEQ ID NO: 189543 - DNA, 25 bp, Rattus norvegicus
atgactttcagtggccttgtacaaa

SEQ ID NO: 189544 - DNA, 25 bp, Rattus norvegicus
atgactttcagtttgccgagcttga

SEQ ID NO: 189545 - DNA, 25 bp, Rattus norvegicus
atgactttcctactgtgaaccggtg

SEQ ID NO: 189546 - DNA, 25 bp, Rattus norvegicus
atgactttcctagtgtgaaccggtg

SEQ ID NO: 189547 - DNA, 25 bp, Rattus norvegicus
atgactttctcgctgagtactttat

SEQ ID NO: 189548 - DNA, 25 bp, Rattus norvegicus
atgactttctcggtgagtactttat

SEQ ID NO: 189549 - DNA, 25 bp, Rattus norvegicus
atgactttctttccagttctgaccg

SEQ ID NO: 189550 - DNA, 25 bp, Rattus norvegicus
atgactttctttgcagttctgaccg

SEQ ID NO: 189551 - DNA, 25 bp, Rattus norvegicus
atgactttgaagctcccgaggctcc

SEQ ID NO: 189552 - DNA, 25 bp, Rattus norvegicus
atgactttgaaggtcccgaggctcc

SEQ ID NO: 189553 - DNA, 25 bp, Rattus norvegicus
atgactttgccaaccttggtgtttt

SEQ ID NO: 189554 - DNA, 25 bp, Rattus norvegicus
atgactttgccatccttggtgtttt

SEQ ID NO: 189555 - DNA, 25 bp, Rattus norvegicus
atgactttggcaatagctgagatac

SEQ ID NO: 189556 - DNA, 25 bp, Rattus norvegicus
atgactttggcattagctgagatac

SEQ ID NO: 189557 - DNA, 25 bp, Rattus norvegicus
atgactttgtccagctgtctgcaaa

SEQ ID NO: 189558 - DNA, 25 bp, Rattus norvegicus
atgactttgtcctgctgtctgcaaa

SEQ ID NO: 189559 - DNA, 25 bp, Rattus norvegicus
atgactttgtcgcttgtgacctgat

SEQ ID NO: 189560 - DNA, 25 bp, Rattus norvegicus
atgactttgtcggttgtgacctgat

SEQ ID NO: 189561 - DNA, 25 bp, Rattus norvegicus
atgactttgttacattttctaattt

SEQ ID NO: 189562 - DNA, 25 bp, Rattus norvegicus
atgactttgttagattttctaattt

SEQ ID NO: 189563 - DNA, 25 bp, Rattus norvegicus
atgacttttaagagccccagttaat

SEQ ID NO: 189564 - DNA, 25 bp, Rattus norvegicus
atgacttttaagtgccccagttaat

SEQ ID NO: 189565 - DNA, 25 bp, Rattus norvegicus
atgacttttctaactgaattttttg

SEQ ID NO: 189566 - DNA, 25 bp, Rattus norvegicus
atgacttttctatctgaattttttg

SEQ ID NO: 189567 - DNA, 25 bp, Rattus norvegicus
atgacttttcttagtttcctctgca

SEQ ID NO: 189568 - DNA, 25 bp, Rattus norvegicus
atgacttttcttatgctcagctttt

SEQ ID NO: 189569 - DNA, 25 bp, Rattus norvegicus
atgacttttctttgtttcctctgca

SEQ ID NO: 189570 - DNA, 25 bp, Rattus norvegicus
atgacttttcttttgctcagctttt

SEQ ID NO: 189571 - DNA, 25 bp, Rattus norvegicus
atgacttttgacagttatgcatgac

SEQ ID NO: 189572 - DNA, 25 bp, Rattus norvegicus
atgacttttgactgttatgcatgac

SEQ ID NO: 189573 - DNA, 25 bp, Rattus norvegicus
atgacttttgcaatccgagtggctg

SEQ ID NO: 189574 - DNA, 25 bp, Rattus norvegicus
atgacttttgcattccgagtggctg

SEQ ID NO: 189575 - DNA, 25 bp, Rattus norvegicus
atgactttttctctgttattagcca

SEQ ID NO: 189576 - DNA, 25 bp, Rattus norvegicus
atgactttttctgtgttattagcca

SEQ ID NO: 189577 - DNA, 25 bp, Rattus norvegicus
atgagaaaattccatccaggcccca

SEQ ID NO: 189578 - DNA, 25 bp, Rattus norvegicus
atgagaaaattcgatccaggcccca

SEQ ID NO: 189579 - DNA, 25 bp, Rattus norvegicus
atgagaaaccaacatgctgccgctg

SEQ ID NO: 189580 - DNA, 25 bp, Rattus norvegicus
atgagaaaccaagatgctgccgctg

SEQ ID NO: 189581 - DNA, 25 bp, Rattus norvegicus
atgagaaacctgatgtttgcacacc

SEQ ID NO: 189582 - DNA, 25 bp, Rattus norvegicus
atgagaaacctgttgtttgcacacc

SEQ ID NO: 189583 - DNA, 25 bp, Rattus norvegicus
atgagaaacggcactactggggact

SEQ ID NO: 189584 - DNA, 25 bp, Rattus norvegicus
atgagaaacggctctactggggact

SEQ ID NO: 189585 - DNA, 25 bp, Rattus norvegicus
atgagaaagctaccaggccctgccc

SEQ ID NO: 189586 - DNA, 25 bp, Rattus norvegicus
atgagaaagctagcaggccctgccc

SEQ ID NO: 189587 - DNA, 25 bp, Rattus norvegicus
atgagaaatactcctaacacccgag

SEQ ID NO: 189588 - DNA, 25 bp, Rattus norvegicus
atgagaaatactgctaacacccgag

SEQ ID NO: 189589 - DNA, 25 bp, Rattus norvegicus
atgagaaattttaacctcgacttat

SEQ ID NO: 189590 - DNA, 25 bp, Rattus norvegicus
atgagaaatttttacctcgacttat

SEQ ID NO: 189591 - DNA, 25 bp, Rattus norvegicus
atgagaacacctcagctgggcgcta

SEQ ID NO: 189592 - DNA, 25 bp, Rattus norvegicus
atgagaacacctgagctgggcgcta

SEQ ID NO: 189593 - DNA, 25 bp, Rattus norvegicus
atgagaacatgaccacctgtgacac

SEQ ID NO: 189594 - DNA, 25 bp, Rattus norvegicus
atgagaacatgagcacctgtgacac

SEQ ID NO: 189595 - DNA, 25 bp, Rattus norvegicus
atgagaacattgagacccaggcaga

SEQ ID NO: 189596 - DNA, 25 bp, Rattus norvegicus
atgagaacattgtgacccaggcaga

SEQ ID NO: 189597 - DNA, 25 bp, Rattus norvegicus
atgagaacctcaacagcccctgaag

SEQ ID NO: 189598 - DNA, 25 bp, Rattus norvegicus
atgagaacctcatcagcccctgaag

SEQ ID NO: 189599 - DNA, 25 bp, Rattus norvegicus
atgagaacctgactggcgtagccac

SEQ ID NO: 189600 - DNA, 25 bp, Rattus norvegicus
atgagaacctgagtggcgtagccac

SEQ ID NO: 189601 - DNA, 25 bp, Rattus norvegicus
atgagaacctgcctgccattaggcc

SEQ ID NO: 189602 - DNA, 25 bp, Rattus norvegicus
atgagaacctgcgtgccattaggcc

SEQ ID NO: 189603 - DNA, 25 bp, Rattus norvegicus
atgagaacgcccagctcacagatgc

SEQ ID NO: 189604 - DNA, 25 bp, Rattus norvegicus
atgagaacgccctgctcacagatgc

SEQ ID NO: 189605 - DNA, 25 bp, Rattus norvegicus
atgagaacggcgactcgtccgagga

SEQ ID NO: 189606 - DNA, 25 bp, Rattus norvegicus
atgagaacggcgtctcgtccgagga

SEQ ID NO: 189607 - DNA, 25 bp, Rattus norvegicus
atgagaactacaccaccagcttctt

SEQ ID NO: 189608 - DNA, 25 bp, Rattus norvegicus
atgagaactacagcaccagcttctt

SEQ ID NO: 189609 - DNA, 25 bp, Rattus norvegicus
atgagaactctgcactaagtaactg

SEQ ID NO: 189610 - DNA, 25 bp, Rattus norvegicus
atgagaactctggactaagtaactg

SEQ ID NO: 189611 - DNA, 25 bp, Rattus norvegicus
atgagaactgatcctgccaaccctt

SEQ ID NO: 189612 - DNA, 25 bp, Rattus norvegicus
atgagaactgatgctgccaaccctt

SEQ ID NO: 189613 - DNA, 25 bp, Rattus norvegicus
atgagaacttctctactgccctgga

SEQ ID NO: 189614 - DNA, 25 bp, Rattus norvegicus
atgagaacttctgtactgccctgga

SEQ ID NO: 189615 - DNA, 25 bp, Rattus norvegicus
atgagaagaatgaagccctggccct

SEQ ID NO: 189616 - DNA, 25 bp, Rattus norvegicus
atgagaagaatgtagccctggccct

SEQ ID NO: 189617 - DNA, 25 bp, Rattus norvegicus
atgagaagcaacatcagaaggtttt

SEQ ID NO: 189618 - DNA, 25 bp, Rattus norvegicus
atgagaagcaacttcagaaggtttt

SEQ ID NO: 189619 - DNA, 25 bp, Rattus norvegicus
atgagaagctttctcagcacctgac

SEQ ID NO: 189620 - DNA, 25 bp, Rattus norvegicus
atgagaagctttgtcagcacctgac

SEQ ID NO: 189621 - DNA, 25 bp, Rattus norvegicus
atgagaaggactccagcctcaacac

SEQ ID NO: 189622 - DNA, 25 bp, Rattus norvegicus
atgagaaggactgcagcctcaacac

SEQ ID NO: 189623 - DNA, 25 bp, Rattus norvegicus
atgagaaggcgtatttatttttcac

SEQ ID NO: 189624 - DNA, 25 bp, Rattus norvegicus
atgagaaggcgtttttatttttcac

SEQ ID NO: 189625 - DNA, 25 bp, Rattus norvegicus
atgagaagtcagaccaccttgtgtt

SEQ ID NO: 189626 - DNA, 25 bp, Rattus norvegicus
atgagaagtcagtccaccttgtgtt

SEQ ID NO: 189627 - DNA, 25 bp, Rattus norvegicus
atgagaagtccaacagccggctaca

SEQ ID NO: 189628 - DNA, 25 bp, Rattus norvegicus
atgagaagtccatcagccggctaca

SEQ ID NO: 189629 - DNA, 25 bp, Rattus norvegicus
atgagaagtcccctgttttctgagc

SEQ ID NO: 189630 - DNA, 25 bp, Rattus norvegicus
atgagaagtcccgtgttttctgagc

SEQ ID NO: 189631 - DNA, 25 bp, Rattus norvegicus
atgagaagtctacgcggtttattaa

SEQ ID NO: 189632 - DNA, 25 bp, Rattus norvegicus
atgagaagtctaggcggtttattaa

SEQ ID NO: 189633 - DNA, 25 bp, Rattus norvegicus
atgagaagtgcgacgaggcacacaa

SEQ ID NO: 189634 - DNA, 25 bp, Rattus norvegicus
atgagaagtgcgtcgaggcacacaa

SEQ ID NO: 189635 - DNA, 25 bp, Rattus norvegicus
atgagaagtgtccttctgggattcc

SEQ ID NO: 189636 - DNA, 25 bp, Rattus norvegicus
atgagaagtgtcgttctgggattcc

SEQ ID NO: 189637 - DNA, 25 bp, Rattus norvegicus
atgagaagtgttctaccccatcgct

SEQ ID NO: 189638 - DNA, 25 bp, Rattus norvegicus
atgagaagtgttgtaccccatcgct

SEQ ID NO: 189639 - DNA, 25 bp, Rattus norvegicus
atgagaagttctctgcctggtgtcg

SEQ ID NO: 189640 - DNA, 25 bp, Rattus norvegicus
atgagaagttctgtgcctggtgtcg

SEQ ID NO: 189641 - DNA, 25 bp, Rattus norvegicus
atgagaatccacagcctgggacaga

SEQ ID NO: 189642 - DNA, 25 bp, Rattus norvegicus
atgagaatccactgcctgggacaga

SEQ ID NO: 189643 - DNA, 25 bp, Rattus norvegicus
atgagaatgaatcccacctctgcgt

SEQ ID NO: 189644 - DNA, 25 bp, Rattus norvegicus
atgagaatgaatgccacctctgcgt

SEQ ID NO: 189645 - DNA, 25 bp, Rattus norvegicus
atgagaatgatcaagtcgttgtcaa

SEQ ID NO: 189646 - DNA, 25 bp, Rattus norvegicus
atgagaatgatctagtcgttgtcaa

SEQ ID NO: 189647 - DNA, 25 bp, Rattus norvegicus
atgagaatgcatccgccatcagggc

SEQ ID NO: 189648 - DNA, 25 bp, Rattus norvegicus
atgagaatgcatgcgccatcagggc

SEQ ID NO: 189649 - DNA, 25 bp, Rattus norvegicus
atgagaatgtggaccctgagcaggc

SEQ ID NO: 189650 - DNA, 25 bp, Rattus norvegicus
atgagaatgtggtccctgagcaggc

SEQ ID NO: 189651 - DNA, 25 bp, Rattus norvegicus
atgagaatgttcagctttctcttaa

SEQ ID NO: 189652 - DNA, 25 bp, Rattus norvegicus
atgagaatgttctgctttctcttaa

SEQ ID NO: 189653 - DNA, 25 bp, Rattus norvegicus
atgagacaaactactcagcgtaaag

SEQ ID NO: 189654 - DNA, 25 bp, Rattus norvegicus
atgagacaaacttctcagcgtaaag

SEQ ID NO: 189655 - DNA, 25 bp, Rattus norvegicus
atgagacaacgccaggtccttggat

SEQ ID NO: 189656 - DNA, 25 bp, Rattus norvegicus
atgagacaacgcgaggtccttggat

SEQ ID NO: 189657 - DNA, 25 bp, Rattus norvegicus
atgagacactttatctgggtggaag

SEQ ID NO: 189658 - DNA, 25 bp, Rattus norvegicus
atgagacactttttctgggtggaag

SEQ ID NO: 189659 - DNA, 25 bp, Rattus norvegicus
atgagacagaaacgccgggccatgt

SEQ ID NO: 189660 - DNA, 25 bp, Rattus norvegicus
atgagacagaaaggccgggccatgt

SEQ ID NO: 189661 - DNA, 25 bp, Rattus norvegicus
atgagacagtgtagcctattgccca

SEQ ID NO: 189662 - DNA, 25 bp, Rattus norvegicus
atgagacagtgttgcctattgccca

SEQ ID NO: 189663 - DNA, 25 bp, Rattus norvegicus
atgagaccaaccagtttctagcacc

SEQ ID NO: 189664 - DNA, 25 bp, Rattus norvegicus
atgagaccaacctgtttctagcacc

SEQ ID NO: 189665 - DNA, 25 bp, Rattus norvegicus
atgagaccatacacccggtgggcat

SEQ ID NO: 189666 - DNA, 25 bp, Rattus norvegicus
atgagaccatactcccggtgggcat

SEQ ID NO: 189667 - DNA, 25 bp, Rattus norvegicus
atgagaccatctctatctgctaagg

SEQ ID NO: 189668 - DNA, 25 bp, Rattus norvegicus
atgagaccatctgtatctgctaagg

SEQ ID NO: 189669 - DNA, 25 bp, Rattus norvegicus
atgagaccatttagatgctgcccac

SEQ ID NO: 189670 - DNA, 25 bp, Rattus norvegicus
atgagaccattttgatgctgcccac

SEQ ID NO: 189671 - DNA, 25 bp, Rattus norvegicus
atgagacccggaatctgcagagtgt

SEQ ID NO: 189672 - DNA, 25 bp, Rattus norvegicus
atgagacccggattctgcagagtgt

SEQ ID NO: 189673 - DNA, 25 bp, Rattus norvegicus
atgagaccctgtcacggcatcagct

SEQ ID NO: 189674 - DNA, 25 bp, Rattus norvegicus
atgagaccctgtgacggcatcagct

SEQ ID NO: 189675 - DNA, 25 bp, Rattus norvegicus
atgagaccctttacattccatgata

SEQ ID NO: 189676 - DNA, 25 bp, Rattus norvegicus
atgagacccttttcattccatgata

SEQ ID NO: 189677 - DNA, 25 bp, Rattus norvegicus
atgagacctaaactctgcctgtgtt

SEQ ID NO: 189678 - DNA, 25 bp, Rattus norvegicus
atgagacctaaagtctgcctgtgtt

SEQ ID NO: 189679 - DNA, 25 bp, Rattus norvegicus
atgagacctacgaagccgacgatgt

SEQ ID NO: 189680 - DNA, 25 bp, Rattus norvegicus
atgagacctacgtagccgacgatgt

SEQ ID NO: 189681 - DNA, 25 bp, Rattus norvegicus
atgagacctatgagaccagcacccc

SEQ ID NO: 189682 - DNA, 25 bp, Rattus norvegicus
atgagacctatgtgaccagcacccc

SEQ ID NO: 189683 - DNA, 25 bp, Rattus norvegicus
atgagacctggtccgggcacgtcat

SEQ ID NO: 189684 - DNA, 25 bp, Rattus norvegicus
atgagacctggtgcgggcacgtcat

SEQ ID NO: 189685 - DNA, 25 bp, Rattus norvegicus
atgagacctttgagctaatcgttta

SEQ ID NO: 189686 - DNA, 25 bp, Rattus norvegicus
atgagacctttgtgctaatcgttta

SEQ ID NO: 189687 - DNA, 25 bp, Rattus norvegicus
atgagacgcaatagtgtcaccccac

SEQ ID NO: 189688 - DNA, 25 bp, Rattus norvegicus
atgagacgcaattgtgtcaccccac

SEQ ID NO: 189689 - DNA, 25 bp, Rattus norvegicus
atgagacgttgacagtggcccagat

SEQ ID NO: 189690 - DNA, 25 bp, Rattus norvegicus
atgagacgttgagagtggcccagat

SEQ ID NO: 189691 - DNA, 25 bp, Rattus norvegicus
atgagactatatctacagtttttta

SEQ ID NO: 189692 - DNA, 25 bp, Rattus norvegicus
atgagactatatgtacagtttttta

SEQ ID NO: 189693 - DNA, 25 bp, Rattus norvegicus
atgagactcatcacgaacacagctg

SEQ ID NO: 189694 - DNA, 25 bp, Rattus norvegicus
atgagactcatctcgaacacagctg

SEQ ID NO: 189695 - DNA, 25 bp, Rattus norvegicus
atgagactccatcgctgggccgcta

SEQ ID NO: 189696 - DNA, 25 bp, Rattus norvegicus
atgagactccatggctgggccgcta

SEQ ID NO: 189697 - DNA, 25 bp, Rattus norvegicus
atgagactccggcagtttcaagaag

SEQ ID NO: 189698 - DNA, 25 bp, Rattus norvegicus
atgagactccgggagtttcaagaag

SEQ ID NO: 189699 - DNA, 25 bp, Rattus norvegicus
atgagactcctcacctttatgggaa

SEQ ID NO: 189700 - DNA, 25 bp, Rattus norvegicus
atgagactcctctcctttatgggaa

SEQ ID NO: 189701 - DNA, 25 bp, Rattus norvegicus
atgagactcttcacgaacggccagg

SEQ ID NO: 189702 - DNA, 25 bp, Rattus norvegicus
atgagactcttctcgaacggccagg

SEQ ID NO: 189703 - DNA, 25 bp, Rattus norvegicus
atgagactcttgagctccggtggca

SEQ ID NO: 189704 - DNA, 25 bp, Rattus norvegicus
atgagactcttgtgctccggtggca

SEQ ID NO: 189705 - DNA, 25 bp, Rattus norvegicus
atgagactggtcatgctaacaaagc

SEQ ID NO: 189706 - DNA, 25 bp, Rattus norvegicus
atgagactggtcttgctaacaaagc

SEQ ID NO: 189707 - DNA, 25 bp, Rattus norvegicus
atgagactgtcgctgtcgaccccaa

SEQ ID NO: 189708 - DNA, 25 bp, Rattus norvegicus
atgagactgtcggtgtcgaccccaa

SEQ ID NO: 189709 - DNA, 25 bp, Rattus norvegicus
atgagacttctcagcaccacgatga

SEQ ID NO: 189710 - DNA, 25 bp, Rattus norvegicus
atgagacttctctgcaccacgatga

SEQ ID NO: 189711 - DNA, 25 bp, Rattus norvegicus
atgagacttgctcctaccaaaccaa

SEQ ID NO: 189712 - DNA, 25 bp, Rattus norvegicus
atgagacttgctgctaccaaaccaa

SEQ ID NO: 189713 - DNA, 25 bp, Rattus norvegicus
atgagactttatctcctagtttgga

SEQ ID NO: 189714 - DNA, 25 bp, Rattus norvegicus
atgagactttatgtcctagtttgga

SEQ ID NO: 189715 - DNA, 25 bp, Rattus norvegicus
atgagactttctctctagttcaggg

SEQ ID NO: 189716 - DNA, 25 bp, Rattus norvegicus
atgagactttctgtctagttcaggg

SEQ ID NO: 189717 - DNA, 25 bp, Rattus norvegicus
atgagacttttgaccctcggaggca

SEQ ID NO: 189718 - DNA, 25 bp, Rattus norvegicus
atgagacttttgtccctcggaggca

SEQ ID NO: 189719 - DNA, 25 bp, Rattus norvegicus
atgagagaaccgaagtggatacttt

SEQ ID NO: 189720 - DNA, 25 bp, Rattus norvegicus
atgagagaaccgtagtggatacttt

SEQ ID NO: 189721 - DNA, 25 bp, Rattus norvegicus
atgagagaactgagtaaccgccccg

SEQ ID NO: 189722 - DNA, 25 bp, Rattus norvegicus
atgagagaactgtgtaaccgccccg

SEQ ID NO: 189723 - DNA, 25 bp, Rattus norvegicus
atgagagacatcctgcagtcctgat

SEQ ID NO: 189724 - DNA, 25 bp, Rattus norvegicus
atgagagacatcgtgcagtcctgat

SEQ ID NO: 189725 - DNA, 25 bp, Rattus norvegicus
atgagagaccctcctgtgtgcccca

SEQ ID NO: 189726 - DNA, 25 bp, Rattus norvegicus
atgagagaccctgctgtgtgcccca

SEQ ID NO: 189727 - DNA, 25 bp, Rattus norvegicus
atgagagacttgctgtgtccaaccc

SEQ ID NO: 189728 - DNA, 25 bp, Rattus norvegicus
atgagagacttggtgtgtccaaccc

SEQ ID NO: 189729 - DNA, 25 bp, Rattus norvegicus
atgagagattctctttccacctctt

SEQ ID NO: 189730 - DNA, 25 bp, Rattus norvegicus
atgagagattctgtttccacctctt

SEQ ID NO: 189731 - DNA, 25 bp, Rattus norvegicus
atgagagcacaaatgcaccccataa

SEQ ID NO: 189732 - DNA, 25 bp, Rattus norvegicus
atgagagcacaattgcaccccataa

SEQ ID NO: 189733 - DNA, 25 bp, Rattus norvegicus
atgagagcagcgacctttccaaaga

SEQ ID NO: 189734 - DNA, 25 bp, Rattus norvegicus
atgagagcagcgtcctttccaaaga

SEQ ID NO: 189735 - DNA, 25 bp, Rattus norvegicus
atgagagccagcaagtcactgcctt

SEQ ID NO: 189736 - DNA, 25 bp, Rattus norvegicus
atgagagccagctagtcactgcctt

SEQ ID NO: 189737 - DNA, 25 bp, Rattus norvegicus
atgagagccgtgaggcatcagtcat

SEQ ID NO: 189738 - DNA, 25 bp, Rattus norvegicus
atgagagccgtgtggcatcagtcat

SEQ ID NO: 189739 - DNA, 25 bp, Rattus norvegicus
atgagagctaccaacacttcatgct

SEQ ID NO: 189740 - DNA, 25 bp, Rattus norvegicus
atgagagctacctacacttcatgct

SEQ ID NO: 189741 - DNA, 25 bp, Rattus norvegicus
atgagagctctgcacttgacgcaca

SEQ ID NO: 189742 - DNA, 25 bp, Rattus norvegicus
atgagagctctggacttgacgcaca

SEQ ID NO: 189743 - DNA, 25 bp, Rattus norvegicus
atgagaggacagatgccacccgcca

SEQ ID NO: 189744 - DNA, 25 bp, Rattus norvegicus
atgagaggacagttgccacccgcca

SEQ ID NO: 189745 - DNA, 25 bp, Rattus norvegicus
atgagaggcctcaggactttgtgag

SEQ ID NO: 189746 - DNA, 25 bp, Rattus norvegicus
atgagaggcctctggactttgtgag

SEQ ID NO: 189747 - DNA, 25 bp, Rattus norvegicus
atgagaggccttcctttgatctaac

SEQ ID NO: 189748 - DNA, 25 bp, Rattus norvegicus
atgagaggccttgctttgatctaac

SEQ ID NO: 189749 - DNA, 25 bp, Rattus norvegicus
atgagaggctcacgcacaaccaacc

SEQ ID NO: 189750 - DNA, 25 bp, Rattus norvegicus
atgagaggctcacttcactgtgggt

SEQ ID NO: 189751 - DNA, 25 bp, Rattus norvegicus
atgagaggctcaggcacaaccaacc

SEQ ID NO: 189752 - DNA, 25 bp, Rattus norvegicus
atgagaggctcagttcactgtgggt

SEQ ID NO: 189753 - DNA, 25 bp, Rattus norvegicus
atgagagggaacacgtttactgggt

SEQ ID NO: 189754 - DNA, 25 bp, Rattus norvegicus
atgagagggaactcgtttactgggt

SEQ ID NO: 189755 - DNA, 25 bp, Rattus norvegicus
atgagagggcccattgctgtggccc

SEQ ID NO: 189756 - DNA, 25 bp, Rattus norvegicus
atgagagggccctttgctgtggccc

SEQ ID NO: 189757 - DNA, 25 bp, Rattus norvegicus
atgagagggcttcctttagcttctt

SEQ ID NO: 189758 - DNA, 25 bp, Rattus norvegicus
atgagagggcttgctttagcttctt

SEQ ID NO: 189759 - DNA, 25 bp, Rattus norvegicus
atgagaggtcatctccagtaaatga

SEQ ID NO: 189760 - DNA, 25 bp, Rattus norvegicus
atgagaggtcatgtccagtaaatga

SEQ ID NO: 189761 - DNA, 25 bp, Rattus norvegicus
atgagagtatttattccagtagcaa

SEQ ID NO: 189762 - DNA, 25 bp, Rattus norvegicus
atgagagtattttttccagtagcaa

SEQ ID NO: 189763 - DNA, 25 bp, Rattus norvegicus
atgagagtccgcagaaggctttgga

SEQ ID NO: 189764 - DNA, 25 bp, Rattus norvegicus
atgagagtccgctgaaggctttgga

SEQ ID NO: 189765 - DNA, 25 bp, Rattus norvegicus
atgagagtcctacctgggccagaga

SEQ ID NO: 189766 - DNA, 25 bp, Rattus norvegicus
atgagagtcctagctgggccagaga

SEQ ID NO: 189767 - DNA, 25 bp, Rattus norvegicus
atgagagtctccagcaagaacttgc

SEQ ID NO: 189768 - DNA, 25 bp, Rattus norvegicus
atgagagtctcctgcaagaacttgc

SEQ ID NO: 189769 - DNA, 25 bp, Rattus norvegicus
atgagagtcttgaagctcgtgggaa

SEQ ID NO: 189770 - DNA, 25 bp, Rattus norvegicus
atgagagtcttgtagctcgtgggaa

SEQ ID NO: 189771 - DNA, 25 bp, Rattus norvegicus
atgagagtgactcttggctgcccta

SEQ ID NO: 189772 - DNA, 25 bp, Rattus norvegicus
atgagagtgactgttggctgcccta

SEQ ID NO: 189773 - DNA, 25 bp, Rattus norvegicus
atgagagtgcttcatggctctgcac

SEQ ID NO: 189774 - DNA, 25 bp, Rattus norvegicus
atgagagtgcttgatggctctgcac

SEQ ID NO: 189775 - DNA, 25 bp, Rattus norvegicus
atgagagtttcgatctcagtgccca

SEQ ID NO: 189776 - DNA, 25 bp, Rattus norvegicus
atgagagtttcgttctcagtgccca

SEQ ID NO: 189777 - DNA, 25 bp, Rattus norvegicus
atgagatacccaaatgctttaggat

SEQ ID NO: 189778 - DNA, 25 bp, Rattus norvegicus
atgagatacccatatgctttaggat

SEQ ID NO: 189779 - DNA, 25 bp, Rattus norvegicus
atgagatagcataggctgcccagga

SEQ ID NO: 189780 - DNA, 25 bp, Rattus norvegicus
atgagatagcattggctgcccagga

SEQ ID NO: 189781 - DNA, 25 bp, Rattus norvegicus
atgagatatattcctagaccaacaa

SEQ ID NO: 189782 - DNA, 25 bp, Rattus norvegicus
atgagatatattgctagaccaacaa

SEQ ID NO: 189783 - DNA, 25 bp, Rattus norvegicus
atgagatcacggctatgcggccaat

SEQ ID NO: 189784 - DNA, 25 bp, Rattus norvegicus
atgagatcacgggtatgcggccaat

SEQ ID NO: 189785 - DNA, 25 bp, Rattus norvegicus
atgagatcatccaggttctgcagca

SEQ ID NO: 189786 - DNA, 25 bp, Rattus norvegicus
atgagatcatcctggttctgcagca

SEQ ID NO: 189787 - DNA, 25 bp, Rattus norvegicus
atgagatcatctccacactgaaaat

SEQ ID NO: 189788 - DNA, 25 bp, Rattus norvegicus
atgagatcatctgcacactgaaaat

SEQ ID NO: 189789 - DNA, 25 bp, Rattus norvegicus
atgagatccatgagatgacgttgca

SEQ ID NO: 189790 - DNA, 25 bp, Rattus norvegicus
atgagatccatgtgatgacgttgca

SEQ ID NO: 189791 - DNA, 25 bp, Rattus norvegicus
atgagatcctcgaatgcacgctggg

SEQ ID NO: 189792 - DNA, 25 bp, Rattus norvegicus
atgagatcctcgtatgcacgctggg

SEQ ID NO: 189793 - DNA, 25 bp, Rattus norvegicus
atgagatctactccctcaatgtgct

SEQ ID NO: 189794 - DNA, 25 bp, Rattus norvegicus
atgagatctactgcctcaatgtgct

SEQ ID NO: 189795 - DNA, 25 bp, Rattus norvegicus
atgagatctctccttaagctctttt

SEQ ID NO: 189796 - DNA, 25 bp, Rattus norvegicus
atgagatctctcgttaagctctttt

SEQ ID NO: 189797 - DNA, 25 bp, Rattus norvegicus
atgagatctgctcgtcagcgaaggc

SEQ ID NO: 189798 - DNA, 25 bp, Rattus norvegicus
atgagatctgctggtcagcgaaggc

SEQ ID NO: 189799 - DNA, 25 bp, Rattus norvegicus
atgagatgaggcctgtgcttgaact

SEQ ID NO: 189800 - DNA, 25 bp, Rattus norvegicus
atgagatgaggcgtgtgcttgaact

SEQ ID NO: 189801 - DNA, 25 bp, Rattus norvegicus
atgagatgatcactagtccttgtct

SEQ ID NO: 189802 - DNA, 25 bp, Rattus norvegicus
atgagatgatcagtagtccttgtct

SEQ ID NO: 189803 - DNA, 25 bp, Rattus norvegicus
atgagatgatgaccccagagagcga

SEQ ID NO: 189804 - DNA, 25 bp, Rattus norvegicus
atgagatgatgagcccagagagcga

SEQ ID NO: 189805 - DNA, 25 bp, Rattus norvegicus
atgagatgcctcatgtcctactctc

SEQ ID NO: 189806 - DNA, 25 bp, Rattus norvegicus
atgagatgcctcttgtcctactctc

SEQ ID NO: 189807 - DNA, 25 bp, Rattus norvegicus
atgagatgcgcaccttggccggcaa

SEQ ID NO: 189808 - DNA, 25 bp, Rattus norvegicus
atgagatgcgcagcttggccggcaa

SEQ ID NO: 189809 - DNA, 25 bp, Rattus norvegicus
atgagatggaacactccactctggc

SEQ ID NO: 189810 - DNA, 25 bp, Rattus norvegicus
atgagatggaactctccactctggc

SEQ ID NO: 189811 - DNA, 25 bp, Rattus norvegicus
atgagatggcttcgctgcctcacca

SEQ ID NO: 189812 - DNA, 25 bp, Rattus norvegicus
atgagatggcttggctgcctcacca

SEQ ID NO: 189813 - DNA, 25 bp, Rattus norvegicus
atgagatgtaatccctcagcttccg

SEQ ID NO: 189814 - DNA, 25 bp, Rattus norvegicus
atgagatgtaatgcctcagcttccg

SEQ ID NO: 189815 - DNA, 25 bp, Rattus norvegicus
atgagatgtcctctttgctagcagc

SEQ ID NO: 189816 - DNA, 25 bp, Rattus norvegicus
atgagatgtcctgtttgctagcagc

SEQ ID NO: 189817 - DNA, 25 bp, Rattus norvegicus
atgagattcatgagacccctggagt

SEQ ID NO: 189818 - DNA, 25 bp, Rattus norvegicus
atgagattcatgtgacccctggagt

SEQ ID NO: 189819 - DNA, 25 bp, Rattus norvegicus
atgagattctggcacggcttctgaa

SEQ ID NO: 189820 - DNA, 25 bp, Rattus norvegicus
atgagattctgggacggcttctgaa

SEQ ID NO: 189821 - DNA, 25 bp, Rattus norvegicus
atgagattctttccgagggcgagct

SEQ ID NO: 189822 - DNA, 25 bp, Rattus norvegicus
atgagattctttgcgagggcgagct

SEQ ID NO: 189823 - DNA, 25 bp, Rattus norvegicus
atgagatttgtcatttcttcccagg

SEQ ID NO: 189824 - DNA, 25 bp, Rattus norvegicus
atgagatttgtcttttcttcccagg

SEQ ID NO: 189825 - DNA, 25 bp, Rattus norvegicus
atgagcaaatcaactgggtggtgtg

SEQ ID NO: 189826 - DNA, 25 bp, Rattus norvegicus
atgagcaaatcatctgggtggtgtg

SEQ ID NO: 189827 - DNA, 25 bp, Rattus norvegicus
atgagcaacctgagcctgctagaag

SEQ ID NO: 189828 - DNA, 25 bp, Rattus norvegicus
atgagcaacctgtgcctgctagaag

SEQ ID NO: 189829 - DNA, 25 bp, Rattus norvegicus
atgagcaacttaaagcctggcttct

SEQ ID NO: 189830 - DNA, 25 bp, Rattus norvegicus
atgagcaacttatagcctggcttct

SEQ ID NO: 189831 - DNA, 25 bp, Rattus norvegicus
atgagcaacttcagagcttcagccc

SEQ ID NO: 189832 - DNA, 25 bp, Rattus norvegicus
atgagcaacttctgagcttcagccc

SEQ ID NO: 189833 - DNA, 25 bp, Rattus norvegicus
atgagcaagcggagcaaatctggct

SEQ ID NO: 189834 - DNA, 25 bp, Rattus norvegicus
atgagcaagcggtgcaaatctggct

SEQ ID NO: 189835 - DNA, 25 bp, Rattus norvegicus
atgagcaaggtgagctgtgtcccca

SEQ ID NO: 189836 - DNA, 25 bp, Rattus norvegicus
atgagcaaggtgtgctgtgtcccca

SEQ ID NO: 189837 - DNA, 25 bp, Rattus norvegicus
atgagcaagtttacatcgtctccaa

SEQ ID NO: 189838 - DNA, 25 bp, Rattus norvegicus
atgagcaagttttcatcgtctccaa

SEQ ID NO: 189839 - DNA, 25 bp, Rattus norvegicus
atgagcaatgctccagacactgtgt

SEQ ID NO: 189840 - DNA, 25 bp, Rattus norvegicus
atgagcaatgctgcagacactgtgt

SEQ ID NO: 189841 - DNA, 25 bp, Rattus norvegicus
atgagcaattctctgcccattagtt

SEQ ID NO: 189842 - DNA, 25 bp, Rattus norvegicus
atgagcaattctgtgcccattagtt

SEQ ID NO: 189843 - DNA, 25 bp, Rattus norvegicus
atgagcacagctagcttcttccaag

SEQ ID NO: 189844 - DNA, 25 bp, Rattus norvegicus
atgagcacagcttgcttcttccaag

SEQ ID NO: 189845 - DNA, 25 bp, Rattus norvegicus
atgagcacaggcatctctcattgcc

SEQ ID NO: 189846 - DNA, 25 bp, Rattus norvegicus
atgagcacaggcttctctcattgcc

SEQ ID NO: 189847 - DNA, 25 bp, Rattus norvegicus
atgagcacaggtccctcatgacaaa

SEQ ID NO: 189848 - DNA, 25 bp, Rattus norvegicus
atgagcacaggtgcctcatgacaaa

SEQ ID NO: 189849 - DNA, 25 bp, Rattus norvegicus
atgagcaccattaagctgagcctgt

SEQ ID NO: 189850 - DNA, 25 bp, Rattus norvegicus
atgagcaccattaatccaactaagg

SEQ ID NO: 189851 - DNA, 25 bp, Rattus norvegicus
atgagcaccatttagctgagcctgt

SEQ ID NO: 189852 - DNA, 25 bp, Rattus norvegicus
atgagcaccatttatccaactaagg

SEQ ID NO: 189853 - DNA, 25 bp, Rattus norvegicus
atgagcacccttcagaaatccaaat

SEQ ID NO: 189854 - DNA, 25 bp, Rattus norvegicus
atgagcacccttgagaaatccaaat

SEQ ID NO: 189855 - DNA, 25 bp, Rattus norvegicus
atgagcacctctacattagtttcca

SEQ ID NO: 189856 - DNA, 25 bp, Rattus norvegicus
atgagcacctcttcattagtttcca

SEQ ID NO: 189857 - DNA, 25 bp, Rattus norvegicus
atgagcacctgcagctgatgagcct

SEQ ID NO: 189858 - DNA, 25 bp, Rattus norvegicus
atgagcacctgcctcacgatcttgg

SEQ ID NO: 189859 - DNA, 25 bp, Rattus norvegicus
atgagcacctgcgtcacgatcttgg

SEQ ID NO: 189860 - DNA, 25 bp, Rattus norvegicus
atgagcacctgctgctgatgagcct

SEQ ID NO: 189861 - DNA, 25 bp, Rattus norvegicus
atgagcacctggagaacgtcctgac

SEQ ID NO: 189862 - DNA, 25 bp, Rattus norvegicus
atgagcacctggtgaacgtcctgac

SEQ ID NO: 189863 - DNA, 25 bp, Rattus norvegicus
atgagcacgactccgagccgttgaa

SEQ ID NO: 189864 - DNA, 25 bp, Rattus norvegicus
atgagcacgactgcgagccgttgaa

SEQ ID NO: 189865 - DNA, 25 bp, Rattus norvegicus
atgagcacgtgcctttactgagaag

SEQ ID NO: 189866 - DNA, 25 bp, Rattus norvegicus
atgagcacgtgcgtttactgagaag

SEQ ID NO: 189867 - DNA, 25 bp, Rattus norvegicus
atgagcactaagctactggcccagg

SEQ ID NO: 189868 - DNA, 25 bp, Rattus norvegicus
atgagcactaaggtactggcccagg

SEQ ID NO: 189869 - DNA, 25 bp, Rattus norvegicus
atgagcactacaagcggaactcgcg

SEQ ID NO: 189870 - DNA, 25 bp, Rattus norvegicus
atgagcactacatgcggaactcgcg

SEQ ID NO: 189871 - DNA, 25 bp, Rattus norvegicus
atgagcactagaagtctgccacacc

SEQ ID NO: 189872 - DNA, 25 bp, Rattus norvegicus
atgagcactagatgtctgccacacc

SEQ ID NO: 189873 - DNA, 25 bp, Rattus norvegicus
atgagcactcggatccagagctgat

SEQ ID NO: 189874 - DNA, 25 bp, Rattus norvegicus
atgagcactcggttccagagctgat

SEQ ID NO: 189875 - DNA, 25 bp, Rattus norvegicus
atgagcactgttcggattcttcggg

SEQ ID NO: 189876 - DNA, 25 bp, Rattus norvegicus
atgagcactgttgggattcttcggg

SEQ ID NO: 189877 - DNA, 25 bp, Rattus norvegicus
atgagcagaaggaacacagcagtgt

SEQ ID NO: 189878 - DNA, 25 bp, Rattus norvegicus
atgagcagaaggtacacagcagtgt

SEQ ID NO: 189879 - DNA, 25 bp, Rattus norvegicus
atgagcagacttacatacccactgt

SEQ ID NO: 189880 - DNA, 25 bp, Rattus norvegicus
atgagcagactttcatacccactgt

SEQ ID NO: 189881 - DNA, 25 bp, Rattus norvegicus
atgagcagcacgacgacgttgacca

SEQ ID NO: 189882 - DNA, 25 bp, Rattus norvegicus
atgagcagcacgtcgacgttgacca

SEQ ID NO: 189883 - DNA, 25 bp, Rattus norvegicus
atgagcagccaaacacactagtgac

SEQ ID NO: 189884 - DNA, 25 bp, Rattus norvegicus
atgagcagccaatcacactagtgac

SEQ ID NO: 189885 - DNA, 25 bp, Rattus norvegicus
atgagcagcgtacgctcagacctga

SEQ ID NO: 189886 - DNA, 25 bp, Rattus norvegicus
atgagcagcgtaggctcagacctga

SEQ ID NO: 189887 - DNA, 25 bp, Rattus norvegicus
atgagcagctgaccctatgcctgga

SEQ ID NO: 189888 - DNA, 25 bp, Rattus norvegicus
atgagcagctgagcctatgcctgga

SEQ ID NO: 189889 - DNA, 25 bp, Rattus norvegicus
atgagcagctgcagatggtccgccc

SEQ ID NO: 189890 - DNA, 25 bp, Rattus norvegicus
atgagcagctgctgatggtccgccc

SEQ ID NO: 189891 - DNA, 25 bp, Rattus norvegicus
atgagcaggctcacagctctgggac

SEQ ID NO: 189892 - DNA, 25 bp, Rattus norvegicus
atgagcaggctctcagctctgggac

SEQ ID NO: 189893 - DNA, 25 bp, Rattus norvegicus
atgagcagttgacgtcctgatccct

SEQ ID NO: 189894 - DNA, 25 bp, Rattus norvegicus
atgagcagttgaggtcctgatccct

SEQ ID NO: 189895 - DNA, 25 bp, Rattus norvegicus
atgagcagtttcattctttcccaca

SEQ ID NO: 189896 - DNA, 25 bp, Rattus norvegicus
atgagcagtttctttctttcccaca

SEQ ID NO: 189897 - DNA, 25 bp, Rattus norvegicus
atgagcataaggcaggtcagcacca

SEQ ID NO: 189898 - DNA, 25 bp, Rattus norvegicus
atgagcataagggaggtcagcacca

SEQ ID NO: 189899 - DNA, 25 bp, Rattus norvegicus
atgagcatcagaccaacctctcagc

SEQ ID NO: 189900 - DNA, 25 bp, Rattus norvegicus
atgagcatcagagcaacctctcagc

SEQ ID NO: 189901 - DNA, 25 bp, Rattus norvegicus
atgagcatcagtcctgccgagtgaa

SEQ ID NO: 189902 - DNA, 25 bp, Rattus norvegicus
atgagcatcagtgctgccgagtgaa

SEQ ID NO: 189903 - DNA, 25 bp, Rattus norvegicus
atgagcatctcaccttttcttttcc

SEQ ID NO: 189904 - DNA, 25 bp, Rattus norvegicus
atgagcatctcagcttttcttttcc

SEQ ID NO: 189905 - DNA, 25 bp, Rattus norvegicus
atgagcatctttatccaccgtaata

SEQ ID NO: 189906 - DNA, 25 bp, Rattus norvegicus
atgagcatctttttccaccgtaata

SEQ ID NO: 189907 - DNA, 25 bp, Rattus norvegicus
atgagcatgtgcatggagccctgtg

SEQ ID NO: 189908 - DNA, 25 bp, Rattus norvegicus
atgagcatgtgcttggagccctgtg

SEQ ID NO: 189909 - DNA, 25 bp, Rattus norvegicus
atgagcattctgcatctgtgtactg

SEQ ID NO: 189910 - DNA, 25 bp, Rattus norvegicus
atgagcattctggatctgtgtactg

SEQ ID NO: 189911 - DNA, 25 bp, Rattus norvegicus
atgagcatttagcagaccacagaat

SEQ ID NO: 189912 - DNA, 25 bp, Rattus norvegicus
atgagcatttaggagaccacagaat

SEQ ID NO: 189913 - DNA, 25 bp, Rattus norvegicus
atgagccaacagatcaggaatgcct

SEQ ID NO: 189914 - DNA, 25 bp, Rattus norvegicus
atgagccaacagttcaggaatgcct

SEQ ID NO: 189915 - DNA, 25 bp, Rattus norvegicus
atgagccaataccttgcatctgtac

SEQ ID NO: 189916 - DNA, 25 bp, Rattus norvegicus
atgagccaatacgttgcatctgtac

SEQ ID NO: 189917 - DNA, 25 bp, Rattus norvegicus
atgagccaattccattttgggccct

SEQ ID NO: 189918 - DNA, 25 bp, Rattus norvegicus
atgagccaattcgattttgggccct

SEQ ID NO: 189919 - DNA, 25 bp, Rattus norvegicus
atgagccacttgagggagaacacgc

SEQ ID NO: 189920 - DNA, 25 bp, Rattus norvegicus
atgagccacttgtgggagaacacgc

SEQ ID NO: 189921 - DNA, 25 bp, Rattus norvegicus
atgagccactttcctgcatgtcagt

SEQ ID NO: 189922 - DNA, 25 bp, Rattus norvegicus
atgagccactttgctgcatgtcagt

SEQ ID NO: 189923 - DNA, 25 bp, Rattus norvegicus
atgagccagagtactgggcccatgt

SEQ ID NO: 189924 - DNA, 25 bp, Rattus norvegicus
atgagccagagttctgggcccatgt

SEQ ID NO: 189925 - DNA, 25 bp, Rattus norvegicus
atgagccagcaacgtcattgcctgg

SEQ ID NO: 189926 - DNA, 25 bp, Rattus norvegicus
atgagccagcaaggtcattgcctgg

SEQ ID NO: 189927 - DNA, 25 bp, Rattus norvegicus
atgagccaggccatgctgagcgtga

SEQ ID NO: 189928 - DNA, 25 bp, Rattus norvegicus
atgagccaggccattagaagagctt

SEQ ID NO: 189929 - DNA, 25 bp, Rattus norvegicus
atgagccaggccttgctgagcgtga

SEQ ID NO: 189930 - DNA, 25 bp, Rattus norvegicus
atgagccaggcctttagaagagctt

SEQ ID NO: 189931 - DNA, 25 bp, Rattus norvegicus
atgagccaggtgcacatcctgaggt

SEQ ID NO: 189932 - DNA, 25 bp, Rattus norvegicus
atgagccaggtggacatcctgaggt

SEQ ID NO: 189933 - DNA, 25 bp, Rattus norvegicus
atgagccagtaacataaccttctct

SEQ ID NO: 189934 - DNA, 25 bp, Rattus norvegicus
atgagccagtaagataaccttctct

SEQ ID NO: 189935 - DNA, 25 bp, Rattus norvegicus
atgagccatcttacttcatctgggt

SEQ ID NO: 189936 - DNA, 25 bp, Rattus norvegicus
atgagccatctttcttcatctgggt

SEQ ID NO: 189937 - DNA, 25 bp, Rattus norvegicus
atgagcccaaggaactaagtctcag

SEQ ID NO: 189938 - DNA, 25 bp, Rattus norvegicus
atgagcccaaggtactaagtctcag

SEQ ID NO: 189939 - DNA, 25 bp, Rattus norvegicus
atgagcccatccatgaagtcaaaat

SEQ ID NO: 189940 - DNA, 25 bp, Rattus norvegicus
atgagcccatccttgaagtcaaaat

SEQ ID NO: 189941 - DNA, 25 bp, Rattus norvegicus
atgagccccatgcaggcccaagagt

SEQ ID NO: 189942 - DNA, 25 bp, Rattus norvegicus
atgagccccatggaggcccaagagt

SEQ ID NO: 189943 - DNA, 25 bp, Rattus norvegicus
atgagcccctgtaggaaacgcgcat

SEQ ID NO: 189944 - DNA, 25 bp, Rattus norvegicus
atgagcccctgttggaaacgcgcat

SEQ ID NO: 189945 - DNA, 25 bp, Rattus norvegicus
atgagccctgatcctgctttgtcag

SEQ ID NO: 189946 - DNA, 25 bp, Rattus norvegicus
atgagccctgatgctgctttgtcag

SEQ ID NO: 189947 - DNA, 25 bp, Rattus norvegicus
atgagccctggcaattggcaactgt

SEQ ID NO: 189948 - DNA, 25 bp, Rattus norvegicus
atgagccctggctattggcaactgt

SEQ ID NO: 189949 - DNA, 25 bp, Rattus norvegicus
atgagccctttgaccaaatccaagc

SEQ ID NO: 189950 - DNA, 25 bp, Rattus norvegicus
atgagccctttgtccaaatccaagc

SEQ ID NO: 189951 - DNA, 25 bp, Rattus norvegicus
atgagccgggccataagactttgag

SEQ ID NO: 189952 - DNA, 25 bp, Rattus norvegicus
atgagccgggccttaagactttgag

SEQ ID NO: 189953 - DNA, 25 bp, Rattus norvegicus
atgagccgggtaccaactgatcctt

SEQ ID NO: 189954 - DNA, 25 bp, Rattus norvegicus
atgagccgggtagcaactgatcctt

SEQ ID NO: 189955 - DNA, 25 bp, Rattus norvegicus
atgagccgtttccagaaaagtgctg

SEQ ID NO: 189956 - DNA, 25 bp, Rattus norvegicus
atgagccgtttcgagaaaagtgctg

SEQ ID NO: 189957 - DNA, 25 bp, Rattus norvegicus
atgagcctacgaccagccttaggct

SEQ ID NO: 189958 - DNA, 25 bp, Rattus norvegicus
atgagcctacgagcagccttaggct

SEQ ID NO: 189959 - DNA, 25 bp, Rattus norvegicus
atgagcctatgcaaagggaattctc

SEQ ID NO: 189960 - DNA, 25 bp, Rattus norvegicus
atgagcctatgctaagggaattctc

SEQ ID NO: 189961 - DNA, 25 bp, Rattus norvegicus
atgagcctcaggcagtggtgttcct

SEQ ID NO: 189962 - DNA, 25 bp, Rattus norvegicus
atgagcctcagggagtggtgttcct

SEQ ID NO: 189963 - DNA, 25 bp, Rattus norvegicus
atgagcctcatgaagccaacgaagt

SEQ ID NO: 189964 - DNA, 25 bp, Rattus norvegicus
atgagcctcatgagtgtcatgtgaa

SEQ ID NO: 189965 - DNA, 25 bp, Rattus norvegicus
atgagcctcatgtagccaacgaagt

SEQ ID NO: 189966 - DNA, 25 bp, Rattus norvegicus
atgagcctcatgtgtgtcatgtgaa

SEQ ID NO: 189967 - DNA, 25 bp, Rattus norvegicus
atgagcctcctaatattttatttta

SEQ ID NO: 189968 - DNA, 25 bp, Rattus norvegicus
atgagcctcctattattttatttta

SEQ ID NO: 189969 - DNA, 25 bp, Rattus norvegicus
atgagcctcttgcaagcagatgcgg

SEQ ID NO: 189970 - DNA, 25 bp, Rattus norvegicus
atgagcctcttggaagcagatgcgg

SEQ ID NO: 189971 - DNA, 25 bp, Rattus norvegicus
atgagcctctttccgttttcttctg

SEQ ID NO: 189972 - DNA, 25 bp, Rattus norvegicus
atgagcctctttgcgttttcttctg

SEQ ID NO: 189973 - DNA, 25 bp, Rattus norvegicus
atgagcctgatacctgtgatccagc

SEQ ID NO: 189974 - DNA, 25 bp, Rattus norvegicus
atgagcctgatagctgtgatccagc

SEQ ID NO: 189975 - DNA, 25 bp, Rattus norvegicus
atgagcctgcacacatacgcacaca

SEQ ID NO: 189976 - DNA, 25 bp, Rattus norvegicus
atgagcctgcactcatacgcacaca

SEQ ID NO: 189977 - DNA, 25 bp, Rattus norvegicus
atgagcctgcggcagcgaagactcc

SEQ ID NO: 189978 - DNA, 25 bp, Rattus norvegicus
atgagcctgcgggagcgaagactcc

SEQ ID NO: 189979 - DNA, 25 bp, Rattus norvegicus
atgagcctggagactaaatcgcaaa

SEQ ID NO: 189980 - DNA, 25 bp, Rattus norvegicus
atgagcctggagtctaaatcgcaaa

SEQ ID NO: 189981 - DNA, 25 bp, Rattus norvegicus
atgagcctggcaagtacactacctt

SEQ ID NO: 189982 - DNA, 25 bp, Rattus norvegicus
atgagcctggcatgtacactacctt

SEQ ID NO: 189983 - DNA, 25 bp, Rattus norvegicus
atgagcctgtcaagtgctagatccc

SEQ ID NO: 189984 - DNA, 25 bp, Rattus norvegicus
atgagcctgtcatgtgctagatccc

SEQ ID NO: 189985 - DNA, 25 bp, Rattus norvegicus
atgagcctgtgtattctttcaacca

SEQ ID NO: 189986 - DNA, 25 bp, Rattus norvegicus
atgagcctgtgttttctttcaacca

SEQ ID NO: 189987 - DNA, 25 bp, Rattus norvegicus
atgagccttgctcattaccttaaaa

SEQ ID NO: 189988 - DNA, 25 bp, Rattus norvegicus
atgagccttgctgattaccttaaaa

SEQ ID NO: 189989 - DNA, 25 bp, Rattus norvegicus
atgagcctttggcttttgaactgga

SEQ ID NO: 189990 - DNA, 25 bp, Rattus norvegicus
atgagcctttgggttttgaactgga

SEQ ID NO: 189991 - DNA, 25 bp, Rattus norvegicus
atgagcgaaactctcaaccacgttg

SEQ ID NO: 189992 - DNA, 25 bp, Rattus norvegicus
atgagcgaaactgtcaaccacgttg

SEQ ID NO: 189993 - DNA, 25 bp, Rattus norvegicus
atgagcgaacgaatttctcaccgct

SEQ ID NO: 189994 - DNA, 25 bp, Rattus norvegicus
atgagcgaacgattttctcaccgct

SEQ ID NO: 189995 - DNA, 25 bp, Rattus norvegicus
atgagcgccaagagtccagacatta

SEQ ID NO: 189996 - DNA, 25 bp, Rattus norvegicus
atgagcgccaagtgtccagacatta

SEQ ID NO: 189997 - DNA, 25 bp, Rattus norvegicus
atgagcgcccagaattcatccccta

SEQ ID NO: 189998 - DNA, 25 bp, Rattus norvegicus
atgagcgcccagtattcatccccta

SEQ ID NO: 189999 - DNA, 25 bp, Rattus norvegicus
atgagcgccggaatacgcgcgcttg

SEQ ID NO: 190000 - DNA, 25 bp, Rattus norvegicus
atgagcgccggattacgcgcgcttg

SEQ ID NO: 190001 - DNA, 25 bp, Rattus norvegicus
atgagcgcctagaacgaggcctaga

SEQ ID NO: 190002 - DNA, 25 bp, Rattus norvegicus
atgagcgcctagtacgaggcctaga

SEQ ID NO: 190003 - DNA, 25 bp, Rattus norvegicus
atgagcgctaagaaatctcccgaag

SEQ ID NO: 190004 - DNA, 25 bp, Rattus norvegicus
atgagcgctaagtaatctcccgaag

SEQ ID NO: 190005 - DNA, 25 bp, Rattus norvegicus
atgagcggcaccagcggctacagcg

SEQ ID NO: 190006 - DNA, 25 bp, Rattus norvegicus
atgagcggcacctgcggctacagcg

SEQ ID NO: 190007 - DNA, 25 bp, Rattus norvegicus
atgagcggccacaacagactgagaa

SEQ ID NO: 190008 - DNA, 25 bp, Rattus norvegicus
atgagcggccactacagactgagaa

SEQ ID NO: 190009 - DNA, 25 bp, Rattus norvegicus
atgagcggcttaaattagagttgat

SEQ ID NO: 190010 - DNA, 25 bp, Rattus norvegicus
atgagcggcttatattagagttgat

SEQ ID NO: 190011 - DNA, 25 bp, Rattus norvegicus
atgagcgggcatcatgttccctgga

SEQ ID NO: 190012 - DNA, 25 bp, Rattus norvegicus
atgagcgggcatgatgttccctgga

SEQ ID NO: 190013 - DNA, 25 bp, Rattus norvegicus
atgagcgggttaactgcgtagcctc

SEQ ID NO: 190014 - DNA, 25 bp, Rattus norvegicus
atgagcgggttatctgcgtagcctc

SEQ ID NO: 190015 - DNA, 25 bp, Rattus norvegicus
atgagcggtaccacactgagagcct

SEQ ID NO: 190016 - DNA, 25 bp, Rattus norvegicus
atgagcggtacctcactgagagcct

SEQ ID NO: 190017 - DNA, 25 bp, Rattus norvegicus
atgagcggtccaaggcccagtggct

SEQ ID NO: 190018 - DNA, 25 bp, Rattus norvegicus
atgagcggtccatggcccagtggct

SEQ ID NO: 190019 - DNA, 25 bp, Rattus norvegicus
atgagcggttcccatgccccgaggc

SEQ ID NO: 190020 - DNA, 25 bp, Rattus norvegicus
atgagcggttccgatgccccgaggc

SEQ ID NO: 190021 - DNA, 25 bp, Rattus norvegicus
atgagcgtctgtcaaaccgtatctt

SEQ ID NO: 190022 - DNA, 25 bp, Rattus norvegicus
atgagcgtctgtgaaaccgtatctt

SEQ ID NO: 190023 - DNA, 25 bp, Rattus norvegicus
atgagcgtggtgactacgaggcttc

SEQ ID NO: 190024 - DNA, 25 bp, Rattus norvegicus
atgagcgtggtgtctacgaggcttc

SEQ ID NO: 190025 - DNA, 25 bp, Rattus norvegicus
atgagcgtgtgcctgagtactgtct

SEQ ID NO: 190026 - DNA, 25 bp, Rattus norvegicus
atgagcgtgtgcgtgagtactgtct

SEQ ID NO: 190027 - DNA, 25 bp, Rattus norvegicus
atgagctaacatctgctggctgttc

SEQ ID NO: 190028 - DNA, 25 bp, Rattus norvegicus
atgagctaacatgtgctggctgttc

SEQ ID NO: 190029 - DNA, 25 bp, Rattus norvegicus
atgagctaacccatttgcgtttcac

SEQ ID NO: 190030 - DNA, 25 bp, Rattus norvegicus
atgagctaacccttttgcgtttcac

SEQ ID NO: 190031 - DNA, 25 bp, Rattus norvegicus
atgagctaacctcctcaccttctta

SEQ ID NO: 190032 - DNA, 25 bp, Rattus norvegicus
atgagctaacctgctcaccttctta

SEQ ID NO: 190033 - DNA, 25 bp, Rattus norvegicus
atgagctaattaccagtcacttcag

SEQ ID NO: 190034 - DNA, 25 bp, Rattus norvegicus
atgagctaattagcagtcacttcag

SEQ ID NO: 190035 - DNA, 25 bp, Rattus norvegicus
atgagctacaatagccctgaccagt

SEQ ID NO: 190036 - DNA, 25 bp, Rattus norvegicus
atgagctacaattgccctgaccagt

SEQ ID NO: 190037 - DNA, 25 bp, Rattus norvegicus
atgagctacagtagtttccattacg

SEQ ID NO: 190038 - DNA, 25 bp, Rattus norvegicus
atgagctacagttgtttccattacg

SEQ ID NO: 190039 - DNA, 25 bp, Rattus norvegicus
atgagctaccatcccaatagccaca

SEQ ID NO: 190040 - DNA, 25 bp, Rattus norvegicus
atgagctaccatgccaatagccaca

SEQ ID NO: 190041 - DNA, 25 bp, Rattus norvegicus
atgagctagtccctgagcacgtggt

SEQ ID NO: 190042 - DNA, 25 bp, Rattus norvegicus
atgagctagtccgtgagcacgtggt

SEQ ID NO: 190043 - DNA, 25 bp, Rattus norvegicus
atgagctatcagcattccacccaga

SEQ ID NO: 190044 - DNA, 25 bp, Rattus norvegicus
atgagctatcaggattccacccaga

SEQ ID NO: 190045 - DNA, 25 bp, Rattus norvegicus
atgagctatttcagcgagttctcct

SEQ ID NO: 190046 - DNA, 25 bp, Rattus norvegicus
atgagctatttctgcgagttctcct

SEQ ID NO: 190047 - DNA, 25 bp, Rattus norvegicus
atgagctcaacccaccgatgttatc

SEQ ID NO: 190048 - DNA, 25 bp, Rattus norvegicus
atgagctcaaccgaccgatgttatc

SEQ ID NO: 190049 - DNA, 25 bp, Rattus norvegicus
atgagctcacaacgcactaccggaa

SEQ ID NO: 190050 - DNA, 25 bp, Rattus norvegicus
atgagctcacaaggcactaccggaa

SEQ ID NO: 190051 - DNA, 25 bp, Rattus norvegicus
atgagctcacagcttcattccctca

SEQ ID NO: 190052 - DNA, 25 bp, Rattus norvegicus
atgagctcacaggttcattccctca

SEQ ID NO: 190053 - DNA, 25 bp, Rattus norvegicus
atgagctcacccagggcatggacat

SEQ ID NO: 190054 - DNA, 25 bp, Rattus norvegicus
atgagctcaccctgggcatggacat

SEQ ID NO: 190055 - DNA, 25 bp, Rattus norvegicus
atgagctcagacacagccatgaaga

SEQ ID NO: 190056 - DNA, 25 bp, Rattus norvegicus
atgagctcagactcagccatgaaga

SEQ ID NO: 190057 - DNA, 25 bp, Rattus norvegicus
atgagctcaggcactgtcagttgag

SEQ ID NO: 190058 - DNA, 25 bp, Rattus norvegicus
atgagctcaggctctgtcagttgag

SEQ ID NO: 190059 - DNA, 25 bp, Rattus norvegicus
atgagctcagtaccttcatccgtgt

SEQ ID NO: 190060 - DNA, 25 bp, Rattus norvegicus
atgagctcagtagcttcatccgtgt

SEQ ID NO: 190061 - DNA, 25 bp, Rattus norvegicus
atgagctcatccacgtcaaactctt

SEQ ID NO: 190062 - DNA, 25 bp, Rattus norvegicus
atgagctcatcctcgtcaaactctt

SEQ ID NO: 190063 - DNA, 25 bp, Rattus norvegicus
atgagctccctgctagctttgcagt

SEQ ID NO: 190064 - DNA, 25 bp, Rattus norvegicus
atgagctccctggtagctttgcagt

SEQ ID NO: 190065 - DNA, 25 bp, Rattus norvegicus
atgagctcccttaaacttgtgacac

SEQ ID NO: 190066 - DNA, 25 bp, Rattus norvegicus
atgagctcccttatgtgggttacct

SEQ ID NO: 190067 - DNA, 25 bp, Rattus norvegicus
atgagctccctttaacttgtgacac

SEQ ID NO: 190068 - DNA, 25 bp, Rattus norvegicus
atgagctcccttttgtgggttacct

SEQ ID NO: 190069 - DNA, 25 bp, Rattus norvegicus
atgagctcctgtctctctgcataca

SEQ ID NO: 190070 - DNA, 25 bp, Rattus norvegicus
atgagctcctgtgtctctgcataca

SEQ ID NO: 190071 - DNA, 25 bp, Rattus norvegicus
atgagctcgccaacattgccagcaa

SEQ ID NO: 190072 - DNA, 25 bp, Rattus norvegicus
atgagctcgccatcattgccagcaa

SEQ ID NO: 190073 - DNA, 25 bp, Rattus norvegicus
atgagctcggtcctcgtggagaaac

SEQ ID NO: 190074 - DNA, 25 bp, Rattus norvegicus
atgagctcggtcgtcgtggagaaac

SEQ ID NO: 190075 - DNA, 25 bp, Rattus norvegicus
atgagctcgtttccagcccagaata

SEQ ID NO: 190076 - DNA, 25 bp, Rattus norvegicus
atgagctcgtttgcagcccagaata

SEQ ID NO: 190077 - DNA, 25 bp, Rattus norvegicus
atgagctctaggacacagcactggg

SEQ ID NO: 190078 - DNA, 25 bp, Rattus norvegicus
atgagctctaggtcacagcactggg

SEQ ID NO: 190079 - DNA, 25 bp, Rattus norvegicus
atgagctctcatatttctgctccat

SEQ ID NO: 190080 - DNA, 25 bp, Rattus norvegicus
atgagctctcatttttctgctccat

SEQ ID NO: 190081 - DNA, 25 bp, Rattus norvegicus
atgagctctggacgagtctcttggt

SEQ ID NO: 190082 - DNA, 25 bp, Rattus norvegicus
atgagctctggaggagtctcttggt

SEQ ID NO: 190083 - DNA, 25 bp, Rattus norvegicus
atgagctgaccaaggctgtgcggaa

SEQ ID NO: 190084 - DNA, 25 bp, Rattus norvegicus
atgagctgaccatggctgtgcggaa

SEQ ID NO: 190085 - DNA, 25 bp, Rattus norvegicus
atgagctgagttccatggcatatga

SEQ ID NO: 190086 - DNA, 25 bp, Rattus norvegicus
atgagctgagttgcatggcatatga

SEQ ID NO: 190087 - DNA, 25 bp, Rattus norvegicus
atgagctgcagaagctacggcaccg

SEQ ID NO: 190088 - DNA, 25 bp, Rattus norvegicus
atgagctgcagatgctacggcaccg

SEQ ID NO: 190089 - DNA, 25 bp, Rattus norvegicus
atgagctgccaacacttacttactg

SEQ ID NO: 190090 - DNA, 25 bp, Rattus norvegicus
atgagctgccaagacttacttactg

SEQ ID NO: 190091 - DNA, 25 bp, Rattus norvegicus
atgagctgccagaggtcgtccgcaa

SEQ ID NO: 190092 - DNA, 25 bp, Rattus norvegicus
atgagctgccagtggtcgtccgcaa

SEQ ID NO: 190093 - DNA, 25 bp, Rattus norvegicus
atgagctgccggaggagatcttaga

SEQ ID NO: 190094 - DNA, 25 bp, Rattus norvegicus
atgagctgccggtggagatcttaga

SEQ ID NO: 190095 - DNA, 25 bp, Rattus norvegicus
atgagctgcgccagcgcggcaagaa

SEQ ID NO: 190096 - DNA, 25 bp, Rattus norvegicus
atgagctgcgcctgcgcggcaagaa

SEQ ID NO: 190097 - DNA, 25 bp, Rattus norvegicus
atgagctgctcgcactgtacgggta

SEQ ID NO: 190098 - DNA, 25 bp, Rattus norvegicus
atgagctgctcggactgtacgggta

SEQ ID NO: 190099 - DNA, 25 bp, Rattus norvegicus
atgagctgctctccaagccaaagtt

SEQ ID NO: 190100 - DNA, 25 bp, Rattus norvegicus
atgagctgctctgcaagccaaagtt

SEQ ID NO: 190101 - DNA, 25 bp, Rattus norvegicus
atgagctggcgcatctgagttgtca

SEQ ID NO: 190102 - DNA, 25 bp, Rattus norvegicus
atgagctggcgcttctgagttgtca

SEQ ID NO: 190103 - DNA, 25 bp, Rattus norvegicus
atgagctggtgtacattctctgtgt

SEQ ID NO: 190104 - DNA, 25 bp, Rattus norvegicus
atgagctggtgttcattctctgtgt

SEQ ID NO: 190105 - DNA, 25 bp, Rattus norvegicus
atgagctgtgctagctacaacatag

SEQ ID NO: 190106 - DNA, 25 bp, Rattus norvegicus
atgagctgtgcttgctacaacatag

SEQ ID NO: 190107 - DNA, 25 bp, Rattus norvegicus
atgagctgtgtactctttgctgtcc

SEQ ID NO: 190108 - DNA, 25 bp, Rattus norvegicus
atgagctgtgtagtctttgctgtcc

SEQ ID NO: 190109 - DNA, 25 bp, Rattus norvegicus
atgagctgtttgaccacatcgtctc

SEQ ID NO: 190110 - DNA, 25 bp, Rattus norvegicus
atgagctgtttgtccacatcgtctc

SEQ ID NO: 190111 - DNA, 25 bp, Rattus norvegicus
atgagcttactcacttggacgcaac

SEQ ID NO: 190112 - DNA, 25 bp, Rattus norvegicus
atgagcttactctcttggacgcaac

SEQ ID NO: 190113 - DNA, 25 bp, Rattus norvegicus
atgagcttattcacgccatcagaaa

SEQ ID NO: 190114 - DNA, 25 bp, Rattus norvegicus
atgagcttattctcgccatcagaaa

SEQ ID NO: 190115 - DNA, 25 bp, Rattus norvegicus
atgagcttccatcatgccaaaggag

SEQ ID NO: 190116 - DNA, 25 bp, Rattus norvegicus
atgagcttccatcctggatcatcaa

SEQ ID NO: 190117 - DNA, 25 bp, Rattus norvegicus
atgagcttccatgatgccaaaggag

SEQ ID NO: 190118 - DNA, 25 bp, Rattus norvegicus
atgagcttccatgctggatcatcaa

SEQ ID NO: 190119 - DNA, 25 bp, Rattus norvegicus
atgagcttcctaccttgccttttga

SEQ ID NO: 190120 - DNA, 25 bp, Rattus norvegicus
atgagcttcctagcttgccttttga

SEQ ID NO: 190121 - DNA, 25 bp, Rattus norvegicus
atgagcttctacatggcatctcaga

SEQ ID NO: 190122 - DNA, 25 bp, Rattus norvegicus
atgagcttctacttggcatctcaga

SEQ ID NO: 190123 - DNA, 25 bp, Rattus norvegicus
atgagcttctccaacaatatcttgt

SEQ ID NO: 190124 - DNA, 25 bp, Rattus norvegicus
atgagcttctccaagtagtctgtct

SEQ ID NO: 190125 - DNA, 25 bp, Rattus norvegicus
atgagcttctccatcgtcagtggca

SEQ ID NO: 190126 - DNA, 25 bp, Rattus norvegicus
atgagcttctcctacaatatcttgt

SEQ ID NO: 190127 - DNA, 25 bp, Rattus norvegicus
atgagcttctcctagtagtctgtct

SEQ ID NO: 190128 - DNA, 25 bp, Rattus norvegicus
atgagcttctccttcgtcagtggca

SEQ ID NO: 190129 - DNA, 25 bp, Rattus norvegicus
atgagcttctgtctctgcactgaat

SEQ ID NO: 190130 - DNA, 25 bp, Rattus norvegicus
atgagcttctgtgtctgcactgaat

SEQ ID NO: 190131 - DNA, 25 bp, Rattus norvegicus
atgagcttgaacatgaactctgttc

SEQ ID NO: 190132 - DNA, 25 bp, Rattus norvegicus
atgagcttgaacttgaactctgttc

SEQ ID NO: 190133 - DNA, 25 bp, Rattus norvegicus
atgagcttgccaatgaccttgttca

SEQ ID NO: 190134 - DNA, 25 bp, Rattus norvegicus
atgagcttgccattgaccttgttca

SEQ ID NO: 190135 - DNA, 25 bp, Rattus norvegicus
atgagcttgctgagtaccctgacaa

SEQ ID NO: 190136 - DNA, 25 bp, Rattus norvegicus
atgagcttgctgtgtaccctgacaa

SEQ ID NO: 190137 - DNA, 25 bp, Rattus norvegicus
atgagcttgggtactgggcactagt

SEQ ID NO: 190138 - DNA, 25 bp, Rattus norvegicus
atgagcttgggttctgggcactagt

SEQ ID NO: 190139 - DNA, 25 bp, Rattus norvegicus
atgagctttcaacgtcattcaagaa

SEQ ID NO: 190140 - DNA, 25 bp, Rattus norvegicus
atgagctttcaaggtcattcaagaa

SEQ ID NO: 190141 - DNA, 25 bp, Rattus norvegicus
atgagcttttgccagtgactgacct

SEQ ID NO: 190142 - DNA, 25 bp, Rattus norvegicus
atgagcttttgcgagtgactgacct

SEQ ID NO: 190143 - DNA, 25 bp, Rattus norvegicus
atgaggaaaagcagcttccttgggt

SEQ ID NO: 190144 - DNA, 25 bp, Rattus norvegicus
atgaggaaaagctgcttccttgggt

SEQ ID NO: 190145 - DNA, 25 bp, Rattus norvegicus
atgaggaaacaaccgccaagcatca

SEQ ID NO: 190146 - DNA, 25 bp, Rattus norvegicus
atgaggaaacaagcgccaagcatca

SEQ ID NO: 190147 - DNA, 25 bp, Rattus norvegicus
atgaggaacagtcacactttcccct

SEQ ID NO: 190148 - DNA, 25 bp, Rattus norvegicus
atgaggaacagtgacactttcccct

SEQ ID NO: 190149 - DNA, 25 bp, Rattus norvegicus
atgaggaacgcaacattgctgagct

SEQ ID NO: 190150 - DNA, 25 bp, Rattus norvegicus
atgaggaacgcatcattgctgagct

SEQ ID NO: 190151 - DNA, 25 bp, Rattus norvegicus
atgaggaacgccatcgcaagtctta

SEQ ID NO: 190152 - DNA, 25 bp, Rattus norvegicus
atgaggaacgccttcgcaagtctta

SEQ ID NO: 190153 - DNA, 25 bp, Rattus norvegicus
atgaggaacgtcacgtaggtacact

SEQ ID NO: 190154 - DNA, 25 bp, Rattus norvegicus
atgaggaacgtctcgtaggtacact

SEQ ID NO: 190155 - DNA, 25 bp, Rattus norvegicus
atgaggaactcgacgccatgatgaa

SEQ ID NO: 190156 - DNA, 25 bp, Rattus norvegicus
atgaggaactcgtcgccatgatgaa

SEQ ID NO: 190157 - DNA, 25 bp, Rattus norvegicus
atgaggaacttcaccgagctgacct

SEQ ID NO: 190158 - DNA, 25 bp, Rattus norvegicus
atgaggaacttctccgagctgacct

SEQ ID NO: 190159 - DNA, 25 bp, Rattus norvegicus
atgaggaagacaatgcccggcggtt

SEQ ID NO: 190160 - DNA, 25 bp, Rattus norvegicus
atgaggaagacattgcccggcggtt

SEQ ID NO: 190161 - DNA, 25 bp, Rattus norvegicus
atgaggaagactcgtccttggccat

SEQ ID NO: 190162 - DNA, 25 bp, Rattus norvegicus
atgaggaagactggtccttggccat

SEQ ID NO: 190163 - DNA, 25 bp, Rattus norvegicus
atgaggaagctcatgggctgtcttc

SEQ ID NO: 190164 - DNA, 25 bp, Rattus norvegicus
atgaggaagctcttgggctgtcttc

SEQ ID NO: 190165 - DNA, 25 bp, Rattus norvegicus
atgaggaatgaaagccacccatctt

SEQ ID NO: 190166 - DNA, 25 bp, Rattus norvegicus
atgaggaatgaatgccacccatctt

SEQ ID NO: 190167 - DNA, 25 bp, Rattus norvegicus
atgaggaatgctagccttcactggc

SEQ ID NO: 190168 - DNA, 25 bp, Rattus norvegicus
atgaggaatgcttgccttcactggc

SEQ ID NO: 190169 - DNA, 25 bp, Rattus norvegicus
atgaggacaaaaccccaactcacgg

SEQ ID NO: 190170 - DNA, 25 bp, Rattus norvegicus
atgaggacaaaagcccaactcacgg

SEQ ID NO: 190171 - DNA, 25 bp, Rattus norvegicus
atgaggacaaacctgtcagcctgca

SEQ ID NO: 190172 - DNA, 25 bp, Rattus norvegicus
atgaggacaaacgtgtcagcctgca

SEQ ID NO: 190173 - DNA, 25 bp, Rattus norvegicus
atgaggacaccactacggacaagct

SEQ ID NO: 190174 - DNA, 25 bp, Rattus norvegicus
atgaggacaccagtacggacaagct

SEQ ID NO: 190175 - DNA, 25 bp, Rattus norvegicus
atgaggacaccgcactaaatgattt

SEQ ID NO: 190176 - DNA, 25 bp, Rattus norvegicus
atgaggacaccggactaaatgattt

SEQ ID NO: 190177 - DNA, 25 bp, Rattus norvegicus
atgaggacacgccagacgcctacag

SEQ ID NO: 190178 - DNA, 25 bp, Rattus norvegicus
atgaggacacgcgagacgcctacag

SEQ ID NO: 190179 - DNA, 25 bp, Rattus norvegicus
atgaggacagtccactctacggcat

SEQ ID NO: 190180 - DNA, 25 bp, Rattus norvegicus
atgaggacagtcgactctacggcat

SEQ ID NO: 190181 - DNA, 25 bp, Rattus norvegicus
atgaggaccagaagaaccggccatg

SEQ ID NO: 190182 - DNA, 25 bp, Rattus norvegicus
atgaggaccagatgaaccggccatg

SEQ ID NO: 190183 - DNA, 25 bp, Rattus norvegicus
atgaggaccagtcttctgatcccca

SEQ ID NO: 190184 - DNA, 25 bp, Rattus norvegicus
atgaggaccagtgttctgatcccca

SEQ ID NO: 190185 - DNA, 25 bp, Rattus norvegicus
atgaggaccatcacctgtgcctgtg

SEQ ID NO: 190186 - DNA, 25 bp, Rattus norvegicus
atgaggaccatctcctgtgcctgtg

SEQ ID NO: 190187 - DNA, 25 bp, Rattus norvegicus
atgaggaccccgatattgctgtctt

SEQ ID NO: 190188 - DNA, 25 bp, Rattus norvegicus
atgaggaccccgttattgctgtctt

SEQ ID NO: 190189 - DNA, 25 bp, Rattus norvegicus
atgaggaccgtcactatggcgacat

SEQ ID NO: 190190 - DNA, 25 bp, Rattus norvegicus
atgaggaccgtctctatggcgacat

SEQ ID NO: 190191 - DNA, 25 bp, Rattus norvegicus
atgaggacgcccatgccagaagtgc

SEQ ID NO: 190192 - DNA, 25 bp, Rattus norvegicus
atgaggacgcccttgccagaagtgc

SEQ ID NO: 190193 - DNA, 25 bp, Rattus norvegicus
atgaggactaagagaacccagtatc

SEQ ID NO: 190194 - DNA, 25 bp, Rattus norvegicus
atgaggactaagtgaacccagtatc

SEQ ID NO: 190195 - DNA, 25 bp, Rattus norvegicus
atgaggactcaaagacccgaccctt

SEQ ID NO: 190196 - DNA, 25 bp, Rattus norvegicus
atgaggactcaatgacccgaccctt

SEQ ID NO: 190197 - DNA, 25 bp, Rattus norvegicus
atgaggactctaagtggtacgccca

SEQ ID NO: 190198 - DNA, 25 bp, Rattus norvegicus
atgaggactctatgtggtacgccca

SEQ ID NO: 190199 - DNA, 25 bp, Rattus norvegicus
atgaggactctgagcatggctgaca

SEQ ID NO: 190200 - DNA, 25 bp, Rattus norvegicus
atgaggactctgtgcatggctgaca

SEQ ID NO: 190201 - DNA, 25 bp, Rattus norvegicus
atgaggactggcaaactcgtcatcc

SEQ ID NO: 190202 - DNA, 25 bp, Rattus norvegicus
atgaggactggctaactcgtcatcc

SEQ ID NO: 190203 - DNA, 25 bp, Rattus norvegicus
atgaggactgtgacgttatgttaaa

SEQ ID NO: 190204 - DNA, 25 bp, Rattus norvegicus
atgaggactgtgtcgttatgttaaa

SEQ ID NO: 190205 - DNA, 25 bp, Rattus norvegicus
atgaggacttctcgacccacaaagc

SEQ ID NO: 190206 - DNA, 25 bp, Rattus norvegicus
atgaggacttctggacccacaaagc

SEQ ID NO: 190207 - DNA, 25 bp, Rattus norvegicus
atgaggagaaacaactgaggccagt

SEQ ID NO: 190208 - DNA, 25 bp, Rattus norvegicus
atgaggagaaactactgaggccagt

SEQ ID NO: 190209 - DNA, 25 bp, Rattus norvegicus
atgaggagaacgagcccctgaacac

SEQ ID NO: 190210 - DNA, 25 bp, Rattus norvegicus
atgaggagaacgtgcccctgaacac

SEQ ID NO: 190211 - DNA, 25 bp, Rattus norvegicus
atgaggagaccacaactccagccct

SEQ ID NO: 190212 - DNA, 25 bp, Rattus norvegicus
atgaggagaccagaactccagccct

SEQ ID NO: 190213 - DNA, 25 bp, Rattus norvegicus
atgaggagagaacccacaccctcgt

SEQ ID NO: 190214 - DNA, 25 bp, Rattus norvegicus
atgaggagagaagccacaccctcgt

SEQ ID NO: 190215 - DNA, 25 bp, Rattus norvegicus
atgaggagatcgagtcgcccttgtc

SEQ ID NO: 190216 - DNA, 25 bp, Rattus norvegicus
atgaggagatcgtgtcgcccttgtc

SEQ ID NO: 190217 - DNA, 25 bp, Rattus norvegicus
atgaggagattacgcccctgctcta

SEQ ID NO: 190218 - DNA, 25 bp, Rattus norvegicus
atgaggagattaggcccctgctcta

SEQ ID NO: 190219 - DNA, 25 bp, Rattus norvegicus
atgaggagccggcacaagtctacgc

SEQ ID NO: 190220 - DNA, 25 bp, Rattus norvegicus
atgaggagccgggacaagtctacgc

SEQ ID NO: 190221 - DNA, 25 bp, Rattus norvegicus
atgaggagctagcaaggcagcccct

SEQ ID NO: 190222 - DNA, 25 bp, Rattus norvegicus
atgaggagctaggaaggcagcccct

SEQ ID NO: 190223 - DNA, 25 bp, Rattus norvegicus
atgaggagctcgagggtgtctctcc

SEQ ID NO: 190224 - DNA, 25 bp, Rattus norvegicus
atgaggagctcgtgggtgtctctcc

SEQ ID NO: 190225 - DNA, 25 bp, Rattus norvegicus
atgaggaggcaaactcctcatctgt

SEQ ID NO: 190226 - DNA, 25 bp, Rattus norvegicus
atgaggaggcaatctcctcatctgt

SEQ ID NO: 190227 - DNA, 25 bp, Rattus norvegicus
atgaggaggccgagcattacatgca

SEQ ID NO: 190228 - DNA, 25 bp, Rattus norvegicus
atgaggaggccgtgcattacatgca

SEQ ID NO: 190229 - DNA, 25 bp, Rattus norvegicus
atgaggagggctatttcaccacccg

SEQ ID NO: 190230 - DNA, 25 bp, Rattus norvegicus
atgaggagggctttttcaccacccg

SEQ ID NO: 190231 - DNA, 25 bp, Rattus norvegicus
atgaggagtcctattcgagagcaaa

SEQ ID NO: 190232 - DNA, 25 bp, Rattus norvegicus
atgaggagtccttttcgagagcaaa

SEQ ID NO: 190233 - DNA, 25 bp, Rattus norvegicus
atgaggagtgcgaccacagaccagt

SEQ ID NO: 190234 - DNA, 25 bp, Rattus norvegicus
atgaggagtgcgtccacagaccagt

SEQ ID NO: 190235 - DNA, 25 bp, Rattus norvegicus
atgaggagtgtcctaccattacccg

SEQ ID NO: 190236 - DNA, 25 bp, Rattus norvegicus
atgaggagtgtcgtaccattacccg

SEQ ID NO: 190237 - DNA, 25 bp, Rattus norvegicus
atgaggagttccacgatggctacgg

SEQ ID NO: 190238 - DNA, 25 bp, Rattus norvegicus
atgaggagttcctcgatggctacgg

SEQ ID NO: 190239 - DNA, 25 bp, Rattus norvegicus
atgaggatacagactccggagctat

SEQ ID NO: 190240 - DNA, 25 bp, Rattus norvegicus
atgaggatacagtctccggagctat

SEQ ID NO: 190241 - DNA, 25 bp, Rattus norvegicus
atgaggatccataaccttctcttct

SEQ ID NO: 190242 - DNA, 25 bp, Rattus norvegicus
atgaggatccattaccttctcttct

SEQ ID NO: 190243 - DNA, 25 bp, Rattus norvegicus
atgaggatcctaatccctccagagt

SEQ ID NO: 190244 - DNA, 25 bp, Rattus norvegicus
atgaggatcctattccctccagagt

SEQ ID NO: 190245 - DNA, 25 bp, Rattus norvegicus
atgaggatcttactcctctgtcttc

SEQ ID NO: 190246 - DNA, 25 bp, Rattus norvegicus
atgaggatcttagtcctctgtcttc

SEQ ID NO: 190247 - DNA, 25 bp, Rattus norvegicus
atgaggatggccacacgccagaaca

SEQ ID NO: 190248 - DNA, 25 bp, Rattus norvegicus
atgaggatggcctcacgccagaaca

SEQ ID NO: 190249 - DNA, 25 bp, Rattus norvegicus
atgaggattaaaaccctgggccaag

SEQ ID NO: 190250 - DNA, 25 bp, Rattus norvegicus
atgaggattaaatccctgggccaag

SEQ ID NO: 190251 - DNA, 25 bp, Rattus norvegicus
atgaggattccaatctgccaggctc

SEQ ID NO: 190252 - DNA, 25 bp, Rattus norvegicus
atgaggattccattctgccaggctc

SEQ ID NO: 190253 - DNA, 25 bp, Rattus norvegicus
atgaggatttctacagccttatcca

SEQ ID NO: 190254 - DNA, 25 bp, Rattus norvegicus
atgaggatttcttcagccttatcca

SEQ ID NO: 190255 - DNA, 25 bp, Rattus norvegicus
atgaggattttactgtgaggccaag

SEQ ID NO: 190256 - DNA, 25 bp, Rattus norvegicus
atgaggattttagtgtgaggccaag

SEQ ID NO: 190257 - DNA, 25 bp, Rattus norvegicus
atgaggcaaaccctgtgaactccgg

SEQ ID NO: 190258 - DNA, 25 bp, Rattus norvegicus
atgaggcaaaccgtgtgaactccgg

SEQ ID NO: 190259 - DNA, 25 bp, Rattus norvegicus
atgaggcaatccatggcagggcagc

SEQ ID NO: 190260 - DNA, 25 bp, Rattus norvegicus
atgaggcaatccttggcagggcagc

SEQ ID NO: 190261 - DNA, 25 bp, Rattus norvegicus
atgaggcacctaaagatcgtctacc

SEQ ID NO: 190262 - DNA, 25 bp, Rattus norvegicus
atgaggcacctatagatcgtctacc

SEQ ID NO: 190263 - DNA, 25 bp, Rattus norvegicus
atgaggcaccttatggaggccagaa

SEQ ID NO: 190264 - DNA, 25 bp, Rattus norvegicus
atgaggcaccttttggaggccagaa

SEQ ID NO: 190265 - DNA, 25 bp, Rattus norvegicus
atgaggcagaccagtagcttcagtt

SEQ ID NO: 190266 - DNA, 25 bp, Rattus norvegicus
atgaggcagacctgtagcttcagtt

SEQ ID NO: 190267 - DNA, 25 bp, Rattus norvegicus
atgaggcagctcaacgtatgaatga

SEQ ID NO: 190268 - DNA, 25 bp, Rattus norvegicus
atgaggcagctctacgtatgaatga

SEQ ID NO: 190269 - DNA, 25 bp, Rattus norvegicus
atgaggcaggctcgtgtctttcaga

SEQ ID NO: 190270 - DNA, 25 bp, Rattus norvegicus
atgaggcaggctggtgtctttcaga

SEQ ID NO: 190271 - DNA, 25 bp, Rattus norvegicus
atgaggccaaagacaaggcactgga

SEQ ID NO: 190272 - DNA, 25 bp, Rattus norvegicus
atgaggccaaagtcaaggcactgga

SEQ ID NO: 190273 - DNA, 25 bp, Rattus norvegicus
atgaggccaactccattgaggtcct

SEQ ID NO: 190274 - DNA, 25 bp, Rattus norvegicus
atgaggccaactgcattgaggtcct

SEQ ID NO: 190275 - DNA, 25 bp, Rattus norvegicus
atgaggccactgcaccaaccaaagt

SEQ ID NO: 190276 - DNA, 25 bp, Rattus norvegicus
atgaggccactggaccaaccaaagt

SEQ ID NO: 190277 - DNA, 25 bp, Rattus norvegicus
atgaggccaggcagcctgtaatccc

SEQ ID NO: 190278 - DNA, 25 bp, Rattus norvegicus
atgaggccaggctgcctgtaatccc

SEQ ID NO: 190279 - DNA, 25 bp, Rattus norvegicus
atgaggcccaagaccttcagtattg

SEQ ID NO: 190280 - DNA, 25 bp, Rattus norvegicus
atgaggcccaagtccttcagtattg

SEQ ID NO: 190281 - DNA, 25 bp, Rattus norvegicus
atgaggccctggaccaagtcagtgg

SEQ ID NO: 190282 - DNA, 25 bp, Rattus norvegicus
atgaggccctggtccaagtcagtgg

SEQ ID NO: 190283 - DNA, 25 bp, Rattus norvegicus
atgaggccctgtctcggaaacagac

SEQ ID NO: 190284 - DNA, 25 bp, Rattus norvegicus
atgaggccctgtgtcggaaacagac

SEQ ID NO: 190285 - DNA, 25 bp, Rattus norvegicus
atgaggccgaggacgttctgtcatg

SEQ ID NO: 190286 - DNA, 25 bp, Rattus norvegicus
atgaggccgaggtcgttctgtcatg

SEQ ID NO: 190287 - DNA, 25 bp, Rattus norvegicus
atgaggccgtggagcagcaggtgca

SEQ ID NO: 190288 - DNA, 25 bp, Rattus norvegicus
atgaggccgtggtgcagcaggtgca

SEQ ID NO: 190289 - DNA, 25 bp, Rattus norvegicus
atgaggcctccaattttacaaaatt

SEQ ID NO: 190290 - DNA, 25 bp, Rattus norvegicus
atgaggcctccatttttacaaaatt

SEQ ID NO: 190291 - DNA, 25 bp, Rattus norvegicus
atgaggccttttcggactggagtta

SEQ ID NO: 190292 - DNA, 25 bp, Rattus norvegicus
atgaggccttttgggactggagtta

SEQ ID NO: 190293 - DNA, 25 bp, Rattus norvegicus
atgaggcgccccactggatggacca

SEQ ID NO: 190294 - DNA, 25 bp, Rattus norvegicus
atgaggcgcccctctggatggacca

SEQ ID NO: 190295 - DNA, 25 bp, Rattus norvegicus
atgaggcgctccatgacagtggctg

SEQ ID NO: 190296 - DNA, 25 bp, Rattus norvegicus
atgaggcgctccttgacagtggctg

SEQ ID NO: 190297 - DNA, 25 bp, Rattus norvegicus
atgaggcggcgcatcaacggcctga

SEQ ID NO: 190298 - DNA, 25 bp, Rattus norvegicus
atgaggcggcgcttcaacggcctga

SEQ ID NO: 190299 - DNA, 25 bp, Rattus norvegicus
atgaggcgtggacctctgtcagttt

SEQ ID NO: 190300 - DNA, 25 bp, Rattus norvegicus
atgaggcgtggagctctgtcagttt

SEQ ID NO: 190301 - DNA, 25 bp, Rattus norvegicus
atgaggctagacattgaggaccaca

SEQ ID NO: 190302 - DNA, 25 bp, Rattus norvegicus
atgaggctagactttgaggaccaca

SEQ ID NO: 190303 - DNA, 25 bp, Rattus norvegicus
atgaggctcctgagaatcttcccaa

SEQ ID NO: 190304 - DNA, 25 bp, Rattus norvegicus
atgaggctcctgtgaatcttcccaa

SEQ ID NO: 190305 - DNA, 25 bp, Rattus norvegicus
atgaggctcgatacatcaggcgttc

SEQ ID NO: 190306 - DNA, 25 bp, Rattus norvegicus
atgaggctcgattcatcaggcgttc

SEQ ID NO: 190307 - DNA, 25 bp, Rattus norvegicus
atgaggctctagcttgctggcagta

SEQ ID NO: 190308 - DNA, 25 bp, Rattus norvegicus
atgaggctctaggttgctggcagta

SEQ ID NO: 190309 - DNA, 25 bp, Rattus norvegicus
atgaggctctctattttgtaataaa

SEQ ID NO: 190310 - DNA, 25 bp, Rattus norvegicus
atgaggctctcttttttgtaataaa

SEQ ID NO: 190311 - DNA, 25 bp, Rattus norvegicus
atgaggctgactatgtttacctgcc

SEQ ID NO: 190312 - DNA, 25 bp, Rattus norvegicus
atgaggctgactctgctactgtacc

SEQ ID NO: 190313 - DNA, 25 bp, Rattus norvegicus
atgaggctgactgtgctactgtacc

SEQ ID NO: 190314 - DNA, 25 bp, Rattus norvegicus
atgaggctgactttgtttacctgcc

SEQ ID NO: 190315 - DNA, 25 bp, Rattus norvegicus
atgaggctgatcaggagcttcagag

SEQ ID NO: 190316 - DNA, 25 bp, Rattus norvegicus
atgaggctgatctggagcttcagag

SEQ ID NO: 190317 - DNA, 25 bp, Rattus norvegicus
atgaggctggcactcacacagttca

SEQ ID NO: 190318 - DNA, 25 bp, Rattus norvegicus
atgaggctggcagtcacacagttca

SEQ ID NO: 190319 - DNA, 25 bp, Rattus norvegicus
atgaggctgggccacaggttacctt

SEQ ID NO: 190320 - DNA, 25 bp, Rattus norvegicus
atgaggctgggcgacaggttacctt

SEQ ID NO: 190321 - DNA, 25 bp, Rattus norvegicus
atgaggctgtagacgttttaacaag

SEQ ID NO: 190322 - DNA, 25 bp, Rattus norvegicus
atgaggctgtagtcgttttaacaag

SEQ ID NO: 190323 - DNA, 25 bp, Rattus norvegicus
atgaggctgtgtaccaccaatctgt

SEQ ID NO: 190324 - DNA, 25 bp, Rattus norvegicus
atgaggctgtgttccaccaatctgt

SEQ ID NO: 190325 - DNA, 25 bp, Rattus norvegicus
atgaggctgttccttgtaatccctg

SEQ ID NO: 190326 - DNA, 25 bp, Rattus norvegicus
atgaggctgttcgttgtaatccctg

SEQ ID NO: 190327 - DNA, 25 bp, Rattus norvegicus
atgaggcttattcgcgaaatgtttc

SEQ ID NO: 190328 - DNA, 25 bp, Rattus norvegicus
atgaggcttattggcgaaatgtttc

SEQ ID NO: 190329 - DNA, 25 bp, Rattus norvegicus
atgagggacagcatctcggtgactc

SEQ ID NO: 190330 - DNA, 25 bp, Rattus norvegicus
atgagggacagcttctcggtgactc

SEQ ID NO: 190331 - DNA, 25 bp, Rattus norvegicus
atgagggacattacttttctgtttg

SEQ ID NO: 190332 - DNA, 25 bp, Rattus norvegicus
atgagggacatttcttttctgtttg

SEQ ID NO: 190333 - DNA, 25 bp, Rattus norvegicus
atgagggactgcctgaacctctcgc

SEQ ID NO: 190334 - DNA, 25 bp, Rattus norvegicus
atgagggactgcgtgaacctctcgc

SEQ ID NO: 190335 - DNA, 25 bp, Rattus norvegicus
atgagggagaggctccatcttcagt

SEQ ID NO: 190336 - DNA, 25 bp, Rattus norvegicus
atgagggagagggtccatcttcagt

SEQ ID NO: 190337 - DNA, 25 bp, Rattus norvegicus
atgagggatagcctatgctccagcc

SEQ ID NO: 190338 - DNA, 25 bp, Rattus norvegicus
atgagggatagcgtatgctccagcc

SEQ ID NO: 190339 - DNA, 25 bp, Rattus norvegicus
atgagggatcgtagctggcctactc

SEQ ID NO: 190340 - DNA, 25 bp, Rattus norvegicus
atgagggatcgttgctggcctactc

SEQ ID NO: 190341 - DNA, 25 bp, Rattus norvegicus
atgagggatgtgactcttttctgcc

SEQ ID NO: 190342 - DNA, 25 bp, Rattus norvegicus
atgagggatgtgtctcttttctgcc

SEQ ID NO: 190343 - DNA, 25 bp, Rattus norvegicus
atgagggcatcactgttagtttggt

SEQ ID NO: 190344 - DNA, 25 bp, Rattus norvegicus
atgagggcatcagtgttagtttggt

SEQ ID NO: 190345 - DNA, 25 bp, Rattus norvegicus
atgagggcatcccaactggacagcc

SEQ ID NO: 190346 - DNA, 25 bp, Rattus norvegicus
atgagggcatccgaactggacagcc

SEQ ID NO: 190347 - DNA, 25 bp, Rattus norvegicus
atgagggcctcacctgcttggcagt

SEQ ID NO: 190348 - DNA, 25 bp, Rattus norvegicus
atgagggcctcagctgcttggcagt

SEQ ID NO: 190349 - DNA, 25 bp, Rattus norvegicus
atgagggccttgaattttctggaac

SEQ ID NO: 190350 - DNA, 25 bp, Rattus norvegicus
atgagggccttgtattttctggaac

SEQ ID NO: 190351 - DNA, 25 bp, Rattus norvegicus
atgagggctgctaatgaggtgacca

SEQ ID NO: 190352 - DNA, 25 bp, Rattus norvegicus
atgagggctgcttatgaggtgacca

SEQ ID NO: 190353 - DNA, 25 bp, Rattus norvegicus
atgagggctggtacatggctttcac

SEQ ID NO: 190354 - DNA, 25 bp, Rattus norvegicus
atgagggctggttcatggctttcac

SEQ ID NO: 190355 - DNA, 25 bp, Rattus norvegicus
atgagggcttcaaacactgtccttt

SEQ ID NO: 190356 - DNA, 25 bp, Rattus norvegicus
atgagggcttcatacactgtccttt

SEQ ID NO: 190357 - DNA, 25 bp, Rattus norvegicus
atgagggctttgacttggctctgtg

SEQ ID NO: 190358 - DNA, 25 bp, Rattus norvegicus
atgagggctttgtcttggctctgtg

SEQ ID NO: 190359 - DNA, 25 bp, Rattus norvegicus
atgagggtctgtctccaggaacctt

SEQ ID NO: 190360 - DNA, 25 bp, Rattus norvegicus
atgagggtctgtgtccaggaacctt

SEQ ID NO: 190361 - DNA, 25 bp, Rattus norvegicus
atgagggtgactattactatgcagg

SEQ ID NO: 190362 - DNA, 25 bp, Rattus norvegicus
atgagggtgacttttactatgcagg

SEQ ID NO: 190363 - DNA, 25 bp, Rattus norvegicus
atgagggttcaaccggatttgcttt

SEQ ID NO: 190364 - DNA, 25 bp, Rattus norvegicus
atgagggttcaagcggatttgcttt

SEQ ID NO: 190365 - DNA, 25 bp, Rattus norvegicus
atgagggttcccaaagctcctgaag

SEQ ID NO: 190366 - DNA, 25 bp, Rattus norvegicus
atgagggttccctaagctcctgaag

SEQ ID NO: 190367 - DNA, 25 bp, Rattus norvegicus
atgagggttcctctactgcctatac

SEQ ID NO: 190368 - DNA, 25 bp, Rattus norvegicus
atgagggttcctgtactgcctatac

SEQ ID NO: 190369 - DNA, 25 bp, Rattus norvegicus
atgagggttgcgcacccggcaacat

SEQ ID NO: 190370 - DNA, 25 bp, Rattus norvegicus
atgagggttgcggacccggcaacat

SEQ ID NO: 190371 - DNA, 25 bp, Rattus norvegicus
atgagggtttctacagcctgtggaa

SEQ ID NO: 190372 - DNA, 25 bp, Rattus norvegicus
atgagggtttcttcagcctgtggaa

SEQ ID NO: 190373 - DNA, 25 bp, Rattus norvegicus
atgaggtaggctcaggccagctaat

SEQ ID NO: 190374 - DNA, 25 bp, Rattus norvegicus
atgaggtaggctctgacccagtctt

SEQ ID NO: 190375 - DNA, 25 bp, Rattus norvegicus
atgaggtaggctgaggccagctaat

SEQ ID NO: 190376 - DNA, 25 bp, Rattus norvegicus
atgaggtaggctgtgacccagtctt

SEQ ID NO: 190377 - DNA, 25 bp, Rattus norvegicus
atgaggtatcgaagcctctggccca

SEQ ID NO: 190378 - DNA, 25 bp, Rattus norvegicus
atgaggtatcgatgcctctggccca

SEQ ID NO: 190379 - DNA, 25 bp, Rattus norvegicus
atgaggtatgtcataccctcgcgtc

SEQ ID NO: 190380 - DNA, 25 bp, Rattus norvegicus
atgaggtatgtcttaccctcgcgtc

SEQ ID NO: 190381 - DNA, 25 bp, Rattus norvegicus
atgaggtattctagagtctgcccac

SEQ ID NO: 190382 - DNA, 25 bp, Rattus norvegicus
atgaggtattcttgagtctgcccac

SEQ ID NO: 190383 - DNA, 25 bp, Rattus norvegicus
atgaggtcatggatgccttccgcaa

SEQ ID NO: 190384 - DNA, 25 bp, Rattus norvegicus
atgaggtcatggttgccttccgcaa

SEQ ID NO: 190385 - DNA, 25 bp, Rattus norvegicus
atgaggtccagcagacacagactgt

SEQ ID NO: 190386 - DNA, 25 bp, Rattus norvegicus
atgaggtccagcagccagtgtatcc

SEQ ID NO: 190387 - DNA, 25 bp, Rattus norvegicus
atgaggtccagctgacacagactgt

SEQ ID NO: 190388 - DNA, 25 bp, Rattus norvegicus
atgaggtccagctgccagtgtatcc

SEQ ID NO: 190389 - DNA, 25 bp, Rattus norvegicus
atgaggtccataagtcccagtggcc

SEQ ID NO: 190390 - DNA, 25 bp, Rattus norvegicus
atgaggtccatatgtcccagtggcc

SEQ ID NO: 190391 - DNA, 25 bp, Rattus norvegicus
atgaggtcctagcagacagcatcct

SEQ ID NO: 190392 - DNA, 25 bp, Rattus norvegicus
atgaggtcctaggagacagcatcct

SEQ ID NO: 190393 - DNA, 25 bp, Rattus norvegicus
atgaggtcgcacatctgggcgacgc

SEQ ID NO: 190394 - DNA, 25 bp, Rattus norvegicus
atgaggtcgcacttctgggcgacgc

SEQ ID NO: 190395 - DNA, 25 bp, Rattus norvegicus
atgaggtcgtccacgagtggtgcta

SEQ ID NO: 190396 - DNA, 25 bp, Rattus norvegicus
atgaggtcgtcctcgagtggtgcta

SEQ ID NO: 190397 - DNA, 25 bp, Rattus norvegicus
atgaggtctccaacaagttcaatga

SEQ ID NO: 190398 - DNA, 25 bp, Rattus norvegicus
atgaggtctccatcaagttcaatga

SEQ ID NO: 190399 - DNA, 25 bp, Rattus norvegicus
atgaggtctgtgaatgctcacttcc

SEQ ID NO: 190400 - DNA, 25 bp, Rattus norvegicus
atgaggtctgtgtatgctcacttcc

SEQ ID NO: 190401 - DNA, 25 bp, Rattus norvegicus
atgaggtcttccacagcaagttcca

SEQ ID NO: 190402 - DNA, 25 bp, Rattus norvegicus
atgaggtcttcctcagcaagttcca

SEQ ID NO: 190403 - DNA, 25 bp, Rattus norvegicus
atgaggtcttctcccgcttcggaat

SEQ ID NO: 190404 - DNA, 25 bp, Rattus norvegicus
atgaggtcttctgccgcttcggaat

SEQ ID NO: 190405 - DNA, 25 bp, Rattus norvegicus
atgaggtgatgtcttttctgacgac

SEQ ID NO: 190406 - DNA, 25 bp, Rattus norvegicus
atgaggtgatgtgttttctgacgac

SEQ ID NO: 190407 - DNA, 25 bp, Rattus norvegicus
atgaggtgcctcagacgcatctcaa

SEQ ID NO: 190408 - DNA, 25 bp, Rattus norvegicus
atgaggtgcctctgacgcatctcaa

SEQ ID NO: 190409 - DNA, 25 bp, Rattus norvegicus
atgaggtgcttcattctgatggctt

SEQ ID NO: 190410 - DNA, 25 bp, Rattus norvegicus
atgaggtgcttctttctgatggctt

SEQ ID NO: 190411 - DNA, 25 bp, Rattus norvegicus
atgaggtgcttgaggttcactcccc

SEQ ID NO: 190412 - DNA, 25 bp, Rattus norvegicus
atgaggtgcttgtggttcactcccc

SEQ ID NO: 190413 - DNA, 25 bp, Rattus norvegicus
atgaggtggaacagcttttgtacta

SEQ ID NO: 190414 - DNA, 25 bp, Rattus norvegicus
atgaggtggaactgcttttgtacta

SEQ ID NO: 190415 - DNA, 25 bp, Rattus norvegicus
atgaggtggtcccagagctgatctc

SEQ ID NO: 190416 - DNA, 25 bp, Rattus norvegicus
atgaggtggtccgagagctgatctc

SEQ ID NO: 190417 - DNA, 25 bp, Rattus norvegicus
atgaggtggtctcactgtaggctcc

SEQ ID NO: 190418 - DNA, 25 bp, Rattus norvegicus
atgaggtggtctgactgtaggctcc

SEQ ID NO: 190419 - DNA, 25 bp, Rattus norvegicus
atgaggtgtccgagaggcgtccact

SEQ ID NO: 190420 - DNA, 25 bp, Rattus norvegicus
atgaggtgtccgtgaggcgtccact

SEQ ID NO: 190421 - DNA, 25 bp, Rattus norvegicus
atgaggtgtggaaagcctgagcccc

SEQ ID NO: 190422 - DNA, 25 bp, Rattus norvegicus
atgaggtgtggatagcctgagcccc

SEQ ID NO: 190423 - DNA, 25 bp, Rattus norvegicus
atgaggtgtggcagtcacagaccaa

SEQ ID NO: 190424 - DNA, 25 bp, Rattus norvegicus
atgaggtgtggctgtcacagaccaa

SEQ ID NO: 190425 - DNA, 25 bp, Rattus norvegicus
atgaggtgtgtgatggtggccactg

SEQ ID NO: 190426 - DNA, 25 bp, Rattus norvegicus
atgaggtgtgtgttggtggccactg

SEQ ID NO: 190427 - DNA, 25 bp, Rattus norvegicus
atgaggttatctctggctcactcgc

SEQ ID NO: 190428 - DNA, 25 bp, Rattus norvegicus
atgaggttatctgtggctcactcgc

SEQ ID NO: 190429 - DNA, 25 bp, Rattus norvegicus
atgaggttcgtgattcttgagggtt

SEQ ID NO: 190430 - DNA, 25 bp, Rattus norvegicus
atgaggttcgtgtttcttgagggtt

SEQ ID NO: 190431 - DNA, 25 bp, Rattus norvegicus
atgaggttctggctagtcacctagc

SEQ ID NO: 190432 - DNA, 25 bp, Rattus norvegicus
atgaggttctgggtagtcacctagc

SEQ ID NO: 190433 - DNA, 25 bp, Rattus norvegicus
atgaggttctttactggaggctgtt

SEQ ID NO: 190434 - DNA, 25 bp, Rattus norvegicus
atgaggttcttttctggaggctgtt

SEQ ID NO: 190435 - DNA, 25 bp, Rattus norvegicus
atgaggttgcaaacagctggactgt

SEQ ID NO: 190436 - DNA, 25 bp, Rattus norvegicus
atgaggttgcaatcagctggactgt

SEQ ID NO: 190437 - DNA, 25 bp, Rattus norvegicus
atgaggtttagcaactctgctgtga

SEQ ID NO: 190438 - DNA, 25 bp, Rattus norvegicus
atgaggtttagctactctgctgtga

SEQ ID NO: 190439 - DNA, 25 bp, Rattus norvegicus
atgaggtttcatcgctggacagata

SEQ ID NO: 190440 - DNA, 25 bp, Rattus norvegicus
atgaggtttcatggctggacagata

SEQ ID NO: 190441 - DNA, 25 bp, Rattus norvegicus
atgaggtttccccttcgtagaagtg

SEQ ID NO: 190442 - DNA, 25 bp, Rattus norvegicus
atgaggtttcccgttcgtagaagtg

SEQ ID NO: 190443 - DNA, 25 bp, Rattus norvegicus
atgaggtttcttagtactccggcca

SEQ ID NO: 190444 - DNA, 25 bp, Rattus norvegicus
atgaggtttctttgtactccggcca

SEQ ID NO: 190445 - DNA, 25 bp, Rattus norvegicus
atgaggttttccaatttctctcagg

SEQ ID NO: 190446 - DNA, 25 bp, Rattus norvegicus
atgaggttttccataccatgtaaat

SEQ ID NO: 190447 - DNA, 25 bp, Rattus norvegicus
atgaggttttcctatttctctcagg

SEQ ID NO: 190448 - DNA, 25 bp, Rattus norvegicus
atgaggttttccttaccatgtaaat

SEQ ID NO: 190449 - DNA, 25 bp, Rattus norvegicus
atgagtaaactgacgtttcgggcgc

SEQ ID NO: 190450 - DNA, 25 bp, Rattus norvegicus
atgagtaaactgtcgtttcgggcgc

SEQ ID NO: 190451 - DNA, 25 bp, Rattus norvegicus
atgagtaacttgctctgtgcatgcc

SEQ ID NO: 190452 - DNA, 25 bp, Rattus norvegicus
atgagtaacttggtctgtgcatgcc

SEQ ID NO: 190453 - DNA, 25 bp, Rattus norvegicus
atgagtaccacacacttccgagctg

SEQ ID NO: 190454 - DNA, 25 bp, Rattus norvegicus
atgagtaccacagacttccgagctg

SEQ ID NO: 190455 - DNA, 25 bp, Rattus norvegicus
atgagtaccatgaccactgcatcga

SEQ ID NO: 190456 - DNA, 25 bp, Rattus norvegicus
atgagtaccatgtccactgcatcga

SEQ ID NO: 190457 - DNA, 25 bp, Rattus norvegicus
atgagtacctagagagcattcccct

SEQ ID NO: 190458 - DNA, 25 bp, Rattus norvegicus
atgagtacctagtgagcattcccct

SEQ ID NO: 190459 - DNA, 25 bp, Rattus norvegicus
atgagtacctcaaggccaggagccc

SEQ ID NO: 190460 - DNA, 25 bp, Rattus norvegicus
atgagtacctcatggccaggagccc

SEQ ID NO: 190461 - DNA, 25 bp, Rattus norvegicus
atgagtactcctcaagccactgcta

SEQ ID NO: 190462 - DNA, 25 bp, Rattus norvegicus
atgagtactcctgaagccactgcta

SEQ ID NO: 190463 - DNA, 25 bp, Rattus norvegicus
atgagtactctactctgggcactgc

SEQ ID NO: 190464 - DNA, 25 bp, Rattus norvegicus
atgagtactctagtctgggcactgc

SEQ ID NO: 190465 - DNA, 25 bp, Rattus norvegicus
atgagtagaattacccttctgtccc

SEQ ID NO: 190466 - DNA, 25 bp, Rattus norvegicus
atgagtagaatttcccttctgtccc

SEQ ID NO: 190467 - DNA, 25 bp, Rattus norvegicus
atgagtagcccaaagactccctttg

SEQ ID NO: 190468 - DNA, 25 bp, Rattus norvegicus
atgagtagcccatagactccctttg

SEQ ID NO: 190469 - DNA, 25 bp, Rattus norvegicus
atgagtaggctgatactcctcactg

SEQ ID NO: 190470 - DNA, 25 bp, Rattus norvegicus
atgagtaggctgttactcctcactg

SEQ ID NO: 190471 - DNA, 25 bp, Rattus norvegicus
atgagtatacatcccttagaggtgt

SEQ ID NO: 190472 - DNA, 25 bp, Rattus norvegicus
atgagtatacatgccttagaggtgt

SEQ ID NO: 190473 - DNA, 25 bp, Rattus norvegicus
atgagtatatgtctgcattcagcaa

SEQ ID NO: 190474 - DNA, 25 bp, Rattus norvegicus
atgagtatatgtgtgcattcagcaa

SEQ ID NO: 190475 - DNA, 25 bp, Rattus norvegicus
atgagtatcctcatcacggttctaa

SEQ ID NO: 190476 - DNA, 25 bp, Rattus norvegicus
atgagtatcctcttcacggttctaa

SEQ ID NO: 190477 - DNA, 25 bp, Rattus norvegicus
atgagtatcggaccagttctcttcc

SEQ ID NO: 190478 - DNA, 25 bp, Rattus norvegicus
atgagtatcggagcagttctcttcc

SEQ ID NO: 190479 - DNA, 25 bp, Rattus norvegicus
atgagtatgactctcctcactggca

SEQ ID NO: 190480 - DNA, 25 bp, Rattus norvegicus
atgagtatgactgtcctcactggca

SEQ ID NO: 190481 - DNA, 25 bp, Rattus norvegicus
atgagtattcctcgtccctaggctg

SEQ ID NO: 190482 - DNA, 25 bp, Rattus norvegicus
atgagtattcctggtccctaggctg

SEQ ID NO: 190483 - DNA, 25 bp, Rattus norvegicus
atgagtattgagaactgtccactca

SEQ ID NO: 190484 - DNA, 25 bp, Rattus norvegicus
atgagtattgagtactgtccactca

SEQ ID NO: 190485 - DNA, 25 bp, Rattus norvegicus
atgagtatttcaagcacgccacgga

SEQ ID NO: 190486 - DNA, 25 bp, Rattus norvegicus
atgagtatttcatgcacgccacgga

SEQ ID NO: 190487 - DNA, 25 bp, Rattus norvegicus
atgagtatttctcggctctgtgggc

SEQ ID NO: 190488 - DNA, 25 bp, Rattus norvegicus
atgagtatttctgggctctgtgggc

SEQ ID NO: 190489 - DNA, 25 bp, Rattus norvegicus
atgagtcactgcagacgctttgctg

SEQ ID NO: 190490 - DNA, 25 bp, Rattus norvegicus
atgagtcactgctgacgctttgctg

SEQ ID NO: 190491 - DNA, 25 bp, Rattus norvegicus
atgagtcagactactcttgtacaaa

SEQ ID NO: 190492 - DNA, 25 bp, Rattus norvegicus
atgagtcagacttctcttgtacaaa

SEQ ID NO: 190493 - DNA, 25 bp, Rattus norvegicus
atgagtcaggcgcttcttctgcttc

SEQ ID NO: 190494 - DNA, 25 bp, Rattus norvegicus
atgagtcaggcggttcttctgcttc

SEQ ID NO: 190495 - DNA, 25 bp, Rattus norvegicus
atgagtcaggctatgggttcagtcc

SEQ ID NO: 190496 - DNA, 25 bp, Rattus norvegicus
atgagtcaggctttgggttcagtcc

SEQ ID NO: 190497 - DNA, 25 bp, Rattus norvegicus
atgagtcatagtccttagcttcctt

SEQ ID NO: 190498 - DNA, 25 bp, Rattus norvegicus
atgagtcatagtgcttagcttcctt

SEQ ID NO: 190499 - DNA, 25 bp, Rattus norvegicus
atgagtccaaacagggcatccgcgg

SEQ ID NO: 190500 - DNA, 25 bp, Rattus norvegicus
atgagtccaaactgggcatccgcgg

SEQ ID NO: 190501 - DNA, 25 bp, Rattus norvegicus
atgagtccacatacctaacacatgc

SEQ ID NO: 190502 - DNA, 25 bp, Rattus norvegicus
atgagtccacattcctaacacatgc

SEQ ID NO: 190503 - DNA, 25 bp, Rattus norvegicus
atgagtccacgcacacaacactgaa

SEQ ID NO: 190504 - DNA, 25 bp, Rattus norvegicus
atgagtccacgctcacaacactgaa

SEQ ID NO: 190505 - DNA, 25 bp, Rattus norvegicus
atgagtccagagcagacggccacga

SEQ ID NO: 190506 - DNA, 25 bp, Rattus norvegicus
atgagtccagaggagacggccacga

SEQ ID NO: 190507 - DNA, 25 bp, Rattus norvegicus
atgagtccattacgtcactcctgca

SEQ ID NO: 190508 - DNA, 25 bp, Rattus norvegicus
atgagtccattaggtcactcctgca

SEQ ID NO: 190509 - DNA, 25 bp, Rattus norvegicus
atgagtcccctcatttaaattggac

SEQ ID NO: 190510 - DNA, 25 bp, Rattus norvegicus
atgagtcccctcctggtggcagata

SEQ ID NO: 190511 - DNA, 25 bp, Rattus norvegicus
atgagtcccctcgtggtggcagata

SEQ ID NO: 190512 - DNA, 25 bp, Rattus norvegicus
atgagtcccctcttttaaattggac

SEQ ID NO: 190513 - DNA, 25 bp, Rattus norvegicus
atgagtccctgacattaaacttggg

SEQ ID NO: 190514 - DNA, 25 bp, Rattus norvegicus
atgagtccctgagattaaacttggg

SEQ ID NO: 190515 - DNA, 25 bp, Rattus norvegicus
atgagtccgcctacgaaagaacctg

SEQ ID NO: 190516 - DNA, 25 bp, Rattus norvegicus
atgagtccgccttcgaaagaacctg

SEQ ID NO: 190517 - DNA, 25 bp, Rattus norvegicus
atgagtcctcccctcagggctccga

SEQ ID NO: 190518 - DNA, 25 bp, Rattus norvegicus
atgagtcctcccgtcagggctccga

SEQ ID NO: 190519 - DNA, 25 bp, Rattus norvegicus
atgagtcctcttctcagggctcaca

SEQ ID NO: 190520 - DNA, 25 bp, Rattus norvegicus
atgagtcctcttgtcagggctcaca

SEQ ID NO: 190521 - DNA, 25 bp, Rattus norvegicus
atgagtcctgctcttacattcttgc

SEQ ID NO: 190522 - DNA, 25 bp, Rattus norvegicus
atgagtcctgctgttacattcttgc

SEQ ID NO: 190523 - DNA, 25 bp, Rattus norvegicus
atgagtcctggaacttactaagttg

SEQ ID NO: 190524 - DNA, 25 bp, Rattus norvegicus
atgagtcctggatcttactaagttg

SEQ ID NO: 190525 - DNA, 25 bp, Rattus norvegicus
atgagtccttatccatctggatgct

SEQ ID NO: 190526 - DNA, 25 bp, Rattus norvegicus
atgagtccttatgcatctggatgct

SEQ ID NO: 190527 - DNA, 25 bp, Rattus norvegicus
atgagtcctttaagaattctggcca

SEQ ID NO: 190528 - DNA, 25 bp, Rattus norvegicus
atgagtcctttatgaattctggcca

SEQ ID NO: 190529 - DNA, 25 bp, Rattus norvegicus
atgagtcgctctatgtctggaattt

SEQ ID NO: 190530 - DNA, 25 bp, Rattus norvegicus
atgagtcgctctttgtctggaattt

SEQ ID NO: 190531 - DNA, 25 bp, Rattus norvegicus
atgagtctaaccagatttacccttc

SEQ ID NO: 190532 - DNA, 25 bp, Rattus norvegicus
atgagtctaacctgatttacccttc

SEQ ID NO: 190533 - DNA, 25 bp, Rattus norvegicus
atgagtctccaaagtcagtgtttac

SEQ ID NO: 190534 - DNA, 25 bp, Rattus norvegicus
atgagtctccaactttaagtagttt

SEQ ID NO: 190535 - DNA, 25 bp, Rattus norvegicus
atgagtctccaagtttaagtagttt

SEQ ID NO: 190536 - DNA, 25 bp, Rattus norvegicus
atgagtctccaatgtcagtgtttac

SEQ ID NO: 190537 - DNA, 25 bp, Rattus norvegicus
atgagtctccaccttacttattgag

SEQ ID NO: 190538 - DNA, 25 bp, Rattus norvegicus
atgagtctccacgttacttattgag

SEQ ID NO: 190539 - DNA, 25 bp, Rattus norvegicus
atgagtctcctcaataaacccaaga

SEQ ID NO: 190540 - DNA, 25 bp, Rattus norvegicus
atgagtctcctctataaacccaaga

SEQ ID NO: 190541 - DNA, 25 bp, Rattus norvegicus
atgagtctcctgcttgttggaatcc

SEQ ID NO: 190542 - DNA, 25 bp, Rattus norvegicus
atgagtctcctggttgttggaatcc

SEQ ID NO: 190543 - DNA, 25 bp, Rattus norvegicus
atgagtctctctccgcacataaata

SEQ ID NO: 190544 - DNA, 25 bp, Rattus norvegicus
atgagtctctctgcgcacataaata

SEQ ID NO: 190545 - DNA, 25 bp, Rattus norvegicus
atgagtctgaagagctgggctacaa

SEQ ID NO: 190546 - DNA, 25 bp, Rattus norvegicus
atgagtctgaagtgctgggctacaa

SEQ ID NO: 190547 - DNA, 25 bp, Rattus norvegicus
atgagtctgacactgagctgagcca

SEQ ID NO: 190548 - DNA, 25 bp, Rattus norvegicus
atgagtctgacagtgagctgagcca

SEQ ID NO: 190549 - DNA, 25 bp, Rattus norvegicus
atgagtctgaggctagtgagttcca

SEQ ID NO: 190550 - DNA, 25 bp, Rattus norvegicus
atgagtctgagggtagtgagttcca

SEQ ID NO: 190551 - DNA, 25 bp, Rattus norvegicus
atgagtctgcggaagcaaaccccta

SEQ ID NO: 190552 - DNA, 25 bp, Rattus norvegicus
atgagtctgcggtagcaaaccccta

SEQ ID NO: 190553 - DNA, 25 bp, Rattus norvegicus
atgagtctggcgaacactctgcaca

SEQ ID NO: 190554 - DNA, 25 bp, Rattus norvegicus
atgagtctggcgtacactctgcaca

SEQ ID NO: 190555 - DNA, 25 bp, Rattus norvegicus
atgagtctgtcaagtggcaccacaa

SEQ ID NO: 190556 - DNA, 25 bp, Rattus norvegicus
atgagtctgtcatgtggcaccacaa

SEQ ID NO: 190557 - DNA, 25 bp, Rattus norvegicus
atgagtgaactgctcgtggacctgt

SEQ ID NO: 190558 - DNA, 25 bp, Rattus norvegicus
atgagtgaactggtcgtggacctgt

SEQ ID NO: 190559 - DNA, 25 bp, Rattus norvegicus
atgagtgaccccagctggaaccgac

SEQ ID NO: 190560 - DNA, 25 bp, Rattus norvegicus
atgagtgaccccatgacagacctgg

SEQ ID NO: 190561 - DNA, 25 bp, Rattus norvegicus
atgagtgacccctgctggaaccgac

SEQ ID NO: 190562 - DNA, 25 bp, Rattus norvegicus
atgagtgaccccttgacagacctgg

SEQ ID NO: 190563 - DNA, 25 bp, Rattus norvegicus
atgagtgactctctgctgatgggcc

SEQ ID NO: 190564 - DNA, 25 bp, Rattus norvegicus
atgagtgactctgtgctgatgggcc

SEQ ID NO: 190565 - DNA, 25 bp, Rattus norvegicus
atgagtgactgaatcctgcattgga

SEQ ID NO: 190566 - DNA, 25 bp, Rattus norvegicus
atgagtgactgattcctgcattgga

SEQ ID NO: 190567 - DNA, 25 bp, Rattus norvegicus
atgagtgactgtactgctactctgt

SEQ ID NO: 190568 - DNA, 25 bp, Rattus norvegicus
atgagtgactgttctgctactctgt

SEQ ID NO: 190569 - DNA, 25 bp, Rattus norvegicus
atgagtgagatcatggaaaccctga

SEQ ID NO: 190570 - DNA, 25 bp, Rattus norvegicus
atgagtgagatcttggaaaccctga

SEQ ID NO: 190571 - DNA, 25 bp, Rattus norvegicus
atgagtgaggcaaagaaaccctttc

SEQ ID NO: 190572 - DNA, 25 bp, Rattus norvegicus
atgagtgaggcatagaaaccctttc

SEQ ID NO: 190573 - DNA, 25 bp, Rattus norvegicus
atgagtgagtgcaccggctgccaca

SEQ ID NO: 190574 - DNA, 25 bp, Rattus norvegicus
atgagtgagtgctccggctgccaca

SEQ ID NO: 190575 - DNA, 25 bp, Rattus norvegicus
atgagtgattagattgagcccttgc

SEQ ID NO: 190576 - DNA, 25 bp, Rattus norvegicus
atgagtgattagtttgagcccttgc

SEQ ID NO: 190577 - DNA, 25 bp, Rattus norvegicus
atgagtgattctattcttcttgtat

SEQ ID NO: 190578 - DNA, 25 bp, Rattus norvegicus
atgagtgattcttttcttcttgtat

SEQ ID NO: 190579 - DNA, 25 bp, Rattus norvegicus
atgagtgcatgcacttcctcaggac

SEQ ID NO: 190580 - DNA, 25 bp, Rattus norvegicus
atgagtgcatgctcttcctcaggac

SEQ ID NO: 190581 - DNA, 25 bp, Rattus norvegicus
atgagtgcatttcaactatgtcaat

SEQ ID NO: 190582 - DNA, 25 bp, Rattus norvegicus
atgagtgcatttccttggtacaagc

SEQ ID NO: 190583 - DNA, 25 bp, Rattus norvegicus
atgagtgcatttgaactatgtcaat

SEQ ID NO: 190584 - DNA, 25 bp, Rattus norvegicus
atgagtgcatttgcttggtacaagc

SEQ ID NO: 190585 - DNA, 25 bp, Rattus norvegicus
atgagtgccactccggtgtttcgag

SEQ ID NO: 190586 - DNA, 25 bp, Rattus norvegicus
atgagtgccactgcggtgtttcgag

SEQ ID NO: 190587 - DNA, 25 bp, Rattus norvegicus
atgagtgcctgccattgtccagagc

SEQ ID NO: 190588 - DNA, 25 bp, Rattus norvegicus
atgagtgcctgcgattgtccagagc

SEQ ID NO: 190589 - DNA, 25 bp, Rattus norvegicus
atgagtgccttactactgtatttat

SEQ ID NO: 190590 - DNA, 25 bp, Rattus norvegicus
atgagtgccttagtactgtatttat

SEQ ID NO: 190591 - DNA, 25 bp, Rattus norvegicus
atgagtgctgcaactgttttccaag

SEQ ID NO: 190592 - DNA, 25 bp, Rattus norvegicus
atgagtgctgcatctgttttccaag

SEQ ID NO: 190593 - DNA, 25 bp, Rattus norvegicus
atgagtgctgtaccagttccagcct

SEQ ID NO: 190594 - DNA, 25 bp, Rattus norvegicus
atgagtgctgtagcagttccagcct

SEQ ID NO: 190595 - DNA, 25 bp, Rattus norvegicus
atgagtgctgtgcaattcgcttccc

SEQ ID NO: 190596 - DNA, 25 bp, Rattus norvegicus
atgagtgctgtggaattcgcttccc

SEQ ID NO: 190597 - DNA, 25 bp, Rattus norvegicus
atgagtggagcaagtccatccagca

SEQ ID NO: 190598 - DNA, 25 bp, Rattus norvegicus
atgagtggagcatgtccatccagca

SEQ ID NO: 190599 - DNA, 25 bp, Rattus norvegicus
atgagtggagtgctgtctaaatgaa

SEQ ID NO: 190600 - DNA, 25 bp, Rattus norvegicus
atgagtggagtggtgtctaaatgaa

SEQ ID NO: 190601 - DNA, 25 bp, Rattus norvegicus
atgagtggatcaacaggacctgccg

SEQ ID NO: 190602 - DNA, 25 bp, Rattus norvegicus
atgagtggatcatcaggacctgccg

SEQ ID NO: 190603 - DNA, 25 bp, Rattus norvegicus
atgagtggcccacagtaccatgttg

SEQ ID NO: 190604 - DNA, 25 bp, Rattus norvegicus
atgagtggcccagagtaccatgttg

SEQ ID NO: 190605 - DNA, 25 bp, Rattus norvegicus
atgagtgggatgcacagctacctcc

SEQ ID NO: 190606 - DNA, 25 bp, Rattus norvegicus
atgagtgggatggacagctacctcc

SEQ ID NO: 190607 - DNA, 25 bp, Rattus norvegicus
atgagtgggtttatgttcggattgt

SEQ ID NO: 190608 - DNA, 25 bp, Rattus norvegicus
atgagtgggtttcatattttcttga

SEQ ID NO: 190609 - DNA, 25 bp, Rattus norvegicus
atgagtgggtttgatattttcttga

SEQ ID NO: 190610 - DNA, 25 bp, Rattus norvegicus
atgagtgggtttttgttcggattgt

SEQ ID NO: 190611 - DNA, 25 bp, Rattus norvegicus
atgagtgtaatcctcagagctttcc

SEQ ID NO: 190612 - DNA, 25 bp, Rattus norvegicus
atgagtgtaatcgtcagagctttcc

SEQ ID NO: 190613 - DNA, 25 bp, Rattus norvegicus
atgagtgtcgttacatacacaggaa

SEQ ID NO: 190614 - DNA, 25 bp, Rattus norvegicus
atgagtgtcgtttcatacacaggaa

SEQ ID NO: 190615 - DNA, 25 bp, Rattus norvegicus
atgagtgtctctattctgagtcctc

SEQ ID NO: 190616 - DNA, 25 bp, Rattus norvegicus
atgagtgtctctccatgatatggta

SEQ ID NO: 190617 - DNA, 25 bp, Rattus norvegicus
atgagtgtctctgcatgatatggta

SEQ ID NO: 190618 - DNA, 25 bp, Rattus norvegicus
atgagtgtctcttttctgagtcctc

SEQ ID NO: 190619 - DNA, 25 bp, Rattus norvegicus
atgagtgtgattacggcatgggcct

SEQ ID NO: 190620 - DNA, 25 bp, Rattus norvegicus
atgagtgtgatttcggcatgggcct

SEQ ID NO: 190621 - DNA, 25 bp, Rattus norvegicus
atgagtgtgcttaccaatggctgtg

SEQ ID NO: 190622 - DNA, 25 bp, Rattus norvegicus
atgagtgtgctttccaatggctgtg

SEQ ID NO: 190623 - DNA, 25 bp, Rattus norvegicus
atgagtgtggacagttctcctcctc

SEQ ID NO: 190624 - DNA, 25 bp, Rattus norvegicus
atgagtgtggactgttctcctcctc

SEQ ID NO: 190625 - DNA, 25 bp, Rattus norvegicus
atgagtgttgagcaacatggcgcct

SEQ ID NO: 190626 - DNA, 25 bp, Rattus norvegicus
atgagtgttgaggaacatggcgcct

SEQ ID NO: 190627 - DNA, 25 bp, Rattus norvegicus
atgagtgttgctacatgcttccccg

SEQ ID NO: 190628 - DNA, 25 bp, Rattus norvegicus
atgagtgttgcttcatgcttccccg

SEQ ID NO: 190629 - DNA, 25 bp, Rattus norvegicus
atgagtgttttgaccaggcgttaca

SEQ ID NO: 190630 - DNA, 25 bp, Rattus norvegicus
atgagtgttttgtccaggcgttaca

SEQ ID NO: 190631 - DNA, 25 bp, Rattus norvegicus
atgagttacagcctactgcgatgta

SEQ ID NO: 190632 - DNA, 25 bp, Rattus norvegicus
atgagttacagcgtactgcgatgta

SEQ ID NO: 190633 - DNA, 25 bp, Rattus norvegicus
atgagttaccagaggaccaacctga

SEQ ID NO: 190634 - DNA, 25 bp, Rattus norvegicus
atgagttaccagtggaccaacctga

SEQ ID NO: 190635 - DNA, 25 bp, Rattus norvegicus
atgagttagccgcacattacccctt

SEQ ID NO: 190636 - DNA, 25 bp, Rattus norvegicus
atgagttagccggacattacccctt

SEQ ID NO: 190637 - DNA, 25 bp, Rattus norvegicus
atgagttaggtcaccaggacccaca

SEQ ID NO: 190638 - DNA, 25 bp, Rattus norvegicus
atgagttaggtctccaggacccaca

SEQ ID NO: 190639 - DNA, 25 bp, Rattus norvegicus
atgagttatgttatccccttccaag

SEQ ID NO: 190640 - DNA, 25 bp, Rattus norvegicus
atgagttatgttttccccttccaag

SEQ ID NO: 190641 - DNA, 25 bp, Rattus norvegicus
atgagttcaaatccaaccttggctt

SEQ ID NO: 190642 - DNA, 25 bp, Rattus norvegicus
atgagttcaaatgcaaccttggctt

SEQ ID NO: 190643 - DNA, 25 bp, Rattus norvegicus
atgagttcaataccatttcagagat

SEQ ID NO: 190644 - DNA, 25 bp, Rattus norvegicus
atgagttcaatagcatttcagagat

SEQ ID NO: 190645 - DNA, 25 bp, Rattus norvegicus
atgagttcagccagacccgagagaa

SEQ ID NO: 190646 - DNA, 25 bp, Rattus norvegicus
atgagttcagcctgacccgagagaa

SEQ ID NO: 190647 - DNA, 25 bp, Rattus norvegicus
atgagttcaggaactacggcaatgt

SEQ ID NO: 190648 - DNA, 25 bp, Rattus norvegicus
atgagttcaggatctacggcaatgt

SEQ ID NO: 190649 - DNA, 25 bp, Rattus norvegicus
atgagttcagtgcttcgtcgtgtaa

SEQ ID NO: 190650 - DNA, 25 bp, Rattus norvegicus
atgagttcagtggttcgtcgtgtaa

SEQ ID NO: 190651 - DNA, 25 bp, Rattus norvegicus
atgagttccaacatccatttggttt

SEQ ID NO: 190652 - DNA, 25 bp, Rattus norvegicus
atgagttccaacttccatttggttt

SEQ ID NO: 190653 - DNA, 25 bp, Rattus norvegicus
atgagttccgggatagcctaggcta

SEQ ID NO: 190654 - DNA, 25 bp, Rattus norvegicus
atgagttccgggttagcctaggcta

SEQ ID NO: 190655 - DNA, 25 bp, Rattus norvegicus
atgagttcctataagttgctccatt

SEQ ID NO: 190656 - DNA, 25 bp, Rattus norvegicus
atgagttcctattagttgctccatt

SEQ ID NO: 190657 - DNA, 25 bp, Rattus norvegicus
atgagttctacgagctacgggcagc

SEQ ID NO: 190658 - DNA, 25 bp, Rattus norvegicus
atgagttctacgtgctacgggcagc

SEQ ID NO: 190659 - DNA, 25 bp, Rattus norvegicus
atgagttctccgatatcccgaagat

SEQ ID NO: 190660 - DNA, 25 bp, Rattus norvegicus
atgagttctccgttatcccgaagat

SEQ ID NO: 190661 - DNA, 25 bp, Rattus norvegicus
atgagttcttatcgtcactttcccc

SEQ ID NO: 190662 - DNA, 25 bp, Rattus norvegicus
atgagttcttatggtcactttcccc

SEQ ID NO: 190663 - DNA, 25 bp, Rattus norvegicus
atgagttgagtcagttgtcctctta

SEQ ID NO: 190664 - DNA, 25 bp, Rattus norvegicus
atgagttgagtctgttgtcctctta

SEQ ID NO: 190665 - DNA, 25 bp, Rattus norvegicus
atgagttgccctacgatgactgtgt

SEQ ID NO: 190666 - DNA, 25 bp, Rattus norvegicus
atgagttgcccttcgatgactgtgt

SEQ ID NO: 190667 - DNA, 25 bp, Rattus norvegicus
atgagttgccgtacttgaggtgccc

SEQ ID NO: 190668 - DNA, 25 bp, Rattus norvegicus
atgagttgccgttcttgaggtgccc

SEQ ID NO: 190669 - DNA, 25 bp, Rattus norvegicus
atgagttggtttcaagcctgccctt

SEQ ID NO: 190670 - DNA, 25 bp, Rattus norvegicus
atgagttggtttgaagcctgccctt

SEQ ID NO: 190671 - DNA, 25 bp, Rattus norvegicus
atgagttgtcctataagcgtggtga

SEQ ID NO: 190672 - DNA, 25 bp, Rattus norvegicus
atgagttgtcctttaagcgtggtga

SEQ ID NO: 190673 - DNA, 25 bp, Rattus norvegicus
atgagttgtggcctcagttggctac

SEQ ID NO: 190674 - DNA, 25 bp, Rattus norvegicus
atgagttgtggcgtcagttggctac

SEQ ID NO: 190675 - DNA, 25 bp, Rattus norvegicus
atgagttgttctccttctttcttat

SEQ ID NO: 190676 - DNA, 25 bp, Rattus norvegicus
atgagttgttctgcttctttcttat

SEQ ID NO: 190677 - DNA, 25 bp, Rattus norvegicus
atgagtttacccctcaatcccaagc

SEQ ID NO: 190678 - DNA, 25 bp, Rattus norvegicus
atgagtttacccgtcaatcccaagc

SEQ ID NO: 190679 - DNA, 25 bp, Rattus norvegicus
atgagtttcagtatcttctgcccag

SEQ ID NO: 190680 - DNA, 25 bp, Rattus norvegicus
atgagtttcagtttcttctgcccag

SEQ ID NO: 190681 - DNA, 25 bp, Rattus norvegicus
atgagtttccccatctgggttgata

SEQ ID NO: 190682 - DNA, 25 bp, Rattus norvegicus
atgagtttccccttctgggttgata

SEQ ID NO: 190683 - DNA, 25 bp, Rattus norvegicus
atgagtttccctcatctaggtcagg

SEQ ID NO: 190684 - DNA, 25 bp, Rattus norvegicus
atgagtttccctgatctaggtcagg

SEQ ID NO: 190685 - DNA, 25 bp, Rattus norvegicus
atgagtttctgaacaggccctctgg

SEQ ID NO: 190686 - DNA, 25 bp, Rattus norvegicus
atgagtttctgatcaggccctctgg

SEQ ID NO: 190687 - DNA, 25 bp, Rattus norvegicus
atgagtttcttcaatcgatacaaaa

SEQ ID NO: 190688 - DNA, 25 bp, Rattus norvegicus
atgagtttcttctatcgatacaaaa

SEQ ID NO: 190689 - DNA, 25 bp, Rattus norvegicus
atgagtttgagtccctggtacgcca

SEQ ID NO: 190690 - DNA, 25 bp, Rattus norvegicus
atgagtttgagtgcctggtacgcca

SEQ ID NO: 190691 - DNA, 25 bp, Rattus norvegicus
atgagtttgctcagtcaatggacaa

SEQ ID NO: 190692 - DNA, 25 bp, Rattus norvegicus
atgagtttgctctgtcaatggacaa

SEQ ID NO: 190693 - DNA, 25 bp, Rattus norvegicus
atgagtttgcttactctgccaatta

SEQ ID NO: 190694 - DNA, 25 bp, Rattus norvegicus
atgagtttgctttctctgccaatta

SEQ ID NO: 190695 - DNA, 25 bp, Rattus norvegicus
atgagtttggtgactgagcatggaa

SEQ ID NO: 190696 - DNA, 25 bp, Rattus norvegicus
atgagtttggtgtctgagcatggaa

SEQ ID NO: 190697 - DNA, 25 bp, Rattus norvegicus
atgagttttatcatccgctctgggt

SEQ ID NO: 190698 - DNA, 25 bp, Rattus norvegicus
atgagttttatcttccgctctgggt

SEQ ID NO: 190699 - DNA, 25 bp, Rattus norvegicus
atgagttttattctgcatgcatgat

SEQ ID NO: 190700 - DNA, 25 bp, Rattus norvegicus
atgagttttattgtgcatgcatgat

SEQ ID NO: 190701 - DNA, 25 bp, Rattus norvegicus
atgagttttcccagtcattcaggag

SEQ ID NO: 190702 - DNA, 25 bp, Rattus norvegicus
atgagttttccctgtcattcaggag

SEQ ID NO: 190703 - DNA, 25 bp, Rattus norvegicus
atgagttttctgatgtttagacatt

SEQ ID NO: 190704 - DNA, 25 bp, Rattus norvegicus
atgagttttctgttgtttagacatt

SEQ ID NO: 190705 - DNA, 25 bp, Rattus norvegicus
atgagtttttccctgggacaacata

SEQ ID NO: 190706 - DNA, 25 bp, Rattus norvegicus
atgagtttttccgtgggacaacata

SEQ ID NO: 190707 - DNA, 25 bp, Rattus norvegicus
atgagtttttctattgttcctttga

SEQ ID NO: 190708 - DNA, 25 bp, Rattus norvegicus
atgagtttttcttttgttcctttga

SEQ ID NO: 190709 - DNA, 25 bp, Rattus norvegicus
atgataaagttcacaccagcccttc

SEQ ID NO: 190710 - DNA, 25 bp, Rattus norvegicus
atgataaagttctcaccagcccttc

SEQ ID NO: 190711 - DNA, 25 bp, Rattus norvegicus
atgataacaaagaaccaggcctacg

SEQ ID NO: 190712 - DNA, 25 bp, Rattus norvegicus
atgataacaaagtaccaggcctacg

SEQ ID NO: 190713 - DNA, 25 bp, Rattus norvegicus
atgataacaatgcatcgtaaaacct

SEQ ID NO: 190714 - DNA, 25 bp, Rattus norvegicus
atgataacaatggatcgtaaaacct

SEQ ID NO: 190715 - DNA, 25 bp, Rattus norvegicus
atgataacacccacgggaatggctt

SEQ ID NO: 190716 - DNA, 25 bp, Rattus norvegicus
atgataacaccctcgggaatggctt

SEQ ID NO: 190717 - DNA, 25 bp, Rattus norvegicus
atgataactacgagccgcgcagtgg

SEQ ID NO: 190718 - DNA, 25 bp, Rattus norvegicus
atgataactacgtgccgcgcagtgg

SEQ ID NO: 190719 - DNA, 25 bp, Rattus norvegicus
atgataactggtctgtgcacctcgt

SEQ ID NO: 190720 - DNA, 25 bp, Rattus norvegicus
atgataactggtgtgtgcacctcgt

SEQ ID NO: 190721 - DNA, 25 bp, Rattus norvegicus
atgataactgtgaggttgcccggta

SEQ ID NO: 190722 - DNA, 25 bp, Rattus norvegicus
atgataactgtgtggttgcccggta

SEQ ID NO: 190723 - DNA, 25 bp, Rattus norvegicus
atgataaggatcacgcccacagcag

SEQ ID NO: 190724 - DNA, 25 bp, Rattus norvegicus
atgataaggatctcgcccacagcag

SEQ ID NO: 190725 - DNA, 25 bp, Rattus norvegicus
atgataaggcggagtttccgtccga

SEQ ID NO: 190726 - DNA, 25 bp, Rattus norvegicus
atgataaggcggtgtttccgtccga

SEQ ID NO: 190727 - DNA, 25 bp, Rattus norvegicus
atgataagtccgagggtggctcttt

SEQ ID NO: 190728 - DNA, 25 bp, Rattus norvegicus
atgataagtccgtgggtggctcttt

SEQ ID NO: 190729 - DNA, 25 bp, Rattus norvegicus
atgataatcccgcttgaccttcaag

SEQ ID NO: 190730 - DNA, 25 bp, Rattus norvegicus
atgataatcccggttgaccttcaag

SEQ ID NO: 190731 - DNA, 25 bp, Rattus norvegicus
atgataatccctccagtcttcgaat

SEQ ID NO: 190732 - DNA, 25 bp, Rattus norvegicus
atgataatccctgcagtcttcgaat

SEQ ID NO: 190733 - DNA, 25 bp, Rattus norvegicus
atgataatggacatgttagccctac

SEQ ID NO: 190734 - DNA, 25 bp, Rattus norvegicus
atgataatggacttgttagccctac

SEQ ID NO: 190735 - DNA, 25 bp, Rattus norvegicus
atgataatggtgaatgactgcttta

SEQ ID NO: 190736 - DNA, 25 bp, Rattus norvegicus
atgataatggtgtatgactgcttta

SEQ ID NO: 190737 - DNA, 25 bp, Rattus norvegicus
atgataattttcctctggtgcatcc

SEQ ID NO: 190738 - DNA, 25 bp, Rattus norvegicus
atgataattttcgtctggtgcatcc

SEQ ID NO: 190739 - DNA, 25 bp, Rattus norvegicus
atgatacaaggaacagggagccaga

SEQ ID NO: 190740 - DNA, 25 bp, Rattus norvegicus
atgatacaaggatcagggagccaga

SEQ ID NO: 190741 - DNA, 25 bp, Rattus norvegicus
atgatacacatccatgcatgcaggg

SEQ ID NO: 190742 - DNA, 25 bp, Rattus norvegicus
atgatacacatcgatgcatgcaggg

SEQ ID NO: 190743 - DNA, 25 bp, Rattus norvegicus
atgatacagccacggactccaatgc

SEQ ID NO: 190744 - DNA, 25 bp, Rattus norvegicus
atgatacagccagggactccaatgc

SEQ ID NO: 190745 - DNA, 25 bp, Rattus norvegicus
atgatacaggctatgttcagacttc

SEQ ID NO: 190746 - DNA, 25 bp, Rattus norvegicus
atgatacaggctttgttcagacttc

SEQ ID NO: 190747 - DNA, 25 bp, Rattus norvegicus
atgatacatccacaaacataagttg

SEQ ID NO: 190748 - DNA, 25 bp, Rattus norvegicus
atgatacatccagaaacataagttg

SEQ ID NO: 190749 - DNA, 25 bp, Rattus norvegicus
atgatacatccccaggttgctattg

SEQ ID NO: 190750 - DNA, 25 bp, Rattus norvegicus
atgatacatcccgaggttgctattg

SEQ ID NO: 190751 - DNA, 25 bp, Rattus norvegicus
atgatacccagccagagtcagcagt

SEQ ID NO: 190752 - DNA, 25 bp, Rattus norvegicus
atgatacccagcgagagtcagcagt

SEQ ID NO: 190753 - DNA, 25 bp, Rattus norvegicus
atgataccccgtattcccagggtag

SEQ ID NO: 190754 - DNA, 25 bp, Rattus norvegicus
atgataccccgttttcccagggtag

SEQ ID NO: 190755 - DNA, 25 bp, Rattus norvegicus
atgataccttgcaagtcacagctaa

SEQ ID NO: 190756 - DNA, 25 bp, Rattus norvegicus
atgataccttgctagtcacagctaa

SEQ ID NO: 190757 - DNA, 25 bp, Rattus norvegicus
atgatactacatatcctgtctccaa

SEQ ID NO: 190758 - DNA, 25 bp, Rattus norvegicus
atgatactacatttcctgtctccaa

SEQ ID NO: 190759 - DNA, 25 bp, Rattus norvegicus
atgatactaggaaatacacttttgt

SEQ ID NO: 190760 - DNA, 25 bp, Rattus norvegicus
atgatactaggatatacacttttgt

SEQ ID NO: 190761 - DNA, 25 bp, Rattus norvegicus
atgatactctgccttagtctcaaac

SEQ ID NO: 190762 - DNA, 25 bp, Rattus norvegicus
atgatactctgcgttagtctcaaac

SEQ ID NO: 190763 - DNA, 25 bp, Rattus norvegicus
atgatactgattatactacaaggag

SEQ ID NO: 190764 - DNA, 25 bp, Rattus norvegicus
atgatactgattttactacaaggag

SEQ ID NO: 190765 - DNA, 25 bp, Rattus norvegicus
atgatactggacacatctcctctgt

SEQ ID NO: 190766 - DNA, 25 bp, Rattus norvegicus
atgatactggactcatctcctctgt

SEQ ID NO: 190767 - DNA, 25 bp, Rattus norvegicus
atgatactttctatgttaggctaac

SEQ ID NO: 190768 - DNA, 25 bp, Rattus norvegicus
atgatactttctttgttaggctaac

SEQ ID NO: 190769 - DNA, 25 bp, Rattus norvegicus
atgatagatctcagccttcagtctg

SEQ ID NO: 190770 - DNA, 25 bp, Rattus norvegicus
atgatagatctctgccttcagtctg

SEQ ID NO: 190771 - DNA, 25 bp, Rattus norvegicus
atgatagcatacaccatcccggtag

SEQ ID NO: 190772 - DNA, 25 bp, Rattus norvegicus
atgatagcatactccatcccggtag

SEQ ID NO: 190773 - DNA, 25 bp, Rattus norvegicus
atgatagccctcaccatgtgcctag

SEQ ID NO: 190774 - DNA, 25 bp, Rattus norvegicus
atgatagccctccaatgatttcacg

SEQ ID NO: 190775 - DNA, 25 bp, Rattus norvegicus
atgatagccctcgaatgatttcacg

SEQ ID NO: 190776 - DNA, 25 bp, Rattus norvegicus
atgatagccctctccatgtgcctag

SEQ ID NO: 190777 - DNA, 25 bp, Rattus norvegicus
atgatagcctagactcccagagctc

SEQ ID NO: 190778 - DNA, 25 bp, Rattus norvegicus
atgatagcctagtctcccagagctc

SEQ ID NO: 190779 - DNA, 25 bp, Rattus norvegicus
atgatagcgagtcagctcccatgag

SEQ ID NO: 190780 - DNA, 25 bp, Rattus norvegicus
atgatagcgagtgagctcccatgag

SEQ ID NO: 190781 - DNA, 25 bp, Rattus norvegicus
atgatagctgttatccttccaactg

SEQ ID NO: 190782 - DNA, 25 bp, Rattus norvegicus
atgatagctgttttccttccaactg

SEQ ID NO: 190783 - DNA, 25 bp, Rattus norvegicus
atgataggtttgatgccacgagata

SEQ ID NO: 190784 - DNA, 25 bp, Rattus norvegicus
atgataggtttgttgccacgagata

SEQ ID NO: 190785 - DNA, 25 bp, Rattus norvegicus
atgatatatccaatccttgcacagg

SEQ ID NO: 190786 - DNA, 25 bp, Rattus norvegicus
atgatatatccattccttgcacagg

SEQ ID NO: 190787 - DNA, 25 bp, Rattus norvegicus
atgatatcaaacacagcgacctggc

SEQ ID NO: 190788 - DNA, 25 bp, Rattus norvegicus
atgatatcaaactcagcgacctggc

SEQ ID NO: 190789 - DNA, 25 bp, Rattus norvegicus
atgatatcagcccacgcttggcact

SEQ ID NO: 190790 - DNA, 25 bp, Rattus norvegicus
atgatatcagccgacgcttggcact

SEQ ID NO: 190791 - DNA, 25 bp, Rattus norvegicus
atgatatcctgccaaaccagttagt

SEQ ID NO: 190792 - DNA, 25 bp, Rattus norvegicus
atgatatcctgcgaaaccagttagt

SEQ ID NO: 190793 - DNA, 25 bp, Rattus norvegicus
atgatatcttctacataatggacac

SEQ ID NO: 190794 - DNA, 25 bp, Rattus norvegicus
atgatatcttcttcataatggacac

SEQ ID NO: 190795 - DNA, 25 bp, Rattus norvegicus
atgatatgaggccttgcttctgcat

SEQ ID NO: 190796 - DNA, 25 bp, Rattus norvegicus
atgatatgaggcgttgcttctgcat

SEQ ID NO: 190797 - DNA, 25 bp, Rattus norvegicus
atgatatgtgttcgctttactaccc

SEQ ID NO: 190798 - DNA, 25 bp, Rattus norvegicus
atgatatgtgttggctttactaccc

SEQ ID NO: 190799 - DNA, 25 bp, Rattus norvegicus
atgatatgttcactgagccctctcc

SEQ ID NO: 190800 - DNA, 25 bp, Rattus norvegicus
atgatatgttcagtgagccctctcc

SEQ ID NO: 190801 - DNA, 25 bp, Rattus norvegicus
atgatattgggcaactctgaaagtt

SEQ ID NO: 190802 - DNA, 25 bp, Rattus norvegicus
atgatattgggctactctgaaagtt

SEQ ID NO: 190803 - DNA, 25 bp, Rattus norvegicus
atgatatttccacctgtggtgtctc

SEQ ID NO: 190804 - DNA, 25 bp, Rattus norvegicus
atgatatttccagctgtggtgtctc

SEQ ID NO: 190805 - DNA, 25 bp, Rattus norvegicus
atgatatttggcagctgtcctccag

SEQ ID NO: 190806 - DNA, 25 bp, Rattus norvegicus
atgatatttggctgctgtcctccag

SEQ ID NO: 190807 - DNA, 25 bp, Rattus norvegicus
atgatattttttcaaggtccccata

SEQ ID NO: 190808 - DNA, 25 bp, Rattus norvegicus
atgatattttttgaaggtccccata

SEQ ID NO: 190809 - DNA, 25 bp, Rattus norvegicus
atgatcaacaatactctcaggagta

SEQ ID NO: 190810 - DNA, 25 bp, Rattus norvegicus
atgatcaacaattctctcaggagta

SEQ ID NO: 190811 - DNA, 25 bp, Rattus norvegicus
atgatcaacagcatggcagtacttg

SEQ ID NO: 190812 - DNA, 25 bp, Rattus norvegicus
atgatcaacagcttggcagtacttg

SEQ ID NO: 190813 - DNA, 25 bp, Rattus norvegicus
atgatcaacagtcgtcttcacctgt

SEQ ID NO: 190814 - DNA, 25 bp, Rattus norvegicus
atgatcaacagtggtcttcacctgt

SEQ ID NO: 190815 - DNA, 25 bp, Rattus norvegicus
atgatcaacgagctggatgccgacg

SEQ ID NO: 190816 - DNA, 25 bp, Rattus norvegicus
atgatcaacgaggtggatgccgacg

SEQ ID NO: 190817 - DNA, 25 bp, Rattus norvegicus
atgatcacagatagtcccaacctta

SEQ ID NO: 190818 - DNA, 25 bp, Rattus norvegicus
atgatcacagattgtcccaacctta

SEQ ID NO: 190819 - DNA, 25 bp, Rattus norvegicus
atgatcaccagcaggtggcgccatg

SEQ ID NO: 190820 - DNA, 25 bp, Rattus norvegicus
atgatcaccagctggtggcgccatg

SEQ ID NO: 190821 - DNA, 25 bp, Rattus norvegicus
atgatcactctcatagaccatgcta

SEQ ID NO: 190822 - DNA, 25 bp, Rattus norvegicus
atgatcactctcttagaccatgcta

SEQ ID NO: 190823 - DNA, 25 bp, Rattus norvegicus
atgatcacttcaaaataccactccc

SEQ ID NO: 190824 - DNA, 25 bp, Rattus norvegicus
atgatcacttcataataccactccc

SEQ ID NO: 190825 - DNA, 25 bp, Rattus norvegicus
atgatcagcatgaacctccccggcg

SEQ ID NO: 190826 - DNA, 25 bp, Rattus norvegicus
atgatcagcatgtacctccccggcg

SEQ ID NO: 190827 - DNA, 25 bp, Rattus norvegicus
atgatcagccagatagggaacttct

SEQ ID NO: 190828 - DNA, 25 bp, Rattus norvegicus
atgatcagccagttagggaacttct

SEQ ID NO: 190829 - DNA, 25 bp, Rattus norvegicus
atgatcagtgcacacatggcccatg

SEQ ID NO: 190830 - DNA, 25 bp, Rattus norvegicus
atgatcagtgcagacatggcccatg

SEQ ID NO: 190831 - DNA, 25 bp, Rattus norvegicus
atgatcatcaagcttatcaccgcca

SEQ ID NO: 190832 - DNA, 25 bp, Rattus norvegicus
atgatcatcaaggttatcaccgcca

SEQ ID NO: 190833 - DNA, 25 bp, Rattus norvegicus
atgatcattgtcatccgtgttttaa

SEQ ID NO: 190834 - DNA, 25 bp, Rattus norvegicus
atgatcattgtcttccgtgttttaa

SEQ ID NO: 190835 - DNA, 25 bp, Rattus norvegicus
atgatcatttctctacttctaccta

SEQ ID NO: 190836 - DNA, 25 bp, Rattus norvegicus
atgatcatttctgtacttctaccta

SEQ ID NO: 190837 - DNA, 25 bp, Rattus norvegicus
atgatccaatacagcgcttccgaga

SEQ ID NO: 190838 - DNA, 25 bp, Rattus norvegicus
atgatccaatactgcgcttccgaga

SEQ ID NO: 190839 - DNA, 25 bp, Rattus norvegicus
atgatccacagcataactgcaggcc

SEQ ID NO: 190840 - DNA, 25 bp, Rattus norvegicus
atgatccacagcttaactgcaggcc

SEQ ID NO: 190841 - DNA, 25 bp, Rattus norvegicus
atgatccaccgtaccaggaagcaga

SEQ ID NO: 190842 - DNA, 25 bp, Rattus norvegicus
atgatccaccgttccaggaagcaga

SEQ ID NO: 190843 - DNA, 25 bp, Rattus norvegicus
atgatccagaaacttcacagagcac

SEQ ID NO: 190844 - DNA, 25 bp, Rattus norvegicus
atgatccagaaagttcacagagcac

SEQ ID NO: 190845 - DNA, 25 bp, Rattus norvegicus
atgatccagggcactctgtctcacc

SEQ ID NO: 190846 - DNA, 25 bp, Rattus norvegicus
atgatccagggctctctgtctcacc

SEQ ID NO: 190847 - DNA, 25 bp, Rattus norvegicus
atgatccatgtgagctatttccctc

SEQ ID NO: 190848 - DNA, 25 bp, Rattus norvegicus
atgatccatgtgtgctatttccctc

SEQ ID NO: 190849 - DNA, 25 bp, Rattus norvegicus
atgatccccatgaatgtcatccagc

SEQ ID NO: 190850 - DNA, 25 bp, Rattus norvegicus
atgatccccatgtatgtcatccagc

SEQ ID NO: 190851 - DNA, 25 bp, Rattus norvegicus
atgatccccggtagatacccctgaa

SEQ ID NO: 190852 - DNA, 25 bp, Rattus norvegicus
atgatccccggttgatacccctgaa

SEQ ID NO: 190853 - DNA, 25 bp, Rattus norvegicus
atgatcccctacactcatggtgatg

SEQ ID NO: 190854 - DNA, 25 bp, Rattus norvegicus
atgatcccctactctcatggtgatg

SEQ ID NO: 190855 - DNA, 25 bp, Rattus norvegicus
atgatccctcagactgcggtagaca

SEQ ID NO: 190856 - DNA, 25 bp, Rattus norvegicus
atgatccctcagtctgcggtagaca

SEQ ID NO: 190857 - DNA, 25 bp, Rattus norvegicus
atgatccctgaactgatgtcctctc

SEQ ID NO: 190858 - DNA, 25 bp, Rattus norvegicus
atgatccctgaagtgatgtcctctc

SEQ ID NO: 190859 - DNA, 25 bp, Rattus norvegicus
atgatccgaataactacctgttttg

SEQ ID NO: 190860 - DNA, 25 bp, Rattus norvegicus
atgatccgaatatctacctgttttg

SEQ ID NO: 190861 - DNA, 25 bp, Rattus norvegicus
atgatcctagccatacactgagtac

SEQ ID NO: 190862 - DNA, 25 bp, Rattus norvegicus
atgatcctagccttacactgagtac

SEQ ID NO: 190863 - DNA, 25 bp, Rattus norvegicus
atgatcctatccactatttgtgcta

SEQ ID NO: 190864 - DNA, 25 bp, Rattus norvegicus
atgatcctatcctctatttgtgcta

SEQ ID NO: 190865 - DNA, 25 bp, Rattus norvegicus
atgatcctatggctctaaccctcag

SEQ ID NO: 190866 - DNA, 25 bp, Rattus norvegicus
atgatcctatgggtctaaccctcag

SEQ ID NO: 190867 - DNA, 25 bp, Rattus norvegicus
atgatcctattacctccagggcagc

SEQ ID NO: 190868 - DNA, 25 bp, Rattus norvegicus
atgatcctattagctccagggcagc

SEQ ID NO: 190869 - DNA, 25 bp, Rattus norvegicus
atgatcctcctcactattcaaagta

SEQ ID NO: 190870 - DNA, 25 bp, Rattus norvegicus
atgatcctcctctctattcaaagta

SEQ ID NO: 190871 - DNA, 25 bp, Rattus norvegicus
atgatcctgaatcttgcctgtgctg

SEQ ID NO: 190872 - DNA, 25 bp, Rattus norvegicus
atgatcctgaatgttgcctgtgctg

SEQ ID NO: 190873 - DNA, 25 bp, Rattus norvegicus
atgatcctgttaaccgcggcaagaa

SEQ ID NO: 190874 - DNA, 25 bp, Rattus norvegicus
atgatcctgttaatgcgcttctgag

SEQ ID NO: 190875 - DNA, 25 bp, Rattus norvegicus
atgatcctgttatccgcggcaagaa

SEQ ID NO: 190876 - DNA, 25 bp, Rattus norvegicus
atgatcctgttattgcgcttctgag

SEQ ID NO: 190877 - DNA, 25 bp, Rattus norvegicus
atgatccttacaactctcccaagta

SEQ ID NO: 190878 - DNA, 25 bp, Rattus norvegicus
atgatccttacatctctcccaagta

SEQ ID NO: 190879 - DNA, 25 bp, Rattus norvegicus
atgatccttatgactgcatccgact

SEQ ID NO: 190880 - DNA, 25 bp, Rattus norvegicus
atgatccttatgtctgcatccgact

SEQ ID NO: 190881 - DNA, 25 bp, Rattus norvegicus
atgatccttctgagggccccaagat

SEQ ID NO: 190882 - DNA, 25 bp, Rattus norvegicus
atgatccttctgtgggccccaagat

SEQ ID NO: 190883 - DNA, 25 bp, Rattus norvegicus
atgatccttgtgaagtcgtcttgta

SEQ ID NO: 190884 - DNA, 25 bp, Rattus norvegicus
atgatccttgtgtagtcgtcttgta

SEQ ID NO: 190885 - DNA, 25 bp, Rattus norvegicus
atgatcctttccagtcagcaggacg

SEQ ID NO: 190886 - DNA, 25 bp, Rattus norvegicus
atgatcctttcctgtcagcaggacg

SEQ ID NO: 190887 - DNA, 25 bp, Rattus norvegicus
atgatcctttgcagtttggtctcaa

SEQ ID NO: 190888 - DNA, 25 bp, Rattus norvegicus
atgatcctttgctgtttggtctcaa

SEQ ID NO: 190889 - DNA, 25 bp, Rattus norvegicus
atgatcgagagaatcccctgtggtc

SEQ ID NO: 190890 - DNA, 25 bp, Rattus norvegicus
atgatcgagagattcccctgtggtc

SEQ ID NO: 190891 - DNA, 25 bp, Rattus norvegicus
atgatcgaggctcatgtccttcttc

SEQ ID NO: 190892 - DNA, 25 bp, Rattus norvegicus
atgatcgaggctgatgtccttcttc

SEQ ID NO: 190893 - DNA, 25 bp, Rattus norvegicus
atgatcgcgaggcacagcagcaact

SEQ ID NO: 190894 - DNA, 25 bp, Rattus norvegicus
atgatcgcgagggacagcagcaact

SEQ ID NO: 190895 - DNA, 25 bp, Rattus norvegicus
atgatcggactgatcaggacctgtc

SEQ ID NO: 190896 - DNA, 25 bp, Rattus norvegicus
atgatcggactgttcaggacctgtc

SEQ ID NO: 190897 - DNA, 25 bp, Rattus norvegicus
atgatcggaggcacccaaaaggcgg

SEQ ID NO: 190898 - DNA, 25 bp, Rattus norvegicus
atgatcggaggctcccaaaaggcgg

SEQ ID NO: 190899 - DNA, 25 bp, Rattus norvegicus
atgatcgtactgatcggctcttgag

SEQ ID NO: 190900 - DNA, 25 bp, Rattus norvegicus
atgatcgtactgttcggctcttgag

SEQ ID NO: 190901 - DNA, 25 bp, Rattus norvegicus
atgatcgtctggatacacttcttac

SEQ ID NO: 190902 - DNA, 25 bp, Rattus norvegicus
atgatcgtctggttacacttcttac

SEQ ID NO: 190903 - DNA, 25 bp, Rattus norvegicus
atgatcgtgctgagcgagagcctgc

SEQ ID NO: 190904 - DNA, 25 bp, Rattus norvegicus
atgatcgtgctgtgcgagagcctgc

SEQ ID NO: 190905 - DNA, 25 bp, Rattus norvegicus
atgatcgttaagagaccccaggttc

SEQ ID NO: 190906 - DNA, 25 bp, Rattus norvegicus
atgatcgttaagtgaccccaggttc

SEQ ID NO: 190907 - DNA, 25 bp, Rattus norvegicus
atgatctaatccatctccaatgcgg

SEQ ID NO: 190908 - DNA, 25 bp, Rattus norvegicus
atgatctaatccttctccaatgcgg

SEQ ID NO: 190909 - DNA, 25 bp, Rattus norvegicus
atgatctcactccaacttgaactct

SEQ ID NO: 190910 - DNA, 25 bp, Rattus norvegicus
atgatctcactcgaacttgaactct

SEQ ID NO: 190911 - DNA, 25 bp, Rattus norvegicus
atgatctcagctcccgtacggtgga

SEQ ID NO: 190912 - DNA, 25 bp, Rattus norvegicus
atgatctcagctgccgtacggtgga

SEQ ID NO: 190913 - DNA, 25 bp, Rattus norvegicus
atgatctccaggaccaggaggcgga

SEQ ID NO: 190914 - DNA, 25 bp, Rattus norvegicus
atgatctccaggtccaggaggcgga

SEQ ID NO: 190915 - DNA, 25 bp, Rattus norvegicus
atgatctccatgacccttttaatta

SEQ ID NO: 190916 - DNA, 25 bp, Rattus norvegicus
atgatctccatgtcccttttaatta

SEQ ID NO: 190917 - DNA, 25 bp, Rattus norvegicus
atgatctccgagctcttaaacacga

SEQ ID NO: 190918 - DNA, 25 bp, Rattus norvegicus
atgatctccgaggtcttaaacacga

SEQ ID NO: 190919 - DNA, 25 bp, Rattus norvegicus
atgatctcctgacgtggcagtgcca

SEQ ID NO: 190920 - DNA, 25 bp, Rattus norvegicus
atgatctcctgaggtggcagtgcca

SEQ ID NO: 190921 - DNA, 25 bp, Rattus norvegicus
atgatctcctgcaatctgagccaat

SEQ ID NO: 190922 - DNA, 25 bp, Rattus norvegicus
atgatctcctgctatctgagccaat

SEQ ID NO: 190923 - DNA, 25 bp, Rattus norvegicus
atgatctctagcacccctggagact

SEQ ID NO: 190924 - DNA, 25 bp, Rattus norvegicus
atgatctctagctcccctggagact

SEQ ID NO: 190925 - DNA, 25 bp, Rattus norvegicus
atgatctctgctactgaggcaaccg

SEQ ID NO: 190926 - DNA, 25 bp, Rattus norvegicus
atgatctctgcttctgaggcaaccg

SEQ ID NO: 190927 - DNA, 25 bp, Rattus norvegicus
atgatctctttcaataatggctaat

SEQ ID NO: 190928 - DNA, 25 bp, Rattus norvegicus
atgatctctttctataatggctaat

SEQ ID NO: 190929 - DNA, 25 bp, Rattus norvegicus
atgatctgaaataccagttccagga

SEQ ID NO: 190930 - DNA, 25 bp, Rattus norvegicus
atgatctgaaattccagttccagga

SEQ ID NO: 190931 - DNA, 25 bp, Rattus norvegicus
atgatctgaacgagcgctgcgagtc

SEQ ID NO: 190932 - DNA, 25 bp, Rattus norvegicus
atgatctgaacgtgcgctgcgagtc

SEQ ID NO: 190933 - DNA, 25 bp, Rattus norvegicus
atgatctgccaaatttggtgcccac

SEQ ID NO: 190934 - DNA, 25 bp, Rattus norvegicus
atgatctgccaattttggtgcccac

SEQ ID NO: 190935 - DNA, 25 bp, Rattus norvegicus
atgatctgccgcaagtgctacgcac

SEQ ID NO: 190936 - DNA, 25 bp, Rattus norvegicus
atgatctgccgctagtgctacgcac

SEQ ID NO: 190937 - DNA, 25 bp, Rattus norvegicus
atgatctgtaggagctggtgaccct

SEQ ID NO: 190938 - DNA, 25 bp, Rattus norvegicus
atgatctgtaggtgctggtgaccct

SEQ ID NO: 190939 - DNA, 25 bp, Rattus norvegicus
atgatctgtcacattgtataaaaac

SEQ ID NO: 190940 - DNA, 25 bp, Rattus norvegicus
atgatctgtcactttgtataaaaac

SEQ ID NO: 190941 - DNA, 25 bp, Rattus norvegicus
atgatctgtgatacgctccaattat

SEQ ID NO: 190942 - DNA, 25 bp, Rattus norvegicus
atgatctgtgattcgctccaattat

SEQ ID NO: 190943 - DNA, 25 bp, Rattus norvegicus
atgatcttaaatagaccctcctgtc

SEQ ID NO: 190944 - DNA, 25 bp, Rattus norvegicus
atgatcttaaattgaccctcctgtc

SEQ ID NO: 190945 - DNA, 25 bp, Rattus norvegicus
atgatcttacacatgtgtgcctcaa

SEQ ID NO: 190946 - DNA, 25 bp, Rattus norvegicus
atgatcttacacttgtgtgcctcaa

SEQ ID NO: 190947 - DNA, 25 bp, Rattus norvegicus
atgatcttacttctgcatactgagt

SEQ ID NO: 190948 - DNA, 25 bp, Rattus norvegicus
atgatcttacttgtgcatactgagt

SEQ ID NO: 190949 - DNA, 25 bp, Rattus norvegicus
atgatcttccctctcctcaactgaa

SEQ ID NO: 190950 - DNA, 25 bp, Rattus norvegicus
atgatcttccctgtcctcaactgaa

SEQ ID NO: 190951 - DNA, 25 bp, Rattus norvegicus
atgatcttcctcatagcctgatctc

SEQ ID NO: 190952 - DNA, 25 bp, Rattus norvegicus
atgatcttcctcttagcctgatctc

SEQ ID NO: 190953 - DNA, 25 bp, Rattus norvegicus
atgatcttccttaagcactactgaa

SEQ ID NO: 190954 - DNA, 25 bp, Rattus norvegicus
atgatcttcctttagcactactgaa

SEQ ID NO: 190955 - DNA, 25 bp, Rattus norvegicus
atgatcttcgcactggtccttgtct

SEQ ID NO: 190956 - DNA, 25 bp, Rattus norvegicus
atgatcttcgcagtggtccttgtct

SEQ ID NO: 190957 - DNA, 25 bp, Rattus norvegicus
atgatcttgacaaagctccttacca

SEQ ID NO: 190958 - DNA, 25 bp, Rattus norvegicus
atgatcttgacatagctccttacca

SEQ ID NO: 190959 - DNA, 25 bp, Rattus norvegicus
atgatctttctcacggtcctttaaa

SEQ ID NO: 190960 - DNA, 25 bp, Rattus norvegicus
atgatctttctctcggtcctttaaa

SEQ ID NO: 190961 - DNA, 25 bp, Rattus norvegicus
atgatctttgtgctgtgcatttccc

SEQ ID NO: 190962 - DNA, 25 bp, Rattus norvegicus
atgatctttgtggtgtgcatttccc

SEQ ID NO: 190963 - DNA, 25 bp, Rattus norvegicus
atgatctttgttaactgggtaccac

SEQ ID NO: 190964 - DNA, 25 bp, Rattus norvegicus
atgatctttgtttactgggtaccac

SEQ ID NO: 190965 - DNA, 25 bp, Rattus norvegicus
atgatcttttcactctgaagccacc

SEQ ID NO: 190966 - DNA, 25 bp, Rattus norvegicus
atgatcttttcagtctgaagccacc

SEQ ID NO: 190967 - DNA, 25 bp, Rattus norvegicus
atgatgaaatcaaccccatgagcat

SEQ ID NO: 190968 - DNA, 25 bp, Rattus norvegicus
atgatgaaatcatccccatgagcat

SEQ ID NO: 190969 - DNA, 25 bp, Rattus norvegicus
atgatgaaatttccctgccctggtg

SEQ ID NO: 190970 - DNA, 25 bp, Rattus norvegicus
atgatgaaatttgcctgccctggtg

SEQ ID NO: 190971 - DNA, 25 bp, Rattus norvegicus
atgatgaacagtatgtcccactccg

SEQ ID NO: 190972 - DNA, 25 bp, Rattus norvegicus
atgatgaacagtttgtcccactccg

SEQ ID NO: 190973 - DNA, 25 bp, Rattus norvegicus
atgatgaaccgcatcatgccactga

SEQ ID NO: 190974 - DNA, 25 bp, Rattus norvegicus
atgatgaaccgcttcatgccactga

SEQ ID NO: 190975 - DNA, 25 bp, Rattus norvegicus
atgatgaacgagctatgccgcgaac

SEQ ID NO: 190976 - DNA, 25 bp, Rattus norvegicus
atgatgaacgaggtatgccgcgaac

SEQ ID NO: 190977 - DNA, 25 bp, Rattus norvegicus
atgatgaagcccaggagtgcgtgcc

SEQ ID NO: 190978 - DNA, 25 bp, Rattus norvegicus
atgatgaagccctggagtgcgtgcc

SEQ ID NO: 190979 - DNA, 25 bp, Rattus norvegicus
atgatgaaggacatcgcctctccag

SEQ ID NO: 190980 - DNA, 25 bp, Rattus norvegicus
atgatgaaggacttcgcctctccag

SEQ ID NO: 190981 - DNA, 25 bp, Rattus norvegicus
atgatgaagtgtcctgtctgtagac

SEQ ID NO: 190982 - DNA, 25 bp, Rattus norvegicus
atgatgaagtgtgctgtctgtagac

SEQ ID NO: 190983 - DNA, 25 bp, Rattus norvegicus
atgatgacacttcggaacctgaggt

SEQ ID NO: 190984 - DNA, 25 bp, Rattus norvegicus
atgatgacacttgggaacctgaggt

SEQ ID NO: 190985 - DNA, 25 bp, Rattus norvegicus
atgatgacaggcagggaccttctcc

SEQ ID NO: 190986 - DNA, 25 bp, Rattus norvegicus
atgatgacaggctgggaccttctcc

SEQ ID NO: 190987 - DNA, 25 bp, Rattus norvegicus
atgatgaccacgctcgtctgaaaaa

SEQ ID NO: 190988 - DNA, 25 bp, Rattus norvegicus
atgatgaccacggtcgtctgaaaaa

SEQ ID NO: 190989 - DNA, 25 bp, Rattus norvegicus
atgatgaccagccatgggttgctct

SEQ ID NO: 190990 - DNA, 25 bp, Rattus norvegicus
atgatgaccagcgatgggttgctct

SEQ ID NO: 190991 - DNA, 25 bp, Rattus norvegicus
atgatgaccgtgaactttggatctg

SEQ ID NO: 190992 - DNA, 25 bp, Rattus norvegicus
atgatgaccgtgtactttggatctg

SEQ ID NO: 190993 - DNA, 25 bp, Rattus norvegicus
atgatgacctgtccgtatgaagaac

SEQ ID NO: 190994 - DNA, 25 bp, Rattus norvegicus
atgatgacctgtgcgtatgaagaac

SEQ ID NO: 190995 - DNA, 25 bp, Rattus norvegicus
atgatgacctttccctctcacaggt

SEQ ID NO: 190996 - DNA, 25 bp, Rattus norvegicus
atgatgacctttgcctctcacaggt

SEQ ID NO: 190997 - DNA, 25 bp, Rattus norvegicus
atgatgacgactatgctgcctgttc

SEQ ID NO: 190998 - DNA, 25 bp, Rattus norvegicus
atgatgacgactttgctgcctgttc

SEQ ID NO: 190999 - DNA, 25 bp, Rattus norvegicus
atgatgacgattcctcctgtgtcac

SEQ ID NO: 191000 - DNA, 25 bp, Rattus norvegicus
atgatgacgattgctcctgtgtcac

SEQ ID NO: 191001 - DNA, 25 bp, Rattus norvegicus
atgatgacggccagtgcagaaaccc

SEQ ID NO: 191002 - DNA, 25 bp, Rattus norvegicus
atgatgacggcctgtgcagaaaccc

SEQ ID NO: 191003 - DNA, 25 bp, Rattus norvegicus
atgatgacgtctccaggaggcccta

SEQ ID NO: 191004 - DNA, 25 bp, Rattus norvegicus
atgatgacgtctgcaggaggcccta

SEQ ID NO: 191005 - DNA, 25 bp, Rattus norvegicus
atgatgactacgactatcctccttg

SEQ ID NO: 191006 - DNA, 25 bp, Rattus norvegicus
atgatgactacgtctatcctccttg

SEQ ID NO: 191007 - DNA, 25 bp, Rattus norvegicus
atgatgactattaaggctccctgag

SEQ ID NO: 191008 - DNA, 25 bp, Rattus norvegicus
atgatgactattcttctgcctctgg

SEQ ID NO: 191009 - DNA, 25 bp, Rattus norvegicus
atgatgactattgttctgcctctgg

SEQ ID NO: 191010 - DNA, 25 bp, Rattus norvegicus
atgatgactatttaggctccctgag

SEQ ID NO: 191011 - DNA, 25 bp, Rattus norvegicus
atgatgactcacacccatatgtacc

SEQ ID NO: 191012 - DNA, 25 bp, Rattus norvegicus
atgatgactcactcccatatgtacc

SEQ ID NO: 191013 - DNA, 25 bp, Rattus norvegicus
atgatgactgcgaagtgaaggcccg

SEQ ID NO: 191014 - DNA, 25 bp, Rattus norvegicus
atgatgactgcgtagtgaaggcccg

SEQ ID NO: 191015 - DNA, 25 bp, Rattus norvegicus
atgatgactgtgatctttgccaaga

SEQ ID NO: 191016 - DNA, 25 bp, Rattus norvegicus
atgatgactgtgttctttgccaaga

SEQ ID NO: 191017 - DNA, 25 bp, Rattus norvegicus
atgatgactttgagatctgagcagg

SEQ ID NO: 191018 - DNA, 25 bp, Rattus norvegicus
atgatgactttgtgatctgagcagg

SEQ ID NO: 191019 - DNA, 25 bp, Rattus norvegicus
atgatgagacatcaccacttccgca

SEQ ID NO: 191020 - DNA, 25 bp, Rattus norvegicus
atgatgagacatgaccacttccgca

SEQ ID NO: 191021 - DNA, 25 bp, Rattus norvegicus
atgatgagctgcagtacctaccagt

SEQ ID NO: 191022 - DNA, 25 bp, Rattus norvegicus
atgatgagctgctgtacctaccagt

SEQ ID NO: 191023 - DNA, 25 bp, Rattus norvegicus
atgatgaggtgaatacttggtaaac

SEQ ID NO: 191024 - DNA, 25 bp, Rattus norvegicus
atgatgaggtgattacttggtaaac

SEQ ID NO: 191025 - DNA, 25 bp, Rattus norvegicus
atgatgaggtgcatcccaagcagca

SEQ ID NO: 191026 - DNA, 25 bp, Rattus norvegicus
atgatgaggtgcttcccaagcagca

SEQ ID NO: 191027 - DNA, 25 bp, Rattus norvegicus
atgatgagtcacacctcgggcctaa

SEQ ID NO: 191028 - DNA, 25 bp, Rattus norvegicus
atgatgagtcactcctcgggcctaa

SEQ ID NO: 191029 - DNA, 25 bp, Rattus norvegicus
atgatgagtcagcttccttcaccat

SEQ ID NO: 191030 - DNA, 25 bp, Rattus norvegicus
atgatgagtcaggttccttcaccat

SEQ ID NO: 191031 - DNA, 25 bp, Rattus norvegicus
atgatgataaaactcggcccctggt

SEQ ID NO: 191032 - DNA, 25 bp, Rattus norvegicus
atgatgataaaagtcggcccctggt

SEQ ID NO: 191033 - DNA, 25 bp, Rattus norvegicus
atgatgataatgagtccctcctttg

SEQ ID NO: 191034 - DNA, 25 bp, Rattus norvegicus
atgatgataatgtgtccctcctttg

SEQ ID NO: 191035 - DNA, 25 bp, Rattus norvegicus
atgatgatcagcattctccactctc

SEQ ID NO: 191036 - DNA, 25 bp, Rattus norvegicus
atgatgatcagctttctccactctc

SEQ ID NO: 191037 - DNA, 25 bp, Rattus norvegicus
atgatgatcctaacacaactggaaa

SEQ ID NO: 191038 - DNA, 25 bp, Rattus norvegicus
atgatgatcctatcacaactggaaa

SEQ ID NO: 191039 - DNA, 25 bp, Rattus norvegicus
atgatgatcctcaggagcttctctt

SEQ ID NO: 191040 - DNA, 25 bp, Rattus norvegicus
atgatgatcctctggagcttctctt

SEQ ID NO: 191041 - DNA, 25 bp, Rattus norvegicus
atgatgatcctgagacttgtcctgc

SEQ ID NO: 191042 - DNA, 25 bp, Rattus norvegicus
atgatgatcctgtgacttgtcctgc

SEQ ID NO: 191043 - DNA, 25 bp, Rattus norvegicus
atgatgatctgcaaggtcctggtga

SEQ ID NO: 191044 - DNA, 25 bp, Rattus norvegicus
atgatgatctgctaggtcctggtga

SEQ ID NO: 191045 - DNA, 25 bp, Rattus norvegicus
atgatgatgactactaccaccagct

SEQ ID NO: 191046 - DNA, 25 bp, Rattus norvegicus
atgatgatgacttctaccaccagct

SEQ ID NO: 191047 - DNA, 25 bp, Rattus norvegicus
atgatgatgctcatgggccgcaccc

SEQ ID NO: 191048 - DNA, 25 bp, Rattus norvegicus
atgatgatgctcttgggccgcaccc

SEQ ID NO: 191049 - DNA, 25 bp, Rattus norvegicus
atgatgatgtcaaccggcctcagac

SEQ ID NO: 191050 - DNA, 25 bp, Rattus norvegicus
atgatgatgtcatccggcctcagac

SEQ ID NO: 191051 - DNA, 25 bp, Rattus norvegicus
atgatgatgtgcagacggcggcctc

SEQ ID NO: 191052 - DNA, 25 bp, Rattus norvegicus
atgatgatgtgctgacggcggcctc

SEQ ID NO: 191053 - DNA, 25 bp, Rattus norvegicus
atgatgcaaaccagtttcctctctg

SEQ ID NO: 191054 - DNA, 25 bp, Rattus norvegicus
atgatgcaaacctgtttcctctctg

SEQ ID NO: 191055 - DNA, 25 bp, Rattus norvegicus
atgatgcaatatcctgcgtttcccc

SEQ ID NO: 191056 - DNA, 25 bp, Rattus norvegicus
atgatgcaatatgctgcgtttcccc

SEQ ID NO: 191057 - DNA, 25 bp, Rattus norvegicus
atgatgcactctacagtgcaaggat

SEQ ID NO: 191058 - DNA, 25 bp, Rattus norvegicus
atgatgcactcttcagtgcaaggat

SEQ ID NO: 191059 - DNA, 25 bp, Rattus norvegicus
atgatgcagcagactcaggccaacc

SEQ ID NO: 191060 - DNA, 25 bp, Rattus norvegicus
atgatgcagcagtctcaggccaacc

SEQ ID NO: 191061 - DNA, 25 bp, Rattus norvegicus
atgatgcagctccagagggcttcct

SEQ ID NO: 191062 - DNA, 25 bp, Rattus norvegicus
atgatgcagctcgagagggcttcct

SEQ ID NO: 191063 - DNA, 25 bp, Rattus norvegicus
atgatgcatctgaatggctggtcca

SEQ ID NO: 191064 - DNA, 25 bp, Rattus norvegicus
atgatgcatctgtatggctggtcca

SEQ ID NO: 191065 - DNA, 25 bp, Rattus norvegicus
atgatgccatggctgtcaaacgagc

SEQ ID NO: 191066 - DNA, 25 bp, Rattus norvegicus
atgatgccatgggtgtcaaacgagc

SEQ ID NO: 191067 - DNA, 25 bp, Rattus norvegicus
atgatgcccaacatacttgttagaa

SEQ ID NO: 191068 - DNA, 25 bp, Rattus norvegicus
atgatgcccaacttacttgttagaa

SEQ ID NO: 191069 - DNA, 25 bp, Rattus norvegicus
atgatgcccatgattgacagccaaa

SEQ ID NO: 191070 - DNA, 25 bp, Rattus norvegicus
atgatgcccatgtttgacagccaaa

SEQ ID NO: 191071 - DNA, 25 bp, Rattus norvegicus
atgatgccgacaatcctgaggttga

SEQ ID NO: 191072 - DNA, 25 bp, Rattus norvegicus
atgatgccgacattcctgaggttga

SEQ ID NO: 191073 - DNA, 25 bp, Rattus norvegicus
atgatgccgcctaacatttctgcaa

SEQ ID NO: 191074 - DNA, 25 bp, Rattus norvegicus
atgatgccgccttacatttctgcaa

SEQ ID NO: 191075 - DNA, 25 bp, Rattus norvegicus
atgatgcctactatcttcaagacct

SEQ ID NO: 191076 - DNA, 25 bp, Rattus norvegicus
atgatgcctactttcttcaagacct

SEQ ID NO: 191077 - DNA, 25 bp, Rattus norvegicus
atgatgcctatcatgggctacctgg

SEQ ID NO: 191078 - DNA, 25 bp, Rattus norvegicus
atgatgcctatcttgggctacctgg

SEQ ID NO: 191079 - DNA, 25 bp, Rattus norvegicus
atgatgcctctcagttcaccattag

SEQ ID NO: 191080 - DNA, 25 bp, Rattus norvegicus
atgatgcctctctgttcaccattag

SEQ ID NO: 191081 - DNA, 25 bp, Rattus norvegicus
atgatgcctgggaacacagctgaca

SEQ ID NO: 191082 - DNA, 25 bp, Rattus norvegicus
atgatgcctgggtacacagctgaca

SEQ ID NO: 191083 - DNA, 25 bp, Rattus norvegicus
atgatgccttttccaggagcaacta

SEQ ID NO: 191084 - DNA, 25 bp, Rattus norvegicus
atgatgccttttgcaggagcaacta

SEQ ID NO: 191085 - DNA, 25 bp, Rattus norvegicus
atgatgcgcccaatgttcacaagga

SEQ ID NO: 191086 - DNA, 25 bp, Rattus norvegicus
atgatgcgcccattgttcacaagga

SEQ ID NO: 191087 - DNA, 25 bp, Rattus norvegicus
atgatgcgctagctgtggcacaaac

SEQ ID NO: 191088 - DNA, 25 bp, Rattus norvegicus
atgatgcgctaggtgtggcacaaac

SEQ ID NO: 191089 - DNA, 25 bp, Rattus norvegicus
atgatgcgctcactgccatgcgttc

SEQ ID NO: 191090 - DNA, 25 bp, Rattus norvegicus
atgatgcgctcagtgccatgcgttc

SEQ ID NO: 191091 - DNA, 25 bp, Rattus norvegicus
atgatgctaatcaccttccgatgaa

SEQ ID NO: 191092 - DNA, 25 bp, Rattus norvegicus
atgatgctaatctccttccgatgaa

SEQ ID NO: 191093 - DNA, 25 bp, Rattus norvegicus
atgatgctagtacactgcaggcagt

SEQ ID NO: 191094 - DNA, 25 bp, Rattus norvegicus
atgatgctagtagactgcaggcagt

SEQ ID NO: 191095 - DNA, 25 bp, Rattus norvegicus
atgatgctcactctggctgccagca

SEQ ID NO: 191096 - DNA, 25 bp, Rattus norvegicus
atgatgctcactgtggctgccagca

SEQ ID NO: 191097 - DNA, 25 bp, Rattus norvegicus
atgatgctcgtgacttgccgtgatg

SEQ ID NO: 191098 - DNA, 25 bp, Rattus norvegicus
atgatgctcgtgtcttgccgtgatg

SEQ ID NO: 191099 - DNA, 25 bp, Rattus norvegicus
atgatgctctctccctctgaaaagg

SEQ ID NO: 191100 - DNA, 25 bp, Rattus norvegicus
atgatgctctctgcctctgaaaagg

SEQ ID NO: 191101 - DNA, 25 bp, Rattus norvegicus
atgatgctgaacctcacagagccgg

SEQ ID NO: 191102 - DNA, 25 bp, Rattus norvegicus
atgatgctgaacgtcacagagccgg

SEQ ID NO: 191103 - DNA, 25 bp, Rattus norvegicus
atgatgctgatgctgcctcagagcg

SEQ ID NO: 191104 - DNA, 25 bp, Rattus norvegicus
atgatgctgatggtgcctcagagcg

SEQ ID NO: 191105 - DNA, 25 bp, Rattus norvegicus
atgatgctggacctagcccaggagt

SEQ ID NO: 191106 - DNA, 25 bp, Rattus norvegicus
atgatgctggacgtagcccaggagt

SEQ ID NO: 191107 - DNA, 25 bp, Rattus norvegicus
atgatgctggagatgctctgtgcaa

SEQ ID NO: 191108 - DNA, 25 bp, Rattus norvegicus
atgatgctggagttgctctgtgcaa

SEQ ID NO: 191109 - DNA, 25 bp, Rattus norvegicus
atgatgctggttatctcacgcgtga

SEQ ID NO: 191110 - DNA, 25 bp, Rattus norvegicus
atgatgctggttttctcacgcgtga

SEQ ID NO: 191111 - DNA, 25 bp, Rattus norvegicus
atgatgctgttcagtgggtctgctt

SEQ ID NO: 191112 - DNA, 25 bp, Rattus norvegicus
atgatgctgttctgtgggtctgctt

SEQ ID NO: 191113 - DNA, 25 bp, Rattus norvegicus
atgatgcttcaacgccaacatatat

SEQ ID NO: 191114 - DNA, 25 bp, Rattus norvegicus
atgatgcttcaaggccaacatatat

SEQ ID NO: 191115 - DNA, 25 bp, Rattus norvegicus
atgatgcttgtcactggctggaact

SEQ ID NO: 191116 - DNA, 25 bp, Rattus norvegicus
atgatgcttgtctctggctggaact

SEQ ID NO: 191117 - DNA, 25 bp, Rattus norvegicus
atgatgctttctcttctaggaaaag

SEQ ID NO: 191118 - DNA, 25 bp, Rattus norvegicus
atgatgctttctgttctaggaaaag

SEQ ID NO: 191119 - DNA, 25 bp, Rattus norvegicus
atgatgctttttaccatactatgga

SEQ ID NO: 191120 - DNA, 25 bp, Rattus norvegicus
atgatgcttttttccatactatgga

SEQ ID NO: 191121 - DNA, 25 bp, Rattus norvegicus
atgatggaagccacactcaggccat

SEQ ID NO: 191122 - DNA, 25 bp, Rattus norvegicus
atgatggaagcctcactcaggccat

SEQ ID NO: 191123 - DNA, 25 bp, Rattus norvegicus
atgatggaagctcgacctggtgccc

SEQ ID NO: 191124 - DNA, 25 bp, Rattus norvegicus
atgatggaagctggacctggtgccc

SEQ ID NO: 191125 - DNA, 25 bp, Rattus norvegicus
atgatggaccataagggatcccaga

SEQ ID NO: 191126 - DNA, 25 bp, Rattus norvegicus
atgatggaccattagggatcccaga

SEQ ID NO: 191127 - DNA, 25 bp, Rattus norvegicus
atgatggagaaacggcccgagttac

SEQ ID NO: 191128 - DNA, 25 bp, Rattus norvegicus
atgatggagaaagggcccgagttac

SEQ ID NO: 191129 - DNA, 25 bp, Rattus norvegicus
atgatggcagccctgaagacctacc

SEQ ID NO: 191130 - DNA, 25 bp, Rattus norvegicus
atgatggcagccgtgaagacctacc

SEQ ID NO: 191131 - DNA, 25 bp, Rattus norvegicus
atgatggccctgagcgttgtgatgc

SEQ ID NO: 191132 - DNA, 25 bp, Rattus norvegicus
atgatggccctgtgcgttgtgatgc

SEQ ID NO: 191133 - DNA, 25 bp, Rattus norvegicus
atgatggcccttaactcagttccag

SEQ ID NO: 191134 - DNA, 25 bp, Rattus norvegicus
atgatggccctttactcagttccag

SEQ ID NO: 191135 - DNA, 25 bp, Rattus norvegicus
atgatggccttgcaatgtccgcctg

SEQ ID NO: 191136 - DNA, 25 bp, Rattus norvegicus
atgatggccttggaatgtccgcctg

SEQ ID NO: 191137 - DNA, 25 bp, Rattus norvegicus
atgatggcgacaaccgcagcgagca

SEQ ID NO: 191138 - DNA, 25 bp, Rattus norvegicus
atgatggcgacatccgcagcgagca

SEQ ID NO: 191139 - DNA, 25 bp, Rattus norvegicus
atgatggcgtttaagattctcgtta

SEQ ID NO: 191140 - DNA, 25 bp, Rattus norvegicus
atgatggcgttttagattctcgtta

SEQ ID NO: 191141 - DNA, 25 bp, Rattus norvegicus
atgatggctatgcacacctcgaatc

SEQ ID NO: 191142 - DNA, 25 bp, Rattus norvegicus
atgatggctatggacacctcgaatc

SEQ ID NO: 191143 - DNA, 25 bp, Rattus norvegicus
atgatggctcagatcctttagttcc

SEQ ID NO: 191144 - DNA, 25 bp, Rattus norvegicus
atgatggctcagttcctttagttcc

SEQ ID NO: 191145 - DNA, 25 bp, Rattus norvegicus
atgatggctgaccaggccctggaca

SEQ ID NO: 191146 - DNA, 25 bp, Rattus norvegicus
atgatggctgacgaggccctggaca

SEQ ID NO: 191147 - DNA, 25 bp, Rattus norvegicus
atgatggcttctacaccactggagt

SEQ ID NO: 191148 - DNA, 25 bp, Rattus norvegicus
atgatggcttcttcaccactggagt

SEQ ID NO: 191149 - DNA, 25 bp, Rattus norvegicus
atgatgggaccaacagcgcccataa

SEQ ID NO: 191150 - DNA, 25 bp, Rattus norvegicus
atgatgggaccatcagcgcccataa

SEQ ID NO: 191151 - DNA, 25 bp, Rattus norvegicus
atgatgggacctcttactcagcaac

SEQ ID NO: 191152 - DNA, 25 bp, Rattus norvegicus
atgatgggacctgttactcagcaac

SEQ ID NO: 191153 - DNA, 25 bp, Rattus norvegicus
atgatgggactcacttggctctgac

SEQ ID NO: 191154 - DNA, 25 bp, Rattus norvegicus
atgatgggactctcttggctctgac

SEQ ID NO: 191155 - DNA, 25 bp, Rattus norvegicus
atgatgggagcaccttctcacctga

SEQ ID NO: 191156 - DNA, 25 bp, Rattus norvegicus
atgatgggagcagcttctcacctga

SEQ ID NO: 191157 - DNA, 25 bp, Rattus norvegicus
atgatgggcaccactaggtctatgc

SEQ ID NO: 191158 - DNA, 25 bp, Rattus norvegicus
atgatgggcacctctaggtctatgc

SEQ ID NO: 191159 - DNA, 25 bp, Rattus norvegicus
atgatgggccatctgaaacctcctc

SEQ ID NO: 191160 - DNA, 25 bp, Rattus norvegicus
atgatgggccatgtgaaacctcctc

SEQ ID NO: 191161 - DNA, 25 bp, Rattus norvegicus
atgatgggcgccagcatgaaggact

SEQ ID NO: 191162 - DNA, 25 bp, Rattus norvegicus
atgatgggcgcctgcatgaaggact

SEQ ID NO: 191163 - DNA, 25 bp, Rattus norvegicus
atgatgggctgaaatgctgccattt

SEQ ID NO: 191164 - DNA, 25 bp, Rattus norvegicus
atgatgggctgatatgctgccattt

SEQ ID NO: 191165 - DNA, 25 bp, Rattus norvegicus
atgatgggtcgaacttcaccagcct

SEQ ID NO: 191166 - DNA, 25 bp, Rattus norvegicus
atgatgggtcgatcttcaccagcct

SEQ ID NO: 191167 - DNA, 25 bp, Rattus norvegicus
atgatgggtttgaatttgcctcaac

SEQ ID NO: 191168 - DNA, 25 bp, Rattus norvegicus
atgatgggtttgtatttgcctcaac

SEQ ID NO: 191169 - DNA, 25 bp, Rattus norvegicus
atgatggtcagtcgccttaacctca

SEQ ID NO: 191170 - DNA, 25 bp, Rattus norvegicus
atgatggtcagtggccttaacctca

SEQ ID NO: 191171 - DNA, 25 bp, Rattus norvegicus
atgatggtctgccaagacggcccga

SEQ ID NO: 191172 - DNA, 25 bp, Rattus norvegicus
atgatggtctgcgaagacggcccga

SEQ ID NO: 191173 - DNA, 25 bp, Rattus norvegicus
atgatggtggctacttttccaccta

SEQ ID NO: 191174 - DNA, 25 bp, Rattus norvegicus
atgatggtggcttcttttccaccta

SEQ ID NO: 191175 - DNA, 25 bp, Rattus norvegicus
atgatggtgtatctggtgactgtac

SEQ ID NO: 191176 - DNA, 25 bp, Rattus norvegicus
atgatggtgtatgtggtgactgtac

SEQ ID NO: 191177 - DNA, 25 bp, Rattus norvegicus
atgatggttattaccgtgggcctaa

SEQ ID NO: 191178 - DNA, 25 bp, Rattus norvegicus
atgatggttatttccgtgggcctaa

SEQ ID NO: 191179 - DNA, 25 bp, Rattus norvegicus
atgatggtttgcaagtcgccaactt

SEQ ID NO: 191180 - DNA, 25 bp, Rattus norvegicus
atgatggtttgctagtcgccaactt

SEQ ID NO: 191181 - DNA, 25 bp, Rattus norvegicus
atgatgtaagccctgtattccctat

SEQ ID NO: 191182 - DNA, 25 bp, Rattus norvegicus
atgatgtaagccgtgtattccctat

SEQ ID NO: 191183 - DNA, 25 bp, Rattus norvegicus
atgatgtaccatatgtcaccagcat

SEQ ID NO: 191184 - DNA, 25 bp, Rattus norvegicus
atgatgtaccatttgtcaccagcat

SEQ ID NO: 191185 - DNA, 25 bp, Rattus norvegicus
atgatgtacttgatggctctgctga

SEQ ID NO: 191186 - DNA, 25 bp, Rattus norvegicus
atgatgtacttgttggctctgctga

SEQ ID NO: 191187 - DNA, 25 bp, Rattus norvegicus
atgatgtagaatatgtaacccactc

SEQ ID NO: 191188 - DNA, 25 bp, Rattus norvegicus
atgatgtagaatttgtaacccactc

SEQ ID NO: 191189 - DNA, 25 bp, Rattus norvegicus
atgatgtcacggatctttttgttgt

SEQ ID NO: 191190 - DNA, 25 bp, Rattus norvegicus
atgatgtcacggttctttttgttgt

SEQ ID NO: 191191 - DNA, 25 bp, Rattus norvegicus
atgatgtcacttatgttgaactgta

SEQ ID NO: 191192 - DNA, 25 bp, Rattus norvegicus
atgatgtcacttttgttgaactgta

SEQ ID NO: 191193 - DNA, 25 bp, Rattus norvegicus
atgatgtcaggaccatcttgctctc

SEQ ID NO: 191194 - DNA, 25 bp, Rattus norvegicus
atgatgtcaggagcatcttgctctc

SEQ ID NO: 191195 - DNA, 25 bp, Rattus norvegicus
atgatgtcaggtagcagcccggtgt

SEQ ID NO: 191196 - DNA, 25 bp, Rattus norvegicus
atgatgtcaggttgcagcccggtgt

SEQ ID NO: 191197 - DNA, 25 bp, Rattus norvegicus
atgatgtcatcccagacgtgggaga

SEQ ID NO: 191198 - DNA, 25 bp, Rattus norvegicus
atgatgtcatccgagacgtgggaga

SEQ ID NO: 191199 - DNA, 25 bp, Rattus norvegicus
atgatgtcatctcatgcccttacct

SEQ ID NO: 191200 - DNA, 25 bp, Rattus norvegicus
atgatgtcatctgatgcccttacct

SEQ ID NO: 191201 - DNA, 25 bp, Rattus norvegicus
atgatgtcatggcatttcggagctg

SEQ ID NO: 191202 - DNA, 25 bp, Rattus norvegicus
atgatgtcatgggatttcggagctg

SEQ ID NO: 191203 - DNA, 25 bp, Rattus norvegicus
atgatgtccacgctgctgggccagc

SEQ ID NO: 191204 - DNA, 25 bp, Rattus norvegicus
atgatgtccacggtgctgggccagc

SEQ ID NO: 191205 - DNA, 25 bp, Rattus norvegicus
atgatgtcccataagcaaactgcac

SEQ ID NO: 191206 - DNA, 25 bp, Rattus norvegicus
atgatgtcccattagcaaactgcac

SEQ ID NO: 191207 - DNA, 25 bp, Rattus norvegicus
atgatgtctccccagaggagtttcc

SEQ ID NO: 191208 - DNA, 25 bp, Rattus norvegicus
atgatgtctcccgagaggagtttcc

SEQ ID NO: 191209 - DNA, 25 bp, Rattus norvegicus
atgatgtcttcgagactgcagagtg

SEQ ID NO: 191210 - DNA, 25 bp, Rattus norvegicus
atgatgtcttcgtgactgcagagtg

SEQ ID NO: 191211 - DNA, 25 bp, Rattus norvegicus
atgatgtgacctcatcctgttgtgt

SEQ ID NO: 191212 - DNA, 25 bp, Rattus norvegicus
atgatgtgacctgatcctgttgtgt

SEQ ID NO: 191213 - DNA, 25 bp, Rattus norvegicus
atgatgtgccggacatcacctcaga

SEQ ID NO: 191214 - DNA, 25 bp, Rattus norvegicus
atgatgtgccggtcatcacctcaga

SEQ ID NO: 191215 - DNA, 25 bp, Rattus norvegicus
atgatgtgctccacgaagccaaggc

SEQ ID NO: 191216 - DNA, 25 bp, Rattus norvegicus
atgatgtgctcctcgaagccaaggc

SEQ ID NO: 191217 - DNA, 25 bp, Rattus norvegicus
atgatgtggtacattgtccttcaga

SEQ ID NO: 191218 - DNA, 25 bp, Rattus norvegicus
atgatgtggtactttgtccttcaga

SEQ ID NO: 191219 - DNA, 25 bp, Rattus norvegicus
atgatgtgttctccaagccaccttc

SEQ ID NO: 191220 - DNA, 25 bp, Rattus norvegicus
atgatgtgttctgcaagccaccttc

SEQ ID NO: 191221 - DNA, 25 bp, Rattus norvegicus
atgatgtgttgacccagacttgctt

SEQ ID NO: 191222 - DNA, 25 bp, Rattus norvegicus
atgatgtgttgagccagacttgctt

SEQ ID NO: 191223 - DNA, 25 bp, Rattus norvegicus
atgatgtgttgtacatgggtgccaa

SEQ ID NO: 191224 - DNA, 25 bp, Rattus norvegicus
atgatgtgttgttcatgggtgccaa

SEQ ID NO: 191225 - DNA, 25 bp, Rattus norvegicus
atgatgttaatcactcgtcttcctg

SEQ ID NO: 191226 - DNA, 25 bp, Rattus norvegicus
atgatgttaatctctcgtcttcctg

SEQ ID NO: 191227 - DNA, 25 bp, Rattus norvegicus
atgatgttacctaggcaccattgga

SEQ ID NO: 191228 - DNA, 25 bp, Rattus norvegicus
atgatgttaccttggcaccattgga

SEQ ID NO: 191229 - DNA, 25 bp, Rattus norvegicus
atgatgttcactagggacactctac

SEQ ID NO: 191230 - DNA, 25 bp, Rattus norvegicus
atgatgttcacttgggacactctac

SEQ ID NO: 191231 - DNA, 25 bp, Rattus norvegicus
atgatgttcgggacaaagacatcca

SEQ ID NO: 191232 - DNA, 25 bp, Rattus norvegicus
atgatgttcgggtcaaagacatcca

SEQ ID NO: 191233 - DNA, 25 bp, Rattus norvegicus
atgatgttgcttctgtgctttctcc

SEQ ID NO: 191234 - DNA, 25 bp, Rattus norvegicus
atgatgttgcttgtgtgctttctcc

SEQ ID NO: 191235 - DNA, 25 bp, Rattus norvegicus
atgatgttgggacacaccccttcga

SEQ ID NO: 191236 - DNA, 25 bp, Rattus norvegicus
atgatgttgggagacaccccttcga

SEQ ID NO: 191237 - DNA, 25 bp, Rattus norvegicus
atgatgttggtccttgaaagtatgc

SEQ ID NO: 191238 - DNA, 25 bp, Rattus norvegicus
atgatgttggtcgttgaaagtatgc

SEQ ID NO: 191239 - DNA, 25 bp, Rattus norvegicus
atgatgtttattccacacctatgtg

SEQ ID NO: 191240 - DNA, 25 bp, Rattus norvegicus
atgatgtttattgcacacctatgtg

SEQ ID NO: 191241 - DNA, 25 bp, Rattus norvegicus
atgatgtttgatagcccatccccac

SEQ ID NO: 191242 - DNA, 25 bp, Rattus norvegicus
atgatgtttgattgcccatccccac

SEQ ID NO: 191243 - DNA, 25 bp, Rattus norvegicus
atgatgtttgtgactctcgactgta

SEQ ID NO: 191244 - DNA, 25 bp, Rattus norvegicus
atgatgtttgtgtctctcgactgta

SEQ ID NO: 191245 - DNA, 25 bp, Rattus norvegicus
atgatgttttcacgcgggtgctttt

SEQ ID NO: 191246 - DNA, 25 bp, Rattus norvegicus
atgatgttttcaggcgggtgctttt

SEQ ID NO: 191247 - DNA, 25 bp, Rattus norvegicus
atgattaagccccaatacgccaacc

SEQ ID NO: 191248 - DNA, 25 bp, Rattus norvegicus
atgattaagcccgaatacgccaacc

SEQ ID NO: 191249 - DNA, 25 bp, Rattus norvegicus
atgattaatgaccatgccactgaaa

SEQ ID NO: 191250 - DNA, 25 bp, Rattus norvegicus
atgattaatgacgatgccactgaaa

SEQ ID NO: 191251 - DNA, 25 bp, Rattus norvegicus
atgattacatttcccatcttcctgt

SEQ ID NO: 191252 - DNA, 25 bp, Rattus norvegicus
atgattacatttgccatcttcctgt

SEQ ID NO: 191253 - DNA, 25 bp, Rattus norvegicus
atgattacggatactttcctttatc

SEQ ID NO: 191254 - DNA, 25 bp, Rattus norvegicus
atgattacggattctttcctttatc

SEQ ID NO: 191255 - DNA, 25 bp, Rattus norvegicus
atgattaggcacacaggcgtcgggc

SEQ ID NO: 191256 - DNA, 25 bp, Rattus norvegicus
atgattaggcactcaggcgtcgggc

SEQ ID NO: 191257 - DNA, 25 bp, Rattus norvegicus
atgattagggtgagtgtccccactc

SEQ ID NO: 191258 - DNA, 25 bp, Rattus norvegicus
atgattagggtgtgtgtccccactc

SEQ ID NO: 191259 - DNA, 25 bp, Rattus norvegicus
atgattagtgtaattgtccttgctg

SEQ ID NO: 191260 - DNA, 25 bp, Rattus norvegicus
atgattagtgtatttgtccttgctg

SEQ ID NO: 191261 - DNA, 25 bp, Rattus norvegicus
atgattatctacagtgtgctgttgt

SEQ ID NO: 191262 - DNA, 25 bp, Rattus norvegicus
atgattatctactgtgtgctgttgt

SEQ ID NO: 191263 - DNA, 25 bp, Rattus norvegicus
atgattattcggatttccctcgtct

SEQ ID NO: 191264 - DNA, 25 bp, Rattus norvegicus
atgattattcggttttccctcgtct

SEQ ID NO: 191265 - DNA, 25 bp, Rattus norvegicus
atgattattgttctgtggtcttcta

SEQ ID NO: 191266 - DNA, 25 bp, Rattus norvegicus
atgattattgttgtgtggtcttcta

SEQ ID NO: 191267 - DNA, 25 bp, Rattus norvegicus
atgattcaagtgctagtgcctgcct

SEQ ID NO: 191268 - DNA, 25 bp, Rattus norvegicus
atgattcaagtggtagtgcctgcct

SEQ ID NO: 191269 - DNA, 25 bp, Rattus norvegicus
atgattcactccatttttacttgta

SEQ ID NO: 191270 - DNA, 25 bp, Rattus norvegicus
atgattcactccttttttacttgta

SEQ ID NO: 191271 - DNA, 25 bp, Rattus norvegicus
atgattcagtttatgtaagactcaa

SEQ ID NO: 191272 - DNA, 25 bp, Rattus norvegicus
atgattcagtttttgtaagactcaa

SEQ ID NO: 191273 - DNA, 25 bp, Rattus norvegicus
atgattccacaaaagtttcccctca

SEQ ID NO: 191274 - DNA, 25 bp, Rattus norvegicus
atgattccacaatagtttcccctca

SEQ ID NO: 191275 - DNA, 25 bp, Rattus norvegicus
atgattccagagaagagcgacgatt

SEQ ID NO: 191276 - DNA, 25 bp, Rattus norvegicus
atgattccagagtagagcgacgatt

SEQ ID NO: 191277 - DNA, 25 bp, Rattus norvegicus
atgattccagtgacatcttcctcag

SEQ ID NO: 191278 - DNA, 25 bp, Rattus norvegicus
atgattccagtgtcatcttcctcag

SEQ ID NO: 191279 - DNA, 25 bp, Rattus norvegicus
atgattcccgctaacgtgggaggca

SEQ ID NO: 191280 - DNA, 25 bp, Rattus norvegicus
atgattcccgcttacgtgggaggca

SEQ ID NO: 191281 - DNA, 25 bp, Rattus norvegicus
atgattccctctccagggtcatcag

SEQ ID NO: 191282 - DNA, 25 bp, Rattus norvegicus
atgattccctctgcagggtcatcag

SEQ ID NO: 191283 - DNA, 25 bp, Rattus norvegicus
atgattccctgtctgtcccatgtta

SEQ ID NO: 191284 - DNA, 25 bp, Rattus norvegicus
atgattccctgtgtgtcccatgtta

SEQ ID NO: 191285 - DNA, 25 bp, Rattus norvegicus
atgattccttcaagggtcacctctg

SEQ ID NO: 191286 - DNA, 25 bp, Rattus norvegicus
atgattccttcatgggtcacctctg

SEQ ID NO: 191287 - DNA, 25 bp, Rattus norvegicus
atgattcgcctccagcagaaaggga

SEQ ID NO: 191288 - DNA, 25 bp, Rattus norvegicus
atgattcgcctcgagcagaaaggga

SEQ ID NO: 191289 - DNA, 25 bp, Rattus norvegicus
atgattctaacccatgaactcctgg

SEQ ID NO: 191290 - DNA, 25 bp, Rattus norvegicus
atgattctaaccgatgaactcctgg

SEQ ID NO: 191291 - DNA, 25 bp, Rattus norvegicus
atgattctcacaagcacatacccac

SEQ ID NO: 191292 - DNA, 25 bp, Rattus norvegicus
atgattctcacatgcacatacccac

SEQ ID NO: 191293 - DNA, 25 bp, Rattus norvegicus
atgattctcacccttcataatgctg

SEQ ID NO: 191294 - DNA, 25 bp, Rattus norvegicus
atgattctcaccgttcataatgctg

SEQ ID NO: 191295 - DNA, 25 bp, Rattus norvegicus
atgattctcagcaactaaccctggg

SEQ ID NO: 191296 - DNA, 25 bp, Rattus norvegicus
atgattctcagctactaaccctggg

SEQ ID NO: 191297 - DNA, 25 bp, Rattus norvegicus
atgattctccggactgactgatcct

SEQ ID NO: 191298 - DNA, 25 bp, Rattus norvegicus
atgattctccggtctgactgatcct

SEQ ID NO: 191299 - DNA, 25 bp, Rattus norvegicus
atgattctgaggacccttctgggac

SEQ ID NO: 191300 - DNA, 25 bp, Rattus norvegicus
atgattctgaggtcccttctgggac

SEQ ID NO: 191301 - DNA, 25 bp, Rattus norvegicus
atgattctggagacctggacgaccc

SEQ ID NO: 191302 - DNA, 25 bp, Rattus norvegicus
atgattctggagtcctggacgaccc

SEQ ID NO: 191303 - DNA, 25 bp, Rattus norvegicus
atgattctgtagattgtctttggga

SEQ ID NO: 191304 - DNA, 25 bp, Rattus norvegicus
atgattctgtagtttgtctttggga

SEQ ID NO: 191305 - DNA, 25 bp, Rattus norvegicus
atgattcttagcacctttcttcaaa

SEQ ID NO: 191306 - DNA, 25 bp, Rattus norvegicus
atgattcttagctcctttcttcaaa

SEQ ID NO: 191307 - DNA, 25 bp, Rattus norvegicus
atgattcttcagacactgctggcct

SEQ ID NO: 191308 - DNA, 25 bp, Rattus norvegicus
atgattcttcagtcactgctggcct

SEQ ID NO: 191309 - DNA, 25 bp, Rattus norvegicus
atgattcttctacatgtaatcgcaa

SEQ ID NO: 191310 - DNA, 25 bp, Rattus norvegicus
atgattcttctagatgtaatcgcaa

SEQ ID NO: 191311 - DNA, 25 bp, Rattus norvegicus
atgattcttctgctgattgtcctcc

SEQ ID NO: 191312 - DNA, 25 bp, Rattus norvegicus
atgattcttctggtgattgtcctcc

SEQ ID NO: 191313 - DNA, 25 bp, Rattus norvegicus
atgattcttggactcaggctgctct

SEQ ID NO: 191314 - DNA, 25 bp, Rattus norvegicus
atgattcttggagtcaggctgctct

SEQ ID NO: 191315 - DNA, 25 bp, Rattus norvegicus
atgattcttgtgatttccctggttg

SEQ ID NO: 191316 - DNA, 25 bp, Rattus norvegicus
atgattcttgtgttttccctggttg

SEQ ID NO: 191317 - DNA, 25 bp, Rattus norvegicus
atgattgacagcactcacagggaat

SEQ ID NO: 191318 - DNA, 25 bp, Rattus norvegicus
atgattgacagctctcacagggaat

SEQ ID NO: 191319 - DNA, 25 bp, Rattus norvegicus
atgattgagagactcccactgaccc

SEQ ID NO: 191320 - DNA, 25 bp, Rattus norvegicus
atgattgagagagtcccactgaccc

SEQ ID NO: 191321 - DNA, 25 bp, Rattus norvegicus
atgattgagcctccctttggtccca

SEQ ID NO: 191322 - DNA, 25 bp, Rattus norvegicus
atgattgagcctgcctttggtccca

SEQ ID NO: 191323 - DNA, 25 bp, Rattus norvegicus
atgattgagttcctagcagtccgtg

SEQ ID NO: 191324 - DNA, 25 bp, Rattus norvegicus
atgattgagttcgtagcagtccgtg

SEQ ID NO: 191325 - DNA, 25 bp, Rattus norvegicus
atgattgattgaatgctgcctcttt

SEQ ID NO: 191326 - DNA, 25 bp, Rattus norvegicus
atgattgattgattgctgcctcttt

SEQ ID NO: 191327 - DNA, 25 bp, Rattus norvegicus
atgattgattgcaaggccagggctg

SEQ ID NO: 191328 - DNA, 25 bp, Rattus norvegicus
atgattgattgctaggccagggctg

SEQ ID NO: 191329 - DNA, 25 bp, Rattus norvegicus
atgattgcaagtagtctctgacctc

SEQ ID NO: 191330 - DNA, 25 bp, Rattus norvegicus
atgattgcaagttgtctctgacctc

SEQ ID NO: 191331 - DNA, 25 bp, Rattus norvegicus
atgattgcacagactgtcactgctg

SEQ ID NO: 191332 - DNA, 25 bp, Rattus norvegicus
atgattgcacagtctgtcactgctg

SEQ ID NO: 191333 - DNA, 25 bp, Rattus norvegicus
atgattgcaccccaatactacgacc

SEQ ID NO: 191334 - DNA, 25 bp, Rattus norvegicus
atgattgcacccgaatactacgacc

SEQ ID NO: 191335 - DNA, 25 bp, Rattus norvegicus
atgattgcatacacaaagcgccttg

SEQ ID NO: 191336 - DNA, 25 bp, Rattus norvegicus
atgattgcatactcaaagcgccttg

SEQ ID NO: 191337 - DNA, 25 bp, Rattus norvegicus
atgattgcatttatccttgggacag

SEQ ID NO: 191338 - DNA, 25 bp, Rattus norvegicus
atgattgcatttttccttgggacag

SEQ ID NO: 191339 - DNA, 25 bp, Rattus norvegicus
atgattgccactagactttatcccc

SEQ ID NO: 191340 - DNA, 25 bp, Rattus norvegicus
atgattgccacttgactttatcccc

SEQ ID NO: 191341 - DNA, 25 bp, Rattus norvegicus
atgattgcctatcatgccctcctgg

SEQ ID NO: 191342 - DNA, 25 bp, Rattus norvegicus
atgattgcctatgatgccctcctgg

SEQ ID NO: 191343 - DNA, 25 bp, Rattus norvegicus
atgattgccttcctcatgggttaca

SEQ ID NO: 191344 - DNA, 25 bp, Rattus norvegicus
atgattgccttcgtcatgggttaca

SEQ ID NO: 191345 - DNA, 25 bp, Rattus norvegicus
atgattgccttgctgtgctaccact

SEQ ID NO: 191346 - DNA, 25 bp, Rattus norvegicus
atgattgccttggtgtgctaccact

SEQ ID NO: 191347 - DNA, 25 bp, Rattus norvegicus
atgattgcgtttctctgggaactac

SEQ ID NO: 191348 - DNA, 25 bp, Rattus norvegicus
atgattgcgtttgtctgggaactac

SEQ ID NO: 191349 - DNA, 25 bp, Rattus norvegicus
atgattgctgcaagtcccaggtcag

SEQ ID NO: 191350 - DNA, 25 bp, Rattus norvegicus
atgattgctgcatgtcccaggtcag

SEQ ID NO: 191351 - DNA, 25 bp, Rattus norvegicus
atgattgcttttcagggcctggaat

SEQ ID NO: 191352 - DNA, 25 bp, Rattus norvegicus
atgattgcttttgagggcctggaat

SEQ ID NO: 191353 - DNA, 25 bp, Rattus norvegicus
atgattggaactatcaagcctccct

SEQ ID NO: 191354 - DNA, 25 bp, Rattus norvegicus
atgattggaactttcaagcctccct

SEQ ID NO: 191355 - DNA, 25 bp, Rattus norvegicus
atgattggagaaactccctgcctgt

SEQ ID NO: 191356 - DNA, 25 bp, Rattus norvegicus
atgattggagaatctccctgcctgt

SEQ ID NO: 191357 - DNA, 25 bp, Rattus norvegicus
atgattggcagaacctcgaggtttc

SEQ ID NO: 191358 - DNA, 25 bp, Rattus norvegicus
atgattggcagatcctcgaggtttc

SEQ ID NO: 191359 - DNA, 25 bp, Rattus norvegicus
atgattgggtacaagccgtggcctc

SEQ ID NO: 191360 - DNA, 25 bp, Rattus norvegicus
atgattgggtactagccgtggcctc

SEQ ID NO: 191361 - DNA, 25 bp, Rattus norvegicus
atgattgtcactcagtcttcctgaa

SEQ ID NO: 191362 - DNA, 25 bp, Rattus norvegicus
atgattgtcactgagtcttcctgaa

SEQ ID NO: 191363 - DNA, 25 bp, Rattus norvegicus
atgattgtctggaaccatttcctcc

SEQ ID NO: 191364 - DNA, 25 bp, Rattus norvegicus
atgattgtctggtaccatttcctcc

SEQ ID NO: 191365 - DNA, 25 bp, Rattus norvegicus
atgattgtgctaaaccacgcccagg

SEQ ID NO: 191366 - DNA, 25 bp, Rattus norvegicus
atgattgtgctataccacgcccagg

SEQ ID NO: 191367 - DNA, 25 bp, Rattus norvegicus
atgattgttagaccatccccattgt

SEQ ID NO: 191368 - DNA, 25 bp, Rattus norvegicus
atgattgttagagcatccccattgt

SEQ ID NO: 191369 - DNA, 25 bp, Rattus norvegicus
atgattgtttatctcccactggcag

SEQ ID NO: 191370 - DNA, 25 bp, Rattus norvegicus
atgattgtttatgtcccactggcag

SEQ ID NO: 191371 - DNA, 25 bp, Rattus norvegicus
atgatttactgtcactcccagcaga

SEQ ID NO: 191372 - DNA, 25 bp, Rattus norvegicus
atgatttactgtgactcccagcaga

SEQ ID NO: 191373 - DNA, 25 bp, Rattus norvegicus
atgatttattcactctctagacaac

SEQ ID NO: 191374 - DNA, 25 bp, Rattus norvegicus
atgatttattcagtctctagacaac

SEQ ID NO: 191375 - DNA, 25 bp, Rattus norvegicus
atgatttcatacagtgcttgcagat

SEQ ID NO: 191376 - DNA, 25 bp, Rattus norvegicus
atgatttcatactgtgcttgcagat

SEQ ID NO: 191377 - DNA, 25 bp, Rattus norvegicus
atgatttccagtcagcatttgtaaa

SEQ ID NO: 191378 - DNA, 25 bp, Rattus norvegicus
atgatttccagtgagcatttgtaaa

SEQ ID NO: 191379 - DNA, 25 bp, Rattus norvegicus
atgatttccctcagtagacaccaac

SEQ ID NO: 191380 - DNA, 25 bp, Rattus norvegicus
atgatttccctctgtagacaccaac

SEQ ID NO: 191381 - DNA, 25 bp, Rattus norvegicus
atgatttcctgtatcgtggctcaaa

SEQ ID NO: 191382 - DNA, 25 bp, Rattus norvegicus
atgatttcctgtttcgtggctcaaa

SEQ ID NO: 191383 - DNA, 25 bp, Rattus norvegicus
atgatttctgcacggtccggtcact

SEQ ID NO: 191384 - DNA, 25 bp, Rattus norvegicus
atgatttctgcagggtccggtcact

SEQ ID NO: 191385 - DNA, 25 bp, Rattus norvegicus
atgatttcttctactcaacaccttc

SEQ ID NO: 191386 - DNA, 25 bp, Rattus norvegicus
atgatttcttcttctcaacaccttc

SEQ ID NO: 191387 - DNA, 25 bp, Rattus norvegicus
atgatttgagctaaggttcctgttg

SEQ ID NO: 191388 - DNA, 25 bp, Rattus norvegicus
atgatttgagcttaggttcctgttg

SEQ ID NO: 191389 - DNA, 25 bp, Rattus norvegicus
atgatttgcactctccattcaaagg

SEQ ID NO: 191390 - DNA, 25 bp, Rattus norvegicus
atgatttgcactgtccattcaaagg

SEQ ID NO: 191391 - DNA, 25 bp, Rattus norvegicus
atgatttggcaaccagcacctcgtt

SEQ ID NO: 191392 - DNA, 25 bp, Rattus norvegicus
atgatttggcaagcagcacctcgtt

SEQ ID NO: 191393 - DNA, 25 bp, Rattus norvegicus
atgatttggctgatagaccatggta

SEQ ID NO: 191394 - DNA, 25 bp, Rattus norvegicus
atgatttggctgttagaccatggta

SEQ ID NO: 191395 - DNA, 25 bp, Rattus norvegicus
atgatttgtaacctgagtgcccttg

SEQ ID NO: 191396 - DNA, 25 bp, Rattus norvegicus
atgatttgtaacgtgagtgcccttg

SEQ ID NO: 191397 - DNA, 25 bp, Rattus norvegicus
atgatttgtgggatccatgcctggc

SEQ ID NO: 191398 - DNA, 25 bp, Rattus norvegicus
atgatttgtgggttccatgcctggc

SEQ ID NO: 191399 - DNA, 25 bp, Rattus norvegicus
atgattttacctatcctatctggag

SEQ ID NO: 191400 - DNA, 25 bp, Rattus norvegicus
atgattttacctttcctatctggag

SEQ ID NO: 191401 - DNA, 25 bp, Rattus norvegicus
atgattttagtcactgatgccccaa

SEQ ID NO: 191402 - DNA, 25 bp, Rattus norvegicus
atgattttagtctctgatgccccaa

SEQ ID NO: 191403 - DNA, 25 bp, Rattus norvegicus
atgattttctttaactcccgcatcg

SEQ ID NO: 191404 - DNA, 25 bp, Rattus norvegicus
atgattttcttttactcccgcatcg

SEQ ID NO: 191405 - DNA, 25 bp, Rattus norvegicus
atgattttgtctccaacactccggg

SEQ ID NO: 191406 - DNA, 25 bp, Rattus norvegicus
atgattttgtctgcaacactccggg

SEQ ID NO: 191407 - DNA, 25 bp, Rattus norvegicus
atgatttttcttaccaaaagcctgg

SEQ ID NO: 191408 - DNA, 25 bp, Rattus norvegicus
atgatttttctttccaaaagcctgg

SEQ ID NO: 191409 - DNA, 25 bp, Rattus norvegicus
atgcaaaaagcaccctatacctgca

SEQ ID NO: 191410 - DNA, 25 bp, Rattus norvegicus
atgcaaaaagcagcctatacctgca

SEQ ID NO: 191411 - DNA, 25 bp, Rattus norvegicus
atgcaaaacatcctgcttacctacc

SEQ ID NO: 191412 - DNA, 25 bp, Rattus norvegicus
atgcaaaacatcgtgcttacctacc

SEQ ID NO: 191413 - DNA, 25 bp, Rattus norvegicus
atgcaaaactgcagagctctccttc

SEQ ID NO: 191414 - DNA, 25 bp, Rattus norvegicus
atgcaaaactgctgagctctccttc

SEQ ID NO: 191415 - DNA, 25 bp, Rattus norvegicus
atgcaaaataggctctgaacggtta

SEQ ID NO: 191416 - DNA, 25 bp, Rattus norvegicus
atgcaaaatagggtctgaacggtta

SEQ ID NO: 191417 - DNA, 25 bp, Rattus norvegicus
atgcaaacagctctctacgcacaca

SEQ ID NO: 191418 - DNA, 25 bp, Rattus norvegicus
atgcaaacagctgtctacgcacaca

SEQ ID NO: 191419 - DNA, 25 bp, Rattus norvegicus
atgcaaaccattaacgggattccta

SEQ ID NO: 191420 - DNA, 25 bp, Rattus norvegicus
atgcaaaccatttacgggattccta

SEQ ID NO: 191421 - DNA, 25 bp, Rattus norvegicus
atgcaaactgcactcaactctgggt

SEQ ID NO: 191422 - DNA, 25 bp, Rattus norvegicus
atgcaaactgcagtcaactctgggt

SEQ ID NO: 191423 - DNA, 25 bp, Rattus norvegicus
atgcaaactgttcagtgaccactgt

SEQ ID NO: 191424 - DNA, 25 bp, Rattus norvegicus
atgcaaactgttgagtgaccactgt

SEQ ID NO: 191425 - DNA, 25 bp, Rattus norvegicus
atgcaaagagccaaagcccagtttt

SEQ ID NO: 191426 - DNA, 25 bp, Rattus norvegicus
atgcaaagagccatttttcttcccc

SEQ ID NO: 191427 - DNA, 25 bp, Rattus norvegicus
atgcaaagagcctaagcccagtttt

SEQ ID NO: 191428 - DNA, 25 bp, Rattus norvegicus
atgcaaagagccttttttcttcccc

SEQ ID NO: 191429 - DNA, 25 bp, Rattus norvegicus
atgcaaagcccaatcctgctcagtt

SEQ ID NO: 191430 - DNA, 25 bp, Rattus norvegicus
atgcaaagcccattcctgctcagtt

SEQ ID NO: 191431 - DNA, 25 bp, Rattus norvegicus
atgcaaagccggatgcaatctttta

SEQ ID NO: 191432 - DNA, 25 bp, Rattus norvegicus
atgcaaagccggttgcaatctttta

SEQ ID NO: 191433 - DNA, 25 bp, Rattus norvegicus
atgcaaagcgatcgccagctgtctc

SEQ ID NO: 191434 - DNA, 25 bp, Rattus norvegicus
atgcaaagcgatggccagctgtctc

SEQ ID NO: 191435 - DNA, 25 bp, Rattus norvegicus
atgcaaaggtcaagctgtgccagca

SEQ ID NO: 191436 - DNA, 25 bp, Rattus norvegicus
atgcaaaggtcatgctgtgccagca

SEQ ID NO: 191437 - DNA, 25 bp, Rattus norvegicus
atgcaaaggtgcatccagaccagcc

SEQ ID NO: 191438 - DNA, 25 bp, Rattus norvegicus
atgcaaaggtgcttccagaccagcc

SEQ ID NO: 191439 - DNA, 25 bp, Rattus norvegicus
atgcaaagtcccaatgccctttttt

SEQ ID NO: 191440 - DNA, 25 bp, Rattus norvegicus
atgcaaagtccctatgccctttttt

SEQ ID NO: 191441 - DNA, 25 bp, Rattus norvegicus
atgcaaagtgctaccttcagacaga

SEQ ID NO: 191442 - DNA, 25 bp, Rattus norvegicus
atgcaaagtgcttccttcagacaga

SEQ ID NO: 191443 - DNA, 25 bp, Rattus norvegicus
atgcaaatagtcagctgcccgtatg

SEQ ID NO: 191444 - DNA, 25 bp, Rattus norvegicus
atgcaaatagtctgctgcccgtatg

SEQ ID NO: 191445 - DNA, 25 bp, Rattus norvegicus
atgcaaatcgggatcccatttgaaa

SEQ ID NO: 191446 - DNA, 25 bp, Rattus norvegicus
atgcaaatcgggttcccatttgaaa

SEQ ID NO: 191447 - DNA, 25 bp, Rattus norvegicus
atgcaaattaagaatccccgagctg

SEQ ID NO: 191448 - DNA, 25 bp, Rattus norvegicus
atgcaaattaagtatccccgagctg

SEQ ID NO: 191449 - DNA, 25 bp, Rattus norvegicus
atgcaacaatcacattgcctttgtg

SEQ ID NO: 191450 - DNA, 25 bp, Rattus norvegicus
atgcaacaatcagattgcctttgtg

SEQ ID NO: 191451 - DNA, 25 bp, Rattus norvegicus
atgcaacacgggagcttcgcaccag

SEQ ID NO: 191452 - DNA, 25 bp, Rattus norvegicus
atgcaacacgggtgcttcgcaccag

SEQ ID NO: 191453 - DNA, 25 bp, Rattus norvegicus
atgcaacaggcacgctccagtggct

SEQ ID NO: 191454 - DNA, 25 bp, Rattus norvegicus
atgcaacaggcaggctccagtggct

SEQ ID NO: 191455 - DNA, 25 bp, Rattus norvegicus
atgcaacattgccatagagccgagg

SEQ ID NO: 191456 - DNA, 25 bp, Rattus norvegicus
atgcaacattgcgatagagccgagg

SEQ ID NO: 191457 - DNA, 25 bp, Rattus norvegicus
atgcaaccagtgaaaggcccctaag

SEQ ID NO: 191458 - DNA, 25 bp, Rattus norvegicus
atgcaaccagtgtaaggcccctaag

SEQ ID NO: 191459 - DNA, 25 bp, Rattus norvegicus
atgcaaccccaaacacaagcaaaat

SEQ ID NO: 191460 - DNA, 25 bp, Rattus norvegicus
atgcaaccccaatcacaagcaaaat

SEQ ID NO: 191461 - DNA, 25 bp, Rattus norvegicus
atgcaacccggactctgcgggacct

SEQ ID NO: 191462 - DNA, 25 bp, Rattus norvegicus
atgcaacccggagtctgcgggacct

SEQ ID NO: 191463 - DNA, 25 bp, Rattus norvegicus
atgcaaccctgaccaacactgaagc

SEQ ID NO: 191464 - DNA, 25 bp, Rattus norvegicus
atgcaaccctgagcaacactgaagc

SEQ ID NO: 191465 - DNA, 25 bp, Rattus norvegicus
atgcaaccctgccaagtcggagaag

SEQ ID NO: 191466 - DNA, 25 bp, Rattus norvegicus
atgcaaccctgcgaagtcggagaag

SEQ ID NO: 191467 - DNA, 25 bp, Rattus norvegicus
atgcaaccggtcattacaggtccaa

SEQ ID NO: 191468 - DNA, 25 bp, Rattus norvegicus
atgcaaccggtctttacaggtccaa

SEQ ID NO: 191469 - DNA, 25 bp, Rattus norvegicus
atgcaaccgtgtacagacagtggcc

SEQ ID NO: 191470 - DNA, 25 bp, Rattus norvegicus
atgcaaccgtgtcttctgattgcca

SEQ ID NO: 191471 - DNA, 25 bp, Rattus norvegicus
atgcaaccgtgtgttctgattgcca

SEQ ID NO: 191472 - DNA, 25 bp, Rattus norvegicus
atgcaaccgtgttcagacagtggcc

SEQ ID NO: 191473 - DNA, 25 bp, Rattus norvegicus
atgcaacctgcaacagttcatccag

SEQ ID NO: 191474 - DNA, 25 bp, Rattus norvegicus
atgcaacctgcatcagttcatccag

SEQ ID NO: 191475 - DNA, 25 bp, Rattus norvegicus
atgcaactcaaccacagttagctgg

SEQ ID NO: 191476 - DNA, 25 bp, Rattus norvegicus
atgcaactcaacgacagttagctgg

SEQ ID NO: 191477 - DNA, 25 bp, Rattus norvegicus
atgcaactcattagcaccagtacct

SEQ ID NO: 191478 - DNA, 25 bp, Rattus norvegicus
atgcaactcatttgcaccagtacct

SEQ ID NO: 191479 - DNA, 25 bp, Rattus norvegicus
atgcaactcctgctgtcaaggctga

SEQ ID NO: 191480 - DNA, 25 bp, Rattus norvegicus
atgcaactcctggtgtcaaggctga

SEQ ID NO: 191481 - DNA, 25 bp, Rattus norvegicus
atgcaactctggctgaggttccaag

SEQ ID NO: 191482 - DNA, 25 bp, Rattus norvegicus
atgcaactctgggtgaggttccaag

SEQ ID NO: 191483 - DNA, 25 bp, Rattus norvegicus
atgcaactgcagctcacaaagcgga

SEQ ID NO: 191484 - DNA, 25 bp, Rattus norvegicus
atgcaactgcaggtcacaaagcgga

SEQ ID NO: 191485 - DNA, 25 bp, Rattus norvegicus
atgcaactgtcgcttgctggtgctg

SEQ ID NO: 191486 - DNA, 25 bp, Rattus norvegicus
atgcaactgtcggttgctggtgctg

SEQ ID NO: 191487 - DNA, 25 bp, Rattus norvegicus
atgcaacttcgtatctttttaactg

SEQ ID NO: 191488 - DNA, 25 bp, Rattus norvegicus
atgcaacttcgtttctttttaactg

SEQ ID NO: 191489 - DNA, 25 bp, Rattus norvegicus
atgcaagaacctatcactcactgtc

SEQ ID NO: 191490 - DNA, 25 bp, Rattus norvegicus
atgcaagaacctttcactcactgtc

SEQ ID NO: 191491 - DNA, 25 bp, Rattus norvegicus
atgcaagaataccagctagaacaga

SEQ ID NO: 191492 - DNA, 25 bp, Rattus norvegicus
atgcaagaatacgagctagaacaga

SEQ ID NO: 191493 - DNA, 25 bp, Rattus norvegicus
atgcaagaatgtcgtgcctctctat

SEQ ID NO: 191494 - DNA, 25 bp, Rattus norvegicus
atgcaagaatgtggtgcctctctat

SEQ ID NO: 191495 - DNA, 25 bp, Rattus norvegicus
atgcaagagcataatttcccttctg

SEQ ID NO: 191496 - DNA, 25 bp, Rattus norvegicus
atgcaagagcattatttcccttctg

SEQ ID NO: 191497 - DNA, 25 bp, Rattus norvegicus
atgcaagagctcagcaccatccaca

SEQ ID NO: 191498 - DNA, 25 bp, Rattus norvegicus
atgcaagagctctgcaccatccaca

SEQ ID NO: 191499 - DNA, 25 bp, Rattus norvegicus
atgcaagcacagattgtttaccaat

SEQ ID NO: 191500 - DNA, 25 bp, Rattus norvegicus
atgcaagcacagtttgtttaccaat

SEQ ID NO: 191501 - DNA, 25 bp, Rattus norvegicus
atgcaagcattgatctctgagtgta

SEQ ID NO: 191502 - DNA, 25 bp, Rattus norvegicus
atgcaagcattgttctctgagtgta

SEQ ID NO: 191503 - DNA, 25 bp, Rattus norvegicus
atgcaagcctcgagtggcaggcgtt

SEQ ID NO: 191504 - DNA, 25 bp, Rattus norvegicus
atgcaagcctcgtgtggcaggcgtt

SEQ ID NO: 191505 - DNA, 25 bp, Rattus norvegicus
atgcaagcgtaacgacactgcctgg

SEQ ID NO: 191506 - DNA, 25 bp, Rattus norvegicus
atgcaagcgtaaggacactgcctgg

SEQ ID NO: 191507 - DNA, 25 bp, Rattus norvegicus
atgcaagctcgaaggacgccatcaa

SEQ ID NO: 191508 - DNA, 25 bp, Rattus norvegicus
atgcaagctcgatggacgccatcaa

SEQ ID NO: 191509 - DNA, 25 bp, Rattus norvegicus
atgcaaggaaccagaacaatgacat

SEQ ID NO: 191510 - DNA, 25 bp, Rattus norvegicus
atgcaaggaaccatctcctgtgtcc

SEQ ID NO: 191511 - DNA, 25 bp, Rattus norvegicus
atgcaaggaacctgaacaatgacat

SEQ ID NO: 191512 - DNA, 25 bp, Rattus norvegicus
atgcaaggaaccttctcctgtgtcc

SEQ ID NO: 191513 - DNA, 25 bp, Rattus norvegicus
atgcaaggactccacccagaaaggt

SEQ ID NO: 191514 - DNA, 25 bp, Rattus norvegicus
atgcaaggactcgacccagaaaggt

SEQ ID NO: 191515 - DNA, 25 bp, Rattus norvegicus
atgcaaggacttagcagggaccctc

SEQ ID NO: 191516 - DNA, 25 bp, Rattus norvegicus
atgcaaggactttgcagggaccctc

SEQ ID NO: 191517 - DNA, 25 bp, Rattus norvegicus
atgcaaggctacatttttcattaac

SEQ ID NO: 191518 - DNA, 25 bp, Rattus norvegicus
atgcaaggctacttttttcattaac

SEQ ID NO: 191519 - DNA, 25 bp, Rattus norvegicus
atgcaaggctcaatttgtccactgt

SEQ ID NO: 191520 - DNA, 25 bp, Rattus norvegicus
atgcaaggctcattttgtccactgt

SEQ ID NO: 191521 - DNA, 25 bp, Rattus norvegicus
atgcaagtcacacagctgttggaat

SEQ ID NO: 191522 - DNA, 25 bp, Rattus norvegicus
atgcaagtcacagagctgttggaat

SEQ ID NO: 191523 - DNA, 25 bp, Rattus norvegicus
atgcaagtcgcaattaccgatccca

SEQ ID NO: 191524 - DNA, 25 bp, Rattus norvegicus
atgcaagtcgcatttaccgatccca

SEQ ID NO: 191525 - DNA, 25 bp, Rattus norvegicus
atgcaagtctccatgtacctctaga

SEQ ID NO: 191526 - DNA, 25 bp, Rattus norvegicus
atgcaagtctccttgtacctctaga

SEQ ID NO: 191527 - DNA, 25 bp, Rattus norvegicus
atgcaagtctctacatcataacgaa

SEQ ID NO: 191528 - DNA, 25 bp, Rattus norvegicus
atgcaagtctcttcatcataacgaa

SEQ ID NO: 191529 - DNA, 25 bp, Rattus norvegicus
atgcaagtggcaaccctaaaacctg

SEQ ID NO: 191530 - DNA, 25 bp, Rattus norvegicus
atgcaagtggcatccctaaaacctg

SEQ ID NO: 191531 - DNA, 25 bp, Rattus norvegicus
atgcaagtggttactccgggacaga

SEQ ID NO: 191532 - DNA, 25 bp, Rattus norvegicus
atgcaagtggtttctccgggacaga

SEQ ID NO: 191533 - DNA, 25 bp, Rattus norvegicus
atgcaagtgtttcgttcccacgttt

SEQ ID NO: 191534 - DNA, 25 bp, Rattus norvegicus
atgcaagtgtttggttcccacgttt

SEQ ID NO: 191535 - DNA, 25 bp, Rattus norvegicus
atgcaagttctaagcaataacctgc

SEQ ID NO: 191536 - DNA, 25 bp, Rattus norvegicus
atgcaagttctatgcaataacctgc

SEQ ID NO: 191537 - DNA, 25 bp, Rattus norvegicus
atgcaataatgacctgtaacctgga

SEQ ID NO: 191538 - DNA, 25 bp, Rattus norvegicus
atgcaataatgagctgtaacctgga

SEQ ID NO: 191539 - DNA, 25 bp, Rattus norvegicus
atgcaatacaagagtgtccgcctca

SEQ ID NO: 191540 - DNA, 25 bp, Rattus norvegicus
atgcaatacaagtgtgtccgcctca

SEQ ID NO: 191541 - DNA, 25 bp, Rattus norvegicus
atgcaatacgtgaaccaatttggac

SEQ ID NO: 191542 - DNA, 25 bp, Rattus norvegicus
atgcaatacgtgtaccaatttggac

SEQ ID NO: 191543 - DNA, 25 bp, Rattus norvegicus
atgcaatcacctatgggtgtccata

SEQ ID NO: 191544 - DNA, 25 bp, Rattus norvegicus
atgcaatcacctttgggtgtccata

SEQ ID NO: 191545 - DNA, 25 bp, Rattus norvegicus
atgcaatcagcgctctgtgaacaat

SEQ ID NO: 191546 - DNA, 25 bp, Rattus norvegicus
atgcaatcagcggtctgtgaacaat

SEQ ID NO: 191547 - DNA, 25 bp, Rattus norvegicus
atgcaatccacccaggcagaggtcg

SEQ ID NO: 191548 - DNA, 25 bp, Rattus norvegicus
atgcaatccaccgaggcagaggtcg

SEQ ID NO: 191549 - DNA, 25 bp, Rattus norvegicus
atgcaatccgcacaggtcgcgccgg

SEQ ID NO: 191550 - DNA, 25 bp, Rattus norvegicus
atgcaatccgcagaggtcgcgccgg

SEQ ID NO: 191551 - DNA, 25 bp, Rattus norvegicus
atgcaatctggtaagtttcactatg

SEQ ID NO: 191552 - DNA, 25 bp, Rattus norvegicus
atgcaatctggttagtttcactatg

SEQ ID NO: 191553 - DNA, 25 bp, Rattus norvegicus
atgcaatgacctacaccttagtggg

SEQ ID NO: 191554 - DNA, 25 bp, Rattus norvegicus
atgcaatgaccttcaccttagtggg

SEQ ID NO: 191555 - DNA, 25 bp, Rattus norvegicus
atgcaatgcagaagttctccccgta

SEQ ID NO: 191556 - DNA, 25 bp, Rattus norvegicus
atgcaatgcagatgttctccccgta

SEQ ID NO: 191557 - DNA, 25 bp, Rattus norvegicus
atgcaatgccagattgggacctgaa

SEQ ID NO: 191558 - DNA, 25 bp, Rattus norvegicus
atgcaatgccagtttgggacctgaa

SEQ ID NO: 191559 - DNA, 25 bp, Rattus norvegicus
atgcaatgcgtacactgagctgaac

SEQ ID NO: 191560 - DNA, 25 bp, Rattus norvegicus
atgcaatgcgtagactgagctgaac

SEQ ID NO: 191561 - DNA, 25 bp, Rattus norvegicus
atgcaatggagtctgcactgcactt

SEQ ID NO: 191562 - DNA, 25 bp, Rattus norvegicus
atgcaatggagtgtgcactgcactt

SEQ ID NO: 191563 - DNA, 25 bp, Rattus norvegicus
atgcaatgtgacaagctacctcaag

SEQ ID NO: 191564 - DNA, 25 bp, Rattus norvegicus
atgcaatgtgactagctacctcaag

SEQ ID NO: 191565 - DNA, 25 bp, Rattus norvegicus
atgcaatgtgtacgtcttcctttta

SEQ ID NO: 191566 - DNA, 25 bp, Rattus norvegicus
atgcaatgtgtaggtcttcctttta

SEQ ID NO: 191567 - DNA, 25 bp, Rattus norvegicus
atgcaatgtgttcatcttcctttca

SEQ ID NO: 191568 - DNA, 25 bp, Rattus norvegicus
atgcaatgtgttgatcttcctttca

SEQ ID NO: 191569 - DNA, 25 bp, Rattus norvegicus
atgcaattatacactctgctctctt

SEQ ID NO: 191570 - DNA, 25 bp, Rattus norvegicus
atgcaattatactctctgctctctt

SEQ ID NO: 191571 - DNA, 25 bp, Rattus norvegicus
atgcaattccttaaccgatgtctgt

SEQ ID NO: 191572 - DNA, 25 bp, Rattus norvegicus
atgcaattcctttaccgatgtctgt

SEQ ID NO: 191573 - DNA, 25 bp, Rattus norvegicus
atgcaattctatacacttgtggatg

SEQ ID NO: 191574 - DNA, 25 bp, Rattus norvegicus
atgcaattctattcacttgtggatg

SEQ ID NO: 191575 - DNA, 25 bp, Rattus norvegicus
atgcaattgggactgctctggtcca

SEQ ID NO: 191576 - DNA, 25 bp, Rattus norvegicus
atgcaattgggagtgctctggtcca

SEQ ID NO: 191577 - DNA, 25 bp, Rattus norvegicus
atgcacaaacatccacgcacacaga

SEQ ID NO: 191578 - DNA, 25 bp, Rattus norvegicus
atgcacaaacatgcacgcacacaga

SEQ ID NO: 191579 - DNA, 25 bp, Rattus norvegicus
atgcacaaagttcctgaggctccac

SEQ ID NO: 191580 - DNA, 25 bp, Rattus norvegicus
atgcacaaagttgctgaggctccac

SEQ ID NO: 191581 - DNA, 25 bp, Rattus norvegicus
atgcacaacccgaacttttgtttga

SEQ ID NO: 191582 - DNA, 25 bp, Rattus norvegicus
atgcacaacccgtacttttgtttga

SEQ ID NO: 191583 - DNA, 25 bp, Rattus norvegicus
atgcacaatcctcgtggctggagct

SEQ ID NO: 191584 - DNA, 25 bp, Rattus norvegicus
atgcacaatcctggtggctggagct

SEQ ID NO: 191585 - DNA, 25 bp, Rattus norvegicus
atgcacacacatctgagccttcaca

SEQ ID NO: 191586 - DNA, 25 bp, Rattus norvegicus
atgcacacacatctgcgtagccctg

SEQ ID NO: 191587 - DNA, 25 bp, Rattus norvegicus
atgcacacacatgtgagccttcaca

SEQ ID NO: 191588 - DNA, 25 bp, Rattus norvegicus
atgcacacacatgtgcgtagccctg

SEQ ID NO: 191589 - DNA, 25 bp, Rattus norvegicus
atgcacacaccacagcttctggaat

SEQ ID NO: 191590 - DNA, 25 bp, Rattus norvegicus
atgcacacaccagagcttctggaat

SEQ ID NO: 191591 - DNA, 25 bp, Rattus norvegicus
atgcacacagacaatgccctgtacg

SEQ ID NO: 191592 - DNA, 25 bp, Rattus norvegicus
atgcacacagactatgccctgtacg

SEQ ID NO: 191593 - DNA, 25 bp, Rattus norvegicus
atgcacacaggccttggacttggct

SEQ ID NO: 191594 - DNA, 25 bp, Rattus norvegicus
atgcacacaggcgttggacttggct

SEQ ID NO: 191595 - DNA, 25 bp, Rattus norvegicus
atgcacacagggaacagaggctgaa

SEQ ID NO: 191596 - DNA, 25 bp, Rattus norvegicus
atgcacacagggtacagaggctgaa

SEQ ID NO: 191597 - DNA, 25 bp, Rattus norvegicus
atgcacaccgcaaggaagactgcct

SEQ ID NO: 191598 - DNA, 25 bp, Rattus norvegicus
atgcacaccgcatggaagactgcct

SEQ ID NO: 191599 - DNA, 25 bp, Rattus norvegicus
atgcacaccttcaaaggaggccact

SEQ ID NO: 191600 - DNA, 25 bp, Rattus norvegicus
atgcacaccttctaaggaggccact

SEQ ID NO: 191601 - DNA, 25 bp, Rattus norvegicus
atgcacacgcagacacagtgcacac

SEQ ID NO: 191602 - DNA, 25 bp, Rattus norvegicus
atgcacacgcagtcacagtgcacac

SEQ ID NO: 191603 - DNA, 25 bp, Rattus norvegicus
atgcacacgcttcttaactagtttt

SEQ ID NO: 191604 - DNA, 25 bp, Rattus norvegicus
atgcacacgcttgttaactagtttt

SEQ ID NO: 191605 - DNA, 25 bp, Rattus norvegicus
atgcacacgtcacattcctttctaa

SEQ ID NO: 191606 - DNA, 25 bp, Rattus norvegicus
atgcacacgtcagattcctttctaa

SEQ ID NO: 191607 - DNA, 25 bp, Rattus norvegicus
atgcacactcttagggacaatcagt

SEQ ID NO: 191608 - DNA, 25 bp, Rattus norvegicus
atgcacactctttgggacaatcagt

SEQ ID NO: 191609 - DNA, 25 bp, Rattus norvegicus
atgcacactgttcatttttccagcc

SEQ ID NO: 191610 - DNA, 25 bp, Rattus norvegicus
atgcacactgttgatttttccagcc

SEQ ID NO: 191611 - DNA, 25 bp, Rattus norvegicus
atgcacacttcacatgatgctgccc

SEQ ID NO: 191612 - DNA, 25 bp, Rattus norvegicus
atgcacacttcagatgatgctgccc

SEQ ID NO: 191613 - DNA, 25 bp, Rattus norvegicus
atgcacactttaacttttattgtac

SEQ ID NO: 191614 - DNA, 25 bp, Rattus norvegicus
atgcacactttatcttttattgtac

SEQ ID NO: 191615 - DNA, 25 bp, Rattus norvegicus
atgcacagacatacaacttggaagg

SEQ ID NO: 191616 - DNA, 25 bp, Rattus norvegicus
atgcacagacattcaacttggaagg

SEQ ID NO: 191617 - DNA, 25 bp, Rattus norvegicus
atgcacagagagaggacgatcagcg

SEQ ID NO: 191618 - DNA, 25 bp, Rattus norvegicus
atgcacagagagtggacgatcagcg

SEQ ID NO: 191619 - DNA, 25 bp, Rattus norvegicus
atgcacagaggtctctgctgctttc

SEQ ID NO: 191620 - DNA, 25 bp, Rattus norvegicus
atgcacagaggtgtctgctgctttc

SEQ ID NO: 191621 - DNA, 25 bp, Rattus norvegicus
atgcacagcagcctgtctcgcacag

SEQ ID NO: 191622 - DNA, 25 bp, Rattus norvegicus
atgcacagcagcgtgtctcgcacag

SEQ ID NO: 191623 - DNA, 25 bp, Rattus norvegicus
atgcacagccaactgtcagctgagt

SEQ ID NO: 191624 - DNA, 25 bp, Rattus norvegicus
atgcacagccaagtgtcagctgagt

SEQ ID NO: 191625 - DNA, 25 bp, Rattus norvegicus
atgcacagccggaagcacactggtg

SEQ ID NO: 191626 - DNA, 25 bp, Rattus norvegicus
atgcacagccggtagcacactggtg

SEQ ID NO: 191627 - DNA, 25 bp, Rattus norvegicus
atgcacagcgttcgacattagccta

SEQ ID NO: 191628 - DNA, 25 bp, Rattus norvegicus
atgcacagcgttggacattagccta

SEQ ID NO: 191629 - DNA, 25 bp, Rattus norvegicus
atgcacagctgaccaaagccatgtc

SEQ ID NO: 191630 - DNA, 25 bp, Rattus norvegicus
atgcacagctgagcaaagccatgtc

SEQ ID NO: 191631 - DNA, 25 bp, Rattus norvegicus
atgcacaggaggctttagtccccag

SEQ ID NO: 191632 - DNA, 25 bp, Rattus norvegicus
atgcacaggagggtttagtccccag

SEQ ID NO: 191633 - DNA, 25 bp, Rattus norvegicus
atgcacaggcccacggttaagatca

SEQ ID NO: 191634 - DNA, 25 bp, Rattus norvegicus
atgcacaggccctcggttaagatca

SEQ ID NO: 191635 - DNA, 25 bp, Rattus norvegicus
atgcacaggttgatcatggtcccat

SEQ ID NO: 191636 - DNA, 25 bp, Rattus norvegicus
atgcacaggttgttcatggtcccat

SEQ ID NO: 191637 - DNA, 25 bp, Rattus norvegicus
atgcacagtcagcagagaaagccgt

SEQ ID NO: 191638 - DNA, 25 bp, Rattus norvegicus
atgcacagtcaggagagaaagccgt

SEQ ID NO: 191639 - DNA, 25 bp, Rattus norvegicus
atgcacagtcttattatatcttatg

SEQ ID NO: 191640 - DNA, 25 bp, Rattus norvegicus
atgcacagtctttttatatcttatg

SEQ ID NO: 191641 - DNA, 25 bp, Rattus norvegicus
atgcacagtgatcatcctcatcttg

SEQ ID NO: 191642 - DNA, 25 bp, Rattus norvegicus
atgcacagtgatgatcctcatcttg

SEQ ID NO: 191643 - DNA, 25 bp, Rattus norvegicus
atgcacagtgcaccgccagtagcaa

SEQ ID NO: 191644 - DNA, 25 bp, Rattus norvegicus
atgcacagtgcagcgccagtagcaa

SEQ ID NO: 191645 - DNA, 25 bp, Rattus norvegicus
atgcacagttcccatagaggccaaa

SEQ ID NO: 191646 - DNA, 25 bp, Rattus norvegicus
atgcacagttccgatagaggccaaa

SEQ ID NO: 191647 - DNA, 25 bp, Rattus norvegicus
atgcacatacacaggtacgcgttag

SEQ ID NO: 191648 - DNA, 25 bp, Rattus norvegicus
atgcacatacactggtacgcgttag

SEQ ID NO: 191649 - DNA, 25 bp, Rattus norvegicus
atgcacatacatactctctctttct

SEQ ID NO: 191650 - DNA, 25 bp, Rattus norvegicus
atgcacatacattctctctctttct

SEQ ID NO: 191651 - DNA, 25 bp, Rattus norvegicus
atgcacatagtacggctctgagcgt

SEQ ID NO: 191652 - DNA, 25 bp, Rattus norvegicus
atgcacatagtagggctctgagcgt

SEQ ID NO: 191653 - DNA, 25 bp, Rattus norvegicus
atgcacatcaccagaaccattttac

SEQ ID NO: 191654 - DNA, 25 bp, Rattus norvegicus
atgcacatcacctgaaccattttac

SEQ ID NO: 191655 - DNA, 25 bp, Rattus norvegicus
atgcacatgagtctttctctgtcga

SEQ ID NO: 191656 - DNA, 25 bp, Rattus norvegicus
atgcacatgagtgtttctctgtcga

SEQ ID NO: 191657 - DNA, 25 bp, Rattus norvegicus
atgcacatgcatactttcctgtggg

SEQ ID NO: 191658 - DNA, 25 bp, Rattus norvegicus
atgcacatgcatcctcctatagata

SEQ ID NO: 191659 - DNA, 25 bp, Rattus norvegicus
atgcacatgcatgctcctatagata

SEQ ID NO: 191660 - DNA, 25 bp, Rattus norvegicus
atgcacatgcattctttcctgtggg

SEQ ID NO: 191661 - DNA, 25 bp, Rattus norvegicus
atgcacatgtagactcagccaccag

SEQ ID NO: 191662 - DNA, 25 bp, Rattus norvegicus
atgcacatgtagtctcagccaccag

SEQ ID NO: 191663 - DNA, 25 bp, Rattus norvegicus
atgcacatgtgcactttatacaatt

SEQ ID NO: 191664 - DNA, 25 bp, Rattus norvegicus
atgcacatgtgctctttatacaatt

SEQ ID NO: 191665 - DNA, 25 bp, Rattus norvegicus
atgcacatgtgtcctttgactacag

SEQ ID NO: 191666 - DNA, 25 bp, Rattus norvegicus
atgcacatgtgtgctttgactacag

SEQ ID NO: 191667 - DNA, 25 bp, Rattus norvegicus
atgcacattaggaaatccctggaaa

SEQ ID NO: 191668 - DNA, 25 bp, Rattus norvegicus
atgcacattaggtaatccctggaaa

SEQ ID NO: 191669 - DNA, 25 bp, Rattus norvegicus
atgcacattatcagttttccagtcc

SEQ ID NO: 191670 - DNA, 25 bp, Rattus norvegicus
atgcacattatctgttttccagtcc

SEQ ID NO: 191671 - DNA, 25 bp, Rattus norvegicus
atgcacattcaaaacttcctccatg

SEQ ID NO: 191672 - DNA, 25 bp, Rattus norvegicus
atgcacattcaatacttcctccatg

SEQ ID NO: 191673 - DNA, 25 bp, Rattus norvegicus
atgcacattgctatcttggactgta

SEQ ID NO: 191674 - DNA, 25 bp, Rattus norvegicus
atgcacattgctttcttggactgta

SEQ ID NO: 191675 - DNA, 25 bp, Rattus norvegicus
atgcacatttagagccttaagggcc

SEQ ID NO: 191676 - DNA, 25 bp, Rattus norvegicus
atgcacatttagtgccttaagggcc

SEQ ID NO: 191677 - DNA, 25 bp, Rattus norvegicus
atgcaccaagccctggttctgtctt

SEQ ID NO: 191678 - DNA, 25 bp, Rattus norvegicus
atgcaccaagccgtggttctgtctt

SEQ ID NO: 191679 - DNA, 25 bp, Rattus norvegicus
atgcaccaaggtatcctctgggaga

SEQ ID NO: 191680 - DNA, 25 bp, Rattus norvegicus
atgcaccaaggtttcctctgggaga

SEQ ID NO: 191681 - DNA, 25 bp, Rattus norvegicus
atgcaccaatggactttcctctaaa

SEQ ID NO: 191682 - DNA, 25 bp, Rattus norvegicus
atgcaccaatggtctttcctctaaa

SEQ ID NO: 191683 - DNA, 25 bp, Rattus norvegicus
atgcaccaccatctctggtctgtac

SEQ ID NO: 191684 - DNA, 25 bp, Rattus norvegicus
atgcaccaccatgtctggtctgtac

SEQ ID NO: 191685 - DNA, 25 bp, Rattus norvegicus
atgcaccaggccacatttaccaaat

SEQ ID NO: 191686 - DNA, 25 bp, Rattus norvegicus
atgcaccaggcctcatttaccaaat

SEQ ID NO: 191687 - DNA, 25 bp, Rattus norvegicus
atgcaccagggtcaggactcagtgt

SEQ ID NO: 191688 - DNA, 25 bp, Rattus norvegicus
atgcaccagggtgaggactcagtgt

SEQ ID NO: 191689 - DNA, 25 bp, Rattus norvegicus
atgcaccatgatctgcaagagcaca

SEQ ID NO: 191690 - DNA, 25 bp, Rattus norvegicus
atgcaccatgatgtgcaagagcaca

SEQ ID NO: 191691 - DNA, 25 bp, Rattus norvegicus
atgcaccattaactcataaaccttt

SEQ ID NO: 191692 - DNA, 25 bp, Rattus norvegicus
atgcaccattaagtcataaaccttt

SEQ ID NO: 191693 - DNA, 25 bp, Rattus norvegicus
atgcacccacgcaggagagcaaggt

SEQ ID NO: 191694 - DNA, 25 bp, Rattus norvegicus
atgcacccacgctggagagcaaggt

SEQ ID NO: 191695 - DNA, 25 bp, Rattus norvegicus
atgcacccactacgcctatgtaata

SEQ ID NO: 191696 - DNA, 25 bp, Rattus norvegicus
atgcacccactaggcctatgtaata

SEQ ID NO: 191697 - DNA, 25 bp, Rattus norvegicus
atgcacccagcgcattcctgtgact

SEQ ID NO: 191698 - DNA, 25 bp, Rattus norvegicus
atgcacccagcggattcctgtgact

SEQ ID NO: 191699 - DNA, 25 bp, Rattus norvegicus
atgcacccagctatttcaagaatgt

SEQ ID NO: 191700 - DNA, 25 bp, Rattus norvegicus
atgcacccagctttttcaagaatgt

SEQ ID NO: 191701 - DNA, 25 bp, Rattus norvegicus
atgcacccaggtctggtccgcaagc

SEQ ID NO: 191702 - DNA, 25 bp, Rattus norvegicus
atgcacccaggtgtggtccgcaagc

SEQ ID NO: 191703 - DNA, 25 bp, Rattus norvegicus
atgcacccagtgacctcttgtatga

SEQ ID NO: 191704 - DNA, 25 bp, Rattus norvegicus
atgcacccagtgtcctcttgtatga

SEQ ID NO: 191705 - DNA, 25 bp, Rattus norvegicus
atgcaccccagcacttaaatgaaaa

SEQ ID NO: 191706 - DNA, 25 bp, Rattus norvegicus
atgcaccccagctcttaaatgaaaa

SEQ ID NO: 191707 - DNA, 25 bp, Rattus norvegicus
atgcaccctgtaagacactgcagta

SEQ ID NO: 191708 - DNA, 25 bp, Rattus norvegicus
atgcaccctgtatgacactgcagta

SEQ ID NO: 191709 - DNA, 25 bp, Rattus norvegicus
atgcaccctttcaggctcaggcttg

SEQ ID NO: 191710 - DNA, 25 bp, Rattus norvegicus
atgcaccctttctggctcaggcttg

SEQ ID NO: 191711 - DNA, 25 bp, Rattus norvegicus
atgcaccgatggcaagctgctccca

SEQ ID NO: 191712 - DNA, 25 bp, Rattus norvegicus
atgcaccgatgggaagctgctccca

SEQ ID NO: 191713 - DNA, 25 bp, Rattus norvegicus
atgcaccgccagatgcacctgtgac

SEQ ID NO: 191714 - DNA, 25 bp, Rattus norvegicus
atgcaccgccagttgcacctgtgac

SEQ ID NO: 191715 - DNA, 25 bp, Rattus norvegicus
atgcaccgtagcatgcttaatcctc

SEQ ID NO: 191716 - DNA, 25 bp, Rattus norvegicus
atgcaccgtagcttgcttaatcctc

SEQ ID NO: 191717 - DNA, 25 bp, Rattus norvegicus
atgcaccgttctacattttcggagt

SEQ ID NO: 191718 - DNA, 25 bp, Rattus norvegicus
atgcaccgttcttcattttcggagt

SEQ ID NO: 191719 - DNA, 25 bp, Rattus norvegicus
atgcacctagccacagaggagctcc

SEQ ID NO: 191720 - DNA, 25 bp, Rattus norvegicus
atgcacctagcctcagaggagctcc

SEQ ID NO: 191721 - DNA, 25 bp, Rattus norvegicus
atgcacctcaacctcaggtatctga

SEQ ID NO: 191722 - DNA, 25 bp, Rattus norvegicus
atgcacctcaacgtcaggtatctga

SEQ ID NO: 191723 - DNA, 25 bp, Rattus norvegicus
atgcacctcaatcccacattgcgag

SEQ ID NO: 191724 - DNA, 25 bp, Rattus norvegicus
atgcacctcaatgccacattgcgag

SEQ ID NO: 191725 - DNA, 25 bp, Rattus norvegicus
atgcacctccatcgcttcggaagga

SEQ ID NO: 191726 - DNA, 25 bp, Rattus norvegicus
atgcacctccatggcttcggaagga

SEQ ID NO: 191727 - DNA, 25 bp, Rattus norvegicus
atgcacctctcgcagaactcttgaa

SEQ ID NO: 191728 - DNA, 25 bp, Rattus norvegicus
atgcacctctcggagaactcttgaa

SEQ ID NO: 191729 - DNA, 25 bp, Rattus norvegicus
atgcacctgcagatatcacagaact

SEQ ID NO: 191730 - DNA, 25 bp, Rattus norvegicus
atgcacctgcagttatcacagaact

SEQ ID NO: 191731 - DNA, 25 bp, Rattus norvegicus
atgcacctgggtcctgggtcaccgt

SEQ ID NO: 191732 - DNA, 25 bp, Rattus norvegicus
atgcacctgggtgctgggtcaccgt

SEQ ID NO: 191733 - DNA, 25 bp, Rattus norvegicus
atgcaccttccaatcatactttagc

SEQ ID NO: 191734 - DNA, 25 bp, Rattus norvegicus
atgcaccttccattcatactttagc

SEQ ID NO: 191735 - DNA, 25 bp, Rattus norvegicus
atgcaccttctgcagacggaggcta

SEQ ID NO: 191736 - DNA, 25 bp, Rattus norvegicus
atgcaccttctggagacggaggcta

SEQ ID NO: 191737 - DNA, 25 bp, Rattus norvegicus
atgcaccttggtctggagttaaaag

SEQ ID NO: 191738 - DNA, 25 bp, Rattus norvegicus
atgcaccttggtgtggagttaaaag

SEQ ID NO: 191739 - DNA, 25 bp, Rattus norvegicus
atgcacgaagctaccgaggtgtaca

SEQ ID NO: 191740 - DNA, 25 bp, Rattus norvegicus
atgcacgaagcttccgaggtgtaca

SEQ ID NO: 191741 - DNA, 25 bp, Rattus norvegicus
atgcacgagtctctcatgctcttcg

SEQ ID NO: 191742 - DNA, 25 bp, Rattus norvegicus
atgcacgagtctgtcatgctcttcg

SEQ ID NO: 191743 - DNA, 25 bp, Rattus norvegicus
atgcacgatgagcaataacctgtcc

SEQ ID NO: 191744 - DNA, 25 bp, Rattus norvegicus
atgcacgatgaggaataacctgtcc

SEQ ID NO: 191745 - DNA, 25 bp, Rattus norvegicus
atgcacgcctggaaccttgaactta

SEQ ID NO: 191746 - DNA, 25 bp, Rattus norvegicus
atgcacgcctggtaccttgaactta

SEQ ID NO: 191747 - DNA, 25 bp, Rattus norvegicus
atgcacgcgtacagcgaaaacccag

SEQ ID NO: 191748 - DNA, 25 bp, Rattus norvegicus
atgcacgcgtactgcgaaaacccag

SEQ ID NO: 191749 - DNA, 25 bp, Rattus norvegicus
atgcacgctggcacgagtgttcagg

SEQ ID NO: 191750 - DNA, 25 bp, Rattus norvegicus
atgcacgctggctcgagtgttcagg

SEQ ID NO: 191751 - DNA, 25 bp, Rattus norvegicus
atgcacggccacatcatggttcaga

SEQ ID NO: 191752 - DNA, 25 bp, Rattus norvegicus
atgcacggccacttcatggttcaga

SEQ ID NO: 191753 - DNA, 25 bp, Rattus norvegicus
atgcacggccccatgggcagagatg

SEQ ID NO: 191754 - DNA, 25 bp, Rattus norvegicus
atgcacggccccttgggcagagatg

SEQ ID NO: 191755 - DNA, 25 bp, Rattus norvegicus
atgcacgggatcatgcttgtccatg

SEQ ID NO: 191756 - DNA, 25 bp, Rattus norvegicus
atgcacgggatcttgcttgtccatg

SEQ ID NO: 191757 - DNA, 25 bp, Rattus norvegicus
atgcacgggcccacggttgtttatt

SEQ ID NO: 191758 - DNA, 25 bp, Rattus norvegicus
atgcacgggccctcggttgtttatt

SEQ ID NO: 191759 - DNA, 25 bp, Rattus norvegicus
atgcacggtggaactgcgaccgcaa

SEQ ID NO: 191760 - DNA, 25 bp, Rattus norvegicus
atgcacggtggatctgcgaccgcaa

SEQ ID NO: 191761 - DNA, 25 bp, Rattus norvegicus
atgcacgtccacacctcagataagc

SEQ ID NO: 191762 - DNA, 25 bp, Rattus norvegicus
atgcacgtccactcctcagataagc

SEQ ID NO: 191763 - DNA, 25 bp, Rattus norvegicus
atgcacgtcggtcatggcaaactgc

SEQ ID NO: 191764 - DNA, 25 bp, Rattus norvegicus
atgcacgtcggtgatggcaaactgc

SEQ ID NO: 191765 - DNA, 25 bp, Rattus norvegicus
atgcacgtgacaaaagtttctcccg

SEQ ID NO: 191766 - DNA, 25 bp, Rattus norvegicus
atgcacgtgacataagtttctcccg

SEQ ID NO: 191767 - DNA, 25 bp, Rattus norvegicus
atgcacgtggacagccaagccgtgt

SEQ ID NO: 191768 - DNA, 25 bp, Rattus norvegicus
atgcacgtggactgccaagccgtgt

SEQ ID NO: 191769 - DNA, 25 bp, Rattus norvegicus
atgcacgtgtgaacatgactggcca

SEQ ID NO: 191770 - DNA, 25 bp, Rattus norvegicus
atgcacgtgtgatcatgactggcca

SEQ ID NO: 191771 - DNA, 25 bp, Rattus norvegicus
atgcacgtgtggaatgcttcattca

SEQ ID NO: 191772 - DNA, 25 bp, Rattus norvegicus
atgcacgtgtggtatgcttcattca

SEQ ID NO: 191773 - DNA, 25 bp, Rattus norvegicus
atgcactaaaatagacctcctatgt

SEQ ID NO: 191774 - DNA, 25 bp, Rattus norvegicus
atgcactaaaattgacctcctatgt

SEQ ID NO: 191775 - DNA, 25 bp, Rattus norvegicus
atgcactagcttaccttctactaca

SEQ ID NO: 191776 - DNA, 25 bp, Rattus norvegicus
atgcactagctttccttctactaca

SEQ ID NO: 191777 - DNA, 25 bp, Rattus norvegicus
atgcactaggtgatgggacttttaa

SEQ ID NO: 191778 - DNA, 25 bp, Rattus norvegicus
atgcactaggtgttgggacttttaa

SEQ ID NO: 191779 - DNA, 25 bp, Rattus norvegicus
atgcactatctcctcaggtgtgacc

SEQ ID NO: 191780 - DNA, 25 bp, Rattus norvegicus
atgcactatctcgtcaggtgtgacc

SEQ ID NO: 191781 - DNA, 25 bp, Rattus norvegicus
atgcactatgcaagcatgtatgctt

SEQ ID NO: 191782 - DNA, 25 bp, Rattus norvegicus
atgcactatgcatgcatgtatgctt

SEQ ID NO: 191783 - DNA, 25 bp, Rattus norvegicus
atgcactcagacataacacttaccg

SEQ ID NO: 191784 - DNA, 25 bp, Rattus norvegicus
atgcactcagacttaacacttaccg

SEQ ID NO: 191785 - DNA, 25 bp, Rattus norvegicus
atgcactcagatcgttcaggactca

SEQ ID NO: 191786 - DNA, 25 bp, Rattus norvegicus
atgcactcagatggttcaggactca

SEQ ID NO: 191787 - DNA, 25 bp, Rattus norvegicus
atgcactccattatactttcttgaa

SEQ ID NO: 191788 - DNA, 25 bp, Rattus norvegicus
atgcactccattttactttcttgaa

SEQ ID NO: 191789 - DNA, 25 bp, Rattus norvegicus
atgcactcccttatgtagttttact

SEQ ID NO: 191790 - DNA, 25 bp, Rattus norvegicus
atgcactcccttttgtagttttact

SEQ ID NO: 191791 - DNA, 25 bp, Rattus norvegicus
atgcactcctgcagaagaattgtta

SEQ ID NO: 191792 - DNA, 25 bp, Rattus norvegicus
atgcactcctgctgaagaattgtta

SEQ ID NO: 191793 - DNA, 25 bp, Rattus norvegicus
atgcactctactactaaccttgatg

SEQ ID NO: 191794 - DNA, 25 bp, Rattus norvegicus
atgcactctacttctaaccttgatg

SEQ ID NO: 191795 - DNA, 25 bp, Rattus norvegicus
atgcactctgagcaactcttggcct

SEQ ID NO: 191796 - DNA, 25 bp, Rattus norvegicus
atgcactctgaggaactcttggcct

SEQ ID NO: 191797 - DNA, 25 bp, Rattus norvegicus
atgcactctggacatagcatctggg

SEQ ID NO: 191798 - DNA, 25 bp, Rattus norvegicus
atgcactctggagatagcatctggg

SEQ ID NO: 191799 - DNA, 25 bp, Rattus norvegicus
atgcactgaaacagtccatcttctc

SEQ ID NO: 191800 - DNA, 25 bp, Rattus norvegicus
atgcactgaaactgtccatcttctc

SEQ ID NO: 191801 - DNA, 25 bp, Rattus norvegicus
atgcactgatcccatgactcggttg

SEQ ID NO: 191802 - DNA, 25 bp, Rattus norvegicus
atgcactgatccgatgactcggttg

SEQ ID NO: 191803 - DNA, 25 bp, Rattus norvegicus
atgcactggaggacatcctgactca

SEQ ID NO: 191804 - DNA, 25 bp, Rattus norvegicus
atgcactggaggtcatcctgactca

SEQ ID NO: 191805 - DNA, 25 bp, Rattus norvegicus
atgcactggcatccttagcttctca

SEQ ID NO: 191806 - DNA, 25 bp, Rattus norvegicus
atgcactggcatgcttagcttctca

SEQ ID NO: 191807 - DNA, 25 bp, Rattus norvegicus
atgcactgtcagaaacaaagaccca

SEQ ID NO: 191808 - DNA, 25 bp, Rattus norvegicus
atgcactgtcagtaacaaagaccca

SEQ ID NO: 191809 - DNA, 25 bp, Rattus norvegicus
atgcactgtcgtacactttatttcc

SEQ ID NO: 191810 - DNA, 25 bp, Rattus norvegicus
atgcactgtcgttcactttatttcc

SEQ ID NO: 191811 - DNA, 25 bp, Rattus norvegicus
atgcactgtctccttctgcagtcag

SEQ ID NO: 191812 - DNA, 25 bp, Rattus norvegicus
atgcactgtctcgttctgcagtcag

SEQ ID NO: 191813 - DNA, 25 bp, Rattus norvegicus
atgcactgtctgaacatactgggtc

SEQ ID NO: 191814 - DNA, 25 bp, Rattus norvegicus
atgcactgtctgtacatactgggtc

SEQ ID NO: 191815 - DNA, 25 bp, Rattus norvegicus
atgcactgtcttatcatttcattgt

SEQ ID NO: 191816 - DNA, 25 bp, Rattus norvegicus
atgcactgtcttttcatttcattgt

SEQ ID NO: 191817 - DNA, 25 bp, Rattus norvegicus
atgcactgtgcaacaaagccttccg

SEQ ID NO: 191818 - DNA, 25 bp, Rattus norvegicus
atgcactgtgcacatgggtcatccc

SEQ ID NO: 191819 - DNA, 25 bp, Rattus norvegicus
atgcactgtgcagatgggtcatccc

SEQ ID NO: 191820 - DNA, 25 bp, Rattus norvegicus
atgcactgtgcatcaaagccttccg

SEQ ID NO: 191821 - DNA, 25 bp, Rattus norvegicus
atgcactgtgtcatccttggtgcca

SEQ ID NO: 191822 - DNA, 25 bp, Rattus norvegicus
atgcactgtgtcttccttggtgcca

SEQ ID NO: 191823 - DNA, 25 bp, Rattus norvegicus
atgcacttaacaatacgtctccctt

SEQ ID NO: 191824 - DNA, 25 bp, Rattus norvegicus
atgcacttaacattacgtctccctt

SEQ ID NO: 191825 - DNA, 25 bp, Rattus norvegicus
atgcacttattcattctaacgtgtc

SEQ ID NO: 191826 - DNA, 25 bp, Rattus norvegicus
atgcacttattctttctaacgtgtc

SEQ ID NO: 191827 - DNA, 25 bp, Rattus norvegicus
atgcacttcaaaagagccatctcca

SEQ ID NO: 191828 - DNA, 25 bp, Rattus norvegicus
atgcacttcaaatgagccatctcca

SEQ ID NO: 191829 - DNA, 25 bp, Rattus norvegicus
atgcacttccctcagatgagcaggg

SEQ ID NO: 191830 - DNA, 25 bp, Rattus norvegicus
atgcacttccctgagatgagcaggg

SEQ ID NO: 191831 - DNA, 25 bp, Rattus norvegicus
atgcacttctccatgtcaatacaca

SEQ ID NO: 191832 - DNA, 25 bp, Rattus norvegicus
atgcacttctccttgtcaatacaca

SEQ ID NO: 191833 - DNA, 25 bp, Rattus norvegicus
atgcacttggctacctcagagttat

SEQ ID NO: 191834 - DNA, 25 bp, Rattus norvegicus
atgcacttggctatacttgattgtc

SEQ ID NO: 191835 - DNA, 25 bp, Rattus norvegicus
atgcacttggcttcctcagagttat

SEQ ID NO: 191836 - DNA, 25 bp, Rattus norvegicus
atgcacttggctttacttgattgtc

SEQ ID NO: 191837 - DNA, 25 bp, Rattus norvegicus
atgcacttgtgcagcctaaggagcc

SEQ ID NO: 191838 - DNA, 25 bp, Rattus norvegicus
atgcacttgtgctgcctaaggagcc

SEQ ID NO: 191839 - DNA, 25 bp, Rattus norvegicus
atgcacttgtgtaatcagacgactt

SEQ ID NO: 191840 - DNA, 25 bp, Rattus norvegicus
atgcacttgtgttatcagacgactt

SEQ ID NO: 191841 - DNA, 25 bp, Rattus norvegicus
atgcactttgcaatctcctagtcgt

SEQ ID NO: 191842 - DNA, 25 bp, Rattus norvegicus
atgcactttgcattctcctagtcgt

SEQ ID NO: 191843 - DNA, 25 bp, Rattus norvegicus
atgcactttgtgatgacctcatccc

SEQ ID NO: 191844 - DNA, 25 bp, Rattus norvegicus
atgcactttgtgttgacctcatccc

SEQ ID NO: 191845 - DNA, 25 bp, Rattus norvegicus
atgcagaagccaaaccaatcacaga

SEQ ID NO: 191846 - DNA, 25 bp, Rattus norvegicus
atgcagaagccataccaatcacaga

SEQ ID NO: 191847 - DNA, 25 bp, Rattus norvegicus
atgcagaagcttctctctgggcgtt

SEQ ID NO: 191848 - DNA, 25 bp, Rattus norvegicus
atgcagaagcttgtctctgggcgtt

SEQ ID NO: 191849 - DNA, 25 bp, Rattus norvegicus
atgcagaaggatacctgggcacccg

SEQ ID NO: 191850 - DNA, 25 bp, Rattus norvegicus
atgcagaaggattcctgggcacccg

SEQ ID NO: 191851 - DNA, 25 bp, Rattus norvegicus
atgcagaaggctctgaaccgccagt

SEQ ID NO: 191852 - DNA, 25 bp, Rattus norvegicus
atgcagaaggctgtgaaccgccagt

SEQ ID NO: 191853 - DNA, 25 bp, Rattus norvegicus
atgcagaataaacctttcatcataa

SEQ ID NO: 191854 - DNA, 25 bp, Rattus norvegicus
atgcagaataaagctttcatcataa

SEQ ID NO: 191855 - DNA, 25 bp, Rattus norvegicus
atgcagaattctatgtacacagtcc

SEQ ID NO: 191856 - DNA, 25 bp, Rattus norvegicus
atgcagaattctttgtacacagtcc

SEQ ID NO: 191857 - DNA, 25 bp, Rattus norvegicus
atgcagaatttcaggaccccagtcc

SEQ ID NO: 191858 - DNA, 25 bp, Rattus norvegicus
atgcagaatttctggaccccagtcc

SEQ ID NO: 191859 - DNA, 25 bp, Rattus norvegicus
atgcagacacagagaccaccgtgat

SEQ ID NO: 191860 - DNA, 25 bp, Rattus norvegicus
atgcagacacagtgaccaccgtgat

SEQ ID NO: 191861 - DNA, 25 bp, Rattus norvegicus
atgcagacaggcatcgccggcagga

SEQ ID NO: 191862 - DNA, 25 bp, Rattus norvegicus
atgcagacaggcttcgccggcagga

SEQ ID NO: 191863 - DNA, 25 bp, Rattus norvegicus
atgcagacatttctactcctcaacc

SEQ ID NO: 191864 - DNA, 25 bp, Rattus norvegicus
atgcagacatttgtactcctcaacc

SEQ ID NO: 191865 - DNA, 25 bp, Rattus norvegicus
atgcagacccatcctttctgggaag

SEQ ID NO: 191866 - DNA, 25 bp, Rattus norvegicus
atgcagacccatgctttctgggaag

SEQ ID NO: 191867 - DNA, 25 bp, Rattus norvegicus
atgcagacgccgcagccacaggcgg

SEQ ID NO: 191868 - DNA, 25 bp, Rattus norvegicus
atgcagacgccggagccacaggcgg

SEQ ID NO: 191869 - DNA, 25 bp, Rattus norvegicus
atgcagactcatcaagacacaactc

SEQ ID NO: 191870 - DNA, 25 bp, Rattus norvegicus
atgcagactcatgaagacacaactc

SEQ ID NO: 191871 - DNA, 25 bp, Rattus norvegicus
atgcagactcttcagtgagactctt

SEQ ID NO: 191872 - DNA, 25 bp, Rattus norvegicus
atgcagactcttcctgtgtcacgtc

SEQ ID NO: 191873 - DNA, 25 bp, Rattus norvegicus
atgcagactcttgagtgagactctt

SEQ ID NO: 191874 - DNA, 25 bp, Rattus norvegicus
atgcagactcttgctgtgtcacgtc

SEQ ID NO: 191875 - DNA, 25 bp, Rattus norvegicus
atgcagagactaaccatccggtcaa

SEQ ID NO: 191876 - DNA, 25 bp, Rattus norvegicus
atgcagagactatccatccggtcaa

SEQ ID NO: 191877 - DNA, 25 bp, Rattus norvegicus
atgcagagagatcggtcgtacacac

SEQ ID NO: 191878 - DNA, 25 bp, Rattus norvegicus
atgcagagagatgggtcgtacacac

SEQ ID NO: 191879 - DNA, 25 bp, Rattus norvegicus
atgcagagaggcattcccacttgga

SEQ ID NO: 191880 - DNA, 25 bp, Rattus norvegicus
atgcagagaggctttcccacttgga

SEQ ID NO: 191881 - DNA, 25 bp, Rattus norvegicus
atgcagagctatcgcttcccggaag

SEQ ID NO: 191882 - DNA, 25 bp, Rattus norvegicus
atgcagagctatggcttcccggaag

SEQ ID NO: 191883 - DNA, 25 bp, Rattus norvegicus
atgcagaggtccatggcacatgaac

SEQ ID NO: 191884 - DNA, 25 bp, Rattus norvegicus
atgcagaggtccttggcacatgaac

SEQ ID NO: 191885 - DNA, 25 bp, Rattus norvegicus
atgcagagtgctccaccctgtgtac

SEQ ID NO: 191886 - DNA, 25 bp, Rattus norvegicus
atgcagagtgctgcaccctgtgtac

SEQ ID NO: 191887 - DNA, 25 bp, Rattus norvegicus
atgcagagtttgaaattggcccaac

SEQ ID NO: 191888 - DNA, 25 bp, Rattus norvegicus
atgcagagtttgtaattggcccaac

SEQ ID NO: 191889 - DNA, 25 bp, Rattus norvegicus
atgcagatactgctactgtcagagt

SEQ ID NO: 191890 - DNA, 25 bp, Rattus norvegicus
atgcagatactggtactgtcagagt

SEQ ID NO: 191891 - DNA, 25 bp, Rattus norvegicus
atgcagatatttatctatagacctg

SEQ ID NO: 191892 - DNA, 25 bp, Rattus norvegicus
atgcagatatttttctatagacctg

SEQ ID NO: 191893 - DNA, 25 bp, Rattus norvegicus
atgcagatcagactctccatcaggg

SEQ ID NO: 191894 - DNA, 25 bp, Rattus norvegicus
atgcagatcagagtctccatcaggg

SEQ ID NO: 191895 - DNA, 25 bp, Rattus norvegicus
atgcagatcccacttgactctgtgt

SEQ ID NO: 191896 - DNA, 25 bp, Rattus norvegicus
atgcagatcccagttgactctgtgt

SEQ ID NO: 191897 - DNA, 25 bp, Rattus norvegicus
atgcagatctacagcgccagagtgc

SEQ ID NO: 191898 - DNA, 25 bp, Rattus norvegicus
atgcagatctactgcgccagagtgc

SEQ ID NO: 191899 - DNA, 25 bp, Rattus norvegicus
atgcagatctccctggttcacatag

SEQ ID NO: 191900 - DNA, 25 bp, Rattus norvegicus
atgcagatctccgtggttcacatag

SEQ ID NO: 191901 - DNA, 25 bp, Rattus norvegicus
atgcagatgcagatgttgagaccca

SEQ ID NO: 191902 - DNA, 25 bp, Rattus norvegicus
atgcagatgcagttgttgagaccca

SEQ ID NO: 191903 - DNA, 25 bp, Rattus norvegicus
atgcagatgccgaaaagaatttcct

SEQ ID NO: 191904 - DNA, 25 bp, Rattus norvegicus
atgcagatgccgtaaagaatttcct

SEQ ID NO: 191905 - DNA, 25 bp, Rattus norvegicus
atgcagatgtctctggcaatgcctc

SEQ ID NO: 191906 - DNA, 25 bp, Rattus norvegicus
atgcagatgtctgtggcaatgcctc

SEQ ID NO: 191907 - DNA, 25 bp, Rattus norvegicus
atgcagcaatacatcttgtgcccag

SEQ ID NO: 191908 - DNA, 25 bp, Rattus norvegicus
atgcagcaatacttcttgtgcccag

SEQ ID NO: 191909 - DNA, 25 bp, Rattus norvegicus
atgcagcaatataaacgtgacagtt

SEQ ID NO: 191910 - DNA, 25 bp, Rattus norvegicus
atgcagcaatattaacgtgacagtt

SEQ ID NO: 191911 - DNA, 25 bp, Rattus norvegicus
atgcagcacgcacaactacaaccag

SEQ ID NO: 191912 - DNA, 25 bp, Rattus norvegicus
atgcagcacgcagaactacaaccag

SEQ ID NO: 191913 - DNA, 25 bp, Rattus norvegicus
atgcagcaggctacgtccagtttgg

SEQ ID NO: 191914 - DNA, 25 bp, Rattus norvegicus
atgcagcaggcttcgtccagtttgg

SEQ ID NO: 191915 - DNA, 25 bp, Rattus norvegicus
atgcagcagtcactggagtcagtat

SEQ ID NO: 191916 - DNA, 25 bp, Rattus norvegicus
atgcagcagtcagtggagtcagtat

SEQ ID NO: 191917 - DNA, 25 bp, Rattus norvegicus
atgcagcatctgatcttcagtgggc

SEQ ID NO: 191918 - DNA, 25 bp, Rattus norvegicus
atgcagcatctgttcttcagtgggc

SEQ ID NO: 191919 - DNA, 25 bp, Rattus norvegicus
atgcagcattgtccttctgactcca

SEQ ID NO: 191920 - DNA, 25 bp, Rattus norvegicus
atgcagcattgtgcttctgactcca

SEQ ID NO: 191921 - DNA, 25 bp, Rattus norvegicus
atgcagccaacgattccagtttgag

SEQ ID NO: 191922 - DNA, 25 bp, Rattus norvegicus
atgcagccaacgtttccagtttgag

SEQ ID NO: 191923 - DNA, 25 bp, Rattus norvegicus
atgcagccagcgacacgcagatgaa

SEQ ID NO: 191924 - DNA, 25 bp, Rattus norvegicus
atgcagccagcgattctcgtaattc

SEQ ID NO: 191925 - DNA, 25 bp, Rattus norvegicus
atgcagccagcgtcacgcagatgaa

SEQ ID NO: 191926 - DNA, 25 bp, Rattus norvegicus
atgcagccagcgtttctcgtaattc

SEQ ID NO: 191927 - DNA, 25 bp, Rattus norvegicus
atgcagccagctacttgtattttta

SEQ ID NO: 191928 - DNA, 25 bp, Rattus norvegicus
atgcagccagcttcttgtattttta

SEQ ID NO: 191929 - DNA, 25 bp, Rattus norvegicus
atgcagccaggccatgacgtggtct

SEQ ID NO: 191930 - DNA, 25 bp, Rattus norvegicus
atgcagccaggcgatgacgtggtct

SEQ ID NO: 191931 - DNA, 25 bp, Rattus norvegicus
atgcagcccattcatcctggagaaa

SEQ ID NO: 191932 - DNA, 25 bp, Rattus norvegicus
atgcagcccattgatcctggagaaa

SEQ ID NO: 191933 - DNA, 25 bp, Rattus norvegicus
atgcagccggtgaagtctagggccc

SEQ ID NO: 191934 - DNA, 25 bp, Rattus norvegicus
atgcagccggtgtagtctagggccc

SEQ ID NO: 191935 - DNA, 25 bp, Rattus norvegicus
atgcagcctcggcaacagaagccag

SEQ ID NO: 191936 - DNA, 25 bp, Rattus norvegicus
atgcagcctcgggaacagaagccag

SEQ ID NO: 191937 - DNA, 25 bp, Rattus norvegicus
atgcagcctggtcgagtacaagcgc

SEQ ID NO: 191938 - DNA, 25 bp, Rattus norvegicus
atgcagcctggtggagtacaagcgc

SEQ ID NO: 191939 - DNA, 25 bp, Rattus norvegicus
atgcagccttggacagggacatcct

SEQ ID NO: 191940 - DNA, 25 bp, Rattus norvegicus
atgcagccttggtcagggacatcct

SEQ ID NO: 191941 - DNA, 25 bp, Rattus norvegicus
atgcagccttttactgactgacaga

SEQ ID NO: 191942 - DNA, 25 bp, Rattus norvegicus
atgcagcctttttctgactgacaga

SEQ ID NO: 191943 - DNA, 25 bp, Rattus norvegicus
atgcagcgagcaacctaccgtacaa

SEQ ID NO: 191944 - DNA, 25 bp, Rattus norvegicus
atgcagcgagcatcctaccgtacaa

SEQ ID NO: 191945 - DNA, 25 bp, Rattus norvegicus
atgcagcgatggcacacagacgaag

SEQ ID NO: 191946 - DNA, 25 bp, Rattus norvegicus
atgcagcgatgggacacagacgaag

SEQ ID NO: 191947 - DNA, 25 bp, Rattus norvegicus
atgcagcgatgtcaagttcttccag

SEQ ID NO: 191948 - DNA, 25 bp, Rattus norvegicus
atgcagcgatgtgaagttcttccag

SEQ ID NO: 191949 - DNA, 25 bp, Rattus norvegicus
atgcagcggcagagatcaacaacta

SEQ ID NO: 191950 - DNA, 25 bp, Rattus norvegicus
atgcagcggcagtgatcaacaacta

SEQ ID NO: 191951 - DNA, 25 bp, Rattus norvegicus
atgcagcgtgctctattcaaagact

SEQ ID NO: 191952 - DNA, 25 bp, Rattus norvegicus
atgcagcgtgctgtattcaaagact

SEQ ID NO: 191953 - DNA, 25 bp, Rattus norvegicus
atgcagcgttccagcaagtggtgaa

SEQ ID NO: 191954 - DNA, 25 bp, Rattus norvegicus
atgcagcgttcctgcaagtggtgaa

SEQ ID NO: 191955 - DNA, 25 bp, Rattus norvegicus
atgcagctagtcagggcgtggaaat

SEQ ID NO: 191956 - DNA, 25 bp, Rattus norvegicus
atgcagctagtctgggcgtggaaat

SEQ ID NO: 191957 - DNA, 25 bp, Rattus norvegicus
atgcagctatccaagtgtccagact

SEQ ID NO: 191958 - DNA, 25 bp, Rattus norvegicus
atgcagctatcctagtgtccagact

SEQ ID NO: 191959 - DNA, 25 bp, Rattus norvegicus
atgcagctcaggaacggatcactcg

SEQ ID NO: 191960 - DNA, 25 bp, Rattus norvegicus
atgcagctcaggatcatttgtggcc

SEQ ID NO: 191961 - DNA, 25 bp, Rattus norvegicus
atgcagctcaggtacggatcactcg

SEQ ID NO: 191962 - DNA, 25 bp, Rattus norvegicus
atgcagctcaggttcatttgtggcc

SEQ ID NO: 191963 - DNA, 25 bp, Rattus norvegicus
atgcagctcagtaacacacctgatt

SEQ ID NO: 191964 - DNA, 25 bp, Rattus norvegicus
atgcagctcagttacacacctgatt

SEQ ID NO: 191965 - DNA, 25 bp, Rattus norvegicus
atgcagctctctcgccaacaataac

SEQ ID NO: 191966 - DNA, 25 bp, Rattus norvegicus
atgcagctctctggccaacaataac

SEQ ID NO: 191967 - DNA, 25 bp, Rattus norvegicus
atgcagctctggcatcaaacaccga

SEQ ID NO: 191968 - DNA, 25 bp, Rattus norvegicus
atgcagctctgggatcaaacaccga

SEQ ID NO: 191969 - DNA, 25 bp, Rattus norvegicus
atgcagctgaaaattttgacgactt

SEQ ID NO: 191970 - DNA, 25 bp, Rattus norvegicus
atgcagctgaaatttttgacgactt

SEQ ID NO: 191971 - DNA, 25 bp, Rattus norvegicus
atgcagctgaagacaccaaccagtg

SEQ ID NO: 191972 - DNA, 25 bp, Rattus norvegicus
atgcagctgaagtcaccaaccagtg

SEQ ID NO: 191973 - DNA, 25 bp, Rattus norvegicus
atgcagctgactagtctgttactga

SEQ ID NO: 191974 - DNA, 25 bp, Rattus norvegicus
atgcagctgacttgtctgttactga

SEQ ID NO: 191975 - DNA, 25 bp, Rattus norvegicus
atgcagctgcagctcttttatgccg

SEQ ID NO: 191976 - DNA, 25 bp, Rattus norvegicus
atgcagctgcaggtcttttatgccg

SEQ ID NO: 191977 - DNA, 25 bp, Rattus norvegicus
atgcagctgctaagggacaatctca

SEQ ID NO: 191978 - DNA, 25 bp, Rattus norvegicus
atgcagctgctatgggacaatctca

SEQ ID NO: 191979 - DNA, 25 bp, Rattus norvegicus
atgcagctgcttagtgttcttattc

SEQ ID NO: 191980 - DNA, 25 bp, Rattus norvegicus
atgcagctgctttgtgttcttattc

SEQ ID NO: 191981 - DNA, 25 bp, Rattus norvegicus
atgcagctggatatcacggtgaaac

SEQ ID NO: 191982 - DNA, 25 bp, Rattus norvegicus
atgcagctggatcggtgtctagtta

SEQ ID NO: 191983 - DNA, 25 bp, Rattus norvegicus
atgcagctggatgggtgtctagtta

SEQ ID NO: 191984 - DNA, 25 bp, Rattus norvegicus
atgcagctggatttcacggtgaaac

SEQ ID NO: 191985 - DNA, 25 bp, Rattus norvegicus
atgcagctgttaaccgtcagtgtcc

SEQ ID NO: 191986 - DNA, 25 bp, Rattus norvegicus
atgcagctgttatccgtcagtgtcc

SEQ ID NO: 191987 - DNA, 25 bp, Rattus norvegicus
atgcagcttaagctcttacattccg

SEQ ID NO: 191988 - DNA, 25 bp, Rattus norvegicus
atgcagcttaaggtcttacattccg

SEQ ID NO: 191989 - DNA, 25 bp, Rattus norvegicus
atgcagcttacaaggaacatcctaa

SEQ ID NO: 191990 - DNA, 25 bp, Rattus norvegicus
atgcagcttacatggaacatcctaa

SEQ ID NO: 191991 - DNA, 25 bp, Rattus norvegicus
atgcagcttacccaagtggagcccc

SEQ ID NO: 191992 - DNA, 25 bp, Rattus norvegicus
atgcagcttaccgaagtggagcccc

SEQ ID NO: 191993 - DNA, 25 bp, Rattus norvegicus
atgcagcttctgcagatgatcctcc

SEQ ID NO: 191994 - DNA, 25 bp, Rattus norvegicus
atgcagcttctggagatgatcctcc

SEQ ID NO: 191995 - DNA, 25 bp, Rattus norvegicus
atgcagcttgacaggtactgtctgt

SEQ ID NO: 191996 - DNA, 25 bp, Rattus norvegicus
atgcagcttgacatggatcatctcc

SEQ ID NO: 191997 - DNA, 25 bp, Rattus norvegicus
atgcagcttgactggtactgtctgt

SEQ ID NO: 191998 - DNA, 25 bp, Rattus norvegicus
atgcagcttgacttggatcatctcc

SEQ ID NO: 191999 - DNA, 25 bp, Rattus norvegicus
atgcagcttgccactgtagctctgg

SEQ ID NO: 192000 - DNA, 25 bp, Rattus norvegicus
atgcagcttgcctctgtagctctgg

SEQ ID NO: 192001 - DNA, 25 bp, Rattus norvegicus
atgcagcttggaatcttatcaacag

SEQ ID NO: 192002 - DNA, 25 bp, Rattus norvegicus
atgcagcttggattcttatcaacag

SEQ ID NO: 192003 - DNA, 25 bp, Rattus norvegicus
atgcaggaaaacatgccttcttaac

SEQ ID NO: 192004 - DNA, 25 bp, Rattus norvegicus
atgcaggaaaacttgccttcttaac

SEQ ID NO: 192005 - DNA, 25 bp, Rattus norvegicus
atgcaggaacccagctgaagaggct

SEQ ID NO: 192006 - DNA, 25 bp, Rattus norvegicus
atgcaggaaccctgctgaagaggct

SEQ ID NO: 192007 - DNA, 25 bp, Rattus norvegicus
atgcaggacagcagagtcccagcca

SEQ ID NO: 192008 - DNA, 25 bp, Rattus norvegicus
atgcaggacagctgagtcccagcca

SEQ ID NO: 192009 - DNA, 25 bp, Rattus norvegicus
atgcaggaccgaaagacctctgttc

SEQ ID NO: 192010 - DNA, 25 bp, Rattus norvegicus
atgcaggaccgatagacctctgttc

SEQ ID NO: 192011 - DNA, 25 bp, Rattus norvegicus
atgcaggacctcactgacttcttat

SEQ ID NO: 192012 - DNA, 25 bp, Rattus norvegicus
atgcaggacctctctgacttcttat

SEQ ID NO: 192013 - DNA, 25 bp, Rattus norvegicus
atgcaggagctgctagcccacggca

SEQ ID NO: 192014 - DNA, 25 bp, Rattus norvegicus
atgcaggagctggtagcccacggca

SEQ ID NO: 192015 - DNA, 25 bp, Rattus norvegicus
atgcaggattggatcgccacggttc

SEQ ID NO: 192016 - DNA, 25 bp, Rattus norvegicus
atgcaggattggttcgccacggttc

SEQ ID NO: 192017 - DNA, 25 bp, Rattus norvegicus
atgcaggccagccagagccatctgc

SEQ ID NO: 192018 - DNA, 25 bp, Rattus norvegicus
atgcaggccagcgagagccatctgc

SEQ ID NO: 192019 - DNA, 25 bp, Rattus norvegicus
atgcaggccctgcttctctaaagaa

SEQ ID NO: 192020 - DNA, 25 bp, Rattus norvegicus
atgcaggccctggttctctaaagaa

SEQ ID NO: 192021 - DNA, 25 bp, Rattus norvegicus
atgcaggccgcactggatgattcat

SEQ ID NO: 192022 - DNA, 25 bp, Rattus norvegicus
atgcaggccgcagtggatgattcat

SEQ ID NO: 192023 - DNA, 25 bp, Rattus norvegicus
atgcaggctgaaaggacctgtgaac

SEQ ID NO: 192024 - DNA, 25 bp, Rattus norvegicus
atgcaggctgaatggacctgtgaac

SEQ ID NO: 192025 - DNA, 25 bp, Rattus norvegicus
atgcaggctgccctacaagctgctg

SEQ ID NO: 192026 - DNA, 25 bp, Rattus norvegicus
atgcaggctgccgtacaagctgctg

SEQ ID NO: 192027 - DNA, 25 bp, Rattus norvegicus
atgcagggagccaacatattgtagc

SEQ ID NO: 192028 - DNA, 25 bp, Rattus norvegicus
atgcagggagccaacgtccttgtaa

SEQ ID NO: 192029 - DNA, 25 bp, Rattus norvegicus
atgcagggagcctacatattgtagc

SEQ ID NO: 192030 - DNA, 25 bp, Rattus norvegicus
atgcagggagcctacgtccttgtaa

SEQ ID NO: 192031 - DNA, 25 bp, Rattus norvegicus
atgcagggcaccctcttctatgtat

SEQ ID NO: 192032 - DNA, 25 bp, Rattus norvegicus
atgcagggcaccgtcttctatgtat

SEQ ID NO: 192033 - DNA, 25 bp, Rattus norvegicus
atgcagggcacgcaatgtcatccta

SEQ ID NO: 192034 - DNA, 25 bp, Rattus norvegicus
atgcagggcacggaatgtcatccta

SEQ ID NO: 192035 - DNA, 25 bp, Rattus norvegicus
atgcagggcagtcagtgttccttca

SEQ ID NO: 192036 - DNA, 25 bp, Rattus norvegicus
atgcagggcagtcgaccagctgctc

SEQ ID NO: 192037 - DNA, 25 bp, Rattus norvegicus
atgcagggcagtgagtgttccttca

SEQ ID NO: 192038 - DNA, 25 bp, Rattus norvegicus
atgcagggcagtggaccagctgctc

SEQ ID NO: 192039 - DNA, 25 bp, Rattus norvegicus
atgcagggccacaggcttccgcgct

SEQ ID NO: 192040 - DNA, 25 bp, Rattus norvegicus
atgcagggccactggcttccgcgct

SEQ ID NO: 192041 - DNA, 25 bp, Rattus norvegicus
atgcagggccatatagtcgggaata

SEQ ID NO: 192042 - DNA, 25 bp, Rattus norvegicus
atgcagggccatttagtcgggaata

SEQ ID NO: 192043 - DNA, 25 bp, Rattus norvegicus
atgcagggcggccacactgacagca

SEQ ID NO: 192044 - DNA, 25 bp, Rattus norvegicus
atgcagggcggcgacactgacagca

SEQ ID NO: 192045 - DNA, 25 bp, Rattus norvegicus
atgcagggctgtattgttccacctt

SEQ ID NO: 192046 - DNA, 25 bp, Rattus norvegicus
atgcagggctgttttgttccacctt

SEQ ID NO: 192047 - DNA, 25 bp, Rattus norvegicus
atgcagggtcagcaactgcaccgcc

SEQ ID NO: 192048 - DNA, 25 bp, Rattus norvegicus
atgcagggtcaggaactgcaccgcc

SEQ ID NO: 192049 - DNA, 25 bp, Rattus norvegicus
atgcagggtgatcttccggtgatct

SEQ ID NO: 192050 - DNA, 25 bp, Rattus norvegicus
atgcagggtgatgttccggtgatct

SEQ ID NO: 192051 - DNA, 25 bp, Rattus norvegicus
atgcagggtgcacaccacaccctgg

SEQ ID NO: 192052 - DNA, 25 bp, Rattus norvegicus
atgcagggtgcagaccacaccctgg

SEQ ID NO: 192053 - DNA, 25 bp, Rattus norvegicus
atgcaggtaccccaaggtttcctga

SEQ ID NO: 192054 - DNA, 25 bp, Rattus norvegicus
atgcaggtacccgaaggtttcctga

SEQ ID NO: 192055 - DNA, 25 bp, Rattus norvegicus
atgcaggtagtactgggtccatcgc

SEQ ID NO: 192056 - DNA, 25 bp, Rattus norvegicus
atgcaggtagtagtgggtccatcgc

SEQ ID NO: 192057 - DNA, 25 bp, Rattus norvegicus
atgcaggtatgtacaggttaagcca

SEQ ID NO: 192058 - DNA, 25 bp, Rattus norvegicus
atgcaggtatgttcaggttaagcca

SEQ ID NO: 192059 - DNA, 25 bp, Rattus norvegicus
atgcaggtccctcatgctagatgtg

SEQ ID NO: 192060 - DNA, 25 bp, Rattus norvegicus
atgcaggtccctgatgctagatgtg

SEQ ID NO: 192061 - DNA, 25 bp, Rattus norvegicus
atgcaggtcctcaagtggaagtcta

SEQ ID NO: 192062 - DNA, 25 bp, Rattus norvegicus
atgcaggtcctctagtggaagtcta

SEQ ID NO: 192063 - DNA, 25 bp, Rattus norvegicus
atgcaggtcgttctggctcgaaagc

SEQ ID NO: 192064 - DNA, 25 bp, Rattus norvegicus
atgcaggtcgttgtggctcgaaagc

SEQ ID NO: 192065 - DNA, 25 bp, Rattus norvegicus
atgcaggtgatcacagaggccacag

SEQ ID NO: 192066 - DNA, 25 bp, Rattus norvegicus
atgcaggtgatctcagaggccacag

SEQ ID NO: 192067 - DNA, 25 bp, Rattus norvegicus
atgcaggtgctaatgtctatccccg

SEQ ID NO: 192068 - DNA, 25 bp, Rattus norvegicus
atgcaggtgctattgtctatccccg

SEQ ID NO: 192069 - DNA, 25 bp, Rattus norvegicus
atgcaggtgctgctcactaccatct

SEQ ID NO: 192070 - DNA, 25 bp, Rattus norvegicus
atgcaggtgctggtcactaccatct

SEQ ID NO: 192071 - DNA, 25 bp, Rattus norvegicus
atgcaggtgttcatagagtccagaa

SEQ ID NO: 192072 - DNA, 25 bp, Rattus norvegicus
atgcaggtgttcttagagtccagaa

SEQ ID NO: 192073 - DNA, 25 bp, Rattus norvegicus
atgcaggttcccaccattgagaagt

SEQ ID NO: 192074 - DNA, 25 bp, Rattus norvegicus
atgcaggttccctccattgagaagt

SEQ ID NO: 192075 - DNA, 25 bp, Rattus norvegicus
atgcaggttctgaggatgatctcca

SEQ ID NO: 192076 - DNA, 25 bp, Rattus norvegicus
atgcaggttctgtggatgatctcca

SEQ ID NO: 192077 - DNA, 25 bp, Rattus norvegicus
atgcaggtttctcatcgtgtgcgga

SEQ ID NO: 192078 - DNA, 25 bp, Rattus norvegicus
atgcaggtttctgatcgtgtgcgga

SEQ ID NO: 192079 - DNA, 25 bp, Rattus norvegicus
atgcagtacaaaagctgggcctctc

SEQ ID NO: 192080 - DNA, 25 bp, Rattus norvegicus
atgcagtacaaatgctgggcctctc

SEQ ID NO: 192081 - DNA, 25 bp, Rattus norvegicus
atgcagtaccccatagactggtgtt

SEQ ID NO: 192082 - DNA, 25 bp, Rattus norvegicus
atgcagtaccccttagactggtgtt

SEQ ID NO: 192083 - DNA, 25 bp, Rattus norvegicus
atgcagtagaacacatcattgtacg

SEQ ID NO: 192084 - DNA, 25 bp, Rattus norvegicus
atgcagtagaactcatcattgtacg

SEQ ID NO: 192085 - DNA, 25 bp, Rattus norvegicus
atgcagtcacgcctcagagcttctt

SEQ ID NO: 192086 - DNA, 25 bp, Rattus norvegicus
atgcagtcacgcgtcagagcttctt

SEQ ID NO: 192087 - DNA, 25 bp, Rattus norvegicus
atgcagtcatttactccatgttccc

SEQ ID NO: 192088 - DNA, 25 bp, Rattus norvegicus
atgcagtcattttctccatgttccc

SEQ ID NO: 192089 - DNA, 25 bp, Rattus norvegicus
atgcagtccactatatattgtacag

SEQ ID NO: 192090 - DNA, 25 bp, Rattus norvegicus
atgcagtccactttatattgtacag

SEQ ID NO: 192091 - DNA, 25 bp, Rattus norvegicus
atgcagtcccctaccagagaaggtg

SEQ ID NO: 192092 - DNA, 25 bp, Rattus norvegicus
atgcagtccccttccagagaaggtg

SEQ ID NO: 192093 - DNA, 25 bp, Rattus norvegicus
atgcagtccctgacggcagtgatga

SEQ ID NO: 192094 - DNA, 25 bp, Rattus norvegicus
atgcagtccctgatgtatatagctt

SEQ ID NO: 192095 - DNA, 25 bp, Rattus norvegicus
atgcagtccctgtcggcagtgatga

SEQ ID NO: 192096 - DNA, 25 bp, Rattus norvegicus
atgcagtccctgttgtatatagctt

SEQ ID NO: 192097 - DNA, 25 bp, Rattus norvegicus
atgcagtctccgagctgatagatgc

SEQ ID NO: 192098 - DNA, 25 bp, Rattus norvegicus
atgcagtctccgtgctgatagatgc

SEQ ID NO: 192099 - DNA, 25 bp, Rattus norvegicus
atgcagtctctactcctacttttaa

SEQ ID NO: 192100 - DNA, 25 bp, Rattus norvegicus
atgcagtctctagtcctacttttaa

SEQ ID NO: 192101 - DNA, 25 bp, Rattus norvegicus
atgcagtctgacactgacactgtgc

SEQ ID NO: 192102 - DNA, 25 bp, Rattus norvegicus
atgcagtctgactctgacactgtgc

SEQ ID NO: 192103 - DNA, 25 bp, Rattus norvegicus
atgcagtctgtgatcgccatagcca

SEQ ID NO: 192104 - DNA, 25 bp, Rattus norvegicus
atgcagtctgtgttcgccatagcca

SEQ ID NO: 192105 - DNA, 25 bp, Rattus norvegicus
atgcagtgaagcagactccagccaa

SEQ ID NO: 192106 - DNA, 25 bp, Rattus norvegicus
atgcagtgaagctgactccagccaa

SEQ ID NO: 192107 - DNA, 25 bp, Rattus norvegicus
atgcagtgactgcatcatccttaga

SEQ ID NO: 192108 - DNA, 25 bp, Rattus norvegicus
atgcagtgactggatcatccttaga

SEQ ID NO: 192109 - DNA, 25 bp, Rattus norvegicus
atgcagtgagagactcctctgctgc

SEQ ID NO: 192110 - DNA, 25 bp, Rattus norvegicus
atgcagtgagagtctcctctgctgc

SEQ ID NO: 192111 - DNA, 25 bp, Rattus norvegicus
atgcagtgcggcctatgtctcatta

SEQ ID NO: 192112 - DNA, 25 bp, Rattus norvegicus
atgcagtgcggcgtatgtctcatta

SEQ ID NO: 192113 - DNA, 25 bp, Rattus norvegicus
atgcagtgctgtctcaggacctggt

SEQ ID NO: 192114 - DNA, 25 bp, Rattus norvegicus
atgcagtgctgtgtcaggacctggt

SEQ ID NO: 192115 - DNA, 25 bp, Rattus norvegicus
atgcagtggcaacacttggtcctaa

SEQ ID NO: 192116 - DNA, 25 bp, Rattus norvegicus
atgcagtggcaagacttggtcctaa

SEQ ID NO: 192117 - DNA, 25 bp, Rattus norvegicus
atgcagtggcacagagtctctggcc

SEQ ID NO: 192118 - DNA, 25 bp, Rattus norvegicus
atgcagtggcactgagtctctggcc

SEQ ID NO: 192119 - DNA, 25 bp, Rattus norvegicus
atgcagtggtttagcgtagcacctc

SEQ ID NO: 192120 - DNA, 25 bp, Rattus norvegicus
atgcagtggttttgcgtagcacctc

SEQ ID NO: 192121 - DNA, 25 bp, Rattus norvegicus
atgcagtgtgatccagttgttttcc

SEQ ID NO: 192122 - DNA, 25 bp, Rattus norvegicus
atgcagtgtgatgcagttgttttcc

SEQ ID NO: 192123 - DNA, 25 bp, Rattus norvegicus
atgcagttctctcggctggatgaaa

SEQ ID NO: 192124 - DNA, 25 bp, Rattus norvegicus
atgcagttctctgggctggatgaaa

SEQ ID NO: 192125 - DNA, 25 bp, Rattus norvegicus
atgcagttgctgatgattcctctaa

SEQ ID NO: 192126 - DNA, 25 bp, Rattus norvegicus
atgcagttgctgttgattcctctaa

SEQ ID NO: 192127 - DNA, 25 bp, Rattus norvegicus
atgcagttgtgaaggcaggtcaagc

SEQ ID NO: 192128 - DNA, 25 bp, Rattus norvegicus
atgcagttgtgatggcaggtcaagc

SEQ ID NO: 192129 - DNA, 25 bp, Rattus norvegicus
atgcagttgttacgtcagccatctt

SEQ ID NO: 192130 - DNA, 25 bp, Rattus norvegicus
atgcagttgttaggtcagccatctt

SEQ ID NO: 192131 - DNA, 25 bp, Rattus norvegicus
atgcagttttcaaaaagaggctcag

SEQ ID NO: 192132 - DNA, 25 bp, Rattus norvegicus
atgcagttttcataaagaggctcag

SEQ ID NO: 192133 - DNA, 25 bp, Rattus norvegicus
atgcataaaacgagccatcccgagc

SEQ ID NO: 192134 - DNA, 25 bp, Rattus norvegicus
atgcataaaacgtgccatcccgagc

SEQ ID NO: 192135 - DNA, 25 bp, Rattus norvegicus
atgcataaaactctcacattcccct

SEQ ID NO: 192136 - DNA, 25 bp, Rattus norvegicus
atgcataaaactgtcacattcccct

SEQ ID NO: 192137 - DNA, 25 bp, Rattus norvegicus
atgcataatttacatcactgagtta

SEQ ID NO: 192138 - DNA, 25 bp, Rattus norvegicus
atgcataatttagatcactgagtta

SEQ ID NO: 192139 - DNA, 25 bp, Rattus norvegicus
atgcatacagccactactgagcaaa

SEQ ID NO: 192140 - DNA, 25 bp, Rattus norvegicus
atgcatacagcctctactgagcaaa

SEQ ID NO: 192141 - DNA, 25 bp, Rattus norvegicus
atgcatacattcactatactaggga

SEQ ID NO: 192142 - DNA, 25 bp, Rattus norvegicus
atgcatacattctctatactaggga

SEQ ID NO: 192143 - DNA, 25 bp, Rattus norvegicus
atgcatactcacattcagagcctta

SEQ ID NO: 192144 - DNA, 25 bp, Rattus norvegicus
atgcatactcactttcagagcctta

SEQ ID NO: 192145 - DNA, 25 bp, Rattus norvegicus
atgcatactgaacctcatggctttg

SEQ ID NO: 192146 - DNA, 25 bp, Rattus norvegicus
atgcatactgaagctcatggctttg

SEQ ID NO: 192147 - DNA, 25 bp, Rattus norvegicus
atgcatactgtaaccaagacattgg

SEQ ID NO: 192148 - DNA, 25 bp, Rattus norvegicus
atgcatactgtatccaagacattgg

SEQ ID NO: 192149 - DNA, 25 bp, Rattus norvegicus
atgcataggaaacaactctcccctt

SEQ ID NO: 192150 - DNA, 25 bp, Rattus norvegicus
atgcataggaaagaactctcccctt

SEQ ID NO: 192151 - DNA, 25 bp, Rattus norvegicus
atgcataggacgatggaggtgaccc

SEQ ID NO: 192152 - DNA, 25 bp, Rattus norvegicus
atgcataggacgttggaggtgaccc

SEQ ID NO: 192153 - DNA, 25 bp, Rattus norvegicus
atgcataggtctcgctttgctgtgg

SEQ ID NO: 192154 - DNA, 25 bp, Rattus norvegicus
atgcataggtctggctttgctgtgg

SEQ ID NO: 192155 - DNA, 25 bp, Rattus norvegicus
atgcatatcttgacatatcccctgg

SEQ ID NO: 192156 - DNA, 25 bp, Rattus norvegicus
atgcatatcttgtcatatcccctgg

SEQ ID NO: 192157 - DNA, 25 bp, Rattus norvegicus
atgcatatctttcagctattggagc

SEQ ID NO: 192158 - DNA, 25 bp, Rattus norvegicus
atgcatatctttgagctattggagc

SEQ ID NO: 192159 - DNA, 25 bp, Rattus norvegicus
atgcatatgcgtccacatgcttgca

SEQ ID NO: 192160 - DNA, 25 bp, Rattus norvegicus
atgcatatgcgtgcacatgcttgca

SEQ ID NO: 192161 - DNA, 25 bp, Rattus norvegicus
atgcatcagcgcaacaccctggtgg

SEQ ID NO: 192162 - DNA, 25 bp, Rattus norvegicus
atgcatcagcgctacaccctggtgg

SEQ ID NO: 192163 - DNA, 25 bp, Rattus norvegicus
atgcatcaggatactctcaggactt

SEQ ID NO: 192164 - DNA, 25 bp, Rattus norvegicus
atgcatcaggattctctcaggactt

SEQ ID NO: 192165 - DNA, 25 bp, Rattus norvegicus
atgcatcatccaactgctccaagat

SEQ ID NO: 192166 - DNA, 25 bp, Rattus norvegicus
atgcatcatccatctgctccaagat

SEQ ID NO: 192167 - DNA, 25 bp, Rattus norvegicus
atgcatcatgggacagaaatcaaac

SEQ ID NO: 192168 - DNA, 25 bp, Rattus norvegicus
atgcatcatgggtcagaaatcaaac

SEQ ID NO: 192169 - DNA, 25 bp, Rattus norvegicus
atgcatccacatacacgtgcgtaca

SEQ ID NO: 192170 - DNA, 25 bp, Rattus norvegicus
atgcatccacattcacgtgcgtaca

SEQ ID NO: 192171 - DNA, 25 bp, Rattus norvegicus
atgcatccactacttggctgcacaa

SEQ ID NO: 192172 - DNA, 25 bp, Rattus norvegicus
atgcatccactagttggctgcacaa

SEQ ID NO: 192173 - DNA, 25 bp, Rattus norvegicus
atgcatccacttcgacagtcctaat

SEQ ID NO: 192174 - DNA, 25 bp, Rattus norvegicus
atgcatccacttggacagtcctaat

SEQ ID NO: 192175 - DNA, 25 bp, Rattus norvegicus
atgcatcccaagagacacagggctt

SEQ ID NO: 192176 - DNA, 25 bp, Rattus norvegicus
atgcatcccaagtgacacagggctt

SEQ ID NO: 192177 - DNA, 25 bp, Rattus norvegicus
atgcatccctctcgttccataatta

SEQ ID NO: 192178 - DNA, 25 bp, Rattus norvegicus
atgcatccctctggttccataatta

SEQ ID NO: 192179 - DNA, 25 bp, Rattus norvegicus
atgcatccctgacacttcgaaacct

SEQ ID NO: 192180 - DNA, 25 bp, Rattus norvegicus
atgcatccctgagacttcgaaacct

SEQ ID NO: 192181 - DNA, 25 bp, Rattus norvegicus
atgcatccgcacattggtcatcttt

SEQ ID NO: 192182 - DNA, 25 bp, Rattus norvegicus
atgcatccgcactttggtcatcttt

SEQ ID NO: 192183 - DNA, 25 bp, Rattus norvegicus
atgcatccttgcatttcctaagaaa

SEQ ID NO: 192184 - DNA, 25 bp, Rattus norvegicus
atgcatccttgcttttcctaagaaa

SEQ ID NO: 192185 - DNA, 25 bp, Rattus norvegicus
atgcatcgctagacccagagtcagg

SEQ ID NO: 192186 - DNA, 25 bp, Rattus norvegicus
atgcatcgctagtcccagagtcagg

SEQ ID NO: 192187 - DNA, 25 bp, Rattus norvegicus
atgcatcggcgcctcgtaaggtcca

SEQ ID NO: 192188 - DNA, 25 bp, Rattus norvegicus
atgcatcggcgcgtcgtaaggtcca

SEQ ID NO: 192189 - DNA, 25 bp, Rattus norvegicus
atgcatctagagaggcctggctggt

SEQ ID NO: 192190 - DNA, 25 bp, Rattus norvegicus
atgcatctagagtggcctggctggt

SEQ ID NO: 192191 - DNA, 25 bp, Rattus norvegicus
atgcatctcacgcaggcaaccaagg

SEQ ID NO: 192192 - DNA, 25 bp, Rattus norvegicus
atgcatctcacggaggcaaccaagg

SEQ ID NO: 192193 - DNA, 25 bp, Rattus norvegicus
atgcatctcattatctttccgtgta

SEQ ID NO: 192194 - DNA, 25 bp, Rattus norvegicus
atgcatctcattttctttccgtgta

SEQ ID NO: 192195 - DNA, 25 bp, Rattus norvegicus
atgcatctccacaggcgtgtttggc

SEQ ID NO: 192196 - DNA, 25 bp, Rattus norvegicus
atgcatctccactggcgtgtttggc

SEQ ID NO: 192197 - DNA, 25 bp, Rattus norvegicus
atgcatctgaccaaggtcccttttg

SEQ ID NO: 192198 - DNA, 25 bp, Rattus norvegicus
atgcatctgacctaggtcccttttg

SEQ ID NO: 192199 - DNA, 25 bp, Rattus norvegicus
atgcatctgtccctgaagacctcag

SEQ ID NO: 192200 - DNA, 25 bp, Rattus norvegicus
atgcatctgtccgtgaagacctcag

SEQ ID NO: 192201 - DNA, 25 bp, Rattus norvegicus
atgcatcttcatctagttctttcag

SEQ ID NO: 192202 - DNA, 25 bp, Rattus norvegicus
atgcatcttcatgtagttctttcag

SEQ ID NO: 192203 - DNA, 25 bp, Rattus norvegicus
atgcatcttcgccaatacgagctgc

SEQ ID NO: 192204 - DNA, 25 bp, Rattus norvegicus
atgcatcttcgcgaatacgagctgc

SEQ ID NO: 192205 - DNA, 25 bp, Rattus norvegicus
atgcatcttcttcggaactatccat

SEQ ID NO: 192206 - DNA, 25 bp, Rattus norvegicus
atgcatcttcttgggaactatccat

SEQ ID NO: 192207 - DNA, 25 bp, Rattus norvegicus
atgcatgaaatcaggctgctgtcaa

SEQ ID NO: 192208 - DNA, 25 bp, Rattus norvegicus
atgcatgaaatctggctgctgtcaa

SEQ ID NO: 192209 - DNA, 25 bp, Rattus norvegicus
atgcatgacaacctgcccagataga

SEQ ID NO: 192210 - DNA, 25 bp, Rattus norvegicus
atgcatgacaacgtgcccagataga

SEQ ID NO: 192211 - DNA, 25 bp, Rattus norvegicus
atgcatgactccacagacaagctta

SEQ ID NO: 192212 - DNA, 25 bp, Rattus norvegicus
atgcatgactcctcagacaagctta

SEQ ID NO: 192213 - DNA, 25 bp, Rattus norvegicus
atgcatgagccaatgaagagtcttc

SEQ ID NO: 192214 - DNA, 25 bp, Rattus norvegicus
atgcatgagccattgaagagtcttc

SEQ ID NO: 192215 - DNA, 25 bp, Rattus norvegicus
atgcatgagcttacgtctgtgattc

SEQ ID NO: 192216 - DNA, 25 bp, Rattus norvegicus
atgcatgagctttcgtctgtgattc

SEQ ID NO: 192217 - DNA, 25 bp, Rattus norvegicus
atgcatgagtttatggcagctgacc

SEQ ID NO: 192218 - DNA, 25 bp, Rattus norvegicus
atgcatgagtttttggcagctgacc

SEQ ID NO: 192219 - DNA, 25 bp, Rattus norvegicus
atgcatgatcgccatgatctcaccg

SEQ ID NO: 192220 - DNA, 25 bp, Rattus norvegicus
atgcatgatcgcgatgatctcaccg

SEQ ID NO: 192221 - DNA, 25 bp, Rattus norvegicus
atgcatgatgaactcaacagtcatt

SEQ ID NO: 192222 - DNA, 25 bp, Rattus norvegicus
atgcatgatgaagtcaacagtcatt

SEQ ID NO: 192223 - DNA, 25 bp, Rattus norvegicus
atgcatgatgccacagcttccatat

SEQ ID NO: 192224 - DNA, 25 bp, Rattus norvegicus
atgcatgatgcctcagcttccatat

SEQ ID NO: 192225 - DNA, 25 bp, Rattus norvegicus
atgcatgatgcgaacacgttctgcc

SEQ ID NO: 192226 - DNA, 25 bp, Rattus norvegicus
atgcatgatgcgtacacgttctgcc

SEQ ID NO: 192227 - DNA, 25 bp, Rattus norvegicus
atgcatgcacatacaattctaggta

SEQ ID NO: 192228 - DNA, 25 bp, Rattus norvegicus
atgcatgcacattcaattctaggta

SEQ ID NO: 192229 - DNA, 25 bp, Rattus norvegicus
atgcatgcacccagattgcaattga

SEQ ID NO: 192230 - DNA, 25 bp, Rattus norvegicus
atgcatgcaccctgattgcaattga

SEQ ID NO: 192231 - DNA, 25 bp, Rattus norvegicus
atgcatgcagcgctcggtagccgca

SEQ ID NO: 192232 - DNA, 25 bp, Rattus norvegicus
atgcatgcagcggtcggtagccgca

SEQ ID NO: 192233 - DNA, 25 bp, Rattus norvegicus
atgcatgcatctagacgcttacctg

SEQ ID NO: 192234 - DNA, 25 bp, Rattus norvegicus
atgcatgcatcttgacgcttacctg

SEQ ID NO: 192235 - DNA, 25 bp, Rattus norvegicus
atgcatgcatggatcattctgcttt

SEQ ID NO: 192236 - DNA, 25 bp, Rattus norvegicus
atgcatgcatggttcattctgcttt

SEQ ID NO: 192237 - DNA, 25 bp, Rattus norvegicus
atgcatgcattcacaagaggtcttg

SEQ ID NO: 192238 - DNA, 25 bp, Rattus norvegicus
atgcatgcattctcaagaggtcttg

SEQ ID NO: 192239 - DNA, 25 bp, Rattus norvegicus
atgcatgccacacaagcttgcccat

SEQ ID NO: 192240 - DNA, 25 bp, Rattus norvegicus
atgcatgccacagaagcttgcccat

SEQ ID NO: 192241 - DNA, 25 bp, Rattus norvegicus
atgcatgcccttcagacctatggtc

SEQ ID NO: 192242 - DNA, 25 bp, Rattus norvegicus
atgcatgcccttgagacctatggtc

SEQ ID NO: 192243 - DNA, 25 bp, Rattus norvegicus
atgcatgcctccagtgctcaggaga

SEQ ID NO: 192244 - DNA, 25 bp, Rattus norvegicus
atgcatgcctcctgtgctcaggaga

SEQ ID NO: 192245 - DNA, 25 bp, Rattus norvegicus
atgcatgcctggcactctgacagag

SEQ ID NO: 192246 - DNA, 25 bp, Rattus norvegicus
atgcatgcctgggactctgacagag

SEQ ID NO: 192247 - DNA, 25 bp, Rattus norvegicus
atgcatgcggctctcaccccagagt

SEQ ID NO: 192248 - DNA, 25 bp, Rattus norvegicus
atgcatgcggctgtcaccccagagt

SEQ ID NO: 192249 - DNA, 25 bp, Rattus norvegicus
atgcatgcgggtaattccacattaa

SEQ ID NO: 192250 - DNA, 25 bp, Rattus norvegicus
atgcatgcgggttattccacattaa

SEQ ID NO: 192251 - DNA, 25 bp, Rattus norvegicus
atgcatgctccgctaccagaagtgt

SEQ ID NO: 192252 - DNA, 25 bp, Rattus norvegicus
atgcatgctccggtaccagaagtgt

SEQ ID NO: 192253 - DNA, 25 bp, Rattus norvegicus
atgcatgctcttctctcacagggag

SEQ ID NO: 192254 - DNA, 25 bp, Rattus norvegicus
atgcatgctcttgtctcacagggag

SEQ ID NO: 192255 - DNA, 25 bp, Rattus norvegicus
atgcatgctgctatcatttttataa

SEQ ID NO: 192256 - DNA, 25 bp, Rattus norvegicus
atgcatgctgctttcatttttataa

SEQ ID NO: 192257 - DNA, 25 bp, Rattus norvegicus
atgcatgcttatctgggaaaccctc

SEQ ID NO: 192258 - DNA, 25 bp, Rattus norvegicus
atgcatgcttatgtgggaaaccctc

SEQ ID NO: 192259 - DNA, 25 bp, Rattus norvegicus
atgcatggacggagccacggctaga

SEQ ID NO: 192260 - DNA, 25 bp, Rattus norvegicus
atgcatggacggtgccacggctaga

SEQ ID NO: 192261 - DNA, 25 bp, Rattus norvegicus
atgcatggagcgagccacttaacct

SEQ ID NO: 192262 - DNA, 25 bp, Rattus norvegicus
atgcatggagcgtgccacttaacct

SEQ ID NO: 192263 - DNA, 25 bp, Rattus norvegicus
atgcatggcaccagtgggtcagacc

SEQ ID NO: 192264 - DNA, 25 bp, Rattus norvegicus
atgcatggcacctgtgggtcagacc

SEQ ID NO: 192265 - DNA, 25 bp, Rattus norvegicus
atgcatggcagtccggagtcctcag

SEQ ID NO: 192266 - DNA, 25 bp, Rattus norvegicus
atgcatggcagtgcggagtcctcag

SEQ ID NO: 192267 - DNA, 25 bp, Rattus norvegicus
atgcatggcgtcacaaagggaataa

SEQ ID NO: 192268 - DNA, 25 bp, Rattus norvegicus
atgcatggcgtctcaaagggaataa

SEQ ID NO: 192269 - DNA, 25 bp, Rattus norvegicus
atgcatggcgttacctagtgggctt

SEQ ID NO: 192270 - DNA, 25 bp, Rattus norvegicus
atgcatggcgtttcctagtgggctt

SEQ ID NO: 192271 - DNA, 25 bp, Rattus norvegicus
atgcatggctgaactactctgttac

SEQ ID NO: 192272 - DNA, 25 bp, Rattus norvegicus
atgcatggctgatctactctgttac

SEQ ID NO: 192273 - DNA, 25 bp, Rattus norvegicus
atgcatgggcatatcagtttttatt

SEQ ID NO: 192274 - DNA, 25 bp, Rattus norvegicus
atgcatgggcatcacagggactaaa

SEQ ID NO: 192275 - DNA, 25 bp, Rattus norvegicus
atgcatgggcatgacagggactaaa

SEQ ID NO: 192276 - DNA, 25 bp, Rattus norvegicus
atgcatgggcatttcagtttttatt

SEQ ID NO: 192277 - DNA, 25 bp, Rattus norvegicus
atgcatgggccaacagagccaccat

SEQ ID NO: 192278 - DNA, 25 bp, Rattus norvegicus
atgcatgggccatcagagccaccat

SEQ ID NO: 192279 - DNA, 25 bp, Rattus norvegicus
atgcatgggctcaaagctggcctgc

SEQ ID NO: 192280 - DNA, 25 bp, Rattus norvegicus
atgcatgggctctaagctggcctgc

SEQ ID NO: 192281 - DNA, 25 bp, Rattus norvegicus
atgcatggtataaacccactaagca

SEQ ID NO: 192282 - DNA, 25 bp, Rattus norvegicus
atgcatggtatatacccactaagca

SEQ ID NO: 192283 - DNA, 25 bp, Rattus norvegicus
atgcatggttctcaggactacccct

SEQ ID NO: 192284 - DNA, 25 bp, Rattus norvegicus
atgcatggttctgaggactacccct

SEQ ID NO: 192285 - DNA, 25 bp, Rattus norvegicus
atgcatgtaaacctgtgctccgtgt

SEQ ID NO: 192286 - DNA, 25 bp, Rattus norvegicus
atgcatgtaaacgtgtgctccgtgt

SEQ ID NO: 192287 - DNA, 25 bp, Rattus norvegicus
atgcatgtcactaagttgtcacccc

SEQ ID NO: 192288 - DNA, 25 bp, Rattus norvegicus
atgcatgtcacttagttgtcacccc

SEQ ID NO: 192289 - DNA, 25 bp, Rattus norvegicus
atgcatgtccccatgtggagttgtc

SEQ ID NO: 192290 - DNA, 25 bp, Rattus norvegicus
atgcatgtccccttgtggagttgtc

SEQ ID NO: 192291 - DNA, 25 bp, Rattus norvegicus
atgcatgtctagatacagtccagaa

SEQ ID NO: 192292 - DNA, 25 bp, Rattus norvegicus
atgcatgtctagttacagtccagaa

SEQ ID NO: 192293 - DNA, 25 bp, Rattus norvegicus
atgcatgtctgtacaccacatgtgt

SEQ ID NO: 192294 - DNA, 25 bp, Rattus norvegicus
atgcatgtctgtagagagatcactc

SEQ ID NO: 192295 - DNA, 25 bp, Rattus norvegicus
atgcatgtctgttcaccacatgtgt

SEQ ID NO: 192296 - DNA, 25 bp, Rattus norvegicus
atgcatgtctgttgagagatcactc

SEQ ID NO: 192297 - DNA, 25 bp, Rattus norvegicus
atgcatgtgctgcacagattctggc

SEQ ID NO: 192298 - DNA, 25 bp, Rattus norvegicus
atgcatgtgctggacagattctggc

SEQ ID NO: 192299 - DNA, 25 bp, Rattus norvegicus
atgcatgtgtaaagactcctgactg

SEQ ID NO: 192300 - DNA, 25 bp, Rattus norvegicus
atgcatgtgtaatgactcctgactg

SEQ ID NO: 192301 - DNA, 25 bp, Rattus norvegicus
atgcatgtgtacatgtccatggtgt

SEQ ID NO: 192302 - DNA, 25 bp, Rattus norvegicus
atgcatgtgtacttgtccatggtgt

SEQ ID NO: 192303 - DNA, 25 bp, Rattus norvegicus
atgcatgtgtataaactttctttca

SEQ ID NO: 192304 - DNA, 25 bp, Rattus norvegicus
atgcatgtgtataactgggtctcaa

SEQ ID NO: 192305 - DNA, 25 bp, Rattus norvegicus
atgcatgtgtatcttagcttctaca

SEQ ID NO: 192306 - DNA, 25 bp, Rattus norvegicus
atgcatgtgtatgttagcttctaca

SEQ ID NO: 192307 - DNA, 25 bp, Rattus norvegicus
atgcatgtgtattaactttctttca

SEQ ID NO: 192308 - DNA, 25 bp, Rattus norvegicus
atgcatgtgtattactgggtctcaa

SEQ ID NO: 192309 - DNA, 25 bp, Rattus norvegicus
atgcatgtgtggaagcttacttaaa

SEQ ID NO: 192310 - DNA, 25 bp, Rattus norvegicus
atgcatgtgtggtagcttacttaaa

SEQ ID NO: 192311 - DNA, 25 bp, Rattus norvegicus
atgcatgttactaacaccccgttta

SEQ ID NO: 192312 - DNA, 25 bp, Rattus norvegicus
atgcatgttacttacaccccgttta

SEQ ID NO: 192313 - DNA, 25 bp, Rattus norvegicus
atgcatgttgctcacaaccttgcag

SEQ ID NO: 192314 - DNA, 25 bp, Rattus norvegicus
atgcatgttgctgacaaccttgcag

SEQ ID NO: 192315 - DNA, 25 bp, Rattus norvegicus
atgcatgtttgcatctgttttaaaa

SEQ ID NO: 192316 - DNA, 25 bp, Rattus norvegicus
atgcatgtttgcttctgttttaaaa

SEQ ID NO: 192317 - DNA, 25 bp, Rattus norvegicus
atgcattaactgaccatttcctgcg

SEQ ID NO: 192318 - DNA, 25 bp, Rattus norvegicus
atgcattaactgtccatttcctgcg

SEQ ID NO: 192319 - DNA, 25 bp, Rattus norvegicus
atgcattagcatatttcagaaccaa

SEQ ID NO: 192320 - DNA, 25 bp, Rattus norvegicus
atgcattagcatttttcagaaccaa

SEQ ID NO: 192321 - DNA, 25 bp, Rattus norvegicus
atgcattatatgagtggtttcctat

SEQ ID NO: 192322 - DNA, 25 bp, Rattus norvegicus
atgcattatatgtgtggtttcctat

SEQ ID NO: 192323 - DNA, 25 bp, Rattus norvegicus
atgcattcactcagccctggaggca

SEQ ID NO: 192324 - DNA, 25 bp, Rattus norvegicus
atgcattcactctgccctggaggca

SEQ ID NO: 192325 - DNA, 25 bp, Rattus norvegicus
atgcattcagagacagtgacttgct

SEQ ID NO: 192326 - DNA, 25 bp, Rattus norvegicus
atgcattcagagtcagtgacttgct

SEQ ID NO: 192327 - DNA, 25 bp, Rattus norvegicus
atgcattcatcaacagggcactgag

SEQ ID NO: 192328 - DNA, 25 bp, Rattus norvegicus
atgcattcatcatcagggcactgag

SEQ ID NO: 192329 - DNA, 25 bp, Rattus norvegicus
atgcattcatccagttgacttccag

SEQ ID NO: 192330 - DNA, 25 bp, Rattus norvegicus
atgcattcatcctgttgacttccag

SEQ ID NO: 192331 - DNA, 25 bp, Rattus norvegicus
atgcattcccctagtggtgcacaat

SEQ ID NO: 192332 - DNA, 25 bp, Rattus norvegicus
atgcattccccttgtggtgcacaat

SEQ ID NO: 192333 - DNA, 25 bp, Rattus norvegicus
atgcattcctgacgcataggatgaa

SEQ ID NO: 192334 - DNA, 25 bp, Rattus norvegicus
atgcattcctgaggcataggatgaa

SEQ ID NO: 192335 - DNA, 25 bp, Rattus norvegicus
atgcattccttgctgctctttgagt

SEQ ID NO: 192336 - DNA, 25 bp, Rattus norvegicus
atgcattccttggtgctctttgagt

SEQ ID NO: 192337 - DNA, 25 bp, Rattus norvegicus
atgcattcctttaagccagccagtg

SEQ ID NO: 192338 - DNA, 25 bp, Rattus norvegicus
atgcattcctttatttgatagtcaa

SEQ ID NO: 192339 - DNA, 25 bp, Rattus norvegicus
atgcattccttttagccagccagtg

SEQ ID NO: 192340 - DNA, 25 bp, Rattus norvegicus
atgcattcctttttttgatagtcaa

SEQ ID NO: 192341 - DNA, 25 bp, Rattus norvegicus
atgcattctggtctcgttcctgtgg

SEQ ID NO: 192342 - DNA, 25 bp, Rattus norvegicus
atgcattctggtgtcgttcctgtgg

SEQ ID NO: 192343 - DNA, 25 bp, Rattus norvegicus
atgcattcttcaattacttcaggga

SEQ ID NO: 192344 - DNA, 25 bp, Rattus norvegicus
atgcattcttcaattgctgctgttt

SEQ ID NO: 192345 - DNA, 25 bp, Rattus norvegicus
atgcattcttcatttacttcaggga

SEQ ID NO: 192346 - DNA, 25 bp, Rattus norvegicus
atgcattcttcatttgctgctgttt

SEQ ID NO: 192347 - DNA, 25 bp, Rattus norvegicus
atgcattcttgtcccgtgatggcag

SEQ ID NO: 192348 - DNA, 25 bp, Rattus norvegicus
atgcattcttgtgccgtgatggcag

SEQ ID NO: 192349 - DNA, 25 bp, Rattus norvegicus
atgcattgacttatcctttacaggg

SEQ ID NO: 192350 - DNA, 25 bp, Rattus norvegicus
atgcattgacttttcctttacaggg

SEQ ID NO: 192351 - DNA, 25 bp, Rattus norvegicus
atgcattgagcacgcaaggaccttt

SEQ ID NO: 192352 - DNA, 25 bp, Rattus norvegicus
atgcattgagcaggcaaggaccttt

SEQ ID NO: 192353 - DNA, 25 bp, Rattus norvegicus
atgcattgagtgattctggctcaga

SEQ ID NO: 192354 - DNA, 25 bp, Rattus norvegicus
atgcattgagtgtttctggctcaga

SEQ ID NO: 192355 - DNA, 25 bp, Rattus norvegicus
atgcattgatgcaatctcatccctt

SEQ ID NO: 192356 - DNA, 25 bp, Rattus norvegicus
atgcattgatgctatctcatccctt

SEQ ID NO: 192357 - DNA, 25 bp, Rattus norvegicus
atgcattgcacacccggtgctaacc

SEQ ID NO: 192358 - DNA, 25 bp, Rattus norvegicus
atgcattgcacagccggtgctaacc

SEQ ID NO: 192359 - DNA, 25 bp, Rattus norvegicus
atgcattgcatgagaccacacagtg

SEQ ID NO: 192360 - DNA, 25 bp, Rattus norvegicus
atgcattgcatgtgaccacacagtg

SEQ ID NO: 192361 - DNA, 25 bp, Rattus norvegicus
atgcattgccaaacatcctgaactg

SEQ ID NO: 192362 - DNA, 25 bp, Rattus norvegicus
atgcattgccaatcatcctgaactg

SEQ ID NO: 192363 - DNA, 25 bp, Rattus norvegicus
atgcattgccaccagtgggctcaga

SEQ ID NO: 192364 - DNA, 25 bp, Rattus norvegicus
atgcattgccacgagtgggctcaga

SEQ ID NO: 192365 - DNA, 25 bp, Rattus norvegicus
atgcattgccccagaggagttggag

SEQ ID NO: 192366 - DNA, 25 bp, Rattus norvegicus
atgcattgcccctgaggagttggag

SEQ ID NO: 192367 - DNA, 25 bp, Rattus norvegicus
atgcattgctgtaccagaggacctg

SEQ ID NO: 192368 - DNA, 25 bp, Rattus norvegicus
atgcattgctgttccagaggacctg

SEQ ID NO: 192369 - DNA, 25 bp, Rattus norvegicus
atgcattgtcgccctgtgtggtcgc

SEQ ID NO: 192370 - DNA, 25 bp, Rattus norvegicus
atgcattgtcgcgctgtgtggtcgc

SEQ ID NO: 192371 - DNA, 25 bp, Rattus norvegicus
atgcattgtgggaagaacgtctcag

SEQ ID NO: 192372 - DNA, 25 bp, Rattus norvegicus
atgcattgtgggtagaacgtctcag

SEQ ID NO: 192373 - DNA, 25 bp, Rattus norvegicus
atgcattgttccagctacttgggag

SEQ ID NO: 192374 - DNA, 25 bp, Rattus norvegicus
atgcattgttcctgctacttgggag

SEQ ID NO: 192375 - DNA, 25 bp, Rattus norvegicus
atgcatttagggaacctcaaggact

SEQ ID NO: 192376 - DNA, 25 bp, Rattus norvegicus
atgcatttagggtacctcaaggact

SEQ ID NO: 192377 - DNA, 25 bp, Rattus norvegicus
atgcatttatgcactgactgggcca

SEQ ID NO: 192378 - DNA, 25 bp, Rattus norvegicus
atgcatttatgctctgactgggcca

SEQ ID NO: 192379 - DNA, 25 bp, Rattus norvegicus
atgcatttcaagctgcctccatgga

SEQ ID NO: 192380 - DNA, 25 bp, Rattus norvegicus
atgcatttcaaggtgcctccatgga

SEQ ID NO: 192381 - DNA, 25 bp, Rattus norvegicus
atgcatttcactcactgtgccatct

SEQ ID NO: 192382 - DNA, 25 bp, Rattus norvegicus
atgcatttcactgactgtgccatct

SEQ ID NO: 192383 - DNA, 25 bp, Rattus norvegicus
atgcatttcaggagctcagcatgga

SEQ ID NO: 192384 - DNA, 25 bp, Rattus norvegicus
atgcatttcaggtgctcagcatgga

SEQ ID NO: 192385 - DNA, 25 bp, Rattus norvegicus
atgcatttctgacttttcttgttaa

SEQ ID NO: 192386 - DNA, 25 bp, Rattus norvegicus
atgcatttctgagttttcttgttaa

SEQ ID NO: 192387 - DNA, 25 bp, Rattus norvegicus
atgcatttctttatcttttactcta

SEQ ID NO: 192388 - DNA, 25 bp, Rattus norvegicus
atgcatttctttttcttttactcta

SEQ ID NO: 192389 - DNA, 25 bp, Rattus norvegicus
atgcatttgagtatttccccatggc

SEQ ID NO: 192390 - DNA, 25 bp, Rattus norvegicus
atgcatttgagtttttccccatggc

SEQ ID NO: 192391 - DNA, 25 bp, Rattus norvegicus
atgcatttgcccacttcaatgctga

SEQ ID NO: 192392 - DNA, 25 bp, Rattus norvegicus
atgcatttgccctcttcaatgctga

SEQ ID NO: 192393 - DNA, 25 bp, Rattus norvegicus
atgcatttggcactactgtcctcct

SEQ ID NO: 192394 - DNA, 25 bp, Rattus norvegicus
atgcatttggcagtactgtcctcct

SEQ ID NO: 192395 - DNA, 25 bp, Rattus norvegicus
atgcatttggccactttctctacaa

SEQ ID NO: 192396 - DNA, 25 bp, Rattus norvegicus
atgcatttggcctctttctctacaa

SEQ ID NO: 192397 - DNA, 25 bp, Rattus norvegicus
atgcatttgtctcactaagttcccc

SEQ ID NO: 192398 - DNA, 25 bp, Rattus norvegicus
atgcatttgtctgactaagttcccc

SEQ ID NO: 192399 - DNA, 25 bp, Rattus norvegicus
atgcattttattacccagcaagctg

SEQ ID NO: 192400 - DNA, 25 bp, Rattus norvegicus
atgcattttatttcccagcaagctg

SEQ ID NO: 192401 - DNA, 25 bp, Rattus norvegicus
atgccaaaatgcctctcattgctgt

SEQ ID NO: 192402 - DNA, 25 bp, Rattus norvegicus
atgccaaaatgcgtctcattgctgt

SEQ ID NO: 192403 - DNA, 25 bp, Rattus norvegicus
atgccaaacacgcaactctgtcatc

SEQ ID NO: 192404 - DNA, 25 bp, Rattus norvegicus
atgccaaacacggaactctgtcatc

SEQ ID NO: 192405 - DNA, 25 bp, Rattus norvegicus
atgccaaactcgagccaaagactgt

SEQ ID NO: 192406 - DNA, 25 bp, Rattus norvegicus
atgccaaactcgtgccaaagactgt

SEQ ID NO: 192407 - DNA, 25 bp, Rattus norvegicus
atgccaaagaccctgggctcaaata

SEQ ID NO: 192408 - DNA, 25 bp, Rattus norvegicus
atgccaaagaccgtgggctcaaata

SEQ ID NO: 192409 - DNA, 25 bp, Rattus norvegicus
atgccaaagatacctccccttaagg

SEQ ID NO: 192410 - DNA, 25 bp, Rattus norvegicus
atgccaaagatagctccccttaagg

SEQ ID NO: 192411 - DNA, 25 bp, Rattus norvegicus
atgccaaagttgattagcctccacc

SEQ ID NO: 192412 - DNA, 25 bp, Rattus norvegicus
atgccaaagttgtttagcctccacc

SEQ ID NO: 192413 - DNA, 25 bp, Rattus norvegicus
atgccaaatttactgctactccccg

SEQ ID NO: 192414 - DNA, 25 bp, Rattus norvegicus
atgccaaatttagtgctactccccg

SEQ ID NO: 192415 - DNA, 25 bp, Rattus norvegicus
atgccaacaccacgtggaaccagta

SEQ ID NO: 192416 - DNA, 25 bp, Rattus norvegicus
atgccaacaccaggtggaaccagta

SEQ ID NO: 192417 - DNA, 25 bp, Rattus norvegicus
atgccaacatagctaacgcgactgt

SEQ ID NO: 192418 - DNA, 25 bp, Rattus norvegicus
atgccaacataggtaacgcgactgt

SEQ ID NO: 192419 - DNA, 25 bp, Rattus norvegicus
atgccaaccactccaaaattctgag

SEQ ID NO: 192420 - DNA, 25 bp, Rattus norvegicus
atgccaaccactgcaaaattctgag

SEQ ID NO: 192421 - DNA, 25 bp, Rattus norvegicus
atgccaacctttctacaatcaactt

SEQ ID NO: 192422 - DNA, 25 bp, Rattus norvegicus
atgccaacctttgtacaatcaactt

SEQ ID NO: 192423 - DNA, 25 bp, Rattus norvegicus
atgccaactctcctcaacagatcag

SEQ ID NO: 192424 - DNA, 25 bp, Rattus norvegicus
atgccaactctcgtcaacagatcag

SEQ ID NO: 192425 - DNA, 25 bp, Rattus norvegicus
atgccaacttaccagatccgagctc

SEQ ID NO: 192426 - DNA, 25 bp, Rattus norvegicus
atgccaacttacgagatccgagctc

SEQ ID NO: 192427 - DNA, 25 bp, Rattus norvegicus
atgccaacttcacagctggatcctg

SEQ ID NO: 192428 - DNA, 25 bp, Rattus norvegicus
atgccaacttcagagctggatcctg

SEQ ID NO: 192429 - DNA, 25 bp, Rattus norvegicus
atgccaagaaagaagctgcccagaa

SEQ ID NO: 192430 - DNA, 25 bp, Rattus norvegicus
atgccaagaaagtagctgcccagaa

SEQ ID NO: 192431 - DNA, 25 bp, Rattus norvegicus
atgccaagaagacctcgtgaccctg

SEQ ID NO: 192432 - DNA, 25 bp, Rattus norvegicus
atgccaagaagagctcgtgaccctg

SEQ ID NO: 192433 - DNA, 25 bp, Rattus norvegicus
atgccaagacccagacacctttgaa

SEQ ID NO: 192434 - DNA, 25 bp, Rattus norvegicus
atgccaagaccctgacacctttgaa

SEQ ID NO: 192435 - DNA, 25 bp, Rattus norvegicus
atgccaagatgtcttggactctgaa

SEQ ID NO: 192436 - DNA, 25 bp, Rattus norvegicus
atgccaagatgtgttggactctgaa

SEQ ID NO: 192437 - DNA, 25 bp, Rattus norvegicus
atgccaagcatgaacgcgtccatgg

SEQ ID NO: 192438 - DNA, 25 bp, Rattus norvegicus
atgccaagcatgtacgcgtccatgg

SEQ ID NO: 192439 - DNA, 25 bp, Rattus norvegicus
atgccaagccttatttctctttgaa

SEQ ID NO: 192440 - DNA, 25 bp, Rattus norvegicus
atgccaagccttttttctctttgaa

SEQ ID NO: 192441 - DNA, 25 bp, Rattus norvegicus
atgccaaggaaaacttaacccgctt

SEQ ID NO: 192442 - DNA, 25 bp, Rattus norvegicus
atgccaaggaaatcttaacccgctt

SEQ ID NO: 192443 - DNA, 25 bp, Rattus norvegicus
atgccaaggaagatcccctgctgac

SEQ ID NO: 192444 - DNA, 25 bp, Rattus norvegicus
atgccaaggaagttcccctgctgac

SEQ ID NO: 192445 - DNA, 25 bp, Rattus norvegicus
atgccaagggtgaccttcgccagat

SEQ ID NO: 192446 - DNA, 25 bp, Rattus norvegicus
atgccaagggtgtccttcgccagat

SEQ ID NO: 192447 - DNA, 25 bp, Rattus norvegicus
atgccaaggtcaaacgggctgccga

SEQ ID NO: 192448 - DNA, 25 bp, Rattus norvegicus
atgccaaggtcatacgggctgccga

SEQ ID NO: 192449 - DNA, 25 bp, Rattus norvegicus
atgccaagtacacatgctactgccg

SEQ ID NO: 192450 - DNA, 25 bp, Rattus norvegicus
atgccaagtacagatgctactgccg

SEQ ID NO: 192451 - DNA, 25 bp, Rattus norvegicus
atgccaagtcccagtgagtccttag

SEQ ID NO: 192452 - DNA, 25 bp, Rattus norvegicus
atgccaagtccctgtgagtccttag

SEQ ID NO: 192453 - DNA, 25 bp, Rattus norvegicus
atgccaagttcaattgacttttatt

SEQ ID NO: 192454 - DNA, 25 bp, Rattus norvegicus
atgccaagttcacccatgagtactc

SEQ ID NO: 192455 - DNA, 25 bp, Rattus norvegicus
atgccaagttcagccatgagtactc

SEQ ID NO: 192456 - DNA, 25 bp, Rattus norvegicus
atgccaagttcatttgacttttatt

SEQ ID NO: 192457 - DNA, 25 bp, Rattus norvegicus
atgccaatccgtattgcaggcctat

SEQ ID NO: 192458 - DNA, 25 bp, Rattus norvegicus
atgccaatccgttttgcaggcctat

SEQ ID NO: 192459 - DNA, 25 bp, Rattus norvegicus
atgccaatggcaacctcaatgtttc

SEQ ID NO: 192460 - DNA, 25 bp, Rattus norvegicus
atgccaatggcaacgtctggaagac

SEQ ID NO: 192461 - DNA, 25 bp, Rattus norvegicus
atgccaatggcatcctcaatgtttc

SEQ ID NO: 192462 - DNA, 25 bp, Rattus norvegicus
atgccaatggcatcgtctggaagac

SEQ ID NO: 192463 - DNA, 25 bp, Rattus norvegicus
atgccaattgttctgtgcaccagcc

SEQ ID NO: 192464 - DNA, 25 bp, Rattus norvegicus
atgccaattgttgtgtgcaccagcc

SEQ ID NO: 192465 - DNA, 25 bp, Rattus norvegicus
atgccaatttggagctttttgtaca

SEQ ID NO: 192466 - DNA, 25 bp, Rattus norvegicus
atgccaatttggtgctttttgtaca

SEQ ID NO: 192467 - DNA, 25 bp, Rattus norvegicus
atgccacaatttcttttgcacacca

SEQ ID NO: 192468 - DNA, 25 bp, Rattus norvegicus
atgccacaatttgttttgcacacca

SEQ ID NO: 192469 - DNA, 25 bp, Rattus norvegicus
atgccacactgtctgtaccaggtag

SEQ ID NO: 192470 - DNA, 25 bp, Rattus norvegicus
atgccacactgtgtgtaccaggtag

SEQ ID NO: 192471 - DNA, 25 bp, Rattus norvegicus
atgccacagaaaacatcccgggact

SEQ ID NO: 192472 - DNA, 25 bp, Rattus norvegicus
atgccacagaaatcatcccgggact

SEQ ID NO: 192473 - DNA, 25 bp, Rattus norvegicus
atgccacagacgacgacatcgtgtt

SEQ ID NO: 192474 - DNA, 25 bp, Rattus norvegicus
atgccacagacgtcgacatcgtgtt

SEQ ID NO: 192475 - DNA, 25 bp, Rattus norvegicus
atgccacagcggcaacttgccagct

SEQ ID NO: 192476 - DNA, 25 bp, Rattus norvegicus
atgccacagcgggaacttgccagct

SEQ ID NO: 192477 - DNA, 25 bp, Rattus norvegicus
atgccacagcttccacagagagacg

SEQ ID NO: 192478 - DNA, 25 bp, Rattus norvegicus
atgccacagcttgcacagagagacg

SEQ ID NO: 192479 - DNA, 25 bp, Rattus norvegicus
atgccacaggacacatttctactgt

SEQ ID NO: 192480 - DNA, 25 bp, Rattus norvegicus
atgccacaggactcatttctactgt

SEQ ID NO: 192481 - DNA, 25 bp, Rattus norvegicus
atgccacaggcacagtcacaagcga

SEQ ID NO: 192482 - DNA, 25 bp, Rattus norvegicus
atgccacaggcagagtcacaagcga

SEQ ID NO: 192483 - DNA, 25 bp, Rattus norvegicus
atgccacagggcaattcgggcgtct

SEQ ID NO: 192484 - DNA, 25 bp, Rattus norvegicus
atgccacagggctattcgggcgtct

SEQ ID NO: 192485 - DNA, 25 bp, Rattus norvegicus
atgccaccagctcttagagcggttg

SEQ ID NO: 192486 - DNA, 25 bp, Rattus norvegicus
atgccaccagctgttagagcggttg

SEQ ID NO: 192487 - DNA, 25 bp, Rattus norvegicus
atgccaccagggatcttgtgcttac

SEQ ID NO: 192488 - DNA, 25 bp, Rattus norvegicus
atgccaccagggttcttgtgcttac

SEQ ID NO: 192489 - DNA, 25 bp, Rattus norvegicus
atgccaccagtcctaatggcttacg

SEQ ID NO: 192490 - DNA, 25 bp, Rattus norvegicus
atgccaccagtcgtaatggcttacg

SEQ ID NO: 192491 - DNA, 25 bp, Rattus norvegicus
atgccacccagaactcacttttgag

SEQ ID NO: 192492 - DNA, 25 bp, Rattus norvegicus
atgccacccagactgcaaggtttta

SEQ ID NO: 192493 - DNA, 25 bp, Rattus norvegicus
atgccacccagagtgcaaggtttta

SEQ ID NO: 192494 - DNA, 25 bp, Rattus norvegicus
atgccacccagatctcacttttgag

SEQ ID NO: 192495 - DNA, 25 bp, Rattus norvegicus
atgccacccagtctgtaggtgagca

SEQ ID NO: 192496 - DNA, 25 bp, Rattus norvegicus
atgccacccagtgtgtaggtgagca

SEQ ID NO: 192497 - DNA, 25 bp, Rattus norvegicus
atgccaccccgaaaagaggcttctt

SEQ ID NO: 192498 - DNA, 25 bp, Rattus norvegicus
atgccaccccgataagaggcttctt

SEQ ID NO: 192499 - DNA, 25 bp, Rattus norvegicus
atgccacccctactattctattggt

SEQ ID NO: 192500 - DNA, 25 bp, Rattus norvegicus
atgccacccctagtattctattggt

SEQ ID NO: 192501 - DNA, 25 bp, Rattus norvegicus
atgccaccctcccaaggtgatggag

SEQ ID NO: 192502 - DNA, 25 bp, Rattus norvegicus
atgccaccctccgaaggtgatggag

SEQ ID NO: 192503 - DNA, 25 bp, Rattus norvegicus
atgccaccgaggcaattcgcactgt

SEQ ID NO: 192504 - DNA, 25 bp, Rattus norvegicus
atgccaccgagggaattcgcactgt

SEQ ID NO: 192505 - DNA, 25 bp, Rattus norvegicus
atgccacctaatcctgctgggacta

SEQ ID NO: 192506 - DNA, 25 bp, Rattus norvegicus
atgccacctaatgctgctgggacta

SEQ ID NO: 192507 - DNA, 25 bp, Rattus norvegicus
atgccacctcttcgccgagtatgat

SEQ ID NO: 192508 - DNA, 25 bp, Rattus norvegicus
atgccacctcttggccgagtatgat

SEQ ID NO: 192509 - DNA, 25 bp, Rattus norvegicus
atgccacctgacaagtaagcctctg

SEQ ID NO: 192510 - DNA, 25 bp, Rattus norvegicus
atgccacctgactagtaagcctctg

SEQ ID NO: 192511 - DNA, 25 bp, Rattus norvegicus
atgccacctgggatcagcaagggct

SEQ ID NO: 192512 - DNA, 25 bp, Rattus norvegicus
atgccacctgggttcagcaagggct

SEQ ID NO: 192513 - DNA, 25 bp, Rattus norvegicus
atgccacctttgactgatgctatcc

SEQ ID NO: 192514 - DNA, 25 bp, Rattus norvegicus
atgccacctttgattatacctacga

SEQ ID NO: 192515 - DNA, 25 bp, Rattus norvegicus
atgccacctttgtctgatgctatcc

SEQ ID NO: 192516 - DNA, 25 bp, Rattus norvegicus
atgccacctttgtttatacctacga

SEQ ID NO: 192517 - DNA, 25 bp, Rattus norvegicus
atgccacgtcgactgagaagctgta

SEQ ID NO: 192518 - DNA, 25 bp, Rattus norvegicus
atgccacgtcgagtgagaagctgta

SEQ ID NO: 192519 - DNA, 25 bp, Rattus norvegicus
atgccacgtgctccaggttggactg

SEQ ID NO: 192520 - DNA, 25 bp, Rattus norvegicus
atgccacgtgctgcaggttggactg

SEQ ID NO: 192521 - DNA, 25 bp, Rattus norvegicus
atgccacgtggccagctgagtccag

SEQ ID NO: 192522 - DNA, 25 bp, Rattus norvegicus
atgccacgtggcgagctgagtccag

SEQ ID NO: 192523 - DNA, 25 bp, Rattus norvegicus
atgccacgttatcctgactcatcag

SEQ ID NO: 192524 - DNA, 25 bp, Rattus norvegicus
atgccacgttatgctgactcatcag

SEQ ID NO: 192525 - DNA, 25 bp, Rattus norvegicus
atgccactacctaccagggatttgt

SEQ ID NO: 192526 - DNA, 25 bp, Rattus norvegicus
atgccactaccttccagggatttgt

SEQ ID NO: 192527 - DNA, 25 bp, Rattus norvegicus
atgccactatgcacaacatctggtg

SEQ ID NO: 192528 - DNA, 25 bp, Rattus norvegicus
atgccactatgctcaacatctggtg

SEQ ID NO: 192529 - DNA, 25 bp, Rattus norvegicus
atgccactcgatccacacgagtctt

SEQ ID NO: 192530 - DNA, 25 bp, Rattus norvegicus
atgccactcgatgcacacgagtctt

SEQ ID NO: 192531 - DNA, 25 bp, Rattus norvegicus
atgccactcgtgaagcgatcagaga

SEQ ID NO: 192532 - DNA, 25 bp, Rattus norvegicus
atgccactcgtgtagcgatcagaga

SEQ ID NO: 192533 - DNA, 25 bp, Rattus norvegicus
atgccactcttactgccagggtgaa

SEQ ID NO: 192534 - DNA, 25 bp, Rattus norvegicus
atgccactcttagtgccagggtgaa

SEQ ID NO: 192535 - DNA, 25 bp, Rattus norvegicus
atgccactgaatacgttgaaaaaat

SEQ ID NO: 192536 - DNA, 25 bp, Rattus norvegicus
atgccactgaattcgttgaaaaaat

SEQ ID NO: 192537 - DNA, 25 bp, Rattus norvegicus
atgccactggaaagggtctttgcct

SEQ ID NO: 192538 - DNA, 25 bp, Rattus norvegicus
atgccactggaatgggtctttgcct

SEQ ID NO: 192539 - DNA, 25 bp, Rattus norvegicus
atgccactggatattactcttgtta

SEQ ID NO: 192540 - DNA, 25 bp, Rattus norvegicus
atgccactggattttactcttgtta

SEQ ID NO: 192541 - DNA, 25 bp, Rattus norvegicus
atgccactgggaccagagccacgtg

SEQ ID NO: 192542 - DNA, 25 bp, Rattus norvegicus
atgccactgggagcagagccacgtg

SEQ ID NO: 192543 - DNA, 25 bp, Rattus norvegicus
atgccactgtggcaagtgtgatagt

SEQ ID NO: 192544 - DNA, 25 bp, Rattus norvegicus
atgccactgtgggaagtgtgatagt

SEQ ID NO: 192545 - DNA, 25 bp, Rattus norvegicus
atgccacttaaccttcccttagata

SEQ ID NO: 192546 - DNA, 25 bp, Rattus norvegicus
atgccacttaacgttcccttagata

SEQ ID NO: 192547 - DNA, 25 bp, Rattus norvegicus
atgccacttcagattagttcatttg

SEQ ID NO: 192548 - DNA, 25 bp, Rattus norvegicus
atgccacttcagtttagttcatttg

SEQ ID NO: 192549 - DNA, 25 bp, Rattus norvegicus
atgccacttgatatgattccacact

SEQ ID NO: 192550 - DNA, 25 bp, Rattus norvegicus
atgccacttgatttgattccacact

SEQ ID NO: 192551 - DNA, 25 bp, Rattus norvegicus
atgccagaaatgcatttgcccgtcc

SEQ ID NO: 192552 - DNA, 25 bp, Rattus norvegicus
atgccagaaatggatttgcccgtcc

SEQ ID NO: 192553 - DNA, 25 bp, Rattus norvegicus
atgccagaatttcaaccaggcggcc

SEQ ID NO: 192554 - DNA, 25 bp, Rattus norvegicus
atgccagaatttgaaccaggcggcc

SEQ ID NO: 192555 - DNA, 25 bp, Rattus norvegicus
atgccagaccctactcaggatgagg

SEQ ID NO: 192556 - DNA, 25 bp, Rattus norvegicus
atgccagacccttctcaggatgagg

SEQ ID NO: 192557 - DNA, 25 bp, Rattus norvegicus
atgccagagcagctgtagccagtca

SEQ ID NO: 192558 - DNA, 25 bp, Rattus norvegicus
atgccagagcaggtgtagccagtca

SEQ ID NO: 192559 - DNA, 25 bp, Rattus norvegicus
atgccagagcctctcatctaatgga

SEQ ID NO: 192560 - DNA, 25 bp, Rattus norvegicus
atgccagagcctgtcatctaatgga

SEQ ID NO: 192561 - DNA, 25 bp, Rattus norvegicus
atgccagagtcgagctttaccgata

SEQ ID NO: 192562 - DNA, 25 bp, Rattus norvegicus
atgccagagtcgtgctttaccgata

SEQ ID NO: 192563 - DNA, 25 bp, Rattus norvegicus
atgccagatgtgaaccaggctgtgt

SEQ ID NO: 192564 - DNA, 25 bp, Rattus norvegicus
atgccagatgtgctgagattttatc

SEQ ID NO: 192565 - DNA, 25 bp, Rattus norvegicus
atgccagatgtggtgagattttatc

SEQ ID NO: 192566 - DNA, 25 bp, Rattus norvegicus
atgccagatgtgtaccaggctgtgt

SEQ ID NO: 192567 - DNA, 25 bp, Rattus norvegicus
atgccagcaaagagacctccaaggg

SEQ ID NO: 192568 - DNA, 25 bp, Rattus norvegicus
atgccagcaaagtgacctccaaggg

SEQ ID NO: 192569 - DNA, 25 bp, Rattus norvegicus
atgccagcactgacacctgggtgta

SEQ ID NO: 192570 - DNA, 25 bp, Rattus norvegicus
atgccagcactgtcacctgggtgta

SEQ ID NO: 192571 - DNA, 25 bp, Rattus norvegicus
atgccagcaggactgttgcaagttt

SEQ ID NO: 192572 - DNA, 25 bp, Rattus norvegicus
atgccagcaggagtgttgcaagttt

SEQ ID NO: 192573 - DNA, 25 bp, Rattus norvegicus
atgccagcagtgacacaactaccag

SEQ ID NO: 192574 - DNA, 25 bp, Rattus norvegicus
atgccagcagtgtcacaactaccag

SEQ ID NO: 192575 - DNA, 25 bp, Rattus norvegicus
atgccagcatccatttggacactca

SEQ ID NO: 192576 - DNA, 25 bp, Rattus norvegicus
atgccagcatccttttggacactca

SEQ ID NO: 192577 - DNA, 25 bp, Rattus norvegicus
atgccagcatttcggctttgttcgt

SEQ ID NO: 192578 - DNA, 25 bp, Rattus norvegicus
atgccagcatttgggctttgttcgt

SEQ ID NO: 192579 - DNA, 25 bp, Rattus norvegicus
atgccagccaagcaatcagcccagg

SEQ ID NO: 192580 - DNA, 25 bp, Rattus norvegicus
atgccagccaaggaatcagcccagg

SEQ ID NO: 192581 - DNA, 25 bp, Rattus norvegicus
atgccagccagacctagtgacactt

SEQ ID NO: 192582 - DNA, 25 bp, Rattus norvegicus
atgccagccagagctagtgacactt

SEQ ID NO: 192583 - DNA, 25 bp, Rattus norvegicus
atgccagccagcctcacacagtgag

SEQ ID NO: 192584 - DNA, 25 bp, Rattus norvegicus
atgccagccagcgtcacacagtgag

SEQ ID NO: 192585 - DNA, 25 bp, Rattus norvegicus
atgccagccatcagttttgacactt

SEQ ID NO: 192586 - DNA, 25 bp, Rattus norvegicus
atgccagccatctgttttgacactt

SEQ ID NO: 192587 - DNA, 25 bp, Rattus norvegicus
atgccagcccgaaaacttcagacac

SEQ ID NO: 192588 - DNA, 25 bp, Rattus norvegicus
atgccagcccgataacttcagacac

SEQ ID NO: 192589 - DNA, 25 bp, Rattus norvegicus
atgccagccgttagacacatgtgct

SEQ ID NO: 192590 - DNA, 25 bp, Rattus norvegicus
atgccagccgtttgacacatgtgct

SEQ ID NO: 192591 - DNA, 25 bp, Rattus norvegicus
atgccagcctgaacctagacttgct

SEQ ID NO: 192592 - DNA, 25 bp, Rattus norvegicus
atgccagcctgatcctagacttgct

SEQ ID NO: 192593 - DNA, 25 bp, Rattus norvegicus
atgccagcctgtctcattgaggtct

SEQ ID NO: 192594 - DNA, 25 bp, Rattus norvegicus
atgccagcctgtgtcattgaggtct

SEQ ID NO: 192595 - DNA, 25 bp, Rattus norvegicus
atgccagccttgacttcatatcaag

SEQ ID NO: 192596 - DNA, 25 bp, Rattus norvegicus
atgccagccttgtcttcatatcaag

SEQ ID NO: 192597 - DNA, 25 bp, Rattus norvegicus
atgccagctcgacctgtcatgggaa

SEQ ID NO: 192598 - DNA, 25 bp, Rattus norvegicus
atgccagctcgagctgtcatgggaa

SEQ ID NO: 192599 - DNA, 25 bp, Rattus norvegicus
atgccagctgctaatattttgtatt

SEQ ID NO: 192600 - DNA, 25 bp, Rattus norvegicus
atgccagctgctactttgacattga

SEQ ID NO: 192601 - DNA, 25 bp, Rattus norvegicus
atgccagctgcttatattttgtatt

SEQ ID NO: 192602 - DNA, 25 bp, Rattus norvegicus
atgccagctgcttctttgacattga

SEQ ID NO: 192603 - DNA, 25 bp, Rattus norvegicus
atgccagcttttctttttccttgat

SEQ ID NO: 192604 - DNA, 25 bp, Rattus norvegicus
atgccagcttttgtttttccttgat

SEQ ID NO: 192605 - DNA, 25 bp, Rattus norvegicus
atgccaggacatcgctgcgtcagtc

SEQ ID NO: 192606 - DNA, 25 bp, Rattus norvegicus
atgccaggacatggctgcgtcagtc

SEQ ID NO: 192607 - DNA, 25 bp, Rattus norvegicus
atgccaggattaccactgtgtgcca

SEQ ID NO: 192608 - DNA, 25 bp, Rattus norvegicus
atgccaggattagcactgtgtgcca

SEQ ID NO: 192609 - DNA, 25 bp, Rattus norvegicus
atgccaggcaggactctcctttata

SEQ ID NO: 192610 - DNA, 25 bp, Rattus norvegicus
atgccaggcaggtctctcctttata

SEQ ID NO: 192611 - DNA, 25 bp, Rattus norvegicus
atgccaggcagtcatgtcattgtcc

SEQ ID NO: 192612 - DNA, 25 bp, Rattus norvegicus
atgccaggcagtgatgtcattgtcc

SEQ ID NO: 192613 - DNA, 25 bp, Rattus norvegicus
atgccaggccctctttcaataaaca

SEQ ID NO: 192614 - DNA, 25 bp, Rattus norvegicus
atgccaggccctgtttcaataaaca

SEQ ID NO: 192615 - DNA, 25 bp, Rattus norvegicus
atgccaggctgacatgacttgcttt

SEQ ID NO: 192616 - DNA, 25 bp, Rattus norvegicus
atgccaggctgagatgacttgcttt

SEQ ID NO: 192617 - DNA, 25 bp, Rattus norvegicus
atgccaggctgtcgctgtctgccat

SEQ ID NO: 192618 - DNA, 25 bp, Rattus norvegicus
atgccaggctgtggctgtctgccat

SEQ ID NO: 192619 - DNA, 25 bp, Rattus norvegicus
atgccagggccacaatggagctcta

SEQ ID NO: 192620 - DNA, 25 bp, Rattus norvegicus
atgccagggccagaatggagctcta

SEQ ID NO: 192621 - DNA, 25 bp, Rattus norvegicus
atgccaggggccagactcagtctaa

SEQ ID NO: 192622 - DNA, 25 bp, Rattus norvegicus
atgccaggggcctgactcagtctaa

SEQ ID NO: 192623 - DNA, 25 bp, Rattus norvegicus
atgccagggttgctgccaggaccac

SEQ ID NO: 192624 - DNA, 25 bp, Rattus norvegicus
atgccagggttggtgccaggaccac

SEQ ID NO: 192625 - DNA, 25 bp, Rattus norvegicus
atgccaggtggcactaaggtccttg

SEQ ID NO: 192626 - DNA, 25 bp, Rattus norvegicus
atgccaggtggctctaaggtccttg

SEQ ID NO: 192627 - DNA, 25 bp, Rattus norvegicus
atgccaggtgttctggttacctcat

SEQ ID NO: 192628 - DNA, 25 bp, Rattus norvegicus
atgccaggtgttgtggttacctcat

SEQ ID NO: 192629 - DNA, 25 bp, Rattus norvegicus
atgccaggttgtccgctcacatgaa

SEQ ID NO: 192630 - DNA, 25 bp, Rattus norvegicus
atgccaggttgtgcgctcacatgaa

SEQ ID NO: 192631 - DNA, 25 bp, Rattus norvegicus
atgccaggtttgaagtctcctttta

SEQ ID NO: 192632 - DNA, 25 bp, Rattus norvegicus
atgccaggtttgtagtctcctttta

SEQ ID NO: 192633 - DNA, 25 bp, Rattus norvegicus
atgccagtaccacactaactttttg

SEQ ID NO: 192634 - DNA, 25 bp, Rattus norvegicus
atgccagtaccagactaactttttg

SEQ ID NO: 192635 - DNA, 25 bp, Rattus norvegicus
atgccagtagacctaaggctgccgc

SEQ ID NO: 192636 - DNA, 25 bp, Rattus norvegicus
atgccagtagacgtaaggctgccgc

SEQ ID NO: 192637 - DNA, 25 bp, Rattus norvegicus
atgccagtccagaactcctgaggtg

SEQ ID NO: 192638 - DNA, 25 bp, Rattus norvegicus
atgccagtccagtactcctgaggtg

SEQ ID NO: 192639 - DNA, 25 bp, Rattus norvegicus
atgccagtcccaatgttcttaagac

SEQ ID NO: 192640 - DNA, 25 bp, Rattus norvegicus
atgccagtcccattgttcttaagac

SEQ ID NO: 192641 - DNA, 25 bp, Rattus norvegicus
atgccagtcctgaggctagcggcca

SEQ ID NO: 192642 - DNA, 25 bp, Rattus norvegicus
atgccagtcctgtggctagcggcca

SEQ ID NO: 192643 - DNA, 25 bp, Rattus norvegicus
atgccagtctcacttacccgtgggt

SEQ ID NO: 192644 - DNA, 25 bp, Rattus norvegicus
atgccagtctcagttacccgtgggt

SEQ ID NO: 192645 - DNA, 25 bp, Rattus norvegicus
atgccagtctggaaattgtacacaa

SEQ ID NO: 192646 - DNA, 25 bp, Rattus norvegicus
atgccagtctggtaattgtacacaa

SEQ ID NO: 192647 - DNA, 25 bp, Rattus norvegicus
atgccagtcttcagggcccatttgg

SEQ ID NO: 192648 - DNA, 25 bp, Rattus norvegicus
atgccagtcttctgggcccatttgg

SEQ ID NO: 192649 - DNA, 25 bp, Rattus norvegicus
atgccagtgcagctggaatccgaca

SEQ ID NO: 192650 - DNA, 25 bp, Rattus norvegicus
atgccagtgcaggtggaatccgaca

SEQ ID NO: 192651 - DNA, 25 bp, Rattus norvegicus
atgccagtgcatcaaaacaccttgt

SEQ ID NO: 192652 - DNA, 25 bp, Rattus norvegicus
atgccagtgcatgaaaacaccttgt

SEQ ID NO: 192653 - DNA, 25 bp, Rattus norvegicus
atgccagtgctccacgtctaatggt

SEQ ID NO: 192654 - DNA, 25 bp, Rattus norvegicus
atgccagtgctcgacgtctaatggt

SEQ ID NO: 192655 - DNA, 25 bp, Rattus norvegicus
atgccagtggttctggctgcagtat

SEQ ID NO: 192656 - DNA, 25 bp, Rattus norvegicus
atgccagtggttgtggctgcagtat

SEQ ID NO: 192657 - DNA, 25 bp, Rattus norvegicus
atgccagttcaaattggtcctgctg

SEQ ID NO: 192658 - DNA, 25 bp, Rattus norvegicus
atgccagttcaatttggtcctgctg

SEQ ID NO: 192659 - DNA, 25 bp, Rattus norvegicus
atgccagttcggagtgatgtcacgt

SEQ ID NO: 192660 - DNA, 25 bp, Rattus norvegicus
atgccagttcggtgtgatgtcacgt

SEQ ID NO: 192661 - DNA, 25 bp, Rattus norvegicus
atgccagttgacatgatgggacttt

SEQ ID NO: 192662 - DNA, 25 bp, Rattus norvegicus
atgccagttgacttgatgggacttt

SEQ ID NO: 192663 - DNA, 25 bp, Rattus norvegicus
atgccagtttatcttccttcacagc

SEQ ID NO: 192664 - DNA, 25 bp, Rattus norvegicus
atgccagtttatgttccttcacagc

SEQ ID NO: 192665 - DNA, 25 bp, Rattus norvegicus
atgccagtttgacttccccaagagt

SEQ ID NO: 192666 - DNA, 25 bp, Rattus norvegicus
atgccagtttgagttccccaagagt

SEQ ID NO: 192667 - DNA, 25 bp, Rattus norvegicus
atgccataaaagaccgatccagttc

SEQ ID NO: 192668 - DNA, 25 bp, Rattus norvegicus
atgccataaaagtccgatccagttc

SEQ ID NO: 192669 - DNA, 25 bp, Rattus norvegicus
atgccatacctacccggtgacaggg

SEQ ID NO: 192670 - DNA, 25 bp, Rattus norvegicus
atgccatacctagccggtgacaggg

SEQ ID NO: 192671 - DNA, 25 bp, Rattus norvegicus
atgccatacgttagcacttgtacca

SEQ ID NO: 192672 - DNA, 25 bp, Rattus norvegicus
atgccatacgtttgcacttgtacca

SEQ ID NO: 192673 - DNA, 25 bp, Rattus norvegicus
atgccatagaggcagcactggccca

SEQ ID NO: 192674 - DNA, 25 bp, Rattus norvegicus
atgccatagagggagcactggccca

SEQ ID NO: 192675 - DNA, 25 bp, Rattus norvegicus
atgccatagcatctcgtttttcctc

SEQ ID NO: 192676 - DNA, 25 bp, Rattus norvegicus
atgccatagcatgtcgtttttcctc

SEQ ID NO: 192677 - DNA, 25 bp, Rattus norvegicus
atgccatattctaggacctgagcca

SEQ ID NO: 192678 - DNA, 25 bp, Rattus norvegicus
atgccatattcttggacctgagcca

SEQ ID NO: 192679 - DNA, 25 bp, Rattus norvegicus
atgccatcacggcttcagttccagg

SEQ ID NO: 192680 - DNA, 25 bp, Rattus norvegicus
atgccatcacgggttcagttccagg

SEQ ID NO: 192681 - DNA, 25 bp, Rattus norvegicus
atgccatcactgccactcagaagac

SEQ ID NO: 192682 - DNA, 25 bp, Rattus norvegicus
atgccatcactggcactcagaagac

SEQ ID NO: 192683 - DNA, 25 bp, Rattus norvegicus
atgccatcatgcctttggatatagc

SEQ ID NO: 192684 - DNA, 25 bp, Rattus norvegicus
atgccatcatgcgtttggatatagc

SEQ ID NO: 192685 - DNA, 25 bp, Rattus norvegicus
atgccatccaagagccgagggtgaa

SEQ ID NO: 192686 - DNA, 25 bp, Rattus norvegicus
atgccatccaagtgccgagggtgaa

SEQ ID NO: 192687 - DNA, 25 bp, Rattus norvegicus
atgccatccagcatgggcccgggct

SEQ ID NO: 192688 - DNA, 25 bp, Rattus norvegicus
atgccatccagcttgggcccgggct

SEQ ID NO: 192689 - DNA, 25 bp, Rattus norvegicus
atgccatcctgcaccacattgaggg

SEQ ID NO: 192690 - DNA, 25 bp, Rattus norvegicus
atgccatcctgctccacattgaggg

SEQ ID NO: 192691 - DNA, 25 bp, Rattus norvegicus
atgccatccttcagtactgcaaagt

SEQ ID NO: 192692 - DNA, 25 bp, Rattus norvegicus
atgccatccttctgtactgcaaagt

SEQ ID NO: 192693 - DNA, 25 bp, Rattus norvegicus
atgccatcctttccacaggagggaa

SEQ ID NO: 192694 - DNA, 25 bp, Rattus norvegicus
atgccatcctttgcacaggagggaa

SEQ ID NO: 192695 - DNA, 25 bp, Rattus norvegicus
atgccatcgatgaggtcttccacag

SEQ ID NO: 192696 - DNA, 25 bp, Rattus norvegicus
atgccatcgatgtggtcttccacag

SEQ ID NO: 192697 - DNA, 25 bp, Rattus norvegicus
atgccatcgctgcttacaatgccac

SEQ ID NO: 192698 - DNA, 25 bp, Rattus norvegicus
atgccatcgctggttacaatgccac

SEQ ID NO: 192699 - DNA, 25 bp, Rattus norvegicus
atgccatcggcgatggtagagtcga

SEQ ID NO: 192700 - DNA, 25 bp, Rattus norvegicus
atgccatcggcgttggtagagtcga

SEQ ID NO: 192701 - DNA, 25 bp, Rattus norvegicus
atgccatcgtggaattctctgtgtg

SEQ ID NO: 192702 - DNA, 25 bp, Rattus norvegicus
atgccatcgtggtattctctgtgtg

SEQ ID NO: 192703 - DNA, 25 bp, Rattus norvegicus
atgccatctaagctcttaaccaggc

SEQ ID NO: 192704 - DNA, 25 bp, Rattus norvegicus
atgccatctaaggtcttaaccaggc

SEQ ID NO: 192705 - DNA, 25 bp, Rattus norvegicus
atgccatctagcctttggtgttaat

SEQ ID NO: 192706 - DNA, 25 bp, Rattus norvegicus
atgccatctagcgtttggtgttaat

SEQ ID NO: 192707 - DNA, 25 bp, Rattus norvegicus
atgccatctcagcatagatcctgtc

SEQ ID NO: 192708 - DNA, 25 bp, Rattus norvegicus
atgccatctcaggatagatcctgtc

SEQ ID NO: 192709 - DNA, 25 bp, Rattus norvegicus
atgccatctcctaaatggagcccag

SEQ ID NO: 192710 - DNA, 25 bp, Rattus norvegicus
atgccatctccttaatggagcccag

SEQ ID NO: 192711 - DNA, 25 bp, Rattus norvegicus
atgccatctgccagctgatagcggg

SEQ ID NO: 192712 - DNA, 25 bp, Rattus norvegicus
atgccatctgcctgctgatagcggg

SEQ ID NO: 192713 - DNA, 25 bp, Rattus norvegicus
atgccatctgtactcgggtctatga

SEQ ID NO: 192714 - DNA, 25 bp, Rattus norvegicus
atgccatctgtagtcgggtctatga

SEQ ID NO: 192715 - DNA, 25 bp, Rattus norvegicus
atgccatgacccacctgcattaaac

SEQ ID NO: 192716 - DNA, 25 bp, Rattus norvegicus
atgccatgaccctcctgcattaaac

SEQ ID NO: 192717 - DNA, 25 bp, Rattus norvegicus
atgccatgacctctgtagatttcta

SEQ ID NO: 192718 - DNA, 25 bp, Rattus norvegicus
atgccatgacctgtgtagatttcta

SEQ ID NO: 192719 - DNA, 25 bp, Rattus norvegicus
atgccatgcacacagcgtaggcttt

SEQ ID NO: 192720 - DNA, 25 bp, Rattus norvegicus
atgccatgcacagagcgtaggcttt

SEQ ID NO: 192721 - DNA, 25 bp, Rattus norvegicus
atgccatgcactaacacaaacctgg

SEQ ID NO: 192722 - DNA, 25 bp, Rattus norvegicus
atgccatgcacttacacaaacctgg

SEQ ID NO: 192723 - DNA, 25 bp, Rattus norvegicus
atgccatgctccatctgcatgtgga

SEQ ID NO: 192724 - DNA, 25 bp, Rattus norvegicus
atgccatgctccttctgcatgtgga

SEQ ID NO: 192725 - DNA, 25 bp, Rattus norvegicus
atgccatgctggatcaaggtgtctt

SEQ ID NO: 192726 - DNA, 25 bp, Rattus norvegicus
atgccatgctggttcaaggtgtctt

SEQ ID NO: 192727 - DNA, 25 bp, Rattus norvegicus
atgccatggctgaaaccacagacag

SEQ ID NO: 192728 - DNA, 25 bp, Rattus norvegicus
atgccatggctgtaaccacagacag

SEQ ID NO: 192729 - DNA, 25 bp, Rattus norvegicus
atgccatgggcaactccagacaagc

SEQ ID NO: 192730 - DNA, 25 bp, Rattus norvegicus
atgccatgggcatctccagacaagc

SEQ ID NO: 192731 - DNA, 25 bp, Rattus norvegicus
atgccatgtgagatcatcctagcct

SEQ ID NO: 192732 - DNA, 25 bp, Rattus norvegicus
atgccatgtgagttcatcctagcct

SEQ ID NO: 192733 - DNA, 25 bp, Rattus norvegicus
atgccatgtgctctgtgcagcccag

SEQ ID NO: 192734 - DNA, 25 bp, Rattus norvegicus
atgccatgtgctgtgtgcagcccag

SEQ ID NO: 192735 - DNA, 25 bp, Rattus norvegicus
atgccattactgaagcaggcccaga

SEQ ID NO: 192736 - DNA, 25 bp, Rattus norvegicus
atgccattactgtagcaggcccaga

SEQ ID NO: 192737 - DNA, 25 bp, Rattus norvegicus
atgccattagctattctccatggaa

SEQ ID NO: 192738 - DNA, 25 bp, Rattus norvegicus
atgccattagcttttctccatggaa

SEQ ID NO: 192739 - DNA, 25 bp, Rattus norvegicus
atgccattagtactgtccacccagt

SEQ ID NO: 192740 - DNA, 25 bp, Rattus norvegicus
atgccattagtagtgtccacccagt

SEQ ID NO: 192741 - DNA, 25 bp, Rattus norvegicus
atgccattctccattacggctgaaa

SEQ ID NO: 192742 - DNA, 25 bp, Rattus norvegicus
atgccattctcctttacggctgaaa

SEQ ID NO: 192743 - DNA, 25 bp, Rattus norvegicus
atgccattgaaaccctcctgcagag

SEQ ID NO: 192744 - DNA, 25 bp, Rattus norvegicus
atgccattgaaagcctcctgcagag

SEQ ID NO: 192745 - DNA, 25 bp, Rattus norvegicus
atgccattgcaccttctttagtctt

SEQ ID NO: 192746 - DNA, 25 bp, Rattus norvegicus
atgccattgcacgttctttagtctt

SEQ ID NO: 192747 - DNA, 25 bp, Rattus norvegicus
atgccattgcctactattcctatac

SEQ ID NO: 192748 - DNA, 25 bp, Rattus norvegicus
atgccattgccttctattcctatac

SEQ ID NO: 192749 - DNA, 25 bp, Rattus norvegicus
atgccattgcgtatccatggagact

SEQ ID NO: 192750 - DNA, 25 bp, Rattus norvegicus
atgccattgcgtttccatggagact

SEQ ID NO: 192751 - DNA, 25 bp, Rattus norvegicus
atgccattgggactggagatacaac

SEQ ID NO: 192752 - DNA, 25 bp, Rattus norvegicus
atgccattgggagtggagatacaac

SEQ ID NO: 192753 - DNA, 25 bp, Rattus norvegicus
atgccattgttgaatcggtgggtgt

SEQ ID NO: 192754 - DNA, 25 bp, Rattus norvegicus
atgccattgttgtatcggtgggtgt

SEQ ID NO: 192755 - DNA, 25 bp, Rattus norvegicus
atgccatttaatcaggtccacagtg

SEQ ID NO: 192756 - DNA, 25 bp, Rattus norvegicus
atgccatttaatgaggtccacagtg

SEQ ID NO: 192757 - DNA, 25 bp, Rattus norvegicus
atgccatttcagacatttcccatga

SEQ ID NO: 192758 - DNA, 25 bp, Rattus norvegicus
atgccatttcagtcatttcccatga

SEQ ID NO: 192759 - DNA, 25 bp, Rattus norvegicus
atgccatttctaacacaggctaaat

SEQ ID NO: 192760 - DNA, 25 bp, Rattus norvegicus
atgccatttctatcacaggctaaat

SEQ ID NO: 192761 - DNA, 25 bp, Rattus norvegicus
atgccatttctgctgaaggcctctt

SEQ ID NO: 192762 - DNA, 25 bp, Rattus norvegicus
atgccatttctggtgaaggcctctt

SEQ ID NO: 192763 - DNA, 25 bp, Rattus norvegicus
atgccatttgtcacgtttaactagt

SEQ ID NO: 192764 - DNA, 25 bp, Rattus norvegicus
atgccatttgtctcgtttaactagt

SEQ ID NO: 192765 - DNA, 25 bp, Rattus norvegicus
atgcccaaaacaccaagctgtcttt

SEQ ID NO: 192766 - DNA, 25 bp, Rattus norvegicus
atgcccaaaacagcaagctgtcttt

SEQ ID NO: 192767 - DNA, 25 bp, Rattus norvegicus
atgcccaaagtcaacatcatcctct

SEQ ID NO: 192768 - DNA, 25 bp, Rattus norvegicus
atgcccaaagtctacatcatcctct

SEQ ID NO: 192769 - DNA, 25 bp, Rattus norvegicus
atgcccaagaggacttgttcccaag

SEQ ID NO: 192770 - DNA, 25 bp, Rattus norvegicus
atgcccaagaggtcttgttcccaag

SEQ ID NO: 192771 - DNA, 25 bp, Rattus norvegicus
atgcccaagcgcctgtagtgaaaac

SEQ ID NO: 192772 - DNA, 25 bp, Rattus norvegicus
atgcccaagcgcgtgtagtgaaaac

SEQ ID NO: 192773 - DNA, 25 bp, Rattus norvegicus
atgcccaaggcactgttatacactt

SEQ ID NO: 192774 - DNA, 25 bp, Rattus norvegicus
atgcccaaggcagtgttatacactt

SEQ ID NO: 192775 - DNA, 25 bp, Rattus norvegicus
atgcccaagtgacacctaaatgttc

SEQ ID NO: 192776 - DNA, 25 bp, Rattus norvegicus
atgcccaagtgagacctaaatgttc

SEQ ID NO: 192777 - DNA, 25 bp, Rattus norvegicus
atgcccaatggcaatcaccaactga

SEQ ID NO: 192778 - DNA, 25 bp, Rattus norvegicus
atgcccaatggctatcaccaactga

SEQ ID NO: 192779 - DNA, 25 bp, Rattus norvegicus
atgcccaattcaatggaatttccca

SEQ ID NO: 192780 - DNA, 25 bp, Rattus norvegicus
atgcccaattcattggaatttccca

SEQ ID NO: 192781 - DNA, 25 bp, Rattus norvegicus
atgcccaattccaagtaactctcaa

SEQ ID NO: 192782 - DNA, 25 bp, Rattus norvegicus
atgcccaattcctagtaactctcaa

SEQ ID NO: 192783 - DNA, 25 bp, Rattus norvegicus
atgcccacaacaagctcttatttga

SEQ ID NO: 192784 - DNA, 25 bp, Rattus norvegicus
atgcccacaacatgctcttatttga

SEQ ID NO: 192785 - DNA, 25 bp, Rattus norvegicus
atgcccacacgtcagcaaagcactt

SEQ ID NO: 192786 - DNA, 25 bp, Rattus norvegicus
atgcccacacgtgagcaaagcactt

SEQ ID NO: 192787 - DNA, 25 bp, Rattus norvegicus
atgcccacactcaatgttctttaga

SEQ ID NO: 192788 - DNA, 25 bp, Rattus norvegicus
atgcccacactctatgttctttaga

SEQ ID NO: 192789 - DNA, 25 bp, Rattus norvegicus
atgcccacagcaaatctttggtgtt

SEQ ID NO: 192790 - DNA, 25 bp, Rattus norvegicus
atgcccacagcatatctttggtgtt

SEQ ID NO: 192791 - DNA, 25 bp, Rattus norvegicus
atgcccacagctcctttgatagtga

SEQ ID NO: 192792 - DNA, 25 bp, Rattus norvegicus
atgcccacagctgctttgatagtga

SEQ ID NO: 192793 - DNA, 25 bp, Rattus norvegicus
atgcccacagtcatgatgatgcttc

SEQ ID NO: 192794 - DNA, 25 bp, Rattus norvegicus
atgcccacagtcttgatgatgcttc

SEQ ID NO: 192795 - DNA, 25 bp, Rattus norvegicus
atgcccacagtgcaggcttaccaaa

SEQ ID NO: 192796 - DNA, 25 bp, Rattus norvegicus
atgcccacagtggaggcttaccaaa

SEQ ID NO: 192797 - DNA, 25 bp, Rattus norvegicus
atgcccacatgaagtgtttttcctt

SEQ ID NO: 192798 - DNA, 25 bp, Rattus norvegicus
atgcccacatgatgtgtttttcctt

SEQ ID NO: 192799 - DNA, 25 bp, Rattus norvegicus
atgcccaccaaactcatcagtgtag

SEQ ID NO: 192800 - DNA, 25 bp, Rattus norvegicus
atgcccaccaaagtcatcagtgtag

SEQ ID NO: 192801 - DNA, 25 bp, Rattus norvegicus
atgcccaccagtcttatagcttcgt

SEQ ID NO: 192802 - DNA, 25 bp, Rattus norvegicus
atgcccaccagtgttatagcttcgt

SEQ ID NO: 192803 - DNA, 25 bp, Rattus norvegicus
atgcccaccataaggccatgacgtg

SEQ ID NO: 192804 - DNA, 25 bp, Rattus norvegicus
atgcccaccatatggccatgacgtg

SEQ ID NO: 192805 - DNA, 25 bp, Rattus norvegicus
atgcccaccctacaagactcttggt

SEQ ID NO: 192806 - DNA, 25 bp, Rattus norvegicus
atgcccaccctagaagactcttggt

SEQ ID NO: 192807 - DNA, 25 bp, Rattus norvegicus
atgcccactgtacatcagacatttt

SEQ ID NO: 192808 - DNA, 25 bp, Rattus norvegicus
atgcccactgtagatcagacatttt

SEQ ID NO: 192809 - DNA, 25 bp, Rattus norvegicus
atgcccacttctatgcatggtctct

SEQ ID NO: 192810 - DNA, 25 bp, Rattus norvegicus
atgcccacttctttgcatggtctct

SEQ ID NO: 192811 - DNA, 25 bp, Rattus norvegicus
atgcccactttccacaggagcgatg

SEQ ID NO: 192812 - DNA, 25 bp, Rattus norvegicus
atgcccactttcgacaggagcgatg

SEQ ID NO: 192813 - DNA, 25 bp, Rattus norvegicus
atgcccagaacccacttaaaggcgg

SEQ ID NO: 192814 - DNA, 25 bp, Rattus norvegicus
atgcccagaaccgacttaaaggcgg

SEQ ID NO: 192815 - DNA, 25 bp, Rattus norvegicus
atgcccagcagtcagagcaaccgga

SEQ ID NO: 192816 - DNA, 25 bp, Rattus norvegicus
atgcccagcagtgagagcaaccgga

SEQ ID NO: 192817 - DNA, 25 bp, Rattus norvegicus
atgcccagccatagtgatattttca

SEQ ID NO: 192818 - DNA, 25 bp, Rattus norvegicus
atgcccagccattgtgatattttca

SEQ ID NO: 192819 - DNA, 25 bp, Rattus norvegicus
atgcccagctagatacttgaccctc

SEQ ID NO: 192820 - DNA, 25 bp, Rattus norvegicus
atgcccagctagttacttgaccctc

SEQ ID NO: 192821 - DNA, 25 bp, Rattus norvegicus
atgcccagcttgaacgttgatcctg

SEQ ID NO: 192822 - DNA, 25 bp, Rattus norvegicus
atgcccagcttgtacgttgatcctg

SEQ ID NO: 192823 - DNA, 25 bp, Rattus norvegicus
atgcccagctttcttaaggctctga

SEQ ID NO: 192824 - DNA, 25 bp, Rattus norvegicus
atgcccagctttgttaaggctctga

SEQ ID NO: 192825 - DNA, 25 bp, Rattus norvegicus
atgcccaggaagaggtgcctctctg

SEQ ID NO: 192826 - DNA, 25 bp, Rattus norvegicus
atgcccaggaagcatgctgtcacag

SEQ ID NO: 192827 - DNA, 25 bp, Rattus norvegicus
atgcccaggaagctgaagcagtcct

SEQ ID NO: 192828 - DNA, 25 bp, Rattus norvegicus
atgcccaggaaggatgctgtcacag

SEQ ID NO: 192829 - DNA, 25 bp, Rattus norvegicus
atgcccaggaaggtgaagcagtcct

SEQ ID NO: 192830 - DNA, 25 bp, Rattus norvegicus
atgcccaggaagtggtgcctctctg

SEQ ID NO: 192831 - DNA, 25 bp, Rattus norvegicus
atgcccaggaggcactgaggacttt

SEQ ID NO: 192832 - DNA, 25 bp, Rattus norvegicus
atgcccaggagggactgaggacttt

SEQ ID NO: 192833 - DNA, 25 bp, Rattus norvegicus
atgcccaggcttaggagctgagaga

SEQ ID NO: 192834 - DNA, 25 bp, Rattus norvegicus
atgcccaggcttccagtaggcagga

SEQ ID NO: 192835 - DNA, 25 bp, Rattus norvegicus
atgcccaggcttgcagtaggcagga

SEQ ID NO: 192836 - DNA, 25 bp, Rattus norvegicus
atgcccaggctttggagctgagaga

SEQ ID NO: 192837 - DNA, 25 bp, Rattus norvegicus
atgcccaggtatcctgaaggtccac

SEQ ID NO: 192838 - DNA, 25 bp, Rattus norvegicus
atgcccaggtatgctgaaggtccac

SEQ ID NO: 192839 - DNA, 25 bp, Rattus norvegicus
atgcccagtagtcacattccaaagc

SEQ ID NO: 192840 - DNA, 25 bp, Rattus norvegicus
atgcccagtagtgacattccaaagc

SEQ ID NO: 192841 - DNA, 25 bp, Rattus norvegicus
atgcccagtcatcattcttgaatag

SEQ ID NO: 192842 - DNA, 25 bp, Rattus norvegicus
atgcccagtcatgattcttgaatag

SEQ ID NO: 192843 - DNA, 25 bp, Rattus norvegicus
atgcccagtgacatagcgcccggct

SEQ ID NO: 192844 - DNA, 25 bp, Rattus norvegicus
atgcccagtgacttagcgcccggct

SEQ ID NO: 192845 - DNA, 25 bp, Rattus norvegicus
atgcccagtgtgatgacttaaatgt

SEQ ID NO: 192846 - DNA, 25 bp, Rattus norvegicus
atgcccagtgtgttgacttaaatgt

SEQ ID NO: 192847 - DNA, 25 bp, Rattus norvegicus
atgcccatatgaaaatactaacagg

SEQ ID NO: 192848 - DNA, 25 bp, Rattus norvegicus
atgcccatatgataatactaacagg

SEQ ID NO: 192849 - DNA, 25 bp, Rattus norvegicus
atgcccatcctcagggagcctgaat

SEQ ID NO: 192850 - DNA, 25 bp, Rattus norvegicus
atgcccatcctctgggagcctgaat

SEQ ID NO: 192851 - DNA, 25 bp, Rattus norvegicus
atgcccatcctgcagctggttgtgt

SEQ ID NO: 192852 - DNA, 25 bp, Rattus norvegicus
atgcccatcctggagctggttgtgt

SEQ ID NO: 192853 - DNA, 25 bp, Rattus norvegicus
atgcccatcgccatgagcatcaagg

SEQ ID NO: 192854 - DNA, 25 bp, Rattus norvegicus
atgcccatcgccttgagcatcaagg

SEQ ID NO: 192855 - DNA, 25 bp, Rattus norvegicus
atgcccatcgctagacagctgatac

SEQ ID NO: 192856 - DNA, 25 bp, Rattus norvegicus
atgcccatcgcttgacagctgatac

SEQ ID NO: 192857 - DNA, 25 bp, Rattus norvegicus
atgcccatcgtcactggaactatga

SEQ ID NO: 192858 - DNA, 25 bp, Rattus norvegicus
atgcccatcgtctctggaactatga

SEQ ID NO: 192859 - DNA, 25 bp, Rattus norvegicus
atgcccatcgttcatgcaggagagc

SEQ ID NO: 192860 - DNA, 25 bp, Rattus norvegicus
atgcccatcgttgatgcaggagagc

SEQ ID NO: 192861 - DNA, 25 bp, Rattus norvegicus
atgcccatctatccttctgtcagag

SEQ ID NO: 192862 - DNA, 25 bp, Rattus norvegicus
atgcccatctatgcttctgtcagag

SEQ ID NO: 192863 - DNA, 25 bp, Rattus norvegicus
atgcccatgggtctctggttctcat

SEQ ID NO: 192864 - DNA, 25 bp, Rattus norvegicus
atgcccatgggtgtctggttctcat

SEQ ID NO: 192865 - DNA, 25 bp, Rattus norvegicus
atgcccatgtctatctctacagatt

SEQ ID NO: 192866 - DNA, 25 bp, Rattus norvegicus
atgcccatgtctttctctacagatt

SEQ ID NO: 192867 - DNA, 25 bp, Rattus norvegicus
atgcccatgtgcactgttctgattg

SEQ ID NO: 192868 - DNA, 25 bp, Rattus norvegicus
atgcccatgtgctctgttctgattg

SEQ ID NO: 192869 - DNA, 25 bp, Rattus norvegicus
atgcccatgttgctgctgcctggcc

SEQ ID NO: 192870 - DNA, 25 bp, Rattus norvegicus
atgcccatgttggtgctgcctggcc

SEQ ID NO: 192871 - DNA, 25 bp, Rattus norvegicus
atgcccattcagagcagaggccgca

SEQ ID NO: 192872 - DNA, 25 bp, Rattus norvegicus
atgcccattcagtgcagaggccgca

SEQ ID NO: 192873 - DNA, 25 bp, Rattus norvegicus
atgcccattgtcacagcacacagga

SEQ ID NO: 192874 - DNA, 25 bp, Rattus norvegicus
atgcccattgtctcagcacacagga

SEQ ID NO: 192875 - DNA, 25 bp, Rattus norvegicus
atgcccattgtgagtgttcgaagct

SEQ ID NO: 192876 - DNA, 25 bp, Rattus norvegicus
atgcccattgtgtgtgttcgaagct

SEQ ID NO: 192877 - DNA, 25 bp, Rattus norvegicus
atgcccatttagaaacttactgttt

SEQ ID NO: 192878 - DNA, 25 bp, Rattus norvegicus
atgcccatttagattctttatacca

SEQ ID NO: 192879 - DNA, 25 bp, Rattus norvegicus
atgcccatttagtaacttactgttt

SEQ ID NO: 192880 - DNA, 25 bp, Rattus norvegicus
atgcccatttagtttctttatacca

SEQ ID NO: 192881 - DNA, 25 bp, Rattus norvegicus
atgcccatttgcacagctgcccagg

SEQ ID NO: 192882 - DNA, 25 bp, Rattus norvegicus
atgcccatttgctcagctgcccagg

SEQ ID NO: 192883 - DNA, 25 bp, Rattus norvegicus
atgcccattttacatcagctcagtc

SEQ ID NO: 192884 - DNA, 25 bp, Rattus norvegicus
atgcccattttagatcagctcagtc

SEQ ID NO: 192885 - DNA, 25 bp, Rattus norvegicus
atgcccattttgaggcaatgctggg

SEQ ID NO: 192886 - DNA, 25 bp, Rattus norvegicus
atgcccattttgtggcaatgctggg

SEQ ID NO: 192887 - DNA, 25 bp, Rattus norvegicus
atgccccaaagtctccttcctgtgt

SEQ ID NO: 192888 - DNA, 25 bp, Rattus norvegicus
atgccccaaagtgtccttcctgtgt

SEQ ID NO: 192889 - DNA, 25 bp, Rattus norvegicus
atgccccacacacacaggtacataa

SEQ ID NO: 192890 - DNA, 25 bp, Rattus norvegicus
atgccccacacagacaggtacataa

SEQ ID NO: 192891 - DNA, 25 bp, Rattus norvegicus
atgccccacccactatcagtgtgga

SEQ ID NO: 192892 - DNA, 25 bp, Rattus norvegicus
atgccccacccagtatcagtgtgga

SEQ ID NO: 192893 - DNA, 25 bp, Rattus norvegicus
atgccccagcttaaattcttaggta

SEQ ID NO: 192894 - DNA, 25 bp, Rattus norvegicus
atgccccagctttaattcttaggta

SEQ ID NO: 192895 - DNA, 25 bp, Rattus norvegicus
atgccccaggacacaagccagtgag

SEQ ID NO: 192896 - DNA, 25 bp, Rattus norvegicus
atgccccaggactcaagccagtgag

SEQ ID NO: 192897 - DNA, 25 bp, Rattus norvegicus
atgccccagggaacggccaggatta

SEQ ID NO: 192898 - DNA, 25 bp, Rattus norvegicus
atgccccagggatcggccaggatta

SEQ ID NO: 192899 - DNA, 25 bp, Rattus norvegicus
atgccccaggtacgtgggtgctact

SEQ ID NO: 192900 - DNA, 25 bp, Rattus norvegicus
atgccccaggtaggtgggtgctact

SEQ ID NO: 192901 - DNA, 25 bp, Rattus norvegicus
atgccccatccgcagagtgatatgg

SEQ ID NO: 192902 - DNA, 25 bp, Rattus norvegicus
atgccccatccggagagtgatatgg

SEQ ID NO: 192903 - DNA, 25 bp, Rattus norvegicus
atgccccatgttctatggagcactt

SEQ ID NO: 192904 - DNA, 25 bp, Rattus norvegicus
atgccccatgttgtatggagcactt

SEQ ID NO: 192905 - DNA, 25 bp, Rattus norvegicus
atgccccgaccactttgaaatgtta

SEQ ID NO: 192906 - DNA, 25 bp, Rattus norvegicus
atgccccgaccagtttgaaatgtta

SEQ ID NO: 192907 - DNA, 25 bp, Rattus norvegicus
atgccccgagcacgctcactggaaa

SEQ ID NO: 192908 - DNA, 25 bp, Rattus norvegicus
atgccccgagcaggctcactggaaa

SEQ ID NO: 192909 - DNA, 25 bp, Rattus norvegicus
atgccccgagtgagccgatgactgc

SEQ ID NO: 192910 - DNA, 25 bp, Rattus norvegicus
atgccccgagtgtgccgatgactgc

SEQ ID NO: 192911 - DNA, 25 bp, Rattus norvegicus
atgccccggatgacgttgatttctt

SEQ ID NO: 192912 - DNA, 25 bp, Rattus norvegicus
atgccccggatgtcgttgatttctt

SEQ ID NO: 192913 - DNA, 25 bp, Rattus norvegicus
atgccccggccaaatgctgcttggc

SEQ ID NO: 192914 - DNA, 25 bp, Rattus norvegicus
atgccccggccatatgctgcttggc

SEQ ID NO: 192915 - DNA, 25 bp, Rattus norvegicus
atgccccgtagtcatcatgttttaa

SEQ ID NO: 192916 - DNA, 25 bp, Rattus norvegicus
atgccccgtagtgatcatgttttaa

SEQ ID NO: 192917 - DNA, 25 bp, Rattus norvegicus
atgcccctaaagaagcagctgacag

SEQ ID NO: 192918 - DNA, 25 bp, Rattus norvegicus
atgcccctaaagtagcagctgacag

SEQ ID NO: 192919 - DNA, 25 bp, Rattus norvegicus
atgcccctactacagtggactagat

SEQ ID NO: 192920 - DNA, 25 bp, Rattus norvegicus
atgcccctactagagtggactagat

SEQ ID NO: 192921 - DNA, 25 bp, Rattus norvegicus
atgcccctgcagattgcactttaat

SEQ ID NO: 192922 - DNA, 25 bp, Rattus norvegicus
atgcccctgcagtttgcactttaat

SEQ ID NO: 192923 - DNA, 25 bp, Rattus norvegicus
atgcccctggaccatcttcttgatt

SEQ ID NO: 192924 - DNA, 25 bp, Rattus norvegicus
atgcccctggacgatcttcttgatt

SEQ ID NO: 192925 - DNA, 25 bp, Rattus norvegicus
atgcccctgtctacttctatgagtt

SEQ ID NO: 192926 - DNA, 25 bp, Rattus norvegicus
atgcccctgtcttcttctatgagtt

SEQ ID NO: 192927 - DNA, 25 bp, Rattus norvegicus
atgccccttgcacattcagatggtg

SEQ ID NO: 192928 - DNA, 25 bp, Rattus norvegicus
atgccccttgcagattcagatggtg

SEQ ID NO: 192929 - DNA, 25 bp, Rattus norvegicus
atgccccttgttaacatgtactata

SEQ ID NO: 192930 - DNA, 25 bp, Rattus norvegicus
atgccccttgtttacatgtactata

SEQ ID NO: 192931 - DNA, 25 bp, Rattus norvegicus
atgcccctttatccaacatttcaaa

SEQ ID NO: 192932 - DNA, 25 bp, Rattus norvegicus
atgcccctttatgcaacatttcaaa

SEQ ID NO: 192933 - DNA, 25 bp, Rattus norvegicus
atgcccctttggaagagtcccagtt

SEQ ID NO: 192934 - DNA, 25 bp, Rattus norvegicus
atgcccctttggtagagtcccagtt

SEQ ID NO: 192935 - DNA, 25 bp, Rattus norvegicus
atgcccgacctaacctttatttctg

SEQ ID NO: 192936 - DNA, 25 bp, Rattus norvegicus
atgcccgacctatcctttatttctg

SEQ ID NO: 192937 - DNA, 25 bp, Rattus norvegicus
atgcccgcagcgatcatgggaatgt

SEQ ID NO: 192938 - DNA, 25 bp, Rattus norvegicus
atgcccgcagcgttcatgggaatgt

SEQ ID NO: 192939 - DNA, 25 bp, Rattus norvegicus
atgcccgcatcactgagatctatga

SEQ ID NO: 192940 - DNA, 25 bp, Rattus norvegicus
atgcccgcatcagtgagatctatga

SEQ ID NO: 192941 - DNA, 25 bp, Rattus norvegicus
atgcccgccgagaggtccgtaaaag

SEQ ID NO: 192942 - DNA, 25 bp, Rattus norvegicus
atgcccgccgagtggtccgtaaaag

SEQ ID NO: 192943 - DNA, 25 bp, Rattus norvegicus
atgcccgcgcggaggtgttttgcct

SEQ ID NO: 192944 - DNA, 25 bp, Rattus norvegicus
atgcccgcgcggtggtgttttgcct

SEQ ID NO: 192945 - DNA, 25 bp, Rattus norvegicus
atgcccgcttctacatagcgaattt

SEQ ID NO: 192946 - DNA, 25 bp, Rattus norvegicus
atgcccgcttcttcatagcgaattt

SEQ ID NO: 192947 - DNA, 25 bp, Rattus norvegicus
atgcccggcctcaggaagtgttcat

SEQ ID NO: 192948 - DNA, 25 bp, Rattus norvegicus
atgcccggcctctggaagtgttcat

SEQ ID NO: 192949 - DNA, 25 bp, Rattus norvegicus
atgcccggctggctctttatttaca

SEQ ID NO: 192950 - DNA, 25 bp, Rattus norvegicus
atgcccggctgggtctttatttaca

SEQ ID NO: 192951 - DNA, 25 bp, Rattus norvegicus
atgcccgggcagatcaatctcgggt

SEQ ID NO: 192952 - DNA, 25 bp, Rattus norvegicus
atgcccgggcagttcaatctcgggt

SEQ ID NO: 192953 - DNA, 25 bp, Rattus norvegicus
atgcccggtttcaacatctggattt

SEQ ID NO: 192954 - DNA, 25 bp, Rattus norvegicus
atgcccggtttctacatctggattt

SEQ ID NO: 192955 - DNA, 25 bp, Rattus norvegicus
atgcccgtcaatctaaaatcaccta

SEQ ID NO: 192956 - DNA, 25 bp, Rattus norvegicus
atgcccgtcaatgtaaaatcaccta

SEQ ID NO: 192957 - DNA, 25 bp, Rattus norvegicus
atgcccgtgcataaagtccctgtta

SEQ ID NO: 192958 - DNA, 25 bp, Rattus norvegicus
atgcccgtgcattaagtccctgtta

SEQ ID NO: 192959 - DNA, 25 bp, Rattus norvegicus
atgcccgttctcaagtaatttgcct

SEQ ID NO: 192960 - DNA, 25 bp, Rattus norvegicus
atgcccgttctctagtaatttgcct

SEQ ID NO: 192961 - DNA, 25 bp, Rattus norvegicus
atgccctacaggaactatgctaaca

SEQ ID NO: 192962 - DNA, 25 bp, Rattus norvegicus
atgccctacaggtactatgctaaca

SEQ ID NO: 192963 - DNA, 25 bp, Rattus norvegicus
atgccctacatgacagcggagcagg

SEQ ID NO: 192964 - DNA, 25 bp, Rattus norvegicus
atgccctacatgtcagcggagcagg

SEQ ID NO: 192965 - DNA, 25 bp, Rattus norvegicus
atgccctaccatatgatctatccac

SEQ ID NO: 192966 - DNA, 25 bp, Rattus norvegicus
atgccctaccatttgatctatccac

SEQ ID NO: 192967 - DNA, 25 bp, Rattus norvegicus
atgccctacgctctgtacatagtgt

SEQ ID NO: 192968 - DNA, 25 bp, Rattus norvegicus
atgccctacgctgtgtacatagtgt

SEQ ID NO: 192969 - DNA, 25 bp, Rattus norvegicus
atgccctagcatctcattatttgtg

SEQ ID NO: 192970 - DNA, 25 bp, Rattus norvegicus
atgccctagcatgtcattatttgtg

SEQ ID NO: 192971 - DNA, 25 bp, Rattus norvegicus
atgccctagctgattgcacttggtg

SEQ ID NO: 192972 - DNA, 25 bp, Rattus norvegicus
atgccctagctgtttgcacttggtg

SEQ ID NO: 192973 - DNA, 25 bp, Rattus norvegicus
atgccctagggcagaaagttgggta

SEQ ID NO: 192974 - DNA, 25 bp, Rattus norvegicus
atgccctagggcctgagactaacta

SEQ ID NO: 192975 - DNA, 25 bp, Rattus norvegicus
atgccctagggcgtgagactaacta

SEQ ID NO: 192976 - DNA, 25 bp, Rattus norvegicus
atgccctagggctgaaagttgggta

SEQ ID NO: 192977 - DNA, 25 bp, Rattus norvegicus
atgccctagtgtcagctgtggtgaa

SEQ ID NO: 192978 - DNA, 25 bp, Rattus norvegicus
atgccctagtgtgagctgtggtgaa

SEQ ID NO: 192979 - DNA, 25 bp, Rattus norvegicus
atgccctatactactgtctttcgat

SEQ ID NO: 192980 - DNA, 25 bp, Rattus norvegicus
atgccctatacttctgtctttcgat

SEQ ID NO: 192981 - DNA, 25 bp, Rattus norvegicus
atgccctcaaacaatctgtagtcct

SEQ ID NO: 192982 - DNA, 25 bp, Rattus norvegicus
atgccctcaaactatctgtagtcct

SEQ ID NO: 192983 - DNA, 25 bp, Rattus norvegicus
atgccctcaatcacggaggctgaga

SEQ ID NO: 192984 - DNA, 25 bp, Rattus norvegicus
atgccctcaatctcggaggctgaga

SEQ ID NO: 192985 - DNA, 25 bp, Rattus norvegicus
atgccctcaccgagaagcagtggct

SEQ ID NO: 192986 - DNA, 25 bp, Rattus norvegicus
atgccctcaccgtgaagcagtggct

SEQ ID NO: 192987 - DNA, 25 bp, Rattus norvegicus
atgccctcagagaagcttcttgcct

SEQ ID NO: 192988 - DNA, 25 bp, Rattus norvegicus
atgccctcagagtagcttcttgcct

SEQ ID NO: 192989 - DNA, 25 bp, Rattus norvegicus
atgccctccgagaagaacctttgtt

SEQ ID NO: 192990 - DNA, 25 bp, Rattus norvegicus
atgccctccgagtagaacctttgtt

SEQ ID NO: 192991 - DNA, 25 bp, Rattus norvegicus
atgccctcgcctaacgggagaagaa

SEQ ID NO: 192992 - DNA, 25 bp, Rattus norvegicus
atgccctcgccttacgggagaagaa

SEQ ID NO: 192993 - DNA, 25 bp, Rattus norvegicus
atgccctcgtcacacaaattagtct

SEQ ID NO: 192994 - DNA, 25 bp, Rattus norvegicus
atgccctcgtcagacaaattagtct

SEQ ID NO: 192995 - DNA, 25 bp, Rattus norvegicus
atgccctctaacatgaatgtccact

SEQ ID NO: 192996 - DNA, 25 bp, Rattus norvegicus
atgccctctaacttgaatgtccact

SEQ ID NO: 192997 - DNA, 25 bp, Rattus norvegicus
atgccctctagcatgtgggatttca

SEQ ID NO: 192998 - DNA, 25 bp, Rattus norvegicus
atgccctctagcttgtgggatttca

SEQ ID NO: 192999 - DNA, 25 bp, Rattus norvegicus
atgccctctccgagctgtggtgtgg

SEQ ID NO: 193000 - DNA, 25 bp, Rattus norvegicus
atgccctctccgtgctgtggtgtgg

SEQ ID NO: 193001 - DNA, 25 bp, Rattus norvegicus
atgccctctgaacacacttgagcta

SEQ ID NO: 193002 - DNA, 25 bp, Rattus norvegicus
atgccctctgaagacacttgagcta

SEQ ID NO: 193003 - DNA, 25 bp, Rattus norvegicus
atgccctcttccagtgctatttgga

SEQ ID NO: 193004 - DNA, 25 bp, Rattus norvegicus
atgccctcttcctgtgctatttgga

SEQ ID NO: 193005 - DNA, 25 bp, Rattus norvegicus
atgccctcttctcgattgtaggagt

SEQ ID NO: 193006 - DNA, 25 bp, Rattus norvegicus
atgccctcttctggattgtaggagt

SEQ ID NO: 193007 - DNA, 25 bp, Rattus norvegicus
atgccctctttaatagacacattgt

SEQ ID NO: 193008 - DNA, 25 bp, Rattus norvegicus
atgccctctttaattcctattacac

SEQ ID NO: 193009 - DNA, 25 bp, Rattus norvegicus
atgccctctttattagacacattgt

SEQ ID NO: 193010 - DNA, 25 bp, Rattus norvegicus
atgccctctttatttcctattacac

SEQ ID NO: 193011 - DNA, 25 bp, Rattus norvegicus
atgccctgacacctgaagcactgag

SEQ ID NO: 193012 - DNA, 25 bp, Rattus norvegicus
atgccctgacacgtgaagcactgag

SEQ ID NO: 193013 - DNA, 25 bp, Rattus norvegicus
atgccctgactgatttgatgcctag

SEQ ID NO: 193014 - DNA, 25 bp, Rattus norvegicus
atgccctgactgttttgatgcctag

SEQ ID NO: 193015 - DNA, 25 bp, Rattus norvegicus
atgccctgagccctcggttttcctg

SEQ ID NO: 193016 - DNA, 25 bp, Rattus norvegicus
atgccctgagccgtcggttttcctg

SEQ ID NO: 193017 - DNA, 25 bp, Rattus norvegicus
atgccctgcatgacctgtgatgctg

SEQ ID NO: 193018 - DNA, 25 bp, Rattus norvegicus
atgccctgcatgtcctgtgatgctg

SEQ ID NO: 193019 - DNA, 25 bp, Rattus norvegicus
atgccctgctcaaatgcttggcttt

SEQ ID NO: 193020 - DNA, 25 bp, Rattus norvegicus
atgccctgctcatatgcttggcttt

SEQ ID NO: 193021 - DNA, 25 bp, Rattus norvegicus
atgccctggacgctctgggcctgaa

SEQ ID NO: 193022 - DNA, 25 bp, Rattus norvegicus
atgccctggacggtctgggcctgaa

SEQ ID NO: 193023 - DNA, 25 bp, Rattus norvegicus
atgccctggagtatgattcagtacc

SEQ ID NO: 193024 - DNA, 25 bp, Rattus norvegicus
atgccctggagtttgattcagtacc

SEQ ID NO: 193025 - DNA, 25 bp, Rattus norvegicus
atgccctggctactttgtaccctat

SEQ ID NO: 193026 - DNA, 25 bp, Rattus norvegicus
atgccctggctagtttgtaccctat

SEQ ID NO: 193027 - DNA, 25 bp, Rattus norvegicus
atgccctggctcaacttgtaacttt

SEQ ID NO: 193028 - DNA, 25 bp, Rattus norvegicus
atgccctggctctacttgtaacttt

SEQ ID NO: 193029 - DNA, 25 bp, Rattus norvegicus
atgccctgggccatgatctgggact

SEQ ID NO: 193030 - DNA, 25 bp, Rattus norvegicus
atgccctgggccttgatctgggact

SEQ ID NO: 193031 - DNA, 25 bp, Rattus norvegicus
atgccctgggttcagcagatcttgg

SEQ ID NO: 193032 - DNA, 25 bp, Rattus norvegicus
atgccctgggttgagcagatcttgg

SEQ ID NO: 193033 - DNA, 25 bp, Rattus norvegicus
atgccctggtctcggtgattgcgaa

SEQ ID NO: 193034 - DNA, 25 bp, Rattus norvegicus
atgccctggtctgggtgattgcgaa

SEQ ID NO: 193035 - DNA, 25 bp, Rattus norvegicus
atgccctggttcctagtgccaaagg

SEQ ID NO: 193036 - DNA, 25 bp, Rattus norvegicus
atgccctggttcgtagtgccaaagg

SEQ ID NO: 193037 - DNA, 25 bp, Rattus norvegicus
atgccctgtattagtcaatgatttg

SEQ ID NO: 193038 - DNA, 25 bp, Rattus norvegicus
atgccctgtatttgtcaatgatttg

SEQ ID NO: 193039 - DNA, 25 bp, Rattus norvegicus
atgccctgtttgatttcttctactg

SEQ ID NO: 193040 - DNA, 25 bp, Rattus norvegicus
atgccctgtttgttttcttctactg

SEQ ID NO: 193041 - DNA, 25 bp, Rattus norvegicus
atgcccttacctaagaaggccctga

SEQ ID NO: 193042 - DNA, 25 bp, Rattus norvegicus
atgcccttaccttagaaggccctga

SEQ ID NO: 193043 - DNA, 25 bp, Rattus norvegicus
atgcccttcaacatggacacgcgtg

SEQ ID NO: 193044 - DNA, 25 bp, Rattus norvegicus
atgcccttcaacttggacacgcgtg

SEQ ID NO: 193045 - DNA, 25 bp, Rattus norvegicus
atgcccttcacgattaaacatcacc

SEQ ID NO: 193046 - DNA, 25 bp, Rattus norvegicus
atgcccttcacgtttaaacatcacc

SEQ ID NO: 193047 - DNA, 25 bp, Rattus norvegicus
atgcccttcactaccgtatcagaac

SEQ ID NO: 193048 - DNA, 25 bp, Rattus norvegicus
atgcccttcacttccgtatcagaac

SEQ ID NO: 193049 - DNA, 25 bp, Rattus norvegicus
atgcccttcagcaggtctcgcaagt

SEQ ID NO: 193050 - DNA, 25 bp, Rattus norvegicus
atgcccttcagctggtctcgcaagt

SEQ ID NO: 193051 - DNA, 25 bp, Rattus norvegicus
atgcccttcctcatttggaacagaa

SEQ ID NO: 193052 - DNA, 25 bp, Rattus norvegicus
atgcccttcctcttttggaacagaa

SEQ ID NO: 193053 - DNA, 25 bp, Rattus norvegicus
atgcccttcggaaggccaactccga

SEQ ID NO: 193054 - DNA, 25 bp, Rattus norvegicus
atgcccttcggatggccaactccga

SEQ ID NO: 193055 - DNA, 25 bp, Rattus norvegicus
atgcccttcttgatgaataccctga

SEQ ID NO: 193056 - DNA, 25 bp, Rattus norvegicus
atgcccttcttgttgaataccctga

SEQ ID NO: 193057 - DNA, 25 bp, Rattus norvegicus
atgcccttgctactctgtctgtata

SEQ ID NO: 193058 - DNA, 25 bp, Rattus norvegicus
atgcccttgctagtctgtctgtata

SEQ ID NO: 193059 - DNA, 25 bp, Rattus norvegicus
atgcccttgcttatctgccttttgc

SEQ ID NO: 193060 - DNA, 25 bp, Rattus norvegicus
atgcccttgcttttctgccttttgc

SEQ ID NO: 193061 - DNA, 25 bp, Rattus norvegicus
atgcccttggcaagtgctatgtaag

SEQ ID NO: 193062 - DNA, 25 bp, Rattus norvegicus
atgcccttggcaatacaaccagcgg

SEQ ID NO: 193063 - DNA, 25 bp, Rattus norvegicus
atgcccttggcatgtgctatgtaag

SEQ ID NO: 193064 - DNA, 25 bp, Rattus norvegicus
atgcccttggcattacaaccagcgg

SEQ ID NO: 193065 - DNA, 25 bp, Rattus norvegicus
atgcccttggctagaccagtagtga

SEQ ID NO: 193066 - DNA, 25 bp, Rattus norvegicus
atgcccttggcttgaccagtagtga

SEQ ID NO: 193067 - DNA, 25 bp, Rattus norvegicus
atgcccttgtctctacctcgtgtgt

SEQ ID NO: 193068 - DNA, 25 bp, Rattus norvegicus
atgcccttgtctgtacctcgtgtgt

SEQ ID NO: 193069 - DNA, 25 bp, Rattus norvegicus
atgccctttatgaccattctggaaa

SEQ ID NO: 193070 - DNA, 25 bp, Rattus norvegicus
atgccctttatgtccattctggaaa

SEQ ID NO: 193071 - DNA, 25 bp, Rattus norvegicus
atgccctttgccatgaaccctgaat

SEQ ID NO: 193072 - DNA, 25 bp, Rattus norvegicus
atgccctttgccctcagacaggagg

SEQ ID NO: 193073 - DNA, 25 bp, Rattus norvegicus
atgccctttgccgtcagacaggagg

SEQ ID NO: 193074 - DNA, 25 bp, Rattus norvegicus
atgccctttgccttgaaccctgaat

SEQ ID NO: 193075 - DNA, 25 bp, Rattus norvegicus
atgccctttggaaatgttatctctg

SEQ ID NO: 193076 - DNA, 25 bp, Rattus norvegicus
atgccctttggatatgttatctctg

SEQ ID NO: 193077 - DNA, 25 bp, Rattus norvegicus
atgccctttgggagtgccctgtgtt

SEQ ID NO: 193078 - DNA, 25 bp, Rattus norvegicus
atgccctttgggtgtgccctgtgtt

SEQ ID NO: 193079 - DNA, 25 bp, Rattus norvegicus
atgccctttggtcaccaagctacat

SEQ ID NO: 193080 - DNA, 25 bp, Rattus norvegicus
atgccctttggtgaccaagctacat

SEQ ID NO: 193081 - DNA, 25 bp, Rattus norvegicus
atgcccttttttcttgtaatccaag

SEQ ID NO: 193082 - DNA, 25 bp, Rattus norvegicus
atgcccttttttgttgtaatccaag

SEQ ID NO: 193083 - DNA, 25 bp, Rattus norvegicus
atgccgaaagcaaattatccatctt

SEQ ID NO: 193084 - DNA, 25 bp, Rattus norvegicus
atgccgaaagcatattatccatctt

SEQ ID NO: 193085 - DNA, 25 bp, Rattus norvegicus
atgccgaaatgaaccgccagataga

SEQ ID NO: 193086 - DNA, 25 bp, Rattus norvegicus
atgccgaaatgatccgccagataga

SEQ ID NO: 193087 - DNA, 25 bp, Rattus norvegicus
atgccgaagaccctcccgatgtagc

SEQ ID NO: 193088 - DNA, 25 bp, Rattus norvegicus
atgccgaagaccgtcccgatgtagc

SEQ ID NO: 193089 - DNA, 25 bp, Rattus norvegicus
atgccgactaatcgactctcagtga

SEQ ID NO: 193090 - DNA, 25 bp, Rattus norvegicus
atgccgactaatggactctcagtga

SEQ ID NO: 193091 - DNA, 25 bp, Rattus norvegicus
atgccgacttcaaagcctacttaaa

SEQ ID NO: 193092 - DNA, 25 bp, Rattus norvegicus
atgccgacttcatagcctacttaaa

SEQ ID NO: 193093 - DNA, 25 bp, Rattus norvegicus
atgccgagaggcactctgtttcagt

SEQ ID NO: 193094 - DNA, 25 bp, Rattus norvegicus
atgccgagaggctctctgtttcagt

SEQ ID NO: 193095 - DNA, 25 bp, Rattus norvegicus
atgccgaggctgagactgacactct

SEQ ID NO: 193096 - DNA, 25 bp, Rattus norvegicus
atgccgaggctgtgactgacactct

SEQ ID NO: 193097 - DNA, 25 bp, Rattus norvegicus
atgccgagttctccccgacttttat

SEQ ID NO: 193098 - DNA, 25 bp, Rattus norvegicus
atgccgagttctgcccgacttttat

SEQ ID NO: 193099 - DNA, 25 bp, Rattus norvegicus
atgccgagtttccaagtgtcttccg

SEQ ID NO: 193100 - DNA, 25 bp, Rattus norvegicus
atgccgagtttcgaagtgtcttccg

SEQ ID NO: 193101 - DNA, 25 bp, Rattus norvegicus
atgccgatctatctatccttccaaa

SEQ ID NO: 193102 - DNA, 25 bp, Rattus norvegicus
atgccgatctatgtatccttccaaa

SEQ ID NO: 193103 - DNA, 25 bp, Rattus norvegicus
atgccgattttaccgtttgcctaca

SEQ ID NO: 193104 - DNA, 25 bp, Rattus norvegicus
atgccgattttagcgtttgcctaca

SEQ ID NO: 193105 - DNA, 25 bp, Rattus norvegicus
atgccgcactagactgtgttacagc

SEQ ID NO: 193106 - DNA, 25 bp, Rattus norvegicus
atgccgcactagtctgtgttacagc

SEQ ID NO: 193107 - DNA, 25 bp, Rattus norvegicus
atgccgcagtatcggaggacactgt

SEQ ID NO: 193108 - DNA, 25 bp, Rattus norvegicus
atgccgcagtatgggaggacactgt

SEQ ID NO: 193109 - DNA, 25 bp, Rattus norvegicus
atgccgcatgtactgattgtccctt

SEQ ID NO: 193110 - DNA, 25 bp, Rattus norvegicus
atgccgcatgtagtgattgtccctt

SEQ ID NO: 193111 - DNA, 25 bp, Rattus norvegicus
atgccgccatccagagccagggaca

SEQ ID NO: 193112 - DNA, 25 bp, Rattus norvegicus
atgccgccatcctgagccagggaca

SEQ ID NO: 193113 - DNA, 25 bp, Rattus norvegicus
atgccgccatcgagttaaaccatga

SEQ ID NO: 193114 - DNA, 25 bp, Rattus norvegicus
atgccgccatcgtgttaaaccatga

SEQ ID NO: 193115 - DNA, 25 bp, Rattus norvegicus
atgccgccgagaaggaaccgcgacc

SEQ ID NO: 193116 - DNA, 25 bp, Rattus norvegicus
atgccgccgagatggaaccgcgacc

SEQ ID NO: 193117 - DNA, 25 bp, Rattus norvegicus
atgccgcctgcacatgtaggtacaa

SEQ ID NO: 193118 - DNA, 25 bp, Rattus norvegicus
atgccgcctgcagatgtaggtacaa

SEQ ID NO: 193119 - DNA, 25 bp, Rattus norvegicus
atgccgctgacaaccccatgatgaa

SEQ ID NO: 193120 - DNA, 25 bp, Rattus norvegicus
atgccgctgacatccccatgatgaa

SEQ ID NO: 193121 - DNA, 25 bp, Rattus norvegicus
atgccggagagtcagagtgcaactt

SEQ ID NO: 193122 - DNA, 25 bp, Rattus norvegicus
atgccggagagtgagagtgcaactt

SEQ ID NO: 193123 - DNA, 25 bp, Rattus norvegicus
atgccggagttcctagaggaccctt

SEQ ID NO: 193124 - DNA, 25 bp, Rattus norvegicus
atgccggagttcgtagaggaccctt

SEQ ID NO: 193125 - DNA, 25 bp, Rattus norvegicus
atgccggcaagaactttgtcagttt

SEQ ID NO: 193126 - DNA, 25 bp, Rattus norvegicus
atgccggcaagatctttgtcagttt

SEQ ID NO: 193127 - DNA, 25 bp, Rattus norvegicus
atgccggcagctatacaagactttt

SEQ ID NO: 193128 - DNA, 25 bp, Rattus norvegicus
atgccggcagctttacaagactttt

SEQ ID NO: 193129 - DNA, 25 bp, Rattus norvegicus
atgccggcgagcacgttgcagctct

SEQ ID NO: 193130 - DNA, 25 bp, Rattus norvegicus
atgccggcgagctcgttgcagctct

SEQ ID NO: 193131 - DNA, 25 bp, Rattus norvegicus
atgccgggagccaagcccacgtaca

SEQ ID NO: 193132 - DNA, 25 bp, Rattus norvegicus
atgccgggagcctagcccacgtaca

SEQ ID NO: 193133 - DNA, 25 bp, Rattus norvegicus
atgccggtaacccaatgctcatgga

SEQ ID NO: 193134 - DNA, 25 bp, Rattus norvegicus
atgccggtaaccgaatgctcatgga

SEQ ID NO: 193135 - DNA, 25 bp, Rattus norvegicus
atgccggtccttagtccacaagaaa

SEQ ID NO: 193136 - DNA, 25 bp, Rattus norvegicus
atgccggtcctttgtccacaagaaa

SEQ ID NO: 193137 - DNA, 25 bp, Rattus norvegicus
atgccggtgaacctgcaaaacaggc

SEQ ID NO: 193138 - DNA, 25 bp, Rattus norvegicus
atgccggtgaacgtgcaaaacaggc

SEQ ID NO: 193139 - DNA, 25 bp, Rattus norvegicus
atgccggtgatcaacatcgaggacc

SEQ ID NO: 193140 - DNA, 25 bp, Rattus norvegicus
atgccggtgatctacatcgaggacc

SEQ ID NO: 193141 - DNA, 25 bp, Rattus norvegicus
atgccggttctgaagatgcccagag

SEQ ID NO: 193142 - DNA, 25 bp, Rattus norvegicus
atgccggttctgtagatgcccagag

SEQ ID NO: 193143 - DNA, 25 bp, Rattus norvegicus
atgccgtacatcctttctcaaaagg

SEQ ID NO: 193144 - DNA, 25 bp, Rattus norvegicus
atgccgtacatcgtttctcaaaagg

SEQ ID NO: 193145 - DNA, 25 bp, Rattus norvegicus
atgccgtcacccactagtggaatgt

SEQ ID NO: 193146 - DNA, 25 bp, Rattus norvegicus
atgccgtcaccctctagtggaatgt

SEQ ID NO: 193147 - DNA, 25 bp, Rattus norvegicus
atgccgtctgtcatggtattcacac

SEQ ID NO: 193148 - DNA, 25 bp, Rattus norvegicus
atgccgtctgtcttggtattcacac

SEQ ID NO: 193149 - DNA, 25 bp, Rattus norvegicus
atgccgtgacttaagactcagccac

SEQ ID NO: 193150 - DNA, 25 bp, Rattus norvegicus
atgccgtgactttagactcagccac

SEQ ID NO: 193151 - DNA, 25 bp, Rattus norvegicus
atgccgtgattcctttacctgaggt

SEQ ID NO: 193152 - DNA, 25 bp, Rattus norvegicus
atgccgtgattcgtttacctgaggt

SEQ ID NO: 193153 - DNA, 25 bp, Rattus norvegicus
atgccgtgcctcaaaatggtgctgg

SEQ ID NO: 193154 - DNA, 25 bp, Rattus norvegicus
atgccgtgcctctaaatggtgctgg

SEQ ID NO: 193155 - DNA, 25 bp, Rattus norvegicus
atgccgtgcggaacctgtcagagct

SEQ ID NO: 193156 - DNA, 25 bp, Rattus norvegicus
atgccgtgcggatcctgtcagagct

SEQ ID NO: 193157 - DNA, 25 bp, Rattus norvegicus
atgccgtggaggagactggactatc

SEQ ID NO: 193158 - DNA, 25 bp, Rattus norvegicus
atgccgtggaggtgactggactatc

SEQ ID NO: 193159 - DNA, 25 bp, Rattus norvegicus
atgccgtggatgctgtagccaacaa

SEQ ID NO: 193160 - DNA, 25 bp, Rattus norvegicus
atgccgtggatggtgtagccaacaa

SEQ ID NO: 193161 - DNA, 25 bp, Rattus norvegicus
atgccgtgtaccctgctgttaatag

SEQ ID NO: 193162 - DNA, 25 bp, Rattus norvegicus
atgccgtgtaccgtgctgttaatag

SEQ ID NO: 193163 - DNA, 25 bp, Rattus norvegicus
atgccgttagcccagtgagttctcc

SEQ ID NO: 193164 - DNA, 25 bp, Rattus norvegicus
atgccgttagccgagtgagttctcc

SEQ ID NO: 193165 - DNA, 25 bp, Rattus norvegicus
atgccgttcctactctcagcagctg

SEQ ID NO: 193166 - DNA, 25 bp, Rattus norvegicus
atgccgttcctagtctcagcagctg

SEQ ID NO: 193167 - DNA, 25 bp, Rattus norvegicus
atgccgttcgcaagaagtgtgctac

SEQ ID NO: 193168 - DNA, 25 bp, Rattus norvegicus
atgccgttcgcatgaagtgtgctac

SEQ ID NO: 193169 - DNA, 25 bp, Rattus norvegicus
atgccgttctctaggtgtttgccaa

SEQ ID NO: 193170 - DNA, 25 bp, Rattus norvegicus
atgccgttctcttggtgtttgccaa

SEQ ID NO: 193171 - DNA, 25 bp, Rattus norvegicus
atgccgttgctacttgcaatcgtct

SEQ ID NO: 193172 - DNA, 25 bp, Rattus norvegicus
atgccgttgctagttgcaatcgtct

SEQ ID NO: 193173 - DNA, 25 bp, Rattus norvegicus
atgcctaaaataacctgcatgaacc

SEQ ID NO: 193174 - DNA, 25 bp, Rattus norvegicus
atgcctaaaatatcctgcatgaacc

SEQ ID NO: 193175 - DNA, 25 bp, Rattus norvegicus
atgcctaacagtcccttttgggttc

SEQ ID NO: 193176 - DNA, 25 bp, Rattus norvegicus
atgcctaacagtgccttttgggttc

SEQ ID NO: 193177 - DNA, 25 bp, Rattus norvegicus
atgcctaacctaaatctgatcctga

SEQ ID NO: 193178 - DNA, 25 bp, Rattus norvegicus
atgcctaacctatatctgatcctga

SEQ ID NO: 193179 - DNA, 25 bp, Rattus norvegicus
atgcctaagcagacatcacacctgt

SEQ ID NO: 193180 - DNA, 25 bp, Rattus norvegicus
atgcctaagcagtcatcacacctgt

SEQ ID NO: 193181 - DNA, 25 bp, Rattus norvegicus
atgcctaagtttcccctggaaagag

SEQ ID NO: 193182 - DNA, 25 bp, Rattus norvegicus
atgcctaagtttgccctggaaagag

SEQ ID NO: 193183 - DNA, 25 bp, Rattus norvegicus
atgcctaatactatggctgcctcca

SEQ ID NO: 193184 - DNA, 25 bp, Rattus norvegicus
atgcctaatactttggctgcctcca

SEQ ID NO: 193185 - DNA, 25 bp, Rattus norvegicus
atgcctaatgtacaggaactgttta

SEQ ID NO: 193186 - DNA, 25 bp, Rattus norvegicus
atgcctaatgtagaggaactgttta

SEQ ID NO: 193187 - DNA, 25 bp, Rattus norvegicus
atgcctacaaccctttggctggagg

SEQ ID NO: 193188 - DNA, 25 bp, Rattus norvegicus
atgcctacaaccgtttggctggagg

SEQ ID NO: 193189 - DNA, 25 bp, Rattus norvegicus
atgcctacaattccagcccttgggt

SEQ ID NO: 193190 - DNA, 25 bp, Rattus norvegicus
atgcctacaattgcagcccttgggt

SEQ ID NO: 193191 - DNA, 25 bp, Rattus norvegicus
atgcctacactcaagcctcaggagg

SEQ ID NO: 193192 - DNA, 25 bp, Rattus norvegicus
atgcctacactctagcctcaggagg

SEQ ID NO: 193193 - DNA, 25 bp, Rattus norvegicus
atgcctacagcaccggaagcagctt

SEQ ID NO: 193194 - DNA, 25 bp, Rattus norvegicus
atgcctacagcagcggaagcagctt

SEQ ID NO: 193195 - DNA, 25 bp, Rattus norvegicus
atgcctaccaccatggaggattttg

SEQ ID NO: 193196 - DNA, 25 bp, Rattus norvegicus
atgcctaccaccttggaggattttg

SEQ ID NO: 193197 - DNA, 25 bp, Rattus norvegicus
atgcctacccttctgtgacttgtga

SEQ ID NO: 193198 - DNA, 25 bp, Rattus norvegicus
atgcctacccttgtgtgacttgtga

SEQ ID NO: 193199 - DNA, 25 bp, Rattus norvegicus
atgcctaccgagaaaacgtgttcaa

SEQ ID NO: 193200 - DNA, 25 bp, Rattus norvegicus
atgcctaccgagtaaacgtgttcaa

SEQ ID NO: 193201 - DNA, 25 bp, Rattus norvegicus
atgcctacctaaattgacagtcttg

SEQ ID NO: 193202 - DNA, 25 bp, Rattus norvegicus
atgcctacctaatttgacagtcttg

SEQ ID NO: 193203 - DNA, 25 bp, Rattus norvegicus
atgcctacctataccactcaacttg

SEQ ID NO: 193204 - DNA, 25 bp, Rattus norvegicus
atgcctacctattccactcaacttg

SEQ ID NO: 193205 - DNA, 25 bp, Rattus norvegicus
atgcctacgggccaagctcagtgag

SEQ ID NO: 193206 - DNA, 25 bp, Rattus norvegicus
atgcctacgggcgaagctcagtgag

SEQ ID NO: 193207 - DNA, 25 bp, Rattus norvegicus
atgcctacgtttctgattgcacgct

SEQ ID NO: 193208 - DNA, 25 bp, Rattus norvegicus
atgcctacgtttgtgattgcacgct

SEQ ID NO: 193209 - DNA, 25 bp, Rattus norvegicus
atgcctactaagacagagcctgggt

SEQ ID NO: 193210 - DNA, 25 bp, Rattus norvegicus
atgcctactaagtcagagcctgggt

SEQ ID NO: 193211 - DNA, 25 bp, Rattus norvegicus
atgcctactcacattgttcttgatg

SEQ ID NO: 193212 - DNA, 25 bp, Rattus norvegicus
atgcctactcactttgttcttgatg

SEQ ID NO: 193213 - DNA, 25 bp, Rattus norvegicus
atgcctacttggaacccacttgcca

SEQ ID NO: 193214 - DNA, 25 bp, Rattus norvegicus
atgcctacttggtacccacttgcca

SEQ ID NO: 193215 - DNA, 25 bp, Rattus norvegicus
atgcctagagagcagggttccagct

SEQ ID NO: 193216 - DNA, 25 bp, Rattus norvegicus
atgcctagagaggagggttccagct

SEQ ID NO: 193217 - DNA, 25 bp, Rattus norvegicus
atgcctagcatcactgcgcattcca

SEQ ID NO: 193218 - DNA, 25 bp, Rattus norvegicus
atgcctagcatctctgcgcattcca

SEQ ID NO: 193219 - DNA, 25 bp, Rattus norvegicus
atgcctagccagataaactccctaa

SEQ ID NO: 193220 - DNA, 25 bp, Rattus norvegicus
atgcctagccagttaaactccctaa

SEQ ID NO: 193221 - DNA, 25 bp, Rattus norvegicus
atgcctagctacagagggcgccagt

SEQ ID NO: 193222 - DNA, 25 bp, Rattus norvegicus
atgcctagctactgagggcgccagt

SEQ ID NO: 193223 - DNA, 25 bp, Rattus norvegicus
atgcctagctctacaactctactga

SEQ ID NO: 193224 - DNA, 25 bp, Rattus norvegicus
atgcctagctcttcaactctactga

SEQ ID NO: 193225 - DNA, 25 bp, Rattus norvegicus
atgcctaggagaactgggactttga

SEQ ID NO: 193226 - DNA, 25 bp, Rattus norvegicus
atgcctaggagatctgggactttga

SEQ ID NO: 193227 - DNA, 25 bp, Rattus norvegicus
atgcctagtaggctattcaatatta

SEQ ID NO: 193228 - DNA, 25 bp, Rattus norvegicus
atgcctagtagggtattcaatatta

SEQ ID NO: 193229 - DNA, 25 bp, Rattus norvegicus
atgcctagtgccaacgaagtccaga

SEQ ID NO: 193230 - DNA, 25 bp, Rattus norvegicus
atgcctagtgcctacgaagtccaga

SEQ ID NO: 193231 - DNA, 25 bp, Rattus norvegicus
atgcctagtgttattcatgcccttc

SEQ ID NO: 193232 - DNA, 25 bp, Rattus norvegicus
atgcctagtgtttttcatgcccttc

SEQ ID NO: 193233 - DNA, 25 bp, Rattus norvegicus
atgcctataggtctccctcgagcag

SEQ ID NO: 193234 - DNA, 25 bp, Rattus norvegicus
atgcctataggtgtccctcgagcag

SEQ ID NO: 193235 - DNA, 25 bp, Rattus norvegicus
atgcctatcctaccgcctaaataag

SEQ ID NO: 193236 - DNA, 25 bp, Rattus norvegicus
atgcctatcctagcgcctaaataag

SEQ ID NO: 193237 - DNA, 25 bp, Rattus norvegicus
atgcctatcggtcaaggatggcctt

SEQ ID NO: 193238 - DNA, 25 bp, Rattus norvegicus
atgcctatcggtgaaggatggcctt

SEQ ID NO: 193239 - DNA, 25 bp, Rattus norvegicus
atgcctatgaacatgcccggtgtaa

SEQ ID NO: 193240 - DNA, 25 bp, Rattus norvegicus
atgcctatgaacttgcccggtgtaa

SEQ ID NO: 193241 - DNA, 25 bp, Rattus norvegicus
atgcctatgaggctcaagctgtcaa

SEQ ID NO: 193242 - DNA, 25 bp, Rattus norvegicus
atgcctatgagggtcaagctgtcaa

SEQ ID NO: 193243 - DNA, 25 bp, Rattus norvegicus
atgcctatggaaactgcacctctgg

SEQ ID NO: 193244 - DNA, 25 bp, Rattus norvegicus
atgcctatggaatctgcacctctgg

SEQ ID NO: 193245 - DNA, 25 bp, Rattus norvegicus
atgcctatggacatcatgcaccccg

SEQ ID NO: 193246 - DNA, 25 bp, Rattus norvegicus
atgcctatggacttcatgcaccccg

SEQ ID NO: 193247 - DNA, 25 bp, Rattus norvegicus
atgcctatggatcacctggaacctt

SEQ ID NO: 193248 - DNA, 25 bp, Rattus norvegicus
atgcctatggatgacctggaacctt

SEQ ID NO: 193249 - DNA, 25 bp, Rattus norvegicus
atgcctattcagactatatacagag

SEQ ID NO: 193250 - DNA, 25 bp, Rattus norvegicus
atgcctattcagtctatatacagag

SEQ ID NO: 193251 - DNA, 25 bp, Rattus norvegicus
atgcctattgaacccataccttaat

SEQ ID NO: 193252 - DNA, 25 bp, Rattus norvegicus
atgcctattgaagccataccttaat

SEQ ID NO: 193253 - DNA, 25 bp, Rattus norvegicus
atgcctattgggatgtaaactcgag

SEQ ID NO: 193254 - DNA, 25 bp, Rattus norvegicus
atgcctattgggttgtaaactcgag

SEQ ID NO: 193255 - DNA, 25 bp, Rattus norvegicus
atgcctatttaacccttcagcacca

SEQ ID NO: 193256 - DNA, 25 bp, Rattus norvegicus
atgcctatttaagccttcagcacca

SEQ ID NO: 193257 - DNA, 25 bp, Rattus norvegicus
atgcctcaagcccagcatttctggg

SEQ ID NO: 193258 - DNA, 25 bp, Rattus norvegicus
atgcctcaagccgagcatttctggg

SEQ ID NO: 193259 - DNA, 25 bp, Rattus norvegicus
atgcctcaagttatgattgtttaag

SEQ ID NO: 193260 - DNA, 25 bp, Rattus norvegicus
atgcctcaagttttgattgtttaag

SEQ ID NO: 193261 - DNA, 25 bp, Rattus norvegicus
atgcctcacaaaagaatgattctgg

SEQ ID NO: 193262 - DNA, 25 bp, Rattus norvegicus
atgcctcacaaatgaatgattctgg

SEQ ID NO: 193263 - DNA, 25 bp, Rattus norvegicus
atgcctcactatatggtttcctctg

SEQ ID NO: 193264 - DNA, 25 bp, Rattus norvegicus
atgcctcactatttggtttcctctg

SEQ ID NO: 193265 - DNA, 25 bp, Rattus norvegicus
atgcctcagcagatgtttccctgta

SEQ ID NO: 193266 - DNA, 25 bp, Rattus norvegicus
atgcctcagcagttgtttccctgta

SEQ ID NO: 193267 - DNA, 25 bp, Rattus norvegicus
atgcctcagccaactgtagcttcag

SEQ ID NO: 193268 - DNA, 25 bp, Rattus norvegicus
atgcctcagccatctgtagcttcag

SEQ ID NO: 193269 - DNA, 25 bp, Rattus norvegicus
atgcctcagcccagcgtaagcggaa

SEQ ID NO: 193270 - DNA, 25 bp, Rattus norvegicus
atgcctcagccctgcgtaagcggaa

SEQ ID NO: 193271 - DNA, 25 bp, Rattus norvegicus
atgcctcagctgatgaaccacctaa

SEQ ID NO: 193272 - DNA, 25 bp, Rattus norvegicus
atgcctcagctgttgaaccacctaa

SEQ ID NO: 193273 - DNA, 25 bp, Rattus norvegicus
atgcctcaggaccactgctgtcttt

SEQ ID NO: 193274 - DNA, 25 bp, Rattus norvegicus
atgcctcaggacgactgctgtcttt

SEQ ID NO: 193275 - DNA, 25 bp, Rattus norvegicus
atgcctcaggcaatgctactaatga

SEQ ID NO: 193276 - DNA, 25 bp, Rattus norvegicus
atgcctcaggcattgctactaatga

SEQ ID NO: 193277 - DNA, 25 bp, Rattus norvegicus
atgcctcaggcccttttcaaggtag

SEQ ID NO: 193278 - DNA, 25 bp, Rattus norvegicus
atgcctcaggccgttttcaaggtag

SEQ ID NO: 193279 - DNA, 25 bp, Rattus norvegicus
atgcctcaggtcaccagggattcct

SEQ ID NO: 193280 - DNA, 25 bp, Rattus norvegicus
atgcctcaggtctccagggattcct

SEQ ID NO: 193281 - DNA, 25 bp, Rattus norvegicus
atgcctcataaaccatcgctgacat

SEQ ID NO: 193282 - DNA, 25 bp, Rattus norvegicus
atgcctcataaagcatcgctgacat

SEQ ID NO: 193283 - DNA, 25 bp, Rattus norvegicus
atgcctcatcatcttaagtctgttg

SEQ ID NO: 193284 - DNA, 25 bp, Rattus norvegicus
atgcctcatcatgttaagtctgttg

SEQ ID NO: 193285 - DNA, 25 bp, Rattus norvegicus
atgcctcatcctctgggagttgtcc

SEQ ID NO: 193286 - DNA, 25 bp, Rattus norvegicus
atgcctcatcctgtgggagttgtcc

SEQ ID NO: 193287 - DNA, 25 bp, Rattus norvegicus
atgcctcatgaaaccaccttaatta

SEQ ID NO: 193288 - DNA, 25 bp, Rattus norvegicus
atgcctcatgaatccaccttaatta

SEQ ID NO: 193289 - DNA, 25 bp, Rattus norvegicus
atgcctcattggcagctgtggagcc

SEQ ID NO: 193290 - DNA, 25 bp, Rattus norvegicus
atgcctcattgggagctgtggagcc

SEQ ID NO: 193291 - DNA, 25 bp, Rattus norvegicus
atgcctcattttcatattgtcctcc

SEQ ID NO: 193292 - DNA, 25 bp, Rattus norvegicus
atgcctcattttgatattgtcctcc

SEQ ID NO: 193293 - DNA, 25 bp, Rattus norvegicus
atgcctccaactattaagctcaaca

SEQ ID NO: 193294 - DNA, 25 bp, Rattus norvegicus
atgcctccaacttttaagctcaaca

SEQ ID NO: 193295 - DNA, 25 bp, Rattus norvegicus
atgcctccattcacttgtgggattt

SEQ ID NO: 193296 - DNA, 25 bp, Rattus norvegicus
atgcctccattctcttgtgggattt

SEQ ID NO: 193297 - DNA, 25 bp, Rattus norvegicus
atgcctcccaacctgcagaaagtgg

SEQ ID NO: 193298 - DNA, 25 bp, Rattus norvegicus
atgcctcccaacgtgcagaaagtgg

SEQ ID NO: 193299 - DNA, 25 bp, Rattus norvegicus
atgcctcccatgatggtatctgata

SEQ ID NO: 193300 - DNA, 25 bp, Rattus norvegicus
atgcctcccatgttggtatctgata

SEQ ID NO: 193301 - DNA, 25 bp, Rattus norvegicus
atgcctcccttaaatgccttgtaat

SEQ ID NO: 193302 - DNA, 25 bp, Rattus norvegicus
atgcctcccttatatgccttgtaat

SEQ ID NO: 193303 - DNA, 25 bp, Rattus norvegicus
atgcctccgactatcatgatagctg

SEQ ID NO: 193304 - DNA, 25 bp, Rattus norvegicus
atgcctccgactttcatgatagctg

SEQ ID NO: 193305 - DNA, 25 bp, Rattus norvegicus
atgcctcctctgaaattactgtatt

SEQ ID NO: 193306 - DNA, 25 bp, Rattus norvegicus
atgcctcctctgtaattactgtatt

SEQ ID NO: 193307 - DNA, 25 bp, Rattus norvegicus
atgcctccttcaaagcaccgtgtga

SEQ ID NO: 193308 - DNA, 25 bp, Rattus norvegicus
atgcctccttcatagcaccgtgtga

SEQ ID NO: 193309 - DNA, 25 bp, Rattus norvegicus
atgcctcgcatgctgatcacaatca

SEQ ID NO: 193310 - DNA, 25 bp, Rattus norvegicus
atgcctcgcatggtgatcacaatca

SEQ ID NO: 193311 - DNA, 25 bp, Rattus norvegicus
atgcctcgctggatgactcaatgtg

SEQ ID NO: 193312 - DNA, 25 bp, Rattus norvegicus
atgcctcgctggttgactcaatgtg

SEQ ID NO: 193313 - DNA, 25 bp, Rattus norvegicus
atgcctcgtcagaagcagcctcagg

SEQ ID NO: 193314 - DNA, 25 bp, Rattus norvegicus
atgcctcgtcagagcgactgaacat

SEQ ID NO: 193315 - DNA, 25 bp, Rattus norvegicus
atgcctcgtcagtagcagcctcagg

SEQ ID NO: 193316 - DNA, 25 bp, Rattus norvegicus
atgcctcgtcagtgcgactgaacat

SEQ ID NO: 193317 - DNA, 25 bp, Rattus norvegicus
atgcctcgtgggatgggtgttttca

SEQ ID NO: 193318 - DNA, 25 bp, Rattus norvegicus
atgcctcgtgggttgggtgttttca

SEQ ID NO: 193319 - DNA, 25 bp, Rattus norvegicus
atgcctcgttgtccctcaataaaaa

SEQ ID NO: 193320 - DNA, 25 bp, Rattus norvegicus
atgcctcgttgtgcctcaataaaaa

SEQ ID NO: 193321 - DNA, 25 bp, Rattus norvegicus
atgcctctaggccttgttctattat

SEQ ID NO: 193322 - DNA, 25 bp, Rattus norvegicus
atgcctctaggcgttgttctattat

SEQ ID NO: 193323 - DNA, 25 bp, Rattus norvegicus
atgcctctcattaggctaggaaccc

SEQ ID NO: 193324 - DNA, 25 bp, Rattus norvegicus
atgcctctcatttggctaggaaccc

SEQ ID NO: 193325 - DNA, 25 bp, Rattus norvegicus
atgcctctcctgcaaagccatggat

SEQ ID NO: 193326 - DNA, 25 bp, Rattus norvegicus
atgcctctcctggaaagccatggat

SEQ ID NO: 193327 - DNA, 25 bp, Rattus norvegicus
atgcctctctgacccctaaacatgg

SEQ ID NO: 193328 - DNA, 25 bp, Rattus norvegicus
atgcctctctgagccctaaacatgg

SEQ ID NO: 193329 - DNA, 25 bp, Rattus norvegicus
atgcctctcttcaaggtctcaaggg

SEQ ID NO: 193330 - DNA, 25 bp, Rattus norvegicus
atgcctctcttctaggtctcaaggg

SEQ ID NO: 193331 - DNA, 25 bp, Rattus norvegicus
atgcctctgacaacatgaccagata

SEQ ID NO: 193332 - DNA, 25 bp, Rattus norvegicus
atgcctctgacatcatgaccagata

SEQ ID NO: 193333 - DNA, 25 bp, Rattus norvegicus
atgcctctgatcactgtcagcatct

SEQ ID NO: 193334 - DNA, 25 bp, Rattus norvegicus
atgcctctgatctctgtcagcatct

SEQ ID NO: 193335 - DNA, 25 bp, Rattus norvegicus
atgcctctgcaacaacctgactaag

SEQ ID NO: 193336 - DNA, 25 bp, Rattus norvegicus
atgcctctgcaagaacctgactaag

SEQ ID NO: 193337 - DNA, 25 bp, Rattus norvegicus
atgcctctggatcacaccgagaact

SEQ ID NO: 193338 - DNA, 25 bp, Rattus norvegicus
atgcctctggatgacaccgagaact

SEQ ID NO: 193339 - DNA, 25 bp, Rattus norvegicus
atgcctctgtacataggattcccaa

SEQ ID NO: 193340 - DNA, 25 bp, Rattus norvegicus
atgcctctgtacttaggattcccaa

SEQ ID NO: 193341 - DNA, 25 bp, Rattus norvegicus
atgcctctgtgtataaacccagtcc

SEQ ID NO: 193342 - DNA, 25 bp, Rattus norvegicus
atgcctctgtgtttaaacccagtcc

SEQ ID NO: 193343 - DNA, 25 bp, Rattus norvegicus
atgcctctgttcctagttgcagttt

SEQ ID NO: 193344 - DNA, 25 bp, Rattus norvegicus
atgcctctgttcgtagttgcagttt

SEQ ID NO: 193345 - DNA, 25 bp, Rattus norvegicus
atgcctcttaatactatatcttctg

SEQ ID NO: 193346 - DNA, 25 bp, Rattus norvegicus
atgcctcttaattctatatcttctg

SEQ ID NO: 193347 - DNA, 25 bp, Rattus norvegicus
atgcctcttctcctgaacagatgtg

SEQ ID NO: 193348 - DNA, 25 bp, Rattus norvegicus
atgcctcttctcgtgaacagatgtg

SEQ ID NO: 193349 - DNA, 25 bp, Rattus norvegicus
atgcctcttgccacagggaaacgtt

SEQ ID NO: 193350 - DNA, 25 bp, Rattus norvegicus
atgcctcttgcctcagggaaacgtt

SEQ ID NO: 193351 - DNA, 25 bp, Rattus norvegicus
atgcctctttgcactagcattcaca

SEQ ID NO: 193352 - DNA, 25 bp, Rattus norvegicus
atgcctctttgctctagcattcaca

SEQ ID NO: 193353 - DNA, 25 bp, Rattus norvegicus
atgcctgaacacagacacgtgctga

SEQ ID NO: 193354 - DNA, 25 bp, Rattus norvegicus
atgcctgaacactgacacgtgctga

SEQ ID NO: 193355 - DNA, 25 bp, Rattus norvegicus
atgcctgaacataagctgactgctg

SEQ ID NO: 193356 - DNA, 25 bp, Rattus norvegicus
atgcctgaacattagctgactgctg

SEQ ID NO: 193357 - DNA, 25 bp, Rattus norvegicus
atgcctgaaccacatgctgggccta

SEQ ID NO: 193358 - DNA, 25 bp, Rattus norvegicus
atgcctgaaccagatgctgggccta

SEQ ID NO: 193359 - DNA, 25 bp, Rattus norvegicus
atgcctgaacgcatcttagatccaa

SEQ ID NO: 193360 - DNA, 25 bp, Rattus norvegicus
atgcctgaacgcttcttagatccaa

SEQ ID NO: 193361 - DNA, 25 bp, Rattus norvegicus
atgcctgacagaaacttgcttccat

SEQ ID NO: 193362 - DNA, 25 bp, Rattus norvegicus
atgcctgacagatacttgcttccat

SEQ ID NO: 193363 - DNA, 25 bp, Rattus norvegicus
atgcctgaccaaaatgctttctctt

SEQ ID NO: 193364 - DNA, 25 bp, Rattus norvegicus
atgcctgaccaatatgctttctctt

SEQ ID NO: 193365 - DNA, 25 bp, Rattus norvegicus
atgcctgacgaactgtagcctttct

SEQ ID NO: 193366 - DNA, 25 bp, Rattus norvegicus
atgcctgacgaagtgtagcctttct

SEQ ID NO: 193367 - DNA, 25 bp, Rattus norvegicus
atgcctgacgctagagtagcactgc

SEQ ID NO: 193368 - DNA, 25 bp, Rattus norvegicus
atgcctgacgcttgagtagcactgc

SEQ ID NO: 193369 - DNA, 25 bp, Rattus norvegicus
atgcctgactagcacatccgatttt

SEQ ID NO: 193370 - DNA, 25 bp, Rattus norvegicus
atgcctgactaggacatccgatttt

SEQ ID NO: 193371 - DNA, 25 bp, Rattus norvegicus
atgcctgactgcacactgccaagca

SEQ ID NO: 193372 - DNA, 25 bp, Rattus norvegicus
atgcctgactgctcactgccaagca

SEQ ID NO: 193373 - DNA, 25 bp, Rattus norvegicus
atgcctgagatcaacgtcagactga

SEQ ID NO: 193374 - DNA, 25 bp, Rattus norvegicus
atgcctgagatctacgtcagactga

SEQ ID NO: 193375 - DNA, 25 bp, Rattus norvegicus
atgcctgagattagtcctactgtgg

SEQ ID NO: 193376 - DNA, 25 bp, Rattus norvegicus
atgcctgagatttgtcctactgtgg

SEQ ID NO: 193377 - DNA, 25 bp, Rattus norvegicus
atgcctgagcaaagcggtgtcatca

SEQ ID NO: 193378 - DNA, 25 bp, Rattus norvegicus
atgcctgagcaatgcggtgtcatca

SEQ ID NO: 193379 - DNA, 25 bp, Rattus norvegicus
atgcctgaggcaactatttcgtaag

SEQ ID NO: 193380 - DNA, 25 bp, Rattus norvegicus
atgcctgaggcatctatttcgtaag

SEQ ID NO: 193381 - DNA, 25 bp, Rattus norvegicus
atgcctgagtctatcctagaagccc

SEQ ID NO: 193382 - DNA, 25 bp, Rattus norvegicus
atgcctgagtctttcctagaagccc

SEQ ID NO: 193383 - DNA, 25 bp, Rattus norvegicus
atgcctgataaactaatgtcctgtg

SEQ ID NO: 193384 - DNA, 25 bp, Rattus norvegicus
atgcctgataaagtaatgtcctgtg

SEQ ID NO: 193385 - DNA, 25 bp, Rattus norvegicus
atgcctgatgacatttggatcttaa

SEQ ID NO: 193386 - DNA, 25 bp, Rattus norvegicus
atgcctgatgacttttggatcttaa

SEQ ID NO: 193387 - DNA, 25 bp, Rattus norvegicus
atgcctgatgttaaccatgtactgt

SEQ ID NO: 193388 - DNA, 25 bp, Rattus norvegicus
atgcctgatgtttaccatgtactgt

SEQ ID NO: 193389 - DNA, 25 bp, Rattus norvegicus
atgcctgcaaggacctttgctgatg

SEQ ID NO: 193390 - DNA, 25 bp, Rattus norvegicus
atgcctgcaaggtcctttgctgatg

SEQ ID NO: 193391 - DNA, 25 bp, Rattus norvegicus
atgcctgcactgaagaagggcagct

SEQ ID NO: 193392 - DNA, 25 bp, Rattus norvegicus
atgcctgcactgtagaagggcagct

SEQ ID NO: 193393 - DNA, 25 bp, Rattus norvegicus
atgcctgcagatactaacttacttg

SEQ ID NO: 193394 - DNA, 25 bp, Rattus norvegicus
atgcctgcagattctaacttacttg

SEQ ID NO: 193395 - DNA, 25 bp, Rattus norvegicus
atgcctgcagctatggcactcagaa

SEQ ID NO: 193396 - DNA, 25 bp, Rattus norvegicus
atgcctgcagctttggcactcagaa

SEQ ID NO: 193397 - DNA, 25 bp, Rattus norvegicus
atgcctgcagtgagcatgtatctcc

SEQ ID NO: 193398 - DNA, 25 bp, Rattus norvegicus
atgcctgcagtgtgcatgtatctcc

SEQ ID NO: 193399 - DNA, 25 bp, Rattus norvegicus
atgcctgcatctcttatttattgta

SEQ ID NO: 193400 - DNA, 25 bp, Rattus norvegicus
atgcctgcatctgttatttattgta

SEQ ID NO: 193401 - DNA, 25 bp, Rattus norvegicus
atgcctgcatgccaatagcttgctt

SEQ ID NO: 193402 - DNA, 25 bp, Rattus norvegicus
atgcctgcatgcgaatagcttgctt

SEQ ID NO: 193403 - DNA, 25 bp, Rattus norvegicus
atgcctgcatttacactccaaatgg

SEQ ID NO: 193404 - DNA, 25 bp, Rattus norvegicus
atgcctgcattttcactccaaatgg

SEQ ID NO: 193405 - DNA, 25 bp, Rattus norvegicus
atgcctgccaatcaagtgttaccca

SEQ ID NO: 193406 - DNA, 25 bp, Rattus norvegicus
atgcctgccaatgaagtgttaccca

SEQ ID NO: 193407 - DNA, 25 bp, Rattus norvegicus
atgcctgccacaattcaaactcaga

SEQ ID NO: 193408 - DNA, 25 bp, Rattus norvegicus
atgcctgccacatttcaaactcaga

SEQ ID NO: 193409 - DNA, 25 bp, Rattus norvegicus
atgcctgcccagctgaaggtcttaa

SEQ ID NO: 193410 - DNA, 25 bp, Rattus norvegicus
atgcctgcccaggtgaaggtcttaa

SEQ ID NO: 193411 - DNA, 25 bp, Rattus norvegicus
atgcctgccctccagtggctggata

SEQ ID NO: 193412 - DNA, 25 bp, Rattus norvegicus
atgcctgccctcgagtggctggata

SEQ ID NO: 193413 - DNA, 25 bp, Rattus norvegicus
atgcctgcctcgaagtgaagtcgta

SEQ ID NO: 193414 - DNA, 25 bp, Rattus norvegicus
atgcctgcctcgcttttttaatgtc

SEQ ID NO: 193415 - DNA, 25 bp, Rattus norvegicus
atgcctgcctcggttttttaatgtc

SEQ ID NO: 193416 - DNA, 25 bp, Rattus norvegicus
atgcctgcctcgtagtgaagtcgta

SEQ ID NO: 193417 - DNA, 25 bp, Rattus norvegicus
atgcctgcctggcaagcgctttaca

SEQ ID NO: 193418 - DNA, 25 bp, Rattus norvegicus
atgcctgcctgggaagcgctttaca

SEQ ID NO: 193419 - DNA, 25 bp, Rattus norvegicus
atgcctgccttaaacttgcaatcta

SEQ ID NO: 193420 - DNA, 25 bp, Rattus norvegicus
atgcctgccttatacttgcaatcta

SEQ ID NO: 193421 - DNA, 25 bp, Rattus norvegicus
atgcctgcctttacttttccaatat

SEQ ID NO: 193422 - DNA, 25 bp, Rattus norvegicus
atgcctgccttttcttttccaatat

SEQ ID NO: 193423 - DNA, 25 bp, Rattus norvegicus
atgcctgcggcaagagtttcagtcg

SEQ ID NO: 193424 - DNA, 25 bp, Rattus norvegicus
atgcctgcggcatgagtttcagtcg

SEQ ID NO: 193425 - DNA, 25 bp, Rattus norvegicus
atgcctgcgttgatgggtgccataa

SEQ ID NO: 193426 - DNA, 25 bp, Rattus norvegicus
atgcctgcgttgttgggtgccataa

SEQ ID NO: 193427 - DNA, 25 bp, Rattus norvegicus
atgcctgctctcataagtgaacttt

SEQ ID NO: 193428 - DNA, 25 bp, Rattus norvegicus
atgcctgctctcttaagtgaacttt

SEQ ID NO: 193429 - DNA, 25 bp, Rattus norvegicus
atgcctgctcttctcatctatttga

SEQ ID NO: 193430 - DNA, 25 bp, Rattus norvegicus
atgcctgctcttgtcatctatttga

SEQ ID NO: 193431 - DNA, 25 bp, Rattus norvegicus
atgcctgctgagatagctgtttgtc

SEQ ID NO: 193432 - DNA, 25 bp, Rattus norvegicus
atgcctgctgagttagctgtttgtc

SEQ ID NO: 193433 - DNA, 25 bp, Rattus norvegicus
atgcctgctgccactggtaaagacc

SEQ ID NO: 193434 - DNA, 25 bp, Rattus norvegicus
atgcctgctgcctctggtaaagacc

SEQ ID NO: 193435 - DNA, 25 bp, Rattus norvegicus
atgcctgctggaaggccaggctgaa

SEQ ID NO: 193436 - DNA, 25 bp, Rattus norvegicus
atgcctgctggatggccaggctgaa

SEQ ID NO: 193437 - DNA, 25 bp, Rattus norvegicus
atgcctgctgggactttgatgctag

SEQ ID NO: 193438 - DNA, 25 bp, Rattus norvegicus
atgcctgctgggtctttgatgctag

SEQ ID NO: 193439 - DNA, 25 bp, Rattus norvegicus
atgcctgcttcgacaataacactgt

SEQ ID NO: 193440 - DNA, 25 bp, Rattus norvegicus
atgcctgcttcgtcaataacactgt

SEQ ID NO: 193441 - DNA, 25 bp, Rattus norvegicus
atgcctgcttttcggccaaagtgaa

SEQ ID NO: 193442 - DNA, 25 bp, Rattus norvegicus
atgcctgcttttgggccaaagtgaa

SEQ ID NO: 193443 - DNA, 25 bp, Rattus norvegicus
atgcctggaaacacagatggaactc

SEQ ID NO: 193444 - DNA, 25 bp, Rattus norvegicus
atgcctggaaactcagatggaactc

SEQ ID NO: 193445 - DNA, 25 bp, Rattus norvegicus
atgcctggactgaatgccggcctgt

SEQ ID NO: 193446 - DNA, 25 bp, Rattus norvegicus
atgcctggactgtatgccggcctgt

SEQ ID NO: 193447 - DNA, 25 bp, Rattus norvegicus
atgcctggacttactgcatcagtaa

SEQ ID NO: 193448 - DNA, 25 bp, Rattus norvegicus
atgcctggactttctgcatcagtaa

SEQ ID NO: 193449 - DNA, 25 bp, Rattus norvegicus
atgcctggaggtatgagccacacgc

SEQ ID NO: 193450 - DNA, 25 bp, Rattus norvegicus
atgcctggaggtttgagccacacgc

SEQ ID NO: 193451 - DNA, 25 bp, Rattus norvegicus
atgcctggattccttactatctcag

SEQ ID NO: 193452 - DNA, 25 bp, Rattus norvegicus
atgcctggattcgttactatctcag

SEQ ID NO: 193453 - DNA, 25 bp, Rattus norvegicus
atgcctggcactccccttgagaaag

SEQ ID NO: 193454 - DNA, 25 bp, Rattus norvegicus
atgcctggcactgcccttgagaaag

SEQ ID NO: 193455 - DNA, 25 bp, Rattus norvegicus
atgcctggcctccatgaccagagga

SEQ ID NO: 193456 - DNA, 25 bp, Rattus norvegicus
atgcctggcctcgatgaccagagga

SEQ ID NO: 193457 - DNA, 25 bp, Rattus norvegicus
atgcctggcctgaggttggaatccc

SEQ ID NO: 193458 - DNA, 25 bp, Rattus norvegicus
atgcctggcctgtggttggaatccc

SEQ ID NO: 193459 - DNA, 25 bp, Rattus norvegicus
atgcctggctatactgtttgtcatc

SEQ ID NO: 193460 - DNA, 25 bp, Rattus norvegicus
atgcctggctattctgtttgtcatc

SEQ ID NO: 193461 - DNA, 25 bp, Rattus norvegicus
atgcctgggagcagtcagaaggtcc

SEQ ID NO: 193462 - DNA, 25 bp, Rattus norvegicus
atgcctgggagctgtcagaaggtcc

SEQ ID NO: 193463 - DNA, 25 bp, Rattus norvegicus
atgcctgggcaactattttttgtaa

SEQ ID NO: 193464 - DNA, 25 bp, Rattus norvegicus
atgcctgggcaagtattttttgtaa

SEQ ID NO: 193465 - DNA, 25 bp, Rattus norvegicus
atgcctgggctcagccaaggaggct

SEQ ID NO: 193466 - DNA, 25 bp, Rattus norvegicus
atgcctgggctctgccaaggaggct

SEQ ID NO: 193467 - DNA, 25 bp, Rattus norvegicus
atgcctgggcttccgtgagaagcct

SEQ ID NO: 193468 - DNA, 25 bp, Rattus norvegicus
atgcctgggcttgcgtgagaagcct

SEQ ID NO: 193469 - DNA, 25 bp, Rattus norvegicus
atgcctggtacccagagtctagaag

SEQ ID NO: 193470 - DNA, 25 bp, Rattus norvegicus
atgcctggtaccgagagtctagaag

SEQ ID NO: 193471 - DNA, 25 bp, Rattus norvegicus
atgcctgtaaacaagccgcacttgc

SEQ ID NO: 193472 - DNA, 25 bp, Rattus norvegicus
atgcctgtaaactagccgcacttgc

SEQ ID NO: 193473 - DNA, 25 bp, Rattus norvegicus
atgcctgtaaccacatggcgcgtgc

SEQ ID NO: 193474 - DNA, 25 bp, Rattus norvegicus
atgcctgtaacctcatggcgcgtgc

SEQ ID NO: 193475 - DNA, 25 bp, Rattus norvegicus
atgcctgtaagaagtaacctgggac

SEQ ID NO: 193476 - DNA, 25 bp, Rattus norvegicus
atgcctgtaagatgtaacctgggac

SEQ ID NO: 193477 - DNA, 25 bp, Rattus norvegicus
atgcctgtagccacagattgctgaa

SEQ ID NO: 193478 - DNA, 25 bp, Rattus norvegicus
atgcctgtagcctcagattgctgaa

SEQ ID NO: 193479 - DNA, 25 bp, Rattus norvegicus
atgcctgtagcgacactggtattac

SEQ ID NO: 193480 - DNA, 25 bp, Rattus norvegicus
atgcctgtagcgtcactggtattac

SEQ ID NO: 193481 - DNA, 25 bp, Rattus norvegicus
atgcctgtatgactgtgtcgggccc

SEQ ID NO: 193482 - DNA, 25 bp, Rattus norvegicus
atgcctgtatgagtgtgtcgggccc

SEQ ID NO: 193483 - DNA, 25 bp, Rattus norvegicus
atgcctgtcaaccttcactgaggag

SEQ ID NO: 193484 - DNA, 25 bp, Rattus norvegicus
atgcctgtcaacgttcactgaggag

SEQ ID NO: 193485 - DNA, 25 bp, Rattus norvegicus
atgcctgtcaccatctttatttgtg

SEQ ID NO: 193486 - DNA, 25 bp, Rattus norvegicus
atgcctgtcaccttctttatttgtg

SEQ ID NO: 193487 - DNA, 25 bp, Rattus norvegicus
atgcctgtcctaaaaacatgcttgg

SEQ ID NO: 193488 - DNA, 25 bp, Rattus norvegicus
atgcctgtcctataaacatgcttgg

SEQ ID NO: 193489 - DNA, 25 bp, Rattus norvegicus
atgcctgtctatattcctgtggaag

SEQ ID NO: 193490 - DNA, 25 bp, Rattus norvegicus
atgcctgtctattttcctgtggaag

SEQ ID NO: 193491 - DNA, 25 bp, Rattus norvegicus
atgcctgtcttcacaatgttttctt

SEQ ID NO: 193492 - DNA, 25 bp, Rattus norvegicus
atgcctgtcttctcaatgttttctt

SEQ ID NO: 193493 - DNA, 25 bp, Rattus norvegicus
atgcctgtcttgctcacagtggaca

SEQ ID NO: 193494 - DNA, 25 bp, Rattus norvegicus
atgcctgtcttgcttcttctctcta

SEQ ID NO: 193495 - DNA, 25 bp, Rattus norvegicus
atgcctgtcttggtcacagtggaca

SEQ ID NO: 193496 - DNA, 25 bp, Rattus norvegicus
atgcctgtcttggttcttctctcta

SEQ ID NO: 193497 - DNA, 25 bp, Rattus norvegicus
atgcctgtgaatactccgctgggaa

SEQ ID NO: 193498 - DNA, 25 bp, Rattus norvegicus
atgcctgtgaattctccgctgggaa

SEQ ID NO: 193499 - DNA, 25 bp, Rattus norvegicus
atgcctgtgagtatggctctccaga

SEQ ID NO: 193500 - DNA, 25 bp, Rattus norvegicus
atgcctgtgagtttggctctccaga

SEQ ID NO: 193501 - DNA, 25 bp, Rattus norvegicus
atgcctgtgatcataacactcaggg

SEQ ID NO: 193502 - DNA, 25 bp, Rattus norvegicus
atgcctgtgatcttaacactcaggg

SEQ ID NO: 193503 - DNA, 25 bp, Rattus norvegicus
atgcctgtgcagattttcctgtcca

SEQ ID NO: 193504 - DNA, 25 bp, Rattus norvegicus
atgcctgtgcagtttttcctgtcca

SEQ ID NO: 193505 - DNA, 25 bp, Rattus norvegicus
atgcctgtgcatacattgtgcccaa

SEQ ID NO: 193506 - DNA, 25 bp, Rattus norvegicus
atgcctgtgcattcattgtgcccaa

SEQ ID NO: 193507 - DNA, 25 bp, Rattus norvegicus
atgcctgtgcccatagaaccgtgaa

SEQ ID NO: 193508 - DNA, 25 bp, Rattus norvegicus
atgcctgtgcccttagaaccgtgaa

SEQ ID NO: 193509 - DNA, 25 bp, Rattus norvegicus
atgcctgtgcgtagtgtccaggaga

SEQ ID NO: 193510 - DNA, 25 bp, Rattus norvegicus
atgcctgtgcgttgtgtccaggaga

SEQ ID NO: 193511 - DNA, 25 bp, Rattus norvegicus
atgcctgtgctcattcatacacgtg

SEQ ID NO: 193512 - DNA, 25 bp, Rattus norvegicus
atgcctgtgctctttcatacacgtg

SEQ ID NO: 193513 - DNA, 25 bp, Rattus norvegicus
atgcctgtggctctgtctagccagg

SEQ ID NO: 193514 - DNA, 25 bp, Rattus norvegicus
atgcctgtggctgtgtctagccagg

SEQ ID NO: 193515 - DNA, 25 bp, Rattus norvegicus
atgcctgtgggcagggaaataactt

SEQ ID NO: 193516 - DNA, 25 bp, Rattus norvegicus
atgcctgtgggcagtactacaaact

SEQ ID NO: 193517 - DNA, 25 bp, Rattus norvegicus
atgcctgtgggctgggaaataactt

SEQ ID NO: 193518 - DNA, 25 bp, Rattus norvegicus
atgcctgtgggctgtactacaaact

SEQ ID NO: 193519 - DNA, 25 bp, Rattus norvegicus
atgcctgtggtcaaaatctgcctgg

SEQ ID NO: 193520 - DNA, 25 bp, Rattus norvegicus
atgcctgtggtcagtctgatgtagc

SEQ ID NO: 193521 - DNA, 25 bp, Rattus norvegicus
atgcctgtggtctaaatctgcctgg

SEQ ID NO: 193522 - DNA, 25 bp, Rattus norvegicus
atgcctgtggtctgtctgatgtagc

SEQ ID NO: 193523 - DNA, 25 bp, Rattus norvegicus
atgcctgttcctacgggacttttat

SEQ ID NO: 193524 - DNA, 25 bp, Rattus norvegicus
atgcctgttccttcgggacttttat

SEQ ID NO: 193525 - DNA, 25 bp, Rattus norvegicus
atgcctgttcttctatccaatatta

SEQ ID NO: 193526 - DNA, 25 bp, Rattus norvegicus
atgcctgttcttgtatccaatatta

SEQ ID NO: 193527 - DNA, 25 bp, Rattus norvegicus
atgcctgtttacaaccagaacttca

SEQ ID NO: 193528 - DNA, 25 bp, Rattus norvegicus
atgcctgtttactaccagaacttca

SEQ ID NO: 193529 - DNA, 25 bp, Rattus norvegicus
atgcctgtttcaaatcgttgtctgt

SEQ ID NO: 193530 - DNA, 25 bp, Rattus norvegicus
atgcctgtttcatatcgttgtctgt

SEQ ID NO: 193531 - DNA, 25 bp, Rattus norvegicus
atgcctgtttgaattacatctgtag

SEQ ID NO: 193532 - DNA, 25 bp, Rattus norvegicus
atgcctgtttgatttacatctgtag

SEQ ID NO: 193533 - DNA, 25 bp, Rattus norvegicus
atgcctgtttgtagtcaccttttca

SEQ ID NO: 193534 - DNA, 25 bp, Rattus norvegicus
atgcctgtttgttgtcaccttttca

SEQ ID NO: 193535 - DNA, 25 bp, Rattus norvegicus
atgcctgttttgaggaaccagaacc

SEQ ID NO: 193536 - DNA, 25 bp, Rattus norvegicus
atgcctgttttgtggaaccagaacc

SEQ ID NO: 193537 - DNA, 25 bp, Rattus norvegicus
atgccttaaataattgttcacccaa

SEQ ID NO: 193538 - DNA, 25 bp, Rattus norvegicus
atgccttaaatatttgttcacccaa

SEQ ID NO: 193539 - DNA, 25 bp, Rattus norvegicus
atgccttaacaccaaaatttcagcg

SEQ ID NO: 193540 - DNA, 25 bp, Rattus norvegicus
atgccttaacacgaaaatttcagcg

SEQ ID NO: 193541 - DNA, 25 bp, Rattus norvegicus
atgccttacatcaggtcactctgta

SEQ ID NO: 193542 - DNA, 25 bp, Rattus norvegicus
atgccttacatctggtcactctgta

SEQ ID NO: 193543 - DNA, 25 bp, Rattus norvegicus
atgccttacattaacccactagcag

SEQ ID NO: 193544 - DNA, 25 bp, Rattus norvegicus
atgccttacatttacccactagcag

SEQ ID NO: 193545 - DNA, 25 bp, Rattus norvegicus
atgccttaccaaattgatctcagtc

SEQ ID NO: 193546 - DNA, 25 bp, Rattus norvegicus
atgccttaccaatttgatctcagtc

SEQ ID NO: 193547 - DNA, 25 bp, Rattus norvegicus
atgccttacggcatgtgtctaccac

SEQ ID NO: 193548 - DNA, 25 bp, Rattus norvegicus
atgccttacggcttgtgtctaccac

SEQ ID NO: 193549 - DNA, 25 bp, Rattus norvegicus
atgccttatctaccctttatttctg

SEQ ID NO: 193550 - DNA, 25 bp, Rattus norvegicus
atgccttatctagcctttatttctg

SEQ ID NO: 193551 - DNA, 25 bp, Rattus norvegicus
atgccttatgcacacttgtaccgac

SEQ ID NO: 193552 - DNA, 25 bp, Rattus norvegicus
atgccttatgcagacttgtaccgac

SEQ ID NO: 193553 - DNA, 25 bp, Rattus norvegicus
atgccttatgttcacatcctctttg

SEQ ID NO: 193554 - DNA, 25 bp, Rattus norvegicus
atgccttatgttgacatcctctttg

SEQ ID NO: 193555 - DNA, 25 bp, Rattus norvegicus
atgccttattaaagttttcccacta

SEQ ID NO: 193556 - DNA, 25 bp, Rattus norvegicus
atgccttattaatgttttcccacta

SEQ ID NO: 193557 - DNA, 25 bp, Rattus norvegicus
atgccttcaactcacatgggatgat

SEQ ID NO: 193558 - DNA, 25 bp, Rattus norvegicus
atgccttcaactgacatgggatgat

SEQ ID NO: 193559 - DNA, 25 bp, Rattus norvegicus
atgccttcaagaataaatgcctagt

SEQ ID NO: 193560 - DNA, 25 bp, Rattus norvegicus
atgccttcaagattaaatgcctagt

SEQ ID NO: 193561 - DNA, 25 bp, Rattus norvegicus
atgccttcaaggctttcaccaacta

SEQ ID NO: 193562 - DNA, 25 bp, Rattus norvegicus
atgccttcaagggtttcaccaacta

SEQ ID NO: 193563 - DNA, 25 bp, Rattus norvegicus
atgccttcacgaccattaggtgtta

SEQ ID NO: 193564 - DNA, 25 bp, Rattus norvegicus
atgccttcacgagcattaggtgtta

SEQ ID NO: 193565 - DNA, 25 bp, Rattus norvegicus
atgccttcagtcatggcctcttaaa

SEQ ID NO: 193566 - DNA, 25 bp, Rattus norvegicus
atgccttcagtcttggcctcttaaa

SEQ ID NO: 193567 - DNA, 25 bp, Rattus norvegicus
atgccttcatcaaacgctctgaggg

SEQ ID NO: 193568 - DNA, 25 bp, Rattus norvegicus
atgccttcatcatacgctctgaggg

SEQ ID NO: 193569 - DNA, 25 bp, Rattus norvegicus
atgccttccaaaacaagctcctggg

SEQ ID NO: 193570 - DNA, 25 bp, Rattus norvegicus
atgccttccaaatcaagctcctggg

SEQ ID NO: 193571 - DNA, 25 bp, Rattus norvegicus
atgccttccaacatgctgtggacat

SEQ ID NO: 193572 - DNA, 25 bp, Rattus norvegicus
atgccttccaacatggctcttggaa

SEQ ID NO: 193573 - DNA, 25 bp, Rattus norvegicus
atgccttccaacttgctgtggacat

SEQ ID NO: 193574 - DNA, 25 bp, Rattus norvegicus
atgccttccaacttggctcttggaa

SEQ ID NO: 193575 - DNA, 25 bp, Rattus norvegicus
atgccttccatgatcttcttggcaa

SEQ ID NO: 193576 - DNA, 25 bp, Rattus norvegicus
atgccttccatgttcttcttggcaa

SEQ ID NO: 193577 - DNA, 25 bp, Rattus norvegicus
atgccttcccatcaatgtctcaatg

SEQ ID NO: 193578 - DNA, 25 bp, Rattus norvegicus
atgccttcccatgaatgtctcaatg

SEQ ID NO: 193579 - DNA, 25 bp, Rattus norvegicus
atgccttccttcagcagatacaaga

SEQ ID NO: 193580 - DNA, 25 bp, Rattus norvegicus
atgccttccttctgcagatacaaga

SEQ ID NO: 193581 - DNA, 25 bp, Rattus norvegicus
atgccttcgcatctactcaactatg

SEQ ID NO: 193582 - DNA, 25 bp, Rattus norvegicus
atgccttcgcatgtactcaactatg

SEQ ID NO: 193583 - DNA, 25 bp, Rattus norvegicus
atgccttctaacaacttattctgcc

SEQ ID NO: 193584 - DNA, 25 bp, Rattus norvegicus
atgccttctaactacttattctgcc

SEQ ID NO: 193585 - DNA, 25 bp, Rattus norvegicus
atgccttctaggaaacaacgactca

SEQ ID NO: 193586 - DNA, 25 bp, Rattus norvegicus
atgccttctaggtaacaacgactca

SEQ ID NO: 193587 - DNA, 25 bp, Rattus norvegicus
atgccttctataaacacacacctat

SEQ ID NO: 193588 - DNA, 25 bp, Rattus norvegicus
atgccttctatatacacacacctat

SEQ ID NO: 193589 - DNA, 25 bp, Rattus norvegicus
atgccttctattatctttgtgtgtg

SEQ ID NO: 193590 - DNA, 25 bp, Rattus norvegicus
atgccttctattttctttgtgtgtg

SEQ ID NO: 193591 - DNA, 25 bp, Rattus norvegicus
atgccttctgttacaatggagtgga

SEQ ID NO: 193592 - DNA, 25 bp, Rattus norvegicus
atgccttctgttatgcaggcataga

SEQ ID NO: 193593 - DNA, 25 bp, Rattus norvegicus
atgccttctgtttcaatggagtgga

SEQ ID NO: 193594 - DNA, 25 bp, Rattus norvegicus
atgccttctgttttgcaggcataga

SEQ ID NO: 193595 - DNA, 25 bp, Rattus norvegicus
atgccttctttcagaatctgggtgc

SEQ ID NO: 193596 - DNA, 25 bp, Rattus norvegicus
atgccttctttctgaatctgggtgc

SEQ ID NO: 193597 - DNA, 25 bp, Rattus norvegicus
atgccttgacttatttgggtcttga

SEQ ID NO: 193598 - DNA, 25 bp, Rattus norvegicus
atgccttgacttttttgggtcttga

SEQ ID NO: 193599 - DNA, 25 bp, Rattus norvegicus
atgccttgagcaattttgtctttcc

SEQ ID NO: 193600 - DNA, 25 bp, Rattus norvegicus
atgccttgagcaccctaagttgtca

SEQ ID NO: 193601 - DNA, 25 bp, Rattus norvegicus
atgccttgagcagcctaagttgtca

SEQ ID NO: 193602 - DNA, 25 bp, Rattus norvegicus
atgccttgagcatttttgtctttcc

SEQ ID NO: 193603 - DNA, 25 bp, Rattus norvegicus
atgccttgcaacatcttgactgttt

SEQ ID NO: 193604 - DNA, 25 bp, Rattus norvegicus
atgccttgcaacttcttgactgttt

SEQ ID NO: 193605 - DNA, 25 bp, Rattus norvegicus
atgccttgcaagactaagctctctg

SEQ ID NO: 193606 - DNA, 25 bp, Rattus norvegicus
atgccttgcaagtctaagctctctg

SEQ ID NO: 193607 - DNA, 25 bp, Rattus norvegicus
atgccttgcgttatagccgacatta

SEQ ID NO: 193608 - DNA, 25 bp, Rattus norvegicus
atgccttgcgttttagccgacatta

SEQ ID NO: 193609 - DNA, 25 bp, Rattus norvegicus
atgccttgctcacaatactcagtat

SEQ ID NO: 193610 - DNA, 25 bp, Rattus norvegicus
atgccttgctcagaatactcagtat

SEQ ID NO: 193611 - DNA, 25 bp, Rattus norvegicus
atgccttgctctcttctggaaggtt

SEQ ID NO: 193612 - DNA, 25 bp, Rattus norvegicus
atgccttgctctgttctggaaggtt

SEQ ID NO: 193613 - DNA, 25 bp, Rattus norvegicus
atgccttgctgcctacaggatgctg

SEQ ID NO: 193614 - DNA, 25 bp, Rattus norvegicus
atgccttgctgcgtacaggatgctg

SEQ ID NO: 193615 - DNA, 25 bp, Rattus norvegicus
atgccttgctggaagtcattgtcag

SEQ ID NO: 193616 - DNA, 25 bp, Rattus norvegicus
atgccttgctggtagtcattgtcag

SEQ ID NO: 193617 - DNA, 25 bp, Rattus norvegicus
atgccttgcttccatgaacactaac

SEQ ID NO: 193618 - DNA, 25 bp, Rattus norvegicus
atgccttgcttcgatgaacactaac

SEQ ID NO: 193619 - DNA, 25 bp, Rattus norvegicus
atgccttggaccaagcaggcccttg

SEQ ID NO: 193620 - DNA, 25 bp, Rattus norvegicus
atgccttggacctagcaggcccttg

SEQ ID NO: 193621 - DNA, 25 bp, Rattus norvegicus
atgccttggagcagggatccctagt

SEQ ID NO: 193622 - DNA, 25 bp, Rattus norvegicus
atgccttggagctgggatccctagt

SEQ ID NO: 193623 - DNA, 25 bp, Rattus norvegicus
atgccttgggaaactggagtcctca

SEQ ID NO: 193624 - DNA, 25 bp, Rattus norvegicus
atgccttgggaatctggagtcctca

SEQ ID NO: 193625 - DNA, 25 bp, Rattus norvegicus
atgccttgggcacatgtcacatata

SEQ ID NO: 193626 - DNA, 25 bp, Rattus norvegicus
atgccttgggcagatgtcacatata

SEQ ID NO: 193627 - DNA, 25 bp, Rattus norvegicus
atgccttgggctactaggacactgg

SEQ ID NO: 193628 - DNA, 25 bp, Rattus norvegicus
atgccttgggcttctaggacactgg

SEQ ID NO: 193629 - DNA, 25 bp, Rattus norvegicus
atgccttgggttcaatctccaacac

SEQ ID NO: 193630 - DNA, 25 bp, Rattus norvegicus
atgccttgggttgaatctccaacac

SEQ ID NO: 193631 - DNA, 25 bp, Rattus norvegicus
atgccttgtacacagccattgttta

SEQ ID NO: 193632 - DNA, 25 bp, Rattus norvegicus
atgccttgtacagagccattgttta

SEQ ID NO: 193633 - DNA, 25 bp, Rattus norvegicus
atgccttgtgtgagtttttactaac

SEQ ID NO: 193634 - DNA, 25 bp, Rattus norvegicus
atgccttgtgtgtgtttttactaac

SEQ ID NO: 193635 - DNA, 25 bp, Rattus norvegicus
atgcctttaatcctgtgcacgggag

SEQ ID NO: 193636 - DNA, 25 bp, Rattus norvegicus
atgcctttaatcgtgtgcacgggag

SEQ ID NO: 193637 - DNA, 25 bp, Rattus norvegicus
atgcctttaattccaacactgagga

SEQ ID NO: 193638 - DNA, 25 bp, Rattus norvegicus
atgcctttaattgcaacactgagga

SEQ ID NO: 193639 - DNA, 25 bp, Rattus norvegicus
atgcctttaccaactccattgtaag

SEQ ID NO: 193640 - DNA, 25 bp, Rattus norvegicus
atgcctttaccatctccattgtaag

SEQ ID NO: 193641 - DNA, 25 bp, Rattus norvegicus
atgcctttaggcaacgtagagagat

SEQ ID NO: 193642 - DNA, 25 bp, Rattus norvegicus
atgcctttaggctacgtagagagat

SEQ ID NO: 193643 - DNA, 25 bp, Rattus norvegicus
atgcctttagggacctctaaaatgt

SEQ ID NO: 193644 - DNA, 25 bp, Rattus norvegicus
atgcctttagggtcctctaaaatgt

SEQ ID NO: 193645 - DNA, 25 bp, Rattus norvegicus
atgcctttatagatttatgtgtgta

SEQ ID NO: 193646 - DNA, 25 bp, Rattus norvegicus
atgcctttatagttttatgtgtgta

SEQ ID NO: 193647 - DNA, 25 bp, Rattus norvegicus
atgcctttatcccaattcctagagc

SEQ ID NO: 193648 - DNA, 25 bp, Rattus norvegicus
atgcctttatccgaattcctagagc

SEQ ID NO: 193649 - DNA, 25 bp, Rattus norvegicus
atgcctttcaagagtgggacccaaa

SEQ ID NO: 193650 - DNA, 25 bp, Rattus norvegicus
atgcctttcaagtgtgggacccaaa

SEQ ID NO: 193651 - DNA, 25 bp, Rattus norvegicus
atgcctttcaggaccattatctaga

SEQ ID NO: 193652 - DNA, 25 bp, Rattus norvegicus
atgcctttcaggtccattatctaga

SEQ ID NO: 193653 - DNA, 25 bp, Rattus norvegicus
atgcctttcctgcttacttacgatt

SEQ ID NO: 193654 - DNA, 25 bp, Rattus norvegicus
atgcctttcctggttacttacgatt

SEQ ID NO: 193655 - DNA, 25 bp, Rattus norvegicus
atgcctttctccatcatgatgggag

SEQ ID NO: 193656 - DNA, 25 bp, Rattus norvegicus
atgcctttctccttcatgatgggag

SEQ ID NO: 193657 - DNA, 25 bp, Rattus norvegicus
atgcctttctctcctagtaagtgtg

SEQ ID NO: 193658 - DNA, 25 bp, Rattus norvegicus
atgcctttctctgctagtaagtgtg

SEQ ID NO: 193659 - DNA, 25 bp, Rattus norvegicus
atgcctttctggatccacagggaag

SEQ ID NO: 193660 - DNA, 25 bp, Rattus norvegicus
atgcctttctggttccacagggaag

SEQ ID NO: 193661 - DNA, 25 bp, Rattus norvegicus
atgcctttgagtacattctgggcac

SEQ ID NO: 193662 - DNA, 25 bp, Rattus norvegicus
atgcctttgagtatactatccccaa

SEQ ID NO: 193663 - DNA, 25 bp, Rattus norvegicus
atgcctttgagttcattctgggcac

SEQ ID NO: 193664 - DNA, 25 bp, Rattus norvegicus
atgcctttgagtttactatccccaa

SEQ ID NO: 193665 - DNA, 25 bp, Rattus norvegicus
atgcctttgattctgtggcttctga

SEQ ID NO: 193666 - DNA, 25 bp, Rattus norvegicus
atgcctttgattgtgtggcttctga

SEQ ID NO: 193667 - DNA, 25 bp, Rattus norvegicus
atgcctttgcagacccttgggaagc

SEQ ID NO: 193668 - DNA, 25 bp, Rattus norvegicus
atgcctttgcagtcccttgggaagc

SEQ ID NO: 193669 - DNA, 25 bp, Rattus norvegicus
atgcctttgcccatctatctaaata

SEQ ID NO: 193670 - DNA, 25 bp, Rattus norvegicus
atgcctttgcccttctatctaaata

SEQ ID NO: 193671 - DNA, 25 bp, Rattus norvegicus
atgcctttgcggctaagtcatttgc

SEQ ID NO: 193672 - DNA, 25 bp, Rattus norvegicus
atgcctttgcgggtaagtcatttgc

SEQ ID NO: 193673 - DNA, 25 bp, Rattus norvegicus
atgcctttgctgaaaaatcaacaaa

SEQ ID NO: 193674 - DNA, 25 bp, Rattus norvegicus
atgcctttgctgtaaaatcaacaaa

SEQ ID NO: 193675 - DNA, 25 bp, Rattus norvegicus
atgcctttgcttatcctactgggat

SEQ ID NO: 193676 - DNA, 25 bp, Rattus norvegicus
atgcctttgcttcgtctgttgatga

SEQ ID NO: 193677 - DNA, 25 bp, Rattus norvegicus
atgcctttgcttggtctgttgatga

SEQ ID NO: 193678 - DNA, 25 bp, Rattus norvegicus
atgcctttgcttttcctactgggat

SEQ ID NO: 193679 - DNA, 25 bp, Rattus norvegicus
atgcctttggagcatagggtactta

SEQ ID NO: 193680 - DNA, 25 bp, Rattus norvegicus
atgcctttggagcttgccttccttt

SEQ ID NO: 193681 - DNA, 25 bp, Rattus norvegicus
atgcctttggaggatagggtactta

SEQ ID NO: 193682 - DNA, 25 bp, Rattus norvegicus
atgcctttggaggttgccttccttt

SEQ ID NO: 193683 - DNA, 25 bp, Rattus norvegicus
atgcctttggatctatcttttggac

SEQ ID NO: 193684 - DNA, 25 bp, Rattus norvegicus
atgcctttggatgtatcttttggac

SEQ ID NO: 193685 - DNA, 25 bp, Rattus norvegicus
atgcctttgggcaactccaggtagg

SEQ ID NO: 193686 - DNA, 25 bp, Rattus norvegicus
atgcctttgggctactccaggtagg

SEQ ID NO: 193687 - DNA, 25 bp, Rattus norvegicus
atgcctttgtcacataacttccttt

SEQ ID NO: 193688 - DNA, 25 bp, Rattus norvegicus
atgcctttgtcagataacttccttt

SEQ ID NO: 193689 - DNA, 25 bp, Rattus norvegicus
atgcctttgtctccaacgagctaga

SEQ ID NO: 193690 - DNA, 25 bp, Rattus norvegicus
atgcctttgtctgcaacgagctaga

SEQ ID NO: 193691 - DNA, 25 bp, Rattus norvegicus
atgccttttcaaaatatctgaacaa

SEQ ID NO: 193692 - DNA, 25 bp, Rattus norvegicus
atgccttttcaatatatctgaacaa

SEQ ID NO: 193693 - DNA, 25 bp, Rattus norvegicus
atgccttttcttcttctaaacccat

SEQ ID NO: 193694 - DNA, 25 bp, Rattus norvegicus
atgccttttcttgttctaaacccat

SEQ ID NO: 193695 - DNA, 25 bp, Rattus norvegicus
atgccttttgccatattgataccca

SEQ ID NO: 193696 - DNA, 25 bp, Rattus norvegicus
atgccttttgccttattgataccca

SEQ ID NO: 193697 - DNA, 25 bp, Rattus norvegicus
atgcgaaagtggctgttatcctcat

SEQ ID NO: 193698 - DNA, 25 bp, Rattus norvegicus
atgcgaaagtgggtgttatcctcat

SEQ ID NO: 193699 - DNA, 25 bp, Rattus norvegicus
atgcgaagtgcaatctgtccactca

SEQ ID NO: 193700 - DNA, 25 bp, Rattus norvegicus
atgcgaagtgcattctgtccactca

SEQ ID NO: 193701 - DNA, 25 bp, Rattus norvegicus
atgcgacaacaaccatcaccttata

SEQ ID NO: 193702 - DNA, 25 bp, Rattus norvegicus
atgcgacaacaagcatcaccttata

SEQ ID NO: 193703 - DNA, 25 bp, Rattus norvegicus
atgcgacaacagcatttctctctgg

SEQ ID NO: 193704 - DNA, 25 bp, Rattus norvegicus
atgcgacaacaggatttctctctgg

SEQ ID NO: 193705 - DNA, 25 bp, Rattus norvegicus
atgcgacaagaactccgggatccaa

SEQ ID NO: 193706 - DNA, 25 bp, Rattus norvegicus
atgcgacaagaagtccgggatccaa

SEQ ID NO: 193707 - DNA, 25 bp, Rattus norvegicus
atgcgacaaggcctcgtgtgctagc

SEQ ID NO: 193708 - DNA, 25 bp, Rattus norvegicus
atgcgacaaggcgtcgtgtgctagc

SEQ ID NO: 193709 - DNA, 25 bp, Rattus norvegicus
atgcgacatcacagaactcatcttg

SEQ ID NO: 193710 - DNA, 25 bp, Rattus norvegicus
atgcgacatcactgaactcatcttg

SEQ ID NO: 193711 - DNA, 25 bp, Rattus norvegicus
atgcgacctgtcacgtgaagtccta

SEQ ID NO: 193712 - DNA, 25 bp, Rattus norvegicus
atgcgacctgtctcgtgaagtccta

SEQ ID NO: 193713 - DNA, 25 bp, Rattus norvegicus
atgcgacctttaaaacgccgacctg

SEQ ID NO: 193714 - DNA, 25 bp, Rattus norvegicus
atgcgacctttataacgccgacctg

SEQ ID NO: 193715 - DNA, 25 bp, Rattus norvegicus
atgcgactctacagttgtgggatcc

SEQ ID NO: 193716 - DNA, 25 bp, Rattus norvegicus
atgcgactctactgttgtgggatcc

SEQ ID NO: 193717 - DNA, 25 bp, Rattus norvegicus
atgcgactctggatgccgcgagcga

SEQ ID NO: 193718 - DNA, 25 bp, Rattus norvegicus
atgcgactctggttgccgcgagcga

SEQ ID NO: 193719 - DNA, 25 bp, Rattus norvegicus
atgcgagcaaagaacttccaggagc

SEQ ID NO: 193720 - DNA, 25 bp, Rattus norvegicus
atgcgagcaaagcattctcatcagt

SEQ ID NO: 193721 - DNA, 25 bp, Rattus norvegicus
atgcgagcaaaggattctcatcagt

SEQ ID NO: 193722 - DNA, 25 bp, Rattus norvegicus
atgcgagcaaagtacttccaggagc

SEQ ID NO: 193723 - DNA, 25 bp, Rattus norvegicus
atgcgagcacatcccatagaacatc

SEQ ID NO: 193724 - DNA, 25 bp, Rattus norvegicus
atgcgagcacatgccatagaacatc

SEQ ID NO: 193725 - DNA, 25 bp, Rattus norvegicus
atgcgagccgttaggatgccattca

SEQ ID NO: 193726 - DNA, 25 bp, Rattus norvegicus
atgcgagccgtttggatgccattca

SEQ ID NO: 193727 - DNA, 25 bp, Rattus norvegicus
atgcgagctcatcgtgggtgcttca

SEQ ID NO: 193728 - DNA, 25 bp, Rattus norvegicus
atgcgagctcatggtgggtgcttca

SEQ ID NO: 193729 - DNA, 25 bp, Rattus norvegicus
atgcgagcttgcaggcctttcccag

SEQ ID NO: 193730 - DNA, 25 bp, Rattus norvegicus
atgcgagcttgctggcctttcccag

SEQ ID NO: 193731 - DNA, 25 bp, Rattus norvegicus
atgcgaggaaccatctcccgggagc

SEQ ID NO: 193732 - DNA, 25 bp, Rattus norvegicus
atgcgaggaaccttctcccgggagc

SEQ ID NO: 193733 - DNA, 25 bp, Rattus norvegicus
atgcgaggccaccatcagccattgg

SEQ ID NO: 193734 - DNA, 25 bp, Rattus norvegicus
atgcgaggccacgatcagccattgg

SEQ ID NO: 193735 - DNA, 25 bp, Rattus norvegicus
atgcgaggctaacgttactgccgcg

SEQ ID NO: 193736 - DNA, 25 bp, Rattus norvegicus
atgcgaggctaaggttactgccgcg

SEQ ID NO: 193737 - DNA, 25 bp, Rattus norvegicus
atgcgaggtccccagtcagcagctg

SEQ ID NO: 193738 - DNA, 25 bp, Rattus norvegicus
atgcgaggtcccgagtcagcagctg

SEQ ID NO: 193739 - DNA, 25 bp, Rattus norvegicus
atgcgagttctcactgtggaccatg

SEQ ID NO: 193740 - DNA, 25 bp, Rattus norvegicus
atgcgagttctctctgtggaccatg

SEQ ID NO: 193741 - DNA, 25 bp, Rattus norvegicus
atgcgatccatcatataaccttttt

SEQ ID NO: 193742 - DNA, 25 bp, Rattus norvegicus
atgcgatccatcttataaccttttt

SEQ ID NO: 193743 - DNA, 25 bp, Rattus norvegicus
atgcgatgcctgcaatcagtgctaa

SEQ ID NO: 193744 - DNA, 25 bp, Rattus norvegicus
atgcgatgcctggaatcagtgctaa

SEQ ID NO: 193745 - DNA, 25 bp, Rattus norvegicus
atgcgattcacaacggcgcaatcag

SEQ ID NO: 193746 - DNA, 25 bp, Rattus norvegicus
atgcgattcacatcggcgcaatcag

SEQ ID NO: 193747 - DNA, 25 bp, Rattus norvegicus
atgcgcaaacggacatttattcagg

SEQ ID NO: 193748 - DNA, 25 bp, Rattus norvegicus
atgcgcaaacggtcatttattcagg

SEQ ID NO: 193749 - DNA, 25 bp, Rattus norvegicus
atgcgcaacactcaagggtccagat

SEQ ID NO: 193750 - DNA, 25 bp, Rattus norvegicus
atgcgcaacactgaagggtccagat

SEQ ID NO: 193751 - DNA, 25 bp, Rattus norvegicus
atgcgcacaatgctgcaaccttagt

SEQ ID NO: 193752 - DNA, 25 bp, Rattus norvegicus
atgcgcacaatggtgcaaccttagt

SEQ ID NO: 193753 - DNA, 25 bp, Rattus norvegicus
atgcgcacatatcaccccatacata

SEQ ID NO: 193754 - DNA, 25 bp, Rattus norvegicus
atgcgcacatatgaccccatacata

SEQ ID NO: 193755 - DNA, 25 bp, Rattus norvegicus
atgcgcacatgcagcaagtcctggc

SEQ ID NO: 193756 - DNA, 25 bp, Rattus norvegicus
atgcgcacatgctgcaagtcctggc

SEQ ID NO: 193757 - DNA, 25 bp, Rattus norvegicus
atgcgcactttgagggctttctaat

SEQ ID NO: 193758 - DNA, 25 bp, Rattus norvegicus
atgcgcactttgtgggctttctaat

SEQ ID NO: 193759 - DNA, 25 bp, Rattus norvegicus
atgcgcagctggcatttacgcctgt

SEQ ID NO: 193760 - DNA, 25 bp, Rattus norvegicus
atgcgcagctgggatttacgcctgt

SEQ ID NO: 193761 - DNA, 25 bp, Rattus norvegicus
atgcgcatggacatggaccgccggc

SEQ ID NO: 193762 - DNA, 25 bp, Rattus norvegicus
atgcgcatggacttggaccgccggc

SEQ ID NO: 193763 - DNA, 25 bp, Rattus norvegicus
atgcgccaaaaccaacatgccagcc

SEQ ID NO: 193764 - DNA, 25 bp, Rattus norvegicus
atgcgccaaaacgaacatgccagcc

SEQ ID NO: 193765 - DNA, 25 bp, Rattus norvegicus
atgcgccaactgattgccatgtgcc

SEQ ID NO: 193766 - DNA, 25 bp, Rattus norvegicus
atgcgccaactgtttgccatgtgcc

SEQ ID NO: 193767 - DNA, 25 bp, Rattus norvegicus
atgcgccagctcatgttatacttaa

SEQ ID NO: 193768 - DNA, 25 bp, Rattus norvegicus
atgcgccagctcttgttatacttaa

SEQ ID NO: 193769 - DNA, 25 bp, Rattus norvegicus
atgcgccagctgaaacttggactta

SEQ ID NO: 193770 - DNA, 25 bp, Rattus norvegicus
atgcgccagctgaaggagtgtgaaa

SEQ ID NO: 193771 - DNA, 25 bp, Rattus norvegicus
atgcgccagctgtaacttggactta

SEQ ID NO: 193772 - DNA, 25 bp, Rattus norvegicus
atgcgccagctgtaggagtgtgaaa

SEQ ID NO: 193773 - DNA, 25 bp, Rattus norvegicus
atgcgccaggctctagtcgccagag

SEQ ID NO: 193774 - DNA, 25 bp, Rattus norvegicus
atgcgccaggctgtagtcgccagag

SEQ ID NO: 193775 - DNA, 25 bp, Rattus norvegicus
atgcgccatcttataccctgaatga

SEQ ID NO: 193776 - DNA, 25 bp, Rattus norvegicus
atgcgccatcttttaccctgaatga

SEQ ID NO: 193777 - DNA, 25 bp, Rattus norvegicus
atgcgccattgaacctgagggtgca

SEQ ID NO: 193778 - DNA, 25 bp, Rattus norvegicus
atgcgccattgatcctgagggtgca

SEQ ID NO: 193779 - DNA, 25 bp, Rattus norvegicus
atgcgccgctgaacctgccggtggt

SEQ ID NO: 193780 - DNA, 25 bp, Rattus norvegicus
atgcgccgctgatcctgccggtggt

SEQ ID NO: 193781 - DNA, 25 bp, Rattus norvegicus
atgcgccgggtacaagatgccttcc

SEQ ID NO: 193782 - DNA, 25 bp, Rattus norvegicus
atgcgccgggtagaagatgccttcc

SEQ ID NO: 193783 - DNA, 25 bp, Rattus norvegicus
atgcgcctgcttattgggtcactgg

SEQ ID NO: 193784 - DNA, 25 bp, Rattus norvegicus
atgcgcctgctttttgggtcactgg

SEQ ID NO: 193785 - DNA, 25 bp, Rattus norvegicus
atgcgcctggcacaacatcgacgca

SEQ ID NO: 193786 - DNA, 25 bp, Rattus norvegicus
atgcgcctggcagaacatcgacgca

SEQ ID NO: 193787 - DNA, 25 bp, Rattus norvegicus
atgcgcctgtacaatgtatgcaccg

SEQ ID NO: 193788 - DNA, 25 bp, Rattus norvegicus
atgcgcctgtactatgtatgcaccg

SEQ ID NO: 193789 - DNA, 25 bp, Rattus norvegicus
atgcgcctttctctctgtttgatga

SEQ ID NO: 193790 - DNA, 25 bp, Rattus norvegicus
atgcgcctttctgtctgtttgatga

SEQ ID NO: 193791 - DNA, 25 bp, Rattus norvegicus
atgcgcgtcttcctgaggtgttcgc

SEQ ID NO: 193792 - DNA, 25 bp, Rattus norvegicus
atgcgcgtcttcgtgaggtgttcgc

SEQ ID NO: 193793 - DNA, 25 bp, Rattus norvegicus
atgcgctatcttaactcgtgtctag

SEQ ID NO: 193794 - DNA, 25 bp, Rattus norvegicus
atgcgctatctttactcgtgtctag

SEQ ID NO: 193795 - DNA, 25 bp, Rattus norvegicus
atgcgctccgaactcaagaccaagg

SEQ ID NO: 193796 - DNA, 25 bp, Rattus norvegicus
atgcgctccgaagtcaagaccaagg

SEQ ID NO: 193797 - DNA, 25 bp, Rattus norvegicus
atgcgctccgagaccttgaggttgc

SEQ ID NO: 193798 - DNA, 25 bp, Rattus norvegicus
atgcgctccgagtccttgaggttgc

SEQ ID NO: 193799 - DNA, 25 bp, Rattus norvegicus
atgcgctctaccaattgctgtgcat

SEQ ID NO: 193800 - DNA, 25 bp, Rattus norvegicus
atgcgctctacctattgctgtgcat

SEQ ID NO: 193801 - DNA, 25 bp, Rattus norvegicus
atgcgctcttccagtgttgtaatct

SEQ ID NO: 193802 - DNA, 25 bp, Rattus norvegicus
atgcgctcttcctgtgttgtaatct

SEQ ID NO: 193803 - DNA, 25 bp, Rattus norvegicus
atgcgctctttgatttttacattgt

SEQ ID NO: 193804 - DNA, 25 bp, Rattus norvegicus
atgcgctctttgttttttacattgt

SEQ ID NO: 193805 - DNA, 25 bp, Rattus norvegicus
atgcgctgatcacgaggcccgacag

SEQ ID NO: 193806 - DNA, 25 bp, Rattus norvegicus
atgcgctgatcaggaggcccgacag

SEQ ID NO: 193807 - DNA, 25 bp, Rattus norvegicus
atgcgctgtgccaacgaagtgacgc

SEQ ID NO: 193808 - DNA, 25 bp, Rattus norvegicus
atgcgctgtgcctacgaagtgacgc

SEQ ID NO: 193809 - DNA, 25 bp, Rattus norvegicus
atgcgcttctggatggcattgccgg

SEQ ID NO: 193810 - DNA, 25 bp, Rattus norvegicus
atgcgcttctggttggcattgccgg

SEQ ID NO: 193811 - DNA, 25 bp, Rattus norvegicus
atgcgcttggcaatgttcaatccag

SEQ ID NO: 193812 - DNA, 25 bp, Rattus norvegicus
atgcgcttggcattgttcaatccag

SEQ ID NO: 193813 - DNA, 25 bp, Rattus norvegicus
atgcggaaagctcttaggacggaca

SEQ ID NO: 193814 - DNA, 25 bp, Rattus norvegicus
atgcggaaagctgttaggacggaca

SEQ ID NO: 193815 - DNA, 25 bp, Rattus norvegicus
atgcggaaatgaagtccacctgccc

SEQ ID NO: 193816 - DNA, 25 bp, Rattus norvegicus
atgcggaaatgatgtccacctgccc

SEQ ID NO: 193817 - DNA, 25 bp, Rattus norvegicus
atgcggaagctcagctgaggctcta

SEQ ID NO: 193818 - DNA, 25 bp, Rattus norvegicus
atgcggaagctctgctgaggctcta

SEQ ID NO: 193819 - DNA, 25 bp, Rattus norvegicus
atgcggagacacagagtttcctctg

SEQ ID NO: 193820 - DNA, 25 bp, Rattus norvegicus
atgcggagacactgagtttcctctg

SEQ ID NO: 193821 - DNA, 25 bp, Rattus norvegicus
atgcggagaccaacatcaccacaga

SEQ ID NO: 193822 - DNA, 25 bp, Rattus norvegicus
atgcggagaccatcatcaccacaga

SEQ ID NO: 193823 - DNA, 25 bp, Rattus norvegicus
atgcggagccttacgatatgacgtt

SEQ ID NO: 193824 - DNA, 25 bp, Rattus norvegicus
atgcggagcctttcgatatgacgtt

SEQ ID NO: 193825 - DNA, 25 bp, Rattus norvegicus
atgcggagttttactcaatttcttc

SEQ ID NO: 193826 - DNA, 25 bp, Rattus norvegicus
atgcggagtttttctcaatttcttc

SEQ ID NO: 193827 - DNA, 25 bp, Rattus norvegicus
atgcggatcgcacaccagcgttaaa

SEQ ID NO: 193828 - DNA, 25 bp, Rattus norvegicus
atgcggatcgcagaccagcgttaaa

SEQ ID NO: 193829 - DNA, 25 bp, Rattus norvegicus
atgcggcaatgacctctagcctggt

SEQ ID NO: 193830 - DNA, 25 bp, Rattus norvegicus
atgcggcaatgagctctagcctggt

SEQ ID NO: 193831 - DNA, 25 bp, Rattus norvegicus
atgcggcagctcattaacgtacttt

SEQ ID NO: 193832 - DNA, 25 bp, Rattus norvegicus
atgcggcagctctttaacgtacttt

SEQ ID NO: 193833 - DNA, 25 bp, Rattus norvegicus
atgcggccaaatatccaaactgtgc

SEQ ID NO: 193834 - DNA, 25 bp, Rattus norvegicus
atgcggccaaatttccaaactgtgc

SEQ ID NO: 193835 - DNA, 25 bp, Rattus norvegicus
atgcggccacagatgccttgctgct

SEQ ID NO: 193836 - DNA, 25 bp, Rattus norvegicus
atgcggccacagttgccttgctgct

SEQ ID NO: 193837 - DNA, 25 bp, Rattus norvegicus
atgcggccatctccgcacggcacga

SEQ ID NO: 193838 - DNA, 25 bp, Rattus norvegicus
atgcggccatctgcgcacggcacga

SEQ ID NO: 193839 - DNA, 25 bp, Rattus norvegicus
atgcggccgaggaactggagaccta

SEQ ID NO: 193840 - DNA, 25 bp, Rattus norvegicus
atgcggccgaggtactggagaccta

SEQ ID NO: 193841 - DNA, 25 bp, Rattus norvegicus
atgcggcctcagaagttgatctaac

SEQ ID NO: 193842 - DNA, 25 bp, Rattus norvegicus
atgcggcctcagcttgtaaggctgt

SEQ ID NO: 193843 - DNA, 25 bp, Rattus norvegicus
atgcggcctcaggttgtaaggctgt

SEQ ID NO: 193844 - DNA, 25 bp, Rattus norvegicus
atgcggcctcagtagttgatctaac

SEQ ID NO: 193845 - DNA, 25 bp, Rattus norvegicus
atgcggctcagaacctgctgaggct

SEQ ID NO: 193846 - DNA, 25 bp, Rattus norvegicus
atgcggctcagatcctgctgaggct

SEQ ID NO: 193847 - DNA, 25 bp, Rattus norvegicus
atgcggctcctgcacttgagttagg

SEQ ID NO: 193848 - DNA, 25 bp, Rattus norvegicus
atgcggctcctggacttgagttagg

SEQ ID NO: 193849 - DNA, 25 bp, Rattus norvegicus
atgcgggaacctctgtttgaatttg

SEQ ID NO: 193850 - DNA, 25 bp, Rattus norvegicus
atgcgggaacctgtgtttgaatttg

SEQ ID NO: 193851 - DNA, 25 bp, Rattus norvegicus
atgcgggaacgcaaccacatccagg

SEQ ID NO: 193852 - DNA, 25 bp, Rattus norvegicus
atgcgggaacgctaccacatccagg

SEQ ID NO: 193853 - DNA, 25 bp, Rattus norvegicus
atgcgggcaactcaaattcaagcga

SEQ ID NO: 193854 - DNA, 25 bp, Rattus norvegicus
atgcgggcaactgaaattcaagcga

SEQ ID NO: 193855 - DNA, 25 bp, Rattus norvegicus
atgcgggcaatccaacatgttcccg

SEQ ID NO: 193856 - DNA, 25 bp, Rattus norvegicus
atgcgggcaatcgaacatgttcccg

SEQ ID NO: 193857 - DNA, 25 bp, Rattus norvegicus
atgcgggcaccgaaaggatattctc

SEQ ID NO: 193858 - DNA, 25 bp, Rattus norvegicus
atgcgggcaccgtaaggatattctc

SEQ ID NO: 193859 - DNA, 25 bp, Rattus norvegicus
atgcgggcccctccggatatcagaa

SEQ ID NO: 193860 - DNA, 25 bp, Rattus norvegicus
atgcgggcccctgcggatatcagaa

SEQ ID NO: 193861 - DNA, 25 bp, Rattus norvegicus
atgcgggctcataaccaaacaggtt

SEQ ID NO: 193862 - DNA, 25 bp, Rattus norvegicus
atgcgggctcattaccaaacaggtt

SEQ ID NO: 193863 - DNA, 25 bp, Rattus norvegicus
atgcgggctttgctcagtcagtgca

SEQ ID NO: 193864 - DNA, 25 bp, Rattus norvegicus
atgcgggctttggtcagtcagtgca

SEQ ID NO: 193865 - DNA, 25 bp, Rattus norvegicus
atgcgggtgctgagcgtatcctgaa

SEQ ID NO: 193866 - DNA, 25 bp, Rattus norvegicus
atgcgggtgctgtgcgtatcctgaa

SEQ ID NO: 193867 - DNA, 25 bp, Rattus norvegicus
atgcggtatattatgattctgattc

SEQ ID NO: 193868 - DNA, 25 bp, Rattus norvegicus
atgcggtatattttgattctgattc

SEQ ID NO: 193869 - DNA, 25 bp, Rattus norvegicus
atgcggtatgcaaagtgactcccct

SEQ ID NO: 193870 - DNA, 25 bp, Rattus norvegicus
atgcggtatgcatagtgactcccct

SEQ ID NO: 193871 - DNA, 25 bp, Rattus norvegicus
atgcggtcatccatgaagcaaccca

SEQ ID NO: 193872 - DNA, 25 bp, Rattus norvegicus
atgcggtcatccttgaagcaaccca

SEQ ID NO: 193873 - DNA, 25 bp, Rattus norvegicus
atgcggtctcatacactgcattgag

SEQ ID NO: 193874 - DNA, 25 bp, Rattus norvegicus
atgcggtctcattcactgcattgag

SEQ ID NO: 193875 - DNA, 25 bp, Rattus norvegicus
atgcggtctctgctttcttacatgc

SEQ ID NO: 193876 - DNA, 25 bp, Rattus norvegicus
atgcggtctctggtttcttacatgc

SEQ ID NO: 193877 - DNA, 25 bp, Rattus norvegicus
atgcggtgagcacttttgcccatcc

SEQ ID NO: 193878 - DNA, 25 bp, Rattus norvegicus
atgcggtgagcagttttgcccatcc

SEQ ID NO: 193879 - DNA, 25 bp, Rattus norvegicus
atgcggtgcatccaggagcgactcc

SEQ ID NO: 193880 - DNA, 25 bp, Rattus norvegicus
atgcggtgcatcgaggagcgactcc

SEQ ID NO: 193881 - DNA, 25 bp, Rattus norvegicus
atgcggtgtcggattgtggccacat

SEQ ID NO: 193882 - DNA, 25 bp, Rattus norvegicus
atgcggtgtcggtttgtggccacat

SEQ ID NO: 193883 - DNA, 25 bp, Rattus norvegicus
atgcggttccttcctttgatatctg

SEQ ID NO: 193884 - DNA, 25 bp, Rattus norvegicus
atgcggttccttgctttgatatctg

SEQ ID NO: 193885 - DNA, 25 bp, Rattus norvegicus
atgcggttctgccaagccagtgcca

SEQ ID NO: 193886 - DNA, 25 bp, Rattus norvegicus
atgcggttctgcgaagccagtgcca

SEQ ID NO: 193887 - DNA, 25 bp, Rattus norvegicus
atgcgtaccctgatggccgtagaga

SEQ ID NO: 193888 - DNA, 25 bp, Rattus norvegicus
atgcgtaccctgttggccgtagaga

SEQ ID NO: 193889 - DNA, 25 bp, Rattus norvegicus
atgcgtaccgtactattattacagg

SEQ ID NO: 193890 - DNA, 25 bp, Rattus norvegicus
atgcgtaccgtagtattattacagg

SEQ ID NO: 193891 - DNA, 25 bp, Rattus norvegicus
atgcgtacctccatcagtgaaggca

SEQ ID NO: 193892 - DNA, 25 bp, Rattus norvegicus
atgcgtacctccttcagtgaaggca

SEQ ID NO: 193893 - DNA, 25 bp, Rattus norvegicus
atgcgtacgacaacgccaggtgtgc

SEQ ID NO: 193894 - DNA, 25 bp, Rattus norvegicus
atgcgtacgacatcgccaggtgtgc

SEQ ID NO: 193895 - DNA, 25 bp, Rattus norvegicus
atgcgtacgcatccacacgtgcata

SEQ ID NO: 193896 - DNA, 25 bp, Rattus norvegicus
atgcgtacgcatgcacacgtgcata

SEQ ID NO: 193897 - DNA, 25 bp, Rattus norvegicus
atgcgtacgtgccaccatataaatg

SEQ ID NO: 193898 - DNA, 25 bp, Rattus norvegicus
atgcgtacgtgcgaccatataaatg

SEQ ID NO: 193899 - DNA, 25 bp, Rattus norvegicus
atgcgtactatgataattccctata

SEQ ID NO: 193900 - DNA, 25 bp, Rattus norvegicus
atgcgtactatgttaattccctata

SEQ ID NO: 193901 - DNA, 25 bp, Rattus norvegicus
atgcgtagacttccctcctgagagg

SEQ ID NO: 193902 - DNA, 25 bp, Rattus norvegicus
atgcgtagacttgcctcctgagagg

SEQ ID NO: 193903 - DNA, 25 bp, Rattus norvegicus
atgcgtagcacaaacaaacccatgt

SEQ ID NO: 193904 - DNA, 25 bp, Rattus norvegicus
atgcgtagcacaactccagagagtc

SEQ ID NO: 193905 - DNA, 25 bp, Rattus norvegicus
atgcgtagcacatacaaacccatgt

SEQ ID NO: 193906 - DNA, 25 bp, Rattus norvegicus
atgcgtagcacatctccagagagtc

SEQ ID NO: 193907 - DNA, 25 bp, Rattus norvegicus
atgcgtagcagacgactaacttgtc

SEQ ID NO: 193908 - DNA, 25 bp, Rattus norvegicus
atgcgtagcagaggactaacttgtc

SEQ ID NO: 193909 - DNA, 25 bp, Rattus norvegicus
atgcgtagttctcgagccatctccc

SEQ ID NO: 193910 - DNA, 25 bp, Rattus norvegicus
atgcgtagttctggagccatctccc

SEQ ID NO: 193911 - DNA, 25 bp, Rattus norvegicus
atgcgtatctacatgacatctccag

SEQ ID NO: 193912 - DNA, 25 bp, Rattus norvegicus
atgcgtatctacttgacatctccag

SEQ ID NO: 193913 - DNA, 25 bp, Rattus norvegicus
atgcgtatctcaacatcctctgcag

SEQ ID NO: 193914 - DNA, 25 bp, Rattus norvegicus
atgcgtatctcatcatcctctgcag

SEQ ID NO: 193915 - DNA, 25 bp, Rattus norvegicus
atgcgtatggatacaagccactcag

SEQ ID NO: 193916 - DNA, 25 bp, Rattus norvegicus
atgcgtatggattcaagccactcag

SEQ ID NO: 193917 - DNA, 25 bp, Rattus norvegicus
atgcgtcccagaaacacttcaggaa

SEQ ID NO: 193918 - DNA, 25 bp, Rattus norvegicus
atgcgtcccagatacacttcaggaa

SEQ ID NO: 193919 - DNA, 25 bp, Rattus norvegicus
atgcgtcctcttcaaaaagccgaag

SEQ ID NO: 193920 - DNA, 25 bp, Rattus norvegicus
atgcgtcctcttgaaaaagccgaag

SEQ ID NO: 193921 - DNA, 25 bp, Rattus norvegicus
atgcgtcctggtctaacgtgagaac

SEQ ID NO: 193922 - DNA, 25 bp, Rattus norvegicus
atgcgtcctggtgtaacgtgagaac

SEQ ID NO: 193923 - DNA, 25 bp, Rattus norvegicus
atgcgtctaggaactatgtttggga

SEQ ID NO: 193924 - DNA, 25 bp, Rattus norvegicus
atgcgtctaggatctatgtttggga

SEQ ID NO: 193925 - DNA, 25 bp, Rattus norvegicus
atgcgtctcctcagtaggtctgcga

SEQ ID NO: 193926 - DNA, 25 bp, Rattus norvegicus
atgcgtctcctctgtaggtctgcga

SEQ ID NO: 193927 - DNA, 25 bp, Rattus norvegicus
atgcgtctgtcaatttgcctttaac

SEQ ID NO: 193928 - DNA, 25 bp, Rattus norvegicus
atgcgtctgtcattttgcctttaac

SEQ ID NO: 193929 - DNA, 25 bp, Rattus norvegicus
atgcgtgaacgtagtgtaaggcctt

SEQ ID NO: 193930 - DNA, 25 bp, Rattus norvegicus
atgcgtgaacgttgtgtaaggcctt

SEQ ID NO: 193931 - DNA, 25 bp, Rattus norvegicus
atgcgtgaaggtccatgcctggcac

SEQ ID NO: 193932 - DNA, 25 bp, Rattus norvegicus
atgcgtgaaggtgcatgcctggcac

SEQ ID NO: 193933 - DNA, 25 bp, Rattus norvegicus
atgcgtgacttcctggatccagaca

SEQ ID NO: 193934 - DNA, 25 bp, Rattus norvegicus
atgcgtgacttcgtggatccagaca

SEQ ID NO: 193935 - DNA, 25 bp, Rattus norvegicus
atgcgtgagtgcacagaactgttct

SEQ ID NO: 193936 - DNA, 25 bp, Rattus norvegicus
atgcgtgagtgctcagaactgttct

SEQ ID NO: 193937 - DNA, 25 bp, Rattus norvegicus
atgcgtgcagttctaccattggaca

SEQ ID NO: 193938 - DNA, 25 bp, Rattus norvegicus
atgcgtgcagttgtaccattggaca

SEQ ID NO: 193939 - DNA, 25 bp, Rattus norvegicus
atgcgtggaggacatacatttggtc

SEQ ID NO: 193940 - DNA, 25 bp, Rattus norvegicus
atgcgtggaggagatacatttggtc

SEQ ID NO: 193941 - DNA, 25 bp, Rattus norvegicus
atgcgtgggctgacatctgctggcc

SEQ ID NO: 193942 - DNA, 25 bp, Rattus norvegicus
atgcgtgggctgtcatctgctggcc

SEQ ID NO: 193943 - DNA, 25 bp, Rattus norvegicus
atgcgtggtattattaacttgacag

SEQ ID NO: 193944 - DNA, 25 bp, Rattus norvegicus
atgcgtggtatttttaacttgacag

SEQ ID NO: 193945 - DNA, 25 bp, Rattus norvegicus
atgcgtgtacacaagcctagtggca

SEQ ID NO: 193946 - DNA, 25 bp, Rattus norvegicus
atgcgtgtacactagcctagtggca

SEQ ID NO: 193947 - DNA, 25 bp, Rattus norvegicus
atgcgtgtactgattgtgagcccca

SEQ ID NO: 193948 - DNA, 25 bp, Rattus norvegicus
atgcgtgtactgtttgtgagcccca

SEQ ID NO: 193949 - DNA, 25 bp, Rattus norvegicus
atgcgtgtgcgtcctcccagatgca

SEQ ID NO: 193950 - DNA, 25 bp, Rattus norvegicus
atgcgtgtgcgtgctcccagatgca

SEQ ID NO: 193951 - DNA, 25 bp, Rattus norvegicus
atgcgttaacatcccaatttttcga

SEQ ID NO: 193952 - DNA, 25 bp, Rattus norvegicus
atgcgttaacatgccaatttttcga

SEQ ID NO: 193953 - DNA, 25 bp, Rattus norvegicus
atgcgttcagttacagtcactcatg

SEQ ID NO: 193954 - DNA, 25 bp, Rattus norvegicus
atgcgttcagtttcagtcactcatg

SEQ ID NO: 193955 - DNA, 25 bp, Rattus norvegicus
atgcgttctgtgctcaccgggacga

SEQ ID NO: 193956 - DNA, 25 bp, Rattus norvegicus
atgcgttctgtggtcaccgggacga

SEQ ID NO: 193957 - DNA, 25 bp, Rattus norvegicus
atgcgtttatgactgtttcttttta

SEQ ID NO: 193958 - DNA, 25 bp, Rattus norvegicus
atgcgtttatgagtgtttcttttta

SEQ ID NO: 193959 - DNA, 25 bp, Rattus norvegicus
atgcgtttcatgataatgcccttcc

SEQ ID NO: 193960 - DNA, 25 bp, Rattus norvegicus
atgcgtttcatgttaatgcccttcc

SEQ ID NO: 193961 - DNA, 25 bp, Rattus norvegicus
atgcgtttggagatgcgtttcctac

SEQ ID NO: 193962 - DNA, 25 bp, Rattus norvegicus
atgcgtttggagttgcgtttcctac

SEQ ID NO: 193963 - DNA, 25 bp, Rattus norvegicus
atgcgttttcaactggctgaccagg

SEQ ID NO: 193964 - DNA, 25 bp, Rattus norvegicus
atgcgttttcaagtggctgaccagg

SEQ ID NO: 193965 - DNA, 25 bp, Rattus norvegicus
atgcgttttgctataattcactgag

SEQ ID NO: 193966 - DNA, 25 bp, Rattus norvegicus
atgcgttttgctttaattcactgag

SEQ ID NO: 193967 - DNA, 25 bp, Rattus norvegicus
atgctaaactagactcgaacccctg

SEQ ID NO: 193968 - DNA, 25 bp, Rattus norvegicus
atgctaaactagtctcgaacccctg

SEQ ID NO: 193969 - DNA, 25 bp, Rattus norvegicus
atgctaaagagtccgttccacccgg

SEQ ID NO: 193970 - DNA, 25 bp, Rattus norvegicus
atgctaaagagtgcgttccacccgg

SEQ ID NO: 193971 - DNA, 25 bp, Rattus norvegicus
atgctaacacatcgagccgctgata

SEQ ID NO: 193972 - DNA, 25 bp, Rattus norvegicus
atgctaacacatggagccgctgata

SEQ ID NO: 193973 - DNA, 25 bp, Rattus norvegicus
atgctaacagctcccaatggtattg

SEQ ID NO: 193974 - DNA, 25 bp, Rattus norvegicus
atgctaacagctgccaatggtattg

SEQ ID NO: 193975 - DNA, 25 bp, Rattus norvegicus
atgctaacagttcaatcactcagag

SEQ ID NO: 193976 - DNA, 25 bp, Rattus norvegicus
atgctaacagttgaatcactcagag

SEQ ID NO: 193977 - DNA, 25 bp, Rattus norvegicus
atgctaacatttctcgactaccaag

SEQ ID NO: 193978 - DNA, 25 bp, Rattus norvegicus
atgctaacatttgtcgactaccaag

SEQ ID NO: 193979 - DNA, 25 bp, Rattus norvegicus
atgctaaccttcaacttttctttca

SEQ ID NO: 193980 - DNA, 25 bp, Rattus norvegicus
atgctaaccttctacttttctttca

SEQ ID NO: 193981 - DNA, 25 bp, Rattus norvegicus
atgctaacggtcacacacaagggaa

SEQ ID NO: 193982 - DNA, 25 bp, Rattus norvegicus
atgctaacggtctcacacaagggaa

SEQ ID NO: 193983 - DNA, 25 bp, Rattus norvegicus
atgctaacgttgaatctgttccacc

SEQ ID NO: 193984 - DNA, 25 bp, Rattus norvegicus
atgctaacgttgtatctgttccacc

SEQ ID NO: 193985 - DNA, 25 bp, Rattus norvegicus
atgctaactcatcgacctgctcttg

SEQ ID NO: 193986 - DNA, 25 bp, Rattus norvegicus
atgctaactcatggacctgctcttg

SEQ ID NO: 193987 - DNA, 25 bp, Rattus norvegicus
atgctaaggactatgaccctgccat

SEQ ID NO: 193988 - DNA, 25 bp, Rattus norvegicus
atgctaaggactttgaccctgccat

SEQ ID NO: 193989 - DNA, 25 bp, Rattus norvegicus
atgctaaggcagcagcttggcttcc

SEQ ID NO: 193990 - DNA, 25 bp, Rattus norvegicus
atgctaaggcaggagcttggcttcc

SEQ ID NO: 193991 - DNA, 25 bp, Rattus norvegicus
atgctaagggcaactgcatccaggg

SEQ ID NO: 193992 - DNA, 25 bp, Rattus norvegicus
atgctaagggcatctgcatccaggg

SEQ ID NO: 193993 - DNA, 25 bp, Rattus norvegicus
atgctaagtgaccagctgtttccag

SEQ ID NO: 193994 - DNA, 25 bp, Rattus norvegicus
atgctaagtgacgagctgtttccag

SEQ ID NO: 193995 - DNA, 25 bp, Rattus norvegicus
atgctaagtgtaattgtgttcccaa

SEQ ID NO: 193996 - DNA, 25 bp, Rattus norvegicus
atgctaagtgtatttgtgttcccaa

SEQ ID NO: 193997 - DNA, 25 bp, Rattus norvegicus
atgctaatattgagtggcggctgat

SEQ ID NO: 193998 - DNA, 25 bp, Rattus norvegicus
atgctaatattgtgtggcggctgat

SEQ ID NO: 193999 - DNA, 25 bp, Rattus norvegicus
atgctaatgtccaactgagcgtgga

SEQ ID NO: 194000 - DNA, 25 bp, Rattus norvegicus
atgctaatgtcctactgagcgtgga

SEQ ID NO: 194001 - DNA, 25 bp, Rattus norvegicus
atgctaatttgcacgtcgattcacc

SEQ ID NO: 194002 - DNA, 25 bp, Rattus norvegicus
atgctaatttgctcgtcgattcacc

SEQ ID NO: 194003 - DNA, 25 bp, Rattus norvegicus
atgctacaacatcgcatgcaggcgt

SEQ ID NO: 194004 - DNA, 25 bp, Rattus norvegicus
atgctacaacatggcatgcaggcgt

SEQ ID NO: 194005 - DNA, 25 bp, Rattus norvegicus
atgctacacacaaattgtagttcag

SEQ ID NO: 194006 - DNA, 25 bp, Rattus norvegicus
atgctacacacatattgtagttcag

SEQ ID NO: 194007 - DNA, 25 bp, Rattus norvegicus
atgctacacagccttagctctcatc

SEQ ID NO: 194008 - DNA, 25 bp, Rattus norvegicus
atgctacacagcgttagctctcatc

SEQ ID NO: 194009 - DNA, 25 bp, Rattus norvegicus
atgctacactttccctcagaacatg

SEQ ID NO: 194010 - DNA, 25 bp, Rattus norvegicus
atgctacactttgcctcagaacatg

SEQ ID NO: 194011 - DNA, 25 bp, Rattus norvegicus
atgctacataatattctcacactgt

SEQ ID NO: 194012 - DNA, 25 bp, Rattus norvegicus
atgctacataattttctcacactgt

SEQ ID NO: 194013 - DNA, 25 bp, Rattus norvegicus
atgctacatggacccagctagcctt

SEQ ID NO: 194014 - DNA, 25 bp, Rattus norvegicus
atgctacatggagccagctagcctt

SEQ ID NO: 194015 - DNA, 25 bp, Rattus norvegicus
atgctacatttgaggccgagaattt

SEQ ID NO: 194016 - DNA, 25 bp, Rattus norvegicus
atgctacatttgtggccgagaattt

SEQ ID NO: 194017 - DNA, 25 bp, Rattus norvegicus
atgctaccatgacctcagagcctgt

SEQ ID NO: 194018 - DNA, 25 bp, Rattus norvegicus
atgctaccatgagctcagagcctgt

SEQ ID NO: 194019 - DNA, 25 bp, Rattus norvegicus
atgctacccctgcaaacccaaatgg

SEQ ID NO: 194020 - DNA, 25 bp, Rattus norvegicus
atgctacccctggaaacccaaatgg

SEQ ID NO: 194021 - DNA, 25 bp, Rattus norvegicus
atgctacccgaaagcttctctgagg

SEQ ID NO: 194022 - DNA, 25 bp, Rattus norvegicus
atgctacccgaatgcttctctgagg

SEQ ID NO: 194023 - DNA, 25 bp, Rattus norvegicus
atgctaccctgccaacctattattt

SEQ ID NO: 194024 - DNA, 25 bp, Rattus norvegicus
atgctaccctgcgaacctattattt

SEQ ID NO: 194025 - DNA, 25 bp, Rattus norvegicus
atgctaccgctgaaggtggtcccga

SEQ ID NO: 194026 - DNA, 25 bp, Rattus norvegicus
atgctaccgctgtaggtggtcccga

SEQ ID NO: 194027 - DNA, 25 bp, Rattus norvegicus
atgctacgctgcaggcaaagccaaa

SEQ ID NO: 194028 - DNA, 25 bp, Rattus norvegicus
atgctacgctgctggcaaagccaaa

SEQ ID NO: 194029 - DNA, 25 bp, Rattus norvegicus
atgctacggagaatctggaggccct

SEQ ID NO: 194030 - DNA, 25 bp, Rattus norvegicus
atgctacggagattctggaggccct

SEQ ID NO: 194031 - DNA, 25 bp, Rattus norvegicus
atgctacggcatctcaaccttgagt

SEQ ID NO: 194032 - DNA, 25 bp, Rattus norvegicus
atgctacggcatgtcaaccttgagt

SEQ ID NO: 194033 - DNA, 25 bp, Rattus norvegicus
atgctacgtgatcagatgccctggt

SEQ ID NO: 194034 - DNA, 25 bp, Rattus norvegicus
atgctacgtgatgagatgccctggt

SEQ ID NO: 194035 - DNA, 25 bp, Rattus norvegicus
atgctactcaatcagactccattgc

SEQ ID NO: 194036 - DNA, 25 bp, Rattus norvegicus
atgctactcaatgagactccattgc

SEQ ID NO: 194037 - DNA, 25 bp, Rattus norvegicus
atgctactcagaactcaattggctt

SEQ ID NO: 194038 - DNA, 25 bp, Rattus norvegicus
atgctactcagatctcaattggctt

SEQ ID NO: 194039 - DNA, 25 bp, Rattus norvegicus
atgctactcttgctgatgctgggtt

SEQ ID NO: 194040 - DNA, 25 bp, Rattus norvegicus
atgctactcttggtgatgctgggtt

SEQ ID NO: 194041 - DNA, 25 bp, Rattus norvegicus
atgctactgccaatgacatcaccaa

SEQ ID NO: 194042 - DNA, 25 bp, Rattus norvegicus
atgctactgccattgacatcaccaa

SEQ ID NO: 194043 - DNA, 25 bp, Rattus norvegicus
atgctactgttccttgcttcaatat

SEQ ID NO: 194044 - DNA, 25 bp, Rattus norvegicus
atgctactgttcgttgcttcaatat

SEQ ID NO: 194045 - DNA, 25 bp, Rattus norvegicus
atgctacttcaactgtccgctttct

SEQ ID NO: 194046 - DNA, 25 bp, Rattus norvegicus
atgctacttcaagtgtccgctttct

SEQ ID NO: 194047 - DNA, 25 bp, Rattus norvegicus
atgctacttcctaagcctctggaaa

SEQ ID NO: 194048 - DNA, 25 bp, Rattus norvegicus
atgctacttccttagcctctggaaa

SEQ ID NO: 194049 - DNA, 25 bp, Rattus norvegicus
atgctagactgaaatcttgccctgg

SEQ ID NO: 194050 - DNA, 25 bp, Rattus norvegicus
atgctagactgatatcttgccctgg

SEQ ID NO: 194051 - DNA, 25 bp, Rattus norvegicus
atgctagactggctacgggattgtc

SEQ ID NO: 194052 - DNA, 25 bp, Rattus norvegicus
atgctagactgggtacgggattgtc

SEQ ID NO: 194053 - DNA, 25 bp, Rattus norvegicus
atgctagaggatcctgtgctcccac

SEQ ID NO: 194054 - DNA, 25 bp, Rattus norvegicus
atgctagaggatgctgtgctcccac

SEQ ID NO: 194055 - DNA, 25 bp, Rattus norvegicus
atgctagagtttatgtgccctgtcc

SEQ ID NO: 194056 - DNA, 25 bp, Rattus norvegicus
atgctagagtttttgtgccctgtcc

SEQ ID NO: 194057 - DNA, 25 bp, Rattus norvegicus
atgctagatcctcccctaagattat

SEQ ID NO: 194058 - DNA, 25 bp, Rattus norvegicus
atgctagatcctgccctaagattat

SEQ ID NO: 194059 - DNA, 25 bp, Rattus norvegicus
atgctagcagcactgtctttggaac

SEQ ID NO: 194060 - DNA, 25 bp, Rattus norvegicus
atgctagcagcagtgtctttggaac

SEQ ID NO: 194061 - DNA, 25 bp, Rattus norvegicus
atgctagcagctccctgcttcaggt

SEQ ID NO: 194062 - DNA, 25 bp, Rattus norvegicus
atgctagcagctcggacaggatgac

SEQ ID NO: 194063 - DNA, 25 bp, Rattus norvegicus
atgctagcagctgcctgcttcaggt

SEQ ID NO: 194064 - DNA, 25 bp, Rattus norvegicus
atgctagcagctgggacaggatgac

SEQ ID NO: 194065 - DNA, 25 bp, Rattus norvegicus
atgctagcagggacatccaaatgat

SEQ ID NO: 194066 - DNA, 25 bp, Rattus norvegicus
atgctagcagggtcatccaaatgat

SEQ ID NO: 194067 - DNA, 25 bp, Rattus norvegicus
atgctagcatctatcagtggcgagt

SEQ ID NO: 194068 - DNA, 25 bp, Rattus norvegicus
atgctagcatctttcagtggcgagt

SEQ ID NO: 194069 - DNA, 25 bp, Rattus norvegicus
atgctagcctcgctttgtttgcttg

SEQ ID NO: 194070 - DNA, 25 bp, Rattus norvegicus
atgctagcctcggtttgtttgcttg

SEQ ID NO: 194071 - DNA, 25 bp, Rattus norvegicus
atgctagcctgcagacattgtcttg

SEQ ID NO: 194072 - DNA, 25 bp, Rattus norvegicus
atgctagcctgcagggtgcctgact

SEQ ID NO: 194073 - DNA, 25 bp, Rattus norvegicus
atgctagcctgctgacattgtcttg

SEQ ID NO: 194074 - DNA, 25 bp, Rattus norvegicus
atgctagcctgctgggtgcctgact

SEQ ID NO: 194075 - DNA, 25 bp, Rattus norvegicus
atgctagctctgagactccgtcctc

SEQ ID NO: 194076 - DNA, 25 bp, Rattus norvegicus
atgctagctctgtgactccgtcctc

SEQ ID NO: 194077 - DNA, 25 bp, Rattus norvegicus
atgctagcttgtccttgtaacccca

SEQ ID NO: 194078 - DNA, 25 bp, Rattus norvegicus
atgctagcttgtgcttgtaacccca

SEQ ID NO: 194079 - DNA, 25 bp, Rattus norvegicus
atgctaggaagaatgtgacctctaa

SEQ ID NO: 194080 - DNA, 25 bp, Rattus norvegicus
atgctaggaagattgtgacctctaa

SEQ ID NO: 194081 - DNA, 25 bp, Rattus norvegicus
atgctaggacaacttacctccggct

SEQ ID NO: 194082 - DNA, 25 bp, Rattus norvegicus
atgctaggacaagttacctccggct

SEQ ID NO: 194083 - DNA, 25 bp, Rattus norvegicus
atgctaggattacatcgccgtggtc

SEQ ID NO: 194084 - DNA, 25 bp, Rattus norvegicus
atgctaggattagatcgccgtggtc

SEQ ID NO: 194085 - DNA, 25 bp, Rattus norvegicus
atgctaggcgacacgtgcgcggact

SEQ ID NO: 194086 - DNA, 25 bp, Rattus norvegicus
atgctaggcgactcgtgcgcggact

SEQ ID NO: 194087 - DNA, 25 bp, Rattus norvegicus
atgctaggcgtgatccgggaagacc

SEQ ID NO: 194088 - DNA, 25 bp, Rattus norvegicus
atgctaggcgtgttccgggaagacc

SEQ ID NO: 194089 - DNA, 25 bp, Rattus norvegicus
atgctagttcctacttggtttgaca

SEQ ID NO: 194090 - DNA, 25 bp, Rattus norvegicus
atgctagttccttcttggtttgaca

SEQ ID NO: 194091 - DNA, 25 bp, Rattus norvegicus
atgctataatctcgtgctgctgcta

SEQ ID NO: 194092 - DNA, 25 bp, Rattus norvegicus
atgctataatctggtgctgctgcta

SEQ ID NO: 194093 - DNA, 25 bp, Rattus norvegicus
atgctatacctgagagcagcccacg

SEQ ID NO: 194094 - DNA, 25 bp, Rattus norvegicus
atgctatacctgtgagcagcccacg

SEQ ID NO: 194095 - DNA, 25 bp, Rattus norvegicus
atgctatatacaagctatacacatg

SEQ ID NO: 194096 - DNA, 25 bp, Rattus norvegicus
atgctatatacatgctatacacatg

SEQ ID NO: 194097 - DNA, 25 bp, Rattus norvegicus
atgctatatgatagcctttgggttt

SEQ ID NO: 194098 - DNA, 25 bp, Rattus norvegicus
atgctatatgattgcctttgggttt

SEQ ID NO: 194099 - DNA, 25 bp, Rattus norvegicus
atgctatcacagaaggctgctggga

SEQ ID NO: 194100 - DNA, 25 bp, Rattus norvegicus
atgctatcacagtaggctgctggga

SEQ ID NO: 194101 - DNA, 25 bp, Rattus norvegicus
atgctatcatgtccagtggccccaa

SEQ ID NO: 194102 - DNA, 25 bp, Rattus norvegicus
atgctatcatgtgcagtggccccaa

SEQ ID NO: 194103 - DNA, 25 bp, Rattus norvegicus
atgctatcccgaagctacttggttt

SEQ ID NO: 194104 - DNA, 25 bp, Rattus norvegicus
atgctatcccgatgctacttggttt

SEQ ID NO: 194105 - DNA, 25 bp, Rattus norvegicus
atgctatccggaatatcagctcata

SEQ ID NO: 194106 - DNA, 25 bp, Rattus norvegicus
atgctatccggattatcagctcata

SEQ ID NO: 194107 - DNA, 25 bp, Rattus norvegicus
atgctatgagcaactgaactgtgat

SEQ ID NO: 194108 - DNA, 25 bp, Rattus norvegicus
atgctatgagcatctgaactgtgat

SEQ ID NO: 194109 - DNA, 25 bp, Rattus norvegicus
atgctatgctacatacctaccccag

SEQ ID NO: 194110 - DNA, 25 bp, Rattus norvegicus
atgctatgctacttacctaccccag

SEQ ID NO: 194111 - DNA, 25 bp, Rattus norvegicus
atgctatgggacacagagcctcact

SEQ ID NO: 194112 - DNA, 25 bp, Rattus norvegicus
atgctatgggactcagagcctcact

SEQ ID NO: 194113 - DNA, 25 bp, Rattus norvegicus
atgctatggtctcctgttacagcca

SEQ ID NO: 194114 - DNA, 25 bp, Rattus norvegicus
atgctatggtctgctgttacagcca

SEQ ID NO: 194115 - DNA, 25 bp, Rattus norvegicus
atgctatgtactactgtggctgcca

SEQ ID NO: 194116 - DNA, 25 bp, Rattus norvegicus
atgctatgtacttctgtggctgcca

SEQ ID NO: 194117 - DNA, 25 bp, Rattus norvegicus
atgctatgttgcctgtttgattttc

SEQ ID NO: 194118 - DNA, 25 bp, Rattus norvegicus
atgctatgttgcgtgtttgattttc

SEQ ID NO: 194119 - DNA, 25 bp, Rattus norvegicus
atgctattcttgaactctgaccctt

SEQ ID NO: 194120 - DNA, 25 bp, Rattus norvegicus
atgctattcttgtactctgaccctt

SEQ ID NO: 194121 - DNA, 25 bp, Rattus norvegicus
atgctattgcccatatcagaccccg

SEQ ID NO: 194122 - DNA, 25 bp, Rattus norvegicus
atgctattgcccttatcagaccccg

SEQ ID NO: 194123 - DNA, 25 bp, Rattus norvegicus
atgctattggaccaacggactgtat

SEQ ID NO: 194124 - DNA, 25 bp, Rattus norvegicus
atgctattggacgaacggactgtat

SEQ ID NO: 194125 - DNA, 25 bp, Rattus norvegicus
atgctatttcagatcgtaacggacc

SEQ ID NO: 194126 - DNA, 25 bp, Rattus norvegicus
atgctatttcagttcgtaacggacc

SEQ ID NO: 194127 - DNA, 25 bp, Rattus norvegicus
atgctatttcatactatgcctggaa

SEQ ID NO: 194128 - DNA, 25 bp, Rattus norvegicus
atgctatttcattctatgcctggaa

SEQ ID NO: 194129 - DNA, 25 bp, Rattus norvegicus
atgctcaacctcaaaactcctggaa

SEQ ID NO: 194130 - DNA, 25 bp, Rattus norvegicus
atgctcaacctctaaactcctggaa

SEQ ID NO: 194131 - DNA, 25 bp, Rattus norvegicus
atgctcaagcttctcaaggccgggt

SEQ ID NO: 194132 - DNA, 25 bp, Rattus norvegicus
atgctcaagcttgtcaaggccgggt

SEQ ID NO: 194133 - DNA, 25 bp, Rattus norvegicus
atgctcaaggtgacgggcagtgcca

SEQ ID NO: 194134 - DNA, 25 bp, Rattus norvegicus
atgctcaaggtgtcgggcagtgcca

SEQ ID NO: 194135 - DNA, 25 bp, Rattus norvegicus
atgctcaagtggacttttctctact

SEQ ID NO: 194136 - DNA, 25 bp, Rattus norvegicus
atgctcaagtggtcttttctctact

SEQ ID NO: 194137 - DNA, 25 bp, Rattus norvegicus
atgctcaatctgatactatctcgta

SEQ ID NO: 194138 - DNA, 25 bp, Rattus norvegicus
atgctcaatctgttactatctcgta

SEQ ID NO: 194139 - DNA, 25 bp, Rattus norvegicus
atgctcaatgagaggccagctggcc

SEQ ID NO: 194140 - DNA, 25 bp, Rattus norvegicus
atgctcaatgagtggccagctggcc

SEQ ID NO: 194141 - DNA, 25 bp, Rattus norvegicus
atgctcacacatatgctacatagga

SEQ ID NO: 194142 - DNA, 25 bp, Rattus norvegicus
atgctcacacatttgctacatagga

SEQ ID NO: 194143 - DNA, 25 bp, Rattus norvegicus
atgctcacattgcttcgattccacg

SEQ ID NO: 194144 - DNA, 25 bp, Rattus norvegicus
atgctcacattggttcgattccacg

SEQ ID NO: 194145 - DNA, 25 bp, Rattus norvegicus
atgctcaccatgcaactgcatttct

SEQ ID NO: 194146 - DNA, 25 bp, Rattus norvegicus
atgctcaccatggaactgcatttct

SEQ ID NO: 194147 - DNA, 25 bp, Rattus norvegicus
atgctcaccgtgctctcaaggagaa

SEQ ID NO: 194148 - DNA, 25 bp, Rattus norvegicus
atgctcaccgtggtctcaaggagaa

SEQ ID NO: 194149 - DNA, 25 bp, Rattus norvegicus
atgctcacctctcatttgatgttga

SEQ ID NO: 194150 - DNA, 25 bp, Rattus norvegicus
atgctcacctctgatttgatgttga

SEQ ID NO: 194151 - DNA, 25 bp, Rattus norvegicus
atgctcacgctgatggataaaacca

SEQ ID NO: 194152 - DNA, 25 bp, Rattus norvegicus
atgctcacgctgttggataaaacca

SEQ ID NO: 194153 - DNA, 25 bp, Rattus norvegicus
atgctcacgggtactttcttggtaa

SEQ ID NO: 194154 - DNA, 25 bp, Rattus norvegicus
atgctcacgggttctttcttggtaa

SEQ ID NO: 194155 - DNA, 25 bp, Rattus norvegicus
atgctcagaccaactcaacgaagga

SEQ ID NO: 194156 - DNA, 25 bp, Rattus norvegicus
atgctcagaccatctcaacgaagga

SEQ ID NO: 194157 - DNA, 25 bp, Rattus norvegicus
atgctcagcagtaccgtttacagct

SEQ ID NO: 194158 - DNA, 25 bp, Rattus norvegicus
atgctcagcagttccgtttacagct

SEQ ID NO: 194159 - DNA, 25 bp, Rattus norvegicus
atgctcagccttctcatttgagttt

SEQ ID NO: 194160 - DNA, 25 bp, Rattus norvegicus
atgctcagccttgtcatttgagttt

SEQ ID NO: 194161 - DNA, 25 bp, Rattus norvegicus
atgctcagctccattgaaccagcgg

SEQ ID NO: 194162 - DNA, 25 bp, Rattus norvegicus
atgctcagctcctttgaaccagcgg

SEQ ID NO: 194163 - DNA, 25 bp, Rattus norvegicus
atgctcaggaacatccagtctctca

SEQ ID NO: 194164 - DNA, 25 bp, Rattus norvegicus
atgctcaggaacttccagtctctca

SEQ ID NO: 194165 - DNA, 25 bp, Rattus norvegicus
atgctcaggagaacaatcgtgcccc

SEQ ID NO: 194166 - DNA, 25 bp, Rattus norvegicus
atgctcaggagatcaatcgtgcccc

SEQ ID NO: 194167 - DNA, 25 bp, Rattus norvegicus
atgctcagggctcatctgttcagat

SEQ ID NO: 194168 - DNA, 25 bp, Rattus norvegicus
atgctcagggctgatctgttcagat

SEQ ID NO: 194169 - DNA, 25 bp, Rattus norvegicus
atgctcagtttcaggaggtcactgt

SEQ ID NO: 194170 - DNA, 25 bp, Rattus norvegicus
atgctcagtttctggaggtcactgt

SEQ ID NO: 194171 - DNA, 25 bp, Rattus norvegicus
atgctcatagtcacgggaactctga

SEQ ID NO: 194172 - DNA, 25 bp, Rattus norvegicus
atgctcatagtctcgggaactctga

SEQ ID NO: 194173 - DNA, 25 bp, Rattus norvegicus
atgctcatcctcaggtgcttgttga

SEQ ID NO: 194174 - DNA, 25 bp, Rattus norvegicus
atgctcatcctctggtgcttgttga

SEQ ID NO: 194175 - DNA, 25 bp, Rattus norvegicus
atgctcatggtcagagatgtggcgc

SEQ ID NO: 194176 - DNA, 25 bp, Rattus norvegicus
atgctcatggtctgagatgtggcgc

SEQ ID NO: 194177 - DNA, 25 bp, Rattus norvegicus
atgctcattggtccataatgccttg

SEQ ID NO: 194178 - DNA, 25 bp, Rattus norvegicus
atgctcattggtgcataatgccttg

SEQ ID NO: 194179 - DNA, 25 bp, Rattus norvegicus
atgctcatttacctcaagactgtcc

SEQ ID NO: 194180 - DNA, 25 bp, Rattus norvegicus
atgctcatttacgtcaagactgtcc

SEQ ID NO: 194181 - DNA, 25 bp, Rattus norvegicus
atgctcatttccctatgacagactc

SEQ ID NO: 194182 - DNA, 25 bp, Rattus norvegicus
atgctcatttccgtatgacagactc

SEQ ID NO: 194183 - DNA, 25 bp, Rattus norvegicus
atgctcattttccaattttacccta

SEQ ID NO: 194184 - DNA, 25 bp, Rattus norvegicus
atgctcattttcgaattttacccta

SEQ ID NO: 194185 - DNA, 25 bp, Rattus norvegicus
atgctccaacagataccccaatgcg

SEQ ID NO: 194186 - DNA, 25 bp, Rattus norvegicus
atgctccaacagttaccccaatgcg

SEQ ID NO: 194187 - DNA, 25 bp, Rattus norvegicus
atgctccacaagcagggttcagctc

SEQ ID NO: 194188 - DNA, 25 bp, Rattus norvegicus
atgctccacaaggagggttcagctc

SEQ ID NO: 194189 - DNA, 25 bp, Rattus norvegicus
atgctccagaacactgcttgtcttg

SEQ ID NO: 194190 - DNA, 25 bp, Rattus norvegicus
atgctccagaactctgcttgtcttg

SEQ ID NO: 194191 - DNA, 25 bp, Rattus norvegicus
atgctccagcctactgggaacagaa

SEQ ID NO: 194192 - DNA, 25 bp, Rattus norvegicus
atgctccagcctactttgaaacgat

SEQ ID NO: 194193 - DNA, 25 bp, Rattus norvegicus
atgctccagccttctgggaacagaa

SEQ ID NO: 194194 - DNA, 25 bp, Rattus norvegicus
atgctccagccttctttgaaacgat

SEQ ID NO: 194195 - DNA, 25 bp, Rattus norvegicus
atgctccaggatatttggctgaaaa

SEQ ID NO: 194196 - DNA, 25 bp, Rattus norvegicus
atgctccaggatttttggctgaaaa

SEQ ID NO: 194197 - DNA, 25 bp, Rattus norvegicus
atgctccagtccagtctgattctgt

SEQ ID NO: 194198 - DNA, 25 bp, Rattus norvegicus
atgctccagtcctgtctgattctgt

SEQ ID NO: 194199 - DNA, 25 bp, Rattus norvegicus
atgctccagttgacgagggcagcta

SEQ ID NO: 194200 - DNA, 25 bp, Rattus norvegicus
atgctccagttgcaaccaggccttt

SEQ ID NO: 194201 - DNA, 25 bp, Rattus norvegicus
atgctccagttggaaccaggccttt

SEQ ID NO: 194202 - DNA, 25 bp, Rattus norvegicus
atgctccagttgtcgagggcagcta

SEQ ID NO: 194203 - DNA, 25 bp, Rattus norvegicus
atgctccatatgctgccggccgtgg

SEQ ID NO: 194204 - DNA, 25 bp, Rattus norvegicus
atgctccatatggtgccggccgtgg

SEQ ID NO: 194205 - DNA, 25 bp, Rattus norvegicus
atgctccatcatacttggcatctta

SEQ ID NO: 194206 - DNA, 25 bp, Rattus norvegicus
atgctccatcattcttggcatctta

SEQ ID NO: 194207 - DNA, 25 bp, Rattus norvegicus
atgctccattttcgctactggatgg

SEQ ID NO: 194208 - DNA, 25 bp, Rattus norvegicus
atgctccattttggctactggatgg

SEQ ID NO: 194209 - DNA, 25 bp, Rattus norvegicus
atgctcccagccatgatgaatgtgc

SEQ ID NO: 194210 - DNA, 25 bp, Rattus norvegicus
atgctcccagccttgatgaatgtgc

SEQ ID NO: 194211 - DNA, 25 bp, Rattus norvegicus
atgctcccagcgattctgaaacatg

SEQ ID NO: 194212 - DNA, 25 bp, Rattus norvegicus
atgctcccagcgtttctgaaacatg

SEQ ID NO: 194213 - DNA, 25 bp, Rattus norvegicus
atgctcccaggaaggccattggcaa

SEQ ID NO: 194214 - DNA, 25 bp, Rattus norvegicus
atgctcccaggatggccattggcaa

SEQ ID NO: 194215 - DNA, 25 bp, Rattus norvegicus
atgctcccagttatgcctgaatgtt

SEQ ID NO: 194216 - DNA, 25 bp, Rattus norvegicus
atgctcccagttttgcctgaatgtt

SEQ ID NO: 194217 - DNA, 25 bp, Rattus norvegicus
atgctcccatgaataccggattttc

SEQ ID NO: 194218 - DNA, 25 bp, Rattus norvegicus
atgctcccatgattaccggattttc

SEQ ID NO: 194219 - DNA, 25 bp, Rattus norvegicus
atgctccccacgaggatacattaga

SEQ ID NO: 194220 - DNA, 25 bp, Rattus norvegicus
atgctccccacgtggatacattaga

SEQ ID NO: 194221 - DNA, 25 bp, Rattus norvegicus
atgctccccagccagatgtgaagga

SEQ ID NO: 194222 - DNA, 25 bp, Rattus norvegicus
atgctccccagcgagatgtgaagga

SEQ ID NO: 194223 - DNA, 25 bp, Rattus norvegicus
atgctccccattctggtgtcgggtg

SEQ ID NO: 194224 - DNA, 25 bp, Rattus norvegicus
atgctccccattgtggtgtcgggtg

SEQ ID NO: 194225 - DNA, 25 bp, Rattus norvegicus
atgctccctactattttgcttcgaa

SEQ ID NO: 194226 - DNA, 25 bp, Rattus norvegicus
atgctccctacttttttgcttcgaa

SEQ ID NO: 194227 - DNA, 25 bp, Rattus norvegicus
atgctccctcaaccaaaacatgtta

SEQ ID NO: 194228 - DNA, 25 bp, Rattus norvegicus
atgctccctcaagcaaaacatgtta

SEQ ID NO: 194229 - DNA, 25 bp, Rattus norvegicus
atgctccctgccatgatgatatgga

SEQ ID NO: 194230 - DNA, 25 bp, Rattus norvegicus
atgctccctgccttgatgatatgga

SEQ ID NO: 194231 - DNA, 25 bp, Rattus norvegicus
atgctccctgtcacacctgaagata

SEQ ID NO: 194232 - DNA, 25 bp, Rattus norvegicus
atgctccctgtctcacctgaagata

SEQ ID NO: 194233 - DNA, 25 bp, Rattus norvegicus
atgctcccttcgatgttggcatcaa

SEQ ID NO: 194234 - DNA, 25 bp, Rattus norvegicus
atgctcccttcgttgttggcatcaa

SEQ ID NO: 194235 - DNA, 25 bp, Rattus norvegicus
atgctcccttctctgattagtaaat

SEQ ID NO: 194236 - DNA, 25 bp, Rattus norvegicus
atgctcccttctgtgattagtaaat

SEQ ID NO: 194237 - DNA, 25 bp, Rattus norvegicus
atgctccgggcaagtaacagaacaa

SEQ ID NO: 194238 - DNA, 25 bp, Rattus norvegicus
atgctccgggcatgtaacagaacaa

SEQ ID NO: 194239 - DNA, 25 bp, Rattus norvegicus
atgctccggtagatggtcccatggg

SEQ ID NO: 194240 - DNA, 25 bp, Rattus norvegicus
atgctccggtagttggtcccatggg

SEQ ID NO: 194241 - DNA, 25 bp, Rattus norvegicus
atgctccgtgcgagtatgtgggtac

SEQ ID NO: 194242 - DNA, 25 bp, Rattus norvegicus
atgctccgtgcgtgtatgtgggtac

SEQ ID NO: 194243 - DNA, 25 bp, Rattus norvegicus
atgctccgtttgcttcagactgtga

SEQ ID NO: 194244 - DNA, 25 bp, Rattus norvegicus
atgctccgtttggttcagactgtga

SEQ ID NO: 194245 - DNA, 25 bp, Rattus norvegicus
atgctcctaaacctcaagattatct

SEQ ID NO: 194246 - DNA, 25 bp, Rattus norvegicus
atgctcctaaacgtcaagattatct

SEQ ID NO: 194247 - DNA, 25 bp, Rattus norvegicus
atgctcctcatgctggtcatggact

SEQ ID NO: 194248 - DNA, 25 bp, Rattus norvegicus
atgctcctcatggtggtcatggact

SEQ ID NO: 194249 - DNA, 25 bp, Rattus norvegicus
atgctcctcattctcacagctgtgg

SEQ ID NO: 194250 - DNA, 25 bp, Rattus norvegicus
atgctcctcattgtcacagctgtgg

SEQ ID NO: 194251 - DNA, 25 bp, Rattus norvegicus
atgctcctccctctgatgacaatga

SEQ ID NO: 194252 - DNA, 25 bp, Rattus norvegicus
atgctcctccctgtgatgacaatga

SEQ ID NO: 194253 - DNA, 25 bp, Rattus norvegicus
atgctcctcctcagaagctgggagt

SEQ ID NO: 194254 - DNA, 25 bp, Rattus norvegicus
atgctcctcctctgaagctgggagt

SEQ ID NO: 194255 - DNA, 25 bp, Rattus norvegicus
atgctcctctatacagtgcagctag

SEQ ID NO: 194256 - DNA, 25 bp, Rattus norvegicus
atgctcctctattcagtgcagctag

SEQ ID NO: 194257 - DNA, 25 bp, Rattus norvegicus
atgctcctctcgctggtttttgtcg

SEQ ID NO: 194258 - DNA, 25 bp, Rattus norvegicus
atgctcctctcggtggtttttgtcg

SEQ ID NO: 194259 - DNA, 25 bp, Rattus norvegicus
atgctcctcttacttgccaaggaca

SEQ ID NO: 194260 - DNA, 25 bp, Rattus norvegicus
atgctcctcttagttgccaaggaca

SEQ ID NO: 194261 - DNA, 25 bp, Rattus norvegicus
atgctcctcttcatcgtgctggaag

SEQ ID NO: 194262 - DNA, 25 bp, Rattus norvegicus
atgctcctcttcttcgtgctggaag

SEQ ID NO: 194263 - DNA, 25 bp, Rattus norvegicus
atgctcctgcaacccaatggatgct

SEQ ID NO: 194264 - DNA, 25 bp, Rattus norvegicus
atgctcctgcaagccaatggatgct

SEQ ID NO: 194265 - DNA, 25 bp, Rattus norvegicus
atgctcctgtctcacctggtgacaa

SEQ ID NO: 194266 - DNA, 25 bp, Rattus norvegicus
atgctcctgtctgacctggtgacaa

SEQ ID NO: 194267 - DNA, 25 bp, Rattus norvegicus
atgctcctgtgtctggttggcacaa

SEQ ID NO: 194268 - DNA, 25 bp, Rattus norvegicus
atgctcctgtgtgtggttggcacaa

SEQ ID NO: 194269 - DNA, 25 bp, Rattus norvegicus
atgctcctgttaagcctaggtcctc

SEQ ID NO: 194270 - DNA, 25 bp, Rattus norvegicus
atgctcctgttatgcctaggtcctc

SEQ ID NO: 194271 - DNA, 25 bp, Rattus norvegicus
atgctcctgttgcagtagccagctt

SEQ ID NO: 194272 - DNA, 25 bp, Rattus norvegicus
atgctcctgttggagtagccagctt

SEQ ID NO: 194273 - DNA, 25 bp, Rattus norvegicus
atgctccttggtctggccactgtaa

SEQ ID NO: 194274 - DNA, 25 bp, Rattus norvegicus
atgctccttggtgtggccactgtaa

SEQ ID NO: 194275 - DNA, 25 bp, Rattus norvegicus
atgctcgaattgaggctgtggcctc

SEQ ID NO: 194276 - DNA, 25 bp, Rattus norvegicus
atgctcgaattgtggctgtggcctc

SEQ ID NO: 194277 - DNA, 25 bp, Rattus norvegicus
atgctcgactctataaaatggctgt

SEQ ID NO: 194278 - DNA, 25 bp, Rattus norvegicus
atgctcgactctttaaaatggctgt

SEQ ID NO: 194279 - DNA, 25 bp, Rattus norvegicus
atgctcgatgcaatttcgtcctgag

SEQ ID NO: 194280 - DNA, 25 bp, Rattus norvegicus
atgctcgatgcattttcgtcctgag

SEQ ID NO: 194281 - DNA, 25 bp, Rattus norvegicus
atgctcgccatcaaagtccagtgga

SEQ ID NO: 194282 - DNA, 25 bp, Rattus norvegicus
atgctcgccatctaagtccagtgga

SEQ ID NO: 194283 - DNA, 25 bp, Rattus norvegicus
atgctcgccggtcctaaagctgaag

SEQ ID NO: 194284 - DNA, 25 bp, Rattus norvegicus
atgctcgccggtgctaaagctgaag

SEQ ID NO: 194285 - DNA, 25 bp, Rattus norvegicus
atgctcgctgggagacatacttcaa

SEQ ID NO: 194286 - DNA, 25 bp, Rattus norvegicus
atgctcgctgggtgacatacttcaa

SEQ ID NO: 194287 - DNA, 25 bp, Rattus norvegicus
atgctcgctttcatgggagaccatg

SEQ ID NO: 194288 - DNA, 25 bp, Rattus norvegicus
atgctcgctttcttgggagaccatg

SEQ ID NO: 194289 - DNA, 25 bp, Rattus norvegicus
atgctcggagacagccatgtgctat

SEQ ID NO: 194290 - DNA, 25 bp, Rattus norvegicus
atgctcggagactgccatgtgctat

SEQ ID NO: 194291 - DNA, 25 bp, Rattus norvegicus
atgctcggcaaacacaacctctgag

SEQ ID NO: 194292 - DNA, 25 bp, Rattus norvegicus
atgctcggcaaagacaacctctgag

SEQ ID NO: 194293 - DNA, 25 bp, Rattus norvegicus
atgctcggccatctacactgtaaat

SEQ ID NO: 194294 - DNA, 25 bp, Rattus norvegicus
atgctcggccatgtacactgtaaat

SEQ ID NO: 194295 - DNA, 25 bp, Rattus norvegicus
atgctcggcggtccaacatgtcagg

SEQ ID NO: 194296 - DNA, 25 bp, Rattus norvegicus
atgctcggcggtgcaacatgtcagg

SEQ ID NO: 194297 - DNA, 25 bp, Rattus norvegicus
atgctcggctttcgagtcctgcgga

SEQ ID NO: 194298 - DNA, 25 bp, Rattus norvegicus
atgctcggctttggagtcctgcgga

SEQ ID NO: 194299 - DNA, 25 bp, Rattus norvegicus
atgctcgtatacactaatggccctc

SEQ ID NO: 194300 - DNA, 25 bp, Rattus norvegicus
atgctcgtatactctaatggccctc

SEQ ID NO: 194301 - DNA, 25 bp, Rattus norvegicus
atgctcgtcaggaggtgcacattct

SEQ ID NO: 194302 - DNA, 25 bp, Rattus norvegicus
atgctcgtcaggtggtgcacattct

SEQ ID NO: 194303 - DNA, 25 bp, Rattus norvegicus
atgctcgtctatatggaatgcccac

SEQ ID NO: 194304 - DNA, 25 bp, Rattus norvegicus
atgctcgtctatttggaatgcccac

SEQ ID NO: 194305 - DNA, 25 bp, Rattus norvegicus
atgctcgtgctcacgcgatgcactc

SEQ ID NO: 194306 - DNA, 25 bp, Rattus norvegicus
atgctcgtgctctcgcgatgcactc

SEQ ID NO: 194307 - DNA, 25 bp, Rattus norvegicus
atgctcgtgggcctctcctaagact

SEQ ID NO: 194308 - DNA, 25 bp, Rattus norvegicus
atgctcgtgggcgtctcctaagact

SEQ ID NO: 194309 - DNA, 25 bp, Rattus norvegicus
atgctctaaaatagttcactgttga

SEQ ID NO: 194310 - DNA, 25 bp, Rattus norvegicus
atgctctaaaattgttcactgttga

SEQ ID NO: 194311 - DNA, 25 bp, Rattus norvegicus
atgctctaagcaaccttttggtccc

SEQ ID NO: 194312 - DNA, 25 bp, Rattus norvegicus
atgctctaagcatccttttggtccc

SEQ ID NO: 194313 - DNA, 25 bp, Rattus norvegicus
atgctctaccatctcttgaccattt

SEQ ID NO: 194314 - DNA, 25 bp, Rattus norvegicus
atgctctaccatgtcttgaccattt

SEQ ID NO: 194315 - DNA, 25 bp, Rattus norvegicus
atgctctagaagattctgtccagct

SEQ ID NO: 194316 - DNA, 25 bp, Rattus norvegicus
atgctctagaagtttctgtccagct

SEQ ID NO: 194317 - DNA, 25 bp, Rattus norvegicus
atgctctagcccaccctgataatat

SEQ ID NO: 194318 - DNA, 25 bp, Rattus norvegicus
atgctctagccctccctgataatat

SEQ ID NO: 194319 - DNA, 25 bp, Rattus norvegicus
atgctctagcttccacgaaacaaac

SEQ ID NO: 194320 - DNA, 25 bp, Rattus norvegicus
atgctctagcttgcacgaaacaaac

SEQ ID NO: 194321 - DNA, 25 bp, Rattus norvegicus
atgctctattctatcttcatgccag

SEQ ID NO: 194322 - DNA, 25 bp, Rattus norvegicus
atgctctattctttcttcatgccag

SEQ ID NO: 194323 - DNA, 25 bp, Rattus norvegicus
atgctctcactaacttcttcctact

SEQ ID NO: 194324 - DNA, 25 bp, Rattus norvegicus
atgctctcactatcttcttcctact

SEQ ID NO: 194325 - DNA, 25 bp, Rattus norvegicus
atgctctcattgattcaactcgtgt

SEQ ID NO: 194326 - DNA, 25 bp, Rattus norvegicus
atgctctcattgtttcaactcgtgt

SEQ ID NO: 194327 - DNA, 25 bp, Rattus norvegicus
atgctctcccagatcagcttgtaga

SEQ ID NO: 194328 - DNA, 25 bp, Rattus norvegicus
atgctctcccagttcagcttgtaga

SEQ ID NO: 194329 - DNA, 25 bp, Rattus norvegicus
atgctctcccatcatatctccatgg

SEQ ID NO: 194330 - DNA, 25 bp, Rattus norvegicus
atgctctcccatcgtcttagatgtt

SEQ ID NO: 194331 - DNA, 25 bp, Rattus norvegicus
atgctctcccatgatatctccatgg

SEQ ID NO: 194332 - DNA, 25 bp, Rattus norvegicus
atgctctcccatggtcttagatgtt

SEQ ID NO: 194333 - DNA, 25 bp, Rattus norvegicus
atgctctccctgctggccataatgg

SEQ ID NO: 194334 - DNA, 25 bp, Rattus norvegicus
atgctctccctggtggccataatgg

SEQ ID NO: 194335 - DNA, 25 bp, Rattus norvegicus
atgctctctagccaagtctaacttt

SEQ ID NO: 194336 - DNA, 25 bp, Rattus norvegicus
atgctctctagcgaagtctaacttt

SEQ ID NO: 194337 - DNA, 25 bp, Rattus norvegicus
atgctctctataaatcctgtaaaaa

SEQ ID NO: 194338 - DNA, 25 bp, Rattus norvegicus
atgctctctatatatcctgtaaaaa

SEQ ID NO: 194339 - DNA, 25 bp, Rattus norvegicus
atgctctctgcaatgaagtgcaccc

SEQ ID NO: 194340 - DNA, 25 bp, Rattus norvegicus
atgctctctgcattgaagtgcaccc

SEQ ID NO: 194341 - DNA, 25 bp, Rattus norvegicus
atgctctctgtaaactctcgatggc

SEQ ID NO: 194342 - DNA, 25 bp, Rattus norvegicus
atgctctctgtatactctcgatggc

SEQ ID NO: 194343 - DNA, 25 bp, Rattus norvegicus
atgctctctgtcatgatcattttaa

SEQ ID NO: 194344 - DNA, 25 bp, Rattus norvegicus
atgctctctgtcttgatcattttaa

SEQ ID NO: 194345 - DNA, 25 bp, Rattus norvegicus
atgctctcttctaatggatacctgc

SEQ ID NO: 194346 - DNA, 25 bp, Rattus norvegicus
atgctctcttcttatggatacctgc

SEQ ID NO: 194347 - DNA, 25 bp, Rattus norvegicus
atgctctcttggatttcttgtggcc

SEQ ID NO: 194348 - DNA, 25 bp, Rattus norvegicus
atgctctcttggttttcttgtggcc

SEQ ID NO: 194349 - DNA, 25 bp, Rattus norvegicus
atgctctgagaaagactgtgggaac

SEQ ID NO: 194350 - DNA, 25 bp, Rattus norvegicus
atgctctgagaatgactgtgggaac

SEQ ID NO: 194351 - DNA, 25 bp, Rattus norvegicus
atgctctgagttctacagtgtctta

SEQ ID NO: 194352 - DNA, 25 bp, Rattus norvegicus
atgctctgagttgtacagtgtctta

SEQ ID NO: 194353 - DNA, 25 bp, Rattus norvegicus
atgctctgccttactgggtaattat

SEQ ID NO: 194354 - DNA, 25 bp, Rattus norvegicus
atgctctgcctttctgggtaattat

SEQ ID NO: 194355 - DNA, 25 bp, Rattus norvegicus
atgctctgcggtccaggtcactaaa

SEQ ID NO: 194356 - DNA, 25 bp, Rattus norvegicus
atgctctgcggtgcaggtcactaaa

SEQ ID NO: 194357 - DNA, 25 bp, Rattus norvegicus
atgctctggagtcatacaccgccat

SEQ ID NO: 194358 - DNA, 25 bp, Rattus norvegicus
atgctctggagtgatacaccgccat

SEQ ID NO: 194359 - DNA, 25 bp, Rattus norvegicus
atgctctggcgcagaaacatgccaa

SEQ ID NO: 194360 - DNA, 25 bp, Rattus norvegicus
atgctctggcgctgaaacatgccaa

SEQ ID NO: 194361 - DNA, 25 bp, Rattus norvegicus
atgctctggctcctgagtgtacaga

SEQ ID NO: 194362 - DNA, 25 bp, Rattus norvegicus
atgctctggctcgtgagtgtacaga

SEQ ID NO: 194363 - DNA, 25 bp, Rattus norvegicus
atgctctggtcgagctgcgccagct

SEQ ID NO: 194364 - DNA, 25 bp, Rattus norvegicus
atgctctggtcgtgctgcgccagct

SEQ ID NO: 194365 - DNA, 25 bp, Rattus norvegicus
atgctctgtcgcagtatgtactgta

SEQ ID NO: 194366 - DNA, 25 bp, Rattus norvegicus
atgctctgtcgctgtatgtactgta

SEQ ID NO: 194367 - DNA, 25 bp, Rattus norvegicus
atgctctgtgaaatccttactctgc

SEQ ID NO: 194368 - DNA, 25 bp, Rattus norvegicus
atgctctgtgaattccttactctgc

SEQ ID NO: 194369 - DNA, 25 bp, Rattus norvegicus
atgctctgtgggatatcttggtctc

SEQ ID NO: 194370 - DNA, 25 bp, Rattus norvegicus
atgctctgtgggttatcttggtctc

SEQ ID NO: 194371 - DNA, 25 bp, Rattus norvegicus
atgctctgttgtagccctatgtggt

SEQ ID NO: 194372 - DNA, 25 bp, Rattus norvegicus
atgctctgttgttgccctatgtggt

SEQ ID NO: 194373 - DNA, 25 bp, Rattus norvegicus
atgctcttaataattatatcggcaa

SEQ ID NO: 194374 - DNA, 25 bp, Rattus norvegicus
atgctcttaatatttatatcggcaa

SEQ ID NO: 194375 - DNA, 25 bp, Rattus norvegicus
atgctcttacacagagatgcggctc

SEQ ID NO: 194376 - DNA, 25 bp, Rattus norvegicus
atgctcttacactgagatgcggctc

SEQ ID NO: 194377 - DNA, 25 bp, Rattus norvegicus
atgctcttagggactgggctttggt

SEQ ID NO: 194378 - DNA, 25 bp, Rattus norvegicus
atgctcttagggtctgggctttggt

SEQ ID NO: 194379 - DNA, 25 bp, Rattus norvegicus
atgctcttaggtccattttttcatg

SEQ ID NO: 194380 - DNA, 25 bp, Rattus norvegicus
atgctcttaggtgcattttttcatg

SEQ ID NO: 194381 - DNA, 25 bp, Rattus norvegicus
atgctcttcactacctttgtggagc

SEQ ID NO: 194382 - DNA, 25 bp, Rattus norvegicus
atgctcttcacttcctttgtggagc

SEQ ID NO: 194383 - DNA, 25 bp, Rattus norvegicus
atgctcttcctgctctatctgcatt

SEQ ID NO: 194384 - DNA, 25 bp, Rattus norvegicus
atgctcttcctggtctatctgcatt

SEQ ID NO: 194385 - DNA, 25 bp, Rattus norvegicus
atgctcttcgatctggagtcagctt

SEQ ID NO: 194386 - DNA, 25 bp, Rattus norvegicus
atgctcttcgatgtggagtcagctt

SEQ ID NO: 194387 - DNA, 25 bp, Rattus norvegicus
atgctcttctgaccttagcaggagt

SEQ ID NO: 194388 - DNA, 25 bp, Rattus norvegicus
atgctcttctgagcttagcaggagt

SEQ ID NO: 194389 - DNA, 25 bp, Rattus norvegicus
atgctcttctgcctgacacaaacaa

SEQ ID NO: 194390 - DNA, 25 bp, Rattus norvegicus
atgctcttctgcgtgacacaaacaa

SEQ ID NO: 194391 - DNA, 25 bp, Rattus norvegicus
atgctcttctggatcctcttgctga

SEQ ID NO: 194392 - DNA, 25 bp, Rattus norvegicus
atgctcttctggttcctcttgctga

SEQ ID NO: 194393 - DNA, 25 bp, Rattus norvegicus
atgctcttcttcatcacttagcagc

SEQ ID NO: 194394 - DNA, 25 bp, Rattus norvegicus
atgctcttcttcttcacttagcagc

SEQ ID NO: 194395 - DNA, 25 bp, Rattus norvegicus
atgctcttcttgaccacatttgcag

SEQ ID NO: 194396 - DNA, 25 bp, Rattus norvegicus
atgctcttcttgtccacatttgcag

SEQ ID NO: 194397 - DNA, 25 bp, Rattus norvegicus
atgctcttgaacaccaagcctgttt

SEQ ID NO: 194398 - DNA, 25 bp, Rattus norvegicus
atgctcttgaactccaagcctgttt

SEQ ID NO: 194399 - DNA, 25 bp, Rattus norvegicus
atgctcttgggcatccacatgatga

SEQ ID NO: 194400 - DNA, 25 bp, Rattus norvegicus
atgctcttgggcttccacatgatga

SEQ ID NO: 194401 - DNA, 25 bp, Rattus norvegicus
atgctcttggttcactgctcgttgg

SEQ ID NO: 194402 - DNA, 25 bp, Rattus norvegicus
atgctcttggttgactgctcgttgg

SEQ ID NO: 194403 - DNA, 25 bp, Rattus norvegicus
atgctcttgtccatgtcgagtctca

SEQ ID NO: 194404 - DNA, 25 bp, Rattus norvegicus
atgctcttgtccttgtcgagtctca

SEQ ID NO: 194405 - DNA, 25 bp, Rattus norvegicus
atgctcttgttcatgtttccatcac

SEQ ID NO: 194406 - DNA, 25 bp, Rattus norvegicus
atgctcttgttcttgtttccatcac

SEQ ID NO: 194407 - DNA, 25 bp, Rattus norvegicus
atgctctttccaaagtctgttcctt

SEQ ID NO: 194408 - DNA, 25 bp, Rattus norvegicus
atgctctttccatagtctgttcctt

SEQ ID NO: 194409 - DNA, 25 bp, Rattus norvegicus
atgctctttggcaatgggacagtgc

SEQ ID NO: 194410 - DNA, 25 bp, Rattus norvegicus
atgctctttggctatgggacagtgc

SEQ ID NO: 194411 - DNA, 25 bp, Rattus norvegicus
atgctctttgggatgatgccgaaga

SEQ ID NO: 194412 - DNA, 25 bp, Rattus norvegicus
atgctctttgggttgatgccgaaga

SEQ ID NO: 194413 - DNA, 25 bp, Rattus norvegicus
atgctctttgtacaaatgtcaccat

SEQ ID NO: 194414 - DNA, 25 bp, Rattus norvegicus
atgctctttgtagaaatgtcaccat

SEQ ID NO: 194415 - DNA, 25 bp, Rattus norvegicus
atgctgaaaaacctctctcggattc

SEQ ID NO: 194416 - DNA, 25 bp, Rattus norvegicus
atgctgaaaaacgtctctcggattc

SEQ ID NO: 194417 - DNA, 25 bp, Rattus norvegicus
atgctgaaagccatgacccatcgta

SEQ ID NO: 194418 - DNA, 25 bp, Rattus norvegicus
atgctgaaagccttgacccatcgta

SEQ ID NO: 194419 - DNA, 25 bp, Rattus norvegicus
atgctgaaattgactggctctctta

SEQ ID NO: 194420 - DNA, 25 bp, Rattus norvegicus
atgctgaaattgtctggctctctta

SEQ ID NO: 194421 - DNA, 25 bp, Rattus norvegicus
atgctgaagaacacggacgccatca

SEQ ID NO: 194422 - DNA, 25 bp, Rattus norvegicus
atgctgaagaactcggacgccatca

SEQ ID NO: 194423 - DNA, 25 bp, Rattus norvegicus
atgctgaagatgacgctcctactaa

SEQ ID NO: 194424 - DNA, 25 bp, Rattus norvegicus
atgctgaagatgtcgctcctactaa

SEQ ID NO: 194425 - DNA, 25 bp, Rattus norvegicus
atgctgaagcccatccccaggaaga

SEQ ID NO: 194426 - DNA, 25 bp, Rattus norvegicus
atgctgaagcccttccccaggaaga

SEQ ID NO: 194427 - DNA, 25 bp, Rattus norvegicus
atgctgaaggcaacccactggaaag

SEQ ID NO: 194428 - DNA, 25 bp, Rattus norvegicus
atgctgaaggcatcccactggaaag

SEQ ID NO: 194429 - DNA, 25 bp, Rattus norvegicus
atgctgaatcctaccatgttctaag

SEQ ID NO: 194430 - DNA, 25 bp, Rattus norvegicus
atgctgaatccttccatgttctaag

SEQ ID NO: 194431 - DNA, 25 bp, Rattus norvegicus
atgctgaatgcacgtgacactgact

SEQ ID NO: 194432 - DNA, 25 bp, Rattus norvegicus
atgctgaatgcaggtgacactgact

SEQ ID NO: 194433 - DNA, 25 bp, Rattus norvegicus
atgctgaattctcctcagcccaaga

SEQ ID NO: 194434 - DNA, 25 bp, Rattus norvegicus
atgctgaattctgctcagcccaaga

SEQ ID NO: 194435 - DNA, 25 bp, Rattus norvegicus
atgctgacaactccctacacaatat

SEQ ID NO: 194436 - DNA, 25 bp, Rattus norvegicus
atgctgacaactgcctacacaatat

SEQ ID NO: 194437 - DNA, 25 bp, Rattus norvegicus
atgctgacactgacaccggtgatga

SEQ ID NO: 194438 - DNA, 25 bp, Rattus norvegicus
atgctgacactgtcaccggtgatga

SEQ ID NO: 194439 - DNA, 25 bp, Rattus norvegicus
atgctgacagatcctctcatggccc

SEQ ID NO: 194440 - DNA, 25 bp, Rattus norvegicus
atgctgacagatgctctcatggccc

SEQ ID NO: 194441 - DNA, 25 bp, Rattus norvegicus
atgctgaccaagatctggtgctcaa

SEQ ID NO: 194442 - DNA, 25 bp, Rattus norvegicus
atgctgaccaagttctggtgctcaa

SEQ ID NO: 194443 - DNA, 25 bp, Rattus norvegicus
atgctgacccagatgtaactcactt

SEQ ID NO: 194444 - DNA, 25 bp, Rattus norvegicus
atgctgacccagttgtaactcactt

SEQ ID NO: 194445 - DNA, 25 bp, Rattus norvegicus
atgctgacccctccagctggtggga

SEQ ID NO: 194446 - DNA, 25 bp, Rattus norvegicus
atgctgacccctgcagctggtggga

SEQ ID NO: 194447 - DNA, 25 bp, Rattus norvegicus
atgctgacccggcttgttcggttgt

SEQ ID NO: 194448 - DNA, 25 bp, Rattus norvegicus
atgctgacccgggttgttcggttgt

SEQ ID NO: 194449 - DNA, 25 bp, Rattus norvegicus
atgctgaccggcctgacagatggct

SEQ ID NO: 194450 - DNA, 25 bp, Rattus norvegicus
atgctgaccggcgtgacagatggct

SEQ ID NO: 194451 - DNA, 25 bp, Rattus norvegicus
atgctgaccgtcacatgtggagtat

SEQ ID NO: 194452 - DNA, 25 bp, Rattus norvegicus
atgctgaccgtctcatgtggagtat

SEQ ID NO: 194453 - DNA, 25 bp, Rattus norvegicus
atgctgacctggaagccatttcatc

SEQ ID NO: 194454 - DNA, 25 bp, Rattus norvegicus
atgctgacctggtagccatttcatc

SEQ ID NO: 194455 - DNA, 25 bp, Rattus norvegicus
atgctgacgaagactgcagtgcctc

SEQ ID NO: 194456 - DNA, 25 bp, Rattus norvegicus
atgctgacgaagtctgcagtgcctc

SEQ ID NO: 194457 - DNA, 25 bp, Rattus norvegicus
atgctgacgttcatgcttttggcgc

SEQ ID NO: 194458 - DNA, 25 bp, Rattus norvegicus
atgctgacgttcttgcttttggcgc

SEQ ID NO: 194459 - DNA, 25 bp, Rattus norvegicus
atgctgactaaaaagctcctcactt

SEQ ID NO: 194460 - DNA, 25 bp, Rattus norvegicus
atgctgactaaatagctcctcactt

SEQ ID NO: 194461 - DNA, 25 bp, Rattus norvegicus
atgctgactcagatagaaatggctc

SEQ ID NO: 194462 - DNA, 25 bp, Rattus norvegicus
atgctgactcagttagaaatggctc

SEQ ID NO: 194463 - DNA, 25 bp, Rattus norvegicus
atgctgactggcaggtcatcactct

SEQ ID NO: 194464 - DNA, 25 bp, Rattus norvegicus
atgctgactggctggtcatcactct

SEQ ID NO: 194465 - DNA, 25 bp, Rattus norvegicus
atgctgagaagccagatcctcgcag

SEQ ID NO: 194466 - DNA, 25 bp, Rattus norvegicus
atgctgagaagcgagatcctcgcag

SEQ ID NO: 194467 - DNA, 25 bp, Rattus norvegicus
atgctgagagctccctgtctggcat

SEQ ID NO: 194468 - DNA, 25 bp, Rattus norvegicus
atgctgagagctgcctgtctggcat

SEQ ID NO: 194469 - DNA, 25 bp, Rattus norvegicus
atgctgagaggaagcttcgtattct

SEQ ID NO: 194470 - DNA, 25 bp, Rattus norvegicus
atgctgagaggatgcttcgtattct

SEQ ID NO: 194471 - DNA, 25 bp, Rattus norvegicus
atgctgagagttcctcttggcttca

SEQ ID NO: 194472 - DNA, 25 bp, Rattus norvegicus
atgctgagagttgctcttggcttca

SEQ ID NO: 194473 - DNA, 25 bp, Rattus norvegicus
atgctgagcatgatttgaactgtaa

SEQ ID NO: 194474 - DNA, 25 bp, Rattus norvegicus
atgctgagcatgttttgaactgtaa

SEQ ID NO: 194475 - DNA, 25 bp, Rattus norvegicus
atgctgagccttacgtggattcact

SEQ ID NO: 194476 - DNA, 25 bp, Rattus norvegicus
atgctgagcctttcgtggattcact

SEQ ID NO: 194477 - DNA, 25 bp, Rattus norvegicus
atgctgagctccctgcagaggtgaa

SEQ ID NO: 194478 - DNA, 25 bp, Rattus norvegicus
atgctgagctccgtgcagaggtgaa

SEQ ID NO: 194479 - DNA, 25 bp, Rattus norvegicus
atgctgaggcagctgagatcgccct

SEQ ID NO: 194480 - DNA, 25 bp, Rattus norvegicus
atgctgaggcaggtgagatcgccct

SEQ ID NO: 194481 - DNA, 25 bp, Rattus norvegicus
atgctgaggccgataaagggttaag

SEQ ID NO: 194482 - DNA, 25 bp, Rattus norvegicus
atgctgaggccgttaaagggttaag

SEQ ID NO: 194483 - DNA, 25 bp, Rattus norvegicus
atgctgaggcgcagttgcggctcac

SEQ ID NO: 194484 - DNA, 25 bp, Rattus norvegicus
atgctgaggcgctgttgcggctcac

SEQ ID NO: 194485 - DNA, 25 bp, Rattus norvegicus
atgctgagggtaccccatttttaaa

SEQ ID NO: 194486 - DNA, 25 bp, Rattus norvegicus
atgctgagggtagcccatttttaaa

SEQ ID NO: 194487 - DNA, 25 bp, Rattus norvegicus
atgctgagtagaatcctgccaagga

SEQ ID NO: 194488 - DNA, 25 bp, Rattus norvegicus
atgctgagtagattcctgccaagga

SEQ ID NO: 194489 - DNA, 25 bp, Rattus norvegicus
atgctgagtagtacaggctgcccca

SEQ ID NO: 194490 - DNA, 25 bp, Rattus norvegicus
atgctgagtagttcaggctgcccca

SEQ ID NO: 194491 - DNA, 25 bp, Rattus norvegicus
atgctgagtggccagtacccagtga

SEQ ID NO: 194492 - DNA, 25 bp, Rattus norvegicus
atgctgagtggcgagtacccagtga

SEQ ID NO: 194493 - DNA, 25 bp, Rattus norvegicus
atgctgagtgtgcatcctctaccca

SEQ ID NO: 194494 - DNA, 25 bp, Rattus norvegicus
atgctgagtgtggatcctctaccca

SEQ ID NO: 194495 - DNA, 25 bp, Rattus norvegicus
atgctgatcatcacgcgcaggtccc

SEQ ID NO: 194496 - DNA, 25 bp, Rattus norvegicus
atgctgatcatctcgcgcaggtccc

SEQ ID NO: 194497 - DNA, 25 bp, Rattus norvegicus
atgctgatcctcacagcactgaaag

SEQ ID NO: 194498 - DNA, 25 bp, Rattus norvegicus
atgctgatcctctcagcactgaaag

SEQ ID NO: 194499 - DNA, 25 bp, Rattus norvegicus
atgctgatcgctagcacaggtagat

SEQ ID NO: 194500 - DNA, 25 bp, Rattus norvegicus
atgctgatcgcttgcacaggtagat

SEQ ID NO: 194501 - DNA, 25 bp, Rattus norvegicus
atgctgatctcaagtctgttgcaca

SEQ ID NO: 194502 - DNA, 25 bp, Rattus norvegicus
atgctgatctcatgtctgttgcaca

SEQ ID NO: 194503 - DNA, 25 bp, Rattus norvegicus
atgctgatctctctatatgccctga

SEQ ID NO: 194504 - DNA, 25 bp, Rattus norvegicus
atgctgatctctgtatatgccctga

SEQ ID NO: 194505 - DNA, 25 bp, Rattus norvegicus
atgctgatgaggattgccacgttcc

SEQ ID NO: 194506 - DNA, 25 bp, Rattus norvegicus
atgctgatgaggtttgccacgttcc

SEQ ID NO: 194507 - DNA, 25 bp, Rattus norvegicus
atgctgatgatgacttctctccatg

SEQ ID NO: 194508 - DNA, 25 bp, Rattus norvegicus
atgctgatgatgagggtctcgttct

SEQ ID NO: 194509 - DNA, 25 bp, Rattus norvegicus
atgctgatgatgtcttctctccatg

SEQ ID NO: 194510 - DNA, 25 bp, Rattus norvegicus
atgctgatgatgtgggtctcgttct

SEQ ID NO: 194511 - DNA, 25 bp, Rattus norvegicus
atgctgatgcccatggtctgtacta

SEQ ID NO: 194512 - DNA, 25 bp, Rattus norvegicus
atgctgatgcccttggtctgtacta

SEQ ID NO: 194513 - DNA, 25 bp, Rattus norvegicus
atgctgatgcttaccagtaagccat

SEQ ID NO: 194514 - DNA, 25 bp, Rattus norvegicus
atgctgatgctttccagtaagccat

SEQ ID NO: 194515 - DNA, 25 bp, Rattus norvegicus
atgctgatgtgaccttccttgatga

SEQ ID NO: 194516 - DNA, 25 bp, Rattus norvegicus
atgctgatgtgagcttccttgatga

SEQ ID NO: 194517 - DNA, 25 bp, Rattus norvegicus
atgctgatgttcctggtcaaagttt

SEQ ID NO: 194518 - DNA, 25 bp, Rattus norvegicus
atgctgatgttcgtggtcaaagttt

SEQ ID NO: 194519 - DNA, 25 bp, Rattus norvegicus
atgctgattggcaagagtcttctta

SEQ ID NO: 194520 - DNA, 25 bp, Rattus norvegicus
atgctgattggctagagtcttctta

SEQ ID NO: 194521 - DNA, 25 bp, Rattus norvegicus
atgctgcacatcaaggttgttctga

SEQ ID NO: 194522 - DNA, 25 bp, Rattus norvegicus
atgctgcacatctaggttgttctga

SEQ ID NO: 194523 - DNA, 25 bp, Rattus norvegicus
atgctgcaccagctcgtgtgggact

SEQ ID NO: 194524 - DNA, 25 bp, Rattus norvegicus
atgctgcaccaggtcgtgtgggact

SEQ ID NO: 194525 - DNA, 25 bp, Rattus norvegicus
atgctgcacctgattcagttatttt

SEQ ID NO: 194526 - DNA, 25 bp, Rattus norvegicus
atgctgcacctgtttcagttatttt

SEQ ID NO: 194527 - DNA, 25 bp, Rattus norvegicus
atgctgcactggaagcccgcggagc

SEQ ID NO: 194528 - DNA, 25 bp, Rattus norvegicus
atgctgcactggctttctcttttcc

SEQ ID NO: 194529 - DNA, 25 bp, Rattus norvegicus
atgctgcactgggtttctcttttcc

SEQ ID NO: 194530 - DNA, 25 bp, Rattus norvegicus
atgctgcactggtagcccgcggagc

SEQ ID NO: 194531 - DNA, 25 bp, Rattus norvegicus
atgctgcagatgatttcacaaccca

SEQ ID NO: 194532 - DNA, 25 bp, Rattus norvegicus
atgctgcagatgttttcacaaccca

SEQ ID NO: 194533 - DNA, 25 bp, Rattus norvegicus
atgctgcagcatagaggaccttgag

SEQ ID NO: 194534 - DNA, 25 bp, Rattus norvegicus
atgctgcagcattgaggaccttgag

SEQ ID NO: 194535 - DNA, 25 bp, Rattus norvegicus
atgctgcagcgccagcccagggtaa

SEQ ID NO: 194536 - DNA, 25 bp, Rattus norvegicus
atgctgcagcgcgagcccagggtaa

SEQ ID NO: 194537 - DNA, 25 bp, Rattus norvegicus
atgctgcagctcatgtctatctgta

SEQ ID NO: 194538 - DNA, 25 bp, Rattus norvegicus
atgctgcagctcttgtctatctgta

SEQ ID NO: 194539 - DNA, 25 bp, Rattus norvegicus
atgctgcagcttcccttacagtcaa

SEQ ID NO: 194540 - DNA, 25 bp, Rattus norvegicus
atgctgcagcttgccttacagtcaa

SEQ ID NO: 194541 - DNA, 25 bp, Rattus norvegicus
atgctgcagggaccatgggtccttc

SEQ ID NO: 194542 - DNA, 25 bp, Rattus norvegicus
atgctgcagggagcatgggtccttc

SEQ ID NO: 194543 - DNA, 25 bp, Rattus norvegicus
atgctgcataacagacctcacgggt

SEQ ID NO: 194544 - DNA, 25 bp, Rattus norvegicus
atgctgcataactgacctcacgggt

SEQ ID NO: 194545 - DNA, 25 bp, Rattus norvegicus
atgctgcatgttatggaagacctca

SEQ ID NO: 194546 - DNA, 25 bp, Rattus norvegicus
atgctgcatgttttggaagacctca

SEQ ID NO: 194547 - DNA, 25 bp, Rattus norvegicus
atgctgcatttaacattctgcccca

SEQ ID NO: 194548 - DNA, 25 bp, Rattus norvegicus
atgctgcatttatcattctgcccca

SEQ ID NO: 194549 - DNA, 25 bp, Rattus norvegicus
atgctgccaactactaaccacaata

SEQ ID NO: 194550 - DNA, 25 bp, Rattus norvegicus
atgctgccaacttctaaccacaata

SEQ ID NO: 194551 - DNA, 25 bp, Rattus norvegicus
atgctgccaaggctccgtgtatcta

SEQ ID NO: 194552 - DNA, 25 bp, Rattus norvegicus
atgctgccaagggtccgtgtatcta

SEQ ID NO: 194553 - DNA, 25 bp, Rattus norvegicus
atgctgccacagctaaggacctggg

SEQ ID NO: 194554 - DNA, 25 bp, Rattus norvegicus
atgctgccacaggtaaggacctggg

SEQ ID NO: 194555 - DNA, 25 bp, Rattus norvegicus
atgctgccacgtaggaggttaccca

SEQ ID NO: 194556 - DNA, 25 bp, Rattus norvegicus
atgctgccacgttggaggttaccca

SEQ ID NO: 194557 - DNA, 25 bp, Rattus norvegicus
atgctgccagagaaggtgacgcgct

SEQ ID NO: 194558 - DNA, 25 bp, Rattus norvegicus
atgctgccagagtaggtgacgcgct

SEQ ID NO: 194559 - DNA, 25 bp, Rattus norvegicus
atgctgccagcccattcggagcaag

SEQ ID NO: 194560 - DNA, 25 bp, Rattus norvegicus
atgctgccagccgattcggagcaag

SEQ ID NO: 194561 - DNA, 25 bp, Rattus norvegicus
atgctgccaggtaatttgtatttct

SEQ ID NO: 194562 - DNA, 25 bp, Rattus norvegicus
atgctgccaggttatttgtatttct

SEQ ID NO: 194563 - DNA, 25 bp, Rattus norvegicus
atgctgccagtaacaacttcatgac

SEQ ID NO: 194564 - DNA, 25 bp, Rattus norvegicus
atgctgccagtatcaacttcatgac

SEQ ID NO: 194565 - DNA, 25 bp, Rattus norvegicus
atgctgccatgacgtggctgtacct

SEQ ID NO: 194566 - DNA, 25 bp, Rattus norvegicus
atgctgccatgaggtggctgtacct

SEQ ID NO: 194567 - DNA, 25 bp, Rattus norvegicus
atgctgccatgtaacttgctttgat

SEQ ID NO: 194568 - DNA, 25 bp, Rattus norvegicus
atgctgccatgttacttgctttgat

SEQ ID NO: 194569 - DNA, 25 bp, Rattus norvegicus
atgctgcccaagaccggctgcgtga

SEQ ID NO: 194570 - DNA, 25 bp, Rattus norvegicus
atgctgcccaagtccggctgcgtga

SEQ ID NO: 194571 - DNA, 25 bp, Rattus norvegicus
atgctgcccactctggttggtgacc

SEQ ID NO: 194572 - DNA, 25 bp, Rattus norvegicus
atgctgcccactgtggttggtgacc

SEQ ID NO: 194573 - DNA, 25 bp, Rattus norvegicus
atgctgccccagatcacattgcaaa

SEQ ID NO: 194574 - DNA, 25 bp, Rattus norvegicus
atgctgccccagttcacattgcaaa

SEQ ID NO: 194575 - DNA, 25 bp, Rattus norvegicus
atgctgccctcgctttgggacccaa

SEQ ID NO: 194576 - DNA, 25 bp, Rattus norvegicus
atgctgccctcggtttgggacccaa

SEQ ID NO: 194577 - DNA, 25 bp, Rattus norvegicus
atgctgccctgcagtgagtgctgag

SEQ ID NO: 194578 - DNA, 25 bp, Rattus norvegicus
atgctgccctgctgtgagtgctgag

SEQ ID NO: 194579 - DNA, 25 bp, Rattus norvegicus
atgctgcccttactgattcttgcct

SEQ ID NO: 194580 - DNA, 25 bp, Rattus norvegicus
atgctgcccttagtgattcttgcct

SEQ ID NO: 194581 - DNA, 25 bp, Rattus norvegicus
atgctgccgcataaattatccataa

SEQ ID NO: 194582 - DNA, 25 bp, Rattus norvegicus
atgctgccgcattaattatccataa

SEQ ID NO: 194583 - DNA, 25 bp, Rattus norvegicus
atgctgcctcctcagcaaagacaga

SEQ ID NO: 194584 - DNA, 25 bp, Rattus norvegicus
atgctgcctcctgagcaaagacaga

SEQ ID NO: 194585 - DNA, 25 bp, Rattus norvegicus
atgctgcctggcacattgtaggtgt

SEQ ID NO: 194586 - DNA, 25 bp, Rattus norvegicus
atgctgcctggctcattgtaggtgt

SEQ ID NO: 194587 - DNA, 25 bp, Rattus norvegicus
atgctgccttctatcaacacagaat

SEQ ID NO: 194588 - DNA, 25 bp, Rattus norvegicus
atgctgccttctttcaacacagaat

SEQ ID NO: 194589 - DNA, 25 bp, Rattus norvegicus
atgctgcctttccaagctgggcaca

SEQ ID NO: 194590 - DNA, 25 bp, Rattus norvegicus
atgctgcctttcgaagctgggcaca

SEQ ID NO: 194591 - DNA, 25 bp, Rattus norvegicus
atgctgctattcacagtagtctggg

SEQ ID NO: 194592 - DNA, 25 bp, Rattus norvegicus
atgctgctattctcagtagtctggg

SEQ ID NO: 194593 - DNA, 25 bp, Rattus norvegicus
atgctgctattgcttcatcttcaac

SEQ ID NO: 194594 - DNA, 25 bp, Rattus norvegicus
atgctgctattggttcatcttcaac

SEQ ID NO: 194595 - DNA, 25 bp, Rattus norvegicus
atgctgctcaggaagtgcgtaggct

SEQ ID NO: 194596 - DNA, 25 bp, Rattus norvegicus
atgctgctcaggtagtgcgtaggct

SEQ ID NO: 194597 - DNA, 25 bp, Rattus norvegicus
atgctgctctccagtttgtggcatt

SEQ ID NO: 194598 - DNA, 25 bp, Rattus norvegicus
atgctgctctcctgtttgtggcatt

SEQ ID NO: 194599 - DNA, 25 bp, Rattus norvegicus
atgctgctctttacccagagataga

SEQ ID NO: 194600 - DNA, 25 bp, Rattus norvegicus
atgctgctcttttcccagagataga

SEQ ID NO: 194601 - DNA, 25 bp, Rattus norvegicus
atgctgctgagcaccgtcaagtgtg

SEQ ID NO: 194602 - DNA, 25 bp, Rattus norvegicus
atgctgctgagctccgtcaagtgtg

SEQ ID NO: 194603 - DNA, 25 bp, Rattus norvegicus
atgctgctgcagaatgccgtgaagt

SEQ ID NO: 194604 - DNA, 25 bp, Rattus norvegicus
atgctgctgcagtatgccgtgaagt

SEQ ID NO: 194605 - DNA, 25 bp, Rattus norvegicus
atgctgctgccacaagatggacctg

SEQ ID NO: 194606 - DNA, 25 bp, Rattus norvegicus
atgctgctgccagaagatggacctg

SEQ ID NO: 194607 - DNA, 25 bp, Rattus norvegicus
atgctgctgcctccgagttttcgga

SEQ ID NO: 194608 - DNA, 25 bp, Rattus norvegicus
atgctgctgcctgcgagttttcgga

SEQ ID NO: 194609 - DNA, 25 bp, Rattus norvegicus
atgctgctgcgtccagcctctgaag

SEQ ID NO: 194610 - DNA, 25 bp, Rattus norvegicus
atgctgctgcgtgcagcctctgaag

SEQ ID NO: 194611 - DNA, 25 bp, Rattus norvegicus
atgctgctgctcattgaccacatgg

SEQ ID NO: 194612 - DNA, 25 bp, Rattus norvegicus
atgctgctgctcctcattaacaaac

SEQ ID NO: 194613 - DNA, 25 bp, Rattus norvegicus
atgctgctgctcgtcattaacaaac

SEQ ID NO: 194614 - DNA, 25 bp, Rattus norvegicus
atgctgctgctctttgaccacatgg

SEQ ID NO: 194615 - DNA, 25 bp, Rattus norvegicus
atgctgctgctgctatgtgtggccc

SEQ ID NO: 194616 - DNA, 25 bp, Rattus norvegicus
atgctgctgctggtatgtgtggccc

SEQ ID NO: 194617 - DNA, 25 bp, Rattus norvegicus
atgctgctgcttcatggatttccag

SEQ ID NO: 194618 - DNA, 25 bp, Rattus norvegicus
atgctgctgcttgatggatttccag

SEQ ID NO: 194619 - DNA, 25 bp, Rattus norvegicus
atgctgctgggcaaactggctgtga

SEQ ID NO: 194620 - DNA, 25 bp, Rattus norvegicus
atgctgctgggctaactggctgtga

SEQ ID NO: 194621 - DNA, 25 bp, Rattus norvegicus
atgctgctgtctaattaaacttcac

SEQ ID NO: 194622 - DNA, 25 bp, Rattus norvegicus
atgctgctgtcttattaaacttcac

SEQ ID NO: 194623 - DNA, 25 bp, Rattus norvegicus
atgctgctgtggagaaactgaggaa

SEQ ID NO: 194624 - DNA, 25 bp, Rattus norvegicus
atgctgctgtggtgaaactgaggaa

SEQ ID NO: 194625 - DNA, 25 bp, Rattus norvegicus
atgctgcttataacgtgctcctgaa

SEQ ID NO: 194626 - DNA, 25 bp, Rattus norvegicus
atgctgcttatatcgtgctcctgaa

SEQ ID NO: 194627 - DNA, 25 bp, Rattus norvegicus
atgctgcttcctcacttataaacaa

SEQ ID NO: 194628 - DNA, 25 bp, Rattus norvegicus
atgctgcttcctgacttataaacaa

SEQ ID NO: 194629 - DNA, 25 bp, Rattus norvegicus
atgctgcttctccaagttgttccaa

SEQ ID NO: 194630 - DNA, 25 bp, Rattus norvegicus
atgctgcttctcgaagttgttccaa

SEQ ID NO: 194631 - DNA, 25 bp, Rattus norvegicus
atgctgcttctgctcaagttggcga

SEQ ID NO: 194632 - DNA, 25 bp, Rattus norvegicus
atgctgcttctggtcaagttggcga

SEQ ID NO: 194633 - DNA, 25 bp, Rattus norvegicus
atgctgcttgcaattcacagtagtt

SEQ ID NO: 194634 - DNA, 25 bp, Rattus norvegicus
atgctgcttgcacacgttcaggaag

SEQ ID NO: 194635 - DNA, 25 bp, Rattus norvegicus
atgctgcttgcagacgttcaggaag

SEQ ID NO: 194636 - DNA, 25 bp, Rattus norvegicus
atgctgcttgcatttcacagtagtt

SEQ ID NO: 194637 - DNA, 25 bp, Rattus norvegicus
atgctgcttgctctagccaatgcta

SEQ ID NO: 194638 - DNA, 25 bp, Rattus norvegicus
atgctgcttgctgtagccaatgcta

SEQ ID NO: 194639 - DNA, 25 bp, Rattus norvegicus
atgctgcttttgagctaatttcctc

SEQ ID NO: 194640 - DNA, 25 bp, Rattus norvegicus
atgctgcttttgtgctaatttcctc

SEQ ID NO: 194641 - DNA, 25 bp, Rattus norvegicus
atgctggaaaccctgagttctgtcc

SEQ ID NO: 194642 - DNA, 25 bp, Rattus norvegicus
atgctggaaaccgtgagttctgtcc

SEQ ID NO: 194643 - DNA, 25 bp, Rattus norvegicus
atgctggaacccaagatggccttct

SEQ ID NO: 194644 - DNA, 25 bp, Rattus norvegicus
atgctggaaccctagatggccttct

SEQ ID NO: 194645 - DNA, 25 bp, Rattus norvegicus
atgctggaagtcaatcgtctgtgtt

SEQ ID NO: 194646 - DNA, 25 bp, Rattus norvegicus
atgctggaagtctatcgtctgtgtt

SEQ ID NO: 194647 - DNA, 25 bp, Rattus norvegicus
atgctggaccagacacatggcttag

SEQ ID NO: 194648 - DNA, 25 bp, Rattus norvegicus
atgctggaccagctctgagcccaag

SEQ ID NO: 194649 - DNA, 25 bp, Rattus norvegicus
atgctggaccaggtctgagcccaag

SEQ ID NO: 194650 - DNA, 25 bp, Rattus norvegicus
atgctggaccagtcacatggcttag

SEQ ID NO: 194651 - DNA, 25 bp, Rattus norvegicus
atgctggacctaccttatcagggct

SEQ ID NO: 194652 - DNA, 25 bp, Rattus norvegicus
atgctggacctactgctgctcacag

SEQ ID NO: 194653 - DNA, 25 bp, Rattus norvegicus
atgctggacctagcttatcagggct

SEQ ID NO: 194654 - DNA, 25 bp, Rattus norvegicus
atgctggacctagtgctgctcacag

SEQ ID NO: 194655 - DNA, 25 bp, Rattus norvegicus
atgctggacttgaacctgtgcactg

SEQ ID NO: 194656 - DNA, 25 bp, Rattus norvegicus
atgctggacttgtacctgtgcactg

SEQ ID NO: 194657 - DNA, 25 bp, Rattus norvegicus
atgctggaggccattgcgattttac

SEQ ID NO: 194658 - DNA, 25 bp, Rattus norvegicus
atgctggaggcctttgcgattttac

SEQ ID NO: 194659 - DNA, 25 bp, Rattus norvegicus
atgctggcaatcagaaaaccgcgtt

SEQ ID NO: 194660 - DNA, 25 bp, Rattus norvegicus
atgctggcaatctgaaaaccgcgtt

SEQ ID NO: 194661 - DNA, 25 bp, Rattus norvegicus
atgctggcacatcattttgctggaa

SEQ ID NO: 194662 - DNA, 25 bp, Rattus norvegicus
atgctggcacatgattttgctggaa

SEQ ID NO: 194663 - DNA, 25 bp, Rattus norvegicus
atgctggcacttagataggatcgga

SEQ ID NO: 194664 - DNA, 25 bp, Rattus norvegicus
atgctggcactttgataggatcgga

SEQ ID NO: 194665 - DNA, 25 bp, Rattus norvegicus
atgctggccaccaccgtgatggagg

SEQ ID NO: 194666 - DNA, 25 bp, Rattus norvegicus
atgctggccacctccgtgatggagg

SEQ ID NO: 194667 - DNA, 25 bp, Rattus norvegicus
atgctggcccagcaggcagttaaga

SEQ ID NO: 194668 - DNA, 25 bp, Rattus norvegicus
atgctggcccaggaggcagttaaga

SEQ ID NO: 194669 - DNA, 25 bp, Rattus norvegicus
atgctggcccctaatgccaaacagt

SEQ ID NO: 194670 - DNA, 25 bp, Rattus norvegicus
atgctggccccttatgccaaacagt

SEQ ID NO: 194671 - DNA, 25 bp, Rattus norvegicus
atgctggcctctagttctcaccaat

SEQ ID NO: 194672 - DNA, 25 bp, Rattus norvegicus
atgctggcctcttgttctcaccaat

SEQ ID NO: 194673 - DNA, 25 bp, Rattus norvegicus
atgctggcctgacctctcgtttcat

SEQ ID NO: 194674 - DNA, 25 bp, Rattus norvegicus
atgctggcctgagctctcgtttcat

SEQ ID NO: 194675 - DNA, 25 bp, Rattus norvegicus
atgctggctaagatgattcccgctt

SEQ ID NO: 194676 - DNA, 25 bp, Rattus norvegicus
atgctggctaagttgattcccgctt

SEQ ID NO: 194677 - DNA, 25 bp, Rattus norvegicus
atgctggctctgagaaagactgaca

SEQ ID NO: 194678 - DNA, 25 bp, Rattus norvegicus
atgctggctctgctagaaacctgga

SEQ ID NO: 194679 - DNA, 25 bp, Rattus norvegicus
atgctggctctggtagaaacctgga

SEQ ID NO: 194680 - DNA, 25 bp, Rattus norvegicus
atgctggctctgtgaaagactgaca

SEQ ID NO: 194681 - DNA, 25 bp, Rattus norvegicus
atgctggcttctcccatgttctgct

SEQ ID NO: 194682 - DNA, 25 bp, Rattus norvegicus
atgctggcttctgccatgttctgct

SEQ ID NO: 194683 - DNA, 25 bp, Rattus norvegicus
atgctgggacatccggagctgctca

SEQ ID NO: 194684 - DNA, 25 bp, Rattus norvegicus
atgctgggacatgcggagctgctca

SEQ ID NO: 194685 - DNA, 25 bp, Rattus norvegicus
atgctgggacccaggactgtataaa

SEQ ID NO: 194686 - DNA, 25 bp, Rattus norvegicus
atgctgggaccctggactgtataaa

SEQ ID NO: 194687 - DNA, 25 bp, Rattus norvegicus
atgctgggactgagctacactgctg

SEQ ID NO: 194688 - DNA, 25 bp, Rattus norvegicus
atgctgggactgtgctacactgctg

SEQ ID NO: 194689 - DNA, 25 bp, Rattus norvegicus
atgctgggagaacacacccttgccc

SEQ ID NO: 194690 - DNA, 25 bp, Rattus norvegicus
atgctgggagaagacacccttgccc

SEQ ID NO: 194691 - DNA, 25 bp, Rattus norvegicus
atgctgggagccatgtgctaaccaa

SEQ ID NO: 194692 - DNA, 25 bp, Rattus norvegicus
atgctgggagccttgtgctaaccaa

SEQ ID NO: 194693 - DNA, 25 bp, Rattus norvegicus
atgctgggagtgcttcagagcccct

SEQ ID NO: 194694 - DNA, 25 bp, Rattus norvegicus
atgctgggagtggttcagagcccct

SEQ ID NO: 194695 - DNA, 25 bp, Rattus norvegicus
atgctgggattcagagatgtcactc

SEQ ID NO: 194696 - DNA, 25 bp, Rattus norvegicus
atgctgggattcagctcctaccctt

SEQ ID NO: 194697 - DNA, 25 bp, Rattus norvegicus
atgctgggattctgagatgtcactc

SEQ ID NO: 194698 - DNA, 25 bp, Rattus norvegicus
atgctgggattctgctcctaccctt

SEQ ID NO: 194699 - DNA, 25 bp, Rattus norvegicus
atgctgggcacccttggtggactac

SEQ ID NO: 194700 - DNA, 25 bp, Rattus norvegicus
atgctgggcaccgttggtggactac

SEQ ID NO: 194701 - DNA, 25 bp, Rattus norvegicus
atgctgggccccatcgggataagaa

SEQ ID NO: 194702 - DNA, 25 bp, Rattus norvegicus
atgctgggccccttcgggataagaa

SEQ ID NO: 194703 - DNA, 25 bp, Rattus norvegicus
atgctgggcctacctttctgtatcc

SEQ ID NO: 194704 - DNA, 25 bp, Rattus norvegicus
atgctgggcctagctttctgtatcc

SEQ ID NO: 194705 - DNA, 25 bp, Rattus norvegicus
atgctgggcctcacgtaagactaca

SEQ ID NO: 194706 - DNA, 25 bp, Rattus norvegicus
atgctgggcctctcgtaagactaca

SEQ ID NO: 194707 - DNA, 25 bp, Rattus norvegicus
atgctgggctccaagtgtggaccga

SEQ ID NO: 194708 - DNA, 25 bp, Rattus norvegicus
atgctgggctcctagtgtggaccga

SEQ ID NO: 194709 - DNA, 25 bp, Rattus norvegicus
atgctgggtagcagacatgtgctga

SEQ ID NO: 194710 - DNA, 25 bp, Rattus norvegicus
atgctgggtagctgacatgtgctga

SEQ ID NO: 194711 - DNA, 25 bp, Rattus norvegicus
atgctgggtcttctcactagcaccg

SEQ ID NO: 194712 - DNA, 25 bp, Rattus norvegicus
atgctgggtcttgtcactagcaccg

SEQ ID NO: 194713 - DNA, 25 bp, Rattus norvegicus
atgctgggtttgcacgttcctacca

SEQ ID NO: 194714 - DNA, 25 bp, Rattus norvegicus
atgctgggtttggacgttcctacca

SEQ ID NO: 194715 - DNA, 25 bp, Rattus norvegicus
atgctggtagctcagtagtcccttt

SEQ ID NO: 194716 - DNA, 25 bp, Rattus norvegicus
atgctggtagctgagtagtcccttt

SEQ ID NO: 194717 - DNA, 25 bp, Rattus norvegicus
atgctggtcctcagctcgatctgcc

SEQ ID NO: 194718 - DNA, 25 bp, Rattus norvegicus
atgctggtcctctgctcgatctgcc

SEQ ID NO: 194719 - DNA, 25 bp, Rattus norvegicus
atgctggtctttcgtcccttcatgc

SEQ ID NO: 194720 - DNA, 25 bp, Rattus norvegicus
atgctggtctttggtcccttcatgc

SEQ ID NO: 194721 - DNA, 25 bp, Rattus norvegicus
atgctggtgatgctgcttacggccc

SEQ ID NO: 194722 - DNA, 25 bp, Rattus norvegicus
atgctggtgatggtgcttacggccc

SEQ ID NO: 194723 - DNA, 25 bp, Rattus norvegicus
atgctggtggccacagggaccctca

SEQ ID NO: 194724 - DNA, 25 bp, Rattus norvegicus
atgctggtggcctcagggaccctca

SEQ ID NO: 194725 - DNA, 25 bp, Rattus norvegicus
atgctggtgtgcaaacatttcctcc

SEQ ID NO: 194726 - DNA, 25 bp, Rattus norvegicus
atgctggtgtgctaacatttcctcc

SEQ ID NO: 194727 - DNA, 25 bp, Rattus norvegicus
atgctggttcatcttgcacttgcgc

SEQ ID NO: 194728 - DNA, 25 bp, Rattus norvegicus
atgctggttcatgttgcacttgcgc

SEQ ID NO: 194729 - DNA, 25 bp, Rattus norvegicus
atgctggttccaagtttcaggatag

SEQ ID NO: 194730 - DNA, 25 bp, Rattus norvegicus
atgctggttccatgtttcaggatag

SEQ ID NO: 194731 - DNA, 25 bp, Rattus norvegicus
atgctggttgctctgtagacgccta

SEQ ID NO: 194732 - DNA, 25 bp, Rattus norvegicus
atgctggttgctgtgtagacgccta

SEQ ID NO: 194733 - DNA, 25 bp, Rattus norvegicus
atgctggttggacagtctccgttcc

SEQ ID NO: 194734 - DNA, 25 bp, Rattus norvegicus
atgctggttggagagtctccgttcc

SEQ ID NO: 194735 - DNA, 25 bp, Rattus norvegicus
atgctggttgtcagcaagcttgtgc

SEQ ID NO: 194736 - DNA, 25 bp, Rattus norvegicus
atgctggttgtctgcaagcttgtgc

SEQ ID NO: 194737 - DNA, 25 bp, Rattus norvegicus
atgctggttttaacttgtatttctc

SEQ ID NO: 194738 - DNA, 25 bp, Rattus norvegicus
atgctggttttatcttgtatttctc

SEQ ID NO: 194739 - DNA, 25 bp, Rattus norvegicus
atgctggttttcagtccgataatcc

SEQ ID NO: 194740 - DNA, 25 bp, Rattus norvegicus
atgctggttttctgtccgataatcc

SEQ ID NO: 194741 - DNA, 25 bp, Rattus norvegicus
atgctgtaaatactgtagtcctgac

SEQ ID NO: 194742 - DNA, 25 bp, Rattus norvegicus
atgctgtaaatagtgtagtcctgac

SEQ ID NO: 194743 - DNA, 25 bp, Rattus norvegicus
atgctgtaactcactgtatttccta

SEQ ID NO: 194744 - DNA, 25 bp, Rattus norvegicus
atgctgtaactctctgtatttccta

SEQ ID NO: 194745 - DNA, 25 bp, Rattus norvegicus
atgctgtaacttatagccagattta

SEQ ID NO: 194746 - DNA, 25 bp, Rattus norvegicus
atgctgtaacttttagccagattta

SEQ ID NO: 194747 - DNA, 25 bp, Rattus norvegicus
atgctgtaagcaccctggcaggaag

SEQ ID NO: 194748 - DNA, 25 bp, Rattus norvegicus
atgctgtaagcagcctggcaggaag

SEQ ID NO: 194749 - DNA, 25 bp, Rattus norvegicus
atgctgtaatccagtgagatgtttt

SEQ ID NO: 194750 - DNA, 25 bp, Rattus norvegicus
atgctgtaatcctgtgagatgtttt

SEQ ID NO: 194751 - DNA, 25 bp, Rattus norvegicus
atgctgtaatttatagcccaagatt

SEQ ID NO: 194752 - DNA, 25 bp, Rattus norvegicus
atgctgtaatttttagcccaagatt

SEQ ID NO: 194753 - DNA, 25 bp, Rattus norvegicus
atgctgtaccttattgccgaggcga

SEQ ID NO: 194754 - DNA, 25 bp, Rattus norvegicus
atgctgtacctttttgccgaggcga

SEQ ID NO: 194755 - DNA, 25 bp, Rattus norvegicus
atgctgtagcatcgcgtgtggcaca

SEQ ID NO: 194756 - DNA, 25 bp, Rattus norvegicus
atgctgtagcatggcgtgtggcaca

SEQ ID NO: 194757 - DNA, 25 bp, Rattus norvegicus
atgctgtagctacttcaggtactga

SEQ ID NO: 194758 - DNA, 25 bp, Rattus norvegicus
atgctgtagctagttcaggtactga

SEQ ID NO: 194759 - DNA, 25 bp, Rattus norvegicus
atgctgtatgtcagtggatccctac

SEQ ID NO: 194760 - DNA, 25 bp, Rattus norvegicus
atgctgtatgtctgtggatccctac

SEQ ID NO: 194761 - DNA, 25 bp, Rattus norvegicus
atgctgtattagatgacaagcttta

SEQ ID NO: 194762 - DNA, 25 bp, Rattus norvegicus
atgctgtattagttgacaagcttta

SEQ ID NO: 194763 - DNA, 25 bp, Rattus norvegicus
atgctgtatttaatatttggatcaa

SEQ ID NO: 194764 - DNA, 25 bp, Rattus norvegicus
atgctgtatttattatttggatcaa

SEQ ID NO: 194765 - DNA, 25 bp, Rattus norvegicus
atgctgtatttgcatctcacgctgc

SEQ ID NO: 194766 - DNA, 25 bp, Rattus norvegicus
atgctgtatttggatctcacgctgc

SEQ ID NO: 194767 - DNA, 25 bp, Rattus norvegicus
atgctgtcaggtaccccactttggg

SEQ ID NO: 194768 - DNA, 25 bp, Rattus norvegicus
atgctgtcaggttccccactttggg

SEQ ID NO: 194769 - DNA, 25 bp, Rattus norvegicus
atgctgtcagtaagggtttggctcc

SEQ ID NO: 194770 - DNA, 25 bp, Rattus norvegicus
atgctgtcagtatgggtttggctcc

SEQ ID NO: 194771 - DNA, 25 bp, Rattus norvegicus
atgctgtcatcactgtcacggctgg

SEQ ID NO: 194772 - DNA, 25 bp, Rattus norvegicus
atgctgtcatcagtgtcacggctgg

SEQ ID NO: 194773 - DNA, 25 bp, Rattus norvegicus
atgctgtcatttattcacgtcagta

SEQ ID NO: 194774 - DNA, 25 bp, Rattus norvegicus
atgctgtcattttttcacgtcagta

SEQ ID NO: 194775 - DNA, 25 bp, Rattus norvegicus
atgctgtccagaaccacattctgaa

SEQ ID NO: 194776 - DNA, 25 bp, Rattus norvegicus
atgctgtccagatccacattctgaa

SEQ ID NO: 194777 - DNA, 25 bp, Rattus norvegicus
atgctgtccagtcgcatcctgagaa

SEQ ID NO: 194778 - DNA, 25 bp, Rattus norvegicus
atgctgtccagtggcatcctgagaa

SEQ ID NO: 194779 - DNA, 25 bp, Rattus norvegicus
atgctgtcccaacaatgtgccatga

SEQ ID NO: 194780 - DNA, 25 bp, Rattus norvegicus
atgctgtcccaacagtcaggctact

SEQ ID NO: 194781 - DNA, 25 bp, Rattus norvegicus
atgctgtcccaagaatgtgccatga

SEQ ID NO: 194782 - DNA, 25 bp, Rattus norvegicus
atgctgtcccaagagtcaggctact

SEQ ID NO: 194783 - DNA, 25 bp, Rattus norvegicus
atgctgtcccgtagccacaattaaa

SEQ ID NO: 194784 - DNA, 25 bp, Rattus norvegicus
atgctgtcccgttgccacaattaaa

SEQ ID NO: 194785 - DNA, 25 bp, Rattus norvegicus
atgctgtccctcctcaggttggctg

SEQ ID NO: 194786 - DNA, 25 bp, Rattus norvegicus
atgctgtccctcgtcaggttggctg

SEQ ID NO: 194787 - DNA, 25 bp, Rattus norvegicus
atgctgtcccttcttttgattatga

SEQ ID NO: 194788 - DNA, 25 bp, Rattus norvegicus
atgctgtcccttgttttgattatga

SEQ ID NO: 194789 - DNA, 25 bp, Rattus norvegicus
atgctgtccgcaagtctactatagg

SEQ ID NO: 194790 - DNA, 25 bp, Rattus norvegicus
atgctgtccgcatgtctactatagg

SEQ ID NO: 194791 - DNA, 25 bp, Rattus norvegicus
atgctgtccgtccatttgcttaatg

SEQ ID NO: 194792 - DNA, 25 bp, Rattus norvegicus
atgctgtccgtcgatttgcttaatg

SEQ ID NO: 194793 - DNA, 25 bp, Rattus norvegicus
atgctgtccttgctgttgtgattac

SEQ ID NO: 194794 - DNA, 25 bp, Rattus norvegicus
atgctgtccttggtgttgtgattac

SEQ ID NO: 194795 - DNA, 25 bp, Rattus norvegicus
atgctgtctactcacttgacgtcta

SEQ ID NO: 194796 - DNA, 25 bp, Rattus norvegicus
atgctgtctactgacttgacgtcta

SEQ ID NO: 194797 - DNA, 25 bp, Rattus norvegicus
atgctgtctaggcttaagatggtaa

SEQ ID NO: 194798 - DNA, 25 bp, Rattus norvegicus
atgctgtctagggttaagatggtaa

SEQ ID NO: 194799 - DNA, 25 bp, Rattus norvegicus
atgctgtctgctagggtctcatggt

SEQ ID NO: 194800 - DNA, 25 bp, Rattus norvegicus
atgctgtctgctctgtgattctgtc

SEQ ID NO: 194801 - DNA, 25 bp, Rattus norvegicus
atgctgtctgctgtgtgattctgtc

SEQ ID NO: 194802 - DNA, 25 bp, Rattus norvegicus
atgctgtctgcttgggtctcatggt

SEQ ID NO: 194803 - DNA, 25 bp, Rattus norvegicus
atgctgtctggaactgggacattca

SEQ ID NO: 194804 - DNA, 25 bp, Rattus norvegicus
atgctgtctggatctgggacattca

SEQ ID NO: 194805 - DNA, 25 bp, Rattus norvegicus
atgctgtctgtgaggctggactgtc

SEQ ID NO: 194806 - DNA, 25 bp, Rattus norvegicus
atgctgtctgtgtggctggactgtc

SEQ ID NO: 194807 - DNA, 25 bp, Rattus norvegicus
atgctgtcttatctgaactcttggc

SEQ ID NO: 194808 - DNA, 25 bp, Rattus norvegicus
atgctgtcttatgtgaactcttggc

SEQ ID NO: 194809 - DNA, 25 bp, Rattus norvegicus
atgctgtcttctaaggtttggacca

SEQ ID NO: 194810 - DNA, 25 bp, Rattus norvegicus
atgctgtcttctcgcggctcaggaa

SEQ ID NO: 194811 - DNA, 25 bp, Rattus norvegicus
atgctgtcttctggcggctcaggaa

SEQ ID NO: 194812 - DNA, 25 bp, Rattus norvegicus
atgctgtcttcttaggtttggacca

SEQ ID NO: 194813 - DNA, 25 bp, Rattus norvegicus
atgctgtcttgacatggctcagtca

SEQ ID NO: 194814 - DNA, 25 bp, Rattus norvegicus
atgctgtcttgagatggctcagtca

SEQ ID NO: 194815 - DNA, 25 bp, Rattus norvegicus
atgctgtgaagcacttgccttggtc

SEQ ID NO: 194816 - DNA, 25 bp, Rattus norvegicus
atgctgtgaagctcttgccttggtc

SEQ ID NO: 194817 - DNA, 25 bp, Rattus norvegicus
atgctgtgacagatctgaacaccga

SEQ ID NO: 194818 - DNA, 25 bp, Rattus norvegicus
atgctgtgacagttctgaacaccga

SEQ ID NO: 194819 - DNA, 25 bp, Rattus norvegicus
atgctgtgacttattggctgtgatc

SEQ ID NO: 194820 - DNA, 25 bp, Rattus norvegicus
atgctgtgactttttggctgtgatc

SEQ ID NO: 194821 - DNA, 25 bp, Rattus norvegicus
atgctgtgaggtatctcctgcacac

SEQ ID NO: 194822 - DNA, 25 bp, Rattus norvegicus
atgctgtgaggtttctcctgcacac

SEQ ID NO: 194823 - DNA, 25 bp, Rattus norvegicus
atgctgtgattcagtgacaccctga

SEQ ID NO: 194824 - DNA, 25 bp, Rattus norvegicus
atgctgtgattctgtgacaccctga

SEQ ID NO: 194825 - DNA, 25 bp, Rattus norvegicus
atgctgtgcacaactcatcagactc

SEQ ID NO: 194826 - DNA, 25 bp, Rattus norvegicus
atgctgtgcacatctcatcagactc

SEQ ID NO: 194827 - DNA, 25 bp, Rattus norvegicus
atgctgtgccatagaccttgatgaa

SEQ ID NO: 194828 - DNA, 25 bp, Rattus norvegicus
atgctgtgccattgaccttgatgaa

SEQ ID NO: 194829 - DNA, 25 bp, Rattus norvegicus
atgctgtgctgacttggaacgcctg

SEQ ID NO: 194830 - DNA, 25 bp, Rattus norvegicus
atgctgtgctgagttggaacgcctg

SEQ ID NO: 194831 - DNA, 25 bp, Rattus norvegicus
atgctgtgctgcatgtgtttgcaaa

SEQ ID NO: 194832 - DNA, 25 bp, Rattus norvegicus
atgctgtgctgcttgtgtttgcaaa

SEQ ID NO: 194833 - DNA, 25 bp, Rattus norvegicus
atgctgtgctggctcacttttcata

SEQ ID NO: 194834 - DNA, 25 bp, Rattus norvegicus
atgctgtgctgggtcacttttcata

SEQ ID NO: 194835 - DNA, 25 bp, Rattus norvegicus
atgctgtggcttctacaaagtggaa

SEQ ID NO: 194836 - DNA, 25 bp, Rattus norvegicus
atgctgtggcttgtacaaagtggaa

SEQ ID NO: 194837 - DNA, 25 bp, Rattus norvegicus
atgctgtggtagactttgattggct

SEQ ID NO: 194838 - DNA, 25 bp, Rattus norvegicus
atgctgtggtagtctttgattggct

SEQ ID NO: 194839 - DNA, 25 bp, Rattus norvegicus
atgctgtgtccaattccactaagga

SEQ ID NO: 194840 - DNA, 25 bp, Rattus norvegicus
atgctgtgtccatttccactaagga

SEQ ID NO: 194841 - DNA, 25 bp, Rattus norvegicus
atgctgtgtccccacagaactcagt

SEQ ID NO: 194842 - DNA, 25 bp, Rattus norvegicus
atgctgtgtcccgacagaactcagt

SEQ ID NO: 194843 - DNA, 25 bp, Rattus norvegicus
atgctgtgtcttactctgtctatat

SEQ ID NO: 194844 - DNA, 25 bp, Rattus norvegicus
atgctgtgtctttctctgtctatat

SEQ ID NO: 194845 - DNA, 25 bp, Rattus norvegicus
atgctgtgtgcccaccaagctgaga

SEQ ID NO: 194846 - DNA, 25 bp, Rattus norvegicus
atgctgtgtgccgaccaagctgaga

SEQ ID NO: 194847 - DNA, 25 bp, Rattus norvegicus
atgctgtgtgctctttctacagtga

SEQ ID NO: 194848 - DNA, 25 bp, Rattus norvegicus
atgctgtgtgctgtttctacagtga

SEQ ID NO: 194849 - DNA, 25 bp, Rattus norvegicus
atgctgtgtgggagtcaggccttca

SEQ ID NO: 194850 - DNA, 25 bp, Rattus norvegicus
atgctgtgtgggtgtcaggccttca

SEQ ID NO: 194851 - DNA, 25 bp, Rattus norvegicus
atgctgttcaacattccctcatctt

SEQ ID NO: 194852 - DNA, 25 bp, Rattus norvegicus
atgctgttcaactttccctcatctt

SEQ ID NO: 194853 - DNA, 25 bp, Rattus norvegicus
atgctgttcatcatctgtccatgta

SEQ ID NO: 194854 - DNA, 25 bp, Rattus norvegicus
atgctgttcatcttctgtccatgta

SEQ ID NO: 194855 - DNA, 25 bp, Rattus norvegicus
atgctgttcatgctaaagatgctca

SEQ ID NO: 194856 - DNA, 25 bp, Rattus norvegicus
atgctgttcatggtaaagatgctca

SEQ ID NO: 194857 - DNA, 25 bp, Rattus norvegicus
atgctgttccccagtgcggtgtacc

SEQ ID NO: 194858 - DNA, 25 bp, Rattus norvegicus
atgctgttcccctgtgcggtgtacc

SEQ ID NO: 194859 - DNA, 25 bp, Rattus norvegicus
atgctgttccctcttttattttgtc

SEQ ID NO: 194860 - DNA, 25 bp, Rattus norvegicus
atgctgttccctgttttattttgtc

SEQ ID NO: 194861 - DNA, 25 bp, Rattus norvegicus
atgctgttcctgcttgttcagtgtt

SEQ ID NO: 194862 - DNA, 25 bp, Rattus norvegicus
atgctgttcctggttgttcagtgtt

SEQ ID NO: 194863 - DNA, 25 bp, Rattus norvegicus
atgctgttctcacgaatggccgggt

SEQ ID NO: 194864 - DNA, 25 bp, Rattus norvegicus
atgctgttctcaggaatggccgggt

SEQ ID NO: 194865 - DNA, 25 bp, Rattus norvegicus
atgctgttctgcaatgggttcacac

SEQ ID NO: 194866 - DNA, 25 bp, Rattus norvegicus
atgctgttctgctatgggttcacac

SEQ ID NO: 194867 - DNA, 25 bp, Rattus norvegicus
atgctgttctttcttgctcacattg

SEQ ID NO: 194868 - DNA, 25 bp, Rattus norvegicus
atgctgttctttgttgctcacattg

SEQ ID NO: 194869 - DNA, 25 bp, Rattus norvegicus
atgctgttgctaaaggtggctccga

SEQ ID NO: 194870 - DNA, 25 bp, Rattus norvegicus
atgctgttgctataggtggctccga

SEQ ID NO: 194871 - DNA, 25 bp, Rattus norvegicus
atgctgttgctgcagttctttttca

SEQ ID NO: 194872 - DNA, 25 bp, Rattus norvegicus
atgctgttgctggagttctttttca

SEQ ID NO: 194873 - DNA, 25 bp, Rattus norvegicus
atgctgttgcttaaactgctgctgt

SEQ ID NO: 194874 - DNA, 25 bp, Rattus norvegicus
atgctgttgctttaactgctgctgt

SEQ ID NO: 194875 - DNA, 25 bp, Rattus norvegicus
atgctgttggccatgttgataccct

SEQ ID NO: 194876 - DNA, 25 bp, Rattus norvegicus
atgctgttggccttgttgataccct

SEQ ID NO: 194877 - DNA, 25 bp, Rattus norvegicus
atgctgttggtgaggaagttcccac

SEQ ID NO: 194878 - DNA, 25 bp, Rattus norvegicus
atgctgttggtgtggaagttcccac

SEQ ID NO: 194879 - DNA, 25 bp, Rattus norvegicus
atgctgttgtacataaggcgtgggt

SEQ ID NO: 194880 - DNA, 25 bp, Rattus norvegicus
atgctgttgtacttaaggcgtgggt

SEQ ID NO: 194881 - DNA, 25 bp, Rattus norvegicus
atgctgttgtgacatctcggagtga

SEQ ID NO: 194882 - DNA, 25 bp, Rattus norvegicus
atgctgttgtgagatctcggagtga

SEQ ID NO: 194883 - DNA, 25 bp, Rattus norvegicus
atgctgttgtggagtttcccttcaa

SEQ ID NO: 194884 - DNA, 25 bp, Rattus norvegicus
atgctgttgtggtgtttcccttcaa

SEQ ID NO: 194885 - DNA, 25 bp, Rattus norvegicus
atgctgtttagcctcaaggtcgatg

SEQ ID NO: 194886 - DNA, 25 bp, Rattus norvegicus
atgctgtttagcgtcaaggtcgatg

SEQ ID NO: 194887 - DNA, 25 bp, Rattus norvegicus
atgctgtttatcacgacatcctctc

SEQ ID NO: 194888 - DNA, 25 bp, Rattus norvegicus
atgctgtttatctcgacatcctctc

SEQ ID NO: 194889 - DNA, 25 bp, Rattus norvegicus
atgctgtttgcaaatctgtgaactt

SEQ ID NO: 194890 - DNA, 25 bp, Rattus norvegicus
atgctgtttgcatatctgtgaactt

SEQ ID NO: 194891 - DNA, 25 bp, Rattus norvegicus
atgctgttttgtaaccctggtgggt

SEQ ID NO: 194892 - DNA, 25 bp, Rattus norvegicus
atgctgttttgttaccctggtgggt

SEQ ID NO: 194893 - DNA, 25 bp, Rattus norvegicus
atgctgtttttcagcctgagtcaga

SEQ ID NO: 194894 - DNA, 25 bp, Rattus norvegicus
atgctgtttttctgcctgagtcaga

SEQ ID NO: 194895 - DNA, 25 bp, Rattus norvegicus
atgcttaacacaatttctgaataac

SEQ ID NO: 194896 - DNA, 25 bp, Rattus norvegicus
atgcttaacacattttctgaataac

SEQ ID NO: 194897 - DNA, 25 bp, Rattus norvegicus
atgcttaacttgatctgtgctgctg

SEQ ID NO: 194898 - DNA, 25 bp, Rattus norvegicus
atgcttaacttgttctgtgctgctg

SEQ ID NO: 194899 - DNA, 25 bp, Rattus norvegicus
atgcttaagagtcctacacaccggg

SEQ ID NO: 194900 - DNA, 25 bp, Rattus norvegicus
atgcttaagagtgctacacaccggg

SEQ ID NO: 194901 - DNA, 25 bp, Rattus norvegicus
atgcttaagcatactgcagctctgg

SEQ ID NO: 194902 - DNA, 25 bp, Rattus norvegicus
atgcttaagcattctgcagctctgg

SEQ ID NO: 194903 - DNA, 25 bp, Rattus norvegicus
atgcttaaggccatggtcaaatacc

SEQ ID NO: 194904 - DNA, 25 bp, Rattus norvegicus
atgcttaaggccttggtcaaatacc

SEQ ID NO: 194905 - DNA, 25 bp, Rattus norvegicus
atgcttaatccaagttgccaactcc

SEQ ID NO: 194906 - DNA, 25 bp, Rattus norvegicus
atgcttaatccatgttgccaactcc

SEQ ID NO: 194907 - DNA, 25 bp, Rattus norvegicus
atgcttacagtgctagcgcttggga

SEQ ID NO: 194908 - DNA, 25 bp, Rattus norvegicus
atgcttacagtggtagcgcttggga

SEQ ID NO: 194909 - DNA, 25 bp, Rattus norvegicus
atgcttacgaacactgggaatccca

SEQ ID NO: 194910 - DNA, 25 bp, Rattus norvegicus
atgcttacgaactctgggaatccca

SEQ ID NO: 194911 - DNA, 25 bp, Rattus norvegicus
atgcttacggccagggaccatgatt

SEQ ID NO: 194912 - DNA, 25 bp, Rattus norvegicus
atgcttacggcctgggaccatgatt

SEQ ID NO: 194913 - DNA, 25 bp, Rattus norvegicus
atgcttactgaacaagaatccccga

SEQ ID NO: 194914 - DNA, 25 bp, Rattus norvegicus
atgcttactgaagaagaatccccga

SEQ ID NO: 194915 - DNA, 25 bp, Rattus norvegicus
atgcttactgcaagtgtggatgtat

SEQ ID NO: 194916 - DNA, 25 bp, Rattus norvegicus
atgcttactgcacacggcctgggaa

SEQ ID NO: 194917 - DNA, 25 bp, Rattus norvegicus
atgcttactgcagacggcctgggaa

SEQ ID NO: 194918 - DNA, 25 bp, Rattus norvegicus
atgcttactgcatgtgtggatgtat

SEQ ID NO: 194919 - DNA, 25 bp, Rattus norvegicus
atgcttactgtgatcctaaagacct

SEQ ID NO: 194920 - DNA, 25 bp, Rattus norvegicus
atgcttactgtgttcctaaagacct

SEQ ID NO: 194921 - DNA, 25 bp, Rattus norvegicus
atgcttacttgtaccgatcctagtg

SEQ ID NO: 194922 - DNA, 25 bp, Rattus norvegicus
atgcttacttgttccgatcctagtg

SEQ ID NO: 194923 - DNA, 25 bp, Rattus norvegicus
atgcttactttcctagcttttctag

SEQ ID NO: 194924 - DNA, 25 bp, Rattus norvegicus
atgcttactttcgtagcttttctag

SEQ ID NO: 194925 - DNA, 25 bp, Rattus norvegicus
atgcttagaattagccaccgcacca

SEQ ID NO: 194926 - DNA, 25 bp, Rattus norvegicus
atgcttagaatttgccaccgcacca

SEQ ID NO: 194927 - DNA, 25 bp, Rattus norvegicus
atgcttagcagaaccgggtcccagg

SEQ ID NO: 194928 - DNA, 25 bp, Rattus norvegicus
atgcttagcagatccgggtcccagg

SEQ ID NO: 194929 - DNA, 25 bp, Rattus norvegicus
atgcttagcttcacacacaggtgat

SEQ ID NO: 194930 - DNA, 25 bp, Rattus norvegicus
atgcttagcttctcacacaggtgat

SEQ ID NO: 194931 - DNA, 25 bp, Rattus norvegicus
atgcttagtggcactgtcactccag

SEQ ID NO: 194932 - DNA, 25 bp, Rattus norvegicus
atgcttagtggctctgtcactccag

SEQ ID NO: 194933 - DNA, 25 bp, Rattus norvegicus
atgcttagtttgaggcttagcctgc

SEQ ID NO: 194934 - DNA, 25 bp, Rattus norvegicus
atgcttagtttgtggcttagcctgc

SEQ ID NO: 194935 - DNA, 25 bp, Rattus norvegicus
atgcttatctataggtatttatgtc

SEQ ID NO: 194936 - DNA, 25 bp, Rattus norvegicus
atgcttatctattggtatttatgtc

SEQ ID NO: 194937 - DNA, 25 bp, Rattus norvegicus
atgcttatctgtaaatgcgaaccta

SEQ ID NO: 194938 - DNA, 25 bp, Rattus norvegicus
atgcttatctgttaatgcgaaccta

SEQ ID NO: 194939 - DNA, 25 bp, Rattus norvegicus
atgcttatgcgcctgacagtgtacg

SEQ ID NO: 194940 - DNA, 25 bp, Rattus norvegicus
atgcttatgcgcgtgacagtgtacg

SEQ ID NO: 194941 - DNA, 25 bp, Rattus norvegicus
atgcttatggctatgtatggttcaa

SEQ ID NO: 194942 - DNA, 25 bp, Rattus norvegicus
atgcttatggctttgtatggttcaa

SEQ ID NO: 194943 - DNA, 25 bp, Rattus norvegicus
atgcttatgtcaatagtgcctcaca

SEQ ID NO: 194944 - DNA, 25 bp, Rattus norvegicus
atgcttatgtcattagtgcctcaca

SEQ ID NO: 194945 - DNA, 25 bp, Rattus norvegicus
atgcttattgttactgtttaccttt

SEQ ID NO: 194946 - DNA, 25 bp, Rattus norvegicus
atgcttattgtttctgtttaccttt

SEQ ID NO: 194947 - DNA, 25 bp, Rattus norvegicus
atgcttcaagagactgtgcttctcg

SEQ ID NO: 194948 - DNA, 25 bp, Rattus norvegicus
atgcttcaagagtctgtgcttctcg

SEQ ID NO: 194949 - DNA, 25 bp, Rattus norvegicus
atgcttcaccagaattctcttgagg

SEQ ID NO: 194950 - DNA, 25 bp, Rattus norvegicus
atgcttcaccagtattctcttgagg

SEQ ID NO: 194951 - DNA, 25 bp, Rattus norvegicus
atgcttcaccatcatgccaaacaaa

SEQ ID NO: 194952 - DNA, 25 bp, Rattus norvegicus
atgcttcaccatgatgccaaacaaa

SEQ ID NO: 194953 - DNA, 25 bp, Rattus norvegicus
atgcttcacgatatgcacacccaag

SEQ ID NO: 194954 - DNA, 25 bp, Rattus norvegicus
atgcttcacgatccatgttgacttc

SEQ ID NO: 194955 - DNA, 25 bp, Rattus norvegicus
atgcttcacgatgcatgttgacttc

SEQ ID NO: 194956 - DNA, 25 bp, Rattus norvegicus
atgcttcacgatttgcacacccaag

SEQ ID NO: 194957 - DNA, 25 bp, Rattus norvegicus
atgcttcacgcaaggccatgagcaa

SEQ ID NO: 194958 - DNA, 25 bp, Rattus norvegicus
atgcttcacgcatggccatgagcaa

SEQ ID NO: 194959 - DNA, 25 bp, Rattus norvegicus
atgcttcagagcatcagcttcagaa

SEQ ID NO: 194960 - DNA, 25 bp, Rattus norvegicus
atgcttcagagcttcagcttcagaa

SEQ ID NO: 194961 - DNA, 25 bp, Rattus norvegicus
atgcttcagctacttgtgtctgcca

SEQ ID NO: 194962 - DNA, 25 bp, Rattus norvegicus
atgcttcagctagttgtgtctgcca

SEQ ID NO: 194963 - DNA, 25 bp, Rattus norvegicus
atgcttcagtggcttcagatgtact

SEQ ID NO: 194964 - DNA, 25 bp, Rattus norvegicus
atgcttcagtgggttcagatgtact

SEQ ID NO: 194965 - DNA, 25 bp, Rattus norvegicus
atgcttcatagtcatgtggctttct

SEQ ID NO: 194966 - DNA, 25 bp, Rattus norvegicus
atgcttcatagtgatgtggctttct

SEQ ID NO: 194967 - DNA, 25 bp, Rattus norvegicus
atgcttcatgcacgccattttgaaa

SEQ ID NO: 194968 - DNA, 25 bp, Rattus norvegicus
atgcttcatgcaggccattttgaaa

SEQ ID NO: 194969 - DNA, 25 bp, Rattus norvegicus
atgcttccaccaaggtggccgtgga

SEQ ID NO: 194970 - DNA, 25 bp, Rattus norvegicus
atgcttccaccatggtggccgtgga

SEQ ID NO: 194971 - DNA, 25 bp, Rattus norvegicus
atgcttccacggagtgaccattcaa

SEQ ID NO: 194972 - DNA, 25 bp, Rattus norvegicus
atgcttccacggtgtgaccattcaa

SEQ ID NO: 194973 - DNA, 25 bp, Rattus norvegicus
atgcttccatatctgacgggactct

SEQ ID NO: 194974 - DNA, 25 bp, Rattus norvegicus
atgcttccatatgtgacgggactct

SEQ ID NO: 194975 - DNA, 25 bp, Rattus norvegicus
atgcttccatgtatctcacttgtag

SEQ ID NO: 194976 - DNA, 25 bp, Rattus norvegicus
atgcttccatgtttctcacttgtag

SEQ ID NO: 194977 - DNA, 25 bp, Rattus norvegicus
atgcttcccaatcttgagccggaaa

SEQ ID NO: 194978 - DNA, 25 bp, Rattus norvegicus
atgcttcccaatgttgagccggaaa

SEQ ID NO: 194979 - DNA, 25 bp, Rattus norvegicus
atgcttcccatacacagctacgggt

SEQ ID NO: 194980 - DNA, 25 bp, Rattus norvegicus
atgcttcccatagacagctacgggt

SEQ ID NO: 194981 - DNA, 25 bp, Rattus norvegicus
atgcttcccctgcattaacttgtac

SEQ ID NO: 194982 - DNA, 25 bp, Rattus norvegicus
atgcttcccctggattaacttgtac

SEQ ID NO: 194983 - DNA, 25 bp, Rattus norvegicus
atgcttcccgtgatcatttcaatta

SEQ ID NO: 194984 - DNA, 25 bp, Rattus norvegicus
atgcttcccgtgttcatttcaatta

SEQ ID NO: 194985 - DNA, 25 bp, Rattus norvegicus
atgcttcctaaaaacatctgtccca

SEQ ID NO: 194986 - DNA, 25 bp, Rattus norvegicus
atgcttcctaaatacatctgtccca

SEQ ID NO: 194987 - DNA, 25 bp, Rattus norvegicus
atgcttcctcctagcatagcaggtg

SEQ ID NO: 194988 - DNA, 25 bp, Rattus norvegicus
atgcttcctccttgcatagcaggtg

SEQ ID NO: 194989 - DNA, 25 bp, Rattus norvegicus
atgcttcctgcactgccatagaaac

SEQ ID NO: 194990 - DNA, 25 bp, Rattus norvegicus
atgcttcctgcagtgccatagaaac

SEQ ID NO: 194991 - DNA, 25 bp, Rattus norvegicus
atgcttcctgtaacctgtgtaatgt

SEQ ID NO: 194992 - DNA, 25 bp, Rattus norvegicus
atgcttcctgtatcctgtgtaatgt

SEQ ID NO: 194993 - DNA, 25 bp, Rattus norvegicus
atgcttcctgtcaggtgagtgtcac

SEQ ID NO: 194994 - DNA, 25 bp, Rattus norvegicus
atgcttcctgtcagtatctctttga

SEQ ID NO: 194995 - DNA, 25 bp, Rattus norvegicus
atgcttcctgtctggtgagtgtcac

SEQ ID NO: 194996 - DNA, 25 bp, Rattus norvegicus
atgcttcctgtctgtatctctttga

SEQ ID NO: 194997 - DNA, 25 bp, Rattus norvegicus
atgcttcctgttatgtgttatccca

SEQ ID NO: 194998 - DNA, 25 bp, Rattus norvegicus
atgcttcctgttttgtgttatccca

SEQ ID NO: 194999 - DNA, 25 bp, Rattus norvegicus
atgcttccttagagtcttctatacc

SEQ ID NO: 195000 - DNA, 25 bp, Rattus norvegicus
atgcttccttagtgtcttctatacc

SEQ ID NO: 195001 - DNA, 25 bp, Rattus norvegicus
atgcttccttccagagtcaggccaa

SEQ ID NO: 195002 - DNA, 25 bp, Rattus norvegicus
atgcttccttcctgagtcaggccaa

SEQ ID NO: 195003 - DNA, 25 bp, Rattus norvegicus
atgcttcgaagccttttggttttat

SEQ ID NO: 195004 - DNA, 25 bp, Rattus norvegicus
atgcttcgaagcgttttggttttat

SEQ ID NO: 195005 - DNA, 25 bp, Rattus norvegicus
atgcttcgtggactctgcatggccg

SEQ ID NO: 195006 - DNA, 25 bp, Rattus norvegicus
atgcttcgtggagtctgcatggccg

SEQ ID NO: 195007 - DNA, 25 bp, Rattus norvegicus
atgcttctatttagtgatgcgtccc

SEQ ID NO: 195008 - DNA, 25 bp, Rattus norvegicus
atgcttctattttgtgatgcgtccc

SEQ ID NO: 195009 - DNA, 25 bp, Rattus norvegicus
atgcttctcaaaacaattctaccaa

SEQ ID NO: 195010 - DNA, 25 bp, Rattus norvegicus
atgcttctcaaatcaattctaccaa

SEQ ID NO: 195011 - DNA, 25 bp, Rattus norvegicus
atgcttctcaccaagggatgtgtgg

SEQ ID NO: 195012 - DNA, 25 bp, Rattus norvegicus
atgcttctcacctagggatgtgtgg

SEQ ID NO: 195013 - DNA, 25 bp, Rattus norvegicus
atgcttctcggaaccttgttgatgc

SEQ ID NO: 195014 - DNA, 25 bp, Rattus norvegicus
atgcttctcggatccttgttgatgc

SEQ ID NO: 195015 - DNA, 25 bp, Rattus norvegicus
atgcttctcgtaagacaggccacag

SEQ ID NO: 195016 - DNA, 25 bp, Rattus norvegicus
atgcttctcgtatgacaggccacag

SEQ ID NO: 195017 - DNA, 25 bp, Rattus norvegicus
atgcttctctctactatataaccct

SEQ ID NO: 195018 - DNA, 25 bp, Rattus norvegicus
atgcttctctcttctatataaccct

SEQ ID NO: 195019 - DNA, 25 bp, Rattus norvegicus
atgcttctgaaaactgatactgtag

SEQ ID NO: 195020 - DNA, 25 bp, Rattus norvegicus
atgcttctgaaatctgatactgtag

SEQ ID NO: 195021 - DNA, 25 bp, Rattus norvegicus
atgcttctgactagaccattagcgt

SEQ ID NO: 195022 - DNA, 25 bp, Rattus norvegicus
atgcttctgacttgaccattagcgt

SEQ ID NO: 195023 - DNA, 25 bp, Rattus norvegicus
atgcttctgaggcttcttaacttgg

SEQ ID NO: 195024 - DNA, 25 bp, Rattus norvegicus
atgcttctgagggttcttaacttgg

SEQ ID NO: 195025 - DNA, 25 bp, Rattus norvegicus
atgcttctgcaaatactttctctta

SEQ ID NO: 195026 - DNA, 25 bp, Rattus norvegicus
atgcttctgcaattactttctctta

SEQ ID NO: 195027 - DNA, 25 bp, Rattus norvegicus
atgcttctggctctactttcttgtc

SEQ ID NO: 195028 - DNA, 25 bp, Rattus norvegicus
atgcttctggctgtactttcttgtc

SEQ ID NO: 195029 - DNA, 25 bp, Rattus norvegicus
atgcttctgggtcccggaaacacta

SEQ ID NO: 195030 - DNA, 25 bp, Rattus norvegicus
atgcttctgggtgccggaaacacta

SEQ ID NO: 195031 - DNA, 25 bp, Rattus norvegicus
atgcttctgtctaaggattttccaa

SEQ ID NO: 195032 - DNA, 25 bp, Rattus norvegicus
atgcttctgtcttaggattttccaa

SEQ ID NO: 195033 - DNA, 25 bp, Rattus norvegicus
atgcttctgtgacaagctgtcgcca

SEQ ID NO: 195034 - DNA, 25 bp, Rattus norvegicus
atgcttctgtgagaagctgtcgcca

SEQ ID NO: 195035 - DNA, 25 bp, Rattus norvegicus
atgcttctgtggctggccagtgtct

SEQ ID NO: 195036 - DNA, 25 bp, Rattus norvegicus
atgcttctgtgggtggccagtgtct

SEQ ID NO: 195037 - DNA, 25 bp, Rattus norvegicus
atgcttctgttgatggaatccgtcc

SEQ ID NO: 195038 - DNA, 25 bp, Rattus norvegicus
atgcttctgttgttggaatccgtcc

SEQ ID NO: 195039 - DNA, 25 bp, Rattus norvegicus
atgcttcttcagacacactttcatt

SEQ ID NO: 195040 - DNA, 25 bp, Rattus norvegicus
atgcttcttcagatgctgacggatc

SEQ ID NO: 195041 - DNA, 25 bp, Rattus norvegicus
atgcttcttcagtcacactttcatt

SEQ ID NO: 195042 - DNA, 25 bp, Rattus norvegicus
atgcttcttcagttgctgacggatc

SEQ ID NO: 195043 - DNA, 25 bp, Rattus norvegicus
atgcttcttcctattacgatgtgta

SEQ ID NO: 195044 - DNA, 25 bp, Rattus norvegicus
atgcttcttccttttacgatgtgta

SEQ ID NO: 195045 - DNA, 25 bp, Rattus norvegicus
atgcttctttagaattcgaactgta

SEQ ID NO: 195046 - DNA, 25 bp, Rattus norvegicus
atgcttctttagtattcgaactgta

SEQ ID NO: 195047 - DNA, 25 bp, Rattus norvegicus
atgcttgaacctacaaattgcttgt

SEQ ID NO: 195048 - DNA, 25 bp, Rattus norvegicus
atgcttgaaccttcaaattgcttgt

SEQ ID NO: 195049 - DNA, 25 bp, Rattus norvegicus
atgcttgaattaatctccttcttag

SEQ ID NO: 195050 - DNA, 25 bp, Rattus norvegicus
atgcttgaattattctccttcttag

SEQ ID NO: 195051 - DNA, 25 bp, Rattus norvegicus
atgcttgacaagacagtttcctgga

SEQ ID NO: 195052 - DNA, 25 bp, Rattus norvegicus
atgcttgacaagtcagtttcctgga

SEQ ID NO: 195053 - DNA, 25 bp, Rattus norvegicus
atgcttgacctccatgagatctgga

SEQ ID NO: 195054 - DNA, 25 bp, Rattus norvegicus
atgcttgacctcgatgagatctgga

SEQ ID NO: 195055 - DNA, 25 bp, Rattus norvegicus
atgcttgacgaacttttcctgctcc

SEQ ID NO: 195056 - DNA, 25 bp, Rattus norvegicus
atgcttgacgaagttttcctgctcc

SEQ ID NO: 195057 - DNA, 25 bp, Rattus norvegicus
atgcttgactttcttgttttccaga

SEQ ID NO: 195058 - DNA, 25 bp, Rattus norvegicus
atgcttgactttgttgttttccaga

SEQ ID NO: 195059 - DNA, 25 bp, Rattus norvegicus
atgcttgagccaaagctgctcttac

SEQ ID NO: 195060 - DNA, 25 bp, Rattus norvegicus
atgcttgagccatagctgctcttac

SEQ ID NO: 195061 - DNA, 25 bp, Rattus norvegicus
atgcttgagggcagtccaaaccaca

SEQ ID NO: 195062 - DNA, 25 bp, Rattus norvegicus
atgcttgagggctgtccaaaccaca

SEQ ID NO: 195063 - DNA, 25 bp, Rattus norvegicus
atgcttgattacattttcacacttg

SEQ ID NO: 195064 - DNA, 25 bp, Rattus norvegicus
atgcttgattactttttcacacttg

SEQ ID NO: 195065 - DNA, 25 bp, Rattus norvegicus
atgcttgcactaacggaaccagcgg

SEQ ID NO: 195066 - DNA, 25 bp, Rattus norvegicus
atgcttgcactatcggaaccagcgg

SEQ ID NO: 195067 - DNA, 25 bp, Rattus norvegicus
atgcttgcaggtaactttcctttca

SEQ ID NO: 195068 - DNA, 25 bp, Rattus norvegicus
atgcttgcaggttactttcctttca

SEQ ID NO: 195069 - DNA, 25 bp, Rattus norvegicus
atgcttgcatgactgaacggcgtct

SEQ ID NO: 195070 - DNA, 25 bp, Rattus norvegicus
atgcttgcatgagtgaacggcgtct

SEQ ID NO: 195071 - DNA, 25 bp, Rattus norvegicus
atgcttgccaagaggagaccgtgtt

SEQ ID NO: 195072 - DNA, 25 bp, Rattus norvegicus
atgcttgccaagtggagaccgtgtt

SEQ ID NO: 195073 - DNA, 25 bp, Rattus norvegicus
atgcttgccagtcccagcatggcac

SEQ ID NO: 195074 - DNA, 25 bp, Rattus norvegicus
atgcttgccagtgccagcatggcac

SEQ ID NO: 195075 - DNA, 25 bp, Rattus norvegicus
atgcttgcccacatgatgactgcat

SEQ ID NO: 195076 - DNA, 25 bp, Rattus norvegicus
atgcttgcccacttgatgactgcat

SEQ ID NO: 195077 - DNA, 25 bp, Rattus norvegicus
atgcttgcccatacatttcctcaga

SEQ ID NO: 195078 - DNA, 25 bp, Rattus norvegicus
atgcttgcccattcatttcctcaga

SEQ ID NO: 195079 - DNA, 25 bp, Rattus norvegicus
atgcttgccccactggttctcaggg

SEQ ID NO: 195080 - DNA, 25 bp, Rattus norvegicus
atgcttgccccagtggttctcaggg

SEQ ID NO: 195081 - DNA, 25 bp, Rattus norvegicus
atgcttgccgcgcttgcagttgaaa

SEQ ID NO: 195082 - DNA, 25 bp, Rattus norvegicus
atgcttgccgcggttgcagttgaaa

SEQ ID NO: 195083 - DNA, 25 bp, Rattus norvegicus
atgcttgcctgcacagagagcatga

SEQ ID NO: 195084 - DNA, 25 bp, Rattus norvegicus
atgcttgcctgctcagagagcatga

SEQ ID NO: 195085 - DNA, 25 bp, Rattus norvegicus
atgcttgcgtacatttgcatgcacc

SEQ ID NO: 195086 - DNA, 25 bp, Rattus norvegicus
atgcttgcgtacttttgcatgcacc

SEQ ID NO: 195087 - DNA, 25 bp, Rattus norvegicus
atgcttgctaagcacatgttcctca

SEQ ID NO: 195088 - DNA, 25 bp, Rattus norvegicus
atgcttgctaaggacatgttcctca

SEQ ID NO: 195089 - DNA, 25 bp, Rattus norvegicus
atgcttgctattactatcctgtcca

SEQ ID NO: 195090 - DNA, 25 bp, Rattus norvegicus
atgcttgctatttctatcctgtcca

SEQ ID NO: 195091 - DNA, 25 bp, Rattus norvegicus
atgcttgctcaactgtttggcttat

SEQ ID NO: 195092 - DNA, 25 bp, Rattus norvegicus
atgcttgctcaagtgtttggcttat

SEQ ID NO: 195093 - DNA, 25 bp, Rattus norvegicus
atgcttgctgtccaaactactcagt

SEQ ID NO: 195094 - DNA, 25 bp, Rattus norvegicus
atgcttgctgtcgaaactactcagt

SEQ ID NO: 195095 - DNA, 25 bp, Rattus norvegicus
atgcttggagctcttcagtgacttc

SEQ ID NO: 195096 - DNA, 25 bp, Rattus norvegicus
atgcttggagctgttcagtgacttc

SEQ ID NO: 195097 - DNA, 25 bp, Rattus norvegicus
atgcttggcacacactaggccggaa

SEQ ID NO: 195098 - DNA, 25 bp, Rattus norvegicus
atgcttggcacagactaggccggaa

SEQ ID NO: 195099 - DNA, 25 bp, Rattus norvegicus
atgcttggcactaaagaacgggtct

SEQ ID NO: 195100 - DNA, 25 bp, Rattus norvegicus
atgcttggcacttaagaacgggtct

SEQ ID NO: 195101 - DNA, 25 bp, Rattus norvegicus
atgcttggccaaatgtagtttgtct

SEQ ID NO: 195102 - DNA, 25 bp, Rattus norvegicus
atgcttggccaacactatacacttt

SEQ ID NO: 195103 - DNA, 25 bp, Rattus norvegicus
atgcttggccaactcattccaggac

SEQ ID NO: 195104 - DNA, 25 bp, Rattus norvegicus
atgcttggccaagactatacacttt

SEQ ID NO: 195105 - DNA, 25 bp, Rattus norvegicus
atgcttggccaagtcattccaggac

SEQ ID NO: 195106 - DNA, 25 bp, Rattus norvegicus
atgcttggccaattgtagtttgtct

SEQ ID NO: 195107 - DNA, 25 bp, Rattus norvegicus
atgcttggcctcaggcaggcaggca

SEQ ID NO: 195108 - DNA, 25 bp, Rattus norvegicus
atgcttggcctctggcaggcaggca

SEQ ID NO: 195109 - DNA, 25 bp, Rattus norvegicus
atgcttggctctacagtacttagtc

SEQ ID NO: 195110 - DNA, 25 bp, Rattus norvegicus
atgcttggctcttcagtacttagtc

SEQ ID NO: 195111 - DNA, 25 bp, Rattus norvegicus
atgcttggtaaaccgcccacatggt

SEQ ID NO: 195112 - DNA, 25 bp, Rattus norvegicus
atgcttggtaaagcgcccacatggt

SEQ ID NO: 195113 - DNA, 25 bp, Rattus norvegicus
atgcttgtaagaaagcccctactcc

SEQ ID NO: 195114 - DNA, 25 bp, Rattus norvegicus
atgcttgtaagatagcccctactcc

SEQ ID NO: 195115 - DNA, 25 bp, Rattus norvegicus
atgcttgtaagcaaccatgaggtac

SEQ ID NO: 195116 - DNA, 25 bp, Rattus norvegicus
atgcttgtaagctaccatgaggtac

SEQ ID NO: 195117 - DNA, 25 bp, Rattus norvegicus
atgcttgtacagattattgcctacc

SEQ ID NO: 195118 - DNA, 25 bp, Rattus norvegicus
atgcttgtacagtttattgcctacc

SEQ ID NO: 195119 - DNA, 25 bp, Rattus norvegicus
atgcttgtactcacagctgccagga

SEQ ID NO: 195120 - DNA, 25 bp, Rattus norvegicus
atgcttgtactctcagctgccagga

SEQ ID NO: 195121 - DNA, 25 bp, Rattus norvegicus
atgcttgtatatccttttaatccta

SEQ ID NO: 195122 - DNA, 25 bp, Rattus norvegicus
atgcttgtatatgcttttaatccta

SEQ ID NO: 195123 - DNA, 25 bp, Rattus norvegicus
atgcttgtcataccaaatgttgtcg

SEQ ID NO: 195124 - DNA, 25 bp, Rattus norvegicus
atgcttgtcatagcaaatgttgtcg

SEQ ID NO: 195125 - DNA, 25 bp, Rattus norvegicus
atgcttgtcatgactaagccgtaga

SEQ ID NO: 195126 - DNA, 25 bp, Rattus norvegicus
atgcttgtcatgtctaagccgtaga

SEQ ID NO: 195127 - DNA, 25 bp, Rattus norvegicus
atgcttgtcctcaacgattcctgtg

SEQ ID NO: 195128 - DNA, 25 bp, Rattus norvegicus
atgcttgtcctccttagcctcaggc

SEQ ID NO: 195129 - DNA, 25 bp, Rattus norvegicus
atgcttgtcctcgttagcctcaggc

SEQ ID NO: 195130 - DNA, 25 bp, Rattus norvegicus
atgcttgtcctctacgattcctgtg

SEQ ID NO: 195131 - DNA, 25 bp, Rattus norvegicus
atgcttgtgagccagtatctgttct

SEQ ID NO: 195132 - DNA, 25 bp, Rattus norvegicus
atgcttgtgagcgagtatctgttct

SEQ ID NO: 195133 - DNA, 25 bp, Rattus norvegicus
atgcttgtgcctcagctgtcaaaag

SEQ ID NO: 195134 - DNA, 25 bp, Rattus norvegicus
atgcttgtgcctgagctgtcaaaag

SEQ ID NO: 195135 - DNA, 25 bp, Rattus norvegicus
atgcttgttgctcatgaggcctgaa

SEQ ID NO: 195136 - DNA, 25 bp, Rattus norvegicus
atgcttgttgctgatgaggcctgaa

SEQ ID NO: 195137 - DNA, 25 bp, Rattus norvegicus
atgctttaaaacatgaaccccattt

SEQ ID NO: 195138 - DNA, 25 bp, Rattus norvegicus
atgctttaaaacttgaaccccattt

SEQ ID NO: 195139 - DNA, 25 bp, Rattus norvegicus
atgctttaacatactagtcctccaa

SEQ ID NO: 195140 - DNA, 25 bp, Rattus norvegicus
atgctttaacattctagtcctccaa

SEQ ID NO: 195141 - DNA, 25 bp, Rattus norvegicus
atgctttaagtgatacgctctctct

SEQ ID NO: 195142 - DNA, 25 bp, Rattus norvegicus
atgctttaagtgttacgctctctct

SEQ ID NO: 195143 - DNA, 25 bp, Rattus norvegicus
atgctttactggataagtgtgccaa

SEQ ID NO: 195144 - DNA, 25 bp, Rattus norvegicus
atgctttactggttaagtgtgccaa

SEQ ID NO: 195145 - DNA, 25 bp, Rattus norvegicus
atgctttagcagaagtcattgtggg

SEQ ID NO: 195146 - DNA, 25 bp, Rattus norvegicus
atgctttagcagactgtggtagcac

SEQ ID NO: 195147 - DNA, 25 bp, Rattus norvegicus
atgctttagcagtagtcattgtggg

SEQ ID NO: 195148 - DNA, 25 bp, Rattus norvegicus
atgctttagcagtctgtggtagcac

SEQ ID NO: 195149 - DNA, 25 bp, Rattus norvegicus
atgctttagcccacacttagagacg

SEQ ID NO: 195150 - DNA, 25 bp, Rattus norvegicus
atgctttagccctcacttagagacg

SEQ ID NO: 195151 - DNA, 25 bp, Rattus norvegicus
atgctttatattactgcccatcagg

SEQ ID NO: 195152 - DNA, 25 bp, Rattus norvegicus
atgctttatatttctgcccatcagg

SEQ ID NO: 195153 - DNA, 25 bp, Rattus norvegicus
atgctttcaagcctttagggactgg

SEQ ID NO: 195154 - DNA, 25 bp, Rattus norvegicus
atgctttcaagcgtttagggactgg

SEQ ID NO: 195155 - DNA, 25 bp, Rattus norvegicus
atgctttcagggactttgtgcgttc

SEQ ID NO: 195156 - DNA, 25 bp, Rattus norvegicus
atgctttcagggtctttgtgcgttc

SEQ ID NO: 195157 - DNA, 25 bp, Rattus norvegicus
atgctttcagtgagccaaacgccgg

SEQ ID NO: 195158 - DNA, 25 bp, Rattus norvegicus
atgctttcagtgtgccaaacgccgg

SEQ ID NO: 195159 - DNA, 25 bp, Rattus norvegicus
atgctttcatgaacatccgtctggc

SEQ ID NO: 195160 - DNA, 25 bp, Rattus norvegicus
atgctttcatgatcatccgtctggc

SEQ ID NO: 195161 - DNA, 25 bp, Rattus norvegicus
atgctttccctgcagagcctgacaa

SEQ ID NO: 195162 - DNA, 25 bp, Rattus norvegicus
atgctttccctggagagcctgacaa

SEQ ID NO: 195163 - DNA, 25 bp, Rattus norvegicus
atgctttcctttatctgtgatctga

SEQ ID NO: 195164 - DNA, 25 bp, Rattus norvegicus
atgctttcctttcctacctaagaag

SEQ ID NO: 195165 - DNA, 25 bp, Rattus norvegicus
atgctttcctttgctacctaagaag

SEQ ID NO: 195166 - DNA, 25 bp, Rattus norvegicus
atgctttcctttttctgtgatctga

SEQ ID NO: 195167 - DNA, 25 bp, Rattus norvegicus
atgctttcgggcatgattgtaacca

SEQ ID NO: 195168 - DNA, 25 bp, Rattus norvegicus
atgctttcgggcttgattgtaacca

SEQ ID NO: 195169 - DNA, 25 bp, Rattus norvegicus
atgctttctagtccccagcacattt

SEQ ID NO: 195170 - DNA, 25 bp, Rattus norvegicus
atgctttctagtgcccagcacattt

SEQ ID NO: 195171 - DNA, 25 bp, Rattus norvegicus
atgctttctatcatgcgttgactgt

SEQ ID NO: 195172 - DNA, 25 bp, Rattus norvegicus
atgctttctatcttgcgttgactgt

SEQ ID NO: 195173 - DNA, 25 bp, Rattus norvegicus
atgctttctcacatgcaagtttcat

SEQ ID NO: 195174 - DNA, 25 bp, Rattus norvegicus
atgctttctcacttgcaagtttcat

SEQ ID NO: 195175 - DNA, 25 bp, Rattus norvegicus
atgctttctgaaaaggccactgtac

SEQ ID NO: 195176 - DNA, 25 bp, Rattus norvegicus
atgctttctgaaaccatcgttgtcg

SEQ ID NO: 195177 - DNA, 25 bp, Rattus norvegicus
atgctttctgaataggccactgtac

SEQ ID NO: 195178 - DNA, 25 bp, Rattus norvegicus
atgctttctgaatccatcgttgtcg

SEQ ID NO: 195179 - DNA, 25 bp, Rattus norvegicus
atgctttctgacacaggtctgggct

SEQ ID NO: 195180 - DNA, 25 bp, Rattus norvegicus
atgctttctgactcaggtctgggct

SEQ ID NO: 195181 - DNA, 25 bp, Rattus norvegicus
atgctttctgttattattgtacctg

SEQ ID NO: 195182 - DNA, 25 bp, Rattus norvegicus
atgctttctgtttttattgtacctg

SEQ ID NO: 195183 - DNA, 25 bp, Rattus norvegicus
atgctttcttctagaccttgtttga

SEQ ID NO: 195184 - DNA, 25 bp, Rattus norvegicus
atgctttcttcttgaccttgtttga

SEQ ID NO: 195185 - DNA, 25 bp, Rattus norvegicus
atgctttctttcagtctcgttccga

SEQ ID NO: 195186 - DNA, 25 bp, Rattus norvegicus
atgctttctttctgtctcgttccga

SEQ ID NO: 195187 - DNA, 25 bp, Rattus norvegicus
atgctttcttttatggtgacgtgtg

SEQ ID NO: 195188 - DNA, 25 bp, Rattus norvegicus
atgctttcttttttggtgacgtgtg

SEQ ID NO: 195189 - DNA, 25 bp, Rattus norvegicus
atgctttgaatcatgcactatgtca

SEQ ID NO: 195190 - DNA, 25 bp, Rattus norvegicus
atgctttgaatcttgcactatgtca

SEQ ID NO: 195191 - DNA, 25 bp, Rattus norvegicus
atgctttgagatctacgttcgtttt

SEQ ID NO: 195192 - DNA, 25 bp, Rattus norvegicus
atgctttgagatgtacgttcgtttt

SEQ ID NO: 195193 - DNA, 25 bp, Rattus norvegicus
atgctttgagctctagagttccctt

SEQ ID NO: 195194 - DNA, 25 bp, Rattus norvegicus
atgctttgagctgtagagttccctt

SEQ ID NO: 195195 - DNA, 25 bp, Rattus norvegicus
atgctttgagtgatttctggcctga

SEQ ID NO: 195196 - DNA, 25 bp, Rattus norvegicus
atgctttgagtgttttctggcctga

SEQ ID NO: 195197 - DNA, 25 bp, Rattus norvegicus
atgctttgcaatcccggttgtttga

SEQ ID NO: 195198 - DNA, 25 bp, Rattus norvegicus
atgctttgcaatgccggttgtttga

SEQ ID NO: 195199 - DNA, 25 bp, Rattus norvegicus
atgctttgctatctcactgtgtctg

SEQ ID NO: 195200 - DNA, 25 bp, Rattus norvegicus
atgctttgctatgtcactgtgtctg

SEQ ID NO: 195201 - DNA, 25 bp, Rattus norvegicus
atgctttgctttctggtgctgtata

SEQ ID NO: 195202 - DNA, 25 bp, Rattus norvegicus
atgctttgctttgtggtgctgtata

SEQ ID NO: 195203 - DNA, 25 bp, Rattus norvegicus
atgctttggctcagtctgacgtggg

SEQ ID NO: 195204 - DNA, 25 bp, Rattus norvegicus
atgctttggctctgtctgacgtggg

SEQ ID NO: 195205 - DNA, 25 bp, Rattus norvegicus
atgctttggcttctaaagggcttct

SEQ ID NO: 195206 - DNA, 25 bp, Rattus norvegicus
atgctttggcttgtaaagggcttct

SEQ ID NO: 195207 - DNA, 25 bp, Rattus norvegicus
atgctttggtctctgcgttaagccc

SEQ ID NO: 195208 - DNA, 25 bp, Rattus norvegicus
atgctttggtctgtgcgttaagccc

SEQ ID NO: 195209 - DNA, 25 bp, Rattus norvegicus
atgctttgtctgcagccttgacttg

SEQ ID NO: 195210 - DNA, 25 bp, Rattus norvegicus
atgctttgtctggagccttgacttg

SEQ ID NO: 195211 - DNA, 25 bp, Rattus norvegicus
atgctttgttgcaggtagctctctg

SEQ ID NO: 195212 - DNA, 25 bp, Rattus norvegicus
atgctttgttgctggtagctctctg

SEQ ID NO: 195213 - DNA, 25 bp, Rattus norvegicus
atgcttttaacaatcttgtgtcacc

SEQ ID NO: 195214 - DNA, 25 bp, Rattus norvegicus
atgcttttaacattcttgtgtcacc

SEQ ID NO: 195215 - DNA, 25 bp, Rattus norvegicus
atgcttttagcactgctttgctgat

SEQ ID NO: 195216 - DNA, 25 bp, Rattus norvegicus
atgcttttagcagtgctttgctgat

SEQ ID NO: 195217 - DNA, 25 bp, Rattus norvegicus
atgcttttccatctagacttttctg

SEQ ID NO: 195218 - DNA, 25 bp, Rattus norvegicus
atgcttttccatgtagacttttctg

SEQ ID NO: 195219 - DNA, 25 bp, Rattus norvegicus
atgcttttcttcacagacacctata

SEQ ID NO: 195220 - DNA, 25 bp, Rattus norvegicus
atgcttttcttctcagacacctata

SEQ ID NO: 195221 - DNA, 25 bp, Rattus norvegicus
atgcttttctttatcctcattctca

SEQ ID NO: 195222 - DNA, 25 bp, Rattus norvegicus
atgcttttctttttcctcattctca

SEQ ID NO: 195223 - DNA, 25 bp, Rattus norvegicus
atgcttttgatgaaggtgtgtccac

SEQ ID NO: 195224 - DNA, 25 bp, Rattus norvegicus
atgcttttgatgtaggtgtgtccac

SEQ ID NO: 195225 - DNA, 25 bp, Rattus norvegicus
atgcttttggctaatatttttatta

SEQ ID NO: 195226 - DNA, 25 bp, Rattus norvegicus
atgcttttggcttatatttttatta

SEQ ID NO: 195227 - DNA, 25 bp, Rattus norvegicus
atgcttttgtggcttactttgctga

SEQ ID NO: 195228 - DNA, 25 bp, Rattus norvegicus
atgcttttgtgggttactttgctga

SEQ ID NO: 195229 - DNA, 25 bp, Rattus norvegicus
atgcttttgtttctcttgtgctgtt

SEQ ID NO: 195230 - DNA, 25 bp, Rattus norvegicus
atgcttttgtttgtcttgtgctgtt

SEQ ID NO: 195231 - DNA, 25 bp, Rattus norvegicus
atgctttttgcactagttgtcttgt

SEQ ID NO: 195232 - DNA, 25 bp, Rattus norvegicus
atgctttttgcagtagttgtcttgt

SEQ ID NO: 195233 - DNA, 25 bp, Rattus norvegicus
atgcttttttgaaagccagcctctg

SEQ ID NO: 195234 - DNA, 25 bp, Rattus norvegicus
atgcttttttgatagccagcctctg

SEQ ID NO: 195235 - DNA, 25 bp, Rattus norvegicus
atggaaaaaccgctgggctgctcac

SEQ ID NO: 195236 - DNA, 25 bp, Rattus norvegicus
atggaaaaaccggtgggctgctcac

SEQ ID NO: 195237 - DNA, 25 bp, Rattus norvegicus
atggaaaacatcagcagagctgctt

SEQ ID NO: 195238 - DNA, 25 bp, Rattus norvegicus
atggaaaacatcatcctcctttgtc

SEQ ID NO: 195239 - DNA, 25 bp, Rattus norvegicus
atggaaaacatctgcagagctgctt

SEQ ID NO: 195240 - DNA, 25 bp, Rattus norvegicus
atggaaaacatcttcctcctttgtc

SEQ ID NO: 195241 - DNA, 25 bp, Rattus norvegicus
atggaaaagccgcatgccactgagc

SEQ ID NO: 195242 - DNA, 25 bp, Rattus norvegicus
atggaaaagccggatgccactgagc

SEQ ID NO: 195243 - DNA, 25 bp, Rattus norvegicus
atggaaaatagccatcgctgccagg

SEQ ID NO: 195244 - DNA, 25 bp, Rattus norvegicus
atggaaaatagcgatcgctgccagg

SEQ ID NO: 195245 - DNA, 25 bp, Rattus norvegicus
atggaaaatttcaggcttgctcctt

SEQ ID NO: 195246 - DNA, 25 bp, Rattus norvegicus
atggaaaatttctggcttgctcctt

SEQ ID NO: 195247 - DNA, 25 bp, Rattus norvegicus
atggaaacaacaacccagagccttc

SEQ ID NO: 195248 - DNA, 25 bp, Rattus norvegicus
atggaaacaacatcccagagccttc

SEQ ID NO: 195249 - DNA, 25 bp, Rattus norvegicus
atggaaacatcaacctcaagaaggg

SEQ ID NO: 195250 - DNA, 25 bp, Rattus norvegicus
atggaaacatcatcctcaagaaggg

SEQ ID NO: 195251 - DNA, 25 bp, Rattus norvegicus
atggaaacattgacgggcaaccttc

SEQ ID NO: 195252 - DNA, 25 bp, Rattus norvegicus
atggaaacattgtcgggcaaccttc

SEQ ID NO: 195253 - DNA, 25 bp, Rattus norvegicus
atggaaaccagtagaccccttccag

SEQ ID NO: 195254 - DNA, 25 bp, Rattus norvegicus
atggaaaccagttgaccccttccag

SEQ ID NO: 195255 - DNA, 25 bp, Rattus norvegicus
atggaaaccatcactggctgcactt

SEQ ID NO: 195256 - DNA, 25 bp, Rattus norvegicus
atggaaaccatctctggctgcactt

SEQ ID NO: 195257 - DNA, 25 bp, Rattus norvegicus
atggaaaccggacacgtgacatcca

SEQ ID NO: 195258 - DNA, 25 bp, Rattus norvegicus
atggaaaccggagacgtgacatcca

SEQ ID NO: 195259 - DNA, 25 bp, Rattus norvegicus
atggaaaccttcaccgaactgattc

SEQ ID NO: 195260 - DNA, 25 bp, Rattus norvegicus
atggaaaccttctccgaactgattc

SEQ ID NO: 195261 - DNA, 25 bp, Rattus norvegicus
atggaaactcggcaagtctatgtga

SEQ ID NO: 195262 - DNA, 25 bp, Rattus norvegicus
atggaaactcgggaagtctatgtga

SEQ ID NO: 195263 - DNA, 25 bp, Rattus norvegicus
atggaaactctacgcttacctcctg

SEQ ID NO: 195264 - DNA, 25 bp, Rattus norvegicus
atggaaactctaggcttacctcctg

SEQ ID NO: 195265 - DNA, 25 bp, Rattus norvegicus
atggaaactgctataaggcccgaag

SEQ ID NO: 195266 - DNA, 25 bp, Rattus norvegicus
atggaaactgctttaaggcccgaag

SEQ ID NO: 195267 - DNA, 25 bp, Rattus norvegicus
atggaaactggcaaagcctccctga

SEQ ID NO: 195268 - DNA, 25 bp, Rattus norvegicus
atggaaactggctaagcctccctga

SEQ ID NO: 195269 - DNA, 25 bp, Rattus norvegicus
atggaaacttctagccagtgtgtgc

SEQ ID NO: 195270 - DNA, 25 bp, Rattus norvegicus
atggaaacttcttgccagtgtgtgc

SEQ ID NO: 195271 - DNA, 25 bp, Rattus norvegicus
atggaaagccaaaacttaccctgtg

SEQ ID NO: 195272 - DNA, 25 bp, Rattus norvegicus
atggaaagccaatacttaccctgtg

SEQ ID NO: 195273 - DNA, 25 bp, Rattus norvegicus
atggaaagctacaccagatggattt

SEQ ID NO: 195274 - DNA, 25 bp, Rattus norvegicus
atggaaagctacatcctgccatcac

SEQ ID NO: 195275 - DNA, 25 bp, Rattus norvegicus
atggaaagctactccagatggattt

SEQ ID NO: 195276 - DNA, 25 bp, Rattus norvegicus
atggaaagctacttcctgccatcac

SEQ ID NO: 195277 - DNA, 25 bp, Rattus norvegicus
atggaaagtcatcacagcttcccca

SEQ ID NO: 195278 - DNA, 25 bp, Rattus norvegicus
atggaaagtcatgacagcttcccca

SEQ ID NO: 195279 - DNA, 25 bp, Rattus norvegicus
atggaaataatgctcctcttgagga

SEQ ID NO: 195280 - DNA, 25 bp, Rattus norvegicus
atggaaataatggtcctcttgagga

SEQ ID NO: 195281 - DNA, 25 bp, Rattus norvegicus
atggaaatcaaacaacttcagcaag

SEQ ID NO: 195282 - DNA, 25 bp, Rattus norvegicus
atggaaatcaaagaacttcagcaag

SEQ ID NO: 195283 - DNA, 25 bp, Rattus norvegicus
atggaaatcctcattcctcaactct

SEQ ID NO: 195284 - DNA, 25 bp, Rattus norvegicus
atggaaatcctctttcctcaactct

SEQ ID NO: 195285 - DNA, 25 bp, Rattus norvegicus
atggaaatcgtcacctacggccgga

SEQ ID NO: 195286 - DNA, 25 bp, Rattus norvegicus
atggaaatcgtctcctacggccgga

SEQ ID NO: 195287 - DNA, 25 bp, Rattus norvegicus
atggaaatggcacttacctctcctg

SEQ ID NO: 195288 - DNA, 25 bp, Rattus norvegicus
atggaaatggcagttacctctcctg

SEQ ID NO: 195289 - DNA, 25 bp, Rattus norvegicus
atggaaattccactgagactcctgg

SEQ ID NO: 195290 - DNA, 25 bp, Rattus norvegicus
atggaaattccagtgagactcctgg

SEQ ID NO: 195291 - DNA, 25 bp, Rattus norvegicus
atggaaattggaatcagtgacctct

SEQ ID NO: 195292 - DNA, 25 bp, Rattus norvegicus
atggaaattggattcagtgacctct

SEQ ID NO: 195293 - DNA, 25 bp, Rattus norvegicus
atggaaattgggagctctgcctcag

SEQ ID NO: 195294 - DNA, 25 bp, Rattus norvegicus
atggaaattgggtgctctgcctcag

SEQ ID NO: 195295 - DNA, 25 bp, Rattus norvegicus
atggaacaccagacctcaaaattat

SEQ ID NO: 195296 - DNA, 25 bp, Rattus norvegicus
atggaacaccagtcctcaaaattat

SEQ ID NO: 195297 - DNA, 25 bp, Rattus norvegicus
atggaacaggaactcgattacgtgc

SEQ ID NO: 195298 - DNA, 25 bp, Rattus norvegicus
atggaacaggaagtcgattacgtgc

SEQ ID NO: 195299 - DNA, 25 bp, Rattus norvegicus
atggaacatcatccctccttgggat

SEQ ID NO: 195300 - DNA, 25 bp, Rattus norvegicus
atggaacatcatgcctccttgggat

SEQ ID NO: 195301 - DNA, 25 bp, Rattus norvegicus
atggaacatcttccagggctgcagc

SEQ ID NO: 195302 - DNA, 25 bp, Rattus norvegicus
atggaacatcttgcagggctgcagc

SEQ ID NO: 195303 - DNA, 25 bp, Rattus norvegicus
atggaaccagacacaggccacctgt

SEQ ID NO: 195304 - DNA, 25 bp, Rattus norvegicus
atggaaccagactcaggccacctgt

SEQ ID NO: 195305 - DNA, 25 bp, Rattus norvegicus
atggaaccagagaaccacatccctg

SEQ ID NO: 195306 - DNA, 25 bp, Rattus norvegicus
atggaaccagagtaccacatccctg

SEQ ID NO: 195307 - DNA, 25 bp, Rattus norvegicus
atggaaccagatcttggacccctgg

SEQ ID NO: 195308 - DNA, 25 bp, Rattus norvegicus
atggaaccagatgttggacccctgg

SEQ ID NO: 195309 - DNA, 25 bp, Rattus norvegicus
atggaacccctcatttcagacatgt

SEQ ID NO: 195310 - DNA, 25 bp, Rattus norvegicus
atggaacccctcttttcagacatgt

SEQ ID NO: 195311 - DNA, 25 bp, Rattus norvegicus
atggaacctaacagagatctcgtga

SEQ ID NO: 195312 - DNA, 25 bp, Rattus norvegicus
atggaacctaactgagatctcgtga

SEQ ID NO: 195313 - DNA, 25 bp, Rattus norvegicus
atggaacctagcaccttcctgggaa

SEQ ID NO: 195314 - DNA, 25 bp, Rattus norvegicus
atggaacctagctccttcctgggaa

SEQ ID NO: 195315 - DNA, 25 bp, Rattus norvegicus
atggaacctcatcattgcccttgtc

SEQ ID NO: 195316 - DNA, 25 bp, Rattus norvegicus
atggaacctcatgattgcccttgtc

SEQ ID NO: 195317 - DNA, 25 bp, Rattus norvegicus
atggaacctgtgagttcctctccaa

SEQ ID NO: 195318 - DNA, 25 bp, Rattus norvegicus
atggaacctgtgtgttcctctccaa

SEQ ID NO: 195319 - DNA, 25 bp, Rattus norvegicus
atggaacgggacaccctgatgctgt

SEQ ID NO: 195320 - DNA, 25 bp, Rattus norvegicus
atggaacgggactccctgatgctgt

SEQ ID NO: 195321 - DNA, 25 bp, Rattus norvegicus
atggaacgtgccaccagagctcgtt

SEQ ID NO: 195322 - DNA, 25 bp, Rattus norvegicus
atggaacgtgcctccagagctcgtt

SEQ ID NO: 195323 - DNA, 25 bp, Rattus norvegicus
atggaactacgcatgcaatcgcatc

SEQ ID NO: 195324 - DNA, 25 bp, Rattus norvegicus
atggaactacgcttgcaatcgcatc

SEQ ID NO: 195325 - DNA, 25 bp, Rattus norvegicus
atggaactagctaccctgtattcct

SEQ ID NO: 195326 - DNA, 25 bp, Rattus norvegicus
atggaactagctctacacgcccagt

SEQ ID NO: 195327 - DNA, 25 bp, Rattus norvegicus
atggaactagctgtacacgcccagt

SEQ ID NO: 195328 - DNA, 25 bp, Rattus norvegicus
atggaactagcttccctgtattcct

SEQ ID NO: 195329 - DNA, 25 bp, Rattus norvegicus
atggaactaggcccgatttgacgaa

SEQ ID NO: 195330 - DNA, 25 bp, Rattus norvegicus
atggaactaggcgcgatttgacgaa

SEQ ID NO: 195331 - DNA, 25 bp, Rattus norvegicus
atggaactcagcacatgacctctca

SEQ ID NO: 195332 - DNA, 25 bp, Rattus norvegicus
atggaactcagctcatgacctctca

SEQ ID NO: 195333 - DNA, 25 bp, Rattus norvegicus
atggaactccagatgtccggaagga

SEQ ID NO: 195334 - DNA, 25 bp, Rattus norvegicus
atggaactccagttgtccggaagga

SEQ ID NO: 195335 - DNA, 25 bp, Rattus norvegicus
atggaactgaatctgcccaccggaa

SEQ ID NO: 195336 - DNA, 25 bp, Rattus norvegicus
atggaactgaatgtgcccaccggaa

SEQ ID NO: 195337 - DNA, 25 bp, Rattus norvegicus
atggaactgactatagggccaccta

SEQ ID NO: 195338 - DNA, 25 bp, Rattus norvegicus
atggaactgactttagggccaccta

SEQ ID NO: 195339 - DNA, 25 bp, Rattus norvegicus
atggaactggtactgatggctcaac

SEQ ID NO: 195340 - DNA, 25 bp, Rattus norvegicus
atggaactggtagtgatggctcaac

SEQ ID NO: 195341 - DNA, 25 bp, Rattus norvegicus
atggaactgtagctctcttctctgg

SEQ ID NO: 195342 - DNA, 25 bp, Rattus norvegicus
atggaactgtaggtctcttctctgg

SEQ ID NO: 195343 - DNA, 25 bp, Rattus norvegicus
atggaactgtcaacgcaagggtaac

SEQ ID NO: 195344 - DNA, 25 bp, Rattus norvegicus
atggaactgtcatcgcaagggtaac

SEQ ID NO: 195345 - DNA, 25 bp, Rattus norvegicus
atggaactgtgcagtgacttggcat

SEQ ID NO: 195346 - DNA, 25 bp, Rattus norvegicus
atggaactgtgctgtgacttggcat

SEQ ID NO: 195347 - DNA, 25 bp, Rattus norvegicus
atggaacttagcaagctgtccccaa

SEQ ID NO: 195348 - DNA, 25 bp, Rattus norvegicus
atggaacttagctagctgtccccaa

SEQ ID NO: 195349 - DNA, 25 bp, Rattus norvegicus
atggaacttccacctgtaaatctag

SEQ ID NO: 195350 - DNA, 25 bp, Rattus norvegicus
atggaacttccagctgtaaatctag

SEQ ID NO: 195351 - DNA, 25 bp, Rattus norvegicus
atggaacttgctcagacccagccgg

SEQ ID NO: 195352 - DNA, 25 bp, Rattus norvegicus
atggaacttgctgagacccagccgg

SEQ ID NO: 195353 - DNA, 25 bp, Rattus norvegicus
atggaacttgttatgggagctcacc

SEQ ID NO: 195354 - DNA, 25 bp, Rattus norvegicus
atggaacttgttttgggagctcacc

SEQ ID NO: 195355 - DNA, 25 bp, Rattus norvegicus
atggaagacaatccctgtgactcat

SEQ ID NO: 195356 - DNA, 25 bp, Rattus norvegicus
atggaagacaatgcctgtgactcat

SEQ ID NO: 195357 - DNA, 25 bp, Rattus norvegicus
atggaagacatgatcttgccagctt

SEQ ID NO: 195358 - DNA, 25 bp, Rattus norvegicus
atggaagacatgttcttgccagctt

SEQ ID NO: 195359 - DNA, 25 bp, Rattus norvegicus
atggaagatccccagctcttggcgg

SEQ ID NO: 195360 - DNA, 25 bp, Rattus norvegicus
atggaagatcccgagctcttggcgg

SEQ ID NO: 195361 - DNA, 25 bp, Rattus norvegicus
atggaagatctgatcctgccccagg

SEQ ID NO: 195362 - DNA, 25 bp, Rattus norvegicus
atggaagatctgttcctgccccagg

SEQ ID NO: 195363 - DNA, 25 bp, Rattus norvegicus
atggaagatggcaccagtctccgag

SEQ ID NO: 195364 - DNA, 25 bp, Rattus norvegicus
atggaagatggctccagtctccgag

SEQ ID NO: 195365 - DNA, 25 bp, Rattus norvegicus
atggaagcacttagcccgtgacagg

SEQ ID NO: 195366 - DNA, 25 bp, Rattus norvegicus
atggaagcactttgcccgtgacagg

SEQ ID NO: 195367 - DNA, 25 bp, Rattus norvegicus
atggaagcatcacgctcgtgtgtgt

SEQ ID NO: 195368 - DNA, 25 bp, Rattus norvegicus
atggaagcatcaggctcgtgtgtgt

SEQ ID NO: 195369 - DNA, 25 bp, Rattus norvegicus
atggaagcatgtcagtgcccttgca

SEQ ID NO: 195370 - DNA, 25 bp, Rattus norvegicus
atggaagcatgtgagtgcccttgca

SEQ ID NO: 195371 - DNA, 25 bp, Rattus norvegicus
atggaagcatttaaaggagacagaa

SEQ ID NO: 195372 - DNA, 25 bp, Rattus norvegicus
atggaagcattttaaggagacagaa

SEQ ID NO: 195373 - DNA, 25 bp, Rattus norvegicus
atggaagccacaatgatcacccgga

SEQ ID NO: 195374 - DNA, 25 bp, Rattus norvegicus
atggaagccacattgatcacccgga

SEQ ID NO: 195375 - DNA, 25 bp, Rattus norvegicus
atggaagccagcaagtacgccacca

SEQ ID NO: 195376 - DNA, 25 bp, Rattus norvegicus
atggaagccagctagtacgccacca

SEQ ID NO: 195377 - DNA, 25 bp, Rattus norvegicus
atggaagccagtctcagtttctcct

SEQ ID NO: 195378 - DNA, 25 bp, Rattus norvegicus
atggaagccagtgtcagtttctcct

SEQ ID NO: 195379 - DNA, 25 bp, Rattus norvegicus
atggaagcccaacccttgtctgtaa

SEQ ID NO: 195380 - DNA, 25 bp, Rattus norvegicus
atggaagcccaagccttgtctgtaa

SEQ ID NO: 195381 - DNA, 25 bp, Rattus norvegicus
atggaagccgttctccaatgatctc

SEQ ID NO: 195382 - DNA, 25 bp, Rattus norvegicus
atggaagccgttgtccaatgatctc

SEQ ID NO: 195383 - DNA, 25 bp, Rattus norvegicus
atggaagcctgcatgcgtgttcaac

SEQ ID NO: 195384 - DNA, 25 bp, Rattus norvegicus
atggaagcctgcttgcgtgttcaac

SEQ ID NO: 195385 - DNA, 25 bp, Rattus norvegicus
atggaagcctttcccagtgctgtca

SEQ ID NO: 195386 - DNA, 25 bp, Rattus norvegicus
atggaagcctttgccagtgctgtca

SEQ ID NO: 195387 - DNA, 25 bp, Rattus norvegicus
atggaagcgccacagctagctgctc

SEQ ID NO: 195388 - DNA, 25 bp, Rattus norvegicus
atggaagcgccagagctagctgctc

SEQ ID NO: 195389 - DNA, 25 bp, Rattus norvegicus
atggaagcgggtactgcgttctctc

SEQ ID NO: 195390 - DNA, 25 bp, Rattus norvegicus
atggaagcgggttctgcgttctctc

SEQ ID NO: 195391 - DNA, 25 bp, Rattus norvegicus
atggaagctcacaagtcctctgact

SEQ ID NO: 195392 - DNA, 25 bp, Rattus norvegicus
atggaagctcactagtcctctgact

SEQ ID NO: 195393 - DNA, 25 bp, Rattus norvegicus
atggaagcttacctgttgctccctg

SEQ ID NO: 195394 - DNA, 25 bp, Rattus norvegicus
atggaagcttacgtgttgctccctg

SEQ ID NO: 195395 - DNA, 25 bp, Rattus norvegicus
atggaagcttgcaagtcgtttctcc

SEQ ID NO: 195396 - DNA, 25 bp, Rattus norvegicus
atggaagcttgctagtcgtttctcc

SEQ ID NO: 195397 - DNA, 25 bp, Rattus norvegicus
atggaaggacagaccagggccgcct

SEQ ID NO: 195398 - DNA, 25 bp, Rattus norvegicus
atggaaggacagtccagggccgcct

SEQ ID NO: 195399 - DNA, 25 bp, Rattus norvegicus
atggaaggagctcggccttacacca

SEQ ID NO: 195400 - DNA, 25 bp, Rattus norvegicus
atggaaggagctgggccttacacca

SEQ ID NO: 195401 - DNA, 25 bp, Rattus norvegicus
atggaaggcacacgactcactgatg

SEQ ID NO: 195402 - DNA, 25 bp, Rattus norvegicus
atggaaggcacaggactcactgatg

SEQ ID NO: 195403 - DNA, 25 bp, Rattus norvegicus
atggaaggcagtcgcactcgacttc

SEQ ID NO: 195404 - DNA, 25 bp, Rattus norvegicus
atggaaggcagtggcactcgacttc

SEQ ID NO: 195405 - DNA, 25 bp, Rattus norvegicus
atggaagtcataacgttgagagcgt

SEQ ID NO: 195406 - DNA, 25 bp, Rattus norvegicus
atggaagtcatatcgttgagagcgt

SEQ ID NO: 195407 - DNA, 25 bp, Rattus norvegicus
atggaagtcctcagcacctgatcag

SEQ ID NO: 195408 - DNA, 25 bp, Rattus norvegicus
atggaagtcctctgcacctgatcag

SEQ ID NO: 195409 - DNA, 25 bp, Rattus norvegicus
atggaagtcgacctggacacccgat

SEQ ID NO: 195410 - DNA, 25 bp, Rattus norvegicus
atggaagtcgacgtggacacccgat

SEQ ID NO: 195411 - DNA, 25 bp, Rattus norvegicus
atggaagtctgtccgagtccaccac

SEQ ID NO: 195412 - DNA, 25 bp, Rattus norvegicus
atggaagtctgtgcgagtccaccac

SEQ ID NO: 195413 - DNA, 25 bp, Rattus norvegicus
atggaagtctttctcttgtggcccc

SEQ ID NO: 195414 - DNA, 25 bp, Rattus norvegicus
atggaagtctttgtcttgtggcccc

SEQ ID NO: 195415 - DNA, 25 bp, Rattus norvegicus
atggaagtgcctactttggcaaccc

SEQ ID NO: 195416 - DNA, 25 bp, Rattus norvegicus
atggaagtgccttctttggcaaccc

SEQ ID NO: 195417 - DNA, 25 bp, Rattus norvegicus
atggaagttctgctatcttgtgccc

SEQ ID NO: 195418 - DNA, 25 bp, Rattus norvegicus
atggaagttctggtatcttgtgccc

SEQ ID NO: 195419 - DNA, 25 bp, Rattus norvegicus
atggaagttgaacgtgccaatccgt

SEQ ID NO: 195420 - DNA, 25 bp, Rattus norvegicus
atggaagttgaaggtgccaatccgt

SEQ ID NO: 195421 - DNA, 25 bp, Rattus norvegicus
atggaagttttaactcctgatgcta

SEQ ID NO: 195422 - DNA, 25 bp, Rattus norvegicus
atggaagttttatctcctgatgcta

SEQ ID NO: 195423 - DNA, 25 bp, Rattus norvegicus
atggaataccttaaacatacagaag

SEQ ID NO: 195424 - DNA, 25 bp, Rattus norvegicus
atggaatacctttaacatacagaag

SEQ ID NO: 195425 - DNA, 25 bp, Rattus norvegicus
atggaatattccaaagtgcctccct

SEQ ID NO: 195426 - DNA, 25 bp, Rattus norvegicus
atggaatattcctaagtgcctccct

SEQ ID NO: 195427 - DNA, 25 bp, Rattus norvegicus
atggaatcacatatcagcagcattg

SEQ ID NO: 195428 - DNA, 25 bp, Rattus norvegicus
atggaatcacatttcagcagcattg

SEQ ID NO: 195429 - DNA, 25 bp, Rattus norvegicus
atggaatcagcaccgagccggcatc

SEQ ID NO: 195430 - DNA, 25 bp, Rattus norvegicus
atggaatcagcagcgagccggcatc

SEQ ID NO: 195431 - DNA, 25 bp, Rattus norvegicus
atggaatcatcaccggagtcatgat

SEQ ID NO: 195432 - DNA, 25 bp, Rattus norvegicus
atggaatcatcagcggagtcatgat

SEQ ID NO: 195433 - DNA, 25 bp, Rattus norvegicus
atggaatcattgacagtttcagaaa

SEQ ID NO: 195434 - DNA, 25 bp, Rattus norvegicus
atggaatcattgtcagtttcagaaa

SEQ ID NO: 195435 - DNA, 25 bp, Rattus norvegicus
atggaatccaagctctgatccctgg

SEQ ID NO: 195436 - DNA, 25 bp, Rattus norvegicus
atggaatccaaggtctgatccctgg

SEQ ID NO: 195437 - DNA, 25 bp, Rattus norvegicus
atggaatccacaacggtcagtcctt

SEQ ID NO: 195438 - DNA, 25 bp, Rattus norvegicus
atggaatccacatcggtcagtcctt

SEQ ID NO: 195439 - DNA, 25 bp, Rattus norvegicus
atggaatcccagatgtagccctcct

SEQ ID NO: 195440 - DNA, 25 bp, Rattus norvegicus
atggaatcccagttgtagccctcct

SEQ ID NO: 195441 - DNA, 25 bp, Rattus norvegicus
atggaatcctgaacactgccagtca

SEQ ID NO: 195442 - DNA, 25 bp, Rattus norvegicus
atggaatcctgatcactgccagtca

SEQ ID NO: 195443 - DNA, 25 bp, Rattus norvegicus
atggaatcgaacactcacaggactg

SEQ ID NO: 195444 - DNA, 25 bp, Rattus norvegicus
atggaatcgaactctcacaggactg

SEQ ID NO: 195445 - DNA, 25 bp, Rattus norvegicus
atggaatcgtgaaatcaccctccct

SEQ ID NO: 195446 - DNA, 25 bp, Rattus norvegicus
atggaatcgtgatatcaccctccct

SEQ ID NO: 195447 - DNA, 25 bp, Rattus norvegicus
atggaatctattacacagggctgtg

SEQ ID NO: 195448 - DNA, 25 bp, Rattus norvegicus
atggaatctatttcacagggctgtg

SEQ ID NO: 195449 - DNA, 25 bp, Rattus norvegicus
atggaatctctgaaaggcctttgaa

SEQ ID NO: 195450 - DNA, 25 bp, Rattus norvegicus
atggaatctctgtaaggcctttgaa

SEQ ID NO: 195451 - DNA, 25 bp, Rattus norvegicus
atggaatctgccacttaactcttag

SEQ ID NO: 195452 - DNA, 25 bp, Rattus norvegicus
atggaatctgcctcttaactcttag

SEQ ID NO: 195453 - DNA, 25 bp, Rattus norvegicus
atggaatcttctctgggccagctat

SEQ ID NO: 195454 - DNA, 25 bp, Rattus norvegicus
atggaatcttctgtgggccagctat

SEQ ID NO: 195455 - DNA, 25 bp, Rattus norvegicus
atggaatcttgaaggcagctctgtc

SEQ ID NO: 195456 - DNA, 25 bp, Rattus norvegicus
atggaatcttgatggcagctctgtc

SEQ ID NO: 195457 - DNA, 25 bp, Rattus norvegicus
atggaatgccgtaattttttccaga

SEQ ID NO: 195458 - DNA, 25 bp, Rattus norvegicus
atggaatgccgttattttttccaga

SEQ ID NO: 195459 - DNA, 25 bp, Rattus norvegicus
atggaatggaagacccacctgtctc

SEQ ID NO: 195460 - DNA, 25 bp, Rattus norvegicus
atggaatggaagtcccacctgtctc

SEQ ID NO: 195461 - DNA, 25 bp, Rattus norvegicus
atggaatggttaaggcagctgccaa

SEQ ID NO: 195462 - DNA, 25 bp, Rattus norvegicus
atggaatggttatggcagctgccaa

SEQ ID NO: 195463 - DNA, 25 bp, Rattus norvegicus
atggaatgtaacaccgagtgcccca

SEQ ID NO: 195464 - DNA, 25 bp, Rattus norvegicus
atggaatgtaactccgagtgcccca

SEQ ID NO: 195465 - DNA, 25 bp, Rattus norvegicus
atggaatgtactccctgcatcatca

SEQ ID NO: 195466 - DNA, 25 bp, Rattus norvegicus
atggaatgtactgcctgcatcatca

SEQ ID NO: 195467 - DNA, 25 bp, Rattus norvegicus
atggaatgtctgcttttgtccacca

SEQ ID NO: 195468 - DNA, 25 bp, Rattus norvegicus
atggaatgtctggttttgtccacca

SEQ ID NO: 195469 - DNA, 25 bp, Rattus norvegicus
atggaatgtggcaacctcaatccct

SEQ ID NO: 195470 - DNA, 25 bp, Rattus norvegicus
atggaatgtggctacctcaatccct

SEQ ID NO: 195471 - DNA, 25 bp, Rattus norvegicus
atggaattcaacaggaccaacccct

SEQ ID NO: 195472 - DNA, 25 bp, Rattus norvegicus
atggaattcaactggaccaacccct

SEQ ID NO: 195473 - DNA, 25 bp, Rattus norvegicus
atggaattcagtccaactgcctctc

SEQ ID NO: 195474 - DNA, 25 bp, Rattus norvegicus
atggaattcagtgcaactgcctctc

SEQ ID NO: 195475 - DNA, 25 bp, Rattus norvegicus
atggaattctaaccaccttcgtgta

SEQ ID NO: 195476 - DNA, 25 bp, Rattus norvegicus
atggaattctaagcaccttcgtgta

SEQ ID NO: 195477 - DNA, 25 bp, Rattus norvegicus
atggaattctggacctactcttggc

SEQ ID NO: 195478 - DNA, 25 bp, Rattus norvegicus
atggaattctggtcctactcttggc

SEQ ID NO: 195479 - DNA, 25 bp, Rattus norvegicus
atggaattgtaaattttatgcttaa

SEQ ID NO: 195480 - DNA, 25 bp, Rattus norvegicus
atggaattgtaatttttatgcttaa

SEQ ID NO: 195481 - DNA, 25 bp, Rattus norvegicus
atggacaaaccgcttgtttccatgt

SEQ ID NO: 195482 - DNA, 25 bp, Rattus norvegicus
atggacaaaccggttgtttccatgt

SEQ ID NO: 195483 - DNA, 25 bp, Rattus norvegicus
atggacaaagcaaccgcccaggtgg

SEQ ID NO: 195484 - DNA, 25 bp, Rattus norvegicus
atggacaaagcatccgcccaggtgg

SEQ ID NO: 195485 - DNA, 25 bp, Rattus norvegicus
atggacaaccagctgttgggctaca

SEQ ID NO: 195486 - DNA, 25 bp, Rattus norvegicus
atggacaaccaggtgttgggctaca

SEQ ID NO: 195487 - DNA, 25 bp, Rattus norvegicus
atggacaatgtcctcctagcgtttt

SEQ ID NO: 195488 - DNA, 25 bp, Rattus norvegicus
atggacaatgtcgtcctagcgtttt

SEQ ID NO: 195489 - DNA, 25 bp, Rattus norvegicus
atggacacacgcatgcacagacgca

SEQ ID NO: 195490 - DNA, 25 bp, Rattus norvegicus
atggacacacgcttgcacagacgca

SEQ ID NO: 195491 - DNA, 25 bp, Rattus norvegicus
atggacacactgaaaacccctgggt

SEQ ID NO: 195492 - DNA, 25 bp, Rattus norvegicus
atggacacactgacgtttctttgca

SEQ ID NO: 195493 - DNA, 25 bp, Rattus norvegicus
atggacacactgtaaacccctgggt

SEQ ID NO: 195494 - DNA, 25 bp, Rattus norvegicus
atggacacactgtcgtttctttgca

SEQ ID NO: 195495 - DNA, 25 bp, Rattus norvegicus
atggacaccaagatgcagagccttc

SEQ ID NO: 195496 - DNA, 25 bp, Rattus norvegicus
atggacaccaagttgcagagccttc

SEQ ID NO: 195497 - DNA, 25 bp, Rattus norvegicus
atggacaccacaatgctactgtacc

SEQ ID NO: 195498 - DNA, 25 bp, Rattus norvegicus
atggacaccacattgctactgtacc

SEQ ID NO: 195499 - DNA, 25 bp, Rattus norvegicus
atggacaccaggcaatgtagaccag

SEQ ID NO: 195500 - DNA, 25 bp, Rattus norvegicus
atggacaccagggaatgtagaccag

SEQ ID NO: 195501 - DNA, 25 bp, Rattus norvegicus
atggacacctgtacatgcatgcggg

SEQ ID NO: 195502 - DNA, 25 bp, Rattus norvegicus
atggacacctgttcatgcatgcggg

SEQ ID NO: 195503 - DNA, 25 bp, Rattus norvegicus
atggacacgctaactgatcttaaaa

SEQ ID NO: 195504 - DNA, 25 bp, Rattus norvegicus
atggacacgctatctgatcttaaaa

SEQ ID NO: 195505 - DNA, 25 bp, Rattus norvegicus
atggacacgtggatggcccagccag

SEQ ID NO: 195506 - DNA, 25 bp, Rattus norvegicus
atggacacgtggttggcccagccag

SEQ ID NO: 195507 - DNA, 25 bp, Rattus norvegicus
atggacacgttcctgagacgctgga

SEQ ID NO: 195508 - DNA, 25 bp, Rattus norvegicus
atggacacgttcgtgagacgctgga

SEQ ID NO: 195509 - DNA, 25 bp, Rattus norvegicus
atggacactaccctggagatcccaa

SEQ ID NO: 195510 - DNA, 25 bp, Rattus norvegicus
atggacactaccgtggagatcccaa

SEQ ID NO: 195511 - DNA, 25 bp, Rattus norvegicus
atggacactcagcacctggcttggc

SEQ ID NO: 195512 - DNA, 25 bp, Rattus norvegicus
atggacactcaggacctggcttggc

SEQ ID NO: 195513 - DNA, 25 bp, Rattus norvegicus
atggacactggcagcttcgtgagga

SEQ ID NO: 195514 - DNA, 25 bp, Rattus norvegicus
atggacactggctgcttcgtgagga

SEQ ID NO: 195515 - DNA, 25 bp, Rattus norvegicus
atggacacttctagaggctccagtt

SEQ ID NO: 195516 - DNA, 25 bp, Rattus norvegicus
atggacacttcttgaggctccagtt

SEQ ID NO: 195517 - DNA, 25 bp, Rattus norvegicus
atggacagaatccagctcctagctg

SEQ ID NO: 195518 - DNA, 25 bp, Rattus norvegicus
atggacagaatcgagctcctagctg

SEQ ID NO: 195519 - DNA, 25 bp, Rattus norvegicus
atggacagacaaccgggctggcttt

SEQ ID NO: 195520 - DNA, 25 bp, Rattus norvegicus
atggacagacaagcgggctggcttt

SEQ ID NO: 195521 - DNA, 25 bp, Rattus norvegicus
atggacagaccaagcatatacatat

SEQ ID NO: 195522 - DNA, 25 bp, Rattus norvegicus
atggacagaccatgcatatacatat

SEQ ID NO: 195523 - DNA, 25 bp, Rattus norvegicus
atggacagatggatttgcatttcaa

SEQ ID NO: 195524 - DNA, 25 bp, Rattus norvegicus
atggacagatggttttgcatttcaa

SEQ ID NO: 195525 - DNA, 25 bp, Rattus norvegicus
atggacagcctgatgtgggctacct

SEQ ID NO: 195526 - DNA, 25 bp, Rattus norvegicus
atggacagcctgttgtgggctacct

SEQ ID NO: 195527 - DNA, 25 bp, Rattus norvegicus
atggacagcggaatcggctcggact

SEQ ID NO: 195528 - DNA, 25 bp, Rattus norvegicus
atggacagcggattcggctcggact

SEQ ID NO: 195529 - DNA, 25 bp, Rattus norvegicus
atggacagctacaggcacagccgct

SEQ ID NO: 195530 - DNA, 25 bp, Rattus norvegicus
atggacagctactggcacagccgct

SEQ ID NO: 195531 - DNA, 25 bp, Rattus norvegicus
atggacaggctccaagagctgccat

SEQ ID NO: 195532 - DNA, 25 bp, Rattus norvegicus
atggacaggctcgaagagctgccat

SEQ ID NO: 195533 - DNA, 25 bp, Rattus norvegicus
atggacagggctccagatcctccaa

SEQ ID NO: 195534 - DNA, 25 bp, Rattus norvegicus
atggacagggctgcagatcctccaa

SEQ ID NO: 195535 - DNA, 25 bp, Rattus norvegicus
atggacagtaccacaaggctccctg

SEQ ID NO: 195536 - DNA, 25 bp, Rattus norvegicus
atggacagtacctcaaggctccctg

SEQ ID NO: 195537 - DNA, 25 bp, Rattus norvegicus
atggacagtattacaccgggactct

SEQ ID NO: 195538 - DNA, 25 bp, Rattus norvegicus
atggacagtatttcaccgggactct

SEQ ID NO: 195539 - DNA, 25 bp, Rattus norvegicus
atggacagtcagaggatccctcacg

SEQ ID NO: 195540 - DNA, 25 bp, Rattus norvegicus
atggacagtcagtggatccctcacg

SEQ ID NO: 195541 - DNA, 25 bp, Rattus norvegicus
atggacagtctgacacctcggagct

SEQ ID NO: 195542 - DNA, 25 bp, Rattus norvegicus
atggacagtctgtcacctcggagct

SEQ ID NO: 195543 - DNA, 25 bp, Rattus norvegicus
atggacatactcacatggcttgtgg

SEQ ID NO: 195544 - DNA, 25 bp, Rattus norvegicus
atggacatactctcatggcttgtgg

SEQ ID NO: 195545 - DNA, 25 bp, Rattus norvegicus
atggacatatctcctatcgacttga

SEQ ID NO: 195546 - DNA, 25 bp, Rattus norvegicus
atggacatatctgctatcgacttga

SEQ ID NO: 195547 - DNA, 25 bp, Rattus norvegicus
atggacatctatctggttgctgccg

SEQ ID NO: 195548 - DNA, 25 bp, Rattus norvegicus
atggacatctatgtggttgctgccg

SEQ ID NO: 195549 - DNA, 25 bp, Rattus norvegicus
atggacatggtgctcagtccgccaa

SEQ ID NO: 195550 - DNA, 25 bp, Rattus norvegicus
atggacatggtggtcagtccgccaa

SEQ ID NO: 195551 - DNA, 25 bp, Rattus norvegicus
atggacatgtcacggcactccacag

SEQ ID NO: 195552 - DNA, 25 bp, Rattus norvegicus
atggacatgtcagggcactccacag

SEQ ID NO: 195553 - DNA, 25 bp, Rattus norvegicus
atggacatgtctacaactatccctc

SEQ ID NO: 195554 - DNA, 25 bp, Rattus norvegicus
atggacatgtcttcaactatccctc

SEQ ID NO: 195555 - DNA, 25 bp, Rattus norvegicus
atggacattactactgaccttcaaa

SEQ ID NO: 195556 - DNA, 25 bp, Rattus norvegicus
atggacattacttctgaccttcaaa

SEQ ID NO: 195557 - DNA, 25 bp, Rattus norvegicus
atggaccaataaaaactgactttga

SEQ ID NO: 195558 - DNA, 25 bp, Rattus norvegicus
atggaccaataataactgactttga

SEQ ID NO: 195559 - DNA, 25 bp, Rattus norvegicus
atggaccactgtcagtcgagctaca

SEQ ID NO: 195560 - DNA, 25 bp, Rattus norvegicus
atggaccactgtgagtcgagctaca

SEQ ID NO: 195561 - DNA, 25 bp, Rattus norvegicus
atggaccagaacctgaagtgtctga

SEQ ID NO: 195562 - DNA, 25 bp, Rattus norvegicus
atggaccagaacgtgaagtgtctga

SEQ ID NO: 195563 - DNA, 25 bp, Rattus norvegicus
atggaccagctgagcaccggctgca

SEQ ID NO: 195564 - DNA, 25 bp, Rattus norvegicus
atggaccagctgtgcaccggctgca

SEQ ID NO: 195565 - DNA, 25 bp, Rattus norvegicus
atggaccagttcctacagcctgaga

SEQ ID NO: 195566 - DNA, 25 bp, Rattus norvegicus
atggaccagttcgtacagcctgaga

SEQ ID NO: 195567 - DNA, 25 bp, Rattus norvegicus
atggaccatcatatccggaagccag

SEQ ID NO: 195568 - DNA, 25 bp, Rattus norvegicus
atggaccatcatttccggaagccag

SEQ ID NO: 195569 - DNA, 25 bp, Rattus norvegicus
atggaccatcgcatcctgtgtggac

SEQ ID NO: 195570 - DNA, 25 bp, Rattus norvegicus
atggaccatcgcttcctgtgtggac

SEQ ID NO: 195571 - DNA, 25 bp, Rattus norvegicus
atggaccattgcaattgcggcggga

SEQ ID NO: 195572 - DNA, 25 bp, Rattus norvegicus
atggaccattgctattgcggcggga

SEQ ID NO: 195573 - DNA, 25 bp, Rattus norvegicus
atggacccaagacccgaaagtgaca

SEQ ID NO: 195574 - DNA, 25 bp, Rattus norvegicus
atggacccaagagccgaaagtgaca

SEQ ID NO: 195575 - DNA, 25 bp, Rattus norvegicus
atggacccagggactcggagaacaa

SEQ ID NO: 195576 - DNA, 25 bp, Rattus norvegicus
atggacccagggtctcggagaacaa

SEQ ID NO: 195577 - DNA, 25 bp, Rattus norvegicus
atggaccccagcacatactcagatg

SEQ ID NO: 195578 - DNA, 25 bp, Rattus norvegicus
atggaccccagctcatactcagatg

SEQ ID NO: 195579 - DNA, 25 bp, Rattus norvegicus
atggacccctcgaggctggaaaact

SEQ ID NO: 195580 - DNA, 25 bp, Rattus norvegicus
atggacccctcgtggctggaaaact

SEQ ID NO: 195581 - DNA, 25 bp, Rattus norvegicus
atggacccgcctctggtatgaataa

SEQ ID NO: 195582 - DNA, 25 bp, Rattus norvegicus
atggacccgcctgtggtatgaataa

SEQ ID NO: 195583 - DNA, 25 bp, Rattus norvegicus
atggaccctctgcactacaaagatc

SEQ ID NO: 195584 - DNA, 25 bp, Rattus norvegicus
atggaccctctggactacaaagatc

SEQ ID NO: 195585 - DNA, 25 bp, Rattus norvegicus
atggaccctgtcctggcagtgctcc

SEQ ID NO: 195586 - DNA, 25 bp, Rattus norvegicus
atggaccctgtcgtggcagtgctcc

SEQ ID NO: 195587 - DNA, 25 bp, Rattus norvegicus
atggaccctttaattatgacgactt

SEQ ID NO: 195588 - DNA, 25 bp, Rattus norvegicus
atggaccctttatttatgacgactt

SEQ ID NO: 195589 - DNA, 25 bp, Rattus norvegicus
atggaccgcttcacagagcttgtta

SEQ ID NO: 195590 - DNA, 25 bp, Rattus norvegicus
atggaccgcttctcagagcttgtta

SEQ ID NO: 195591 - DNA, 25 bp, Rattus norvegicus
atggaccggtacctgaactacttcg

SEQ ID NO: 195592 - DNA, 25 bp, Rattus norvegicus
atggaccggtacgtgaactacttcg

SEQ ID NO: 195593 - DNA, 25 bp, Rattus norvegicus
atggaccgtcttaagctgcttctca

SEQ ID NO: 195594 - DNA, 25 bp, Rattus norvegicus
atggaccgtctttagctgcttctca

SEQ ID NO: 195595 - DNA, 25 bp, Rattus norvegicus
atggaccgttcacgagctagagaca

SEQ ID NO: 195596 - DNA, 25 bp, Rattus norvegicus
atggaccgttcaggagctagagaca

SEQ ID NO: 195597 - DNA, 25 bp, Rattus norvegicus
atggacctaatgaccacacttccta

SEQ ID NO: 195598 - DNA, 25 bp, Rattus norvegicus
atggacctaatgtccacacttccta

SEQ ID NO: 195599 - DNA, 25 bp, Rattus norvegicus
atggacctcattaccacacgtgatg

SEQ ID NO: 195600 - DNA, 25 bp, Rattus norvegicus
atggacctcatttccacacgtgatg

SEQ ID NO: 195601 - DNA, 25 bp, Rattus norvegicus
atggacctgaaactccatcagctcc

SEQ ID NO: 195602 - DNA, 25 bp, Rattus norvegicus
atggacctgaaagtccatcagctcc

SEQ ID NO: 195603 - DNA, 25 bp, Rattus norvegicus
atggacctgaacatgaaaacatcaa

SEQ ID NO: 195604 - DNA, 25 bp, Rattus norvegicus
atggacctgaacttgaaaacatcaa

SEQ ID NO: 195605 - DNA, 25 bp, Rattus norvegicus
atggacctgactcgactttttaagc

SEQ ID NO: 195606 - DNA, 25 bp, Rattus norvegicus
atggacctgactggactttttaagc

SEQ ID NO: 195607 - DNA, 25 bp, Rattus norvegicus
atggacctgcacactgagttcccaa

SEQ ID NO: 195608 - DNA, 25 bp, Rattus norvegicus
atggacctgcactctgagttcccaa

SEQ ID NO: 195609 - DNA, 25 bp, Rattus norvegicus
atggacctgcagagggcatctcgaa

SEQ ID NO: 195610 - DNA, 25 bp, Rattus norvegicus
atggacctgcagtgggcatctcgaa

SEQ ID NO: 195611 - DNA, 25 bp, Rattus norvegicus
atggacctgtgacttctttcagttt

SEQ ID NO: 195612 - DNA, 25 bp, Rattus norvegicus
atggacctgtgagttctttcagttt

SEQ ID NO: 195613 - DNA, 25 bp, Rattus norvegicus
atggaccttccacgatttattgtgg

SEQ ID NO: 195614 - DNA, 25 bp, Rattus norvegicus
atggaccttccaggatttattgtgg

SEQ ID NO: 195615 - DNA, 25 bp, Rattus norvegicus
atggaccttgtacagaccagaccta

SEQ ID NO: 195616 - DNA, 25 bp, Rattus norvegicus
atggaccttgtagagaccagaccta

SEQ ID NO: 195617 - DNA, 25 bp, Rattus norvegicus
atggacctttggacagacttagttt

SEQ ID NO: 195618 - DNA, 25 bp, Rattus norvegicus
atggacctttggtcagacttagttt

SEQ ID NO: 195619 - DNA, 25 bp, Rattus norvegicus
atggacgaccaaacgcgctaacgat

SEQ ID NO: 195620 - DNA, 25 bp, Rattus norvegicus
atggacgaccaatcgcgctaacgat

SEQ ID NO: 195621 - DNA, 25 bp, Rattus norvegicus
atggacgcagctcttctattgatag

SEQ ID NO: 195622 - DNA, 25 bp, Rattus norvegicus
atggacgcagctgttctattgatag

SEQ ID NO: 195623 - DNA, 25 bp, Rattus norvegicus
atggacgcatgcacatcaagctgct

SEQ ID NO: 195624 - DNA, 25 bp, Rattus norvegicus
atggacgcatgctcatcaagctgct

SEQ ID NO: 195625 - DNA, 25 bp, Rattus norvegicus
atggacgccaagctcgtcgctgtgc

SEQ ID NO: 195626 - DNA, 25 bp, Rattus norvegicus
atggacgccaaggtcgtcgctgtgc

SEQ ID NO: 195627 - DNA, 25 bp, Rattus norvegicus
atggacgcctcaactctgagctcaa

SEQ ID NO: 195628 - DNA, 25 bp, Rattus norvegicus
atggacgcctcatctctgagctcaa

SEQ ID NO: 195629 - DNA, 25 bp, Rattus norvegicus
atggacgcctgactcacttcctggg

SEQ ID NO: 195630 - DNA, 25 bp, Rattus norvegicus
atggacgcctgagtcacttcctggg

SEQ ID NO: 195631 - DNA, 25 bp, Rattus norvegicus
atggacgcctgcaagttggagccga

SEQ ID NO: 195632 - DNA, 25 bp, Rattus norvegicus
atggacgcctgctagttggagccga

SEQ ID NO: 195633 - DNA, 25 bp, Rattus norvegicus
atggacgccttgatacagttcagtt

SEQ ID NO: 195634 - DNA, 25 bp, Rattus norvegicus
atggacgccttgttacagttcagtt

SEQ ID NO: 195635 - DNA, 25 bp, Rattus norvegicus
atggacgcggacatgattgcagcac

SEQ ID NO: 195636 - DNA, 25 bp, Rattus norvegicus
atggacgcggacttgattgcagcac

SEQ ID NO: 195637 - DNA, 25 bp, Rattus norvegicus
atggacgcgttcatgcttggcatgg

SEQ ID NO: 195638 - DNA, 25 bp, Rattus norvegicus
atggacgcgttcttgcttggcatgg

SEQ ID NO: 195639 - DNA, 25 bp, Rattus norvegicus
atggacgctggaatacaagcatggc

SEQ ID NO: 195640 - DNA, 25 bp, Rattus norvegicus
atggacgctggattacaagcatggc

SEQ ID NO: 195641 - DNA, 25 bp, Rattus norvegicus
atggacggacatcacactcatcctg

SEQ ID NO: 195642 - DNA, 25 bp, Rattus norvegicus
atggacggacatgacactcatcctg

SEQ ID NO: 195643 - DNA, 25 bp, Rattus norvegicus
atggacggagtcaaagctgggccct

SEQ ID NO: 195644 - DNA, 25 bp, Rattus norvegicus
atggacggagtctaagctgggccct

SEQ ID NO: 195645 - DNA, 25 bp, Rattus norvegicus
atggacggatgcatgctctgcctgg

SEQ ID NO: 195646 - DNA, 25 bp, Rattus norvegicus
atggacggatgcttgctctgcctgg

SEQ ID NO: 195647 - DNA, 25 bp, Rattus norvegicus
atggacggcgctcaggtctcaacca

SEQ ID NO: 195648 - DNA, 25 bp, Rattus norvegicus
atggacggcgctgaggtctcaacca

SEQ ID NO: 195649 - DNA, 25 bp, Rattus norvegicus
atggacggcggcagttggttgatgt

SEQ ID NO: 195650 - DNA, 25 bp, Rattus norvegicus
atggacggcggctgttggttgatgt

SEQ ID NO: 195651 - DNA, 25 bp, Rattus norvegicus
atggacggctacagcttgcatggac

SEQ ID NO: 195652 - DNA, 25 bp, Rattus norvegicus
atggacggctactgcttgcatggac

SEQ ID NO: 195653 - DNA, 25 bp, Rattus norvegicus
atggacgggctcaggttgttaccga

SEQ ID NO: 195654 - DNA, 25 bp, Rattus norvegicus
atggacgggctctggttgttaccga

SEQ ID NO: 195655 - DNA, 25 bp, Rattus norvegicus
atggacggtccaagaactggcccct

SEQ ID NO: 195656 - DNA, 25 bp, Rattus norvegicus
atggacggtccatgaactggcccct

SEQ ID NO: 195657 - DNA, 25 bp, Rattus norvegicus
atggacggtcctccgactacaaagt

SEQ ID NO: 195658 - DNA, 25 bp, Rattus norvegicus
atggacggtcctgcgactacaaagt

SEQ ID NO: 195659 - DNA, 25 bp, Rattus norvegicus
atggacggttggattctttgctcca

SEQ ID NO: 195660 - DNA, 25 bp, Rattus norvegicus
atggacggttggtttctttgctcca

SEQ ID NO: 195661 - DNA, 25 bp, Rattus norvegicus
atggacggttgtcctggaactcttt

SEQ ID NO: 195662 - DNA, 25 bp, Rattus norvegicus
atggacggttgtgctggaactcttt

SEQ ID NO: 195663 - DNA, 25 bp, Rattus norvegicus
atggacgtaccacttgactgaaggg

SEQ ID NO: 195664 - DNA, 25 bp, Rattus norvegicus
atggacgtaccagttgactgaaggg

SEQ ID NO: 195665 - DNA, 25 bp, Rattus norvegicus
atggacgtccccaggagatgatcga

SEQ ID NO: 195666 - DNA, 25 bp, Rattus norvegicus
atggacgtcccctggagatgatcga

SEQ ID NO: 195667 - DNA, 25 bp, Rattus norvegicus
atggacgtggtccacaatgcctgtg

SEQ ID NO: 195668 - DNA, 25 bp, Rattus norvegicus
atggacgtggtcgacaatgcctgtg

SEQ ID NO: 195669 - DNA, 25 bp, Rattus norvegicus
atggacgttaacagctcctttgtca

SEQ ID NO: 195670 - DNA, 25 bp, Rattus norvegicus
atggacgttaactgctcctttgtca

SEQ ID NO: 195671 - DNA, 25 bp, Rattus norvegicus
atggactaactgactggttctccac

SEQ ID NO: 195672 - DNA, 25 bp, Rattus norvegicus
atggactaactgtctggttctccac

SEQ ID NO: 195673 - DNA, 25 bp, Rattus norvegicus
atggactaccaccacgagactcaca

SEQ ID NO: 195674 - DNA, 25 bp, Rattus norvegicus
atggactaccacgacgagactcaca

SEQ ID NO: 195675 - DNA, 25 bp, Rattus norvegicus
atggactactaaatgccttcaccca

SEQ ID NO: 195676 - DNA, 25 bp, Rattus norvegicus
atggactactaattgccttcaccca

SEQ ID NO: 195677 - DNA, 25 bp, Rattus norvegicus
atggactagaacagtgcacctgaga

SEQ ID NO: 195678 - DNA, 25 bp, Rattus norvegicus
atggactagaactgtgcacctgaga

SEQ ID NO: 195679 - DNA, 25 bp, Rattus norvegicus
atggactagcacagcaaaccgcagt

SEQ ID NO: 195680 - DNA, 25 bp, Rattus norvegicus
atggactagcactgcaaaccgcagt

SEQ ID NO: 195681 - DNA, 25 bp, Rattus norvegicus
atggactaggccacacggctcaggc

SEQ ID NO: 195682 - DNA, 25 bp, Rattus norvegicus
atggactaggcctcacggctcaggc

SEQ ID NO: 195683 - DNA, 25 bp, Rattus norvegicus
atggactccaacattaaggcagtag

SEQ ID NO: 195684 - DNA, 25 bp, Rattus norvegicus
atggactccaactttaaggcagtag

SEQ ID NO: 195685 - DNA, 25 bp, Rattus norvegicus
atggactccacaactttgcacatct

SEQ ID NO: 195686 - DNA, 25 bp, Rattus norvegicus
atggactccacatctttgcacatct

SEQ ID NO: 195687 - DNA, 25 bp, Rattus norvegicus
atggactccagcatctcgaagcagg

SEQ ID NO: 195688 - DNA, 25 bp, Rattus norvegicus
atggactccagcttctcgaagcagg

SEQ ID NO: 195689 - DNA, 25 bp, Rattus norvegicus
atggactcccatagctagccaatca

SEQ ID NO: 195690 - DNA, 25 bp, Rattus norvegicus
atggactcccattgctagccaatca

SEQ ID NO: 195691 - DNA, 25 bp, Rattus norvegicus
atggactcccctcagagagttctga

SEQ ID NO: 195692 - DNA, 25 bp, Rattus norvegicus
atggactcccctgagagagttctga

SEQ ID NO: 195693 - DNA, 25 bp, Rattus norvegicus
atggactccctcaagtgacagacaa

SEQ ID NO: 195694 - DNA, 25 bp, Rattus norvegicus
atggactccctctagtgacagacaa

SEQ ID NO: 195695 - DNA, 25 bp, Rattus norvegicus
atggactccgtcctgcatgttaaag

SEQ ID NO: 195696 - DNA, 25 bp, Rattus norvegicus
atggactccgtcgtgcatgttaaag

SEQ ID NO: 195697 - DNA, 25 bp, Rattus norvegicus
atggactcgtggctgttgctaaccc

SEQ ID NO: 195698 - DNA, 25 bp, Rattus norvegicus
atggactcgtgggtgttgctaaccc

SEQ ID NO: 195699 - DNA, 25 bp, Rattus norvegicus
atggactctcctccgtgggtgcagt

SEQ ID NO: 195700 - DNA, 25 bp, Rattus norvegicus
atggactctcctgcgtgggtgcagt

SEQ ID NO: 195701 - DNA, 25 bp, Rattus norvegicus
atggactctcgaaaattgtcctctg

SEQ ID NO: 195702 - DNA, 25 bp, Rattus norvegicus
atggactctcgataattgtcctctg

SEQ ID NO: 195703 - DNA, 25 bp, Rattus norvegicus
atggactctctaaatgccgggatct

SEQ ID NO: 195704 - DNA, 25 bp, Rattus norvegicus
atggactctctatatgccgggatct

SEQ ID NO: 195705 - DNA, 25 bp, Rattus norvegicus
atggactctgagctccactcttcca

SEQ ID NO: 195706 - DNA, 25 bp, Rattus norvegicus
atggactctgaggtccactcttcca

SEQ ID NO: 195707 - DNA, 25 bp, Rattus norvegicus
atggactcttcaatcctgtggaaca

SEQ ID NO: 195708 - DNA, 25 bp, Rattus norvegicus
atggactcttcattcctgtggaaca

SEQ ID NO: 195709 - DNA, 25 bp, Rattus norvegicus
atggactcttccacatacacacaca

SEQ ID NO: 195710 - DNA, 25 bp, Rattus norvegicus
atggactcttccagacgcctctgtg

SEQ ID NO: 195711 - DNA, 25 bp, Rattus norvegicus
atggactcttcctcatacacacaca

SEQ ID NO: 195712 - DNA, 25 bp, Rattus norvegicus
atggactcttcctgacgcctctgtg

SEQ ID NO: 195713 - DNA, 25 bp, Rattus norvegicus
atggactcttgcaccggctagaagg

SEQ ID NO: 195714 - DNA, 25 bp, Rattus norvegicus
atggactcttgcagatggcaccggc

SEQ ID NO: 195715 - DNA, 25 bp, Rattus norvegicus
atggactcttgctccggctagaagg

SEQ ID NO: 195716 - DNA, 25 bp, Rattus norvegicus
atggactcttgctgatggcaccggc

SEQ ID NO: 195717 - DNA, 25 bp, Rattus norvegicus
atggactctttaattggatcatgaa

SEQ ID NO: 195718 - DNA, 25 bp, Rattus norvegicus
atggactctttatttggatcatgaa

SEQ ID NO: 195719 - DNA, 25 bp, Rattus norvegicus
atggactgaggcatccacagtactt

SEQ ID NO: 195720 - DNA, 25 bp, Rattus norvegicus
atggactgaggcatgatcatcatgt

SEQ ID NO: 195721 - DNA, 25 bp, Rattus norvegicus
atggactgaggcttccacagtactt

SEQ ID NO: 195722 - DNA, 25 bp, Rattus norvegicus
atggactgaggcttgatcatcatgt

SEQ ID NO: 195723 - DNA, 25 bp, Rattus norvegicus
atggactgatttccactcttggttc

SEQ ID NO: 195724 - DNA, 25 bp, Rattus norvegicus
atggactgatttgcactcttggttc

SEQ ID NO: 195725 - DNA, 25 bp, Rattus norvegicus
atggactgcggtagcatcggccaca

SEQ ID NO: 195726 - DNA, 25 bp, Rattus norvegicus
atggactgcggttgcatcggccaca

SEQ ID NO: 195727 - DNA, 25 bp, Rattus norvegicus
atggactggcatatccagactctta

SEQ ID NO: 195728 - DNA, 25 bp, Rattus norvegicus
atggactggcatttccagactctta

SEQ ID NO: 195729 - DNA, 25 bp, Rattus norvegicus
atggactggttcatggccgtctgtt

SEQ ID NO: 195730 - DNA, 25 bp, Rattus norvegicus
atggactggttcttggccgtctgtt

SEQ ID NO: 195731 - DNA, 25 bp, Rattus norvegicus
atggactgtctgacatctttccggg

SEQ ID NO: 195732 - DNA, 25 bp, Rattus norvegicus
atggactgtctgtcatctttccggg

SEQ ID NO: 195733 - DNA, 25 bp, Rattus norvegicus
atggactgtgccaaacacccagtga

SEQ ID NO: 195734 - DNA, 25 bp, Rattus norvegicus
atggactgtgcctaacacccagtga

SEQ ID NO: 195735 - DNA, 25 bp, Rattus norvegicus
atggactgtgtgaacatgggcctat

SEQ ID NO: 195736 - DNA, 25 bp, Rattus norvegicus
atggactgtgtgtacatgggcctat

SEQ ID NO: 195737 - DNA, 25 bp, Rattus norvegicus
atggactgtgttcctagacaactaa

SEQ ID NO: 195738 - DNA, 25 bp, Rattus norvegicus
atggactgtgttgctagacaactaa

SEQ ID NO: 195739 - DNA, 25 bp, Rattus norvegicus
atggactgttcaatgcctgtttcgc

SEQ ID NO: 195740 - DNA, 25 bp, Rattus norvegicus
atggactgttcattgcctgtttcgc

SEQ ID NO: 195741 - DNA, 25 bp, Rattus norvegicus
atggactgttttcctgacatcctgt

SEQ ID NO: 195742 - DNA, 25 bp, Rattus norvegicus
atggactgttttgctgacatcctgt

SEQ ID NO: 195743 - DNA, 25 bp, Rattus norvegicus
atggacttatccacttctctactac

SEQ ID NO: 195744 - DNA, 25 bp, Rattus norvegicus
atggacttatcctcttctctactac

SEQ ID NO: 195745 - DNA, 25 bp, Rattus norvegicus
atggacttccagatgcgatgcctgc

SEQ ID NO: 195746 - DNA, 25 bp, Rattus norvegicus
atggacttccagttgcgatgcctgc

SEQ ID NO: 195747 - DNA, 25 bp, Rattus norvegicus
atggacttccctacgggagtcagga

SEQ ID NO: 195748 - DNA, 25 bp, Rattus norvegicus
atggacttcccttcgggagtcagga

SEQ ID NO: 195749 - DNA, 25 bp, Rattus norvegicus
atggacttcctaaagctgcagatac

SEQ ID NO: 195750 - DNA, 25 bp, Rattus norvegicus
atggacttcctatagctgcagatac

SEQ ID NO: 195751 - DNA, 25 bp, Rattus norvegicus
atggacttcggtcccggtgcacgat

SEQ ID NO: 195752 - DNA, 25 bp, Rattus norvegicus
atggacttcggtgccggtgcacgat

SEQ ID NO: 195753 - DNA, 25 bp, Rattus norvegicus
atggacttctgaacgcttcggagtg

SEQ ID NO: 195754 - DNA, 25 bp, Rattus norvegicus
atggacttctgatcgcttcggagtg

SEQ ID NO: 195755 - DNA, 25 bp, Rattus norvegicus
atggacttgtccctttagtggcctt

SEQ ID NO: 195756 - DNA, 25 bp, Rattus norvegicus
atggacttgtccgtttagtggcctt

SEQ ID NO: 195757 - DNA, 25 bp, Rattus norvegicus
atggacttgttgatgggcgttcaga

SEQ ID NO: 195758 - DNA, 25 bp, Rattus norvegicus
atggacttgttgttgggcgttcaga

SEQ ID NO: 195759 - DNA, 25 bp, Rattus norvegicus
atggacttgtttatattctcccaga

SEQ ID NO: 195760 - DNA, 25 bp, Rattus norvegicus
atggacttgtttttattctcccaga

SEQ ID NO: 195761 - DNA, 25 bp, Rattus norvegicus
atggactttgccacagacctcatgc

SEQ ID NO: 195762 - DNA, 25 bp, Rattus norvegicus
atggactttgccatgctttgctcgt

SEQ ID NO: 195763 - DNA, 25 bp, Rattus norvegicus
atggactttgcctcagacctcatgc

SEQ ID NO: 195764 - DNA, 25 bp, Rattus norvegicus
atggactttgccttgctttgctcgt

SEQ ID NO: 195765 - DNA, 25 bp, Rattus norvegicus
atggacttttttcacatacattgat

SEQ ID NO: 195766 - DNA, 25 bp, Rattus norvegicus
atggacttttttgacatacattgat

SEQ ID NO: 195767 - DNA, 25 bp, Rattus norvegicus
atggagaaccatcatcccggaagtt

SEQ ID NO: 195768 - DNA, 25 bp, Rattus norvegicus
atggagaaccatgatcccggaagtt

SEQ ID NO: 195769 - DNA, 25 bp, Rattus norvegicus
atggagaactaaacagccctgacat

SEQ ID NO: 195770 - DNA, 25 bp, Rattus norvegicus
atggagaactaatcagccctgacat

SEQ ID NO: 195771 - DNA, 25 bp, Rattus norvegicus
atggagaactagatccagcccaccc

SEQ ID NO: 195772 - DNA, 25 bp, Rattus norvegicus
atggagaactagttccagcccaccc

SEQ ID NO: 195773 - DNA, 25 bp, Rattus norvegicus
atggagaactcgagtctctttcacc

SEQ ID NO: 195774 - DNA, 25 bp, Rattus norvegicus
atggagaactcgtgtctctttcacc

SEQ ID NO: 195775 - DNA, 25 bp, Rattus norvegicus
atggagaatggtactgccctccttg

SEQ ID NO: 195776 - DNA, 25 bp, Rattus norvegicus
atggagaatggttctgccctccttg

SEQ ID NO: 195777 - DNA, 25 bp, Rattus norvegicus
atggagaattctcgttgggcctaga

SEQ ID NO: 195778 - DNA, 25 bp, Rattus norvegicus
atggagaattctggttgggcctaga

SEQ ID NO: 195779 - DNA, 25 bp, Rattus norvegicus
atggagacaattaagcaatgctgaa

SEQ ID NO: 195780 - DNA, 25 bp, Rattus norvegicus
atggagacaatttagcaatgctgaa

SEQ ID NO: 195781 - DNA, 25 bp, Rattus norvegicus
atggagacacacattctctgccaag

SEQ ID NO: 195782 - DNA, 25 bp, Rattus norvegicus
atggagacacactttctctgccaag

SEQ ID NO: 195783 - DNA, 25 bp, Rattus norvegicus
atggagacacccacattgtggtcaa

SEQ ID NO: 195784 - DNA, 25 bp, Rattus norvegicus
atggagacaccctcattgtggtcaa

SEQ ID NO: 195785 - DNA, 25 bp, Rattus norvegicus
atggagacatccattcgtttgagaa

SEQ ID NO: 195786 - DNA, 25 bp, Rattus norvegicus
atggagacatcctttcgtttgagaa

SEQ ID NO: 195787 - DNA, 25 bp, Rattus norvegicus
atggagacatggcttctgtgcttcc

SEQ ID NO: 195788 - DNA, 25 bp, Rattus norvegicus
atggagacatgggttctgtgcttcc

SEQ ID NO: 195789 - DNA, 25 bp, Rattus norvegicus
atggagaccaagagcttcatctgtg

SEQ ID NO: 195790 - DNA, 25 bp, Rattus norvegicus
atggagaccaagtgcttcatctgtg

SEQ ID NO: 195791 - DNA, 25 bp, Rattus norvegicus
atggagacccagaaactctgtggaa

SEQ ID NO: 195792 - DNA, 25 bp, Rattus norvegicus
atggagacccagactttccgtggct

SEQ ID NO: 195793 - DNA, 25 bp, Rattus norvegicus
atggagacccagtaactctgtggaa

SEQ ID NO: 195794 - DNA, 25 bp, Rattus norvegicus
atggagacccagtctttccgtggct

SEQ ID NO: 195795 - DNA, 25 bp, Rattus norvegicus
atggagacctacagcaacagcggtt

SEQ ID NO: 195796 - DNA, 25 bp, Rattus norvegicus
atggagacctactgcaacagcggtt

SEQ ID NO: 195797 - DNA, 25 bp, Rattus norvegicus
atggagacctgactgcctctaagtg

SEQ ID NO: 195798 - DNA, 25 bp, Rattus norvegicus
atggagacctgagtgcctctaagtg

SEQ ID NO: 195799 - DNA, 25 bp, Rattus norvegicus
atggagacgcagcagcttcactgac

SEQ ID NO: 195800 - DNA, 25 bp, Rattus norvegicus
atggagacgcaggagcttcactgac

SEQ ID NO: 195801 - DNA, 25 bp, Rattus norvegicus
atggagacgcatacatccgcggaaa

SEQ ID NO: 195802 - DNA, 25 bp, Rattus norvegicus
atggagacgcattcatccgcggaaa

SEQ ID NO: 195803 - DNA, 25 bp, Rattus norvegicus
atggagacgcccatccagcgcgaaa

SEQ ID NO: 195804 - DNA, 25 bp, Rattus norvegicus
atggagacgcccttccagcgcgaaa

SEQ ID NO: 195805 - DNA, 25 bp, Rattus norvegicus
atggagacgtctccagaaccaggag

SEQ ID NO: 195806 - DNA, 25 bp, Rattus norvegicus
atggagacgtctgcagaaccaggag

SEQ ID NO: 195807 - DNA, 25 bp, Rattus norvegicus
atggagagacttccgaactctggaa

SEQ ID NO: 195808 - DNA, 25 bp, Rattus norvegicus
atggagagacttgcgaactctggaa

SEQ ID NO: 195809 - DNA, 25 bp, Rattus norvegicus
atggagagagcactgagccagcatt

SEQ ID NO: 195810 - DNA, 25 bp, Rattus norvegicus
atggagagagcagtgagccagcatt

SEQ ID NO: 195811 - DNA, 25 bp, Rattus norvegicus
atggagagccagacgaggttataca

SEQ ID NO: 195812 - DNA, 25 bp, Rattus norvegicus
atggagagccagtcgaggttataca

SEQ ID NO: 195813 - DNA, 25 bp, Rattus norvegicus
atggagagccatctcagatttgaac

SEQ ID NO: 195814 - DNA, 25 bp, Rattus norvegicus
atggagagccatgtcagatttgaac

SEQ ID NO: 195815 - DNA, 25 bp, Rattus norvegicus
atggagaggctaacagacaacctga

SEQ ID NO: 195816 - DNA, 25 bp, Rattus norvegicus
atggagaggctatcagacaacctga

SEQ ID NO: 195817 - DNA, 25 bp, Rattus norvegicus
atggagagggctagctgggccttgc

SEQ ID NO: 195818 - DNA, 25 bp, Rattus norvegicus
atggagagggcttgctgggccttgc

SEQ ID NO: 195819 - DNA, 25 bp, Rattus norvegicus
atggagagtctgcactacgcaggcc

SEQ ID NO: 195820 - DNA, 25 bp, Rattus norvegicus
atggagagtctggactacgcaggcc

SEQ ID NO: 195821 - DNA, 25 bp, Rattus norvegicus
atggagataggtatactgtgcttaa

SEQ ID NO: 195822 - DNA, 25 bp, Rattus norvegicus
atggagataggtttactgtgcttaa

SEQ ID NO: 195823 - DNA, 25 bp, Rattus norvegicus
atggagatcctcatggacctcgtgc

SEQ ID NO: 195824 - DNA, 25 bp, Rattus norvegicus
atggagatcctcttggacctcgtgc

SEQ ID NO: 195825 - DNA, 25 bp, Rattus norvegicus
atggagatgcctatggtgctgcccc

SEQ ID NO: 195826 - DNA, 25 bp, Rattus norvegicus
atggagatgcctttggtgctgcccc

SEQ ID NO: 195827 - DNA, 25 bp, Rattus norvegicus
atggagatgctcacgtgtcacagaa

SEQ ID NO: 195828 - DNA, 25 bp, Rattus norvegicus
atggagatgctctcgtgtcacagaa

SEQ ID NO: 195829 - DNA, 25 bp, Rattus norvegicus
atggagattcagcagatccagctga

SEQ ID NO: 195830 - DNA, 25 bp, Rattus norvegicus
atggagattcaggagatccagctga

SEQ ID NO: 195831 - DNA, 25 bp, Rattus norvegicus
atggagattgcccagagtcccttga

SEQ ID NO: 195832 - DNA, 25 bp, Rattus norvegicus
atggagattgccctgatgctgcttc

SEQ ID NO: 195833 - DNA, 25 bp, Rattus norvegicus
atggagattgccgagagtcccttga

SEQ ID NO: 195834 - DNA, 25 bp, Rattus norvegicus
atggagattgccgtgatgctgcttc

SEQ ID NO: 195835 - DNA, 25 bp, Rattus norvegicus
atggagcaaataagcatcccttgaa

SEQ ID NO: 195836 - DNA, 25 bp, Rattus norvegicus
atggagcaaatatgcatcccttgaa

SEQ ID NO: 195837 - DNA, 25 bp, Rattus norvegicus
atggagcaaccaacacaatcaggat

SEQ ID NO: 195838 - DNA, 25 bp, Rattus norvegicus
atggagcaaccatcacaatcaggat

SEQ ID NO: 195839 - DNA, 25 bp, Rattus norvegicus
atggagcaagtaatactgttgtgtt

SEQ ID NO: 195840 - DNA, 25 bp, Rattus norvegicus
atggagcaagtattactgttgtgtt

SEQ ID NO: 195841 - DNA, 25 bp, Rattus norvegicus
atggagcaatcaaccgtgacgccag

SEQ ID NO: 195842 - DNA, 25 bp, Rattus norvegicus
atggagcaatcatccgtgacgccag

SEQ ID NO: 195843 - DNA, 25 bp, Rattus norvegicus
atggagcaatctcgcagtgcagtgg

SEQ ID NO: 195844 - DNA, 25 bp, Rattus norvegicus
atggagcaatctggcagtgcagtgg

SEQ ID NO: 195845 - DNA, 25 bp, Rattus norvegicus
atggagcacaacctggcgtatccca

SEQ ID NO: 195846 - DNA, 25 bp, Rattus norvegicus
atggagcacaacgtggcgtatccca

SEQ ID NO: 195847 - DNA, 25 bp, Rattus norvegicus
atggagcacaccaggaggccccatt

SEQ ID NO: 195848 - DNA, 25 bp, Rattus norvegicus
atggagcacacctggaggccccatt

SEQ ID NO: 195849 - DNA, 25 bp, Rattus norvegicus
atggagcactctcgtgggttcccaa

SEQ ID NO: 195850 - DNA, 25 bp, Rattus norvegicus
atggagcactctggtgggttcccaa

SEQ ID NO: 195851 - DNA, 25 bp, Rattus norvegicus
atggagcagcacagcgccggaatct

SEQ ID NO: 195852 - DNA, 25 bp, Rattus norvegicus
atggagcagcactgcgccggaatct

SEQ ID NO: 195853 - DNA, 25 bp, Rattus norvegicus
atggagcagcccacaaacctgaaat

SEQ ID NO: 195854 - DNA, 25 bp, Rattus norvegicus
atggagcagccctcaaacctgaaat

SEQ ID NO: 195855 - DNA, 25 bp, Rattus norvegicus
atggagcaggacagacttcttccga

SEQ ID NO: 195856 - DNA, 25 bp, Rattus norvegicus
atggagcaggacatccttcaccaca

SEQ ID NO: 195857 - DNA, 25 bp, Rattus norvegicus
atggagcaggactgacttcttccga

SEQ ID NO: 195858 - DNA, 25 bp, Rattus norvegicus
atggagcaggacttccttcaccaca

SEQ ID NO: 195859 - DNA, 25 bp, Rattus norvegicus
atggagcaggcaatgagcacaaggc

SEQ ID NO: 195860 - DNA, 25 bp, Rattus norvegicus
atggagcaggcattgagcacaaggc

SEQ ID NO: 195861 - DNA, 25 bp, Rattus norvegicus
atggagcagtggcaaaactctgaaa

SEQ ID NO: 195862 - DNA, 25 bp, Rattus norvegicus
atggagcagtgggaaaactctgaaa

SEQ ID NO: 195863 - DNA, 25 bp, Rattus norvegicus
atggagcatggcctggatcttcacc

SEQ ID NO: 195864 - DNA, 25 bp, Rattus norvegicus
atggagcatggcgtggatcttcacc

SEQ ID NO: 195865 - DNA, 25 bp, Rattus norvegicus
atggagcattcaacatctaccaggg

SEQ ID NO: 195866 - DNA, 25 bp, Rattus norvegicus
atggagcattcatcatctaccaggg

SEQ ID NO: 195867 - DNA, 25 bp, Rattus norvegicus
atggagcattttacagacttttcta

SEQ ID NO: 195868 - DNA, 25 bp, Rattus norvegicus
atggagcatttttcagacttttcta

SEQ ID NO: 195869 - DNA, 25 bp, Rattus norvegicus
atggagccaaaaactacttttaaag

SEQ ID NO: 195870 - DNA, 25 bp, Rattus norvegicus
atggagccaaaactctgctgcttca

SEQ ID NO: 195871 - DNA, 25 bp, Rattus norvegicus
atggagccaaaagtctgctgcttca

SEQ ID NO: 195872 - DNA, 25 bp, Rattus norvegicus
atggagccaaaatctacttttaaag

SEQ ID NO: 195873 - DNA, 25 bp, Rattus norvegicus
atggagccaggcagaccacgctgga

SEQ ID NO: 195874 - DNA, 25 bp, Rattus norvegicus
atggagccaggctgaccacgctgga

SEQ ID NO: 195875 - DNA, 25 bp, Rattus norvegicus
atggagccagtgagtcagacaacct

SEQ ID NO: 195876 - DNA, 25 bp, Rattus norvegicus
atggagccagtgtgtcagacaacct

SEQ ID NO: 195877 - DNA, 25 bp, Rattus norvegicus
atggagccatacaagtgtgatctgt

SEQ ID NO: 195878 - DNA, 25 bp, Rattus norvegicus
atggagccatactagtgtgatctgt

SEQ ID NO: 195879 - DNA, 25 bp, Rattus norvegicus
atggagcccagaccgcagcagtgct

SEQ ID NO: 195880 - DNA, 25 bp, Rattus norvegicus
atggagcccagagcgcagcagtgct

SEQ ID NO: 195881 - DNA, 25 bp, Rattus norvegicus
atggagcccaggagcggtttccttg

SEQ ID NO: 195882 - DNA, 25 bp, Rattus norvegicus
atggagcccaggtgcggtttccttg

SEQ ID NO: 195883 - DNA, 25 bp, Rattus norvegicus
atggagccgaccagcaggtacgtca

SEQ ID NO: 195884 - DNA, 25 bp, Rattus norvegicus
atggagccgacctgcaggtacgtca

SEQ ID NO: 195885 - DNA, 25 bp, Rattus norvegicus
atggagccgcaccacgtgaacggat

SEQ ID NO: 195886 - DNA, 25 bp, Rattus norvegicus
atggagccgcacgacgtgaacggat

SEQ ID NO: 195887 - DNA, 25 bp, Rattus norvegicus
atggagccggccctgaccagaacaa

SEQ ID NO: 195888 - DNA, 25 bp, Rattus norvegicus
atggagccggccgtgaccagaacaa

SEQ ID NO: 195889 - DNA, 25 bp, Rattus norvegicus
atggagcctactacagaccacagga

SEQ ID NO: 195890 - DNA, 25 bp, Rattus norvegicus
atggagcctacttcagaccacagga

SEQ ID NO: 195891 - DNA, 25 bp, Rattus norvegicus
atggagcctcacatgatagagcccc

SEQ ID NO: 195892 - DNA, 25 bp, Rattus norvegicus
atggagcctcacttgatagagcccc

SEQ ID NO: 195893 - DNA, 25 bp, Rattus norvegicus
atggagcctcatagtcttctatggg

SEQ ID NO: 195894 - DNA, 25 bp, Rattus norvegicus
atggagcctcattgtcttctatggg

SEQ ID NO: 195895 - DNA, 25 bp, Rattus norvegicus
atggagcctctgagcttagtggccg

SEQ ID NO: 195896 - DNA, 25 bp, Rattus norvegicus
atggagcctctgtgcttagtggccg

SEQ ID NO: 195897 - DNA, 25 bp, Rattus norvegicus
atggagcctgctcgtgttttagcca

SEQ ID NO: 195898 - DNA, 25 bp, Rattus norvegicus
atggagcctgctggtgttttagcca

SEQ ID NO: 195899 - DNA, 25 bp, Rattus norvegicus
atggagcctgtaaatgtttttgcac

SEQ ID NO: 195900 - DNA, 25 bp, Rattus norvegicus
atggagcctgtatatgtttttgcac

SEQ ID NO: 195901 - DNA, 25 bp, Rattus norvegicus
atggagcctgtcctagctgtcagtg

SEQ ID NO: 195902 - DNA, 25 bp, Rattus norvegicus
atggagcctgtcgtagctgtcagtg

SEQ ID NO: 195903 - DNA, 25 bp, Rattus norvegicus
atggagcgagctcaccctttatttc

SEQ ID NO: 195904 - DNA, 25 bp, Rattus norvegicus
atggagcgagctgaccctttatttc

SEQ ID NO: 195905 - DNA, 25 bp, Rattus norvegicus
atggagcgctcacagtgtcctcttt

SEQ ID NO: 195906 - DNA, 25 bp, Rattus norvegicus
atggagcgctcagagtgtcctcttt

SEQ ID NO: 195907 - DNA, 25 bp, Rattus norvegicus
atggagcggattccatgttccctag

SEQ ID NO: 195908 - DNA, 25 bp, Rattus norvegicus
atggagcggattgcatgttccctag

SEQ ID NO: 195909 - DNA, 25 bp, Rattus norvegicus
atggagcggcagcagccccagttct

SEQ ID NO: 195910 - DNA, 25 bp, Rattus norvegicus
atggagcggcaggagccccagttct

SEQ ID NO: 195911 - DNA, 25 bp, Rattus norvegicus
atggagcggctcatggcccctttgg

SEQ ID NO: 195912 - DNA, 25 bp, Rattus norvegicus
atggagcggctcttggcccctttgg

SEQ ID NO: 195913 - DNA, 25 bp, Rattus norvegicus
atggagctaaccactcattttccaa

SEQ ID NO: 195914 - DNA, 25 bp, Rattus norvegicus
atggagctaacctctcattttccaa

SEQ ID NO: 195915 - DNA, 25 bp, Rattus norvegicus
atggagctcagcagatgacgctgga

SEQ ID NO: 195916 - DNA, 25 bp, Rattus norvegicus
atggagctcagctgatgacgctgga

SEQ ID NO: 195917 - DNA, 25 bp, Rattus norvegicus
atggagctcaggcagaccacctcgc

SEQ ID NO: 195918 - DNA, 25 bp, Rattus norvegicus
atggagctcagggagaccacctcgc

SEQ ID NO: 195919 - DNA, 25 bp, Rattus norvegicus
atggagctcgtgaatgcctacttgg

SEQ ID NO: 195920 - DNA, 25 bp, Rattus norvegicus
atggagctcgtgtatgcctacttgg

SEQ ID NO: 195921 - DNA, 25 bp, Rattus norvegicus
atggagctcttcctgctgctcacca

SEQ ID NO: 195922 - DNA, 25 bp, Rattus norvegicus
atggagctcttcgtgctgctcacca

SEQ ID NO: 195923 - DNA, 25 bp, Rattus norvegicus
atggagctgaagcagtgtccctcct

SEQ ID NO: 195924 - DNA, 25 bp, Rattus norvegicus
atggagctgaaggagtgtccctcct

SEQ ID NO: 195925 - DNA, 25 bp, Rattus norvegicus
atggagctgacactgacaatggcct

SEQ ID NO: 195926 - DNA, 25 bp, Rattus norvegicus
atggagctgacagtgacaatggcct

SEQ ID NO: 195927 - DNA, 25 bp, Rattus norvegicus
atggagctgaccatccccagcaaga

SEQ ID NO: 195928 - DNA, 25 bp, Rattus norvegicus
atggagctgaccttccccagcaaga

SEQ ID NO: 195929 - DNA, 25 bp, Rattus norvegicus
atggagctgagtctgtcaccactgt

SEQ ID NO: 195930 - DNA, 25 bp, Rattus norvegicus
atggagctgagtgtgtcaccactgt

SEQ ID NO: 195931 - DNA, 25 bp, Rattus norvegicus
atggagctgcgtatgttccgccaaa

SEQ ID NO: 195932 - DNA, 25 bp, Rattus norvegicus
atggagctgcgtttgttccgccaaa

SEQ ID NO: 195933 - DNA, 25 bp, Rattus norvegicus
atggagctggctacagggcatcctt

SEQ ID NO: 195934 - DNA, 25 bp, Rattus norvegicus
atggagctggcttcagggcatcctt

SEQ ID NO: 195935 - DNA, 25 bp, Rattus norvegicus
atggagctgtatactctgttgatcc

SEQ ID NO: 195936 - DNA, 25 bp, Rattus norvegicus
atggagctgtattctctgttgatcc

SEQ ID NO: 195937 - DNA, 25 bp, Rattus norvegicus
atggagcttcagaccaaggctaaac

SEQ ID NO: 195938 - DNA, 25 bp, Rattus norvegicus
atggagcttcagtccaaggctaaac

SEQ ID NO: 195939 - DNA, 25 bp, Rattus norvegicus
atggagcttccacagcagtggttct

SEQ ID NO: 195940 - DNA, 25 bp, Rattus norvegicus
atggagcttccagagcagtggttct

SEQ ID NO: 195941 - DNA, 25 bp, Rattus norvegicus
atggaggaacgaaaccgccgctacg

SEQ ID NO: 195942 - DNA, 25 bp, Rattus norvegicus
atggaggaacgataccgccgctacg

SEQ ID NO: 195943 - DNA, 25 bp, Rattus norvegicus
atggaggaattcatccattgccctc

SEQ ID NO: 195944 - DNA, 25 bp, Rattus norvegicus
atggaggaattcttccattgccctc

SEQ ID NO: 195945 - DNA, 25 bp, Rattus norvegicus
atggaggacactcgtgtctgctcac

SEQ ID NO: 195946 - DNA, 25 bp, Rattus norvegicus
atggaggacactggtgtctgctcac

SEQ ID NO: 195947 - DNA, 25 bp, Rattus norvegicus
atggaggacagtacaggctctctcg

SEQ ID NO: 195948 - DNA, 25 bp, Rattus norvegicus
atggaggacagttcaggctctctcg

SEQ ID NO: 195949 - DNA, 25 bp, Rattus norvegicus
atggaggacctgaacgccatggccg

SEQ ID NO: 195950 - DNA, 25 bp, Rattus norvegicus
atggaggacctgtacgccatggccg

SEQ ID NO: 195951 - DNA, 25 bp, Rattus norvegicus
atggaggacgccactttgtggatgt

SEQ ID NO: 195952 - DNA, 25 bp, Rattus norvegicus
atggaggacgcctctttgtggatgt

SEQ ID NO: 195953 - DNA, 25 bp, Rattus norvegicus
atggaggacgtcacctctcactgac

SEQ ID NO: 195954 - DNA, 25 bp, Rattus norvegicus
atggaggacgtctcctctcactgac

SEQ ID NO: 195955 - DNA, 25 bp, Rattus norvegicus
atggaggagagaaggcaagcatccc

SEQ ID NO: 195956 - DNA, 25 bp, Rattus norvegicus
atggaggagagatggcaagcatccc

SEQ ID NO: 195957 - DNA, 25 bp, Rattus norvegicus
atggaggagagcaggttcatcactc

SEQ ID NO: 195958 - DNA, 25 bp, Rattus norvegicus
atggaggagagctggttcatcactc

SEQ ID NO: 195959 - DNA, 25 bp, Rattus norvegicus
atggaggagccgcattacagttctg

SEQ ID NO: 195960 - DNA, 25 bp, Rattus norvegicus
atggaggagccggattacagttctg

SEQ ID NO: 195961 - DNA, 25 bp, Rattus norvegicus
atggaggcaccaagacggaccctga

SEQ ID NO: 195962 - DNA, 25 bp, Rattus norvegicus
atggaggcaccatgacggaccctga

SEQ ID NO: 195963 - DNA, 25 bp, Rattus norvegicus
atggaggcagtacgcagtccttgat

SEQ ID NO: 195964 - DNA, 25 bp, Rattus norvegicus
atggaggcagtaggcagtccttgat

SEQ ID NO: 195965 - DNA, 25 bp, Rattus norvegicus
atggaggcatcaaccggcatggtgc

SEQ ID NO: 195966 - DNA, 25 bp, Rattus norvegicus
atggaggcatcatccggcatggtgc

SEQ ID NO: 195967 - DNA, 25 bp, Rattus norvegicus
atggaggccatgctcagcactgtgc

SEQ ID NO: 195968 - DNA, 25 bp, Rattus norvegicus
atggaggccatggtcagcactgtgc

SEQ ID NO: 195969 - DNA, 25 bp, Rattus norvegicus
atggaggcccatagtcactcagcag

SEQ ID NO: 195970 - DNA, 25 bp, Rattus norvegicus
atggaggcccattgtcactcagcag

SEQ ID NO: 195971 - DNA, 25 bp, Rattus norvegicus
atggaggccccaagttcagtgagaa

SEQ ID NO: 195972 - DNA, 25 bp, Rattus norvegicus
atggaggccccatgttcagtgagaa

SEQ ID NO: 195973 - DNA, 25 bp, Rattus norvegicus
atggaggccctgaccctggatgcat

SEQ ID NO: 195974 - DNA, 25 bp, Rattus norvegicus
atggaggccctgtccctggatgcat

SEQ ID NO: 195975 - DNA, 25 bp, Rattus norvegicus
atggaggccgctcttggtcgtggtt

SEQ ID NO: 195976 - DNA, 25 bp, Rattus norvegicus
atggaggccgctgttggtcgtggtt

SEQ ID NO: 195977 - DNA, 25 bp, Rattus norvegicus
atggaggccgttcctacgcccactt

SEQ ID NO: 195978 - DNA, 25 bp, Rattus norvegicus
atggaggccgttgctacgcccactt

SEQ ID NO: 195979 - DNA, 25 bp, Rattus norvegicus
atggaggctacgcatgtctctaacg

SEQ ID NO: 195980 - DNA, 25 bp, Rattus norvegicus
atggaggctacggatgtctctaacg

SEQ ID NO: 195981 - DNA, 25 bp, Rattus norvegicus
atggaggctggtacttgggcatcct

SEQ ID NO: 195982 - DNA, 25 bp, Rattus norvegicus
atggaggctggttcttgggcatcct

SEQ ID NO: 195983 - DNA, 25 bp, Rattus norvegicus
atggaggctgtacgctgttccttca

SEQ ID NO: 195984 - DNA, 25 bp, Rattus norvegicus
atggaggctgtaggctgttccttca

SEQ ID NO: 195985 - DNA, 25 bp, Rattus norvegicus
atggaggcttgtcgatcagcgcttc

SEQ ID NO: 195986 - DNA, 25 bp, Rattus norvegicus
atggaggcttgtggatcagcgcttc

SEQ ID NO: 195987 - DNA, 25 bp, Rattus norvegicus
atggaggcttttcgacccatggacc

SEQ ID NO: 195988 - DNA, 25 bp, Rattus norvegicus
atggaggcttttggacccatggacc

SEQ ID NO: 195989 - DNA, 25 bp, Rattus norvegicus
atggagggactccagacattccttc

SEQ ID NO: 195990 - DNA, 25 bp, Rattus norvegicus
atggagggactcgagacattccttc

SEQ ID NO: 195991 - DNA, 25 bp, Rattus norvegicus
atggagggatccaaccactcagcaa

SEQ ID NO: 195992 - DNA, 25 bp, Rattus norvegicus
atggagggatcctaccactcagcaa

SEQ ID NO: 195993 - DNA, 25 bp, Rattus norvegicus
atggagggcaccatttgtcatggag

SEQ ID NO: 195994 - DNA, 25 bp, Rattus norvegicus
atggagggcaccttttgtcatggag

SEQ ID NO: 195995 - DNA, 25 bp, Rattus norvegicus
atggagggccagaaaccccgttgca

SEQ ID NO: 195996 - DNA, 25 bp, Rattus norvegicus
atggagggccagtaaccccgttgca

SEQ ID NO: 195997 - DNA, 25 bp, Rattus norvegicus
atggagggccctcggacactgttct

SEQ ID NO: 195998 - DNA, 25 bp, Rattus norvegicus
atggagggccctgggacactgttct

SEQ ID NO: 195999 - DNA, 25 bp, Rattus norvegicus
atggagggccgtctagccattacca

SEQ ID NO: 196000 - DNA, 25 bp, Rattus norvegicus
atggagggccgtgtagccattacca

SEQ ID NO: 196001 - DNA, 25 bp, Rattus norvegicus
atggagggcctgcatagccacacca

SEQ ID NO: 196002 - DNA, 25 bp, Rattus norvegicus
atggagggcctggatagccacacca

SEQ ID NO: 196003 - DNA, 25 bp, Rattus norvegicus
atggagggccttacagctgtcagaa

SEQ ID NO: 196004 - DNA, 25 bp, Rattus norvegicus
atggagggcctttcagctgtcagaa

SEQ ID NO: 196005 - DNA, 25 bp, Rattus norvegicus
atggagggtagtcgccattaacttt

SEQ ID NO: 196006 - DNA, 25 bp, Rattus norvegicus
atggagggtagtggccattaacttt

SEQ ID NO: 196007 - DNA, 25 bp, Rattus norvegicus
atggagggtctgagatcatatacac

SEQ ID NO: 196008 - DNA, 25 bp, Rattus norvegicus
atggagggtctgtgatcatatacac

SEQ ID NO: 196009 - DNA, 25 bp, Rattus norvegicus
atggagggttctattggctcaccct

SEQ ID NO: 196010 - DNA, 25 bp, Rattus norvegicus
atggagggttcttttggctcaccct

SEQ ID NO: 196011 - DNA, 25 bp, Rattus norvegicus
atggaggtaactcagccctactgtc

SEQ ID NO: 196012 - DNA, 25 bp, Rattus norvegicus
atggaggtaactgagccctactgtc

SEQ ID NO: 196013 - DNA, 25 bp, Rattus norvegicus
atggaggtacaaagatcccgggcaa

SEQ ID NO: 196014 - DNA, 25 bp, Rattus norvegicus
atggaggtacaatgatcccgggcaa

SEQ ID NO: 196015 - DNA, 25 bp, Rattus norvegicus
atggaggtacccaggcagccagagc

SEQ ID NO: 196016 - DNA, 25 bp, Rattus norvegicus
atggaggtaccctggcagccagagc

SEQ ID NO: 196017 - DNA, 25 bp, Rattus norvegicus
atggaggtacgacgcttccagtcct

SEQ ID NO: 196018 - DNA, 25 bp, Rattus norvegicus
atggaggtacgaggcttccagtcct

SEQ ID NO: 196019 - DNA, 25 bp, Rattus norvegicus
atggaggtcctcaaagcttctgagc

SEQ ID NO: 196020 - DNA, 25 bp, Rattus norvegicus
atggaggtcctctaagcttctgagc

SEQ ID NO: 196021 - DNA, 25 bp, Rattus norvegicus
atggaggtccttaacacattgcctt

SEQ ID NO: 196022 - DNA, 25 bp, Rattus norvegicus
atggaggtcctttacacattgcctt

SEQ ID NO: 196023 - DNA, 25 bp, Rattus norvegicus
atggaggtctgcaagttgcctcggc

SEQ ID NO: 196024 - DNA, 25 bp, Rattus norvegicus
atggaggtctgctagttgcctcggc

SEQ ID NO: 196025 - DNA, 25 bp, Rattus norvegicus
atggaggtctgtcattgcgcaccaa

SEQ ID NO: 196026 - DNA, 25 bp, Rattus norvegicus
atggaggtctgtgattgcgcaccaa

SEQ ID NO: 196027 - DNA, 25 bp, Rattus norvegicus
atggaggtgaagatcaagcccatcc

SEQ ID NO: 196028 - DNA, 25 bp, Rattus norvegicus
atggaggtgaagttcaagcccatcc

SEQ ID NO: 196029 - DNA, 25 bp, Rattus norvegicus
atggaggtgacaactgagcccacgc

SEQ ID NO: 196030 - DNA, 25 bp, Rattus norvegicus
atggaggtgacatctgagcccacgc

SEQ ID NO: 196031 - DNA, 25 bp, Rattus norvegicus
atggaggtgctccaggcctcgccct

SEQ ID NO: 196032 - DNA, 25 bp, Rattus norvegicus
atggaggtgctcgaggcctcgccct

SEQ ID NO: 196033 - DNA, 25 bp, Rattus norvegicus
atggaggtgtatcgcacccgccagc

SEQ ID NO: 196034 - DNA, 25 bp, Rattus norvegicus
atggaggtgtatggcacccgccagc

SEQ ID NO: 196035 - DNA, 25 bp, Rattus norvegicus
atggaggttcccaggctgcttggat

SEQ ID NO: 196036 - DNA, 25 bp, Rattus norvegicus
atggaggttccctggctgcttggat

SEQ ID NO: 196037 - DNA, 25 bp, Rattus norvegicus
atggaggtttagattctagactgac

SEQ ID NO: 196038 - DNA, 25 bp, Rattus norvegicus
atggaggtttagtttctagactgac

SEQ ID NO: 196039 - DNA, 25 bp, Rattus norvegicus
atggagtacaccaggctagctctgt

SEQ ID NO: 196040 - DNA, 25 bp, Rattus norvegicus
atggagtacacctggctagctctgt

SEQ ID NO: 196041 - DNA, 25 bp, Rattus norvegicus
atggagtaccttcttgcttcccaaa

SEQ ID NO: 196042 - DNA, 25 bp, Rattus norvegicus
atggagtaccttgttgcttcccaaa

SEQ ID NO: 196043 - DNA, 25 bp, Rattus norvegicus
atggagtactggaccatgcccaagc

SEQ ID NO: 196044 - DNA, 25 bp, Rattus norvegicus
atggagtactggtccatgcccaagc

SEQ ID NO: 196045 - DNA, 25 bp, Rattus norvegicus
atggagtagcatcattcctgcccct

SEQ ID NO: 196046 - DNA, 25 bp, Rattus norvegicus
atggagtagcatgattcctgcccct

SEQ ID NO: 196047 - DNA, 25 bp, Rattus norvegicus
atggagtagccaacacactgcccgg

SEQ ID NO: 196048 - DNA, 25 bp, Rattus norvegicus
atggagtagccatcacactgcccgg

SEQ ID NO: 196049 - DNA, 25 bp, Rattus norvegicus
atggagtagtggcactctccctatt

SEQ ID NO: 196050 - DNA, 25 bp, Rattus norvegicus
atggagtagtgggactctccctatt

SEQ ID NO: 196051 - DNA, 25 bp, Rattus norvegicus
atggagtcaccaaaggccctgctga

SEQ ID NO: 196052 - DNA, 25 bp, Rattus norvegicus
atggagtcaccataggccctgctga

SEQ ID NO: 196053 - DNA, 25 bp, Rattus norvegicus
atggagtcacctaagccagctcagg

SEQ ID NO: 196054 - DNA, 25 bp, Rattus norvegicus
atggagtcaccttagccagctcagg

SEQ ID NO: 196055 - DNA, 25 bp, Rattus norvegicus
atggagtcatatcctctatcattct

SEQ ID NO: 196056 - DNA, 25 bp, Rattus norvegicus
atggagtcatatgctctatcattct

SEQ ID NO: 196057 - DNA, 25 bp, Rattus norvegicus
atggagtcatcaatgaggctctgag

SEQ ID NO: 196058 - DNA, 25 bp, Rattus norvegicus
atggagtcatcattgaggctctgag

SEQ ID NO: 196059 - DNA, 25 bp, Rattus norvegicus
atggagtcattcctgcgcaggtctg

SEQ ID NO: 196060 - DNA, 25 bp, Rattus norvegicus
atggagtcattcgtgcgcaggtctg

SEQ ID NO: 196061 - DNA, 25 bp, Rattus norvegicus
atggagtcatttcctaaggccctga

SEQ ID NO: 196062 - DNA, 25 bp, Rattus norvegicus
atggagtcatttgctaaggccctga

SEQ ID NO: 196063 - DNA, 25 bp, Rattus norvegicus
atggagtccaaacatcaaggagcaa

SEQ ID NO: 196064 - DNA, 25 bp, Rattus norvegicus
atggagtccaaagatcaaggagcaa

SEQ ID NO: 196065 - DNA, 25 bp, Rattus norvegicus
atggagtccacccagtaagtgcagt

SEQ ID NO: 196066 - DNA, 25 bp, Rattus norvegicus
atggagtccaccgagtaagtgcagt

SEQ ID NO: 196067 - DNA, 25 bp, Rattus norvegicus
atggagtcctgcacgtgtcccacaa

SEQ ID NO: 196068 - DNA, 25 bp, Rattus norvegicus
atggagtcctgcagctgcgaccgct

SEQ ID NO: 196069 - DNA, 25 bp, Rattus norvegicus
atggagtcctgctcgtgtcccacaa

SEQ ID NO: 196070 - DNA, 25 bp, Rattus norvegicus
atggagtcctgctgctgcgaccgct

SEQ ID NO: 196071 - DNA, 25 bp, Rattus norvegicus
atggagtcggttactgcgaacttcc

SEQ ID NO: 196072 - DNA, 25 bp, Rattus norvegicus
atggagtcggtttctgcgaacttcc

SEQ ID NO: 196073 - DNA, 25 bp, Rattus norvegicus
atggagtctgagataccacaggtat

SEQ ID NO: 196074 - DNA, 25 bp, Rattus norvegicus
atggagtctgagttaccacaggtat

SEQ ID NO: 196075 - DNA, 25 bp, Rattus norvegicus
atggagtctgtgactactctcttgt

SEQ ID NO: 196076 - DNA, 25 bp, Rattus norvegicus
atggagtctgtgtctactctcttgt

SEQ ID NO: 196077 - DNA, 25 bp, Rattus norvegicus
atggagtcttctcggtcagtggcaa

SEQ ID NO: 196078 - DNA, 25 bp, Rattus norvegicus
atggagtcttctgggtcagtggcaa

SEQ ID NO: 196079 - DNA, 25 bp, Rattus norvegicus
atggagtgaactcgcagcggtccct

SEQ ID NO: 196080 - DNA, 25 bp, Rattus norvegicus
atggagtgaactctgggaccctctt

SEQ ID NO: 196081 - DNA, 25 bp, Rattus norvegicus
atggagtgaactggcagcggtccct

SEQ ID NO: 196082 - DNA, 25 bp, Rattus norvegicus
atggagtgaactgtgggaccctctt

SEQ ID NO: 196083 - DNA, 25 bp, Rattus norvegicus
atggagtgcgccagggtcccaaaca

SEQ ID NO: 196084 - DNA, 25 bp, Rattus norvegicus
atggagtgcgcctgggtcccaaaca

SEQ ID NO: 196085 - DNA, 25 bp, Rattus norvegicus
atggagtggcttacctttcagagta

SEQ ID NO: 196086 - DNA, 25 bp, Rattus norvegicus
atggagtggcttagcagcaatcaaa

SEQ ID NO: 196087 - DNA, 25 bp, Rattus norvegicus
atggagtggctttcctttcagagta

SEQ ID NO: 196088 - DNA, 25 bp, Rattus norvegicus
atggagtggctttgcagcaatcaaa

SEQ ID NO: 196089 - DNA, 25 bp, Rattus norvegicus
atggagtggtccataatgcctgcat

SEQ ID NO: 196090 - DNA, 25 bp, Rattus norvegicus
atggagtggtccttaatgcctgcat

SEQ ID NO: 196091 - DNA, 25 bp, Rattus norvegicus
atggagtgtgcacagaattttcttt

SEQ ID NO: 196092 - DNA, 25 bp, Rattus norvegicus
atggagtgtgcagagaattttcttt

SEQ ID NO: 196093 - DNA, 25 bp, Rattus norvegicus
atggagtgtggcagttgctgcccaa

SEQ ID NO: 196094 - DNA, 25 bp, Rattus norvegicus
atggagtgtggctgttgctgcccaa

SEQ ID NO: 196095 - DNA, 25 bp, Rattus norvegicus
atggagtgtttgaggccttcacaga

SEQ ID NO: 196096 - DNA, 25 bp, Rattus norvegicus
atggagtgtttgtggccttcacaga

SEQ ID NO: 196097 - DNA, 25 bp, Rattus norvegicus
atggagttacaccttctgctgtctg

SEQ ID NO: 196098 - DNA, 25 bp, Rattus norvegicus
atggagttacacgttctgctgtctg

SEQ ID NO: 196099 - DNA, 25 bp, Rattus norvegicus
atggagttaccaaccccacatgtat

SEQ ID NO: 196100 - DNA, 25 bp, Rattus norvegicus
atggagttaccatccccacatgtat

SEQ ID NO: 196101 - DNA, 25 bp, Rattus norvegicus
atggagttagtgacaaccccacgtc

SEQ ID NO: 196102 - DNA, 25 bp, Rattus norvegicus
atggagttagtgtcaaccccacgtc

SEQ ID NO: 196103 - DNA, 25 bp, Rattus norvegicus
atggagttcaacatactgatcagaa

SEQ ID NO: 196104 - DNA, 25 bp, Rattus norvegicus
atggagttcaacttactgatcagaa

SEQ ID NO: 196105 - DNA, 25 bp, Rattus norvegicus
atggagttcagccatctatgcctac

SEQ ID NO: 196106 - DNA, 25 bp, Rattus norvegicus
atggagttcagcgatctatgcctac

SEQ ID NO: 196107 - DNA, 25 bp, Rattus norvegicus
atggagttcagtccccttagaaagc

SEQ ID NO: 196108 - DNA, 25 bp, Rattus norvegicus
atggagttcagtgcccttagaaagc

SEQ ID NO: 196109 - DNA, 25 bp, Rattus norvegicus
atggagttcccaagttgttgctggt

SEQ ID NO: 196110 - DNA, 25 bp, Rattus norvegicus
atggagttcccatgttgttgctggt

SEQ ID NO: 196111 - DNA, 25 bp, Rattus norvegicus
atggagttcctaaagcactagcaat

SEQ ID NO: 196112 - DNA, 25 bp, Rattus norvegicus
atggagttcctatagcactagcaat

SEQ ID NO: 196113 - DNA, 25 bp, Rattus norvegicus
atggagttcctcattgttatcgtgg

SEQ ID NO: 196114 - DNA, 25 bp, Rattus norvegicus
atggagttcctctttgttatcgtgg

SEQ ID NO: 196115 - DNA, 25 bp, Rattus norvegicus
atggagttctgactttcactgcctt

SEQ ID NO: 196116 - DNA, 25 bp, Rattus norvegicus
atggagttctgagtttcactgcctt

SEQ ID NO: 196117 - DNA, 25 bp, Rattus norvegicus
atggagttcttgatcttgtgttgca

SEQ ID NO: 196118 - DNA, 25 bp, Rattus norvegicus
atggagttcttgttcttgtgttgca

SEQ ID NO: 196119 - DNA, 25 bp, Rattus norvegicus
atggagttgctcacaccagaagact

SEQ ID NO: 196120 - DNA, 25 bp, Rattus norvegicus
atggagttgctctcaccagaagact

SEQ ID NO: 196121 - DNA, 25 bp, Rattus norvegicus
atggagttggctcagtgtcacacaa

SEQ ID NO: 196122 - DNA, 25 bp, Rattus norvegicus
atggagttggctgagtgtcacacaa

SEQ ID NO: 196123 - DNA, 25 bp, Rattus norvegicus
atggagttgtccctgctatccttgc

SEQ ID NO: 196124 - DNA, 25 bp, Rattus norvegicus
atggagttgtccgtgctatccttgc

SEQ ID NO: 196125 - DNA, 25 bp, Rattus norvegicus
atggagtttcatatgcttgctggta

SEQ ID NO: 196126 - DNA, 25 bp, Rattus norvegicus
atggagtttcatttgcttgctggta

SEQ ID NO: 196127 - DNA, 25 bp, Rattus norvegicus
atggagtttcctcaacatgtagtgt

SEQ ID NO: 196128 - DNA, 25 bp, Rattus norvegicus
atggagtttcctgaacatgtagtgt

SEQ ID NO: 196129 - DNA, 25 bp, Rattus norvegicus
atggagtttggcatgttcctcccca

SEQ ID NO: 196130 - DNA, 25 bp, Rattus norvegicus
atggagtttggcttgttcctcccca

SEQ ID NO: 196131 - DNA, 25 bp, Rattus norvegicus
atggagttttgtatcagagcagcac

SEQ ID NO: 196132 - DNA, 25 bp, Rattus norvegicus
atggagttttgtttcagagcagcac

SEQ ID NO: 196133 - DNA, 25 bp, Rattus norvegicus
atggataactgcatgggtgtcttgg

SEQ ID NO: 196134 - DNA, 25 bp, Rattus norvegicus
atggataactgcttgggtgtcttgg

SEQ ID NO: 196135 - DNA, 25 bp, Rattus norvegicus
atggataatcttctctgtctccttc

SEQ ID NO: 196136 - DNA, 25 bp, Rattus norvegicus
atggataatcttgtctgtctccttc

SEQ ID NO: 196137 - DNA, 25 bp, Rattus norvegicus
atggatacagaacagcagtcaggtc

SEQ ID NO: 196138 - DNA, 25 bp, Rattus norvegicus
atggatacagaagagcagtcaggtc

SEQ ID NO: 196139 - DNA, 25 bp, Rattus norvegicus
atggatacagggacctccttggtga

SEQ ID NO: 196140 - DNA, 25 bp, Rattus norvegicus
atggatacagggtcctccttggtga

SEQ ID NO: 196141 - DNA, 25 bp, Rattus norvegicus
atggataccagcctaggctccacaa

SEQ ID NO: 196142 - DNA, 25 bp, Rattus norvegicus
atggataccagcgtaggctccacaa

SEQ ID NO: 196143 - DNA, 25 bp, Rattus norvegicus
atggatacctttactttcattatga

SEQ ID NO: 196144 - DNA, 25 bp, Rattus norvegicus
atggataccttttctttcattatga

SEQ ID NO: 196145 - DNA, 25 bp, Rattus norvegicus
atggatacgtgcatgcagtctgcct

SEQ ID NO: 196146 - DNA, 25 bp, Rattus norvegicus
atggatacgtgcttgcagtctgcct

SEQ ID NO: 196147 - DNA, 25 bp, Rattus norvegicus
atggatactcttcctgtaagcggcc

SEQ ID NO: 196148 - DNA, 25 bp, Rattus norvegicus
atggatactcttgctgtaagcggcc

SEQ ID NO: 196149 - DNA, 25 bp, Rattus norvegicus
atggataggatcatcttgtttgttt

SEQ ID NO: 196150 - DNA, 25 bp, Rattus norvegicus
atggataggatcttcttgtttgttt

SEQ ID NO: 196151 - DNA, 25 bp, Rattus norvegicus
atggatagtaagcttggccacactt

SEQ ID NO: 196152 - DNA, 25 bp, Rattus norvegicus
atggatagtaaggttggccacactt

SEQ ID NO: 196153 - DNA, 25 bp, Rattus norvegicus
atggatatacttaacgcaggtcgaa

SEQ ID NO: 196154 - DNA, 25 bp, Rattus norvegicus
atggatatactttacgcaggtcgaa

SEQ ID NO: 196155 - DNA, 25 bp, Rattus norvegicus
atggatatccgacgcaagctgaccg

SEQ ID NO: 196156 - DNA, 25 bp, Rattus norvegicus
atggatatccgaggcaagctgaccg

SEQ ID NO: 196157 - DNA, 25 bp, Rattus norvegicus
atggatatctccatagcttgctgat

SEQ ID NO: 196158 - DNA, 25 bp, Rattus norvegicus
atggatatctccttagcttgctgat

SEQ ID NO: 196159 - DNA, 25 bp, Rattus norvegicus
atggatatctgcatcttccagagaa

SEQ ID NO: 196160 - DNA, 25 bp, Rattus norvegicus
atggatatctgcttcttccagagaa

SEQ ID NO: 196161 - DNA, 25 bp, Rattus norvegicus
atggatatgaggacaccagcccagc

SEQ ID NO: 196162 - DNA, 25 bp, Rattus norvegicus
atggatatgaggtcaccagcccagc

SEQ ID NO: 196163 - DNA, 25 bp, Rattus norvegicus
atggatatgtgaaccacctggctcc

SEQ ID NO: 196164 - DNA, 25 bp, Rattus norvegicus
atggatatgtgaagtctggtcgtgt

SEQ ID NO: 196165 - DNA, 25 bp, Rattus norvegicus
atggatatgtgatccacctggctcc

SEQ ID NO: 196166 - DNA, 25 bp, Rattus norvegicus
atggatatgtgatgtctggtcgtgt

SEQ ID NO: 196167 - DNA, 25 bp, Rattus norvegicus
atggatcaagatagaggttcctaga

SEQ ID NO: 196168 - DNA, 25 bp, Rattus norvegicus
atggatcaagattgaggttcctaga

SEQ ID NO: 196169 - DNA, 25 bp, Rattus norvegicus
atggatcacaagctagtctctaact

SEQ ID NO: 196170 - DNA, 25 bp, Rattus norvegicus
atggatcacaaggtagtctctaact

SEQ ID NO: 196171 - DNA, 25 bp, Rattus norvegicus
atggatcactcacaagtcacctttc

SEQ ID NO: 196172 - DNA, 25 bp, Rattus norvegicus
atggatcactcagaagtcacctttc

SEQ ID NO: 196173 - DNA, 25 bp, Rattus norvegicus
atggatcactgacgcactgacgtag

SEQ ID NO: 196174 - DNA, 25 bp, Rattus norvegicus
atggatcactgaggcactgacgtag

SEQ ID NO: 196175 - DNA, 25 bp, Rattus norvegicus
atggatcccatgagagcctgacctg

SEQ ID NO: 196176 - DNA, 25 bp, Rattus norvegicus
atggatcccatgtgagcctgacctg

SEQ ID NO: 196177 - DNA, 25 bp, Rattus norvegicus
atggatcccgcccagtagccttatg

SEQ ID NO: 196178 - DNA, 25 bp, Rattus norvegicus
atggatcccgccgagtagccttatg

SEQ ID NO: 196179 - DNA, 25 bp, Rattus norvegicus
atggatccctcactgtggcaagctc

SEQ ID NO: 196180 - DNA, 25 bp, Rattus norvegicus
atggatccctcagtgtggcaagctc

SEQ ID NO: 196181 - DNA, 25 bp, Rattus norvegicus
atggatccctccagggacactcctt

SEQ ID NO: 196182 - DNA, 25 bp, Rattus norvegicus
atggatccctcctgggacactcctt

SEQ ID NO: 196183 - DNA, 25 bp, Rattus norvegicus
atggatcctagcagggagcagctct

SEQ ID NO: 196184 - DNA, 25 bp, Rattus norvegicus
atggatcctagctgggagcagctct

SEQ ID NO: 196185 - DNA, 25 bp, Rattus norvegicus
atggatcctatcagctaggtcaccc

SEQ ID NO: 196186 - DNA, 25 bp, Rattus norvegicus
atggatcctatctgctaggtcaccc

SEQ ID NO: 196187 - DNA, 25 bp, Rattus norvegicus
atggatcctggaactgtgggctgtt

SEQ ID NO: 196188 - DNA, 25 bp, Rattus norvegicus
atggatcctggatctgtgggctgtt

SEQ ID NO: 196189 - DNA, 25 bp, Rattus norvegicus
atggatccttgtacttccaaaatgt

SEQ ID NO: 196190 - DNA, 25 bp, Rattus norvegicus
atggatccttgttcttccaaaatgt

SEQ ID NO: 196191 - DNA, 25 bp, Rattus norvegicus
atggatcgcagcaccaagaggaggc

SEQ ID NO: 196192 - DNA, 25 bp, Rattus norvegicus
atggatcgcagctccaagaggaggc

SEQ ID NO: 196193 - DNA, 25 bp, Rattus norvegicus
atggatctccagaaatctcctgcat

SEQ ID NO: 196194 - DNA, 25 bp, Rattus norvegicus
atggatctccagtaatctcctgcat

SEQ ID NO: 196195 - DNA, 25 bp, Rattus norvegicus
atggatctctaaccccagtactcag

SEQ ID NO: 196196 - DNA, 25 bp, Rattus norvegicus
atggatctctaagcccagtactcag

SEQ ID NO: 196197 - DNA, 25 bp, Rattus norvegicus
atggatctgaccacggagtgtgcta

SEQ ID NO: 196198 - DNA, 25 bp, Rattus norvegicus
atggatctgacctcggagtgtgcta

SEQ ID NO: 196199 - DNA, 25 bp, Rattus norvegicus
atggatctgccactacatgcatgga

SEQ ID NO: 196200 - DNA, 25 bp, Rattus norvegicus
atggatctgccagtacatgcatgga

SEQ ID NO: 196201 - DNA, 25 bp, Rattus norvegicus
atggatctgtctaatcggtgacctc

SEQ ID NO: 196202 - DNA, 25 bp, Rattus norvegicus
atggatctgtcttatcggtgacctc

SEQ ID NO: 196203 - DNA, 25 bp, Rattus norvegicus
atggatcttcctcgatggtttgccg

SEQ ID NO: 196204 - DNA, 25 bp, Rattus norvegicus
atggatcttcctggatggtttgccg

SEQ ID NO: 196205 - DNA, 25 bp, Rattus norvegicus
atggatgaaaccacttcccgaaagg

SEQ ID NO: 196206 - DNA, 25 bp, Rattus norvegicus
atggatgaaacctcttcccgaaagg

SEQ ID NO: 196207 - DNA, 25 bp, Rattus norvegicus
atggatgaccctaggacacgttgta

SEQ ID NO: 196208 - DNA, 25 bp, Rattus norvegicus
atggatgacccttggacacgttgta

SEQ ID NO: 196209 - DNA, 25 bp, Rattus norvegicus
atggatgacgatatcgctgcgctcg

SEQ ID NO: 196210 - DNA, 25 bp, Rattus norvegicus
atggatgacgatttcgctgcgctcg

SEQ ID NO: 196211 - DNA, 25 bp, Rattus norvegicus
atggatgacggccagacccgtttca

SEQ ID NO: 196212 - DNA, 25 bp, Rattus norvegicus
atggatgacggcgagacccgtttca

SEQ ID NO: 196213 - DNA, 25 bp, Rattus norvegicus
atggatgactccagactctgtcatt

SEQ ID NO: 196214 - DNA, 25 bp, Rattus norvegicus
atggatgactccatgggtatcgtcc

SEQ ID NO: 196215 - DNA, 25 bp, Rattus norvegicus
atggatgactcctgactctgtcatt

SEQ ID NO: 196216 - DNA, 25 bp, Rattus norvegicus
atggatgactccttgggtatcgtcc

SEQ ID NO: 196217 - DNA, 25 bp, Rattus norvegicus
atggatgactgacaggccctgcact

SEQ ID NO: 196218 - DNA, 25 bp, Rattus norvegicus
atggatgactgagaggccctgcact

SEQ ID NO: 196219 - DNA, 25 bp, Rattus norvegicus
atggatgaggagaccgttcacgcac

SEQ ID NO: 196220 - DNA, 25 bp, Rattus norvegicus
atggatgaggagacgtttccttact

SEQ ID NO: 196221 - DNA, 25 bp, Rattus norvegicus
atggatgaggagtccgttcacgcac

SEQ ID NO: 196222 - DNA, 25 bp, Rattus norvegicus
atggatgaggagtcgtttccttact

SEQ ID NO: 196223 - DNA, 25 bp, Rattus norvegicus
atggatgagtgacccaggcgcatct

SEQ ID NO: 196224 - DNA, 25 bp, Rattus norvegicus
atggatgagtgagccaggcgcatct

SEQ ID NO: 196225 - DNA, 25 bp, Rattus norvegicus
atggatgagtgtacagttgtgtgca

SEQ ID NO: 196226 - DNA, 25 bp, Rattus norvegicus
atggatgagtgttcagttgtgtgca

SEQ ID NO: 196227 - DNA, 25 bp, Rattus norvegicus
atggatgcagccattgtgagcccca

SEQ ID NO: 196228 - DNA, 25 bp, Rattus norvegicus
atggatgcagcctttgtgagcccca

SEQ ID NO: 196229 - DNA, 25 bp, Rattus norvegicus
atggatgccacacggtcctttccaa

SEQ ID NO: 196230 - DNA, 25 bp, Rattus norvegicus
atggatgccacagggtcctttccaa

SEQ ID NO: 196231 - DNA, 25 bp, Rattus norvegicus
atggatgccaggctaagcctttgcc

SEQ ID NO: 196232 - DNA, 25 bp, Rattus norvegicus
atggatgccagggtaagcctttgcc

SEQ ID NO: 196233 - DNA, 25 bp, Rattus norvegicus
atggatgcccaacaagcactagcta

SEQ ID NO: 196234 - DNA, 25 bp, Rattus norvegicus
atggatgcccaagaagcactagcta

SEQ ID NO: 196235 - DNA, 25 bp, Rattus norvegicus
atggatgccctcatcgaagctggag

SEQ ID NO: 196236 - DNA, 25 bp, Rattus norvegicus
atggatgccctcttcgaagctggag

SEQ ID NO: 196237 - DNA, 25 bp, Rattus norvegicus
atggatgcctcccactcagtattga

SEQ ID NO: 196238 - DNA, 25 bp, Rattus norvegicus
atggatgcctccgactcagtattga

SEQ ID NO: 196239 - DNA, 25 bp, Rattus norvegicus
atggatgcctgtcgtgcaattctct

SEQ ID NO: 196240 - DNA, 25 bp, Rattus norvegicus
atggatgcctgtggtgcaattctct

SEQ ID NO: 196241 - DNA, 25 bp, Rattus norvegicus
atggatgctcacactgaacatgggc

SEQ ID NO: 196242 - DNA, 25 bp, Rattus norvegicus
atggatgctcaccatgagcttgccc

SEQ ID NO: 196243 - DNA, 25 bp, Rattus norvegicus
atggatgctcacgatgagcttgccc

SEQ ID NO: 196244 - DNA, 25 bp, Rattus norvegicus
atggatgctcactctgaacatgggc

SEQ ID NO: 196245 - DNA, 25 bp, Rattus norvegicus
atggatgctgaaagcctggccacag

SEQ ID NO: 196246 - DNA, 25 bp, Rattus norvegicus
atggatgctgaatgcctggccacag

SEQ ID NO: 196247 - DNA, 25 bp, Rattus norvegicus
atggatgctgtactgatgtctctca

SEQ ID NO: 196248 - DNA, 25 bp, Rattus norvegicus
atggatgctgtagtgatgtctctca

SEQ ID NO: 196249 - DNA, 25 bp, Rattus norvegicus
atggatgctttgactataccagaga

SEQ ID NO: 196250 - DNA, 25 bp, Rattus norvegicus
atggatgctttgtctataccagaga

SEQ ID NO: 196251 - DNA, 25 bp, Rattus norvegicus
atggatggacgaacctgcagacccc

SEQ ID NO: 196252 - DNA, 25 bp, Rattus norvegicus
atggatggacgatcctgcagacccc

SEQ ID NO: 196253 - DNA, 25 bp, Rattus norvegicus
atggatggacttaggtcgccgtagc

SEQ ID NO: 196254 - DNA, 25 bp, Rattus norvegicus
atggatggactttggtcgccgtagc

SEQ ID NO: 196255 - DNA, 25 bp, Rattus norvegicus
atggatggcaggatgtgattcacta

SEQ ID NO: 196256 - DNA, 25 bp, Rattus norvegicus
atggatggcaggttgtgattcacta

SEQ ID NO: 196257 - DNA, 25 bp, Rattus norvegicus
atggatggccaaccctcatgtggga

SEQ ID NO: 196258 - DNA, 25 bp, Rattus norvegicus
atggatggccaagcctcatgtggga

SEQ ID NO: 196259 - DNA, 25 bp, Rattus norvegicus
atggatgggagccagttcaggaaca

SEQ ID NO: 196260 - DNA, 25 bp, Rattus norvegicus
atggatgggagcgagttcaggaaca

SEQ ID NO: 196261 - DNA, 25 bp, Rattus norvegicus
atggatgggcagcatcgacccttct

SEQ ID NO: 196262 - DNA, 25 bp, Rattus norvegicus
atggatgggcaggatcgacccttct

SEQ ID NO: 196263 - DNA, 25 bp, Rattus norvegicus
atggatggtccaatccagagacgct

SEQ ID NO: 196264 - DNA, 25 bp, Rattus norvegicus
atggatggtccattccagagacgct

SEQ ID NO: 196265 - DNA, 25 bp, Rattus norvegicus
atggatggtcctatccatctgtggc

SEQ ID NO: 196266 - DNA, 25 bp, Rattus norvegicus
atggatggtcctttccatctgtggc

SEQ ID NO: 196267 - DNA, 25 bp, Rattus norvegicus
atggatggtttcactatctgtacag

SEQ ID NO: 196268 - DNA, 25 bp, Rattus norvegicus
atggatggtttctctatctgtacag

SEQ ID NO: 196269 - DNA, 25 bp, Rattus norvegicus
atggatgtcgacacacagaacccta

SEQ ID NO: 196270 - DNA, 25 bp, Rattus norvegicus
atggatgtcgactcacagaacccta

SEQ ID NO: 196271 - DNA, 25 bp, Rattus norvegicus
atggatgtctgtctgctgcttttgt

SEQ ID NO: 196272 - DNA, 25 bp, Rattus norvegicus
atggatgtctgtctgtttgctcagt

SEQ ID NO: 196273 - DNA, 25 bp, Rattus norvegicus
atggatgtctgtgtgctgcttttgt

SEQ ID NO: 196274 - DNA, 25 bp, Rattus norvegicus
atggatgtctgtgtgtttgctcagt

SEQ ID NO: 196275 - DNA, 25 bp, Rattus norvegicus
atggatgtgcacattacgccgggca

SEQ ID NO: 196276 - DNA, 25 bp, Rattus norvegicus
atggatgtgcactttacgccgggca

SEQ ID NO: 196277 - DNA, 25 bp, Rattus norvegicus
atggatgtgctgacggtagcatttt

SEQ ID NO: 196278 - DNA, 25 bp, Rattus norvegicus
atggatgtgctgtcggtagcatttt

SEQ ID NO: 196279 - DNA, 25 bp, Rattus norvegicus
atggatgtggcccttcgcatgtacc

SEQ ID NO: 196280 - DNA, 25 bp, Rattus norvegicus
atggatgtggccgttcgcatgtacc

SEQ ID NO: 196281 - DNA, 25 bp, Rattus norvegicus
atggatgtgtgcactatgcctggtt

SEQ ID NO: 196282 - DNA, 25 bp, Rattus norvegicus
atggatgtgtgctctatgcctggtt

SEQ ID NO: 196283 - DNA, 25 bp, Rattus norvegicus
atggatgtgttacagatggttgaaa

SEQ ID NO: 196284 - DNA, 25 bp, Rattus norvegicus
atggatgtgttagagatggttgaaa

SEQ ID NO: 196285 - DNA, 25 bp, Rattus norvegicus
atggatgtgttgataggtggccctc

SEQ ID NO: 196286 - DNA, 25 bp, Rattus norvegicus
atggatgtgttgttaggtggccctc

SEQ ID NO: 196287 - DNA, 25 bp, Rattus norvegicus
atggatgttccaaaggacgagctta

SEQ ID NO: 196288 - DNA, 25 bp, Rattus norvegicus
atggatgttccaacaccaacaaatc

SEQ ID NO: 196289 - DNA, 25 bp, Rattus norvegicus
atggatgttccataggacgagctta

SEQ ID NO: 196290 - DNA, 25 bp, Rattus norvegicus
atggatgttccatcaccaacaaatc

SEQ ID NO: 196291 - DNA, 25 bp, Rattus norvegicus
atggatgttgagatcagcccctgtc

SEQ ID NO: 196292 - DNA, 25 bp, Rattus norvegicus
atggatgttgagttcagcccctgtc

SEQ ID NO: 196293 - DNA, 25 bp, Rattus norvegicus
atggatgttgcaattcacttctctg

SEQ ID NO: 196294 - DNA, 25 bp, Rattus norvegicus
atggatgttgcatttcacttctctg

SEQ ID NO: 196295 - DNA, 25 bp, Rattus norvegicus
atggatgttttacttgcccgtacga

SEQ ID NO: 196296 - DNA, 25 bp, Rattus norvegicus
atggatgttttagttgcccgtacga

SEQ ID NO: 196297 - DNA, 25 bp, Rattus norvegicus
atggattaaaccactttgaccctgt

SEQ ID NO: 196298 - DNA, 25 bp, Rattus norvegicus
atggattaaacctctttgaccctgt

SEQ ID NO: 196299 - DNA, 25 bp, Rattus norvegicus
atggattacaacaacccgctgtgtg

SEQ ID NO: 196300 - DNA, 25 bp, Rattus norvegicus
atggattacaactacccgctgtgtg

SEQ ID NO: 196301 - DNA, 25 bp, Rattus norvegicus
atggattcaaagagtcctttctgga

SEQ ID NO: 196302 - DNA, 25 bp, Rattus norvegicus
atggattcaaagtgtcctttctgga

SEQ ID NO: 196303 - DNA, 25 bp, Rattus norvegicus
atggattcatagatcctcccaataa

SEQ ID NO: 196304 - DNA, 25 bp, Rattus norvegicus
atggattcatagttcctcccaataa

SEQ ID NO: 196305 - DNA, 25 bp, Rattus norvegicus
atggattcatctagatctcagccct

SEQ ID NO: 196306 - DNA, 25 bp, Rattus norvegicus
atggattcatctctccgactaggat

SEQ ID NO: 196307 - DNA, 25 bp, Rattus norvegicus
atggattcatctgtccgactaggat

SEQ ID NO: 196308 - DNA, 25 bp, Rattus norvegicus
atggattcatcttgatctcagccct

SEQ ID NO: 196309 - DNA, 25 bp, Rattus norvegicus
atggattccagtcgagatgaggtct

SEQ ID NO: 196310 - DNA, 25 bp, Rattus norvegicus
atggattccagtggagatgaggtct

SEQ ID NO: 196311 - DNA, 25 bp, Rattus norvegicus
atggattcgaccacaaaccagtgaa

SEQ ID NO: 196312 - DNA, 25 bp, Rattus norvegicus
atggattcgacctcaaaccagtgaa

SEQ ID NO: 196313 - DNA, 25 bp, Rattus norvegicus
atggattcgcatctacctgtatatt

SEQ ID NO: 196314 - DNA, 25 bp, Rattus norvegicus
atggattcgcatgtacctgtatatt

SEQ ID NO: 196315 - DNA, 25 bp, Rattus norvegicus
atggattctaaaacctctggctggg

SEQ ID NO: 196316 - DNA, 25 bp, Rattus norvegicus
atggattctaaatcctctggctggg

SEQ ID NO: 196317 - DNA, 25 bp, Rattus norvegicus
atggattctagtctctattctgtta

SEQ ID NO: 196318 - DNA, 25 bp, Rattus norvegicus
atggattctagtgtctattctgtta

SEQ ID NO: 196319 - DNA, 25 bp, Rattus norvegicus
atggattcttgtaatgtggcatgaa

SEQ ID NO: 196320 - DNA, 25 bp, Rattus norvegicus
atggattcttgttatgtggcatgaa

SEQ ID NO: 196321 - DNA, 25 bp, Rattus norvegicus
atggattgcagcctctcagtttaat

SEQ ID NO: 196322 - DNA, 25 bp, Rattus norvegicus
atggattgcagcgtctcagtttaat

SEQ ID NO: 196323 - DNA, 25 bp, Rattus norvegicus
atggattgctccagtgcacgaacca

SEQ ID NO: 196324 - DNA, 25 bp, Rattus norvegicus
atggattgctcctgtgcacgaacca

SEQ ID NO: 196325 - DNA, 25 bp, Rattus norvegicus
atggattgctggaaccttgctgggt

SEQ ID NO: 196326 - DNA, 25 bp, Rattus norvegicus
atggattgctggtaccttgctgggt

SEQ ID NO: 196327 - DNA, 25 bp, Rattus norvegicus
atggattggactctgtttccgggaa

SEQ ID NO: 196328 - DNA, 25 bp, Rattus norvegicus
atggattggactgtgtttccgggaa

SEQ ID NO: 196329 - DNA, 25 bp, Rattus norvegicus
atggattgtaggattccttacgctg

SEQ ID NO: 196330 - DNA, 25 bp, Rattus norvegicus
atggattgtaggtttccttacgctg

SEQ ID NO: 196331 - DNA, 25 bp, Rattus norvegicus
atggattgtgcaagactgtgtcttg

SEQ ID NO: 196332 - DNA, 25 bp, Rattus norvegicus
atggattgtgcatgactgtgtcttg

SEQ ID NO: 196333 - DNA, 25 bp, Rattus norvegicus
atggatttacaccttacacctttct

SEQ ID NO: 196334 - DNA, 25 bp, Rattus norvegicus
atggatttacacgttacacctttct

SEQ ID NO: 196335 - DNA, 25 bp, Rattus norvegicus
atggatttagacaccctttgaggaa

SEQ ID NO: 196336 - DNA, 25 bp, Rattus norvegicus
atggatttagactccctttgaggaa

SEQ ID NO: 196337 - DNA, 25 bp, Rattus norvegicus
atggatttcaggcaagtgccctcct

SEQ ID NO: 196338 - DNA, 25 bp, Rattus norvegicus
atggatttcagggaagtgccctcct

SEQ ID NO: 196339 - DNA, 25 bp, Rattus norvegicus
atggatttcccactttcagacttga

SEQ ID NO: 196340 - DNA, 25 bp, Rattus norvegicus
atggatttcccagtttcagacttga

SEQ ID NO: 196341 - DNA, 25 bp, Rattus norvegicus
atggatttccctcgtatgctcggta

SEQ ID NO: 196342 - DNA, 25 bp, Rattus norvegicus
atggatttccctggtatgctcggta

SEQ ID NO: 196343 - DNA, 25 bp, Rattus norvegicus
atggatttccgtctctggtgtagct

SEQ ID NO: 196344 - DNA, 25 bp, Rattus norvegicus
atggatttccgtgtctggtgtagct

SEQ ID NO: 196345 - DNA, 25 bp, Rattus norvegicus
atggatttcgtgctcaaggctctca

SEQ ID NO: 196346 - DNA, 25 bp, Rattus norvegicus
atggatttcgtggtcaaggctctca

SEQ ID NO: 196347 - DNA, 25 bp, Rattus norvegicus
atggatttgcagatcccaggactta

SEQ ID NO: 196348 - DNA, 25 bp, Rattus norvegicus
atggatttgcagttcccaggactta

SEQ ID NO: 196349 - DNA, 25 bp, Rattus norvegicus
atggatttgccaactgtgttaggag

SEQ ID NO: 196350 - DNA, 25 bp, Rattus norvegicus
atggatttgccatctgtgttaggag

SEQ ID NO: 196351 - DNA, 25 bp, Rattus norvegicus
atggatttgggcagagccactctgt

SEQ ID NO: 196352 - DNA, 25 bp, Rattus norvegicus
atggatttgggctgagccactctgt

SEQ ID NO: 196353 - DNA, 25 bp, Rattus norvegicus
atggcaaacagtcgtcccagtacaa

SEQ ID NO: 196354 - DNA, 25 bp, Rattus norvegicus
atggcaaacagtggtcccagtacaa

SEQ ID NO: 196355 - DNA, 25 bp, Rattus norvegicus
atggcaaacgagctcacttcccatt

SEQ ID NO: 196356 - DNA, 25 bp, Rattus norvegicus
atggcaaacgaggtcacttcccatt

SEQ ID NO: 196357 - DNA, 25 bp, Rattus norvegicus
atggcaaagaacatcctcctccttg

SEQ ID NO: 196358 - DNA, 25 bp, Rattus norvegicus
atggcaaagaacttcctcctccttg

SEQ ID NO: 196359 - DNA, 25 bp, Rattus norvegicus
atggcaaagcatcgcacagatgatg

SEQ ID NO: 196360 - DNA, 25 bp, Rattus norvegicus
atggcaaagcatggcacagatgatg

SEQ ID NO: 196361 - DNA, 25 bp, Rattus norvegicus
atggcaaagcttaagaggtcctcac

SEQ ID NO: 196362 - DNA, 25 bp, Rattus norvegicus
atggcaaagctttagaggtcctcac

SEQ ID NO: 196363 - DNA, 25 bp, Rattus norvegicus
atggcaaatggtcctactctacccc

SEQ ID NO: 196364 - DNA, 25 bp, Rattus norvegicus
atggcaaatggtgctactctacccc

SEQ ID NO: 196365 - DNA, 25 bp, Rattus norvegicus
atggcaacatcacccgcttcattaa

SEQ ID NO: 196366 - DNA, 25 bp, Rattus norvegicus
atggcaacatcagccgcttcattaa

SEQ ID NO: 196367 - DNA, 25 bp, Rattus norvegicus
atggcaaccaacacggctggcttga

SEQ ID NO: 196368 - DNA, 25 bp, Rattus norvegicus
atggcaaccaactcggctggcttga

SEQ ID NO: 196369 - DNA, 25 bp, Rattus norvegicus
atggcaaccgagctgctggtgctaa

SEQ ID NO: 196370 - DNA, 25 bp, Rattus norvegicus
atggcaaccgaggtgctggtgctaa

SEQ ID NO: 196371 - DNA, 25 bp, Rattus norvegicus
atggcaaccgttactggctacacac

SEQ ID NO: 196372 - DNA, 25 bp, Rattus norvegicus
atggcaaccgtttctggctacacac

SEQ ID NO: 196373 - DNA, 25 bp, Rattus norvegicus
atggcaacctcaacttcttgatgtg

SEQ ID NO: 196374 - DNA, 25 bp, Rattus norvegicus
atggcaacctcatcttcttgatgtg

SEQ ID NO: 196375 - DNA, 25 bp, Rattus norvegicus
atggcaacctccctcggctgaaact

SEQ ID NO: 196376 - DNA, 25 bp, Rattus norvegicus
atggcaacctccgtcggctgaaact

SEQ ID NO: 196377 - DNA, 25 bp, Rattus norvegicus
atggcaacctctccagacaacgtat

SEQ ID NO: 196378 - DNA, 25 bp, Rattus norvegicus
atggcaacctctgcagacaacgtat

SEQ ID NO: 196379 - DNA, 25 bp, Rattus norvegicus
atggcaaccttgagacacagatttc

SEQ ID NO: 196380 - DNA, 25 bp, Rattus norvegicus
atggcaaccttgtgacacagatttc

SEQ ID NO: 196381 - DNA, 25 bp, Rattus norvegicus
atggcaacgaaacctcgccggctga

SEQ ID NO: 196382 - DNA, 25 bp, Rattus norvegicus
atggcaacgaaagctcgccggctga

SEQ ID NO: 196383 - DNA, 25 bp, Rattus norvegicus
atggcaacgataccccttggtgtgc

SEQ ID NO: 196384 - DNA, 25 bp, Rattus norvegicus
atggcaacgatagcccttggtgtgc

SEQ ID NO: 196385 - DNA, 25 bp, Rattus norvegicus
atggcaacggctcctgcgtttggca

SEQ ID NO: 196386 - DNA, 25 bp, Rattus norvegicus
atggcaacggctgctgcgtttggca

SEQ ID NO: 196387 - DNA, 25 bp, Rattus norvegicus
atggcaacggtgcttactgccggct

SEQ ID NO: 196388 - DNA, 25 bp, Rattus norvegicus
atggcaacggtggttactgccggct

SEQ ID NO: 196389 - DNA, 25 bp, Rattus norvegicus
atggcaactcacaacttcctataac

SEQ ID NO: 196390 - DNA, 25 bp, Rattus norvegicus
atggcaactcactacttcctataac

SEQ ID NO: 196391 - DNA, 25 bp, Rattus norvegicus
atggcaactctcacagcattcaaac

SEQ ID NO: 196392 - DNA, 25 bp, Rattus norvegicus
atggcaactctctcagcattcaaac

SEQ ID NO: 196393 - DNA, 25 bp, Rattus norvegicus
atggcaactggaacaccggctggga

SEQ ID NO: 196394 - DNA, 25 bp, Rattus norvegicus
atggcaactggatcaccggctggga

SEQ ID NO: 196395 - DNA, 25 bp, Rattus norvegicus
atggcaacttgaacaggtaggaacc

SEQ ID NO: 196396 - DNA, 25 bp, Rattus norvegicus
atggcaacttgatcaggtaggaacc

SEQ ID NO: 196397 - DNA, 25 bp, Rattus norvegicus
atggcaagatgcacattaccctctg

SEQ ID NO: 196398 - DNA, 25 bp, Rattus norvegicus
atggcaagatgctcattaccctctg

SEQ ID NO: 196399 - DNA, 25 bp, Rattus norvegicus
atggcaagccagactcttgtgggaa

SEQ ID NO: 196400 - DNA, 25 bp, Rattus norvegicus
atggcaagccagtctcttgtgggaa

SEQ ID NO: 196401 - DNA, 25 bp, Rattus norvegicus
atggcaagccctatggagacatcac

SEQ ID NO: 196402 - DNA, 25 bp, Rattus norvegicus
atggcaagccctttggagacatcac

SEQ ID NO: 196403 - DNA, 25 bp, Rattus norvegicus
atggcaagcctaagttcatctggta

SEQ ID NO: 196404 - DNA, 25 bp, Rattus norvegicus
atggcaagcctatgttcatctggta

SEQ ID NO: 196405 - DNA, 25 bp, Rattus norvegicus
atggcaagctccaggtgtacccaag

SEQ ID NO: 196406 - DNA, 25 bp, Rattus norvegicus
atggcaagctcctggtgtacccaag

SEQ ID NO: 196407 - DNA, 25 bp, Rattus norvegicus
atggcaagctgcaactcttcgagta

SEQ ID NO: 196408 - DNA, 25 bp, Rattus norvegicus
atggcaagctgctactcttcgagta

SEQ ID NO: 196409 - DNA, 25 bp, Rattus norvegicus
atggcaaggtatcttttagtattca

SEQ ID NO: 196410 - DNA, 25 bp, Rattus norvegicus
atggcaaggtatgttttagtattca

SEQ ID NO: 196411 - DNA, 25 bp, Rattus norvegicus
atggcaagtctcactccagtcaaaa

SEQ ID NO: 196412 - DNA, 25 bp, Rattus norvegicus
atggcaagtctctctccagtcaaaa

SEQ ID NO: 196413 - DNA, 25 bp, Rattus norvegicus
atggcaataaatcgctcgtgggctc

SEQ ID NO: 196414 - DNA, 25 bp, Rattus norvegicus
atggcaataaatggctcgtgggctc

SEQ ID NO: 196415 - DNA, 25 bp, Rattus norvegicus
atggcaatacctacatgacaccgta

SEQ ID NO: 196416 - DNA, 25 bp, Rattus norvegicus
atggcaataccttcatgacaccgta

SEQ ID NO: 196417 - DNA, 25 bp, Rattus norvegicus
atggcaatcatcagtcagttgactc

SEQ ID NO: 196418 - DNA, 25 bp, Rattus norvegicus
atggcaatcatctgtcagttgactc

SEQ ID NO: 196419 - DNA, 25 bp, Rattus norvegicus
atggcaatccttctttctgtcattc

SEQ ID NO: 196420 - DNA, 25 bp, Rattus norvegicus
atggcaatccttgtttctgtcattc

SEQ ID NO: 196421 - DNA, 25 bp, Rattus norvegicus
atggcaatctaactctattacacaa

SEQ ID NO: 196422 - DNA, 25 bp, Rattus norvegicus
atggcaatctaagtctattacacaa

SEQ ID NO: 196423 - DNA, 25 bp, Rattus norvegicus
atggcaatctacacacttctgggat

SEQ ID NO: 196424 - DNA, 25 bp, Rattus norvegicus
atggcaatctactcacttctgggat

SEQ ID NO: 196425 - DNA, 25 bp, Rattus norvegicus
atggcaatgccgaagtgactccatt

SEQ ID NO: 196426 - DNA, 25 bp, Rattus norvegicus
atggcaatgccgtagtgactccatt

SEQ ID NO: 196427 - DNA, 25 bp, Rattus norvegicus
atggcaatggctatattagtgcagt

SEQ ID NO: 196428 - DNA, 25 bp, Rattus norvegicus
atggcaatggctttattagtgcagt

SEQ ID NO: 196429 - DNA, 25 bp, Rattus norvegicus
atggcacaacccagcatttgcagag

SEQ ID NO: 196430 - DNA, 25 bp, Rattus norvegicus
atggcacaaccctgcatttgcagag

SEQ ID NO: 196431 - DNA, 25 bp, Rattus norvegicus
atggcacaatgacctacctaacgaa

SEQ ID NO: 196432 - DNA, 25 bp, Rattus norvegicus
atggcacaatgagctacctaacgaa

SEQ ID NO: 196433 - DNA, 25 bp, Rattus norvegicus
atggcacaatgcatacagagataca

SEQ ID NO: 196434 - DNA, 25 bp, Rattus norvegicus
atggcacaatgcttacagagataca

SEQ ID NO: 196435 - DNA, 25 bp, Rattus norvegicus
atggcacacaacagcttctcaagtg

SEQ ID NO: 196436 - DNA, 25 bp, Rattus norvegicus
atggcacacaactgcttctcaagtg

SEQ ID NO: 196437 - DNA, 25 bp, Rattus norvegicus
atggcacacatgcagctgtaggatc

SEQ ID NO: 196438 - DNA, 25 bp, Rattus norvegicus
atggcacacatgcagggatcaatac

SEQ ID NO: 196439 - DNA, 25 bp, Rattus norvegicus
atggcacacatggagctgtaggatc

SEQ ID NO: 196440 - DNA, 25 bp, Rattus norvegicus
atggcacacatggagggatcaatac

SEQ ID NO: 196441 - DNA, 25 bp, Rattus norvegicus
atggcacacccaaagacatgacttc

SEQ ID NO: 196442 - DNA, 25 bp, Rattus norvegicus
atggcacacccatagacatgacttc

SEQ ID NO: 196443 - DNA, 25 bp, Rattus norvegicus
atggcacagactacatgacccacag

SEQ ID NO: 196444 - DNA, 25 bp, Rattus norvegicus
atggcacagacttcatgacccacag

SEQ ID NO: 196445 - DNA, 25 bp, Rattus norvegicus
atggcacagccaaggcaggcatcca

SEQ ID NO: 196446 - DNA, 25 bp, Rattus norvegicus
atggcacagccatggcaggcatcca

SEQ ID NO: 196447 - DNA, 25 bp, Rattus norvegicus
atggcacagcggatagggcacttgt

SEQ ID NO: 196448 - DNA, 25 bp, Rattus norvegicus
atggcacagcggttagggcacttgt

SEQ ID NO: 196449 - DNA, 25 bp, Rattus norvegicus
atggcacagtgactctagagcccac

SEQ ID NO: 196450 - DNA, 25 bp, Rattus norvegicus
atggcacagtgagtctagagcccac

SEQ ID NO: 196451 - DNA, 25 bp, Rattus norvegicus
atggcacataggcttctattaccta

SEQ ID NO: 196452 - DNA, 25 bp, Rattus norvegicus
atggcacatagggttctattaccta

SEQ ID NO: 196453 - DNA, 25 bp, Rattus norvegicus
atggcaccagtacgccgctggcaga

SEQ ID NO: 196454 - DNA, 25 bp, Rattus norvegicus
atggcaccagtaggccgctggcaga

SEQ ID NO: 196455 - DNA, 25 bp, Rattus norvegicus
atggcaccattcattttggagtcca

SEQ ID NO: 196456 - DNA, 25 bp, Rattus norvegicus
atggcaccattctttttggagtcca

SEQ ID NO: 196457 - DNA, 25 bp, Rattus norvegicus
atggcacccaaaacctcatatctag

SEQ ID NO: 196458 - DNA, 25 bp, Rattus norvegicus
atggcacccaaatcctcatatctag

SEQ ID NO: 196459 - DNA, 25 bp, Rattus norvegicus
atggcacccagaatgcagttcagct

SEQ ID NO: 196460 - DNA, 25 bp, Rattus norvegicus
atggcacccagattgcagttcagct

SEQ ID NO: 196461 - DNA, 25 bp, Rattus norvegicus
atggcacccgctagtcaacagatag

SEQ ID NO: 196462 - DNA, 25 bp, Rattus norvegicus
atggcacccgcttgtcaacagatag

SEQ ID NO: 196463 - DNA, 25 bp, Rattus norvegicus
atggcaccctcaagcttcttagaga

SEQ ID NO: 196464 - DNA, 25 bp, Rattus norvegicus
atggcaccctcatgcttcttagaga

SEQ ID NO: 196465 - DNA, 25 bp, Rattus norvegicus
atggcaccctgtagcacggaacgac

SEQ ID NO: 196466 - DNA, 25 bp, Rattus norvegicus
atggcaccctgttgcacggaacgac

SEQ ID NO: 196467 - DNA, 25 bp, Rattus norvegicus
atggcaccgaccaccaagtgtacgt

SEQ ID NO: 196468 - DNA, 25 bp, Rattus norvegicus
atggcaccgacctccaagtgtacgt

SEQ ID NO: 196469 - DNA, 25 bp, Rattus norvegicus
atggcacctactacaacaacttctg

SEQ ID NO: 196470 - DNA, 25 bp, Rattus norvegicus
atggcacctacttcaacaacttctg

SEQ ID NO: 196471 - DNA, 25 bp, Rattus norvegicus
atggcacctgatccacctggaggag

SEQ ID NO: 196472 - DNA, 25 bp, Rattus norvegicus
atggcacctgatgcacctggaggag

SEQ ID NO: 196473 - DNA, 25 bp, Rattus norvegicus
atggcacctgcaacaccaacagaag

SEQ ID NO: 196474 - DNA, 25 bp, Rattus norvegicus
atggcacctgcatcaccaacagaag

SEQ ID NO: 196475 - DNA, 25 bp, Rattus norvegicus
atggcacctgcgctcgaagtcaaag

SEQ ID NO: 196476 - DNA, 25 bp, Rattus norvegicus
atggcacctgcggtcgaagtcaaag

SEQ ID NO: 196477 - DNA, 25 bp, Rattus norvegicus
atggcacctgctcagattgcttcta

SEQ ID NO: 196478 - DNA, 25 bp, Rattus norvegicus
atggcacctgctcggcataagcatg

SEQ ID NO: 196479 - DNA, 25 bp, Rattus norvegicus
atggcacctgctgagattgcttcta

SEQ ID NO: 196480 - DNA, 25 bp, Rattus norvegicus
atggcacctgctgggcataagcatg

SEQ ID NO: 196481 - DNA, 25 bp, Rattus norvegicus
atggcaccttaaacaaagtttctgg

SEQ ID NO: 196482 - DNA, 25 bp, Rattus norvegicus
atggcaccttaatcaaagtttctgg

SEQ ID NO: 196483 - DNA, 25 bp, Rattus norvegicus
atggcaccttgcagggagcactgaa

SEQ ID NO: 196484 - DNA, 25 bp, Rattus norvegicus
atggcaccttgctgggagcactgaa

SEQ ID NO: 196485 - DNA, 25 bp, Rattus norvegicus
atggcacgaacaaccctttcaagcg

SEQ ID NO: 196486 - DNA, 25 bp, Rattus norvegicus
atggcacgaacatccctttcaagcg

SEQ ID NO: 196487 - DNA, 25 bp, Rattus norvegicus
atggcacgactgacccaagtttgaa

SEQ ID NO: 196488 - DNA, 25 bp, Rattus norvegicus
atggcacgactgtcccaagtttgaa

SEQ ID NO: 196489 - DNA, 25 bp, Rattus norvegicus
atggcactatctcccagagcgaaag

SEQ ID NO: 196490 - DNA, 25 bp, Rattus norvegicus
atggcactatctgccagagcgaaag

SEQ ID NO: 196491 - DNA, 25 bp, Rattus norvegicus
atggcactccgtccctaacatcttt

SEQ ID NO: 196492 - DNA, 25 bp, Rattus norvegicus
atggcactccgtgcctaacatcttt

SEQ ID NO: 196493 - DNA, 25 bp, Rattus norvegicus
atggcactctggctcacgctttggt

SEQ ID NO: 196494 - DNA, 25 bp, Rattus norvegicus
atggcactctgggtcacgctttggt

SEQ ID NO: 196495 - DNA, 25 bp, Rattus norvegicus
atggcactgaccctttggtcggaac

SEQ ID NO: 196496 - DNA, 25 bp, Rattus norvegicus
atggcactgaccgtttggtcggaac

SEQ ID NO: 196497 - DNA, 25 bp, Rattus norvegicus
atggcactgagcatgcaccggtgtg

SEQ ID NO: 196498 - DNA, 25 bp, Rattus norvegicus
atggcactgagcttgcaccggtgtg

SEQ ID NO: 196499 - DNA, 25 bp, Rattus norvegicus
atggcactgatcatcattccacaat

SEQ ID NO: 196500 - DNA, 25 bp, Rattus norvegicus
atggcactgatcttcattccacaat

SEQ ID NO: 196501 - DNA, 25 bp, Rattus norvegicus
atggcactgcagacagaaccgtgta

SEQ ID NO: 196502 - DNA, 25 bp, Rattus norvegicus
atggcactgcagtcagaaccgtgta

SEQ ID NO: 196503 - DNA, 25 bp, Rattus norvegicus
atggcactgcatcgtaactctgact

SEQ ID NO: 196504 - DNA, 25 bp, Rattus norvegicus
atggcactgcatggtaactctgact

SEQ ID NO: 196505 - DNA, 25 bp, Rattus norvegicus
atggcactgccaactacatgtatct

SEQ ID NO: 196506 - DNA, 25 bp, Rattus norvegicus
atggcactgccatctacatgtatct

SEQ ID NO: 196507 - DNA, 25 bp, Rattus norvegicus
atggcactgctcaggctttgggtac

SEQ ID NO: 196508 - DNA, 25 bp, Rattus norvegicus
atggcactgctctggctttgggtac

SEQ ID NO: 196509 - DNA, 25 bp, Rattus norvegicus
atggcactgtggaactcctcttgag

SEQ ID NO: 196510 - DNA, 25 bp, Rattus norvegicus
atggcactgtggtactcctcttgag

SEQ ID NO: 196511 - DNA, 25 bp, Rattus norvegicus
atggcacttcagacagtggaccctt

SEQ ID NO: 196512 - DNA, 25 bp, Rattus norvegicus
atggcacttcagtcagtggaccctt

SEQ ID NO: 196513 - DNA, 25 bp, Rattus norvegicus
atggcacttggcctaaggctgcttc

SEQ ID NO: 196514 - DNA, 25 bp, Rattus norvegicus
atggcacttggcgtaaggctgcttc

SEQ ID NO: 196515 - DNA, 25 bp, Rattus norvegicus
atggcacttgtgatagtcttgtagt

SEQ ID NO: 196516 - DNA, 25 bp, Rattus norvegicus
atggcacttgtgttagtcttgtagt

SEQ ID NO: 196517 - DNA, 25 bp, Rattus norvegicus
atggcagaaaggagctccaagggaa

SEQ ID NO: 196518 - DNA, 25 bp, Rattus norvegicus
atggcagaaaggtgctccaagggaa

SEQ ID NO: 196519 - DNA, 25 bp, Rattus norvegicus
atggcagaaccccagaacttcgaat

SEQ ID NO: 196520 - DNA, 25 bp, Rattus norvegicus
atggcagaacccgagaacttcgaat

SEQ ID NO: 196521 - DNA, 25 bp, Rattus norvegicus
atggcagaacgcatcttaatgacaa

SEQ ID NO: 196522 - DNA, 25 bp, Rattus norvegicus
atggcagaacgcttcttaatgacaa

SEQ ID NO: 196523 - DNA, 25 bp, Rattus norvegicus
atggcagaatgaacgtgggaaccct

SEQ ID NO: 196524 - DNA, 25 bp, Rattus norvegicus
atggcagaatgatcgtgggaaccct

SEQ ID NO: 196525 - DNA, 25 bp, Rattus norvegicus
atggcagacccacagcaggagtgct

SEQ ID NO: 196526 - DNA, 25 bp, Rattus norvegicus
atggcagacccagagcaggagtgct

SEQ ID NO: 196527 - DNA, 25 bp, Rattus norvegicus
atggcagagacgacctgagacaccc

SEQ ID NO: 196528 - DNA, 25 bp, Rattus norvegicus
atggcagagacgtcctgagacaccc

SEQ ID NO: 196529 - DNA, 25 bp, Rattus norvegicus
atggcagagcaaaatcagtcctaat

SEQ ID NO: 196530 - DNA, 25 bp, Rattus norvegicus
atggcagagcaatatcagtcctaat

SEQ ID NO: 196531 - DNA, 25 bp, Rattus norvegicus
atggcagagcagatcttcctctctt

SEQ ID NO: 196532 - DNA, 25 bp, Rattus norvegicus
atggcagagcagttcttcctctctt

SEQ ID NO: 196533 - DNA, 25 bp, Rattus norvegicus
atggcagagcggagcaggccacact

SEQ ID NO: 196534 - DNA, 25 bp, Rattus norvegicus
atggcagagcggtgcaggccacact

SEQ ID NO: 196535 - DNA, 25 bp, Rattus norvegicus
atggcagagctgacgctatgcacac

SEQ ID NO: 196536 - DNA, 25 bp, Rattus norvegicus
atggcagagctgtcgctatgcacac

SEQ ID NO: 196537 - DNA, 25 bp, Rattus norvegicus
atggcagaggccaccgtgatgtccc

SEQ ID NO: 196538 - DNA, 25 bp, Rattus norvegicus
atggcagaggcctccgtgatgtccc

SEQ ID NO: 196539 - DNA, 25 bp, Rattus norvegicus
atggcagaggctatcctggatttgc

SEQ ID NO: 196540 - DNA, 25 bp, Rattus norvegicus
atggcagaggctttcctggatttgc

SEQ ID NO: 196541 - DNA, 25 bp, Rattus norvegicus
atggcagagtccagagttgtcttga

SEQ ID NO: 196542 - DNA, 25 bp, Rattus norvegicus
atggcagagtcctgagttgtcttga

SEQ ID NO: 196543 - DNA, 25 bp, Rattus norvegicus
atggcagatagcaaccaccaccaca

SEQ ID NO: 196544 - DNA, 25 bp, Rattus norvegicus
atggcagatagctaccaccaccaca

SEQ ID NO: 196545 - DNA, 25 bp, Rattus norvegicus
atggcagatctgacgacatcaagag

SEQ ID NO: 196546 - DNA, 25 bp, Rattus norvegicus
atggcagatctgtcgacatcaagag

SEQ ID NO: 196547 - DNA, 25 bp, Rattus norvegicus
atggcagattggactcgagctcaga

SEQ ID NO: 196548 - DNA, 25 bp, Rattus norvegicus
atggcagattggtctcgagctcaga

SEQ ID NO: 196549 - DNA, 25 bp, Rattus norvegicus
atggcagcaaccagacctggacatc

SEQ ID NO: 196550 - DNA, 25 bp, Rattus norvegicus
atggcagcaacctgacctggacatc

SEQ ID NO: 196551 - DNA, 25 bp, Rattus norvegicus
atggcagcaagcaaccacgttcaac

SEQ ID NO: 196552 - DNA, 25 bp, Rattus norvegicus
atggcagcaagctaccacgttcaac

SEQ ID NO: 196553 - DNA, 25 bp, Rattus norvegicus
atggcagcagcccttgaagatttga

SEQ ID NO: 196554 - DNA, 25 bp, Rattus norvegicus
atggcagcagccgttgaagatttga

SEQ ID NO: 196555 - DNA, 25 bp, Rattus norvegicus
atggcagcagctcacttaggcagga

SEQ ID NO: 196556 - DNA, 25 bp, Rattus norvegicus
atggcagcagctgacttaggcagga

SEQ ID NO: 196557 - DNA, 25 bp, Rattus norvegicus
atggcagcatagacactcagagatt

SEQ ID NO: 196558 - DNA, 25 bp, Rattus norvegicus
atggcagcatagtcactcagagatt

SEQ ID NO: 196559 - DNA, 25 bp, Rattus norvegicus
atggcagcatccagacatggtactg

SEQ ID NO: 196560 - DNA, 25 bp, Rattus norvegicus
atggcagcatcctgacatggtactg

SEQ ID NO: 196561 - DNA, 25 bp, Rattus norvegicus
atggcagcatcgattcatgtcaaaa

SEQ ID NO: 196562 - DNA, 25 bp, Rattus norvegicus
atggcagcatcgtttcatgtcaaaa

SEQ ID NO: 196563 - DNA, 25 bp, Rattus norvegicus
atggcagcatggctccaggatgacc

SEQ ID NO: 196564 - DNA, 25 bp, Rattus norvegicus
atggcagcatgggtccaggatgacc

SEQ ID NO: 196565 - DNA, 25 bp, Rattus norvegicus
atggcagcattactgtagagtgtgc

SEQ ID NO: 196566 - DNA, 25 bp, Rattus norvegicus
atggcagcattagtgtagagtgtgc

SEQ ID NO: 196567 - DNA, 25 bp, Rattus norvegicus
atggcagcattcaggctggttcctg

SEQ ID NO: 196568 - DNA, 25 bp, Rattus norvegicus
atggcagcattctggctggttcctg

SEQ ID NO: 196569 - DNA, 25 bp, Rattus norvegicus
atggcagccaaaacgagcctctttg

SEQ ID NO: 196570 - DNA, 25 bp, Rattus norvegicus
atggcagccaaatcgagcctctttg

SEQ ID NO: 196571 - DNA, 25 bp, Rattus norvegicus
atggcagccaacctatatgctcgct

SEQ ID NO: 196572 - DNA, 25 bp, Rattus norvegicus
atggcagccaacgtatatgctcgct

SEQ ID NO: 196573 - DNA, 25 bp, Rattus norvegicus
atggcagccactcttgtccttttag

SEQ ID NO: 196574 - DNA, 25 bp, Rattus norvegicus
atggcagccactgttgtccttttag

SEQ ID NO: 196575 - DNA, 25 bp, Rattus norvegicus
atggcagccaggatcatttgcagtc

SEQ ID NO: 196576 - DNA, 25 bp, Rattus norvegicus
atggcagccaggttcatttgcagtc

SEQ ID NO: 196577 - DNA, 25 bp, Rattus norvegicus
atggcagccatgagactagtgtccg

SEQ ID NO: 196578 - DNA, 25 bp, Rattus norvegicus
atggcagccatgtgactagtgtccg

SEQ ID NO: 196579 - DNA, 25 bp, Rattus norvegicus
atggcagcccatacatctgtgacag

SEQ ID NO: 196580 - DNA, 25 bp, Rattus norvegicus
atggcagcccattcatctgtgacag

SEQ ID NO: 196581 - DNA, 25 bp, Rattus norvegicus
atggcagcctctcctcctgcggtat

SEQ ID NO: 196582 - DNA, 25 bp, Rattus norvegicus
atggcagcctctgctcctgcggtat

SEQ ID NO: 196583 - DNA, 25 bp, Rattus norvegicus
atggcagccttcctccaaagatctt

SEQ ID NO: 196584 - DNA, 25 bp, Rattus norvegicus
atggcagccttcgtccaaagatctt

SEQ ID NO: 196585 - DNA, 25 bp, Rattus norvegicus
atggcagcggacatgtagctgtctc

SEQ ID NO: 196586 - DNA, 25 bp, Rattus norvegicus
atggcagcggacttgtagctgtctc

SEQ ID NO: 196587 - DNA, 25 bp, Rattus norvegicus
atggcagctaaccttaagattccat

SEQ ID NO: 196588 - DNA, 25 bp, Rattus norvegicus
atggcagctaacgttaagattccat

SEQ ID NO: 196589 - DNA, 25 bp, Rattus norvegicus
atggcagctactacagtgatgctca

SEQ ID NO: 196590 - DNA, 25 bp, Rattus norvegicus
atggcagctacttcagtgatgctca

SEQ ID NO: 196591 - DNA, 25 bp, Rattus norvegicus
atggcagctcacatatgtcggactc

SEQ ID NO: 196592 - DNA, 25 bp, Rattus norvegicus
atggcagctcacttatgtcggactc

SEQ ID NO: 196593 - DNA, 25 bp, Rattus norvegicus
atggcagctcagcacaagtggctcc

SEQ ID NO: 196594 - DNA, 25 bp, Rattus norvegicus
atggcagctcaggacaagtggctcc

SEQ ID NO: 196595 - DNA, 25 bp, Rattus norvegicus
atggcagctcccaaccatcgttaac

SEQ ID NO: 196596 - DNA, 25 bp, Rattus norvegicus
atggcagctccctaccatcgttaac

SEQ ID NO: 196597 - DNA, 25 bp, Rattus norvegicus
atggcagctgctcttgtgttggcat

SEQ ID NO: 196598 - DNA, 25 bp, Rattus norvegicus
atggcagctgctgttgtgttggcat

SEQ ID NO: 196599 - DNA, 25 bp, Rattus norvegicus
atggcagctggcagtcccttggtaa

SEQ ID NO: 196600 - DNA, 25 bp, Rattus norvegicus
atggcagctggctgtcccttggtaa

SEQ ID NO: 196601 - DNA, 25 bp, Rattus norvegicus
atggcagctggtaccatcagccctg

SEQ ID NO: 196602 - DNA, 25 bp, Rattus norvegicus
atggcagctggttccatcagccctg

SEQ ID NO: 196603 - DNA, 25 bp, Rattus norvegicus
atggcagcttctacatacgaattaa

SEQ ID NO: 196604 - DNA, 25 bp, Rattus norvegicus
atggcagcttcttcatacgaattaa

SEQ ID NO: 196605 - DNA, 25 bp, Rattus norvegicus
atggcaggaccacggtttcatcaca

SEQ ID NO: 196606 - DNA, 25 bp, Rattus norvegicus
atggcaggaccagggtttcatcaca

SEQ ID NO: 196607 - DNA, 25 bp, Rattus norvegicus
atggcaggaccgagtacagtaagac

SEQ ID NO: 196608 - DNA, 25 bp, Rattus norvegicus
atggcaggaccgtgtacagtaagac

SEQ ID NO: 196609 - DNA, 25 bp, Rattus norvegicus
atggcaggatacaagttcccacgag

SEQ ID NO: 196610 - DNA, 25 bp, Rattus norvegicus
atggcaggatactagttcccacgag

SEQ ID NO: 196611 - DNA, 25 bp, Rattus norvegicus
atggcaggcgcaaactcgattttct

SEQ ID NO: 196612 - DNA, 25 bp, Rattus norvegicus
atggcaggcgcatactcgattttct

SEQ ID NO: 196613 - DNA, 25 bp, Rattus norvegicus
atggcaggctcactttaatccctta

SEQ ID NO: 196614 - DNA, 25 bp, Rattus norvegicus
atggcaggctcagtttaatccctta

SEQ ID NO: 196615 - DNA, 25 bp, Rattus norvegicus
atggcaggctcccaggcgtcctatc

SEQ ID NO: 196616 - DNA, 25 bp, Rattus norvegicus
atggcaggctccgaggcgtcctatc

SEQ ID NO: 196617 - DNA, 25 bp, Rattus norvegicus
atggcaggcttgctctcctgagtca

SEQ ID NO: 196618 - DNA, 25 bp, Rattus norvegicus
atggcaggcttggtctcctgagtca

SEQ ID NO: 196619 - DNA, 25 bp, Rattus norvegicus
atggcaggctttagatctagtcctc

SEQ ID NO: 196620 - DNA, 25 bp, Rattus norvegicus
atggcaggcttttgatctagtcctc

SEQ ID NO: 196621 - DNA, 25 bp, Rattus norvegicus
atggcagggcccaggtagcaccagc

SEQ ID NO: 196622 - DNA, 25 bp, Rattus norvegicus
atggcagggccctggtagcaccagc

SEQ ID NO: 196623 - DNA, 25 bp, Rattus norvegicus
atggcagggctgagaaaatttaatt

SEQ ID NO: 196624 - DNA, 25 bp, Rattus norvegicus
atggcagggctgtgaaaatttaatt

SEQ ID NO: 196625 - DNA, 25 bp, Rattus norvegicus
atggcagggtctacatgctcatggc

SEQ ID NO: 196626 - DNA, 25 bp, Rattus norvegicus
atggcagggtcttcatgctcatggc

SEQ ID NO: 196627 - DNA, 25 bp, Rattus norvegicus
atggcaggtataagtcatctctccc

SEQ ID NO: 196628 - DNA, 25 bp, Rattus norvegicus
atggcaggtatatgtcatctctccc

SEQ ID NO: 196629 - DNA, 25 bp, Rattus norvegicus
atggcaggtgcacgtccttctcaac

SEQ ID NO: 196630 - DNA, 25 bp, Rattus norvegicus
atggcaggtgcaggtccttctcaac

SEQ ID NO: 196631 - DNA, 25 bp, Rattus norvegicus
atggcaggtgtgagtcactgcatct

SEQ ID NO: 196632 - DNA, 25 bp, Rattus norvegicus
atggcaggtgtgtgtcactgcatct

SEQ ID NO: 196633 - DNA, 25 bp, Rattus norvegicus
atggcagtaaccacaacagctccag

SEQ ID NO: 196634 - DNA, 25 bp, Rattus norvegicus
atggcagtaacctcaacagctccag

SEQ ID NO: 196635 - DNA, 25 bp, Rattus norvegicus
atggcagtatcacgccaggcgcaga

SEQ ID NO: 196636 - DNA, 25 bp, Rattus norvegicus
atggcagtatcaggccaggcgcaga

SEQ ID NO: 196637 - DNA, 25 bp, Rattus norvegicus
atggcagtattcacctgtcatctca

SEQ ID NO: 196638 - DNA, 25 bp, Rattus norvegicus
atggcagtattctcctgtcatctca

SEQ ID NO: 196639 - DNA, 25 bp, Rattus norvegicus
atggcagtcactatgtcgtttctag

SEQ ID NO: 196640 - DNA, 25 bp, Rattus norvegicus
atggcagtcactttgtcgtttctag

SEQ ID NO: 196641 - DNA, 25 bp, Rattus norvegicus
atggcagtcagcaatgagccctaaa

SEQ ID NO: 196642 - DNA, 25 bp, Rattus norvegicus
atggcagtcagctatgagccctaaa

SEQ ID NO: 196643 - DNA, 25 bp, Rattus norvegicus
atggcagtcagtagggctgctcaga

SEQ ID NO: 196644 - DNA, 25 bp, Rattus norvegicus
atggcagtcagttgggctgctcaga

SEQ ID NO: 196645 - DNA, 25 bp, Rattus norvegicus
atggcagtcatcaattactaggttt

SEQ ID NO: 196646 - DNA, 25 bp, Rattus norvegicus
atggcagtcatctattactaggttt

SEQ ID NO: 196647 - DNA, 25 bp, Rattus norvegicus
atggcagtccaaatttacagagaat

SEQ ID NO: 196648 - DNA, 25 bp, Rattus norvegicus
atggcagtccaattttacagagaat

SEQ ID NO: 196649 - DNA, 25 bp, Rattus norvegicus
atggcagtcctgcaccagtgtactg

SEQ ID NO: 196650 - DNA, 25 bp, Rattus norvegicus
atggcagtcctggaccagtgtactg

SEQ ID NO: 196651 - DNA, 25 bp, Rattus norvegicus
atggcagtcgtgcttttctacgtga

SEQ ID NO: 196652 - DNA, 25 bp, Rattus norvegicus
atggcagtcgtggttttctacgtga

SEQ ID NO: 196653 - DNA, 25 bp, Rattus norvegicus
atggcagtctctcacatcacagatg

SEQ ID NO: 196654 - DNA, 25 bp, Rattus norvegicus
atggcagtctctgacatcacagatg

SEQ ID NO: 196655 - DNA, 25 bp, Rattus norvegicus
atggcagtctgtcagattcaagttc

SEQ ID NO: 196656 - DNA, 25 bp, Rattus norvegicus
atggcagtctgtgagattcaagttc

SEQ ID NO: 196657 - DNA, 25 bp, Rattus norvegicus
atggcagtgccaagaatctcccaca

SEQ ID NO: 196658 - DNA, 25 bp, Rattus norvegicus
atggcagtgccatgaatctcccaca

SEQ ID NO: 196659 - DNA, 25 bp, Rattus norvegicus
atggcagtggacagccttgcccagg

SEQ ID NO: 196660 - DNA, 25 bp, Rattus norvegicus
atggcagtggactgccttgcccagg

SEQ ID NO: 196661 - DNA, 25 bp, Rattus norvegicus
atggcagtggctacgtataaatcta

SEQ ID NO: 196662 - DNA, 25 bp, Rattus norvegicus
atggcagtggcttcgtataaatcta

SEQ ID NO: 196663 - DNA, 25 bp, Rattus norvegicus
atggcagtgttgaagcagcctctcg

SEQ ID NO: 196664 - DNA, 25 bp, Rattus norvegicus
atggcagtgttgtagcagcctctcg

SEQ ID NO: 196665 - DNA, 25 bp, Rattus norvegicus
atggcagttggcatcttttcagcag

SEQ ID NO: 196666 - DNA, 25 bp, Rattus norvegicus
atggcagttggcttcttttcagcag

SEQ ID NO: 196667 - DNA, 25 bp, Rattus norvegicus
atggcagtttcccagaacattggca

SEQ ID NO: 196668 - DNA, 25 bp, Rattus norvegicus
atggcagtttccgagaacattggca

SEQ ID NO: 196669 - DNA, 25 bp, Rattus norvegicus
atggcatacagcatgtgcgagcgat

SEQ ID NO: 196670 - DNA, 25 bp, Rattus norvegicus
atggcatacagcttgtgcgagcgat

SEQ ID NO: 196671 - DNA, 25 bp, Rattus norvegicus
atggcatacatgcacggatcaataa

SEQ ID NO: 196672 - DNA, 25 bp, Rattus norvegicus
atggcatacatggacggatcaataa

SEQ ID NO: 196673 - DNA, 25 bp, Rattus norvegicus
atggcataggagacacacgtctgtt

SEQ ID NO: 196674 - DNA, 25 bp, Rattus norvegicus
atggcataggagtcacacgtctgtt

SEQ ID NO: 196675 - DNA, 25 bp, Rattus norvegicus
atggcataggccatgacaggcacct

SEQ ID NO: 196676 - DNA, 25 bp, Rattus norvegicus
atggcataggccttgacaggcacct

SEQ ID NO: 196677 - DNA, 25 bp, Rattus norvegicus
atggcatcaagaaaccccggtcaca

SEQ ID NO: 196678 - DNA, 25 bp, Rattus norvegicus
atggcatcaagataccccggtcaca

SEQ ID NO: 196679 - DNA, 25 bp, Rattus norvegicus
atggcatcaagtcgctggcattgtc

SEQ ID NO: 196680 - DNA, 25 bp, Rattus norvegicus
atggcatcaagtggctggcattgtc

SEQ ID NO: 196681 - DNA, 25 bp, Rattus norvegicus
atggcatcatcccaatggacctgga

SEQ ID NO: 196682 - DNA, 25 bp, Rattus norvegicus
atggcatcatccgaatggacctgga

SEQ ID NO: 196683 - DNA, 25 bp, Rattus norvegicus
atggcatcatcgacttcacatctgg

SEQ ID NO: 196684 - DNA, 25 bp, Rattus norvegicus
atggcatcatcgtcttcacatctgg

SEQ ID NO: 196685 - DNA, 25 bp, Rattus norvegicus
atggcatccagcaagcacacattaa

SEQ ID NO: 196686 - DNA, 25 bp, Rattus norvegicus
atggcatccagctagcacacattaa

SEQ ID NO: 196687 - DNA, 25 bp, Rattus norvegicus
atggcatcccatccgactgagggag

SEQ ID NO: 196688 - DNA, 25 bp, Rattus norvegicus
atggcatcccatgcgactgagggag

SEQ ID NO: 196689 - DNA, 25 bp, Rattus norvegicus
atggcatccccgacagcgatgaaca

SEQ ID NO: 196690 - DNA, 25 bp, Rattus norvegicus
atggcatccccgtcagcgatgaaca

SEQ ID NO: 196691 - DNA, 25 bp, Rattus norvegicus
atggcatcgtctactcaggaggttc

SEQ ID NO: 196692 - DNA, 25 bp, Rattus norvegicus
atggcatcgtcttctcaggaggttc

SEQ ID NO: 196693 - DNA, 25 bp, Rattus norvegicus
atggcatctataagcacgtgcacat

SEQ ID NO: 196694 - DNA, 25 bp, Rattus norvegicus
atggcatctatatgcacgtgcacat

SEQ ID NO: 196695 - DNA, 25 bp, Rattus norvegicus
atggcatctatgaggcagtcatctg

SEQ ID NO: 196696 - DNA, 25 bp, Rattus norvegicus
atggcatctatgtggcagtcatctg

SEQ ID NO: 196697 - DNA, 25 bp, Rattus norvegicus
atggcatctgcacagaaacattcct

SEQ ID NO: 196698 - DNA, 25 bp, Rattus norvegicus
atggcatctgcagagaaacattcct

SEQ ID NO: 196699 - DNA, 25 bp, Rattus norvegicus
atggcatctgtcactttgagttcct

SEQ ID NO: 196700 - DNA, 25 bp, Rattus norvegicus
atggcatctgtctctttgagttcct

SEQ ID NO: 196701 - DNA, 25 bp, Rattus norvegicus
atggcatcttgcactgttccttgat

SEQ ID NO: 196702 - DNA, 25 bp, Rattus norvegicus
atggcatcttgctctgttccttgat

SEQ ID NO: 196703 - DNA, 25 bp, Rattus norvegicus
atggcatgaccaacttctcaaggaa

SEQ ID NO: 196704 - DNA, 25 bp, Rattus norvegicus
atggcatgaccatcttctcaaggaa

SEQ ID NO: 196705 - DNA, 25 bp, Rattus norvegicus
atggcatgcatacctgggatctgtg

SEQ ID NO: 196706 - DNA, 25 bp, Rattus norvegicus
atggcatgcatagctgggatctgtg

SEQ ID NO: 196707 - DNA, 25 bp, Rattus norvegicus
atggcatgctgcagccctgtggcat

SEQ ID NO: 196708 - DNA, 25 bp, Rattus norvegicus
atggcatgctgctgccctgtggcat

SEQ ID NO: 196709 - DNA, 25 bp, Rattus norvegicus
atggcatggatcatacccgggacaa

SEQ ID NO: 196710 - DNA, 25 bp, Rattus norvegicus
atggcatggatcttacccgggacaa

SEQ ID NO: 196711 - DNA, 25 bp, Rattus norvegicus
atggcatggcagctactactggaac

SEQ ID NO: 196712 - DNA, 25 bp, Rattus norvegicus
atggcatggcaggtactactggaac

SEQ ID NO: 196713 - DNA, 25 bp, Rattus norvegicus
atggcatgggaaatccgtgtggctc

SEQ ID NO: 196714 - DNA, 25 bp, Rattus norvegicus
atggcatgggaattccgtgtggctc

SEQ ID NO: 196715 - DNA, 25 bp, Rattus norvegicus
atggcatggtgcacgtctactgaaa

SEQ ID NO: 196716 - DNA, 25 bp, Rattus norvegicus
atggcatggtgctcgtctactgaaa

SEQ ID NO: 196717 - DNA, 25 bp, Rattus norvegicus
atggcattaaccagtataatcccag

SEQ ID NO: 196718 - DNA, 25 bp, Rattus norvegicus
atggcattaacctgtataatcccag

SEQ ID NO: 196719 - DNA, 25 bp, Rattus norvegicus
atggcattccaactgagctgtgctc

SEQ ID NO: 196720 - DNA, 25 bp, Rattus norvegicus
atggcattccaagtgagctgtgctc

SEQ ID NO: 196721 - DNA, 25 bp, Rattus norvegicus
atggcattctcaactcatgaccaag

SEQ ID NO: 196722 - DNA, 25 bp, Rattus norvegicus
atggcattctcatctcatgaccaag

SEQ ID NO: 196723 - DNA, 25 bp, Rattus norvegicus
atggcattcttcagtgtcagtgggc

SEQ ID NO: 196724 - DNA, 25 bp, Rattus norvegicus
atggcattcttctgtgtcagtgggc

SEQ ID NO: 196725 - DNA, 25 bp, Rattus norvegicus
atggcattgaggcactgtggtcctt

SEQ ID NO: 196726 - DNA, 25 bp, Rattus norvegicus
atggcattgagggactgtggtcctt

SEQ ID NO: 196727 - DNA, 25 bp, Rattus norvegicus
atggcattgcacatcggtagcttga

SEQ ID NO: 196728 - DNA, 25 bp, Rattus norvegicus
atggcattgcaccagggagcctcct

SEQ ID NO: 196729 - DNA, 25 bp, Rattus norvegicus
atggcattgcacgagggagcctcct

SEQ ID NO: 196730 - DNA, 25 bp, Rattus norvegicus
atggcattgcacttcggtagcttga

SEQ ID NO: 196731 - DNA, 25 bp, Rattus norvegicus
atggcattgtcacaaaagtcagatc

SEQ ID NO: 196732 - DNA, 25 bp, Rattus norvegicus
atggcattgtcagaaaagtcagatc

SEQ ID NO: 196733 - DNA, 25 bp, Rattus norvegicus
atggcatttgccaacaagcctggtg

SEQ ID NO: 196734 - DNA, 25 bp, Rattus norvegicus
atggcatttgcctacaagcctggtg

SEQ ID NO: 196735 - DNA, 25 bp, Rattus norvegicus
atggcatttgctactgagccacctt

SEQ ID NO: 196736 - DNA, 25 bp, Rattus norvegicus
atggcatttgcttctgagccacctt

SEQ ID NO: 196737 - DNA, 25 bp, Rattus norvegicus
atggcattttggctctatggattat

SEQ ID NO: 196738 - DNA, 25 bp, Rattus norvegicus
atggcattttgggtctatggattat

SEQ ID NO: 196739 - DNA, 25 bp, Rattus norvegicus
atggccaaagagagctccacactgc

SEQ ID NO: 196740 - DNA, 25 bp, Rattus norvegicus
atggccaaagagtgctccacactgc

SEQ ID NO: 196741 - DNA, 25 bp, Rattus norvegicus
atggccaaagctaacaggactctga

SEQ ID NO: 196742 - DNA, 25 bp, Rattus norvegicus
atggccaaagcttacaggactctga

SEQ ID NO: 196743 - DNA, 25 bp, Rattus norvegicus
atggccaaatgcagagcctctgtca

SEQ ID NO: 196744 - DNA, 25 bp, Rattus norvegicus
atggccaaatgctgagcctctgtca

SEQ ID NO: 196745 - DNA, 25 bp, Rattus norvegicus
atggccaaatggacgtcactttctc

SEQ ID NO: 196746 - DNA, 25 bp, Rattus norvegicus
atggccaaatggtcgtcactttctc

SEQ ID NO: 196747 - DNA, 25 bp, Rattus norvegicus
atggccaacctgacgagttgtgtta

SEQ ID NO: 196748 - DNA, 25 bp, Rattus norvegicus
atggccaacctgtcgagttgtgtta

SEQ ID NO: 196749 - DNA, 25 bp, Rattus norvegicus
atggccaacggcctgaataccagga

SEQ ID NO: 196750 - DNA, 25 bp, Rattus norvegicus
atggccaacggcgtgaataccagga

SEQ ID NO: 196751 - DNA, 25 bp, Rattus norvegicus
atggccaacgttaccagcacagaag

SEQ ID NO: 196752 - DNA, 25 bp, Rattus norvegicus
atggccaacgtttccagcacagaag

SEQ ID NO: 196753 - DNA, 25 bp, Rattus norvegicus
atggccaagaccagaagaacctgtt

SEQ ID NO: 196754 - DNA, 25 bp, Rattus norvegicus
atggccaagacctgaagaacctgtt

SEQ ID NO: 196755 - DNA, 25 bp, Rattus norvegicus
atggccaaggtgctgtttgctccta

SEQ ID NO: 196756 - DNA, 25 bp, Rattus norvegicus
atggccaaggtggtgtttgctccta

SEQ ID NO: 196757 - DNA, 25 bp, Rattus norvegicus
atggccaagtcacgaagctcagagc

SEQ ID NO: 196758 - DNA, 25 bp, Rattus norvegicus
atggccaagtcaggaagctcagagc

SEQ ID NO: 196759 - DNA, 25 bp, Rattus norvegicus
atggccaagttcatccgtaacctcg

SEQ ID NO: 196760 - DNA, 25 bp, Rattus norvegicus
atggccaagttcttccgtaacctcg

SEQ ID NO: 196761 - DNA, 25 bp, Rattus norvegicus
atggccaatctgaactttccttgaa

SEQ ID NO: 196762 - DNA, 25 bp, Rattus norvegicus
atggccaatctgtactttccttgaa

SEQ ID NO: 196763 - DNA, 25 bp, Rattus norvegicus
atggccacaaaaactctcatcactt

SEQ ID NO: 196764 - DNA, 25 bp, Rattus norvegicus
atggccacaaaatctctcatcactt

SEQ ID NO: 196765 - DNA, 25 bp, Rattus norvegicus
atggccacaaagctgtttgatggtt

SEQ ID NO: 196766 - DNA, 25 bp, Rattus norvegicus
atggccacaaaggtgtttgatggtt

SEQ ID NO: 196767 - DNA, 25 bp, Rattus norvegicus
atggccacaagcattcaagtcgcat

SEQ ID NO: 196768 - DNA, 25 bp, Rattus norvegicus
atggccacaagctttcaagtcgcat

SEQ ID NO: 196769 - DNA, 25 bp, Rattus norvegicus
atggccacaagtctgctagttgcac

SEQ ID NO: 196770 - DNA, 25 bp, Rattus norvegicus
atggccacaagtgtgctagttgcac

SEQ ID NO: 196771 - DNA, 25 bp, Rattus norvegicus
atggccacactgacctgaaggctaa

SEQ ID NO: 196772 - DNA, 25 bp, Rattus norvegicus
atggccacactgtcctgaaggctaa

SEQ ID NO: 196773 - DNA, 25 bp, Rattus norvegicus
atggccacagctaaagcccagagtg

SEQ ID NO: 196774 - DNA, 25 bp, Rattus norvegicus
atggccacagcttaagcccagagtg

SEQ ID NO: 196775 - DNA, 25 bp, Rattus norvegicus
atggccacaggtaactgaatatctt

SEQ ID NO: 196776 - DNA, 25 bp, Rattus norvegicus
atggccacaggtcagtcttacagag

SEQ ID NO: 196777 - DNA, 25 bp, Rattus norvegicus
atggccacaggtgagtcttacagag

SEQ ID NO: 196778 - DNA, 25 bp, Rattus norvegicus
atggccacaggttactgaatatctt

SEQ ID NO: 196779 - DNA, 25 bp, Rattus norvegicus
atggccacagtgctaaaacctgaag

SEQ ID NO: 196780 - DNA, 25 bp, Rattus norvegicus
atggccacagtggtaaaacctgaag

SEQ ID NO: 196781 - DNA, 25 bp, Rattus norvegicus
atggccacatcactgattcactttg

SEQ ID NO: 196782 - DNA, 25 bp, Rattus norvegicus
atggccacatcagtgattcactttg

SEQ ID NO: 196783 - DNA, 25 bp, Rattus norvegicus
atggccacatggactgctgagaacc

SEQ ID NO: 196784 - DNA, 25 bp, Rattus norvegicus
atggccacatggtctgctgagaacc

SEQ ID NO: 196785 - DNA, 25 bp, Rattus norvegicus
atggccacattgctgactggagtct

SEQ ID NO: 196786 - DNA, 25 bp, Rattus norvegicus
atggccacattggtgactggagtct

SEQ ID NO: 196787 - DNA, 25 bp, Rattus norvegicus
atggccaccaccaaatttattgctg

SEQ ID NO: 196788 - DNA, 25 bp, Rattus norvegicus
atggccaccacctaatttattgctg

SEQ ID NO: 196789 - DNA, 25 bp, Rattus norvegicus
atggccaccctcaagacgtgggatg

SEQ ID NO: 196790 - DNA, 25 bp, Rattus norvegicus
atggccaccctctagacgtgggatg

SEQ ID NO: 196791 - DNA, 25 bp, Rattus norvegicus
atggccacccttagagcctaagaga

SEQ ID NO: 196792 - DNA, 25 bp, Rattus norvegicus
atggccaccctttgagcctaagaga

SEQ ID NO: 196793 - DNA, 25 bp, Rattus norvegicus
atggccacctctctggacagtttat

SEQ ID NO: 196794 - DNA, 25 bp, Rattus norvegicus
atggccacctctgtggacagtttat

SEQ ID NO: 196795 - DNA, 25 bp, Rattus norvegicus
atggccaccttcacgttcccagaga

SEQ ID NO: 196796 - DNA, 25 bp, Rattus norvegicus
atggccaccttctcgttcccagaga

SEQ ID NO: 196797 - DNA, 25 bp, Rattus norvegicus
atggccaccttgcaatgctcggtga

SEQ ID NO: 196798 - DNA, 25 bp, Rattus norvegicus
atggccaccttgctgtgctcggcaa

SEQ ID NO: 196799 - DNA, 25 bp, Rattus norvegicus
atggccaccttggaatgctcggtga

SEQ ID NO: 196800 - DNA, 25 bp, Rattus norvegicus
atggccaccttggtgtgctcggcaa

SEQ ID NO: 196801 - DNA, 25 bp, Rattus norvegicus
atggccacgggcatttgctatgagc

SEQ ID NO: 196802 - DNA, 25 bp, Rattus norvegicus
atggccacgggcttttgctatgagc

SEQ ID NO: 196803 - DNA, 25 bp, Rattus norvegicus
atggccacgtttagcgtgttcggga

SEQ ID NO: 196804 - DNA, 25 bp, Rattus norvegicus
atggccacgttttgcgtgttcggga

SEQ ID NO: 196805 - DNA, 25 bp, Rattus norvegicus
atggccactaagcatccagaagctg

SEQ ID NO: 196806 - DNA, 25 bp, Rattus norvegicus
atggccactaaggatccagaagctg

SEQ ID NO: 196807 - DNA, 25 bp, Rattus norvegicus
atggccactggactttactgttttc

SEQ ID NO: 196808 - DNA, 25 bp, Rattus norvegicus
atggccactggagtttactgttttc

SEQ ID NO: 196809 - DNA, 25 bp, Rattus norvegicus
atggccacttttatacagtcaatgt

SEQ ID NO: 196810 - DNA, 25 bp, Rattus norvegicus
atggccacttttttacagtcaatgt

SEQ ID NO: 196811 - DNA, 25 bp, Rattus norvegicus
atggccagagctcatgtcatttcct

SEQ ID NO: 196812 - DNA, 25 bp, Rattus norvegicus
atggccagagctgatgtcatttcct

SEQ ID NO: 196813 - DNA, 25 bp, Rattus norvegicus
atggccagaggtcaccctggactca

SEQ ID NO: 196814 - DNA, 25 bp, Rattus norvegicus
atggccagaggtgaccctggactca

SEQ ID NO: 196815 - DNA, 25 bp, Rattus norvegicus
atggccagagtgactccgtttctga

SEQ ID NO: 196816 - DNA, 25 bp, Rattus norvegicus
atggccagagtgtctccgtttctga

SEQ ID NO: 196817 - DNA, 25 bp, Rattus norvegicus
atggccagagttacggcgttacttt

SEQ ID NO: 196818 - DNA, 25 bp, Rattus norvegicus
atggccagagtttcggcgttacttt

SEQ ID NO: 196819 - DNA, 25 bp, Rattus norvegicus
atggccagcctactggccggaagct

SEQ ID NO: 196820 - DNA, 25 bp, Rattus norvegicus
atggccagcctagtggccggaagct

SEQ ID NO: 196821 - DNA, 25 bp, Rattus norvegicus
atggccagcgctccctagagaaaca

SEQ ID NO: 196822 - DNA, 25 bp, Rattus norvegicus
atggccagcgctgcctagagaaaca

SEQ ID NO: 196823 - DNA, 25 bp, Rattus norvegicus
atggccagctatcttctttctagac

SEQ ID NO: 196824 - DNA, 25 bp, Rattus norvegicus
atggccagctatgttctttctagac

SEQ ID NO: 196825 - DNA, 25 bp, Rattus norvegicus
atggccagctgacgccgaggcctct

SEQ ID NO: 196826 - DNA, 25 bp, Rattus norvegicus
atggccagctgaggccgaggcctct

SEQ ID NO: 196827 - DNA, 25 bp, Rattus norvegicus
atggccaggacgatgccaggagcta

SEQ ID NO: 196828 - DNA, 25 bp, Rattus norvegicus
atggccaggacgttgccaggagcta

SEQ ID NO: 196829 - DNA, 25 bp, Rattus norvegicus
atggccaggcagcaaagtccgtcca

SEQ ID NO: 196830 - DNA, 25 bp, Rattus norvegicus
atggccaggcaggaaagtccgtcca

SEQ ID NO: 196831 - DNA, 25 bp, Rattus norvegicus
atggccaggctgatctagagagttc

SEQ ID NO: 196832 - DNA, 25 bp, Rattus norvegicus
atggccaggctgttctagagagttc

SEQ ID NO: 196833 - DNA, 25 bp, Rattus norvegicus
atggccaggtatagttccttttatc

SEQ ID NO: 196834 - DNA, 25 bp, Rattus norvegicus
atggccaggtattgttccttttatc

SEQ ID NO: 196835 - DNA, 25 bp, Rattus norvegicus
atggccagtacccagtatggatgaa

SEQ ID NO: 196836 - DNA, 25 bp, Rattus norvegicus
atggccagtaccgagtatggatgaa

SEQ ID NO: 196837 - DNA, 25 bp, Rattus norvegicus
atggccagtcggctaagtcagctag

SEQ ID NO: 196838 - DNA, 25 bp, Rattus norvegicus
atggccagtcgggtaagtcagctag

SEQ ID NO: 196839 - DNA, 25 bp, Rattus norvegicus
atggccagtctgaggaacacccaat

SEQ ID NO: 196840 - DNA, 25 bp, Rattus norvegicus
atggccagtctgtggaacacccaat

SEQ ID NO: 196841 - DNA, 25 bp, Rattus norvegicus
atggccagtgatctctgcctctgac

SEQ ID NO: 196842 - DNA, 25 bp, Rattus norvegicus
atggccagtgatgtctgcctctgac

SEQ ID NO: 196843 - DNA, 25 bp, Rattus norvegicus
atggccagtgcacaagctccgcagg

SEQ ID NO: 196844 - DNA, 25 bp, Rattus norvegicus
atggccagtgcagaagctccgcagg

SEQ ID NO: 196845 - DNA, 25 bp, Rattus norvegicus
atggccagtgccatggtctcttgct

SEQ ID NO: 196846 - DNA, 25 bp, Rattus norvegicus
atggccagtgccttggtctcttgct

SEQ ID NO: 196847 - DNA, 25 bp, Rattus norvegicus
atggccagttttatgttccctcttc

SEQ ID NO: 196848 - DNA, 25 bp, Rattus norvegicus
atggccagttttttgttccctcttc

SEQ ID NO: 196849 - DNA, 25 bp, Rattus norvegicus
atggccataccccagccattttgta

SEQ ID NO: 196850 - DNA, 25 bp, Rattus norvegicus
atggccatacccgagccattttgta

SEQ ID NO: 196851 - DNA, 25 bp, Rattus norvegicus
atggccatagccaaggtggctcggc

SEQ ID NO: 196852 - DNA, 25 bp, Rattus norvegicus
atggccatagcctaggtggctcggc

SEQ ID NO: 196853 - DNA, 25 bp, Rattus norvegicus
atggccatatggctgctgtgaaata

SEQ ID NO: 196854 - DNA, 25 bp, Rattus norvegicus
atggccatatgggtgctgtgaaata

SEQ ID NO: 196855 - DNA, 25 bp, Rattus norvegicus
atggccatcagaaccgacagctgaa

SEQ ID NO: 196856 - DNA, 25 bp, Rattus norvegicus
atggccatcagatccgacagctgaa

SEQ ID NO: 196857 - DNA, 25 bp, Rattus norvegicus
atggccatccagcaccgcgaaaaaa

SEQ ID NO: 196858 - DNA, 25 bp, Rattus norvegicus
atggccatccaggaccgcgaaaaaa

SEQ ID NO: 196859 - DNA, 25 bp, Rattus norvegicus
atggccatcggaatgggcatacgat

SEQ ID NO: 196860 - DNA, 25 bp, Rattus norvegicus
atggccatcggattgggcatacgat

SEQ ID NO: 196861 - DNA, 25 bp, Rattus norvegicus
atggccatctacatgtaacgctact

SEQ ID NO: 196862 - DNA, 25 bp, Rattus norvegicus
atggccatctacttgtaacgctact

SEQ ID NO: 196863 - DNA, 25 bp, Rattus norvegicus
atggccatctcacccatgttcaggg

SEQ ID NO: 196864 - DNA, 25 bp, Rattus norvegicus
atggccatctcagccatgttcaggg

SEQ ID NO: 196865 - DNA, 25 bp, Rattus norvegicus
atggccatctccaagcgtgagggaa

SEQ ID NO: 196866 - DNA, 25 bp, Rattus norvegicus
atggccatctcctagcgtgagggaa

SEQ ID NO: 196867 - DNA, 25 bp, Rattus norvegicus
atggccatcttgcttcatcaatcaa

SEQ ID NO: 196868 - DNA, 25 bp, Rattus norvegicus
atggccatcttggttcatcaatcaa

SEQ ID NO: 196869 - DNA, 25 bp, Rattus norvegicus
atggccatgacacatccagcttttg

SEQ ID NO: 196870 - DNA, 25 bp, Rattus norvegicus
atggccatgacagatccagcttttg

SEQ ID NO: 196871 - DNA, 25 bp, Rattus norvegicus
atggccatggcacatgtccaacagg

SEQ ID NO: 196872 - DNA, 25 bp, Rattus norvegicus
atggccatggcagatgtccaacagg

SEQ ID NO: 196873 - DNA, 25 bp, Rattus norvegicus
atggccatgtatcaactttccttca

SEQ ID NO: 196874 - DNA, 25 bp, Rattus norvegicus
atggccatgtatgaactttccttca

SEQ ID NO: 196875 - DNA, 25 bp, Rattus norvegicus
atggccatgtgaaagggacttcctt

SEQ ID NO: 196876 - DNA, 25 bp, Rattus norvegicus
atggccatgtgatagggacttcctt

SEQ ID NO: 196877 - DNA, 25 bp, Rattus norvegicus
atggccattcagaacttttaagtct

SEQ ID NO: 196878 - DNA, 25 bp, Rattus norvegicus
atggccattcagtacttttaagtct

SEQ ID NO: 196879 - DNA, 25 bp, Rattus norvegicus
atggccattcatagggaatttgtta

SEQ ID NO: 196880 - DNA, 25 bp, Rattus norvegicus
atggccattcattgggaatttgtta

SEQ ID NO: 196881 - DNA, 25 bp, Rattus norvegicus
atggccattgacctcacttcaagca

SEQ ID NO: 196882 - DNA, 25 bp, Rattus norvegicus
atggccattgacgtcacttcaagca

SEQ ID NO: 196883 - DNA, 25 bp, Rattus norvegicus
atggccatttgactgaagaactctt

SEQ ID NO: 196884 - DNA, 25 bp, Rattus norvegicus
atggccatttgagtgaagaactctt

SEQ ID NO: 196885 - DNA, 25 bp, Rattus norvegicus
atggccatttttctgtggtactctg

SEQ ID NO: 196886 - DNA, 25 bp, Rattus norvegicus
atggccatttttgtgtggtactctg

SEQ ID NO: 196887 - DNA, 25 bp, Rattus norvegicus
atggcccaaattctgagcctgctaa

SEQ ID NO: 196888 - DNA, 25 bp, Rattus norvegicus
atggcccaaattgtgagcctgctaa

SEQ ID NO: 196889 - DNA, 25 bp, Rattus norvegicus
atggcccaagctattttagcctgta

SEQ ID NO: 196890 - DNA, 25 bp, Rattus norvegicus
atggcccaagcttttttagcctgta

SEQ ID NO: 196891 - DNA, 25 bp, Rattus norvegicus
atggcccagacgagacctttggatg

SEQ ID NO: 196892 - DNA, 25 bp, Rattus norvegicus
atggcccagacgtgacctttggatg

SEQ ID NO: 196893 - DNA, 25 bp, Rattus norvegicus
atggcccagcagctagaagaactta

SEQ ID NO: 196894 - DNA, 25 bp, Rattus norvegicus
atggcccagcaggtagaagaactta

SEQ ID NO: 196895 - DNA, 25 bp, Rattus norvegicus
atggcccaggagctacaacaatcta

SEQ ID NO: 196896 - DNA, 25 bp, Rattus norvegicus
atggcccaggaggtacaacaatcta

SEQ ID NO: 196897 - DNA, 25 bp, Rattus norvegicus
atggcccaggcaagtaacagtgttg

SEQ ID NO: 196898 - DNA, 25 bp, Rattus norvegicus
atggcccaggcatgtaacagtgttg

SEQ ID NO: 196899 - DNA, 25 bp, Rattus norvegicus
atggcccaggccaatgtgtccaggg

SEQ ID NO: 196900 - DNA, 25 bp, Rattus norvegicus
atggcccaggcctatgtgtccaggg

SEQ ID NO: 196901 - DNA, 25 bp, Rattus norvegicus
atggcccatcctctagttatcttta

SEQ ID NO: 196902 - DNA, 25 bp, Rattus norvegicus
atggcccatcctgtagttatcttta

SEQ ID NO: 196903 - DNA, 25 bp, Rattus norvegicus
atggcccatggaacatatctccctg

SEQ ID NO: 196904 - DNA, 25 bp, Rattus norvegicus
atggcccatggatcatatctccctg

SEQ ID NO: 196905 - DNA, 25 bp, Rattus norvegicus
atggcccatgtgcacctgactggag

SEQ ID NO: 196906 - DNA, 25 bp, Rattus norvegicus
atggcccatgtggacctgactggag

SEQ ID NO: 196907 - DNA, 25 bp, Rattus norvegicus
atggccccaaatacacatcagtctt

SEQ ID NO: 196908 - DNA, 25 bp, Rattus norvegicus
atggccccaaattcacatcagtctt

SEQ ID NO: 196909 - DNA, 25 bp, Rattus norvegicus
atggccccaaggacacatcagtgga

SEQ ID NO: 196910 - DNA, 25 bp, Rattus norvegicus
atggccccaaggtcacatcagtgga

SEQ ID NO: 196911 - DNA, 25 bp, Rattus norvegicus
atggccccagcacggacttgtcatg

SEQ ID NO: 196912 - DNA, 25 bp, Rattus norvegicus
atggccccagcagggacttgtcatg

SEQ ID NO: 196913 - DNA, 25 bp, Rattus norvegicus
atggccccaggtctgtattctaaaa

SEQ ID NO: 196914 - DNA, 25 bp, Rattus norvegicus
atggccccaggtgtgtattctaaaa

SEQ ID NO: 196915 - DNA, 25 bp, Rattus norvegicus
atggccccatgtcagctcagttgtc

SEQ ID NO: 196916 - DNA, 25 bp, Rattus norvegicus
atggccccatgtgagctcagttgtc

SEQ ID NO: 196917 - DNA, 25 bp, Rattus norvegicus
atggccccggaacttctagaatcca

SEQ ID NO: 196918 - DNA, 25 bp, Rattus norvegicus
atggccccggaagttctagaatcca

SEQ ID NO: 196919 - DNA, 25 bp, Rattus norvegicus
atggccccgggaatggttgtcacag

SEQ ID NO: 196920 - DNA, 25 bp, Rattus norvegicus
atggccccgggattggttgtcacag

SEQ ID NO: 196921 - DNA, 25 bp, Rattus norvegicus
atggcccctctgcaaagctgtggcg

SEQ ID NO: 196922 - DNA, 25 bp, Rattus norvegicus
atggcccctctggaaagctgtggcg

SEQ ID NO: 196923 - DNA, 25 bp, Rattus norvegicus
atggcccctgtgaggtgaagatcaa

SEQ ID NO: 196924 - DNA, 25 bp, Rattus norvegicus
atggcccctgtgtggtgaagatcaa

SEQ ID NO: 196925 - DNA, 25 bp, Rattus norvegicus
atggcccctttcagaactgacataa

SEQ ID NO: 196926 - DNA, 25 bp, Rattus norvegicus
atggcccctttctgaactgacataa

SEQ ID NO: 196927 - DNA, 25 bp, Rattus norvegicus
atggcccgagatccccggtgaggaa

SEQ ID NO: 196928 - DNA, 25 bp, Rattus norvegicus
atggcccgagatgcccggtgaggaa

SEQ ID NO: 196929 - DNA, 25 bp, Rattus norvegicus
atggcccgctgaacaaatctccagg

SEQ ID NO: 196930 - DNA, 25 bp, Rattus norvegicus
atggcccgctgatcaaatctccagg

SEQ ID NO: 196931 - DNA, 25 bp, Rattus norvegicus
atggcccggaacctggcgtgggtga

SEQ ID NO: 196932 - DNA, 25 bp, Rattus norvegicus
atggcccggaacgtggcgtgggtga

SEQ ID NO: 196933 - DNA, 25 bp, Rattus norvegicus
atggccctacatctctcttaatata

SEQ ID NO: 196934 - DNA, 25 bp, Rattus norvegicus
atggccctacatgtctcttaatata

SEQ ID NO: 196935 - DNA, 25 bp, Rattus norvegicus
atggccctagttaccagacttctgt

SEQ ID NO: 196936 - DNA, 25 bp, Rattus norvegicus
atggccctagtttccagacttctgt

SEQ ID NO: 196937 - DNA, 25 bp, Rattus norvegicus
atggccctatggagtagtgtgtcac

SEQ ID NO: 196938 - DNA, 25 bp, Rattus norvegicus
atggccctatggtgtagtgtgtcac

SEQ ID NO: 196939 - DNA, 25 bp, Rattus norvegicus
atggccctcacaacgactgtgccag

SEQ ID NO: 196940 - DNA, 25 bp, Rattus norvegicus
atggccctcacatcgactgtgccag

SEQ ID NO: 196941 - DNA, 25 bp, Rattus norvegicus
atggccctcagcaaattctgtcata

SEQ ID NO: 196942 - DNA, 25 bp, Rattus norvegicus
atggccctcagctaattctgtcata

SEQ ID NO: 196943 - DNA, 25 bp, Rattus norvegicus
atggccctcaggatacgtgtctacg

SEQ ID NO: 196944 - DNA, 25 bp, Rattus norvegicus
atggccctcaggcagtgaatacctt

SEQ ID NO: 196945 - DNA, 25 bp, Rattus norvegicus
atggccctcagggagtgaatacctt

SEQ ID NO: 196946 - DNA, 25 bp, Rattus norvegicus
atggccctcaggttacgtgtctacg

SEQ ID NO: 196947 - DNA, 25 bp, Rattus norvegicus
atggccctgcccctaactaaatgtc

SEQ ID NO: 196948 - DNA, 25 bp, Rattus norvegicus
atggccctgcccgtaactaaatgtc

SEQ ID NO: 196949 - DNA, 25 bp, Rattus norvegicus
atggccctggagctctacaagctga

SEQ ID NO: 196950 - DNA, 25 bp, Rattus norvegicus
atggccctggaggtctacaagctga

SEQ ID NO: 196951 - DNA, 25 bp, Rattus norvegicus
atggccctgtctaatcacctgaatg

SEQ ID NO: 196952 - DNA, 25 bp, Rattus norvegicus
atggccctgtctctatggcgccaga

SEQ ID NO: 196953 - DNA, 25 bp, Rattus norvegicus
atggccctgtctgtatggcgccaga

SEQ ID NO: 196954 - DNA, 25 bp, Rattus norvegicus
atggccctgtcttatcacctgaatg

SEQ ID NO: 196955 - DNA, 25 bp, Rattus norvegicus
atggccctgtggacacagagctgaa

SEQ ID NO: 196956 - DNA, 25 bp, Rattus norvegicus
atggccctgtggtcacagagctgaa

SEQ ID NO: 196957 - DNA, 25 bp, Rattus norvegicus
atggcccttaatatgtgtacttagc

SEQ ID NO: 196958 - DNA, 25 bp, Rattus norvegicus
atggcccttaatttgtgtacttagc

SEQ ID NO: 196959 - DNA, 25 bp, Rattus norvegicus
atggccgaaatgactgtgttccttg

SEQ ID NO: 196960 - DNA, 25 bp, Rattus norvegicus
atggccgaaatgtctgtgttccttg

SEQ ID NO: 196961 - DNA, 25 bp, Rattus norvegicus
atggccgacttcatttttgacctta

SEQ ID NO: 196962 - DNA, 25 bp, Rattus norvegicus
atggccgacttcttttttgacctta

SEQ ID NO: 196963 - DNA, 25 bp, Rattus norvegicus
atggccgagccgagtgctatggaca

SEQ ID NO: 196964 - DNA, 25 bp, Rattus norvegicus
atggccgagccgtgtgctatggaca

SEQ ID NO: 196965 - DNA, 25 bp, Rattus norvegicus
atggccgagcgcatagctgacaaat

SEQ ID NO: 196966 - DNA, 25 bp, Rattus norvegicus
atggccgagcgcttagctgacaaat

SEQ ID NO: 196967 - DNA, 25 bp, Rattus norvegicus
atggccgaggccattctcagaatga

SEQ ID NO: 196968 - DNA, 25 bp, Rattus norvegicus
atggccgaggcctttctcagaatga

SEQ ID NO: 196969 - DNA, 25 bp, Rattus norvegicus
atggccgatgttctgttttggttac

SEQ ID NO: 196970 - DNA, 25 bp, Rattus norvegicus
atggccgatgttgtgttttggttac

SEQ ID NO: 196971 - DNA, 25 bp, Rattus norvegicus
atggccgcaagcatgggctcctgga

SEQ ID NO: 196972 - DNA, 25 bp, Rattus norvegicus
atggccgcaagcttgggctcctgga

SEQ ID NO: 196973 - DNA, 25 bp, Rattus norvegicus
atggccgcattgacttcgacgagtt

SEQ ID NO: 196974 - DNA, 25 bp, Rattus norvegicus
atggccgcattgtcttcgacgagtt

SEQ ID NO: 196975 - DNA, 25 bp, Rattus norvegicus
atggccgccgtgaccgggatttaga

SEQ ID NO: 196976 - DNA, 25 bp, Rattus norvegicus
atggccgccgtgtccgggatttaga

SEQ ID NO: 196977 - DNA, 25 bp, Rattus norvegicus
atggccgcctatcgtatccaggtgt

SEQ ID NO: 196978 - DNA, 25 bp, Rattus norvegicus
atggccgcctatggtatccaggtgt

SEQ ID NO: 196979 - DNA, 25 bp, Rattus norvegicus
atggccgctgcgctttcagtctgag

SEQ ID NO: 196980 - DNA, 25 bp, Rattus norvegicus
atggccgctgcggtttcagtctgag

SEQ ID NO: 196981 - DNA, 25 bp, Rattus norvegicus
atggccgggccaattgcaacgtgtt

SEQ ID NO: 196982 - DNA, 25 bp, Rattus norvegicus
atggccgggccatttgcaacgtgtt

SEQ ID NO: 196983 - DNA, 25 bp, Rattus norvegicus
atggccggtgctcgccttcggcatc

SEQ ID NO: 196984 - DNA, 25 bp, Rattus norvegicus
atggccggtgctggccttcggcatc

SEQ ID NO: 196985 - DNA, 25 bp, Rattus norvegicus
atggccgtacatagagttactgtgg

SEQ ID NO: 196986 - DNA, 25 bp, Rattus norvegicus
atggccgtacattgagttactgtgg

SEQ ID NO: 196987 - DNA, 25 bp, Rattus norvegicus
atggccgtagacatgtagctctaaa

SEQ ID NO: 196988 - DNA, 25 bp, Rattus norvegicus
atggccgtagacttgtagctctaaa

SEQ ID NO: 196989 - DNA, 25 bp, Rattus norvegicus
atggccgtcactaattctcaatgtc

SEQ ID NO: 196990 - DNA, 25 bp, Rattus norvegicus
atggccgtcacttattctcaatgtc

SEQ ID NO: 196991 - DNA, 25 bp, Rattus norvegicus
atggccgtccagcactacatagaga

SEQ ID NO: 196992 - DNA, 25 bp, Rattus norvegicus
atggccgtccaggactacatagaga

SEQ ID NO: 196993 - DNA, 25 bp, Rattus norvegicus
atggccgtcccacaaataaactatt

SEQ ID NO: 196994 - DNA, 25 bp, Rattus norvegicus
atggccgtcccagaaataaactatt

SEQ ID NO: 196995 - DNA, 25 bp, Rattus norvegicus
atggccgtcctcacctgatattggc

SEQ ID NO: 196996 - DNA, 25 bp, Rattus norvegicus
atggccgtcctctcctgatattggc

SEQ ID NO: 196997 - DNA, 25 bp, Rattus norvegicus
atggccgtctagatcctgacagaag

SEQ ID NO: 196998 - DNA, 25 bp, Rattus norvegicus
atggccgtctagttcctgacagaag

SEQ ID NO: 196999 - DNA, 25 bp, Rattus norvegicus
atggccgtgcacaggttaggtttta

SEQ ID NO: 197000 - DNA, 25 bp, Rattus norvegicus
atggccgtgcactggttaggtttta

SEQ ID NO: 197001 - DNA, 25 bp, Rattus norvegicus
atggccgtgggcctcaacaaaggcc

SEQ ID NO: 197002 - DNA, 25 bp, Rattus norvegicus
atggccgtgggcgtcaacaaaggcc

SEQ ID NO: 197003 - DNA, 25 bp, Rattus norvegicus
atggccgtgtatccattctaccaag

SEQ ID NO: 197004 - DNA, 25 bp, Rattus norvegicus
atggccgtgtatgcattctaccaag

SEQ ID NO: 197005 - DNA, 25 bp, Rattus norvegicus
atggccgttctacttgcagtactgc

SEQ ID NO: 197006 - DNA, 25 bp, Rattus norvegicus
atggccgttctagttgcagtactgc

SEQ ID NO: 197007 - DNA, 25 bp, Rattus norvegicus
atggcctactacaggacagtctgct

SEQ ID NO: 197008 - DNA, 25 bp, Rattus norvegicus
atggcctactactggacagtctgct

SEQ ID NO: 197009 - DNA, 25 bp, Rattus norvegicus
atggcctagcacctggcatacgcga

SEQ ID NO: 197010 - DNA, 25 bp, Rattus norvegicus
atggcctagcacgtggcatacgcga

SEQ ID NO: 197011 - DNA, 25 bp, Rattus norvegicus
atggcctagcctcctggacaaggaa

SEQ ID NO: 197012 - DNA, 25 bp, Rattus norvegicus
atggcctagcctgctggacaaggaa

SEQ ID NO: 197013 - DNA, 25 bp, Rattus norvegicus
atggcctcaccgaggtctgagcacc

SEQ ID NO: 197014 - DNA, 25 bp, Rattus norvegicus
atggcctcaccgtggtctgagcacc

SEQ ID NO: 197015 - DNA, 25 bp, Rattus norvegicus
atggcctcagacaacattctttcta

SEQ ID NO: 197016 - DNA, 25 bp, Rattus norvegicus
atggcctcagactacattctttcta

SEQ ID NO: 197017 - DNA, 25 bp, Rattus norvegicus
atggcctcaggtcgtgtccgagatt

SEQ ID NO: 197018 - DNA, 25 bp, Rattus norvegicus
atggcctcaggtggtgtccgagatt

SEQ ID NO: 197019 - DNA, 25 bp, Rattus norvegicus
atggcctcatgtaactgtgctgcat

SEQ ID NO: 197020 - DNA, 25 bp, Rattus norvegicus
atggcctcatgttactgtgctgcat

SEQ ID NO: 197021 - DNA, 25 bp, Rattus norvegicus
atggcctccaaacatgcggtcctgc

SEQ ID NO: 197022 - DNA, 25 bp, Rattus norvegicus
atggcctccaaagatgcggtcctgc

SEQ ID NO: 197023 - DNA, 25 bp, Rattus norvegicus
atggcctccaatatgtaattcctaa

SEQ ID NO: 197024 - DNA, 25 bp, Rattus norvegicus
atggcctccaatttgtaattcctaa

SEQ ID NO: 197025 - DNA, 25 bp, Rattus norvegicus
atggcctccaggaggttccaaagaa

SEQ ID NO: 197026 - DNA, 25 bp, Rattus norvegicus
atggcctccaggtggttccaaagaa

SEQ ID NO: 197027 - DNA, 25 bp, Rattus norvegicus
atggcctccccactttaagatgtat

SEQ ID NO: 197028 - DNA, 25 bp, Rattus norvegicus
atggcctccccagtttaagatgtat

SEQ ID NO: 197029 - DNA, 25 bp, Rattus norvegicus
atggcctcctgaatcctttagtctg

SEQ ID NO: 197030 - DNA, 25 bp, Rattus norvegicus
atggcctcctgattcctttagtctg

SEQ ID NO: 197031 - DNA, 25 bp, Rattus norvegicus
atggcctcctggcattatttctaag

SEQ ID NO: 197032 - DNA, 25 bp, Rattus norvegicus
atggcctcctgggattatttctaag

SEQ ID NO: 197033 - DNA, 25 bp, Rattus norvegicus
atggcctcctgtcagtacagctcca

SEQ ID NO: 197034 - DNA, 25 bp, Rattus norvegicus
atggcctcctgtgagtacagctcca

SEQ ID NO: 197035 - DNA, 25 bp, Rattus norvegicus
atggcctccttacggactagtcttg

SEQ ID NO: 197036 - DNA, 25 bp, Rattus norvegicus
atggcctccttagggactagtcttg

SEQ ID NO: 197037 - DNA, 25 bp, Rattus norvegicus
atggcctccttcagcaatcaagagg

SEQ ID NO: 197038 - DNA, 25 bp, Rattus norvegicus
atggcctccttctgcaatcaagagg

SEQ ID NO: 197039 - DNA, 25 bp, Rattus norvegicus
atggcctcctttacaaagccgcaaa

SEQ ID NO: 197040 - DNA, 25 bp, Rattus norvegicus
atggcctccttttcaaagccgcaaa

SEQ ID NO: 197041 - DNA, 25 bp, Rattus norvegicus
atggcctcgacacgacaccaaggaa

SEQ ID NO: 197042 - DNA, 25 bp, Rattus norvegicus
atggcctcgacaggacaccaaggaa

SEQ ID NO: 197043 - DNA, 25 bp, Rattus norvegicus
atggcctcgaggagctcttatacca

SEQ ID NO: 197044 - DNA, 25 bp, Rattus norvegicus
atggcctcgaggtgctcttatacca

SEQ ID NO: 197045 - DNA, 25 bp, Rattus norvegicus
atggcctcggccatcaaggatgaag

SEQ ID NO: 197046 - DNA, 25 bp, Rattus norvegicus
atggcctcggccttcaaggatgaag

SEQ ID NO: 197047 - DNA, 25 bp, Rattus norvegicus
atggcctcgtatataccgctgtttc

SEQ ID NO: 197048 - DNA, 25 bp, Rattus norvegicus
atggcctcgtatttaccgctgtttc

SEQ ID NO: 197049 - DNA, 25 bp, Rattus norvegicus
atggcctcgtcccagtaactgtgtg

SEQ ID NO: 197050 - DNA, 25 bp, Rattus norvegicus
atggcctcgtccgagtaactgtgtg

SEQ ID NO: 197051 - DNA, 25 bp, Rattus norvegicus
atggcctcgtgactagacctgtttt

SEQ ID NO: 197052 - DNA, 25 bp, Rattus norvegicus
atggcctcgtgagtagacctgtttt

SEQ ID NO: 197053 - DNA, 25 bp, Rattus norvegicus
atggcctctctgaaaatcccattct

SEQ ID NO: 197054 - DNA, 25 bp, Rattus norvegicus
atggcctctctgtaaatcccattct

SEQ ID NO: 197055 - DNA, 25 bp, Rattus norvegicus
atggcctctttcatcactattctaa

SEQ ID NO: 197056 - DNA, 25 bp, Rattus norvegicus
atggcctctttcttcactattctaa

SEQ ID NO: 197057 - DNA, 25 bp, Rattus norvegicus
atggcctgcactaatgtcaccgaag

SEQ ID NO: 197058 - DNA, 25 bp, Rattus norvegicus
atggcctgcacttatgtcaccgaag

SEQ ID NO: 197059 - DNA, 25 bp, Rattus norvegicus
atggcctgcaggatgtagaactact

SEQ ID NO: 197060 - DNA, 25 bp, Rattus norvegicus
atggcctgcaggttgtagaactact

SEQ ID NO: 197061 - DNA, 25 bp, Rattus norvegicus
atggcctgccaaacttaacccaaga

SEQ ID NO: 197062 - DNA, 25 bp, Rattus norvegicus
atggcctgccaatcttaacccaaga

SEQ ID NO: 197063 - DNA, 25 bp, Rattus norvegicus
atggcctgctctccctaggttgtgg

SEQ ID NO: 197064 - DNA, 25 bp, Rattus norvegicus
atggcctgctctgcctaggttgtgg

SEQ ID NO: 197065 - DNA, 25 bp, Rattus norvegicus
atggcctgctggaatctgtgagatt

SEQ ID NO: 197066 - DNA, 25 bp, Rattus norvegicus
atggcctgctggtatctgtgagatt

SEQ ID NO: 197067 - DNA, 25 bp, Rattus norvegicus
atggcctggctaaagacctgtttag

SEQ ID NO: 197068 - DNA, 25 bp, Rattus norvegicus
atggcctggctatagacctgtttag

SEQ ID NO: 197069 - DNA, 25 bp, Rattus norvegicus
atggcctggtttccgttggtatgaa

SEQ ID NO: 197070 - DNA, 25 bp, Rattus norvegicus
atggcctggtttgcgttggtatgaa

SEQ ID NO: 197071 - DNA, 25 bp, Rattus norvegicus
atggcctgtcagatgtcagcttgtt

SEQ ID NO: 197072 - DNA, 25 bp, Rattus norvegicus
atggcctgtcagttgtcagcttgtt

SEQ ID NO: 197073 - DNA, 25 bp, Rattus norvegicus
atggcctgtcgaattttgaccttaa

SEQ ID NO: 197074 - DNA, 25 bp, Rattus norvegicus
atggcctgtcgatttttgaccttaa

SEQ ID NO: 197075 - DNA, 25 bp, Rattus norvegicus
atggcctgtgaaaccccatttttca

SEQ ID NO: 197076 - DNA, 25 bp, Rattus norvegicus
atggcctgtgaatccccatttttca

SEQ ID NO: 197077 - DNA, 25 bp, Rattus norvegicus
atggcctgtgcgcagtgttaagtca

SEQ ID NO: 197078 - DNA, 25 bp, Rattus norvegicus
atggcctgtgcggagtgttaagtca

SEQ ID NO: 197079 - DNA, 25 bp, Rattus norvegicus
atggcctgttctacagttttttgct

SEQ ID NO: 197080 - DNA, 25 bp, Rattus norvegicus
atggcctgttcttcagttttttgct

SEQ ID NO: 197081 - DNA, 25 bp, Rattus norvegicus
atggccttaaaaactgacagcatgg

SEQ ID NO: 197082 - DNA, 25 bp, Rattus norvegicus
atggccttaaaatctgacagcatgg

SEQ ID NO: 197083 - DNA, 25 bp, Rattus norvegicus
atggccttagacacagaatcctcct

SEQ ID NO: 197084 - DNA, 25 bp, Rattus norvegicus
atggccttagactcagaatcctcct

SEQ ID NO: 197085 - DNA, 25 bp, Rattus norvegicus
atggccttcaaaccaggcgtgatct

SEQ ID NO: 197086 - DNA, 25 bp, Rattus norvegicus
atggccttcaaagcaggcgtgatct

SEQ ID NO: 197087 - DNA, 25 bp, Rattus norvegicus
atggccttcagaaatgcacacgacc

SEQ ID NO: 197088 - DNA, 25 bp, Rattus norvegicus
atggccttcagatatgcacacgacc

SEQ ID NO: 197089 - DNA, 25 bp, Rattus norvegicus
atggccttccttcttcatttcgaca

SEQ ID NO: 197090 - DNA, 25 bp, Rattus norvegicus
atggccttccttgttcatttcgaca

SEQ ID NO: 197091 - DNA, 25 bp, Rattus norvegicus
atggccttcgggaggtcattggcct

SEQ ID NO: 197092 - DNA, 25 bp, Rattus norvegicus
atggccttcgggtggtcattggcct

SEQ ID NO: 197093 - DNA, 25 bp, Rattus norvegicus
atggccttctgaatcctaatgtttg

SEQ ID NO: 197094 - DNA, 25 bp, Rattus norvegicus
atggccttctgattcctaatgtttg

SEQ ID NO: 197095 - DNA, 25 bp, Rattus norvegicus
atggccttgatcagactgctcttaa

SEQ ID NO: 197096 - DNA, 25 bp, Rattus norvegicus
atggccttgatctgactgctcttaa

SEQ ID NO: 197097 - DNA, 25 bp, Rattus norvegicus
atggccttggctagggagcacccat

SEQ ID NO: 197098 - DNA, 25 bp, Rattus norvegicus
atggccttggcttgggagcacccat

SEQ ID NO: 197099 - DNA, 25 bp, Rattus norvegicus
atggccttgtacatgctgcaacagg

SEQ ID NO: 197100 - DNA, 25 bp, Rattus norvegicus
atggccttgtacttgctgcaacagg

SEQ ID NO: 197101 - DNA, 25 bp, Rattus norvegicus
atggccttgttcaatgcagcatacg

SEQ ID NO: 197102 - DNA, 25 bp, Rattus norvegicus
atggccttgttctatgcagcatacg

SEQ ID NO: 197103 - DNA, 25 bp, Rattus norvegicus
atggcctttaggacagtcctcgata

SEQ ID NO: 197104 - DNA, 25 bp, Rattus norvegicus
atggcctttaggtcagtcctcgata

SEQ ID NO: 197105 - DNA, 25 bp, Rattus norvegicus
atggcctttcacagcagagaccgaa

SEQ ID NO: 197106 - DNA, 25 bp, Rattus norvegicus
atggcctttcactgcagagaccgaa

SEQ ID NO: 197107 - DNA, 25 bp, Rattus norvegicus
atggcctttcagatcttcagtgtgt

SEQ ID NO: 197108 - DNA, 25 bp, Rattus norvegicus
atggcctttcagttcttcagtgtgt

SEQ ID NO: 197109 - DNA, 25 bp, Rattus norvegicus
atggcctttctacccaggagtttat

SEQ ID NO: 197110 - DNA, 25 bp, Rattus norvegicus
atggcctttctagccaggagtttat

SEQ ID NO: 197111 - DNA, 25 bp, Rattus norvegicus
atggcctttctgaagcctcggaaac

SEQ ID NO: 197112 - DNA, 25 bp, Rattus norvegicus
atggcctttctgtagcctcggaaac

SEQ ID NO: 197113 - DNA, 25 bp, Rattus norvegicus
atggcctttgaacaggagtgttcct

SEQ ID NO: 197114 - DNA, 25 bp, Rattus norvegicus
atggcctttgaagaggagtgttcct

SEQ ID NO: 197115 - DNA, 25 bp, Rattus norvegicus
atggcctttgcgcttgagcagcaga

SEQ ID NO: 197116 - DNA, 25 bp, Rattus norvegicus
atggcctttgcggttgagcagcaga

SEQ ID NO: 197117 - DNA, 25 bp, Rattus norvegicus
atggccttttctctaacccaagagg

SEQ ID NO: 197118 - DNA, 25 bp, Rattus norvegicus
atggccttttctgtaacccaagagg

SEQ ID NO: 197119 - DNA, 25 bp, Rattus norvegicus
atggccttttggatgcagctgtcaa

SEQ ID NO: 197120 - DNA, 25 bp, Rattus norvegicus
atggccttttggttgcagctgtcaa

SEQ ID NO: 197121 - DNA, 25 bp, Rattus norvegicus
atggcgaatccaaggcttacctctt

SEQ ID NO: 197122 - DNA, 25 bp, Rattus norvegicus
atggcgaatccatggcttacctctt

SEQ ID NO: 197123 - DNA, 25 bp, Rattus norvegicus
atggcgacatccaacagtgggactt

SEQ ID NO: 197124 - DNA, 25 bp, Rattus norvegicus
atggcgacatcctacagtgggactt

SEQ ID NO: 197125 - DNA, 25 bp, Rattus norvegicus
atggcgacctgcattctgctgcgga

SEQ ID NO: 197126 - DNA, 25 bp, Rattus norvegicus
atggcgacctgctttctgctgcgga

SEQ ID NO: 197127 - DNA, 25 bp, Rattus norvegicus
atggcgacctttctcacttccagca

SEQ ID NO: 197128 - DNA, 25 bp, Rattus norvegicus
atggcgacctttgtcacttccagca

SEQ ID NO: 197129 - DNA, 25 bp, Rattus norvegicus
atggcgacgcctctaagtttgccga

SEQ ID NO: 197130 - DNA, 25 bp, Rattus norvegicus
atggcgacgcctgtaagtttgccga

SEQ ID NO: 197131 - DNA, 25 bp, Rattus norvegicus
atggcgactacccagacactgggat

SEQ ID NO: 197132 - DNA, 25 bp, Rattus norvegicus
atggcgactaccgagacactgggat

SEQ ID NO: 197133 - DNA, 25 bp, Rattus norvegicus
atggcgactcccctggtgtcaatcc

SEQ ID NO: 197134 - DNA, 25 bp, Rattus norvegicus
atggcgactcccgtggtgtcaatcc

SEQ ID NO: 197135 - DNA, 25 bp, Rattus norvegicus
atggcgactcttattatagcgactt

SEQ ID NO: 197136 - DNA, 25 bp, Rattus norvegicus
atggcgactctttttatagcgactt

SEQ ID NO: 197137 - DNA, 25 bp, Rattus norvegicus
atggcgacttggcatcgctttctgc

SEQ ID NO: 197138 - DNA, 25 bp, Rattus norvegicus
atggcgacttgggatcgctttctgc

SEQ ID NO: 197139 - DNA, 25 bp, Rattus norvegicus
atggcgagagccctgaggatccctc

SEQ ID NO: 197140 - DNA, 25 bp, Rattus norvegicus
atggcgagagccgtgaggatccctc

SEQ ID NO: 197141 - DNA, 25 bp, Rattus norvegicus
atggcgagagtaaccgggcactgtt

SEQ ID NO: 197142 - DNA, 25 bp, Rattus norvegicus
atggcgagagtatccgggcactgtt

SEQ ID NO: 197143 - DNA, 25 bp, Rattus norvegicus
atggcgaggccaagccgttgcacag

SEQ ID NO: 197144 - DNA, 25 bp, Rattus norvegicus
atggcgaggccatgccgttgcacag

SEQ ID NO: 197145 - DNA, 25 bp, Rattus norvegicus
atggcgaggcgcattaaccgaaacg

SEQ ID NO: 197146 - DNA, 25 bp, Rattus norvegicus
atggcgaggcgctttaaccgaaacg

SEQ ID NO: 197147 - DNA, 25 bp, Rattus norvegicus
atggcgatagtgactgatcctctcc

SEQ ID NO: 197148 - DNA, 25 bp, Rattus norvegicus
atggcgatagtgtctgatcctctcc

SEQ ID NO: 197149 - DNA, 25 bp, Rattus norvegicus
atggcgatccagaacgcgccggaga

SEQ ID NO: 197150 - DNA, 25 bp, Rattus norvegicus
atggcgatccagtacgcgccggaga

SEQ ID NO: 197151 - DNA, 25 bp, Rattus norvegicus
atggcgcacgtacacttctggcttg

SEQ ID NO: 197152 - DNA, 25 bp, Rattus norvegicus
atggcgcacgtagacttctggcttg

SEQ ID NO: 197153 - DNA, 25 bp, Rattus norvegicus
atggcgcactatcccatcagtgcaa

SEQ ID NO: 197154 - DNA, 25 bp, Rattus norvegicus
atggcgcactatgccatcagtgcaa

SEQ ID NO: 197155 - DNA, 25 bp, Rattus norvegicus
atggcgcagcatcactttgctccag

SEQ ID NO: 197156 - DNA, 25 bp, Rattus norvegicus
atggcgcagcatgactttgctccag

SEQ ID NO: 197157 - DNA, 25 bp, Rattus norvegicus
atggcgcagtacatcgactagcagc

SEQ ID NO: 197158 - DNA, 25 bp, Rattus norvegicus
atggcgcagtacttcgactagcagc

SEQ ID NO: 197159 - DNA, 25 bp, Rattus norvegicus
atggcgcatgtcatgagcatcatta

SEQ ID NO: 197160 - DNA, 25 bp, Rattus norvegicus
atggcgcatgtcttgagcatcatta

SEQ ID NO: 197161 - DNA, 25 bp, Rattus norvegicus
atggcgccatgtaccgaagctactg

SEQ ID NO: 197162 - DNA, 25 bp, Rattus norvegicus
atggcgccatgttccgaagctactg

SEQ ID NO: 197163 - DNA, 25 bp, Rattus norvegicus
atggcgccgaggaatatgccccact

SEQ ID NO: 197164 - DNA, 25 bp, Rattus norvegicus
atggcgccgaggtatatgccccact

SEQ ID NO: 197165 - DNA, 25 bp, Rattus norvegicus
atggcgcggaaaccgcacgggctgc

SEQ ID NO: 197166 - DNA, 25 bp, Rattus norvegicus
atggcgcggaaagcgcacgggctgc

SEQ ID NO: 197167 - DNA, 25 bp, Rattus norvegicus
atggcgctactgcaactgcaatctc

SEQ ID NO: 197168 - DNA, 25 bp, Rattus norvegicus
atggcgctactggaactgcaatctc

SEQ ID NO: 197169 - DNA, 25 bp, Rattus norvegicus
atggcgctcaggattcttctgccag

SEQ ID NO: 197170 - DNA, 25 bp, Rattus norvegicus
atggcgctcaggtttcttctgccag

SEQ ID NO: 197171 - DNA, 25 bp, Rattus norvegicus
atggcgctcattataatcgactgga

SEQ ID NO: 197172 - DNA, 25 bp, Rattus norvegicus
atggcgctcattttaatcgactgga

SEQ ID NO: 197173 - DNA, 25 bp, Rattus norvegicus
atggcggaacacaccctacgttgag

SEQ ID NO: 197174 - DNA, 25 bp, Rattus norvegicus
atggcggaacactccctacgttgag

SEQ ID NO: 197175 - DNA, 25 bp, Rattus norvegicus
atggcggaacctcaccctgaggaca

SEQ ID NO: 197176 - DNA, 25 bp, Rattus norvegicus
atggcggaacctgaccctgaggaca

SEQ ID NO: 197177 - DNA, 25 bp, Rattus norvegicus
atggcggaatgcatgttgtgtcatc

SEQ ID NO: 197178 - DNA, 25 bp, Rattus norvegicus
atggcggaatgcttgttgtgtcatc

SEQ ID NO: 197179 - DNA, 25 bp, Rattus norvegicus
atggcggagctgctccaaccttcaa

SEQ ID NO: 197180 - DNA, 25 bp, Rattus norvegicus
atggcggagctggtccaaccttcaa

SEQ ID NO: 197181 - DNA, 25 bp, Rattus norvegicus
atggcggcagagctggttcttccat

SEQ ID NO: 197182 - DNA, 25 bp, Rattus norvegicus
atggcggcagaggtggttcttccat

SEQ ID NO: 197183 - DNA, 25 bp, Rattus norvegicus
atggcggcgctcagcgtcgtctgtc

SEQ ID NO: 197184 - DNA, 25 bp, Rattus norvegicus
atggcggcgctctgcgtcgtctgtc

SEQ ID NO: 197185 - DNA, 25 bp, Rattus norvegicus
atggcggcggctactgaggaaaaca

SEQ ID NO: 197186 - DNA, 25 bp, Rattus norvegicus
atggcggcggcttctgaggaaaaca

SEQ ID NO: 197187 - DNA, 25 bp, Rattus norvegicus
atggcggcggtcaccgtaaacagcg

SEQ ID NO: 197188 - DNA, 25 bp, Rattus norvegicus
atggcggcggtctccgtaaacagcg

SEQ ID NO: 197189 - DNA, 25 bp, Rattus norvegicus
atggcggctgtaaggctctagaccc

SEQ ID NO: 197190 - DNA, 25 bp, Rattus norvegicus
atggcggctgtatggctctagaccc

SEQ ID NO: 197191 - DNA, 25 bp, Rattus norvegicus
atggcggctgttatgttgacattct

SEQ ID NO: 197192 - DNA, 25 bp, Rattus norvegicus
atggcggctgttttgttgacattct

SEQ ID NO: 197193 - DNA, 25 bp, Rattus norvegicus
atggcgggcagacacccagtgttca

SEQ ID NO: 197194 - DNA, 25 bp, Rattus norvegicus
atggcgggcagagacccagtgttca

SEQ ID NO: 197195 - DNA, 25 bp, Rattus norvegicus
atggcgggttccatgggatatcacc

SEQ ID NO: 197196 - DNA, 25 bp, Rattus norvegicus
atggcgggttccttgggatatcacc

SEQ ID NO: 197197 - DNA, 25 bp, Rattus norvegicus
atggcggtctggacatctgatggaa

SEQ ID NO: 197198 - DNA, 25 bp, Rattus norvegicus
atggcggtctggtcatctgatggaa

SEQ ID NO: 197199 - DNA, 25 bp, Rattus norvegicus
atggcggtggctatgacgcgaatca

SEQ ID NO: 197200 - DNA, 25 bp, Rattus norvegicus
atggcggtggctttgacgcgaatca

SEQ ID NO: 197201 - DNA, 25 bp, Rattus norvegicus
atggcggttcccaaggacgatggat

SEQ ID NO: 197202 - DNA, 25 bp, Rattus norvegicus
atggcggttccctaggacgatggat

SEQ ID NO: 197203 - DNA, 25 bp, Rattus norvegicus
atggcgtacgcaaggcagaaatggt

SEQ ID NO: 197204 - DNA, 25 bp, Rattus norvegicus
atggcgtacgcatggcagaaatggt

SEQ ID NO: 197205 - DNA, 25 bp, Rattus norvegicus
atggcgtaggccaagcaagcttatt

SEQ ID NO: 197206 - DNA, 25 bp, Rattus norvegicus
atggcgtaggcctagcaagcttatt

SEQ ID NO: 197207 - DNA, 25 bp, Rattus norvegicus
atggcgtagtcccagagctggtctt

SEQ ID NO: 197208 - DNA, 25 bp, Rattus norvegicus
atggcgtagtccgagagctggtctt

SEQ ID NO: 197209 - DNA, 25 bp, Rattus norvegicus
atggcgtatgtccaagatagcttcc

SEQ ID NO: 197210 - DNA, 25 bp, Rattus norvegicus
atggcgtatgtcgaagatagcttcc

SEQ ID NO: 197211 - DNA, 25 bp, Rattus norvegicus
atggcgtcagagacttttctacctc

SEQ ID NO: 197212 - DNA, 25 bp, Rattus norvegicus
atggcgtcagagtcttttctacctc

SEQ ID NO: 197213 - DNA, 25 bp, Rattus norvegicus
atggcgtccagcaagctactgttag

SEQ ID NO: 197214 - DNA, 25 bp, Rattus norvegicus
atggcgtccagctagctactgttag

SEQ ID NO: 197215 - DNA, 25 bp, Rattus norvegicus
atggcgtccttgattattttatgtt

SEQ ID NO: 197216 - DNA, 25 bp, Rattus norvegicus
atggcgtccttgtttattttatgtt

SEQ ID NO: 197217 - DNA, 25 bp, Rattus norvegicus
atggcgtcgctcagcacaggtgcag

SEQ ID NO: 197218 - DNA, 25 bp, Rattus norvegicus
atggcgtcgctctgcacaggtgcag

SEQ ID NO: 197219 - DNA, 25 bp, Rattus norvegicus
atggcgtctacccaggctgcttagg

SEQ ID NO: 197220 - DNA, 25 bp, Rattus norvegicus
atggcgtctaccgaggctgcttagg

SEQ ID NO: 197221 - DNA, 25 bp, Rattus norvegicus
atggcgtctacgcattgccagttac

SEQ ID NO: 197222 - DNA, 25 bp, Rattus norvegicus
atggcgtctacggattgccagttac

SEQ ID NO: 197223 - DNA, 25 bp, Rattus norvegicus
atggcgtctcagataggcttcagat

SEQ ID NO: 197224 - DNA, 25 bp, Rattus norvegicus
atggcgtctcagttaggcttcagat

SEQ ID NO: 197225 - DNA, 25 bp, Rattus norvegicus
atggcgtgaccaagcaggtgactgt

SEQ ID NO: 197226 - DNA, 25 bp, Rattus norvegicus
atggcgtgaccatgcaggtgactgt

SEQ ID NO: 197227 - DNA, 25 bp, Rattus norvegicus
atggcgtgcggacccactctgaaaa

SEQ ID NO: 197228 - DNA, 25 bp, Rattus norvegicus
atggcgtgcggagccactctgaaaa

SEQ ID NO: 197229 - DNA, 25 bp, Rattus norvegicus
atggcgtgcggcatgtgtaactagt

SEQ ID NO: 197230 - DNA, 25 bp, Rattus norvegicus
atggcgtgcggcttgtgtaactagt

SEQ ID NO: 197231 - DNA, 25 bp, Rattus norvegicus
atggcgtgctcaccattaagctggg

SEQ ID NO: 197232 - DNA, 25 bp, Rattus norvegicus
atggcgtgctcagcattaagctggg

SEQ ID NO: 197233 - DNA, 25 bp, Rattus norvegicus
atggcgtggccacacagatgttata

SEQ ID NO: 197234 - DNA, 25 bp, Rattus norvegicus
atggcgtggccagacagatgttata

SEQ ID NO: 197235 - DNA, 25 bp, Rattus norvegicus
atggcgttactgattcttctatgga

SEQ ID NO: 197236 - DNA, 25 bp, Rattus norvegicus
atggcgttactgtttcttctatgga

SEQ ID NO: 197237 - DNA, 25 bp, Rattus norvegicus
atggcgttccacatgacagcctggt

SEQ ID NO: 197238 - DNA, 25 bp, Rattus norvegicus
atggcgttccacttgacagcctggt

SEQ ID NO: 197239 - DNA, 25 bp, Rattus norvegicus
atggcgttcgacattattcttgaca

SEQ ID NO: 197240 - DNA, 25 bp, Rattus norvegicus
atggcgttcgactttattcttgaca

SEQ ID NO: 197241 - DNA, 25 bp, Rattus norvegicus
atggcgttgcccagcagtgtagtca

SEQ ID NO: 197242 - DNA, 25 bp, Rattus norvegicus
atggcgttgcccaggaaacccttat

SEQ ID NO: 197243 - DNA, 25 bp, Rattus norvegicus
atggcgttgccctgcagtgtagtca

SEQ ID NO: 197244 - DNA, 25 bp, Rattus norvegicus
atggcgttgccctggaaacccttat

SEQ ID NO: 197245 - DNA, 25 bp, Rattus norvegicus
atggcgttgtgcctagggacttcca

SEQ ID NO: 197246 - DNA, 25 bp, Rattus norvegicus
atggcgttgtgcgtagggacttcca

SEQ ID NO: 197247 - DNA, 25 bp, Rattus norvegicus
atggctaaaatcacataaacctttg

SEQ ID NO: 197248 - DNA, 25 bp, Rattus norvegicus
atggctaaaatctcataaacctttg

SEQ ID NO: 197249 - DNA, 25 bp, Rattus norvegicus
atggctaactgtcaacaccagcttg

SEQ ID NO: 197250 - DNA, 25 bp, Rattus norvegicus
atggctaactgtgaacaccagcttg

SEQ ID NO: 197251 - DNA, 25 bp, Rattus norvegicus
atggctaagatgagtcttcccacct

SEQ ID NO: 197252 - DNA, 25 bp, Rattus norvegicus
atggctaagatgtgtcttcccacct

SEQ ID NO: 197253 - DNA, 25 bp, Rattus norvegicus
atggctaagcatcacgtggcctgga

SEQ ID NO: 197254 - DNA, 25 bp, Rattus norvegicus
atggctaagcatgacgtggcctgga

SEQ ID NO: 197255 - DNA, 25 bp, Rattus norvegicus
atggctaagctgatgcagacactga

SEQ ID NO: 197256 - DNA, 25 bp, Rattus norvegicus
atggctaagctgttgcagacactga

SEQ ID NO: 197257 - DNA, 25 bp, Rattus norvegicus
atggctaagtacatcctcatggagt

SEQ ID NO: 197258 - DNA, 25 bp, Rattus norvegicus
atggctaagtacttcctcatggagt

SEQ ID NO: 197259 - DNA, 25 bp, Rattus norvegicus
atggctaatgggatagtgccctctt

SEQ ID NO: 197260 - DNA, 25 bp, Rattus norvegicus
atggctaatgggttagtgccctctt

SEQ ID NO: 197261 - DNA, 25 bp, Rattus norvegicus
atggctaattatcgccttgtcagca

SEQ ID NO: 197262 - DNA, 25 bp, Rattus norvegicus
atggctaattatggccttgtcagca

SEQ ID NO: 197263 - DNA, 25 bp, Rattus norvegicus
atggctacacttataattggcttta

SEQ ID NO: 197264 - DNA, 25 bp, Rattus norvegicus
atggctacacttttaattggcttta

SEQ ID NO: 197265 - DNA, 25 bp, Rattus norvegicus
atggctacagggattatttggtcaa

SEQ ID NO: 197266 - DNA, 25 bp, Rattus norvegicus
atggctacagggtttatttggtcaa

SEQ ID NO: 197267 - DNA, 25 bp, Rattus norvegicus
atggctacaggtcagcatttctcac

SEQ ID NO: 197268 - DNA, 25 bp, Rattus norvegicus
atggctacaggtgagcatttctcac

SEQ ID NO: 197269 - DNA, 25 bp, Rattus norvegicus
atggctacattgagacctctgggag

SEQ ID NO: 197270 - DNA, 25 bp, Rattus norvegicus
atggctacattgtgacctctgggag

SEQ ID NO: 197271 - DNA, 25 bp, Rattus norvegicus
atggctaccaaaagtccagtgtttt

SEQ ID NO: 197272 - DNA, 25 bp, Rattus norvegicus
atggctaccaaatgtccagtgtttt

SEQ ID NO: 197273 - DNA, 25 bp, Rattus norvegicus
atggctacccatctgtgctcaggac

SEQ ID NO: 197274 - DNA, 25 bp, Rattus norvegicus
atggctacccatgtgtgctcaggac

SEQ ID NO: 197275 - DNA, 25 bp, Rattus norvegicus
atggctaccgacatgtatccttgct

SEQ ID NO: 197276 - DNA, 25 bp, Rattus norvegicus
atggctaccgacttgtatccttgct

SEQ ID NO: 197277 - DNA, 25 bp, Rattus norvegicus
atggctaccgggaagtctaagggat

SEQ ID NO: 197278 - DNA, 25 bp, Rattus norvegicus
atggctaccgggtagtctaagggat

SEQ ID NO: 197279 - DNA, 25 bp, Rattus norvegicus
atggctacgatgaatcggattcttt

SEQ ID NO: 197280 - DNA, 25 bp, Rattus norvegicus
atggctacgatgtatcggattcttt

SEQ ID NO: 197281 - DNA, 25 bp, Rattus norvegicus
atggctacgccactttcttgagatt

SEQ ID NO: 197282 - DNA, 25 bp, Rattus norvegicus
atggctacgccagtttcttgagatt

SEQ ID NO: 197283 - DNA, 25 bp, Rattus norvegicus
atggctactgaaatccgacaggctt

SEQ ID NO: 197284 - DNA, 25 bp, Rattus norvegicus
atggctactgaattccgacaggctt

SEQ ID NO: 197285 - DNA, 25 bp, Rattus norvegicus
atggctagagccaccttaactggcc

SEQ ID NO: 197286 - DNA, 25 bp, Rattus norvegicus
atggctagagcctccttaactggcc

SEQ ID NO: 197287 - DNA, 25 bp, Rattus norvegicus
atggctagccagaggcctgtatctt

SEQ ID NO: 197288 - DNA, 25 bp, Rattus norvegicus
atggctagccagtggcctgtatctt

SEQ ID NO: 197289 - DNA, 25 bp, Rattus norvegicus
atggctagcttcacaaccttagctg

SEQ ID NO: 197290 - DNA, 25 bp, Rattus norvegicus
atggctagcttctcaaccttagctg

SEQ ID NO: 197291 - DNA, 25 bp, Rattus norvegicus
atggctaggatacttcctcaccgtt

SEQ ID NO: 197292 - DNA, 25 bp, Rattus norvegicus
atggctaggatagttcctcaccgtt

SEQ ID NO: 197293 - DNA, 25 bp, Rattus norvegicus
atggctaggtgtaggcctctgcagc

SEQ ID NO: 197294 - DNA, 25 bp, Rattus norvegicus
atggctaggtgttggcctctgcagc

SEQ ID NO: 197295 - DNA, 25 bp, Rattus norvegicus
atggctagtattattccactggact

SEQ ID NO: 197296 - DNA, 25 bp, Rattus norvegicus
atggctagtatttttccactggact

SEQ ID NO: 197297 - DNA, 25 bp, Rattus norvegicus
atggctatacatacttaacaggatc

SEQ ID NO: 197298 - DNA, 25 bp, Rattus norvegicus
atggctatacattcttaacaggatc

SEQ ID NO: 197299 - DNA, 25 bp, Rattus norvegicus
atggctatatccatggttgtcaata

SEQ ID NO: 197300 - DNA, 25 bp, Rattus norvegicus
atggctatatccttggttgtcaata

SEQ ID NO: 197301 - DNA, 25 bp, Rattus norvegicus
atggctatccatacagctttctgat

SEQ ID NO: 197302 - DNA, 25 bp, Rattus norvegicus
atggctatccattcagctttctgat

SEQ ID NO: 197303 - DNA, 25 bp, Rattus norvegicus
atggctatcctcacgatcattcttt

SEQ ID NO: 197304 - DNA, 25 bp, Rattus norvegicus
atggctatcctctcgatcattcttt

SEQ ID NO: 197305 - DNA, 25 bp, Rattus norvegicus
atggctatcttgaaagtgtgctgtc

SEQ ID NO: 197306 - DNA, 25 bp, Rattus norvegicus
atggctatcttgtaagtgtgctgtc

SEQ ID NO: 197307 - DNA, 25 bp, Rattus norvegicus
atggctatttataaaagggcagtca

SEQ ID NO: 197308 - DNA, 25 bp, Rattus norvegicus
atggctatttattaaagggcagtca

SEQ ID NO: 197309 - DNA, 25 bp, Rattus norvegicus
atggctatttcaacatccgaacttc

SEQ ID NO: 197310 - DNA, 25 bp, Rattus norvegicus
atggctatttcatcatccgaacttc

SEQ ID NO: 197311 - DNA, 25 bp, Rattus norvegicus
atggctcaacagctacaggcgtttg

SEQ ID NO: 197312 - DNA, 25 bp, Rattus norvegicus
atggctcaacaggtacaggcgtttg

SEQ ID NO: 197313 - DNA, 25 bp, Rattus norvegicus
atggctcaagaacctgtgaatgctt

SEQ ID NO: 197314 - DNA, 25 bp, Rattus norvegicus
atggctcaagaagctgtgaatgctt

SEQ ID NO: 197315 - DNA, 25 bp, Rattus norvegicus
atggctcacactcggcatggtatgg

SEQ ID NO: 197316 - DNA, 25 bp, Rattus norvegicus
atggctcacactgggcatggtatgg

SEQ ID NO: 197317 - DNA, 25 bp, Rattus norvegicus
atggctcacagaaagggacccacgt

SEQ ID NO: 197318 - DNA, 25 bp, Rattus norvegicus
atggctcacagatagggacccacgt

SEQ ID NO: 197319 - DNA, 25 bp, Rattus norvegicus
atggctcactgcacatatcctgaaa

SEQ ID NO: 197320 - DNA, 25 bp, Rattus norvegicus
atggctcactgctcatatcctgaaa

SEQ ID NO: 197321 - DNA, 25 bp, Rattus norvegicus
atggctcactgtactgtactttttt

SEQ ID NO: 197322 - DNA, 25 bp, Rattus norvegicus
atggctcactgttctgtactttttt

SEQ ID NO: 197323 - DNA, 25 bp, Rattus norvegicus
atggctcagactctgtggtttccgc

SEQ ID NO: 197324 - DNA, 25 bp, Rattus norvegicus
atggctcagactgtgtggtttccgc

SEQ ID NO: 197325 - DNA, 25 bp, Rattus norvegicus
atggctcagccaacgtctgttgaga

SEQ ID NO: 197326 - DNA, 25 bp, Rattus norvegicus
atggctcagccatcgtctgttgaga

SEQ ID NO: 197327 - DNA, 25 bp, Rattus norvegicus
atggctcagcttagcaaactcagtt

SEQ ID NO: 197328 - DNA, 25 bp, Rattus norvegicus
atggctcagctttgcaaactcagtt

SEQ ID NO: 197329 - DNA, 25 bp, Rattus norvegicus
atggctcaggagacaaaccgttccc

SEQ ID NO: 197330 - DNA, 25 bp, Rattus norvegicus
atggctcaggagatgctaccagcaa

SEQ ID NO: 197331 - DNA, 25 bp, Rattus norvegicus
atggctcaggagtcaaaccgttccc

SEQ ID NO: 197332 - DNA, 25 bp, Rattus norvegicus
atggctcaggagttgctaccagcaa

SEQ ID NO: 197333 - DNA, 25 bp, Rattus norvegicus
atggctcagggcactgtgggtctca

SEQ ID NO: 197334 - DNA, 25 bp, Rattus norvegicus
atggctcagggctctgtgggtctca

SEQ ID NO: 197335 - DNA, 25 bp, Rattus norvegicus
atggctcaggtcactgtgtgcagtg

SEQ ID NO: 197336 - DNA, 25 bp, Rattus norvegicus
atggctcaggtctctgtgtgcagtg

SEQ ID NO: 197337 - DNA, 25 bp, Rattus norvegicus
atggctcagtataggcctcctaggg

SEQ ID NO: 197338 - DNA, 25 bp, Rattus norvegicus
atggctcagtattggcctcctaggg

SEQ ID NO: 197339 - DNA, 25 bp, Rattus norvegicus
atggctcagtgaaagtggtgctttc

SEQ ID NO: 197340 - DNA, 25 bp, Rattus norvegicus
atggctcagtgatagtggtgctttc

SEQ ID NO: 197341 - DNA, 25 bp, Rattus norvegicus
atggctcagttgagtggaggtcaga

SEQ ID NO: 197342 - DNA, 25 bp, Rattus norvegicus
atggctcagttgataagacctccga

SEQ ID NO: 197343 - DNA, 25 bp, Rattus norvegicus
atggctcagttgtgtggaggtcaga

SEQ ID NO: 197344 - DNA, 25 bp, Rattus norvegicus
atggctcagttgttaagacctccga

SEQ ID NO: 197345 - DNA, 25 bp, Rattus norvegicus
atggctcatctaagtgaacactcag

SEQ ID NO: 197346 - DNA, 25 bp, Rattus norvegicus
atggctcatctatgtgaacactcag

SEQ ID NO: 197347 - DNA, 25 bp, Rattus norvegicus
atggctccaagacagttggcatggt

SEQ ID NO: 197348 - DNA, 25 bp, Rattus norvegicus
atggctccaagagagttggcatggt

SEQ ID NO: 197349 - DNA, 25 bp, Rattus norvegicus
atggctccaatgaattcactatgtt

SEQ ID NO: 197350 - DNA, 25 bp, Rattus norvegicus
atggctccaatgtattcactatgtt

SEQ ID NO: 197351 - DNA, 25 bp, Rattus norvegicus
atggctccacccattggtgaggctg

SEQ ID NO: 197352 - DNA, 25 bp, Rattus norvegicus
atggctccaccctttggtgaggctg

SEQ ID NO: 197353 - DNA, 25 bp, Rattus norvegicus
atggctccagacagacagggccttg

SEQ ID NO: 197354 - DNA, 25 bp, Rattus norvegicus
atggctccagactgacagggccttg

SEQ ID NO: 197355 - DNA, 25 bp, Rattus norvegicus
atggctccagccaggtaggttagac

SEQ ID NO: 197356 - DNA, 25 bp, Rattus norvegicus
atggctccagcctggtaggttagac

SEQ ID NO: 197357 - DNA, 25 bp, Rattus norvegicus
atggctccaggcctgatgttttatg

SEQ ID NO: 197358 - DNA, 25 bp, Rattus norvegicus
atggctccaggcgtgatgttttatg

SEQ ID NO: 197359 - DNA, 25 bp, Rattus norvegicus
atggctccagtcaagcctcagagag

SEQ ID NO: 197360 - DNA, 25 bp, Rattus norvegicus
atggctccagtctagcctcagagag

SEQ ID NO: 197361 - DNA, 25 bp, Rattus norvegicus
atggctcccattctgtgtgaggtaa

SEQ ID NO: 197362 - DNA, 25 bp, Rattus norvegicus
atggctcccattgtgtgtgaggtaa

SEQ ID NO: 197363 - DNA, 25 bp, Rattus norvegicus
atggctccccaacgaatctttcagg

SEQ ID NO: 197364 - DNA, 25 bp, Rattus norvegicus
atggctccccaaggaatctttcagg

SEQ ID NO: 197365 - DNA, 25 bp, Rattus norvegicus
atggctccctgcctttatagtcgta

SEQ ID NO: 197366 - DNA, 25 bp, Rattus norvegicus
atggctccctgcgtttatagtcgta

SEQ ID NO: 197367 - DNA, 25 bp, Rattus norvegicus
atggctcctgaccatactgtcgaag

SEQ ID NO: 197368 - DNA, 25 bp, Rattus norvegicus
atggctcctgacgatactgtcgaag

SEQ ID NO: 197369 - DNA, 25 bp, Rattus norvegicus
atggctcctgatcaattcacccaaa

SEQ ID NO: 197370 - DNA, 25 bp, Rattus norvegicus
atggctcctgatgaattcacccaaa

SEQ ID NO: 197371 - DNA, 25 bp, Rattus norvegicus
atggctcctgctctaggcaatcttt

SEQ ID NO: 197372 - DNA, 25 bp, Rattus norvegicus
atggctcctgctgtaggcaatcttt

SEQ ID NO: 197373 - DNA, 25 bp, Rattus norvegicus
atggctcggcagctaaaggtttgtc

SEQ ID NO: 197374 - DNA, 25 bp, Rattus norvegicus
atggctcggcaggtaaaggtttgtc

SEQ ID NO: 197375 - DNA, 25 bp, Rattus norvegicus
atggctcgggctagtgatggtcctt

SEQ ID NO: 197376 - DNA, 25 bp, Rattus norvegicus
atggctcgggcttgtgatggtcctt

SEQ ID NO: 197377 - DNA, 25 bp, Rattus norvegicus
atggctcggtttataagagcacata

SEQ ID NO: 197378 - DNA, 25 bp, Rattus norvegicus
atggctcggtttttaagagcacata

SEQ ID NO: 197379 - DNA, 25 bp, Rattus norvegicus
atggctctaaaacgtaacccctcat

SEQ ID NO: 197380 - DNA, 25 bp, Rattus norvegicus
atggctctaaaaggtaacccctcat

SEQ ID NO: 197381 - DNA, 25 bp, Rattus norvegicus
atggctctagcgattgacctacaga

SEQ ID NO: 197382 - DNA, 25 bp, Rattus norvegicus
atggctctagcgtttgacctacaga

SEQ ID NO: 197383 - DNA, 25 bp, Rattus norvegicus
atggctctcaccagtgactacagga

SEQ ID NO: 197384 - DNA, 25 bp, Rattus norvegicus
atggctctcacctgtgactacagga

SEQ ID NO: 197385 - DNA, 25 bp, Rattus norvegicus
atggctctcagaagtaggaccttca

SEQ ID NO: 197386 - DNA, 25 bp, Rattus norvegicus
atggctctcagatgtaggaccttca

SEQ ID NO: 197387 - DNA, 25 bp, Rattus norvegicus
atggctctccatagatcagtggttc

SEQ ID NO: 197388 - DNA, 25 bp, Rattus norvegicus
atggctctccattgatcagtggttc

SEQ ID NO: 197389 - DNA, 25 bp, Rattus norvegicus
atggctctcccacagggtacagatg

SEQ ID NO: 197390 - DNA, 25 bp, Rattus norvegicus
atggctctcccagagggtacagatg

SEQ ID NO: 197391 - DNA, 25 bp, Rattus norvegicus
atggctctccgacatccatctcgtg

SEQ ID NO: 197392 - DNA, 25 bp, Rattus norvegicus
atggctctccgagatccatctcgtg

SEQ ID NO: 197393 - DNA, 25 bp, Rattus norvegicus
atggctctcctcatgtatatatgtg

SEQ ID NO: 197394 - DNA, 25 bp, Rattus norvegicus
atggctctcctcttgtatatatgtg

SEQ ID NO: 197395 - DNA, 25 bp, Rattus norvegicus
atggctctcctgctttttaaagatg

SEQ ID NO: 197396 - DNA, 25 bp, Rattus norvegicus
atggctctcctggtttttaaagatg

SEQ ID NO: 197397 - DNA, 25 bp, Rattus norvegicus
atggctctcgacacagtggagactt

SEQ ID NO: 197398 - DNA, 25 bp, Rattus norvegicus
atggctctcgactcagtggagactt

SEQ ID NO: 197399 - DNA, 25 bp, Rattus norvegicus
atggctctctggaatggtccctttt

SEQ ID NO: 197400 - DNA, 25 bp, Rattus norvegicus
atggctctctggtatggtccctttt

SEQ ID NO: 197401 - DNA, 25 bp, Rattus norvegicus
atggctctgaacacactgtgagtgg

SEQ ID NO: 197402 - DNA, 25 bp, Rattus norvegicus
atggctctgaactcactgtgagtgg

SEQ ID NO: 197403 - DNA, 25 bp, Rattus norvegicus
atggctctgactcctatttatcatg

SEQ ID NO: 197404 - DNA, 25 bp, Rattus norvegicus
atggctctgactgctatttatcatg

SEQ ID NO: 197405 - DNA, 25 bp, Rattus norvegicus
atggctctgaggcagtcatctacct

SEQ ID NO: 197406 - DNA, 25 bp, Rattus norvegicus
atggctctgagggagtcatctacct

SEQ ID NO: 197407 - DNA, 25 bp, Rattus norvegicus
atggctctgcggagatccccaggta

SEQ ID NO: 197408 - DNA, 25 bp, Rattus norvegicus
atggctctgcggtgatccccaggta

SEQ ID NO: 197409 - DNA, 25 bp, Rattus norvegicus
atggctctgctgaaatctgtgactt

SEQ ID NO: 197410 - DNA, 25 bp, Rattus norvegicus
atggctctgctgtaatctgtgactt

SEQ ID NO: 197411 - DNA, 25 bp, Rattus norvegicus
atggctctgcttaattacaaatttc

SEQ ID NO: 197412 - DNA, 25 bp, Rattus norvegicus
atggctctgctttattacaaatttc

SEQ ID NO: 197413 - DNA, 25 bp, Rattus norvegicus
atggctctggagaagcaccctgtgc

SEQ ID NO: 197414 - DNA, 25 bp, Rattus norvegicus
atggctctggagtagcaccctgtgc

SEQ ID NO: 197415 - DNA, 25 bp, Rattus norvegicus
atggctctggctctgtcggtgcaca

SEQ ID NO: 197416 - DNA, 25 bp, Rattus norvegicus
atggctctggctgtgtcggtgcaca

SEQ ID NO: 197417 - DNA, 25 bp, Rattus norvegicus
atggctctggtgagcccctatcaca

SEQ ID NO: 197418 - DNA, 25 bp, Rattus norvegicus
atggctctggtgtgcccctatcaca

SEQ ID NO: 197419 - DNA, 25 bp, Rattus norvegicus
atggctctgtacaaaacactctacc

SEQ ID NO: 197420 - DNA, 25 bp, Rattus norvegicus
atggctctgtactaaacactctacc

SEQ ID NO: 197421 - DNA, 25 bp, Rattus norvegicus
atggctctgtgcacaggatcatctt

SEQ ID NO: 197422 - DNA, 25 bp, Rattus norvegicus
atggctctgtgcagtacctagtcga

SEQ ID NO: 197423 - DNA, 25 bp, Rattus norvegicus
atggctctgtgcctggacatagaaa

SEQ ID NO: 197424 - DNA, 25 bp, Rattus norvegicus
atggctctgtgcgtggacatagaaa

SEQ ID NO: 197425 - DNA, 25 bp, Rattus norvegicus
atggctctgtgctcaggatcatctt

SEQ ID NO: 197426 - DNA, 25 bp, Rattus norvegicus
atggctctgtgctgtacctagtcga

SEQ ID NO: 197427 - DNA, 25 bp, Rattus norvegicus
atggctctgtggatggttgttttga

SEQ ID NO: 197428 - DNA, 25 bp, Rattus norvegicus
atggctctgtggttggttgttttga

SEQ ID NO: 197429 - DNA, 25 bp, Rattus norvegicus
atggctcttaatccatctctgtctc

SEQ ID NO: 197430 - DNA, 25 bp, Rattus norvegicus
atggctcttaatgcatctctgtctc

SEQ ID NO: 197431 - DNA, 25 bp, Rattus norvegicus
atggctgaacagctgttgtctcctc

SEQ ID NO: 197432 - DNA, 25 bp, Rattus norvegicus
atggctgaacaggtgttgtctcctc

SEQ ID NO: 197433 - DNA, 25 bp, Rattus norvegicus
atggctgaagccatcagtgaccatt

SEQ ID NO: 197434 - DNA, 25 bp, Rattus norvegicus
atggctgaagccttcagtgaccatt

SEQ ID NO: 197435 - DNA, 25 bp, Rattus norvegicus
atggctgaaggaaaccagtgcaaca

SEQ ID NO: 197436 - DNA, 25 bp, Rattus norvegicus
atggctgaaggataccagtgcaaca

SEQ ID NO: 197437 - DNA, 25 bp, Rattus norvegicus
atggctgacactaacgctgtggtgc

SEQ ID NO: 197438 - DNA, 25 bp, Rattus norvegicus
atggctgacacttacgctgtggtgc

SEQ ID NO: 197439 - DNA, 25 bp, Rattus norvegicus
atggctgacagcctggcctctaagg

SEQ ID NO: 197440 - DNA, 25 bp, Rattus norvegicus
atggctgacagcgtggcctctaagg

SEQ ID NO: 197441 - DNA, 25 bp, Rattus norvegicus
atggctgaccctaagagaaccagag

SEQ ID NO: 197442 - DNA, 25 bp, Rattus norvegicus
atggctgacccttagagaaccagag

SEQ ID NO: 197443 - DNA, 25 bp, Rattus norvegicus
atggctgactcacacttgctggctt

SEQ ID NO: 197444 - DNA, 25 bp, Rattus norvegicus
atggctgactcacatcatttgtctg

SEQ ID NO: 197445 - DNA, 25 bp, Rattus norvegicus
atggctgactcagacttgctggctt

SEQ ID NO: 197446 - DNA, 25 bp, Rattus norvegicus
atggctgactcagatcatttgtctg

SEQ ID NO: 197447 - DNA, 25 bp, Rattus norvegicus
atggctgactgacttgtgtccttgg

SEQ ID NO: 197448 - DNA, 25 bp, Rattus norvegicus
atggctgactgagttgtgtccttgg

SEQ ID NO: 197449 - DNA, 25 bp, Rattus norvegicus
atggctgagggaagcctcttgccac

SEQ ID NO: 197450 - DNA, 25 bp, Rattus norvegicus
atggctgagggatgcctcttgccac

SEQ ID NO: 197451 - DNA, 25 bp, Rattus norvegicus
atggctgaggtgcacaggcttctta

SEQ ID NO: 197452 - DNA, 25 bp, Rattus norvegicus
atggctgaggtggacaggcttctta

SEQ ID NO: 197453 - DNA, 25 bp, Rattus norvegicus
atggctgagtatcgtagttgcacac

SEQ ID NO: 197454 - DNA, 25 bp, Rattus norvegicus
atggctgagtatggtagttgcacac

SEQ ID NO: 197455 - DNA, 25 bp, Rattus norvegicus
atggctgagtgccttcagtgacaca

SEQ ID NO: 197456 - DNA, 25 bp, Rattus norvegicus
atggctgagtgcgttcagtgacaca

SEQ ID NO: 197457 - DNA, 25 bp, Rattus norvegicus
atggctgagtgtctggaacccgctc

SEQ ID NO: 197458 - DNA, 25 bp, Rattus norvegicus
atggctgagtgtgtggaacccgctc

SEQ ID NO: 197459 - DNA, 25 bp, Rattus norvegicus
atggctgatcgaccacaagtacatc

SEQ ID NO: 197460 - DNA, 25 bp, Rattus norvegicus
atggctgatcgagcacaagtacatc

SEQ ID NO: 197461 - DNA, 25 bp, Rattus norvegicus
atggctgatctcatttttcattaac

SEQ ID NO: 197462 - DNA, 25 bp, Rattus norvegicus
atggctgatctcttttttcattaac

SEQ ID NO: 197463 - DNA, 25 bp, Rattus norvegicus
atggctgcacaacgcctatgaagga

SEQ ID NO: 197464 - DNA, 25 bp, Rattus norvegicus
atggctgcacaaggcctatgaagga

SEQ ID NO: 197465 - DNA, 25 bp, Rattus norvegicus
atggctgcactaatcctaatgcctt

SEQ ID NO: 197466 - DNA, 25 bp, Rattus norvegicus
atggctgcactattcctaatgcctt

SEQ ID NO: 197467 - DNA, 25 bp, Rattus norvegicus
atggctgcagccagtgtgacttccc

SEQ ID NO: 197468 - DNA, 25 bp, Rattus norvegicus
atggctgcagcctgtgtgacttccc

SEQ ID NO: 197469 - DNA, 25 bp, Rattus norvegicus
atggctgcagctaaaggctacttcc

SEQ ID NO: 197470 - DNA, 25 bp, Rattus norvegicus
atggctgcagcttaaggctacttcc

SEQ ID NO: 197471 - DNA, 25 bp, Rattus norvegicus
atggctgccacgcttacctgagtaa

SEQ ID NO: 197472 - DNA, 25 bp, Rattus norvegicus
atggctgccacggttacctgagtaa

SEQ ID NO: 197473 - DNA, 25 bp, Rattus norvegicus
atggctgccctcacaagtgttaact

SEQ ID NO: 197474 - DNA, 25 bp, Rattus norvegicus
atggctgccctccaaattgtctcaa

SEQ ID NO: 197475 - DNA, 25 bp, Rattus norvegicus
atggctgccctccagtatttagtgt

SEQ ID NO: 197476 - DNA, 25 bp, Rattus norvegicus
atggctgccctcgaaattgtctcaa

SEQ ID NO: 197477 - DNA, 25 bp, Rattus norvegicus
atggctgccctcgagtatttagtgt

SEQ ID NO: 197478 - DNA, 25 bp, Rattus norvegicus
atggctgccctctcaagtgttaact

SEQ ID NO: 197479 - DNA, 25 bp, Rattus norvegicus
atggctgcccttctgttgtgatctc

SEQ ID NO: 197480 - DNA, 25 bp, Rattus norvegicus
atggctgcccttgtgttgtgatctc

SEQ ID NO: 197481 - DNA, 25 bp, Rattus norvegicus
atggctgccgcccaggagagagcgg

SEQ ID NO: 197482 - DNA, 25 bp, Rattus norvegicus
atggctgccgccgaggagagagcgg

SEQ ID NO: 197483 - DNA, 25 bp, Rattus norvegicus
atggctgccgtcagcataatgactg

SEQ ID NO: 197484 - DNA, 25 bp, Rattus norvegicus
atggctgccgtctgcataatgactg

SEQ ID NO: 197485 - DNA, 25 bp, Rattus norvegicus
atggctgcctctagtcttctatttt

SEQ ID NO: 197486 - DNA, 25 bp, Rattus norvegicus
atggctgcctcttgtcttctatttt

SEQ ID NO: 197487 - DNA, 25 bp, Rattus norvegicus
atggctgccttaaaattttgtgtct

SEQ ID NO: 197488 - DNA, 25 bp, Rattus norvegicus
atggctgccttataattttgtgtct

SEQ ID NO: 197489 - DNA, 25 bp, Rattus norvegicus
atggctgccttgaacaaaatccgtt

SEQ ID NO: 197490 - DNA, 25 bp, Rattus norvegicus
atggctgccttgtacaaaatccgtt

SEQ ID NO: 197491 - DNA, 25 bp, Rattus norvegicus
atggctgcgtaccatctctgtgatc

SEQ ID NO: 197492 - DNA, 25 bp, Rattus norvegicus
atggctgcgtacgatctctgtgatc

SEQ ID NO: 197493 - DNA, 25 bp, Rattus norvegicus
atggctgctaacaacagtctgcaat

SEQ ID NO: 197494 - DNA, 25 bp, Rattus norvegicus
atggctgctaactacagtctgcaat

SEQ ID NO: 197495 - DNA, 25 bp, Rattus norvegicus
atggctgctagacgaggcctgtacc

SEQ ID NO: 197496 - DNA, 25 bp, Rattus norvegicus
atggctgctagaggaggcctgtacc

SEQ ID NO: 197497 - DNA, 25 bp, Rattus norvegicus
atggctgctatgactgcccaggaat

SEQ ID NO: 197498 - DNA, 25 bp, Rattus norvegicus
atggctgctatgattcccatgctgt

SEQ ID NO: 197499 - DNA, 25 bp, Rattus norvegicus
atggctgctatgtctgcccaggaat

SEQ ID NO: 197500 - DNA, 25 bp, Rattus norvegicus
atggctgctatgtttcccatgctgt

SEQ ID NO: 197501 - DNA, 25 bp, Rattus norvegicus
atggctgctcacaactattcttttt

SEQ ID NO: 197502 - DNA, 25 bp, Rattus norvegicus
atggctgctcacactcaagggctcg

SEQ ID NO: 197503 - DNA, 25 bp, Rattus norvegicus
atggctgctcactactattcttttt

SEQ ID NO: 197504 - DNA, 25 bp, Rattus norvegicus
atggctgctcactctcaagggctcg

SEQ ID NO: 197505 - DNA, 25 bp, Rattus norvegicus
atggctgctcctagactgtcatcat

SEQ ID NO: 197506 - DNA, 25 bp, Rattus norvegicus
atggctgctccttgactgtcatcat

SEQ ID NO: 197507 - DNA, 25 bp, Rattus norvegicus
atggctgctctcacatggctgaaag

SEQ ID NO: 197508 - DNA, 25 bp, Rattus norvegicus
atggctgctctctcatggctgaaag

SEQ ID NO: 197509 - DNA, 25 bp, Rattus norvegicus
atggctgctgagacacagacagaac

SEQ ID NO: 197510 - DNA, 25 bp, Rattus norvegicus
atggctgctgagtcacagacagaac

SEQ ID NO: 197511 - DNA, 25 bp, Rattus norvegicus
atggctgctgcaaggaactggctag

SEQ ID NO: 197512 - DNA, 25 bp, Rattus norvegicus
atggctgctgcatggaactggctag

SEQ ID NO: 197513 - DNA, 25 bp, Rattus norvegicus
atggctgctgccacaggtgacatgc

SEQ ID NO: 197514 - DNA, 25 bp, Rattus norvegicus
atggctgctgcctcaggtgacatgc

SEQ ID NO: 197515 - DNA, 25 bp, Rattus norvegicus
atggctgctggacactgaaactctt

SEQ ID NO: 197516 - DNA, 25 bp, Rattus norvegicus
atggctgctggacatggtcacgaac

SEQ ID NO: 197517 - DNA, 25 bp, Rattus norvegicus
atggctgctggagactgaaactctt

SEQ ID NO: 197518 - DNA, 25 bp, Rattus norvegicus
atggctgctggagatggtcacgaac

SEQ ID NO: 197519 - DNA, 25 bp, Rattus norvegicus
atggctgctgtgaccctgctgacca

SEQ ID NO: 197520 - DNA, 25 bp, Rattus norvegicus
atggctgctgtgagcaacttccgcg

SEQ ID NO: 197521 - DNA, 25 bp, Rattus norvegicus
atggctgctgtgattctagaaatca

SEQ ID NO: 197522 - DNA, 25 bp, Rattus norvegicus
atggctgctgtgtccctgctgacca

SEQ ID NO: 197523 - DNA, 25 bp, Rattus norvegicus
atggctgctgtgtgcaacttccgcg

SEQ ID NO: 197524 - DNA, 25 bp, Rattus norvegicus
atggctgctgtgtttctagaaatca

SEQ ID NO: 197525 - DNA, 25 bp, Rattus norvegicus
atggctgcttacagtacagggctaa

SEQ ID NO: 197526 - DNA, 25 bp, Rattus norvegicus
atggctgcttactgtacagggctaa

SEQ ID NO: 197527 - DNA, 25 bp, Rattus norvegicus
atggctgctttaattgcatctccag

SEQ ID NO: 197528 - DNA, 25 bp, Rattus norvegicus
atggctgctttatttgcatctccag

SEQ ID NO: 197529 - DNA, 25 bp, Rattus norvegicus
atggctggaaggacacacaagggcg

SEQ ID NO: 197530 - DNA, 25 bp, Rattus norvegicus
atggctggaaggtcacacaagggcg

SEQ ID NO: 197531 - DNA, 25 bp, Rattus norvegicus
atggctggacacctacacttctaag

SEQ ID NO: 197532 - DNA, 25 bp, Rattus norvegicus
atggctggacacgtacacttctaag

SEQ ID NO: 197533 - DNA, 25 bp, Rattus norvegicus
atggctggacatcgccccaataaat

SEQ ID NO: 197534 - DNA, 25 bp, Rattus norvegicus
atggctggacatctgcaatcgtgag

SEQ ID NO: 197535 - DNA, 25 bp, Rattus norvegicus
atggctggacatggccccaataaat

SEQ ID NO: 197536 - DNA, 25 bp, Rattus norvegicus
atggctggacatgtgcaatcgtgag

SEQ ID NO: 197537 - DNA, 25 bp, Rattus norvegicus
atggctggacttaaaacggtctcac

SEQ ID NO: 197538 - DNA, 25 bp, Rattus norvegicus
atggctggactttaaacggtctcac

SEQ ID NO: 197539 - DNA, 25 bp, Rattus norvegicus
atggctggcatccttgcttatacag

SEQ ID NO: 197540 - DNA, 25 bp, Rattus norvegicus
atggctggcatcgttgcttatacag

SEQ ID NO: 197541 - DNA, 25 bp, Rattus norvegicus
atggctggcgccaacctagaaagaa

SEQ ID NO: 197542 - DNA, 25 bp, Rattus norvegicus
atggctggcgcctacctagaaagaa

SEQ ID NO: 197543 - DNA, 25 bp, Rattus norvegicus
atggctggctacaaagtcacccaaa

SEQ ID NO: 197544 - DNA, 25 bp, Rattus norvegicus
atggctggctactaagtcacccaaa

SEQ ID NO: 197545 - DNA, 25 bp, Rattus norvegicus
atggctggctatccctgaacccaat

SEQ ID NO: 197546 - DNA, 25 bp, Rattus norvegicus
atggctggctatgcctgaacccaat

SEQ ID NO: 197547 - DNA, 25 bp, Rattus norvegicus
atggctggcttacatcacccaagat

SEQ ID NO: 197548 - DNA, 25 bp, Rattus norvegicus
atggctggcttagatcacccaagat

SEQ ID NO: 197549 - DNA, 25 bp, Rattus norvegicus
atggctggtcacatttggtcagtac

SEQ ID NO: 197550 - DNA, 25 bp, Rattus norvegicus
atggctggtcacttttggtcagtac

SEQ ID NO: 197551 - DNA, 25 bp, Rattus norvegicus
atggctggtgtacactttcctccct

SEQ ID NO: 197552 - DNA, 25 bp, Rattus norvegicus
atggctggtgtagactttcctccct

SEQ ID NO: 197553 - DNA, 25 bp, Rattus norvegicus
atggctggttgcacagcagggttcc

SEQ ID NO: 197554 - DNA, 25 bp, Rattus norvegicus
atggctggttgctcagcagggttcc

SEQ ID NO: 197555 - DNA, 25 bp, Rattus norvegicus
atggctggttttagttctttcctct

SEQ ID NO: 197556 - DNA, 25 bp, Rattus norvegicus
atggctggtttttgttctttcctct

SEQ ID NO: 197557 - DNA, 25 bp, Rattus norvegicus
atggctgtaactcgagatgaaactg

SEQ ID NO: 197558 - DNA, 25 bp, Rattus norvegicus
atggctgtaactggagatgaaactg

SEQ ID NO: 197559 - DNA, 25 bp, Rattus norvegicus
atggctgtacagaggtccgtggaat

SEQ ID NO: 197560 - DNA, 25 bp, Rattus norvegicus
atggctgtacagtggtccgtggaat

SEQ ID NO: 197561 - DNA, 25 bp, Rattus norvegicus
atggctgtacatctgtgtgtcacat

SEQ ID NO: 197562 - DNA, 25 bp, Rattus norvegicus
atggctgtacatgtgtgtgtcacat

SEQ ID NO: 197563 - DNA, 25 bp, Rattus norvegicus
atggctgtaccgagaacttcaatca

SEQ ID NO: 197564 - DNA, 25 bp, Rattus norvegicus
atggctgtaccgtgaacttcaatca

SEQ ID NO: 197565 - DNA, 25 bp, Rattus norvegicus
atggctgtagccctctaggtttttt

SEQ ID NO: 197566 - DNA, 25 bp, Rattus norvegicus
atggctgtagccgtctaggtttttt

SEQ ID NO: 197567 - DNA, 25 bp, Rattus norvegicus
atggctgtaggtcttactcgctcta

SEQ ID NO: 197568 - DNA, 25 bp, Rattus norvegicus
atggctgtaggtgttactcgctcta

SEQ ID NO: 197569 - DNA, 25 bp, Rattus norvegicus
atggctgtatccatactggcctggc

SEQ ID NO: 197570 - DNA, 25 bp, Rattus norvegicus
atggctgtatccttactggcctggc

SEQ ID NO: 197571 - DNA, 25 bp, Rattus norvegicus
atggctgtcactctatgctgtgtag

SEQ ID NO: 197572 - DNA, 25 bp, Rattus norvegicus
atggctgtcactgtatgctgtgtag

SEQ ID NO: 197573 - DNA, 25 bp, Rattus norvegicus
atggctgtcaggattctcatcatga

SEQ ID NO: 197574 - DNA, 25 bp, Rattus norvegicus
atggctgtcaggtttctcatcatga

SEQ ID NO: 197575 - DNA, 25 bp, Rattus norvegicus
atggctgtcatgctatccctgctga

SEQ ID NO: 197576 - DNA, 25 bp, Rattus norvegicus
atggctgtcatggtatccctgctga

SEQ ID NO: 197577 - DNA, 25 bp, Rattus norvegicus
atggctgtcattatgtttcgctgag

SEQ ID NO: 197578 - DNA, 25 bp, Rattus norvegicus
atggctgtcattttgtttcgctgag

SEQ ID NO: 197579 - DNA, 25 bp, Rattus norvegicus
atggctgtcctgagactggatgctt

SEQ ID NO: 197580 - DNA, 25 bp, Rattus norvegicus
atggctgtcctgatcatagcttggt

SEQ ID NO: 197581 - DNA, 25 bp, Rattus norvegicus
atggctgtcctgtgactggatgctt

SEQ ID NO: 197582 - DNA, 25 bp, Rattus norvegicus
atggctgtcctgttcatagcttggt

SEQ ID NO: 197583 - DNA, 25 bp, Rattus norvegicus
atggctgtccttagagaggcccgac

SEQ ID NO: 197584 - DNA, 25 bp, Rattus norvegicus
atggctgtcctttgagaggcccgac

SEQ ID NO: 197585 - DNA, 25 bp, Rattus norvegicus
atggctgtgaggacacgtgacttca

SEQ ID NO: 197586 - DNA, 25 bp, Rattus norvegicus
atggctgtgaggtcacgtgacttca

SEQ ID NO: 197587 - DNA, 25 bp, Rattus norvegicus
atggctgtgatcctatcatgcctga

SEQ ID NO: 197588 - DNA, 25 bp, Rattus norvegicus
atggctgtgatcgtatcatgcctga

SEQ ID NO: 197589 - DNA, 25 bp, Rattus norvegicus
atggctgtgcctacttggtggacga

SEQ ID NO: 197590 - DNA, 25 bp, Rattus norvegicus
atggctgtgccttcttggtggacga

SEQ ID NO: 197591 - DNA, 25 bp, Rattus norvegicus
atggctgtggataagcactgctgct

SEQ ID NO: 197592 - DNA, 25 bp, Rattus norvegicus
atggctgtggattagcactgctgct

SEQ ID NO: 197593 - DNA, 25 bp, Rattus norvegicus
atggctgtggccctaaagagcagaa

SEQ ID NO: 197594 - DNA, 25 bp, Rattus norvegicus
atggctgtggcccttcaggactacg

SEQ ID NO: 197595 - DNA, 25 bp, Rattus norvegicus
atggctgtggccgtaaagagcagaa

SEQ ID NO: 197596 - DNA, 25 bp, Rattus norvegicus
atggctgtggccgttcaggactacg

SEQ ID NO: 197597 - DNA, 25 bp, Rattus norvegicus
atggctgtgtcaccatcgtccagag

SEQ ID NO: 197598 - DNA, 25 bp, Rattus norvegicus
atggctgtgtcagcatcgtccagag

SEQ ID NO: 197599 - DNA, 25 bp, Rattus norvegicus
atggctgtgtctcttctcatcgtgc

SEQ ID NO: 197600 - DNA, 25 bp, Rattus norvegicus
atggctgtgtctgttctcatcgtgc

SEQ ID NO: 197601 - DNA, 25 bp, Rattus norvegicus
atggctgtgtgaaagctgctgcccg

SEQ ID NO: 197602 - DNA, 25 bp, Rattus norvegicus
atggctgtgtgatagctgctgcccg

SEQ ID NO: 197603 - DNA, 25 bp, Rattus norvegicus
atggctgttactatcaatggactga

SEQ ID NO: 197604 - DNA, 25 bp, Rattus norvegicus
atggctgttactttcaatggactga

SEQ ID NO: 197605 - DNA, 25 bp, Rattus norvegicus
atggctgttatccatgcaccatgtg

SEQ ID NO: 197606 - DNA, 25 bp, Rattus norvegicus
atggctgttatcgatgcaccatgtg

SEQ ID NO: 197607 - DNA, 25 bp, Rattus norvegicus
atggctgttctcatttcagttctga

SEQ ID NO: 197608 - DNA, 25 bp, Rattus norvegicus
atggctgttctcttttcagttctga

SEQ ID NO: 197609 - DNA, 25 bp, Rattus norvegicus
atggctgttgagctcaacatcccta

SEQ ID NO: 197610 - DNA, 25 bp, Rattus norvegicus
atggctgttgaggtcaacatcccta

SEQ ID NO: 197611 - DNA, 25 bp, Rattus norvegicus
atggctgtttagagacaggctctca

SEQ ID NO: 197612 - DNA, 25 bp, Rattus norvegicus
atggctgtttagtgacaggctctca

SEQ ID NO: 197613 - DNA, 25 bp, Rattus norvegicus
atggctgtttctcccaagtagtagc

SEQ ID NO: 197614 - DNA, 25 bp, Rattus norvegicus
atggctgtttctgccaagtagtagc

SEQ ID NO: 197615 - DNA, 25 bp, Rattus norvegicus
atggctgtttgcctgaatacaccgt

SEQ ID NO: 197616 - DNA, 25 bp, Rattus norvegicus
atggctgtttgcgtgaatacaccgt

SEQ ID NO: 197617 - DNA, 25 bp, Rattus norvegicus
atggctgtttgtacatctgtccctc

SEQ ID NO: 197618 - DNA, 25 bp, Rattus norvegicus
atggctgtttgttcatctgtccctc

SEQ ID NO: 197619 - DNA, 25 bp, Rattus norvegicus
atggctgttttcattcactgctgta

SEQ ID NO: 197620 - DNA, 25 bp, Rattus norvegicus
atggctgttttctttcactgctgta

SEQ ID NO: 197621 - DNA, 25 bp, Rattus norvegicus
atggcttaaccaaggactttaccct

SEQ ID NO: 197622 - DNA, 25 bp, Rattus norvegicus
atggcttaaccatggactttaccct

SEQ ID NO: 197623 - DNA, 25 bp, Rattus norvegicus
atggcttaatcgcactctccagagg

SEQ ID NO: 197624 - DNA, 25 bp, Rattus norvegicus
atggcttaatcggactctccagagg

SEQ ID NO: 197625 - DNA, 25 bp, Rattus norvegicus
atggcttacaggctgctcaggagca

SEQ ID NO: 197626 - DNA, 25 bp, Rattus norvegicus
atggcttacagggtgctcaggagca

SEQ ID NO: 197627 - DNA, 25 bp, Rattus norvegicus
atggcttaccatactcagatgatgc

SEQ ID NO: 197628 - DNA, 25 bp, Rattus norvegicus
atggcttaccattctcagatgatgc

SEQ ID NO: 197629 - DNA, 25 bp, Rattus norvegicus
atggcttacttgactatccaacacc

SEQ ID NO: 197630 - DNA, 25 bp, Rattus norvegicus
atggcttacttgtctatccaacacc

SEQ ID NO: 197631 - DNA, 25 bp, Rattus norvegicus
atggcttagagcctggatcaaacta

SEQ ID NO: 197632 - DNA, 25 bp, Rattus norvegicus
atggcttagagcgtggatcaaacta

SEQ ID NO: 197633 - DNA, 25 bp, Rattus norvegicus
atggcttagtagcatggcaaaggcc

SEQ ID NO: 197634 - DNA, 25 bp, Rattus norvegicus
atggcttagtaggatggcaaaggcc

SEQ ID NO: 197635 - DNA, 25 bp, Rattus norvegicus
atggcttatcagatgctgctgctcc

SEQ ID NO: 197636 - DNA, 25 bp, Rattus norvegicus
atggcttatcagttgctgctgctcc

SEQ ID NO: 197637 - DNA, 25 bp, Rattus norvegicus
atggcttatccgacatggcctctgc

SEQ ID NO: 197638 - DNA, 25 bp, Rattus norvegicus
atggcttatccgtcatggcctctgc

SEQ ID NO: 197639 - DNA, 25 bp, Rattus norvegicus
atggcttattacatcaaccaccctc

SEQ ID NO: 197640 - DNA, 25 bp, Rattus norvegicus
atggcttattacttcaaccaccctc

SEQ ID NO: 197641 - DNA, 25 bp, Rattus norvegicus
atggcttcaacaatccacaagtgac

SEQ ID NO: 197642 - DNA, 25 bp, Rattus norvegicus
atggcttcaacattccacaagtgac

SEQ ID NO: 197643 - DNA, 25 bp, Rattus norvegicus
atggcttcaagtacctagctgatga

SEQ ID NO: 197644 - DNA, 25 bp, Rattus norvegicus
atggcttcaagttcctagctgatga

SEQ ID NO: 197645 - DNA, 25 bp, Rattus norvegicus
atggcttcacagatatattgctagt

SEQ ID NO: 197646 - DNA, 25 bp, Rattus norvegicus
atggcttcacagttatattgctagt

SEQ ID NO: 197647 - DNA, 25 bp, Rattus norvegicus
atggcttcacatcgcatgaggaggt

SEQ ID NO: 197648 - DNA, 25 bp, Rattus norvegicus
atggcttcacatggcatgaggaggt

SEQ ID NO: 197649 - DNA, 25 bp, Rattus norvegicus
atggcttccaagaccagctagaatc

SEQ ID NO: 197650 - DNA, 25 bp, Rattus norvegicus
atggcttccaagtccagctagaatc

SEQ ID NO: 197651 - DNA, 25 bp, Rattus norvegicus
atggcttccacgaacttgtagtccg

SEQ ID NO: 197652 - DNA, 25 bp, Rattus norvegicus
atggcttccacgtacttgtagtccg

SEQ ID NO: 197653 - DNA, 25 bp, Rattus norvegicus
atggcttccactaccaagctaaagg

SEQ ID NO: 197654 - DNA, 25 bp, Rattus norvegicus
atggcttccacttccaagctaaagg

SEQ ID NO: 197655 - DNA, 25 bp, Rattus norvegicus
atggcttccagcctgacatggtgtt

SEQ ID NO: 197656 - DNA, 25 bp, Rattus norvegicus
atggcttccagcgtgacatggtgtt

SEQ ID NO: 197657 - DNA, 25 bp, Rattus norvegicus
atggcttcctacatcggcacaagat

SEQ ID NO: 197658 - DNA, 25 bp, Rattus norvegicus
atggcttcctacttcggcacaagat

SEQ ID NO: 197659 - DNA, 25 bp, Rattus norvegicus
atggcttcctcccaaggcacagaga

SEQ ID NO: 197660 - DNA, 25 bp, Rattus norvegicus
atggcttcctccgaaggcacagaga

SEQ ID NO: 197661 - DNA, 25 bp, Rattus norvegicus
atggcttccttaaatgctcactgta

SEQ ID NO: 197662 - DNA, 25 bp, Rattus norvegicus
atggcttccttatatgctcactgta

SEQ ID NO: 197663 - DNA, 25 bp, Rattus norvegicus
atggcttccttcaagatcctggctg

SEQ ID NO: 197664 - DNA, 25 bp, Rattus norvegicus
atggcttccttctagatcctggctg

SEQ ID NO: 197665 - DNA, 25 bp, Rattus norvegicus
atggcttcgggtattaatgtgctgt

SEQ ID NO: 197666 - DNA, 25 bp, Rattus norvegicus
atggcttcgggtcgttcctcggact

SEQ ID NO: 197667 - DNA, 25 bp, Rattus norvegicus
atggcttcgggtggttcctcggact

SEQ ID NO: 197668 - DNA, 25 bp, Rattus norvegicus
atggcttcgggttttaatgtgctgt

SEQ ID NO: 197669 - DNA, 25 bp, Rattus norvegicus
atggcttcgtgacttgtcattgtca

SEQ ID NO: 197670 - DNA, 25 bp, Rattus norvegicus
atggcttcgtgagttgtcattgtca

SEQ ID NO: 197671 - DNA, 25 bp, Rattus norvegicus
atggcttctaaaatggctcagcagt

SEQ ID NO: 197672 - DNA, 25 bp, Rattus norvegicus
atggcttctaaattggctcagcagt

SEQ ID NO: 197673 - DNA, 25 bp, Rattus norvegicus
atggcttctactcacaggtgctggt

SEQ ID NO: 197674 - DNA, 25 bp, Rattus norvegicus
atggcttctactgacaggtgctggt

SEQ ID NO: 197675 - DNA, 25 bp, Rattus norvegicus
atggcttctagtacaatctgttcag

SEQ ID NO: 197676 - DNA, 25 bp, Rattus norvegicus
atggcttctagttcaatctgttcag

SEQ ID NO: 197677 - DNA, 25 bp, Rattus norvegicus
atggcttctattcaagttgtttcac

SEQ ID NO: 197678 - DNA, 25 bp, Rattus norvegicus
atggcttctattgaagttgtttcac

SEQ ID NO: 197679 - DNA, 25 bp, Rattus norvegicus
atggcttctcacaagaccttcagaa

SEQ ID NO: 197680 - DNA, 25 bp, Rattus norvegicus
atggcttctcacctgacagggagaa

SEQ ID NO: 197681 - DNA, 25 bp, Rattus norvegicus
atggcttctcacgtgacagggagaa

SEQ ID NO: 197682 - DNA, 25 bp, Rattus norvegicus
atggcttctcactagaccttcagaa

SEQ ID NO: 197683 - DNA, 25 bp, Rattus norvegicus
atggcttctcagagttgtagcccag

SEQ ID NO: 197684 - DNA, 25 bp, Rattus norvegicus
atggcttctcagtgttgtagcccag

SEQ ID NO: 197685 - DNA, 25 bp, Rattus norvegicus
atggcttctcatatcacttctgaat

SEQ ID NO: 197686 - DNA, 25 bp, Rattus norvegicus
atggcttctcatatttaagtctcct

SEQ ID NO: 197687 - DNA, 25 bp, Rattus norvegicus
atggcttctcatttcacttctgaat

SEQ ID NO: 197688 - DNA, 25 bp, Rattus norvegicus
atggcttctcatttttaagtctcct

SEQ ID NO: 197689 - DNA, 25 bp, Rattus norvegicus
atggcttctcgtctacctctgacga

SEQ ID NO: 197690 - DNA, 25 bp, Rattus norvegicus
atggcttctcgtgtacctctgacga

SEQ ID NO: 197691 - DNA, 25 bp, Rattus norvegicus
atggcttctgagatttgtgttgctg

SEQ ID NO: 197692 - DNA, 25 bp, Rattus norvegicus
atggcttctgagttttgtgttgctg

SEQ ID NO: 197693 - DNA, 25 bp, Rattus norvegicus
atggcttctgcaaaacctcttgtct

SEQ ID NO: 197694 - DNA, 25 bp, Rattus norvegicus
atggcttctgcataacctcttgtct

SEQ ID NO: 197695 - DNA, 25 bp, Rattus norvegicus
atggcttctgggataaggtgaacct

SEQ ID NO: 197696 - DNA, 25 bp, Rattus norvegicus
atggcttctgggttaaggtgaacct

SEQ ID NO: 197697 - DNA, 25 bp, Rattus norvegicus
atggcttctttgctgtgtctgacag

SEQ ID NO: 197698 - DNA, 25 bp, Rattus norvegicus
atggcttctttggtgtgtctgacag

SEQ ID NO: 197699 - DNA, 25 bp, Rattus norvegicus
atggcttgaatccaccagacctaga

SEQ ID NO: 197700 - DNA, 25 bp, Rattus norvegicus
atggcttgaatcgaccagacctaga

SEQ ID NO: 197701 - DNA, 25 bp, Rattus norvegicus
atggcttgaccaagcatcacttgga

SEQ ID NO: 197702 - DNA, 25 bp, Rattus norvegicus
atggcttgaccatgcatcacttgga

SEQ ID NO: 197703 - DNA, 25 bp, Rattus norvegicus
atggcttgacgtacccagagcttag

SEQ ID NO: 197704 - DNA, 25 bp, Rattus norvegicus
atggcttgacgttcccagagcttag

SEQ ID NO: 197705 - DNA, 25 bp, Rattus norvegicus
atggcttgactcaaagtagctgaac

SEQ ID NO: 197706 - DNA, 25 bp, Rattus norvegicus
atggcttgactctaagtagctgaac

SEQ ID NO: 197707 - DNA, 25 bp, Rattus norvegicus
atggcttgactgaatccttcttggc

SEQ ID NO: 197708 - DNA, 25 bp, Rattus norvegicus
atggcttgactgtatccttcttggc

SEQ ID NO: 197709 - DNA, 25 bp, Rattus norvegicus
atggcttgcagtattctaagtcccc

SEQ ID NO: 197710 - DNA, 25 bp, Rattus norvegicus
atggcttgcagttttctaagtcccc

SEQ ID NO: 197711 - DNA, 25 bp, Rattus norvegicus
atggcttgctcaagataggcaccct

SEQ ID NO: 197712 - DNA, 25 bp, Rattus norvegicus
atggcttgctcatgataggcaccct

SEQ ID NO: 197713 - DNA, 25 bp, Rattus norvegicus
atggcttgctgacctttgagctgaa

SEQ ID NO: 197714 - DNA, 25 bp, Rattus norvegicus
atggcttgctgagctttgagctgaa

SEQ ID NO: 197715 - DNA, 25 bp, Rattus norvegicus
atggcttggagcctggacttctgtc

SEQ ID NO: 197716 - DNA, 25 bp, Rattus norvegicus
atggcttggagcgtggacttctgtc

SEQ ID NO: 197717 - DNA, 25 bp, Rattus norvegicus
atggcttggccacatttgttacttc

SEQ ID NO: 197718 - DNA, 25 bp, Rattus norvegicus
atggcttggccagatttgttacttc

SEQ ID NO: 197719 - DNA, 25 bp, Rattus norvegicus
atggcttgggtgaatcctgtaacct

SEQ ID NO: 197720 - DNA, 25 bp, Rattus norvegicus
atggcttgggtgtatcctgtaacct

SEQ ID NO: 197721 - DNA, 25 bp, Rattus norvegicus
atggcttggtccaggtgccagaaaa

SEQ ID NO: 197722 - DNA, 25 bp, Rattus norvegicus
atggcttggtcctggtgccagaaaa

SEQ ID NO: 197723 - DNA, 25 bp, Rattus norvegicus
atggcttgtaccagtaatcacagct

SEQ ID NO: 197724 - DNA, 25 bp, Rattus norvegicus
atggcttgtacctgtaatcacagct

SEQ ID NO: 197725 - DNA, 25 bp, Rattus norvegicus
atggcttgtgccatgggctccactg

SEQ ID NO: 197726 - DNA, 25 bp, Rattus norvegicus
atggcttgtgccttgggctccactg

SEQ ID NO: 197727 - DNA, 25 bp, Rattus norvegicus
atggcttgttacactatttagttga

SEQ ID NO: 197728 - DNA, 25 bp, Rattus norvegicus
atggcttgttactctatttagttga

SEQ ID NO: 197729 - DNA, 25 bp, Rattus norvegicus
atggctttaaaacctgctgcagctg

SEQ ID NO: 197730 - DNA, 25 bp, Rattus norvegicus
atggctttaaaagctgctgcagctg

SEQ ID NO: 197731 - DNA, 25 bp, Rattus norvegicus
atggctttaagcactcaagtcactg

SEQ ID NO: 197732 - DNA, 25 bp, Rattus norvegicus
atggctttaagctctcaagtcactg

SEQ ID NO: 197733 - DNA, 25 bp, Rattus norvegicus
atggctttacgtcatgcacgtttca

SEQ ID NO: 197734 - DNA, 25 bp, Rattus norvegicus
atggctttacgtgatgcacgtttca

SEQ ID NO: 197735 - DNA, 25 bp, Rattus norvegicus
atggctttagctatgttggacttct

SEQ ID NO: 197736 - DNA, 25 bp, Rattus norvegicus
atggctttagctttgttggacttct

SEQ ID NO: 197737 - DNA, 25 bp, Rattus norvegicus
atggctttatgtcgcctgaaattgt

SEQ ID NO: 197738 - DNA, 25 bp, Rattus norvegicus
atggctttatgtggcctgaaattgt

SEQ ID NO: 197739 - DNA, 25 bp, Rattus norvegicus
atggctttcagaatgagaaactttc

SEQ ID NO: 197740 - DNA, 25 bp, Rattus norvegicus
atggctttcagattgagaaactttc

SEQ ID NO: 197741 - DNA, 25 bp, Rattus norvegicus
atggctttcagcactatcagagtga

SEQ ID NO: 197742 - DNA, 25 bp, Rattus norvegicus
atggctttcagctctatcagagtga

SEQ ID NO: 197743 - DNA, 25 bp, Rattus norvegicus
atggctttcattaacatgggctttg

SEQ ID NO: 197744 - DNA, 25 bp, Rattus norvegicus
atggctttcatttacatgggctttg

SEQ ID NO: 197745 - DNA, 25 bp, Rattus norvegicus
atggctttccatcgctttagctgtg

SEQ ID NO: 197746 - DNA, 25 bp, Rattus norvegicus
atggctttccatggctttagctgtg

SEQ ID NO: 197747 - DNA, 25 bp, Rattus norvegicus
atggctttcccaacaatgacactgt

SEQ ID NO: 197748 - DNA, 25 bp, Rattus norvegicus
atggctttcccacttgagcagttgc

SEQ ID NO: 197749 - DNA, 25 bp, Rattus norvegicus
atggctttcccagttgagcagttgc

SEQ ID NO: 197750 - DNA, 25 bp, Rattus norvegicus
atggctttcccatcaatgacactgt

SEQ ID NO: 197751 - DNA, 25 bp, Rattus norvegicus
atggctttccccacaggtcctcatt

SEQ ID NO: 197752 - DNA, 25 bp, Rattus norvegicus
atggctttcccctcaggtcctcatt

SEQ ID NO: 197753 - DNA, 25 bp, Rattus norvegicus
atggctttcccgctccttgcatcaa

SEQ ID NO: 197754 - DNA, 25 bp, Rattus norvegicus
atggctttcccggtccttgcatcaa

SEQ ID NO: 197755 - DNA, 25 bp, Rattus norvegicus
atggctttcgatacctgctggccca

SEQ ID NO: 197756 - DNA, 25 bp, Rattus norvegicus
atggctttcgattcctgctggccca

SEQ ID NO: 197757 - DNA, 25 bp, Rattus norvegicus
atggctttctaaaatgcattattca

SEQ ID NO: 197758 - DNA, 25 bp, Rattus norvegicus
atggctttctaaacggtaccaaccg

SEQ ID NO: 197759 - DNA, 25 bp, Rattus norvegicus
atggctttctaatatgcattattca

SEQ ID NO: 197760 - DNA, 25 bp, Rattus norvegicus
atggctttctaatcggtaccaaccg

SEQ ID NO: 197761 - DNA, 25 bp, Rattus norvegicus
atggctttgcatactaaagacacta

SEQ ID NO: 197762 - DNA, 25 bp, Rattus norvegicus
atggctttgcattctaaagacacta

SEQ ID NO: 197763 - DNA, 25 bp, Rattus norvegicus
atggctttgccgatgtatttaccaa

SEQ ID NO: 197764 - DNA, 25 bp, Rattus norvegicus
atggctttgccgttgtatttaccaa

SEQ ID NO: 197765 - DNA, 25 bp, Rattus norvegicus
atggctttgctacccaaagggtttt

SEQ ID NO: 197766 - DNA, 25 bp, Rattus norvegicus
atggctttgctagccaaagggtttt

SEQ ID NO: 197767 - DNA, 25 bp, Rattus norvegicus
atggctttggtacctgggaccttcc

SEQ ID NO: 197768 - DNA, 25 bp, Rattus norvegicus
atggctttggtagctgggaccttcc

SEQ ID NO: 197769 - DNA, 25 bp, Rattus norvegicus
atggctttgtcgactgtcatctgca

SEQ ID NO: 197770 - DNA, 25 bp, Rattus norvegicus
atggctttgtcgtctgtcatctgca

SEQ ID NO: 197771 - DNA, 25 bp, Rattus norvegicus
atggcttttcaaattttcatttcag

SEQ ID NO: 197772 - DNA, 25 bp, Rattus norvegicus
atggcttttcaatttttcatttcag

SEQ ID NO: 197773 - DNA, 25 bp, Rattus norvegicus
atggcttttccactttcccgtgtgt

SEQ ID NO: 197774 - DNA, 25 bp, Rattus norvegicus
atggcttttccagtttcccgtgtgt

SEQ ID NO: 197775 - DNA, 25 bp, Rattus norvegicus
atggcttttccccattattgctgtc

SEQ ID NO: 197776 - DNA, 25 bp, Rattus norvegicus
atggcttttcccgattattgctgtc

SEQ ID NO: 197777 - DNA, 25 bp, Rattus norvegicus
atggcttttcgtcaggtgtgcatct

SEQ ID NO: 197778 - DNA, 25 bp, Rattus norvegicus
atggcttttcgtgaggtgtgcatct

SEQ ID NO: 197779 - DNA, 25 bp, Rattus norvegicus
atggcttttcttacccagattgtgt

SEQ ID NO: 197780 - DNA, 25 bp, Rattus norvegicus
atggcttttctttcccagattgtgt

SEQ ID NO: 197781 - DNA, 25 bp, Rattus norvegicus
atggcttttggcagaagactggctc

SEQ ID NO: 197782 - DNA, 25 bp, Rattus norvegicus
atggcttttggctgaagactggctc

SEQ ID NO: 197783 - DNA, 25 bp, Rattus norvegicus
atggcttttgtcaatatgtatgtat

SEQ ID NO: 197784 - DNA, 25 bp, Rattus norvegicus
atggcttttgtctatatgtatgtat

SEQ ID NO: 197785 - DNA, 25 bp, Rattus norvegicus
atgggaaaactgaggcaaacgacta

SEQ ID NO: 197786 - DNA, 25 bp, Rattus norvegicus
atgggaaaactgtggcaaacgacta

SEQ ID NO: 197787 - DNA, 25 bp, Rattus norvegicus
atgggaaaatcaaccacctggagaa

SEQ ID NO: 197788 - DNA, 25 bp, Rattus norvegicus
atgggaaaatcatccacctggagaa

SEQ ID NO: 197789 - DNA, 25 bp, Rattus norvegicus
atgggaaaccaaactctctgtggcc

SEQ ID NO: 197790 - DNA, 25 bp, Rattus norvegicus
atgggaaaccaatctctctgtggcc

SEQ ID NO: 197791 - DNA, 25 bp, Rattus norvegicus
atgggaaaccacaggctctgagcct

SEQ ID NO: 197792 - DNA, 25 bp, Rattus norvegicus
atgggaaaccactggctctgagcct

SEQ ID NO: 197793 - DNA, 25 bp, Rattus norvegicus
atgggaaaccccaaatgtctcctcg

SEQ ID NO: 197794 - DNA, 25 bp, Rattus norvegicus
atgggaaacccctaatgtctcctcg

SEQ ID NO: 197795 - DNA, 25 bp, Rattus norvegicus
atgggaaacctgcacttagtatctt

SEQ ID NO: 197796 - DNA, 25 bp, Rattus norvegicus
atgggaaacctggacttagtatctt

SEQ ID NO: 197797 - DNA, 25 bp, Rattus norvegicus
atgggaaactccaggactcttctac

SEQ ID NO: 197798 - DNA, 25 bp, Rattus norvegicus
atgggaaactcctggactcttctac

SEQ ID NO: 197799 - DNA, 25 bp, Rattus norvegicus
atgggaaagaccagccgcacttgga

SEQ ID NO: 197800 - DNA, 25 bp, Rattus norvegicus
atgggaaagacctgccgcacttgga

SEQ ID NO: 197801 - DNA, 25 bp, Rattus norvegicus
atgggaacagcaactggcccagaat

SEQ ID NO: 197802 - DNA, 25 bp, Rattus norvegicus
atgggaacagcatctggcccagaat

SEQ ID NO: 197803 - DNA, 25 bp, Rattus norvegicus
atgggaacagccacgaaagcggact

SEQ ID NO: 197804 - DNA, 25 bp, Rattus norvegicus
atgggaacagcctcgaaagcggact

SEQ ID NO: 197805 - DNA, 25 bp, Rattus norvegicus
atgggaacagtcaagggcaccaccg

SEQ ID NO: 197806 - DNA, 25 bp, Rattus norvegicus
atgggaacagtctagggcaccaccg

SEQ ID NO: 197807 - DNA, 25 bp, Rattus norvegicus
atgggaacatcaaggccttcatctc

SEQ ID NO: 197808 - DNA, 25 bp, Rattus norvegicus
atgggaacatcatggccttcatctc

SEQ ID NO: 197809 - DNA, 25 bp, Rattus norvegicus
atgggaaccacacgcttttccacaa

SEQ ID NO: 197810 - DNA, 25 bp, Rattus norvegicus
atgggaaccacaggcttttccacaa

SEQ ID NO: 197811 - DNA, 25 bp, Rattus norvegicus
atgggaaccagcatggaacctggaa

SEQ ID NO: 197812 - DNA, 25 bp, Rattus norvegicus
atgggaaccagcttggaacctggaa

SEQ ID NO: 197813 - DNA, 25 bp, Rattus norvegicus
atgggaacccagaaaacatgcttgg

SEQ ID NO: 197814 - DNA, 25 bp, Rattus norvegicus
atgggaacccagtaaacatgcttgg

SEQ ID NO: 197815 - DNA, 25 bp, Rattus norvegicus
atgggaacgctaacacatctacctc

SEQ ID NO: 197816 - DNA, 25 bp, Rattus norvegicus
atgggaacgctatcacatctacctc

SEQ ID NO: 197817 - DNA, 25 bp, Rattus norvegicus
atgggaactccacatgtgcgcatag

SEQ ID NO: 197818 - DNA, 25 bp, Rattus norvegicus
atgggaactccaccctctgtggtaa

SEQ ID NO: 197819 - DNA, 25 bp, Rattus norvegicus
atgggaactccagatgtgcgcatag

SEQ ID NO: 197820 - DNA, 25 bp, Rattus norvegicus
atgggaactccagcctctgtggtaa

SEQ ID NO: 197821 - DNA, 25 bp, Rattus norvegicus
atgggaactcggcaaaccagacgct

SEQ ID NO: 197822 - DNA, 25 bp, Rattus norvegicus
atgggaactcgggaaaccagacgct

SEQ ID NO: 197823 - DNA, 25 bp, Rattus norvegicus
atgggaactcgtctggatagccctg

SEQ ID NO: 197824 - DNA, 25 bp, Rattus norvegicus
atgggaactcgtgtggatagccctg

SEQ ID NO: 197825 - DNA, 25 bp, Rattus norvegicus
atgggaactgtaactcctcttacac

SEQ ID NO: 197826 - DNA, 25 bp, Rattus norvegicus
atgggaactgtatctcctcttacac

SEQ ID NO: 197827 - DNA, 25 bp, Rattus norvegicus
atgggaagacctccgtctggattta

SEQ ID NO: 197828 - DNA, 25 bp, Rattus norvegicus
atgggaagacctgcgtctggattta

SEQ ID NO: 197829 - DNA, 25 bp, Rattus norvegicus
atgggaagatctctccactgcgggt

SEQ ID NO: 197830 - DNA, 25 bp, Rattus norvegicus
atgggaagatctgtccactgcgggt

SEQ ID NO: 197831 - DNA, 25 bp, Rattus norvegicus
atgggaagcagcacaagggaccctg

SEQ ID NO: 197832 - DNA, 25 bp, Rattus norvegicus
atgggaagcagctcaagggaccctg

SEQ ID NO: 197833 - DNA, 25 bp, Rattus norvegicus
atgggaaggacactttaccctctca

SEQ ID NO: 197834 - DNA, 25 bp, Rattus norvegicus
atgggaaggacagtttaccctctca

SEQ ID NO: 197835 - DNA, 25 bp, Rattus norvegicus
atgggaagtacgagggctcacgccc

SEQ ID NO: 197836 - DNA, 25 bp, Rattus norvegicus
atgggaagtacgtgggctcacgccc

SEQ ID NO: 197837 - DNA, 25 bp, Rattus norvegicus
atgggaagtgcgagcaggcctccac

SEQ ID NO: 197838 - DNA, 25 bp, Rattus norvegicus
atgggaagtgcgtgcaggcctccac

SEQ ID NO: 197839 - DNA, 25 bp, Rattus norvegicus
atgggaatcatgatttcttacaaag

SEQ ID NO: 197840 - DNA, 25 bp, Rattus norvegicus
atgggaatcatgttttcttacaaag

SEQ ID NO: 197841 - DNA, 25 bp, Rattus norvegicus
atgggaatccttcgacacagctcat

SEQ ID NO: 197842 - DNA, 25 bp, Rattus norvegicus
atgggaatccttggacacagctcat

SEQ ID NO: 197843 - DNA, 25 bp, Rattus norvegicus
atgggaatggctctcctggtcctca

SEQ ID NO: 197844 - DNA, 25 bp, Rattus norvegicus
atgggaatggctgtcctggtcctca

SEQ ID NO: 197845 - DNA, 25 bp, Rattus norvegicus
atgggaatgttacccctgctcacag

SEQ ID NO: 197846 - DNA, 25 bp, Rattus norvegicus
atgggaatgttagccctgctcacag

SEQ ID NO: 197847 - DNA, 25 bp, Rattus norvegicus
atgggaatgtttcttccttgccatt

SEQ ID NO: 197848 - DNA, 25 bp, Rattus norvegicus
atgggaatgtttgttccttgccatt

SEQ ID NO: 197849 - DNA, 25 bp, Rattus norvegicus
atgggaattagtcccttcccctgaa

SEQ ID NO: 197850 - DNA, 25 bp, Rattus norvegicus
atgggaattagtgccttcccctgaa

SEQ ID NO: 197851 - DNA, 25 bp, Rattus norvegicus
atgggaattccaaagttttcataaa

SEQ ID NO: 197852 - DNA, 25 bp, Rattus norvegicus
atgggaattccatagttttcataaa

SEQ ID NO: 197853 - DNA, 25 bp, Rattus norvegicus
atgggaattccgctttgcacttggc

SEQ ID NO: 197854 - DNA, 25 bp, Rattus norvegicus
atgggaattccggtttgcacttggc

SEQ ID NO: 197855 - DNA, 25 bp, Rattus norvegicus
atgggaattggcatctgccttccag

SEQ ID NO: 197856 - DNA, 25 bp, Rattus norvegicus
atgggaattggcttctgccttccag

SEQ ID NO: 197857 - DNA, 25 bp, Rattus norvegicus
atgggacaacccagactttctatac

SEQ ID NO: 197858 - DNA, 25 bp, Rattus norvegicus
atgggacaaccctgactttctatac

SEQ ID NO: 197859 - DNA, 25 bp, Rattus norvegicus
atgggacacacacctggaatctcca

SEQ ID NO: 197860 - DNA, 25 bp, Rattus norvegicus
atgggacacacagctggaatctcca

SEQ ID NO: 197861 - DNA, 25 bp, Rattus norvegicus
atgggacacagcagcgtctctcaca

SEQ ID NO: 197862 - DNA, 25 bp, Rattus norvegicus
atgggacacagctgcgtctctcaca

SEQ ID NO: 197863 - DNA, 25 bp, Rattus norvegicus
atgggacagaatcgccttaacgcct

SEQ ID NO: 197864 - DNA, 25 bp, Rattus norvegicus
atgggacagaatggccttaacgcct

SEQ ID NO: 197865 - DNA, 25 bp, Rattus norvegicus
atgggacagatgctgacccggatcc

SEQ ID NO: 197866 - DNA, 25 bp, Rattus norvegicus
atgggacagatggtgacccggatcc

SEQ ID NO: 197867 - DNA, 25 bp, Rattus norvegicus
atgggacagccaatcagtgttgact

SEQ ID NO: 197868 - DNA, 25 bp, Rattus norvegicus
atgggacagccattcagtgttgact

SEQ ID NO: 197869 - DNA, 25 bp, Rattus norvegicus
atgggacagctcactgctgcccgaa

SEQ ID NO: 197870 - DNA, 25 bp, Rattus norvegicus
atgggacagctctctgctgcccgaa

SEQ ID NO: 197871 - DNA, 25 bp, Rattus norvegicus
atgggacaggatcctctgaagactt

SEQ ID NO: 197872 - DNA, 25 bp, Rattus norvegicus
atgggacaggatgctctgaagactt

SEQ ID NO: 197873 - DNA, 25 bp, Rattus norvegicus
atgggacagtccctttcatcagtgc

SEQ ID NO: 197874 - DNA, 25 bp, Rattus norvegicus
atgggacagtccgtttcatcagtgc

SEQ ID NO: 197875 - DNA, 25 bp, Rattus norvegicus
atgggacatcacatccgtctgtaac

SEQ ID NO: 197876 - DNA, 25 bp, Rattus norvegicus
atgggacatcacttccgtctgtaac

SEQ ID NO: 197877 - DNA, 25 bp, Rattus norvegicus
atgggacatcctcgtgtttccgtgg

SEQ ID NO: 197878 - DNA, 25 bp, Rattus norvegicus
atgggacatcctggtgtttccgtgg

SEQ ID NO: 197879 - DNA, 25 bp, Rattus norvegicus
atgggaccaagtcggaatctcctgc

SEQ ID NO: 197880 - DNA, 25 bp, Rattus norvegicus
atgggaccaagtgggaatctcctgc

SEQ ID NO: 197881 - DNA, 25 bp, Rattus norvegicus
atgggaccaccacagaggcaactct

SEQ ID NO: 197882 - DNA, 25 bp, Rattus norvegicus
atgggaccaccagagaggcaactct

SEQ ID NO: 197883 - DNA, 25 bp, Rattus norvegicus
atgggaccaggccatcactgaaggc

SEQ ID NO: 197884 - DNA, 25 bp, Rattus norvegicus
atgggaccaggcgatcactgaaggc

SEQ ID NO: 197885 - DNA, 25 bp, Rattus norvegicus
atgggaccagtgaccatcgactgaa

SEQ ID NO: 197886 - DNA, 25 bp, Rattus norvegicus
atgggaccagtgtccatcgactgaa

SEQ ID NO: 197887 - DNA, 25 bp, Rattus norvegicus
atgggaccattaaccttttaacaag

SEQ ID NO: 197888 - DNA, 25 bp, Rattus norvegicus
atgggaccattatccttttaacaag

SEQ ID NO: 197889 - DNA, 25 bp, Rattus norvegicus
atgggacccactcgcatgaccgtgt

SEQ ID NO: 197890 - DNA, 25 bp, Rattus norvegicus
atgggacccactggcatgaccgtgt

SEQ ID NO: 197891 - DNA, 25 bp, Rattus norvegicus
atgggacccaggaggaatctgtgca

SEQ ID NO: 197892 - DNA, 25 bp, Rattus norvegicus
atgggacccaggtggaatctgtgca

SEQ ID NO: 197893 - DNA, 25 bp, Rattus norvegicus
atgggaccccttcatgctgtgcatg

SEQ ID NO: 197894 - DNA, 25 bp, Rattus norvegicus
atgggaccccttgatgctgtgcatg

SEQ ID NO: 197895 - DNA, 25 bp, Rattus norvegicus
atgggaccctagagctatgtacagt

SEQ ID NO: 197896 - DNA, 25 bp, Rattus norvegicus
atgggaccctagtgctatgtacagt

SEQ ID NO: 197897 - DNA, 25 bp, Rattus norvegicus
atgggaccgactcggacatcttctg

SEQ ID NO: 197898 - DNA, 25 bp, Rattus norvegicus
atgggaccgactgggacatcttctg

SEQ ID NO: 197899 - DNA, 25 bp, Rattus norvegicus
atgggacctatcagggctggctgac

SEQ ID NO: 197900 - DNA, 25 bp, Rattus norvegicus
atgggacctatctgggctggctgac

SEQ ID NO: 197901 - DNA, 25 bp, Rattus norvegicus
atgggacgcactcagatgctcttct

SEQ ID NO: 197902 - DNA, 25 bp, Rattus norvegicus
atgggacgcactcccctcagagaag

SEQ ID NO: 197903 - DNA, 25 bp, Rattus norvegicus
atgggacgcactgagatgctcttct

SEQ ID NO: 197904 - DNA, 25 bp, Rattus norvegicus
atgggacgcactgccctcagagaag

SEQ ID NO: 197905 - DNA, 25 bp, Rattus norvegicus
atgggactcaaactggccctcacaa

SEQ ID NO: 197906 - DNA, 25 bp, Rattus norvegicus
atgggactcaaagtggccctcacaa

SEQ ID NO: 197907 - DNA, 25 bp, Rattus norvegicus
atgggactcctccagtttggctctt

SEQ ID NO: 197908 - DNA, 25 bp, Rattus norvegicus
atgggactcctcgagtttggctctt

SEQ ID NO: 197909 - DNA, 25 bp, Rattus norvegicus
atgggactcggcactcgggacagat

SEQ ID NO: 197910 - DNA, 25 bp, Rattus norvegicus
atgggactcggctctcgggacagat

SEQ ID NO: 197911 - DNA, 25 bp, Rattus norvegicus
atgggactcgtgctgctcagcttgt

SEQ ID NO: 197912 - DNA, 25 bp, Rattus norvegicus
atgggactcgtggtgctcagcttgt

SEQ ID NO: 197913 - DNA, 25 bp, Rattus norvegicus
atgggactgagtctgttccccataa

SEQ ID NO: 197914 - DNA, 25 bp, Rattus norvegicus
atgggactgagtgtgttccccataa

SEQ ID NO: 197915 - DNA, 25 bp, Rattus norvegicus
atgggactgatgagcaattaacttg

SEQ ID NO: 197916 - DNA, 25 bp, Rattus norvegicus
atgggactgatgtgcaattaacttg

SEQ ID NO: 197917 - DNA, 25 bp, Rattus norvegicus
atgggactgctcatcctgaagccca

SEQ ID NO: 197918 - DNA, 25 bp, Rattus norvegicus
atgggactgctcttcctgaagccca

SEQ ID NO: 197919 - DNA, 25 bp, Rattus norvegicus
atgggactgtagcacccaatacggt

SEQ ID NO: 197920 - DNA, 25 bp, Rattus norvegicus
atgggactgtaggacccaatacggt

SEQ ID NO: 197921 - DNA, 25 bp, Rattus norvegicus
atgggactgtcaatccaggactgct

SEQ ID NO: 197922 - DNA, 25 bp, Rattus norvegicus
atgggactgtcattccaggactgct

SEQ ID NO: 197923 - DNA, 25 bp, Rattus norvegicus
atgggactgtgcacgattaccggcc

SEQ ID NO: 197924 - DNA, 25 bp, Rattus norvegicus
atgggactgtgctcgattaccggcc

SEQ ID NO: 197925 - DNA, 25 bp, Rattus norvegicus
atgggagaatatcggcacccatccc

SEQ ID NO: 197926 - DNA, 25 bp, Rattus norvegicus
atgggagaatatgggcacccatccc

SEQ ID NO: 197927 - DNA, 25 bp, Rattus norvegicus
atgggagacctgctcattgatgaca

SEQ ID NO: 197928 - DNA, 25 bp, Rattus norvegicus
atgggagacctggtcattgatgaca

SEQ ID NO: 197929 - DNA, 25 bp, Rattus norvegicus
atgggagactccagcatacaccacc

SEQ ID NO: 197930 - DNA, 25 bp, Rattus norvegicus
atgggagactcctgcatacaccacc

SEQ ID NO: 197931 - DNA, 25 bp, Rattus norvegicus
atgggagactctcgcggaccgctac

SEQ ID NO: 197932 - DNA, 25 bp, Rattus norvegicus
atgggagactctggcggaccgctac

SEQ ID NO: 197933 - DNA, 25 bp, Rattus norvegicus
atgggagagcctcacgccagaagcc

SEQ ID NO: 197934 - DNA, 25 bp, Rattus norvegicus
atgggagagcctgacgccagaagcc

SEQ ID NO: 197935 - DNA, 25 bp, Rattus norvegicus
atgggagagggcatctgcactcctt

SEQ ID NO: 197936 - DNA, 25 bp, Rattus norvegicus
atgggagagggcttctgcactcctt

SEQ ID NO: 197937 - DNA, 25 bp, Rattus norvegicus
atgggagatggcatgttcctgcact

SEQ ID NO: 197938 - DNA, 25 bp, Rattus norvegicus
atgggagatggcttgttcctgcact

SEQ ID NO: 197939 - DNA, 25 bp, Rattus norvegicus
atgggagcaagtcttctgcgccaca

SEQ ID NO: 197940 - DNA, 25 bp, Rattus norvegicus
atgggagcaagtgttctgcgccaca

SEQ ID NO: 197941 - DNA, 25 bp, Rattus norvegicus
atgggagcagacaggccactggcct

SEQ ID NO: 197942 - DNA, 25 bp, Rattus norvegicus
atgggagcagactggccactggcct

SEQ ID NO: 197943 - DNA, 25 bp, Rattus norvegicus
atgggagccacacagaaacacttta

SEQ ID NO: 197944 - DNA, 25 bp, Rattus norvegicus
atgggagccacagagaaacacttta

SEQ ID NO: 197945 - DNA, 25 bp, Rattus norvegicus
atgggagccacgcacatcaaagcca

SEQ ID NO: 197946 - DNA, 25 bp, Rattus norvegicus
atgggagccacggacatcaaagcca

SEQ ID NO: 197947 - DNA, 25 bp, Rattus norvegicus
atgggagccagtcttctagcagcct

SEQ ID NO: 197948 - DNA, 25 bp, Rattus norvegicus
atgggagccagtgttctagcagcct

SEQ ID NO: 197949 - DNA, 25 bp, Rattus norvegicus
atgggagccatcagcaaggatgcaa

SEQ ID NO: 197950 - DNA, 25 bp, Rattus norvegicus
atgggagccatctgcaaggatgcaa

SEQ ID NO: 197951 - DNA, 25 bp, Rattus norvegicus
atgggagccatgactctagtcttcc

SEQ ID NO: 197952 - DNA, 25 bp, Rattus norvegicus
atgggagccatgtctctagtcttcc

SEQ ID NO: 197953 - DNA, 25 bp, Rattus norvegicus
atgggagccccaagtcctgaaaaat

SEQ ID NO: 197954 - DNA, 25 bp, Rattus norvegicus
atgggagccccatgtcctgaaaaat

SEQ ID NO: 197955 - DNA, 25 bp, Rattus norvegicus
atgggagcccctcaatctggcatgg

SEQ ID NO: 197956 - DNA, 25 bp, Rattus norvegicus
atgggagcccctgaatctggcatgg

SEQ ID NO: 197957 - DNA, 25 bp, Rattus norvegicus
atgggagcctccagagcacagacgg

SEQ ID NO: 197958 - DNA, 25 bp, Rattus norvegicus
atgggagcctcctgagcacagacgg

SEQ ID NO: 197959 - DNA, 25 bp, Rattus norvegicus
atgggagcctgaaccaaaacctgga

SEQ ID NO: 197960 - DNA, 25 bp, Rattus norvegicus
atgggagcctgatccaaaacctgga

SEQ ID NO: 197961 - DNA, 25 bp, Rattus norvegicus
atgggagcggctagttcaatggatt

SEQ ID NO: 197962 - DNA, 25 bp, Rattus norvegicus
atgggagcggcttgttcaatggatt

SEQ ID NO: 197963 - DNA, 25 bp, Rattus norvegicus
atgggagctcacagatcaagcagga

SEQ ID NO: 197964 - DNA, 25 bp, Rattus norvegicus
atgggagctcactgatcaagcagga

SEQ ID NO: 197965 - DNA, 25 bp, Rattus norvegicus
atgggagctgtgcacacttgttaca

SEQ ID NO: 197966 - DNA, 25 bp, Rattus norvegicus
atgggagctgtggacacttgttaca

SEQ ID NO: 197967 - DNA, 25 bp, Rattus norvegicus
atgggagcttctactggttcactct

SEQ ID NO: 197968 - DNA, 25 bp, Rattus norvegicus
atgggagcttcttctggttcactct

SEQ ID NO: 197969 - DNA, 25 bp, Rattus norvegicus
atgggaggaaacacctgaggcccac

SEQ ID NO: 197970 - DNA, 25 bp, Rattus norvegicus
atgggaggaaactcctgaggcccac

SEQ ID NO: 197971 - DNA, 25 bp, Rattus norvegicus
atgggaggagcaagccttagcctaa

SEQ ID NO: 197972 - DNA, 25 bp, Rattus norvegicus
atgggaggagcatgccttagcctaa

SEQ ID NO: 197973 - DNA, 25 bp, Rattus norvegicus
atgggaggcaggacttcaaaccaaa

SEQ ID NO: 197974 - DNA, 25 bp, Rattus norvegicus
atgggaggcaggtcttcaaaccaaa

SEQ ID NO: 197975 - DNA, 25 bp, Rattus norvegicus
atgggaggcccactctgactaactg

SEQ ID NO: 197976 - DNA, 25 bp, Rattus norvegicus
atgggaggcccagtctgactaactg

SEQ ID NO: 197977 - DNA, 25 bp, Rattus norvegicus
atgggaggccccacaggtcctggag

SEQ ID NO: 197978 - DNA, 25 bp, Rattus norvegicus
atgggaggcccctcaggtcctggag

SEQ ID NO: 197979 - DNA, 25 bp, Rattus norvegicus
atgggaggctatacagctgtgccct

SEQ ID NO: 197980 - DNA, 25 bp, Rattus norvegicus
atgggaggctattcagctgtgccct

SEQ ID NO: 197981 - DNA, 25 bp, Rattus norvegicus
atgggagggagcatgtatacacaca

SEQ ID NO: 197982 - DNA, 25 bp, Rattus norvegicus
atgggagggagcttgtatacacaca

SEQ ID NO: 197983 - DNA, 25 bp, Rattus norvegicus
atgggagggccgcttcatctctgct

SEQ ID NO: 197984 - DNA, 25 bp, Rattus norvegicus
atgggagggccggttcatctctgct

SEQ ID NO: 197985 - DNA, 25 bp, Rattus norvegicus
atgggagggcttctcttgccattcc

SEQ ID NO: 197986 - DNA, 25 bp, Rattus norvegicus
atgggagggcttgtcttgccattcc

SEQ ID NO: 197987 - DNA, 25 bp, Rattus norvegicus
atgggaggtgccacataggttcata

SEQ ID NO: 197988 - DNA, 25 bp, Rattus norvegicus
atgggaggtgcctcataggttcata

SEQ ID NO: 197989 - DNA, 25 bp, Rattus norvegicus
atgggaggtttcaggattcgttctt

SEQ ID NO: 197990 - DNA, 25 bp, Rattus norvegicus
atgggaggtttctggattcgttctt

SEQ ID NO: 197991 - DNA, 25 bp, Rattus norvegicus
atgggagtaaccaccttcttgagtg

SEQ ID NO: 197992 - DNA, 25 bp, Rattus norvegicus
atgggagtaacctccttcttgagtg

SEQ ID NO: 197993 - DNA, 25 bp, Rattus norvegicus
atgggagtacagagcccttaggacc

SEQ ID NO: 197994 - DNA, 25 bp, Rattus norvegicus
atgggagtacagtgcccttaggacc

SEQ ID NO: 197995 - DNA, 25 bp, Rattus norvegicus
atgggagtatgccttgtactggccc

SEQ ID NO: 197996 - DNA, 25 bp, Rattus norvegicus
atgggagtatgcgttgtactggccc

SEQ ID NO: 197997 - DNA, 25 bp, Rattus norvegicus
atgggagtcacaacactgtctggta

SEQ ID NO: 197998 - DNA, 25 bp, Rattus norvegicus
atgggagtcacatcactgtctggta

SEQ ID NO: 197999 - DNA, 25 bp, Rattus norvegicus
atgggagtccagattcttgccacac

SEQ ID NO: 198000 - DNA, 25 bp, Rattus norvegicus
atgggagtccagtttcttgccacac

SEQ ID NO: 198001 - DNA, 25 bp, Rattus norvegicus
atgggagtccctagaagcagccctg

SEQ ID NO: 198002 - DNA, 25 bp, Rattus norvegicus
atgggagtcccttgaagcagccctg

SEQ ID NO: 198003 - DNA, 25 bp, Rattus norvegicus
atgggagtctctcctacaacccggg

SEQ ID NO: 198004 - DNA, 25 bp, Rattus norvegicus
atgggagtctctgctacaacccggg

SEQ ID NO: 198005 - DNA, 25 bp, Rattus norvegicus
atgggagtctgtcaattcccaccct

SEQ ID NO: 198006 - DNA, 25 bp, Rattus norvegicus
atgggagtctgtccatcctacagga

SEQ ID NO: 198007 - DNA, 25 bp, Rattus norvegicus
atgggagtctgtgaattcccaccct

SEQ ID NO: 198008 - DNA, 25 bp, Rattus norvegicus
atgggagtctgtgcatcctacagga

SEQ ID NO: 198009 - DNA, 25 bp, Rattus norvegicus
atgggagtgaacaggagtcctctga

SEQ ID NO: 198010 - DNA, 25 bp, Rattus norvegicus
atgggagtgaactggagtcctctga

SEQ ID NO: 198011 - DNA, 25 bp, Rattus norvegicus
atgggagtgcctcctgctgtgtact

SEQ ID NO: 198012 - DNA, 25 bp, Rattus norvegicus
atgggagtgcctgctgctgtgtact

SEQ ID NO: 198013 - DNA, 25 bp, Rattus norvegicus
atgggagtgtgtcatctgccctgct

SEQ ID NO: 198014 - DNA, 25 bp, Rattus norvegicus
atgggagtgtgtgatctgccctgct

SEQ ID NO: 198015 - DNA, 25 bp, Rattus norvegicus
atgggagtttcacttctccctagaa

SEQ ID NO: 198016 - DNA, 25 bp, Rattus norvegicus
atgggagtttcagttctccctagaa

SEQ ID NO: 198017 - DNA, 25 bp, Rattus norvegicus
atgggatcacatacctaagtcagcc

SEQ ID NO: 198018 - DNA, 25 bp, Rattus norvegicus
atgggatcacattcctaagtcagcc

SEQ ID NO: 198019 - DNA, 25 bp, Rattus norvegicus
atgggatcccgaaagctcgcaggaa

SEQ ID NO: 198020 - DNA, 25 bp, Rattus norvegicus
atgggatcccgatagctcgcaggaa

SEQ ID NO: 198021 - DNA, 25 bp, Rattus norvegicus
atgggatccctaacttaacacacgg

SEQ ID NO: 198022 - DNA, 25 bp, Rattus norvegicus
atgggatccctatcttaacacacgg

SEQ ID NO: 198023 - DNA, 25 bp, Rattus norvegicus
atgggatccgagcagtcacattcca

SEQ ID NO: 198024 - DNA, 25 bp, Rattus norvegicus
atgggatccgaggagtcacattcca

SEQ ID NO: 198025 - DNA, 25 bp, Rattus norvegicus
atgggatcctctattctcagcacgt

SEQ ID NO: 198026 - DNA, 25 bp, Rattus norvegicus
atgggatcctctcggttccaaggac

SEQ ID NO: 198027 - DNA, 25 bp, Rattus norvegicus
atgggatcctctgggttccaaggac

SEQ ID NO: 198028 - DNA, 25 bp, Rattus norvegicus
atgggatcctcttttctcagcacgt

SEQ ID NO: 198029 - DNA, 25 bp, Rattus norvegicus
atgggatctcggcaacagcttgcta

SEQ ID NO: 198030 - DNA, 25 bp, Rattus norvegicus
atgggatctcgggaacagcttgcta

SEQ ID NO: 198031 - DNA, 25 bp, Rattus norvegicus
atgggatcttcaagtgcaacacgga

SEQ ID NO: 198032 - DNA, 25 bp, Rattus norvegicus
atgggatcttcatgtgcaacacgga

SEQ ID NO: 198033 - DNA, 25 bp, Rattus norvegicus
atgggatctttgattctgtgttaat

SEQ ID NO: 198034 - DNA, 25 bp, Rattus norvegicus
atgggatctttgtttctgtgttaat

SEQ ID NO: 198035 - DNA, 25 bp, Rattus norvegicus
atgggatgagctattccccttttat

SEQ ID NO: 198036 - DNA, 25 bp, Rattus norvegicus
atgggatgagcttttccccttttat

SEQ ID NO: 198037 - DNA, 25 bp, Rattus norvegicus
atgggatgccttctttgtggctgtt

SEQ ID NO: 198038 - DNA, 25 bp, Rattus norvegicus
atgggatgccttgtttgtggctgtt

SEQ ID NO: 198039 - DNA, 25 bp, Rattus norvegicus
atgggatggccacaagcgcacctga

SEQ ID NO: 198040 - DNA, 25 bp, Rattus norvegicus
atgggatggccagaagcgcacctga

SEQ ID NO: 198041 - DNA, 25 bp, Rattus norvegicus
atgggatgtacgaggctgccttgaa

SEQ ID NO: 198042 - DNA, 25 bp, Rattus norvegicus
atgggatgtacgtggctgccttgaa

SEQ ID NO: 198043 - DNA, 25 bp, Rattus norvegicus
atgggatgtgtaccttcctcacact

SEQ ID NO: 198044 - DNA, 25 bp, Rattus norvegicus
atgggatgtgtagcttcctcacact

SEQ ID NO: 198045 - DNA, 25 bp, Rattus norvegicus
atgggatgtgtgattgtcttctgaa

SEQ ID NO: 198046 - DNA, 25 bp, Rattus norvegicus
atgggatgtgtgtttgtcttctgaa

SEQ ID NO: 198047 - DNA, 25 bp, Rattus norvegicus
atgggatgttacaagcctcacagac

SEQ ID NO: 198048 - DNA, 25 bp, Rattus norvegicus
atgggatgttactagcctcacagac

SEQ ID NO: 198049 - DNA, 25 bp, Rattus norvegicus
atgggatgttccctgttttcatggc

SEQ ID NO: 198050 - DNA, 25 bp, Rattus norvegicus
atgggatgttccgtgttttcatggc

SEQ ID NO: 198051 - DNA, 25 bp, Rattus norvegicus
atgggattcaaacctttcccgccat

SEQ ID NO: 198052 - DNA, 25 bp, Rattus norvegicus
atgggattcaaagctttcccgccat

SEQ ID NO: 198053 - DNA, 25 bp, Rattus norvegicus
atgggattcaacactaagctgctat

SEQ ID NO: 198054 - DNA, 25 bp, Rattus norvegicus
atgggattcaactctaagctgctat

SEQ ID NO: 198055 - DNA, 25 bp, Rattus norvegicus
atgggattccctcagcataccattg

SEQ ID NO: 198056 - DNA, 25 bp, Rattus norvegicus
atgggattccctgagcataccattg

SEQ ID NO: 198057 - DNA, 25 bp, Rattus norvegicus
atgggattcgaaacgatgttatcgt

SEQ ID NO: 198058 - DNA, 25 bp, Rattus norvegicus
atgggattcgaatcgatgttatcgt

SEQ ID NO: 198059 - DNA, 25 bp, Rattus norvegicus
atgggattcgagctctcctggaacc

SEQ ID NO: 198060 - DNA, 25 bp, Rattus norvegicus
atgggattcgaggtctcctggaacc

SEQ ID NO: 198061 - DNA, 25 bp, Rattus norvegicus
atgggattcgccatctgtagtggac

SEQ ID NO: 198062 - DNA, 25 bp, Rattus norvegicus
atgggattcgccttctgtagtggac

SEQ ID NO: 198063 - DNA, 25 bp, Rattus norvegicus
atgggattctgccttggtttccaag

SEQ ID NO: 198064 - DNA, 25 bp, Rattus norvegicus
atgggattctgcgttggtttccaag

SEQ ID NO: 198065 - DNA, 25 bp, Rattus norvegicus
atgggattctgtcctgatggcacaa

SEQ ID NO: 198066 - DNA, 25 bp, Rattus norvegicus
atgggattctgtgctgatggcacaa

SEQ ID NO: 198067 - DNA, 25 bp, Rattus norvegicus
atgggattgcagatacacgcctgta

SEQ ID NO: 198068 - DNA, 25 bp, Rattus norvegicus
atgggattgcagttacacgcctgta

SEQ ID NO: 198069 - DNA, 25 bp, Rattus norvegicus
atgggattggagacacaccttgtga

SEQ ID NO: 198070 - DNA, 25 bp, Rattus norvegicus
atgggattggagtcacaccttgtga

SEQ ID NO: 198071 - DNA, 25 bp, Rattus norvegicus
atgggattgtctacagctcactgta

SEQ ID NO: 198072 - DNA, 25 bp, Rattus norvegicus
atgggattgtcttcagctcactgta

SEQ ID NO: 198073 - DNA, 25 bp, Rattus norvegicus
atgggattgtgcacgtttctgccaa

SEQ ID NO: 198074 - DNA, 25 bp, Rattus norvegicus
atgggattgtgctcgtttctgccaa

SEQ ID NO: 198075 - DNA, 25 bp, Rattus norvegicus
atgggattgtttatctccgaggtct

SEQ ID NO: 198076 - DNA, 25 bp, Rattus norvegicus
atgggattgtttttctccgaggtct

SEQ ID NO: 198077 - DNA, 25 bp, Rattus norvegicus
atgggatttcagaggtttcttcttt

SEQ ID NO: 198078 - DNA, 25 bp, Rattus norvegicus
atgggatttcagtggtttcttcttt

SEQ ID NO: 198079 - DNA, 25 bp, Rattus norvegicus
atgggatttcttacattcacccctg

SEQ ID NO: 198080 - DNA, 25 bp, Rattus norvegicus
atgggatttctttcattcacccctg

SEQ ID NO: 198081 - DNA, 25 bp, Rattus norvegicus
atgggattttccacatgttgcatgc

SEQ ID NO: 198082 - DNA, 25 bp, Rattus norvegicus
atgggattttcctcatgttgcatgc

SEQ ID NO: 198083 - DNA, 25 bp, Rattus norvegicus
atgggattttggagcctctgacgtc

SEQ ID NO: 198084 - DNA, 25 bp, Rattus norvegicus
atgggattttggtgcctctgacgtc

SEQ ID NO: 198085 - DNA, 25 bp, Rattus norvegicus
atgggcaaactcagtcctgtcgtga

SEQ ID NO: 198086 - DNA, 25 bp, Rattus norvegicus
atgggcaaactctgtcctgtcgtga

SEQ ID NO: 198087 - DNA, 25 bp, Rattus norvegicus
atgggcaacaatccagtctcaccct

SEQ ID NO: 198088 - DNA, 25 bp, Rattus norvegicus
atgggcaacaatgcagtctcaccct

SEQ ID NO: 198089 - DNA, 25 bp, Rattus norvegicus
atgggcaaccggatatctcacctta

SEQ ID NO: 198090 - DNA, 25 bp, Rattus norvegicus
atgggcaaccggttatctcacctta

SEQ ID NO: 198091 - DNA, 25 bp, Rattus norvegicus
atgggcaagcatcagacgcctctac

SEQ ID NO: 198092 - DNA, 25 bp, Rattus norvegicus
atgggcaagcatgagacgcctctac

SEQ ID NO: 198093 - DNA, 25 bp, Rattus norvegicus
atgggcaagcccacagtacaaggaa

SEQ ID NO: 198094 - DNA, 25 bp, Rattus norvegicus
atgggcaagccctcagtacaaggaa

SEQ ID NO: 198095 - DNA, 25 bp, Rattus norvegicus
atgggcacaccactagacagcactt

SEQ ID NO: 198096 - DNA, 25 bp, Rattus norvegicus
atgggcacaccagtagacagcactt

SEQ ID NO: 198097 - DNA, 25 bp, Rattus norvegicus
atgggcacactgacatctgcgtctg

SEQ ID NO: 198098 - DNA, 25 bp, Rattus norvegicus
atgggcacactgtcatctgcgtctg

SEQ ID NO: 198099 - DNA, 25 bp, Rattus norvegicus
atgggcacagacaggcagcatcttc

SEQ ID NO: 198100 - DNA, 25 bp, Rattus norvegicus
atgggcacagactggcagcatcttc

SEQ ID NO: 198101 - DNA, 25 bp, Rattus norvegicus
atgggcaccggtaaaagaacagctc

SEQ ID NO: 198102 - DNA, 25 bp, Rattus norvegicus
atgggcaccggttaaagaacagctc

SEQ ID NO: 198103 - DNA, 25 bp, Rattus norvegicus
atgggcacgcggctctcgctgatct

SEQ ID NO: 198104 - DNA, 25 bp, Rattus norvegicus
atgggcacgcgggtctcgctgatct

SEQ ID NO: 198105 - DNA, 25 bp, Rattus norvegicus
atgggcactattagtggatcagtca

SEQ ID NO: 198106 - DNA, 25 bp, Rattus norvegicus
atgggcactatttgtggatcagtca

SEQ ID NO: 198107 - DNA, 25 bp, Rattus norvegicus
atgggcactgctctagctaggagct

SEQ ID NO: 198108 - DNA, 25 bp, Rattus norvegicus
atgggcactgctgtagctaggagct

SEQ ID NO: 198109 - DNA, 25 bp, Rattus norvegicus
atgggcactggcagattccaagaaa

SEQ ID NO: 198110 - DNA, 25 bp, Rattus norvegicus
atgggcactggctgattccaagaaa

SEQ ID NO: 198111 - DNA, 25 bp, Rattus norvegicus
atgggcacttccagctccaaacaat

SEQ ID NO: 198112 - DNA, 25 bp, Rattus norvegicus
atgggcacttcctgctccaaacaat

SEQ ID NO: 198113 - DNA, 25 bp, Rattus norvegicus
atgggcacttctaatgccactgtgc

SEQ ID NO: 198114 - DNA, 25 bp, Rattus norvegicus
atgggcacttcttatgccactgtgc

SEQ ID NO: 198115 - DNA, 25 bp, Rattus norvegicus
atgggcacttgcactgccgcgtatc

SEQ ID NO: 198116 - DNA, 25 bp, Rattus norvegicus
atgggcacttgctctgccgcgtatc

SEQ ID NO: 198117 - DNA, 25 bp, Rattus norvegicus
atgggcagaacgcagtgtccccgaa

SEQ ID NO: 198118 - DNA, 25 bp, Rattus norvegicus
atgggcagaacggagtgtccccgaa

SEQ ID NO: 198119 - DNA, 25 bp, Rattus norvegicus
atgggcagaccaacattgagattga

SEQ ID NO: 198120 - DNA, 25 bp, Rattus norvegicus
atgggcagaccatcattgagattga

SEQ ID NO: 198121 - DNA, 25 bp, Rattus norvegicus
atgggcagacccaggcatctcttga

SEQ ID NO: 198122 - DNA, 25 bp, Rattus norvegicus
atgggcagaccctggcatctcttga

SEQ ID NO: 198123 - DNA, 25 bp, Rattus norvegicus
atgggcagactcctttggttctaag

SEQ ID NO: 198124 - DNA, 25 bp, Rattus norvegicus
atgggcagactcgtttggttctaag

SEQ ID NO: 198125 - DNA, 25 bp, Rattus norvegicus
atgggcagagttaacatttacacac

SEQ ID NO: 198126 - DNA, 25 bp, Rattus norvegicus
atgggcagagtttacatttacacac

SEQ ID NO: 198127 - DNA, 25 bp, Rattus norvegicus
atgggcagatctatactttgtaacc

SEQ ID NO: 198128 - DNA, 25 bp, Rattus norvegicus
atgggcagatctttactttgtaacc

SEQ ID NO: 198129 - DNA, 25 bp, Rattus norvegicus
atgggcagccaccatcatcttgatt

SEQ ID NO: 198130 - DNA, 25 bp, Rattus norvegicus
atgggcagccacgatcatcttgatt

SEQ ID NO: 198131 - DNA, 25 bp, Rattus norvegicus
atgggcagcctccttaccaaaggaa

SEQ ID NO: 198132 - DNA, 25 bp, Rattus norvegicus
atgggcagcctcgttaccaaaggaa

SEQ ID NO: 198133 - DNA, 25 bp, Rattus norvegicus
atgggcagcgatagtgaacttggac

SEQ ID NO: 198134 - DNA, 25 bp, Rattus norvegicus
atgggcagcgattgtgaacttggac

SEQ ID NO: 198135 - DNA, 25 bp, Rattus norvegicus
atgggcagctacagggagaccctat

SEQ ID NO: 198136 - DNA, 25 bp, Rattus norvegicus
atgggcagctactgggagaccctat

SEQ ID NO: 198137 - DNA, 25 bp, Rattus norvegicus
atgggcagcttacaatgtcattcct

SEQ ID NO: 198138 - DNA, 25 bp, Rattus norvegicus
atgggcagcttagaatgtcattcct

SEQ ID NO: 198139 - DNA, 25 bp, Rattus norvegicus
atgggcagcttcatttttaacggaa

SEQ ID NO: 198140 - DNA, 25 bp, Rattus norvegicus
atgggcagcttcttttttaacggaa

SEQ ID NO: 198141 - DNA, 25 bp, Rattus norvegicus
atgggcaggaaaacgcctcactttc

SEQ ID NO: 198142 - DNA, 25 bp, Rattus norvegicus
atgggcaggaaatcgcctcactttc

SEQ ID NO: 198143 - DNA, 25 bp, Rattus norvegicus
atgggcaggacgaacatgctacccc

SEQ ID NO: 198144 - DNA, 25 bp, Rattus norvegicus
atgggcaggacgtacatgctacccc

SEQ ID NO: 198145 - DNA, 25 bp, Rattus norvegicus
atgggcaggcccaaggaaccgactt

SEQ ID NO: 198146 - DNA, 25 bp, Rattus norvegicus
atgggcaggccctaggaaccgactt

SEQ ID NO: 198147 - DNA, 25 bp, Rattus norvegicus
atgggcagggtcaccaaaccagggt

SEQ ID NO: 198148 - DNA, 25 bp, Rattus norvegicus
atgggcagggtctccaaaccagggt

SEQ ID NO: 198149 - DNA, 25 bp, Rattus norvegicus
atgggcagtcacaccagaggtattt

SEQ ID NO: 198150 - DNA, 25 bp, Rattus norvegicus
atgggcagtcactccagaggtattt

SEQ ID NO: 198151 - DNA, 25 bp, Rattus norvegicus
atgggcagtgcccactctctcagtc

SEQ ID NO: 198152 - DNA, 25 bp, Rattus norvegicus
atgggcagtgccgactctctcagtc

SEQ ID NO: 198153 - DNA, 25 bp, Rattus norvegicus
atgggcagtgggagtctatctttct

SEQ ID NO: 198154 - DNA, 25 bp, Rattus norvegicus
atgggcagtgggtgtctatctttct

SEQ ID NO: 198155 - DNA, 25 bp, Rattus norvegicus
atgggcagttacatgcatacttcaa

SEQ ID NO: 198156 - DNA, 25 bp, Rattus norvegicus
atgggcagttacttgcatacttcaa

SEQ ID NO: 198157 - DNA, 25 bp, Rattus norvegicus
atgggcagttgtcagttactgatgt

SEQ ID NO: 198158 - DNA, 25 bp, Rattus norvegicus
atgggcagttgtgagttactgatgt

SEQ ID NO: 198159 - DNA, 25 bp, Rattus norvegicus
atgggcatagctccaccgtgagtat

SEQ ID NO: 198160 - DNA, 25 bp, Rattus norvegicus
atgggcatagctgcaccgtgagtat

SEQ ID NO: 198161 - DNA, 25 bp, Rattus norvegicus
atgggcatccggagcctggaatttc

SEQ ID NO: 198162 - DNA, 25 bp, Rattus norvegicus
atgggcatccggtgcctggaatttc

SEQ ID NO: 198163 - DNA, 25 bp, Rattus norvegicus
atgggcatcctgctgtcataccata

SEQ ID NO: 198164 - DNA, 25 bp, Rattus norvegicus
atgggcatcctggtgtcataccata

SEQ ID NO: 198165 - DNA, 25 bp, Rattus norvegicus
atgggcatctgtcctcacacgtgct

SEQ ID NO: 198166 - DNA, 25 bp, Rattus norvegicus
atgggcatctgtgctcacacgtgct

SEQ ID NO: 198167 - DNA, 25 bp, Rattus norvegicus
atgggcatgatcatgctgtaacctt

SEQ ID NO: 198168 - DNA, 25 bp, Rattus norvegicus
atgggcatgatcttgctgtaacctt

SEQ ID NO: 198169 - DNA, 25 bp, Rattus norvegicus
atgggcatgatgagttggtctcctc

SEQ ID NO: 198170 - DNA, 25 bp, Rattus norvegicus
atgggcatgatgtgttggtctcctc

SEQ ID NO: 198171 - DNA, 25 bp, Rattus norvegicus
atgggcatggccatgtgcgtacaat

SEQ ID NO: 198172 - DNA, 25 bp, Rattus norvegicus
atgggcatggccttgtgcgtacaat

SEQ ID NO: 198173 - DNA, 25 bp, Rattus norvegicus
atgggcatggctccaacactatgca

SEQ ID NO: 198174 - DNA, 25 bp, Rattus norvegicus
atgggcatggctgcaacactatgca

SEQ ID NO: 198175 - DNA, 25 bp, Rattus norvegicus
atgggcatggtccacacagtctcag

SEQ ID NO: 198176 - DNA, 25 bp, Rattus norvegicus
atgggcatggtcgacacagtctcag

SEQ ID NO: 198177 - DNA, 25 bp, Rattus norvegicus
atgggcatgtccacgacacccaggg

SEQ ID NO: 198178 - DNA, 25 bp, Rattus norvegicus
atgggcatgtcctcgacacccaggg

SEQ ID NO: 198179 - DNA, 25 bp, Rattus norvegicus
atgggcattatcacaccagacttac

SEQ ID NO: 198180 - DNA, 25 bp, Rattus norvegicus
atgggcattatctcaccagacttac

SEQ ID NO: 198181 - DNA, 25 bp, Rattus norvegicus
atgggcattccgcagctgcagcagc

SEQ ID NO: 198182 - DNA, 25 bp, Rattus norvegicus
atgggcattccggagctgcagcagc

SEQ ID NO: 198183 - DNA, 25 bp, Rattus norvegicus
atgggcattgcactcaggaacacaa

SEQ ID NO: 198184 - DNA, 25 bp, Rattus norvegicus
atgggcattgcagtcaggaacacaa

SEQ ID NO: 198185 - DNA, 25 bp, Rattus norvegicus
atgggcattggaattggcttctgaa

SEQ ID NO: 198186 - DNA, 25 bp, Rattus norvegicus
atgggcattggatttggcttctgaa

SEQ ID NO: 198187 - DNA, 25 bp, Rattus norvegicus
atgggcattgttaccttttgcagga

SEQ ID NO: 198188 - DNA, 25 bp, Rattus norvegicus
atgggcattgtttccttttgcagga

SEQ ID NO: 198189 - DNA, 25 bp, Rattus norvegicus
atgggcatttaaatgcttacttaag

SEQ ID NO: 198190 - DNA, 25 bp, Rattus norvegicus
atgggcatttaattgcttacttaag

SEQ ID NO: 198191 - DNA, 25 bp, Rattus norvegicus
atgggcatttcacggattgaactca

SEQ ID NO: 198192 - DNA, 25 bp, Rattus norvegicus
atgggcatttcagggattgaactca

SEQ ID NO: 198193 - DNA, 25 bp, Rattus norvegicus
atgggccacatgatactcctaagtc

SEQ ID NO: 198194 - DNA, 25 bp, Rattus norvegicus
atgggccacatgttactcctaagtc

SEQ ID NO: 198195 - DNA, 25 bp, Rattus norvegicus
atgggccacccaatgtgtctttcta

SEQ ID NO: 198196 - DNA, 25 bp, Rattus norvegicus
atgggccacccattgtgtctttcta

SEQ ID NO: 198197 - DNA, 25 bp, Rattus norvegicus
atgggccacttgaggagcccctcga

SEQ ID NO: 198198 - DNA, 25 bp, Rattus norvegicus
atgggccacttgatttctttgaatg

SEQ ID NO: 198199 - DNA, 25 bp, Rattus norvegicus
atgggccacttgtggagcccctcga

SEQ ID NO: 198200 - DNA, 25 bp, Rattus norvegicus
atgggccacttgttttctttgaatg

SEQ ID NO: 198201 - DNA, 25 bp, Rattus norvegicus
atgggccagagtctatgtcttcttt

SEQ ID NO: 198202 - DNA, 25 bp, Rattus norvegicus
atgggccagagtgtatgtcttcttt

SEQ ID NO: 198203 - DNA, 25 bp, Rattus norvegicus
atgggccagccaaggtcatgtacat

SEQ ID NO: 198204 - DNA, 25 bp, Rattus norvegicus
atgggccagccatggtcatgtacat

SEQ ID NO: 198205 - DNA, 25 bp, Rattus norvegicus
atgggccaggctaatttgcattcaa

SEQ ID NO: 198206 - DNA, 25 bp, Rattus norvegicus
atgggccaggcttatttgcattcaa

SEQ ID NO: 198207 - DNA, 25 bp, Rattus norvegicus
atgggccagtcactgttgagtcctt

SEQ ID NO: 198208 - DNA, 25 bp, Rattus norvegicus
atgggccagtcagtgttgagtcctt

SEQ ID NO: 198209 - DNA, 25 bp, Rattus norvegicus
atgggccagtgcattctatacccaa

SEQ ID NO: 198210 - DNA, 25 bp, Rattus norvegicus
atgggccagtgctttctatacccaa

SEQ ID NO: 198211 - DNA, 25 bp, Rattus norvegicus
atgggccagtggcttaacatttcac

SEQ ID NO: 198212 - DNA, 25 bp, Rattus norvegicus
atgggccagtgggttaacatttcac

SEQ ID NO: 198213 - DNA, 25 bp, Rattus norvegicus
atgggccatatactggttgacctgc

SEQ ID NO: 198214 - DNA, 25 bp, Rattus norvegicus
atgggccatatagtggttgacctgc

SEQ ID NO: 198215 - DNA, 25 bp, Rattus norvegicus
atgggccatcatacccagtttatgt

SEQ ID NO: 198216 - DNA, 25 bp, Rattus norvegicus
atgggccatcattcccagtttatgt

SEQ ID NO: 198217 - DNA, 25 bp, Rattus norvegicus
atgggccatgtaactgcctacaaga

SEQ ID NO: 198218 - DNA, 25 bp, Rattus norvegicus
atgggccatgtatctgcctacaaga

SEQ ID NO: 198219 - DNA, 25 bp, Rattus norvegicus
atgggccatgtcatacatccttcag

SEQ ID NO: 198220 - DNA, 25 bp, Rattus norvegicus
atgggccatgtcttacatccttcag

SEQ ID NO: 198221 - DNA, 25 bp, Rattus norvegicus
atgggccattttcatccaaattttc

SEQ ID NO: 198222 - DNA, 25 bp, Rattus norvegicus
atgggccattttgatccaaattttc

SEQ ID NO: 198223 - DNA, 25 bp, Rattus norvegicus
atgggcccaattaatactgctatag

SEQ ID NO: 198224 - DNA, 25 bp, Rattus norvegicus
atgggcccaatttatactgctatag

SEQ ID NO: 198225 - DNA, 25 bp, Rattus norvegicus
atgggcccaccacggaactggagcc

SEQ ID NO: 198226 - DNA, 25 bp, Rattus norvegicus
atgggcccaccagggaactggagcc

SEQ ID NO: 198227 - DNA, 25 bp, Rattus norvegicus
atgggcccagcaagctatgcgacaa

SEQ ID NO: 198228 - DNA, 25 bp, Rattus norvegicus
atgggcccagcatgctatgcgacaa

SEQ ID NO: 198229 - DNA, 25 bp, Rattus norvegicus
atgggccccaaaccactacatacag

SEQ ID NO: 198230 - DNA, 25 bp, Rattus norvegicus
atgggccccaaagcactacatacag

SEQ ID NO: 198231 - DNA, 25 bp, Rattus norvegicus
atgggccccacgacaggtcctgtat

SEQ ID NO: 198232 - DNA, 25 bp, Rattus norvegicus
atgggccccacgtcaggtcctgtat

SEQ ID NO: 198233 - DNA, 25 bp, Rattus norvegicus
atgggcccccaacttcaaagtctct

SEQ ID NO: 198234 - DNA, 25 bp, Rattus norvegicus
atgggcccccaagttcaaagtctct

SEQ ID NO: 198235 - DNA, 25 bp, Rattus norvegicus
atgggccccggtcactcagatgaag

SEQ ID NO: 198236 - DNA, 25 bp, Rattus norvegicus
atgggccccggtgactcagatgaag

SEQ ID NO: 198237 - DNA, 25 bp, Rattus norvegicus
atgggcccctgtcttgataatactc

SEQ ID NO: 198238 - DNA, 25 bp, Rattus norvegicus
atgggcccctgtgttgataatactc

SEQ ID NO: 198239 - DNA, 25 bp, Rattus norvegicus
atgggccctaaactcctggcggaga

SEQ ID NO: 198240 - DNA, 25 bp, Rattus norvegicus
atgggccctaaagtcctggcggaga

SEQ ID NO: 198241 - DNA, 25 bp, Rattus norvegicus
atgggccggtacacagagattttca

SEQ ID NO: 198242 - DNA, 25 bp, Rattus norvegicus
atgggccggtactcagagattttca

SEQ ID NO: 198243 - DNA, 25 bp, Rattus norvegicus
atgggccggtatctccactactggg

SEQ ID NO: 198244 - DNA, 25 bp, Rattus norvegicus
atgggccggtatgtccactactggg

SEQ ID NO: 198245 - DNA, 25 bp, Rattus norvegicus
atgggccgtcccatggaactgacca

SEQ ID NO: 198246 - DNA, 25 bp, Rattus norvegicus
atgggccgtcccttggaactgacca

SEQ ID NO: 198247 - DNA, 25 bp, Rattus norvegicus
atgggcctaaggcatacttctccag

SEQ ID NO: 198248 - DNA, 25 bp, Rattus norvegicus
atgggcctaagggatacttctccag

SEQ ID NO: 198249 - DNA, 25 bp, Rattus norvegicus
atgggcctaccaacatgagtttgat

SEQ ID NO: 198250 - DNA, 25 bp, Rattus norvegicus
atgggcctaccatcatgagtttgat

SEQ ID NO: 198251 - DNA, 25 bp, Rattus norvegicus
atgggcctactcagttacatctgca

SEQ ID NO: 198252 - DNA, 25 bp, Rattus norvegicus
atgggcctactctgttacatctgca

SEQ ID NO: 198253 - DNA, 25 bp, Rattus norvegicus
atgggcctagacctatgagatagct

SEQ ID NO: 198254 - DNA, 25 bp, Rattus norvegicus
atgggcctagacgtatgagatagct

SEQ ID NO: 198255 - DNA, 25 bp, Rattus norvegicus
atgggcctcctgactagactttggt

SEQ ID NO: 198256 - DNA, 25 bp, Rattus norvegicus
atgggcctcctgtctagactttggt

SEQ ID NO: 198257 - DNA, 25 bp, Rattus norvegicus
atgggcctgaaccagtgagtgtcct

SEQ ID NO: 198258 - DNA, 25 bp, Rattus norvegicus
atgggcctgaacgagtgagtgtcct

SEQ ID NO: 198259 - DNA, 25 bp, Rattus norvegicus
atgggcctgaagacttacctggtcc

SEQ ID NO: 198260 - DNA, 25 bp, Rattus norvegicus
atgggcctgaagtcttacctggtcc

SEQ ID NO: 198261 - DNA, 25 bp, Rattus norvegicus
atgggcctgcctaactgagagccag

SEQ ID NO: 198262 - DNA, 25 bp, Rattus norvegicus
atgggcctgccttactgagagccag

SEQ ID NO: 198263 - DNA, 25 bp, Rattus norvegicus
atgggcctgctacctgagcttcgga

SEQ ID NO: 198264 - DNA, 25 bp, Rattus norvegicus
atgggcctgctagctgagcttcgga

SEQ ID NO: 198265 - DNA, 25 bp, Rattus norvegicus
atgggcctggccagtggtaacaaga

SEQ ID NO: 198266 - DNA, 25 bp, Rattus norvegicus
atgggcctggcctgtggtaacaaga

SEQ ID NO: 198267 - DNA, 25 bp, Rattus norvegicus
atgggccttacacggctaggactga

SEQ ID NO: 198268 - DNA, 25 bp, Rattus norvegicus
atgggccttacagggctaggactga

SEQ ID NO: 198269 - DNA, 25 bp, Rattus norvegicus
atgggccttatcaaactgctttcct

SEQ ID NO: 198270 - DNA, 25 bp, Rattus norvegicus
atgggccttatctaactgctttcct

SEQ ID NO: 198271 - DNA, 25 bp, Rattus norvegicus
atgggccttcataggtgctgcagca

SEQ ID NO: 198272 - DNA, 25 bp, Rattus norvegicus
atgggccttcattggtgctgcagca

SEQ ID NO: 198273 - DNA, 25 bp, Rattus norvegicus
atgggccttgacattctcctatggc

SEQ ID NO: 198274 - DNA, 25 bp, Rattus norvegicus
atgggccttgactttctcctatggc

SEQ ID NO: 198275 - DNA, 25 bp, Rattus norvegicus
atgggccttgagcttatccttgtgc

SEQ ID NO: 198276 - DNA, 25 bp, Rattus norvegicus
atgggccttgaggttatccttgtgc

SEQ ID NO: 198277 - DNA, 25 bp, Rattus norvegicus
atgggccttggcaggcactcttttc

SEQ ID NO: 198278 - DNA, 25 bp, Rattus norvegicus
atgggccttggctggcactcttttc

SEQ ID NO: 198279 - DNA, 25 bp, Rattus norvegicus
atgggccttgtgaacctttgaactt

SEQ ID NO: 198280 - DNA, 25 bp, Rattus norvegicus
atgggccttgtgtacctttgaactt

SEQ ID NO: 198281 - DNA, 25 bp, Rattus norvegicus
atgggcctttggcaacaatccaggg

SEQ ID NO: 198282 - DNA, 25 bp, Rattus norvegicus
atgggcctttgggaacaatccaggg

SEQ ID NO: 198283 - DNA, 25 bp, Rattus norvegicus
atgggcctttttcccagttcatatg

SEQ ID NO: 198284 - DNA, 25 bp, Rattus norvegicus
atgggcctttttgccagttcatatg

SEQ ID NO: 198285 - DNA, 25 bp, Rattus norvegicus
atgggcgaccccagagagctgttaa

SEQ ID NO: 198286 - DNA, 25 bp, Rattus norvegicus
atgggcgacccctgagagctgttaa

SEQ ID NO: 198287 - DNA, 25 bp, Rattus norvegicus
atgggcgaccctcacagtctgagat

SEQ ID NO: 198288 - DNA, 25 bp, Rattus norvegicus
atgggcgaccctgacagtctgagat

SEQ ID NO: 198289 - DNA, 25 bp, Rattus norvegicus
atgggcgagatcctctagccttgta

SEQ ID NO: 198290 - DNA, 25 bp, Rattus norvegicus
atgggcgagatcgtctagccttgta

SEQ ID NO: 198291 - DNA, 25 bp, Rattus norvegicus
atgggcgagcatcctcacatacata

SEQ ID NO: 198292 - DNA, 25 bp, Rattus norvegicus
atgggcgagcatgctcacatacata

SEQ ID NO: 198293 - DNA, 25 bp, Rattus norvegicus
atgggcgatccaacagtgacaaact

SEQ ID NO: 198294 - DNA, 25 bp, Rattus norvegicus
atgggcgatccatcagtgacaaact

SEQ ID NO: 198295 - DNA, 25 bp, Rattus norvegicus
atgggcgcaaacactgttaccgact

SEQ ID NO: 198296 - DNA, 25 bp, Rattus norvegicus
atgggcgcaaactctgttaccgact

SEQ ID NO: 198297 - DNA, 25 bp, Rattus norvegicus
atgggcgcatacctgttactgaaac

SEQ ID NO: 198298 - DNA, 25 bp, Rattus norvegicus
atgggcgcatacgtgttactgaaac

SEQ ID NO: 198299 - DNA, 25 bp, Rattus norvegicus
atgggcgcattgatgagaccgatga

SEQ ID NO: 198300 - DNA, 25 bp, Rattus norvegicus
atgggcgcattgttgagaccgatga

SEQ ID NO: 198301 - DNA, 25 bp, Rattus norvegicus
atgggcgctactagacagtggctgc

SEQ ID NO: 198302 - DNA, 25 bp, Rattus norvegicus
atgggcgctacttgacagtggctgc

SEQ ID NO: 198303 - DNA, 25 bp, Rattus norvegicus
atgggcgctaggagccaactctagt

SEQ ID NO: 198304 - DNA, 25 bp, Rattus norvegicus
atgggcgctaggtgccaactctagt

SEQ ID NO: 198305 - DNA, 25 bp, Rattus norvegicus
atgggcgctcatcgaaatgtgcagt

SEQ ID NO: 198306 - DNA, 25 bp, Rattus norvegicus
atgggcgctcatggaaatgtgcagt

SEQ ID NO: 198307 - DNA, 25 bp, Rattus norvegicus
atgggcggattcaatggctttcctc

SEQ ID NO: 198308 - DNA, 25 bp, Rattus norvegicus
atgggcggattctatggctttcctc

SEQ ID NO: 198309 - DNA, 25 bp, Rattus norvegicus
atgggcggcgccatctccagcatgg

SEQ ID NO: 198310 - DNA, 25 bp, Rattus norvegicus
atgggcggcgccttctccagcatgg

SEQ ID NO: 198311 - DNA, 25 bp, Rattus norvegicus
atgggcggctacagcctggagttcc

SEQ ID NO: 198312 - DNA, 25 bp, Rattus norvegicus
atgggcggctactgcctggagttcc

SEQ ID NO: 198313 - DNA, 25 bp, Rattus norvegicus
atgggcgtccggagagcttcagtaa

SEQ ID NO: 198314 - DNA, 25 bp, Rattus norvegicus
atgggcgtccggtgagcttcagtaa

SEQ ID NO: 198315 - DNA, 25 bp, Rattus norvegicus
atgggcgtctcaatgtttctacaga

SEQ ID NO: 198316 - DNA, 25 bp, Rattus norvegicus
atgggcgtctcattgtttctacaga

SEQ ID NO: 198317 - DNA, 25 bp, Rattus norvegicus
atgggcgtgtgcactggttgactcc

SEQ ID NO: 198318 - DNA, 25 bp, Rattus norvegicus
atgggcgtgtgctctggttgactcc

SEQ ID NO: 198319 - DNA, 25 bp, Rattus norvegicus
atgggctaactgattcgtgcacaca

SEQ ID NO: 198320 - DNA, 25 bp, Rattus norvegicus
atgggctaactgtttcgtgcacaca

SEQ ID NO: 198321 - DNA, 25 bp, Rattus norvegicus
atgggctaagtcatccgggaatcct

SEQ ID NO: 198322 - DNA, 25 bp, Rattus norvegicus
atgggctaagtcttccgggaatcct

SEQ ID NO: 198323 - DNA, 25 bp, Rattus norvegicus
atgggctacaaaacctcgggctctt

SEQ ID NO: 198324 - DNA, 25 bp, Rattus norvegicus
atgggctacaaacactgctcagctc

SEQ ID NO: 198325 - DNA, 25 bp, Rattus norvegicus
atgggctacaaagactgctcagctc

SEQ ID NO: 198326 - DNA, 25 bp, Rattus norvegicus
atgggctacaaatcctcgggctctt

SEQ ID NO: 198327 - DNA, 25 bp, Rattus norvegicus
atgggctacagtacaacgtatcttt

SEQ ID NO: 198328 - DNA, 25 bp, Rattus norvegicus
atgggctacagttcaacgtatcttt

SEQ ID NO: 198329 - DNA, 25 bp, Rattus norvegicus
atgggctacgccaggaaagtaggct

SEQ ID NO: 198330 - DNA, 25 bp, Rattus norvegicus
atgggctacgcctggaaagtaggct

SEQ ID NO: 198331 - DNA, 25 bp, Rattus norvegicus
atgggctactttaggtatagacctt

SEQ ID NO: 198332 - DNA, 25 bp, Rattus norvegicus
atgggctactttctggagtccagcg

SEQ ID NO: 198333 - DNA, 25 bp, Rattus norvegicus
atgggctactttgtggagtccagcg

SEQ ID NO: 198334 - DNA, 25 bp, Rattus norvegicus
atgggctacttttggtatagacctt

SEQ ID NO: 198335 - DNA, 25 bp, Rattus norvegicus
atgggctagagcatgagtatttaat

SEQ ID NO: 198336 - DNA, 25 bp, Rattus norvegicus
atgggctagagcttgagtatttaat

SEQ ID NO: 198337 - DNA, 25 bp, Rattus norvegicus
atgggctagctccagcaatttcatg

SEQ ID NO: 198338 - DNA, 25 bp, Rattus norvegicus
atgggctagctcgagcaatttcatg

SEQ ID NO: 198339 - DNA, 25 bp, Rattus norvegicus
atgggctatagccaaatattcactt

SEQ ID NO: 198340 - DNA, 25 bp, Rattus norvegicus
atgggctatagcgaaatattcactt

SEQ ID NO: 198341 - DNA, 25 bp, Rattus norvegicus
atgggctatcacagtgggcagatac

SEQ ID NO: 198342 - DNA, 25 bp, Rattus norvegicus
atgggctatcactgtgggcagatac

SEQ ID NO: 198343 - DNA, 25 bp, Rattus norvegicus
atgggctatgctctggtgaacactg

SEQ ID NO: 198344 - DNA, 25 bp, Rattus norvegicus
atgggctatgctgtggtgaacactg

SEQ ID NO: 198345 - DNA, 25 bp, Rattus norvegicus
atgggctcaaagatgctcttctgtg

SEQ ID NO: 198346 - DNA, 25 bp, Rattus norvegicus
atgggctcaaagttgctcttctgtg

SEQ ID NO: 198347 - DNA, 25 bp, Rattus norvegicus
atgggctcaattaccccgagagact

SEQ ID NO: 198348 - DNA, 25 bp, Rattus norvegicus
atgggctcaatttccccgagagact

SEQ ID NO: 198349 - DNA, 25 bp, Rattus norvegicus
atgggctcacagatgagctgctttt

SEQ ID NO: 198350 - DNA, 25 bp, Rattus norvegicus
atgggctcacagttgagctgctttt

SEQ ID NO: 198351 - DNA, 25 bp, Rattus norvegicus
atgggctcactaaagctgttgctcc

SEQ ID NO: 198352 - DNA, 25 bp, Rattus norvegicus
atgggctcactatagctgttgctcc

SEQ ID NO: 198353 - DNA, 25 bp, Rattus norvegicus
atgggctcagccacggaaatgcttg

SEQ ID NO: 198354 - DNA, 25 bp, Rattus norvegicus
atgggctcagcctcggaaatgcttg

SEQ ID NO: 198355 - DNA, 25 bp, Rattus norvegicus
atgggctcaggaactctaacagcag

SEQ ID NO: 198356 - DNA, 25 bp, Rattus norvegicus
atgggctcaggatctctaacagcag

SEQ ID NO: 198357 - DNA, 25 bp, Rattus norvegicus
atgggctcaggcagtccctcaggat

SEQ ID NO: 198358 - DNA, 25 bp, Rattus norvegicus
atgggctcaggctgtccctcaggat

SEQ ID NO: 198359 - DNA, 25 bp, Rattus norvegicus
atgggctcagtcagatctgggccac

SEQ ID NO: 198360 - DNA, 25 bp, Rattus norvegicus
atgggctcagtctgatctgggccac

SEQ ID NO: 198361 - DNA, 25 bp, Rattus norvegicus
atgggctcatagacacccatgggct

SEQ ID NO: 198362 - DNA, 25 bp, Rattus norvegicus
atgggctcatagtcacccatgggct

SEQ ID NO: 198363 - DNA, 25 bp, Rattus norvegicus
atgggctcatccatggcccaaagaa

SEQ ID NO: 198364 - DNA, 25 bp, Rattus norvegicus
atgggctcatccttggcccaaagaa

SEQ ID NO: 198365 - DNA, 25 bp, Rattus norvegicus
atgggctccatcatgatcttatgtg

SEQ ID NO: 198366 - DNA, 25 bp, Rattus norvegicus
atgggctccatcttgatcttatgtg

SEQ ID NO: 198367 - DNA, 25 bp, Rattus norvegicus
atgggctccattccagaacacaagc

SEQ ID NO: 198368 - DNA, 25 bp, Rattus norvegicus
atgggctccattgcagaacacaagc

SEQ ID NO: 198369 - DNA, 25 bp, Rattus norvegicus
atgggctccgtgatagagaaccagc

SEQ ID NO: 198370 - DNA, 25 bp, Rattus norvegicus
atgggctccgtgctcagctagccta

SEQ ID NO: 198371 - DNA, 25 bp, Rattus norvegicus
atgggctccgtggtcagctagccta

SEQ ID NO: 198372 - DNA, 25 bp, Rattus norvegicus
atgggctccgtgttagagaaccagc

SEQ ID NO: 198373 - DNA, 25 bp, Rattus norvegicus
atgggctcctaacaggcaagcgtca

SEQ ID NO: 198374 - DNA, 25 bp, Rattus norvegicus
atgggctcctaagaggcaagcgtca

SEQ ID NO: 198375 - DNA, 25 bp, Rattus norvegicus
atgggctctaaccactggactcatg

SEQ ID NO: 198376 - DNA, 25 bp, Rattus norvegicus
atgggctctaacgactggactcatg

SEQ ID NO: 198377 - DNA, 25 bp, Rattus norvegicus
atgggctctcagctctgtgtataaa

SEQ ID NO: 198378 - DNA, 25 bp, Rattus norvegicus
atgggctctcaggtctgtgtataaa

SEQ ID NO: 198379 - DNA, 25 bp, Rattus norvegicus
atgggctctctcaggaagcaagtag

SEQ ID NO: 198380 - DNA, 25 bp, Rattus norvegicus
atgggctctctctggaagcaagtag

SEQ ID NO: 198381 - DNA, 25 bp, Rattus norvegicus
atgggctctgtcaggatctgcagct

SEQ ID NO: 198382 - DNA, 25 bp, Rattus norvegicus
atgggctctgtcatggctcaggtgc

SEQ ID NO: 198383 - DNA, 25 bp, Rattus norvegicus
atgggctctgtctggatctgcagct

SEQ ID NO: 198384 - DNA, 25 bp, Rattus norvegicus
atgggctctgtcttggctcaggtgc

SEQ ID NO: 198385 - DNA, 25 bp, Rattus norvegicus
atgggctctttccaaggctgatctt

SEQ ID NO: 198386 - DNA, 25 bp, Rattus norvegicus
atgggctctttcgaaggctgatctt

SEQ ID NO: 198387 - DNA, 25 bp, Rattus norvegicus
atgggctgccccaagtatcctgtga

SEQ ID NO: 198388 - DNA, 25 bp, Rattus norvegicus
atgggctgcccctagtatcctgtga

SEQ ID NO: 198389 - DNA, 25 bp, Rattus norvegicus
atgggctgcctgacggtgagtcctt

SEQ ID NO: 198390 - DNA, 25 bp, Rattus norvegicus
atgggctgcctgtcggtgagtcctt

SEQ ID NO: 198391 - DNA, 25 bp, Rattus norvegicus
atgggctgctggcacatgtatcgtc

SEQ ID NO: 198392 - DNA, 25 bp, Rattus norvegicus
atgggctgctgggacatgtatcgtc

SEQ ID NO: 198393 - DNA, 25 bp, Rattus norvegicus
atgggctgggctatgaagagcttca

SEQ ID NO: 198394 - DNA, 25 bp, Rattus norvegicus
atgggctgggctttgaagagcttca

SEQ ID NO: 198395 - DNA, 25 bp, Rattus norvegicus
atgggctgtcagaggcctgatagat

SEQ ID NO: 198396 - DNA, 25 bp, Rattus norvegicus
atgggctgtcagtggcctgatagat

SEQ ID NO: 198397 - DNA, 25 bp, Rattus norvegicus
atgggctgtgacaatttgacccgcc

SEQ ID NO: 198398 - DNA, 25 bp, Rattus norvegicus
atgggctgtgactatttgacccgcc

SEQ ID NO: 198399 - DNA, 25 bp, Rattus norvegicus
atgggctgtggaatctcaccttaaa

SEQ ID NO: 198400 - DNA, 25 bp, Rattus norvegicus
atgggctgtggattctcaccttaaa

SEQ ID NO: 198401 - DNA, 25 bp, Rattus norvegicus
atgggctgtgtgaaaacccggcaga

SEQ ID NO: 198402 - DNA, 25 bp, Rattus norvegicus
atgggctgtgtgtaaacccggcaga

SEQ ID NO: 198403 - DNA, 25 bp, Rattus norvegicus
atgggcttcaccctgatgttttggt

SEQ ID NO: 198404 - DNA, 25 bp, Rattus norvegicus
atgggcttcaccgtgatgttttggt

SEQ ID NO: 198405 - DNA, 25 bp, Rattus norvegicus
atgggcttcagactcagacctacat

SEQ ID NO: 198406 - DNA, 25 bp, Rattus norvegicus
atgggcttcagagtcagacctacat

SEQ ID NO: 198407 - DNA, 25 bp, Rattus norvegicus
atgggcttcatgacctcatcaggtc

SEQ ID NO: 198408 - DNA, 25 bp, Rattus norvegicus
atgggcttcatgtcctcatcaggtc

SEQ ID NO: 198409 - DNA, 25 bp, Rattus norvegicus
atgggcttccatacctgttttctta

SEQ ID NO: 198410 - DNA, 25 bp, Rattus norvegicus
atgggcttccattcctgttttctta

SEQ ID NO: 198411 - DNA, 25 bp, Rattus norvegicus
atgggcttcccaaggacttaactgc

SEQ ID NO: 198412 - DNA, 25 bp, Rattus norvegicus
atgggcttcccatggacttaactgc

SEQ ID NO: 198413 - DNA, 25 bp, Rattus norvegicus
atgggcttccctatggaggcctgca

SEQ ID NO: 198414 - DNA, 25 bp, Rattus norvegicus
atgggcttccctcagagcagtctgc

SEQ ID NO: 198415 - DNA, 25 bp, Rattus norvegicus
atgggcttccctgagagcagtctgc

SEQ ID NO: 198416 - DNA, 25 bp, Rattus norvegicus
atgggcttccctttggaggcctgca

SEQ ID NO: 198417 - DNA, 25 bp, Rattus norvegicus
atgggcttccggaggtgacaactta

SEQ ID NO: 198418 - DNA, 25 bp, Rattus norvegicus
atgggcttccggtggtgacaactta

SEQ ID NO: 198419 - DNA, 25 bp, Rattus norvegicus
atgggcttctctctattttatactt

SEQ ID NO: 198420 - DNA, 25 bp, Rattus norvegicus
atgggcttctctgtattttatactt

SEQ ID NO: 198421 - DNA, 25 bp, Rattus norvegicus
atgggcttctgcctaattactcagc

SEQ ID NO: 198422 - DNA, 25 bp, Rattus norvegicus
atgggcttctgcgtaattactcagc

SEQ ID NO: 198423 - DNA, 25 bp, Rattus norvegicus
atgggcttcttgactgttctctgtt

SEQ ID NO: 198424 - DNA, 25 bp, Rattus norvegicus
atgggcttcttgtctgttctctgtt

SEQ ID NO: 198425 - DNA, 25 bp, Rattus norvegicus
atgggcttctttaaattctatatta

SEQ ID NO: 198426 - DNA, 25 bp, Rattus norvegicus
atgggcttcttttaattctatatta

SEQ ID NO: 198427 - DNA, 25 bp, Rattus norvegicus
atgggcttgccaaatacttgccaaa

SEQ ID NO: 198428 - DNA, 25 bp, Rattus norvegicus
atgggcttgccatatacttgccaaa

SEQ ID NO: 198429 - DNA, 25 bp, Rattus norvegicus
atgggcttgctgcattcagagcgtt

SEQ ID NO: 198430 - DNA, 25 bp, Rattus norvegicus
atgggcttgctggattcagagcgtt

SEQ ID NO: 198431 - DNA, 25 bp, Rattus norvegicus
atgggcttggctcttcaggtgcaca

SEQ ID NO: 198432 - DNA, 25 bp, Rattus norvegicus
atgggcttggctgttcaggtgcaca

SEQ ID NO: 198433 - DNA, 25 bp, Rattus norvegicus
atgggcttggtacccttctggtcac

SEQ ID NO: 198434 - DNA, 25 bp, Rattus norvegicus
atgggcttggtagccttctggtcac

SEQ ID NO: 198435 - DNA, 25 bp, Rattus norvegicus
atgggcttgttcctgtgtgcgtcca

SEQ ID NO: 198436 - DNA, 25 bp, Rattus norvegicus
atgggcttgttcgtgtgtgcgtcca

SEQ ID NO: 198437 - DNA, 25 bp, Rattus norvegicus
atgggctttaccacaaaggactggc

SEQ ID NO: 198438 - DNA, 25 bp, Rattus norvegicus
atgggctttacctcaaaggactggc

SEQ ID NO: 198439 - DNA, 25 bp, Rattus norvegicus
atgggctttcggcttcctgtgctct

SEQ ID NO: 198440 - DNA, 25 bp, Rattus norvegicus
atgggctttcgggttcctgtgctct

SEQ ID NO: 198441 - DNA, 25 bp, Rattus norvegicus
atgggctttctgacttcagtgccaa

SEQ ID NO: 198442 - DNA, 25 bp, Rattus norvegicus
atgggctttctgtcttcagtgccaa

SEQ ID NO: 198443 - DNA, 25 bp, Rattus norvegicus
atggggaccagtcctttctttcttt

SEQ ID NO: 198444 - DNA, 25 bp, Rattus norvegicus
atggggaccagtgctttctttcttt

SEQ ID NO: 198445 - DNA, 25 bp, Rattus norvegicus
atgggtaagacaccactcaacagac

SEQ ID NO: 198446 - DNA, 25 bp, Rattus norvegicus
atgggtaagacagcactcaacagac

SEQ ID NO: 198447 - DNA, 25 bp, Rattus norvegicus
atgggtaagcgtcgtgtgtcacacc

SEQ ID NO: 198448 - DNA, 25 bp, Rattus norvegicus
atgggtaagcgtggtgtgtcacacc

SEQ ID NO: 198449 - DNA, 25 bp, Rattus norvegicus
atgggtacacaaacacttctctcgg

SEQ ID NO: 198450 - DNA, 25 bp, Rattus norvegicus
atgggtacacaatcacttctctcgg

SEQ ID NO: 198451 - DNA, 25 bp, Rattus norvegicus
atgggtacactcatgaccttgttta

SEQ ID NO: 198452 - DNA, 25 bp, Rattus norvegicus
atgggtacactcttgaccttgttta

SEQ ID NO: 198453 - DNA, 25 bp, Rattus norvegicus
atgggtacagaaagccttctcctgg

SEQ ID NO: 198454 - DNA, 25 bp, Rattus norvegicus
atgggtacagaatgccttctcctgg

SEQ ID NO: 198455 - DNA, 25 bp, Rattus norvegicus
atgggtacagccatcaccaaggtca

SEQ ID NO: 198456 - DNA, 25 bp, Rattus norvegicus
atgggtacagccttcaccaaggtca

SEQ ID NO: 198457 - DNA, 25 bp, Rattus norvegicus
atgggtacagctcactccagaggag

SEQ ID NO: 198458 - DNA, 25 bp, Rattus norvegicus
atgggtacagctgactccagaggag

SEQ ID NO: 198459 - DNA, 25 bp, Rattus norvegicus
atgggtaccacgaatgtagcacaca

SEQ ID NO: 198460 - DNA, 25 bp, Rattus norvegicus
atgggtaccacgtatgtagcacaca

SEQ ID NO: 198461 - DNA, 25 bp, Rattus norvegicus
atgggtacccagaaagtgtccttgc

SEQ ID NO: 198462 - DNA, 25 bp, Rattus norvegicus
atgggtacccagtaagtgtccttgc

SEQ ID NO: 198463 - DNA, 25 bp, Rattus norvegicus
atgggtacccatatcttgatgtgaa

SEQ ID NO: 198464 - DNA, 25 bp, Rattus norvegicus
atgggtacccatttcttgatgtgaa

SEQ ID NO: 198465 - DNA, 25 bp, Rattus norvegicus
atgggtacgttactctccttggagc

SEQ ID NO: 198466 - DNA, 25 bp, Rattus norvegicus
atgggtacgttagtctccttggagc

SEQ ID NO: 198467 - DNA, 25 bp, Rattus norvegicus
atgggtactcagcaaaggaccttac

SEQ ID NO: 198468 - DNA, 25 bp, Rattus norvegicus
atgggtactcaggaaaggaccttac

SEQ ID NO: 198469 - DNA, 25 bp, Rattus norvegicus
atgggtactgcaactgtaaaattgg

SEQ ID NO: 198470 - DNA, 25 bp, Rattus norvegicus
atgggtactgcatctgtaaaattgg

SEQ ID NO: 198471 - DNA, 25 bp, Rattus norvegicus
atgggtactgtgaactgtcacctcc

SEQ ID NO: 198472 - DNA, 25 bp, Rattus norvegicus
atgggtactgtgtactgtcacctcc

SEQ ID NO: 198473 - DNA, 25 bp, Rattus norvegicus
atgggtactttacgcaattccaaga

SEQ ID NO: 198474 - DNA, 25 bp, Rattus norvegicus
atgggtactttaggcaattccaaga

SEQ ID NO: 198475 - DNA, 25 bp, Rattus norvegicus
atgggtagtgccctagcctgaaagc

SEQ ID NO: 198476 - DNA, 25 bp, Rattus norvegicus
atgggtagtgccgtagcctgaaagc

SEQ ID NO: 198477 - DNA, 25 bp, Rattus norvegicus
atgggtatactcaagaaggcagttc

SEQ ID NO: 198478 - DNA, 25 bp, Rattus norvegicus
atgggtatactctagaaggcagttc

SEQ ID NO: 198479 - DNA, 25 bp, Rattus norvegicus
atgggtatggtactgaagtttcttc

SEQ ID NO: 198480 - DNA, 25 bp, Rattus norvegicus
atgggtatggtagtgaagtttcttc

SEQ ID NO: 198481 - DNA, 25 bp, Rattus norvegicus
atgggtattgccaaacagactttat

SEQ ID NO: 198482 - DNA, 25 bp, Rattus norvegicus
atgggtattgcctaacagactttat

SEQ ID NO: 198483 - DNA, 25 bp, Rattus norvegicus
atgggtcaaaatacacctcgttgcc

SEQ ID NO: 198484 - DNA, 25 bp, Rattus norvegicus
atgggtcaaaattcacctcgttgcc

SEQ ID NO: 198485 - DNA, 25 bp, Rattus norvegicus
atgggtcaacatacaggtccacaga

SEQ ID NO: 198486 - DNA, 25 bp, Rattus norvegicus
atgggtcaacattcaggtccacaga

SEQ ID NO: 198487 - DNA, 25 bp, Rattus norvegicus
atgggtcacatgatccctgtgtgct

SEQ ID NO: 198488 - DNA, 25 bp, Rattus norvegicus
atgggtcacatgttccctgtgtgct

SEQ ID NO: 198489 - DNA, 25 bp, Rattus norvegicus
atgggtcactataggtcacctcttc

SEQ ID NO: 198490 - DNA, 25 bp, Rattus norvegicus
atgggtcactatcctcctggtctag

SEQ ID NO: 198491 - DNA, 25 bp, Rattus norvegicus
atgggtcactatgctcctggtctag

SEQ ID NO: 198492 - DNA, 25 bp, Rattus norvegicus
atgggtcactattggtcacctcttc

SEQ ID NO: 198493 - DNA, 25 bp, Rattus norvegicus
atgggtcagcacctgtattcacatc

SEQ ID NO: 198494 - DNA, 25 bp, Rattus norvegicus
atgggtcagcacgtgtattcacatc

SEQ ID NO: 198495 - DNA, 25 bp, Rattus norvegicus
atgggtcagtacagatcctcacttg

SEQ ID NO: 198496 - DNA, 25 bp, Rattus norvegicus
atgggtcagtactgatcctcacttg

SEQ ID NO: 198497 - DNA, 25 bp, Rattus norvegicus
atgggtcatatacaccaccgaaatg

SEQ ID NO: 198498 - DNA, 25 bp, Rattus norvegicus
atgggtcatatagaccaccgaaatg

SEQ ID NO: 198499 - DNA, 25 bp, Rattus norvegicus
atgggtcatgaaccctacctttcaa

SEQ ID NO: 198500 - DNA, 25 bp, Rattus norvegicus
atgggtcatgaagcctacctttcaa

SEQ ID NO: 198501 - DNA, 25 bp, Rattus norvegicus
atgggtcattgtaaacctgtcccca

SEQ ID NO: 198502 - DNA, 25 bp, Rattus norvegicus
atgggtcattgttaacctgtcccca

SEQ ID NO: 198503 - DNA, 25 bp, Rattus norvegicus
atgggtccaccgacagagcagttga

SEQ ID NO: 198504 - DNA, 25 bp, Rattus norvegicus
atgggtccaccgtcagagcagttga

SEQ ID NO: 198505 - DNA, 25 bp, Rattus norvegicus
atgggtccactgaagcaagtttctt

SEQ ID NO: 198506 - DNA, 25 bp, Rattus norvegicus
atgggtccactgtagcaagtttctt

SEQ ID NO: 198507 - DNA, 25 bp, Rattus norvegicus
atgggtccagataacagagtccttg

SEQ ID NO: 198508 - DNA, 25 bp, Rattus norvegicus
atgggtccagattacagagtccttg

SEQ ID NO: 198509 - DNA, 25 bp, Rattus norvegicus
atgggtccaggaaacttcaaattat

SEQ ID NO: 198510 - DNA, 25 bp, Rattus norvegicus
atgggtccaggaactggttccacga

SEQ ID NO: 198511 - DNA, 25 bp, Rattus norvegicus
atgggtccaggatacttcaaattat

SEQ ID NO: 198512 - DNA, 25 bp, Rattus norvegicus
atgggtccaggatctggttccacga

SEQ ID NO: 198513 - DNA, 25 bp, Rattus norvegicus
atgggtccatttatcctggaatagc

SEQ ID NO: 198514 - DNA, 25 bp, Rattus norvegicus
atgggtccatttttcctggaatagc

SEQ ID NO: 198515 - DNA, 25 bp, Rattus norvegicus
atgggtcccaggaatgcatgtacag

SEQ ID NO: 198516 - DNA, 25 bp, Rattus norvegicus
atgggtcccaggtatgcatgtacag

SEQ ID NO: 198517 - DNA, 25 bp, Rattus norvegicus
atgggtccgtggaatagcctccata

SEQ ID NO: 198518 - DNA, 25 bp, Rattus norvegicus
atgggtccgtggtatagcctccata

SEQ ID NO: 198519 - DNA, 25 bp, Rattus norvegicus
atgggtcctgttcaggtacgcacac

SEQ ID NO: 198520 - DNA, 25 bp, Rattus norvegicus
atgggtcctgttgaggtacgcacac

SEQ ID NO: 198521 - DNA, 25 bp, Rattus norvegicus
atgggtccttcacactggaggtgac

SEQ ID NO: 198522 - DNA, 25 bp, Rattus norvegicus
atgggtccttcagactggaggtgac

SEQ ID NO: 198523 - DNA, 25 bp, Rattus norvegicus
atgggtcgagaaaccagcttctttc

SEQ ID NO: 198524 - DNA, 25 bp, Rattus norvegicus
atgggtcgagaatccagcttctttc

SEQ ID NO: 198525 - DNA, 25 bp, Rattus norvegicus
atgggtcgaggcacctgagaactgc

SEQ ID NO: 198526 - DNA, 25 bp, Rattus norvegicus
atgggtcgaggctcctgagaactgc

SEQ ID NO: 198527 - DNA, 25 bp, Rattus norvegicus
atgggtctaaaaaggccggtcctag

SEQ ID NO: 198528 - DNA, 25 bp, Rattus norvegicus
atgggtctaaaatggccggtcctag

SEQ ID NO: 198529 - DNA, 25 bp, Rattus norvegicus
atgggtctatgaagagtttcactta

SEQ ID NO: 198530 - DNA, 25 bp, Rattus norvegicus
atgggtctatgatgagtttcactta

SEQ ID NO: 198531 - DNA, 25 bp, Rattus norvegicus
atgggtctatggctccaggcccaaa

SEQ ID NO: 198532 - DNA, 25 bp, Rattus norvegicus
atgggtctatgggtccaggcccaaa

SEQ ID NO: 198533 - DNA, 25 bp, Rattus norvegicus
atgggtctattcaagccactctgac

SEQ ID NO: 198534 - DNA, 25 bp, Rattus norvegicus
atgggtctattctagccactctgac

SEQ ID NO: 198535 - DNA, 25 bp, Rattus norvegicus
atgggtctcatgcatacaacactgg

SEQ ID NO: 198536 - DNA, 25 bp, Rattus norvegicus
atgggtctcatggatacaacactgg

SEQ ID NO: 198537 - DNA, 25 bp, Rattus norvegicus
atgggtctccagctcaaggttgact

SEQ ID NO: 198538 - DNA, 25 bp, Rattus norvegicus
atgggtctccaggtcaaggttgact

SEQ ID NO: 198539 - DNA, 25 bp, Rattus norvegicus
atgggtctctatctctattgtctaa

SEQ ID NO: 198540 - DNA, 25 bp, Rattus norvegicus
atgggtctctatgtctattgtctaa

SEQ ID NO: 198541 - DNA, 25 bp, Rattus norvegicus
atgggtctgacacctccggtgttgt

SEQ ID NO: 198542 - DNA, 25 bp, Rattus norvegicus
atgggtctgacagctccggtgttgt

SEQ ID NO: 198543 - DNA, 25 bp, Rattus norvegicus
atgggtctgcataagttgcaacaat

SEQ ID NO: 198544 - DNA, 25 bp, Rattus norvegicus
atgggtctgcattagttgcaacaat

SEQ ID NO: 198545 - DNA, 25 bp, Rattus norvegicus
atgggtctgcctagaaacagcacaa

SEQ ID NO: 198546 - DNA, 25 bp, Rattus norvegicus
atgggtctgccttgaaacagcacaa

SEQ ID NO: 198547 - DNA, 25 bp, Rattus norvegicus
atgggtctgggcctcttctgcatcc

SEQ ID NO: 198548 - DNA, 25 bp, Rattus norvegicus
atgggtctgggcgtcttctgcatcc

SEQ ID NO: 198549 - DNA, 25 bp, Rattus norvegicus
atgggtctgtgtaagtgtcttcccc

SEQ ID NO: 198550 - DNA, 25 bp, Rattus norvegicus
atgggtctgtgttagtgtcttcccc

SEQ ID NO: 198551 - DNA, 25 bp, Rattus norvegicus
atgggtcttcataccaagagcactg

SEQ ID NO: 198552 - DNA, 25 bp, Rattus norvegicus
atgggtcttcattccaagagcactg

SEQ ID NO: 198553 - DNA, 25 bp, Rattus norvegicus
atgggtcttgagcttgtgatcctcc

SEQ ID NO: 198554 - DNA, 25 bp, Rattus norvegicus
atgggtcttgaggttgtgatcctcc

SEQ ID NO: 198555 - DNA, 25 bp, Rattus norvegicus
atgggtcttggaacattcttggcac

SEQ ID NO: 198556 - DNA, 25 bp, Rattus norvegicus
atgggtcttggatcattcttggcac

SEQ ID NO: 198557 - DNA, 25 bp, Rattus norvegicus
atgggtcttggtctggtctcttcta

SEQ ID NO: 198558 - DNA, 25 bp, Rattus norvegicus
atgggtcttggtgtggtctcttcta

SEQ ID NO: 198559 - DNA, 25 bp, Rattus norvegicus
atgggtcttttaaagggaaacactg

SEQ ID NO: 198560 - DNA, 25 bp, Rattus norvegicus
atgggtcttttatagggaaacactg

SEQ ID NO: 198561 - DNA, 25 bp, Rattus norvegicus
atgggtgaacccctggtgcattcac

SEQ ID NO: 198562 - DNA, 25 bp, Rattus norvegicus
atgggtgaacccgtggtgcattcac

SEQ ID NO: 198563 - DNA, 25 bp, Rattus norvegicus
atgggtgaactaaccacctctcact

SEQ ID NO: 198564 - DNA, 25 bp, Rattus norvegicus
atgggtgaactacatcagcgcctgc

SEQ ID NO: 198565 - DNA, 25 bp, Rattus norvegicus
atgggtgaactagatcagcgcctgc

SEQ ID NO: 198566 - DNA, 25 bp, Rattus norvegicus
atgggtgaactatccacctctcact

SEQ ID NO: 198567 - DNA, 25 bp, Rattus norvegicus
atgggtgacctaaggcttcctggtt

SEQ ID NO: 198568 - DNA, 25 bp, Rattus norvegicus
atgggtgacctatggcttcctggtt

SEQ ID NO: 198569 - DNA, 25 bp, Rattus norvegicus
atgggtgacgagacagcctgcatcg

SEQ ID NO: 198570 - DNA, 25 bp, Rattus norvegicus
atgggtgacgagtcagcctgcatcg

SEQ ID NO: 198571 - DNA, 25 bp, Rattus norvegicus
atgggtgactacacacaccgggtac

SEQ ID NO: 198572 - DNA, 25 bp, Rattus norvegicus
atgggtgactactcacaccgggtac

SEQ ID NO: 198573 - DNA, 25 bp, Rattus norvegicus
atgggtgactctcacagtggcccgc

SEQ ID NO: 198574 - DNA, 25 bp, Rattus norvegicus
atgggtgactctgacagtggcccgc

SEQ ID NO: 198575 - DNA, 25 bp, Rattus norvegicus
atgggtgagccaccaatgcgcatgc

SEQ ID NO: 198576 - DNA, 25 bp, Rattus norvegicus
atgggtgagccagcaatgcgcatgc

SEQ ID NO: 198577 - DNA, 25 bp, Rattus norvegicus
atgggtgatagcatgggaagccttc

SEQ ID NO: 198578 - DNA, 25 bp, Rattus norvegicus
atgggtgatagcttgggaagccttc

SEQ ID NO: 198579 - DNA, 25 bp, Rattus norvegicus
atgggtgatgacagtagctgcccct

SEQ ID NO: 198580 - DNA, 25 bp, Rattus norvegicus
atgggtgatgactgtagctgcccct

SEQ ID NO: 198581 - DNA, 25 bp, Rattus norvegicus
atgggtgattatccagacttctggg

SEQ ID NO: 198582 - DNA, 25 bp, Rattus norvegicus
atgggtgattatgcagacttctggg

SEQ ID NO: 198583 - DNA, 25 bp, Rattus norvegicus
atgggtgattctacctacaagttca

SEQ ID NO: 198584 - DNA, 25 bp, Rattus norvegicus
atgggtgattcttcctacaagttca

SEQ ID NO: 198585 - DNA, 25 bp, Rattus norvegicus
atgggtgcagcaatcctttggacaa

SEQ ID NO: 198586 - DNA, 25 bp, Rattus norvegicus
atgggtgcagcattcctttggacaa

SEQ ID NO: 198587 - DNA, 25 bp, Rattus norvegicus
atgggtgcatacactgttgctgctg

SEQ ID NO: 198588 - DNA, 25 bp, Rattus norvegicus
atgggtgcatactctgttgctgctg

SEQ ID NO: 198589 - DNA, 25 bp, Rattus norvegicus
atgggtgccagcacctggaaggaat

SEQ ID NO: 198590 - DNA, 25 bp, Rattus norvegicus
atgggtgccagctcctggaaggaat

SEQ ID NO: 198591 - DNA, 25 bp, Rattus norvegicus
atgggtgccgccatgttattgtgcc

SEQ ID NO: 198592 - DNA, 25 bp, Rattus norvegicus
atgggtgccgccttgttattgtgcc

SEQ ID NO: 198593 - DNA, 25 bp, Rattus norvegicus
atgggtgccgtgaggagtccattta

SEQ ID NO: 198594 - DNA, 25 bp, Rattus norvegicus
atgggtgccgtgtggagtccattta

SEQ ID NO: 198595 - DNA, 25 bp, Rattus norvegicus
atgggtgcgctcagacacaggatta

SEQ ID NO: 198596 - DNA, 25 bp, Rattus norvegicus
atgggtgcgctctgacacaggatta

SEQ ID NO: 198597 - DNA, 25 bp, Rattus norvegicus
atgggtgcgtaaaccaaaaatcagt

SEQ ID NO: 198598 - DNA, 25 bp, Rattus norvegicus
atgggtgcgtaatccaaaaatcagt

SEQ ID NO: 198599 - DNA, 25 bp, Rattus norvegicus
atgggtgctaccaatttattgctta

SEQ ID NO: 198600 - DNA, 25 bp, Rattus norvegicus
atgggtgctacctatttattgctta

SEQ ID NO: 198601 - DNA, 25 bp, Rattus norvegicus
atgggtgctgaccaactctgcattt

SEQ ID NO: 198602 - DNA, 25 bp, Rattus norvegicus
atgggtgctgacgaactctgcattt

SEQ ID NO: 198603 - DNA, 25 bp, Rattus norvegicus
atgggtgcttacaggaattccacaa

SEQ ID NO: 198604 - DNA, 25 bp, Rattus norvegicus
atgggtgcttactggaattccacaa

SEQ ID NO: 198605 - DNA, 25 bp, Rattus norvegicus
atgggtggatcccagccattcatgt

SEQ ID NO: 198606 - DNA, 25 bp, Rattus norvegicus
atgggtggatccgagccattcatgt

SEQ ID NO: 198607 - DNA, 25 bp, Rattus norvegicus
atgggtggatttcgtgctcagcctc

SEQ ID NO: 198608 - DNA, 25 bp, Rattus norvegicus
atgggtggatttggtgctcagcctc

SEQ ID NO: 198609 - DNA, 25 bp, Rattus norvegicus
atgggtggctacatgaccaacctgc

SEQ ID NO: 198610 - DNA, 25 bp, Rattus norvegicus
atgggtggctacttgaccaacctgc

SEQ ID NO: 198611 - DNA, 25 bp, Rattus norvegicus
atgggtggtactatcaagtgccccg

SEQ ID NO: 198612 - DNA, 25 bp, Rattus norvegicus
atgggtggtactttcaagtgccccg

SEQ ID NO: 198613 - DNA, 25 bp, Rattus norvegicus
atgggtggttgcagctcagtttata

SEQ ID NO: 198614 - DNA, 25 bp, Rattus norvegicus
atgggtggttgctgctcagtttata

SEQ ID NO: 198615 - DNA, 25 bp, Rattus norvegicus
atgggtgtatcccttgttgttgtct

SEQ ID NO: 198616 - DNA, 25 bp, Rattus norvegicus
atgggtgtatccgttgttgttgtct

SEQ ID NO: 198617 - DNA, 25 bp, Rattus norvegicus
atgggtgtattgaccacatgtatgt

SEQ ID NO: 198618 - DNA, 25 bp, Rattus norvegicus
atgggtgtattgtccacatgtatgt

SEQ ID NO: 198619 - DNA, 25 bp, Rattus norvegicus
atgggtgtcctacggcatcagctga

SEQ ID NO: 198620 - DNA, 25 bp, Rattus norvegicus
atgggtgtcctagggcatcagctga

SEQ ID NO: 198621 - DNA, 25 bp, Rattus norvegicus
atgggtgtccttaccagttaccagg

SEQ ID NO: 198622 - DNA, 25 bp, Rattus norvegicus
atgggtgtcctttccagttaccagg

SEQ ID NO: 198623 - DNA, 25 bp, Rattus norvegicus
atgggtgtctatcgcgctctcacca

SEQ ID NO: 198624 - DNA, 25 bp, Rattus norvegicus
atgggtgtctatggcgctctcacca

SEQ ID NO: 198625 - DNA, 25 bp, Rattus norvegicus
atgggtgtgaccaaagcgggcatca

SEQ ID NO: 198626 - DNA, 25 bp, Rattus norvegicus
atgggtgtgacctaagcgggcatca

SEQ ID NO: 198627 - DNA, 25 bp, Rattus norvegicus
atgggtgtgcttatattgtatgtaa

SEQ ID NO: 198628 - DNA, 25 bp, Rattus norvegicus
atgggtgtgcttttattgtatgtaa

SEQ ID NO: 198629 - DNA, 25 bp, Rattus norvegicus
atgggtgtggccaatgctctgtccc

SEQ ID NO: 198630 - DNA, 25 bp, Rattus norvegicus
atgggtgtggcctatgctctgtccc

SEQ ID NO: 198631 - DNA, 25 bp, Rattus norvegicus
atgggtgttccaagactcttaagag

SEQ ID NO: 198632 - DNA, 25 bp, Rattus norvegicus
atgggtgttccatgactcttaagag

SEQ ID NO: 198633 - DNA, 25 bp, Rattus norvegicus
atgggtgttcccatgagtgttgcca

SEQ ID NO: 198634 - DNA, 25 bp, Rattus norvegicus
atgggtgttcccttgagtgttgcca

SEQ ID NO: 198635 - DNA, 25 bp, Rattus norvegicus
atgggtgttttgactcaaagcacgc

SEQ ID NO: 198636 - DNA, 25 bp, Rattus norvegicus
atgggtgttttgtctcaaagcacgc

SEQ ID NO: 198637 - DNA, 25 bp, Rattus norvegicus
atgggttaactgaaattttagctag

SEQ ID NO: 198638 - DNA, 25 bp, Rattus norvegicus
atgggttaactgtaattttagctag

SEQ ID NO: 198639 - DNA, 25 bp, Rattus norvegicus
atgggttacactactctgctgtgga

SEQ ID NO: 198640 - DNA, 25 bp, Rattus norvegicus
atgggttacacttctctgctgtgga

SEQ ID NO: 198641 - DNA, 25 bp, Rattus norvegicus
atgggttaccacagggctgctctgt

SEQ ID NO: 198642 - DNA, 25 bp, Rattus norvegicus
atgggttaccactgggctgctctgt

SEQ ID NO: 198643 - DNA, 25 bp, Rattus norvegicus
atgggttagagtcctcatccagaaa

SEQ ID NO: 198644 - DNA, 25 bp, Rattus norvegicus
atgggttagagtgctcatccagaaa

SEQ ID NO: 198645 - DNA, 25 bp, Rattus norvegicus
atgggttagatcaggctacccaacc

SEQ ID NO: 198646 - DNA, 25 bp, Rattus norvegicus
atgggttagatctggctacccaacc

SEQ ID NO: 198647 - DNA, 25 bp, Rattus norvegicus
atgggttatttcctggttggcaagc

SEQ ID NO: 198648 - DNA, 25 bp, Rattus norvegicus
atgggttatttcgtggttggcaagc

SEQ ID NO: 198649 - DNA, 25 bp, Rattus norvegicus
atgggttcactcagtggtgtcctca

SEQ ID NO: 198650 - DNA, 25 bp, Rattus norvegicus
atgggttcactctgtggtgtcctca

SEQ ID NO: 198651 - DNA, 25 bp, Rattus norvegicus
atgggttcagctagtgctgccggaa

SEQ ID NO: 198652 - DNA, 25 bp, Rattus norvegicus
atgggttcagcttgtgctgccggaa

SEQ ID NO: 198653 - DNA, 25 bp, Rattus norvegicus
atgggttcaggcctcagctctgtca

SEQ ID NO: 198654 - DNA, 25 bp, Rattus norvegicus
atgggttcaggcgtcagctctgtca

SEQ ID NO: 198655 - DNA, 25 bp, Rattus norvegicus
atgggttccaatccccaggacacat

SEQ ID NO: 198656 - DNA, 25 bp, Rattus norvegicus
atgggttccaatgcccaggacacat

SEQ ID NO: 198657 - DNA, 25 bp, Rattus norvegicus
atgggttccaggcttcagatgacga

SEQ ID NO: 198658 - DNA, 25 bp, Rattus norvegicus
atgggttccagggttcagatgacga

SEQ ID NO: 198659 - DNA, 25 bp, Rattus norvegicus
atgggttcccacacaaaatgtggat

SEQ ID NO: 198660 - DNA, 25 bp, Rattus norvegicus
atgggttcccactcaaaatgtggat

SEQ ID NO: 198661 - DNA, 25 bp, Rattus norvegicus
atgggttccccacaaatcatcgaga

SEQ ID NO: 198662 - DNA, 25 bp, Rattus norvegicus
atgggttccccagaaatcatcgaga

SEQ ID NO: 198663 - DNA, 25 bp, Rattus norvegicus
atgggttcctacctctgtaacactg

SEQ ID NO: 198664 - DNA, 25 bp, Rattus norvegicus
atgggttcctacgtctgtaacactg

SEQ ID NO: 198665 - DNA, 25 bp, Rattus norvegicus
atgggttcctccactgacaatggaa

SEQ ID NO: 198666 - DNA, 25 bp, Rattus norvegicus
atgggttcctcctctgacaatggaa

SEQ ID NO: 198667 - DNA, 25 bp, Rattus norvegicus
atgggttcggtgactaacacatcag

SEQ ID NO: 198668 - DNA, 25 bp, Rattus norvegicus
atgggttcggtgtctaacacatcag

SEQ ID NO: 198669 - DNA, 25 bp, Rattus norvegicus
atgggttctcccatgagggctccag

SEQ ID NO: 198670 - DNA, 25 bp, Rattus norvegicus
atgggttctcccttgagggctccag

SEQ ID NO: 198671 - DNA, 25 bp, Rattus norvegicus
atgggttctggcaccttggcagcaa

SEQ ID NO: 198672 - DNA, 25 bp, Rattus norvegicus
atgggttctggctccttggcagcaa

SEQ ID NO: 198673 - DNA, 25 bp, Rattus norvegicus
atgggttctgtacaaaaatactgct

SEQ ID NO: 198674 - DNA, 25 bp, Rattus norvegicus
atgggttctgtagaaaaatactgct

SEQ ID NO: 198675 - DNA, 25 bp, Rattus norvegicus
atgggttctgtccttgaagtttcat

SEQ ID NO: 198676 - DNA, 25 bp, Rattus norvegicus
atgggttctgtcgttgaagtttcat

SEQ ID NO: 198677 - DNA, 25 bp, Rattus norvegicus
atgggttctgtgacctgtgtcctgt

SEQ ID NO: 198678 - DNA, 25 bp, Rattus norvegicus
atgggttctgtgtcctgtgtcctgt

SEQ ID NO: 198679 - DNA, 25 bp, Rattus norvegicus
atgggttcttctctcttgccagagc

SEQ ID NO: 198680 - DNA, 25 bp, Rattus norvegicus
atgggttcttctgtcttgccagagc

SEQ ID NO: 198681 - DNA, 25 bp, Rattus norvegicus
atgggttgccacagttttgggaatt

SEQ ID NO: 198682 - DNA, 25 bp, Rattus norvegicus
atgggttgccactgttttgggaatt

SEQ ID NO: 198683 - DNA, 25 bp, Rattus norvegicus
atgggttgctgcagaggttcctaca

SEQ ID NO: 198684 - DNA, 25 bp, Rattus norvegicus
atgggttgctgctgaggttcctaca

SEQ ID NO: 198685 - DNA, 25 bp, Rattus norvegicus
atgggttggctaaaggttctgtctc

SEQ ID NO: 198686 - DNA, 25 bp, Rattus norvegicus
atgggttggctataggttctgtctc

SEQ ID NO: 198687 - DNA, 25 bp, Rattus norvegicus
atgggttgtccaccagggttcacac

SEQ ID NO: 198688 - DNA, 25 bp, Rattus norvegicus
atgggttgtccagcagggttcacac

SEQ ID NO: 198689 - DNA, 25 bp, Rattus norvegicus
atgggttgtgttccgctcctaattc

SEQ ID NO: 198690 - DNA, 25 bp, Rattus norvegicus
atgggttgtgttgcgctcctaattc

SEQ ID NO: 198691 - DNA, 25 bp, Rattus norvegicus
atgggttgttccaaattctgttgtt

SEQ ID NO: 198692 - DNA, 25 bp, Rattus norvegicus
atgggttgttcctaattctgttgtt

SEQ ID NO: 198693 - DNA, 25 bp, Rattus norvegicus
atgggtttaccaatcaacaagcaga

SEQ ID NO: 198694 - DNA, 25 bp, Rattus norvegicus
atgggtttaccattcaacaagcaga

SEQ ID NO: 198695 - DNA, 25 bp, Rattus norvegicus
atgggtttatttcactgtcttgtca

SEQ ID NO: 198696 - DNA, 25 bp, Rattus norvegicus
atgggtttatttgactgtcttgtca

SEQ ID NO: 198697 - DNA, 25 bp, Rattus norvegicus
atgggtttcagcatagccagggcta

SEQ ID NO: 198698 - DNA, 25 bp, Rattus norvegicus
atgggtttcagcttagccagggcta

SEQ ID NO: 198699 - DNA, 25 bp, Rattus norvegicus
atgggtttcgaaattgcttctgcct

SEQ ID NO: 198700 - DNA, 25 bp, Rattus norvegicus
atgggtttcgaatttgcttctgcct

SEQ ID NO: 198701 - DNA, 25 bp, Rattus norvegicus
atgggtttgacgatcctagcggcag

SEQ ID NO: 198702 - DNA, 25 bp, Rattus norvegicus
atgggtttgacgttcctagcggcag

SEQ ID NO: 198703 - DNA, 25 bp, Rattus norvegicus
atgggtttgattcctggcactgaat

SEQ ID NO: 198704 - DNA, 25 bp, Rattus norvegicus
atgggtttgattgctggcactgaat

SEQ ID NO: 198705 - DNA, 25 bp, Rattus norvegicus
atgggtttgccacatgctatatgat

SEQ ID NO: 198706 - DNA, 25 bp, Rattus norvegicus
atgggtttgccagatgctatatgat

SEQ ID NO: 198707 - DNA, 25 bp, Rattus norvegicus
atgggtttgctgagcctctggcatc

SEQ ID NO: 198708 - DNA, 25 bp, Rattus norvegicus
atgggtttgctgtgcctctggcatc

SEQ ID NO: 198709 - DNA, 25 bp, Rattus norvegicus
atgggtttgggtatcacatcttcaa

SEQ ID NO: 198710 - DNA, 25 bp, Rattus norvegicus
atgggtttgggtttcacatcttcaa

SEQ ID NO: 198711 - DNA, 25 bp, Rattus norvegicus
atgggtttggttcctcctgacactg

SEQ ID NO: 198712 - DNA, 25 bp, Rattus norvegicus
atgggtttggttgctcctgacactg

SEQ ID NO: 198713 - DNA, 25 bp, Rattus norvegicus
atgggtttgtatcggctctaaggac

SEQ ID NO: 198714 - DNA, 25 bp, Rattus norvegicus
atgggtttgtatgggctctaaggac

SEQ ID NO: 198715 - DNA, 25 bp, Rattus norvegicus
atgggtttgtgacatcttacgttgt

SEQ ID NO: 198716 - DNA, 25 bp, Rattus norvegicus
atgggtttgtgagatcttacgttgt

SEQ ID NO: 198717 - DNA, 25 bp, Rattus norvegicus
atgggttttcaaagtttctgtggga

SEQ ID NO: 198718 - DNA, 25 bp, Rattus norvegicus
atgggttttcaatgtttctgtggga

SEQ ID NO: 198719 - DNA, 25 bp, Rattus norvegicus
atgggttttggaatttgtggacaca

SEQ ID NO: 198720 - DNA, 25 bp, Rattus norvegicus
atgggttttggattttgtggacaca

SEQ ID NO: 198721 - DNA, 25 bp, Rattus norvegicus
atggtaaaccaactcttccttcaat

SEQ ID NO: 198722 - DNA, 25 bp, Rattus norvegicus
atggtaaaccaagtcttccttcaat

SEQ ID NO: 198723 - DNA, 25 bp, Rattus norvegicus
atggtaaagttgactcatctcaagt

SEQ ID NO: 198724 - DNA, 25 bp, Rattus norvegicus
atggtaaagttgtctcatctcaagt

SEQ ID NO: 198725 - DNA, 25 bp, Rattus norvegicus
atggtaaatacaaggcttgctgcct

SEQ ID NO: 198726 - DNA, 25 bp, Rattus norvegicus
atggtaaatacatggcttgctgcct

SEQ ID NO: 198727 - DNA, 25 bp, Rattus norvegicus
atggtaaccagtctggcctgtcaac

SEQ ID NO: 198728 - DNA, 25 bp, Rattus norvegicus
atggtaaccagtgtggcctgtcaac

SEQ ID NO: 198729 - DNA, 25 bp, Rattus norvegicus
atggtaaccatcacattttcctggc

SEQ ID NO: 198730 - DNA, 25 bp, Rattus norvegicus
atggtaaccatctcattttcctggc

SEQ ID NO: 198731 - DNA, 25 bp, Rattus norvegicus
atggtaaccggacgcgccaacctgg

SEQ ID NO: 198732 - DNA, 25 bp, Rattus norvegicus
atggtaaccggaggcgccaacctgg

SEQ ID NO: 198733 - DNA, 25 bp, Rattus norvegicus
atggtaaccttacgcctcagtctct

SEQ ID NO: 198734 - DNA, 25 bp, Rattus norvegicus
atggtaaccttaggcctcagtctct

SEQ ID NO: 198735 - DNA, 25 bp, Rattus norvegicus
atggtaactcaactcatggtcttaa

SEQ ID NO: 198736 - DNA, 25 bp, Rattus norvegicus
atggtaactcaagtcatggtcttaa

SEQ ID NO: 198737 - DNA, 25 bp, Rattus norvegicus
atggtaactcatctctttaatccta

SEQ ID NO: 198738 - DNA, 25 bp, Rattus norvegicus
atggtaactcatgtctttaatccta

SEQ ID NO: 198739 - DNA, 25 bp, Rattus norvegicus
atggtaactcgcagtctgtaactag

SEQ ID NO: 198740 - DNA, 25 bp, Rattus norvegicus
atggtaactcgcctggactctgttt

SEQ ID NO: 198741 - DNA, 25 bp, Rattus norvegicus
atggtaactcgcgtggactctgttt

SEQ ID NO: 198742 - DNA, 25 bp, Rattus norvegicus
atggtaactcgctgtctgtaactag

SEQ ID NO: 198743 - DNA, 25 bp, Rattus norvegicus
atggtaactcttagtaccttggttg

SEQ ID NO: 198744 - DNA, 25 bp, Rattus norvegicus
atggtaactctttgtaccttggttg

SEQ ID NO: 198745 - DNA, 25 bp, Rattus norvegicus
atggtaagcattattgccaggctct

SEQ ID NO: 198746 - DNA, 25 bp, Rattus norvegicus
atggtaagcatttttgccaggctct

SEQ ID NO: 198747 - DNA, 25 bp, Rattus norvegicus
atggtaataagtactaaggttctag

SEQ ID NO: 198748 - DNA, 25 bp, Rattus norvegicus
atggtaataagttctaaggttctag

SEQ ID NO: 198749 - DNA, 25 bp, Rattus norvegicus
atggtaatacacaccactttccagc

SEQ ID NO: 198750 - DNA, 25 bp, Rattus norvegicus
atggtaatacactccactttccagc

SEQ ID NO: 198751 - DNA, 25 bp, Rattus norvegicus
atggtaatctgcagaggacactcct

SEQ ID NO: 198752 - DNA, 25 bp, Rattus norvegicus
atggtaatctgctgaggacactcct

SEQ ID NO: 198753 - DNA, 25 bp, Rattus norvegicus
atggtaatctttacctagcgtgaac

SEQ ID NO: 198754 - DNA, 25 bp, Rattus norvegicus
atggtaatcttttcctagcgtgaac

SEQ ID NO: 198755 - DNA, 25 bp, Rattus norvegicus
atggtaattatcatttctttctggc

SEQ ID NO: 198756 - DNA, 25 bp, Rattus norvegicus
atggtaattatcttttctttctggc

SEQ ID NO: 198757 - DNA, 25 bp, Rattus norvegicus
atggtaattttcaggccggagtctt

SEQ ID NO: 198758 - DNA, 25 bp, Rattus norvegicus
atggtaattttctggccggagtctt

SEQ ID NO: 198759 - DNA, 25 bp, Rattus norvegicus
atggtacaaacaccaccgtctggag

SEQ ID NO: 198760 - DNA, 25 bp, Rattus norvegicus
atggtacaaacagcaccgtctggag

SEQ ID NO: 198761 - DNA, 25 bp, Rattus norvegicus
atggtacaatggaaccttgaacggt

SEQ ID NO: 198762 - DNA, 25 bp, Rattus norvegicus
atggtacaatggtaccttgaacggt

SEQ ID NO: 198763 - DNA, 25 bp, Rattus norvegicus
atggtacacaacattagtccccagc

SEQ ID NO: 198764 - DNA, 25 bp, Rattus norvegicus
atggtacacaactttagtccccagc

SEQ ID NO: 198765 - DNA, 25 bp, Rattus norvegicus
atggtacatgcgcagcatatcgtcc

SEQ ID NO: 198766 - DNA, 25 bp, Rattus norvegicus
atggtacatgcggagcatatcgtcc

SEQ ID NO: 198767 - DNA, 25 bp, Rattus norvegicus
atggtaccaaatccgctggcttgtt

SEQ ID NO: 198768 - DNA, 25 bp, Rattus norvegicus
atggtaccaaatgcgctggcttgtt

SEQ ID NO: 198769 - DNA, 25 bp, Rattus norvegicus
atggtaccactgataatcttgatgt

SEQ ID NO: 198770 - DNA, 25 bp, Rattus norvegicus
atggtaccactgttaatcttgatgt

SEQ ID NO: 198771 - DNA, 25 bp, Rattus norvegicus
atggtacccagaacctggactggtt

SEQ ID NO: 198772 - DNA, 25 bp, Rattus norvegicus
atggtacccagacccagtagtcact

SEQ ID NO: 198773 - DNA, 25 bp, Rattus norvegicus
atggtacccagacccgcaggacgga

SEQ ID NO: 198774 - DNA, 25 bp, Rattus norvegicus
atggtacccagagccagtagtcact

SEQ ID NO: 198775 - DNA, 25 bp, Rattus norvegicus
atggtacccagagccgcaggacgga

SEQ ID NO: 198776 - DNA, 25 bp, Rattus norvegicus
atggtacccagatcctggactggtt

SEQ ID NO: 198777 - DNA, 25 bp, Rattus norvegicus
atggtacctgggacagaccactcaa

SEQ ID NO: 198778 - DNA, 25 bp, Rattus norvegicus
atggtacctgggtcagaccactcaa

SEQ ID NO: 198779 - DNA, 25 bp, Rattus norvegicus
atggtacctgtcatttaaacacaag

SEQ ID NO: 198780 - DNA, 25 bp, Rattus norvegicus
atggtacctgtcttttaaacacaag

SEQ ID NO: 198781 - DNA, 25 bp, Rattus norvegicus
atggtacgctccactctggatgcga

SEQ ID NO: 198782 - DNA, 25 bp, Rattus norvegicus
atggtacgctcctctctggatgcga

SEQ ID NO: 198783 - DNA, 25 bp, Rattus norvegicus
atggtacgctgcaagtctccgggaa

SEQ ID NO: 198784 - DNA, 25 bp, Rattus norvegicus
atggtacgctgctagtctccgggaa

SEQ ID NO: 198785 - DNA, 25 bp, Rattus norvegicus
atggtactacatccctccaccatga

SEQ ID NO: 198786 - DNA, 25 bp, Rattus norvegicus
atggtactacatgcctccaccatga

SEQ ID NO: 198787 - DNA, 25 bp, Rattus norvegicus
atggtactaggtccctgctgtgttc

SEQ ID NO: 198788 - DNA, 25 bp, Rattus norvegicus
atggtactaggtgcctgctgtgttc

SEQ ID NO: 198789 - DNA, 25 bp, Rattus norvegicus
atggtactatgtcgctctctcggtc

SEQ ID NO: 198790 - DNA, 25 bp, Rattus norvegicus
atggtactatgtggctctctcggtc

SEQ ID NO: 198791 - DNA, 25 bp, Rattus norvegicus
atggtactcaccatctatttaaata

SEQ ID NO: 198792 - DNA, 25 bp, Rattus norvegicus
atggtactcaccttctatttaaata

SEQ ID NO: 198793 - DNA, 25 bp, Rattus norvegicus
atggtactcgttatctgcttattcc

SEQ ID NO: 198794 - DNA, 25 bp, Rattus norvegicus
atggtactcgttttctgcttattcc

SEQ ID NO: 198795 - DNA, 25 bp, Rattus norvegicus
atggtactctacacagtcctcttat

SEQ ID NO: 198796 - DNA, 25 bp, Rattus norvegicus
atggtactctactcagtcctcttat

SEQ ID NO: 198797 - DNA, 25 bp, Rattus norvegicus
atggtactgactatgcttgctttga

SEQ ID NO: 198798 - DNA, 25 bp, Rattus norvegicus
atggtactgactttgcttgctttga

SEQ ID NO: 198799 - DNA, 25 bp, Rattus norvegicus
atggtactgaggaactctcaccctt

SEQ ID NO: 198800 - DNA, 25 bp, Rattus norvegicus
atggtactgaggtactctcaccctt

SEQ ID NO: 198801 - DNA, 25 bp, Rattus norvegicus
atggtactgctcctggaactttcca

SEQ ID NO: 198802 - DNA, 25 bp, Rattus norvegicus
atggtactgctcgtggaactttcca

SEQ ID NO: 198803 - DNA, 25 bp, Rattus norvegicus
atggtacttcatactttcatccagc

SEQ ID NO: 198804 - DNA, 25 bp, Rattus norvegicus
atggtacttcattctttcatccagc

SEQ ID NO: 198805 - DNA, 25 bp, Rattus norvegicus
atggtacttcctcaaccggcagtgg

SEQ ID NO: 198806 - DNA, 25 bp, Rattus norvegicus
atggtacttcctgaaccggcagtgg

SEQ ID NO: 198807 - DNA, 25 bp, Rattus norvegicus
atggtacttgtcatgattgttttca

SEQ ID NO: 198808 - DNA, 25 bp, Rattus norvegicus
atggtacttgtcttgattgttttca

SEQ ID NO: 198809 - DNA, 25 bp, Rattus norvegicus
atggtagaagacattccctcttgga

SEQ ID NO: 198810 - DNA, 25 bp, Rattus norvegicus
atggtagaagactttccctcttgga

SEQ ID NO: 198811 - DNA, 25 bp, Rattus norvegicus
atggtagacaatccattcaattcta

SEQ ID NO: 198812 - DNA, 25 bp, Rattus norvegicus
atggtagacaatgcattcaattcta

SEQ ID NO: 198813 - DNA, 25 bp, Rattus norvegicus
atggtagacagtaggctctccagag

SEQ ID NO: 198814 - DNA, 25 bp, Rattus norvegicus
atggtagacagttggctctccagag

SEQ ID NO: 198815 - DNA, 25 bp, Rattus norvegicus
atggtagagatacgcttaatggttc

SEQ ID NO: 198816 - DNA, 25 bp, Rattus norvegicus
atggtagagataggcttaatggttc

SEQ ID NO: 198817 - DNA, 25 bp, Rattus norvegicus
atggtagagccaacagtctcgccag

SEQ ID NO: 198818 - DNA, 25 bp, Rattus norvegicus
atggtagagccatcagtctcgccag

SEQ ID NO: 198819 - DNA, 25 bp, Rattus norvegicus
atggtagattacactggctgctcag

SEQ ID NO: 198820 - DNA, 25 bp, Rattus norvegicus
atggtagattactctggctgctcag

SEQ ID NO: 198821 - DNA, 25 bp, Rattus norvegicus
atggtagcagcgaaccgaaagtagc

SEQ ID NO: 198822 - DNA, 25 bp, Rattus norvegicus
atggtagcagcgtaccgaaagtagc

SEQ ID NO: 198823 - DNA, 25 bp, Rattus norvegicus
atggtagccattaagcctgattccc

SEQ ID NO: 198824 - DNA, 25 bp, Rattus norvegicus
atggtagccatttagcctgattccc

SEQ ID NO: 198825 - DNA, 25 bp, Rattus norvegicus
atggtagcgccaatttccttttctt

SEQ ID NO: 198826 - DNA, 25 bp, Rattus norvegicus
atggtagcgccattttccttttctt

SEQ ID NO: 198827 - DNA, 25 bp, Rattus norvegicus
atggtagcgcccaagatgtgcatct

SEQ ID NO: 198828 - DNA, 25 bp, Rattus norvegicus
atggtagcgccctagatgtgcatct

SEQ ID NO: 198829 - DNA, 25 bp, Rattus norvegicus
atggtagcgtatccccgcaatctca

SEQ ID NO: 198830 - DNA, 25 bp, Rattus norvegicus
atggtagcgtatgcccgcaatctca

SEQ ID NO: 198831 - DNA, 25 bp, Rattus norvegicus
atggtagctggcagagggccaccac

SEQ ID NO: 198832 - DNA, 25 bp, Rattus norvegicus
atggtagctggcagtgctttgcact

SEQ ID NO: 198833 - DNA, 25 bp, Rattus norvegicus
atggtagctggctgagggccaccac

SEQ ID NO: 198834 - DNA, 25 bp, Rattus norvegicus
atggtagctggctgtgctttgcact

SEQ ID NO: 198835 - DNA, 25 bp, Rattus norvegicus
atggtagcttccctgactgctcaga

SEQ ID NO: 198836 - DNA, 25 bp, Rattus norvegicus
atggtagcttccgtgactgctcaga

SEQ ID NO: 198837 - DNA, 25 bp, Rattus norvegicus
atggtaggccacagagctacaggaa

SEQ ID NO: 198838 - DNA, 25 bp, Rattus norvegicus
atggtaggccactgagctacaggaa

SEQ ID NO: 198839 - DNA, 25 bp, Rattus norvegicus
atggtaggccgtatcttaaatacat

SEQ ID NO: 198840 - DNA, 25 bp, Rattus norvegicus
atggtaggccgtttcttaaatacat

SEQ ID NO: 198841 - DNA, 25 bp, Rattus norvegicus
atggtaggtaagcttgtctctgtgc

SEQ ID NO: 198842 - DNA, 25 bp, Rattus norvegicus
atggtaggtaaggttgtctctgtgc

SEQ ID NO: 198843 - DNA, 25 bp, Rattus norvegicus
atggtaggtggtcactcctgtctcc

SEQ ID NO: 198844 - DNA, 25 bp, Rattus norvegicus
atggtaggtggtgactcctgtctcc

SEQ ID NO: 198845 - DNA, 25 bp, Rattus norvegicus
atggtaggttccaggatgttccaca

SEQ ID NO: 198846 - DNA, 25 bp, Rattus norvegicus
atggtaggttcctggatgttccaca

SEQ ID NO: 198847 - DNA, 25 bp, Rattus norvegicus
atggtagtccagattcaccactgaa

SEQ ID NO: 198848 - DNA, 25 bp, Rattus norvegicus
atggtagtccagtttcaccactgaa

SEQ ID NO: 198849 - DNA, 25 bp, Rattus norvegicus
atggtagtgcgtatgggtcccatcc

SEQ ID NO: 198850 - DNA, 25 bp, Rattus norvegicus
atggtagtgcgtttgggtcccatcc

SEQ ID NO: 198851 - DNA, 25 bp, Rattus norvegicus
atggtagtgtatccatgtccctgtt

SEQ ID NO: 198852 - DNA, 25 bp, Rattus norvegicus
atggtagtgtatgcatgtccctgtt

SEQ ID NO: 198853 - DNA, 25 bp, Rattus norvegicus
atggtatacaatattacggccctga

SEQ ID NO: 198854 - DNA, 25 bp, Rattus norvegicus
atggtatacaattttacggccctga

SEQ ID NO: 198855 - DNA, 25 bp, Rattus norvegicus
atggtatacttgcacccggtggctg

SEQ ID NO: 198856 - DNA, 25 bp, Rattus norvegicus
atggtatacttggacccggtggctg

SEQ ID NO: 198857 - DNA, 25 bp, Rattus norvegicus
atggtatatacaagcccacccatat

SEQ ID NO: 198858 - DNA, 25 bp, Rattus norvegicus
atggtatatacatgcccacccatat

SEQ ID NO: 198859 - DNA, 25 bp, Rattus norvegicus
atggtatatatcatgtggagggcac

SEQ ID NO: 198860 - DNA, 25 bp, Rattus norvegicus
atggtatatatcttgtggagggcac

SEQ ID NO: 198861 - DNA, 25 bp, Rattus norvegicus
atggtatcagttaatgtgcagagac

SEQ ID NO: 198862 - DNA, 25 bp, Rattus norvegicus
atggtatcagtttatgtgcagagac

SEQ ID NO: 198863 - DNA, 25 bp, Rattus norvegicus
atggtatgcattaccatttcatgtt

SEQ ID NO: 198864 - DNA, 25 bp, Rattus norvegicus
atggtatgcattactgaccttcaga

SEQ ID NO: 198865 - DNA, 25 bp, Rattus norvegicus
atggtatgcatttccatttcatgtt

SEQ ID NO: 198866 - DNA, 25 bp, Rattus norvegicus
atggtatgcatttctgaccttcaga

SEQ ID NO: 198867 - DNA, 25 bp, Rattus norvegicus
atggtatgtcagaggcgctgcctac

SEQ ID NO: 198868 - DNA, 25 bp, Rattus norvegicus
atggtatgtcagtggcgctgcctac

SEQ ID NO: 198869 - DNA, 25 bp, Rattus norvegicus
atggtatgtgttctcagccacacgt

SEQ ID NO: 198870 - DNA, 25 bp, Rattus norvegicus
atggtatgtgttgtcagccacacgt

SEQ ID NO: 198871 - DNA, 25 bp, Rattus norvegicus
atggtatgttgtcagcatgtgctac

SEQ ID NO: 198872 - DNA, 25 bp, Rattus norvegicus
atggtatgttgtgagcatgtgctac

SEQ ID NO: 198873 - DNA, 25 bp, Rattus norvegicus
atggtattacaaattccctctctac

SEQ ID NO: 198874 - DNA, 25 bp, Rattus norvegicus
atggtattacaatttccctctctac

SEQ ID NO: 198875 - DNA, 25 bp, Rattus norvegicus
atggtattactgctaaatgcactga

SEQ ID NO: 198876 - DNA, 25 bp, Rattus norvegicus
atggtattactggtaaatgcactga

SEQ ID NO: 198877 - DNA, 25 bp, Rattus norvegicus
atggtattccttattcttctaacaa

SEQ ID NO: 198878 - DNA, 25 bp, Rattus norvegicus
atggtattcctttttcttctaacaa

SEQ ID NO: 198879 - DNA, 25 bp, Rattus norvegicus
atggtatttcccctgagtgcttgtc

SEQ ID NO: 198880 - DNA, 25 bp, Rattus norvegicus
atggtatttcccgtgagtgcttgtc

SEQ ID NO: 198881 - DNA, 25 bp, Rattus norvegicus
atggtatttgttcttctcttctggt

SEQ ID NO: 198882 - DNA, 25 bp, Rattus norvegicus
atggtatttgttgttctcttctggt

SEQ ID NO: 198883 - DNA, 25 bp, Rattus norvegicus
atggtcaaactgacaagagcccacc

SEQ ID NO: 198884 - DNA, 25 bp, Rattus norvegicus
atggtcaaactgtcaagagcccacc

SEQ ID NO: 198885 - DNA, 25 bp, Rattus norvegicus
atggtcaaagtcagggactgcctca

SEQ ID NO: 198886 - DNA, 25 bp, Rattus norvegicus
atggtcaaagtctgggactgcctca

SEQ ID NO: 198887 - DNA, 25 bp, Rattus norvegicus
atggtcaaatatccagtcaacagct

SEQ ID NO: 198888 - DNA, 25 bp, Rattus norvegicus
atggtcaaatatgcagtcaacagct

SEQ ID NO: 198889 - DNA, 25 bp, Rattus norvegicus
atggtcaaatggcacgcttgtctgt

SEQ ID NO: 198890 - DNA, 25 bp, Rattus norvegicus
atggtcaaatgggacgcttgtctgt

SEQ ID NO: 198891 - DNA, 25 bp, Rattus norvegicus
atggtcaacaagaactgtcagtttc

SEQ ID NO: 198892 - DNA, 25 bp, Rattus norvegicus
atggtcaacaagtactgtcagtttc

SEQ ID NO: 198893 - DNA, 25 bp, Rattus norvegicus
atggtcaacattcaagctggcacac

SEQ ID NO: 198894 - DNA, 25 bp, Rattus norvegicus
atggtcaacattgaagctggcacac

SEQ ID NO: 198895 - DNA, 25 bp, Rattus norvegicus
atggtcaactggcttaagttctaaa

SEQ ID NO: 198896 - DNA, 25 bp, Rattus norvegicus
atggtcaactgggttaagttctaaa

SEQ ID NO: 198897 - DNA, 25 bp, Rattus norvegicus
atggtcaacttgcatttccttcatc

SEQ ID NO: 198898 - DNA, 25 bp, Rattus norvegicus
atggtcaacttggatttccttcatc

SEQ ID NO: 198899 - DNA, 25 bp, Rattus norvegicus
atggtcaaggatcgacttccgtcca

SEQ ID NO: 198900 - DNA, 25 bp, Rattus norvegicus
atggtcaaggatggacttccgtcca

SEQ ID NO: 198901 - DNA, 25 bp, Rattus norvegicus
atggtcaagggcattcaccacggcc

SEQ ID NO: 198902 - DNA, 25 bp, Rattus norvegicus
atggtcaagggctttcaccacggcc

SEQ ID NO: 198903 - DNA, 25 bp, Rattus norvegicus
atggtcaagtcaaaccctgcccagt

SEQ ID NO: 198904 - DNA, 25 bp, Rattus norvegicus
atggtcaagtcataccctgcccagt

SEQ ID NO: 198905 - DNA, 25 bp, Rattus norvegicus
atggtcacacagatggccctgggta

SEQ ID NO: 198906 - DNA, 25 bp, Rattus norvegicus
atggtcacacagttggccctgggta

SEQ ID NO: 198907 - DNA, 25 bp, Rattus norvegicus
atggtcacagtacttcacctgttca

SEQ ID NO: 198908 - DNA, 25 bp, Rattus norvegicus
atggtcacagtagttcacctgttca

SEQ ID NO: 198909 - DNA, 25 bp, Rattus norvegicus
atggtcacatacacagttggatttg

SEQ ID NO: 198910 - DNA, 25 bp, Rattus norvegicus
atggtcacatactcagttggatttg

SEQ ID NO: 198911 - DNA, 25 bp, Rattus norvegicus
atggtcacatcgcacagcagacgcg

SEQ ID NO: 198912 - DNA, 25 bp, Rattus norvegicus
atggtcacatcggacagcagacgcg

SEQ ID NO: 198913 - DNA, 25 bp, Rattus norvegicus
atggtcacattaacctgttcacatt

SEQ ID NO: 198914 - DNA, 25 bp, Rattus norvegicus
atggtcacattatcctgttcacatt

SEQ ID NO: 198915 - DNA, 25 bp, Rattus norvegicus
atggtcaccaggcaagtctttctta

SEQ ID NO: 198916 - DNA, 25 bp, Rattus norvegicus
atggtcaccagggaagtctttctta

SEQ ID NO: 198917 - DNA, 25 bp, Rattus norvegicus
atggtcacccaactggactgtttga

SEQ ID NO: 198918 - DNA, 25 bp, Rattus norvegicus
atggtcacccaagtggactgtttga

SEQ ID NO: 198919 - DNA, 25 bp, Rattus norvegicus
atggtcacgggtcgctggcttacca

SEQ ID NO: 198920 - DNA, 25 bp, Rattus norvegicus
atggtcacgggtggctggcttacca

SEQ ID NO: 198921 - DNA, 25 bp, Rattus norvegicus
atggtcactgttactcttctgtcta

SEQ ID NO: 198922 - DNA, 25 bp, Rattus norvegicus
atggtcactgtttctcttctgtcta

SEQ ID NO: 198923 - DNA, 25 bp, Rattus norvegicus
atggtcagaaggctgctccccggac

SEQ ID NO: 198924 - DNA, 25 bp, Rattus norvegicus
atggtcagaagggtgctccccggac

SEQ ID NO: 198925 - DNA, 25 bp, Rattus norvegicus
atggtcagcatgctcactgcacaac

SEQ ID NO: 198926 - DNA, 25 bp, Rattus norvegicus
atggtcagcatggtcactgcacaac

SEQ ID NO: 198927 - DNA, 25 bp, Rattus norvegicus
atggtcagcccaagtggcagtgctc

SEQ ID NO: 198928 - DNA, 25 bp, Rattus norvegicus
atggtcagcccatgtggcagtgctc

SEQ ID NO: 198929 - DNA, 25 bp, Rattus norvegicus
atggtcagccttactacctcataga

SEQ ID NO: 198930 - DNA, 25 bp, Rattus norvegicus
atggtcagcctttctacctcataga

SEQ ID NO: 198931 - DNA, 25 bp, Rattus norvegicus
atggtcagctagctcacatctctat

SEQ ID NO: 198932 - DNA, 25 bp, Rattus norvegicus
atggtcagctaggtcacatctctat

SEQ ID NO: 198933 - DNA, 25 bp, Rattus norvegicus
atggtcagctctcaggtgcgacttt

SEQ ID NO: 198934 - DNA, 25 bp, Rattus norvegicus
atggtcagctctgaggtgcgacttt

SEQ ID NO: 198935 - DNA, 25 bp, Rattus norvegicus
atggtcaggagcataggaaccccaa

SEQ ID NO: 198936 - DNA, 25 bp, Rattus norvegicus
atggtcaggagcttaggaaccccaa

SEQ ID NO: 198937 - DNA, 25 bp, Rattus norvegicus
atggtcagggacaatgctcacctca

SEQ ID NO: 198938 - DNA, 25 bp, Rattus norvegicus
atggtcagggactatgctcacctca

SEQ ID NO: 198939 - DNA, 25 bp, Rattus norvegicus
atggtcagggctatggatttgcagt

SEQ ID NO: 198940 - DNA, 25 bp, Rattus norvegicus
atggtcagggctttggatttgcagt

SEQ ID NO: 198941 - DNA, 25 bp, Rattus norvegicus
atggtcagtctcatccttgtgttca

SEQ ID NO: 198942 - DNA, 25 bp, Rattus norvegicus
atggtcagtctcttccttgtgttca

SEQ ID NO: 198943 - DNA, 25 bp, Rattus norvegicus
atggtcagtgccagtgagtcccaga

SEQ ID NO: 198944 - DNA, 25 bp, Rattus norvegicus
atggtcagtgcctgtgagtcccaga

SEQ ID NO: 198945 - DNA, 25 bp, Rattus norvegicus
atggtcagtgtgagagttacttctc

SEQ ID NO: 198946 - DNA, 25 bp, Rattus norvegicus
atggtcagtgtgcaggctggagcaa

SEQ ID NO: 198947 - DNA, 25 bp, Rattus norvegicus
atggtcagtgtggaggctggagcaa

SEQ ID NO: 198948 - DNA, 25 bp, Rattus norvegicus
atggtcagtgtgtgagttacttctc

SEQ ID NO: 198949 - DNA, 25 bp, Rattus norvegicus
atggtcatatatagcccagtctggc

SEQ ID NO: 198950 - DNA, 25 bp, Rattus norvegicus
atggtcatatattgcccagtctggc

SEQ ID NO: 198951 - DNA, 25 bp, Rattus norvegicus
atggtcatctgcaccattttctaca

SEQ ID NO: 198952 - DNA, 25 bp, Rattus norvegicus
atggtcatctgctccattttctaca

SEQ ID NO: 198953 - DNA, 25 bp, Rattus norvegicus
atggtcatcttgaccagctgtgcag

SEQ ID NO: 198954 - DNA, 25 bp, Rattus norvegicus
atggtcatcttgtccagctgtgcag

SEQ ID NO: 198955 - DNA, 25 bp, Rattus norvegicus
atggtcatctttaccctcagtgtgt

SEQ ID NO: 198956 - DNA, 25 bp, Rattus norvegicus
atggtcatcttttccctcagtgtgt

SEQ ID NO: 198957 - DNA, 25 bp, Rattus norvegicus
atggtcatgatcacctttgcataaa

SEQ ID NO: 198958 - DNA, 25 bp, Rattus norvegicus
atggtcatgatctcctttgcataaa

SEQ ID NO: 198959 - DNA, 25 bp, Rattus norvegicus
atggtcatgctgaacctggcatcac

SEQ ID NO: 198960 - DNA, 25 bp, Rattus norvegicus
atggtcatgctgccgcaggatgatc

SEQ ID NO: 198961 - DNA, 25 bp, Rattus norvegicus
atggtcatgctggcgcaggatgatc

SEQ ID NO: 198962 - DNA, 25 bp, Rattus norvegicus
atggtcatgctgtacctggcatcac

SEQ ID NO: 198963 - DNA, 25 bp, Rattus norvegicus
atggtcatgcttcaattccctagta

SEQ ID NO: 198964 - DNA, 25 bp, Rattus norvegicus
atggtcatgcttgaattccctagta

SEQ ID NO: 198965 - DNA, 25 bp, Rattus norvegicus
atggtcatgtggcacagccttcagc

SEQ ID NO: 198966 - DNA, 25 bp, Rattus norvegicus
atggtcatgtgggacagccttcagc

SEQ ID NO: 198967 - DNA, 25 bp, Rattus norvegicus
atggtcattagacctgacactccaa

SEQ ID NO: 198968 - DNA, 25 bp, Rattus norvegicus
atggtcattagagctgacactccaa

SEQ ID NO: 198969 - DNA, 25 bp, Rattus norvegicus
atggtcattcatatcagtccacacc

SEQ ID NO: 198970 - DNA, 25 bp, Rattus norvegicus
atggtcattcatttcagtccacacc

SEQ ID NO: 198971 - DNA, 25 bp, Rattus norvegicus
atggtccaaagcacatttgagctga

SEQ ID NO: 198972 - DNA, 25 bp, Rattus norvegicus
atggtccaaagctcatttgagctga

SEQ ID NO: 198973 - DNA, 25 bp, Rattus norvegicus
atggtccaacgtactcagaggcatg

SEQ ID NO: 198974 - DNA, 25 bp, Rattus norvegicus
atggtccaacgttctcagaggcatg

SEQ ID NO: 198975 - DNA, 25 bp, Rattus norvegicus
atggtccaactgctcagggatgctg

SEQ ID NO: 198976 - DNA, 25 bp, Rattus norvegicus
atggtccaactggtcagggatgctg

SEQ ID NO: 198977 - DNA, 25 bp, Rattus norvegicus
atggtccacaacaaagggcacctaa

SEQ ID NO: 198978 - DNA, 25 bp, Rattus norvegicus
atggtccacaactaagggcacctaa

SEQ ID NO: 198979 - DNA, 25 bp, Rattus norvegicus
atggtccagcagcaccagatggtca

SEQ ID NO: 198980 - DNA, 25 bp, Rattus norvegicus
atggtccagcaggaccagatggtca

SEQ ID NO: 198981 - DNA, 25 bp, Rattus norvegicus
atggtccagctaacatcaagatggt

SEQ ID NO: 198982 - DNA, 25 bp, Rattus norvegicus
atggtccagctatcatcaagatggt

SEQ ID NO: 198983 - DNA, 25 bp, Rattus norvegicus
atggtccaggacatgggtttgaaca

SEQ ID NO: 198984 - DNA, 25 bp, Rattus norvegicus
atggtccaggacttgggtttgaaca

SEQ ID NO: 198985 - DNA, 25 bp, Rattus norvegicus
atggtccaggtcatttgcaatgcgt

SEQ ID NO: 198986 - DNA, 25 bp, Rattus norvegicus
atggtccaggtcttttgcaatgcgt

SEQ ID NO: 198987 - DNA, 25 bp, Rattus norvegicus
atggtccagtggataaactgcttgc

SEQ ID NO: 198988 - DNA, 25 bp, Rattus norvegicus
atggtccagtggttaaactgcttgc

SEQ ID NO: 198989 - DNA, 25 bp, Rattus norvegicus
atggtccagtgtatgcacagcgaca

SEQ ID NO: 198990 - DNA, 25 bp, Rattus norvegicus
atggtccagtgtttgcacagcgaca

SEQ ID NO: 198991 - DNA, 25 bp, Rattus norvegicus
atggtccatccacaacagccacagg

SEQ ID NO: 198992 - DNA, 25 bp, Rattus norvegicus
atggtccatccagaacagccacagg

SEQ ID NO: 198993 - DNA, 25 bp, Rattus norvegicus
atggtccatggacccaggtggctct

SEQ ID NO: 198994 - DNA, 25 bp, Rattus norvegicus
atggtccatggagccaggtggctct

SEQ ID NO: 198995 - DNA, 25 bp, Rattus norvegicus
atggtccatggtcagttatcttact

SEQ ID NO: 198996 - DNA, 25 bp, Rattus norvegicus
atggtccatggtgagttatcttact

SEQ ID NO: 198997 - DNA, 25 bp, Rattus norvegicus
atggtccattagctttctgtctttt

SEQ ID NO: 198998 - DNA, 25 bp, Rattus norvegicus
atggtccattaggtttctgtctttt

SEQ ID NO: 198999 - DNA, 25 bp, Rattus norvegicus
atggtccattttccatttgtcagag

SEQ ID NO: 199000 - DNA, 25 bp, Rattus norvegicus
atggtccattttgcatttgtcagag

SEQ ID NO: 199001 - DNA, 25 bp, Rattus norvegicus
atggtcccagggattaagcctatga

SEQ ID NO: 199002 - DNA, 25 bp, Rattus norvegicus
atggtcccagggtttaagcctatga

SEQ ID NO: 199003 - DNA, 25 bp, Rattus norvegicus
atggtcccattacgaaccccaatcg

SEQ ID NO: 199004 - DNA, 25 bp, Rattus norvegicus
atggtcccattaggaaccccaatcg

SEQ ID NO: 199005 - DNA, 25 bp, Rattus norvegicus
atggtccccagccatggatttagtc

SEQ ID NO: 199006 - DNA, 25 bp, Rattus norvegicus
atggtccccagcgatggatttagtc

SEQ ID NO: 199007 - DNA, 25 bp, Rattus norvegicus
atggtcccctctactaatctgatgt

SEQ ID NO: 199008 - DNA, 25 bp, Rattus norvegicus
atggtcccctcttctaatctgatgt

SEQ ID NO: 199009 - DNA, 25 bp, Rattus norvegicus
atggtcccctttctaagcattgtca

SEQ ID NO: 199010 - DNA, 25 bp, Rattus norvegicus
atggtcccctttgtaagcattgtca

SEQ ID NO: 199011 - DNA, 25 bp, Rattus norvegicus
atggtccctacaaacaaggtgcttt

SEQ ID NO: 199012 - DNA, 25 bp, Rattus norvegicus
atggtccctacatacaaggtgcttt

SEQ ID NO: 199013 - DNA, 25 bp, Rattus norvegicus
atggtccctataatccgcattcggg

SEQ ID NO: 199014 - DNA, 25 bp, Rattus norvegicus
atggtccctatattccgcattcggg

SEQ ID NO: 199015 - DNA, 25 bp, Rattus norvegicus
atggtccgattgctgcctgtcctat

SEQ ID NO: 199016 - DNA, 25 bp, Rattus norvegicus
atggtccgattggtgcctgtcctat

SEQ ID NO: 199017 - DNA, 25 bp, Rattus norvegicus
atggtccggcgaagtttcaggtcac

SEQ ID NO: 199018 - DNA, 25 bp, Rattus norvegicus
atggtccggcgatgtttcaggtcac

SEQ ID NO: 199019 - DNA, 25 bp, Rattus norvegicus
atggtccggtagctccttttcttgt

SEQ ID NO: 199020 - DNA, 25 bp, Rattus norvegicus
atggtccggtaggtccttttcttgt

SEQ ID NO: 199021 - DNA, 25 bp, Rattus norvegicus
atggtccgtgacaagcctgtgtgca

SEQ ID NO: 199022 - DNA, 25 bp, Rattus norvegicus
atggtccgtgactagcctgtgtgca

SEQ ID NO: 199023 - DNA, 25 bp, Rattus norvegicus
atggtcctacagcatgccctatact

SEQ ID NO: 199024 - DNA, 25 bp, Rattus norvegicus
atggtcctacaggatgccctatact

SEQ ID NO: 199025 - DNA, 25 bp, Rattus norvegicus
atggtcctccagctgctgggcttcc

SEQ ID NO: 199026 - DNA, 25 bp, Rattus norvegicus
atggtcctccaggtgctgggcttcc

SEQ ID NO: 199027 - DNA, 25 bp, Rattus norvegicus
atggtcctcctgacttgtagctaag

SEQ ID NO: 199028 - DNA, 25 bp, Rattus norvegicus
atggtcctcctgtcttgtagctaag

SEQ ID NO: 199029 - DNA, 25 bp, Rattus norvegicus
atggtcctcggcaaaggactgctct

SEQ ID NO: 199030 - DNA, 25 bp, Rattus norvegicus
atggtcctcggctaaggactgctct

SEQ ID NO: 199031 - DNA, 25 bp, Rattus norvegicus
atggtcctgaatcttgtgctttgta

SEQ ID NO: 199032 - DNA, 25 bp, Rattus norvegicus
atggtcctgaatgttgtgctttgta

SEQ ID NO: 199033 - DNA, 25 bp, Rattus norvegicus
atggtcctgatgaagccatctataa

SEQ ID NO: 199034 - DNA, 25 bp, Rattus norvegicus
atggtcctgatgtagccatctataa

SEQ ID NO: 199035 - DNA, 25 bp, Rattus norvegicus
atggtcctgcatactgtttccagca

SEQ ID NO: 199036 - DNA, 25 bp, Rattus norvegicus
atggtcctgcattctgtttccagca

SEQ ID NO: 199037 - DNA, 25 bp, Rattus norvegicus
atggtcctggtcacagctcttctgt

SEQ ID NO: 199038 - DNA, 25 bp, Rattus norvegicus
atggtcctggtctcagctcttctgt

SEQ ID NO: 199039 - DNA, 25 bp, Rattus norvegicus
atggtcctgtctctcagcgcagttt

SEQ ID NO: 199040 - DNA, 25 bp, Rattus norvegicus
atggtcctgtctgtcagcgcagttt

SEQ ID NO: 199041 - DNA, 25 bp, Rattus norvegicus
atggtccttagaccacatgaagttt

SEQ ID NO: 199042 - DNA, 25 bp, Rattus norvegicus
atggtccttagagcacatgaagttt

SEQ ID NO: 199043 - DNA, 25 bp, Rattus norvegicus
atggtccttccacatgacgtccgag

SEQ ID NO: 199044 - DNA, 25 bp, Rattus norvegicus
atggtccttccagatgacgtccgag

SEQ ID NO: 199045 - DNA, 25 bp, Rattus norvegicus
atggtcctttccatctgtggctggg

SEQ ID NO: 199046 - DNA, 25 bp, Rattus norvegicus
atggtcctttccttctgtggctggg

SEQ ID NO: 199047 - DNA, 25 bp, Rattus norvegicus
atggtcgagggcaggcaaacttctt

SEQ ID NO: 199048 - DNA, 25 bp, Rattus norvegicus
atggtcgagggctggcaaacttctt

SEQ ID NO: 199049 - DNA, 25 bp, Rattus norvegicus
atggtcgccctgaggattggcagct

SEQ ID NO: 199050 - DNA, 25 bp, Rattus norvegicus
atggtcgccctgtggattggcagct

SEQ ID NO: 199051 - DNA, 25 bp, Rattus norvegicus
atggtcgcgtttatcatggactttt

SEQ ID NO: 199052 - DNA, 25 bp, Rattus norvegicus
atggtcgcgtttttcatggactttt

SEQ ID NO: 199053 - DNA, 25 bp, Rattus norvegicus
atggtcgctcaacatgacactacaa

SEQ ID NO: 199054 - DNA, 25 bp, Rattus norvegicus
atggtcgctcaagatgacactacaa

SEQ ID NO: 199055 - DNA, 25 bp, Rattus norvegicus
atggtcgctgctagccaatgtgcca

SEQ ID NO: 199056 - DNA, 25 bp, Rattus norvegicus
atggtcgctgcttgccaatgtgcca

SEQ ID NO: 199057 - DNA, 25 bp, Rattus norvegicus
atggtcgcttctcagactggtgccc

SEQ ID NO: 199058 - DNA, 25 bp, Rattus norvegicus
atggtcgcttctgagactggtgccc

SEQ ID NO: 199059 - DNA, 25 bp, Rattus norvegicus
atggtcgggctgaagccacagctac

SEQ ID NO: 199060 - DNA, 25 bp, Rattus norvegicus
atggtcgggctgtagccacagctac

SEQ ID NO: 199061 - DNA, 25 bp, Rattus norvegicus
atggtcgtatgtcccagtgcatctc

SEQ ID NO: 199062 - DNA, 25 bp, Rattus norvegicus
atggtcgtatgtgccagtgcatctc

SEQ ID NO: 199063 - DNA, 25 bp, Rattus norvegicus
atggtcgtgagcatgaacgccttgt

SEQ ID NO: 199064 - DNA, 25 bp, Rattus norvegicus
atggtcgtgagcttgaacgccttgt

SEQ ID NO: 199065 - DNA, 25 bp, Rattus norvegicus
atggtcgtgcctcagatagtctata

SEQ ID NO: 199066 - DNA, 25 bp, Rattus norvegicus
atggtcgtgcctgagatagtctata

SEQ ID NO: 199067 - DNA, 25 bp, Rattus norvegicus
atggtcgtgtgtcccgccatcactt

SEQ ID NO: 199068 - DNA, 25 bp, Rattus norvegicus
atggtcgtgtgtgccgccatcactt

SEQ ID NO: 199069 - DNA, 25 bp, Rattus norvegicus
atggtcgtttcacattaaccttgta

SEQ ID NO: 199070 - DNA, 25 bp, Rattus norvegicus
atggtcgtttcagattaaccttgta

SEQ ID NO: 199071 - DNA, 25 bp, Rattus norvegicus
atggtctaccccatggtaaggccat

SEQ ID NO: 199072 - DNA, 25 bp, Rattus norvegicus
atggtctaccccttggtaaggccat

SEQ ID NO: 199073 - DNA, 25 bp, Rattus norvegicus
atggtctactgaaaccctgtgcttt

SEQ ID NO: 199074 - DNA, 25 bp, Rattus norvegicus
atggtctactgataccctgtgcttt

SEQ ID NO: 199075 - DNA, 25 bp, Rattus norvegicus
atggtctagaatacttttgcagctc

SEQ ID NO: 199076 - DNA, 25 bp, Rattus norvegicus
atggtctagaattcttttgcagctc

SEQ ID NO: 199077 - DNA, 25 bp, Rattus norvegicus
atggtctagacgaccttccggaact

SEQ ID NO: 199078 - DNA, 25 bp, Rattus norvegicus
atggtctagacgtccttccggaact

SEQ ID NO: 199079 - DNA, 25 bp, Rattus norvegicus
atggtctagatccatgctcagtggc

SEQ ID NO: 199080 - DNA, 25 bp, Rattus norvegicus
atggtctagatcgatgctcagtggc

SEQ ID NO: 199081 - DNA, 25 bp, Rattus norvegicus
atggtctatgaaatcttttccttgg

SEQ ID NO: 199082 - DNA, 25 bp, Rattus norvegicus
atggtctatgaattcttttccttgg

SEQ ID NO: 199083 - DNA, 25 bp, Rattus norvegicus
atggtctcacatatgcattagcatt

SEQ ID NO: 199084 - DNA, 25 bp, Rattus norvegicus
atggtctcacatttgcattagcatt

SEQ ID NO: 199085 - DNA, 25 bp, Rattus norvegicus
atggtctcagctactaggaggcaga

SEQ ID NO: 199086 - DNA, 25 bp, Rattus norvegicus
atggtctcagcttctaggaggcaga

SEQ ID NO: 199087 - DNA, 25 bp, Rattus norvegicus
atggtctcagtgactatggccactt

SEQ ID NO: 199088 - DNA, 25 bp, Rattus norvegicus
atggtctcagtgtctatggccactt

SEQ ID NO: 199089 - DNA, 25 bp, Rattus norvegicus
atggtctccaggattcaggttgaca

SEQ ID NO: 199090 - DNA, 25 bp, Rattus norvegicus
atggtctccaggtttcaggttgaca

SEQ ID NO: 199091 - DNA, 25 bp, Rattus norvegicus
atggtctccgaacatgtgccagcaa

SEQ ID NO: 199092 - DNA, 25 bp, Rattus norvegicus
atggtctccgaagatgtgccagcaa

SEQ ID NO: 199093 - DNA, 25 bp, Rattus norvegicus
atggtctcctctcagtattagtgac

SEQ ID NO: 199094 - DNA, 25 bp, Rattus norvegicus
atggtctcctctgagtattagtgac

SEQ ID NO: 199095 - DNA, 25 bp, Rattus norvegicus
atggtctctccgctgacgaagtgga

SEQ ID NO: 199096 - DNA, 25 bp, Rattus norvegicus
atggtctctccggtgacgaagtgga

SEQ ID NO: 199097 - DNA, 25 bp, Rattus norvegicus
atggtctctgatacatttgctgtat

SEQ ID NO: 199098 - DNA, 25 bp, Rattus norvegicus
atggtctctgattcatttgctgtat

SEQ ID NO: 199099 - DNA, 25 bp, Rattus norvegicus
atggtctctgcaacatcgatttaat

SEQ ID NO: 199100 - DNA, 25 bp, Rattus norvegicus
atggtctctgcatcatcgatttaat

SEQ ID NO: 199101 - DNA, 25 bp, Rattus norvegicus
atggtctctgcccagtcagagttga

SEQ ID NO: 199102 - DNA, 25 bp, Rattus norvegicus
atggtctctgccgagtcagagttga

SEQ ID NO: 199103 - DNA, 25 bp, Rattus norvegicus
atggtctctgtcaactctgtaattc

SEQ ID NO: 199104 - DNA, 25 bp, Rattus norvegicus
atggtctctgtctactctgtaattc

SEQ ID NO: 199105 - DNA, 25 bp, Rattus norvegicus
atggtctcttgaacacagctttctg

SEQ ID NO: 199106 - DNA, 25 bp, Rattus norvegicus
atggtctcttgatcacagctttctg

SEQ ID NO: 199107 - DNA, 25 bp, Rattus norvegicus
atggtctgcactcaggatacctgat

SEQ ID NO: 199108 - DNA, 25 bp, Rattus norvegicus
atggtctgcactgaggatacctgat

SEQ ID NO: 199109 - DNA, 25 bp, Rattus norvegicus
atggtctgcctacttctttctggac

SEQ ID NO: 199110 - DNA, 25 bp, Rattus norvegicus
atggtctgcctagttctttctggac

SEQ ID NO: 199111 - DNA, 25 bp, Rattus norvegicus
atggtctgccttctattgagctgag

SEQ ID NO: 199112 - DNA, 25 bp, Rattus norvegicus
atggtctgccttgtattgagctgag

SEQ ID NO: 199113 - DNA, 25 bp, Rattus norvegicus
atggtctggatcctggcctttatga

SEQ ID NO: 199114 - DNA, 25 bp, Rattus norvegicus
atggtctggatcgtggcctttatga

SEQ ID NO: 199115 - DNA, 25 bp, Rattus norvegicus
atggtctgggagcacttgcccatca

SEQ ID NO: 199116 - DNA, 25 bp, Rattus norvegicus
atggtctgggaggacttgcccatca

SEQ ID NO: 199117 - DNA, 25 bp, Rattus norvegicus
atggtctgtacaagactcctcctgt

SEQ ID NO: 199118 - DNA, 25 bp, Rattus norvegicus
atggtctgtacatgactcctcctgt

SEQ ID NO: 199119 - DNA, 25 bp, Rattus norvegicus
atggtctgtctactgcccagtgttc

SEQ ID NO: 199120 - DNA, 25 bp, Rattus norvegicus
atggtctgtctagtgcccagtgttc

SEQ ID NO: 199121 - DNA, 25 bp, Rattus norvegicus
atggtctgtctgctgagcagctcca

SEQ ID NO: 199122 - DNA, 25 bp, Rattus norvegicus
atggtctgtctggtgagcagctcca

SEQ ID NO: 199123 - DNA, 25 bp, Rattus norvegicus
atggtctgtcttatatatgttcgta

SEQ ID NO: 199124 - DNA, 25 bp, Rattus norvegicus
atggtctgtcttttatatgttcgta

SEQ ID NO: 199125 - DNA, 25 bp, Rattus norvegicus
atggtctgtttcctacaccggctgg

SEQ ID NO: 199126 - DNA, 25 bp, Rattus norvegicus
atggtctgtttcgtacaccggctgg

SEQ ID NO: 199127 - DNA, 25 bp, Rattus norvegicus
atggtcttcctgattgatacccgta

SEQ ID NO: 199128 - DNA, 25 bp, Rattus norvegicus
atggtcttcctgtttgatacccgta

SEQ ID NO: 199129 - DNA, 25 bp, Rattus norvegicus
atggtcttctgcagccaggacaaac

SEQ ID NO: 199130 - DNA, 25 bp, Rattus norvegicus
atggtcttctgctgccaggacaaac

SEQ ID NO: 199131 - DNA, 25 bp, Rattus norvegicus
atggtcttgcttctgtggctcttag

SEQ ID NO: 199132 - DNA, 25 bp, Rattus norvegicus
atggtcttgcttgtgtggctcttag

SEQ ID NO: 199133 - DNA, 25 bp, Rattus norvegicus
atggtcttgggcagtcttctaattc

SEQ ID NO: 199134 - DNA, 25 bp, Rattus norvegicus
atggtcttgggctgtcttctaattc

SEQ ID NO: 199135 - DNA, 25 bp, Rattus norvegicus
atggtctttcccaatcaaagcggtc

SEQ ID NO: 199136 - DNA, 25 bp, Rattus norvegicus
atggtctttccctatcaaagcggtc

SEQ ID NO: 199137 - DNA, 25 bp, Rattus norvegicus
atggtctttgccatgtgcctcttcc

SEQ ID NO: 199138 - DNA, 25 bp, Rattus norvegicus
atggtctttgccttgtgcctcttcc

SEQ ID NO: 199139 - DNA, 25 bp, Rattus norvegicus
atggtctttggtcatgggccaagct

SEQ ID NO: 199140 - DNA, 25 bp, Rattus norvegicus
atggtctttggtgatgggccaagct

SEQ ID NO: 199141 - DNA, 25 bp, Rattus norvegicus
atggtcttttctatgattggctgcg

SEQ ID NO: 199142 - DNA, 25 bp, Rattus norvegicus
atggtcttttctttgattggctgcg

SEQ ID NO: 199143 - DNA, 25 bp, Rattus norvegicus
atggtcttttgtcatatgcgttaac

SEQ ID NO: 199144 - DNA, 25 bp, Rattus norvegicus
atggtcttttgtgatatgcgttaac

SEQ ID NO: 199145 - DNA, 25 bp, Rattus norvegicus
atggtgaaatcacaccttctctctt

SEQ ID NO: 199146 - DNA, 25 bp, Rattus norvegicus
atggtgaaatcagaccttctctctt

SEQ ID NO: 199147 - DNA, 25 bp, Rattus norvegicus
atggtgaaatctactgtcttttgca

SEQ ID NO: 199148 - DNA, 25 bp, Rattus norvegicus
atggtgaaatcttctgtcttttgca

SEQ ID NO: 199149 - DNA, 25 bp, Rattus norvegicus
atggtgaacgctccgtctaggccac

SEQ ID NO: 199150 - DNA, 25 bp, Rattus norvegicus
atggtgaacgctgcgtctaggccac

SEQ ID NO: 199151 - DNA, 25 bp, Rattus norvegicus
atggtgaatgtccacctcatcactc

SEQ ID NO: 199152 - DNA, 25 bp, Rattus norvegicus
atggtgaatgtcgacctcatcactc

SEQ ID NO: 199153 - DNA, 25 bp, Rattus norvegicus
atggtgaattctccagttactggta

SEQ ID NO: 199154 - DNA, 25 bp, Rattus norvegicus
atggtgaattctgcagttactggta

SEQ ID NO: 199155 - DNA, 25 bp, Rattus norvegicus
atggtgacacagcatgcctctaatc

SEQ ID NO: 199156 - DNA, 25 bp, Rattus norvegicus
atggtgacacaggatgcctctaatc

SEQ ID NO: 199157 - DNA, 25 bp, Rattus norvegicus
atggtgacacggcacacgagtgatt

SEQ ID NO: 199158 - DNA, 25 bp, Rattus norvegicus
atggtgacacgggacacgagtgatt

SEQ ID NO: 199159 - DNA, 25 bp, Rattus norvegicus
atggtgacagagctgtactccggcc

SEQ ID NO: 199160 - DNA, 25 bp, Rattus norvegicus
atggtgacagaggtgtactccggcc

SEQ ID NO: 199161 - DNA, 25 bp, Rattus norvegicus
atggtgacagcactcatcctaagac

SEQ ID NO: 199162 - DNA, 25 bp, Rattus norvegicus
atggtgacagcagtcatcctaagac

SEQ ID NO: 199163 - DNA, 25 bp, Rattus norvegicus
atggtgacagttaccaaacctgccc

SEQ ID NO: 199164 - DNA, 25 bp, Rattus norvegicus
atggtgacagtttccaaacctgccc

SEQ ID NO: 199165 - DNA, 25 bp, Rattus norvegicus
atggtgacatgtatttgcaagcaat

SEQ ID NO: 199166 - DNA, 25 bp, Rattus norvegicus
atggtgacatgtttttgcaagcaat

SEQ ID NO: 199167 - DNA, 25 bp, Rattus norvegicus
atggtgaccaccatggctattccac

SEQ ID NO: 199168 - DNA, 25 bp, Rattus norvegicus
atggtgaccaccttggctattccac

SEQ ID NO: 199169 - DNA, 25 bp, Rattus norvegicus
atggtgaccagcacacgttggctga

SEQ ID NO: 199170 - DNA, 25 bp, Rattus norvegicus
atggtgaccagctcacgttggctga

SEQ ID NO: 199171 - DNA, 25 bp, Rattus norvegicus
atggtgaccatcatgagcctatttg

SEQ ID NO: 199172 - DNA, 25 bp, Rattus norvegicus
atggtgaccatcttgagcctatttg

SEQ ID NO: 199173 - DNA, 25 bp, Rattus norvegicus
atggtgaccccaaagctccagacat

SEQ ID NO: 199174 - DNA, 25 bp, Rattus norvegicus
atggtgaccccatagctccagacat

SEQ ID NO: 199175 - DNA, 25 bp, Rattus norvegicus
atggtgaccgtcactgtgctctgta

SEQ ID NO: 199176 - DNA, 25 bp, Rattus norvegicus
atggtgaccgtctctgtgctctgta

SEQ ID NO: 199177 - DNA, 25 bp, Rattus norvegicus
atggtgacctacatggcttgactca

SEQ ID NO: 199178 - DNA, 25 bp, Rattus norvegicus
atggtgacctacttggcttgactca

SEQ ID NO: 199179 - DNA, 25 bp, Rattus norvegicus
atggtgacctggagctggccgcaaa

SEQ ID NO: 199180 - DNA, 25 bp, Rattus norvegicus
atggtgacctggtgctggccgcaaa

SEQ ID NO: 199181 - DNA, 25 bp, Rattus norvegicus
atggtgacgcccctgagagaactca

SEQ ID NO: 199182 - DNA, 25 bp, Rattus norvegicus
atggtgacgcccgtgagagaactca

SEQ ID NO: 199183 - DNA, 25 bp, Rattus norvegicus
atggtgactagtacagcgccaagcc

SEQ ID NO: 199184 - DNA, 25 bp, Rattus norvegicus
atggtgactagtacattgtgccctg

SEQ ID NO: 199185 - DNA, 25 bp, Rattus norvegicus
atggtgactagttcagcgccaagcc

SEQ ID NO: 199186 - DNA, 25 bp, Rattus norvegicus
atggtgactagttcattgtgccctg

SEQ ID NO: 199187 - DNA, 25 bp, Rattus norvegicus
atggtgactctcctatggaggcaca

SEQ ID NO: 199188 - DNA, 25 bp, Rattus norvegicus
atggtgactctcgtatggaggcaca

SEQ ID NO: 199189 - DNA, 25 bp, Rattus norvegicus
atggtgactgacatcacagcttcag

SEQ ID NO: 199190 - DNA, 25 bp, Rattus norvegicus
atggtgactgacttcacagcttcag

SEQ ID NO: 199191 - DNA, 25 bp, Rattus norvegicus
atggtgacttaaagggaggtgcctc

SEQ ID NO: 199192 - DNA, 25 bp, Rattus norvegicus
atggtgacttaatgggaggtgcctc

SEQ ID NO: 199193 - DNA, 25 bp, Rattus norvegicus
atggtgacttcaattcagcctggag

SEQ ID NO: 199194 - DNA, 25 bp, Rattus norvegicus
atggtgacttcatttcagcctggag

SEQ ID NO: 199195 - DNA, 25 bp, Rattus norvegicus
atggtgacttctacattgccaacga

SEQ ID NO: 199196 - DNA, 25 bp, Rattus norvegicus
atggtgacttcttcattgccaacga

SEQ ID NO: 199197 - DNA, 25 bp, Rattus norvegicus
atggtgagatagctctttggccttt

SEQ ID NO: 199198 - DNA, 25 bp, Rattus norvegicus
atggtgagataggtctttggccttt

SEQ ID NO: 199199 - DNA, 25 bp, Rattus norvegicus
atggtgagcgtgcactttcctgaaa

SEQ ID NO: 199200 - DNA, 25 bp, Rattus norvegicus
atggtgagcgtggactttcctgaaa

SEQ ID NO: 199201 - DNA, 25 bp, Rattus norvegicus
atggtgaggtgtaccacaccctgga

SEQ ID NO: 199202 - DNA, 25 bp, Rattus norvegicus
atggtgaggtgttccacaccctgga

SEQ ID NO: 199203 - DNA, 25 bp, Rattus norvegicus
atggtgataattactccctcttttg

SEQ ID NO: 199204 - DNA, 25 bp, Rattus norvegicus
atggtgataatttctccctcttttg

SEQ ID NO: 199205 - DNA, 25 bp, Rattus norvegicus
atggtgatactcctcactctgcatg

SEQ ID NO: 199206 - DNA, 25 bp, Rattus norvegicus
atggtgatactcgtcactctgcatg

SEQ ID NO: 199207 - DNA, 25 bp, Rattus norvegicus
atggtgatcctcatgttttactaac

SEQ ID NO: 199208 - DNA, 25 bp, Rattus norvegicus
atggtgatcctcttgttttactaac

SEQ ID NO: 199209 - DNA, 25 bp, Rattus norvegicus
atggtgatcctgagaactagttaac

SEQ ID NO: 199210 - DNA, 25 bp, Rattus norvegicus
atggtgatcctgtgaactagttaac

SEQ ID NO: 199211 - DNA, 25 bp, Rattus norvegicus
atggtgatcgcaacctgtgcacagc

SEQ ID NO: 199212 - DNA, 25 bp, Rattus norvegicus
atggtgatcgcatcctgtgcacagc

SEQ ID NO: 199213 - DNA, 25 bp, Rattus norvegicus
atggtgatgaacacatttaatccca

SEQ ID NO: 199214 - DNA, 25 bp, Rattus norvegicus
atggtgatgaactcatttaatccca

SEQ ID NO: 199215 - DNA, 25 bp, Rattus norvegicus
atggtgatgacccaggtggaagccc

SEQ ID NO: 199216 - DNA, 25 bp, Rattus norvegicus
atggtgatgaccgaggtggaagccc

SEQ ID NO: 199217 - DNA, 25 bp, Rattus norvegicus
atggtgatgatgagcgtgtgtcctc

SEQ ID NO: 199218 - DNA, 25 bp, Rattus norvegicus
atggtgatgatgtgcgtgtgtcctc

SEQ ID NO: 199219 - DNA, 25 bp, Rattus norvegicus
atggtgatgcatactgtaatcccag

SEQ ID NO: 199220 - DNA, 25 bp, Rattus norvegicus
atggtgatgcattctgtaatcccag

SEQ ID NO: 199221 - DNA, 25 bp, Rattus norvegicus
atggtgatgctacattttcgtttat

SEQ ID NO: 199222 - DNA, 25 bp, Rattus norvegicus
atggtgatgctagattttcgtttat

SEQ ID NO: 199223 - DNA, 25 bp, Rattus norvegicus
atggtgatggccagtgtcatgcaga

SEQ ID NO: 199224 - DNA, 25 bp, Rattus norvegicus
atggtgatggcctgtgtcatgcaga

SEQ ID NO: 199225 - DNA, 25 bp, Rattus norvegicus
atggtgatggctcatctcattccca

SEQ ID NO: 199226 - DNA, 25 bp, Rattus norvegicus
atggtgatggctgatctcattccca

SEQ ID NO: 199227 - DNA, 25 bp, Rattus norvegicus
atggtgattcgtatctttaaaagca

SEQ ID NO: 199228 - DNA, 25 bp, Rattus norvegicus
atggtgattcgtttctttaaaagca

SEQ ID NO: 199229 - DNA, 25 bp, Rattus norvegicus
atggtgattctacactccctcgagt

SEQ ID NO: 199230 - DNA, 25 bp, Rattus norvegicus
atggtgattctagactccctcgagt

SEQ ID NO: 199231 - DNA, 25 bp, Rattus norvegicus
atggtgattctccagttactccaat

SEQ ID NO: 199232 - DNA, 25 bp, Rattus norvegicus
atggtgattctcgagttactccaat

SEQ ID NO: 199233 - DNA, 25 bp, Rattus norvegicus
atggtgcaaattctggccctggcaa

SEQ ID NO: 199234 - DNA, 25 bp, Rattus norvegicus
atggtgcaaattgtggccctggcaa

SEQ ID NO: 199235 - DNA, 25 bp, Rattus norvegicus
atggtgcaatgcagcaatggctaaa

SEQ ID NO: 199236 - DNA, 25 bp, Rattus norvegicus
atggtgcaatgctgcaatggctaaa

SEQ ID NO: 199237 - DNA, 25 bp, Rattus norvegicus
atggtgcaccgcacagagctgagtg

SEQ ID NO: 199238 - DNA, 25 bp, Rattus norvegicus
atggtgcaccgctcagagctgagtg

SEQ ID NO: 199239 - DNA, 25 bp, Rattus norvegicus
atggtgcacctaactgatgctgaga

SEQ ID NO: 199240 - DNA, 25 bp, Rattus norvegicus
atggtgcacctatctgatgctgaga

SEQ ID NO: 199241 - DNA, 25 bp, Rattus norvegicus
atggtgcacctgactgatgctgaga

SEQ ID NO: 199242 - DNA, 25 bp, Rattus norvegicus
atggtgcacctgtctgatgctgaga

SEQ ID NO: 199243 - DNA, 25 bp, Rattus norvegicus
atggtgcactttattcgctatttaa

SEQ ID NO: 199244 - DNA, 25 bp, Rattus norvegicus
atggtgcacttttttcgctatttaa

SEQ ID NO: 199245 - DNA, 25 bp, Rattus norvegicus
atggtgcagcacagttcttaagaga

SEQ ID NO: 199246 - DNA, 25 bp, Rattus norvegicus
atggtgcagcactgttcttaagaga

SEQ ID NO: 199247 - DNA, 25 bp, Rattus norvegicus
atggtgcagccaagcccaagggagc

SEQ ID NO: 199248 - DNA, 25 bp, Rattus norvegicus
atggtgcagccatgcccaagggagc

SEQ ID NO: 199249 - DNA, 25 bp, Rattus norvegicus
atggtgcatcctccttttttaattt

SEQ ID NO: 199250 - DNA, 25 bp, Rattus norvegicus
atggtgcatcctgcttttttaattt

SEQ ID NO: 199251 - DNA, 25 bp, Rattus norvegicus
atggtgcatctgaaacgtccagtca

SEQ ID NO: 199252 - DNA, 25 bp, Rattus norvegicus
atggtgcatctgtaacgtccagtca

SEQ ID NO: 199253 - DNA, 25 bp, Rattus norvegicus
atggtgcatgctcacactttcgaat

SEQ ID NO: 199254 - DNA, 25 bp, Rattus norvegicus
atggtgcatgctgacactttcgaat

SEQ ID NO: 199255 - DNA, 25 bp, Rattus norvegicus
atggtgccaacaagaatctacctcg

SEQ ID NO: 199256 - DNA, 25 bp, Rattus norvegicus
atggtgccaacatgaatctacctcg

SEQ ID NO: 199257 - DNA, 25 bp, Rattus norvegicus
atggtgccaggcactggtactgccc

SEQ ID NO: 199258 - DNA, 25 bp, Rattus norvegicus
atggtgccaggctctggtactgccc

SEQ ID NO: 199259 - DNA, 25 bp, Rattus norvegicus
atggtgccatttactagagcttgta

SEQ ID NO: 199260 - DNA, 25 bp, Rattus norvegicus
atggtgccattttctagagcttgta

SEQ ID NO: 199261 - DNA, 25 bp, Rattus norvegicus
atggtgcccaccaatgagtcgtgct

SEQ ID NO: 199262 - DNA, 25 bp, Rattus norvegicus
atggtgcccacctatgagtcgtgct

SEQ ID NO: 199263 - DNA, 25 bp, Rattus norvegicus
atggtgccctggactaagcatgtca

SEQ ID NO: 199264 - DNA, 25 bp, Rattus norvegicus
atggtgccctggactgtcacaggcc

SEQ ID NO: 199265 - DNA, 25 bp, Rattus norvegicus
atggtgccctggtctaagcatgtca

SEQ ID NO: 199266 - DNA, 25 bp, Rattus norvegicus
atggtgccctggtctgtcacaggcc

SEQ ID NO: 199267 - DNA, 25 bp, Rattus norvegicus
atggtgcctgaacctttctcccaat

SEQ ID NO: 199268 - DNA, 25 bp, Rattus norvegicus
atggtgcctgaagctttctcccaat

SEQ ID NO: 199269 - DNA, 25 bp, Rattus norvegicus
atggtgcctgagatagtcctgtgcc

SEQ ID NO: 199270 - DNA, 25 bp, Rattus norvegicus
atggtgcctgagttagtcctgtgcc

SEQ ID NO: 199271 - DNA, 25 bp, Rattus norvegicus
atggtgccttagcagttaatgcccc

SEQ ID NO: 199272 - DNA, 25 bp, Rattus norvegicus
atggtgccttaggagttaatgcccc

SEQ ID NO: 199273 - DNA, 25 bp, Rattus norvegicus
atggtgcggcccatgtgcaggaacc

SEQ ID NO: 199274 - DNA, 25 bp, Rattus norvegicus
atggtgcggcccttgtgcaggaacc

SEQ ID NO: 199275 - DNA, 25 bp, Rattus norvegicus
atggtgctacataaggttccctggt

SEQ ID NO: 199276 - DNA, 25 bp, Rattus norvegicus
atggtgctacattaggttccctggt

SEQ ID NO: 199277 - DNA, 25 bp, Rattus norvegicus
atggtgctaccaaactttcaagagc

SEQ ID NO: 199278 - DNA, 25 bp, Rattus norvegicus
atggtgctaccatactttcaagagc

SEQ ID NO: 199279 - DNA, 25 bp, Rattus norvegicus
atggtgctcctaacacagaccgaag

SEQ ID NO: 199280 - DNA, 25 bp, Rattus norvegicus
atggtgctcctaaggaggtcctagc

SEQ ID NO: 199281 - DNA, 25 bp, Rattus norvegicus
atggtgctcctatcacagaccgaag

SEQ ID NO: 199282 - DNA, 25 bp, Rattus norvegicus
atggtgctcctatggaggtcctagc

SEQ ID NO: 199283 - DNA, 25 bp, Rattus norvegicus
atggtgctgacaaggctgattgtga

SEQ ID NO: 199284 - DNA, 25 bp, Rattus norvegicus
atggtgctgacatggctgattgtga

SEQ ID NO: 199285 - DNA, 25 bp, Rattus norvegicus
atggtgctgctgctcaatcttgaat

SEQ ID NO: 199286 - DNA, 25 bp, Rattus norvegicus
atggtgctgctggtcaatcttgaat

SEQ ID NO: 199287 - DNA, 25 bp, Rattus norvegicus
atggtgctggccaattaccgtatct

SEQ ID NO: 199288 - DNA, 25 bp, Rattus norvegicus
atggtgctggccacagaagagtttg

SEQ ID NO: 199289 - DNA, 25 bp, Rattus norvegicus
atggtgctggcctattaccgtatct

SEQ ID NO: 199290 - DNA, 25 bp, Rattus norvegicus
atggtgctggcctcagaagagtttg

SEQ ID NO: 199291 - DNA, 25 bp, Rattus norvegicus
atggtgctgggcaagccagacctaa

SEQ ID NO: 199292 - DNA, 25 bp, Rattus norvegicus
atggtgctgggctagccagacctaa

SEQ ID NO: 199293 - DNA, 25 bp, Rattus norvegicus
atggtgctggtgactgtttctgtct

SEQ ID NO: 199294 - DNA, 25 bp, Rattus norvegicus
atggtgctggtgatgcagactttcc

SEQ ID NO: 199295 - DNA, 25 bp, Rattus norvegicus
atggtgctggtgtctgtttctgtct

SEQ ID NO: 199296 - DNA, 25 bp, Rattus norvegicus
atggtgctggtgttgcagactttcc

SEQ ID NO: 199297 - DNA, 25 bp, Rattus norvegicus
atggtgctgtctcaccttaacctta

SEQ ID NO: 199298 - DNA, 25 bp, Rattus norvegicus
atggtgctgtctgaccttaacctta

SEQ ID NO: 199299 - DNA, 25 bp, Rattus norvegicus
atggtgcttgcacgttttctaggta

SEQ ID NO: 199300 - DNA, 25 bp, Rattus norvegicus
atggtgcttgcaggttttctaggta

SEQ ID NO: 199301 - DNA, 25 bp, Rattus norvegicus
atggtgcttgtcaataatgccagca

SEQ ID NO: 199302 - DNA, 25 bp, Rattus norvegicus
atggtgcttgtctataatgccagca

SEQ ID NO: 199303 - DNA, 25 bp, Rattus norvegicus
atggtgctttgtctgagctggacct

SEQ ID NO: 199304 - DNA, 25 bp, Rattus norvegicus
atggtgctttgtgtgagctggacct

SEQ ID NO: 199305 - DNA, 25 bp, Rattus norvegicus
atggtgctttttctggatgctaact

SEQ ID NO: 199306 - DNA, 25 bp, Rattus norvegicus
atggtgctttttgtggatgctaact

SEQ ID NO: 199307 - DNA, 25 bp, Rattus norvegicus
atggtggaaccactggtgaccagaa

SEQ ID NO: 199308 - DNA, 25 bp, Rattus norvegicus
atggtggaaccagtggtgaccagaa

SEQ ID NO: 199309 - DNA, 25 bp, Rattus norvegicus
atggtggaaggtcttgtacccctca

SEQ ID NO: 199310 - DNA, 25 bp, Rattus norvegicus
atggtggaaggtgttgtacccctca

SEQ ID NO: 199311 - DNA, 25 bp, Rattus norvegicus
atggtggacaaaacgatgtcatctg

SEQ ID NO: 199312 - DNA, 25 bp, Rattus norvegicus
atggtggacaaatcgatgtcatctg

SEQ ID NO: 199313 - DNA, 25 bp, Rattus norvegicus
atggtggacacaatcagccccggta

SEQ ID NO: 199314 - DNA, 25 bp, Rattus norvegicus
atggtggacacattcagccccggta

SEQ ID NO: 199315 - DNA, 25 bp, Rattus norvegicus
atggtggacccccacattcacaggc

SEQ ID NO: 199316 - DNA, 25 bp, Rattus norvegicus
atggtggaccccgacattcacaggc

SEQ ID NO: 199317 - DNA, 25 bp, Rattus norvegicus
atggtggaccctaatgcttctggaa

SEQ ID NO: 199318 - DNA, 25 bp, Rattus norvegicus
atggtggacccttatgcttctggaa

SEQ ID NO: 199319 - DNA, 25 bp, Rattus norvegicus
atggtggacctaataccctatgggt

SEQ ID NO: 199320 - DNA, 25 bp, Rattus norvegicus
atggtggacctattaccctatgggt

SEQ ID NO: 199321 - DNA, 25 bp, Rattus norvegicus
atggtggactatccactctgagcct

SEQ ID NO: 199322 - DNA, 25 bp, Rattus norvegicus
atggtggactatgcactctgagcct

SEQ ID NO: 199323 - DNA, 25 bp, Rattus norvegicus
atggtggactccactatgatgccta

SEQ ID NO: 199324 - DNA, 25 bp, Rattus norvegicus
atggtggactcctctatgatgccta

SEQ ID NO: 199325 - DNA, 25 bp, Rattus norvegicus
atggtggagatgacgctcagcctct

SEQ ID NO: 199326 - DNA, 25 bp, Rattus norvegicus
atggtggagatgtcgctcagcctct

SEQ ID NO: 199327 - DNA, 25 bp, Rattus norvegicus
atggtggaggccactgccatgacaa

SEQ ID NO: 199328 - DNA, 25 bp, Rattus norvegicus
atggtggaggcccacccagaccaga

SEQ ID NO: 199329 - DNA, 25 bp, Rattus norvegicus
atggtggaggccgacccagaccaga

SEQ ID NO: 199330 - DNA, 25 bp, Rattus norvegicus
atggtggaggcctctgccatgacaa

SEQ ID NO: 199331 - DNA, 25 bp, Rattus norvegicus
atggtggagtgcagggccctaacac

SEQ ID NO: 199332 - DNA, 25 bp, Rattus norvegicus
atggtggagtgctgggccctaacac

SEQ ID NO: 199333 - DNA, 25 bp, Rattus norvegicus
atggtggatcacaacacccacaact

SEQ ID NO: 199334 - DNA, 25 bp, Rattus norvegicus
atggtggatcactacacccacaact

SEQ ID NO: 199335 - DNA, 25 bp, Rattus norvegicus
atggtggatcctcgaggacctctta

SEQ ID NO: 199336 - DNA, 25 bp, Rattus norvegicus
atggtggatcctggaggacctctta

SEQ ID NO: 199337 - DNA, 25 bp, Rattus norvegicus
atggtggatgctatacctctgttcc

SEQ ID NO: 199338 - DNA, 25 bp, Rattus norvegicus
atggtggatgctttacctctgttcc

SEQ ID NO: 199339 - DNA, 25 bp, Rattus norvegicus
atggtggatgtaaacttgcctataa

SEQ ID NO: 199340 - DNA, 25 bp, Rattus norvegicus
atggtggatgtatacttgcctataa

SEQ ID NO: 199341 - DNA, 25 bp, Rattus norvegicus
atggtggcaagaatgctgcagtgct

SEQ ID NO: 199342 - DNA, 25 bp, Rattus norvegicus
atggtggcaagattgctgcagtgct

SEQ ID NO: 199343 - DNA, 25 bp, Rattus norvegicus
atggtggcacatccctgtcagcact

SEQ ID NO: 199344 - DNA, 25 bp, Rattus norvegicus
atggtggcacatgcctgtcagcact

SEQ ID NO: 199345 - DNA, 25 bp, Rattus norvegicus
atggtggcaccacagctagtggcat

SEQ ID NO: 199346 - DNA, 25 bp, Rattus norvegicus
atggtggcaccagagctagtggcat

SEQ ID NO: 199347 - DNA, 25 bp, Rattus norvegicus
atggtggcactcctgtgccctgcct

SEQ ID NO: 199348 - DNA, 25 bp, Rattus norvegicus
atggtggcactcgtgtgccctgcct

SEQ ID NO: 199349 - DNA, 25 bp, Rattus norvegicus
atggtggcaggcctaaatcttcctt

SEQ ID NO: 199350 - DNA, 25 bp, Rattus norvegicus
atggtggcaggcgtaaatcttcctt

SEQ ID NO: 199351 - DNA, 25 bp, Rattus norvegicus
atggtggccaacctcttgtatgaga

SEQ ID NO: 199352 - DNA, 25 bp, Rattus norvegicus
atggtggccaacgtcttgtatgaga

SEQ ID NO: 199353 - DNA, 25 bp, Rattus norvegicus
atggtggccaagcactcagactttg

SEQ ID NO: 199354 - DNA, 25 bp, Rattus norvegicus
atggtggccaaggactcagactttg

SEQ ID NO: 199355 - DNA, 25 bp, Rattus norvegicus
atggtggccagtccctgtgactcca

SEQ ID NO: 199356 - DNA, 25 bp, Rattus norvegicus
atggtggccagtgcctgtgactcca

SEQ ID NO: 199357 - DNA, 25 bp, Rattus norvegicus
atggtggcccagcttttgatacaag

SEQ ID NO: 199358 - DNA, 25 bp, Rattus norvegicus
atggtggcccaggttttgatacaag

SEQ ID NO: 199359 - DNA, 25 bp, Rattus norvegicus
atggtggcctacactttaagtccca

SEQ ID NO: 199360 - DNA, 25 bp, Rattus norvegicus
atggtggcctactctttaagtccca

SEQ ID NO: 199361 - DNA, 25 bp, Rattus norvegicus
atggtggcgcatacagaccctgtga

SEQ ID NO: 199362 - DNA, 25 bp, Rattus norvegicus
atggtggcgcattcagaccctgtga

SEQ ID NO: 199363 - DNA, 25 bp, Rattus norvegicus
atggtggcgctcatcttcacgttgt

SEQ ID NO: 199364 - DNA, 25 bp, Rattus norvegicus
atggtggcgctcttcttcacgttgt

SEQ ID NO: 199365 - DNA, 25 bp, Rattus norvegicus
atggtggctacccaatgcggctgcc

SEQ ID NO: 199366 - DNA, 25 bp, Rattus norvegicus
atggtggctaccgaatgcggctgcc

SEQ ID NO: 199367 - DNA, 25 bp, Rattus norvegicus
atggtggctatgcaagtcttctcta

SEQ ID NO: 199368 - DNA, 25 bp, Rattus norvegicus
atggtggctatggaagtcttctcta

SEQ ID NO: 199369 - DNA, 25 bp, Rattus norvegicus
atggtggctcgcaccaaccaggctg

SEQ ID NO: 199370 - DNA, 25 bp, Rattus norvegicus
atggtggctcgctccaaccaggctg

SEQ ID NO: 199371 - DNA, 25 bp, Rattus norvegicus
atggtggctcttcatgatgtcatct

SEQ ID NO: 199372 - DNA, 25 bp, Rattus norvegicus
atggtggctcttgatgatgtcatct

SEQ ID NO: 199373 - DNA, 25 bp, Rattus norvegicus
atggtggctggaacatctatttttc

SEQ ID NO: 199374 - DNA, 25 bp, Rattus norvegicus
atggtggctggatcatctatttttc

SEQ ID NO: 199375 - DNA, 25 bp, Rattus norvegicus
atggtggcttcaactatatacaaac

SEQ ID NO: 199376 - DNA, 25 bp, Rattus norvegicus
atggtggcttcatctatatacaaac

SEQ ID NO: 199377 - DNA, 25 bp, Rattus norvegicus
atggtggcttgaccatcttcctgag

SEQ ID NO: 199378 - DNA, 25 bp, Rattus norvegicus
atggtggcttgagcatcttcctgag

SEQ ID NO: 199379 - DNA, 25 bp, Rattus norvegicus
atggtggcttggcacacatctgtca

SEQ ID NO: 199380 - DNA, 25 bp, Rattus norvegicus
atggtggcttgggacacatctgtca

SEQ ID NO: 199381 - DNA, 25 bp, Rattus norvegicus
atggtggcttgtaactatctatgag

SEQ ID NO: 199382 - DNA, 25 bp, Rattus norvegicus
atggtggcttgttactatctatgag

SEQ ID NO: 199383 - DNA, 25 bp, Rattus norvegicus
atggtggctttgaagacctgctctc

SEQ ID NO: 199384 - DNA, 25 bp, Rattus norvegicus
atggtggctttgtagacctgctctc

SEQ ID NO: 199385 - DNA, 25 bp, Rattus norvegicus
atggtgggcatcaaggaagagtcta

SEQ ID NO: 199386 - DNA, 25 bp, Rattus norvegicus
atggtgggcatctaggaagagtcta

SEQ ID NO: 199387 - DNA, 25 bp, Rattus norvegicus
atggtgggccccaagaagttctctg

SEQ ID NO: 199388 - DNA, 25 bp, Rattus norvegicus
atggtgggcccctagaagttctctg

SEQ ID NO: 199389 - DNA, 25 bp, Rattus norvegicus
atggtgggcctgacatcttcctgca

SEQ ID NO: 199390 - DNA, 25 bp, Rattus norvegicus
atggtgggcctgtcatcttcctgca

SEQ ID NO: 199391 - DNA, 25 bp, Rattus norvegicus
atggtgggctatcccttgctcagtg

SEQ ID NO: 199392 - DNA, 25 bp, Rattus norvegicus
atggtgggctatgccttgctcagtg

SEQ ID NO: 199393 - DNA, 25 bp, Rattus norvegicus
atggtgggtgctacatgactgacat

SEQ ID NO: 199394 - DNA, 25 bp, Rattus norvegicus
atggtgggtgcttcatgactgacat

SEQ ID NO: 199395 - DNA, 25 bp, Rattus norvegicus
atggtggtcaccaccagggcgagca

SEQ ID NO: 199396 - DNA, 25 bp, Rattus norvegicus
atggtggtcacctccagggcgagca

SEQ ID NO: 199397 - DNA, 25 bp, Rattus norvegicus
atggtggtcatcacggtgctgctgt

SEQ ID NO: 199398 - DNA, 25 bp, Rattus norvegicus
atggtggtcatctcggtgctgctgt

SEQ ID NO: 199399 - DNA, 25 bp, Rattus norvegicus
atggtggtcattctgcttggagcct

SEQ ID NO: 199400 - DNA, 25 bp, Rattus norvegicus
atggtggtcattgtgcttggagcct

SEQ ID NO: 199401 - DNA, 25 bp, Rattus norvegicus
atggtggtcccaaagctggtcgtga

SEQ ID NO: 199402 - DNA, 25 bp, Rattus norvegicus
atggtggtcccatagctggtcgtga

SEQ ID NO: 199403 - DNA, 25 bp, Rattus norvegicus
atggtggtcctcatggtcgctgaga

SEQ ID NO: 199404 - DNA, 25 bp, Rattus norvegicus
atggtggtcctcttggtcgctgaga

SEQ ID NO: 199405 - DNA, 25 bp, Rattus norvegicus
atggtggtcgtcatgacttcatcca

SEQ ID NO: 199406 - DNA, 25 bp, Rattus norvegicus
atggtggtcgtcttgacttcatcca

SEQ ID NO: 199407 - DNA, 25 bp, Rattus norvegicus
atggtggtctgcagctttacccagt

SEQ ID NO: 199408 - DNA, 25 bp, Rattus norvegicus
atggtggtctgctgctttacccagt

SEQ ID NO: 199409 - DNA, 25 bp, Rattus norvegicus
atggtggtgaacacctttctccagg

SEQ ID NO: 199410 - DNA, 25 bp, Rattus norvegicus
atggtggtgaactcctttctccagg

SEQ ID NO: 199411 - DNA, 25 bp, Rattus norvegicus
atggtggtgacactgaccgcctacc

SEQ ID NO: 199412 - DNA, 25 bp, Rattus norvegicus
atggtggtgacagtgaccgcctacc

SEQ ID NO: 199413 - DNA, 25 bp, Rattus norvegicus
atggtggtgctaacgacggtgctac

SEQ ID NO: 199414 - DNA, 25 bp, Rattus norvegicus
atggtggtgctatcgacggtgctac

SEQ ID NO: 199415 - DNA, 25 bp, Rattus norvegicus
atggtggtggaccaccgccccaaag

SEQ ID NO: 199416 - DNA, 25 bp, Rattus norvegicus
atggtggtggacgaccgccccaaag

SEQ ID NO: 199417 - DNA, 25 bp, Rattus norvegicus
atggtggtgggcatacttcacatcc

SEQ ID NO: 199418 - DNA, 25 bp, Rattus norvegicus
atggtggtgggcttacttcacatcc

SEQ ID NO: 199419 - DNA, 25 bp, Rattus norvegicus
atggtggtggtacaaacctctggaa

SEQ ID NO: 199420 - DNA, 25 bp, Rattus norvegicus
atggtggtggtagaaacctctggaa

SEQ ID NO: 199421 - DNA, 25 bp, Rattus norvegicus
atggtggttatcagggtatcctaga

SEQ ID NO: 199422 - DNA, 25 bp, Rattus norvegicus
atggtggttatctgggtatcctaga

SEQ ID NO: 199423 - DNA, 25 bp, Rattus norvegicus
atggtggttctcatctttattctga

SEQ ID NO: 199424 - DNA, 25 bp, Rattus norvegicus
atggtggttctcttctttattctga

SEQ ID NO: 199425 - DNA, 25 bp, Rattus norvegicus
atggtggttgttacttctgttattt

SEQ ID NO: 199426 - DNA, 25 bp, Rattus norvegicus
atggtggttgtttcttctgttattt

SEQ ID NO: 199427 - DNA, 25 bp, Rattus norvegicus
atggtgtaagacaagctttggagcc

SEQ ID NO: 199428 - DNA, 25 bp, Rattus norvegicus
atggtgtaagactagctttggagcc

SEQ ID NO: 199429 - DNA, 25 bp, Rattus norvegicus
atggtgtacaatcacctgctgcaga

SEQ ID NO: 199430 - DNA, 25 bp, Rattus norvegicus
atggtgtacaatgacctgctgcaga

SEQ ID NO: 199431 - DNA, 25 bp, Rattus norvegicus
atggtgtagcaacgcccaagggttc

SEQ ID NO: 199432 - DNA, 25 bp, Rattus norvegicus
atggtgtagcaaggcccaagggttc

SEQ ID NO: 199433 - DNA, 25 bp, Rattus norvegicus
atggtgtatgtgattccggtccctc

SEQ ID NO: 199434 - DNA, 25 bp, Rattus norvegicus
atggtgtatgtgtttccggtccctc

SEQ ID NO: 199435 - DNA, 25 bp, Rattus norvegicus
atggtgtcaacaccgtgtcacaggc

SEQ ID NO: 199436 - DNA, 25 bp, Rattus norvegicus
atggtgtcaacagcgtgtcacaggc

SEQ ID NO: 199437 - DNA, 25 bp, Rattus norvegicus
atggtgtcaaggattccctctgagc

SEQ ID NO: 199438 - DNA, 25 bp, Rattus norvegicus
atggtgtcaaggtttccctctgagc

SEQ ID NO: 199439 - DNA, 25 bp, Rattus norvegicus
atggtgtcaataaactgcagtcctg

SEQ ID NO: 199440 - DNA, 25 bp, Rattus norvegicus
atggtgtcaatatactgcagtcctg

SEQ ID NO: 199441 - DNA, 25 bp, Rattus norvegicus
atggtgtcaggcatcatacctgtga

SEQ ID NO: 199442 - DNA, 25 bp, Rattus norvegicus
atggtgtcaggcttcatacctgtga

SEQ ID NO: 199443 - DNA, 25 bp, Rattus norvegicus
atggtgtccacaagttcaactgtaa

SEQ ID NO: 199444 - DNA, 25 bp, Rattus norvegicus
atggtgtccacatgttcaactgtaa

SEQ ID NO: 199445 - DNA, 25 bp, Rattus norvegicus
atggtgtcccatcgtgtattcattg

SEQ ID NO: 199446 - DNA, 25 bp, Rattus norvegicus
atggtgtcccatggtgtattcattg

SEQ ID NO: 199447 - DNA, 25 bp, Rattus norvegicus
atggtgtccctgatgacctgctcta

SEQ ID NO: 199448 - DNA, 25 bp, Rattus norvegicus
atggtgtccctgttgacctgctcta

SEQ ID NO: 199449 - DNA, 25 bp, Rattus norvegicus
atggtgtcctctcagcgccacaagc

SEQ ID NO: 199450 - DNA, 25 bp, Rattus norvegicus
atggtgtcctctgagcgccacaagc

SEQ ID NO: 199451 - DNA, 25 bp, Rattus norvegicus
atggtgtctagcaatcacggctgca

SEQ ID NO: 199452 - DNA, 25 bp, Rattus norvegicus
atggtgtctagctatcacggctgca

SEQ ID NO: 199453 - DNA, 25 bp, Rattus norvegicus
atggtgtctctaccacgtctatagc

SEQ ID NO: 199454 - DNA, 25 bp, Rattus norvegicus
atggtgtctctagcacgtctatagc

SEQ ID NO: 199455 - DNA, 25 bp, Rattus norvegicus
atggtgtctctgagttagccctaat

SEQ ID NO: 199456 - DNA, 25 bp, Rattus norvegicus
atggtgtctctgtgttagccctaat

SEQ ID NO: 199457 - DNA, 25 bp, Rattus norvegicus
atggtgtcttcaccgactatctgca

SEQ ID NO: 199458 - DNA, 25 bp, Rattus norvegicus
atggtgtcttcagcgactatctgca

SEQ ID NO: 199459 - DNA, 25 bp, Rattus norvegicus
atggtgtgactgaaattctcccctt

SEQ ID NO: 199460 - DNA, 25 bp, Rattus norvegicus
atggtgtgactgtaattctcccctt

SEQ ID NO: 199461 - DNA, 25 bp, Rattus norvegicus
atggtgtgatgtacttcgccagcct

SEQ ID NO: 199462 - DNA, 25 bp, Rattus norvegicus
atggtgtgatgttcttcgccagcct

SEQ ID NO: 199463 - DNA, 25 bp, Rattus norvegicus
atggtgtgcagcaaggccttccgac

SEQ ID NO: 199464 - DNA, 25 bp, Rattus norvegicus
atggtgtgcagctaggccttccgac

SEQ ID NO: 199465 - DNA, 25 bp, Rattus norvegicus
atggtgtgctttcattctggtactc

SEQ ID NO: 199466 - DNA, 25 bp, Rattus norvegicus
atggtgtgctttgattctggtactc

SEQ ID NO: 199467 - DNA, 25 bp, Rattus norvegicus
atggtgtggagacctggtcccctaa

SEQ ID NO: 199468 - DNA, 25 bp, Rattus norvegicus
atggtgtggagagctggtcccctaa

SEQ ID NO: 199469 - DNA, 25 bp, Rattus norvegicus
atggtgtggatgacacatagaaacc

SEQ ID NO: 199470 - DNA, 25 bp, Rattus norvegicus
atggtgtggatgtcacatagaaacc

SEQ ID NO: 199471 - DNA, 25 bp, Rattus norvegicus
atggtgtgggaacgacacccacgtc

SEQ ID NO: 199472 - DNA, 25 bp, Rattus norvegicus
atggtgtgggaaggacacccacgtc

SEQ ID NO: 199473 - DNA, 25 bp, Rattus norvegicus
atggtgtggtgtacccagtcctggc

SEQ ID NO: 199474 - DNA, 25 bp, Rattus norvegicus
atggtgtggtgttcccagtcctggc

SEQ ID NO: 199475 - DNA, 25 bp, Rattus norvegicus
atggtgtgtacaccaggtgcctctc

SEQ ID NO: 199476 - DNA, 25 bp, Rattus norvegicus
atggtgtgtacagcaggtgcctctc

SEQ ID NO: 199477 - DNA, 25 bp, Rattus norvegicus
atggtgtgtgcaaaccttgtctcaa

SEQ ID NO: 199478 - DNA, 25 bp, Rattus norvegicus
atggtgtgtgcataccttgtctcaa

SEQ ID NO: 199479 - DNA, 25 bp, Rattus norvegicus
atggtgtgttagatcttcaggctca

SEQ ID NO: 199480 - DNA, 25 bp, Rattus norvegicus
atggtgtgttagttcttcaggctca

SEQ ID NO: 199481 - DNA, 25 bp, Rattus norvegicus
atggtgtgtttgcttgtttgattgt

SEQ ID NO: 199482 - DNA, 25 bp, Rattus norvegicus
atggtgtgtttggttgtttgattgt

SEQ ID NO: 199483 - DNA, 25 bp, Rattus norvegicus
atggtgttaatcagcatagtgctta

SEQ ID NO: 199484 - DNA, 25 bp, Rattus norvegicus
atggtgttaatctgcatagtgctta

SEQ ID NO: 199485 - DNA, 25 bp, Rattus norvegicus
atggtgttatcccagtgcagtgcct

SEQ ID NO: 199486 - DNA, 25 bp, Rattus norvegicus
atggtgttatccgagtgcagtgcct

SEQ ID NO: 199487 - DNA, 25 bp, Rattus norvegicus
atggtgttcattctcttgggtttta

SEQ ID NO: 199488 - DNA, 25 bp, Rattus norvegicus
atggtgttcattgtcttgggtttta

SEQ ID NO: 199489 - DNA, 25 bp, Rattus norvegicus
atggtgttcggcatcatcattggaa

SEQ ID NO: 199490 - DNA, 25 bp, Rattus norvegicus
atggtgttcggcttcatcattggaa

SEQ ID NO: 199491 - DNA, 25 bp, Rattus norvegicus
atggtgttgggtactttggcccaca

SEQ ID NO: 199492 - DNA, 25 bp, Rattus norvegicus
atggtgttgggttctttggcccaca

SEQ ID NO: 199493 - DNA, 25 bp, Rattus norvegicus
atggtgtttgtaatatgcttatggc

SEQ ID NO: 199494 - DNA, 25 bp, Rattus norvegicus
atggtgtttgtattatgcttatggc

SEQ ID NO: 199495 - DNA, 25 bp, Rattus norvegicus
atggtgttttatatgacgtctgtaa

SEQ ID NO: 199496 - DNA, 25 bp, Rattus norvegicus
atggtgttttatttgacgtctgtaa

SEQ ID NO: 199497 - DNA, 25 bp, Rattus norvegicus
atggttaaacatacatgacgtgaga

SEQ ID NO: 199498 - DNA, 25 bp, Rattus norvegicus
atggttaaacattcatgacgtgaga

SEQ ID NO: 199499 - DNA, 25 bp, Rattus norvegicus
atggttaacaccaagcgactccagt

SEQ ID NO: 199500 - DNA, 25 bp, Rattus norvegicus
atggttaacacctagcgactccagt

SEQ ID NO: 199501 - DNA, 25 bp, Rattus norvegicus
atggttaacctgctagttccactag

SEQ ID NO: 199502 - DNA, 25 bp, Rattus norvegicus
atggttaacctggtagttccactag

SEQ ID NO: 199503 - DNA, 25 bp, Rattus norvegicus
atggttaccatgacaacccaacctt

SEQ ID NO: 199504 - DNA, 25 bp, Rattus norvegicus
atggttaccatgtcaacccaacctt

SEQ ID NO: 199505 - DNA, 25 bp, Rattus norvegicus
atggttacccagagtctctacatag

SEQ ID NO: 199506 - DNA, 25 bp, Rattus norvegicus
atggttacccagtgtctctacatag

SEQ ID NO: 199507 - DNA, 25 bp, Rattus norvegicus
atggttacctggatcctgcagaggc

SEQ ID NO: 199508 - DNA, 25 bp, Rattus norvegicus
atggttacctggttcctgcagaggc

SEQ ID NO: 199509 - DNA, 25 bp, Rattus norvegicus
atggttacctttcgacacatctgtc

SEQ ID NO: 199510 - DNA, 25 bp, Rattus norvegicus
atggttacctttggacacatctgtc

SEQ ID NO: 199511 - DNA, 25 bp, Rattus norvegicus
atggttactcagaagcagttggtat

SEQ ID NO: 199512 - DNA, 25 bp, Rattus norvegicus
atggttactcagtagcagttggtat

SEQ ID NO: 199513 - DNA, 25 bp, Rattus norvegicus
atggttactgtgacttgcaccttca

SEQ ID NO: 199514 - DNA, 25 bp, Rattus norvegicus
atggttactgtgtcttgcaccttca

SEQ ID NO: 199515 - DNA, 25 bp, Rattus norvegicus
atggttagcaaaactccagctccct

SEQ ID NO: 199516 - DNA, 25 bp, Rattus norvegicus
atggttagcaaatctccagctccct

SEQ ID NO: 199517 - DNA, 25 bp, Rattus norvegicus
atggttaggactacaaacaaggcag

SEQ ID NO: 199518 - DNA, 25 bp, Rattus norvegicus
atggttaggacttcaaacaaggcag

SEQ ID NO: 199519 - DNA, 25 bp, Rattus norvegicus
atggttataaatcacccctggtatt

SEQ ID NO: 199520 - DNA, 25 bp, Rattus norvegicus
atggttataaatgacccctggtatt

SEQ ID NO: 199521 - DNA, 25 bp, Rattus norvegicus
atggttatgtgtattctcatcttta

SEQ ID NO: 199522 - DNA, 25 bp, Rattus norvegicus
atggttatgtgttttctcatcttta

SEQ ID NO: 199523 - DNA, 25 bp, Rattus norvegicus
atggttattttcagttctgtattta

SEQ ID NO: 199524 - DNA, 25 bp, Rattus norvegicus
atggttattttctgttctgtattta

SEQ ID NO: 199525 - DNA, 25 bp, Rattus norvegicus
atggttcacagtctgggtttctgga

SEQ ID NO: 199526 - DNA, 25 bp, Rattus norvegicus
atggttcacagtgtgggtttctgga

SEQ ID NO: 199527 - DNA, 25 bp, Rattus norvegicus
atggttcacatcctttagcacagag

SEQ ID NO: 199528 - DNA, 25 bp, Rattus norvegicus
atggttcacatcgtttagcacagag

SEQ ID NO: 199529 - DNA, 25 bp, Rattus norvegicus
atggttcaccgcagtgcacattgca

SEQ ID NO: 199530 - DNA, 25 bp, Rattus norvegicus
atggttcaccgctgtgcacattgca

SEQ ID NO: 199531 - DNA, 25 bp, Rattus norvegicus
atggttcagatcacttcactgtctt

SEQ ID NO: 199532 - DNA, 25 bp, Rattus norvegicus
atggttcagatctcttcactgtctt

SEQ ID NO: 199533 - DNA, 25 bp, Rattus norvegicus
atggttcagctcctaggcatcatgg

SEQ ID NO: 199534 - DNA, 25 bp, Rattus norvegicus
atggttcagctcgtaggcatcatgg

SEQ ID NO: 199535 - DNA, 25 bp, Rattus norvegicus
atggttcagctgaccacacagcgat

SEQ ID NO: 199536 - DNA, 25 bp, Rattus norvegicus
atggttcagctgtccacacagcgat

SEQ ID NO: 199537 - DNA, 25 bp, Rattus norvegicus
atggttcaggccagccctatgcact

SEQ ID NO: 199538 - DNA, 25 bp, Rattus norvegicus
atggttcaggcctgccctatgcact

SEQ ID NO: 199539 - DNA, 25 bp, Rattus norvegicus
atggttcagtctatgtttgctccgc

SEQ ID NO: 199540 - DNA, 25 bp, Rattus norvegicus
atggttcagtctttgtttgctccgc

SEQ ID NO: 199541 - DNA, 25 bp, Rattus norvegicus
atggttcagtttcatcaccggcttc

SEQ ID NO: 199542 - DNA, 25 bp, Rattus norvegicus
atggttcagtttccaaagagcccaa

SEQ ID NO: 199543 - DNA, 25 bp, Rattus norvegicus
atggttcagtttgatcaccggcttc

SEQ ID NO: 199544 - DNA, 25 bp, Rattus norvegicus
atggttcagtttgcaaagagcccaa

SEQ ID NO: 199545 - DNA, 25 bp, Rattus norvegicus
atggttcatatcctgataactggga

SEQ ID NO: 199546 - DNA, 25 bp, Rattus norvegicus
atggttcatatcgtgataactggga

SEQ ID NO: 199547 - DNA, 25 bp, Rattus norvegicus
atggttcatgccctggttgactgcc

SEQ ID NO: 199548 - DNA, 25 bp, Rattus norvegicus
atggttcatgccgtggttgactgcc

SEQ ID NO: 199549 - DNA, 25 bp, Rattus norvegicus
atggttcatttccaagggcacccta

SEQ ID NO: 199550 - DNA, 25 bp, Rattus norvegicus
atggttcatttcgaagggcacccta

SEQ ID NO: 199551 - DNA, 25 bp, Rattus norvegicus
atggttccacaacacaccgttgttg

SEQ ID NO: 199552 - DNA, 25 bp, Rattus norvegicus
atggttccacaagacaccgttgttg

SEQ ID NO: 199553 - DNA, 25 bp, Rattus norvegicus
atggttccaggaagtgcgtcaccga

SEQ ID NO: 199554 - DNA, 25 bp, Rattus norvegicus
atggttccaggaccacgtgttatca

SEQ ID NO: 199555 - DNA, 25 bp, Rattus norvegicus
atggttccaggagcacgtgttatca

SEQ ID NO: 199556 - DNA, 25 bp, Rattus norvegicus
atggttccaggatgtgcgtcaccga

SEQ ID NO: 199557 - DNA, 25 bp, Rattus norvegicus
atggttccatcacctgtgtctgggc

SEQ ID NO: 199558 - DNA, 25 bp, Rattus norvegicus
atggttccatcagctgtgtctgggc

SEQ ID NO: 199559 - DNA, 25 bp, Rattus norvegicus
atggttcccagtattttatctgcac

SEQ ID NO: 199560 - DNA, 25 bp, Rattus norvegicus
atggttcccagttttttatctgcac

SEQ ID NO: 199561 - DNA, 25 bp, Rattus norvegicus
atggttcctaccagatcaagttgcc

SEQ ID NO: 199562 - DNA, 25 bp, Rattus norvegicus
atggttcctaccatgccagagactc

SEQ ID NO: 199563 - DNA, 25 bp, Rattus norvegicus
atggttcctacctgatcaagttgcc

SEQ ID NO: 199564 - DNA, 25 bp, Rattus norvegicus
atggttcctaccttgccagagactc

SEQ ID NO: 199565 - DNA, 25 bp, Rattus norvegicus
atggttcctactactcatagcagcg

SEQ ID NO: 199566 - DNA, 25 bp, Rattus norvegicus
atggttcctacttctcatagcagcg

SEQ ID NO: 199567 - DNA, 25 bp, Rattus norvegicus
atggttcctcagaggccgcgggata

SEQ ID NO: 199568 - DNA, 25 bp, Rattus norvegicus
atggttcctcagtggccgcgggata

SEQ ID NO: 199569 - DNA, 25 bp, Rattus norvegicus
atggttcctgctacttgtgtccagt

SEQ ID NO: 199570 - DNA, 25 bp, Rattus norvegicus
atggttcctgcttcttgtgtccagt

SEQ ID NO: 199571 - DNA, 25 bp, Rattus norvegicus
atggttcctgggagcatgcagcaca

SEQ ID NO: 199572 - DNA, 25 bp, Rattus norvegicus
atggttcctgggtgcatgcagcaca

SEQ ID NO: 199573 - DNA, 25 bp, Rattus norvegicus
atggttccttccatatgcagtaatc

SEQ ID NO: 199574 - DNA, 25 bp, Rattus norvegicus
atggttccttccttatgcagtaatc

SEQ ID NO: 199575 - DNA, 25 bp, Rattus norvegicus
atggttcctttccttgtcagaggta

SEQ ID NO: 199576 - DNA, 25 bp, Rattus norvegicus
atggttcctttcgttgtcagaggta

SEQ ID NO: 199577 - DNA, 25 bp, Rattus norvegicus
atggttcgttttcctagggtgactg

SEQ ID NO: 199578 - DNA, 25 bp, Rattus norvegicus
atggttcgttttgctagggtgactg

SEQ ID NO: 199579 - DNA, 25 bp, Rattus norvegicus
atggttctactcagtcatccagatt

SEQ ID NO: 199580 - DNA, 25 bp, Rattus norvegicus
atggttctactctgtcatccagatt

SEQ ID NO: 199581 - DNA, 25 bp, Rattus norvegicus
atggttctacttctgttattgttaa

SEQ ID NO: 199582 - DNA, 25 bp, Rattus norvegicus
atggttctacttgtgttattgttaa

SEQ ID NO: 199583 - DNA, 25 bp, Rattus norvegicus
atggttctcagaccgtccgtctgta

SEQ ID NO: 199584 - DNA, 25 bp, Rattus norvegicus
atggttctcagagcgtccgtctgta

SEQ ID NO: 199585 - DNA, 25 bp, Rattus norvegicus
atggttctcagcagaggaccggcag

SEQ ID NO: 199586 - DNA, 25 bp, Rattus norvegicus
atggttctcagctgaggaccggcag

SEQ ID NO: 199587 - DNA, 25 bp, Rattus norvegicus
atggttctctggaacccatcaggga

SEQ ID NO: 199588 - DNA, 25 bp, Rattus norvegicus
atggttctctggtacccatcaggga

SEQ ID NO: 199589 - DNA, 25 bp, Rattus norvegicus
atggttctctgtcccataatcctca

SEQ ID NO: 199590 - DNA, 25 bp, Rattus norvegicus
atggttctctgtgccataatcctca

SEQ ID NO: 199591 - DNA, 25 bp, Rattus norvegicus
atggttctgatgagaatgtgcccta

SEQ ID NO: 199592 - DNA, 25 bp, Rattus norvegicus
atggttctgatgtgaatgtgcccta

SEQ ID NO: 199593 - DNA, 25 bp, Rattus norvegicus
atggttctggaacagacacctctcc

SEQ ID NO: 199594 - DNA, 25 bp, Rattus norvegicus
atggttctggaagagacacctctcc

SEQ ID NO: 199595 - DNA, 25 bp, Rattus norvegicus
atggttctggataccatgttttctc

SEQ ID NO: 199596 - DNA, 25 bp, Rattus norvegicus
atggttctggattccatgttttctc

SEQ ID NO: 199597 - DNA, 25 bp, Rattus norvegicus
atggttctggttagcctggtactcc

SEQ ID NO: 199598 - DNA, 25 bp, Rattus norvegicus
atggttctggtttgcctggtactcc

SEQ ID NO: 199599 - DNA, 25 bp, Rattus norvegicus
atggttcttaacacatgaactggac

SEQ ID NO: 199600 - DNA, 25 bp, Rattus norvegicus
atggttcttaactcatgaactggac

SEQ ID NO: 199601 - DNA, 25 bp, Rattus norvegicus
atggttcttgaaataacgccacaga

SEQ ID NO: 199602 - DNA, 25 bp, Rattus norvegicus
atggttcttgaattaacgccacaga

SEQ ID NO: 199603 - DNA, 25 bp, Rattus norvegicus
atggttctttctatccacacagtga

SEQ ID NO: 199604 - DNA, 25 bp, Rattus norvegicus
atggttctttctttccacacagtga

SEQ ID NO: 199605 - DNA, 25 bp, Rattus norvegicus
atggttgaagttagatagtggcccc

SEQ ID NO: 199606 - DNA, 25 bp, Rattus norvegicus
atggttgaagtttgatagtggcccc

SEQ ID NO: 199607 - DNA, 25 bp, Rattus norvegicus
atggttgacaaaatacacaggatct

SEQ ID NO: 199608 - DNA, 25 bp, Rattus norvegicus
atggttgacaaattacacaggatct

SEQ ID NO: 199609 - DNA, 25 bp, Rattus norvegicus
atggttgacacactttaagcgatgt

SEQ ID NO: 199610 - DNA, 25 bp, Rattus norvegicus
atggttgacacagtttaagcgatgt

SEQ ID NO: 199611 - DNA, 25 bp, Rattus norvegicus
atggttgacagtactgccagcacct

SEQ ID NO: 199612 - DNA, 25 bp, Rattus norvegicus
atggttgacagttctgccagcacct

SEQ ID NO: 199613 - DNA, 25 bp, Rattus norvegicus
atggttgacgttccaaaggcgctta

SEQ ID NO: 199614 - DNA, 25 bp, Rattus norvegicus
atggttgacgttgcaaaggcgctta

SEQ ID NO: 199615 - DNA, 25 bp, Rattus norvegicus
atggttgagaagatgcggaaataca

SEQ ID NO: 199616 - DNA, 25 bp, Rattus norvegicus
atggttgagaagttgcggaaataca

SEQ ID NO: 199617 - DNA, 25 bp, Rattus norvegicus
atggttgcaagcacttcaggataac

SEQ ID NO: 199618 - DNA, 25 bp, Rattus norvegicus
atggttgcaagctcttcaggataac

SEQ ID NO: 199619 - DNA, 25 bp, Rattus norvegicus
atggttgcacgactgctgcagcaaa

SEQ ID NO: 199620 - DNA, 25 bp, Rattus norvegicus
atggttgcacgagtgctgcagcaaa

SEQ ID NO: 199621 - DNA, 25 bp, Rattus norvegicus
atggttgcattgatcacggcaaaac

SEQ ID NO: 199622 - DNA, 25 bp, Rattus norvegicus
atggttgcattgttcacggcaaaac

SEQ ID NO: 199623 - DNA, 25 bp, Rattus norvegicus
atggttgccaaaaatctactatgta

SEQ ID NO: 199624 - DNA, 25 bp, Rattus norvegicus
atggttgccaaatatctactatgta

SEQ ID NO: 199625 - DNA, 25 bp, Rattus norvegicus
atggttgcccaacttttatgcctat

SEQ ID NO: 199626 - DNA, 25 bp, Rattus norvegicus
atggttgcccaagttttatgcctat

SEQ ID NO: 199627 - DNA, 25 bp, Rattus norvegicus
atggttgcccgaaattataatgtta

SEQ ID NO: 199628 - DNA, 25 bp, Rattus norvegicus
atggttgcccgatattataatgtta

SEQ ID NO: 199629 - DNA, 25 bp, Rattus norvegicus
atggttgcctgtaaatctgtatcgt

SEQ ID NO: 199630 - DNA, 25 bp, Rattus norvegicus
atggttgcctgttaatctgtatcgt

SEQ ID NO: 199631 - DNA, 25 bp, Rattus norvegicus
atggttgctggcaactctcaataaa

SEQ ID NO: 199632 - DNA, 25 bp, Rattus norvegicus
atggttgctggctactctcaataaa

SEQ ID NO: 199633 - DNA, 25 bp, Rattus norvegicus
atggttgctttgagccacagagcgc

SEQ ID NO: 199634 - DNA, 25 bp, Rattus norvegicus
atggttgctttgtgccacagagcgc

SEQ ID NO: 199635 - DNA, 25 bp, Rattus norvegicus
atggttggaacgcacagtcttagta

SEQ ID NO: 199636 - DNA, 25 bp, Rattus norvegicus
atggttggaacggacagtcttagta

SEQ ID NO: 199637 - DNA, 25 bp, Rattus norvegicus
atggttggatccaatgcatcttgaa

SEQ ID NO: 199638 - DNA, 25 bp, Rattus norvegicus
atggttggatcctatgcatcttgaa

SEQ ID NO: 199639 - DNA, 25 bp, Rattus norvegicus
atggttggatgtctgtgagtaccta

SEQ ID NO: 199640 - DNA, 25 bp, Rattus norvegicus
atggttggatgtgtgtgagtaccta

SEQ ID NO: 199641 - DNA, 25 bp, Rattus norvegicus
atggttgggcacatctgggtcctca

SEQ ID NO: 199642 - DNA, 25 bp, Rattus norvegicus
atggttgggcacttctgggtcctca

SEQ ID NO: 199643 - DNA, 25 bp, Rattus norvegicus
atggttgggccaagtgcatcttcac

SEQ ID NO: 199644 - DNA, 25 bp, Rattus norvegicus
atggttgggccatgtgcatcttcac

SEQ ID NO: 199645 - DNA, 25 bp, Rattus norvegicus
atggttggtccgagactgttcatga

SEQ ID NO: 199646 - DNA, 25 bp, Rattus norvegicus
atggttggtccgagtgcatcagcag

SEQ ID NO: 199647 - DNA, 25 bp, Rattus norvegicus
atggttggtccgtgactgttcatga

SEQ ID NO: 199648 - DNA, 25 bp, Rattus norvegicus
atggttggtccgtgtgcatcagcag

SEQ ID NO: 199649 - DNA, 25 bp, Rattus norvegicus
atggttggttctcatagtgccttca

SEQ ID NO: 199650 - DNA, 25 bp, Rattus norvegicus
atggttggttctgatagtgccttca

SEQ ID NO: 199651 - DNA, 25 bp, Rattus norvegicus
atggttgtactaacagcacctgctg

SEQ ID NO: 199652 - DNA, 25 bp, Rattus norvegicus
atggttgtactatcagcacctgctg

SEQ ID NO: 199653 - DNA, 25 bp, Rattus norvegicus
atggttgtcacccacagcccttggg

SEQ ID NO: 199654 - DNA, 25 bp, Rattus norvegicus
atggttgtcaccgacagcccttggg

SEQ ID NO: 199655 - DNA, 25 bp, Rattus norvegicus
atggttgtctagagctttcaatcaa

SEQ ID NO: 199656 - DNA, 25 bp, Rattus norvegicus
atggttgtctagtgctttcaatcaa

SEQ ID NO: 199657 - DNA, 25 bp, Rattus norvegicus
atggttgtctccaagagcctgaagt

SEQ ID NO: 199658 - DNA, 25 bp, Rattus norvegicus
atggttgtctcctagagcctgaagt

SEQ ID NO: 199659 - DNA, 25 bp, Rattus norvegicus
atggttgtgaaacgactacgttgac

SEQ ID NO: 199660 - DNA, 25 bp, Rattus norvegicus
atggttgtgaaaggactacgttgac

SEQ ID NO: 199661 - DNA, 25 bp, Rattus norvegicus
atggttgttcaaagcttcctagtcc

SEQ ID NO: 199662 - DNA, 25 bp, Rattus norvegicus
atggttgttcaatgcttcctagtcc

SEQ ID NO: 199663 - DNA, 25 bp, Rattus norvegicus
atggtttaatacacgctcgggattc

SEQ ID NO: 199664 - DNA, 25 bp, Rattus norvegicus
atggtttaatactcgctcgggattc

SEQ ID NO: 199665 - DNA, 25 bp, Rattus norvegicus
atggtttaatgtccacagtgtgtgt

SEQ ID NO: 199666 - DNA, 25 bp, Rattus norvegicus
atggtttaatgtgcacagtgtgtgt

SEQ ID NO: 199667 - DNA, 25 bp, Rattus norvegicus
atggtttacaggcagcttcccaggc

SEQ ID NO: 199668 - DNA, 25 bp, Rattus norvegicus
atggtttacagggagcttcccaggc

SEQ ID NO: 199669 - DNA, 25 bp, Rattus norvegicus
atggtttaggcacaggctttggcta

SEQ ID NO: 199670 - DNA, 25 bp, Rattus norvegicus
atggtttaggcagaggctttggcta

SEQ ID NO: 199671 - DNA, 25 bp, Rattus norvegicus
atggtttatactacgtggttgcccg

SEQ ID NO: 199672 - DNA, 25 bp, Rattus norvegicus
atggtttatacttcgtggttgcccg

SEQ ID NO: 199673 - DNA, 25 bp, Rattus norvegicus
atggtttcagatatagcccttgcct

SEQ ID NO: 199674 - DNA, 25 bp, Rattus norvegicus
atggtttcagatttagcccttgcct

SEQ ID NO: 199675 - DNA, 25 bp, Rattus norvegicus
atggtttcaggacctacacatcccc

SEQ ID NO: 199676 - DNA, 25 bp, Rattus norvegicus
atggtttcaggagctacacatcccc

SEQ ID NO: 199677 - DNA, 25 bp, Rattus norvegicus
atggtttcatttaatcagggcacag

SEQ ID NO: 199678 - DNA, 25 bp, Rattus norvegicus
atggtttcattttatcagggcacag

SEQ ID NO: 199679 - DNA, 25 bp, Rattus norvegicus
atggtttcccttactcttccaattg

SEQ ID NO: 199680 - DNA, 25 bp, Rattus norvegicus
atggtttccctttctcttccaattg

SEQ ID NO: 199681 - DNA, 25 bp, Rattus norvegicus
atggtttcctagacagcaccagccg

SEQ ID NO: 199682 - DNA, 25 bp, Rattus norvegicus
atggtttcctagagtccttgagcaa

SEQ ID NO: 199683 - DNA, 25 bp, Rattus norvegicus
atggtttcctagtcagcaccagccg

SEQ ID NO: 199684 - DNA, 25 bp, Rattus norvegicus
atggtttcctagtgtccttgagcaa

SEQ ID NO: 199685 - DNA, 25 bp, Rattus norvegicus
atggtttccttacgactcccaatgg

SEQ ID NO: 199686 - DNA, 25 bp, Rattus norvegicus
atggtttccttaggactcccaatgg

SEQ ID NO: 199687 - DNA, 25 bp, Rattus norvegicus
atggtttccttgagtgtttattgtc

SEQ ID NO: 199688 - DNA, 25 bp, Rattus norvegicus
atggtttccttgtgtgtttattgtc

SEQ ID NO: 199689 - DNA, 25 bp, Rattus norvegicus
atggtttctaataccttctctctca

SEQ ID NO: 199690 - DNA, 25 bp, Rattus norvegicus
atggtttctaattccttctctctca

SEQ ID NO: 199691 - DNA, 25 bp, Rattus norvegicus
atggtttctgatctgggaggcactt

SEQ ID NO: 199692 - DNA, 25 bp, Rattus norvegicus
atggtttctgatgtgggaggcactt

SEQ ID NO: 199693 - DNA, 25 bp, Rattus norvegicus
atggtttgactgaccctagttggat

SEQ ID NO: 199694 - DNA, 25 bp, Rattus norvegicus
atggtttgactgtccctagttggat

SEQ ID NO: 199695 - DNA, 25 bp, Rattus norvegicus
atggtttgcataagcgtggccccgg

SEQ ID NO: 199696 - DNA, 25 bp, Rattus norvegicus
atggtttgcatatgcgtggccccgg

SEQ ID NO: 199697 - DNA, 25 bp, Rattus norvegicus
atggtttgctaaacgctaggtgact

SEQ ID NO: 199698 - DNA, 25 bp, Rattus norvegicus
atggtttgctaatcgctaggtgact

SEQ ID NO: 199699 - DNA, 25 bp, Rattus norvegicus
atggtttgctcaaattacttccctc

SEQ ID NO: 199700 - DNA, 25 bp, Rattus norvegicus
atggtttgctcatattacttccctc

SEQ ID NO: 199701 - DNA, 25 bp, Rattus norvegicus
atggtttgctgaagacactgttgaa

SEQ ID NO: 199702 - DNA, 25 bp, Rattus norvegicus
atggtttgctgatgacactgttgaa

SEQ ID NO: 199703 - DNA, 25 bp, Rattus norvegicus
atggtttgcttgctgcagggtccaa

SEQ ID NO: 199704 - DNA, 25 bp, Rattus norvegicus
atggtttgcttggtgcagggtccaa

SEQ ID NO: 199705 - DNA, 25 bp, Rattus norvegicus
atggtttgggctctgagaagacaaa

SEQ ID NO: 199706 - DNA, 25 bp, Rattus norvegicus
atggtttgggctgtgagaagacaaa

SEQ ID NO: 199707 - DNA, 25 bp, Rattus norvegicus
atggtttggttaccatctcatcccc

SEQ ID NO: 199708 - DNA, 25 bp, Rattus norvegicus
atggtttggttagcatctcatcccc

SEQ ID NO: 199709 - DNA, 25 bp, Rattus norvegicus
atggtttgtcgcaccttatgttgca

SEQ ID NO: 199710 - DNA, 25 bp, Rattus norvegicus
atggtttgtcgctccttatgttgca

SEQ ID NO: 199711 - DNA, 25 bp, Rattus norvegicus
atggtttgtggtactctcacatcca

SEQ ID NO: 199712 - DNA, 25 bp, Rattus norvegicus
atggtttgtggttctctcacatcca

SEQ ID NO: 199713 - DNA, 25 bp, Rattus norvegicus
atggtttgttgaagccggctagcga

SEQ ID NO: 199714 - DNA, 25 bp, Rattus norvegicus
atggtttgttgatgccggctagcga

SEQ ID NO: 199715 - DNA, 25 bp, Rattus norvegicus
atggttttacatacaatccttaaga

SEQ ID NO: 199716 - DNA, 25 bp, Rattus norvegicus
atggttttacattcaatccttaaga

SEQ ID NO: 199717 - DNA, 25 bp, Rattus norvegicus
atggttttactcatctgctttcagc

SEQ ID NO: 199718 - DNA, 25 bp, Rattus norvegicus
atggttttactcttctgctttcagc

SEQ ID NO: 199719 - DNA, 25 bp, Rattus norvegicus
atggttttcaagagctccagggaag

SEQ ID NO: 199720 - DNA, 25 bp, Rattus norvegicus
atggttttcaagtgctccagggaag

SEQ ID NO: 199721 - DNA, 25 bp, Rattus norvegicus
atggttttcagcacgtcatcgatcc

SEQ ID NO: 199722 - DNA, 25 bp, Rattus norvegicus
atggttttcagctcgtcatcgatcc

SEQ ID NO: 199723 - DNA, 25 bp, Rattus norvegicus
atggttttcccactgatgtatctca

SEQ ID NO: 199724 - DNA, 25 bp, Rattus norvegicus
atggttttcccagtgatgtatctca

SEQ ID NO: 199725 - DNA, 25 bp, Rattus norvegicus
atggttttcctcaactgggtatatt

SEQ ID NO: 199726 - DNA, 25 bp, Rattus norvegicus
atggttttcctctactgggtatatt

SEQ ID NO: 199727 - DNA, 25 bp, Rattus norvegicus
atggttttccttacggcccatatag

SEQ ID NO: 199728 - DNA, 25 bp, Rattus norvegicus
atggttttcctttcggcccatatag

SEQ ID NO: 199729 - DNA, 25 bp, Rattus norvegicus
atggttttgacaagtgcatcacaca

SEQ ID NO: 199730 - DNA, 25 bp, Rattus norvegicus
atggttttgacatgtgcatcacaca

SEQ ID NO: 199731 - DNA, 25 bp, Rattus norvegicus
atggttttgtgcatctttcaatatt

SEQ ID NO: 199732 - DNA, 25 bp, Rattus norvegicus
atggttttgtgcttctttcaatatt

SEQ ID NO: 199733 - DNA, 25 bp, Rattus norvegicus
atggtttttaacattcagtgaatct

SEQ ID NO: 199734 - DNA, 25 bp, Rattus norvegicus
atggtttttaactttcagtgaatct

SEQ ID NO: 199735 - DNA, 25 bp, Rattus norvegicus
atggtttttgtactggcctagtcac

SEQ ID NO: 199736 - DNA, 25 bp, Rattus norvegicus
atggtttttgtagtggcctagtcac

SEQ ID NO: 199737 - DNA, 25 bp, Rattus norvegicus
atgtaaaaatgccacctcactctca

SEQ ID NO: 199738 - DNA, 25 bp, Rattus norvegicus
atgtaaaaatgcgacctcactctca

SEQ ID NO: 199739 - DNA, 25 bp, Rattus norvegicus
atgtaaaattttccactgtggagaa

SEQ ID NO: 199740 - DNA, 25 bp, Rattus norvegicus
atgtaaaattttgcactgtggagaa

SEQ ID NO: 199741 - DNA, 25 bp, Rattus norvegicus
atgtaaacagctataatgcccaatt

SEQ ID NO: 199742 - DNA, 25 bp, Rattus norvegicus
atgtaaacagctttaatgcccaatt

SEQ ID NO: 199743 - DNA, 25 bp, Rattus norvegicus
atgtaaaccaggatgccctctagct

SEQ ID NO: 199744 - DNA, 25 bp, Rattus norvegicus
atgtaaaccaggttgccctctagct

SEQ ID NO: 199745 - DNA, 25 bp, Rattus norvegicus
atgtaaacccaccatgagtcactgc

SEQ ID NO: 199746 - DNA, 25 bp, Rattus norvegicus
atgtaaacccacgatgagtcactgc

SEQ ID NO: 199747 - DNA, 25 bp, Rattus norvegicus
atgtaaacggcacagcaggccccgc

SEQ ID NO: 199748 - DNA, 25 bp, Rattus norvegicus
atgtaaacggcagagcaggccccgc

SEQ ID NO: 199749 - DNA, 25 bp, Rattus norvegicus
atgtaaactaatcttcccttgcacg

SEQ ID NO: 199750 - DNA, 25 bp, Rattus norvegicus
atgtaaactaatgttcccttgcacg

SEQ ID NO: 199751 - DNA, 25 bp, Rattus norvegicus
atgtaaactagactcccctcttggg

SEQ ID NO: 199752 - DNA, 25 bp, Rattus norvegicus
atgtaaactagagtcccctcttggg

SEQ ID NO: 199753 - DNA, 25 bp, Rattus norvegicus
atgtaaactcatagggcctgcccca

SEQ ID NO: 199754 - DNA, 25 bp, Rattus norvegicus
atgtaaactcattgggcctgcccca

SEQ ID NO: 199755 - DNA, 25 bp, Rattus norvegicus
atgtaaactcgcacgggaccaggga

SEQ ID NO: 199756 - DNA, 25 bp, Rattus norvegicus
atgtaaactcgctcgggaccaggga

SEQ ID NO: 199757 - DNA, 25 bp, Rattus norvegicus
atgtaaactttcattgtcaaatcta

SEQ ID NO: 199758 - DNA, 25 bp, Rattus norvegicus
atgtaaactttctttgtcaaatcta

SEQ ID NO: 199759 - DNA, 25 bp, Rattus norvegicus
atgtaaactttgactcaacctctga

SEQ ID NO: 199760 - DNA, 25 bp, Rattus norvegicus
atgtaaactttgtctcaacctctga

SEQ ID NO: 199761 - DNA, 25 bp, Rattus norvegicus
atgtaaagagttccctcatgcttcc

SEQ ID NO: 199762 - DNA, 25 bp, Rattus norvegicus
atgtaaagagttgcctcatgcttcc

SEQ ID NO: 199763 - DNA, 25 bp, Rattus norvegicus
atgtaaagcccaagtgcctccactt

SEQ ID NO: 199764 - DNA, 25 bp, Rattus norvegicus
atgtaaagcccatgtgcctccactt

SEQ ID NO: 199765 - DNA, 25 bp, Rattus norvegicus
atgtaaagcgtgctctccggaggaa

SEQ ID NO: 199766 - DNA, 25 bp, Rattus norvegicus
atgtaaagcgtggtctccggaggaa

SEQ ID NO: 199767 - DNA, 25 bp, Rattus norvegicus
atgtaaatacgtacccacttcaaga

SEQ ID NO: 199768 - DNA, 25 bp, Rattus norvegicus
atgtaaatacgttcccacttcaaga

SEQ ID NO: 199769 - DNA, 25 bp, Rattus norvegicus
atgtaaatcaagctcccatgtatga

SEQ ID NO: 199770 - DNA, 25 bp, Rattus norvegicus
atgtaaatcaaggtcccatgtatga

SEQ ID NO: 199771 - DNA, 25 bp, Rattus norvegicus
atgtaaatcttaactgccccactgg

SEQ ID NO: 199772 - DNA, 25 bp, Rattus norvegicus
atgtaaatcttatctgccccactgg

SEQ ID NO: 199773 - DNA, 25 bp, Rattus norvegicus
atgtaaatgggcatggcttccacac

SEQ ID NO: 199774 - DNA, 25 bp, Rattus norvegicus
atgtaaatgggcttggcttccacac

SEQ ID NO: 199775 - DNA, 25 bp, Rattus norvegicus
atgtaaatgtctctccatttgggct

SEQ ID NO: 199776 - DNA, 25 bp, Rattus norvegicus
atgtaaatgtctgtccatttgggct

SEQ ID NO: 199777 - DNA, 25 bp, Rattus norvegicus
atgtaaatgtgcacctgtgtgttcc

SEQ ID NO: 199778 - DNA, 25 bp, Rattus norvegicus
atgtaaatgtgctcctgtgtgttcc

SEQ ID NO: 199779 - DNA, 25 bp, Rattus norvegicus
atgtaaattgccagactgggtctct

SEQ ID NO: 199780 - DNA, 25 bp, Rattus norvegicus
atgtaaattgcctgactgggtctct

SEQ ID NO: 199781 - DNA, 25 bp, Rattus norvegicus
atgtaaatttcaatcctccaggcct

SEQ ID NO: 199782 - DNA, 25 bp, Rattus norvegicus
atgtaaatttcattcctccaggcct

SEQ ID NO: 199783 - DNA, 25 bp, Rattus norvegicus
atgtaacacagcacaggcacactgg

SEQ ID NO: 199784 - DNA, 25 bp, Rattus norvegicus
atgtaacacagctcaggcacactgg

SEQ ID NO: 199785 - DNA, 25 bp, Rattus norvegicus
atgtaacaggaacatctgacatcag

SEQ ID NO: 199786 - DNA, 25 bp, Rattus norvegicus
atgtaacaggaagatctgacatcag

SEQ ID NO: 199787 - DNA, 25 bp, Rattus norvegicus
atgtaacatcctcctcctaattttg

SEQ ID NO: 199788 - DNA, 25 bp, Rattus norvegicus
atgtaacatcctgctcctaattttg

SEQ ID NO: 199789 - DNA, 25 bp, Rattus norvegicus
atgtaacatctgaatccaggatggt

SEQ ID NO: 199790 - DNA, 25 bp, Rattus norvegicus
atgtaacatctgtatccaggatggt

SEQ ID NO: 199791 - DNA, 25 bp, Rattus norvegicus
atgtaacatgggaggctgctgctgc

SEQ ID NO: 199792 - DNA, 25 bp, Rattus norvegicus
atgtaacatgggtggctgctgctgc

SEQ ID NO: 199793 - DNA, 25 bp, Rattus norvegicus
atgtaaccacctagcctgttggttg

SEQ ID NO: 199794 - DNA, 25 bp, Rattus norvegicus
atgtaaccaccttgcctgttggttg

SEQ ID NO: 199795 - DNA, 25 bp, Rattus norvegicus
atgtaaccacttctttgtttcttca

SEQ ID NO: 199796 - DNA, 25 bp, Rattus norvegicus
atgtaaccacttgtttgtttcttca

SEQ ID NO: 199797 - DNA, 25 bp, Rattus norvegicus
atgtaaccagaactcctaggaatga

SEQ ID NO: 199798 - DNA, 25 bp, Rattus norvegicus
atgtaaccagaagtcctaggaatga

SEQ ID NO: 199799 - DNA, 25 bp, Rattus norvegicus
atgtaacccgtgacaatcagatgca

SEQ ID NO: 199800 - DNA, 25 bp, Rattus norvegicus
atgtaacccgtgtcaatcagatgca

SEQ ID NO: 199801 - DNA, 25 bp, Rattus norvegicus
atgtaacctgaaatcctagcacttg

SEQ ID NO: 199802 - DNA, 25 bp, Rattus norvegicus
atgtaacctgaattcctagcacttg

SEQ ID NO: 199803 - DNA, 25 bp, Rattus norvegicus
atgtaacctgctccagaccagacaa

SEQ ID NO: 199804 - DNA, 25 bp, Rattus norvegicus
atgtaacctgctgcagaccagacaa

SEQ ID NO: 199805 - DNA, 25 bp, Rattus norvegicus
atgtaactaaccatggcggctcctt

SEQ ID NO: 199806 - DNA, 25 bp, Rattus norvegicus
atgtaactaaccttggcggctcctt

SEQ ID NO: 199807 - DNA, 25 bp, Rattus norvegicus
atgtaactaagtctcctccgtgtaa

SEQ ID NO: 199808 - DNA, 25 bp, Rattus norvegicus
atgtaactaagtgtcctccgtgtaa

SEQ ID NO: 199809 - DNA, 25 bp, Rattus norvegicus
atgtaactgactacccaaaatatga

SEQ ID NO: 199810 - DNA, 25 bp, Rattus norvegicus
atgtaactgacttcccaaaatatga

SEQ ID NO: 199811 - DNA, 25 bp, Rattus norvegicus
atgtaactgctgagactggaaggat

SEQ ID NO: 199812 - DNA, 25 bp, Rattus norvegicus
atgtaactgctgtgactggaaggat

SEQ ID NO: 199813 - DNA, 25 bp, Rattus norvegicus
atgtaactgcttatccattccatac

SEQ ID NO: 199814 - DNA, 25 bp, Rattus norvegicus
atgtaactgcttttccattccatac

SEQ ID NO: 199815 - DNA, 25 bp, Rattus norvegicus
atgtaactggagctgccttgtcaac

SEQ ID NO: 199816 - DNA, 25 bp, Rattus norvegicus
atgtaactggaggtgccttgtcaac

SEQ ID NO: 199817 - DNA, 25 bp, Rattus norvegicus
atgtaacttacccacaggcctaagg

SEQ ID NO: 199818 - DNA, 25 bp, Rattus norvegicus
atgtaacttaccgacaggcctaagg

SEQ ID NO: 199819 - DNA, 25 bp, Rattus norvegicus
atgtaacttgttactcacgtgtgtc

SEQ ID NO: 199820 - DNA, 25 bp, Rattus norvegicus
atgtaacttgttccagactggtgtt

SEQ ID NO: 199821 - DNA, 25 bp, Rattus norvegicus
atgtaacttgttgcagactggtgtt

SEQ ID NO: 199822 - DNA, 25 bp, Rattus norvegicus
atgtaacttgtttctcacgtgtgtc

SEQ ID NO: 199823 - DNA, 25 bp, Rattus norvegicus
atgtaactttgaactgctgggaaaa

SEQ ID NO: 199824 - DNA, 25 bp, Rattus norvegicus
atgtaactttgatctgctgggaaaa

SEQ ID NO: 199825 - DNA, 25 bp, Rattus norvegicus
atgtaactttgcctagtgatgccac

SEQ ID NO: 199826 - DNA, 25 bp, Rattus norvegicus
atgtaactttgcgtagtgatgccac

SEQ ID NO: 199827 - DNA, 25 bp, Rattus norvegicus
atgtaagactgccatgggtcctgcc

SEQ ID NO: 199828 - DNA, 25 bp, Rattus norvegicus
atgtaagactgcgatgggtcctgcc

SEQ ID NO: 199829 - DNA, 25 bp, Rattus norvegicus
atgtaagactggatgcccttggcct

SEQ ID NO: 199830 - DNA, 25 bp, Rattus norvegicus
atgtaagactggttgcccttggcct

SEQ ID NO: 199831 - DNA, 25 bp, Rattus norvegicus
atgtaagcaactatctcctttccat

SEQ ID NO: 199832 - DNA, 25 bp, Rattus norvegicus
atgtaagcaactttctcctttccat

SEQ ID NO: 199833 - DNA, 25 bp, Rattus norvegicus
atgtaagcaccccttaggtttctct

SEQ ID NO: 199834 - DNA, 25 bp, Rattus norvegicus
atgtaagcacccgttaggtttctct

SEQ ID NO: 199835 - DNA, 25 bp, Rattus norvegicus
atgtaagccattctaaccctttcct

SEQ ID NO: 199836 - DNA, 25 bp, Rattus norvegicus
atgtaagccattgtaaccctttcct

SEQ ID NO: 199837 - DNA, 25 bp, Rattus norvegicus
atgtaagcctttatggcccacagcc

SEQ ID NO: 199838 - DNA, 25 bp, Rattus norvegicus
atgtaagcctttttggcccacagcc

SEQ ID NO: 199839 - DNA, 25 bp, Rattus norvegicus
atgtaagctgccatgtgtctgtctg

SEQ ID NO: 199840 - DNA, 25 bp, Rattus norvegicus
atgtaagctgccttgtgtctgtctg

SEQ ID NO: 199841 - DNA, 25 bp, Rattus norvegicus
atgtaagcttccacgttctcttcat

SEQ ID NO: 199842 - DNA, 25 bp, Rattus norvegicus
atgtaagcttcctcgttctcttcat

SEQ ID NO: 199843 - DNA, 25 bp, Rattus norvegicus
atgtaaggcgtccagcatagtgcac

SEQ ID NO: 199844 - DNA, 25 bp, Rattus norvegicus
atgtaaggcgtcgagcatagtgcac

SEQ ID NO: 199845 - DNA, 25 bp, Rattus norvegicus
atgtaagtagctcctttctcgcctg

SEQ ID NO: 199846 - DNA, 25 bp, Rattus norvegicus
atgtaagtagctgctttctcgcctg

SEQ ID NO: 199847 - DNA, 25 bp, Rattus norvegicus
atgtaagtattcctagcacttggga

SEQ ID NO: 199848 - DNA, 25 bp, Rattus norvegicus
atgtaagtattcgtagcacttggga

SEQ ID NO: 199849 - DNA, 25 bp, Rattus norvegicus
atgtaagtccagaacacctagaact

SEQ ID NO: 199850 - DNA, 25 bp, Rattus norvegicus
atgtaagtccagtacacctagaact

SEQ ID NO: 199851 - DNA, 25 bp, Rattus norvegicus
atgtaagtgcagatctagacagatt

SEQ ID NO: 199852 - DNA, 25 bp, Rattus norvegicus
atgtaagtgcagttctagacagatt

SEQ ID NO: 199853 - DNA, 25 bp, Rattus norvegicus
atgtaagtggagacggctgtctgct

SEQ ID NO: 199854 - DNA, 25 bp, Rattus norvegicus
atgtaagtggagtcggctgtctgct

SEQ ID NO: 199855 - DNA, 25 bp, Rattus norvegicus
atgtaagtgtcgcttgttctctggg

SEQ ID NO: 199856 - DNA, 25 bp, Rattus norvegicus
atgtaagtgtcggttgttctctggg

SEQ ID NO: 199857 - DNA, 25 bp, Rattus norvegicus
atgtaagttctcacatgacctcact

SEQ ID NO: 199858 - DNA, 25 bp, Rattus norvegicus
atgtaagttctctcatgacctcact

SEQ ID NO: 199859 - DNA, 25 bp, Rattus norvegicus
atgtaagttgtcaaggtttaatttg

SEQ ID NO: 199860 - DNA, 25 bp, Rattus norvegicus
atgtaagttgtctaggtttaatttg

SEQ ID NO: 199861 - DNA, 25 bp, Rattus norvegicus
atgtaagtttgcatagccacctcgt

SEQ ID NO: 199862 - DNA, 25 bp, Rattus norvegicus
atgtaagtttgcttagccacctcgt

SEQ ID NO: 199863 - DNA, 25 bp, Rattus norvegicus
atgtaatacagtactcttccacctt

SEQ ID NO: 199864 - DNA, 25 bp, Rattus norvegicus
atgtaatacagttctcttccacctt

SEQ ID NO: 199865 - DNA, 25 bp, Rattus norvegicus
atgtaatacattaggccagaaagaa

SEQ ID NO: 199866 - DNA, 25 bp, Rattus norvegicus
atgtaatacatttggccagaaagaa

SEQ ID NO: 199867 - DNA, 25 bp, Rattus norvegicus
atgtaataccagcactctagtgaag

SEQ ID NO: 199868 - DNA, 25 bp, Rattus norvegicus
atgtaataccaggactctagtgaag

SEQ ID NO: 199869 - DNA, 25 bp, Rattus norvegicus
atgtaatactacacagccacttcct

SEQ ID NO: 199870 - DNA, 25 bp, Rattus norvegicus
atgtaatactactcagccacttcct

SEQ ID NO: 199871 - DNA, 25 bp, Rattus norvegicus
atgtaatacttaactacctcccttg

SEQ ID NO: 199872 - DNA, 25 bp, Rattus norvegicus
atgtaatacttatctacctcccttg

SEQ ID NO: 199873 - DNA, 25 bp, Rattus norvegicus
atgtaatatctcaacagcctgctta

SEQ ID NO: 199874 - DNA, 25 bp, Rattus norvegicus
atgtaatatctctacagcctgctta

SEQ ID NO: 199875 - DNA, 25 bp, Rattus norvegicus
atgtaatatttgaaatccctgtgca

SEQ ID NO: 199876 - DNA, 25 bp, Rattus norvegicus
atgtaatatttgatggctgggccac

SEQ ID NO: 199877 - DNA, 25 bp, Rattus norvegicus
atgtaatatttgtaatccctgtgca

SEQ ID NO: 199878 - DNA, 25 bp, Rattus norvegicus
atgtaatatttgttggctgggccac

SEQ ID NO: 199879 - DNA, 25 bp, Rattus norvegicus
atgtaatcccatccttgtaagtttt

SEQ ID NO: 199880 - DNA, 25 bp, Rattus norvegicus
atgtaatcccatgcttgtaagtttt

SEQ ID NO: 199881 - DNA, 25 bp, Rattus norvegicus
atgtaatcctcgaaagagctctacg

SEQ ID NO: 199882 - DNA, 25 bp, Rattus norvegicus
atgtaatcctcgtaagagctctacg

SEQ ID NO: 199883 - DNA, 25 bp, Rattus norvegicus
atgtaatcttgcagccatgctatgt

SEQ ID NO: 199884 - DNA, 25 bp, Rattus norvegicus
atgtaatcttgctgccatgctatgt

SEQ ID NO: 199885 - DNA, 25 bp, Rattus norvegicus
atgtaatggtggagcaagtccaggc

SEQ ID NO: 199886 - DNA, 25 bp, Rattus norvegicus
atgtaatggtggtgcaagtccaggc

SEQ ID NO: 199887 - DNA, 25 bp, Rattus norvegicus
atgtaattacgcatccttgtgcagc

SEQ ID NO: 199888 - DNA, 25 bp, Rattus norvegicus
atgtaattacgcttccttgtgcagc

SEQ ID NO: 199889 - DNA, 25 bp, Rattus norvegicus
atgtaattagctcgttggttctgtt

SEQ ID NO: 199890 - DNA, 25 bp, Rattus norvegicus
atgtaattagctggttggttctgtt

SEQ ID NO: 199891 - DNA, 25 bp, Rattus norvegicus
atgtaatttccaactgaacaactgg

SEQ ID NO: 199892 - DNA, 25 bp, Rattus norvegicus
atgtaatttccatctgaacaactgg

SEQ ID NO: 199893 - DNA, 25 bp, Rattus norvegicus
atgtacaagaccaatgccagccagt

SEQ ID NO: 199894 - DNA, 25 bp, Rattus norvegicus
atgtacaagacctatgccagccagt

SEQ ID NO: 199895 - DNA, 25 bp, Rattus norvegicus
atgtacaagcacacacttaattaaa

SEQ ID NO: 199896 - DNA, 25 bp, Rattus norvegicus
atgtacaagcactcacttaattaaa

SEQ ID NO: 199897 - DNA, 25 bp, Rattus norvegicus
atgtacaagttgatgcctgcagtaa

SEQ ID NO: 199898 - DNA, 25 bp, Rattus norvegicus
atgtacaagttgttgcctgcagtaa

SEQ ID NO: 199899 - DNA, 25 bp, Rattus norvegicus
atgtacaagtttagaggttactcct

SEQ ID NO: 199900 - DNA, 25 bp, Rattus norvegicus
atgtacaagttttgaggttactcct

SEQ ID NO: 199901 - DNA, 25 bp, Rattus norvegicus
atgtacacacctagacacttttcta

SEQ ID NO: 199902 - DNA, 25 bp, Rattus norvegicus
atgtacacaccttgacacttttcta

SEQ ID NO: 199903 - DNA, 25 bp, Rattus norvegicus
atgtacacaggtacacgcgcacaca

SEQ ID NO: 199904 - DNA, 25 bp, Rattus norvegicus
atgtacacaggttcacgcgcacaca

SEQ ID NO: 199905 - DNA, 25 bp, Rattus norvegicus
atgtacacatacctgacatcatcag

SEQ ID NO: 199906 - DNA, 25 bp, Rattus norvegicus
atgtacacatacgtgacatcatcag

SEQ ID NO: 199907 - DNA, 25 bp, Rattus norvegicus
atgtacaccatcatgaatcccatcg

SEQ ID NO: 199908 - DNA, 25 bp, Rattus norvegicus
atgtacaccatcttgaatcccatcg

SEQ ID NO: 199909 - DNA, 25 bp, Rattus norvegicus
atgtacacccaaaaggaaccatgtt

SEQ ID NO: 199910 - DNA, 25 bp, Rattus norvegicus
atgtacacccaataggaaccatgtt

SEQ ID NO: 199911 - DNA, 25 bp, Rattus norvegicus
atgtacactgcacaggcacatggag

SEQ ID NO: 199912 - DNA, 25 bp, Rattus norvegicus
atgtacactgcagaggcacatggag

SEQ ID NO: 199913 - DNA, 25 bp, Rattus norvegicus
atgtacagaactaagagagcaaatc

SEQ ID NO: 199914 - DNA, 25 bp, Rattus norvegicus
atgtacagaacttagagagcaaatc

SEQ ID NO: 199915 - DNA, 25 bp, Rattus norvegicus
atgtacagagcccagcccctgcaag

SEQ ID NO: 199916 - DNA, 25 bp, Rattus norvegicus
atgtacagagccgagcccctgcaag

SEQ ID NO: 199917 - DNA, 25 bp, Rattus norvegicus
atgtacagagctacctaaagcaggg

SEQ ID NO: 199918 - DNA, 25 bp, Rattus norvegicus
atgtacagagcttcctaaagcaggg

SEQ ID NO: 199919 - DNA, 25 bp, Rattus norvegicus
atgtacagcaaaagctcggcggcca

SEQ ID NO: 199920 - DNA, 25 bp, Rattus norvegicus
atgtacagcaaatgctcggcggcca

SEQ ID NO: 199921 - DNA, 25 bp, Rattus norvegicus
atgtacagcagtagagccttcagcc

SEQ ID NO: 199922 - DNA, 25 bp, Rattus norvegicus
atgtacagcagttgagccttcagcc

SEQ ID NO: 199923 - DNA, 25 bp, Rattus norvegicus
atgtacagccatatagccatagcaa

SEQ ID NO: 199924 - DNA, 25 bp, Rattus norvegicus
atgtacagccatttagccatagcaa

SEQ ID NO: 199925 - DNA, 25 bp, Rattus norvegicus
atgtacagcctgaggtagatccctg

SEQ ID NO: 199926 - DNA, 25 bp, Rattus norvegicus
atgtacagcctgtggtagatccctg

SEQ ID NO: 199927 - DNA, 25 bp, Rattus norvegicus
atgtacaggagacacacggcatctt

SEQ ID NO: 199928 - DNA, 25 bp, Rattus norvegicus
atgtacaggagagacacggcatctt

SEQ ID NO: 199929 - DNA, 25 bp, Rattus norvegicus
atgtacagtgcactgtgctttagac

SEQ ID NO: 199930 - DNA, 25 bp, Rattus norvegicus
atgtacagtgcagtgtgctttagac

SEQ ID NO: 199931 - DNA, 25 bp, Rattus norvegicus
atgtacatacacagctgacaccgac

SEQ ID NO: 199932 - DNA, 25 bp, Rattus norvegicus
atgtacatacactgctgacaccgac

SEQ ID NO: 199933 - DNA, 25 bp, Rattus norvegicus
atgtacatacataggccaggattat

SEQ ID NO: 199934 - DNA, 25 bp, Rattus norvegicus
atgtacatacattggccaggattat

SEQ ID NO: 199935 - DNA, 25 bp, Rattus norvegicus
atgtacatatacactgtctcccagc

SEQ ID NO: 199936 - DNA, 25 bp, Rattus norvegicus
atgtacatatactctgtctcccagc

SEQ ID NO: 199937 - DNA, 25 bp, Rattus norvegicus
atgtacatattgaagccctctctcc

SEQ ID NO: 199938 - DNA, 25 bp, Rattus norvegicus
atgtacatattgtagccctctctcc

SEQ ID NO: 199939 - DNA, 25 bp, Rattus norvegicus
atgtacatcaccagtggtcgcagag

SEQ ID NO: 199940 - DNA, 25 bp, Rattus norvegicus
atgtacatcacctgtggtcgcagag

SEQ ID NO: 199941 - DNA, 25 bp, Rattus norvegicus
atgtacatcagtagtgtgaatccac

SEQ ID NO: 199942 - DNA, 25 bp, Rattus norvegicus
atgtacatcagttgtgtgaatccac

SEQ ID NO: 199943 - DNA, 25 bp, Rattus norvegicus
atgtacatctgaatatccgcggcgc

SEQ ID NO: 199944 - DNA, 25 bp, Rattus norvegicus
atgtacatctgattatccgcggcgc

SEQ ID NO: 199945 - DNA, 25 bp, Rattus norvegicus
atgtacatctggattgggatacttt

SEQ ID NO: 199946 - DNA, 25 bp, Rattus norvegicus
atgtacatctggtttgggatacttt

SEQ ID NO: 199947 - DNA, 25 bp, Rattus norvegicus
atgtacatggtacccttgaccttgg

SEQ ID NO: 199948 - DNA, 25 bp, Rattus norvegicus
atgtacatggtagccttgaccttgg

SEQ ID NO: 199949 - DNA, 25 bp, Rattus norvegicus
atgtacatggtccagagccaccagg

SEQ ID NO: 199950 - DNA, 25 bp, Rattus norvegicus
atgtacatggtcgagagccaccagg

SEQ ID NO: 199951 - DNA, 25 bp, Rattus norvegicus
atgtacattcccattgttgcttttt

SEQ ID NO: 199952 - DNA, 25 bp, Rattus norvegicus
atgtacattccctttgttgcttttt

SEQ ID NO: 199953 - DNA, 25 bp, Rattus norvegicus
atgtacattctcaggaaggctcaca

SEQ ID NO: 199954 - DNA, 25 bp, Rattus norvegicus
atgtacattctctggaaggctcaca

SEQ ID NO: 199955 - DNA, 25 bp, Rattus norvegicus
atgtacattgcacacactttaccct

SEQ ID NO: 199956 - DNA, 25 bp, Rattus norvegicus
atgtacattgcagacactttaccct

SEQ ID NO: 199957 - DNA, 25 bp, Rattus norvegicus
atgtacatttacaacgcggccttat

SEQ ID NO: 199958 - DNA, 25 bp, Rattus norvegicus
atgtacatttactacgcggccttat

SEQ ID NO: 199959 - DNA, 25 bp, Rattus norvegicus
atgtacatttctctgcctgagcatc

SEQ ID NO: 199960 - DNA, 25 bp, Rattus norvegicus
atgtacatttctgtgcctgagcatc

SEQ ID NO: 199961 - DNA, 25 bp, Rattus norvegicus
atgtacattttcaacccggaccctg

SEQ ID NO: 199962 - DNA, 25 bp, Rattus norvegicus
atgtacattttctacccggaccctg

SEQ ID NO: 199963 - DNA, 25 bp, Rattus norvegicus
atgtaccaaaatctcaccccttaag

SEQ ID NO: 199964 - DNA, 25 bp, Rattus norvegicus
atgtaccaaaatgtcaccccttaag

SEQ ID NO: 199965 - DNA, 25 bp, Rattus norvegicus
atgtaccaaatgatagtcacctgac

SEQ ID NO: 199966 - DNA, 25 bp, Rattus norvegicus
atgtaccaaatgttagtcacctgac

SEQ ID NO: 199967 - DNA, 25 bp, Rattus norvegicus
atgtaccaacatagacacttcgtgt

SEQ ID NO: 199968 - DNA, 25 bp, Rattus norvegicus
atgtaccaacattgacacttcgtgt

SEQ ID NO: 199969 - DNA, 25 bp, Rattus norvegicus
atgtaccacactcagaggacttact

SEQ ID NO: 199970 - DNA, 25 bp, Rattus norvegicus
atgtaccacactgagaggacttact

SEQ ID NO: 199971 - DNA, 25 bp, Rattus norvegicus
atgtaccaccttaatgatctacttg

SEQ ID NO: 199972 - DNA, 25 bp, Rattus norvegicus
atgtaccacctttatgatctacttg

SEQ ID NO: 199973 - DNA, 25 bp, Rattus norvegicus
atgtaccacgcaactccaaatgtta

SEQ ID NO: 199974 - DNA, 25 bp, Rattus norvegicus
atgtaccacgcatctccaaatgtta

SEQ ID NO: 199975 - DNA, 25 bp, Rattus norvegicus
atgtaccactttctctgctaattga

SEQ ID NO: 199976 - DNA, 25 bp, Rattus norvegicus
atgtaccactttgtctgctaattga

SEQ ID NO: 199977 - DNA, 25 bp, Rattus norvegicus
atgtaccatcatcccctggagggag

SEQ ID NO: 199978 - DNA, 25 bp, Rattus norvegicus
atgtaccatcatgccctggagggag

SEQ ID NO: 199979 - DNA, 25 bp, Rattus norvegicus
atgtaccatctcagttattctgaag

SEQ ID NO: 199980 - DNA, 25 bp, Rattus norvegicus
atgtaccatctctgttattctgaag

SEQ ID NO: 199981 - DNA, 25 bp, Rattus norvegicus
atgtacccagttccagtatgttata

SEQ ID NO: 199982 - DNA, 25 bp, Rattus norvegicus
atgtacccagttgcagtatgttata

SEQ ID NO: 199983 - DNA, 25 bp, Rattus norvegicus
atgtaccccaggataagccttctgt

SEQ ID NO: 199984 - DNA, 25 bp, Rattus norvegicus
atgtaccccaggttaagccttctgt

SEQ ID NO: 199985 - DNA, 25 bp, Rattus norvegicus
atgtacccctcaaaatcccagtgct

SEQ ID NO: 199986 - DNA, 25 bp, Rattus norvegicus
atgtacccctcataatcccagtgct

SEQ ID NO: 199987 - DNA, 25 bp, Rattus norvegicus
atgtacccctttattgctcagagaa

SEQ ID NO: 199988 - DNA, 25 bp, Rattus norvegicus
atgtaccccttttttgctcagagaa

SEQ ID NO: 199989 - DNA, 25 bp, Rattus norvegicus
atgtaccctctcaatgtactctgat

SEQ ID NO: 199990 - DNA, 25 bp, Rattus norvegicus
atgtaccctctccttaaagcgcaga

SEQ ID NO: 199991 - DNA, 25 bp, Rattus norvegicus
atgtaccctctcgttaaagcgcaga

SEQ ID NO: 199992 - DNA, 25 bp, Rattus norvegicus
atgtaccctctctatgtactctgat

SEQ ID NO: 199993 - DNA, 25 bp, Rattus norvegicus
atgtaccctggcatgttaacctcat

SEQ ID NO: 199994 - DNA, 25 bp, Rattus norvegicus
atgtaccctggcttgttaacctcat

SEQ ID NO: 199995 - DNA, 25 bp, Rattus norvegicus
atgtaccctgtgcaatgacttccct

SEQ ID NO: 199996 - DNA, 25 bp, Rattus norvegicus
atgtaccctgtggaatgacttccct

SEQ ID NO: 199997 - DNA, 25 bp, Rattus norvegicus
atgtaccctgttccttagagcacta

SEQ ID NO: 199998 - DNA, 25 bp, Rattus norvegicus
atgtaccctgttgcttagagcacta

SEQ ID NO: 199999 - DNA, 25 bp, Rattus norvegicus
atgtaccgaaggactgagctcaagg

SEQ ID NO: 200000 - DNA, 25 bp, Rattus norvegicus
atgtaccgaaggtctgagctcaagg

SEQ ID NO: 200001 - DNA, 25 bp, Rattus norvegicus
atgtacctaagtagagctgttggga

SEQ ID NO: 200002 - DNA, 25 bp, Rattus norvegicus
atgtacctaagttgagctgttggga

SEQ ID NO: 200003 - DNA, 25 bp, Rattus norvegicus
atgtacctacatagtaaagcccttt

SEQ ID NO: 200004 - DNA, 25 bp, Rattus norvegicus
atgtacctacattgtaaagcccttt

SEQ ID NO: 200005 - DNA, 25 bp, Rattus norvegicus
atgtacctagacattggtctctctg

SEQ ID NO: 200006 - DNA, 25 bp, Rattus norvegicus
atgtacctagactttggtctctctg

SEQ ID NO: 200007 - DNA, 25 bp, Rattus norvegicus
atgtacctcgagacttgaaatctgg

SEQ ID NO: 200008 - DNA, 25 bp, Rattus norvegicus
atgtacctcgagtcttgaaatctgg

SEQ ID NO: 200009 - DNA, 25 bp, Rattus norvegicus
atgtacctcggaatcagcctgtgac

SEQ ID NO: 200010 - DNA, 25 bp, Rattus norvegicus
atgtacctcggattcagcctgtgac

SEQ ID NO: 200011 - DNA, 25 bp, Rattus norvegicus
atgtacctctcacaaggctacctga

SEQ ID NO: 200012 - DNA, 25 bp, Rattus norvegicus
atgtacctctcagaaggctacctga

SEQ ID NO: 200013 - DNA, 25 bp, Rattus norvegicus
atgtacctctggctacagagcttca

SEQ ID NO: 200014 - DNA, 25 bp, Rattus norvegicus
atgtacctctgggtacagagcttca

SEQ ID NO: 200015 - DNA, 25 bp, Rattus norvegicus
atgtacctgaacatcacagcgtgtt

SEQ ID NO: 200016 - DNA, 25 bp, Rattus norvegicus
atgtacctgaacttcacagcgtgtt

SEQ ID NO: 200017 - DNA, 25 bp, Rattus norvegicus
atgtacctgcacatgtgacctttgt

SEQ ID NO: 200018 - DNA, 25 bp, Rattus norvegicus
atgtacctgcacttgtgacctttgt

SEQ ID NO: 200019 - DNA, 25 bp, Rattus norvegicus
atgtacctgggtcagatcgtccgta

SEQ ID NO: 200020 - DNA, 25 bp, Rattus norvegicus
atgtacctgggtgagatcgtccgta

SEQ ID NO: 200021 - DNA, 25 bp, Rattus norvegicus
atgtacctgtgtagggaatcatgcc

SEQ ID NO: 200022 - DNA, 25 bp, Rattus norvegicus
atgtacctgtgttgggaatcatgcc

SEQ ID NO: 200023 - DNA, 25 bp, Rattus norvegicus
atgtaccttaccaattgcaccagaa

SEQ ID NO: 200024 - DNA, 25 bp, Rattus norvegicus
atgtaccttacctattgcaccagaa

SEQ ID NO: 200025 - DNA, 25 bp, Rattus norvegicus
atgtaccttggacagcactgcatat

SEQ ID NO: 200026 - DNA, 25 bp, Rattus norvegicus
atgtaccttggagagcactgcatat

SEQ ID NO: 200027 - DNA, 25 bp, Rattus norvegicus
atgtacctttgacaacagattttga

SEQ ID NO: 200028 - DNA, 25 bp, Rattus norvegicus
atgtacctttgagaacagattttga

SEQ ID NO: 200029 - DNA, 25 bp, Rattus norvegicus
atgtacgaatctatcagggccctac

SEQ ID NO: 200030 - DNA, 25 bp, Rattus norvegicus
atgtacgaatctttcagggccctac

SEQ ID NO: 200031 - DNA, 25 bp, Rattus norvegicus
atgtacgaatgtccgctcttattta

SEQ ID NO: 200032 - DNA, 25 bp, Rattus norvegicus
atgtacgaatgtgcgctcttattta

SEQ ID NO: 200033 - DNA, 25 bp, Rattus norvegicus
atgtacgaccatatgtatgtgtatg

SEQ ID NO: 200034 - DNA, 25 bp, Rattus norvegicus
atgtacgaccatttgtatgtgtatg

SEQ ID NO: 200035 - DNA, 25 bp, Rattus norvegicus
atgtacgagcgactgctacacccgt

SEQ ID NO: 200036 - DNA, 25 bp, Rattus norvegicus
atgtacgagcgagtgctacacccgt

SEQ ID NO: 200037 - DNA, 25 bp, Rattus norvegicus
atgtacgcacagatcctccattgaa

SEQ ID NO: 200038 - DNA, 25 bp, Rattus norvegicus
atgtacgcacagttcctccattgaa

SEQ ID NO: 200039 - DNA, 25 bp, Rattus norvegicus
atgtacgcctttaatcacagactta

SEQ ID NO: 200040 - DNA, 25 bp, Rattus norvegicus
atgtacgccttttatcacagactta

SEQ ID NO: 200041 - DNA, 25 bp, Rattus norvegicus
atgtacgcgcttatgagtgactgct

SEQ ID NO: 200042 - DNA, 25 bp, Rattus norvegicus
atgtacgcgcttttgagtgactgct

SEQ ID NO: 200043 - DNA, 25 bp, Rattus norvegicus
atgtacggatacactggcagactgc

SEQ ID NO: 200044 - DNA, 25 bp, Rattus norvegicus
atgtacggatactctggcagactgc

SEQ ID NO: 200045 - DNA, 25 bp, Rattus norvegicus
atgtacgtacatattctgtatgtga

SEQ ID NO: 200046 - DNA, 25 bp, Rattus norvegicus
atgtacgtacattttctgtatgtga

SEQ ID NO: 200047 - DNA, 25 bp, Rattus norvegicus
atgtacgtagccatccaggctgtgt

SEQ ID NO: 200048 - DNA, 25 bp, Rattus norvegicus
atgtacgtagccttccaggctgtgt

SEQ ID NO: 200049 - DNA, 25 bp, Rattus norvegicus
atgtacgtcagacctcaatgttccc

SEQ ID NO: 200050 - DNA, 25 bp, Rattus norvegicus
atgtacgtcagagctcaatgttccc

SEQ ID NO: 200051 - DNA, 25 bp, Rattus norvegicus
atgtacgtgctgatcttgctgtgtc

SEQ ID NO: 200052 - DNA, 25 bp, Rattus norvegicus
atgtacgtgctgttcttgctgtgtc

SEQ ID NO: 200053 - DNA, 25 bp, Rattus norvegicus
atgtactaacatctggagagccaca

SEQ ID NO: 200054 - DNA, 25 bp, Rattus norvegicus
atgtactaacatgtggagagccaca

SEQ ID NO: 200055 - DNA, 25 bp, Rattus norvegicus
atgtactaagtgaatgcctggtgcc

SEQ ID NO: 200056 - DNA, 25 bp, Rattus norvegicus
atgtactaagtgtatgcctggtgcc

SEQ ID NO: 200057 - DNA, 25 bp, Rattus norvegicus
atgtactacaaccacacactttctt

SEQ ID NO: 200058 - DNA, 25 bp, Rattus norvegicus
atgtactacaacgacacactttctt

SEQ ID NO: 200059 - DNA, 25 bp, Rattus norvegicus
atgtactacattagcatgcctttgg

SEQ ID NO: 200060 - DNA, 25 bp, Rattus norvegicus
atgtactacatttgcatgcctttgg

SEQ ID NO: 200061 - DNA, 25 bp, Rattus norvegicus
atgtactactccatggcaatggcga

SEQ ID NO: 200062 - DNA, 25 bp, Rattus norvegicus
atgtactactccttggcaatggcga

SEQ ID NO: 200063 - DNA, 25 bp, Rattus norvegicus
atgtactactttaacggcagtcggc

SEQ ID NO: 200064 - DNA, 25 bp, Rattus norvegicus
atgtactacttttacggcagtcggc

SEQ ID NO: 200065 - DNA, 25 bp, Rattus norvegicus
atgtactattcaagccaccaggtta

SEQ ID NO: 200066 - DNA, 25 bp, Rattus norvegicus
atgtactattcactggctatggcca

SEQ ID NO: 200067 - DNA, 25 bp, Rattus norvegicus
atgtactattcagtggctatggcca

SEQ ID NO: 200068 - DNA, 25 bp, Rattus norvegicus
atgtactattcatgccaccaggtta

SEQ ID NO: 200069 - DNA, 25 bp, Rattus norvegicus
atgtactattggagcttctggtcta

SEQ ID NO: 200070 - DNA, 25 bp, Rattus norvegicus
atgtactattggtgcttctggtcta

SEQ ID NO: 200071 - DNA, 25 bp, Rattus norvegicus
atgtactccattagaattccactga

SEQ ID NO: 200072 - DNA, 25 bp, Rattus norvegicus
atgtactccatttgaattccactga

SEQ ID NO: 200073 - DNA, 25 bp, Rattus norvegicus
atgtactcctccatgggctctgaag

SEQ ID NO: 200074 - DNA, 25 bp, Rattus norvegicus
atgtactcctccttgggctctgaag

SEQ ID NO: 200075 - DNA, 25 bp, Rattus norvegicus
atgtactcgataacggcttctaccg

SEQ ID NO: 200076 - DNA, 25 bp, Rattus norvegicus
atgtactcgatatcggcttctaccg

SEQ ID NO: 200077 - DNA, 25 bp, Rattus norvegicus
atgtactcttcgcttgatggtttag

SEQ ID NO: 200078 - DNA, 25 bp, Rattus norvegicus
atgtactcttcggttgatggtttag

SEQ ID NO: 200079 - DNA, 25 bp, Rattus norvegicus
atgtactcttctctcctttgaagta

SEQ ID NO: 200080 - DNA, 25 bp, Rattus norvegicus
atgtactcttctgtcctttgaagta

SEQ ID NO: 200081 - DNA, 25 bp, Rattus norvegicus
atgtactgagcaagggtttgattcc

SEQ ID NO: 200082 - DNA, 25 bp, Rattus norvegicus
atgtactgagcatgggtttgattcc

SEQ ID NO: 200083 - DNA, 25 bp, Rattus norvegicus
atgtactgagccctgtcagtcacag

SEQ ID NO: 200084 - DNA, 25 bp, Rattus norvegicus
atgtactgagccgtgtcagtcacag

SEQ ID NO: 200085 - DNA, 25 bp, Rattus norvegicus
atgtactgccacaagttctcactga

SEQ ID NO: 200086 - DNA, 25 bp, Rattus norvegicus
atgtactgccactagttctcactga

SEQ ID NO: 200087 - DNA, 25 bp, Rattus norvegicus
atgtactgcggacacacacttttaa

SEQ ID NO: 200088 - DNA, 25 bp, Rattus norvegicus
atgtactgcggagacacacttttaa

SEQ ID NO: 200089 - DNA, 25 bp, Rattus norvegicus
atgtactgggagcagacacctcctt

SEQ ID NO: 200090 - DNA, 25 bp, Rattus norvegicus
atgtactgggaggagacacctcctt

SEQ ID NO: 200091 - DNA, 25 bp, Rattus norvegicus
atgtactgtaacattatcagtgaac

SEQ ID NO: 200092 - DNA, 25 bp, Rattus norvegicus
atgtactgtaactttatcagtgaac

SEQ ID NO: 200093 - DNA, 25 bp, Rattus norvegicus
atgtactgtggaactcagacccttc

SEQ ID NO: 200094 - DNA, 25 bp, Rattus norvegicus
atgtactgtggatctcagacccttc

SEQ ID NO: 200095 - DNA, 25 bp, Rattus norvegicus
atgtacttactcagtagatgcctgt

SEQ ID NO: 200096 - DNA, 25 bp, Rattus norvegicus
atgtacttactctgtagatgcctgt

SEQ ID NO: 200097 - DNA, 25 bp, Rattus norvegicus
atgtacttcctacgtttgctgtgaa

SEQ ID NO: 200098 - DNA, 25 bp, Rattus norvegicus
atgtacttcctaggtttgctgtgaa

SEQ ID NO: 200099 - DNA, 25 bp, Rattus norvegicus
atgtacttccttctgacctgcagga

SEQ ID NO: 200100 - DNA, 25 bp, Rattus norvegicus
atgtacttccttgtgacctgcagga

SEQ ID NO: 200101 - DNA, 25 bp, Rattus norvegicus
atgtacttcggcagcatccatttta

SEQ ID NO: 200102 - DNA, 25 bp, Rattus norvegicus
atgtacttcggctgcatccatttta

SEQ ID NO: 200103 - DNA, 25 bp, Rattus norvegicus
atgtacttcttgctccgtccatgtg

SEQ ID NO: 200104 - DNA, 25 bp, Rattus norvegicus
atgtacttcttggtccgtccatgtg

SEQ ID NO: 200105 - DNA, 25 bp, Rattus norvegicus
atgtacttgaccatgccgtagtgat

SEQ ID NO: 200106 - DNA, 25 bp, Rattus norvegicus
atgtacttgaccttgccgtagtgat

SEQ ID NO: 200107 - DNA, 25 bp, Rattus norvegicus
atgtacttgagtcgcttcttctcct

SEQ ID NO: 200108 - DNA, 25 bp, Rattus norvegicus
atgtacttgagtggcttcttctcct

SEQ ID NO: 200109 - DNA, 25 bp, Rattus norvegicus
atgtacttgtgtcccagtgcttaga

SEQ ID NO: 200110 - DNA, 25 bp, Rattus norvegicus
atgtacttgtgtgccagtgcttaga

SEQ ID NO: 200111 - DNA, 25 bp, Rattus norvegicus
atgtactttgaaccaaccgcatcac

SEQ ID NO: 200112 - DNA, 25 bp, Rattus norvegicus
atgtactttgaagcaaccgcatcac

SEQ ID NO: 200113 - DNA, 25 bp, Rattus norvegicus
atgtactttgtcctggtctacgtcc

SEQ ID NO: 200114 - DNA, 25 bp, Rattus norvegicus
atgtactttgtcgtggtctacgtcc

SEQ ID NO: 200115 - DNA, 25 bp, Rattus norvegicus
atgtagaaacaaagcatttatcccc

SEQ ID NO: 200116 - DNA, 25 bp, Rattus norvegicus
atgtagaaacaatgcatttatcccc

SEQ ID NO: 200117 - DNA, 25 bp, Rattus norvegicus
atgtagaagactctccctggtctga

SEQ ID NO: 200118 - DNA, 25 bp, Rattus norvegicus
atgtagaagactgtccctggtctga

SEQ ID NO: 200119 - DNA, 25 bp, Rattus norvegicus
atgtagaatagacggtctccctccc

SEQ ID NO: 200120 - DNA, 25 bp, Rattus norvegicus
atgtagaatagagggtctccctccc

SEQ ID NO: 200121 - DNA, 25 bp, Rattus norvegicus
atgtagacaccaagcacagacacct

SEQ ID NO: 200122 - DNA, 25 bp, Rattus norvegicus
atgtagacaccatgcacagacacct

SEQ ID NO: 200123 - DNA, 25 bp, Rattus norvegicus
atgtagacacctacaggcaagcctt

SEQ ID NO: 200124 - DNA, 25 bp, Rattus norvegicus
atgtagacaccttcaggcaagcctt

SEQ ID NO: 200125 - DNA, 25 bp, Rattus norvegicus
atgtagacagcaaaggatattccac

SEQ ID NO: 200126 - DNA, 25 bp, Rattus norvegicus
atgtagacagcataggatattccac

SEQ ID NO: 200127 - DNA, 25 bp, Rattus norvegicus
atgtagacatttaaggcggttcctg

SEQ ID NO: 200128 - DNA, 25 bp, Rattus norvegicus
atgtagacatttcactgccagtgct

SEQ ID NO: 200129 - DNA, 25 bp, Rattus norvegicus
atgtagacatttgactgccagtgct

SEQ ID NO: 200130 - DNA, 25 bp, Rattus norvegicus
atgtagacattttaggcggttcctg

SEQ ID NO: 200131 - DNA, 25 bp, Rattus norvegicus
atgtagaccagcagggccttgaact

SEQ ID NO: 200132 - DNA, 25 bp, Rattus norvegicus
atgtagaccagctgggccttgaact

SEQ ID NO: 200133 - DNA, 25 bp, Rattus norvegicus
atgtagacgcagcagataaccgcaa

SEQ ID NO: 200134 - DNA, 25 bp, Rattus norvegicus
atgtagacgcaggagataaccgcaa

SEQ ID NO: 200135 - DNA, 25 bp, Rattus norvegicus
atgtagagactcattcaacagcaat

SEQ ID NO: 200136 - DNA, 25 bp, Rattus norvegicus
atgtagagactctttcaacagcaat

SEQ ID NO: 200137 - DNA, 25 bp, Rattus norvegicus
atgtagagccttctggagtgcctgc

SEQ ID NO: 200138 - DNA, 25 bp, Rattus norvegicus
atgtagagccttgtggagtgcctgc

SEQ ID NO: 200139 - DNA, 25 bp, Rattus norvegicus
atgtagaggaccctgtttaccccag

SEQ ID NO: 200140 - DNA, 25 bp, Rattus norvegicus
atgtagaggaccgtgtttaccccag

SEQ ID NO: 200141 - DNA, 25 bp, Rattus norvegicus
atgtagagggccctaggtcaacccg

SEQ ID NO: 200142 - DNA, 25 bp, Rattus norvegicus
atgtagagggccgtaggtcaacccg

SEQ ID NO: 200143 - DNA, 25 bp, Rattus norvegicus
atgtagataggtacctgggcttcct

SEQ ID NO: 200144 - DNA, 25 bp, Rattus norvegicus
atgtagataggttcctgggcttcct

SEQ ID NO: 200145 - DNA, 25 bp, Rattus norvegicus
atgtagatgactattggccctgtcc

SEQ ID NO: 200146 - DNA, 25 bp, Rattus norvegicus
atgtagatgacttttggccctgtcc

SEQ ID NO: 200147 - DNA, 25 bp, Rattus norvegicus
atgtagatgctcaaccattctcctc

SEQ ID NO: 200148 - DNA, 25 bp, Rattus norvegicus
atgtagatgctctaccattctcctc

SEQ ID NO: 200149 - DNA, 25 bp, Rattus norvegicus
atgtagattttgagtcctgaaagct

SEQ ID NO: 200150 - DNA, 25 bp, Rattus norvegicus
atgtagattttgtgtcctgaaagct

SEQ ID NO: 200151 - DNA, 25 bp, Rattus norvegicus
atgtagcacagtatccacactggga

SEQ ID NO: 200152 - DNA, 25 bp, Rattus norvegicus
atgtagcacagtttccacactggga

SEQ ID NO: 200153 - DNA, 25 bp, Rattus norvegicus
atgtagcagatgactcctcagccaa

SEQ ID NO: 200154 - DNA, 25 bp, Rattus norvegicus
atgtagcagatgtctcctcagccaa

SEQ ID NO: 200155 - DNA, 25 bp, Rattus norvegicus
atgtagcagctacagtgtaaagagg

SEQ ID NO: 200156 - DNA, 25 bp, Rattus norvegicus
atgtagcagctagagtgtaaagagg

SEQ ID NO: 200157 - DNA, 25 bp, Rattus norvegicus
atgtagcatcctacaaattccactt

SEQ ID NO: 200158 - DNA, 25 bp, Rattus norvegicus
atgtagcatccttcaaattccactt

SEQ ID NO: 200159 - DNA, 25 bp, Rattus norvegicus
atgtagccaaggattccctcatact

SEQ ID NO: 200160 - DNA, 25 bp, Rattus norvegicus
atgtagccaaggtttccctcatact

SEQ ID NO: 200161 - DNA, 25 bp, Rattus norvegicus
atgtagccaccaaccatgagcaggt

SEQ ID NO: 200162 - DNA, 25 bp, Rattus norvegicus
atgtagccaccatccatgagcaggt

SEQ ID NO: 200163 - DNA, 25 bp, Rattus norvegicus
atgtagccacgcaaacactgagtaa

SEQ ID NO: 200164 - DNA, 25 bp, Rattus norvegicus
atgtagccacgctaacactgagtaa

SEQ ID NO: 200165 - DNA, 25 bp, Rattus norvegicus
atgtagccagatcttggttgcccaa

SEQ ID NO: 200166 - DNA, 25 bp, Rattus norvegicus
atgtagccagatgttggttgcccaa

SEQ ID NO: 200167 - DNA, 25 bp, Rattus norvegicus
atgtagccaggacacctccgctgtt

SEQ ID NO: 200168 - DNA, 25 bp, Rattus norvegicus
atgtagccaggagacctccgctgtt

SEQ ID NO: 200169 - DNA, 25 bp, Rattus norvegicus
atgtagccctgacaatgtacccact

SEQ ID NO: 200170 - DNA, 25 bp, Rattus norvegicus
atgtagccctgagaatgtacccact

SEQ ID NO: 200171 - DNA, 25 bp, Rattus norvegicus
atgtagccgatgaccctccggtttt

SEQ ID NO: 200172 - DNA, 25 bp, Rattus norvegicus
atgtagccgatgtccctccggtttt

SEQ ID NO: 200173 - DNA, 25 bp, Rattus norvegicus
atgtagcctgtcagtggaagcactg

SEQ ID NO: 200174 - DNA, 25 bp, Rattus norvegicus
atgtagcctgtctgtggaagcactg

SEQ ID NO: 200175 - DNA, 25 bp, Rattus norvegicus
atgtagcctttcctttgcatcatag

SEQ ID NO: 200176 - DNA, 25 bp, Rattus norvegicus
atgtagcctttcgtttgcatcatag

SEQ ID NO: 200177 - DNA, 25 bp, Rattus norvegicus
atgtagcctttgctggtctctccag

SEQ ID NO: 200178 - DNA, 25 bp, Rattus norvegicus
atgtagcctttggtggtctctccag

SEQ ID NO: 200179 - DNA, 25 bp, Rattus norvegicus
atgtagcgtctcacatttcagtcat

SEQ ID NO: 200180 - DNA, 25 bp, Rattus norvegicus
atgtagcgtctctcatttcagtcat

SEQ ID NO: 200181 - DNA, 25 bp, Rattus norvegicus
atgtagctaactcatctgcccagcc

SEQ ID NO: 200182 - DNA, 25 bp, Rattus norvegicus
atgtagctaactgatctgcccagcc

SEQ ID NO: 200183 - DNA, 25 bp, Rattus norvegicus
atgtagctagaacacagagccctgc

SEQ ID NO: 200184 - DNA, 25 bp, Rattus norvegicus
atgtagctagaagacagagccctgc

SEQ ID NO: 200185 - DNA, 25 bp, Rattus norvegicus
atgtagctagagagccttctgactt

SEQ ID NO: 200186 - DNA, 25 bp, Rattus norvegicus
atgtagctagagtgccttctgactt

SEQ ID NO: 200187 - DNA, 25 bp, Rattus norvegicus
atgtagctcagcagccgctgtcatg

SEQ ID NO: 200188 - DNA, 25 bp, Rattus norvegicus
atgtagctcagctgccgctgtcatg

SEQ ID NO: 200189 - DNA, 25 bp, Rattus norvegicus
atgtagctgtggacatccgtgcacg

SEQ ID NO: 200190 - DNA, 25 bp, Rattus norvegicus
atgtagctgtggtcatccgtgcacg

SEQ ID NO: 200191 - DNA, 25 bp, Rattus norvegicus
atgtagctttaaagcccacgcccga

SEQ ID NO: 200192 - DNA, 25 bp, Rattus norvegicus
atgtagctttaatgcccacgcccga

SEQ ID NO: 200193 - DNA, 25 bp, Rattus norvegicus
atgtagctttctaaacagccccgtt

SEQ ID NO: 200194 - DNA, 25 bp, Rattus norvegicus
atgtagctttcttaacagccccgtt

SEQ ID NO: 200195 - DNA, 25 bp, Rattus norvegicus
atgtagctttggagaccgagggtct

SEQ ID NO: 200196 - DNA, 25 bp, Rattus norvegicus
atgtagctttggtgaccgagggtct

SEQ ID NO: 200197 - DNA, 25 bp, Rattus norvegicus
atgtaggaaacaccagcccactgtg

SEQ ID NO: 200198 - DNA, 25 bp, Rattus norvegicus
atgtaggaaacagcagcccactgtg

SEQ ID NO: 200199 - DNA, 25 bp, Rattus norvegicus
atgtaggaagtcagccccttgatct

SEQ ID NO: 200200 - DNA, 25 bp, Rattus norvegicus
atgtaggaagtctgccccttgatct

SEQ ID NO: 200201 - DNA, 25 bp, Rattus norvegicus
atgtaggatacacacccttgcaaac

SEQ ID NO: 200202 - DNA, 25 bp, Rattus norvegicus
atgtaggatacagacccttgcaaac

SEQ ID NO: 200203 - DNA, 25 bp, Rattus norvegicus
atgtaggcagacctttcctccagag

SEQ ID NO: 200204 - DNA, 25 bp, Rattus norvegicus
atgtaggcagacgtttcctccagag

SEQ ID NO: 200205 - DNA, 25 bp, Rattus norvegicus
atgtaggcctcaatcacacggcatt

SEQ ID NO: 200206 - DNA, 25 bp, Rattus norvegicus
atgtaggcctcattcacacggcatt

SEQ ID NO: 200207 - DNA, 25 bp, Rattus norvegicus
atgtaggcgggactcaagaaaccat

SEQ ID NO: 200208 - DNA, 25 bp, Rattus norvegicus
atgtaggcgggagtcaagaaaccat

SEQ ID NO: 200209 - DNA, 25 bp, Rattus norvegicus
atgtaggctgtaatcccgaggcaaa

SEQ ID NO: 200210 - DNA, 25 bp, Rattus norvegicus
atgtaggctgtattcccgaggcaaa

SEQ ID NO: 200211 - DNA, 25 bp, Rattus norvegicus
atgtagggtctcaagctacatcgtt

SEQ ID NO: 200212 - DNA, 25 bp, Rattus norvegicus
atgtagggtctctagctacatcgtt

SEQ ID NO: 200213 - DNA, 25 bp, Rattus norvegicus
atgtaggtaaatctcctgtcacccc

SEQ ID NO: 200214 - DNA, 25 bp, Rattus norvegicus
atgtaggtaaatgtcctgtcacccc

SEQ ID NO: 200215 - DNA, 25 bp, Rattus norvegicus
atgtaggtacataccatattggaca

SEQ ID NO: 200216 - DNA, 25 bp, Rattus norvegicus
atgtaggtacattccatattggaca

SEQ ID NO: 200217 - DNA, 25 bp, Rattus norvegicus
atgtaggtgaagatctcactcctcc

SEQ ID NO: 200218 - DNA, 25 bp, Rattus norvegicus
atgtaggtgaagttctcactcctcc

SEQ ID NO: 200219 - DNA, 25 bp, Rattus norvegicus
atgtaggtgacgaggctcagagcaa

SEQ ID NO: 200220 - DNA, 25 bp, Rattus norvegicus
atgtaggtgacgtggctcagagcaa

SEQ ID NO: 200221 - DNA, 25 bp, Rattus norvegicus
atgtaggtgcttcaacatgccccac

SEQ ID NO: 200222 - DNA, 25 bp, Rattus norvegicus
atgtaggtgcttgaacatgccccac

SEQ ID NO: 200223 - DNA, 25 bp, Rattus norvegicus
atgtaggttaccaccaacattctcc

SEQ ID NO: 200224 - DNA, 25 bp, Rattus norvegicus
atgtaggttacctccaacattctcc

SEQ ID NO: 200225 - DNA, 25 bp, Rattus norvegicus
atgtaggttccactttctttccctg

SEQ ID NO: 200226 - DNA, 25 bp, Rattus norvegicus
atgtaggttccagtttctttccctg

SEQ ID NO: 200227 - DNA, 25 bp, Rattus norvegicus
atgtaggttctgagtcgactgggtc

SEQ ID NO: 200228 - DNA, 25 bp, Rattus norvegicus
atgtaggttctgtgtcgactgggtc

SEQ ID NO: 200229 - DNA, 25 bp, Rattus norvegicus
atgtagtaccctcgtgctgtgtcag

SEQ ID NO: 200230 - DNA, 25 bp, Rattus norvegicus
atgtagtaccctggtgctgtgtcag

SEQ ID NO: 200231 - DNA, 25 bp, Rattus norvegicus
atgtagtaggcgatgcccagcaccc

SEQ ID NO: 200232 - DNA, 25 bp, Rattus norvegicus
atgtagtaggcgttgcccagcaccc

SEQ ID NO: 200233 - DNA, 25 bp, Rattus norvegicus
atgtagtatgctatcatcttgtacg

SEQ ID NO: 200234 - DNA, 25 bp, Rattus norvegicus
atgtagtatgctttcatcttgtacg

SEQ ID NO: 200235 - DNA, 25 bp, Rattus norvegicus
atgtagtcagcaacttcatgttaaa

SEQ ID NO: 200236 - DNA, 25 bp, Rattus norvegicus
atgtagtcagcatcttcatgttaaa

SEQ ID NO: 200237 - DNA, 25 bp, Rattus norvegicus
atgtagtcatgtctaggctcttccg

SEQ ID NO: 200238 - DNA, 25 bp, Rattus norvegicus
atgtagtcatgtgtaggctcttccg

SEQ ID NO: 200239 - DNA, 25 bp, Rattus norvegicus
atgtagtcatttcctgttgcagcag

SEQ ID NO: 200240 - DNA, 25 bp, Rattus norvegicus
atgtagtcatttgctgttgcagcag

SEQ ID NO: 200241 - DNA, 25 bp, Rattus norvegicus
atgtagtccaggctttccctgtact

SEQ ID NO: 200242 - DNA, 25 bp, Rattus norvegicus
atgtagtccagggtttccctgtact

SEQ ID NO: 200243 - DNA, 25 bp, Rattus norvegicus
atgtagtcccgcctgagaaagctgt

SEQ ID NO: 200244 - DNA, 25 bp, Rattus norvegicus
atgtagtcccgcgtgagaaagctgt

SEQ ID NO: 200245 - DNA, 25 bp, Rattus norvegicus
atgtagtccctaagcagtgcacagc

SEQ ID NO: 200246 - DNA, 25 bp, Rattus norvegicus
atgtagtccctatgcagtgcacagc

SEQ ID NO: 200247 - DNA, 25 bp, Rattus norvegicus
atgtagtctcataaagatgcagcaa

SEQ ID NO: 200248 - DNA, 25 bp, Rattus norvegicus
atgtagtctcattaagatgcagcaa

SEQ ID NO: 200249 - DNA, 25 bp, Rattus norvegicus
atgtagtgaggtaccacgagtgcgt

SEQ ID NO: 200250 - DNA, 25 bp, Rattus norvegicus
atgtagtgaggttccacgagtgcgt

SEQ ID NO: 200251 - DNA, 25 bp, Rattus norvegicus
atgtagtggcctctgtggccttgac

SEQ ID NO: 200252 - DNA, 25 bp, Rattus norvegicus
atgtagtggcctgtgtggccttgac

SEQ ID NO: 200253 - DNA, 25 bp, Rattus norvegicus
atgtagtgtatcaagcccttgggcc

SEQ ID NO: 200254 - DNA, 25 bp, Rattus norvegicus
atgtagtgtatctagcccttgggcc

SEQ ID NO: 200255 - DNA, 25 bp, Rattus norvegicus
atgtagttaccgactgcttggaaga

SEQ ID NO: 200256 - DNA, 25 bp, Rattus norvegicus
atgtagttaccgtctgcttggaaga

SEQ ID NO: 200257 - DNA, 25 bp, Rattus norvegicus
atgtagttcaggaggttgtaggtca

SEQ ID NO: 200258 - DNA, 25 bp, Rattus norvegicus
atgtagttcaggtggttgtaggtca

SEQ ID NO: 200259 - DNA, 25 bp, Rattus norvegicus
atgtagttccccacccctgtgtgaa

SEQ ID NO: 200260 - DNA, 25 bp, Rattus norvegicus
atgtagttcccctcccctgtgtgaa

SEQ ID NO: 200261 - DNA, 25 bp, Rattus norvegicus
atgtagttggttctcatgctctccc

SEQ ID NO: 200262 - DNA, 25 bp, Rattus norvegicus
atgtagttggttgtcatgctctccc

SEQ ID NO: 200263 - DNA, 25 bp, Rattus norvegicus
atgtataacctcaccatcaaacctg

SEQ ID NO: 200264 - DNA, 25 bp, Rattus norvegicus
atgtataacctctccatcaaacctg

SEQ ID NO: 200265 - DNA, 25 bp, Rattus norvegicus
atgtataagctgattctggaaagga

SEQ ID NO: 200266 - DNA, 25 bp, Rattus norvegicus
atgtataagctgtttctggaaagga

SEQ ID NO: 200267 - DNA, 25 bp, Rattus norvegicus
atgtataatctcaacgctacccctt

SEQ ID NO: 200268 - DNA, 25 bp, Rattus norvegicus
atgtataatctctacgctacccctt

SEQ ID NO: 200269 - DNA, 25 bp, Rattus norvegicus
atgtatacagtcacatgtggcagaa

SEQ ID NO: 200270 - DNA, 25 bp, Rattus norvegicus
atgtatacagtctcatgtggcagaa

SEQ ID NO: 200271 - DNA, 25 bp, Rattus norvegicus
atgtatacgaaccaagcccgggtgt

SEQ ID NO: 200272 - DNA, 25 bp, Rattus norvegicus
atgtatacgaacgaagcccgggtgt

SEQ ID NO: 200273 - DNA, 25 bp, Rattus norvegicus
atgtatactcatagctatggaaacc

SEQ ID NO: 200274 - DNA, 25 bp, Rattus norvegicus
atgtatactcattgctatggaaacc

SEQ ID NO: 200275 - DNA, 25 bp, Rattus norvegicus
atgtatacttacactgatcccagct

SEQ ID NO: 200276 - DNA, 25 bp, Rattus norvegicus
atgtatacttactctgatcccagct

SEQ ID NO: 200277 - DNA, 25 bp, Rattus norvegicus
atgtatagcaatctcacctctaatt

SEQ ID NO: 200278 - DNA, 25 bp, Rattus norvegicus
atgtatagcaatgtcacctctaatt

SEQ ID NO: 200279 - DNA, 25 bp, Rattus norvegicus
atgtatagccttagctccatgaggg

SEQ ID NO: 200280 - DNA, 25 bp, Rattus norvegicus
atgtatagcctttgctccatgaggg

SEQ ID NO: 200281 - DNA, 25 bp, Rattus norvegicus
atgtatagctatcacccggcagaag

SEQ ID NO: 200282 - DNA, 25 bp, Rattus norvegicus
atgtatagctatgacccggcagaag

SEQ ID NO: 200283 - DNA, 25 bp, Rattus norvegicus
atgtatagtttgatttggcttggtt

SEQ ID NO: 200284 - DNA, 25 bp, Rattus norvegicus
atgtatagtttgttttggcttggtt

SEQ ID NO: 200285 - DNA, 25 bp, Rattus norvegicus
atgtatatcccgagttcaagaccag

SEQ ID NO: 200286 - DNA, 25 bp, Rattus norvegicus
atgtatatcccgtgttcaagaccag

SEQ ID NO: 200287 - DNA, 25 bp, Rattus norvegicus
atgtatatcgggaccttctgtatgt

SEQ ID NO: 200288 - DNA, 25 bp, Rattus norvegicus
atgtatatcgggtccttctgtatgt

SEQ ID NO: 200289 - DNA, 25 bp, Rattus norvegicus
atgtatatgataatgtgagcacaca

SEQ ID NO: 200290 - DNA, 25 bp, Rattus norvegicus
atgtatatgatattgtgagcacaca

SEQ ID NO: 200291 - DNA, 25 bp, Rattus norvegicus
atgtatatgcaccacatacatgcct

SEQ ID NO: 200292 - DNA, 25 bp, Rattus norvegicus
atgtatatgcacgacatacatgcct

SEQ ID NO: 200293 - DNA, 25 bp, Rattus norvegicus
atgtatatggacaggctgactgtgt

SEQ ID NO: 200294 - DNA, 25 bp, Rattus norvegicus
atgtatatggactggctgactgtgt

SEQ ID NO: 200295 - DNA, 25 bp, Rattus norvegicus
atgtatattaaaaccctcctgtctc

SEQ ID NO: 200296 - DNA, 25 bp, Rattus norvegicus
atgtatattaaatccctcctgtctc

SEQ ID NO: 200297 - DNA, 25 bp, Rattus norvegicus
atgtatattgcaccagtcgctaacg

SEQ ID NO: 200298 - DNA, 25 bp, Rattus norvegicus
atgtatattgcagcagtcgctaacg

SEQ ID NO: 200299 - DNA, 25 bp, Rattus norvegicus
atgtatattgtgagtctttctagaa

SEQ ID NO: 200300 - DNA, 25 bp, Rattus norvegicus
atgtatattgtgtgtctttctagaa

SEQ ID NO: 200301 - DNA, 25 bp, Rattus norvegicus
atgtatcaccgtccccaggacgttc

SEQ ID NO: 200302 - DNA, 25 bp, Rattus norvegicus
atgtatcaccgtgcccaggacgttc

SEQ ID NO: 200303 - DNA, 25 bp, Rattus norvegicus
atgtatcacctaaccacatgcagtg

SEQ ID NO: 200304 - DNA, 25 bp, Rattus norvegicus
atgtatcacctatccacatgcagtg

SEQ ID NO: 200305 - DNA, 25 bp, Rattus norvegicus
atgtatcacgctctgaccacgagga

SEQ ID NO: 200306 - DNA, 25 bp, Rattus norvegicus
atgtatcacgctgtgaccacgagga

SEQ ID NO: 200307 - DNA, 25 bp, Rattus norvegicus
atgtatcacttaatctgccttagag

SEQ ID NO: 200308 - DNA, 25 bp, Rattus norvegicus
atgtatcacttattctgccttagag

SEQ ID NO: 200309 - DNA, 25 bp, Rattus norvegicus
atgtatcagccccacggtgtagcat

SEQ ID NO: 200310 - DNA, 25 bp, Rattus norvegicus
atgtatcagcccgacggtgtagcat

SEQ ID NO: 200311 - DNA, 25 bp, Rattus norvegicus
atgtatcagcgcagtttcctgagac

SEQ ID NO: 200312 - DNA, 25 bp, Rattus norvegicus
atgtatcagcgctgtttcctgagac

SEQ ID NO: 200313 - DNA, 25 bp, Rattus norvegicus
atgtatcagttacctcttgtgtgta

SEQ ID NO: 200314 - DNA, 25 bp, Rattus norvegicus
atgtatcagttagctcttgtgtgta

SEQ ID NO: 200315 - DNA, 25 bp, Rattus norvegicus
atgtatccacagagcagcagtgctg

SEQ ID NO: 200316 - DNA, 25 bp, Rattus norvegicus
atgtatccacagtgcagcagtgctg

SEQ ID NO: 200317 - DNA, 25 bp, Rattus norvegicus
atgtatccagacctcctgcaaataa

SEQ ID NO: 200318 - DNA, 25 bp, Rattus norvegicus
atgtatccagacgtcctgcaaataa

SEQ ID NO: 200319 - DNA, 25 bp, Rattus norvegicus
atgtatccatctcacttcatatctg

SEQ ID NO: 200320 - DNA, 25 bp, Rattus norvegicus
atgtatccatctgacttcatatctg

SEQ ID NO: 200321 - DNA, 25 bp, Rattus norvegicus
atgtatcctaatctcatctttgccc

SEQ ID NO: 200322 - DNA, 25 bp, Rattus norvegicus
atgtatcctaatgtcatctttgccc

SEQ ID NO: 200323 - DNA, 25 bp, Rattus norvegicus
atgtatcctatgactgggtcggtga

SEQ ID NO: 200324 - DNA, 25 bp, Rattus norvegicus
atgtatcctatgtctgggtcggtga

SEQ ID NO: 200325 - DNA, 25 bp, Rattus norvegicus
atgtatcgcacactgtcatattccc

SEQ ID NO: 200326 - DNA, 25 bp, Rattus norvegicus
atgtatcgcacagtgtcatattccc

SEQ ID NO: 200327 - DNA, 25 bp, Rattus norvegicus
atgtatctaaacactgtcccacgct

SEQ ID NO: 200328 - DNA, 25 bp, Rattus norvegicus
atgtatctaaactctgtcccacgct

SEQ ID NO: 200329 - DNA, 25 bp, Rattus norvegicus
atgtatctatatccctgcgtttgtc

SEQ ID NO: 200330 - DNA, 25 bp, Rattus norvegicus
atgtatctatatgcctgcgtttgtc

SEQ ID NO: 200331 - DNA, 25 bp, Rattus norvegicus
atgtatctattcattgggaaactgt

SEQ ID NO: 200332 - DNA, 25 bp, Rattus norvegicus
atgtatctattctttgggaaactgt

SEQ ID NO: 200333 - DNA, 25 bp, Rattus norvegicus
atgtatctcaatctttttctgacac

SEQ ID NO: 200334 - DNA, 25 bp, Rattus norvegicus
atgtatctcaatgtttttctgacac

SEQ ID NO: 200335 - DNA, 25 bp, Rattus norvegicus
atgtatctcctcaccatgttttcta

SEQ ID NO: 200336 - DNA, 25 bp, Rattus norvegicus
atgtatctcctctccatgttttcta

SEQ ID NO: 200337 - DNA, 25 bp, Rattus norvegicus
atgtatctcgtgattatgtgcacca

SEQ ID NO: 200338 - DNA, 25 bp, Rattus norvegicus
atgtatctcgtgtttatgtgcacca

SEQ ID NO: 200339 - DNA, 25 bp, Rattus norvegicus
atgtatctctccatttcagtgtttt

SEQ ID NO: 200340 - DNA, 25 bp, Rattus norvegicus
atgtatctctccttttcagtgtttt

SEQ ID NO: 200341 - DNA, 25 bp, Rattus norvegicus
atgtatctctttcccaggatctagg

SEQ ID NO: 200342 - DNA, 25 bp, Rattus norvegicus
atgtatctctttgccaggatctagg

SEQ ID NO: 200343 - DNA, 25 bp, Rattus norvegicus
atgtatctgagacttcactctgcag

SEQ ID NO: 200344 - DNA, 25 bp, Rattus norvegicus
atgtatctgagagttcactctgcag

SEQ ID NO: 200345 - DNA, 25 bp, Rattus norvegicus
atgtatctgtctagtttcttgcacc

SEQ ID NO: 200346 - DNA, 25 bp, Rattus norvegicus
atgtatctgtcttgtttcttgcacc

SEQ ID NO: 200347 - DNA, 25 bp, Rattus norvegicus
atgtatcttgccatgactttctcac

SEQ ID NO: 200348 - DNA, 25 bp, Rattus norvegicus
atgtatcttgccttgactttctcac

SEQ ID NO: 200349 - DNA, 25 bp, Rattus norvegicus
atgtatgaccatcaactgttttgaa

SEQ ID NO: 200350 - DNA, 25 bp, Rattus norvegicus
atgtatgaccatgaactgttttgaa

SEQ ID NO: 200351 - DNA, 25 bp, Rattus norvegicus
atgtatgacctaacgtcaaagcccc

SEQ ID NO: 200352 - DNA, 25 bp, Rattus norvegicus
atgtatgacctatcgtcaaagcccc

SEQ ID NO: 200353 - DNA, 25 bp, Rattus norvegicus
atgtatgaccttccagttccacata

SEQ ID NO: 200354 - DNA, 25 bp, Rattus norvegicus
atgtatgaccttgcagttccacata

SEQ ID NO: 200355 - DNA, 25 bp, Rattus norvegicus
atgtatgagtgtccaagggtaccca

SEQ ID NO: 200356 - DNA, 25 bp, Rattus norvegicus
atgtatgagtgtgcaagggtaccca

SEQ ID NO: 200357 - DNA, 25 bp, Rattus norvegicus
atgtatgatgaaatgctccccttcc

SEQ ID NO: 200358 - DNA, 25 bp, Rattus norvegicus
atgtatgatgaattgctccccttcc

SEQ ID NO: 200359 - DNA, 25 bp, Rattus norvegicus
atgtatgcacccatgaattaggctg

SEQ ID NO: 200360 - DNA, 25 bp, Rattus norvegicus
atgtatgcacccttgaattaggctg

SEQ ID NO: 200361 - DNA, 25 bp, Rattus norvegicus
atgtatgcgcctacacagcaggcct

SEQ ID NO: 200362 - DNA, 25 bp, Rattus norvegicus
atgtatgcgccttcacagcaggcct

SEQ ID NO: 200363 - DNA, 25 bp, Rattus norvegicus
atgtatgctcaaatgggacttctgt

SEQ ID NO: 200364 - DNA, 25 bp, Rattus norvegicus
atgtatgctcaattgggacttctgt

SEQ ID NO: 200365 - DNA, 25 bp, Rattus norvegicus
atgtatgctctgctccaagtgtaga

SEQ ID NO: 200366 - DNA, 25 bp, Rattus norvegicus
atgtatgctctggtccaagtgtaga

SEQ ID NO: 200367 - DNA, 25 bp, Rattus norvegicus
atgtatgctgcactgggtttctctt

SEQ ID NO: 200368 - DNA, 25 bp, Rattus norvegicus
atgtatgctgcagtgggtttctctt

SEQ ID NO: 200369 - DNA, 25 bp, Rattus norvegicus
atgtatgcttgtatctagctagaac

SEQ ID NO: 200370 - DNA, 25 bp, Rattus norvegicus
atgtatgcttgtttctagctagaac

SEQ ID NO: 200371 - DNA, 25 bp, Rattus norvegicus
atgtatggctggctcctttctcaac

SEQ ID NO: 200372 - DNA, 25 bp, Rattus norvegicus
atgtatggctgggtcctttctcaac

SEQ ID NO: 200373 - DNA, 25 bp, Rattus norvegicus
atgtatgggaccctagagcgcaccg

SEQ ID NO: 200374 - DNA, 25 bp, Rattus norvegicus
atgtatgggaccgtagagcgcaccg

SEQ ID NO: 200375 - DNA, 25 bp, Rattus norvegicus
atgtatggtctgcaattgcttgtca

SEQ ID NO: 200376 - DNA, 25 bp, Rattus norvegicus
atgtatggtctggaattgcttgtca

SEQ ID NO: 200377 - DNA, 25 bp, Rattus norvegicus
atgtatgtaacactgcccaacgtct

SEQ ID NO: 200378 - DNA, 25 bp, Rattus norvegicus
atgtatgtaacagtgcccaacgtct

SEQ ID NO: 200379 - DNA, 25 bp, Rattus norvegicus
atgtatgtacacctctgtacctcag

SEQ ID NO: 200380 - DNA, 25 bp, Rattus norvegicus
atgtatgtacacgtctgtacctcag

SEQ ID NO: 200381 - DNA, 25 bp, Rattus norvegicus
atgtatgtacccagcactcatgaat

SEQ ID NO: 200382 - DNA, 25 bp, Rattus norvegicus
atgtatgtaccctgcactcatgaat

SEQ ID NO: 200383 - DNA, 25 bp, Rattus norvegicus
atgtatgtagatcatgcttttggaa

SEQ ID NO: 200384 - DNA, 25 bp, Rattus norvegicus
atgtatgtagatgatgcttttggaa

SEQ ID NO: 200385 - DNA, 25 bp, Rattus norvegicus
atgtatgtatccacagtcactgtct

SEQ ID NO: 200386 - DNA, 25 bp, Rattus norvegicus
atgtatgtatcctcagtcactgtct

SEQ ID NO: 200387 - DNA, 25 bp, Rattus norvegicus
atgtatgtctgtcaacccagcctca

SEQ ID NO: 200388 - DNA, 25 bp, Rattus norvegicus
atgtatgtctgtgaacccagcctca

SEQ ID NO: 200389 - DNA, 25 bp, Rattus norvegicus
atgtatgtcttgagcactgtctgga

SEQ ID NO: 200390 - DNA, 25 bp, Rattus norvegicus
atgtatgtcttgctttttgtctcca

SEQ ID NO: 200391 - DNA, 25 bp, Rattus norvegicus
atgtatgtcttggtttttgtctcca

SEQ ID NO: 200392 - DNA, 25 bp, Rattus norvegicus
atgtatgtcttgtgcactgtctgga

SEQ ID NO: 200393 - DNA, 25 bp, Rattus norvegicus
atgtatgtggtcaggtcttcactac

SEQ ID NO: 200394 - DNA, 25 bp, Rattus norvegicus
atgtatgtggtctggtcttcactac

SEQ ID NO: 200395 - DNA, 25 bp, Rattus norvegicus
atgtatgtggtgacttccctactag

SEQ ID NO: 200396 - DNA, 25 bp, Rattus norvegicus
atgtatgtggtgtcttccctactag

SEQ ID NO: 200397 - DNA, 25 bp, Rattus norvegicus
atgtatgtggttagctgcctatgcc

SEQ ID NO: 200398 - DNA, 25 bp, Rattus norvegicus
atgtatgtggtttgctgcctatgcc

SEQ ID NO: 200399 - DNA, 25 bp, Rattus norvegicus
atgtatgtgtaccacccgcatgcag

SEQ ID NO: 200400 - DNA, 25 bp, Rattus norvegicus
atgtatgtgtacgacccgcatgcag

SEQ ID NO: 200401 - DNA, 25 bp, Rattus norvegicus
atgtatgtgtccacgaagtcaaccc

SEQ ID NO: 200402 - DNA, 25 bp, Rattus norvegicus
atgtatgtgtcctcgaagtcaaccc

SEQ ID NO: 200403 - DNA, 25 bp, Rattus norvegicus
atgtatgttcttagcacgtgtttga

SEQ ID NO: 200404 - DNA, 25 bp, Rattus norvegicus
atgtatgttctttgcacgtgtttga

SEQ ID NO: 200405 - DNA, 25 bp, Rattus norvegicus
atgtatgtttctctgcttttgtgta

SEQ ID NO: 200406 - DNA, 25 bp, Rattus norvegicus
atgtatgtttctgtgcttttgtgta

SEQ ID NO: 200407 - DNA, 25 bp, Rattus norvegicus
atgtattacatcatggtcgccagga

SEQ ID NO: 200408 - DNA, 25 bp, Rattus norvegicus
atgtattacatcttggtcgccagga

SEQ ID NO: 200409 - DNA, 25 bp, Rattus norvegicus
atgtattagggactcgaacgtgttt

SEQ ID NO: 200410 - DNA, 25 bp, Rattus norvegicus
atgtattagggagtcgaacgtgttt

SEQ ID NO: 200411 - DNA, 25 bp, Rattus norvegicus
atgtattccctcatccggtatgaat

SEQ ID NO: 200412 - DNA, 25 bp, Rattus norvegicus
atgtattccctcttccggtatgaat

SEQ ID NO: 200413 - DNA, 25 bp, Rattus norvegicus
atgtattcctagatccgcacaatgg

SEQ ID NO: 200414 - DNA, 25 bp, Rattus norvegicus
atgtattcctagttccgcacaatgg

SEQ ID NO: 200415 - DNA, 25 bp, Rattus norvegicus
atgtattcctgacagtcgctcaata

SEQ ID NO: 200416 - DNA, 25 bp, Rattus norvegicus
atgtattcctgagagtcgctcaata

SEQ ID NO: 200417 - DNA, 25 bp, Rattus norvegicus
atgtattccttgatctcttgcttgt

SEQ ID NO: 200418 - DNA, 25 bp, Rattus norvegicus
atgtattccttgttctcttgcttgt

SEQ ID NO: 200419 - DNA, 25 bp, Rattus norvegicus
atgtattcggatatttgctttcaga

SEQ ID NO: 200420 - DNA, 25 bp, Rattus norvegicus
atgtattcggatttttgctttcaga

SEQ ID NO: 200421 - DNA, 25 bp, Rattus norvegicus
atgtattcggctcatggttcagcaa

SEQ ID NO: 200422 - DNA, 25 bp, Rattus norvegicus
atgtattcggctgatggttcagcaa

SEQ ID NO: 200423 - DNA, 25 bp, Rattus norvegicus
atgtattctgtcaagggctgcgatt

SEQ ID NO: 200424 - DNA, 25 bp, Rattus norvegicus
atgtattctgtctagggctgcgatt

SEQ ID NO: 200425 - DNA, 25 bp, Rattus norvegicus
atgtattgaaaccaggcttgacccc

SEQ ID NO: 200426 - DNA, 25 bp, Rattus norvegicus
atgtattgaaacgaggcttgacccc

SEQ ID NO: 200427 - DNA, 25 bp, Rattus norvegicus
atgtattgacccaccaaagttccat

SEQ ID NO: 200428 - DNA, 25 bp, Rattus norvegicus
atgtattgaccctccaaagttccat

SEQ ID NO: 200429 - DNA, 25 bp, Rattus norvegicus
atgtattgatatactgctcgtctcc

SEQ ID NO: 200430 - DNA, 25 bp, Rattus norvegicus
atgtattgatattctgctcgtctcc

SEQ ID NO: 200431 - DNA, 25 bp, Rattus norvegicus
atgtattgatcaccctggtggccgc

SEQ ID NO: 200432 - DNA, 25 bp, Rattus norvegicus
atgtattgatcagcctggtggccgc

SEQ ID NO: 200433 - DNA, 25 bp, Rattus norvegicus
atgtattgcatcattaatgtattaa

SEQ ID NO: 200434 - DNA, 25 bp, Rattus norvegicus
atgtattgcatctttaatgtattaa

SEQ ID NO: 200435 - DNA, 25 bp, Rattus norvegicus
atgtattgcttcagtgcgcagtgga

SEQ ID NO: 200436 - DNA, 25 bp, Rattus norvegicus
atgtattgcttctgtgcgcagtgga

SEQ ID NO: 200437 - DNA, 25 bp, Rattus norvegicus
atgtattggcccatgctggcaaggg

SEQ ID NO: 200438 - DNA, 25 bp, Rattus norvegicus
atgtattggcccttgctggcaaggg

SEQ ID NO: 200439 - DNA, 25 bp, Rattus norvegicus
atgtattgggtcagtcaaggtgcac

SEQ ID NO: 200440 - DNA, 25 bp, Rattus norvegicus
atgtattgggtctgtcaaggtgcac

SEQ ID NO: 200441 - DNA, 25 bp, Rattus norvegicus
atgtattgtactcgcctattgcata

SEQ ID NO: 200442 - DNA, 25 bp, Rattus norvegicus
atgtattgtactggcctattgcata

SEQ ID NO: 200443 - DNA, 25 bp, Rattus norvegicus
atgtatttaaaaccactggcctggg

SEQ ID NO: 200444 - DNA, 25 bp, Rattus norvegicus
atgtatttaaaagcactggcctggg

SEQ ID NO: 200445 - DNA, 25 bp, Rattus norvegicus
atgtatttactcagccaagtgccta

SEQ ID NO: 200446 - DNA, 25 bp, Rattus norvegicus
atgtatttactctgccaagtgccta

SEQ ID NO: 200447 - DNA, 25 bp, Rattus norvegicus
atgtatttcccaactctaaatccca

SEQ ID NO: 200448 - DNA, 25 bp, Rattus norvegicus
atgtatttcccatctctaaatccca

SEQ ID NO: 200449 - DNA, 25 bp, Rattus norvegicus
atgtatttccgtattgcccagaaga

SEQ ID NO: 200450 - DNA, 25 bp, Rattus norvegicus
atgtatttccgttttgcccagaaga

SEQ ID NO: 200451 - DNA, 25 bp, Rattus norvegicus
atgtatttggtgactgccacatctt

SEQ ID NO: 200452 - DNA, 25 bp, Rattus norvegicus
atgtatttggtgtctgccacatctt

SEQ ID NO: 200453 - DNA, 25 bp, Rattus norvegicus
atgtattttacaaggccaccgagga

SEQ ID NO: 200454 - DNA, 25 bp, Rattus norvegicus
atgtattttacatggccaccgagga

SEQ ID NO: 200455 - DNA, 25 bp, Rattus norvegicus
atgtattttcccagatctctttccc

SEQ ID NO: 200456 - DNA, 25 bp, Rattus norvegicus
atgtattttccctgatctctttccc

SEQ ID NO: 200457 - DNA, 25 bp, Rattus norvegicus
atgtattttgcgaccacgtcatcca

SEQ ID NO: 200458 - DNA, 25 bp, Rattus norvegicus
atgtattttgcgtccacgtcatcca

SEQ ID NO: 200459 - DNA, 25 bp, Rattus norvegicus
atgtatttttcaagccatatttact

SEQ ID NO: 200460 - DNA, 25 bp, Rattus norvegicus
atgtatttttcatgccatatttact

SEQ ID NO: 200461 - DNA, 25 bp, Rattus norvegicus
atgtatttttccaagagctgctgta

SEQ ID NO: 200462 - DNA, 25 bp, Rattus norvegicus
atgtatttttcctagagctgctgta

SEQ ID NO: 200463 - DNA, 25 bp, Rattus norvegicus
atgtatttttctcatctaccaaagg

SEQ ID NO: 200464 - DNA, 25 bp, Rattus norvegicus
atgtatttttctgatctaccaaagg

SEQ ID NO: 200465 - DNA, 25 bp, Rattus norvegicus
atgtattttttcacactacagcatt

SEQ ID NO: 200466 - DNA, 25 bp, Rattus norvegicus
atgtattttttcatcgcgcagtata

SEQ ID NO: 200467 - DNA, 25 bp, Rattus norvegicus
atgtattttttctcactacagcatt

SEQ ID NO: 200468 - DNA, 25 bp, Rattus norvegicus
atgtattttttcttcgcgcagtata

SEQ ID NO: 200469 - DNA, 25 bp, Rattus norvegicus
atgtcaaaaattaccaggcactgtt

SEQ ID NO: 200470 - DNA, 25 bp, Rattus norvegicus
atgtcaaaaatttccaggcactgtt

SEQ ID NO: 200471 - DNA, 25 bp, Rattus norvegicus
atgtcaaacttcaaagccctggaac

SEQ ID NO: 200472 - DNA, 25 bp, Rattus norvegicus
atgtcaaacttctaagccctggaac

SEQ ID NO: 200473 - DNA, 25 bp, Rattus norvegicus
atgtcaaatgggaactcctccttca

SEQ ID NO: 200474 - DNA, 25 bp, Rattus norvegicus
atgtcaaatgggtactcctccttca

SEQ ID NO: 200475 - DNA, 25 bp, Rattus norvegicus
atgtcaaattgtcccactctctgtc

SEQ ID NO: 200476 - DNA, 25 bp, Rattus norvegicus
atgtcaaattgtgccactctctgtc

SEQ ID NO: 200477 - DNA, 25 bp, Rattus norvegicus
atgtcaacaattactctcctgtgtg

SEQ ID NO: 200478 - DNA, 25 bp, Rattus norvegicus
atgtcaacaatttctctcctgtgtg

SEQ ID NO: 200479 - DNA, 25 bp, Rattus norvegicus
atgtcaacagacacgtggctatcga

SEQ ID NO: 200480 - DNA, 25 bp, Rattus norvegicus
atgtcaacagactcgtggctatcga

SEQ ID NO: 200481 - DNA, 25 bp, Rattus norvegicus
atgtcaaccaacacagacctttctc

SEQ ID NO: 200482 - DNA, 25 bp, Rattus norvegicus
atgtcaaccaactcagacctttctc

SEQ ID NO: 200483 - DNA, 25 bp, Rattus norvegicus
atgtcaacccacctgagtatgctaa

SEQ ID NO: 200484 - DNA, 25 bp, Rattus norvegicus
atgtcaacccacgtgagtatgctaa

SEQ ID NO: 200485 - DNA, 25 bp, Rattus norvegicus
atgtcaacggctcggctaacggcgc

SEQ ID NO: 200486 - DNA, 25 bp, Rattus norvegicus
atgtcaacggctgggctaacggcgc

SEQ ID NO: 200487 - DNA, 25 bp, Rattus norvegicus
atgtcaactcttcaattcctcaaaa

SEQ ID NO: 200488 - DNA, 25 bp, Rattus norvegicus
atgtcaactcttgaattcctcaaaa

SEQ ID NO: 200489 - DNA, 25 bp, Rattus norvegicus
atgtcaactgtcatgtttgggccaa

SEQ ID NO: 200490 - DNA, 25 bp, Rattus norvegicus
atgtcaactgtcttgtttgggccaa

SEQ ID NO: 200491 - DNA, 25 bp, Rattus norvegicus
atgtcaacttctcacaccacctgaa

SEQ ID NO: 200492 - DNA, 25 bp, Rattus norvegicus
atgtcaacttctgacaccacctgaa

SEQ ID NO: 200493 - DNA, 25 bp, Rattus norvegicus
atgtcaagaactcgccgatcacgga

SEQ ID NO: 200494 - DNA, 25 bp, Rattus norvegicus
atgtcaagaactggccgatcacgga

SEQ ID NO: 200495 - DNA, 25 bp, Rattus norvegicus
atgtcaagacctagaccagcgtgat

SEQ ID NO: 200496 - DNA, 25 bp, Rattus norvegicus
atgtcaagaccttgaccagcgtgat

SEQ ID NO: 200497 - DNA, 25 bp, Rattus norvegicus
atgtcaagacttcgctatgtgcatt

SEQ ID NO: 200498 - DNA, 25 bp, Rattus norvegicus
atgtcaagacttggctatgtgcatt

SEQ ID NO: 200499 - DNA, 25 bp, Rattus norvegicus
atgtcaagagagaccccagatccct

SEQ ID NO: 200500 - DNA, 25 bp, Rattus norvegicus
atgtcaagagagtccccagatccct

SEQ ID NO: 200501 - DNA, 25 bp, Rattus norvegicus
atgtcaagatcacagcctctgcaga

SEQ ID NO: 200502 - DNA, 25 bp, Rattus norvegicus
atgtcaagatcagagcctctgcaga

SEQ ID NO: 200503 - DNA, 25 bp, Rattus norvegicus
atgtcaagccatcgacctgaacctg

SEQ ID NO: 200504 - DNA, 25 bp, Rattus norvegicus
atgtcaagccatggacctgaacctg

SEQ ID NO: 200505 - DNA, 25 bp, Rattus norvegicus
atgtcaagcctcagggtctgccatc

SEQ ID NO: 200506 - DNA, 25 bp, Rattus norvegicus
atgtcaagcctctgggtctgccatc

SEQ ID NO: 200507 - DNA, 25 bp, Rattus norvegicus
atgtcaagctctctgagggcttcaa

SEQ ID NO: 200508 - DNA, 25 bp, Rattus norvegicus
atgtcaagctctgtgagggcttcaa

SEQ ID NO: 200509 - DNA, 25 bp, Rattus norvegicus
atgtcaagctgcactactgcgtgag

SEQ ID NO: 200510 - DNA, 25 bp, Rattus norvegicus
atgtcaagctgctctactgcgtgag

SEQ ID NO: 200511 - DNA, 25 bp, Rattus norvegicus
atgtcaaggatgaccagtctgctcc

SEQ ID NO: 200512 - DNA, 25 bp, Rattus norvegicus
atgtcaaggatgtccagtctgctcc

SEQ ID NO: 200513 - DNA, 25 bp, Rattus norvegicus
atgtcaaggcttatctgtagatata

SEQ ID NO: 200514 - DNA, 25 bp, Rattus norvegicus
atgtcaaggcttcgtattctgagac

SEQ ID NO: 200515 - DNA, 25 bp, Rattus norvegicus
atgtcaaggcttggtattctgagac

SEQ ID NO: 200516 - DNA, 25 bp, Rattus norvegicus
atgtcaaggcttttctgtagatata

SEQ ID NO: 200517 - DNA, 25 bp, Rattus norvegicus
atgtcaagggacagacggccctgta

SEQ ID NO: 200518 - DNA, 25 bp, Rattus norvegicus
atgtcaagggactgacggccctgta

SEQ ID NO: 200519 - DNA, 25 bp, Rattus norvegicus
atgtcaagtctcctcctagagaagg

SEQ ID NO: 200520 - DNA, 25 bp, Rattus norvegicus
atgtcaagtctcgtcctagagaagg

SEQ ID NO: 200521 - DNA, 25 bp, Rattus norvegicus
atgtcaagtgacagccgaatggttg

SEQ ID NO: 200522 - DNA, 25 bp, Rattus norvegicus
atgtcaagtgactgccgaatggttg

SEQ ID NO: 200523 - DNA, 25 bp, Rattus norvegicus
atgtcaagttcacctttgcttgtta

SEQ ID NO: 200524 - DNA, 25 bp, Rattus norvegicus
atgtcaagttcagctttgcttgtta

SEQ ID NO: 200525 - DNA, 25 bp, Rattus norvegicus
atgtcaagttccctgaaccgtgttt

SEQ ID NO: 200526 - DNA, 25 bp, Rattus norvegicus
atgtcaagttccgtgaaccgtgttt

SEQ ID NO: 200527 - DNA, 25 bp, Rattus norvegicus
atgtcaatacacatgagggctcatc

SEQ ID NO: 200528 - DNA, 25 bp, Rattus norvegicus
atgtcaatacacttgagggctcatc

SEQ ID NO: 200529 - DNA, 25 bp, Rattus norvegicus
atgtcaatcaaaatgtccatgtgtg

SEQ ID NO: 200530 - DNA, 25 bp, Rattus norvegicus
atgtcaatcaaattgtccatgtgtg

SEQ ID NO: 200531 - DNA, 25 bp, Rattus norvegicus
atgtcaatgagaagccgtccggcct

SEQ ID NO: 200532 - DNA, 25 bp, Rattus norvegicus
atgtcaatgagatgccgtccggcct

SEQ ID NO: 200533 - DNA, 25 bp, Rattus norvegicus
atgtcaatgagcacgtcaacagttc

SEQ ID NO: 200534 - DNA, 25 bp, Rattus norvegicus
atgtcaatgagctcgtcaacagttc

SEQ ID NO: 200535 - DNA, 25 bp, Rattus norvegicus
atgtcaatgcccatatggtctgcca

SEQ ID NO: 200536 - DNA, 25 bp, Rattus norvegicus
atgtcaatgcccttatggtctgcca

SEQ ID NO: 200537 - DNA, 25 bp, Rattus norvegicus
atgtcaattcgcacggagaccatcg

SEQ ID NO: 200538 - DNA, 25 bp, Rattus norvegicus
atgtcaattcgctcggagaccatcg

SEQ ID NO: 200539 - DNA, 25 bp, Rattus norvegicus
atgtcacaaacaacgcacacagggt

SEQ ID NO: 200540 - DNA, 25 bp, Rattus norvegicus
atgtcacaaacatcgcacacagggt

SEQ ID NO: 200541 - DNA, 25 bp, Rattus norvegicus
atgtcacaaactactgcaactttcc

SEQ ID NO: 200542 - DNA, 25 bp, Rattus norvegicus
atgtcacaaacttctgcaactttcc

SEQ ID NO: 200543 - DNA, 25 bp, Rattus norvegicus
atgtcacaagaacaggctatcagtc

SEQ ID NO: 200544 - DNA, 25 bp, Rattus norvegicus
atgtcacaagaagaggctatcagtc

SEQ ID NO: 200545 - DNA, 25 bp, Rattus norvegicus
atgtcacaatctacctagttttccc

SEQ ID NO: 200546 - DNA, 25 bp, Rattus norvegicus
atgtcacaatcttcctagttttccc

SEQ ID NO: 200547 - DNA, 25 bp, Rattus norvegicus
atgtcacacaatctgataccatcaa

SEQ ID NO: 200548 - DNA, 25 bp, Rattus norvegicus
atgtcacacaatgtgataccatcaa

SEQ ID NO: 200549 - DNA, 25 bp, Rattus norvegicus
atgtcacacatcacacgtagcactg

SEQ ID NO: 200550 - DNA, 25 bp, Rattus norvegicus
atgtcacacatctcacgtagcactg

SEQ ID NO: 200551 - DNA, 25 bp, Rattus norvegicus
atgtcacaccagagatcatccatgc

SEQ ID NO: 200552 - DNA, 25 bp, Rattus norvegicus
atgtcacaccagtgatcatccatgc

SEQ ID NO: 200553 - DNA, 25 bp, Rattus norvegicus
atgtcacactgactggctcgcctaa

SEQ ID NO: 200554 - DNA, 25 bp, Rattus norvegicus
atgtcacactgagtggctcgcctaa

SEQ ID NO: 200555 - DNA, 25 bp, Rattus norvegicus
atgtcacagaagatccgggcggcct

SEQ ID NO: 200556 - DNA, 25 bp, Rattus norvegicus
atgtcacagaagttccgggcggcct

SEQ ID NO: 200557 - DNA, 25 bp, Rattus norvegicus
atgtcacagatgatgctgacctcag

SEQ ID NO: 200558 - DNA, 25 bp, Rattus norvegicus
atgtcacagatgttgctgacctcag

SEQ ID NO: 200559 - DNA, 25 bp, Rattus norvegicus
atgtcacagcaaatgcccctgaaat

SEQ ID NO: 200560 - DNA, 25 bp, Rattus norvegicus
atgtcacagcaattgcccctgaaat

SEQ ID NO: 200561 - DNA, 25 bp, Rattus norvegicus
atgtcacagcacaagcacggagtac

SEQ ID NO: 200562 - DNA, 25 bp, Rattus norvegicus
atgtcacagcacacgggctgtttca

SEQ ID NO: 200563 - DNA, 25 bp, Rattus norvegicus
atgtcacagcactagcacggagtac

SEQ ID NO: 200564 - DNA, 25 bp, Rattus norvegicus
atgtcacagcactcgggctgtttca

SEQ ID NO: 200565 - DNA, 25 bp, Rattus norvegicus
atgtcacagctcaccatacccaaat

SEQ ID NO: 200566 - DNA, 25 bp, Rattus norvegicus
atgtcacagctctccatacccaaat

SEQ ID NO: 200567 - DNA, 25 bp, Rattus norvegicus
atgtcacaggtgctcttgtgtctca

SEQ ID NO: 200568 - DNA, 25 bp, Rattus norvegicus
atgtcacaggtggtcttgtgtctca

SEQ ID NO: 200569 - DNA, 25 bp, Rattus norvegicus
atgtcacatgatatctagctggttt

SEQ ID NO: 200570 - DNA, 25 bp, Rattus norvegicus
atgtcacatgatttctagctggttt

SEQ ID NO: 200571 - DNA, 25 bp, Rattus norvegicus
atgtcacatgtcaccgggcttggag

SEQ ID NO: 200572 - DNA, 25 bp, Rattus norvegicus
atgtcacatgtctccgggcttggag

SEQ ID NO: 200573 - DNA, 25 bp, Rattus norvegicus
atgtcacatgttcagcgtgttcacc

SEQ ID NO: 200574 - DNA, 25 bp, Rattus norvegicus
atgtcacatgttgagcgtgttcacc

SEQ ID NO: 200575 - DNA, 25 bp, Rattus norvegicus
atgtcaccaagaaggcttcctgagg

SEQ ID NO: 200576 - DNA, 25 bp, Rattus norvegicus
atgtcaccaagatggcttcctgagg

SEQ ID NO: 200577 - DNA, 25 bp, Rattus norvegicus
atgtcaccaaggcactccgctaagc

SEQ ID NO: 200578 - DNA, 25 bp, Rattus norvegicus
atgtcaccaagggactccgctaagc

SEQ ID NO: 200579 - DNA, 25 bp, Rattus norvegicus
atgtcaccaggactcagcagcacgc

SEQ ID NO: 200580 - DNA, 25 bp, Rattus norvegicus
atgtcaccaggagtcagcagcacgc

SEQ ID NO: 200581 - DNA, 25 bp, Rattus norvegicus
atgtcaccagggaaaagggctcctt

SEQ ID NO: 200582 - DNA, 25 bp, Rattus norvegicus
atgtcaccagggtaaagggctcctt

SEQ ID NO: 200583 - DNA, 25 bp, Rattus norvegicus
atgtcaccatcaccgagaaaccatg

SEQ ID NO: 200584 - DNA, 25 bp, Rattus norvegicus
atgtcaccatcagcgagaaaccatg

SEQ ID NO: 200585 - DNA, 25 bp, Rattus norvegicus
atgtcacccggaatgacactgggtt

SEQ ID NO: 200586 - DNA, 25 bp, Rattus norvegicus
atgtcacccggattgacactgggtt

SEQ ID NO: 200587 - DNA, 25 bp, Rattus norvegicus
atgtcacctacaatgctgagcgttc

SEQ ID NO: 200588 - DNA, 25 bp, Rattus norvegicus
atgtcacctacattgctgagcgttc

SEQ ID NO: 200589 - DNA, 25 bp, Rattus norvegicus
atgtcacctccaagaagccctggaa

SEQ ID NO: 200590 - DNA, 25 bp, Rattus norvegicus
atgtcacctccatgaagccctggaa

SEQ ID NO: 200591 - DNA, 25 bp, Rattus norvegicus
atgtcacctcctaagtgagccagag

SEQ ID NO: 200592 - DNA, 25 bp, Rattus norvegicus
atgtcacctcctctttgcggaagaa

SEQ ID NO: 200593 - DNA, 25 bp, Rattus norvegicus
atgtcacctcctgtttgcggaagaa

SEQ ID NO: 200594 - DNA, 25 bp, Rattus norvegicus
atgtcacctccttagtgagccagag

SEQ ID NO: 200595 - DNA, 25 bp, Rattus norvegicus
atgtcacctgcaatgctgtcctgaa

SEQ ID NO: 200596 - DNA, 25 bp, Rattus norvegicus
atgtcacctgcattgctgtcctgaa

SEQ ID NO: 200597 - DNA, 25 bp, Rattus norvegicus
atgtcaccttcacggtttgcaacct

SEQ ID NO: 200598 - DNA, 25 bp, Rattus norvegicus
atgtcaccttcagggtttgcaacct

SEQ ID NO: 200599 - DNA, 25 bp, Rattus norvegicus
atgtcaccttctcgctgcttagtaa

SEQ ID NO: 200600 - DNA, 25 bp, Rattus norvegicus
atgtcaccttctggctgcttagtaa

SEQ ID NO: 200601 - DNA, 25 bp, Rattus norvegicus
atgtcacggacaacggcgtcattgc

SEQ ID NO: 200602 - DNA, 25 bp, Rattus norvegicus
atgtcacggacatcggcgtcattgc

SEQ ID NO: 200603 - DNA, 25 bp, Rattus norvegicus
atgtcacggagaaggaagcattcta

SEQ ID NO: 200604 - DNA, 25 bp, Rattus norvegicus
atgtcacggagatggaagcattcta

SEQ ID NO: 200605 - DNA, 25 bp, Rattus norvegicus
atgtcacgggtgaggcaggtacaag

SEQ ID NO: 200606 - DNA, 25 bp, Rattus norvegicus
atgtcacgggtgtggcaggtacaag

SEQ ID NO: 200607 - DNA, 25 bp, Rattus norvegicus
atgtcactcagtcgcaggcagtgct

SEQ ID NO: 200608 - DNA, 25 bp, Rattus norvegicus
atgtcactcagtggcaggcagtgct

SEQ ID NO: 200609 - DNA, 25 bp, Rattus norvegicus
atgtcactcctcctgttggtggtct

SEQ ID NO: 200610 - DNA, 25 bp, Rattus norvegicus
atgtcactcctcgtgttggtggtct

SEQ ID NO: 200611 - DNA, 25 bp, Rattus norvegicus
atgtcactcgtcagtgatctggcac

SEQ ID NO: 200612 - DNA, 25 bp, Rattus norvegicus
atgtcactcgtctgtgatctggcac

SEQ ID NO: 200613 - DNA, 25 bp, Rattus norvegicus
atgtcactctttccatgggcagagg

SEQ ID NO: 200614 - DNA, 25 bp, Rattus norvegicus
atgtcactctttgcatgggcagagg

SEQ ID NO: 200615 - DNA, 25 bp, Rattus norvegicus
atgtcactgaatcaagctgcttccg

SEQ ID NO: 200616 - DNA, 25 bp, Rattus norvegicus
atgtcactgaatgaagctgcttccg

SEQ ID NO: 200617 - DNA, 25 bp, Rattus norvegicus
atgtcactgagtagtctgagccccg

SEQ ID NO: 200618 - DNA, 25 bp, Rattus norvegicus
atgtcactgagttgtctgagccccg

SEQ ID NO: 200619 - DNA, 25 bp, Rattus norvegicus
atgtcactgcacatagaaccctggg

SEQ ID NO: 200620 - DNA, 25 bp, Rattus norvegicus
atgtcactgcacttagaaccctggg

SEQ ID NO: 200621 - DNA, 25 bp, Rattus norvegicus
atgtcactggcacctggagctaccg

SEQ ID NO: 200622 - DNA, 25 bp, Rattus norvegicus
atgtcactggcagctggagctaccg

SEQ ID NO: 200623 - DNA, 25 bp, Rattus norvegicus
atgtcactgtgtaatataccttgtc

SEQ ID NO: 200624 - DNA, 25 bp, Rattus norvegicus
atgtcactgtgttatataccttgtc

SEQ ID NO: 200625 - DNA, 25 bp, Rattus norvegicus
atgtcactgtttatattctgccctc

SEQ ID NO: 200626 - DNA, 25 bp, Rattus norvegicus
atgtcactgtttttattctgccctc

SEQ ID NO: 200627 - DNA, 25 bp, Rattus norvegicus
atgtcacttaggctgggcttttcct

SEQ ID NO: 200628 - DNA, 25 bp, Rattus norvegicus
atgtcacttagggtgggcttttcct

SEQ ID NO: 200629 - DNA, 25 bp, Rattus norvegicus
atgtcactttacactcaggtctgag

SEQ ID NO: 200630 - DNA, 25 bp, Rattus norvegicus
atgtcactttactctcaggtctgag

SEQ ID NO: 200631 - DNA, 25 bp, Rattus norvegicus
atgtcactttgaatttgctctgcct

SEQ ID NO: 200632 - DNA, 25 bp, Rattus norvegicus
atgtcactttgacgcccatgttagg

SEQ ID NO: 200633 - DNA, 25 bp, Rattus norvegicus
atgtcactttgaggcccatgttagg

SEQ ID NO: 200634 - DNA, 25 bp, Rattus norvegicus
atgtcactttgattttgctctgcct

SEQ ID NO: 200635 - DNA, 25 bp, Rattus norvegicus
atgtcagaattgatgtacctttttt

SEQ ID NO: 200636 - DNA, 25 bp, Rattus norvegicus
atgtcagaattgttgtacctttttt

SEQ ID NO: 200637 - DNA, 25 bp, Rattus norvegicus
atgtcagacaagatgccactttctc

SEQ ID NO: 200638 - DNA, 25 bp, Rattus norvegicus
atgtcagacaagttgccactttctc

SEQ ID NO: 200639 - DNA, 25 bp, Rattus norvegicus
atgtcagacatgctccacattgcgt

SEQ ID NO: 200640 - DNA, 25 bp, Rattus norvegicus
atgtcagacatggtccacattgcgt

SEQ ID NO: 200641 - DNA, 25 bp, Rattus norvegicus
atgtcagaccgtaggtttacccagg

SEQ ID NO: 200642 - DNA, 25 bp, Rattus norvegicus
atgtcagaccgttggtttacccagg

SEQ ID NO: 200643 - DNA, 25 bp, Rattus norvegicus
atgtcagacttaacctgatgagatt

SEQ ID NO: 200644 - DNA, 25 bp, Rattus norvegicus
atgtcagacttatcctgatgagatt

SEQ ID NO: 200645 - DNA, 25 bp, Rattus norvegicus
atgtcagagacaaagaagccatctt

SEQ ID NO: 200646 - DNA, 25 bp, Rattus norvegicus
atgtcagagacatagaagccatctt

SEQ ID NO: 200647 - DNA, 25 bp, Rattus norvegicus
atgtcagagagaacgatgtgatttt

SEQ ID NO: 200648 - DNA, 25 bp, Rattus norvegicus
atgtcagagagatcgatgtgatttt

SEQ ID NO: 200649 - DNA, 25 bp, Rattus norvegicus
atgtcagagcggaacattctcagcc

SEQ ID NO: 200650 - DNA, 25 bp, Rattus norvegicus
atgtcagagcggtacattctcagcc

SEQ ID NO: 200651 - DNA, 25 bp, Rattus norvegicus
atgtcagaggccagcatgacctctt

SEQ ID NO: 200652 - DNA, 25 bp, Rattus norvegicus
atgtcagaggcctgcatgacctctt

SEQ ID NO: 200653 - DNA, 25 bp, Rattus norvegicus
atgtcagatctcatcaggacctagc

SEQ ID NO: 200654 - DNA, 25 bp, Rattus norvegicus
atgtcagatctcttcaggacctagc

SEQ ID NO: 200655 - DNA, 25 bp, Rattus norvegicus
atgtcagatgacatttgactgcaaa

SEQ ID NO: 200656 - DNA, 25 bp, Rattus norvegicus
atgtcagatgacttttgactgcaaa

SEQ ID NO: 200657 - DNA, 25 bp, Rattus norvegicus
atgtcagcacttccacatgcgtaat

SEQ ID NO: 200658 - DNA, 25 bp, Rattus norvegicus
atgtcagcacttgcacatgcgtaat

SEQ ID NO: 200659 - DNA, 25 bp, Rattus norvegicus
atgtcagcagccagtttaccgcaaa

SEQ ID NO: 200660 - DNA, 25 bp, Rattus norvegicus
atgtcagcagcccagcattgttaga

SEQ ID NO: 200661 - DNA, 25 bp, Rattus norvegicus
atgtcagcagccgagcattgttaga

SEQ ID NO: 200662 - DNA, 25 bp, Rattus norvegicus
atgtcagcagcctgtttaccgcaaa

SEQ ID NO: 200663 - DNA, 25 bp, Rattus norvegicus
atgtcagcaggcaatgaggaacagc

SEQ ID NO: 200664 - DNA, 25 bp, Rattus norvegicus
atgtcagcaggccaacttctgagag

SEQ ID NO: 200665 - DNA, 25 bp, Rattus norvegicus
atgtcagcaggcgaacttctgagag

SEQ ID NO: 200666 - DNA, 25 bp, Rattus norvegicus
atgtcagcaggctatgaggaacagc

SEQ ID NO: 200667 - DNA, 25 bp, Rattus norvegicus
atgtcagcagtgattgtcttcagcc

SEQ ID NO: 200668 - DNA, 25 bp, Rattus norvegicus
atgtcagcagtgtttgtcttcagcc

SEQ ID NO: 200669 - DNA, 25 bp, Rattus norvegicus
atgtcagcagttctaaatgggtccg

SEQ ID NO: 200670 - DNA, 25 bp, Rattus norvegicus
atgtcagcagttgtaaatgggtccg

SEQ ID NO: 200671 - DNA, 25 bp, Rattus norvegicus
atgtcagcatgacctcatcagggtt

SEQ ID NO: 200672 - DNA, 25 bp, Rattus norvegicus
atgtcagcatgagctcatcagggtt

SEQ ID NO: 200673 - DNA, 25 bp, Rattus norvegicus
atgtcagcccagcaggagttaacca

SEQ ID NO: 200674 - DNA, 25 bp, Rattus norvegicus
atgtcagcccaggaggagttaacca

SEQ ID NO: 200675 - DNA, 25 bp, Rattus norvegicus
atgtcagccgatagagatctctcct

SEQ ID NO: 200676 - DNA, 25 bp, Rattus norvegicus
atgtcagccgattgagatctctcct

SEQ ID NO: 200677 - DNA, 25 bp, Rattus norvegicus
atgtcagcctctcccattatgaatt

SEQ ID NO: 200678 - DNA, 25 bp, Rattus norvegicus
atgtcagcctctgccattatgaatt

SEQ ID NO: 200679 - DNA, 25 bp, Rattus norvegicus
atgtcagccttcattgtagcctgag

SEQ ID NO: 200680 - DNA, 25 bp, Rattus norvegicus
atgtcagccttctttgtagcctgag

SEQ ID NO: 200681 - DNA, 25 bp, Rattus norvegicus
atgtcagctcatatcatttgaagga

SEQ ID NO: 200682 - DNA, 25 bp, Rattus norvegicus
atgtcagctcatttcatttgaagga

SEQ ID NO: 200683 - DNA, 25 bp, Rattus norvegicus
atgtcagctgcactcttgttgtttt

SEQ ID NO: 200684 - DNA, 25 bp, Rattus norvegicus
atgtcagctgcagtcttgttgtttt

SEQ ID NO: 200685 - DNA, 25 bp, Rattus norvegicus
atgtcagctgctatgatttccactg

SEQ ID NO: 200686 - DNA, 25 bp, Rattus norvegicus
atgtcagctgctttgatttccactg

SEQ ID NO: 200687 - DNA, 25 bp, Rattus norvegicus
atgtcagcttgaattagatgtcact

SEQ ID NO: 200688 - DNA, 25 bp, Rattus norvegicus
atgtcagcttgatttagatgtcact

SEQ ID NO: 200689 - DNA, 25 bp, Rattus norvegicus
atgtcagcttggctggactccagca

SEQ ID NO: 200690 - DNA, 25 bp, Rattus norvegicus
atgtcagcttgggtggactccagca

SEQ ID NO: 200691 - DNA, 25 bp, Rattus norvegicus
atgtcaggacagcactacgggcctc

SEQ ID NO: 200692 - DNA, 25 bp, Rattus norvegicus
atgtcaggacaggactacgggcctc

SEQ ID NO: 200693 - DNA, 25 bp, Rattus norvegicus
atgtcaggacccaccgtgtttgagt

SEQ ID NO: 200694 - DNA, 25 bp, Rattus norvegicus
atgtcaggaccctccgtgtttgagt

SEQ ID NO: 200695 - DNA, 25 bp, Rattus norvegicus
atgtcaggactgactgaactttcac

SEQ ID NO: 200696 - DNA, 25 bp, Rattus norvegicus
atgtcaggactgtctgaactttcac

SEQ ID NO: 200697 - DNA, 25 bp, Rattus norvegicus
atgtcaggaggcaccctagcttcca

SEQ ID NO: 200698 - DNA, 25 bp, Rattus norvegicus
atgtcaggaggcaggacagccaaga

SEQ ID NO: 200699 - DNA, 25 bp, Rattus norvegicus
atgtcaggaggctccctagcttcca

SEQ ID NO: 200700 - DNA, 25 bp, Rattus norvegicus
atgtcaggaggctggacagccaaga

SEQ ID NO: 200701 - DNA, 25 bp, Rattus norvegicus
atgtcaggcaatccctccaagtggt

SEQ ID NO: 200702 - DNA, 25 bp, Rattus norvegicus
atgtcaggcaatgcctccaagtggt

SEQ ID NO: 200703 - DNA, 25 bp, Rattus norvegicus
atgtcagggacacgcatgcgctctg

SEQ ID NO: 200704 - DNA, 25 bp, Rattus norvegicus
atgtcagggacaggcatgcgctctg

SEQ ID NO: 200705 - DNA, 25 bp, Rattus norvegicus
atgtcagggctgaattgttctgtgt

SEQ ID NO: 200706 - DNA, 25 bp, Rattus norvegicus
atgtcagggctgtattgttctgtgt

SEQ ID NO: 200707 - DNA, 25 bp, Rattus norvegicus
atgtcagggtaacaacattgtctac

SEQ ID NO: 200708 - DNA, 25 bp, Rattus norvegicus
atgtcagggtaagaacattgtctac

SEQ ID NO: 200709 - DNA, 25 bp, Rattus norvegicus
atgtcaggtcctagagtcagtaaag

SEQ ID NO: 200710 - DNA, 25 bp, Rattus norvegicus
atgtcaggtccttgagtcagtaaag

SEQ ID NO: 200711 - DNA, 25 bp, Rattus norvegicus
atgtcaggtggactccaggccttgc

SEQ ID NO: 200712 - DNA, 25 bp, Rattus norvegicus
atgtcaggtggagtccaggccttgc

SEQ ID NO: 200713 - DNA, 25 bp, Rattus norvegicus
atgtcaggtttgaccagtctttttc

SEQ ID NO: 200714 - DNA, 25 bp, Rattus norvegicus
atgtcaggtttgtccagtctttttc

SEQ ID NO: 200715 - DNA, 25 bp, Rattus norvegicus
atgtcagtacttaacgtctgggccc

SEQ ID NO: 200716 - DNA, 25 bp, Rattus norvegicus
atgtcagtactttacgtctgggccc

SEQ ID NO: 200717 - DNA, 25 bp, Rattus norvegicus
atgtcagtcactatagtttccttag

SEQ ID NO: 200718 - DNA, 25 bp, Rattus norvegicus
atgtcagtcactctccatttgttgg

SEQ ID NO: 200719 - DNA, 25 bp, Rattus norvegicus
atgtcagtcactgtccatttgttgg

SEQ ID NO: 200720 - DNA, 25 bp, Rattus norvegicus
atgtcagtcactttagtttccttag

SEQ ID NO: 200721 - DNA, 25 bp, Rattus norvegicus
atgtcagtcagaatgtccttttcct

SEQ ID NO: 200722 - DNA, 25 bp, Rattus norvegicus
atgtcagtcagattgtccttttcct

SEQ ID NO: 200723 - DNA, 25 bp, Rattus norvegicus
atgtcagtcaggctgagggccttat

SEQ ID NO: 200724 - DNA, 25 bp, Rattus norvegicus
atgtcagtcagggtgagggccttat

SEQ ID NO: 200725 - DNA, 25 bp, Rattus norvegicus
atgtcagtgactcactgcactgccg

SEQ ID NO: 200726 - DNA, 25 bp, Rattus norvegicus
atgtcagtgactgactgcactgccg

SEQ ID NO: 200727 - DNA, 25 bp, Rattus norvegicus
atgtcagtgctaatgtaagtggcca

SEQ ID NO: 200728 - DNA, 25 bp, Rattus norvegicus
atgtcagtgctattgtaagtggcca

SEQ ID NO: 200729 - DNA, 25 bp, Rattus norvegicus
atgtcagtggcacagctcatttgct

SEQ ID NO: 200730 - DNA, 25 bp, Rattus norvegicus
atgtcagtggcagagctcatttgct

SEQ ID NO: 200731 - DNA, 25 bp, Rattus norvegicus
atgtcagtggccagcgtgcatgtcc

SEQ ID NO: 200732 - DNA, 25 bp, Rattus norvegicus
atgtcagtggcctgcgtgcatgtcc

SEQ ID NO: 200733 - DNA, 25 bp, Rattus norvegicus
atgtcagtgtacactgtgaacttga

SEQ ID NO: 200734 - DNA, 25 bp, Rattus norvegicus
atgtcagtgtactctgtgaacttga

SEQ ID NO: 200735 - DNA, 25 bp, Rattus norvegicus
atgtcagttgtacatgtcaccttca

SEQ ID NO: 200736 - DNA, 25 bp, Rattus norvegicus
atgtcagttgtagatgtcaccttca

SEQ ID NO: 200737 - DNA, 25 bp, Rattus norvegicus
atgtcataccacacccatagtaggg

SEQ ID NO: 200738 - DNA, 25 bp, Rattus norvegicus
atgtcataccactcccatagtaggg

SEQ ID NO: 200739 - DNA, 25 bp, Rattus norvegicus
atgtcataggatatctgtctccctg

SEQ ID NO: 200740 - DNA, 25 bp, Rattus norvegicus
atgtcataggatttctgtctccctg

SEQ ID NO: 200741 - DNA, 25 bp, Rattus norvegicus
atgtcatcagatatgccaggagaac

SEQ ID NO: 200742 - DNA, 25 bp, Rattus norvegicus
atgtcatcagatttgccaggagaac

SEQ ID NO: 200743 - DNA, 25 bp, Rattus norvegicus
atgtcatcatccctgttcttatttt

SEQ ID NO: 200744 - DNA, 25 bp, Rattus norvegicus
atgtcatcatccgtgttcttatttt

SEQ ID NO: 200745 - DNA, 25 bp, Rattus norvegicus
atgtcatcatgtatgtttgcaacac

SEQ ID NO: 200746 - DNA, 25 bp, Rattus norvegicus
atgtcatcatgtttgtttgcaacac

SEQ ID NO: 200747 - DNA, 25 bp, Rattus norvegicus
atgtcatccaccagcaactaatgca

SEQ ID NO: 200748 - DNA, 25 bp, Rattus norvegicus
atgtcatccacctgcaactaatgca

SEQ ID NO: 200749 - DNA, 25 bp, Rattus norvegicus
atgtcatcccacagagcatcggcag

SEQ ID NO: 200750 - DNA, 25 bp, Rattus norvegicus
atgtcatcccactgagcatcggcag

SEQ ID NO: 200751 - DNA, 25 bp, Rattus norvegicus
atgtcatcccagaaaatgctttgta

SEQ ID NO: 200752 - DNA, 25 bp, Rattus norvegicus
atgtcatcccagtaaatgctttgta

SEQ ID NO: 200753 - DNA, 25 bp, Rattus norvegicus
atgtcatccggcaaagtccttcctc

SEQ ID NO: 200754 - DNA, 25 bp, Rattus norvegicus
atgtcatccggcaaatcgaggccca

SEQ ID NO: 200755 - DNA, 25 bp, Rattus norvegicus
atgtcatccggctaagtccttcctc

SEQ ID NO: 200756 - DNA, 25 bp, Rattus norvegicus
atgtcatccggctaatcgaggccca

SEQ ID NO: 200757 - DNA, 25 bp, Rattus norvegicus
atgtcatcctgaagattttcccatc

SEQ ID NO: 200758 - DNA, 25 bp, Rattus norvegicus
atgtcatcctgatgattttcccatc

SEQ ID NO: 200759 - DNA, 25 bp, Rattus norvegicus
atgtcatccttgaagaggctcccag

SEQ ID NO: 200760 - DNA, 25 bp, Rattus norvegicus
atgtcatccttgtagaggctcccag

SEQ ID NO: 200761 - DNA, 25 bp, Rattus norvegicus
atgtcatcgagcagcctagctttgc

SEQ ID NO: 200762 - DNA, 25 bp, Rattus norvegicus
atgtcatcgagctgcctagctttgc

SEQ ID NO: 200763 - DNA, 25 bp, Rattus norvegicus
atgtcatcgctcagggtgttggcaa

SEQ ID NO: 200764 - DNA, 25 bp, Rattus norvegicus
atgtcatcgctctgggtgttggcaa

SEQ ID NO: 200765 - DNA, 25 bp, Rattus norvegicus
atgtcatcggtgcattcattttgat

SEQ ID NO: 200766 - DNA, 25 bp, Rattus norvegicus
atgtcatcggtggattcattttgat

SEQ ID NO: 200767 - DNA, 25 bp, Rattus norvegicus
atgtcatctactcgtgcatgtctac

SEQ ID NO: 200768 - DNA, 25 bp, Rattus norvegicus
atgtcatctactggtgcatgtctac

SEQ ID NO: 200769 - DNA, 25 bp, Rattus norvegicus
atgtcatctcagactgtaagccctg

SEQ ID NO: 200770 - DNA, 25 bp, Rattus norvegicus
atgtcatctcagtctgtaagccctg

SEQ ID NO: 200771 - DNA, 25 bp, Rattus norvegicus
atgtcatctctactggaccttgtgg

SEQ ID NO: 200772 - DNA, 25 bp, Rattus norvegicus
atgtcatctctagtggaccttgtgg

SEQ ID NO: 200773 - DNA, 25 bp, Rattus norvegicus
atgtcatctctgctgcaggttctca

SEQ ID NO: 200774 - DNA, 25 bp, Rattus norvegicus
atgtcatctctggtgcaggttctca

SEQ ID NO: 200775 - DNA, 25 bp, Rattus norvegicus
atgtcatctgacagctaccctgtta

SEQ ID NO: 200776 - DNA, 25 bp, Rattus norvegicus
atgtcatctgactgctaccctgtta

SEQ ID NO: 200777 - DNA, 25 bp, Rattus norvegicus
atgtcatctgcacccaagcatgcac

SEQ ID NO: 200778 - DNA, 25 bp, Rattus norvegicus
atgtcatctgcagccaagcatgcac

SEQ ID NO: 200779 - DNA, 25 bp, Rattus norvegicus
atgtcatcttaaattttggcccctt

SEQ ID NO: 200780 - DNA, 25 bp, Rattus norvegicus
atgtcatcttaatttttggcccctt

SEQ ID NO: 200781 - DNA, 25 bp, Rattus norvegicus
atgtcatcttacacctaatttctta

SEQ ID NO: 200782 - DNA, 25 bp, Rattus norvegicus
atgtcatcttactcctaatttctta

SEQ ID NO: 200783 - DNA, 25 bp, Rattus norvegicus
atgtcatcttcaaggtgtatcccct

SEQ ID NO: 200784 - DNA, 25 bp, Rattus norvegicus
atgtcatcttcatggtgtatcccct

SEQ ID NO: 200785 - DNA, 25 bp, Rattus norvegicus
atgtcatcttctacctgttcaaagc

SEQ ID NO: 200786 - DNA, 25 bp, Rattus norvegicus
atgtcatcttcttcctgttcaaagc

SEQ ID NO: 200787 - DNA, 25 bp, Rattus norvegicus
atgtcatcttggctcatgtgtgaag

SEQ ID NO: 200788 - DNA, 25 bp, Rattus norvegicus
atgtcatcttgggtcatgtgtgaag

SEQ ID NO: 200789 - DNA, 25 bp, Rattus norvegicus
atgtcatgacccctggatattcact

SEQ ID NO: 200790 - DNA, 25 bp, Rattus norvegicus
atgtcatgacccgtggatattcact

SEQ ID NO: 200791 - DNA, 25 bp, Rattus norvegicus
atgtcatgcatactatatatctggg

SEQ ID NO: 200792 - DNA, 25 bp, Rattus norvegicus
atgtcatgcatagtatatatctggg

SEQ ID NO: 200793 - DNA, 25 bp, Rattus norvegicus
atgtcatgctatctggagtggcccc

SEQ ID NO: 200794 - DNA, 25 bp, Rattus norvegicus
atgtcatgctatgtggagtggcccc

SEQ ID NO: 200795 - DNA, 25 bp, Rattus norvegicus
atgtcatggatgagcctggtgccct

SEQ ID NO: 200796 - DNA, 25 bp, Rattus norvegicus
atgtcatggatgtgcctggtgccct

SEQ ID NO: 200797 - DNA, 25 bp, Rattus norvegicus
atgtcatggcctcatttttgtttct

SEQ ID NO: 200798 - DNA, 25 bp, Rattus norvegicus
atgtcatggcctgatttttgtttct

SEQ ID NO: 200799 - DNA, 25 bp, Rattus norvegicus
atgtcatggctaatttctttcccag

SEQ ID NO: 200800 - DNA, 25 bp, Rattus norvegicus
atgtcatggctattttctttcccag

SEQ ID NO: 200801 - DNA, 25 bp, Rattus norvegicus
atgtcatgggcaacctgcaagttca

SEQ ID NO: 200802 - DNA, 25 bp, Rattus norvegicus
atgtcatgggcatcctgcaagttca

SEQ ID NO: 200803 - DNA, 25 bp, Rattus norvegicus
atgtcatgtataaattggagcctta

SEQ ID NO: 200804 - DNA, 25 bp, Rattus norvegicus
atgtcatgtatatattggagcctta

SEQ ID NO: 200805 - DNA, 25 bp, Rattus norvegicus
atgtcatgtcagaggccaccatcca

SEQ ID NO: 200806 - DNA, 25 bp, Rattus norvegicus
atgtcatgtcagcaggctcttctta

SEQ ID NO: 200807 - DNA, 25 bp, Rattus norvegicus
atgtcatgtcaggaggctcttctta

SEQ ID NO: 200808 - DNA, 25 bp, Rattus norvegicus
atgtcatgtcagtggccaccatcca

SEQ ID NO: 200809 - DNA, 25 bp, Rattus norvegicus
atgtcatgttatatttactttcaga

SEQ ID NO: 200810 - DNA, 25 bp, Rattus norvegicus
atgtcatgttatttttactttcaga

SEQ ID NO: 200811 - DNA, 25 bp, Rattus norvegicus
atgtcattaaccaggcttctttgtc

SEQ ID NO: 200812 - DNA, 25 bp, Rattus norvegicus
atgtcattaacctggcttctttgtc

SEQ ID NO: 200813 - DNA, 25 bp, Rattus norvegicus
atgtcattacagagtcaccaaccca

SEQ ID NO: 200814 - DNA, 25 bp, Rattus norvegicus
atgtcattacagtgtcaccaaccca

SEQ ID NO: 200815 - DNA, 25 bp, Rattus norvegicus
atgtcattacttatgtctttatttc

SEQ ID NO: 200816 - DNA, 25 bp, Rattus norvegicus
atgtcattacttttgtctttatttc

SEQ ID NO: 200817 - DNA, 25 bp, Rattus norvegicus
atgtcattatgacacccatcgcgct

SEQ ID NO: 200818 - DNA, 25 bp, Rattus norvegicus
atgtcattatgagacccatcgcgct

SEQ ID NO: 200819 - DNA, 25 bp, Rattus norvegicus
atgtcattcaataatgccaccacct

SEQ ID NO: 200820 - DNA, 25 bp, Rattus norvegicus
atgtcattcaattatgccaccacct

SEQ ID NO: 200821 - DNA, 25 bp, Rattus norvegicus
atgtcattcataaataccttgtgga

SEQ ID NO: 200822 - DNA, 25 bp, Rattus norvegicus
atgtcattcatatataccttgtgga

SEQ ID NO: 200823 - DNA, 25 bp, Rattus norvegicus
atgtcattcatcacactccacagag

SEQ ID NO: 200824 - DNA, 25 bp, Rattus norvegicus
atgtcattcatctcactccacagag

SEQ ID NO: 200825 - DNA, 25 bp, Rattus norvegicus
atgtcattcgcactaacaagcctct

SEQ ID NO: 200826 - DNA, 25 bp, Rattus norvegicus
atgtcattcgcacttgtcaaaaccc

SEQ ID NO: 200827 - DNA, 25 bp, Rattus norvegicus
atgtcattcgcagtaacaagcctct

SEQ ID NO: 200828 - DNA, 25 bp, Rattus norvegicus
atgtcattcgcagttgtcaaaaccc

SEQ ID NO: 200829 - DNA, 25 bp, Rattus norvegicus
atgtcattctacactgctctaggga

SEQ ID NO: 200830 - DNA, 25 bp, Rattus norvegicus
atgtcattctactctgctctaggga

SEQ ID NO: 200831 - DNA, 25 bp, Rattus norvegicus
atgtcattgcgaaatccctgggaga

SEQ ID NO: 200832 - DNA, 25 bp, Rattus norvegicus
atgtcattgcgatatccctgggaga

SEQ ID NO: 200833 - DNA, 25 bp, Rattus norvegicus
atgtcattggctattcatgatcaaa

SEQ ID NO: 200834 - DNA, 25 bp, Rattus norvegicus
atgtcattggcttttcatgatcaaa

SEQ ID NO: 200835 - DNA, 25 bp, Rattus norvegicus
atgtcattgtttcctgaagtcacta

SEQ ID NO: 200836 - DNA, 25 bp, Rattus norvegicus
atgtcattgtttgctgaagtcacta

SEQ ID NO: 200837 - DNA, 25 bp, Rattus norvegicus
atgtcatttcccatacttcctagta

SEQ ID NO: 200838 - DNA, 25 bp, Rattus norvegicus
atgtcatttcccttacttcctagta

SEQ ID NO: 200839 - DNA, 25 bp, Rattus norvegicus
atgtcatttgctatttgtaccatga

SEQ ID NO: 200840 - DNA, 25 bp, Rattus norvegicus
atgtcatttgctttttgtaccatga

SEQ ID NO: 200841 - DNA, 25 bp, Rattus norvegicus
atgtcatttgggacagaggtcctcc

SEQ ID NO: 200842 - DNA, 25 bp, Rattus norvegicus
atgtcatttgggtcagaggtcctcc

SEQ ID NO: 200843 - DNA, 25 bp, Rattus norvegicus
atgtcatttgtaataagcccagatc

SEQ ID NO: 200844 - DNA, 25 bp, Rattus norvegicus
atgtcatttgtattaagcccagatc

SEQ ID NO: 200845 - DNA, 25 bp, Rattus norvegicus
atgtcattttgtaaagcagttatgc

SEQ ID NO: 200846 - DNA, 25 bp, Rattus norvegicus
atgtcattttgttaagcagttatgc

SEQ ID NO: 200847 - DNA, 25 bp, Rattus norvegicus
atgtccaaaggaagccacatggtgg

SEQ ID NO: 200848 - DNA, 25 bp, Rattus norvegicus
atgtccaaaggatgccacatggtgg

SEQ ID NO: 200849 - DNA, 25 bp, Rattus norvegicus
atgtccaaatccatgtagctctcaa

SEQ ID NO: 200850 - DNA, 25 bp, Rattus norvegicus
atgtccaaatccttgtagctctcaa

SEQ ID NO: 200851 - DNA, 25 bp, Rattus norvegicus
atgtccaaatttcaattttccaggg

SEQ ID NO: 200852 - DNA, 25 bp, Rattus norvegicus
atgtccaaatttgaattttccaggg

SEQ ID NO: 200853 - DNA, 25 bp, Rattus norvegicus
atgtccaacagcatgccgtggataa

SEQ ID NO: 200854 - DNA, 25 bp, Rattus norvegicus
atgtccaacagcttgccgtggataa

SEQ ID NO: 200855 - DNA, 25 bp, Rattus norvegicus
atgtccaactccatgaggtcagctt

SEQ ID NO: 200856 - DNA, 25 bp, Rattus norvegicus
atgtccaactccttgaggtcagctt

SEQ ID NO: 200857 - DNA, 25 bp, Rattus norvegicus
atgtccaagagtcttattcccttca

SEQ ID NO: 200858 - DNA, 25 bp, Rattus norvegicus
atgtccaagagtgttattcccttca

SEQ ID NO: 200859 - DNA, 25 bp, Rattus norvegicus
atgtccaagtcgactgtaaacctac

SEQ ID NO: 200860 - DNA, 25 bp, Rattus norvegicus
atgtccaagtcgtctgtaaacctac

SEQ ID NO: 200861 - DNA, 25 bp, Rattus norvegicus
atgtccaatcccagtgtgtttcaaa

SEQ ID NO: 200862 - DNA, 25 bp, Rattus norvegicus
atgtccaatccctgtgtgtttcaaa

SEQ ID NO: 200863 - DNA, 25 bp, Rattus norvegicus
atgtccaatggtccccacggtgagg

SEQ ID NO: 200864 - DNA, 25 bp, Rattus norvegicus
atgtccaatggtgcccacggtgagg

SEQ ID NO: 200865 - DNA, 25 bp, Rattus norvegicus
atgtccaattatagtctcattaagg

SEQ ID NO: 200866 - DNA, 25 bp, Rattus norvegicus
atgtccaattattgtctcattaagg

SEQ ID NO: 200867 - DNA, 25 bp, Rattus norvegicus
atgtccacaatgatgtgcctctggt

SEQ ID NO: 200868 - DNA, 25 bp, Rattus norvegicus
atgtccacaatgttgtgcctctggt

SEQ ID NO: 200869 - DNA, 25 bp, Rattus norvegicus
atgtccacactgctcttcaaataaa

SEQ ID NO: 200870 - DNA, 25 bp, Rattus norvegicus
atgtccacactggtcttcaaataaa

SEQ ID NO: 200871 - DNA, 25 bp, Rattus norvegicus
atgtccacagaaccagccacagaga

SEQ ID NO: 200872 - DNA, 25 bp, Rattus norvegicus
atgtccacagaagcagccacagaga

SEQ ID NO: 200873 - DNA, 25 bp, Rattus norvegicus
atgtccacagtccagcattgttgag

SEQ ID NO: 200874 - DNA, 25 bp, Rattus norvegicus
atgtccacagtcctcttaagtacag

SEQ ID NO: 200875 - DNA, 25 bp, Rattus norvegicus
atgtccacagtcgagcattgttgag

SEQ ID NO: 200876 - DNA, 25 bp, Rattus norvegicus
atgtccacagtcgtcttaagtacag

SEQ ID NO: 200877 - DNA, 25 bp, Rattus norvegicus
atgtccacagttaatttaacagtgt

SEQ ID NO: 200878 - DNA, 25 bp, Rattus norvegicus
atgtccacagtttatttaacagtgt

SEQ ID NO: 200879 - DNA, 25 bp, Rattus norvegicus
atgtccacatttacctgcttggata

SEQ ID NO: 200880 - DNA, 25 bp, Rattus norvegicus
atgtccacattttcctgcttggata

SEQ ID NO: 200881 - DNA, 25 bp, Rattus norvegicus
atgtccaccttaaattttgtattgt

SEQ ID NO: 200882 - DNA, 25 bp, Rattus norvegicus
atgtccaccttatattttgtattgt

SEQ ID NO: 200883 - DNA, 25 bp, Rattus norvegicus
atgtccaccttcagggagaagctga

SEQ ID NO: 200884 - DNA, 25 bp, Rattus norvegicus
atgtccaccttctgggagaagctga

SEQ ID NO: 200885 - DNA, 25 bp, Rattus norvegicus
atgtccacggaacagggcaaacctg

SEQ ID NO: 200886 - DNA, 25 bp, Rattus norvegicus
atgtccacggaagagggcaaacctg

SEQ ID NO: 200887 - DNA, 25 bp, Rattus norvegicus
atgtccacggagatcttgggatcac

SEQ ID NO: 200888 - DNA, 25 bp, Rattus norvegicus
atgtccacggagttcttgggatcac

SEQ ID NO: 200889 - DNA, 25 bp, Rattus norvegicus
atgtccacggcacctgcatgtctca

SEQ ID NO: 200890 - DNA, 25 bp, Rattus norvegicus
atgtccacggcagctgcatgtctca

SEQ ID NO: 200891 - DNA, 25 bp, Rattus norvegicus
atgtccactcacagaggaataaact

SEQ ID NO: 200892 - DNA, 25 bp, Rattus norvegicus
atgtccactcactgaggaataaact

SEQ ID NO: 200893 - DNA, 25 bp, Rattus norvegicus
atgtccactcgactccacaagggag

SEQ ID NO: 200894 - DNA, 25 bp, Rattus norvegicus
atgtccactcgagtccacaagggag

SEQ ID NO: 200895 - DNA, 25 bp, Rattus norvegicus
atgtccactgctagtgcagctagag

SEQ ID NO: 200896 - DNA, 25 bp, Rattus norvegicus
atgtccactgcttgtgcagctagag

SEQ ID NO: 200897 - DNA, 25 bp, Rattus norvegicus
atgtccactttcagtcctattctta

SEQ ID NO: 200898 - DNA, 25 bp, Rattus norvegicus
atgtccactttctgtcctattctta

SEQ ID NO: 200899 - DNA, 25 bp, Rattus norvegicus
atgtccagaaccattgcagagtgaa

SEQ ID NO: 200900 - DNA, 25 bp, Rattus norvegicus
atgtccagaacctttgcagagtgaa

SEQ ID NO: 200901 - DNA, 25 bp, Rattus norvegicus
atgtccagaaggcagcatgccatcc

SEQ ID NO: 200902 - DNA, 25 bp, Rattus norvegicus
atgtccagaagggagcatgccatcc

SEQ ID NO: 200903 - DNA, 25 bp, Rattus norvegicus
atgtccagacgccaaataacagcag

SEQ ID NO: 200904 - DNA, 25 bp, Rattus norvegicus
atgtccagacgcgaaataacagcag

SEQ ID NO: 200905 - DNA, 25 bp, Rattus norvegicus
atgtccagagtacatgggttgccac

SEQ ID NO: 200906 - DNA, 25 bp, Rattus norvegicus
atgtccagagtagatgggttgccac

SEQ ID NO: 200907 - DNA, 25 bp, Rattus norvegicus
atgtccagagttcggctgttcagaa

SEQ ID NO: 200908 - DNA, 25 bp, Rattus norvegicus
atgtccagagttgggctgttcagaa

SEQ ID NO: 200909 - DNA, 25 bp, Rattus norvegicus
atgtccagataacgctcatctcgga

SEQ ID NO: 200910 - DNA, 25 bp, Rattus norvegicus
atgtccagataaggctcatctcgga

SEQ ID NO: 200911 - DNA, 25 bp, Rattus norvegicus
atgtccagatgcagacggtgttgtc

SEQ ID NO: 200912 - DNA, 25 bp, Rattus norvegicus
atgtccagatgctgacggtgttgtc

SEQ ID NO: 200913 - DNA, 25 bp, Rattus norvegicus
atgtccagatgtccaccgattcatt

SEQ ID NO: 200914 - DNA, 25 bp, Rattus norvegicus
atgtccagatgtgcaccgattcatt

SEQ ID NO: 200915 - DNA, 25 bp, Rattus norvegicus
atgtccagcacgagcctcaagagca

SEQ ID NO: 200916 - DNA, 25 bp, Rattus norvegicus
atgtccagcacgtgcctcaagagca

SEQ ID NO: 200917 - DNA, 25 bp, Rattus norvegicus
atgtccagctcacaggaggcctcat

SEQ ID NO: 200918 - DNA, 25 bp, Rattus norvegicus
atgtccagctcagaggaggcctcat

SEQ ID NO: 200919 - DNA, 25 bp, Rattus norvegicus
atgtccagctccagttttaatagca

SEQ ID NO: 200920 - DNA, 25 bp, Rattus norvegicus
atgtccagctcctgttttaatagca

SEQ ID NO: 200921 - DNA, 25 bp, Rattus norvegicus
atgtccaggaagagggctccagtcc

SEQ ID NO: 200922 - DNA, 25 bp, Rattus norvegicus
atgtccaggaagtgggctccagtcc

SEQ ID NO: 200923 - DNA, 25 bp, Rattus norvegicus
atgtccagtgtaccctgacttcaga

SEQ ID NO: 200924 - DNA, 25 bp, Rattus norvegicus
atgtccagtgtagcctgacttcaga

SEQ ID NO: 200925 - DNA, 25 bp, Rattus norvegicus
atgtccatcgaaatcttccttaggc

SEQ ID NO: 200926 - DNA, 25 bp, Rattus norvegicus
atgtccatcgaattcttccttaggc

SEQ ID NO: 200927 - DNA, 25 bp, Rattus norvegicus
atgtccatgaagctgcgtcggtcct

SEQ ID NO: 200928 - DNA, 25 bp, Rattus norvegicus
atgtccatgaaggtgcgtcggtcct

SEQ ID NO: 200929 - DNA, 25 bp, Rattus norvegicus
atgtccatgacccagacacgggaac

SEQ ID NO: 200930 - DNA, 25 bp, Rattus norvegicus
atgtccatgaccgagacacgggaac

SEQ ID NO: 200931 - DNA, 25 bp, Rattus norvegicus
atgtccatgactctaaccccattga

SEQ ID NO: 200932 - DNA, 25 bp, Rattus norvegicus
atgtccatgactgtaaccccattga

SEQ ID NO: 200933 - DNA, 25 bp, Rattus norvegicus
atgtccatgagcatcgcaccacgga

SEQ ID NO: 200934 - DNA, 25 bp, Rattus norvegicus
atgtccatgagcttcgcaccacgga

SEQ ID NO: 200935 - DNA, 25 bp, Rattus norvegicus
atgtccatgcagcttgatatcgttg

SEQ ID NO: 200936 - DNA, 25 bp, Rattus norvegicus
atgtccatgcaggttgatatcgttg

SEQ ID NO: 200937 - DNA, 25 bp, Rattus norvegicus
atgtccatggcccagtagtacttag

SEQ ID NO: 200938 - DNA, 25 bp, Rattus norvegicus
atgtccatggccgagtagtacttag

SEQ ID NO: 200939 - DNA, 25 bp, Rattus norvegicus
atgtccatggtaatgtaagtctgcc

SEQ ID NO: 200940 - DNA, 25 bp, Rattus norvegicus
atgtccatggtattgtaagtctgcc

SEQ ID NO: 200941 - DNA, 25 bp, Rattus norvegicus
atgtccatggttacccttttattca

SEQ ID NO: 200942 - DNA, 25 bp, Rattus norvegicus
atgtccatggtttcccttttattca

SEQ ID NO: 200943 - DNA, 25 bp, Rattus norvegicus
atgtccattcatccaagctctgatc

SEQ ID NO: 200944 - DNA, 25 bp, Rattus norvegicus
atgtccattcatgcaagctctgatc

SEQ ID NO: 200945 - DNA, 25 bp, Rattus norvegicus
atgtccattgttaataagctgagaa

SEQ ID NO: 200946 - DNA, 25 bp, Rattus norvegicus
atgtccattgtttataagctgagaa

SEQ ID NO: 200947 - DNA, 25 bp, Rattus norvegicus
atgtccatttgcagaaggtaatcca

SEQ ID NO: 200948 - DNA, 25 bp, Rattus norvegicus
atgtccatttgctgaaggtaatcca

SEQ ID NO: 200949 - DNA, 25 bp, Rattus norvegicus
atgtcccaaagtcaagtggcagcca

SEQ ID NO: 200950 - DNA, 25 bp, Rattus norvegicus
atgtcccaaagtgaagtggcagcca

SEQ ID NO: 200951 - DNA, 25 bp, Rattus norvegicus
atgtcccaacaacctgttcagttta

SEQ ID NO: 200952 - DNA, 25 bp, Rattus norvegicus
atgtcccaacaagctgttcagttta

SEQ ID NO: 200953 - DNA, 25 bp, Rattus norvegicus
atgtcccacctgacttgttgatgac

SEQ ID NO: 200954 - DNA, 25 bp, Rattus norvegicus
atgtcccacctgcagtgttgtctag

SEQ ID NO: 200955 - DNA, 25 bp, Rattus norvegicus
atgtcccacctggagtgttgtctag

SEQ ID NO: 200956 - DNA, 25 bp, Rattus norvegicus
atgtcccacctgtcttgttgatgac

SEQ ID NO: 200957 - DNA, 25 bp, Rattus norvegicus
atgtcccaccttcacaggtctatat

SEQ ID NO: 200958 - DNA, 25 bp, Rattus norvegicus
atgtcccaccttgacaggtctatat

SEQ ID NO: 200959 - DNA, 25 bp, Rattus norvegicus
atgtcccacggcatcctggaaggaa

SEQ ID NO: 200960 - DNA, 25 bp, Rattus norvegicus
atgtcccacggcttcctggaaggaa

SEQ ID NO: 200961 - DNA, 25 bp, Rattus norvegicus
atgtcccactttccatctgggatgt

SEQ ID NO: 200962 - DNA, 25 bp, Rattus norvegicus
atgtcccactttgcatctgggatgt

SEQ ID NO: 200963 - DNA, 25 bp, Rattus norvegicus
atgtcccagaatctatcctctctaa

SEQ ID NO: 200964 - DNA, 25 bp, Rattus norvegicus
atgtcccagaatgtatcctctctaa

SEQ ID NO: 200965 - DNA, 25 bp, Rattus norvegicus
atgtcccaggacagggtgttaccca

SEQ ID NO: 200966 - DNA, 25 bp, Rattus norvegicus
atgtcccaggactgggtgttaccca

SEQ ID NO: 200967 - DNA, 25 bp, Rattus norvegicus
atgtcccatttcacctggttggtaa

SEQ ID NO: 200968 - DNA, 25 bp, Rattus norvegicus
atgtcccatttctcctggttggtaa

SEQ ID NO: 200969 - DNA, 25 bp, Rattus norvegicus
atgtccccaacacgtgggaagtgga

SEQ ID NO: 200970 - DNA, 25 bp, Rattus norvegicus
atgtccccaacaggtgggaagtgga

SEQ ID NO: 200971 - DNA, 25 bp, Rattus norvegicus
atgtccccaagaacgcttgattcta

SEQ ID NO: 200972 - DNA, 25 bp, Rattus norvegicus
atgtccccaagatcgcttgattcta

SEQ ID NO: 200973 - DNA, 25 bp, Rattus norvegicus
atgtccccaccaagcagatcagagg

SEQ ID NO: 200974 - DNA, 25 bp, Rattus norvegicus
atgtccccaccatgcagatcagagg

SEQ ID NO: 200975 - DNA, 25 bp, Rattus norvegicus
atgtccccacccaagatcaggaagt

SEQ ID NO: 200976 - DNA, 25 bp, Rattus norvegicus
atgtccccaccctagatcaggaagt

SEQ ID NO: 200977 - DNA, 25 bp, Rattus norvegicus
atgtccccacctcatggaagtgaga

SEQ ID NO: 200978 - DNA, 25 bp, Rattus norvegicus
atgtccccacctgatggaagtgaga

SEQ ID NO: 200979 - DNA, 25 bp, Rattus norvegicus
atgtccccagcaacttttatgtctg

SEQ ID NO: 200980 - DNA, 25 bp, Rattus norvegicus
atgtccccagcatcttttatgtctg

SEQ ID NO: 200981 - DNA, 25 bp, Rattus norvegicus
atgtccccagtgattacacatcctt

SEQ ID NO: 200982 - DNA, 25 bp, Rattus norvegicus
atgtccccagtgtttacacatcctt

SEQ ID NO: 200983 - DNA, 25 bp, Rattus norvegicus
atgtccccatggagatagcgtgaag

SEQ ID NO: 200984 - DNA, 25 bp, Rattus norvegicus
atgtccccatggtgatagcgtgaag

SEQ ID NO: 200985 - DNA, 25 bp, Rattus norvegicus
atgtccccatgtaacaatctgcagg

SEQ ID NO: 200986 - DNA, 25 bp, Rattus norvegicus
atgtccccatgtattctgcatacaa

SEQ ID NO: 200987 - DNA, 25 bp, Rattus norvegicus
atgtccccatgtctgtcagtgtatg

SEQ ID NO: 200988 - DNA, 25 bp, Rattus norvegicus
atgtccccatgtgtgtcagtgtatg

SEQ ID NO: 200989 - DNA, 25 bp, Rattus norvegicus
atgtccccatgttacaatctgcagg

SEQ ID NO: 200990 - DNA, 25 bp, Rattus norvegicus
atgtccccatgttttctgcatacaa

SEQ ID NO: 200991 - DNA, 25 bp, Rattus norvegicus
atgtccccgaagcaaccagatccga

SEQ ID NO: 200992 - DNA, 25 bp, Rattus norvegicus
atgtccccgaaggaaccagatccga

SEQ ID NO: 200993 - DNA, 25 bp, Rattus norvegicus
atgtccccgctacatattgactgtt

SEQ ID NO: 200994 - DNA, 25 bp, Rattus norvegicus
atgtccccgctagatattgactgtt

SEQ ID NO: 200995 - DNA, 25 bp, Rattus norvegicus
atgtccccgttgaacacagatatgg

SEQ ID NO: 200996 - DNA, 25 bp, Rattus norvegicus
atgtccccgttgtacacagatatgg

SEQ ID NO: 200997 - DNA, 25 bp, Rattus norvegicus
atgtcccctccaaggctgagcaaat

SEQ ID NO: 200998 - DNA, 25 bp, Rattus norvegicus
atgtcccctccatggctgagcaaat

SEQ ID NO: 200999 - DNA, 25 bp, Rattus norvegicus
atgtcccctgcgcagaacacgagga

SEQ ID NO: 201000 - DNA, 25 bp, Rattus norvegicus
atgtcccctgcggagaacacgagga

SEQ ID NO: 201001 - DNA, 25 bp, Rattus norvegicus
atgtccccttacagtctttatttat

SEQ ID NO: 201002 - DNA, 25 bp, Rattus norvegicus
atgtccccttactgtctttatttat

SEQ ID NO: 201003 - DNA, 25 bp, Rattus norvegicus
atgtccccttgtcctgaagaagcag

SEQ ID NO: 201004 - DNA, 25 bp, Rattus norvegicus
atgtccccttgtgctgaagaagcag

SEQ ID NO: 201005 - DNA, 25 bp, Rattus norvegicus
atgtcccgagacagccgtgtatgtg

SEQ ID NO: 201006 - DNA, 25 bp, Rattus norvegicus
atgtcccgagactgccgtgtatgtg

SEQ ID NO: 201007 - DNA, 25 bp, Rattus norvegicus
atgtcccgccgccaagtggaggacc

SEQ ID NO: 201008 - DNA, 25 bp, Rattus norvegicus
atgtcccgccgcgaagtggaggacc

SEQ ID NO: 201009 - DNA, 25 bp, Rattus norvegicus
atgtcccgcctcagtttacatgtta

SEQ ID NO: 201010 - DNA, 25 bp, Rattus norvegicus
atgtcccgcctctgtttacatgtta

SEQ ID NO: 201011 - DNA, 25 bp, Rattus norvegicus
atgtcccgctgtagtctggattgga

SEQ ID NO: 201012 - DNA, 25 bp, Rattus norvegicus
atgtcccgctgttgtctggattgga

SEQ ID NO: 201013 - DNA, 25 bp, Rattus norvegicus
atgtcccggaacagcctgcaacagg

SEQ ID NO: 201014 - DNA, 25 bp, Rattus norvegicus
atgtcccggaactgcctgcaacagg

SEQ ID NO: 201015 - DNA, 25 bp, Rattus norvegicus
atgtcccggtgtatccggtgggcac

SEQ ID NO: 201016 - DNA, 25 bp, Rattus norvegicus
atgtcccggtgtttccggtgggcac

SEQ ID NO: 201017 - DNA, 25 bp, Rattus norvegicus
atgtcccgttcaattcttcaaggag

SEQ ID NO: 201018 - DNA, 25 bp, Rattus norvegicus
atgtcccgttcatttcttcaaggag

SEQ ID NO: 201019 - DNA, 25 bp, Rattus norvegicus
atgtccctacagagtgtgttggcat

SEQ ID NO: 201020 - DNA, 25 bp, Rattus norvegicus
atgtccctacagtgtgtgttggcat

SEQ ID NO: 201021 - DNA, 25 bp, Rattus norvegicus
atgtccctatatctgctgcatttta

SEQ ID NO: 201022 - DNA, 25 bp, Rattus norvegicus
atgtccctatatgtgctgcatttta

SEQ ID NO: 201023 - DNA, 25 bp, Rattus norvegicus
atgtccctatgccttacgcaaagat

SEQ ID NO: 201024 - DNA, 25 bp, Rattus norvegicus
atgtccctatgcgttacgcaaagat

SEQ ID NO: 201025 - DNA, 25 bp, Rattus norvegicus
atgtccctcattatctgcagtggcc

SEQ ID NO: 201026 - DNA, 25 bp, Rattus norvegicus
atgtccctcattttctgcagtggcc

SEQ ID NO: 201027 - DNA, 25 bp, Rattus norvegicus
atgtccctcccaatcttctgtatat

SEQ ID NO: 201028 - DNA, 25 bp, Rattus norvegicus
atgtccctcccattcttctgtatat

SEQ ID NO: 201029 - DNA, 25 bp, Rattus norvegicus
atgtccctcctacttttcaatttat

SEQ ID NO: 201030 - DNA, 25 bp, Rattus norvegicus
atgtccctcctagttttcaatttat

SEQ ID NO: 201031 - DNA, 25 bp, Rattus norvegicus
atgtccctcctcctttaaagactct

SEQ ID NO: 201032 - DNA, 25 bp, Rattus norvegicus
atgtccctcctcgtttaaagactct

SEQ ID NO: 201033 - DNA, 25 bp, Rattus norvegicus
atgtccctcctgagagcattgatca

SEQ ID NO: 201034 - DNA, 25 bp, Rattus norvegicus
atgtccctcctgtgagcattgatca

SEQ ID NO: 201035 - DNA, 25 bp, Rattus norvegicus
atgtccctcgcactgatccgtggta

SEQ ID NO: 201036 - DNA, 25 bp, Rattus norvegicus
atgtccctcgcagtgatccgtggta

SEQ ID NO: 201037 - DNA, 25 bp, Rattus norvegicus
atgtccctctcactgtgatcaagtt

SEQ ID NO: 201038 - DNA, 25 bp, Rattus norvegicus
atgtccctctcagtgtgatcaagtt

SEQ ID NO: 201039 - DNA, 25 bp, Rattus norvegicus
atgtccctctgtatcactggctgaa

SEQ ID NO: 201040 - DNA, 25 bp, Rattus norvegicus
atgtccctctgtttcactggctgaa

SEQ ID NO: 201041 - DNA, 25 bp, Rattus norvegicus
atgtccctgacacttttcactgcag

SEQ ID NO: 201042 - DNA, 25 bp, Rattus norvegicus
atgtccctgacagttttcactgcag

SEQ ID NO: 201043 - DNA, 25 bp, Rattus norvegicus
atgtccctgaggacgagtatgtaaa

SEQ ID NO: 201044 - DNA, 25 bp, Rattus norvegicus
atgtccctgaggtcgagtatgtaaa

SEQ ID NO: 201045 - DNA, 25 bp, Rattus norvegicus
atgtccctgagtcctggttagtgtc

SEQ ID NO: 201046 - DNA, 25 bp, Rattus norvegicus
atgtccctgagtcttccgtgggaag

SEQ ID NO: 201047 - DNA, 25 bp, Rattus norvegicus
atgtccctgagtgctggttagtgtc

SEQ ID NO: 201048 - DNA, 25 bp, Rattus norvegicus
atgtccctgagtgttccgtgggaag

SEQ ID NO: 201049 - DNA, 25 bp, Rattus norvegicus
atgtccctgatacttaacacacgct

SEQ ID NO: 201050 - DNA, 25 bp, Rattus norvegicus
atgtccctgatagttaacacacgct

SEQ ID NO: 201051 - DNA, 25 bp, Rattus norvegicus
atgtccctgcctactgtaagtatct

SEQ ID NO: 201052 - DNA, 25 bp, Rattus norvegicus
atgtccctgccttctgtaagtatct

SEQ ID NO: 201053 - DNA, 25 bp, Rattus norvegicus
atgtccctgcttctgtatggccaga

SEQ ID NO: 201054 - DNA, 25 bp, Rattus norvegicus
atgtccctgcttgtgtatggccaga

SEQ ID NO: 201055 - DNA, 25 bp, Rattus norvegicus
atgtccctggagacgcgccaatcaa

SEQ ID NO: 201056 - DNA, 25 bp, Rattus norvegicus
atgtccctggagtcgcgccaatcaa

SEQ ID NO: 201057 - DNA, 25 bp, Rattus norvegicus
atgtccctggcaattgttcagagca

SEQ ID NO: 201058 - DNA, 25 bp, Rattus norvegicus
atgtccctggcatttgttcagagca

SEQ ID NO: 201059 - DNA, 25 bp, Rattus norvegicus
atgtccctgggtacagatttgtcca

SEQ ID NO: 201060 - DNA, 25 bp, Rattus norvegicus
atgtccctgggtattatttactcaa

SEQ ID NO: 201061 - DNA, 25 bp, Rattus norvegicus
atgtccctgggttcagatttgtcca

SEQ ID NO: 201062 - DNA, 25 bp, Rattus norvegicus
atgtccctgggttttatttactcaa

SEQ ID NO: 201063 - DNA, 25 bp, Rattus norvegicus
atgtccctgtacagaactctgaaag

SEQ ID NO: 201064 - DNA, 25 bp, Rattus norvegicus
atgtccctgtactgaactctgaaag

SEQ ID NO: 201065 - DNA, 25 bp, Rattus norvegicus
atgtcccttaacaacattgctatgg

SEQ ID NO: 201066 - DNA, 25 bp, Rattus norvegicus
atgtcccttaactacattgctatgg

SEQ ID NO: 201067 - DNA, 25 bp, Rattus norvegicus
atgtcccttagtatgttgtggcaca

SEQ ID NO: 201068 - DNA, 25 bp, Rattus norvegicus
atgtcccttagtttgttgtggcaca

SEQ ID NO: 201069 - DNA, 25 bp, Rattus norvegicus
atgtcccttgacatacagtagttca

SEQ ID NO: 201070 - DNA, 25 bp, Rattus norvegicus
atgtcccttgacttacagtagttca

SEQ ID NO: 201071 - DNA, 25 bp, Rattus norvegicus
atgtcccttgagaaacgtggtccta

SEQ ID NO: 201072 - DNA, 25 bp, Rattus norvegicus
atgtcccttgagtaacgtggtccta

SEQ ID NO: 201073 - DNA, 25 bp, Rattus norvegicus
atgtccgaagacaacaacgactcca

SEQ ID NO: 201074 - DNA, 25 bp, Rattus norvegicus
atgtccgaagactacaacgactcca

SEQ ID NO: 201075 - DNA, 25 bp, Rattus norvegicus
atgtccgaagagcaaccagccctag

SEQ ID NO: 201076 - DNA, 25 bp, Rattus norvegicus
atgtccgaagaggaaccagccctag

SEQ ID NO: 201077 - DNA, 25 bp, Rattus norvegicus
atgtccgaatccaggcttcatggaa

SEQ ID NO: 201078 - DNA, 25 bp, Rattus norvegicus
atgtccgaatcctggcttcatggaa

SEQ ID NO: 201079 - DNA, 25 bp, Rattus norvegicus
atgtccgacattaaactctggtgcg

SEQ ID NO: 201080 - DNA, 25 bp, Rattus norvegicus
atgtccgacatttaactctggtgcg

SEQ ID NO: 201081 - DNA, 25 bp, Rattus norvegicus
atgtccgactacaaactgcccatgg

SEQ ID NO: 201082 - DNA, 25 bp, Rattus norvegicus
atgtccgactactaactgcccatgg

SEQ ID NO: 201083 - DNA, 25 bp, Rattus norvegicus
atgtccgcagctagatttaaaagtc

SEQ ID NO: 201084 - DNA, 25 bp, Rattus norvegicus
atgtccgcagcttgatttaaaagtc

SEQ ID NO: 201085 - DNA, 25 bp, Rattus norvegicus
atgtccgcgagactgaactttccag

SEQ ID NO: 201086 - DNA, 25 bp, Rattus norvegicus
atgtccgcgagagtgaactttccag

SEQ ID NO: 201087 - DNA, 25 bp, Rattus norvegicus
atgtccgcgcatctgcaatggatgg

SEQ ID NO: 201088 - DNA, 25 bp, Rattus norvegicus
atgtccgcgcatgtgcaatggatgg

SEQ ID NO: 201089 - DNA, 25 bp, Rattus norvegicus
atgtccgcggaactccccgaggcag

SEQ ID NO: 201090 - DNA, 25 bp, Rattus norvegicus
atgtccgcggaagtccccgaggcag

SEQ ID NO: 201091 - DNA, 25 bp, Rattus norvegicus
atgtccgcgtctcgttgggcttgaa

SEQ ID NO: 201092 - DNA, 25 bp, Rattus norvegicus
atgtccgcgtctggttgggcttgaa

SEQ ID NO: 201093 - DNA, 25 bp, Rattus norvegicus
atgtccgctcttcgttgccatgtat

SEQ ID NO: 201094 - DNA, 25 bp, Rattus norvegicus
atgtccgctcttggttgccatgtat

SEQ ID NO: 201095 - DNA, 25 bp, Rattus norvegicus
atgtccggtgtcatttcagaataca

SEQ ID NO: 201096 - DNA, 25 bp, Rattus norvegicus
atgtccggtgtcttttcagaataca

SEQ ID NO: 201097 - DNA, 25 bp, Rattus norvegicus
atgtccgtcaaccacgaggaactgg

SEQ ID NO: 201098 - DNA, 25 bp, Rattus norvegicus
atgtccgtcaacgacgaggaactgg

SEQ ID NO: 201099 - DNA, 25 bp, Rattus norvegicus
atgtccgtgaagaccctggaggtga

SEQ ID NO: 201100 - DNA, 25 bp, Rattus norvegicus
atgtccgtgaagtccctggaggtga

SEQ ID NO: 201101 - DNA, 25 bp, Rattus norvegicus
atgtccgtgcaaagtggtatcctga

SEQ ID NO: 201102 - DNA, 25 bp, Rattus norvegicus
atgtccgtgcaatgtggtatcctga

SEQ ID NO: 201103 - DNA, 25 bp, Rattus norvegicus
atgtccgttggtcatgggctctcct

SEQ ID NO: 201104 - DNA, 25 bp, Rattus norvegicus
atgtccgttggtgatgggctctcct

SEQ ID NO: 201105 - DNA, 25 bp, Rattus norvegicus
atgtccgtttgactggtcattgcag

SEQ ID NO: 201106 - DNA, 25 bp, Rattus norvegicus
atgtccgtttgagtggtcattgcag

SEQ ID NO: 201107 - DNA, 25 bp, Rattus norvegicus
atgtcctaaaaccttccagaactga

SEQ ID NO: 201108 - DNA, 25 bp, Rattus norvegicus
atgtcctaaaacgttccagaactga

SEQ ID NO: 201109 - DNA, 25 bp, Rattus norvegicus
atgtcctaaagcattcctgagtgcc

SEQ ID NO: 201110 - DNA, 25 bp, Rattus norvegicus
atgtcctaaagctttcctgagtgcc

SEQ ID NO: 201111 - DNA, 25 bp, Rattus norvegicus
atgtcctaactaacttcaatccctg

SEQ ID NO: 201112 - DNA, 25 bp, Rattus norvegicus
atgtcctaactatcttcaatccctg

SEQ ID NO: 201113 - DNA, 25 bp, Rattus norvegicus
atgtcctaactgaacatttccttcc

SEQ ID NO: 201114 - DNA, 25 bp, Rattus norvegicus
atgtcctaactgtacatttccttcc

SEQ ID NO: 201115 - DNA, 25 bp, Rattus norvegicus
atgtcctaaggacctacacctggaa

SEQ ID NO: 201116 - DNA, 25 bp, Rattus norvegicus
atgtcctaaggagctacacctggaa

SEQ ID NO: 201117 - DNA, 25 bp, Rattus norvegicus
atgtcctacagcaattctgcgctca

SEQ ID NO: 201118 - DNA, 25 bp, Rattus norvegicus
atgtcctacagctattctgcgctca

SEQ ID NO: 201119 - DNA, 25 bp, Rattus norvegicus
atgtcctaccgcaagcagggtgagc

SEQ ID NO: 201120 - DNA, 25 bp, Rattus norvegicus
atgtcctaccgctagcagggtgagc

SEQ ID NO: 201121 - DNA, 25 bp, Rattus norvegicus
atgtcctacctaagaaaggcctcac

SEQ ID NO: 201122 - DNA, 25 bp, Rattus norvegicus
atgtcctacctatgaaaggcctcac

SEQ ID NO: 201123 - DNA, 25 bp, Rattus norvegicus
atgtcctactctctgactatagcag

SEQ ID NO: 201124 - DNA, 25 bp, Rattus norvegicus
atgtcctactctgtgactatagcag

SEQ ID NO: 201125 - DNA, 25 bp, Rattus norvegicus
atgtcctagtcccagagcttagttt

SEQ ID NO: 201126 - DNA, 25 bp, Rattus norvegicus
atgtcctagtccgagagcttagttt

SEQ ID NO: 201127 - DNA, 25 bp, Rattus norvegicus
atgtcctatggcatctgtgctttca

SEQ ID NO: 201128 - DNA, 25 bp, Rattus norvegicus
atgtcctatggcttctgtgctttca

SEQ ID NO: 201129 - DNA, 25 bp, Rattus norvegicus
atgtcctatgttccccgtggtttac

SEQ ID NO: 201130 - DNA, 25 bp, Rattus norvegicus
atgtcctatgttgcccgtggtttac

SEQ ID NO: 201131 - DNA, 25 bp, Rattus norvegicus
atgtcctcaaggagttagcaagact

SEQ ID NO: 201132 - DNA, 25 bp, Rattus norvegicus
atgtcctcaaggtgttagcaagact

SEQ ID NO: 201133 - DNA, 25 bp, Rattus norvegicus
atgtcctcacaaaaggccctggtgt

SEQ ID NO: 201134 - DNA, 25 bp, Rattus norvegicus
atgtcctcacaataggccctggtgt

SEQ ID NO: 201135 - DNA, 25 bp, Rattus norvegicus
atgtcctcacccatccatatagatt

SEQ ID NO: 201136 - DNA, 25 bp, Rattus norvegicus
atgtcctcacccttccatatagatt

SEQ ID NO: 201137 - DNA, 25 bp, Rattus norvegicus
atgtcctcacgcagcatctgaatgt

SEQ ID NO: 201138 - DNA, 25 bp, Rattus norvegicus
atgtcctcacgctgcatctgaatgt

SEQ ID NO: 201139 - DNA, 25 bp, Rattus norvegicus
atgtcctcagccacttgtgaggcca

SEQ ID NO: 201140 - DNA, 25 bp, Rattus norvegicus
atgtcctcagcctcttgtgaggcca

SEQ ID NO: 201141 - DNA, 25 bp, Rattus norvegicus
atgtcctcaggcagtggcggttcac

SEQ ID NO: 201142 - DNA, 25 bp, Rattus norvegicus
atgtcctcaggctgtggcggttcac

SEQ ID NO: 201143 - DNA, 25 bp, Rattus norvegicus
atgtcctcagtgaatagcgaccctc

SEQ ID NO: 201144 - DNA, 25 bp, Rattus norvegicus
atgtcctcagtgtatagcgaccctc

SEQ ID NO: 201145 - DNA, 25 bp, Rattus norvegicus
atgtcctcatcacctgtgcaacttg

SEQ ID NO: 201146 - DNA, 25 bp, Rattus norvegicus
atgtcctcatcagctgtgcaacttg

SEQ ID NO: 201147 - DNA, 25 bp, Rattus norvegicus
atgtcctcatctaccagtgcctcat

SEQ ID NO: 201148 - DNA, 25 bp, Rattus norvegicus
atgtcctcatcttccagtgcctcat

SEQ ID NO: 201149 - DNA, 25 bp, Rattus norvegicus
atgtcctccatcagcatggacggat

SEQ ID NO: 201150 - DNA, 25 bp, Rattus norvegicus
atgtcctccatcatgttgtgtggca

SEQ ID NO: 201151 - DNA, 25 bp, Rattus norvegicus
atgtcctccatctgcatggacggat

SEQ ID NO: 201152 - DNA, 25 bp, Rattus norvegicus
atgtcctccatcttgttgtgtggca

SEQ ID NO: 201153 - DNA, 25 bp, Rattus norvegicus
atgtcctcccgtcggacgctagagg

SEQ ID NO: 201154 - DNA, 25 bp, Rattus norvegicus
atgtcctcccgtgggacgctagagg

SEQ ID NO: 201155 - DNA, 25 bp, Rattus norvegicus
atgtcctccgagaagtggcaccaga

SEQ ID NO: 201156 - DNA, 25 bp, Rattus norvegicus
atgtcctccgagtagtggcaccaga

SEQ ID NO: 201157 - DNA, 25 bp, Rattus norvegicus
atgtcctcctgaccaggaactggaa

SEQ ID NO: 201158 - DNA, 25 bp, Rattus norvegicus
atgtcctcctgagcaggaactggaa

SEQ ID NO: 201159 - DNA, 25 bp, Rattus norvegicus
atgtcctcgacacccagggagctga

SEQ ID NO: 201160 - DNA, 25 bp, Rattus norvegicus
atgtcctcgacagccagggagctga

SEQ ID NO: 201161 - DNA, 25 bp, Rattus norvegicus
atgtcctcgactcggaaagttttca

SEQ ID NO: 201162 - DNA, 25 bp, Rattus norvegicus
atgtcctcgactgggaaagttttca

SEQ ID NO: 201163 - DNA, 25 bp, Rattus norvegicus
atgtcctcggttcccagtggtgttg

SEQ ID NO: 201164 - DNA, 25 bp, Rattus norvegicus
atgtcctcggttgccagtggtgttg

SEQ ID NO: 201165 - DNA, 25 bp, Rattus norvegicus
atgtcctcgtctcagacacttgttt

SEQ ID NO: 201166 - DNA, 25 bp, Rattus norvegicus
atgtcctcgtctgagacacttgttt

SEQ ID NO: 201167 - DNA, 25 bp, Rattus norvegicus
atgtcctctacaacagaggtgtcga

SEQ ID NO: 201168 - DNA, 25 bp, Rattus norvegicus
atgtcctctacatcagaggtgtcga

SEQ ID NO: 201169 - DNA, 25 bp, Rattus norvegicus
atgtcctctcacagtctctggagaa

SEQ ID NO: 201170 - DNA, 25 bp, Rattus norvegicus
atgtcctctcactgtctctggagaa

SEQ ID NO: 201171 - DNA, 25 bp, Rattus norvegicus
atgtcctctcagaccacaacatgta

SEQ ID NO: 201172 - DNA, 25 bp, Rattus norvegicus
atgtcctctcagtccacaacatgta

SEQ ID NO: 201173 - DNA, 25 bp, Rattus norvegicus
atgtcctctctcagtggtcctttag

SEQ ID NO: 201174 - DNA, 25 bp, Rattus norvegicus
atgtcctctctctgtggtcctttag

SEQ ID NO: 201175 - DNA, 25 bp, Rattus norvegicus
atgtcctctctgaagggctgaagtc

SEQ ID NO: 201176 - DNA, 25 bp, Rattus norvegicus
atgtcctctctgtagggctgaagtc

SEQ ID NO: 201177 - DNA, 25 bp, Rattus norvegicus
atgtcctctgcacaatcactatgaa

SEQ ID NO: 201178 - DNA, 25 bp, Rattus norvegicus
atgtcctctgcagaatcactatgaa

SEQ ID NO: 201179 - DNA, 25 bp, Rattus norvegicus
atgtcctcttgcactgtcaagctat

SEQ ID NO: 201180 - DNA, 25 bp, Rattus norvegicus
atgtcctcttgctctgtcaagctat

SEQ ID NO: 201181 - DNA, 25 bp, Rattus norvegicus
atgtcctcttggactaatgtgttga

SEQ ID NO: 201182 - DNA, 25 bp, Rattus norvegicus
atgtcctcttggtctaatgtgttga

SEQ ID NO: 201183 - DNA, 25 bp, Rattus norvegicus
atgtcctgaaagctcatccatgctt

SEQ ID NO: 201184 - DNA, 25 bp, Rattus norvegicus
atgtcctgaaaggtcatccatgctt

SEQ ID NO: 201185 - DNA, 25 bp, Rattus norvegicus
atgtcctgaattactcgaccttgaa

SEQ ID NO: 201186 - DNA, 25 bp, Rattus norvegicus
atgtcctgaattcgtgttgtgctga

SEQ ID NO: 201187 - DNA, 25 bp, Rattus norvegicus
atgtcctgaattggtgttgtgctga

SEQ ID NO: 201188 - DNA, 25 bp, Rattus norvegicus
atgtcctgaatttctcgaccttgaa

SEQ ID NO: 201189 - DNA, 25 bp, Rattus norvegicus
atgtcctgactcaaggaaatggctc

SEQ ID NO: 201190 - DNA, 25 bp, Rattus norvegicus
atgtcctgactctaggaaatggctc

SEQ ID NO: 201191 - DNA, 25 bp, Rattus norvegicus
atgtcctgaggactgttgctgaaat

SEQ ID NO: 201192 - DNA, 25 bp, Rattus norvegicus
atgtcctgaggagtgttgctgaaat

SEQ ID NO: 201193 - DNA, 25 bp, Rattus norvegicus
atgtcctgcattatgtgaaatactc

SEQ ID NO: 201194 - DNA, 25 bp, Rattus norvegicus
atgtcctgcattttgtgaaatactc

SEQ ID NO: 201195 - DNA, 25 bp, Rattus norvegicus
atgtcctgccaaagccagtgggttt

SEQ ID NO: 201196 - DNA, 25 bp, Rattus norvegicus
atgtcctgccaactagtagccagca

SEQ ID NO: 201197 - DNA, 25 bp, Rattus norvegicus
atgtcctgccaagtagtagccagca

SEQ ID NO: 201198 - DNA, 25 bp, Rattus norvegicus
atgtcctgccaatgccagtgggttt

SEQ ID NO: 201199 - DNA, 25 bp, Rattus norvegicus
atgtcctgccatattattctttccc

SEQ ID NO: 201200 - DNA, 25 bp, Rattus norvegicus
atgtcctgccattttattctttccc

SEQ ID NO: 201201 - DNA, 25 bp, Rattus norvegicus
atgtcctgcctcagctgcgggatct

SEQ ID NO: 201202 - DNA, 25 bp, Rattus norvegicus
atgtcctgcctctgctgcgggatct

SEQ ID NO: 201203 - DNA, 25 bp, Rattus norvegicus
atgtcctgctatccttgagggtcct

SEQ ID NO: 201204 - DNA, 25 bp, Rattus norvegicus
atgtcctgctatgcttgagggtcct

SEQ ID NO: 201205 - DNA, 25 bp, Rattus norvegicus
atgtcctggagaaagccttcctcag

SEQ ID NO: 201206 - DNA, 25 bp, Rattus norvegicus
atgtcctggagatagccttcctcag

SEQ ID NO: 201207 - DNA, 25 bp, Rattus norvegicus
atgtcctggtctcgccttggtgaga

SEQ ID NO: 201208 - DNA, 25 bp, Rattus norvegicus
atgtcctggtctggccttggtgaga

SEQ ID NO: 201209 - DNA, 25 bp, Rattus norvegicus
atgtcctgtcaacaattcgtatagt

SEQ ID NO: 201210 - DNA, 25 bp, Rattus norvegicus
atgtcctgtcaagaattcgtatagt

SEQ ID NO: 201211 - DNA, 25 bp, Rattus norvegicus
atgtcctgtccaatctcagtctaat

SEQ ID NO: 201212 - DNA, 25 bp, Rattus norvegicus
atgtcctgtccattctcagtctaat

SEQ ID NO: 201213 - DNA, 25 bp, Rattus norvegicus
atgtcctgtgctaacgttttctgta

SEQ ID NO: 201214 - DNA, 25 bp, Rattus norvegicus
atgtcctgtgcttacgttttctgta

SEQ ID NO: 201215 - DNA, 25 bp, Rattus norvegicus
atgtcctgtgttctcagggagccaa

SEQ ID NO: 201216 - DNA, 25 bp, Rattus norvegicus
atgtcctgtgttgtcagggagccaa

SEQ ID NO: 201217 - DNA, 25 bp, Rattus norvegicus
atgtcctgttgtaatatgcctcttc

SEQ ID NO: 201218 - DNA, 25 bp, Rattus norvegicus
atgtcctgttgtctaaatccgatcc

SEQ ID NO: 201219 - DNA, 25 bp, Rattus norvegicus
atgtcctgttgtgtaaatccgatcc

SEQ ID NO: 201220 - DNA, 25 bp, Rattus norvegicus
atgtcctgttgttatatgcctcttc

SEQ ID NO: 201221 - DNA, 25 bp, Rattus norvegicus
atgtcctgtttcaccttagtgtgga

SEQ ID NO: 201222 - DNA, 25 bp, Rattus norvegicus
atgtcctgtttctccttagtgtgga

SEQ ID NO: 201223 - DNA, 25 bp, Rattus norvegicus
atgtccttaaagaatctcccctttg

SEQ ID NO: 201224 - DNA, 25 bp, Rattus norvegicus
atgtccttaaagtatctcccctttg

SEQ ID NO: 201225 - DNA, 25 bp, Rattus norvegicus
atgtccttaagcctgtcagcagtga

SEQ ID NO: 201226 - DNA, 25 bp, Rattus norvegicus
atgtccttaagcgtgtcagcagtga

SEQ ID NO: 201227 - DNA, 25 bp, Rattus norvegicus
atgtccttacagacactgtcctata

SEQ ID NO: 201228 - DNA, 25 bp, Rattus norvegicus
atgtccttacagtcactgtcctata

SEQ ID NO: 201229 - DNA, 25 bp, Rattus norvegicus
atgtccttacataccaatagccagc

SEQ ID NO: 201230 - DNA, 25 bp, Rattus norvegicus
atgtccttacatctctctactccat

SEQ ID NO: 201231 - DNA, 25 bp, Rattus norvegicus
atgtccttacatgtctctactccat

SEQ ID NO: 201232 - DNA, 25 bp, Rattus norvegicus
atgtccttacattccaatagccagc

SEQ ID NO: 201233 - DNA, 25 bp, Rattus norvegicus
atgtccttactgacccctgatataa

SEQ ID NO: 201234 - DNA, 25 bp, Rattus norvegicus
atgtccttactgtcccctgatataa

SEQ ID NO: 201235 - DNA, 25 bp, Rattus norvegicus
atgtccttatacctctaaagtccct

SEQ ID NO: 201236 - DNA, 25 bp, Rattus norvegicus
atgtccttatacgtctaaagtccct

SEQ ID NO: 201237 - DNA, 25 bp, Rattus norvegicus
atgtccttcactacagtgccttaga

SEQ ID NO: 201238 - DNA, 25 bp, Rattus norvegicus
atgtccttcacttcagtgccttaga

SEQ ID NO: 201239 - DNA, 25 bp, Rattus norvegicus
atgtccttcagcagatgacagtccc

SEQ ID NO: 201240 - DNA, 25 bp, Rattus norvegicus
atgtccttcagctgatgacagtccc

SEQ ID NO: 201241 - DNA, 25 bp, Rattus norvegicus
atgtccttcatgaccgtctgcagca

SEQ ID NO: 201242 - DNA, 25 bp, Rattus norvegicus
atgtccttcatgatggctccaaggt

SEQ ID NO: 201243 - DNA, 25 bp, Rattus norvegicus
atgtccttcatgtccgtctgcagca

SEQ ID NO: 201244 - DNA, 25 bp, Rattus norvegicus
atgtccttcatgttggctccaaggt

SEQ ID NO: 201245 - DNA, 25 bp, Rattus norvegicus
atgtccttcccactaaagcattctg

SEQ ID NO: 201246 - DNA, 25 bp, Rattus norvegicus
atgtccttcccagtaaagcattctg

SEQ ID NO: 201247 - DNA, 25 bp, Rattus norvegicus
atgtccttcgtacattgtttttcca

SEQ ID NO: 201248 - DNA, 25 bp, Rattus norvegicus
atgtccttcgtagattgtttttcca

SEQ ID NO: 201249 - DNA, 25 bp, Rattus norvegicus
atgtccttctagaactttccaagtc

SEQ ID NO: 201250 - DNA, 25 bp, Rattus norvegicus
atgtccttctagtactttccaagtc

SEQ ID NO: 201251 - DNA, 25 bp, Rattus norvegicus
atgtccttctgaaagccttacgtgt

SEQ ID NO: 201252 - DNA, 25 bp, Rattus norvegicus
atgtccttctgatagccttacgtgt

SEQ ID NO: 201253 - DNA, 25 bp, Rattus norvegicus
atgtccttctttcggatcctccaga

SEQ ID NO: 201254 - DNA, 25 bp, Rattus norvegicus
atgtccttctttgggatcctccaga

SEQ ID NO: 201255 - DNA, 25 bp, Rattus norvegicus
atgtccttgaccctgggccacttac

SEQ ID NO: 201256 - DNA, 25 bp, Rattus norvegicus
atgtccttgaccgtgggccacttac

SEQ ID NO: 201257 - DNA, 25 bp, Rattus norvegicus
atgtccttgatgaacagctggcctt

SEQ ID NO: 201258 - DNA, 25 bp, Rattus norvegicus
atgtccttgatgtacagctggcctt

SEQ ID NO: 201259 - DNA, 25 bp, Rattus norvegicus
atgtccttgcaaacccagaactcag

SEQ ID NO: 201260 - DNA, 25 bp, Rattus norvegicus
atgtccttgcaatcccagaactcag

SEQ ID NO: 201261 - DNA, 25 bp, Rattus norvegicus
atgtccttgcctagtttttcagttt

SEQ ID NO: 201262 - DNA, 25 bp, Rattus norvegicus
atgtccttgccttgtttttcagttt

SEQ ID NO: 201263 - DNA, 25 bp, Rattus norvegicus
atgtccttgtctctgaactgctgaa

SEQ ID NO: 201264 - DNA, 25 bp, Rattus norvegicus
atgtccttgtctgtgaactgctgaa

SEQ ID NO: 201265 - DNA, 25 bp, Rattus norvegicus
atgtccttgtgcaacctgaagtctg

SEQ ID NO: 201266 - DNA, 25 bp, Rattus norvegicus
atgtccttgtgcagtttttactgaa

SEQ ID NO: 201267 - DNA, 25 bp, Rattus norvegicus
atgtccttgtgctacctgaagtctg

SEQ ID NO: 201268 - DNA, 25 bp, Rattus norvegicus
atgtccttgtgctgtttttactgaa

SEQ ID NO: 201269 - DNA, 25 bp, Rattus norvegicus
atgtccttgttcctgcgtttaatgg

SEQ ID NO: 201270 - DNA, 25 bp, Rattus norvegicus
atgtccttgttcgtgcgtttaatgg

SEQ ID NO: 201271 - DNA, 25 bp, Rattus norvegicus
atgtccttgttgaactatcctggta

SEQ ID NO: 201272 - DNA, 25 bp, Rattus norvegicus
atgtccttgttgtactatcctggta

SEQ ID NO: 201273 - DNA, 25 bp, Rattus norvegicus
atgtcctttatgaaggccaccagca

SEQ ID NO: 201274 - DNA, 25 bp, Rattus norvegicus
atgtcctttatgtaggccaccagca

SEQ ID NO: 201275 - DNA, 25 bp, Rattus norvegicus
atgtcctttgagatagtgcagattc

SEQ ID NO: 201276 - DNA, 25 bp, Rattus norvegicus
atgtcctttgagttagtgcagattc

SEQ ID NO: 201277 - DNA, 25 bp, Rattus norvegicus
atgtcctttggcaccctgtgcatta

SEQ ID NO: 201278 - DNA, 25 bp, Rattus norvegicus
atgtcctttggctccctgtgcatta

SEQ ID NO: 201279 - DNA, 25 bp, Rattus norvegicus
atgtcctttttcattgatgatgtgg

SEQ ID NO: 201280 - DNA, 25 bp, Rattus norvegicus
atgtcctttttctttgatgatgtgg

SEQ ID NO: 201281 - DNA, 25 bp, Rattus norvegicus
atgtcgaatctcagaggtgacccac

SEQ ID NO: 201282 - DNA, 25 bp, Rattus norvegicus
atgtcgaatctctgaggtgacccac

SEQ ID NO: 201283 - DNA, 25 bp, Rattus norvegicus
atgtcgaatgctcaagagccctctc

SEQ ID NO: 201284 - DNA, 25 bp, Rattus norvegicus
atgtcgaatgctgaagagccctctc

SEQ ID NO: 201285 - DNA, 25 bp, Rattus norvegicus
atgtcgaattgccagtccttcaatc

SEQ ID NO: 201286 - DNA, 25 bp, Rattus norvegicus
atgtcgaattgcgagtccttcaatc

SEQ ID NO: 201287 - DNA, 25 bp, Rattus norvegicus
atgtcgacagaccaatccttgatgt

SEQ ID NO: 201288 - DNA, 25 bp, Rattus norvegicus
atgtcgacagacgaatccttgatgt

SEQ ID NO: 201289 - DNA, 25 bp, Rattus norvegicus
atgtcgacccataggttgtctttag

SEQ ID NO: 201290 - DNA, 25 bp, Rattus norvegicus
atgtcgacccattggttgtctttag

SEQ ID NO: 201291 - DNA, 25 bp, Rattus norvegicus
atgtcgaggtacatgttccaccacg

SEQ ID NO: 201292 - DNA, 25 bp, Rattus norvegicus
atgtcgaggtacttgttccaccacg

SEQ ID NO: 201293 - DNA, 25 bp, Rattus norvegicus
atgtcgaggtctatgatccacttag

SEQ ID NO: 201294 - DNA, 25 bp, Rattus norvegicus
atgtcgaggtctttgatccacttag

SEQ ID NO: 201295 - DNA, 25 bp, Rattus norvegicus
atgtcgatattgctacgttccacac

SEQ ID NO: 201296 - DNA, 25 bp, Rattus norvegicus
atgtcgatattggtacgttccacac

SEQ ID NO: 201297 - DNA, 25 bp, Rattus norvegicus
atgtcgatcctgacaacaaggtctt

SEQ ID NO: 201298 - DNA, 25 bp, Rattus norvegicus
atgtcgatcctgtcaacaaggtctt

SEQ ID NO: 201299 - DNA, 25 bp, Rattus norvegicus
atgtcgatggctaatctgtgggtgc

SEQ ID NO: 201300 - DNA, 25 bp, Rattus norvegicus
atgtcgatggcttatctgtgggtgc

SEQ ID NO: 201301 - DNA, 25 bp, Rattus norvegicus
atgtcgcatctgctagccaaggctg

SEQ ID NO: 201302 - DNA, 25 bp, Rattus norvegicus
atgtcgcatctggtagccaaggctg

SEQ ID NO: 201303 - DNA, 25 bp, Rattus norvegicus
atgtcgccatatcctgtatagtgat

SEQ ID NO: 201304 - DNA, 25 bp, Rattus norvegicus
atgtcgccatatgctgtatagtgat

SEQ ID NO: 201305 - DNA, 25 bp, Rattus norvegicus
atgtcgccattgctttgcccagtgg

SEQ ID NO: 201306 - DNA, 25 bp, Rattus norvegicus
atgtcgccattggtttgcccagtgg

SEQ ID NO: 201307 - DNA, 25 bp, Rattus norvegicus
atgtcgcccctgagatgcatatata

SEQ ID NO: 201308 - DNA, 25 bp, Rattus norvegicus
atgtcgcccctgtgatgcatatata

SEQ ID NO: 201309 - DNA, 25 bp, Rattus norvegicus
atgtcgccgggaaggatgttttgcc

SEQ ID NO: 201310 - DNA, 25 bp, Rattus norvegicus
atgtcgccgggatggatgttttgcc

SEQ ID NO: 201311 - DNA, 25 bp, Rattus norvegicus
atgtcgccttttcggagcctgtttc

SEQ ID NO: 201312 - DNA, 25 bp, Rattus norvegicus
atgtcgccttttgggagcctgtttc

SEQ ID NO: 201313 - DNA, 25 bp, Rattus norvegicus
atgtcgcggcggaaatagtaacgta

SEQ ID NO: 201314 - DNA, 25 bp, Rattus norvegicus
atgtcgcggcggtaatagtaacgta

SEQ ID NO: 201315 - DNA, 25 bp, Rattus norvegicus
atgtcgctattactgaactcgcacc

SEQ ID NO: 201316 - DNA, 25 bp, Rattus norvegicus
atgtcgctattagtgaactcgcacc

SEQ ID NO: 201317 - DNA, 25 bp, Rattus norvegicus
atgtcgctccgacgtcagtgtgtct

SEQ ID NO: 201318 - DNA, 25 bp, Rattus norvegicus
atgtcgctccgaggtcagtgtgtct

SEQ ID NO: 201319 - DNA, 25 bp, Rattus norvegicus
atgtcgctgacacatcggtatgttt

SEQ ID NO: 201320 - DNA, 25 bp, Rattus norvegicus
atgtcgctgacagatcggtatgttt

SEQ ID NO: 201321 - DNA, 25 bp, Rattus norvegicus
atgtcgctgcccaagctgcagcagg

SEQ ID NO: 201322 - DNA, 25 bp, Rattus norvegicus
atgtcgctgccctagctgcagcagg

SEQ ID NO: 201323 - DNA, 25 bp, Rattus norvegicus
atgtcgctggtcagacgctcggcga

SEQ ID NO: 201324 - DNA, 25 bp, Rattus norvegicus
atgtcgctggtctgacgctcggcga

SEQ ID NO: 201325 - DNA, 25 bp, Rattus norvegicus
atgtcgctgtctagagcccggatct

SEQ ID NO: 201326 - DNA, 25 bp, Rattus norvegicus
atgtcgctgtcttgagcccggatct

SEQ ID NO: 201327 - DNA, 25 bp, Rattus norvegicus
atgtcgcttcaccattagggctgca

SEQ ID NO: 201328 - DNA, 25 bp, Rattus norvegicus
atgtcgcttcacgattagggctgca

SEQ ID NO: 201329 - DNA, 25 bp, Rattus norvegicus
atgtcgcttctcaatcactgaggtg

SEQ ID NO: 201330 - DNA, 25 bp, Rattus norvegicus
atgtcgcttctctatcactgaggtg

SEQ ID NO: 201331 - DNA, 25 bp, Rattus norvegicus
atgtcgcttgctctggctgattata

SEQ ID NO: 201332 - DNA, 25 bp, Rattus norvegicus
atgtcgcttgctgtggctgattata

SEQ ID NO: 201333 - DNA, 25 bp, Rattus norvegicus
atgtcggaactaaggctatactgtg

SEQ ID NO: 201334 - DNA, 25 bp, Rattus norvegicus
atgtcggaactatggctatactgtg

SEQ ID NO: 201335 - DNA, 25 bp, Rattus norvegicus
atgtcggaagcacgtctccgttgtg

SEQ ID NO: 201336 - DNA, 25 bp, Rattus norvegicus
atgtcggaagcaggtctccgttgtg

SEQ ID NO: 201337 - DNA, 25 bp, Rattus norvegicus
atgtcggaagccctcaggacttgga

SEQ ID NO: 201338 - DNA, 25 bp, Rattus norvegicus
atgtcggaagccgtcaggacttgga

SEQ ID NO: 201339 - DNA, 25 bp, Rattus norvegicus
atgtcggacaggatcttgtacttga

SEQ ID NO: 201340 - DNA, 25 bp, Rattus norvegicus
atgtcggacaggttcttgtacttga

SEQ ID NO: 201341 - DNA, 25 bp, Rattus norvegicus
atgtcggacctgacgtcagtgcgct

SEQ ID NO: 201342 - DNA, 25 bp, Rattus norvegicus
atgtcggacctgtcgtcagtgcgct

SEQ ID NO: 201343 - DNA, 25 bp, Rattus norvegicus
atgtcggattttacgtctgtccttt

SEQ ID NO: 201344 - DNA, 25 bp, Rattus norvegicus
atgtcggatttttcgtctgtccttt

SEQ ID NO: 201345 - DNA, 25 bp, Rattus norvegicus
atgtcggcagacatcagctgggcag

SEQ ID NO: 201346 - DNA, 25 bp, Rattus norvegicus
atgtcggcagacttcagctgggcag

SEQ ID NO: 201347 - DNA, 25 bp, Rattus norvegicus
atgtcggctgaccataagtcatcca

SEQ ID NO: 201348 - DNA, 25 bp, Rattus norvegicus
atgtcggctgacgataagtcatcca

SEQ ID NO: 201349 - DNA, 25 bp, Rattus norvegicus
atgtcggctgctctgcttgagtttc

SEQ ID NO: 201350 - DNA, 25 bp, Rattus norvegicus
atgtcggctgctgtgcttgagtttc

SEQ ID NO: 201351 - DNA, 25 bp, Rattus norvegicus
atgtcgtaacgaacctgaacactta

SEQ ID NO: 201352 - DNA, 25 bp, Rattus norvegicus
atgtcgtaacgatcctgaacactta

SEQ ID NO: 201353 - DNA, 25 bp, Rattus norvegicus
atgtcgtacgtgagtgttagaaact

SEQ ID NO: 201354 - DNA, 25 bp, Rattus norvegicus
atgtcgtacgtgtgtgttagaaact

SEQ ID NO: 201355 - DNA, 25 bp, Rattus norvegicus
atgtcgtaggacctggacctgtgtc

SEQ ID NO: 201356 - DNA, 25 bp, Rattus norvegicus
atgtcgtaggacgtggacctgtgtc

SEQ ID NO: 201357 - DNA, 25 bp, Rattus norvegicus
atgtcgtatccgcaggagagctata

SEQ ID NO: 201358 - DNA, 25 bp, Rattus norvegicus
atgtcgtatccggaggagagctata

SEQ ID NO: 201359 - DNA, 25 bp, Rattus norvegicus
atgtcgtcatcaacgaggtcacgta

SEQ ID NO: 201360 - DNA, 25 bp, Rattus norvegicus
atgtcgtcatcatcgaggtcacgta

SEQ ID NO: 201361 - DNA, 25 bp, Rattus norvegicus
atgtcgtcgtccctctgggttacag

SEQ ID NO: 201362 - DNA, 25 bp, Rattus norvegicus
atgtcgtcgtccgtctgggttacag

SEQ ID NO: 201363 - DNA, 25 bp, Rattus norvegicus
atgtcgtcgttgcagctgccttggc

SEQ ID NO: 201364 - DNA, 25 bp, Rattus norvegicus
atgtcgtcgttggagctgccttggc

SEQ ID NO: 201365 - DNA, 25 bp, Rattus norvegicus
atgtcgtctcaaagctccttacagt

SEQ ID NO: 201366 - DNA, 25 bp, Rattus norvegicus
atgtcgtctcaatgctccttacagt

SEQ ID NO: 201367 - DNA, 25 bp, Rattus norvegicus
atgtcgtctctgattcaggtctaca

SEQ ID NO: 201368 - DNA, 25 bp, Rattus norvegicus
atgtcgtctctgtttcaggtctaca

SEQ ID NO: 201369 - DNA, 25 bp, Rattus norvegicus
atgtcgtctgtgctctttattaatc

SEQ ID NO: 201370 - DNA, 25 bp, Rattus norvegicus
atgtcgtctgtggtctttattaatc

SEQ ID NO: 201371 - DNA, 25 bp, Rattus norvegicus
atgtcgtgagttagttggagccaga

SEQ ID NO: 201372 - DNA, 25 bp, Rattus norvegicus
atgtcgtgagtttgttggagccaga

SEQ ID NO: 201373 - DNA, 25 bp, Rattus norvegicus
atgtcgtgcagaaggaaggcacctc

SEQ ID NO: 201374 - DNA, 25 bp, Rattus norvegicus
atgtcgtgcagatggaaggcacctc

SEQ ID NO: 201375 - DNA, 25 bp, Rattus norvegicus
atgtcgtggtcaaggcagactctga

SEQ ID NO: 201376 - DNA, 25 bp, Rattus norvegicus
atgtcgtggtcatggcagactctga

SEQ ID NO: 201377 - DNA, 25 bp, Rattus norvegicus
atgtcgttggaaacccaagctcaga

SEQ ID NO: 201378 - DNA, 25 bp, Rattus norvegicus
atgtcgttggaatcccaagctcaga

SEQ ID NO: 201379 - DNA, 25 bp, Rattus norvegicus
atgtcgtttgacagtatacccatag

SEQ ID NO: 201380 - DNA, 25 bp, Rattus norvegicus
atgtcgtttgactgtatacccatag

SEQ ID NO: 201381 - DNA, 25 bp, Rattus norvegicus
atgtcgttttctatgcctcctacac

SEQ ID NO: 201382 - DNA, 25 bp, Rattus norvegicus
atgtcgttttctttgcctcctacac

SEQ ID NO: 201383 - DNA, 25 bp, Rattus norvegicus
atgtctaaaagactgtcctgcctgg

SEQ ID NO: 201384 - DNA, 25 bp, Rattus norvegicus
atgtctaaaagagtgtcctgcctgg

SEQ ID NO: 201385 - DNA, 25 bp, Rattus norvegicus
atgtctaaatggagatgtgtctttt

SEQ ID NO: 201386 - DNA, 25 bp, Rattus norvegicus
atgtctaaatggtgatgtgtctttt

SEQ ID NO: 201387 - DNA, 25 bp, Rattus norvegicus
atgtctaactctaaagccattcctc

SEQ ID NO: 201388 - DNA, 25 bp, Rattus norvegicus
atgtctaactcttaagccattcctc

SEQ ID NO: 201389 - DNA, 25 bp, Rattus norvegicus
atgtctaagaccattgaggcagctt

SEQ ID NO: 201390 - DNA, 25 bp, Rattus norvegicus
atgtctaagacctttgaggcagctt

SEQ ID NO: 201391 - DNA, 25 bp, Rattus norvegicus
atgtctaagcatcctcacaccggag

SEQ ID NO: 201392 - DNA, 25 bp, Rattus norvegicus
atgtctaagcatgctcacaccggag

SEQ ID NO: 201393 - DNA, 25 bp, Rattus norvegicus
atgtctaatatgacccttcagtgtc

SEQ ID NO: 201394 - DNA, 25 bp, Rattus norvegicus
atgtctaatatgtcccttcagtgtc

SEQ ID NO: 201395 - DNA, 25 bp, Rattus norvegicus
atgtctaatgcaccttacttcctcg

SEQ ID NO: 201396 - DNA, 25 bp, Rattus norvegicus
atgtctaatgcagcttacttcctcg

SEQ ID NO: 201397 - DNA, 25 bp, Rattus norvegicus
atgtctacactgcttcttctaatga

SEQ ID NO: 201398 - DNA, 25 bp, Rattus norvegicus
atgtctacactggttcttctaatga

SEQ ID NO: 201399 - DNA, 25 bp, Rattus norvegicus
atgtctacagtaacttccggtctgg

SEQ ID NO: 201400 - DNA, 25 bp, Rattus norvegicus
atgtctacagtatcttccggtctgg

SEQ ID NO: 201401 - DNA, 25 bp, Rattus norvegicus
atgtctacatcaaacaccctgtatc

SEQ ID NO: 201402 - DNA, 25 bp, Rattus norvegicus
atgtctacatcatacaccctgtatc

SEQ ID NO: 201403 - DNA, 25 bp, Rattus norvegicus
atgtctacatgtcccttcctgcaga

SEQ ID NO: 201404 - DNA, 25 bp, Rattus norvegicus
atgtctacatgtgccttcctgcaga

SEQ ID NO: 201405 - DNA, 25 bp, Rattus norvegicus
atgtctaccagtctgttctcacagc

SEQ ID NO: 201406 - DNA, 25 bp, Rattus norvegicus
atgtctaccagtgtgttctcacagc

SEQ ID NO: 201407 - DNA, 25 bp, Rattus norvegicus
atgtctactactccgccgggtatga

SEQ ID NO: 201408 - DNA, 25 bp, Rattus norvegicus
atgtctactactgcgccgggtatga

SEQ ID NO: 201409 - DNA, 25 bp, Rattus norvegicus
atgtctactgccacatcttgattta

SEQ ID NO: 201410 - DNA, 25 bp, Rattus norvegicus
atgtctactgcctcatcttgattta

SEQ ID NO: 201411 - DNA, 25 bp, Rattus norvegicus
atgtctagcaagatttctttcttca

SEQ ID NO: 201412 - DNA, 25 bp, Rattus norvegicus
atgtctagcaagttttctttcttca

SEQ ID NO: 201413 - DNA, 25 bp, Rattus norvegicus
atgtctaggagaaattcctgggttt

SEQ ID NO: 201414 - DNA, 25 bp, Rattus norvegicus
atgtctaggagaagggctgccccag

SEQ ID NO: 201415 - DNA, 25 bp, Rattus norvegicus
atgtctaggagatattcctgggttt

SEQ ID NO: 201416 - DNA, 25 bp, Rattus norvegicus
atgtctaggagatgggctgccccag

SEQ ID NO: 201417 - DNA, 25 bp, Rattus norvegicus
atgtctatagcccaagcaccctgag

SEQ ID NO: 201418 - DNA, 25 bp, Rattus norvegicus
atgtctatagccgaagcaccctgag

SEQ ID NO: 201419 - DNA, 25 bp, Rattus norvegicus
atgtctatagcgcagactcctgagg

SEQ ID NO: 201420 - DNA, 25 bp, Rattus norvegicus
atgtctatagcggagactcctgagg

SEQ ID NO: 201421 - DNA, 25 bp, Rattus norvegicus
atgtctatatgtaggagttctcaaa

SEQ ID NO: 201422 - DNA, 25 bp, Rattus norvegicus
atgtctatatgtctcttgctttcct

SEQ ID NO: 201423 - DNA, 25 bp, Rattus norvegicus
atgtctatatgtgtcttgctttcct

SEQ ID NO: 201424 - DNA, 25 bp, Rattus norvegicus
atgtctatatgttggagttctcaaa

SEQ ID NO: 201425 - DNA, 25 bp, Rattus norvegicus
atgtctatattgattcctacctgga

SEQ ID NO: 201426 - DNA, 25 bp, Rattus norvegicus
atgtctatattgtttcctacctgga

SEQ ID NO: 201427 - DNA, 25 bp, Rattus norvegicus
atgtctatcacacccaagcttacct

SEQ ID NO: 201428 - DNA, 25 bp, Rattus norvegicus
atgtctatcacagccaagcttacct

SEQ ID NO: 201429 - DNA, 25 bp, Rattus norvegicus
atgtctatcatcaggacacggcgtc

SEQ ID NO: 201430 - DNA, 25 bp, Rattus norvegicus
atgtctatcatctggacacggcgtc

SEQ ID NO: 201431 - DNA, 25 bp, Rattus norvegicus
atgtctatcggcatcaccttcatgg

SEQ ID NO: 201432 - DNA, 25 bp, Rattus norvegicus
atgtctatcggcttcaccttcatgg

SEQ ID NO: 201433 - DNA, 25 bp, Rattus norvegicus
atgtctatgcatccacagaggccag

SEQ ID NO: 201434 - DNA, 25 bp, Rattus norvegicus
atgtctatgcatgcacagaggccag

SEQ ID NO: 201435 - DNA, 25 bp, Rattus norvegicus
atgtctatggaaatgccttctctag

SEQ ID NO: 201436 - DNA, 25 bp, Rattus norvegicus
atgtctatggaattgccttctctag

SEQ ID NO: 201437 - DNA, 25 bp, Rattus norvegicus
atgtctatgttaagttccggcggga

SEQ ID NO: 201438 - DNA, 25 bp, Rattus norvegicus
atgtctatgttatgttccggcggga

SEQ ID NO: 201439 - DNA, 25 bp, Rattus norvegicus
atgtctattccaaggttccttgtac

SEQ ID NO: 201440 - DNA, 25 bp, Rattus norvegicus
atgtctattccatggttccttgtac

SEQ ID NO: 201441 - DNA, 25 bp, Rattus norvegicus
atgtctattgaaatcccagcatagg

SEQ ID NO: 201442 - DNA, 25 bp, Rattus norvegicus
atgtctattgaattcccagcatagg

SEQ ID NO: 201443 - DNA, 25 bp, Rattus norvegicus
atgtctattttacacctcttcagca

SEQ ID NO: 201444 - DNA, 25 bp, Rattus norvegicus
atgtctattttagacctcttcagca

SEQ ID NO: 201445 - DNA, 25 bp, Rattus norvegicus
atgtctcaactccatcttatctgcg

SEQ ID NO: 201446 - DNA, 25 bp, Rattus norvegicus
atgtctcaactcgatcttatctgcg

SEQ ID NO: 201447 - DNA, 25 bp, Rattus norvegicus
atgtctcaactgatcagtcaccgct

SEQ ID NO: 201448 - DNA, 25 bp, Rattus norvegicus
atgtctcaactgttcagtcaccgct

SEQ ID NO: 201449 - DNA, 25 bp, Rattus norvegicus
atgtctcaatctacacagtgggctt

SEQ ID NO: 201450 - DNA, 25 bp, Rattus norvegicus
atgtctcaatcttcacagtgggctt

SEQ ID NO: 201451 - DNA, 25 bp, Rattus norvegicus
atgtctcacagaagcgtctcacaga

SEQ ID NO: 201452 - DNA, 25 bp, Rattus norvegicus
atgtctcacagatgcgtctcacaga

SEQ ID NO: 201453 - DNA, 25 bp, Rattus norvegicus
atgtctcacattcgagcaacttgac

SEQ ID NO: 201454 - DNA, 25 bp, Rattus norvegicus
atgtctcacattggagcaacttgac

SEQ ID NO: 201455 - DNA, 25 bp, Rattus norvegicus
atgtctcagacacagcaccccatag

SEQ ID NO: 201456 - DNA, 25 bp, Rattus norvegicus
atgtctcagacagagcaccccatag

SEQ ID NO: 201457 - DNA, 25 bp, Rattus norvegicus
atgtctcagcagacatttctgttta

SEQ ID NO: 201458 - DNA, 25 bp, Rattus norvegicus
atgtctcagcagtcatttctgttta

SEQ ID NO: 201459 - DNA, 25 bp, Rattus norvegicus
atgtctcagcccctggcaggaagaa

SEQ ID NO: 201460 - DNA, 25 bp, Rattus norvegicus
atgtctcagcccgtggcaggaagaa

SEQ ID NO: 201461 - DNA, 25 bp, Rattus norvegicus
atgtctcagctcagcaaactctttg

SEQ ID NO: 201462 - DNA, 25 bp, Rattus norvegicus
atgtctcagctctgcaaactctttg

SEQ ID NO: 201463 - DNA, 25 bp, Rattus norvegicus
atgtctcatagacactgtctcttct

SEQ ID NO: 201464 - DNA, 25 bp, Rattus norvegicus
atgtctcatagagactgtctcttct

SEQ ID NO: 201465 - DNA, 25 bp, Rattus norvegicus
atgtctcatgcactggcacgatggt

SEQ ID NO: 201466 - DNA, 25 bp, Rattus norvegicus
atgtctcatgcagtggcacgatggt

SEQ ID NO: 201467 - DNA, 25 bp, Rattus norvegicus
atgtctcatttcatcatggagggta

SEQ ID NO: 201468 - DNA, 25 bp, Rattus norvegicus
atgtctcatttcttcatggagggta

SEQ ID NO: 201469 - DNA, 25 bp, Rattus norvegicus
atgtctccaagcagtgctaaggctt

SEQ ID NO: 201470 - DNA, 25 bp, Rattus norvegicus
atgtctccaagctgtgctaaggctt

SEQ ID NO: 201471 - DNA, 25 bp, Rattus norvegicus
atgtctccaaggcaagccacaggct

SEQ ID NO: 201472 - DNA, 25 bp, Rattus norvegicus
atgtctccaagggaagccacaggct

SEQ ID NO: 201473 - DNA, 25 bp, Rattus norvegicus
atgtctccaattagatgcacctgcc

SEQ ID NO: 201474 - DNA, 25 bp, Rattus norvegicus
atgtctccaatttgatgcacctgcc

SEQ ID NO: 201475 - DNA, 25 bp, Rattus norvegicus
atgtctccactgagcactgtgaatg

SEQ ID NO: 201476 - DNA, 25 bp, Rattus norvegicus
atgtctccactgtgcactgtgaatg

SEQ ID NO: 201477 - DNA, 25 bp, Rattus norvegicus
atgtctccagcaacaacctgaagtc

SEQ ID NO: 201478 - DNA, 25 bp, Rattus norvegicus
atgtctccagcatcaacctgaagtc

SEQ ID NO: 201479 - DNA, 25 bp, Rattus norvegicus
atgtctccagtgaagaccacattgg

SEQ ID NO: 201480 - DNA, 25 bp, Rattus norvegicus
atgtctccagtgtagaccacattgg

SEQ ID NO: 201481 - DNA, 25 bp, Rattus norvegicus
atgtctccatgcactttaaaactag

SEQ ID NO: 201482 - DNA, 25 bp, Rattus norvegicus
atgtctccatgctctttaaaactag

SEQ ID NO: 201483 - DNA, 25 bp, Rattus norvegicus
atgtctccatgtatgaacctctaga

SEQ ID NO: 201484 - DNA, 25 bp, Rattus norvegicus
atgtctccatgtttgaacctctaga

SEQ ID NO: 201485 - DNA, 25 bp, Rattus norvegicus
atgtctccctacaatgttgggcttt

SEQ ID NO: 201486 - DNA, 25 bp, Rattus norvegicus
atgtctccctactatgttgggcttt

SEQ ID NO: 201487 - DNA, 25 bp, Rattus norvegicus
atgtctcctacaatcaccagcagag

SEQ ID NO: 201488 - DNA, 25 bp, Rattus norvegicus
atgtctcctacattcaccagcagag

SEQ ID NO: 201489 - DNA, 25 bp, Rattus norvegicus
atgtctcctcaaccgtggatcgtga

SEQ ID NO: 201490 - DNA, 25 bp, Rattus norvegicus
atgtctcctcaagcgtggatcgtga

SEQ ID NO: 201491 - DNA, 25 bp, Rattus norvegicus
atgtctcctctcatgccaaatgtta

SEQ ID NO: 201492 - DNA, 25 bp, Rattus norvegicus
atgtctcctctcttgccaaatgtta

SEQ ID NO: 201493 - DNA, 25 bp, Rattus norvegicus
atgtctccttctatggtaggtcacc

SEQ ID NO: 201494 - DNA, 25 bp, Rattus norvegicus
atgtctccttctttggtaggtcacc

SEQ ID NO: 201495 - DNA, 25 bp, Rattus norvegicus
atgtctccttttagatggctcttgg

SEQ ID NO: 201496 - DNA, 25 bp, Rattus norvegicus
atgtctcctttttgatggctcttgg

SEQ ID NO: 201497 - DNA, 25 bp, Rattus norvegicus
atgtctcgaaggattttgttctcac

SEQ ID NO: 201498 - DNA, 25 bp, Rattus norvegicus
atgtctcgaaggtttttgttctcac

SEQ ID NO: 201499 - DNA, 25 bp, Rattus norvegicus
atgtctcgatcaccttgggctgaag

SEQ ID NO: 201500 - DNA, 25 bp, Rattus norvegicus
atgtctcgatcagcttgggctgaag

SEQ ID NO: 201501 - DNA, 25 bp, Rattus norvegicus
atgtctcgggttagtcctgcccaat

SEQ ID NO: 201502 - DNA, 25 bp, Rattus norvegicus
atgtctcgggtttgtcctgcccaat

SEQ ID NO: 201503 - DNA, 25 bp, Rattus norvegicus
atgtctcgtatcatactagcttagt

SEQ ID NO: 201504 - DNA, 25 bp, Rattus norvegicus
atgtctcgtatcttactagcttagt

SEQ ID NO: 201505 - DNA, 25 bp, Rattus norvegicus
atgtctctaaacatttgtttgggat

SEQ ID NO: 201506 - DNA, 25 bp, Rattus norvegicus
atgtctctaaacttttgtttgggat

SEQ ID NO: 201507 - DNA, 25 bp, Rattus norvegicus
atgtctctaagcactgatgatctac

SEQ ID NO: 201508 - DNA, 25 bp, Rattus norvegicus
atgtctctaagctctgatgatctac

SEQ ID NO: 201509 - DNA, 25 bp, Rattus norvegicus
atgtctctaattaaaggaagcccta

SEQ ID NO: 201510 - DNA, 25 bp, Rattus norvegicus
atgtctctaatttaaggaagcccta

SEQ ID NO: 201511 - DNA, 25 bp, Rattus norvegicus
atgtctctacagatcttgtcagcat

SEQ ID NO: 201512 - DNA, 25 bp, Rattus norvegicus
atgtctctacagttcttgtcagcat

SEQ ID NO: 201513 - DNA, 25 bp, Rattus norvegicus
atgtctctagagatccaggctccgc

SEQ ID NO: 201514 - DNA, 25 bp, Rattus norvegicus
atgtctctagagttccaggctccgc

SEQ ID NO: 201515 - DNA, 25 bp, Rattus norvegicus
atgtctctagctactgcttataaag

SEQ ID NO: 201516 - DNA, 25 bp, Rattus norvegicus
atgtctctagcttctgcttataaag

SEQ ID NO: 201517 - DNA, 25 bp, Rattus norvegicus
atgtctctcaaaatggcctcagaat

SEQ ID NO: 201518 - DNA, 25 bp, Rattus norvegicus
atgtctctcaaattggcctcagaat

SEQ ID NO: 201519 - DNA, 25 bp, Rattus norvegicus
atgtctctcagtcggttcttccagg

SEQ ID NO: 201520 - DNA, 25 bp, Rattus norvegicus
atgtctctcagtgggttcttccagg

SEQ ID NO: 201521 - DNA, 25 bp, Rattus norvegicus
atgtctctcccaacgtcgtttggat

SEQ ID NO: 201522 - DNA, 25 bp, Rattus norvegicus
atgtctctcccatcgtcgtttggat

SEQ ID NO: 201523 - DNA, 25 bp, Rattus norvegicus
atgtctctcccgcaaggtccagaat

SEQ ID NO: 201524 - DNA, 25 bp, Rattus norvegicus
atgtctctcccggaaggtccagaat

SEQ ID NO: 201525 - DNA, 25 bp, Rattus norvegicus
atgtctctccctaccaagtgctgtg

SEQ ID NO: 201526 - DNA, 25 bp, Rattus norvegicus
atgtctctcccttccaagtgctgtg

SEQ ID NO: 201527 - DNA, 25 bp, Rattus norvegicus
atgtctctcctaagcgtcaagtgga

SEQ ID NO: 201528 - DNA, 25 bp, Rattus norvegicus
atgtctctcctatgcgtcaagtgga

SEQ ID NO: 201529 - DNA, 25 bp, Rattus norvegicus
atgtctctgactactgactgttcta

SEQ ID NO: 201530 - DNA, 25 bp, Rattus norvegicus
atgtctctgacttctgactgttcta

SEQ ID NO: 201531 - DNA, 25 bp, Rattus norvegicus
atgtctctgattcgaaagaaggttc

SEQ ID NO: 201532 - DNA, 25 bp, Rattus norvegicus
atgtctctgattggaaagaaggttc

SEQ ID NO: 201533 - DNA, 25 bp, Rattus norvegicus
atgtctctgcacattctgccattat

SEQ ID NO: 201534 - DNA, 25 bp, Rattus norvegicus
atgtctctgcactttctgccattat

SEQ ID NO: 201535 - DNA, 25 bp, Rattus norvegicus
atgtctctgggtctacacagtgctg

SEQ ID NO: 201536 - DNA, 25 bp, Rattus norvegicus
atgtctctgggtgtacacagtgctg

SEQ ID NO: 201537 - DNA, 25 bp, Rattus norvegicus
atgtctctgtataaactgatctcca

SEQ ID NO: 201538 - DNA, 25 bp, Rattus norvegicus
atgtctctgtattaactgatctcca

SEQ ID NO: 201539 - DNA, 25 bp, Rattus norvegicus
atgtctctgtctaaagctgctctgt

SEQ ID NO: 201540 - DNA, 25 bp, Rattus norvegicus
atgtctctgtcttaagctgctctgt

SEQ ID NO: 201541 - DNA, 25 bp, Rattus norvegicus
atgtctctgttgagtgtcagcacct

SEQ ID NO: 201542 - DNA, 25 bp, Rattus norvegicus
atgtctctgttgtgtgtcagcacct

SEQ ID NO: 201543 - DNA, 25 bp, Rattus norvegicus
atgtctcttagacgagtcaccctgc

SEQ ID NO: 201544 - DNA, 25 bp, Rattus norvegicus
atgtctcttagaggagtcaccctgc

SEQ ID NO: 201545 - DNA, 25 bp, Rattus norvegicus
atgtctcttgagcatcaatcttgtt

SEQ ID NO: 201546 - DNA, 25 bp, Rattus norvegicus
atgtctcttgaggatcaatcttgtt

SEQ ID NO: 201547 - DNA, 25 bp, Rattus norvegicus
atgtctctttaaccagtctctgttg

SEQ ID NO: 201548 - DNA, 25 bp, Rattus norvegicus
atgtctctttaagcagtctctgttg

SEQ ID NO: 201549 - DNA, 25 bp, Rattus norvegicus
atgtctctttacagcacaccacagt

SEQ ID NO: 201550 - DNA, 25 bp, Rattus norvegicus
atgtctctttactgcacaccacagt

SEQ ID NO: 201551 - DNA, 25 bp, Rattus norvegicus
atgtctctttggagcagccttgtaa

SEQ ID NO: 201552 - DNA, 25 bp, Rattus norvegicus
atgtctctttggtgcagccttgtaa

SEQ ID NO: 201553 - DNA, 25 bp, Rattus norvegicus
atgtctgaaagactggctgtcccca

SEQ ID NO: 201554 - DNA, 25 bp, Rattus norvegicus
atgtctgaaagagtggctgtcccca

SEQ ID NO: 201555 - DNA, 25 bp, Rattus norvegicus
atgtctgaaagcctaggtgtcctga

SEQ ID NO: 201556 - DNA, 25 bp, Rattus norvegicus
atgtctgaaagcgtaggtgtcctga

SEQ ID NO: 201557 - DNA, 25 bp, Rattus norvegicus
atgtctgaatttcctctggatccac

SEQ ID NO: 201558 - DNA, 25 bp, Rattus norvegicus
atgtctgaatttgctctggatccac

SEQ ID NO: 201559 - DNA, 25 bp, Rattus norvegicus
atgtctgacaaacccgatatggctg

SEQ ID NO: 201560 - DNA, 25 bp, Rattus norvegicus
atgtctgacaaagccgatatggctg

SEQ ID NO: 201561 - DNA, 25 bp, Rattus norvegicus
atgtctgacaacagggctctgcata

SEQ ID NO: 201562 - DNA, 25 bp, Rattus norvegicus
atgtctgacaactgggctctgcata

SEQ ID NO: 201563 - DNA, 25 bp, Rattus norvegicus
atgtctgacagcatgtttgtgatcg

SEQ ID NO: 201564 - DNA, 25 bp, Rattus norvegicus
atgtctgacagcttgtttgtgatcg

SEQ ID NO: 201565 - DNA, 25 bp, Rattus norvegicus
atgtctgacccactatgtgcttgtc

SEQ ID NO: 201566 - DNA, 25 bp, Rattus norvegicus
atgtctgacccagtatgtgcttgtc

SEQ ID NO: 201567 - DNA, 25 bp, Rattus norvegicus
atgtctgaccccagtctttgtgaag

SEQ ID NO: 201568 - DNA, 25 bp, Rattus norvegicus
atgtctgacccctgtctttgtgaag

SEQ ID NO: 201569 - DNA, 25 bp, Rattus norvegicus
atgtctgaccggatatttagttggg

SEQ ID NO: 201570 - DNA, 25 bp, Rattus norvegicus
atgtctgaccggttatttagttggg

SEQ ID NO: 201571 - DNA, 25 bp, Rattus norvegicus
atgtctgaccttcttagccaggctt

SEQ ID NO: 201572 - DNA, 25 bp, Rattus norvegicus
atgtctgaccttgttagccaggctt

SEQ ID NO: 201573 - DNA, 25 bp, Rattus norvegicus
atgtctgacggcaccgcagagaagc

SEQ ID NO: 201574 - DNA, 25 bp, Rattus norvegicus
atgtctgacggctccgcagagaagc

SEQ ID NO: 201575 - DNA, 25 bp, Rattus norvegicus
atgtctgactgacccttaagtctcc

SEQ ID NO: 201576 - DNA, 25 bp, Rattus norvegicus
atgtctgactgagccttaagtctcc

SEQ ID NO: 201577 - DNA, 25 bp, Rattus norvegicus
atgtctgactgcacaggttggctct

SEQ ID NO: 201578 - DNA, 25 bp, Rattus norvegicus
atgtctgactgctcaggttggctct

SEQ ID NO: 201579 - DNA, 25 bp, Rattus norvegicus
atgtctgagacaaggagcggctcat

SEQ ID NO: 201580 - DNA, 25 bp, Rattus norvegicus
atgtctgagacatggagcggctcat

SEQ ID NO: 201581 - DNA, 25 bp, Rattus norvegicus
atgtctgagcttcggagtgttccct

SEQ ID NO: 201582 - DNA, 25 bp, Rattus norvegicus
atgtctgagcttgggagtgttccct

SEQ ID NO: 201583 - DNA, 25 bp, Rattus norvegicus
atgtctgagggcatggtgtcatttg

SEQ ID NO: 201584 - DNA, 25 bp, Rattus norvegicus
atgtctgagggcttggtgtcatttg

SEQ ID NO: 201585 - DNA, 25 bp, Rattus norvegicus
atgtctgagtgaaactagcgctttt

SEQ ID NO: 201586 - DNA, 25 bp, Rattus norvegicus
atgtctgagtgatactagcgctttt

SEQ ID NO: 201587 - DNA, 25 bp, Rattus norvegicus
atgtctgatgtgaacaggcccgagt

SEQ ID NO: 201588 - DNA, 25 bp, Rattus norvegicus
atgtctgatgtgtacaggcccgagt

SEQ ID NO: 201589 - DNA, 25 bp, Rattus norvegicus
atgtctgcaacgcagggagatccct

SEQ ID NO: 201590 - DNA, 25 bp, Rattus norvegicus
atgtctgcaacggagggagatccct

SEQ ID NO: 201591 - DNA, 25 bp, Rattus norvegicus
atgtctgcacctcaacttgtggtta

SEQ ID NO: 201592 - DNA, 25 bp, Rattus norvegicus
atgtctgcacctccgcttgtaagag

SEQ ID NO: 201593 - DNA, 25 bp, Rattus norvegicus
atgtctgcacctgaacttgtggtta

SEQ ID NO: 201594 - DNA, 25 bp, Rattus norvegicus
atgtctgcacctgcgcttgtaagag

SEQ ID NO: 201595 - DNA, 25 bp, Rattus norvegicus
atgtctgcagacacaatgttccact

SEQ ID NO: 201596 - DNA, 25 bp, Rattus norvegicus
atgtctgcagactcaatgttccact

SEQ ID NO: 201597 - DNA, 25 bp, Rattus norvegicus
atgtctgcagcacaggcccagttgc

SEQ ID NO: 201598 - DNA, 25 bp, Rattus norvegicus
atgtctgcagcacttttccctgtgt

SEQ ID NO: 201599 - DNA, 25 bp, Rattus norvegicus
atgtctgcagcagaggcccagttgc

SEQ ID NO: 201600 - DNA, 25 bp, Rattus norvegicus
atgtctgcagcagttttccctgtgt

SEQ ID NO: 201601 - DNA, 25 bp, Rattus norvegicus
atgtctgcattaatggaacaaaccc

SEQ ID NO: 201602 - DNA, 25 bp, Rattus norvegicus
atgtctgcattattggaacaaaccc

SEQ ID NO: 201603 - DNA, 25 bp, Rattus norvegicus
atgtctgccacaatgttttgtcaca

SEQ ID NO: 201604 - DNA, 25 bp, Rattus norvegicus
atgtctgccacattgttttgtcaca

SEQ ID NO: 201605 - DNA, 25 bp, Rattus norvegicus
atgtctgccagccaagtgaaggata

SEQ ID NO: 201606 - DNA, 25 bp, Rattus norvegicus
atgtctgccagcgaagtgaaggata

SEQ ID NO: 201607 - DNA, 25 bp, Rattus norvegicus
atgtctgccatgattgttctaaaag

SEQ ID NO: 201608 - DNA, 25 bp, Rattus norvegicus
atgtctgccatgtttgttctaaaag

SEQ ID NO: 201609 - DNA, 25 bp, Rattus norvegicus
atgtctgcccacctttacaagtgtt

SEQ ID NO: 201610 - DNA, 25 bp, Rattus norvegicus
atgtctgcccacgtttacaagtgtt

SEQ ID NO: 201611 - DNA, 25 bp, Rattus norvegicus
atgtctgccctcaacccaagaggag

SEQ ID NO: 201612 - DNA, 25 bp, Rattus norvegicus
atgtctgccctctacccaagaggag

SEQ ID NO: 201613 - DNA, 25 bp, Rattus norvegicus
atgtctgcctatctgctaccatgct

SEQ ID NO: 201614 - DNA, 25 bp, Rattus norvegicus
atgtctgcctatgtgctaccatgct

SEQ ID NO: 201615 - DNA, 25 bp, Rattus norvegicus
atgtctgcctcgaaaactgcgtgct

SEQ ID NO: 201616 - DNA, 25 bp, Rattus norvegicus
atgtctgcctcgtaaactgcgtgct

SEQ ID NO: 201617 - DNA, 25 bp, Rattus norvegicus
atgtctgcctctccaagtacgagtt

SEQ ID NO: 201618 - DNA, 25 bp, Rattus norvegicus
atgtctgcctctgcaagtacgagtt

SEQ ID NO: 201619 - DNA, 25 bp, Rattus norvegicus
atgtctgcggagctctttgggccca

SEQ ID NO: 201620 - DNA, 25 bp, Rattus norvegicus
atgtctgcggaggtctttgggccca

SEQ ID NO: 201621 - DNA, 25 bp, Rattus norvegicus
atgtctgcggccagtgtggagcacc

SEQ ID NO: 201622 - DNA, 25 bp, Rattus norvegicus
atgtctgcggcctgtgtggagcacc

SEQ ID NO: 201623 - DNA, 25 bp, Rattus norvegicus
atgtctgcgggcacatatgtgtccc

SEQ ID NO: 201624 - DNA, 25 bp, Rattus norvegicus
atgtctgcgggctcatatgtgtccc

SEQ ID NO: 201625 - DNA, 25 bp, Rattus norvegicus
atgtctgcggtcactcaagagagcc

SEQ ID NO: 201626 - DNA, 25 bp, Rattus norvegicus
atgtctgcggtctctcaagagagcc

SEQ ID NO: 201627 - DNA, 25 bp, Rattus norvegicus
atgtctgcgttgaccactggctgta

SEQ ID NO: 201628 - DNA, 25 bp, Rattus norvegicus
atgtctgcgttgtccactggctgta

SEQ ID NO: 201629 - DNA, 25 bp, Rattus norvegicus
atgtctgcgtttcctataggccact

SEQ ID NO: 201630 - DNA, 25 bp, Rattus norvegicus
atgtctgcgtttgctataggccact

SEQ ID NO: 201631 - DNA, 25 bp, Rattus norvegicus
atgtctgctgacatgtgtcgttctc

SEQ ID NO: 201632 - DNA, 25 bp, Rattus norvegicus
atgtctgctgacttgtgtcgttctc

SEQ ID NO: 201633 - DNA, 25 bp, Rattus norvegicus
atgtctgctgcgctgtgtctgctca

SEQ ID NO: 201634 - DNA, 25 bp, Rattus norvegicus
atgtctgctgcggtgtgtctgctca

SEQ ID NO: 201635 - DNA, 25 bp, Rattus norvegicus
atgtctgctgtcatcagttttagtg

SEQ ID NO: 201636 - DNA, 25 bp, Rattus norvegicus
atgtctgctgtcttcagttttagtg

SEQ ID NO: 201637 - DNA, 25 bp, Rattus norvegicus
atgtctggaacaatctttctggcct

SEQ ID NO: 201638 - DNA, 25 bp, Rattus norvegicus
atgtctggaacattctttctggcct

SEQ ID NO: 201639 - DNA, 25 bp, Rattus norvegicus
atgtctggaaccattaccttgtctg

SEQ ID NO: 201640 - DNA, 25 bp, Rattus norvegicus
atgtctggaacctttaccttgtctg

SEQ ID NO: 201641 - DNA, 25 bp, Rattus norvegicus
atgtctggaagcctgttcacgacac

SEQ ID NO: 201642 - DNA, 25 bp, Rattus norvegicus
atgtctggaagcgtgttcacgacac

SEQ ID NO: 201643 - DNA, 25 bp, Rattus norvegicus
atgtctggacaactcactatgattt

SEQ ID NO: 201644 - DNA, 25 bp, Rattus norvegicus
atgtctggacaagtcactatgattt

SEQ ID NO: 201645 - DNA, 25 bp, Rattus norvegicus
atgtctggacctcgttcctgcttgg

SEQ ID NO: 201646 - DNA, 25 bp, Rattus norvegicus
atgtctggacctggttcctgcttgg

SEQ ID NO: 201647 - DNA, 25 bp, Rattus norvegicus
atgtctggactccaactccagtgca

SEQ ID NO: 201648 - DNA, 25 bp, Rattus norvegicus
atgtctggactcgaactccagtgca

SEQ ID NO: 201649 - DNA, 25 bp, Rattus norvegicus
atgtctggcacaatgcaatcctcaa

SEQ ID NO: 201650 - DNA, 25 bp, Rattus norvegicus
atgtctggcacattgcaatcctcaa

SEQ ID NO: 201651 - DNA, 25 bp, Rattus norvegicus
atgtctggcatgcacaaggccctta

SEQ ID NO: 201652 - DNA, 25 bp, Rattus norvegicus
atgtctggcatggacaaggccctta

SEQ ID NO: 201653 - DNA, 25 bp, Rattus norvegicus
atgtctggctgtattgtggcactca

SEQ ID NO: 201654 - DNA, 25 bp, Rattus norvegicus
atgtctggctgttttgtggcactca

SEQ ID NO: 201655 - DNA, 25 bp, Rattus norvegicus
atgtctggctttctactttgcagtc

SEQ ID NO: 201656 - DNA, 25 bp, Rattus norvegicus
atgtctggctttgtactttgcagtc

SEQ ID NO: 201657 - DNA, 25 bp, Rattus norvegicus
atgtctgggcttactatgtgggttc

SEQ ID NO: 201658 - DNA, 25 bp, Rattus norvegicus
atgtctgggctttctatgtgggttc

SEQ ID NO: 201659 - DNA, 25 bp, Rattus norvegicus
atgtctgggtctactgaacctcagt

SEQ ID NO: 201660 - DNA, 25 bp, Rattus norvegicus
atgtctgggtcttctgaacctcagt

SEQ ID NO: 201661 - DNA, 25 bp, Rattus norvegicus
atgtctggtccaatgcgtgttgagc

SEQ ID NO: 201662 - DNA, 25 bp, Rattus norvegicus
atgtctggtccaatgtcgtgatgaa

SEQ ID NO: 201663 - DNA, 25 bp, Rattus norvegicus
atgtctggtccattgcgtgttgagc

SEQ ID NO: 201664 - DNA, 25 bp, Rattus norvegicus
atgtctggtccattgtcgtgatgaa

SEQ ID NO: 201665 - DNA, 25 bp, Rattus norvegicus
atgtctggtctaagagctcaagcct

SEQ ID NO: 201666 - DNA, 25 bp, Rattus norvegicus
atgtctggtctatgagctcaagcct

SEQ ID NO: 201667 - DNA, 25 bp, Rattus norvegicus
atgtctggtgacaaccgtaaggacc

SEQ ID NO: 201668 - DNA, 25 bp, Rattus norvegicus
atgtctggtgacatgcttattttaa

SEQ ID NO: 201669 - DNA, 25 bp, Rattus norvegicus
atgtctggtgactaccgtaaggacc

SEQ ID NO: 201670 - DNA, 25 bp, Rattus norvegicus
atgtctggtgacttgcttattttaa

SEQ ID NO: 201671 - DNA, 25 bp, Rattus norvegicus
atgtctggttgaagctgagtcccga

SEQ ID NO: 201672 - DNA, 25 bp, Rattus norvegicus
atgtctggttgatgctgagtcccga

SEQ ID NO: 201673 - DNA, 25 bp, Rattus norvegicus
atgtctgtaaagagtaacctaggaa

SEQ ID NO: 201674 - DNA, 25 bp, Rattus norvegicus
atgtctgtaaagtgtaacctaggaa

SEQ ID NO: 201675 - DNA, 25 bp, Rattus norvegicus
atgtctgtaaatcctcaaagccttt

SEQ ID NO: 201676 - DNA, 25 bp, Rattus norvegicus
atgtctgtaaatgctcaaagccttt

SEQ ID NO: 201677 - DNA, 25 bp, Rattus norvegicus
atgtctgtactgcacccatactatt

SEQ ID NO: 201678 - DNA, 25 bp, Rattus norvegicus
atgtctgtactggacccatactatt

SEQ ID NO: 201679 - DNA, 25 bp, Rattus norvegicus
atgtctgtagcccagtgcccagtgc

SEQ ID NO: 201680 - DNA, 25 bp, Rattus norvegicus
atgtctgtagccgagtgcccagtgc

SEQ ID NO: 201681 - DNA, 25 bp, Rattus norvegicus
atgtctgtagtgattcagaaggcaa

SEQ ID NO: 201682 - DNA, 25 bp, Rattus norvegicus
atgtctgtagtgtttcagaaggcaa

SEQ ID NO: 201683 - DNA, 25 bp, Rattus norvegicus
atgtctgtatcccaccctaaatgtt

SEQ ID NO: 201684 - DNA, 25 bp, Rattus norvegicus
atgtctgtatccgaccctaaatgtt

SEQ ID NO: 201685 - DNA, 25 bp, Rattus norvegicus
atgtctgtatgtctccatggaggcc

SEQ ID NO: 201686 - DNA, 25 bp, Rattus norvegicus
atgtctgtatgtgtccatggaggcc

SEQ ID NO: 201687 - DNA, 25 bp, Rattus norvegicus
atgtctgtattgcaagcatggctgc

SEQ ID NO: 201688 - DNA, 25 bp, Rattus norvegicus
atgtctgtattggaagcatggctgc

SEQ ID NO: 201689 - DNA, 25 bp, Rattus norvegicus
atgtctgtcacgcagttttgggtca

SEQ ID NO: 201690 - DNA, 25 bp, Rattus norvegicus
atgtctgtcacggagttttgggtca

SEQ ID NO: 201691 - DNA, 25 bp, Rattus norvegicus
atgtctgtccagctggatgctttat

SEQ ID NO: 201692 - DNA, 25 bp, Rattus norvegicus
atgtctgtccaggtggatgctttat

SEQ ID NO: 201693 - DNA, 25 bp, Rattus norvegicus
atgtctgtcccactgtggtcccggg

SEQ ID NO: 201694 - DNA, 25 bp, Rattus norvegicus
atgtctgtcccagtgtggtcccggg

SEQ ID NO: 201695 - DNA, 25 bp, Rattus norvegicus
atgtctgtccttactggttcaatac

SEQ ID NO: 201696 - DNA, 25 bp, Rattus norvegicus
atgtctgtcctttctggttcaatac

SEQ ID NO: 201697 - DNA, 25 bp, Rattus norvegicus
atgtctgtctggcatccagggcaaa

SEQ ID NO: 201698 - DNA, 25 bp, Rattus norvegicus
atgtctgtctgggatccagggcaaa

SEQ ID NO: 201699 - DNA, 25 bp, Rattus norvegicus
atgtctgtgacgctaaggacccctc

SEQ ID NO: 201700 - DNA, 25 bp, Rattus norvegicus
atgtctgtgacggtaaggacccctc

SEQ ID NO: 201701 - DNA, 25 bp, Rattus norvegicus
atgtctgtgcacctggccatgaagt

SEQ ID NO: 201702 - DNA, 25 bp, Rattus norvegicus
atgtctgtgcacgtggccatgaagt

SEQ ID NO: 201703 - DNA, 25 bp, Rattus norvegicus
atgtctgtgcttcttgcctgaggag

SEQ ID NO: 201704 - DNA, 25 bp, Rattus norvegicus
atgtctgtgcttgttgcctgaggag

SEQ ID NO: 201705 - DNA, 25 bp, Rattus norvegicus
atgtctgtgggaaagcacttctcac

SEQ ID NO: 201706 - DNA, 25 bp, Rattus norvegicus
atgtctgtgggacctgtctgaagta

SEQ ID NO: 201707 - DNA, 25 bp, Rattus norvegicus
atgtctgtgggagctgtctgaagta

SEQ ID NO: 201708 - DNA, 25 bp, Rattus norvegicus
atgtctgtgggatagcacttctcac

SEQ ID NO: 201709 - DNA, 25 bp, Rattus norvegicus
atgtctgtgggtcgaagcactctct

SEQ ID NO: 201710 - DNA, 25 bp, Rattus norvegicus
atgtctgtgggtggaagcactctct

SEQ ID NO: 201711 - DNA, 25 bp, Rattus norvegicus
atgtctgtggtcatggcagtccatt

SEQ ID NO: 201712 - DNA, 25 bp, Rattus norvegicus
atgtctgtggtcttggcagtccatt

SEQ ID NO: 201713 - DNA, 25 bp, Rattus norvegicus
atgtctgtgtaaagtatcgtccgtg

SEQ ID NO: 201714 - DNA, 25 bp, Rattus norvegicus
atgtctgtgtaacagctctgcctgc

SEQ ID NO: 201715 - DNA, 25 bp, Rattus norvegicus
atgtctgtgtaagagctctgcctgc

SEQ ID NO: 201716 - DNA, 25 bp, Rattus norvegicus
atgtctgtgtaatgtatcgtccgtg

SEQ ID NO: 201717 - DNA, 25 bp, Rattus norvegicus
atgtctgtgtatattccctgtggca

SEQ ID NO: 201718 - DNA, 25 bp, Rattus norvegicus
atgtctgtgtattttccctgtggca

SEQ ID NO: 201719 - DNA, 25 bp, Rattus norvegicus
atgtctgtgtcgagtcaacacctca

SEQ ID NO: 201720 - DNA, 25 bp, Rattus norvegicus
atgtctgtgtcgtgtcaacacctca

SEQ ID NO: 201721 - DNA, 25 bp, Rattus norvegicus
atgtctgtgtgcatcatttctctca

SEQ ID NO: 201722 - DNA, 25 bp, Rattus norvegicus
atgtctgtgtgcttcatttctctca

SEQ ID NO: 201723 - DNA, 25 bp, Rattus norvegicus
atgtctgtgtggctactgccaattt

SEQ ID NO: 201724 - DNA, 25 bp, Rattus norvegicus
atgtctgtgtgggtactgccaattt

SEQ ID NO: 201725 - DNA, 25 bp, Rattus norvegicus
atgtctgttcataccagatcatgga

SEQ ID NO: 201726 - DNA, 25 bp, Rattus norvegicus
atgtctgttcattccagatcatgga

SEQ ID NO: 201727 - DNA, 25 bp, Rattus norvegicus
atgtctgttgagaaagaaccccgat

SEQ ID NO: 201728 - DNA, 25 bp, Rattus norvegicus
atgtctgttgagtaagaaccccgat

SEQ ID NO: 201729 - DNA, 25 bp, Rattus norvegicus
atgtctgtttctaggtgtccctgaa

SEQ ID NO: 201730 - DNA, 25 bp, Rattus norvegicus
atgtctgtttcttggtgtccctgaa

SEQ ID NO: 201731 - DNA, 25 bp, Rattus norvegicus
atgtctgttttcaaatttcttcctt

SEQ ID NO: 201732 - DNA, 25 bp, Rattus norvegicus
atgtctgttttctaatttcttcctt

SEQ ID NO: 201733 - DNA, 25 bp, Rattus norvegicus
atgtcttaaagtctctctcctggaa

SEQ ID NO: 201734 - DNA, 25 bp, Rattus norvegicus
atgtcttaaagtgtctctcctggaa

SEQ ID NO: 201735 - DNA, 25 bp, Rattus norvegicus
atgtcttaacctcacctactttgag

SEQ ID NO: 201736 - DNA, 25 bp, Rattus norvegicus
atgtcttaacctgacctactttgag

SEQ ID NO: 201737 - DNA, 25 bp, Rattus norvegicus
atgtcttaaggccatctgtgatgtt

SEQ ID NO: 201738 - DNA, 25 bp, Rattus norvegicus
atgtcttaaggcgatctgtgatgtt

SEQ ID NO: 201739 - DNA, 25 bp, Rattus norvegicus
atgtcttacacacttgctttccaaa

SEQ ID NO: 201740 - DNA, 25 bp, Rattus norvegicus
atgtcttacacagttgctttccaaa

SEQ ID NO: 201741 - DNA, 25 bp, Rattus norvegicus
atgtcttacttaatgttcagtgttt

SEQ ID NO: 201742 - DNA, 25 bp, Rattus norvegicus
atgtcttacttattgttcagtgttt

SEQ ID NO: 201743 - DNA, 25 bp, Rattus norvegicus
atgtcttagtacagcagttcttaac

SEQ ID NO: 201744 - DNA, 25 bp, Rattus norvegicus
atgtcttagtactgcagttcttaac

SEQ ID NO: 201745 - DNA, 25 bp, Rattus norvegicus
atgtcttatcacatggttgggtcca

SEQ ID NO: 201746 - DNA, 25 bp, Rattus norvegicus
atgtcttatcacttggttgggtcca

SEQ ID NO: 201747 - DNA, 25 bp, Rattus norvegicus
atgtcttatggtcttttcagcctat

SEQ ID NO: 201748 - DNA, 25 bp, Rattus norvegicus
atgtcttatggtgttttcagcctat

SEQ ID NO: 201749 - DNA, 25 bp, Rattus norvegicus
atgtcttatgttatctcattccctg

SEQ ID NO: 201750 - DNA, 25 bp, Rattus norvegicus
atgtcttatgttttctcattccctg

SEQ ID NO: 201751 - DNA, 25 bp, Rattus norvegicus
atgtcttcaatgactcatctactgt

SEQ ID NO: 201752 - DNA, 25 bp, Rattus norvegicus
atgtcttcaatgcagtctggtccca

SEQ ID NO: 201753 - DNA, 25 bp, Rattus norvegicus
atgtcttcaatggagtctggtccca

SEQ ID NO: 201754 - DNA, 25 bp, Rattus norvegicus
atgtcttcaatgtctcatctactgt

SEQ ID NO: 201755 - DNA, 25 bp, Rattus norvegicus
atgtcttcacatccacttgcttatc

SEQ ID NO: 201756 - DNA, 25 bp, Rattus norvegicus
atgtcttcacatgcacttgcttatc

SEQ ID NO: 201757 - DNA, 25 bp, Rattus norvegicus
atgtcttcacgtcagcagaggagct

SEQ ID NO: 201758 - DNA, 25 bp, Rattus norvegicus
atgtcttcacgtgagcagaggagct

SEQ ID NO: 201759 - DNA, 25 bp, Rattus norvegicus
atgtcttcaggtctcagtcattggg

SEQ ID NO: 201760 - DNA, 25 bp, Rattus norvegicus
atgtcttcaggtgtcagtcattggg

SEQ ID NO: 201761 - DNA, 25 bp, Rattus norvegicus
atgtcttcagtcatagcttagccct

SEQ ID NO: 201762 - DNA, 25 bp, Rattus norvegicus
atgtcttcagtcttagcttagccct

SEQ ID NO: 201763 - DNA, 25 bp, Rattus norvegicus
atgtcttcagttacgtcttcagaac

SEQ ID NO: 201764 - DNA, 25 bp, Rattus norvegicus
atgtcttcagtttcgtcttcagaac

SEQ ID NO: 201765 - DNA, 25 bp, Rattus norvegicus
atgtcttcatacatttgcctcgttg

SEQ ID NO: 201766 - DNA, 25 bp, Rattus norvegicus
atgtcttcatacttttgcctcgttg

SEQ ID NO: 201767 - DNA, 25 bp, Rattus norvegicus
atgtcttcattcctttatgggcctt

SEQ ID NO: 201768 - DNA, 25 bp, Rattus norvegicus
atgtcttcattcgtttatgggcctt

SEQ ID NO: 201769 - DNA, 25 bp, Rattus norvegicus
atgtcttcatttcttggctcatgga

SEQ ID NO: 201770 - DNA, 25 bp, Rattus norvegicus
atgtcttcatttgttggctcatgga

SEQ ID NO: 201771 - DNA, 25 bp, Rattus norvegicus
atgtcttccaatcctgggagctttc

SEQ ID NO: 201772 - DNA, 25 bp, Rattus norvegicus
atgtcttccaatgctgggagctttc

SEQ ID NO: 201773 - DNA, 25 bp, Rattus norvegicus
atgtcttcccacacctgtgtaggga

SEQ ID NO: 201774 - DNA, 25 bp, Rattus norvegicus
atgtcttcccactcctgtgtaggga

SEQ ID NO: 201775 - DNA, 25 bp, Rattus norvegicus
atgtcttccccaatctgcgtgcagg

SEQ ID NO: 201776 - DNA, 25 bp, Rattus norvegicus
atgtcttccccattctgcgtgcagg

SEQ ID NO: 201777 - DNA, 25 bp, Rattus norvegicus
atgtcttccctgctgtgttagaaaa

SEQ ID NO: 201778 - DNA, 25 bp, Rattus norvegicus
atgtcttccctggtgtgttagaaaa

SEQ ID NO: 201779 - DNA, 25 bp, Rattus norvegicus
atgtcttcctacatcaagtcctgaa

SEQ ID NO: 201780 - DNA, 25 bp, Rattus norvegicus
atgtcttcctacttcaagtcctgaa

SEQ ID NO: 201781 - DNA, 25 bp, Rattus norvegicus
atgtcttcctatcctaccatgtagg

SEQ ID NO: 201782 - DNA, 25 bp, Rattus norvegicus
atgtcttcctatgctaccatgtagg

SEQ ID NO: 201783 - DNA, 25 bp, Rattus norvegicus
atgtcttcctgtatagcagccactt

SEQ ID NO: 201784 - DNA, 25 bp, Rattus norvegicus
atgtcttcctgtttagcagccactt

SEQ ID NO: 201785 - DNA, 25 bp, Rattus norvegicus
atgtcttcgctccatgatccagctg

SEQ ID NO: 201786 - DNA, 25 bp, Rattus norvegicus
atgtcttcgctcgatgatccagctg

SEQ ID NO: 201787 - DNA, 25 bp, Rattus norvegicus
atgtcttcggcacctgcacacagga

SEQ ID NO: 201788 - DNA, 25 bp, Rattus norvegicus
atgtcttcggcagctgcacacagga

SEQ ID NO: 201789 - DNA, 25 bp, Rattus norvegicus
atgtcttctattctgttcccaaacc

SEQ ID NO: 201790 - DNA, 25 bp, Rattus norvegicus
atgtcttctattgtgttcccaaacc

SEQ ID NO: 201791 - DNA, 25 bp, Rattus norvegicus
atgtcttctctgctgagttcttcaa

SEQ ID NO: 201792 - DNA, 25 bp, Rattus norvegicus
atgtcttctctggtgagttcttcaa

SEQ ID NO: 201793 - DNA, 25 bp, Rattus norvegicus
atgtcttctcttagaggccagagct

SEQ ID NO: 201794 - DNA, 25 bp, Rattus norvegicus
atgtcttctctttgaggccagagct

SEQ ID NO: 201795 - DNA, 25 bp, Rattus norvegicus
atgtcttctgaaacgtttgagtgtg

SEQ ID NO: 201796 - DNA, 25 bp, Rattus norvegicus
atgtcttctgaactggttatccaca

SEQ ID NO: 201797 - DNA, 25 bp, Rattus norvegicus
atgtcttctgaagtggttatccaca

SEQ ID NO: 201798 - DNA, 25 bp, Rattus norvegicus
atgtcttctgaatcgtttgagtgtg

SEQ ID NO: 201799 - DNA, 25 bp, Rattus norvegicus
atgtcttctgccatgatgctcgtga

SEQ ID NO: 201800 - DNA, 25 bp, Rattus norvegicus
atgtcttctgccttgatgctcgtga

SEQ ID NO: 201801 - DNA, 25 bp, Rattus norvegicus
atgtcttcttacagctgtacttcag

SEQ ID NO: 201802 - DNA, 25 bp, Rattus norvegicus
atgtcttcttactgctgtacttcag

SEQ ID NO: 201803 - DNA, 25 bp, Rattus norvegicus
atgtcttcttatattgctgaggcca

SEQ ID NO: 201804 - DNA, 25 bp, Rattus norvegicus
atgtcttcttattttgctgaggcca

SEQ ID NO: 201805 - DNA, 25 bp, Rattus norvegicus
atgtcttcttgcaccttaactttat

SEQ ID NO: 201806 - DNA, 25 bp, Rattus norvegicus
atgtcttcttgctccttaactttat

SEQ ID NO: 201807 - DNA, 25 bp, Rattus norvegicus
atgtcttgaattcaccgagttggct

SEQ ID NO: 201808 - DNA, 25 bp, Rattus norvegicus
atgtcttgaattgaccgagttggct

SEQ ID NO: 201809 - DNA, 25 bp, Rattus norvegicus
atgtcttgacgcagtgtggctgagt

SEQ ID NO: 201810 - DNA, 25 bp, Rattus norvegicus
atgtcttgacgctgtgtggctgagt

SEQ ID NO: 201811 - DNA, 25 bp, Rattus norvegicus
atgtcttgatacaggacccacacta

SEQ ID NO: 201812 - DNA, 25 bp, Rattus norvegicus
atgtcttgatactggacccacacta

SEQ ID NO: 201813 - DNA, 25 bp, Rattus norvegicus
atgtcttgattgacttcaggccgga

SEQ ID NO: 201814 - DNA, 25 bp, Rattus norvegicus
atgtcttgattgtcttcaggccgga

SEQ ID NO: 201815 - DNA, 25 bp, Rattus norvegicus
atgtcttgccataatgatggactgt

SEQ ID NO: 201816 - DNA, 25 bp, Rattus norvegicus
atgtcttgccattatgatggactgt

SEQ ID NO: 201817 - DNA, 25 bp, Rattus norvegicus
atgtcttgcctccacggacggcaaa

SEQ ID NO: 201818 - DNA, 25 bp, Rattus norvegicus
atgtcttgcctcgacggacggcaaa

SEQ ID NO: 201819 - DNA, 25 bp, Rattus norvegicus
atgtcttgctttcagtggtatcacc

SEQ ID NO: 201820 - DNA, 25 bp, Rattus norvegicus
atgtcttgctttgagtggtatcacc

SEQ ID NO: 201821 - DNA, 25 bp, Rattus norvegicus
atgtcttgttctctggttcctaggg

SEQ ID NO: 201822 - DNA, 25 bp, Rattus norvegicus
atgtcttgttctgtggttcctaggg

SEQ ID NO: 201823 - DNA, 25 bp, Rattus norvegicus
atgtctttaaagcacacgtacacag

SEQ ID NO: 201824 - DNA, 25 bp, Rattus norvegicus
atgtctttaaaggacacgtacacag

SEQ ID NO: 201825 - DNA, 25 bp, Rattus norvegicus
atgtctttaacccaggagcccaggg

SEQ ID NO: 201826 - DNA, 25 bp, Rattus norvegicus
atgtctttaaccgaggagcccaggg

SEQ ID NO: 201827 - DNA, 25 bp, Rattus norvegicus
atgtctttaattccccacacttggg

SEQ ID NO: 201828 - DNA, 25 bp, Rattus norvegicus
atgtctttaattgcccacacttggg

SEQ ID NO: 201829 - DNA, 25 bp, Rattus norvegicus
atgtctttcatactgattgtgcaga

SEQ ID NO: 201830 - DNA, 25 bp, Rattus norvegicus
atgtctttcatagtgattgtgcaga

SEQ ID NO: 201831 - DNA, 25 bp, Rattus norvegicus
atgtctttcattcgccacgatcaag

SEQ ID NO: 201832 - DNA, 25 bp, Rattus norvegicus
atgtctttcattggccacgatcaag

SEQ ID NO: 201833 - DNA, 25 bp, Rattus norvegicus
atgtctttccagcattaccattctg

SEQ ID NO: 201834 - DNA, 25 bp, Rattus norvegicus
atgtctttccaggattaccattctg

SEQ ID NO: 201835 - DNA, 25 bp, Rattus norvegicus
atgtctttctatatgcgtgtgtatg

SEQ ID NO: 201836 - DNA, 25 bp, Rattus norvegicus
atgtctttctatttgcgtgtgtatg

SEQ ID NO: 201837 - DNA, 25 bp, Rattus norvegicus
atgtctttctggcaacgggtcacca

SEQ ID NO: 201838 - DNA, 25 bp, Rattus norvegicus
atgtctttctgggaacgggtcacca

SEQ ID NO: 201839 - DNA, 25 bp, Rattus norvegicus
atgtctttcttcactccccaggact

SEQ ID NO: 201840 - DNA, 25 bp, Rattus norvegicus
atgtctttcttcagacactcgggaa

SEQ ID NO: 201841 - DNA, 25 bp, Rattus norvegicus
atgtctttcttctctccccaggact

SEQ ID NO: 201842 - DNA, 25 bp, Rattus norvegicus
atgtctttcttctgacactcgggaa

SEQ ID NO: 201843 - DNA, 25 bp, Rattus norvegicus
atgtctttgacacctagaagcgcat

SEQ ID NO: 201844 - DNA, 25 bp, Rattus norvegicus
atgtctttgacagctagaagcgcat

SEQ ID NO: 201845 - DNA, 25 bp, Rattus norvegicus
atgtctttgatcactgtagcacctt

SEQ ID NO: 201846 - DNA, 25 bp, Rattus norvegicus
atgtctttgatctctgtagcacctt

SEQ ID NO: 201847 - DNA, 25 bp, Rattus norvegicus
atgtctttgcatatactcagtgtca

SEQ ID NO: 201848 - DNA, 25 bp, Rattus norvegicus
atgtctttgcatttactcagtgtca

SEQ ID NO: 201849 - DNA, 25 bp, Rattus norvegicus
atgtctttggccattccaaattgtg

SEQ ID NO: 201850 - DNA, 25 bp, Rattus norvegicus
atgtctttggcctttccaaattgtg

SEQ ID NO: 201851 - DNA, 25 bp, Rattus norvegicus
atgtctttggctatcaccagtcaag

SEQ ID NO: 201852 - DNA, 25 bp, Rattus norvegicus
atgtctttggctttcaccagtcaag

SEQ ID NO: 201853 - DNA, 25 bp, Rattus norvegicus
atgtctttggttacagagcacaagg

SEQ ID NO: 201854 - DNA, 25 bp, Rattus norvegicus
atgtctttggtttcagagcacaagg

SEQ ID NO: 201855 - DNA, 25 bp, Rattus norvegicus
atgtctttgtaactcagtgttgaga

SEQ ID NO: 201856 - DNA, 25 bp, Rattus norvegicus
atgtctttgtaagtcagtgttgaga

SEQ ID NO: 201857 - DNA, 25 bp, Rattus norvegicus
atgtctttgtgcaccacatgaatgc

SEQ ID NO: 201858 - DNA, 25 bp, Rattus norvegicus
atgtctttgtgctccacatgaatgc

SEQ ID NO: 201859 - DNA, 25 bp, Rattus norvegicus
atgtctttgttgctacttttgtgtt

SEQ ID NO: 201860 - DNA, 25 bp, Rattus norvegicus
atgtctttgttggtacttttgtgtt

SEQ ID NO: 201861 - DNA, 25 bp, Rattus norvegicus
atgtcttttatcactggtgccctga

SEQ ID NO: 201862 - DNA, 25 bp, Rattus norvegicus
atgtcttttatctctggtgccctga

SEQ ID NO: 201863 - DNA, 25 bp, Rattus norvegicus
atgtcttttgaaacggctcctactg

SEQ ID NO: 201864 - DNA, 25 bp, Rattus norvegicus
atgtcttttgaatcggctcctactg

SEQ ID NO: 201865 - DNA, 25 bp, Rattus norvegicus
atgtcttttgtcactgtctatctgt

SEQ ID NO: 201866 - DNA, 25 bp, Rattus norvegicus
atgtcttttgtctctgtctatctgt

SEQ ID NO: 201867 - DNA, 25 bp, Rattus norvegicus
atgtgaaaacaccagcctttctcac

SEQ ID NO: 201868 - DNA, 25 bp, Rattus norvegicus
atgtgaaaacacgagcctttctcac

SEQ ID NO: 201869 - DNA, 25 bp, Rattus norvegicus
atgtgaaaacgcactcggctgacct

SEQ ID NO: 201870 - DNA, 25 bp, Rattus norvegicus
atgtgaaaacgctctcggctgacct

SEQ ID NO: 201871 - DNA, 25 bp, Rattus norvegicus
atgtgaaaagcccacaccgttctgt

SEQ ID NO: 201872 - DNA, 25 bp, Rattus norvegicus
atgtgaaaagccgacaccgttctgt

SEQ ID NO: 201873 - DNA, 25 bp, Rattus norvegicus
atgtgaaaatctactcgaccgcctt

SEQ ID NO: 201874 - DNA, 25 bp, Rattus norvegicus
atgtgaaaatcttctcgaccgcctt

SEQ ID NO: 201875 - DNA, 25 bp, Rattus norvegicus
atgtgaaacacaatttagtcctcgt

SEQ ID NO: 201876 - DNA, 25 bp, Rattus norvegicus
atgtgaaacacattttagtcctcgt

SEQ ID NO: 201877 - DNA, 25 bp, Rattus norvegicus
atgtgaaacagtctctcttgtcccc

SEQ ID NO: 201878 - DNA, 25 bp, Rattus norvegicus
atgtgaaacagtgtctcttgtcccc

SEQ ID NO: 201879 - DNA, 25 bp, Rattus norvegicus
atgtgaaaccatctcctgcagctta

SEQ ID NO: 201880 - DNA, 25 bp, Rattus norvegicus
atgtgaaaccatgtcctgcagctta

SEQ ID NO: 201881 - DNA, 25 bp, Rattus norvegicus
atgtgaaaccgacacacctgggcca

SEQ ID NO: 201882 - DNA, 25 bp, Rattus norvegicus
atgtgaaaccgagacacctgggcca

SEQ ID NO: 201883 - DNA, 25 bp, Rattus norvegicus
atgtgaaaccgtacttagcacccaa

SEQ ID NO: 201884 - DNA, 25 bp, Rattus norvegicus
atgtgaaaccgttcttagcacccaa

SEQ ID NO: 201885 - DNA, 25 bp, Rattus norvegicus
atgtgaaactggagacttctccttc

SEQ ID NO: 201886 - DNA, 25 bp, Rattus norvegicus
atgtgaaactggtgacttctccttc

SEQ ID NO: 201887 - DNA, 25 bp, Rattus norvegicus
atgtgaaagccccactgaaccgaag

SEQ ID NO: 201888 - DNA, 25 bp, Rattus norvegicus
atgtgaaagcccgactgaaccgaag

SEQ ID NO: 201889 - DNA, 25 bp, Rattus norvegicus
atgtgaaaggcaatcccgtgacctt

SEQ ID NO: 201890 - DNA, 25 bp, Rattus norvegicus
atgtgaaaggcattcccgtgacctt

SEQ ID NO: 201891 - DNA, 25 bp, Rattus norvegicus
atgtgaaatgcccaggatgctataa

SEQ ID NO: 201892 - DNA, 25 bp, Rattus norvegicus
atgtgaaatgccgaggatgctataa

SEQ ID NO: 201893 - DNA, 25 bp, Rattus norvegicus
atgtgaacacatcttactctgaata

SEQ ID NO: 201894 - DNA, 25 bp, Rattus norvegicus
atgtgaacacatgttactctgaata

SEQ ID NO: 201895 - DNA, 25 bp, Rattus norvegicus
atgtgaacaccaccaacctgtggct

SEQ ID NO: 201896 - DNA, 25 bp, Rattus norvegicus
atgtgaacaccagcaacctgtggct

SEQ ID NO: 201897 - DNA, 25 bp, Rattus norvegicus
atgtgaacacccagcttctgatctt

SEQ ID NO: 201898 - DNA, 25 bp, Rattus norvegicus
atgtgaacaccctgcttctgatctt

SEQ ID NO: 201899 - DNA, 25 bp, Rattus norvegicus
atgtgaacagacacttaagctctta

SEQ ID NO: 201900 - DNA, 25 bp, Rattus norvegicus
atgtgaacagactcttaagctctta

SEQ ID NO: 201901 - DNA, 25 bp, Rattus norvegicus
atgtgaaccaagcagtccatcgtcc

SEQ ID NO: 201902 - DNA, 25 bp, Rattus norvegicus
atgtgaaccaaggagtccatcgtcc

SEQ ID NO: 201903 - DNA, 25 bp, Rattus norvegicus
atgtgaacccaacggcgctgctgca

SEQ ID NO: 201904 - DNA, 25 bp, Rattus norvegicus
atgtgaacccaagggcgctgctgca

SEQ ID NO: 201905 - DNA, 25 bp, Rattus norvegicus
atgtgaacccagagacacccctgta

SEQ ID NO: 201906 - DNA, 25 bp, Rattus norvegicus
atgtgaacccagtgacacccctgta

SEQ ID NO: 201907 - DNA, 25 bp, Rattus norvegicus
atgtgaacctcactgggcacagtcc

SEQ ID NO: 201908 - DNA, 25 bp, Rattus norvegicus
atgtgaacctcagtgggcacagtcc

SEQ ID NO: 201909 - DNA, 25 bp, Rattus norvegicus
atgtgaacctccaccagaaatgaag

SEQ ID NO: 201910 - DNA, 25 bp, Rattus norvegicus
atgtgaacctccctgcatcctgaat

SEQ ID NO: 201911 - DNA, 25 bp, Rattus norvegicus
atgtgaacctccgtgcatcctgaat

SEQ ID NO: 201912 - DNA, 25 bp, Rattus norvegicus
atgtgaacctcctccagaaatgaag

SEQ ID NO: 201913 - DNA, 25 bp, Rattus norvegicus
atgtgaacctttctctctctttgaa

SEQ ID NO: 201914 - DNA, 25 bp, Rattus norvegicus
atgtgaacctttgtctctctttgaa

SEQ ID NO: 201915 - DNA, 25 bp, Rattus norvegicus
atgtgaacgtaaatccagagtgcta

SEQ ID NO: 201916 - DNA, 25 bp, Rattus norvegicus
atgtgaacgtaattccagagtgcta

SEQ ID NO: 201917 - DNA, 25 bp, Rattus norvegicus
atgtgaactagtcctgttgatacta

SEQ ID NO: 201918 - DNA, 25 bp, Rattus norvegicus
atgtgaactagtgctgttgatacta

SEQ ID NO: 201919 - DNA, 25 bp, Rattus norvegicus
atgtgaagagcaataccccgttagg

SEQ ID NO: 201920 - DNA, 25 bp, Rattus norvegicus
atgtgaagagcattaccccgttagg

SEQ ID NO: 201921 - DNA, 25 bp, Rattus norvegicus
atgtgaagcaagctgtccccgcgga

SEQ ID NO: 201922 - DNA, 25 bp, Rattus norvegicus
atgtgaagcaaggtgtccccgcgga

SEQ ID NO: 201923 - DNA, 25 bp, Rattus norvegicus
atgtgaagcatcatcagtggcacca

SEQ ID NO: 201924 - DNA, 25 bp, Rattus norvegicus
atgtgaagcatcttcagtggcacca

SEQ ID NO: 201925 - DNA, 25 bp, Rattus norvegicus
atgtgaagcccgctaccattcacgg

SEQ ID NO: 201926 - DNA, 25 bp, Rattus norvegicus
atgtgaagcccggtaccattcacgg

SEQ ID NO: 201927 - DNA, 25 bp, Rattus norvegicus
atgtgaagccgactgagcctctgcc

SEQ ID NO: 201928 - DNA, 25 bp, Rattus norvegicus
atgtgaagccgagtgagcctctgcc

SEQ ID NO: 201929 - DNA, 25 bp, Rattus norvegicus
atgtgaagcctgagtgctacccaga

SEQ ID NO: 201930 - DNA, 25 bp, Rattus norvegicus
atgtgaagcctgtgtgctacccaga

SEQ ID NO: 201931 - DNA, 25 bp, Rattus norvegicus
atgtgaagctctctccgatgatgga

SEQ ID NO: 201932 - DNA, 25 bp, Rattus norvegicus
atgtgaagctctgtccgatgatgga

SEQ ID NO: 201933 - DNA, 25 bp, Rattus norvegicus
atgtgaagggacatgcagacagcct

SEQ ID NO: 201934 - DNA, 25 bp, Rattus norvegicus
atgtgaagggacttgcagacagcct

SEQ ID NO: 201935 - DNA, 25 bp, Rattus norvegicus
atgtgaaggtgactttccgcctgga

SEQ ID NO: 201936 - DNA, 25 bp, Rattus norvegicus
atgtgaaggtgagtttccgcctgga

SEQ ID NO: 201937 - DNA, 25 bp, Rattus norvegicus
atgtgaaggtggcacggaccctacc

SEQ ID NO: 201938 - DNA, 25 bp, Rattus norvegicus
atgtgaaggtgggacggaccctacc

SEQ ID NO: 201939 - DNA, 25 bp, Rattus norvegicus
atgtgaagtcagattcaggcctaca

SEQ ID NO: 201940 - DNA, 25 bp, Rattus norvegicus
atgtgaagtcagtttcaggcctaca

SEQ ID NO: 201941 - DNA, 25 bp, Rattus norvegicus
atgtgaagtgcacttccaagcccgg

SEQ ID NO: 201942 - DNA, 25 bp, Rattus norvegicus
atgtgaagtgcagttccaagcccgg

SEQ ID NO: 201943 - DNA, 25 bp, Rattus norvegicus
atgtgaagtgcccatcgattgctgc

SEQ ID NO: 201944 - DNA, 25 bp, Rattus norvegicus
atgtgaagtgccgatcgattgctgc

SEQ ID NO: 201945 - DNA, 25 bp, Rattus norvegicus
atgtgaatactgactgttgcaatac

SEQ ID NO: 201946 - DNA, 25 bp, Rattus norvegicus
atgtgaatactgtctgttgcaatac

SEQ ID NO: 201947 - DNA, 25 bp, Rattus norvegicus
atgtgaataggactgcccgggcctt

SEQ ID NO: 201948 - DNA, 25 bp, Rattus norvegicus
atgtgaataggagtgcccgggcctt

SEQ ID NO: 201949 - DNA, 25 bp, Rattus norvegicus
atgtgaatatcaccgccatccagga

SEQ ID NO: 201950 - DNA, 25 bp, Rattus norvegicus
atgtgaatatcagcgccatccagga

SEQ ID NO: 201951 - DNA, 25 bp, Rattus norvegicus
atgtgaatcaggcaccggcttgcag

SEQ ID NO: 201952 - DNA, 25 bp, Rattus norvegicus
atgtgaatcagggaccggcttgcag

SEQ ID NO: 201953 - DNA, 25 bp, Rattus norvegicus
atgtgaatcattccctgccaggtgc

SEQ ID NO: 201954 - DNA, 25 bp, Rattus norvegicus
atgtgaatcattgcctgccaggtgc

SEQ ID NO: 201955 - DNA, 25 bp, Rattus norvegicus
atgtgaatccatccagggcccaggt

SEQ ID NO: 201956 - DNA, 25 bp, Rattus norvegicus
atgtgaatccatgcagggcccaggt

SEQ ID NO: 201957 - DNA, 25 bp, Rattus norvegicus
atgtgaatcccaccaacccatggag

SEQ ID NO: 201958 - DNA, 25 bp, Rattus norvegicus
atgtgaatcccagcaacccatggag

SEQ ID NO: 201959 - DNA, 25 bp, Rattus norvegicus
atgtgaatccccacacaagtggagg

SEQ ID NO: 201960 - DNA, 25 bp, Rattus norvegicus
atgtgaatcccctcacaagtggagg

SEQ ID NO: 201961 - DNA, 25 bp, Rattus norvegicus
atgtgaatcctcatccggtccaagt

SEQ ID NO: 201962 - DNA, 25 bp, Rattus norvegicus
atgtgaatcctcttccggtccaagt

SEQ ID NO: 201963 - DNA, 25 bp, Rattus norvegicus
atgtgaatgagtactgccccatgag

SEQ ID NO: 201964 - DNA, 25 bp, Rattus norvegicus
atgtgaatgagttctgccccatgag

SEQ ID NO: 201965 - DNA, 25 bp, Rattus norvegicus
atgtgaatgcagaccccagtccgag

SEQ ID NO: 201966 - DNA, 25 bp, Rattus norvegicus
atgtgaatgcagtccccagtccgag

SEQ ID NO: 201967 - DNA, 25 bp, Rattus norvegicus
atgtgaatgtgcactttcctatccg

SEQ ID NO: 201968 - DNA, 25 bp, Rattus norvegicus
atgtgaatgtgctctttcctatccg

SEQ ID NO: 201969 - DNA, 25 bp, Rattus norvegicus
atgtgaattcttcgtcctcagtgga

SEQ ID NO: 201970 - DNA, 25 bp, Rattus norvegicus
atgtgaattcttggtcctcagtgga

SEQ ID NO: 201971 - DNA, 25 bp, Rattus norvegicus
atgtgaatttctcatctatttctaa

SEQ ID NO: 201972 - DNA, 25 bp, Rattus norvegicus
atgtgaatttctgatctatttctaa

SEQ ID NO: 201973 - DNA, 25 bp, Rattus norvegicus
atgtgaatttgtacgccactgcatc

SEQ ID NO: 201974 - DNA, 25 bp, Rattus norvegicus
atgtgaatttgttcgccactgcatc

SEQ ID NO: 201975 - DNA, 25 bp, Rattus norvegicus
atgtgaattttcagtttcccacctc

SEQ ID NO: 201976 - DNA, 25 bp, Rattus norvegicus
atgtgaattttctgtttcccacctc

SEQ ID NO: 201977 - DNA, 25 bp, Rattus norvegicus
atgtgacacacacactagcaaatcc

SEQ ID NO: 201978 - DNA, 25 bp, Rattus norvegicus
atgtgacacacagactagcaaatcc

SEQ ID NO: 201979 - DNA, 25 bp, Rattus norvegicus
atgtgacacaccactagatctctgc

SEQ ID NO: 201980 - DNA, 25 bp, Rattus norvegicus
atgtgacacacctctagatctctgc

SEQ ID NO: 201981 - DNA, 25 bp, Rattus norvegicus
atgtgacacactcctgtaccattaa

SEQ ID NO: 201982 - DNA, 25 bp, Rattus norvegicus
atgtgacacactgctgtaccattaa

SEQ ID NO: 201983 - DNA, 25 bp, Rattus norvegicus
atgtgacacttgcaggacactacaa

SEQ ID NO: 201984 - DNA, 25 bp, Rattus norvegicus
atgtgacacttggaggacactacaa

SEQ ID NO: 201985 - DNA, 25 bp, Rattus norvegicus
atgtgacagtatagacagcggtgct

SEQ ID NO: 201986 - DNA, 25 bp, Rattus norvegicus
atgtgacagtattgacagcggtgct

SEQ ID NO: 201987 - DNA, 25 bp, Rattus norvegicus
atgtgacatcatcccatgttggcaa

SEQ ID NO: 201988 - DNA, 25 bp, Rattus norvegicus
atgtgacatcatgccatgttggcaa

SEQ ID NO: 201989 - DNA, 25 bp, Rattus norvegicus
atgtgacatgacacaagtacctgtg

SEQ ID NO: 201990 - DNA, 25 bp, Rattus norvegicus
atgtgacatgactcaagtacctgtg

SEQ ID NO: 201991 - DNA, 25 bp, Rattus norvegicus
atgtgacattctagatgactctgag

SEQ ID NO: 201992 - DNA, 25 bp, Rattus norvegicus
atgtgacattctctcattccacttc

SEQ ID NO: 201993 - DNA, 25 bp, Rattus norvegicus
atgtgacattctgtcattccacttc

SEQ ID NO: 201994 - DNA, 25 bp, Rattus norvegicus
atgtgacattcttgatgactctgag

SEQ ID NO: 201995 - DNA, 25 bp, Rattus norvegicus
atgtgaccaattacaaatgttgtgt

SEQ ID NO: 201996 - DNA, 25 bp, Rattus norvegicus
atgtgaccaatttcaaatgttgtgt

SEQ ID NO: 201997 - DNA, 25 bp, Rattus norvegicus
atgtgaccaggaagcccacgagtct

SEQ ID NO: 201998 - DNA, 25 bp, Rattus norvegicus
atgtgaccaggaccttggagtgcct

SEQ ID NO: 201999 - DNA, 25 bp, Rattus norvegicus
atgtgaccaggagcttggagtgcct

SEQ ID NO: 202000 - DNA, 25 bp, Rattus norvegicus
atgtgaccaggatgcccacgagtct

SEQ ID NO: 202001 - DNA, 25 bp, Rattus norvegicus
atgtgaccatgacccagtgtgccaa

SEQ ID NO: 202002 - DNA, 25 bp, Rattus norvegicus
atgtgaccatgagccagtgtgccaa

SEQ ID NO: 202003 - DNA, 25 bp, Rattus norvegicus
atgtgaccatggatgacggacgcat

SEQ ID NO: 202004 - DNA, 25 bp, Rattus norvegicus
atgtgaccatggttgacggacgcat

SEQ ID NO: 202005 - DNA, 25 bp, Rattus norvegicus
atgtgacccaacactaactgacact

SEQ ID NO: 202006 - DNA, 25 bp, Rattus norvegicus
atgtgacccaactctaactgacact

SEQ ID NO: 202007 - DNA, 25 bp, Rattus norvegicus
atgtgacccaggagcagctgagcca

SEQ ID NO: 202008 - DNA, 25 bp, Rattus norvegicus
atgtgacccaggtgcagctgagcca

SEQ ID NO: 202009 - DNA, 25 bp, Rattus norvegicus
atgtgacccatcagcactattttgg

SEQ ID NO: 202010 - DNA, 25 bp, Rattus norvegicus
atgtgacccatctgcactattttgg

SEQ ID NO: 202011 - DNA, 25 bp, Rattus norvegicus
atgtgaccccagcaactttggtgat

SEQ ID NO: 202012 - DNA, 25 bp, Rattus norvegicus
atgtgaccccagcatcattggagga

SEQ ID NO: 202013 - DNA, 25 bp, Rattus norvegicus
atgtgaccccaggaactttggtgat

SEQ ID NO: 202014 - DNA, 25 bp, Rattus norvegicus
atgtgaccccaggatcattggagga

SEQ ID NO: 202015 - DNA, 25 bp, Rattus norvegicus
atgtgacccggacacttgttcaaat

SEQ ID NO: 202016 - DNA, 25 bp, Rattus norvegicus
atgtgacccggagacttgttcaaat

SEQ ID NO: 202017 - DNA, 25 bp, Rattus norvegicus
atgtgacccttcatacagttccatt

SEQ ID NO: 202018 - DNA, 25 bp, Rattus norvegicus
atgtgacccttcttacagttccatt

SEQ ID NO: 202019 - DNA, 25 bp, Rattus norvegicus
atgtgaccctttaaccttggtctca

SEQ ID NO: 202020 - DNA, 25 bp, Rattus norvegicus
atgtgacccttttaccttggtctca

SEQ ID NO: 202021 - DNA, 25 bp, Rattus norvegicus
atgtgacctggcaccagtcatgagg

SEQ ID NO: 202022 - DNA, 25 bp, Rattus norvegicus
atgtgacctggctccagtcatgagg

SEQ ID NO: 202023 - DNA, 25 bp, Rattus norvegicus
atgtgacctgggatgactttaccaa

SEQ ID NO: 202024 - DNA, 25 bp, Rattus norvegicus
atgtgacctgggttgactttaccaa

SEQ ID NO: 202025 - DNA, 25 bp, Rattus norvegicus
atgtgaccttcgagacaactgcact

SEQ ID NO: 202026 - DNA, 25 bp, Rattus norvegicus
atgtgaccttcgtgacaactgcact

SEQ ID NO: 202027 - DNA, 25 bp, Rattus norvegicus
atgtgacgactcatcacattaccat

SEQ ID NO: 202028 - DNA, 25 bp, Rattus norvegicus
atgtgacgactcttcacattaccat

SEQ ID NO: 202029 - DNA, 25 bp, Rattus norvegicus
atgtgacgataaaagctttgctctg

SEQ ID NO: 202030 - DNA, 25 bp, Rattus norvegicus
atgtgacgataatagctttgctctg

SEQ ID NO: 202031 - DNA, 25 bp, Rattus norvegicus
atgtgacggtatcagcgagcagcca

SEQ ID NO: 202032 - DNA, 25 bp, Rattus norvegicus
atgtgacggtatgagcgagcagcca

SEQ ID NO: 202033 - DNA, 25 bp, Rattus norvegicus
atgtgacgtctgactttttgtctca

SEQ ID NO: 202034 - DNA, 25 bp, Rattus norvegicus
atgtgacgtctgtctttttgtctca

SEQ ID NO: 202035 - DNA, 25 bp, Rattus norvegicus
atgtgacgtgatattatccttcggg

SEQ ID NO: 202036 - DNA, 25 bp, Rattus norvegicus
atgtgacgtgattttatccttcggg

SEQ ID NO: 202037 - DNA, 25 bp, Rattus norvegicus
atgtgactaaggactccatgagttc

SEQ ID NO: 202038 - DNA, 25 bp, Rattus norvegicus
atgtgactaaggtctccatgagttc

SEQ ID NO: 202039 - DNA, 25 bp, Rattus norvegicus
atgtgactaggaaattgtgtttttc

SEQ ID NO: 202040 - DNA, 25 bp, Rattus norvegicus
atgtgactaggatattgtgtttttc

SEQ ID NO: 202041 - DNA, 25 bp, Rattus norvegicus
atgtgactcacccataacggccaca

SEQ ID NO: 202042 - DNA, 25 bp, Rattus norvegicus
atgtgactcaccgataacggccaca

SEQ ID NO: 202043 - DNA, 25 bp, Rattus norvegicus
atgtgactcattaacgttctgagca

SEQ ID NO: 202044 - DNA, 25 bp, Rattus norvegicus
atgtgactcatttacgttctgagca

SEQ ID NO: 202045 - DNA, 25 bp, Rattus norvegicus
atgtgactccttactccaactatag

SEQ ID NO: 202046 - DNA, 25 bp, Rattus norvegicus
atgtgactcctttctccaactatag

SEQ ID NO: 202047 - DNA, 25 bp, Rattus norvegicus
atgtgactctttcatgcaacctcat

SEQ ID NO: 202048 - DNA, 25 bp, Rattus norvegicus
atgtgactctttgatgcaacctcat

SEQ ID NO: 202049 - DNA, 25 bp, Rattus norvegicus
atgtgactgaccatattcatgcggg

SEQ ID NO: 202050 - DNA, 25 bp, Rattus norvegicus
atgtgactgaccttattcatgcggg

SEQ ID NO: 202051 - DNA, 25 bp, Rattus norvegicus
atgtgactggccagagtccatcatc

SEQ ID NO: 202052 - DNA, 25 bp, Rattus norvegicus
atgtgactggcctgagtccatcatc

SEQ ID NO: 202053 - DNA, 25 bp, Rattus norvegicus
atgtgactgtccattaagccatgcc

SEQ ID NO: 202054 - DNA, 25 bp, Rattus norvegicus
atgtgactgtcctttaagccatgcc

SEQ ID NO: 202055 - DNA, 25 bp, Rattus norvegicus
atgtgacttcatatcactgctgtat

SEQ ID NO: 202056 - DNA, 25 bp, Rattus norvegicus
atgtgacttcatttcactgctgtat

SEQ ID NO: 202057 - DNA, 25 bp, Rattus norvegicus
atgtgacttggacgctattcacctc

SEQ ID NO: 202058 - DNA, 25 bp, Rattus norvegicus
atgtgacttggaggctattcacctc

SEQ ID NO: 202059 - DNA, 25 bp, Rattus norvegicus
atgtgacttgtcatggaggagctct

SEQ ID NO: 202060 - DNA, 25 bp, Rattus norvegicus
atgtgacttgtcttggaggagctct

SEQ ID NO: 202061 - DNA, 25 bp, Rattus norvegicus
atgtgagacaccagaggcctagagg

SEQ ID NO: 202062 - DNA, 25 bp, Rattus norvegicus
atgtgagacaccatgttaaatcaac

SEQ ID NO: 202063 - DNA, 25 bp, Rattus norvegicus
atgtgagacacctgaggcctagagg

SEQ ID NO: 202064 - DNA, 25 bp, Rattus norvegicus
atgtgagacaccttgttaaatcaac

SEQ ID NO: 202065 - DNA, 25 bp, Rattus norvegicus
atgtgagacctcagcttttgctcca

SEQ ID NO: 202066 - DNA, 25 bp, Rattus norvegicus
atgtgagacctctgcttttgctcca

SEQ ID NO: 202067 - DNA, 25 bp, Rattus norvegicus
atgtgagactgtaagccacgccctc

SEQ ID NO: 202068 - DNA, 25 bp, Rattus norvegicus
atgtgagactgttagccacgccctc

SEQ ID NO: 202069 - DNA, 25 bp, Rattus norvegicus
atgtgagacttcacgggctttccag

SEQ ID NO: 202070 - DNA, 25 bp, Rattus norvegicus
atgtgagacttctcgggctttccag

SEQ ID NO: 202071 - DNA, 25 bp, Rattus norvegicus
atgtgagagaaaagctgccctgaca

SEQ ID NO: 202072 - DNA, 25 bp, Rattus norvegicus
atgtgagagaaatgctgccctgaca

SEQ ID NO: 202073 - DNA, 25 bp, Rattus norvegicus
atgtgagatctgatcttctagctgg

SEQ ID NO: 202074 - DNA, 25 bp, Rattus norvegicus
atgtgagatctgttcttctagctgg

SEQ ID NO: 202075 - DNA, 25 bp, Rattus norvegicus
atgtgagattcacgcctagggttat

SEQ ID NO: 202076 - DNA, 25 bp, Rattus norvegicus
atgtgagattcaggcctagggttat

SEQ ID NO: 202077 - DNA, 25 bp, Rattus norvegicus
atgtgagcaatcctgtataaaacga

SEQ ID NO: 202078 - DNA, 25 bp, Rattus norvegicus
atgtgagcaatcgtgtataaaacga

SEQ ID NO: 202079 - DNA, 25 bp, Rattus norvegicus
atgtgagcaatgctatcggtcccct

SEQ ID NO: 202080 - DNA, 25 bp, Rattus norvegicus
atgtgagcaatggtatcggtcccct

SEQ ID NO: 202081 - DNA, 25 bp, Rattus norvegicus
atgtgagcaccgattatacccaaaa

SEQ ID NO: 202082 - DNA, 25 bp, Rattus norvegicus
atgtgagcaccgtttatacccaaaa

SEQ ID NO: 202083 - DNA, 25 bp, Rattus norvegicus
atgtgagcagccacgacggcaagct

SEQ ID NO: 202084 - DNA, 25 bp, Rattus norvegicus
atgtgagcagcctcgacggcaagct

SEQ ID NO: 202085 - DNA, 25 bp, Rattus norvegicus
atgtgagcagtcactgtttctctta

SEQ ID NO: 202086 - DNA, 25 bp, Rattus norvegicus
atgtgagcagtctctgtttctctta

SEQ ID NO: 202087 - DNA, 25 bp, Rattus norvegicus
atgtgagcatccagtccagcttgct

SEQ ID NO: 202088 - DNA, 25 bp, Rattus norvegicus
atgtgagcatcctgtccagcttgct

SEQ ID NO: 202089 - DNA, 25 bp, Rattus norvegicus
atgtgagcatcgcagttgtttaaac

SEQ ID NO: 202090 - DNA, 25 bp, Rattus norvegicus
atgtgagcatcggagttgtttaaac

SEQ ID NO: 202091 - DNA, 25 bp, Rattus norvegicus
atgtgagcatctaaccaaccggtga

SEQ ID NO: 202092 - DNA, 25 bp, Rattus norvegicus
atgtgagcatcttaccaaccggtga

SEQ ID NO: 202093 - DNA, 25 bp, Rattus norvegicus
atgtgagcattaaccctgttataga

SEQ ID NO: 202094 - DNA, 25 bp, Rattus norvegicus
atgtgagcattatccctgttataga

SEQ ID NO: 202095 - DNA, 25 bp, Rattus norvegicus
atgtgagccatgattctacagtttg

SEQ ID NO: 202096 - DNA, 25 bp, Rattus norvegicus
atgtgagccatgtttctacagtttg

SEQ ID NO: 202097 - DNA, 25 bp, Rattus norvegicus
atgtgagcccagacattcttctgaa

SEQ ID NO: 202098 - DNA, 25 bp, Rattus norvegicus
atgtgagcccagtcattcttctgaa

SEQ ID NO: 202099 - DNA, 25 bp, Rattus norvegicus
atgtgagcctttctcctaccgaggt

SEQ ID NO: 202100 - DNA, 25 bp, Rattus norvegicus
atgtgagcctttgtcctaccgaggt

SEQ ID NO: 202101 - DNA, 25 bp, Rattus norvegicus
atgtgagcgaacactcatgttcctg

SEQ ID NO: 202102 - DNA, 25 bp, Rattus norvegicus
atgtgagcgaactctcatgttcctg

SEQ ID NO: 202103 - DNA, 25 bp, Rattus norvegicus
atgtgagctgtgatgtttttcttta

SEQ ID NO: 202104 - DNA, 25 bp, Rattus norvegicus
atgtgagctgtgttgtttttcttta

SEQ ID NO: 202105 - DNA, 25 bp, Rattus norvegicus
atgtgaggaaaccaccctgtgagct

SEQ ID NO: 202106 - DNA, 25 bp, Rattus norvegicus
atgtgaggaaacgaccctgtgagct

SEQ ID NO: 202107 - DNA, 25 bp, Rattus norvegicus
atgtgaggagtcagcctcctttgac

SEQ ID NO: 202108 - DNA, 25 bp, Rattus norvegicus
atgtgaggagtctgcctcctttgac

SEQ ID NO: 202109 - DNA, 25 bp, Rattus norvegicus
atgtgaggatttcttttatggctaa

SEQ ID NO: 202110 - DNA, 25 bp, Rattus norvegicus
atgtgaggatttgttttatggctaa

SEQ ID NO: 202111 - DNA, 25 bp, Rattus norvegicus
atgtgaggcaccagcagctcaccca

SEQ ID NO: 202112 - DNA, 25 bp, Rattus norvegicus
atgtgaggcacctgcagctcaccca

SEQ ID NO: 202113 - DNA, 25 bp, Rattus norvegicus
atgtgaggccatcttacaaccgctt

SEQ ID NO: 202114 - DNA, 25 bp, Rattus norvegicus
atgtgaggccatgttacaaccgctt

SEQ ID NO: 202115 - DNA, 25 bp, Rattus norvegicus
atgtgaggcctcactgaatttcaga

SEQ ID NO: 202116 - DNA, 25 bp, Rattus norvegicus
atgtgaggcctctctgaatttcaga

SEQ ID NO: 202117 - DNA, 25 bp, Rattus norvegicus
atgtgaggcgtaatttgccccagtc

SEQ ID NO: 202118 - DNA, 25 bp, Rattus norvegicus
atgtgaggcgtattttgccccagtc

SEQ ID NO: 202119 - DNA, 25 bp, Rattus norvegicus
atgtgagggagcctcttcattgcca

SEQ ID NO: 202120 - DNA, 25 bp, Rattus norvegicus
atgtgagggagcgtcttcattgcca

SEQ ID NO: 202121 - DNA, 25 bp, Rattus norvegicus
atgtgaggtagcatcctggctggtc

SEQ ID NO: 202122 - DNA, 25 bp, Rattus norvegicus
atgtgaggtagcttcctggctggtc

SEQ ID NO: 202123 - DNA, 25 bp, Rattus norvegicus
atgtgaggtcatactatctttataa

SEQ ID NO: 202124 - DNA, 25 bp, Rattus norvegicus
atgtgaggtcattctatctttataa

SEQ ID NO: 202125 - DNA, 25 bp, Rattus norvegicus
atgtgaggtctccaatcctgtcagt

SEQ ID NO: 202126 - DNA, 25 bp, Rattus norvegicus
atgtgaggtctcgaatcctgtcagt

SEQ ID NO: 202127 - DNA, 25 bp, Rattus norvegicus
atgtgaggtgtaccttttcctgctc

SEQ ID NO: 202128 - DNA, 25 bp, Rattus norvegicus
atgtgaggtgtagcttttcctgctc

SEQ ID NO: 202129 - DNA, 25 bp, Rattus norvegicus
atgtgagtagacctgctgtggccaa

SEQ ID NO: 202130 - DNA, 25 bp, Rattus norvegicus
atgtgagtagacgtgctgtggccaa

SEQ ID NO: 202131 - DNA, 25 bp, Rattus norvegicus
atgtgagtagcacctacccagaagc

SEQ ID NO: 202132 - DNA, 25 bp, Rattus norvegicus
atgtgagtagcagctacccagaagc

SEQ ID NO: 202133 - DNA, 25 bp, Rattus norvegicus
atgtgagtagccactggtcctgttc

SEQ ID NO: 202134 - DNA, 25 bp, Rattus norvegicus
atgtgagtagcctctggtcctgttc

SEQ ID NO: 202135 - DNA, 25 bp, Rattus norvegicus
atgtgagtcacacctgccgccatga

SEQ ID NO: 202136 - DNA, 25 bp, Rattus norvegicus
atgtgagtcacagctgccgccatga

SEQ ID NO: 202137 - DNA, 25 bp, Rattus norvegicus
atgtgagtcctactttggcaccact

SEQ ID NO: 202138 - DNA, 25 bp, Rattus norvegicus
atgtgagtcctagtttggcaccact

SEQ ID NO: 202139 - DNA, 25 bp, Rattus norvegicus
atgtgagtgaaccttctccgtttct

SEQ ID NO: 202140 - DNA, 25 bp, Rattus norvegicus
atgtgagtgaacgttctccgtttct

SEQ ID NO: 202141 - DNA, 25 bp, Rattus norvegicus
atgtgagtgcaactagctccatggg

SEQ ID NO: 202142 - DNA, 25 bp, Rattus norvegicus
atgtgagtgcaagtagctccatggg

SEQ ID NO: 202143 - DNA, 25 bp, Rattus norvegicus
atgtgagtgtttctacgtgtgcttt

SEQ ID NO: 202144 - DNA, 25 bp, Rattus norvegicus
atgtgagtgtttgtacgtgtgcttt

SEQ ID NO: 202145 - DNA, 25 bp, Rattus norvegicus
atgtgagttaaaaccctaagcattt

SEQ ID NO: 202146 - DNA, 25 bp, Rattus norvegicus
atgtgagttaaatccctaagcattt

SEQ ID NO: 202147 - DNA, 25 bp, Rattus norvegicus
atgtgagttacaactcaactgacta

SEQ ID NO: 202148 - DNA, 25 bp, Rattus norvegicus
atgtgagttacatctcaactgacta

SEQ ID NO: 202149 - DNA, 25 bp, Rattus norvegicus
atgtgagttagtctcggtgccagca

SEQ ID NO: 202150 - DNA, 25 bp, Rattus norvegicus
atgtgagttagtgtcggtgccagca

SEQ ID NO: 202151 - DNA, 25 bp, Rattus norvegicus
atgtgagttcatcctagcctgtctc

SEQ ID NO: 202152 - DNA, 25 bp, Rattus norvegicus
atgtgagttcatgctagcctgtctc

SEQ ID NO: 202153 - DNA, 25 bp, Rattus norvegicus
atgtgagttccaccgggccaagtgc

SEQ ID NO: 202154 - DNA, 25 bp, Rattus norvegicus
atgtgagttccagcgggccaagtgc

SEQ ID NO: 202155 - DNA, 25 bp, Rattus norvegicus
atgtgagttcttacttggagggcca

SEQ ID NO: 202156 - DNA, 25 bp, Rattus norvegicus
atgtgagttctttcttggagggcca

SEQ ID NO: 202157 - DNA, 25 bp, Rattus norvegicus
atgtgagttttcactaagcagcttc

SEQ ID NO: 202158 - DNA, 25 bp, Rattus norvegicus
atgtgagttttctctaagcagcttc

SEQ ID NO: 202159 - DNA, 25 bp, Rattus norvegicus
atgtgataacacagcccgagctcac

SEQ ID NO: 202160 - DNA, 25 bp, Rattus norvegicus
atgtgataacactgcccgagctcac

SEQ ID NO: 202161 - DNA, 25 bp, Rattus norvegicus
atgtgataatatatctctggttcta

SEQ ID NO: 202162 - DNA, 25 bp, Rattus norvegicus
atgtgataatatttctctggttcta

SEQ ID NO: 202163 - DNA, 25 bp, Rattus norvegicus
atgtgatacaaaaacttaccagtga

SEQ ID NO: 202164 - DNA, 25 bp, Rattus norvegicus
atgtgatacaaatacttaccagtga

SEQ ID NO: 202165 - DNA, 25 bp, Rattus norvegicus
atgtgatacacacccaacacttgtc

SEQ ID NO: 202166 - DNA, 25 bp, Rattus norvegicus
atgtgatacacagccaacacttgtc

SEQ ID NO: 202167 - DNA, 25 bp, Rattus norvegicus
atgtgatagcttaagatcctccctt

SEQ ID NO: 202168 - DNA, 25 bp, Rattus norvegicus
atgtgatagctttagatcctccctt

SEQ ID NO: 202169 - DNA, 25 bp, Rattus norvegicus
atgtgatcacaacaggtggcctaaa

SEQ ID NO: 202170 - DNA, 25 bp, Rattus norvegicus
atgtgatcacaagaggtggcctaaa

SEQ ID NO: 202171 - DNA, 25 bp, Rattus norvegicus
atgtgatcacttaccagtttgagag

SEQ ID NO: 202172 - DNA, 25 bp, Rattus norvegicus
atgtgatcactttccagtttgagag

SEQ ID NO: 202173 - DNA, 25 bp, Rattus norvegicus
atgtgatcagacagccgttgggtcc

SEQ ID NO: 202174 - DNA, 25 bp, Rattus norvegicus
atgtgatcagactgccgttgggtcc

SEQ ID NO: 202175 - DNA, 25 bp, Rattus norvegicus
atgtgatcatgcattcttctctata

SEQ ID NO: 202176 - DNA, 25 bp, Rattus norvegicus
atgtgatcatgcctttcaccatcgt

SEQ ID NO: 202177 - DNA, 25 bp, Rattus norvegicus
atgtgatcatgcgtttcaccatcgt

SEQ ID NO: 202178 - DNA, 25 bp, Rattus norvegicus
atgtgatcatgctttcttctctata

SEQ ID NO: 202179 - DNA, 25 bp, Rattus norvegicus
atgtgatccagacgctgagacccgt

SEQ ID NO: 202180 - DNA, 25 bp, Rattus norvegicus
atgtgatccagaggctgagacccgt

SEQ ID NO: 202181 - DNA, 25 bp, Rattus norvegicus
atgtgatccccacagccttgtggag

SEQ ID NO: 202182 - DNA, 25 bp, Rattus norvegicus
atgtgatccccagagccttgtggag

SEQ ID NO: 202183 - DNA, 25 bp, Rattus norvegicus
atgtgatcccgtaaagtgtgtaagc

SEQ ID NO: 202184 - DNA, 25 bp, Rattus norvegicus
atgtgatcccgttaagtgtgtaagc

SEQ ID NO: 202185 - DNA, 25 bp, Rattus norvegicus
atgtgatccgaaagcacgtagatct

SEQ ID NO: 202186 - DNA, 25 bp, Rattus norvegicus
atgtgatccgaatgcacgtagatct

SEQ ID NO: 202187 - DNA, 25 bp, Rattus norvegicus
atgtgatctcctctgtttgtttcga

SEQ ID NO: 202188 - DNA, 25 bp, Rattus norvegicus
atgtgatctcctgtgtttgtttcga

SEQ ID NO: 202189 - DNA, 25 bp, Rattus norvegicus
atgtgatctgccatacatgcactgt

SEQ ID NO: 202190 - DNA, 25 bp, Rattus norvegicus
atgtgatctgccttacatgcactgt

SEQ ID NO: 202191 - DNA, 25 bp, Rattus norvegicus
atgtgatctggcagtacactgtctt

SEQ ID NO: 202192 - DNA, 25 bp, Rattus norvegicus
atgtgatctggccttcaagagcagt

SEQ ID NO: 202193 - DNA, 25 bp, Rattus norvegicus
atgtgatctggcgttcaagagcagt

SEQ ID NO: 202194 - DNA, 25 bp, Rattus norvegicus
atgtgatctggctgtacactgtctt

SEQ ID NO: 202195 - DNA, 25 bp, Rattus norvegicus
atgtgatctgtgctccggtggcccc

SEQ ID NO: 202196 - DNA, 25 bp, Rattus norvegicus
atgtgatctgtggtccggtggcccc

SEQ ID NO: 202197 - DNA, 25 bp, Rattus norvegicus
atgtgatcttcaaagctctgggcca

SEQ ID NO: 202198 - DNA, 25 bp, Rattus norvegicus
atgtgatcttcaccttggattcctt

SEQ ID NO: 202199 - DNA, 25 bp, Rattus norvegicus
atgtgatcttcagcttggattcctt

SEQ ID NO: 202200 - DNA, 25 bp, Rattus norvegicus
atgtgatcttcatagctctgggcca

SEQ ID NO: 202201 - DNA, 25 bp, Rattus norvegicus
atgtgatgaaatccgtaatgtctgg

SEQ ID NO: 202202 - DNA, 25 bp, Rattus norvegicus
atgtgatgaaatgcgtaatgtctgg

SEQ ID NO: 202203 - DNA, 25 bp, Rattus norvegicus
atgtgatgaatcacggagccttctc

SEQ ID NO: 202204 - DNA, 25 bp, Rattus norvegicus
atgtgatgaatctcggagccttctc

SEQ ID NO: 202205 - DNA, 25 bp, Rattus norvegicus
atgtgatgactcctggctatggctc

SEQ ID NO: 202206 - DNA, 25 bp, Rattus norvegicus
atgtgatgactcgtggctatggctc

SEQ ID NO: 202207 - DNA, 25 bp, Rattus norvegicus
atgtgatgccagctacttactgtga

SEQ ID NO: 202208 - DNA, 25 bp, Rattus norvegicus
atgtgatgccaggtacttactgtga

SEQ ID NO: 202209 - DNA, 25 bp, Rattus norvegicus
atgtgatgctaactgttgccctctt

SEQ ID NO: 202210 - DNA, 25 bp, Rattus norvegicus
atgtgatgctaagtgttgccctctt

SEQ ID NO: 202211 - DNA, 25 bp, Rattus norvegicus
atgtgatggaagcttacctggccct

SEQ ID NO: 202212 - DNA, 25 bp, Rattus norvegicus
atgtgatggaaggttacctggccct

SEQ ID NO: 202213 - DNA, 25 bp, Rattus norvegicus
atgtgatggctgcaactggtctaca

SEQ ID NO: 202214 - DNA, 25 bp, Rattus norvegicus
atgtgatggctggaactggtctaca

SEQ ID NO: 202215 - DNA, 25 bp, Rattus norvegicus
atgtgatgtcacagttgctgacgtt

SEQ ID NO: 202216 - DNA, 25 bp, Rattus norvegicus
atgtgatgtcactgttgctgacgtt

SEQ ID NO: 202217 - DNA, 25 bp, Rattus norvegicus
atgtgatgtcccctgtcggaagtta

SEQ ID NO: 202218 - DNA, 25 bp, Rattus norvegicus
atgtgatgtcccgtgtcggaagtta

SEQ ID NO: 202219 - DNA, 25 bp, Rattus norvegicus
atgtgattacagcaaggacggtctt

SEQ ID NO: 202220 - DNA, 25 bp, Rattus norvegicus
atgtgattacaggaaggacggtctt

SEQ ID NO: 202221 - DNA, 25 bp, Rattus norvegicus
atgtgattaccgctgtattcccaaa

SEQ ID NO: 202222 - DNA, 25 bp, Rattus norvegicus
atgtgattaccggtgtattcccaaa

SEQ ID NO: 202223 - DNA, 25 bp, Rattus norvegicus
atgtgattattgagtctctcggcca

SEQ ID NO: 202224 - DNA, 25 bp, Rattus norvegicus
atgtgattattgtgtctctcggcca

SEQ ID NO: 202225 - DNA, 25 bp, Rattus norvegicus
atgtgattctcaatttctccctcta

SEQ ID NO: 202226 - DNA, 25 bp, Rattus norvegicus
atgtgattctcattttctccctcta

SEQ ID NO: 202227 - DNA, 25 bp, Rattus norvegicus
atgtgattctgaattctccttctag

SEQ ID NO: 202228 - DNA, 25 bp, Rattus norvegicus
atgtgattctgatttctccttctag

SEQ ID NO: 202229 - DNA, 25 bp, Rattus norvegicus
atgtgattctgcagtgtgttcgata

SEQ ID NO: 202230 - DNA, 25 bp, Rattus norvegicus
atgtgattctgctgtgtgttcgata

SEQ ID NO: 202231 - DNA, 25 bp, Rattus norvegicus
atgtgattcttcctgggctgcagcc

SEQ ID NO: 202232 - DNA, 25 bp, Rattus norvegicus
atgtgattcttcgtgggctgcagcc

SEQ ID NO: 202233 - DNA, 25 bp, Rattus norvegicus
atgtgattgccaaacacttgctggg

SEQ ID NO: 202234 - DNA, 25 bp, Rattus norvegicus
atgtgattgccatacacttgctggg

SEQ ID NO: 202235 - DNA, 25 bp, Rattus norvegicus
atgtgattgtcccatctggagctac

SEQ ID NO: 202236 - DNA, 25 bp, Rattus norvegicus
atgtgattgtccgatctggagctac

SEQ ID NO: 202237 - DNA, 25 bp, Rattus norvegicus
atgtgatttcctcgctgcgtcttct

SEQ ID NO: 202238 - DNA, 25 bp, Rattus norvegicus
atgtgatttcctggctgcgtcttct

SEQ ID NO: 202239 - DNA, 25 bp, Rattus norvegicus
atgtgatttgctccatttacctggg

SEQ ID NO: 202240 - DNA, 25 bp, Rattus norvegicus
atgtgatttgctgcatttacctggg

SEQ ID NO: 202241 - DNA, 25 bp, Rattus norvegicus
atgtgattttggcaactccttaaaa

SEQ ID NO: 202242 - DNA, 25 bp, Rattus norvegicus
atgtgattttgggaactccttaaaa

SEQ ID NO: 202243 - DNA, 25 bp, Rattus norvegicus
atgtgcaaaagaatccagttggcag

SEQ ID NO: 202244 - DNA, 25 bp, Rattus norvegicus
atgtgcaaaagattccagttggcag

SEQ ID NO: 202245 - DNA, 25 bp, Rattus norvegicus
atgtgcaaactgagctgggtcaccc

SEQ ID NO: 202246 - DNA, 25 bp, Rattus norvegicus
atgtgcaaactgtgctgggtcaccc

SEQ ID NO: 202247 - DNA, 25 bp, Rattus norvegicus
atgtgcaaagaccagcgtgccgtgt

SEQ ID NO: 202248 - DNA, 25 bp, Rattus norvegicus
atgtgcaaagacgagcgtgccgtgt

SEQ ID NO: 202249 - DNA, 25 bp, Rattus norvegicus
atgtgcaaagcactctgtctccagg

SEQ ID NO: 202250 - DNA, 25 bp, Rattus norvegicus
atgtgcaaagcagtctgtctccagg

SEQ ID NO: 202251 - DNA, 25 bp, Rattus norvegicus
atgtgcaactccctcaatgcaggtt

SEQ ID NO: 202252 - DNA, 25 bp, Rattus norvegicus
atgtgcaactccgtcaatgcaggtt

SEQ ID NO: 202253 - DNA, 25 bp, Rattus norvegicus
atgtgcaactgaaaagcccttcctt

SEQ ID NO: 202254 - DNA, 25 bp, Rattus norvegicus
atgtgcaactgataagcccttcctt

SEQ ID NO: 202255 - DNA, 25 bp, Rattus norvegicus
atgtgcaaggatactgtttgtgttt

SEQ ID NO: 202256 - DNA, 25 bp, Rattus norvegicus
atgtgcaaggattctgtttgtgttt

SEQ ID NO: 202257 - DNA, 25 bp, Rattus norvegicus
atgtgcaataacctggtgtcccggg

SEQ ID NO: 202258 - DNA, 25 bp, Rattus norvegicus
atgtgcaataacgtggtgtcccggg

SEQ ID NO: 202259 - DNA, 25 bp, Rattus norvegicus
atgtgcaatctcattgccctggttt

SEQ ID NO: 202260 - DNA, 25 bp, Rattus norvegicus
atgtgcaatctctttgccctggttt

SEQ ID NO: 202261 - DNA, 25 bp, Rattus norvegicus
atgtgcacacacacgtgtaccaaat

SEQ ID NO: 202262 - DNA, 25 bp, Rattus norvegicus
atgtgcacacactcgtgtaccaaat

SEQ ID NO: 202263 - DNA, 25 bp, Rattus norvegicus
atgtgcacacatccaggctgtctag

SEQ ID NO: 202264 - DNA, 25 bp, Rattus norvegicus
atgtgcacacatgcaggctgtctag

SEQ ID NO: 202265 - DNA, 25 bp, Rattus norvegicus
atgtgcacactcagctggatcgtgt

SEQ ID NO: 202266 - DNA, 25 bp, Rattus norvegicus
atgtgcacactctgctggatcgtgt

SEQ ID NO: 202267 - DNA, 25 bp, Rattus norvegicus
atgtgcacatatcaagctttgtctt

SEQ ID NO: 202268 - DNA, 25 bp, Rattus norvegicus
atgtgcacatatgaagctttgtctt

SEQ ID NO: 202269 - DNA, 25 bp, Rattus norvegicus
atgtgcaccactccatactgagatg

SEQ ID NO: 202270 - DNA, 25 bp, Rattus norvegicus
atgtgcaccactgcatactgagatg

SEQ ID NO: 202271 - DNA, 25 bp, Rattus norvegicus
atgtgcaccagacccatgcgcgtct

SEQ ID NO: 202272 - DNA, 25 bp, Rattus norvegicus
atgtgcaccagagccatgcgcgtct

SEQ ID NO: 202273 - DNA, 25 bp, Rattus norvegicus
atgtgcaccagcagtttcactgaag

SEQ ID NO: 202274 - DNA, 25 bp, Rattus norvegicus
atgtgcaccagctgtttcactgaag

SEQ ID NO: 202275 - DNA, 25 bp, Rattus norvegicus
atgtgcaccataaagaaagcctttg

SEQ ID NO: 202276 - DNA, 25 bp, Rattus norvegicus
atgtgcaccatatagaaagcctttg

SEQ ID NO: 202277 - DNA, 25 bp, Rattus norvegicus
atgtgcacccacagcctggccttag

SEQ ID NO: 202278 - DNA, 25 bp, Rattus norvegicus
atgtgcacccactgcctggccttag

SEQ ID NO: 202279 - DNA, 25 bp, Rattus norvegicus
atgtgcactccaattctgctaacta

SEQ ID NO: 202280 - DNA, 25 bp, Rattus norvegicus
atgtgcactccatttctgctaacta

SEQ ID NO: 202281 - DNA, 25 bp, Rattus norvegicus
atgtgcactggccttgggccaagaa

SEQ ID NO: 202282 - DNA, 25 bp, Rattus norvegicus
atgtgcactggcgttgggccaagaa

SEQ ID NO: 202283 - DNA, 25 bp, Rattus norvegicus
atgtgcactgtgaaaacttgacctc

SEQ ID NO: 202284 - DNA, 25 bp, Rattus norvegicus
atgtgcactgtgacctctacaggac

SEQ ID NO: 202285 - DNA, 25 bp, Rattus norvegicus
atgtgcactgtgtaaacttgacctc

SEQ ID NO: 202286 - DNA, 25 bp, Rattus norvegicus
atgtgcactgtgtcctctacaggac

SEQ ID NO: 202287 - DNA, 25 bp, Rattus norvegicus
atgtgcagagttcccaaggcccagc

SEQ ID NO: 202288 - DNA, 25 bp, Rattus norvegicus
atgtgcagagttgccaaggcccagc

SEQ ID NO: 202289 - DNA, 25 bp, Rattus norvegicus
atgtgcagcccaactggattactct

SEQ ID NO: 202290 - DNA, 25 bp, Rattus norvegicus
atgtgcagcccatctggattactct

SEQ ID NO: 202291 - DNA, 25 bp, Rattus norvegicus
atgtgcagcggtcgcttaagtcctg

SEQ ID NO: 202292 - DNA, 25 bp, Rattus norvegicus
atgtgcagcggtggcttaagtcctg

SEQ ID NO: 202293 - DNA, 25 bp, Rattus norvegicus
atgtgcagctgacccatgagcgcat

SEQ ID NO: 202294 - DNA, 25 bp, Rattus norvegicus
atgtgcagctgagccatgagcgcat

SEQ ID NO: 202295 - DNA, 25 bp, Rattus norvegicus
atgtgcaggaacctgttctcggcct

SEQ ID NO: 202296 - DNA, 25 bp, Rattus norvegicus
atgtgcaggaacgtgttctcggcct

SEQ ID NO: 202297 - DNA, 25 bp, Rattus norvegicus
atgtgcaggcgacagaggtccctct

SEQ ID NO: 202298 - DNA, 25 bp, Rattus norvegicus
atgtgcaggcgagagaggtccctct

SEQ ID NO: 202299 - DNA, 25 bp, Rattus norvegicus
atgtgcagtgacaagtgtcgggcta

SEQ ID NO: 202300 - DNA, 25 bp, Rattus norvegicus
atgtgcagtgactagtgtcgggcta

SEQ ID NO: 202301 - DNA, 25 bp, Rattus norvegicus
atgtgcagtgccagtggcctgaaag

SEQ ID NO: 202302 - DNA, 25 bp, Rattus norvegicus
atgtgcagtgcctgtggcctgaaag

SEQ ID NO: 202303 - DNA, 25 bp, Rattus norvegicus
atgtgcatatctacgtctctgagta

SEQ ID NO: 202304 - DNA, 25 bp, Rattus norvegicus
atgtgcatatcttcgtctctgagta

SEQ ID NO: 202305 - DNA, 25 bp, Rattus norvegicus
atgtgcatatgcagacgcctgagac

SEQ ID NO: 202306 - DNA, 25 bp, Rattus norvegicus
atgtgcatatgctgacgcctgagac

SEQ ID NO: 202307 - DNA, 25 bp, Rattus norvegicus
atgtgcatcagcattgttttgcctt

SEQ ID NO: 202308 - DNA, 25 bp, Rattus norvegicus
atgtgcatcagctttgttttgcctt

SEQ ID NO: 202309 - DNA, 25 bp, Rattus norvegicus
atgtgcatcgacagcagagtcgcct

SEQ ID NO: 202310 - DNA, 25 bp, Rattus norvegicus
atgtgcatcgactgcagagtcgcct

SEQ ID NO: 202311 - DNA, 25 bp, Rattus norvegicus
atgtgcatgctcctatgtgcataca

SEQ ID NO: 202312 - DNA, 25 bp, Rattus norvegicus
atgtgcatgctcgtatgtgcataca

SEQ ID NO: 202313 - DNA, 25 bp, Rattus norvegicus
atgtgcatggacagccctatacagg

SEQ ID NO: 202314 - DNA, 25 bp, Rattus norvegicus
atgtgcatggactgccctatacagg

SEQ ID NO: 202315 - DNA, 25 bp, Rattus norvegicus
atgtgcatgttaccagagcccgtga

SEQ ID NO: 202316 - DNA, 25 bp, Rattus norvegicus
atgtgcatgttagcagagcccgtga

SEQ ID NO: 202317 - DNA, 25 bp, Rattus norvegicus
atgtgcattcagatggtcgagggct

SEQ ID NO: 202318 - DNA, 25 bp, Rattus norvegicus
atgtgcattcagttggtcgagggct

SEQ ID NO: 202319 - DNA, 25 bp, Rattus norvegicus
atgtgcattgtcacctctgttgtcc

SEQ ID NO: 202320 - DNA, 25 bp, Rattus norvegicus
atgtgcattgtctcctctgttgtcc

SEQ ID NO: 202321 - DNA, 25 bp, Rattus norvegicus
atgtgcatttcactttatctttaaa

SEQ ID NO: 202322 - DNA, 25 bp, Rattus norvegicus
atgtgcatttcagtttatctttaaa

SEQ ID NO: 202323 - DNA, 25 bp, Rattus norvegicus
atgtgccaataaactatgtccctgc

SEQ ID NO: 202324 - DNA, 25 bp, Rattus norvegicus
atgtgccaataatctatgtccctgc

SEQ ID NO: 202325 - DNA, 25 bp, Rattus norvegicus
atgtgccaatccacaccaggaaagt

SEQ ID NO: 202326 - DNA, 25 bp, Rattus norvegicus
atgtgccaatcctcaccaggaaagt

SEQ ID NO: 202327 - DNA, 25 bp, Rattus norvegicus
atgtgccaatgcctgtacattaaca

SEQ ID NO: 202328 - DNA, 25 bp, Rattus norvegicus
atgtgccaatgcgtgtacattaaca

SEQ ID NO: 202329 - DNA, 25 bp, Rattus norvegicus
atgtgccacactaatccaggacgca

SEQ ID NO: 202330 - DNA, 25 bp, Rattus norvegicus
atgtgccacacttatccaggacgca

SEQ ID NO: 202331 - DNA, 25 bp, Rattus norvegicus
atgtgccacagaacttttgcttttc

SEQ ID NO: 202332 - DNA, 25 bp, Rattus norvegicus
atgtgccacagatcttttgcttttc

SEQ ID NO: 202333 - DNA, 25 bp, Rattus norvegicus
atgtgccacagcatacggagtactt

SEQ ID NO: 202334 - DNA, 25 bp, Rattus norvegicus
atgtgccacagcttacggagtactt

SEQ ID NO: 202335 - DNA, 25 bp, Rattus norvegicus
atgtgccacagtagcaaatgctttt

SEQ ID NO: 202336 - DNA, 25 bp, Rattus norvegicus
atgtgccacagttgcaaatgctttt

SEQ ID NO: 202337 - DNA, 25 bp, Rattus norvegicus
atgtgccacgtgctgtcaggtgtac

SEQ ID NO: 202338 - DNA, 25 bp, Rattus norvegicus
atgtgccacgtggtgtcaggtgtac

SEQ ID NO: 202339 - DNA, 25 bp, Rattus norvegicus
atgtgccactcgatggaccactggg

SEQ ID NO: 202340 - DNA, 25 bp, Rattus norvegicus
atgtgccactcgttggaccactggg

SEQ ID NO: 202341 - DNA, 25 bp, Rattus norvegicus
atgtgccacttaaatcagcccaggg

SEQ ID NO: 202342 - DNA, 25 bp, Rattus norvegicus
atgtgccacttatatcagcccaggg

SEQ ID NO: 202343 - DNA, 25 bp, Rattus norvegicus
atgtgccagacactggtagctccct

SEQ ID NO: 202344 - DNA, 25 bp, Rattus norvegicus
atgtgccagacagtggtagctccct

SEQ ID NO: 202345 - DNA, 25 bp, Rattus norvegicus
atgtgccagaccactgcaactgctg

SEQ ID NO: 202346 - DNA, 25 bp, Rattus norvegicus
atgtgccagacctctgcaactgctg

SEQ ID NO: 202347 - DNA, 25 bp, Rattus norvegicus
atgtgccagagaatgccgtgtatcc

SEQ ID NO: 202348 - DNA, 25 bp, Rattus norvegicus
atgtgccagagattgccgtgtatcc

SEQ ID NO: 202349 - DNA, 25 bp, Rattus norvegicus
atgtgccagcctccaatgggagaca

SEQ ID NO: 202350 - DNA, 25 bp, Rattus norvegicus
atgtgccagcctgcaatgggagaca

SEQ ID NO: 202351 - DNA, 25 bp, Rattus norvegicus
atgtgccaggcactgtatctccaga

SEQ ID NO: 202352 - DNA, 25 bp, Rattus norvegicus
atgtgccaggcagtgtatctccaga

SEQ ID NO: 202353 - DNA, 25 bp, Rattus norvegicus
atgtgccatcctctgagggagttct

SEQ ID NO: 202354 - DNA, 25 bp, Rattus norvegicus
atgtgccatcctgtgagggagttct

SEQ ID NO: 202355 - DNA, 25 bp, Rattus norvegicus
atgtgccatgagaacccagtctaca

SEQ ID NO: 202356 - DNA, 25 bp, Rattus norvegicus
atgtgccatgagtacccagtctaca

SEQ ID NO: 202357 - DNA, 25 bp, Rattus norvegicus
atgtgccatgatcagcagttcgccc

SEQ ID NO: 202358 - DNA, 25 bp, Rattus norvegicus
atgtgccatgatgagcagttcgccc

SEQ ID NO: 202359 - DNA, 25 bp, Rattus norvegicus
atgtgccatggaagtgtcagcccgc

SEQ ID NO: 202360 - DNA, 25 bp, Rattus norvegicus
atgtgccatggatgtgtcagcccgc

SEQ ID NO: 202361 - DNA, 25 bp, Rattus norvegicus
atgtgcccaaggcaggcatctgtca

SEQ ID NO: 202362 - DNA, 25 bp, Rattus norvegicus
atgtgcccaagggaggcatctgtca

SEQ ID NO: 202363 - DNA, 25 bp, Rattus norvegicus
atgtgcccagcaataatccaacctt

SEQ ID NO: 202364 - DNA, 25 bp, Rattus norvegicus
atgtgcccagcaatgtggctccttg

SEQ ID NO: 202365 - DNA, 25 bp, Rattus norvegicus
atgtgcccagcattaatccaacctt

SEQ ID NO: 202366 - DNA, 25 bp, Rattus norvegicus
atgtgcccagcattgtggctccttg

SEQ ID NO: 202367 - DNA, 25 bp, Rattus norvegicus
atgtgcccagctactgtgggagcca

SEQ ID NO: 202368 - DNA, 25 bp, Rattus norvegicus
atgtgcccagcttctgtgggagcca

SEQ ID NO: 202369 - DNA, 25 bp, Rattus norvegicus
atgtgcccagggaccgcagccaggt

SEQ ID NO: 202370 - DNA, 25 bp, Rattus norvegicus
atgtgcccagggatgtttgtagacc

SEQ ID NO: 202371 - DNA, 25 bp, Rattus norvegicus
atgtgcccagggtccgcagccaggt

SEQ ID NO: 202372 - DNA, 25 bp, Rattus norvegicus
atgtgcccagggttgtttgtagacc

SEQ ID NO: 202373 - DNA, 25 bp, Rattus norvegicus
atgtgcccagtacaaggctctcaga

SEQ ID NO: 202374 - DNA, 25 bp, Rattus norvegicus
atgtgcccagtacctgttctgtgtg

SEQ ID NO: 202375 - DNA, 25 bp, Rattus norvegicus
atgtgcccagtagaaggctctcaga

SEQ ID NO: 202376 - DNA, 25 bp, Rattus norvegicus
atgtgcccagtagctgttctgtgtg

SEQ ID NO: 202377 - DNA, 25 bp, Rattus norvegicus
atgtgcccatctaccaggagattgt

SEQ ID NO: 202378 - DNA, 25 bp, Rattus norvegicus
atgtgcccatcttccaggagattgt

SEQ ID NO: 202379 - DNA, 25 bp, Rattus norvegicus
atgtgccccacaatgctgcttttga

SEQ ID NO: 202380 - DNA, 25 bp, Rattus norvegicus
atgtgccccacattgctgcttttga

SEQ ID NO: 202381 - DNA, 25 bp, Rattus norvegicus
atgtgccccacgcatggcctttcta

SEQ ID NO: 202382 - DNA, 25 bp, Rattus norvegicus
atgtgccccacggatggcctttcta

SEQ ID NO: 202383 - DNA, 25 bp, Rattus norvegicus
atgtgccccatcaggacagctttat

SEQ ID NO: 202384 - DNA, 25 bp, Rattus norvegicus
atgtgccccatctggacagctttat

SEQ ID NO: 202385 - DNA, 25 bp, Rattus norvegicus
atgtgccccggaaagcaaagcgaaa

SEQ ID NO: 202386 - DNA, 25 bp, Rattus norvegicus
atgtgccccggatagcaaagcgaaa

SEQ ID NO: 202387 - DNA, 25 bp, Rattus norvegicus
atgtgcccctaacatcttgtgttgt

SEQ ID NO: 202388 - DNA, 25 bp, Rattus norvegicus
atgtgcccctaagatcttgtgttgt

SEQ ID NO: 202389 - DNA, 25 bp, Rattus norvegicus
atgtgcccgacgctgtccgtaaagt

SEQ ID NO: 202390 - DNA, 25 bp, Rattus norvegicus
atgtgcccgacggtgtccgtaaagt

SEQ ID NO: 202391 - DNA, 25 bp, Rattus norvegicus
atgtgcccgtgaacctggacaagct

SEQ ID NO: 202392 - DNA, 25 bp, Rattus norvegicus
atgtgcccgtgatcctggacaagct

SEQ ID NO: 202393 - DNA, 25 bp, Rattus norvegicus
atgtgcccgttacgttaggactcca

SEQ ID NO: 202394 - DNA, 25 bp, Rattus norvegicus
atgtgcccgttaggttaggactcca

SEQ ID NO: 202395 - DNA, 25 bp, Rattus norvegicus
atgtgccctctcagtaggtaggctt

SEQ ID NO: 202396 - DNA, 25 bp, Rattus norvegicus
atgtgccctctctgtaggtaggctt

SEQ ID NO: 202397 - DNA, 25 bp, Rattus norvegicus
atgtgccctcttacttgtgtgcttt

SEQ ID NO: 202398 - DNA, 25 bp, Rattus norvegicus
atgtgccctctttcttgtgtgcttt

SEQ ID NO: 202399 - DNA, 25 bp, Rattus norvegicus
atgtgccctggccttctgtgagctg

SEQ ID NO: 202400 - DNA, 25 bp, Rattus norvegicus
atgtgccctggcgttctgtgagctg

SEQ ID NO: 202401 - DNA, 25 bp, Rattus norvegicus
atgtgccctgtccataatcttgcat

SEQ ID NO: 202402 - DNA, 25 bp, Rattus norvegicus
atgtgccctgtcgataatcttgcat

SEQ ID NO: 202403 - DNA, 25 bp, Rattus norvegicus
atgtgccctgttaacatggtccagt

SEQ ID NO: 202404 - DNA, 25 bp, Rattus norvegicus
atgtgccctgtttacatggtccagt

SEQ ID NO: 202405 - DNA, 25 bp, Rattus norvegicus
atgtgcccttacacagacactcgga

SEQ ID NO: 202406 - DNA, 25 bp, Rattus norvegicus
atgtgcccttactcagacactcgga

SEQ ID NO: 202407 - DNA, 25 bp, Rattus norvegicus
atgtgcccttccagttactaaaaga

SEQ ID NO: 202408 - DNA, 25 bp, Rattus norvegicus
atgtgcccttccctgaggagaagcc

SEQ ID NO: 202409 - DNA, 25 bp, Rattus norvegicus
atgtgcccttccgtgaggagaagcc

SEQ ID NO: 202410 - DNA, 25 bp, Rattus norvegicus
atgtgcccttcctgttactaaaaga

SEQ ID NO: 202411 - DNA, 25 bp, Rattus norvegicus
atgtgcccttttaaagggtctgtct

SEQ ID NO: 202412 - DNA, 25 bp, Rattus norvegicus
atgtgccctttttaagggtctgtct

SEQ ID NO: 202413 - DNA, 25 bp, Rattus norvegicus
atgtgccgacacatattccaggtaa

SEQ ID NO: 202414 - DNA, 25 bp, Rattus norvegicus
atgtgccgacacttattccaggtaa

SEQ ID NO: 202415 - DNA, 25 bp, Rattus norvegicus
atgtgccgcattacgcagtggactt

SEQ ID NO: 202416 - DNA, 25 bp, Rattus norvegicus
atgtgccgcatttcgcagtggactt

SEQ ID NO: 202417 - DNA, 25 bp, Rattus norvegicus
atgtgccgccagattgtgcaggaat

SEQ ID NO: 202418 - DNA, 25 bp, Rattus norvegicus
atgtgccgccagtttgtgcaggaat

SEQ ID NO: 202419 - DNA, 25 bp, Rattus norvegicus
atgtgccgcctgaacataggatacc

SEQ ID NO: 202420 - DNA, 25 bp, Rattus norvegicus
atgtgccgcctgtacataggatacc

SEQ ID NO: 202421 - DNA, 25 bp, Rattus norvegicus
atgtgccgcgatcgtgtacatggaa

SEQ ID NO: 202422 - DNA, 25 bp, Rattus norvegicus
atgtgccgcgatggtgtacatggaa

SEQ ID NO: 202423 - DNA, 25 bp, Rattus norvegicus
atgtgccggacaaccgagtaggcta

SEQ ID NO: 202424 - DNA, 25 bp, Rattus norvegicus
atgtgccggacatccgagtaggcta

SEQ ID NO: 202425 - DNA, 25 bp, Rattus norvegicus
atgtgccgggatagcagtcctgtcc

SEQ ID NO: 202426 - DNA, 25 bp, Rattus norvegicus
atgtgccgggattgcagtcctgtcc

SEQ ID NO: 202427 - DNA, 25 bp, Rattus norvegicus
atgtgccgggtaactcagcgctgaa

SEQ ID NO: 202428 - DNA, 25 bp, Rattus norvegicus
atgtgccgggtatctcagcgctgaa

SEQ ID NO: 202429 - DNA, 25 bp, Rattus norvegicus
atgtgcctacagatatgcagttccc

SEQ ID NO: 202430 - DNA, 25 bp, Rattus norvegicus
atgtgcctacagttatgcagttccc

SEQ ID NO: 202431 - DNA, 25 bp, Rattus norvegicus
atgtgcctactgaatgctgggaaaa

SEQ ID NO: 202432 - DNA, 25 bp, Rattus norvegicus
atgtgcctactgtatgctgggaaaa

SEQ ID NO: 202433 - DNA, 25 bp, Rattus norvegicus
atgtgcctagctaggtgtccattca

SEQ ID NO: 202434 - DNA, 25 bp, Rattus norvegicus
atgtgcctagcttggtgtccattca

SEQ ID NO: 202435 - DNA, 25 bp, Rattus norvegicus
atgtgcctaggcagctgattttgaa

SEQ ID NO: 202436 - DNA, 25 bp, Rattus norvegicus
atgtgcctaggctgctgattttgaa

SEQ ID NO: 202437 - DNA, 25 bp, Rattus norvegicus
atgtgcctcaagacccagatggtgg

SEQ ID NO: 202438 - DNA, 25 bp, Rattus norvegicus
atgtgcctcaagtcccagatggtgg

SEQ ID NO: 202439 - DNA, 25 bp, Rattus norvegicus
atgtgcctccctaattggacgtgat

SEQ ID NO: 202440 - DNA, 25 bp, Rattus norvegicus
atgtgcctccctatctgagaggtct

SEQ ID NO: 202441 - DNA, 25 bp, Rattus norvegicus
atgtgcctcccttattggacgtgat

SEQ ID NO: 202442 - DNA, 25 bp, Rattus norvegicus
atgtgcctccctttctgagaggtct

SEQ ID NO: 202443 - DNA, 25 bp, Rattus norvegicus
atgtgcctcctgataagagcactca

SEQ ID NO: 202444 - DNA, 25 bp, Rattus norvegicus
atgtgcctcctgattatccggagac

SEQ ID NO: 202445 - DNA, 25 bp, Rattus norvegicus
atgtgcctcctgttaagagcactca

SEQ ID NO: 202446 - DNA, 25 bp, Rattus norvegicus
atgtgcctcctgtttatccggagac

SEQ ID NO: 202447 - DNA, 25 bp, Rattus norvegicus
atgtgcctctgtatcctagtgtgac

SEQ ID NO: 202448 - DNA, 25 bp, Rattus norvegicus
atgtgcctctgtttcctagtgtgac

SEQ ID NO: 202449 - DNA, 25 bp, Rattus norvegicus
atgtgcctgagactgttgactgtca

SEQ ID NO: 202450 - DNA, 25 bp, Rattus norvegicus
atgtgcctgagagtgttgactgtca

SEQ ID NO: 202451 - DNA, 25 bp, Rattus norvegicus
atgtgcctgcccagttgatgtaaag

SEQ ID NO: 202452 - DNA, 25 bp, Rattus norvegicus
atgtgcctgccctgttgatgtaaag

SEQ ID NO: 202453 - DNA, 25 bp, Rattus norvegicus
atgtgcctgctcagactggaaacca

SEQ ID NO: 202454 - DNA, 25 bp, Rattus norvegicus
atgtgcctgctctgactggaaacca

SEQ ID NO: 202455 - DNA, 25 bp, Rattus norvegicus
atgtgcctggcgatagacaactgtt

SEQ ID NO: 202456 - DNA, 25 bp, Rattus norvegicus
atgtgcctggcgttagacaactgtt

SEQ ID NO: 202457 - DNA, 25 bp, Rattus norvegicus
atgtgcctgtaactttcttccaaaa

SEQ ID NO: 202458 - DNA, 25 bp, Rattus norvegicus
atgtgcctgtaagtttcttccaaaa

SEQ ID NO: 202459 - DNA, 25 bp, Rattus norvegicus
atgtgcctgtgcatagctgcaactc

SEQ ID NO: 202460 - DNA, 25 bp, Rattus norvegicus
atgtgcctgtgcttagctgcaactc

SEQ ID NO: 202461 - DNA, 25 bp, Rattus norvegicus
atgtgcctgttaccaagtgcttcgt

SEQ ID NO: 202462 - DNA, 25 bp, Rattus norvegicus
atgtgcctgttagcaagtgcttcgt

SEQ ID NO: 202463 - DNA, 25 bp, Rattus norvegicus
atgtgccttaaacctgaatgtctgt

SEQ ID NO: 202464 - DNA, 25 bp, Rattus norvegicus
atgtgccttaaagctgaatgtctgt

SEQ ID NO: 202465 - DNA, 25 bp, Rattus norvegicus
atgtgccttacaagtgccagagacc

SEQ ID NO: 202466 - DNA, 25 bp, Rattus norvegicus
atgtgccttacatgtgccagagacc

SEQ ID NO: 202467 - DNA, 25 bp, Rattus norvegicus
atgtgccttatgcatggtgatcatc

SEQ ID NO: 202468 - DNA, 25 bp, Rattus norvegicus
atgtgccttatggatggtgatcatc

SEQ ID NO: 202469 - DNA, 25 bp, Rattus norvegicus
atgtgccttcagaaactgggccttg

SEQ ID NO: 202470 - DNA, 25 bp, Rattus norvegicus
atgtgccttcagtaactgggccttg

SEQ ID NO: 202471 - DNA, 25 bp, Rattus norvegicus
atgtgccttcgaacccagcattcag

SEQ ID NO: 202472 - DNA, 25 bp, Rattus norvegicus
atgtgccttcgatcccagcattcag

SEQ ID NO: 202473 - DNA, 25 bp, Rattus norvegicus
atgtgccttgatctatccaggaagg

SEQ ID NO: 202474 - DNA, 25 bp, Rattus norvegicus
atgtgccttgatgtatccaggaagg

SEQ ID NO: 202475 - DNA, 25 bp, Rattus norvegicus
atgtgccttgcactactgtaattca

SEQ ID NO: 202476 - DNA, 25 bp, Rattus norvegicus
atgtgccttgcagtactgtaattca

SEQ ID NO: 202477 - DNA, 25 bp, Rattus norvegicus
atgtgccttttcctgggtatcaaca

SEQ ID NO: 202478 - DNA, 25 bp, Rattus norvegicus
atgtgccttttcgtgggtatcaaca

SEQ ID NO: 202479 - DNA, 25 bp, Rattus norvegicus
atgtgcctttttctacctttttcag

SEQ ID NO: 202480 - DNA, 25 bp, Rattus norvegicus
atgtgcctttttgtacctttttcag

SEQ ID NO: 202481 - DNA, 25 bp, Rattus norvegicus
atgtgcgaccctcgaatgacagcct

SEQ ID NO: 202482 - DNA, 25 bp, Rattus norvegicus
atgtgcgaccctggaatgacagcct

SEQ ID NO: 202483 - DNA, 25 bp, Rattus norvegicus
atgtgcgaggaccagaacttgccct

SEQ ID NO: 202484 - DNA, 25 bp, Rattus norvegicus
atgtgcgaggacgagaacttgccct

SEQ ID NO: 202485 - DNA, 25 bp, Rattus norvegicus
atgtgcgcagataactctcctttta

SEQ ID NO: 202486 - DNA, 25 bp, Rattus norvegicus
atgtgcgcagattactctcctttta

SEQ ID NO: 202487 - DNA, 25 bp, Rattus norvegicus
atgtgcgccaagagtgtccgggaca

SEQ ID NO: 202488 - DNA, 25 bp, Rattus norvegicus
atgtgcgccaagtgtgtccgggaca

SEQ ID NO: 202489 - DNA, 25 bp, Rattus norvegicus
atgtgcgcggctacttacgcttggg

SEQ ID NO: 202490 - DNA, 25 bp, Rattus norvegicus
atgtgcgcggcttcttacgcttggg

SEQ ID NO: 202491 - DNA, 25 bp, Rattus norvegicus
atgtgcgcgtggcaaacactaccat

SEQ ID NO: 202492 - DNA, 25 bp, Rattus norvegicus
atgtgcgcgtgggaaacactaccat

SEQ ID NO: 202493 - DNA, 25 bp, Rattus norvegicus
atgtgcgctgttagcatgtgcccaa

SEQ ID NO: 202494 - DNA, 25 bp, Rattus norvegicus
atgtgcgctgtttgcatgtgcccaa

SEQ ID NO: 202495 - DNA, 25 bp, Rattus norvegicus
atgtgcgggtctccagagaaccttg

SEQ ID NO: 202496 - DNA, 25 bp, Rattus norvegicus
atgtgcgggtctgcagagaaccttg

SEQ ID NO: 202497 - DNA, 25 bp, Rattus norvegicus
atgtgcggtcggatgtcacaacagc

SEQ ID NO: 202498 - DNA, 25 bp, Rattus norvegicus
atgtgcggtcggttgtcacaacagc

SEQ ID NO: 202499 - DNA, 25 bp, Rattus norvegicus
atgtgcgtacacagcgagctctact

SEQ ID NO: 202500 - DNA, 25 bp, Rattus norvegicus
atgtgcgtacactgcgagctctact

SEQ ID NO: 202501 - DNA, 25 bp, Rattus norvegicus
atgtgcgtccgacgttatctggctg

SEQ ID NO: 202502 - DNA, 25 bp, Rattus norvegicus
atgtgcgtccgaggttatctggctg

SEQ ID NO: 202503 - DNA, 25 bp, Rattus norvegicus
atgtgcgtcctgatgtgatgagcct

SEQ ID NO: 202504 - DNA, 25 bp, Rattus norvegicus
atgtgcgtcctgttgtgatgagcct

SEQ ID NO: 202505 - DNA, 25 bp, Rattus norvegicus
atgtgcgtctggcaaacagctacat

SEQ ID NO: 202506 - DNA, 25 bp, Rattus norvegicus
atgtgcgtctgggaaacagctacat

SEQ ID NO: 202507 - DNA, 25 bp, Rattus norvegicus
atgtgcgtgccaagcgtgagatgaa

SEQ ID NO: 202508 - DNA, 25 bp, Rattus norvegicus
atgtgcgtgccatgcgtgagatgaa

SEQ ID NO: 202509 - DNA, 25 bp, Rattus norvegicus
atgtgcgtgtccatcatgtatatct

SEQ ID NO: 202510 - DNA, 25 bp, Rattus norvegicus
atgtgcgtgtccttcatgtatatct

SEQ ID NO: 202511 - DNA, 25 bp, Rattus norvegicus
atgtgcgtgttcagttttagctgcc

SEQ ID NO: 202512 - DNA, 25 bp, Rattus norvegicus
atgtgcgtgttctgttttagctgcc

SEQ ID NO: 202513 - DNA, 25 bp, Rattus norvegicus
atgtgcgttacaaccagcaaggcct

SEQ ID NO: 202514 - DNA, 25 bp, Rattus norvegicus
atgtgcgttacatccagcaaggcct

SEQ ID NO: 202515 - DNA, 25 bp, Rattus norvegicus
atgtgcgttatcatggttcatatca

SEQ ID NO: 202516 - DNA, 25 bp, Rattus norvegicus
atgtgcgttatcttggttcatatca

SEQ ID NO: 202517 - DNA, 25 bp, Rattus norvegicus
atgtgcgttcagagttttaccaaga

SEQ ID NO: 202518 - DNA, 25 bp, Rattus norvegicus
atgtgcgttcagtgttttaccaaga

SEQ ID NO: 202519 - DNA, 25 bp, Rattus norvegicus
atgtgcgtttctcggcttttacttc

SEQ ID NO: 202520 - DNA, 25 bp, Rattus norvegicus
atgtgcgtttctgggcttttacttc

SEQ ID NO: 202521 - DNA, 25 bp, Rattus norvegicus
atgtgctaacacatattcttgagat

SEQ ID NO: 202522 - DNA, 25 bp, Rattus norvegicus
atgtgctaacaccactgcatgtcag

SEQ ID NO: 202523 - DNA, 25 bp, Rattus norvegicus
atgtgctaacacgactgcatgtcag

SEQ ID NO: 202524 - DNA, 25 bp, Rattus norvegicus
atgtgctaacacttattcttgagat

SEQ ID NO: 202525 - DNA, 25 bp, Rattus norvegicus
atgtgctaactgaactgcatattat

SEQ ID NO: 202526 - DNA, 25 bp, Rattus norvegicus
atgtgctaactgtactgcatattat

SEQ ID NO: 202527 - DNA, 25 bp, Rattus norvegicus
atgtgctacaatacctgtcctgatg

SEQ ID NO: 202528 - DNA, 25 bp, Rattus norvegicus
atgtgctacaattcctgtcctgatg

SEQ ID NO: 202529 - DNA, 25 bp, Rattus norvegicus
atgtgctagtagcatcttgcccacc

SEQ ID NO: 202530 - DNA, 25 bp, Rattus norvegicus
atgtgctagtaggatcttgcccacc

SEQ ID NO: 202531 - DNA, 25 bp, Rattus norvegicus
atgtgctataacattgccccagcta

SEQ ID NO: 202532 - DNA, 25 bp, Rattus norvegicus
atgtgctataactttgccccagcta

SEQ ID NO: 202533 - DNA, 25 bp, Rattus norvegicus
atgtgctatagactgctgcctggct

SEQ ID NO: 202534 - DNA, 25 bp, Rattus norvegicus
atgtgctatagagtgctgcctggct

SEQ ID NO: 202535 - DNA, 25 bp, Rattus norvegicus
atgtgctatcataggtgtaagttcc

SEQ ID NO: 202536 - DNA, 25 bp, Rattus norvegicus
atgtgctatcattggtgtaagttcc

SEQ ID NO: 202537 - DNA, 25 bp, Rattus norvegicus
atgtgctatgagcaccccaggaggc

SEQ ID NO: 202538 - DNA, 25 bp, Rattus norvegicus
atgtgctatgaggaccccaggaggc

SEQ ID NO: 202539 - DNA, 25 bp, Rattus norvegicus
atgtgctatgccagttcccagagag

SEQ ID NO: 202540 - DNA, 25 bp, Rattus norvegicus
atgtgctatgcctgttcccagagag

SEQ ID NO: 202541 - DNA, 25 bp, Rattus norvegicus
atgtgctattatagttttgtctttt

SEQ ID NO: 202542 - DNA, 25 bp, Rattus norvegicus
atgtgctattattgttttgtctttt

SEQ ID NO: 202543 - DNA, 25 bp, Rattus norvegicus
atgtgctcaaggacaccaaggctgc

SEQ ID NO: 202544 - DNA, 25 bp, Rattus norvegicus
atgtgctcaaggtcaccaaggctgc

SEQ ID NO: 202545 - DNA, 25 bp, Rattus norvegicus
atgtgctcaagtacgaggcttgccc

SEQ ID NO: 202546 - DNA, 25 bp, Rattus norvegicus
atgtgctcaagttcgaggcttgccc

SEQ ID NO: 202547 - DNA, 25 bp, Rattus norvegicus
atgtgctcacaccagggagagcctt

SEQ ID NO: 202548 - DNA, 25 bp, Rattus norvegicus
atgtgctcacacgagggagagcctt

SEQ ID NO: 202549 - DNA, 25 bp, Rattus norvegicus
atgtgctcacggatgtgtgttgccc

SEQ ID NO: 202550 - DNA, 25 bp, Rattus norvegicus
atgtgctcacggttgtgtgttgccc

SEQ ID NO: 202551 - DNA, 25 bp, Rattus norvegicus
atgtgctcactgaatatccacgtct

SEQ ID NO: 202552 - DNA, 25 bp, Rattus norvegicus
atgtgctcactgtatatccacgtct

SEQ ID NO: 202553 - DNA, 25 bp, Rattus norvegicus
atgtgctcagtgaagaccggctact

SEQ ID NO: 202554 - DNA, 25 bp, Rattus norvegicus
atgtgctcagtgtagaccggctact

SEQ ID NO: 202555 - DNA, 25 bp, Rattus norvegicus
atgtgctccagacgccctgaggact

SEQ ID NO: 202556 - DNA, 25 bp, Rattus norvegicus
atgtgctccagaggccctgaggact

SEQ ID NO: 202557 - DNA, 25 bp, Rattus norvegicus
atgtgctccagcaattttttctatt

SEQ ID NO: 202558 - DNA, 25 bp, Rattus norvegicus
atgtgctccagctattttttctatt

SEQ ID NO: 202559 - DNA, 25 bp, Rattus norvegicus
atgtgctcccacattaatttttctc

SEQ ID NO: 202560 - DNA, 25 bp, Rattus norvegicus
atgtgctcccacatttactgcagtg

SEQ ID NO: 202561 - DNA, 25 bp, Rattus norvegicus
atgtgctcccactttaatttttctc

SEQ ID NO: 202562 - DNA, 25 bp, Rattus norvegicus
atgtgctcccacttttactgcagtg

SEQ ID NO: 202563 - DNA, 25 bp, Rattus norvegicus
atgtgctccgctctttttaaatgtg

SEQ ID NO: 202564 - DNA, 25 bp, Rattus norvegicus
atgtgctccgctgtttttaaatgtg

SEQ ID NO: 202565 - DNA, 25 bp, Rattus norvegicus
atgtgctccgtgaacctgaaagata

SEQ ID NO: 202566 - DNA, 25 bp, Rattus norvegicus
atgtgctccgtgtacctgaaagata

SEQ ID NO: 202567 - DNA, 25 bp, Rattus norvegicus
atgtgctcctcacacagggcgtgct

SEQ ID NO: 202568 - DNA, 25 bp, Rattus norvegicus
atgtgctcctcagacagggcgtgct

SEQ ID NO: 202569 - DNA, 25 bp, Rattus norvegicus
atgtgctcctctatgggtctcgtgt

SEQ ID NO: 202570 - DNA, 25 bp, Rattus norvegicus
atgtgctcctctttgggtctcgtgt

SEQ ID NO: 202571 - DNA, 25 bp, Rattus norvegicus
atgtgctcctgtccagatatttgat

SEQ ID NO: 202572 - DNA, 25 bp, Rattus norvegicus
atgtgctcctgtgcagatatttgat

SEQ ID NO: 202573 - DNA, 25 bp, Rattus norvegicus
atgtgctccttaaccgaaatgcctg

SEQ ID NO: 202574 - DNA, 25 bp, Rattus norvegicus
atgtgctccttatccgaaatgcctg

SEQ ID NO: 202575 - DNA, 25 bp, Rattus norvegicus
atgtgctccttgatggccccaaagt

SEQ ID NO: 202576 - DNA, 25 bp, Rattus norvegicus
atgtgctccttgttggccccaaagt

SEQ ID NO: 202577 - DNA, 25 bp, Rattus norvegicus
atgtgctcgcatcctcaaaagtatg

SEQ ID NO: 202578 - DNA, 25 bp, Rattus norvegicus
atgtgctcgcatctctgtatggaaa

SEQ ID NO: 202579 - DNA, 25 bp, Rattus norvegicus
atgtgctcgcatgctcaaaagtatg

SEQ ID NO: 202580 - DNA, 25 bp, Rattus norvegicus
atgtgctcgcatgtctgtatggaaa

SEQ ID NO: 202581 - DNA, 25 bp, Rattus norvegicus
atgtgctcgtgcctctggtacaaga

SEQ ID NO: 202582 - DNA, 25 bp, Rattus norvegicus
atgtgctcgtgcgtctggtacaaga

SEQ ID NO: 202583 - DNA, 25 bp, Rattus norvegicus
atgtgctctgagctctctataggat

SEQ ID NO: 202584 - DNA, 25 bp, Rattus norvegicus
atgtgctctgaggtctctataggat

SEQ ID NO: 202585 - DNA, 25 bp, Rattus norvegicus
atgtgctctgataaaaaccctcccc

SEQ ID NO: 202586 - DNA, 25 bp, Rattus norvegicus
atgtgctctgattaaaaccctcccc

SEQ ID NO: 202587 - DNA, 25 bp, Rattus norvegicus
atgtgctctggaattgtccctgtat

SEQ ID NO: 202588 - DNA, 25 bp, Rattus norvegicus
atgtgctctggatttgtccctgtat

SEQ ID NO: 202589 - DNA, 25 bp, Rattus norvegicus
atgtgctcttttacgtgaatgtcaa

SEQ ID NO: 202590 - DNA, 25 bp, Rattus norvegicus
atgtgctctttttcgtgaatgtcaa

SEQ ID NO: 202591 - DNA, 25 bp, Rattus norvegicus
atgtgctgaaccctataacccaggt

SEQ ID NO: 202592 - DNA, 25 bp, Rattus norvegicus
atgtgctgaaccgtataacccaggt

SEQ ID NO: 202593 - DNA, 25 bp, Rattus norvegicus
atgtgctgaagcattaactctaggg

SEQ ID NO: 202594 - DNA, 25 bp, Rattus norvegicus
atgtgctgaagctttaactctaggg

SEQ ID NO: 202595 - DNA, 25 bp, Rattus norvegicus
atgtgctgacacagcctcattctct

SEQ ID NO: 202596 - DNA, 25 bp, Rattus norvegicus
atgtgctgacactgcctcattctct

SEQ ID NO: 202597 - DNA, 25 bp, Rattus norvegicus
atgtgctgagggaccttctgattca

SEQ ID NO: 202598 - DNA, 25 bp, Rattus norvegicus
atgtgctgagggtccttctgattca

SEQ ID NO: 202599 - DNA, 25 bp, Rattus norvegicus
atgtgctgatctatgtggctcctac

SEQ ID NO: 202600 - DNA, 25 bp, Rattus norvegicus
atgtgctgatctttgtggctcctac

SEQ ID NO: 202601 - DNA, 25 bp, Rattus norvegicus
atgtgctgcagcaccagttcacggg

SEQ ID NO: 202602 - DNA, 25 bp, Rattus norvegicus
atgtgctgcagctccagttcacggg

SEQ ID NO: 202603 - DNA, 25 bp, Rattus norvegicus
atgtgctgcattattcgtcttcctc

SEQ ID NO: 202604 - DNA, 25 bp, Rattus norvegicus
atgtgctgcatttttcgtcttcctc

SEQ ID NO: 202605 - DNA, 25 bp, Rattus norvegicus
atgtgctgccatcctgaactaggga

SEQ ID NO: 202606 - DNA, 25 bp, Rattus norvegicus
atgtgctgccatgctgaactaggga

SEQ ID NO: 202607 - DNA, 25 bp, Rattus norvegicus
atgtgctgcccgcattgctggtgac

SEQ ID NO: 202608 - DNA, 25 bp, Rattus norvegicus
atgtgctgcccggattgctggtgac

SEQ ID NO: 202609 - DNA, 25 bp, Rattus norvegicus
atgtgctgccttatcaagccacctg

SEQ ID NO: 202610 - DNA, 25 bp, Rattus norvegicus
atgtgctgccttcggtcgcttgctg

SEQ ID NO: 202611 - DNA, 25 bp, Rattus norvegicus
atgtgctgccttgggtcgcttgctg

SEQ ID NO: 202612 - DNA, 25 bp, Rattus norvegicus
atgtgctgccttttcaagccacctg

SEQ ID NO: 202613 - DNA, 25 bp, Rattus norvegicus
atgtgctggcatccaaacaaggcaa

SEQ ID NO: 202614 - DNA, 25 bp, Rattus norvegicus
atgtgctggcatgcaaacaaggcaa

SEQ ID NO: 202615 - DNA, 25 bp, Rattus norvegicus
atgtgctggtttaatagcttaccaa

SEQ ID NO: 202616 - DNA, 25 bp, Rattus norvegicus
atgtgctggttttatagcttaccaa

SEQ ID NO: 202617 - DNA, 25 bp, Rattus norvegicus
atgtgctgtaacatgccctcttgtt

SEQ ID NO: 202618 - DNA, 25 bp, Rattus norvegicus
atgtgctgtaacttgccctcttgtt

SEQ ID NO: 202619 - DNA, 25 bp, Rattus norvegicus
atgtgctgtagccagtaccaactga

SEQ ID NO: 202620 - DNA, 25 bp, Rattus norvegicus
atgtgctgtagcgagtaccaactga

SEQ ID NO: 202621 - DNA, 25 bp, Rattus norvegicus
atgtgctgtatgctctcaaagaaga

SEQ ID NO: 202622 - DNA, 25 bp, Rattus norvegicus
atgtgctgtatggtctcaaagaaga

SEQ ID NO: 202623 - DNA, 25 bp, Rattus norvegicus
atgtgctgtattccttggcctttga

SEQ ID NO: 202624 - DNA, 25 bp, Rattus norvegicus
atgtgctgtattgcttggcctttga

SEQ ID NO: 202625 - DNA, 25 bp, Rattus norvegicus
atgtgctgtccccttcagtacaaac

SEQ ID NO: 202626 - DNA, 25 bp, Rattus norvegicus
atgtgctgtcccgttcagtacaaac

SEQ ID NO: 202627 - DNA, 25 bp, Rattus norvegicus
atgtgctgtcgtcatgaagctctct

SEQ ID NO: 202628 - DNA, 25 bp, Rattus norvegicus
atgtgctgtcgtgatgaagctctct

SEQ ID NO: 202629 - DNA, 25 bp, Rattus norvegicus
atgtgctgtctaatctgcatctgag

SEQ ID NO: 202630 - DNA, 25 bp, Rattus norvegicus
atgtgctgtctattctgcatctgag

SEQ ID NO: 202631 - DNA, 25 bp, Rattus norvegicus
atgtgctgtctcatttgcttctcaa

SEQ ID NO: 202632 - DNA, 25 bp, Rattus norvegicus
atgtgctgtctcttttgcttctcaa

SEQ ID NO: 202633 - DNA, 25 bp, Rattus norvegicus
atgtgctgtggaaacttggcttttc

SEQ ID NO: 202634 - DNA, 25 bp, Rattus norvegicus
atgtgctgtggatacttggcttttc

SEQ ID NO: 202635 - DNA, 25 bp, Rattus norvegicus
atgtgctgtgggagctaagcagatc

SEQ ID NO: 202636 - DNA, 25 bp, Rattus norvegicus
atgtgctgtgggtgctaagcagatc

SEQ ID NO: 202637 - DNA, 25 bp, Rattus norvegicus
atgtgctgtgtacccatttctactt

SEQ ID NO: 202638 - DNA, 25 bp, Rattus norvegicus
atgtgctgtgtagccatttctactt

SEQ ID NO: 202639 - DNA, 25 bp, Rattus norvegicus
atgtgctgtgtccaagccactgtgt

SEQ ID NO: 202640 - DNA, 25 bp, Rattus norvegicus
atgtgctgtgtcgaagccactgtgt

SEQ ID NO: 202641 - DNA, 25 bp, Rattus norvegicus
atgtgctgtgtgactatgattccta

SEQ ID NO: 202642 - DNA, 25 bp, Rattus norvegicus
atgtgctgtgtgtctatgattccta

SEQ ID NO: 202643 - DNA, 25 bp, Rattus norvegicus
atgtgctgttttagcttcaagctca

SEQ ID NO: 202644 - DNA, 25 bp, Rattus norvegicus
atgtgctgtttttgcttcaagctca

SEQ ID NO: 202645 - DNA, 25 bp, Rattus norvegicus
atgtgcttaggtcagccactcaaga

SEQ ID NO: 202646 - DNA, 25 bp, Rattus norvegicus
atgtgcttaggtgagccactcaaga

SEQ ID NO: 202647 - DNA, 25 bp, Rattus norvegicus
atgtgcttagtcacttcttccttaa

SEQ ID NO: 202648 - DNA, 25 bp, Rattus norvegicus
atgtgcttagtctcttcttccttaa

SEQ ID NO: 202649 - DNA, 25 bp, Rattus norvegicus
atgtgcttatggaactgcttacccc

SEQ ID NO: 202650 - DNA, 25 bp, Rattus norvegicus
atgtgcttatggtactgcttacccc

SEQ ID NO: 202651 - DNA, 25 bp, Rattus norvegicus
atgtgcttattcagtttcttcctca

SEQ ID NO: 202652 - DNA, 25 bp, Rattus norvegicus
atgtgcttattctgtttcttcctca

SEQ ID NO: 202653 - DNA, 25 bp, Rattus norvegicus
atgtgcttcaacagccttttccagg

SEQ ID NO: 202654 - DNA, 25 bp, Rattus norvegicus
atgtgcttcaactgccttttccagg

SEQ ID NO: 202655 - DNA, 25 bp, Rattus norvegicus
atgtgcttcacaaagttactactgc

SEQ ID NO: 202656 - DNA, 25 bp, Rattus norvegicus
atgtgcttcacatagttactactgc

SEQ ID NO: 202657 - DNA, 25 bp, Rattus norvegicus
atgtgcttcactactgttccattta

SEQ ID NO: 202658 - DNA, 25 bp, Rattus norvegicus
atgtgcttcacttctgttccattta

SEQ ID NO: 202659 - DNA, 25 bp, Rattus norvegicus
atgtgcttcctgagttagagtgtga

SEQ ID NO: 202660 - DNA, 25 bp, Rattus norvegicus
atgtgcttcctgtgttagagtgtga

SEQ ID NO: 202661 - DNA, 25 bp, Rattus norvegicus
atgtgcttcgatcagcctccggttt

SEQ ID NO: 202662 - DNA, 25 bp, Rattus norvegicus
atgtgcttcgatgagcctccggttt

SEQ ID NO: 202663 - DNA, 25 bp, Rattus norvegicus
atgtgctttacaacgggcctgcaag

SEQ ID NO: 202664 - DNA, 25 bp, Rattus norvegicus
atgtgctttacatcgggcctgcaag

SEQ ID NO: 202665 - DNA, 25 bp, Rattus norvegicus
atgtgctttactctaactgcctcac

SEQ ID NO: 202666 - DNA, 25 bp, Rattus norvegicus
atgtgctttactgtaactgcctcac

SEQ ID NO: 202667 - DNA, 25 bp, Rattus norvegicus
atgtgctttatacgcctcagcgctg

SEQ ID NO: 202668 - DNA, 25 bp, Rattus norvegicus
atgtgctttataggcctcagcgctg

SEQ ID NO: 202669 - DNA, 25 bp, Rattus norvegicus
atgtgctttcagagccttagttatg

SEQ ID NO: 202670 - DNA, 25 bp, Rattus norvegicus
atgtgctttcagtgccttagttatg

SEQ ID NO: 202671 - DNA, 25 bp, Rattus norvegicus
atgtgctttcccagttgagccatct

SEQ ID NO: 202672 - DNA, 25 bp, Rattus norvegicus
atgtgctttccctgttgagccatct

SEQ ID NO: 202673 - DNA, 25 bp, Rattus norvegicus
atgtgctttttaaatcacctgaaga

SEQ ID NO: 202674 - DNA, 25 bp, Rattus norvegicus
atgtgctttttatatcacctgaaga

SEQ ID NO: 202675 - DNA, 25 bp, Rattus norvegicus
atgtgctttttgagagtgcccatgc

SEQ ID NO: 202676 - DNA, 25 bp, Rattus norvegicus
atgtgctttttgtgagtgcccatgc

SEQ ID NO: 202677 - DNA, 25 bp, Rattus norvegicus
atgtggaaacgtccaatccctccgt

SEQ ID NO: 202678 - DNA, 25 bp, Rattus norvegicus
atgtggaaacgtgcaatccctccgt

SEQ ID NO: 202679 - DNA, 25 bp, Rattus norvegicus
atgtggaaacttagtcccattctgg

SEQ ID NO: 202680 - DNA, 25 bp, Rattus norvegicus
atgtggaaactttgtcccattctgg

SEQ ID NO: 202681 - DNA, 25 bp, Rattus norvegicus
atgtggaaagacactgacctctggg

SEQ ID NO: 202682 - DNA, 25 bp, Rattus norvegicus
atgtggaaagactctgacctctggg

SEQ ID NO: 202683 - DNA, 25 bp, Rattus norvegicus
atgtggaaatggacgagcatctggt

SEQ ID NO: 202684 - DNA, 25 bp, Rattus norvegicus
atgtggaaatggtcgagcatctggt

SEQ ID NO: 202685 - DNA, 25 bp, Rattus norvegicus
atgtggaacatgagccattttggct

SEQ ID NO: 202686 - DNA, 25 bp, Rattus norvegicus
atgtggaacatgtgccattttggct

SEQ ID NO: 202687 - DNA, 25 bp, Rattus norvegicus
atgtggaaccaccttgcagggatcc

SEQ ID NO: 202688 - DNA, 25 bp, Rattus norvegicus
atgtggaaccacgttgcagggatcc

SEQ ID NO: 202689 - DNA, 25 bp, Rattus norvegicus
atgtggaacccaccattgtgactgg

SEQ ID NO: 202690 - DNA, 25 bp, Rattus norvegicus
atgtggaacccagcattgtgactgg

SEQ ID NO: 202691 - DNA, 25 bp, Rattus norvegicus
atgtggaaccttcctttctagtgct

SEQ ID NO: 202692 - DNA, 25 bp, Rattus norvegicus
atgtggaaccttgctttctagtgct

SEQ ID NO: 202693 - DNA, 25 bp, Rattus norvegicus
atgtggaactctcccgggaccagac

SEQ ID NO: 202694 - DNA, 25 bp, Rattus norvegicus
atgtggaactctgccgggaccagac

SEQ ID NO: 202695 - DNA, 25 bp, Rattus norvegicus
atgtggaactgacaagcccctatgc

SEQ ID NO: 202696 - DNA, 25 bp, Rattus norvegicus
atgtggaactgagaagcccctatgc

SEQ ID NO: 202697 - DNA, 25 bp, Rattus norvegicus
atgtggaagatgaagccagcggctt

SEQ ID NO: 202698 - DNA, 25 bp, Rattus norvegicus
atgtggaagatgtagccagcggctt

SEQ ID NO: 202699 - DNA, 25 bp, Rattus norvegicus
atgtggaagccgcaatctcgatttc

SEQ ID NO: 202700 - DNA, 25 bp, Rattus norvegicus
atgtggaagccggaatctcgatttc

SEQ ID NO: 202701 - DNA, 25 bp, Rattus norvegicus
atgtggaagcctcccatgtagacta

SEQ ID NO: 202702 - DNA, 25 bp, Rattus norvegicus
atgtggaagcctgccatgtagacta

SEQ ID NO: 202703 - DNA, 25 bp, Rattus norvegicus
atgtggaaggacacgcccaaatctt

SEQ ID NO: 202704 - DNA, 25 bp, Rattus norvegicus
atgtggaaggactcgcccaaatctt

SEQ ID NO: 202705 - DNA, 25 bp, Rattus norvegicus
atgtggaaggccacccaacaaccat

SEQ ID NO: 202706 - DNA, 25 bp, Rattus norvegicus
atgtggaaggccctcatttacttcg

SEQ ID NO: 202707 - DNA, 25 bp, Rattus norvegicus
atgtggaaggccgtcatttacttcg

SEQ ID NO: 202708 - DNA, 25 bp, Rattus norvegicus
atgtggaaggcctcccaacaaccat

SEQ ID NO: 202709 - DNA, 25 bp, Rattus norvegicus
atgtggaatggaaggccccgtgacc

SEQ ID NO: 202710 - DNA, 25 bp, Rattus norvegicus
atgtggaatggatggccccgtgacc

SEQ ID NO: 202711 - DNA, 25 bp, Rattus norvegicus
atgtggacaggcacccacgtgaacg

SEQ ID NO: 202712 - DNA, 25 bp, Rattus norvegicus
atgtggacaggctcccacgtgaacg

SEQ ID NO: 202713 - DNA, 25 bp, Rattus norvegicus
atgtggacatcaatgcccgtacaga

SEQ ID NO: 202714 - DNA, 25 bp, Rattus norvegicus
atgtggacatcattgcccgtacaga

SEQ ID NO: 202715 - DNA, 25 bp, Rattus norvegicus
atgtggacatctcagggccaccggc

SEQ ID NO: 202716 - DNA, 25 bp, Rattus norvegicus
atgtggacatctgagggccaccggc

SEQ ID NO: 202717 - DNA, 25 bp, Rattus norvegicus
atgtggacatgcacccgcatgtaca

SEQ ID NO: 202718 - DNA, 25 bp, Rattus norvegicus
atgtggacatgctcccgcatgtaca

SEQ ID NO: 202719 - DNA, 25 bp, Rattus norvegicus
atgtggaccagcacttgggcaggta

SEQ ID NO: 202720 - DNA, 25 bp, Rattus norvegicus
atgtggaccagctcttgggcaggta

SEQ ID NO: 202721 - DNA, 25 bp, Rattus norvegicus
atgtggaccgggagacagagctcct

SEQ ID NO: 202722 - DNA, 25 bp, Rattus norvegicus
atgtggaccgggtgacagagctcct

SEQ ID NO: 202723 - DNA, 25 bp, Rattus norvegicus
atgtggacctctacaagggtacttt

SEQ ID NO: 202724 - DNA, 25 bp, Rattus norvegicus
atgtggacctctcacagcggtgcca

SEQ ID NO: 202725 - DNA, 25 bp, Rattus norvegicus
atgtggacctctgacagcggtgcca

SEQ ID NO: 202726 - DNA, 25 bp, Rattus norvegicus
atgtggacctcttcaagggtacttt

SEQ ID NO: 202727 - DNA, 25 bp, Rattus norvegicus
atgtggaccttgaagctttcttaga

SEQ ID NO: 202728 - DNA, 25 bp, Rattus norvegicus
atgtggaccttgtagctttcttaga

SEQ ID NO: 202729 - DNA, 25 bp, Rattus norvegicus
atgtggacgattctggcttttcttt

SEQ ID NO: 202730 - DNA, 25 bp, Rattus norvegicus
atgtggacgattgtggcttttcttt

SEQ ID NO: 202731 - DNA, 25 bp, Rattus norvegicus
atgtggacgctcagaagcaaatctg

SEQ ID NO: 202732 - DNA, 25 bp, Rattus norvegicus
atgtggacgctctgaagcaaatctg

SEQ ID NO: 202733 - DNA, 25 bp, Rattus norvegicus
atgtggacgtccacagatatagcta

SEQ ID NO: 202734 - DNA, 25 bp, Rattus norvegicus
atgtggacgtcctcagatatagcta

SEQ ID NO: 202735 - DNA, 25 bp, Rattus norvegicus
atgtggactatgctgccaagcctgg

SEQ ID NO: 202736 - DNA, 25 bp, Rattus norvegicus
atgtggactatggtgccaagcctgg

SEQ ID NO: 202737 - DNA, 25 bp, Rattus norvegicus
atgtggacttctcacattgaccaac

SEQ ID NO: 202738 - DNA, 25 bp, Rattus norvegicus
atgtggacttctgacattgaccaac

SEQ ID NO: 202739 - DNA, 25 bp, Rattus norvegicus
atgtggagaacccagtaccctgcaa

SEQ ID NO: 202740 - DNA, 25 bp, Rattus norvegicus
atgtggagaaccgagtaccctgcaa

SEQ ID NO: 202741 - DNA, 25 bp, Rattus norvegicus
atgtggagaatactgggctaacgcc

SEQ ID NO: 202742 - DNA, 25 bp, Rattus norvegicus
atgtggagaatagtgggctaacgcc

SEQ ID NO: 202743 - DNA, 25 bp, Rattus norvegicus
atgtggagacacatcactggcccaa

SEQ ID NO: 202744 - DNA, 25 bp, Rattus norvegicus
atgtggagacacttcactggcccaa

SEQ ID NO: 202745 - DNA, 25 bp, Rattus norvegicus
atgtggagacctatgacttcttcac

SEQ ID NO: 202746 - DNA, 25 bp, Rattus norvegicus
atgtggagacctttgacttcttcac

SEQ ID NO: 202747 - DNA, 25 bp, Rattus norvegicus
atgtggagcagtcctgacctgccag

SEQ ID NO: 202748 - DNA, 25 bp, Rattus norvegicus
atgtggagcagtgctgacctgccag

SEQ ID NO: 202749 - DNA, 25 bp, Rattus norvegicus
atgtggagcattcgccttcagaaca

SEQ ID NO: 202750 - DNA, 25 bp, Rattus norvegicus
atgtggagcattggccttcagaaca

SEQ ID NO: 202751 - DNA, 25 bp, Rattus norvegicus
atgtggagccacacttggacacagc

SEQ ID NO: 202752 - DNA, 25 bp, Rattus norvegicus
atgtggagccactcttggacacagc

SEQ ID NO: 202753 - DNA, 25 bp, Rattus norvegicus
atgtggagctgaaggagaccctagt

SEQ ID NO: 202754 - DNA, 25 bp, Rattus norvegicus
atgtggagctgatggagaccctagt

SEQ ID NO: 202755 - DNA, 25 bp, Rattus norvegicus
atgtggagctgcctacctgcagtca

SEQ ID NO: 202756 - DNA, 25 bp, Rattus norvegicus
atgtggagctgcgtacctgcagtca

SEQ ID NO: 202757 - DNA, 25 bp, Rattus norvegicus
atgtggaggactatcgccgcactgt

SEQ ID NO: 202758 - DNA, 25 bp, Rattus norvegicus
atgtggaggactttcgccgcactgt

SEQ ID NO: 202759 - DNA, 25 bp, Rattus norvegicus
atgtggatacctcataaccgagtcc

SEQ ID NO: 202760 - DNA, 25 bp, Rattus norvegicus
atgtggatacctcgctttgcatgtt

SEQ ID NO: 202761 - DNA, 25 bp, Rattus norvegicus
atgtggatacctgataaccgagtcc

SEQ ID NO: 202762 - DNA, 25 bp, Rattus norvegicus
atgtggatacctggctttgcatgtt

SEQ ID NO: 202763 - DNA, 25 bp, Rattus norvegicus
atgtggatagttctggccacctgct

SEQ ID NO: 202764 - DNA, 25 bp, Rattus norvegicus
atgtggatagttgtggccacctgct

SEQ ID NO: 202765 - DNA, 25 bp, Rattus norvegicus
atgtggatatacacgaatcgcatac

SEQ ID NO: 202766 - DNA, 25 bp, Rattus norvegicus
atgtggatatactcgaatcgcatac

SEQ ID NO: 202767 - DNA, 25 bp, Rattus norvegicus
atgtggatcatgctttctcaggccc

SEQ ID NO: 202768 - DNA, 25 bp, Rattus norvegicus
atgtggatcatggtttctcaggccc

SEQ ID NO: 202769 - DNA, 25 bp, Rattus norvegicus
atgtggatcccacaaatcccgttct

SEQ ID NO: 202770 - DNA, 25 bp, Rattus norvegicus
atgtggatcccagaaatcccgttct

SEQ ID NO: 202771 - DNA, 25 bp, Rattus norvegicus
atgtggatctctacattctaggcca

SEQ ID NO: 202772 - DNA, 25 bp, Rattus norvegicus
atgtggatctcttcattctaggcca

SEQ ID NO: 202773 - DNA, 25 bp, Rattus norvegicus
atgtggatctgtcgtcatttcctct

SEQ ID NO: 202774 - DNA, 25 bp, Rattus norvegicus
atgtggatctgtggtcatttcctct

SEQ ID NO: 202775 - DNA, 25 bp, Rattus norvegicus
atgtggatgactacgacgccctaca

SEQ ID NO: 202776 - DNA, 25 bp, Rattus norvegicus
atgtggatgacttcgacgccctaca

SEQ ID NO: 202777 - DNA, 25 bp, Rattus norvegicus
atgtggattattattctgtctcaaa

SEQ ID NO: 202778 - DNA, 25 bp, Rattus norvegicus
atgtggattatttttctgtctcaaa

SEQ ID NO: 202779 - DNA, 25 bp, Rattus norvegicus
atgtggcaaaaacccttggacttgg

SEQ ID NO: 202780 - DNA, 25 bp, Rattus norvegicus
atgtggcaaaaagccttggacttgg

SEQ ID NO: 202781 - DNA, 25 bp, Rattus norvegicus
atgtggcaaattaacacttgggtgt

SEQ ID NO: 202782 - DNA, 25 bp, Rattus norvegicus
atgtggcaaatttacacttgggtgt

SEQ ID NO: 202783 - DNA, 25 bp, Rattus norvegicus
atgtggcaaccacctcttaggcgtg

SEQ ID NO: 202784 - DNA, 25 bp, Rattus norvegicus
atgtggcaaccagctcttaggcgtg

SEQ ID NO: 202785 - DNA, 25 bp, Rattus norvegicus
atgtggcaacccatatctaacttga

SEQ ID NO: 202786 - DNA, 25 bp, Rattus norvegicus
atgtggcaacccttatctaacttga

SEQ ID NO: 202787 - DNA, 25 bp, Rattus norvegicus
atgtggcaacctactgggaggtgcc

SEQ ID NO: 202788 - DNA, 25 bp, Rattus norvegicus
atgtggcaaccttctgggaggtgcc

SEQ ID NO: 202789 - DNA, 25 bp, Rattus norvegicus
atgtggcaactcagtcacagccaca

SEQ ID NO: 202790 - DNA, 25 bp, Rattus norvegicus
atgtggcaactctgtcacagccaca

SEQ ID NO: 202791 - DNA, 25 bp, Rattus norvegicus
atgtggcaatttaaagtcgctttct

SEQ ID NO: 202792 - DNA, 25 bp, Rattus norvegicus
atgtggcaattttaagtcgctttct

SEQ ID NO: 202793 - DNA, 25 bp, Rattus norvegicus
atgtggcaccttagggatgctgcag

SEQ ID NO: 202794 - DNA, 25 bp, Rattus norvegicus
atgtggcacctttgggatgctgcag

SEQ ID NO: 202795 - DNA, 25 bp, Rattus norvegicus
atgtggcacgcacgccactgcagaa

SEQ ID NO: 202796 - DNA, 25 bp, Rattus norvegicus
atgtggcacgcaggccactgcagaa

SEQ ID NO: 202797 - DNA, 25 bp, Rattus norvegicus
atgtggcactgtccattttcagaga

SEQ ID NO: 202798 - DNA, 25 bp, Rattus norvegicus
atgtggcactgtgcattttcagaga

SEQ ID NO: 202799 - DNA, 25 bp, Rattus norvegicus
atgtggcatgggaacagcaactcca

SEQ ID NO: 202800 - DNA, 25 bp, Rattus norvegicus
atgtggcatgggtacagcaactcca

SEQ ID NO: 202801 - DNA, 25 bp, Rattus norvegicus
atgtggccaaagatgttgccttctt

SEQ ID NO: 202802 - DNA, 25 bp, Rattus norvegicus
atgtggccaaagttgttgccttctt

SEQ ID NO: 202803 - DNA, 25 bp, Rattus norvegicus
atgtggccaagaccctgctgtaaca

SEQ ID NO: 202804 - DNA, 25 bp, Rattus norvegicus
atgtggccaagagcctgctgtaaca

SEQ ID NO: 202805 - DNA, 25 bp, Rattus norvegicus
atgtggccaatcatctgactgcttt

SEQ ID NO: 202806 - DNA, 25 bp, Rattus norvegicus
atgtggccaatcttctgactgcttt

SEQ ID NO: 202807 - DNA, 25 bp, Rattus norvegicus
atgtggccaatgacttcactctaac

SEQ ID NO: 202808 - DNA, 25 bp, Rattus norvegicus
atgtggccaatgtcttcactctaac

SEQ ID NO: 202809 - DNA, 25 bp, Rattus norvegicus
atgtggccagctacattgccaaggc

SEQ ID NO: 202810 - DNA, 25 bp, Rattus norvegicus
atgtggccagctccattttacagga

SEQ ID NO: 202811 - DNA, 25 bp, Rattus norvegicus
atgtggccagctgcattttacagga

SEQ ID NO: 202812 - DNA, 25 bp, Rattus norvegicus
atgtggccagcttcattgccaaggc

SEQ ID NO: 202813 - DNA, 25 bp, Rattus norvegicus
atgtggccatagacccttgagagtt

SEQ ID NO: 202814 - DNA, 25 bp, Rattus norvegicus
atgtggccatagtcccttgagagtt

SEQ ID NO: 202815 - DNA, 25 bp, Rattus norvegicus
atgtggcccagaccacttggaaact

SEQ ID NO: 202816 - DNA, 25 bp, Rattus norvegicus
atgtggcccagagcacttggaaact

SEQ ID NO: 202817 - DNA, 25 bp, Rattus norvegicus
atgtggccccacacaagaaggaggt

SEQ ID NO: 202818 - DNA, 25 bp, Rattus norvegicus
atgtggccccactcaagaaggaggt

SEQ ID NO: 202819 - DNA, 25 bp, Rattus norvegicus
atgtggccccatacaaggtagctca

SEQ ID NO: 202820 - DNA, 25 bp, Rattus norvegicus
atgtggccccattcaaggtagctca

SEQ ID NO: 202821 - DNA, 25 bp, Rattus norvegicus
atgtggcccggaagacagctacagg

SEQ ID NO: 202822 - DNA, 25 bp, Rattus norvegicus
atgtggcccggatgacagctacagg

SEQ ID NO: 202823 - DNA, 25 bp, Rattus norvegicus
atgtggccctcacaggtgctcttaa

SEQ ID NO: 202824 - DNA, 25 bp, Rattus norvegicus
atgtggccctcagaggtgctcttaa

SEQ ID NO: 202825 - DNA, 25 bp, Rattus norvegicus
atgtggccctctccaaatcaaggat

SEQ ID NO: 202826 - DNA, 25 bp, Rattus norvegicus
atgtggccctctgcaaatcaaggat

SEQ ID NO: 202827 - DNA, 25 bp, Rattus norvegicus
atgtggccctggaacaccatgagga

SEQ ID NO: 202828 - DNA, 25 bp, Rattus norvegicus
atgtggccctggtacaccatgagga

SEQ ID NO: 202829 - DNA, 25 bp, Rattus norvegicus
atgtggccgagtatcttggtaggaa

SEQ ID NO: 202830 - DNA, 25 bp, Rattus norvegicus
atgtggccgagtttcttggtaggaa

SEQ ID NO: 202831 - DNA, 25 bp, Rattus norvegicus
atgtggccgcagatcgtagcagtga

SEQ ID NO: 202832 - DNA, 25 bp, Rattus norvegicus
atgtggccgcagttcgtagcagtga

SEQ ID NO: 202833 - DNA, 25 bp, Rattus norvegicus
atgtggccggaccacagctactggt

SEQ ID NO: 202834 - DNA, 25 bp, Rattus norvegicus
atgtggccggacgacagctactggt

SEQ ID NO: 202835 - DNA, 25 bp, Rattus norvegicus
atgtggccgttaatctgtatatggt

SEQ ID NO: 202836 - DNA, 25 bp, Rattus norvegicus
atgtggccgttattctgtatatggt

SEQ ID NO: 202837 - DNA, 25 bp, Rattus norvegicus
atgtggcctcaactcatggagccct

SEQ ID NO: 202838 - DNA, 25 bp, Rattus norvegicus
atgtggcctcaagtcatggagccct

SEQ ID NO: 202839 - DNA, 25 bp, Rattus norvegicus
atgtggcctcacactggagttatga

SEQ ID NO: 202840 - DNA, 25 bp, Rattus norvegicus
atgtggcctcacatggatgcttccc

SEQ ID NO: 202841 - DNA, 25 bp, Rattus norvegicus
atgtggcctcactctggagttatga

SEQ ID NO: 202842 - DNA, 25 bp, Rattus norvegicus
atgtggcctcacttggatgcttccc

SEQ ID NO: 202843 - DNA, 25 bp, Rattus norvegicus
atgtggcctggcatcataacctcag

SEQ ID NO: 202844 - DNA, 25 bp, Rattus norvegicus
atgtggcctggcttcataacctcag

SEQ ID NO: 202845 - DNA, 25 bp, Rattus norvegicus
atgtggcctgtgattttagagtagc

SEQ ID NO: 202846 - DNA, 25 bp, Rattus norvegicus
atgtggcctgtgtttttagagtagc

SEQ ID NO: 202847 - DNA, 25 bp, Rattus norvegicus
atgtggcgccacagaaagcactgga

SEQ ID NO: 202848 - DNA, 25 bp, Rattus norvegicus
atgtggcgccactgaaagcactgga

SEQ ID NO: 202849 - DNA, 25 bp, Rattus norvegicus
atgtggcgcctgctgcccctgaagc

SEQ ID NO: 202850 - DNA, 25 bp, Rattus norvegicus
atgtggcgcctggtgcccctgaagc

SEQ ID NO: 202851 - DNA, 25 bp, Rattus norvegicus
atgtggcgcttcatgttggcctgca

SEQ ID NO: 202852 - DNA, 25 bp, Rattus norvegicus
atgtggcgcttcttgttggcctgca

SEQ ID NO: 202853 - DNA, 25 bp, Rattus norvegicus
atgtggcgtcaactacatcgtccaa

SEQ ID NO: 202854 - DNA, 25 bp, Rattus norvegicus
atgtggcgtcaagtacatcgtccaa

SEQ ID NO: 202855 - DNA, 25 bp, Rattus norvegicus
atgtggcgtcacatgaggtggttct

SEQ ID NO: 202856 - DNA, 25 bp, Rattus norvegicus
atgtggcgtcacttgaggtggttct

SEQ ID NO: 202857 - DNA, 25 bp, Rattus norvegicus
atgtggcgtgttccattttccagtt

SEQ ID NO: 202858 - DNA, 25 bp, Rattus norvegicus
atgtggcgtgttgcattttccagtt

SEQ ID NO: 202859 - DNA, 25 bp, Rattus norvegicus
atgtggctaacaatgacctgaactt

SEQ ID NO: 202860 - DNA, 25 bp, Rattus norvegicus
atgtggctaacattgacctgaactt

SEQ ID NO: 202861 - DNA, 25 bp, Rattus norvegicus
atgtggctaccaaaacaaggtcctt

SEQ ID NO: 202862 - DNA, 25 bp, Rattus norvegicus
atgtggctaccataacaaggtcctt

SEQ ID NO: 202863 - DNA, 25 bp, Rattus norvegicus
atgtggctacctcaatccctggtga

SEQ ID NO: 202864 - DNA, 25 bp, Rattus norvegicus
atgtggctacctgaatccctggtga

SEQ ID NO: 202865 - DNA, 25 bp, Rattus norvegicus
atgtggctacttacattgttactga

SEQ ID NO: 202866 - DNA, 25 bp, Rattus norvegicus
atgtggctactttcattgttactga

SEQ ID NO: 202867 - DNA, 25 bp, Rattus norvegicus
atgtggctataactgtgggctcctc

SEQ ID NO: 202868 - DNA, 25 bp, Rattus norvegicus
atgtggctataagtgtgggctcctc

SEQ ID NO: 202869 - DNA, 25 bp, Rattus norvegicus
atgtggctatatatcctagagcacc

SEQ ID NO: 202870 - DNA, 25 bp, Rattus norvegicus
atgtggctatatttcctagagcacc

SEQ ID NO: 202871 - DNA, 25 bp, Rattus norvegicus
atgtggctcagccttccaagagaaa

SEQ ID NO: 202872 - DNA, 25 bp, Rattus norvegicus
atgtggctcagcgttccaagagaaa

SEQ ID NO: 202873 - DNA, 25 bp, Rattus norvegicus
atgtggctcagtatcatagctttct

SEQ ID NO: 202874 - DNA, 25 bp, Rattus norvegicus
atgtggctcagtttcatagctttct

SEQ ID NO: 202875 - DNA, 25 bp, Rattus norvegicus
atgtggctcattatatatttcctaa

SEQ ID NO: 202876 - DNA, 25 bp, Rattus norvegicus
atgtggctcattttatatttcctaa

SEQ ID NO: 202877 - DNA, 25 bp, Rattus norvegicus
atgtggctccctaggacattggtgc

SEQ ID NO: 202878 - DNA, 25 bp, Rattus norvegicus
atgtggctcccttggacattggtgc

SEQ ID NO: 202879 - DNA, 25 bp, Rattus norvegicus
atgtggctcctgatgggtccaccat

SEQ ID NO: 202880 - DNA, 25 bp, Rattus norvegicus
atgtggctcctgttgggtccaccat

SEQ ID NO: 202881 - DNA, 25 bp, Rattus norvegicus
atgtggctctaacacacgtgacccg

SEQ ID NO: 202882 - DNA, 25 bp, Rattus norvegicus
atgtggctctaagacacgtgacccg

SEQ ID NO: 202883 - DNA, 25 bp, Rattus norvegicus
atgtggctctgaatgttaaactgta

SEQ ID NO: 202884 - DNA, 25 bp, Rattus norvegicus
atgtggctctgattgttaaactgta

SEQ ID NO: 202885 - DNA, 25 bp, Rattus norvegicus
atgtggctctggctctgtgtgaact

SEQ ID NO: 202886 - DNA, 25 bp, Rattus norvegicus
atgtggctctgggtctgtgtgaact

SEQ ID NO: 202887 - DNA, 25 bp, Rattus norvegicus
atgtggctgattaccaggacccgag

SEQ ID NO: 202888 - DNA, 25 bp, Rattus norvegicus
atgtggctgatttccaggacccgag

SEQ ID NO: 202889 - DNA, 25 bp, Rattus norvegicus
atgtggctgccactagctggacgtt

SEQ ID NO: 202890 - DNA, 25 bp, Rattus norvegicus
atgtggctgccagtagctggacgtt

SEQ ID NO: 202891 - DNA, 25 bp, Rattus norvegicus
atgtggctgctcatggttctggcta

SEQ ID NO: 202892 - DNA, 25 bp, Rattus norvegicus
atgtggctgctcttggttctggcta

SEQ ID NO: 202893 - DNA, 25 bp, Rattus norvegicus
atgtggctggtgatgatgaccctga

SEQ ID NO: 202894 - DNA, 25 bp, Rattus norvegicus
atgtggctggtgttgatgaccctga

SEQ ID NO: 202895 - DNA, 25 bp, Rattus norvegicus
atgtggctgtggagaacggtcacct

SEQ ID NO: 202896 - DNA, 25 bp, Rattus norvegicus
atgtggctgtggtgaacggtcacct

SEQ ID NO: 202897 - DNA, 25 bp, Rattus norvegicus
atgtggcttagtattatgttttgat

SEQ ID NO: 202898 - DNA, 25 bp, Rattus norvegicus
atgtggcttagttttatgttttgat

SEQ ID NO: 202899 - DNA, 25 bp, Rattus norvegicus
atgtggcttcatagtgagggcacct

SEQ ID NO: 202900 - DNA, 25 bp, Rattus norvegicus
atgtggcttcattgtgagggcacct

SEQ ID NO: 202901 - DNA, 25 bp, Rattus norvegicus
atgtggcttccacgcataaacgaga

SEQ ID NO: 202902 - DNA, 25 bp, Rattus norvegicus
atgtggcttccaggcataaacgaga

SEQ ID NO: 202903 - DNA, 25 bp, Rattus norvegicus
atgtggcttctgcagctccagaaaa

SEQ ID NO: 202904 - DNA, 25 bp, Rattus norvegicus
atgtggcttctggagctccagaaaa

SEQ ID NO: 202905 - DNA, 25 bp, Rattus norvegicus
atgtggcttgcactaggcctggcat

SEQ ID NO: 202906 - DNA, 25 bp, Rattus norvegicus
atgtggcttgcagtaggcctggcat

SEQ ID NO: 202907 - DNA, 25 bp, Rattus norvegicus
atgtggcttggcagttactctgtac

SEQ ID NO: 202908 - DNA, 25 bp, Rattus norvegicus
atgtggcttggctgttactctgtac

SEQ ID NO: 202909 - DNA, 25 bp, Rattus norvegicus
atgtggcttgttattcacctgagtc

SEQ ID NO: 202910 - DNA, 25 bp, Rattus norvegicus
atgtggcttgtttttcacctgagtc

SEQ ID NO: 202911 - DNA, 25 bp, Rattus norvegicus
atgtggctttagaggctggagacac

SEQ ID NO: 202912 - DNA, 25 bp, Rattus norvegicus
atgtggctttagtggctggagacac

SEQ ID NO: 202913 - DNA, 25 bp, Rattus norvegicus
atgtggctttatccatctctccagg

SEQ ID NO: 202914 - DNA, 25 bp, Rattus norvegicus
atgtggctttatgcatctctccagg

SEQ ID NO: 202915 - DNA, 25 bp, Rattus norvegicus
atgtggctttggctcagtccaatat

SEQ ID NO: 202916 - DNA, 25 bp, Rattus norvegicus
atgtggctttgggtcagtccaatat

SEQ ID NO: 202917 - DNA, 25 bp, Rattus norvegicus
atgtggcttttgacccatcctaagc

SEQ ID NO: 202918 - DNA, 25 bp, Rattus norvegicus
atgtggcttttgacccgtgctatta

SEQ ID NO: 202919 - DNA, 25 bp, Rattus norvegicus
atgtggcttttgtcccatcctaagc

SEQ ID NO: 202920 - DNA, 25 bp, Rattus norvegicus
atgtggcttttgtcccgtgctatta

SEQ ID NO: 202921 - DNA, 25 bp, Rattus norvegicus
atgtgggaaagtcgccaatcttctc

SEQ ID NO: 202922 - DNA, 25 bp, Rattus norvegicus
atgtgggaaagtggccaatcttctc

SEQ ID NO: 202923 - DNA, 25 bp, Rattus norvegicus
atgtgggaaggcacagtccattgag

SEQ ID NO: 202924 - DNA, 25 bp, Rattus norvegicus
atgtgggaaggcagaacctctctcc

SEQ ID NO: 202925 - DNA, 25 bp, Rattus norvegicus
atgtgggaaggctcagtccattgag

SEQ ID NO: 202926 - DNA, 25 bp, Rattus norvegicus
atgtgggaaggctgaacctctctcc

SEQ ID NO: 202927 - DNA, 25 bp, Rattus norvegicus
atgtgggagccaaggacttgaactc

SEQ ID NO: 202928 - DNA, 25 bp, Rattus norvegicus
atgtgggagccatggacttgaactc

SEQ ID NO: 202929 - DNA, 25 bp, Rattus norvegicus
atgtgggagcgcagctaagcccttg

SEQ ID NO: 202930 - DNA, 25 bp, Rattus norvegicus
atgtgggagcgctgctaagcccttg

SEQ ID NO: 202931 - DNA, 25 bp, Rattus norvegicus
atgtgggatgacctttagttgaata

SEQ ID NO: 202932 - DNA, 25 bp, Rattus norvegicus
atgtgggatgacgtttagttgaata

SEQ ID NO: 202933 - DNA, 25 bp, Rattus norvegicus
atgtgggatgtcagttttctattac

SEQ ID NO: 202934 - DNA, 25 bp, Rattus norvegicus
atgtgggatgtctgttttctattac

SEQ ID NO: 202935 - DNA, 25 bp, Rattus norvegicus
atgtgggattacagctcaccgtcaa

SEQ ID NO: 202936 - DNA, 25 bp, Rattus norvegicus
atgtgggattactgctcaccgtcaa

SEQ ID NO: 202937 - DNA, 25 bp, Rattus norvegicus
atgtgggcattaacacctcacccta

SEQ ID NO: 202938 - DNA, 25 bp, Rattus norvegicus
atgtgggcattatcacctcacccta

SEQ ID NO: 202939 - DNA, 25 bp, Rattus norvegicus
atgtgggcatttcggaaatccctcc

SEQ ID NO: 202940 - DNA, 25 bp, Rattus norvegicus
atgtgggcatttgggaaatccctcc

SEQ ID NO: 202941 - DNA, 25 bp, Rattus norvegicus
atgtgggccaaaccgttctggatca

SEQ ID NO: 202942 - DNA, 25 bp, Rattus norvegicus
atgtgggccaaagcgttctggatca

SEQ ID NO: 202943 - DNA, 25 bp, Rattus norvegicus
atgtgggccccacatctgaggactc

SEQ ID NO: 202944 - DNA, 25 bp, Rattus norvegicus
atgtgggccccagatctgaggactc

SEQ ID NO: 202945 - DNA, 25 bp, Rattus norvegicus
atgtgggccgcaagttcaaacagtt

SEQ ID NO: 202946 - DNA, 25 bp, Rattus norvegicus
atgtgggccgcatgttcaaacagtt

SEQ ID NO: 202947 - DNA, 25 bp, Rattus norvegicus
atgtgggcgaccaccagtgaacaag

SEQ ID NO: 202948 - DNA, 25 bp, Rattus norvegicus
atgtgggcgacctccagtgaacaag

SEQ ID NO: 202949 - DNA, 25 bp, Rattus norvegicus
atgtgggcggcaacgtggactacaa

SEQ ID NO: 202950 - DNA, 25 bp, Rattus norvegicus
atgtgggcggcatcgtggactacaa

SEQ ID NO: 202951 - DNA, 25 bp, Rattus norvegicus
atgtgggcggctcgtaaacatgtcc

SEQ ID NO: 202952 - DNA, 25 bp, Rattus norvegicus
atgtgggcggctggtaaacatgtcc

SEQ ID NO: 202953 - DNA, 25 bp, Rattus norvegicus
atgtgggctcacctagttttttcag

SEQ ID NO: 202954 - DNA, 25 bp, Rattus norvegicus
atgtgggctcacgtagttttttcag

SEQ ID NO: 202955 - DNA, 25 bp, Rattus norvegicus
atgtgggctccactgttgtctgatc

SEQ ID NO: 202956 - DNA, 25 bp, Rattus norvegicus
atgtgggctccagtgttgtctgatc

SEQ ID NO: 202957 - DNA, 25 bp, Rattus norvegicus
atgtgggcttgtcagcactgcacct

SEQ ID NO: 202958 - DNA, 25 bp, Rattus norvegicus
atgtgggcttgtgagcactgcacct

SEQ ID NO: 202959 - DNA, 25 bp, Rattus norvegicus
atgtgggtacccatggaccatgtgt

SEQ ID NO: 202960 - DNA, 25 bp, Rattus norvegicus
atgtgggtacccttggaccatgtgt

SEQ ID NO: 202961 - DNA, 25 bp, Rattus norvegicus
atgtgggtcagacagcctgctgctc

SEQ ID NO: 202962 - DNA, 25 bp, Rattus norvegicus
atgtgggtcagagagcctgctgctc

SEQ ID NO: 202963 - DNA, 25 bp, Rattus norvegicus
atgtgggtcagcctatgctcaactt

SEQ ID NO: 202964 - DNA, 25 bp, Rattus norvegicus
atgtgggtcagcgtatgctcaactt

SEQ ID NO: 202965 - DNA, 25 bp, Rattus norvegicus
atgtgggtcccaaacaactgcgagc

SEQ ID NO: 202966 - DNA, 25 bp, Rattus norvegicus
atgtgggtcccaaagatgaaactcg

SEQ ID NO: 202967 - DNA, 25 bp, Rattus norvegicus
atgtgggtcccatacaactgcgagc

SEQ ID NO: 202968 - DNA, 25 bp, Rattus norvegicus
atgtgggtcccatagatgaaactcg

SEQ ID NO: 202969 - DNA, 25 bp, Rattus norvegicus
atgtgggtccttctggtcaagcaca

SEQ ID NO: 202970 - DNA, 25 bp, Rattus norvegicus
atgtgggtccttgtggtcaagcaca

SEQ ID NO: 202971 - DNA, 25 bp, Rattus norvegicus
atgtgggtctacagctgggctccaa

SEQ ID NO: 202972 - DNA, 25 bp, Rattus norvegicus
atgtgggtctactgctgggctccaa

SEQ ID NO: 202973 - DNA, 25 bp, Rattus norvegicus
atgtgggtgcccacgtgaacacgtt

SEQ ID NO: 202974 - DNA, 25 bp, Rattus norvegicus
atgtgggtgccctcgtgaacacgtt

SEQ ID NO: 202975 - DNA, 25 bp, Rattus norvegicus
atgtgggtgctactaaccaagcaca

SEQ ID NO: 202976 - DNA, 25 bp, Rattus norvegicus
atgtgggtgctagtaaccaagcaca

SEQ ID NO: 202977 - DNA, 25 bp, Rattus norvegicus
atgtgggtgctcatcggaggaatct

SEQ ID NO: 202978 - DNA, 25 bp, Rattus norvegicus
atgtgggtgctcttcggaggaatct

SEQ ID NO: 202979 - DNA, 25 bp, Rattus norvegicus
atgtgggtgctgctctcactgtcac

SEQ ID NO: 202980 - DNA, 25 bp, Rattus norvegicus
atgtgggtgctggtctcactgtcac

SEQ ID NO: 202981 - DNA, 25 bp, Rattus norvegicus
atgtgggtgggtacacatgcagcat

SEQ ID NO: 202982 - DNA, 25 bp, Rattus norvegicus
atgtgggtgggttcacatgcagcat

SEQ ID NO: 202983 - DNA, 25 bp, Rattus norvegicus
atgtgggtggtgcttttcctgactc

SEQ ID NO: 202984 - DNA, 25 bp, Rattus norvegicus
atgtgggtggtggttttcctgactc

SEQ ID NO: 202985 - DNA, 25 bp, Rattus norvegicus
atgtgggttcagacctcagtgcttc

SEQ ID NO: 202986 - DNA, 25 bp, Rattus norvegicus
atgtgggttcagtcctcagtgcttc

SEQ ID NO: 202987 - DNA, 25 bp, Rattus norvegicus
atgtgggttcccacaaagtcagctc

SEQ ID NO: 202988 - DNA, 25 bp, Rattus norvegicus
atgtgggttccctcaaagtcagctc

SEQ ID NO: 202989 - DNA, 25 bp, Rattus norvegicus
atgtgggttcctctcttacatggac

SEQ ID NO: 202990 - DNA, 25 bp, Rattus norvegicus
atgtgggttcctgtcttacatggac

SEQ ID NO: 202991 - DNA, 25 bp, Rattus norvegicus
atgtgggttctacctgcaacaggca

SEQ ID NO: 202992 - DNA, 25 bp, Rattus norvegicus
atgtgggttctagctgcaacaggca

SEQ ID NO: 202993 - DNA, 25 bp, Rattus norvegicus
atgtggtaacgccagctacctgaac

SEQ ID NO: 202994 - DNA, 25 bp, Rattus norvegicus
atgtggtaacgcgagctacctgaac

SEQ ID NO: 202995 - DNA, 25 bp, Rattus norvegicus
atgtggtaccatctgtcatgctgca

SEQ ID NO: 202996 - DNA, 25 bp, Rattus norvegicus
atgtggtaccatgtgtcatgctgca

SEQ ID NO: 202997 - DNA, 25 bp, Rattus norvegicus
atgtggtactttcgttcagcccagg

SEQ ID NO: 202998 - DNA, 25 bp, Rattus norvegicus
atgtggtactttggttcagcccagg

SEQ ID NO: 202999 - DNA, 25 bp, Rattus norvegicus
atgtggtagatgagtgctctcctcc

SEQ ID NO: 203000 - DNA, 25 bp, Rattus norvegicus
atgtggtagatgtgtgctctcctcc

SEQ ID NO: 203001 - DNA, 25 bp, Rattus norvegicus
atgtggtataacagttccgctgcct

SEQ ID NO: 203002 - DNA, 25 bp, Rattus norvegicus
atgtggtataactgttccgctgcct

SEQ ID NO: 203003 - DNA, 25 bp, Rattus norvegicus
atgtggtatcagagccccactgttt

SEQ ID NO: 203004 - DNA, 25 bp, Rattus norvegicus
atgtggtatcagtgccccactgttt

SEQ ID NO: 203005 - DNA, 25 bp, Rattus norvegicus
atgtggtcaaaacgtacctctctga

SEQ ID NO: 203006 - DNA, 25 bp, Rattus norvegicus
atgtggtcaaaaggtacctctctga

SEQ ID NO: 203007 - DNA, 25 bp, Rattus norvegicus
atgtggtcagccatgtgcagcatta

SEQ ID NO: 203008 - DNA, 25 bp, Rattus norvegicus
atgtggtcagccttgtgcagcatta

SEQ ID NO: 203009 - DNA, 25 bp, Rattus norvegicus
atgtggtcagtgatcctatctcggt

SEQ ID NO: 203010 - DNA, 25 bp, Rattus norvegicus
atgtggtcagtgttcctatctcggt

SEQ ID NO: 203011 - DNA, 25 bp, Rattus norvegicus
atgtggtcatagctacctatataga

SEQ ID NO: 203012 - DNA, 25 bp, Rattus norvegicus
atgtggtcataggtacctatataga

SEQ ID NO: 203013 - DNA, 25 bp, Rattus norvegicus
atgtggtcatctcctatggcctggt

SEQ ID NO: 203014 - DNA, 25 bp, Rattus norvegicus
atgtggtcatctgctatggcctggt

SEQ ID NO: 203015 - DNA, 25 bp, Rattus norvegicus
atgtggtcattgctggtccccagga

SEQ ID NO: 203016 - DNA, 25 bp, Rattus norvegicus
atgtggtcattggtggtccccagga

SEQ ID NO: 203017 - DNA, 25 bp, Rattus norvegicus
atgtggtcctgcaggcagaggccac

SEQ ID NO: 203018 - DNA, 25 bp, Rattus norvegicus
atgtggtcctgctggcagaggccac

SEQ ID NO: 203019 - DNA, 25 bp, Rattus norvegicus
atgtggtcgcatacatagctgagtt

SEQ ID NO: 203020 - DNA, 25 bp, Rattus norvegicus
atgtggtcgcattcatagctgagtt

SEQ ID NO: 203021 - DNA, 25 bp, Rattus norvegicus
atgtggtctgtactgtctggtttcc

SEQ ID NO: 203022 - DNA, 25 bp, Rattus norvegicus
atgtggtctgtagtgtctggtttcc

SEQ ID NO: 203023 - DNA, 25 bp, Rattus norvegicus
atgtggtctgtgatccagcagcatt

SEQ ID NO: 203024 - DNA, 25 bp, Rattus norvegicus
atgtggtctgtgttccagcagcatt

SEQ ID NO: 203025 - DNA, 25 bp, Rattus norvegicus
atgtggtcttacattggtgtctgca

SEQ ID NO: 203026 - DNA, 25 bp, Rattus norvegicus
atgtggtcttactttggtgtctgca

SEQ ID NO: 203027 - DNA, 25 bp, Rattus norvegicus
atgtggtcttatactagaatctgtt

SEQ ID NO: 203028 - DNA, 25 bp, Rattus norvegicus
atgtggtcttattctagaatctgtt

SEQ ID NO: 203029 - DNA, 25 bp, Rattus norvegicus
atgtggtgaaccagcgggatgctct

SEQ ID NO: 203030 - DNA, 25 bp, Rattus norvegicus
atgtggtgaacctgcgggatgctct

SEQ ID NO: 203031 - DNA, 25 bp, Rattus norvegicus
atgtggtgagcactcggacttacga

SEQ ID NO: 203032 - DNA, 25 bp, Rattus norvegicus
atgtggtgagcagtcggacttacga

SEQ ID NO: 203033 - DNA, 25 bp, Rattus norvegicus
atgtggtgatttctagtgttccccg

SEQ ID NO: 203034 - DNA, 25 bp, Rattus norvegicus
atgtggtgatttgtagtgttccccg

SEQ ID NO: 203035 - DNA, 25 bp, Rattus norvegicus
atgtggtgcatcagccaagggcatc

SEQ ID NO: 203036 - DNA, 25 bp, Rattus norvegicus
atgtggtgcatctgccaagggcatc

SEQ ID NO: 203037 - DNA, 25 bp, Rattus norvegicus
atgtggtgccaaagccaagcagtcc

SEQ ID NO: 203038 - DNA, 25 bp, Rattus norvegicus
atgtggtgccaatgccaagcagtcc

SEQ ID NO: 203039 - DNA, 25 bp, Rattus norvegicus
atgtggtgccatccttgtcttcaaa

SEQ ID NO: 203040 - DNA, 25 bp, Rattus norvegicus
atgtggtgccatgcttgtcttcaaa

SEQ ID NO: 203041 - DNA, 25 bp, Rattus norvegicus
atgtggtgcctcaacctgtaaatgt

SEQ ID NO: 203042 - DNA, 25 bp, Rattus norvegicus
atgtggtgcctctacctgtaaatgt

SEQ ID NO: 203043 - DNA, 25 bp, Rattus norvegicus
atgtggtgctcgaggtgccctcaga

SEQ ID NO: 203044 - DNA, 25 bp, Rattus norvegicus
atgtggtgctcgtggtgccctcaga

SEQ ID NO: 203045 - DNA, 25 bp, Rattus norvegicus
atgtggtgggaactacactgtctac

SEQ ID NO: 203046 - DNA, 25 bp, Rattus norvegicus
atgtggtgggaagtacactgtctac

SEQ ID NO: 203047 - DNA, 25 bp, Rattus norvegicus
atgtggtgtactagaagcctgttca

SEQ ID NO: 203048 - DNA, 25 bp, Rattus norvegicus
atgtggtgtacttgaagcctgttca

SEQ ID NO: 203049 - DNA, 25 bp, Rattus norvegicus
atgtggtgtccccagtgtgactcag

SEQ ID NO: 203050 - DNA, 25 bp, Rattus norvegicus
atgtggtgtcccgagtgtgactcag

SEQ ID NO: 203051 - DNA, 25 bp, Rattus norvegicus
atgtggtgtgtaaccttcagaaaaa

SEQ ID NO: 203052 - DNA, 25 bp, Rattus norvegicus
atgtggtgtgtatccttcagaaaaa

SEQ ID NO: 203053 - DNA, 25 bp, Rattus norvegicus
atgtggtgttctagcttcaaaggat

SEQ ID NO: 203054 - DNA, 25 bp, Rattus norvegicus
atgtggtgttcttgcttcaaaggat

SEQ ID NO: 203055 - DNA, 25 bp, Rattus norvegicus
atgtggttatctacttactaaacgg

SEQ ID NO: 203056 - DNA, 25 bp, Rattus norvegicus
atgtggttatcttcttactaaacgg

SEQ ID NO: 203057 - DNA, 25 bp, Rattus norvegicus
atgtggttatggagggagtccacct

SEQ ID NO: 203058 - DNA, 25 bp, Rattus norvegicus
atgtggttatggtgggagtccacct

SEQ ID NO: 203059 - DNA, 25 bp, Rattus norvegicus
atgtggttcttaacagctgtgccgc

SEQ ID NO: 203060 - DNA, 25 bp, Rattus norvegicus
atgtggttcttatcagctgtgccgc

SEQ ID NO: 203061 - DNA, 25 bp, Rattus norvegicus
atgtggttgagcctctttgcaagcc

SEQ ID NO: 203062 - DNA, 25 bp, Rattus norvegicus
atgtggttgagcgtctttgcaagcc

SEQ ID NO: 203063 - DNA, 25 bp, Rattus norvegicus
atgtggttgccaatgaggctccata

SEQ ID NO: 203064 - DNA, 25 bp, Rattus norvegicus
atgtggttgccattgaggctccata

SEQ ID NO: 203065 - DNA, 25 bp, Rattus norvegicus
atgtggttgccccaaggctctggta

SEQ ID NO: 203066 - DNA, 25 bp, Rattus norvegicus
atgtggttgcccgaaggctctggta

SEQ ID NO: 203067 - DNA, 25 bp, Rattus norvegicus
atgtggttgcctcccttaggatgat

SEQ ID NO: 203068 - DNA, 25 bp, Rattus norvegicus
atgtggttgcctgccttaggatgat

SEQ ID NO: 203069 - DNA, 25 bp, Rattus norvegicus
atgtggttggctcccagctcagaac

SEQ ID NO: 203070 - DNA, 25 bp, Rattus norvegicus
atgtggttggctgccagctcagaac

SEQ ID NO: 203071 - DNA, 25 bp, Rattus norvegicus
atgtggtttaccacaattctctgat

SEQ ID NO: 203072 - DNA, 25 bp, Rattus norvegicus
atgtggtttacctcaattctctgat

SEQ ID NO: 203073 - DNA, 25 bp, Rattus norvegicus
atgtggtttattcattggccaagcc

SEQ ID NO: 203074 - DNA, 25 bp, Rattus norvegicus
atgtggtttattgattggccaagcc

SEQ ID NO: 203075 - DNA, 25 bp, Rattus norvegicus
atgtggtttcaacgcactgtccaaa

SEQ ID NO: 203076 - DNA, 25 bp, Rattus norvegicus
atgtggtttcaaggcactgtccaaa

SEQ ID NO: 203077 - DNA, 25 bp, Rattus norvegicus
atgtggtttcgaagtgtcaggagtc

SEQ ID NO: 203078 - DNA, 25 bp, Rattus norvegicus
atgtggtttcgatgtgtcaggagtc

SEQ ID NO: 203079 - DNA, 25 bp, Rattus norvegicus
atgtggtttgggaatctttggtatc

SEQ ID NO: 203080 - DNA, 25 bp, Rattus norvegicus
atgtggtttgggtatctttggtatc

SEQ ID NO: 203081 - DNA, 25 bp, Rattus norvegicus
atgtgtaacctaccacagactctct

SEQ ID NO: 203082 - DNA, 25 bp, Rattus norvegicus
atgtgtaacctagcacagactctct

SEQ ID NO: 203083 - DNA, 25 bp, Rattus norvegicus
atgtgtaagaatacctgtccctgca

SEQ ID NO: 203084 - DNA, 25 bp, Rattus norvegicus
atgtgtaagaattcctgtccctgca

SEQ ID NO: 203085 - DNA, 25 bp, Rattus norvegicus
atgtgtaagctcattgaatcaactt

SEQ ID NO: 203086 - DNA, 25 bp, Rattus norvegicus
atgtgtaagctctttgaatcaactt

SEQ ID NO: 203087 - DNA, 25 bp, Rattus norvegicus
atgtgtaagggaaccatgaaccaaa

SEQ ID NO: 203088 - DNA, 25 bp, Rattus norvegicus
atgtgtaagggatccatgaaccaaa

SEQ ID NO: 203089 - DNA, 25 bp, Rattus norvegicus
atgtgtaagtcactcctgtaacctt

SEQ ID NO: 203090 - DNA, 25 bp, Rattus norvegicus
atgtgtaagtcagtcctgtaacctt

SEQ ID NO: 203091 - DNA, 25 bp, Rattus norvegicus
atgtgtaatgtgagccaccacctta

SEQ ID NO: 203092 - DNA, 25 bp, Rattus norvegicus
atgtgtaatgtgtgccaccacctta

SEQ ID NO: 203093 - DNA, 25 bp, Rattus norvegicus
atgtgtaattgtaccagcattccaa

SEQ ID NO: 203094 - DNA, 25 bp, Rattus norvegicus
atgtgtaattgttccagcattccaa

SEQ ID NO: 203095 - DNA, 25 bp, Rattus norvegicus
atgtgtacagagcagccaacagcct

SEQ ID NO: 203096 - DNA, 25 bp, Rattus norvegicus
atgtgtacagaggagccaacagcct

SEQ ID NO: 203097 - DNA, 25 bp, Rattus norvegicus
atgtgtacagggaccttttgcaata

SEQ ID NO: 203098 - DNA, 25 bp, Rattus norvegicus
atgtgtacagggtccttttgcaata

SEQ ID NO: 203099 - DNA, 25 bp, Rattus norvegicus
atgtgtacccctccacacttcatat

SEQ ID NO: 203100 - DNA, 25 bp, Rattus norvegicus
atgtgtacccctgcacacttcatat

SEQ ID NO: 203101 - DNA, 25 bp, Rattus norvegicus
atgtgtacgtttactcgtgctcaca

SEQ ID NO: 203102 - DNA, 25 bp, Rattus norvegicus
atgtgtacgttttctcgtgctcaca

SEQ ID NO: 203103 - DNA, 25 bp, Rattus norvegicus
atgtgtactacaagcatgatgcctg

SEQ ID NO: 203104 - DNA, 25 bp, Rattus norvegicus
atgtgtactacatgcatgatgcctg

SEQ ID NO: 203105 - DNA, 25 bp, Rattus norvegicus
atgtgtacttaaacagccctcctag

SEQ ID NO: 203106 - DNA, 25 bp, Rattus norvegicus
atgtgtacttaatcagccctcctag

SEQ ID NO: 203107 - DNA, 25 bp, Rattus norvegicus
atgtgtacttcaagtcagaccctct

SEQ ID NO: 203108 - DNA, 25 bp, Rattus norvegicus
atgtgtacttcatgtcagaccctct

SEQ ID NO: 203109 - DNA, 25 bp, Rattus norvegicus
atgtgtagacttcatggctctcatc

SEQ ID NO: 203110 - DNA, 25 bp, Rattus norvegicus
atgtgtagacttgatggctctcatc

SEQ ID NO: 203111 - DNA, 25 bp, Rattus norvegicus
atgtgtagcgatctgatcacactgt

SEQ ID NO: 203112 - DNA, 25 bp, Rattus norvegicus
atgtgtagcgatgtgatcacactgt

SEQ ID NO: 203113 - DNA, 25 bp, Rattus norvegicus
atgtgtaggttcatattccccacca

SEQ ID NO: 203114 - DNA, 25 bp, Rattus norvegicus
atgtgtaggttcttattccccacca

SEQ ID NO: 203115 - DNA, 25 bp, Rattus norvegicus
atgtgtagtaaacctttccctctct

SEQ ID NO: 203116 - DNA, 25 bp, Rattus norvegicus
atgtgtagtaaagctttccctctct

SEQ ID NO: 203117 - DNA, 25 bp, Rattus norvegicus
atgtgtagtctgatcgtcagtctgt

SEQ ID NO: 203118 - DNA, 25 bp, Rattus norvegicus
atgtgtagtctgttcgtcagtctgt

SEQ ID NO: 203119 - DNA, 25 bp, Rattus norvegicus
atgtgtatacagcaggtcagaggaa

SEQ ID NO: 203120 - DNA, 25 bp, Rattus norvegicus
atgtgtatacaggaggtcagaggaa

SEQ ID NO: 203121 - DNA, 25 bp, Rattus norvegicus
atgtgtatagacagcttccttacgt

SEQ ID NO: 203122 - DNA, 25 bp, Rattus norvegicus
atgtgtatagactgcttccttacgt

SEQ ID NO: 203123 - DNA, 25 bp, Rattus norvegicus
atgtgtatatatcctatagcttgtg

SEQ ID NO: 203124 - DNA, 25 bp, Rattus norvegicus
atgtgtatatatgctatagcttgtg

SEQ ID NO: 203125 - DNA, 25 bp, Rattus norvegicus
atgtgtatctgtacacacagcgcct

SEQ ID NO: 203126 - DNA, 25 bp, Rattus norvegicus
atgtgtatctgtagtcccatgaata

SEQ ID NO: 203127 - DNA, 25 bp, Rattus norvegicus
atgtgtatctgtctgtcctttacgc

SEQ ID NO: 203128 - DNA, 25 bp, Rattus norvegicus
atgtgtatctgtgtgtcctttacgc

SEQ ID NO: 203129 - DNA, 25 bp, Rattus norvegicus
atgtgtatctgttcacacagcgcct

SEQ ID NO: 203130 - DNA, 25 bp, Rattus norvegicus
atgtgtatctgttgtcccatgaata

SEQ ID NO: 203131 - DNA, 25 bp, Rattus norvegicus
atgtgtatgtcaacatggacttgac

SEQ ID NO: 203132 - DNA, 25 bp, Rattus norvegicus
atgtgtatgtcatcatggacttgac

SEQ ID NO: 203133 - DNA, 25 bp, Rattus norvegicus
atgtgtatgtttatcttcctaaggt

SEQ ID NO: 203134 - DNA, 25 bp, Rattus norvegicus
atgtgtatgtttccatcctgaaaga

SEQ ID NO: 203135 - DNA, 25 bp, Rattus norvegicus
atgtgtatgtttgcatcctgaaaga

SEQ ID NO: 203136 - DNA, 25 bp, Rattus norvegicus
atgtgtatgtttttcttcctaaggt

SEQ ID NO: 203137 - DNA, 25 bp, Rattus norvegicus
atgtgtattagcacaacccacctag

SEQ ID NO: 203138 - DNA, 25 bp, Rattus norvegicus
atgtgtattagctcaacccacctag

SEQ ID NO: 203139 - DNA, 25 bp, Rattus norvegicus
atgtgtattcttacatcctcaccat

SEQ ID NO: 203140 - DNA, 25 bp, Rattus norvegicus
atgtgtattctttcatcctcaccat

SEQ ID NO: 203141 - DNA, 25 bp, Rattus norvegicus
atgtgtatttccatgcggtaatcaa

SEQ ID NO: 203142 - DNA, 25 bp, Rattus norvegicus
atgtgtatttccttgcggtaatcaa

SEQ ID NO: 203143 - DNA, 25 bp, Rattus norvegicus
atgtgtcaacctcgctgccaaggag

SEQ ID NO: 203144 - DNA, 25 bp, Rattus norvegicus
atgtgtcaacctggctgccaaggag

SEQ ID NO: 203145 - DNA, 25 bp, Rattus norvegicus
atgtgtcaccttcaacaagtcacgt

SEQ ID NO: 203146 - DNA, 25 bp, Rattus norvegicus
atgtgtcaccttgaacaagtcacgt

SEQ ID NO: 203147 - DNA, 25 bp, Rattus norvegicus
atgtgtcacgaccagggcggttctc

SEQ ID NO: 203148 - DNA, 25 bp, Rattus norvegicus
atgtgtcacgacgagggcggttctc

SEQ ID NO: 203149 - DNA, 25 bp, Rattus norvegicus
atgtgtcactgccaaactgtctgag

SEQ ID NO: 203150 - DNA, 25 bp, Rattus norvegicus
atgtgtcactgcgaaactgtctgag

SEQ ID NO: 203151 - DNA, 25 bp, Rattus norvegicus
atgtgtcagcttaaaggcatagttc

SEQ ID NO: 203152 - DNA, 25 bp, Rattus norvegicus
atgtgtcagctttaaggcatagttc

SEQ ID NO: 203153 - DNA, 25 bp, Rattus norvegicus
atgtgtcagtcaagcgcacgtgcac

SEQ ID NO: 203154 - DNA, 25 bp, Rattus norvegicus
atgtgtcagtcatgcgcacgtgcac

SEQ ID NO: 203155 - DNA, 25 bp, Rattus norvegicus
atgtgtcagtccagggttcccagaa

SEQ ID NO: 203156 - DNA, 25 bp, Rattus norvegicus
atgtgtcagtcctgggttcccagaa

SEQ ID NO: 203157 - DNA, 25 bp, Rattus norvegicus
atgtgtcatctaccaagtgtccaat

SEQ ID NO: 203158 - DNA, 25 bp, Rattus norvegicus
atgtgtcatctagcaagtgtccaat

SEQ ID NO: 203159 - DNA, 25 bp, Rattus norvegicus
atgtgtccacgtctaagttcttaga

SEQ ID NO: 203160 - DNA, 25 bp, Rattus norvegicus
atgtgtccacgtgtaagttcttaga

SEQ ID NO: 203161 - DNA, 25 bp, Rattus norvegicus
atgtgtccactaagttgaggcaatt

SEQ ID NO: 203162 - DNA, 25 bp, Rattus norvegicus
atgtgtccactatgttgaggcaatt

SEQ ID NO: 203163 - DNA, 25 bp, Rattus norvegicus
atgtgtccactgaggcgttggtgac

SEQ ID NO: 203164 - DNA, 25 bp, Rattus norvegicus
atgtgtccactgctactatactgtt

SEQ ID NO: 203165 - DNA, 25 bp, Rattus norvegicus
atgtgtccactggtactatactgtt

SEQ ID NO: 203166 - DNA, 25 bp, Rattus norvegicus
atgtgtccactgtggcgttggtgac

SEQ ID NO: 203167 - DNA, 25 bp, Rattus norvegicus
atgtgtccagttctttgcactcatc

SEQ ID NO: 203168 - DNA, 25 bp, Rattus norvegicus
atgtgtccagttgtttgcactcatc

SEQ ID NO: 203169 - DNA, 25 bp, Rattus norvegicus
atgtgtccatagataagtccttagt

SEQ ID NO: 203170 - DNA, 25 bp, Rattus norvegicus
atgtgtccatagttaagtccttagt

SEQ ID NO: 203171 - DNA, 25 bp, Rattus norvegicus
atgtgtcccactataaaactaactg

SEQ ID NO: 203172 - DNA, 25 bp, Rattus norvegicus
atgtgtcccactttaaaactaactg

SEQ ID NO: 203173 - DNA, 25 bp, Rattus norvegicus
atgtgtccccagatatttgtacaac

SEQ ID NO: 203174 - DNA, 25 bp, Rattus norvegicus
atgtgtccccagttatttgtacaac

SEQ ID NO: 203175 - DNA, 25 bp, Rattus norvegicus
atgtgtcccgagcagtgtgcttccg

SEQ ID NO: 203176 - DNA, 25 bp, Rattus norvegicus
atgtgtcccgaggagtgtgcttccg

SEQ ID NO: 203177 - DNA, 25 bp, Rattus norvegicus
atgtgtccgatacagtgctgctgca

SEQ ID NO: 203178 - DNA, 25 bp, Rattus norvegicus
atgtgtccgatagagtgctgctgca

SEQ ID NO: 203179 - DNA, 25 bp, Rattus norvegicus
atgtgtccgggtataacatctcctg

SEQ ID NO: 203180 - DNA, 25 bp, Rattus norvegicus
atgtgtccgggtttaacatctcctg

SEQ ID NO: 203181 - DNA, 25 bp, Rattus norvegicus
atgtgtccgtccctctgttcattaa

SEQ ID NO: 203182 - DNA, 25 bp, Rattus norvegicus
atgtgtccgtccgtctgttcattaa

SEQ ID NO: 203183 - DNA, 25 bp, Rattus norvegicus
atgtgtcctagcaaccattcccgat

SEQ ID NO: 203184 - DNA, 25 bp, Rattus norvegicus
atgtgtcctagctaccattcccgat

SEQ ID NO: 203185 - DNA, 25 bp, Rattus norvegicus
atgtgtcctatgattgttccaaccc

SEQ ID NO: 203186 - DNA, 25 bp, Rattus norvegicus
atgtgtcctatgtttgttccaaccc

SEQ ID NO: 203187 - DNA, 25 bp, Rattus norvegicus
atgtgtcctcagacccagggatttg

SEQ ID NO: 203188 - DNA, 25 bp, Rattus norvegicus
atgtgtcctcagtcccagggatttg

SEQ ID NO: 203189 - DNA, 25 bp, Rattus norvegicus
atgtgtcctgatctcatctcagtgt

SEQ ID NO: 203190 - DNA, 25 bp, Rattus norvegicus
atgtgtcctgatgtcatctcagtgt

SEQ ID NO: 203191 - DNA, 25 bp, Rattus norvegicus
atgtgtcctgctcagaagtgtccca

SEQ ID NO: 203192 - DNA, 25 bp, Rattus norvegicus
atgtgtcctgctgagaagtgtccca

SEQ ID NO: 203193 - DNA, 25 bp, Rattus norvegicus
atgtgtcctggaacgtagctcgaac

SEQ ID NO: 203194 - DNA, 25 bp, Rattus norvegicus
atgtgtcctggatcgtagctcgaac

SEQ ID NO: 203195 - DNA, 25 bp, Rattus norvegicus
atgtgtcctgtcaaaaggcaagcca

SEQ ID NO: 203196 - DNA, 25 bp, Rattus norvegicus
atgtgtcctgtcagtgcttagtcaa

SEQ ID NO: 203197 - DNA, 25 bp, Rattus norvegicus
atgtgtcctgtctaaaggcaagcca

SEQ ID NO: 203198 - DNA, 25 bp, Rattus norvegicus
atgtgtcctgtctgtgcttagtcaa

SEQ ID NO: 203199 - DNA, 25 bp, Rattus norvegicus
atgtgtcgacagaattgcgtcaccc

SEQ ID NO: 203200 - DNA, 25 bp, Rattus norvegicus
atgtgtcgacagtattgcgtcaccc

SEQ ID NO: 203201 - DNA, 25 bp, Rattus norvegicus
atgtgtcggcaaccaggcaggccaa

SEQ ID NO: 203202 - DNA, 25 bp, Rattus norvegicus
atgtgtcggcaagcaggcaggccaa

SEQ ID NO: 203203 - DNA, 25 bp, Rattus norvegicus
atgtgtctagttcaagctgcctgtc

SEQ ID NO: 203204 - DNA, 25 bp, Rattus norvegicus
atgtgtctagttgaagctgcctgtc

SEQ ID NO: 203205 - DNA, 25 bp, Rattus norvegicus
atgtgtctattgctgcagggccctc

SEQ ID NO: 203206 - DNA, 25 bp, Rattus norvegicus
atgtgtctattggtgcagggccctc

SEQ ID NO: 203207 - DNA, 25 bp, Rattus norvegicus
atgtgtctatttattcattttgaag

SEQ ID NO: 203208 - DNA, 25 bp, Rattus norvegicus
atgtgtctattttttcattttgaag

SEQ ID NO: 203209 - DNA, 25 bp, Rattus norvegicus
atgtgtctcaaacagaaccaccacc

SEQ ID NO: 203210 - DNA, 25 bp, Rattus norvegicus
atgtgtctcaaagagaaccaccacc

SEQ ID NO: 203211 - DNA, 25 bp, Rattus norvegicus
atgtgtctcatcacctagcctagtg

SEQ ID NO: 203212 - DNA, 25 bp, Rattus norvegicus
atgtgtctcatctcctagcctagtg

SEQ ID NO: 203213 - DNA, 25 bp, Rattus norvegicus
atgtgtctccgccagaacagtgcag

SEQ ID NO: 203214 - DNA, 25 bp, Rattus norvegicus
atgtgtctccgcgagaacagtgcag

SEQ ID NO: 203215 - DNA, 25 bp, Rattus norvegicus
atgtgtctcctaaacgttgtccaga

SEQ ID NO: 203216 - DNA, 25 bp, Rattus norvegicus
atgtgtctcctatacgttgtccaga

SEQ ID NO: 203217 - DNA, 25 bp, Rattus norvegicus
atgtgtctctctcgatggtggttta

SEQ ID NO: 203218 - DNA, 25 bp, Rattus norvegicus
atgtgtctctctggatggtggttta

SEQ ID NO: 203219 - DNA, 25 bp, Rattus norvegicus
atgtgtctctgtcgctcaagtcata

SEQ ID NO: 203220 - DNA, 25 bp, Rattus norvegicus
atgtgtctctgtggctcaagtcata

SEQ ID NO: 203221 - DNA, 25 bp, Rattus norvegicus
atgtgtctcttgagactctgtacaa

SEQ ID NO: 203222 - DNA, 25 bp, Rattus norvegicus
atgtgtctcttgtgactctgtacaa

SEQ ID NO: 203223 - DNA, 25 bp, Rattus norvegicus
atgtgtctgagtcatttccctgaat

SEQ ID NO: 203224 - DNA, 25 bp, Rattus norvegicus
atgtgtctgagtcggcacagcacca

SEQ ID NO: 203225 - DNA, 25 bp, Rattus norvegicus
atgtgtctgagtgatttccctgaat

SEQ ID NO: 203226 - DNA, 25 bp, Rattus norvegicus
atgtgtctgagtgggcacagcacca

SEQ ID NO: 203227 - DNA, 25 bp, Rattus norvegicus
atgtgtctgatcagctacctgtgtg

SEQ ID NO: 203228 - DNA, 25 bp, Rattus norvegicus
atgtgtctgatctgctacctgtgtg

SEQ ID NO: 203229 - DNA, 25 bp, Rattus norvegicus
atgtgtctgcacaggttagttctat

SEQ ID NO: 203230 - DNA, 25 bp, Rattus norvegicus
atgtgtctgcactggttagttctat

SEQ ID NO: 203231 - DNA, 25 bp, Rattus norvegicus
atgtgtctgcagagctggctactgg

SEQ ID NO: 203232 - DNA, 25 bp, Rattus norvegicus
atgtgtctgcagtgctggctactgg

SEQ ID NO: 203233 - DNA, 25 bp, Rattus norvegicus
atgtgtctgcctcgcgctcttggag

SEQ ID NO: 203234 - DNA, 25 bp, Rattus norvegicus
atgtgtctgcctggcgctcttggag

SEQ ID NO: 203235 - DNA, 25 bp, Rattus norvegicus
atgtgtctggacattcagatcccta

SEQ ID NO: 203236 - DNA, 25 bp, Rattus norvegicus
atgtgtctggactttcagatcccta

SEQ ID NO: 203237 - DNA, 25 bp, Rattus norvegicus
atgtgtctgtacatgaagcccctgt

SEQ ID NO: 203238 - DNA, 25 bp, Rattus norvegicus
atgtgtctgtacttgaagcccctgt

SEQ ID NO: 203239 - DNA, 25 bp, Rattus norvegicus
atgtgtctgtccacatgtgggctgg

SEQ ID NO: 203240 - DNA, 25 bp, Rattus norvegicus
atgtgtctgtcctcatgtgggctgg

SEQ ID NO: 203241 - DNA, 25 bp, Rattus norvegicus
atgtgtctgtttagaagtcctcctt

SEQ ID NO: 203242 - DNA, 25 bp, Rattus norvegicus
atgtgtctgttttgaagtcctcctt

SEQ ID NO: 203243 - DNA, 25 bp, Rattus norvegicus
atgtgtcttagcaatagtagtcgat

SEQ ID NO: 203244 - DNA, 25 bp, Rattus norvegicus
atgtgtcttagctatagtagtcgat

SEQ ID NO: 203245 - DNA, 25 bp, Rattus norvegicus
atgtgtcttagtatgcttccctgaa

SEQ ID NO: 203246 - DNA, 25 bp, Rattus norvegicus
atgtgtcttagtttgcttccctgaa

SEQ ID NO: 203247 - DNA, 25 bp, Rattus norvegicus
atgtgtcttgtccttgcacttgtta

SEQ ID NO: 203248 - DNA, 25 bp, Rattus norvegicus
atgtgtcttgtcgttgcacttgtta

SEQ ID NO: 203249 - DNA, 25 bp, Rattus norvegicus
atgtgtctttacagtacttttgcca

SEQ ID NO: 203250 - DNA, 25 bp, Rattus norvegicus
atgtgtctttactgtacttttgcca

SEQ ID NO: 203251 - DNA, 25 bp, Rattus norvegicus
atgtgtctttcgactgacgtaactt

SEQ ID NO: 203252 - DNA, 25 bp, Rattus norvegicus
atgtgtctttcgtctgacgtaactt

SEQ ID NO: 203253 - DNA, 25 bp, Rattus norvegicus
atgtgtctttgcacaggcaaccact

SEQ ID NO: 203254 - DNA, 25 bp, Rattus norvegicus
atgtgtctttgccttgtaattctct

SEQ ID NO: 203255 - DNA, 25 bp, Rattus norvegicus
atgtgtctttgcgttgtaattctct

SEQ ID NO: 203256 - DNA, 25 bp, Rattus norvegicus
atgtgtctttgctcaggcaaccact

SEQ ID NO: 203257 - DNA, 25 bp, Rattus norvegicus
atgtgtgaacaaccacttctgatca

SEQ ID NO: 203258 - DNA, 25 bp, Rattus norvegicus
atgtgtgaacaagcacttctgatca

SEQ ID NO: 203259 - DNA, 25 bp, Rattus norvegicus
atgtgtgaacctcattccctgtggt

SEQ ID NO: 203260 - DNA, 25 bp, Rattus norvegicus
atgtgtgaacctgattccctgtggt

SEQ ID NO: 203261 - DNA, 25 bp, Rattus norvegicus
atgtgtgaacttcgagtctcgggcc

SEQ ID NO: 203262 - DNA, 25 bp, Rattus norvegicus
atgtgtgaacttggagtctcgggcc

SEQ ID NO: 203263 - DNA, 25 bp, Rattus norvegicus
atgtgtgaagacacagacaccacga

SEQ ID NO: 203264 - DNA, 25 bp, Rattus norvegicus
atgtgtgaagactcagacaccacga

SEQ ID NO: 203265 - DNA, 25 bp, Rattus norvegicus
atgtgtgaagtaaccggcttctacc

SEQ ID NO: 203266 - DNA, 25 bp, Rattus norvegicus
atgtgtgaagtaccttcctccctca

SEQ ID NO: 203267 - DNA, 25 bp, Rattus norvegicus
atgtgtgaagtagcttcctccctca

SEQ ID NO: 203268 - DNA, 25 bp, Rattus norvegicus
atgtgtgaagtatccggcttctacc

SEQ ID NO: 203269 - DNA, 25 bp, Rattus norvegicus
atgtgtgaatttagccgtcacccta

SEQ ID NO: 203270 - DNA, 25 bp, Rattus norvegicus
atgtgtgaattttgccgtcacccta

SEQ ID NO: 203271 - DNA, 25 bp, Rattus norvegicus
atgtgtgacaccatttctaggaagc

SEQ ID NO: 203272 - DNA, 25 bp, Rattus norvegicus
atgtgtgacaccttttctaggaagc

SEQ ID NO: 203273 - DNA, 25 bp, Rattus norvegicus
atgtgtgactccctcaacattccaa

SEQ ID NO: 203274 - DNA, 25 bp, Rattus norvegicus
atgtgtgactccgtcaacattccaa

SEQ ID NO: 203275 - DNA, 25 bp, Rattus norvegicus
atgtgtgactctaaacatcccaaga

SEQ ID NO: 203276 - DNA, 25 bp, Rattus norvegicus
atgtgtgactcttaacatcccaaga

SEQ ID NO: 203277 - DNA, 25 bp, Rattus norvegicus
atgtgtgactggagccactggctga

SEQ ID NO: 203278 - DNA, 25 bp, Rattus norvegicus
atgtgtgactggtgccactggctga

SEQ ID NO: 203279 - DNA, 25 bp, Rattus norvegicus
atgtgtgagatgctgccttaccgac

SEQ ID NO: 203280 - DNA, 25 bp, Rattus norvegicus
atgtgtgagatggtgccttaccgac

SEQ ID NO: 203281 - DNA, 25 bp, Rattus norvegicus
atgtgtgagctcacaactgctactc

SEQ ID NO: 203282 - DNA, 25 bp, Rattus norvegicus
atgtgtgagctctcaactgctactc

SEQ ID NO: 203283 - DNA, 25 bp, Rattus norvegicus
atgtgtgaggccatgtgtccaatcc

SEQ ID NO: 203284 - DNA, 25 bp, Rattus norvegicus
atgtgtgaggcccaggttcgatccc

SEQ ID NO: 203285 - DNA, 25 bp, Rattus norvegicus
atgtgtgaggccgaggttcgatccc

SEQ ID NO: 203286 - DNA, 25 bp, Rattus norvegicus
atgtgtgaggccttgtgtccaatcc

SEQ ID NO: 203287 - DNA, 25 bp, Rattus norvegicus
atgtgtgagtctctctgggagccca

SEQ ID NO: 203288 - DNA, 25 bp, Rattus norvegicus
atgtgtgagtctgtctgggagccca

SEQ ID NO: 203289 - DNA, 25 bp, Rattus norvegicus
atgtgtgatccaacagagatgtcct

SEQ ID NO: 203290 - DNA, 25 bp, Rattus norvegicus
atgtgtgatccatcagagatgtcct

SEQ ID NO: 203291 - DNA, 25 bp, Rattus norvegicus
atgtgtgattcaccttccctttgac

SEQ ID NO: 203292 - DNA, 25 bp, Rattus norvegicus
atgtgtgattcagcttccctttgac

SEQ ID NO: 203293 - DNA, 25 bp, Rattus norvegicus
atgtgtgcaaagaggcttctggcca

SEQ ID NO: 203294 - DNA, 25 bp, Rattus norvegicus
atgtgtgcaaagtggcttctggcca

SEQ ID NO: 203295 - DNA, 25 bp, Rattus norvegicus
atgtgtgcaagtcacccttgaggtc

SEQ ID NO: 203296 - DNA, 25 bp, Rattus norvegicus
atgtgtgcaagtgacccttgaggtc

SEQ ID NO: 203297 - DNA, 25 bp, Rattus norvegicus
atgtgtgcacacagggtgacccttg

SEQ ID NO: 203298 - DNA, 25 bp, Rattus norvegicus
atgtgtgcacacatgcctttgggtg

SEQ ID NO: 203299 - DNA, 25 bp, Rattus norvegicus
atgtgtgcacactgggtgacccttg

SEQ ID NO: 203300 - DNA, 25 bp, Rattus norvegicus
atgtgtgcacacttgcctttgggtg

SEQ ID NO: 203301 - DNA, 25 bp, Rattus norvegicus
atgtgtgcacatctttccgggaaaa

SEQ ID NO: 203302 - DNA, 25 bp, Rattus norvegicus
atgtgtgcacatgtttccgggaaaa

SEQ ID NO: 203303 - DNA, 25 bp, Rattus norvegicus
atgtgtgccatccatgtcactttta

SEQ ID NO: 203304 - DNA, 25 bp, Rattus norvegicus
atgtgtgccatcgatgtcactttta

SEQ ID NO: 203305 - DNA, 25 bp, Rattus norvegicus
atgtgtgccctgacatgttcatgta

SEQ ID NO: 203306 - DNA, 25 bp, Rattus norvegicus
atgtgtgccctgcaggtaacagagt

SEQ ID NO: 203307 - DNA, 25 bp, Rattus norvegicus
atgtgtgccctggaggtaacagagt

SEQ ID NO: 203308 - DNA, 25 bp, Rattus norvegicus
atgtgtgccctgtcatgttcatgta

SEQ ID NO: 203309 - DNA, 25 bp, Rattus norvegicus
atgtgtgccgctaagggcccaggta

SEQ ID NO: 203310 - DNA, 25 bp, Rattus norvegicus
atgtgtgccgcttagggcccaggta

SEQ ID NO: 203311 - DNA, 25 bp, Rattus norvegicus
atgtgtgccttaacttatccctggg

SEQ ID NO: 203312 - DNA, 25 bp, Rattus norvegicus
atgtgtgccttatcttatccctggg

SEQ ID NO: 203313 - DNA, 25 bp, Rattus norvegicus
atgtgtgcctttaatgttatttctg

SEQ ID NO: 203314 - DNA, 25 bp, Rattus norvegicus
atgtgtgccttttatgttatttctg

SEQ ID NO: 203315 - DNA, 25 bp, Rattus norvegicus
atgtgtgcgcatacgattcagttct

SEQ ID NO: 203316 - DNA, 25 bp, Rattus norvegicus
atgtgtgcgcattcgattcagttct

SEQ ID NO: 203317 - DNA, 25 bp, Rattus norvegicus
atgtgtgctattaccctcaaagaag

SEQ ID NO: 203318 - DNA, 25 bp, Rattus norvegicus
atgtgtgctatttccctcaaagaag

SEQ ID NO: 203319 - DNA, 25 bp, Rattus norvegicus
atgtgtgctcacacctgtgcactcg

SEQ ID NO: 203320 - DNA, 25 bp, Rattus norvegicus
atgtgtgctcactcctgtgcactcg

SEQ ID NO: 203321 - DNA, 25 bp, Rattus norvegicus
atgtgtgctcccctctcaaggaaaa

SEQ ID NO: 203322 - DNA, 25 bp, Rattus norvegicus
atgtgtgctcccgtctcaaggaaaa

SEQ ID NO: 203323 - DNA, 25 bp, Rattus norvegicus
atgtgtgctcgtaaggctgcatgaa

SEQ ID NO: 203324 - DNA, 25 bp, Rattus norvegicus
atgtgtgctcgtcgttctttgtaaa

SEQ ID NO: 203325 - DNA, 25 bp, Rattus norvegicus
atgtgtgctcgtggttctttgtaaa

SEQ ID NO: 203326 - DNA, 25 bp, Rattus norvegicus
atgtgtgctcgttaggctgcatgaa

SEQ ID NO: 203327 - DNA, 25 bp, Rattus norvegicus
atgtgtgctctaccttaccttaaga

SEQ ID NO: 203328 - DNA, 25 bp, Rattus norvegicus
atgtgtgctctagcttaccttaaga

SEQ ID NO: 203329 - DNA, 25 bp, Rattus norvegicus
atgtgtgctggacctgtccggctat

SEQ ID NO: 203330 - DNA, 25 bp, Rattus norvegicus
atgtgtgctggagctgtccggctat

SEQ ID NO: 203331 - DNA, 25 bp, Rattus norvegicus
atgtgtgcttcacggttctcaggaa

SEQ ID NO: 203332 - DNA, 25 bp, Rattus norvegicus
atgtgtgcttcagggttctcaggaa

SEQ ID NO: 203333 - DNA, 25 bp, Rattus norvegicus
atgtgtgcttctcattttaatatgg

SEQ ID NO: 203334 - DNA, 25 bp, Rattus norvegicus
atgtgtgcttctctgacttgtatca

SEQ ID NO: 203335 - DNA, 25 bp, Rattus norvegicus
atgtgtgcttctgattttaatatgg

SEQ ID NO: 203336 - DNA, 25 bp, Rattus norvegicus
atgtgtgcttctgtgacttgtatca

SEQ ID NO: 203337 - DNA, 25 bp, Rattus norvegicus
atgtgtgcttggctcgtccttgcgt

SEQ ID NO: 203338 - DNA, 25 bp, Rattus norvegicus
atgtgtgcttgggtcgtccttgcgt

SEQ ID NO: 203339 - DNA, 25 bp, Rattus norvegicus
atgtgtgctttcatcttggatgctt

SEQ ID NO: 203340 - DNA, 25 bp, Rattus norvegicus
atgtgtgctttcttcttggatgctt

SEQ ID NO: 203341 - DNA, 25 bp, Rattus norvegicus
atgtgtggaactcctctgctgtccc

SEQ ID NO: 203342 - DNA, 25 bp, Rattus norvegicus
atgtgtggaactgctctgctgtccc

SEQ ID NO: 203343 - DNA, 25 bp, Rattus norvegicus
atgtgtggaagcagctcacgggcac

SEQ ID NO: 203344 - DNA, 25 bp, Rattus norvegicus
atgtgtggaagctgctcacgggcac

SEQ ID NO: 203345 - DNA, 25 bp, Rattus norvegicus
atgtgtggaatcagtaaccagtctc

SEQ ID NO: 203346 - DNA, 25 bp, Rattus norvegicus
atgtgtggaatctgtaaccagtctc

SEQ ID NO: 203347 - DNA, 25 bp, Rattus norvegicus
atgtgtggacaacagccttcctgtt

SEQ ID NO: 203348 - DNA, 25 bp, Rattus norvegicus
atgtgtggacaagagccttcctgtt

SEQ ID NO: 203349 - DNA, 25 bp, Rattus norvegicus
atgtgtggacagagctgctccagtc

SEQ ID NO: 203350 - DNA, 25 bp, Rattus norvegicus
atgtgtggacagtgctgctccagtc

SEQ ID NO: 203351 - DNA, 25 bp, Rattus norvegicus
atgtgtggactgagcagtcggaatc

SEQ ID NO: 203352 - DNA, 25 bp, Rattus norvegicus
atgtgtggactgtgcagtcggaatc

SEQ ID NO: 203353 - DNA, 25 bp, Rattus norvegicus
atgtgtggcaggagcactcacccga

SEQ ID NO: 203354 - DNA, 25 bp, Rattus norvegicus
atgtgtggcaggtgcactcacccga

SEQ ID NO: 203355 - DNA, 25 bp, Rattus norvegicus
atgtgtggccctacattatggatac

SEQ ID NO: 203356 - DNA, 25 bp, Rattus norvegicus
atgtgtggcccttcattatggatac

SEQ ID NO: 203357 - DNA, 25 bp, Rattus norvegicus
atgtgtggctcaatctgtagtcgca

SEQ ID NO: 203358 - DNA, 25 bp, Rattus norvegicus
atgtgtggctcattctgtagtcgca

SEQ ID NO: 203359 - DNA, 25 bp, Rattus norvegicus
atgtgtgggactcggttgacctcca

SEQ ID NO: 203360 - DNA, 25 bp, Rattus norvegicus
atgtgtgggactgggttgacctcca

SEQ ID NO: 203361 - DNA, 25 bp, Rattus norvegicus
atgtgtgggagcacacaactgcctt

SEQ ID NO: 203362 - DNA, 25 bp, Rattus norvegicus
atgtgtgggagctcacaactgcctt

SEQ ID NO: 203363 - DNA, 25 bp, Rattus norvegicus
atgtgtgggaggatgcctttctaca

SEQ ID NO: 203364 - DNA, 25 bp, Rattus norvegicus
atgtgtgggaggttgcctttctaca

SEQ ID NO: 203365 - DNA, 25 bp, Rattus norvegicus
atgtgtgggcttcagacgccagcac

SEQ ID NO: 203366 - DNA, 25 bp, Rattus norvegicus
atgtgtgggcttgagacgccagcac

SEQ ID NO: 203367 - DNA, 25 bp, Rattus norvegicus
atgtgtgggtataatgggtctcttt

SEQ ID NO: 203368 - DNA, 25 bp, Rattus norvegicus
atgtgtgggtattatgggtctcttt

SEQ ID NO: 203369 - DNA, 25 bp, Rattus norvegicus
atgtgtgggtctcagaagctccgca

SEQ ID NO: 203370 - DNA, 25 bp, Rattus norvegicus
atgtgtgggtctgagaagctccgca

SEQ ID NO: 203371 - DNA, 25 bp, Rattus norvegicus
atgtgtgtaaccatctgctagccag

SEQ ID NO: 203372 - DNA, 25 bp, Rattus norvegicus
atgtgtgtaaccttctgctagccag

SEQ ID NO: 203373 - DNA, 25 bp, Rattus norvegicus
atgtgtgtaatccttgttgctttcc

SEQ ID NO: 203374 - DNA, 25 bp, Rattus norvegicus
atgtgtgtaatcgttgttgctttcc

SEQ ID NO: 203375 - DNA, 25 bp, Rattus norvegicus
atgtgtgtactcaaagcttctctgt

SEQ ID NO: 203376 - DNA, 25 bp, Rattus norvegicus
atgtgtgtactctaagcttctctgt

SEQ ID NO: 203377 - DNA, 25 bp, Rattus norvegicus
atgtgtgtactgaccgtctgctggt

SEQ ID NO: 203378 - DNA, 25 bp, Rattus norvegicus
atgtgtgtactgtccgtctgctggt

SEQ ID NO: 203379 - DNA, 25 bp, Rattus norvegicus
atgtgtgtagacatctctgcctcct

SEQ ID NO: 203380 - DNA, 25 bp, Rattus norvegicus
atgtgtgtagacttctctgcctcct

SEQ ID NO: 203381 - DNA, 25 bp, Rattus norvegicus
atgtgtgtaggtaccacagcttgta

SEQ ID NO: 203382 - DNA, 25 bp, Rattus norvegicus
atgtgtgtaggttccacagcttgta

SEQ ID NO: 203383 - DNA, 25 bp, Rattus norvegicus
atgtgtgtatatccacctgcctgta

SEQ ID NO: 203384 - DNA, 25 bp, Rattus norvegicus
atgtgtgtatatgcacctgcctgta

SEQ ID NO: 203385 - DNA, 25 bp, Rattus norvegicus
atgtgtgtatgcacagaccacgctg

SEQ ID NO: 203386 - DNA, 25 bp, Rattus norvegicus
atgtgtgtatgctcagaccacgctg

SEQ ID NO: 203387 - DNA, 25 bp, Rattus norvegicus
atgtgtgtatgtatcacctatccac

SEQ ID NO: 203388 - DNA, 25 bp, Rattus norvegicus
atgtgtgtatgtttcacctatccac

SEQ ID NO: 203389 - DNA, 25 bp, Rattus norvegicus
atgtgtgtatttaaagctccgtgct

SEQ ID NO: 203390 - DNA, 25 bp, Rattus norvegicus
atgtgtgtattttaagctccgtgct

SEQ ID NO: 203391 - DNA, 25 bp, Rattus norvegicus
atgtgtgtccctagtattttcttat

SEQ ID NO: 203392 - DNA, 25 bp, Rattus norvegicus
atgtgtgtcccttgtattttcttat

SEQ ID NO: 203393 - DNA, 25 bp, Rattus norvegicus
atgtgtgtccgactgtgcagatctg

SEQ ID NO: 203394 - DNA, 25 bp, Rattus norvegicus
atgtgtgtccgagtgtgcagatctg

SEQ ID NO: 203395 - DNA, 25 bp, Rattus norvegicus
atgtgtgtctcacctaatctgtgga

SEQ ID NO: 203396 - DNA, 25 bp, Rattus norvegicus
atgtgtgtctcagctaatctgtgga

SEQ ID NO: 203397 - DNA, 25 bp, Rattus norvegicus
atgtgtgtctccagccttgtcagag

SEQ ID NO: 203398 - DNA, 25 bp, Rattus norvegicus
atgtgtgtctccatccgagggtacc

SEQ ID NO: 203399 - DNA, 25 bp, Rattus norvegicus
atgtgtgtctcctgccttgtcagag

SEQ ID NO: 203400 - DNA, 25 bp, Rattus norvegicus
atgtgtgtctccttccgagggtacc

SEQ ID NO: 203401 - DNA, 25 bp, Rattus norvegicus
atgtgtgtctgcatgaagcctttag

SEQ ID NO: 203402 - DNA, 25 bp, Rattus norvegicus
atgtgtgtctgcttgaagcctttag

SEQ ID NO: 203403 - DNA, 25 bp, Rattus norvegicus
atgtgtgtctggatctcactgacag

SEQ ID NO: 203404 - DNA, 25 bp, Rattus norvegicus
atgtgtgtctggttctcactgacag

SEQ ID NO: 203405 - DNA, 25 bp, Rattus norvegicus
atgtgtgtctgtatcgatgcctgaa

SEQ ID NO: 203406 - DNA, 25 bp, Rattus norvegicus
atgtgtgtctgtttcgatgcctgaa

SEQ ID NO: 203407 - DNA, 25 bp, Rattus norvegicus
atgtgtgtctttaacccgtactaag

SEQ ID NO: 203408 - DNA, 25 bp, Rattus norvegicus
atgtgtgtcttttacccgtactaag

SEQ ID NO: 203409 - DNA, 25 bp, Rattus norvegicus
atgtgtgtgcacaatgtgtctgcct

SEQ ID NO: 203410 - DNA, 25 bp, Rattus norvegicus
atgtgtgtgcactatgtgtctgcct

SEQ ID NO: 203411 - DNA, 25 bp, Rattus norvegicus
atgtgtgtgcatatcttttttatta

SEQ ID NO: 203412 - DNA, 25 bp, Rattus norvegicus
atgtgtgtgcatttcttttttatta

SEQ ID NO: 203413 - DNA, 25 bp, Rattus norvegicus
atgtgtgtgcctacctggacagcca

SEQ ID NO: 203414 - DNA, 25 bp, Rattus norvegicus
atgtgtgtgcctcttggatccctga

SEQ ID NO: 203415 - DNA, 25 bp, Rattus norvegicus
atgtgtgtgcctgttggatccctga

SEQ ID NO: 203416 - DNA, 25 bp, Rattus norvegicus
atgtgtgtgccttcctggacagcca

SEQ ID NO: 203417 - DNA, 25 bp, Rattus norvegicus
atgtgtgtgcttacagaaccactga

SEQ ID NO: 203418 - DNA, 25 bp, Rattus norvegicus
atgtgtgtgctttcagaaccactga

SEQ ID NO: 203419 - DNA, 25 bp, Rattus norvegicus
atgtgtgtggcacccatacaaacaa

SEQ ID NO: 203420 - DNA, 25 bp, Rattus norvegicus
atgtgtgtggcagccatacaaacaa

SEQ ID NO: 203421 - DNA, 25 bp, Rattus norvegicus
atgtgtgtgggtcatttgcctccaa

SEQ ID NO: 203422 - DNA, 25 bp, Rattus norvegicus
atgtgtgtgggtgatttgcctccaa

SEQ ID NO: 203423 - DNA, 25 bp, Rattus norvegicus
atgtgtgtgtgcaggccttccagac

SEQ ID NO: 203424 - DNA, 25 bp, Rattus norvegicus
atgtgtgtgtgctggccttccagac

SEQ ID NO: 203425 - DNA, 25 bp, Rattus norvegicus
atgtgtgttatcactttccagtcga

SEQ ID NO: 203426 - DNA, 25 bp, Rattus norvegicus
atgtgtgttatctctttccagtcga

SEQ ID NO: 203427 - DNA, 25 bp, Rattus norvegicus
atgtgtgttcacacttgccatcctt

SEQ ID NO: 203428 - DNA, 25 bp, Rattus norvegicus
atgtgtgttcactcttgccatcctt

SEQ ID NO: 203429 - DNA, 25 bp, Rattus norvegicus
atgtgtgttcagataacccttccta

SEQ ID NO: 203430 - DNA, 25 bp, Rattus norvegicus
atgtgtgttcagttaacccttccta

SEQ ID NO: 203431 - DNA, 25 bp, Rattus norvegicus
atgtgtgttccgagtctaggcagac

SEQ ID NO: 203432 - DNA, 25 bp, Rattus norvegicus
atgtgtgttccgtgtctaggcagac

SEQ ID NO: 203433 - DNA, 25 bp, Rattus norvegicus
atgtgtgttgcaatactccctcaga

SEQ ID NO: 203434 - DNA, 25 bp, Rattus norvegicus
atgtgtgttgcattactccctcaga

SEQ ID NO: 203435 - DNA, 25 bp, Rattus norvegicus
atgtgtgttggactctgcatggcca

SEQ ID NO: 203436 - DNA, 25 bp, Rattus norvegicus
atgtgtgttggagtctgcatggcca

SEQ ID NO: 203437 - DNA, 25 bp, Rattus norvegicus
atgtgtgtttgtctgcatttgctct

SEQ ID NO: 203438 - DNA, 25 bp, Rattus norvegicus
atgtgtgtttgtgtgcatttgctct

SEQ ID NO: 203439 - DNA, 25 bp, Rattus norvegicus
atgtgtgttttcaaccttttcccat

SEQ ID NO: 203440 - DNA, 25 bp, Rattus norvegicus
atgtgtgttttctaccttttcccat

SEQ ID NO: 203441 - DNA, 25 bp, Rattus norvegicus
atgtgttaatacaactgctgatgca

SEQ ID NO: 203442 - DNA, 25 bp, Rattus norvegicus
atgtgttaatactactgctgatgca

SEQ ID NO: 203443 - DNA, 25 bp, Rattus norvegicus
atgtgttaccttcttcatctttctg

SEQ ID NO: 203444 - DNA, 25 bp, Rattus norvegicus
atgtgttaccttgttcatctttctg

SEQ ID NO: 203445 - DNA, 25 bp, Rattus norvegicus
atgtgttactgcaggccatcaatcc

SEQ ID NO: 203446 - DNA, 25 bp, Rattus norvegicus
atgtgttactgctggccatcaatcc

SEQ ID NO: 203447 - DNA, 25 bp, Rattus norvegicus
atgtgttagccaagctttcgttcat

SEQ ID NO: 203448 - DNA, 25 bp, Rattus norvegicus
atgtgttagccatgctttcgttcat

SEQ ID NO: 203449 - DNA, 25 bp, Rattus norvegicus
atgtgttagctcaacctagtctcaa

SEQ ID NO: 203450 - DNA, 25 bp, Rattus norvegicus
atgtgttagctctacctagtctcaa

SEQ ID NO: 203451 - DNA, 25 bp, Rattus norvegicus
atgtgttatcttcctctctacttta

SEQ ID NO: 203452 - DNA, 25 bp, Rattus norvegicus
atgtgttatcttgctctctacttta

SEQ ID NO: 203453 - DNA, 25 bp, Rattus norvegicus
atgtgttattccagaggcttgcctt

SEQ ID NO: 203454 - DNA, 25 bp, Rattus norvegicus
atgtgttattcctgaggcttgcctt

SEQ ID NO: 203455 - DNA, 25 bp, Rattus norvegicus
atgtgttcaagactcttccctgtag

SEQ ID NO: 203456 - DNA, 25 bp, Rattus norvegicus
atgtgttcaagagtcttccctgtag

SEQ ID NO: 203457 - DNA, 25 bp, Rattus norvegicus
atgtgttcacctacatcaccgagga

SEQ ID NO: 203458 - DNA, 25 bp, Rattus norvegicus
atgtgttcaccttcatcaccgagga

SEQ ID NO: 203459 - DNA, 25 bp, Rattus norvegicus
atgtgttcactcctcttcctttggg

SEQ ID NO: 203460 - DNA, 25 bp, Rattus norvegicus
atgtgttcactcgtcttcctttggg

SEQ ID NO: 203461 - DNA, 25 bp, Rattus norvegicus
atgtgttcccaccatgagatgctac

SEQ ID NO: 203462 - DNA, 25 bp, Rattus norvegicus
atgtgttcccacgatgagatgctac

SEQ ID NO: 203463 - DNA, 25 bp, Rattus norvegicus
atgtgttcctggcagttgagcttgt

SEQ ID NO: 203464 - DNA, 25 bp, Rattus norvegicus
atgtgttcctgggagttgagcttgt

SEQ ID NO: 203465 - DNA, 25 bp, Rattus norvegicus
atgtgttcgccaatgtcatatccaa

SEQ ID NO: 203466 - DNA, 25 bp, Rattus norvegicus
atgtgttcgccattgtcatatccaa

SEQ ID NO: 203467 - DNA, 25 bp, Rattus norvegicus
atgtgttcggtgatctaactctgcc

SEQ ID NO: 203468 - DNA, 25 bp, Rattus norvegicus
atgtgttcggtgttctaactctgcc

SEQ ID NO: 203469 - DNA, 25 bp, Rattus norvegicus
atgtgttctgggaggtatcgttaaa

SEQ ID NO: 203470 - DNA, 25 bp, Rattus norvegicus
atgtgttctgggtggtatcgttaaa

SEQ ID NO: 203471 - DNA, 25 bp, Rattus norvegicus
atgtgttctgtaattctgtagattg

SEQ ID NO: 203472 - DNA, 25 bp, Rattus norvegicus
atgtgttctgtatttctgtagattg

SEQ ID NO: 203473 - DNA, 25 bp, Rattus norvegicus
atgtgttcttggaccgaaactggga

SEQ ID NO: 203474 - DNA, 25 bp, Rattus norvegicus
atgtgttcttggatttagtttgcaa

SEQ ID NO: 203475 - DNA, 25 bp, Rattus norvegicus
atgtgttcttggtccgaaactggga

SEQ ID NO: 203476 - DNA, 25 bp, Rattus norvegicus
atgtgttcttggttttagtttgcaa

SEQ ID NO: 203477 - DNA, 25 bp, Rattus norvegicus
atgtgttctttcacgaatggatttc

SEQ ID NO: 203478 - DNA, 25 bp, Rattus norvegicus
atgtgttctttctcgaatggatttc

SEQ ID NO: 203479 - DNA, 25 bp, Rattus norvegicus
atgtgttgaagcatcccttggacat

SEQ ID NO: 203480 - DNA, 25 bp, Rattus norvegicus
atgtgttgaagcttcccttggacat

SEQ ID NO: 203481 - DNA, 25 bp, Rattus norvegicus
atgtgttgccttcggtttcacattg

SEQ ID NO: 203482 - DNA, 25 bp, Rattus norvegicus
atgtgttgccttgggtttcacattg

SEQ ID NO: 203483 - DNA, 25 bp, Rattus norvegicus
atgtgttgctcaactgtgtttcatc

SEQ ID NO: 203484 - DNA, 25 bp, Rattus norvegicus
atgtgttgctcatctgtgtttcatc

SEQ ID NO: 203485 - DNA, 25 bp, Rattus norvegicus
atgtgttggacaatgggtgtacccc

SEQ ID NO: 203486 - DNA, 25 bp, Rattus norvegicus
atgtgttggacattgggtgtacccc

SEQ ID NO: 203487 - DNA, 25 bp, Rattus norvegicus
atgtgttggatgatcccgctgactg

SEQ ID NO: 203488 - DNA, 25 bp, Rattus norvegicus
atgtgttggatgttcccgctgactg

SEQ ID NO: 203489 - DNA, 25 bp, Rattus norvegicus
atgtgttgtattctgctgtttgccc

SEQ ID NO: 203490 - DNA, 25 bp, Rattus norvegicus
atgtgttgtattgtgctgtttgccc

SEQ ID NO: 203491 - DNA, 25 bp, Rattus norvegicus
atgtgttgtccccatctttttggga

SEQ ID NO: 203492 - DNA, 25 bp, Rattus norvegicus
atgtgttgtcccgatctttttggga

SEQ ID NO: 203493 - DNA, 25 bp, Rattus norvegicus
atgtgttgtgggactcaaacctcaa

SEQ ID NO: 203494 - DNA, 25 bp, Rattus norvegicus
atgtgttgtgggtctcaaacctcaa

SEQ ID NO: 203495 - DNA, 25 bp, Rattus norvegicus
atgtgttgttcaatacaacttttta

SEQ ID NO: 203496 - DNA, 25 bp, Rattus norvegicus
atgtgttgttcattacaacttttta

SEQ ID NO: 203497 - DNA, 25 bp, Rattus norvegicus
atgtgtttaactctgtgtatgtcta

SEQ ID NO: 203498 - DNA, 25 bp, Rattus norvegicus
atgtgtttaactgtgtgtatgtcta

SEQ ID NO: 203499 - DNA, 25 bp, Rattus norvegicus
atgtgtttacatcctcacacacaga

SEQ ID NO: 203500 - DNA, 25 bp, Rattus norvegicus
atgtgtttacatctgaagcccaaag

SEQ ID NO: 203501 - DNA, 25 bp, Rattus norvegicus
atgtgtttacatgctcacacacaga

SEQ ID NO: 203502 - DNA, 25 bp, Rattus norvegicus
atgtgtttacatgtgaagcccaaag

SEQ ID NO: 203503 - DNA, 25 bp, Rattus norvegicus
atgtgtttactcaggattgtcaata

SEQ ID NO: 203504 - DNA, 25 bp, Rattus norvegicus
atgtgtttactctggattgtcaata

SEQ ID NO: 203505 - DNA, 25 bp, Rattus norvegicus
atgtgtttactgactggtcctgtgc

SEQ ID NO: 203506 - DNA, 25 bp, Rattus norvegicus
atgtgtttactgtctggtcctgtgc

SEQ ID NO: 203507 - DNA, 25 bp, Rattus norvegicus
atgtgtttatgtcaagcctctccct

SEQ ID NO: 203508 - DNA, 25 bp, Rattus norvegicus
atgtgtttatgtgaagcctctccct

SEQ ID NO: 203509 - DNA, 25 bp, Rattus norvegicus
atgtgtttattaaaatgtccacccc

SEQ ID NO: 203510 - DNA, 25 bp, Rattus norvegicus
atgtgtttattataatgtccacccc

SEQ ID NO: 203511 - DNA, 25 bp, Rattus norvegicus
atgtgtttattgacccttctacagc

SEQ ID NO: 203512 - DNA, 25 bp, Rattus norvegicus
atgtgtttattgtcccttctacagc

SEQ ID NO: 203513 - DNA, 25 bp, Rattus norvegicus
atgtgtttcaggagaccctcaacta

SEQ ID NO: 203514 - DNA, 25 bp, Rattus norvegicus
atgtgtttcaggtgaccctcaacta

SEQ ID NO: 203515 - DNA, 25 bp, Rattus norvegicus
atgtgtttcatgactagccctcttt

SEQ ID NO: 203516 - DNA, 25 bp, Rattus norvegicus
atgtgtttcatgattgcgggcaggt

SEQ ID NO: 203517 - DNA, 25 bp, Rattus norvegicus
atgtgtttcatgtctagccctcttt

SEQ ID NO: 203518 - DNA, 25 bp, Rattus norvegicus
atgtgtttcatgtttgcgggcaggt

SEQ ID NO: 203519 - DNA, 25 bp, Rattus norvegicus
atgtgtttccgtcgcaacgttcaac

SEQ ID NO: 203520 - DNA, 25 bp, Rattus norvegicus
atgtgtttccgtggcaacgttcaac

SEQ ID NO: 203521 - DNA, 25 bp, Rattus norvegicus
atgtgtttcctgatgttattccttc

SEQ ID NO: 203522 - DNA, 25 bp, Rattus norvegicus
atgtgtttcctgttgttattccttc

SEQ ID NO: 203523 - DNA, 25 bp, Rattus norvegicus
atgtgtttctcaaacagcagggcca

SEQ ID NO: 203524 - DNA, 25 bp, Rattus norvegicus
atgtgtttctcatacagcagggcca

SEQ ID NO: 203525 - DNA, 25 bp, Rattus norvegicus
atgtgtttctccatagctctttgcc

SEQ ID NO: 203526 - DNA, 25 bp, Rattus norvegicus
atgtgtttctccttagctctttgcc

SEQ ID NO: 203527 - DNA, 25 bp, Rattus norvegicus
atgtgtttctttcccacctaaacag

SEQ ID NO: 203528 - DNA, 25 bp, Rattus norvegicus
atgtgtttctttgccacctaaacag

SEQ ID NO: 203529 - DNA, 25 bp, Rattus norvegicus
atgtgtttgccaacaatgacccctt

SEQ ID NO: 203530 - DNA, 25 bp, Rattus norvegicus
atgtgtttgccatcaatgacccctt

SEQ ID NO: 203531 - DNA, 25 bp, Rattus norvegicus
atgtgtttgcgcatggaggtctcca

SEQ ID NO: 203532 - DNA, 25 bp, Rattus norvegicus
atgtgtttgcgcttggaggtctcca

SEQ ID NO: 203533 - DNA, 25 bp, Rattus norvegicus
atgtgtttgcttccacgtgtgtcta

SEQ ID NO: 203534 - DNA, 25 bp, Rattus norvegicus
atgtgtttgcttgcacgtgtgtcta

SEQ ID NO: 203535 - DNA, 25 bp, Rattus norvegicus
atgtgtttgggcaacgtcatcccct

SEQ ID NO: 203536 - DNA, 25 bp, Rattus norvegicus
atgtgtttgggctacgtcatcccct

SEQ ID NO: 203537 - DNA, 25 bp, Rattus norvegicus
atgtgtttgtatacccatacgtcgt

SEQ ID NO: 203538 - DNA, 25 bp, Rattus norvegicus
atgtgtttgtattcccatacgtcgt

SEQ ID NO: 203539 - DNA, 25 bp, Rattus norvegicus
atgtgttttatgaccttactgccct

SEQ ID NO: 203540 - DNA, 25 bp, Rattus norvegicus
atgtgttttatgtccttactgccct

SEQ ID NO: 203541 - DNA, 25 bp, Rattus norvegicus
atgtgttttcatcgtcacctggtca

SEQ ID NO: 203542 - DNA, 25 bp, Rattus norvegicus
atgtgttttcatggtcacctggtca

SEQ ID NO: 203543 - DNA, 25 bp, Rattus norvegicus
atgtgttttcccagctacgtgtaca

SEQ ID NO: 203544 - DNA, 25 bp, Rattus norvegicus
atgtgttttccctgctacgtgtaca

SEQ ID NO: 203545 - DNA, 25 bp, Rattus norvegicus
atgtgttttctaaggttggatcgta

SEQ ID NO: 203546 - DNA, 25 bp, Rattus norvegicus
atgtgttttctatggttggatcgta

SEQ ID NO: 203547 - DNA, 25 bp, Rattus norvegicus
atgtgttttgccaagcagctaggaa

SEQ ID NO: 203548 - DNA, 25 bp, Rattus norvegicus
atgtgttttgcctagcagctaggaa

SEQ ID NO: 203549 - DNA, 25 bp, Rattus norvegicus
atgtgttttgttctcattgctttcc

SEQ ID NO: 203550 - DNA, 25 bp, Rattus norvegicus
atgtgttttgttgtcattgctttcc

SEQ ID NO: 203551 - DNA, 25 bp, Rattus norvegicus
atgttaaacctgaggtctctctcct

SEQ ID NO: 203552 - DNA, 25 bp, Rattus norvegicus
atgttaaacctgtggtctctctcct

SEQ ID NO: 203553 - DNA, 25 bp, Rattus norvegicus
atgttaaatatcatcaggtctctgt

SEQ ID NO: 203554 - DNA, 25 bp, Rattus norvegicus
atgttaaatatcttcaggtctctgt

SEQ ID NO: 203555 - DNA, 25 bp, Rattus norvegicus
atgttaaatgttatcaaggcctgtt

SEQ ID NO: 203556 - DNA, 25 bp, Rattus norvegicus
atgttaaatgttttcaaggcctgtt

SEQ ID NO: 203557 - DNA, 25 bp, Rattus norvegicus
atgttaacccttagtgtctagtttg

SEQ ID NO: 203558 - DNA, 25 bp, Rattus norvegicus
atgttaaccctttgtgtctagtttg

SEQ ID NO: 203559 - DNA, 25 bp, Rattus norvegicus
atgttaatatctataagcgaggctt

SEQ ID NO: 203560 - DNA, 25 bp, Rattus norvegicus
atgttaatatctttaagcgaggctt

SEQ ID NO: 203561 - DNA, 25 bp, Rattus norvegicus
atgttaatgctgaaatctgtggcca

SEQ ID NO: 203562 - DNA, 25 bp, Rattus norvegicus
atgttaatgctgtaatctgtggcca

SEQ ID NO: 203563 - DNA, 25 bp, Rattus norvegicus
atgttaattgataccagtggccagt

SEQ ID NO: 203564 - DNA, 25 bp, Rattus norvegicus
atgttaattgattccagtggccagt

SEQ ID NO: 203565 - DNA, 25 bp, Rattus norvegicus
atgttaattttcctactcctgtgct

SEQ ID NO: 203566 - DNA, 25 bp, Rattus norvegicus
atgttaattttcgtactcctgtgct

SEQ ID NO: 203567 - DNA, 25 bp, Rattus norvegicus
atgttacaccagctgttttctctag

SEQ ID NO: 203568 - DNA, 25 bp, Rattus norvegicus
atgttacaccaggtgttttctctag

SEQ ID NO: 203569 - DNA, 25 bp, Rattus norvegicus
atgttacacgctccatacgatgtga

SEQ ID NO: 203570 - DNA, 25 bp, Rattus norvegicus
atgttacacgctgcatacgatgtga

SEQ ID NO: 203571 - DNA, 25 bp, Rattus norvegicus
atgttacagcctccatgagcttcct

SEQ ID NO: 203572 - DNA, 25 bp, Rattus norvegicus
atgttacagcctgcatgagcttcct

SEQ ID NO: 203573 - DNA, 25 bp, Rattus norvegicus
atgttacagctgaaccttagtaatg

SEQ ID NO: 203574 - DNA, 25 bp, Rattus norvegicus
atgttacagctgtaccttagtaatg

SEQ ID NO: 203575 - DNA, 25 bp, Rattus norvegicus
atgttaccaccgatctatttttgaa

SEQ ID NO: 203576 - DNA, 25 bp, Rattus norvegicus
atgttaccaccgttctatttttgaa

SEQ ID NO: 203577 - DNA, 25 bp, Rattus norvegicus
atgttaccagtgaatttcctctttt

SEQ ID NO: 203578 - DNA, 25 bp, Rattus norvegicus
atgttaccagtgtatttcctctttt

SEQ ID NO: 203579 - DNA, 25 bp, Rattus norvegicus
atgttacccctacaaaagctgctga

SEQ ID NO: 203580 - DNA, 25 bp, Rattus norvegicus
atgttacccctagaaaagctgctga

SEQ ID NO: 203581 - DNA, 25 bp, Rattus norvegicus
atgttacccttgagttctgacgagc

SEQ ID NO: 203582 - DNA, 25 bp, Rattus norvegicus
atgttacccttgtgttctgacgagc

SEQ ID NO: 203583 - DNA, 25 bp, Rattus norvegicus
atgttaccgtgtctcacaaggccat

SEQ ID NO: 203584 - DNA, 25 bp, Rattus norvegicus
atgttaccgtgtgtcacaaggccat

SEQ ID NO: 203585 - DNA, 25 bp, Rattus norvegicus
atgttacctatgatcttccagttct

SEQ ID NO: 203586 - DNA, 25 bp, Rattus norvegicus
atgttacctatgttcttccagttct

SEQ ID NO: 203587 - DNA, 25 bp, Rattus norvegicus
atgttacctgatagccaagacgctt

SEQ ID NO: 203588 - DNA, 25 bp, Rattus norvegicus
atgttacctgattgccaagacgctt

SEQ ID NO: 203589 - DNA, 25 bp, Rattus norvegicus
atgttaccttcgaatatctgtccac

SEQ ID NO: 203590 - DNA, 25 bp, Rattus norvegicus
atgttaccttcgtatatctgtccac

SEQ ID NO: 203591 - DNA, 25 bp, Rattus norvegicus
atgttacgcttgatctgtggttgca

SEQ ID NO: 203592 - DNA, 25 bp, Rattus norvegicus
atgttacgcttgttctgtggttgca

SEQ ID NO: 203593 - DNA, 25 bp, Rattus norvegicus
atgttactatatagccctttgtggg

SEQ ID NO: 203594 - DNA, 25 bp, Rattus norvegicus
atgttactatattgccctttgtggg

SEQ ID NO: 203595 - DNA, 25 bp, Rattus norvegicus
atgttactctgcagaatgtattcct

SEQ ID NO: 203596 - DNA, 25 bp, Rattus norvegicus
atgttactctgctgaatgtattcct

SEQ ID NO: 203597 - DNA, 25 bp, Rattus norvegicus
atgttactgaggcttcttaccagga

SEQ ID NO: 203598 - DNA, 25 bp, Rattus norvegicus
atgttactgagggttcttaccagga

SEQ ID NO: 203599 - DNA, 25 bp, Rattus norvegicus
atgttactgatcattctggcaagga

SEQ ID NO: 203600 - DNA, 25 bp, Rattus norvegicus
atgttactgatctttctggcaagga

SEQ ID NO: 203601 - DNA, 25 bp, Rattus norvegicus
atgttactggccacacatgactttc

SEQ ID NO: 203602 - DNA, 25 bp, Rattus norvegicus
atgttactggccaggtgatcccaaa

SEQ ID NO: 203603 - DNA, 25 bp, Rattus norvegicus
atgttactggcctcacatgactttc

SEQ ID NO: 203604 - DNA, 25 bp, Rattus norvegicus
atgttactggcctggtgatcccaaa

SEQ ID NO: 203605 - DNA, 25 bp, Rattus norvegicus
atgttacttcccctgatgttcttcc

SEQ ID NO: 203606 - DNA, 25 bp, Rattus norvegicus
atgttacttcccgtgatgttcttcc

SEQ ID NO: 203607 - DNA, 25 bp, Rattus norvegicus
atgttacttgctacttttcaacctt

SEQ ID NO: 203608 - DNA, 25 bp, Rattus norvegicus
atgttacttgcttcttttcaacctt

SEQ ID NO: 203609 - DNA, 25 bp, Rattus norvegicus
atgttagacactactccgtgagata

SEQ ID NO: 203610 - DNA, 25 bp, Rattus norvegicus
atgttagacacttctccgtgagata

SEQ ID NO: 203611 - DNA, 25 bp, Rattus norvegicus
atgttagactctcctcgggatgtga

SEQ ID NO: 203612 - DNA, 25 bp, Rattus norvegicus
atgttagactctgctcgggatgtga

SEQ ID NO: 203613 - DNA, 25 bp, Rattus norvegicus
atgttagcagctcgctcctgtgtga

SEQ ID NO: 203614 - DNA, 25 bp, Rattus norvegicus
atgttagcagctggctcctgtgtga

SEQ ID NO: 203615 - DNA, 25 bp, Rattus norvegicus
atgttagccataatttcccagcctt

SEQ ID NO: 203616 - DNA, 25 bp, Rattus norvegicus
atgttagccatattttcccagcctt

SEQ ID NO: 203617 - DNA, 25 bp, Rattus norvegicus
atgttagctccaagcggacccgtgg

SEQ ID NO: 203618 - DNA, 25 bp, Rattus norvegicus
atgttagctccatgcggacccgtgg

SEQ ID NO: 203619 - DNA, 25 bp, Rattus norvegicus
atgttagctgacagtcttctctctc

SEQ ID NO: 203620 - DNA, 25 bp, Rattus norvegicus
atgttagctgactgtcttctctctc

SEQ ID NO: 203621 - DNA, 25 bp, Rattus norvegicus
atgttagctgctcgaaactcgataa

SEQ ID NO: 203622 - DNA, 25 bp, Rattus norvegicus
atgttagctgctggaaactcgataa

SEQ ID NO: 203623 - DNA, 25 bp, Rattus norvegicus
atgttagctgttagcctctattacc

SEQ ID NO: 203624 - DNA, 25 bp, Rattus norvegicus
atgttagctgtttgcctctattacc

SEQ ID NO: 203625 - DNA, 25 bp, Rattus norvegicus
atgttagcttaacctgcctgtttcc

SEQ ID NO: 203626 - DNA, 25 bp, Rattus norvegicus
atgttagcttaagctgcctgtttcc

SEQ ID NO: 203627 - DNA, 25 bp, Rattus norvegicus
atgttagctttcctgagatccatcc

SEQ ID NO: 203628 - DNA, 25 bp, Rattus norvegicus
atgttagctttcgtgagatccatcc

SEQ ID NO: 203629 - DNA, 25 bp, Rattus norvegicus
atgttagcttttagccaacctggct

SEQ ID NO: 203630 - DNA, 25 bp, Rattus norvegicus
atgttagctttttgccaacctggct

SEQ ID NO: 203631 - DNA, 25 bp, Rattus norvegicus
atgttaggctaacagccctccagtt

SEQ ID NO: 203632 - DNA, 25 bp, Rattus norvegicus
atgttaggctaagagccctccagtt

SEQ ID NO: 203633 - DNA, 25 bp, Rattus norvegicus
atgttagggtctcgatgctctctgc

SEQ ID NO: 203634 - DNA, 25 bp, Rattus norvegicus
atgttagggtctggatgctctctgc

SEQ ID NO: 203635 - DNA, 25 bp, Rattus norvegicus
atgttaggttggaactttctctgcc

SEQ ID NO: 203636 - DNA, 25 bp, Rattus norvegicus
atgttaggttggtactttctctgcc

SEQ ID NO: 203637 - DNA, 25 bp, Rattus norvegicus
atgttagtacttctcgttggcagcc

SEQ ID NO: 203638 - DNA, 25 bp, Rattus norvegicus
atgttagtacttgtcgttggcagcc

SEQ ID NO: 203639 - DNA, 25 bp, Rattus norvegicus
atgttagtattgatttgttcctcca

SEQ ID NO: 203640 - DNA, 25 bp, Rattus norvegicus
atgttagtattgttttgttcctcca

SEQ ID NO: 203641 - DNA, 25 bp, Rattus norvegicus
atgttagtcaccacctgtctgattg

SEQ ID NO: 203642 - DNA, 25 bp, Rattus norvegicus
atgttagtcacctcctgtctgattg

SEQ ID NO: 203643 - DNA, 25 bp, Rattus norvegicus
atgttagtcagccatttacagcaat

SEQ ID NO: 203644 - DNA, 25 bp, Rattus norvegicus
atgttagtcagcgatttacagcaat

SEQ ID NO: 203645 - DNA, 25 bp, Rattus norvegicus
atgttagtgacgactgtgaattcct

SEQ ID NO: 203646 - DNA, 25 bp, Rattus norvegicus
atgttagtgacgtctgtgaattcct

SEQ ID NO: 203647 - DNA, 25 bp, Rattus norvegicus
atgttagtgtccagaacttccttca

SEQ ID NO: 203648 - DNA, 25 bp, Rattus norvegicus
atgttagtgtcctgaacttccttca

SEQ ID NO: 203649 - DNA, 25 bp, Rattus norvegicus
atgttagttagtagctccattgtac

SEQ ID NO: 203650 - DNA, 25 bp, Rattus norvegicus
atgttagttagttgctccattgtac

SEQ ID NO: 203651 - DNA, 25 bp, Rattus norvegicus
atgttagttcgcacatctgtgatct

SEQ ID NO: 203652 - DNA, 25 bp, Rattus norvegicus
atgttagttcgctcatctgtgatct

SEQ ID NO: 203653 - DNA, 25 bp, Rattus norvegicus
atgttatatgttacttaaaggccca

SEQ ID NO: 203654 - DNA, 25 bp, Rattus norvegicus
atgttatatgtttcttaaaggccca

SEQ ID NO: 203655 - DNA, 25 bp, Rattus norvegicus
atgttatccaagcaattcactctag

SEQ ID NO: 203656 - DNA, 25 bp, Rattus norvegicus
atgttatccaaggaattcactctag

SEQ ID NO: 203657 - DNA, 25 bp, Rattus norvegicus
atgttatctgtacaagttacactac

SEQ ID NO: 203658 - DNA, 25 bp, Rattus norvegicus
atgttatctgtagaagttacactac

SEQ ID NO: 203659 - DNA, 25 bp, Rattus norvegicus
atgttatgacaacaatgcctggagt

SEQ ID NO: 203660 - DNA, 25 bp, Rattus norvegicus
atgttatgacaagaatgcctggagt

SEQ ID NO: 203661 - DNA, 25 bp, Rattus norvegicus
atgttatgatcacttctaggtggta

SEQ ID NO: 203662 - DNA, 25 bp, Rattus norvegicus
atgttatgatcagttctaggtggta

SEQ ID NO: 203663 - DNA, 25 bp, Rattus norvegicus
atgttatggttcaaaccctggccca

SEQ ID NO: 203664 - DNA, 25 bp, Rattus norvegicus
atgttatggttctaaccctggccca

SEQ ID NO: 203665 - DNA, 25 bp, Rattus norvegicus
atgttattctacaccctatgtgcta

SEQ ID NO: 203666 - DNA, 25 bp, Rattus norvegicus
atgttattctactccctatgtgcta

SEQ ID NO: 203667 - DNA, 25 bp, Rattus norvegicus
atgttatttagtcacctccttccca

SEQ ID NO: 203668 - DNA, 25 bp, Rattus norvegicus
atgttatttagtgacctccttccca

SEQ ID NO: 203669 - DNA, 25 bp, Rattus norvegicus
atgttatttcttcccactagaggga

SEQ ID NO: 203670 - DNA, 25 bp, Rattus norvegicus
atgttatttcttgccactagaggga

SEQ ID NO: 203671 - DNA, 25 bp, Rattus norvegicus
atgttcaaaagtatctcctgctgga

SEQ ID NO: 203672 - DNA, 25 bp, Rattus norvegicus
atgttcaaaagtttctcctgctgga

SEQ ID NO: 203673 - DNA, 25 bp, Rattus norvegicus
atgttcaaaattccgcttcaagcct

SEQ ID NO: 203674 - DNA, 25 bp, Rattus norvegicus
atgttcaaaattgcgcttcaagcct

SEQ ID NO: 203675 - DNA, 25 bp, Rattus norvegicus
atgttcaactacacgaagcctttct

SEQ ID NO: 203676 - DNA, 25 bp, Rattus norvegicus
atgttcaactactcgaagcctttct

SEQ ID NO: 203677 - DNA, 25 bp, Rattus norvegicus
atgttcaagaccatctaggtagtgg

SEQ ID NO: 203678 - DNA, 25 bp, Rattus norvegicus
atgttcaagaccttctaggtagtgg

SEQ ID NO: 203679 - DNA, 25 bp, Rattus norvegicus
atgttcaaggcgagttccctgttca

SEQ ID NO: 203680 - DNA, 25 bp, Rattus norvegicus
atgttcaaggcgtgttccctgttca

SEQ ID NO: 203681 - DNA, 25 bp, Rattus norvegicus
atgttcaaggtgctcaatctaggga

SEQ ID NO: 203682 - DNA, 25 bp, Rattus norvegicus
atgttcaaggtggtcaatctaggga

SEQ ID NO: 203683 - DNA, 25 bp, Rattus norvegicus
atgttcaatattatcctgccgtcta

SEQ ID NO: 203684 - DNA, 25 bp, Rattus norvegicus
atgttcaatattttcctgccgtcta

SEQ ID NO: 203685 - DNA, 25 bp, Rattus norvegicus
atgttcaattttagacatgagtcta

SEQ ID NO: 203686 - DNA, 25 bp, Rattus norvegicus
atgttcaatttttgacatgagtcta

SEQ ID NO: 203687 - DNA, 25 bp, Rattus norvegicus
atgttcacagagcacctcagagcaa

SEQ ID NO: 203688 - DNA, 25 bp, Rattus norvegicus
atgttcacagaggacctcagagcaa

SEQ ID NO: 203689 - DNA, 25 bp, Rattus norvegicus
atgttcacagttactttctttcctt

SEQ ID NO: 203690 - DNA, 25 bp, Rattus norvegicus
atgttcacagtttctttctttcctt

SEQ ID NO: 203691 - DNA, 25 bp, Rattus norvegicus
atgttcaccagacagcacagcctgt

SEQ ID NO: 203692 - DNA, 25 bp, Rattus norvegicus
atgttcaccagagagcacagcctgt

SEQ ID NO: 203693 - DNA, 25 bp, Rattus norvegicus
atgttcacccatcaaaggacttttg

SEQ ID NO: 203694 - DNA, 25 bp, Rattus norvegicus
atgttcacccatgaaaggacttttg

SEQ ID NO: 203695 - DNA, 25 bp, Rattus norvegicus
atgttcacctttccctaggatctag

SEQ ID NO: 203696 - DNA, 25 bp, Rattus norvegicus
atgttcacctttgcctaggatctag

SEQ ID NO: 203697 - DNA, 25 bp, Rattus norvegicus
atgttcacgggcatcggagcgtttc

SEQ ID NO: 203698 - DNA, 25 bp, Rattus norvegicus
atgttcacgggcttcggagcgtttc

SEQ ID NO: 203699 - DNA, 25 bp, Rattus norvegicus
atgttcactctgaatgtgggacctc

SEQ ID NO: 203700 - DNA, 25 bp, Rattus norvegicus
atgttcactctgtatgtgggacctc

SEQ ID NO: 203701 - DNA, 25 bp, Rattus norvegicus
atgttcactggtctggccggcatag

SEQ ID NO: 203702 - DNA, 25 bp, Rattus norvegicus
atgttcactggtgtggccggcatag

SEQ ID NO: 203703 - DNA, 25 bp, Rattus norvegicus
atgttcactttgcactctctcagac

SEQ ID NO: 203704 - DNA, 25 bp, Rattus norvegicus
atgttcactttggactctctcagac

SEQ ID NO: 203705 - DNA, 25 bp, Rattus norvegicus
atgttcagaacaacgtgccctccat

SEQ ID NO: 203706 - DNA, 25 bp, Rattus norvegicus
atgttcagaacatcgtgccctccat

SEQ ID NO: 203707 - DNA, 25 bp, Rattus norvegicus
atgttcagagagactgtcctggtcc

SEQ ID NO: 203708 - DNA, 25 bp, Rattus norvegicus
atgttcagagagtctgtcctggtcc

SEQ ID NO: 203709 - DNA, 25 bp, Rattus norvegicus
atgttcagagctattcacgcatttg

SEQ ID NO: 203710 - DNA, 25 bp, Rattus norvegicus
atgttcagagcttttcacgcatttg

SEQ ID NO: 203711 - DNA, 25 bp, Rattus norvegicus
atgttcagctatcattgccatccag

SEQ ID NO: 203712 - DNA, 25 bp, Rattus norvegicus
atgttcagctatgattgccatccag

SEQ ID NO: 203713 - DNA, 25 bp, Rattus norvegicus
atgttcaggcaacctccgaagttgc

SEQ ID NO: 203714 - DNA, 25 bp, Rattus norvegicus
atgttcaggcaagctccgaagttgc

SEQ ID NO: 203715 - DNA, 25 bp, Rattus norvegicus
atgttcaggctcctcacaggccagg

SEQ ID NO: 203716 - DNA, 25 bp, Rattus norvegicus
atgttcaggctcgtcacaggccagg

SEQ ID NO: 203717 - DNA, 25 bp, Rattus norvegicus
atgttcagtctgaaggttctcatcc

SEQ ID NO: 203718 - DNA, 25 bp, Rattus norvegicus
atgttcagtctgtaggttctcatcc

SEQ ID NO: 203719 - DNA, 25 bp, Rattus norvegicus
atgttcagttgcagctcccatgtgg

SEQ ID NO: 203720 - DNA, 25 bp, Rattus norvegicus
atgttcagttgctgctcccatgtgg

SEQ ID NO: 203721 - DNA, 25 bp, Rattus norvegicus
atgttcatcatcaaggctgtgctgc

SEQ ID NO: 203722 - DNA, 25 bp, Rattus norvegicus
atgttcatcatctaggctgtgctgc

SEQ ID NO: 203723 - DNA, 25 bp, Rattus norvegicus
atgttcatctggaaacaccggtgcc

SEQ ID NO: 203724 - DNA, 25 bp, Rattus norvegicus
atgttcatctggtaacaccggtgcc

SEQ ID NO: 203725 - DNA, 25 bp, Rattus norvegicus
atgttcatgatccataccatcgcgc

SEQ ID NO: 203726 - DNA, 25 bp, Rattus norvegicus
atgttcatgatcgataccatcgcgc

SEQ ID NO: 203727 - DNA, 25 bp, Rattus norvegicus
atgttcatgcagatgtggctgcctt

SEQ ID NO: 203728 - DNA, 25 bp, Rattus norvegicus
atgttcatgcagttgtggctgcctt

SEQ ID NO: 203729 - DNA, 25 bp, Rattus norvegicus
atgttcatgcctcggtgaccaagaa

SEQ ID NO: 203730 - DNA, 25 bp, Rattus norvegicus
atgttcatgcctgggtgaccaagaa

SEQ ID NO: 203731 - DNA, 25 bp, Rattus norvegicus
atgttcatgggcaagtagcgtcccc

SEQ ID NO: 203732 - DNA, 25 bp, Rattus norvegicus
atgttcatgggcatctacctgctca

SEQ ID NO: 203733 - DNA, 25 bp, Rattus norvegicus
atgttcatgggctagtagcgtcccc

SEQ ID NO: 203734 - DNA, 25 bp, Rattus norvegicus
atgttcatgggcttctacctgctca

SEQ ID NO: 203735 - DNA, 25 bp, Rattus norvegicus
atgttcatgtgccacaccatgttca

SEQ ID NO: 203736 - DNA, 25 bp, Rattus norvegicus
atgttcatgtgcgacaccatgttca

SEQ ID NO: 203737 - DNA, 25 bp, Rattus norvegicus
atgttcattctaacatcaggcacga

SEQ ID NO: 203738 - DNA, 25 bp, Rattus norvegicus
atgttcattctatcatcaggcacga

SEQ ID NO: 203739 - DNA, 25 bp, Rattus norvegicus
atgttcattggcacataattcatta

SEQ ID NO: 203740 - DNA, 25 bp, Rattus norvegicus
atgttcattggctcataattcatta

SEQ ID NO: 203741 - DNA, 25 bp, Rattus norvegicus
atgttcatttataagtcagaggtag

SEQ ID NO: 203742 - DNA, 25 bp, Rattus norvegicus
atgttcatttattagtcagaggtag

SEQ ID NO: 203743 - DNA, 25 bp, Rattus norvegicus
atgttccacacacgcttcaagcagg

SEQ ID NO: 203744 - DNA, 25 bp, Rattus norvegicus
atgttccacacaggcttcaagcagg

SEQ ID NO: 203745 - DNA, 25 bp, Rattus norvegicus
atgttccactggctatcctgttgaa

SEQ ID NO: 203746 - DNA, 25 bp, Rattus norvegicus
atgttccactgggtatcctgttgaa

SEQ ID NO: 203747 - DNA, 25 bp, Rattus norvegicus
atgttccacttcaccactccactgc

SEQ ID NO: 203748 - DNA, 25 bp, Rattus norvegicus
atgttccacttctccactccactgc

SEQ ID NO: 203749 - DNA, 25 bp, Rattus norvegicus
atgttccagaacagggcttgacctt

SEQ ID NO: 203750 - DNA, 25 bp, Rattus norvegicus
atgttccagaactgggcttgacctt

SEQ ID NO: 203751 - DNA, 25 bp, Rattus norvegicus
atgttccagagcctaccttcaaagc

SEQ ID NO: 203752 - DNA, 25 bp, Rattus norvegicus
atgttccagagcgtaccttcaaagc

SEQ ID NO: 203753 - DNA, 25 bp, Rattus norvegicus
atgttccagatgattgaatcctcac

SEQ ID NO: 203754 - DNA, 25 bp, Rattus norvegicus
atgttccagatgtttgaatcctcac

SEQ ID NO: 203755 - DNA, 25 bp, Rattus norvegicus
atgttccagctgactatatagttgt

SEQ ID NO: 203756 - DNA, 25 bp, Rattus norvegicus
atgttccagctgtctatatagttgt

SEQ ID NO: 203757 - DNA, 25 bp, Rattus norvegicus
atgttccagcttaccacttgtggga

SEQ ID NO: 203758 - DNA, 25 bp, Rattus norvegicus
atgttccagctttccacttgtggga

SEQ ID NO: 203759 - DNA, 25 bp, Rattus norvegicus
atgttccagggacctttgtgtgcgt

SEQ ID NO: 203760 - DNA, 25 bp, Rattus norvegicus
atgttccagggagctttgtgtgcgt

SEQ ID NO: 203761 - DNA, 25 bp, Rattus norvegicus
atgttccatacaacatgcacccact

SEQ ID NO: 203762 - DNA, 25 bp, Rattus norvegicus
atgttccatacatcatgcacccact

SEQ ID NO: 203763 - DNA, 25 bp, Rattus norvegicus
atgttccatgatcaaactcagcaga

SEQ ID NO: 203764 - DNA, 25 bp, Rattus norvegicus
atgttccatgatgaaactcagcaga

SEQ ID NO: 203765 - DNA, 25 bp, Rattus norvegicus
atgttccatggactccctggattaa

SEQ ID NO: 203766 - DNA, 25 bp, Rattus norvegicus
atgttccatggagtccctggattaa

SEQ ID NO: 203767 - DNA, 25 bp, Rattus norvegicus
atgttcccaaaacttgagtctgtcg

SEQ ID NO: 203768 - DNA, 25 bp, Rattus norvegicus
atgttcccaaaagttgagtctgtcg

SEQ ID NO: 203769 - DNA, 25 bp, Rattus norvegicus
atgttcccaacaaggtggtgtggta

SEQ ID NO: 203770 - DNA, 25 bp, Rattus norvegicus
atgttcccaacatggtggtgtggta

SEQ ID NO: 203771 - DNA, 25 bp, Rattus norvegicus
atgttcccacagctgacgtctttga

SEQ ID NO: 203772 - DNA, 25 bp, Rattus norvegicus
atgttcccacaggtgacgtctttga

SEQ ID NO: 203773 - DNA, 25 bp, Rattus norvegicus
atgttcccactcagacaatcatggc

SEQ ID NO: 203774 - DNA, 25 bp, Rattus norvegicus
atgttcccactctgacaatcatggc

SEQ ID NO: 203775 - DNA, 25 bp, Rattus norvegicus
atgttcccagccaaggcagagggcc

SEQ ID NO: 203776 - DNA, 25 bp, Rattus norvegicus
atgttcccagcctaggcagagggcc

SEQ ID NO: 203777 - DNA, 25 bp, Rattus norvegicus
atgttcccagtcatgtgaggtgctc

SEQ ID NO: 203778 - DNA, 25 bp, Rattus norvegicus
atgttcccagtcttgtgaggtgctc

SEQ ID NO: 203779 - DNA, 25 bp, Rattus norvegicus
atgttcccagttcagtgccaaagag

SEQ ID NO: 203780 - DNA, 25 bp, Rattus norvegicus
atgttcccagttgagtgccaaagag

SEQ ID NO: 203781 - DNA, 25 bp, Rattus norvegicus
atgttcccataaaatctgccttgtg

SEQ ID NO: 203782 - DNA, 25 bp, Rattus norvegicus
atgttcccataatatctgccttgtg

SEQ ID NO: 203783 - DNA, 25 bp, Rattus norvegicus
atgttcccatagacttcaaggttga

SEQ ID NO: 203784 - DNA, 25 bp, Rattus norvegicus
atgttcccatagtcttcaaggttga

SEQ ID NO: 203785 - DNA, 25 bp, Rattus norvegicus
atgttccccatccacacaagaagag

SEQ ID NO: 203786 - DNA, 25 bp, Rattus norvegicus
atgttccccatcgacacaagaagag

SEQ ID NO: 203787 - DNA, 25 bp, Rattus norvegicus
atgttcccgcctagacttctctcaa

SEQ ID NO: 203788 - DNA, 25 bp, Rattus norvegicus
atgttcccgccttgacttctctcaa

SEQ ID NO: 203789 - DNA, 25 bp, Rattus norvegicus
atgttccctaaccagagagctttgc

SEQ ID NO: 203790 - DNA, 25 bp, Rattus norvegicus
atgttccctaaccagtaccgagagg

SEQ ID NO: 203791 - DNA, 25 bp, Rattus norvegicus
atgttccctaacgagagagctttgc

SEQ ID NO: 203792 - DNA, 25 bp, Rattus norvegicus
atgttccctaacgagtaccgagagg

SEQ ID NO: 203793 - DNA, 25 bp, Rattus norvegicus
atgttccctccaatttctgagtagc

SEQ ID NO: 203794 - DNA, 25 bp, Rattus norvegicus
atgttccctccattttctgagtagc

SEQ ID NO: 203795 - DNA, 25 bp, Rattus norvegicus
atgttccctcctaactatgatcaga

SEQ ID NO: 203796 - DNA, 25 bp, Rattus norvegicus
atgttccctccttactatgatcaga

SEQ ID NO: 203797 - DNA, 25 bp, Rattus norvegicus
atgttccctcttcgctgtgtagaca

SEQ ID NO: 203798 - DNA, 25 bp, Rattus norvegicus
atgttccctcttggctgtgtagaca

SEQ ID NO: 203799 - DNA, 25 bp, Rattus norvegicus
atgttcccttttaattctgtgtcct

SEQ ID NO: 203800 - DNA, 25 bp, Rattus norvegicus
atgttccctttttattctgtgtcct

SEQ ID NO: 203801 - DNA, 25 bp, Rattus norvegicus
atgttccgccagcatcatgaacgaa

SEQ ID NO: 203802 - DNA, 25 bp, Rattus norvegicus
atgttccgccaggatcatgaacgaa

SEQ ID NO: 203803 - DNA, 25 bp, Rattus norvegicus
atgttccggatgaagaagccaccct

SEQ ID NO: 203804 - DNA, 25 bp, Rattus norvegicus
atgttccggatgtagaagccaccct

SEQ ID NO: 203805 - DNA, 25 bp, Rattus norvegicus
atgttccgtattagtatctgttttt

SEQ ID NO: 203806 - DNA, 25 bp, Rattus norvegicus
atgttccgtatttgtatctgttttt

SEQ ID NO: 203807 - DNA, 25 bp, Rattus norvegicus
atgttccgttaaatccagcttgtgc

SEQ ID NO: 203808 - DNA, 25 bp, Rattus norvegicus
atgttccgttaattccagcttgtgc

SEQ ID NO: 203809 - DNA, 25 bp, Rattus norvegicus
atgttcctaacacgcctgattgttt

SEQ ID NO: 203810 - DNA, 25 bp, Rattus norvegicus
atgttcctaacaggcctgattgttt

SEQ ID NO: 203811 - DNA, 25 bp, Rattus norvegicus
atgttcctaaccaattgcatcagaa

SEQ ID NO: 203812 - DNA, 25 bp, Rattus norvegicus
atgttcctaacctattgcatcagaa

SEQ ID NO: 203813 - DNA, 25 bp, Rattus norvegicus
atgttcctaaggacagttctctgct

SEQ ID NO: 203814 - DNA, 25 bp, Rattus norvegicus
atgttcctaaggtcagttctctgct

SEQ ID NO: 203815 - DNA, 25 bp, Rattus norvegicus
atgttcctcaacatccctgagggtt

SEQ ID NO: 203816 - DNA, 25 bp, Rattus norvegicus
atgttcctcaacttccctgagggtt

SEQ ID NO: 203817 - DNA, 25 bp, Rattus norvegicus
atgttcctcccaagggcggatgcaa

SEQ ID NO: 203818 - DNA, 25 bp, Rattus norvegicus
atgttcctcccatgggcggatgcaa

SEQ ID NO: 203819 - DNA, 25 bp, Rattus norvegicus
atgttcctgaatccggcccagaggg

SEQ ID NO: 203820 - DNA, 25 bp, Rattus norvegicus
atgttcctgaatgcggcccagaggg

SEQ ID NO: 203821 - DNA, 25 bp, Rattus norvegicus
atgttcctgattacgtttctggttg

SEQ ID NO: 203822 - DNA, 25 bp, Rattus norvegicus
atgttcctgatttcgtttctggttg

SEQ ID NO: 203823 - DNA, 25 bp, Rattus norvegicus
atgttcctggatcccgtagcaatgc

SEQ ID NO: 203824 - DNA, 25 bp, Rattus norvegicus
atgttcctggatgccgtagcaatgc

SEQ ID NO: 203825 - DNA, 25 bp, Rattus norvegicus
atgttcctggccatttggatgaggg

SEQ ID NO: 203826 - DNA, 25 bp, Rattus norvegicus
atgttcctggccttttggatgaggg

SEQ ID NO: 203827 - DNA, 25 bp, Rattus norvegicus
atgttcctgggtcaacagcttcctt

SEQ ID NO: 203828 - DNA, 25 bp, Rattus norvegicus
atgttcctgggtgaacagcttcctt

SEQ ID NO: 203829 - DNA, 25 bp, Rattus norvegicus
atgttcctggtgagcactagacctg

SEQ ID NO: 203830 - DNA, 25 bp, Rattus norvegicus
atgttcctggtgtgcactagacctg

SEQ ID NO: 203831 - DNA, 25 bp, Rattus norvegicus
atgttcctgtacacgatccttgggt

SEQ ID NO: 203832 - DNA, 25 bp, Rattus norvegicus
atgttcctgtactcgatccttgggt

SEQ ID NO: 203833 - DNA, 25 bp, Rattus norvegicus
atgttcctgttgatctatatcttga

SEQ ID NO: 203834 - DNA, 25 bp, Rattus norvegicus
atgttcctgttgttctatatcttga

SEQ ID NO: 203835 - DNA, 25 bp, Rattus norvegicus
atgttccttatacgtgtcaccatga

SEQ ID NO: 203836 - DNA, 25 bp, Rattus norvegicus
atgttccttataggtgtcaccatga

SEQ ID NO: 203837 - DNA, 25 bp, Rattus norvegicus
atgttccttcaaacccagatcatca

SEQ ID NO: 203838 - DNA, 25 bp, Rattus norvegicus
atgttccttcaatcccagatcatca

SEQ ID NO: 203839 - DNA, 25 bp, Rattus norvegicus
atgttccttcacaaactgttcatcc

SEQ ID NO: 203840 - DNA, 25 bp, Rattus norvegicus
atgttccttcactaactgttcatcc

SEQ ID NO: 203841 - DNA, 25 bp, Rattus norvegicus
atgttccttggtcctgaagcagcag

SEQ ID NO: 203842 - DNA, 25 bp, Rattus norvegicus
atgttccttggtgctgaagcagcag

SEQ ID NO: 203843 - DNA, 25 bp, Rattus norvegicus
atgttcctttctcaatgcttgtctc

SEQ ID NO: 203844 - DNA, 25 bp, Rattus norvegicus
atgttcctttctgaatgcttgtctc

SEQ ID NO: 203845 - DNA, 25 bp, Rattus norvegicus
atgttcgagtcccaagagcttcctg

SEQ ID NO: 203846 - DNA, 25 bp, Rattus norvegicus
atgttcgagtccgaagagcttcctg

SEQ ID NO: 203847 - DNA, 25 bp, Rattus norvegicus
atgttcgcaagtctgccatcagtga

SEQ ID NO: 203848 - DNA, 25 bp, Rattus norvegicus
atgttcgcaagtgtgccatcagtga

SEQ ID NO: 203849 - DNA, 25 bp, Rattus norvegicus
atgttcgcatgccttttggtctttc

SEQ ID NO: 203850 - DNA, 25 bp, Rattus norvegicus
atgttcgcatgcgttttggtctttc

SEQ ID NO: 203851 - DNA, 25 bp, Rattus norvegicus
atgttcgccatgaccagctcagagg

SEQ ID NO: 203852 - DNA, 25 bp, Rattus norvegicus
atgttcgccatgtccagctcagagg

SEQ ID NO: 203853 - DNA, 25 bp, Rattus norvegicus
atgttcgcgcgccacgacattgtag

SEQ ID NO: 203854 - DNA, 25 bp, Rattus norvegicus
atgttcgcgcgcgacgacattgtag

SEQ ID NO: 203855 - DNA, 25 bp, Rattus norvegicus
atgttcgcgctgagtattttaccct

SEQ ID NO: 203856 - DNA, 25 bp, Rattus norvegicus
atgttcgcgctgtgtattttaccct

SEQ ID NO: 203857 - DNA, 25 bp, Rattus norvegicus
atgttcgctctcatgttcagcaggg

SEQ ID NO: 203858 - DNA, 25 bp, Rattus norvegicus
atgttcgctctcttgttcagcaggg

SEQ ID NO: 203859 - DNA, 25 bp, Rattus norvegicus
atgttcggctctacatttcttagat

SEQ ID NO: 203860 - DNA, 25 bp, Rattus norvegicus
atgttcggctcttcatttcttagat

SEQ ID NO: 203861 - DNA, 25 bp, Rattus norvegicus
atgttcgtagacatggacttctcca

SEQ ID NO: 203862 - DNA, 25 bp, Rattus norvegicus
atgttcgtagacttggacttctcca

SEQ ID NO: 203863 - DNA, 25 bp, Rattus norvegicus
atgttcgtggtcaaggcctacctgc

SEQ ID NO: 203864 - DNA, 25 bp, Rattus norvegicus
atgttcgtggtctaggcctacctgc

SEQ ID NO: 203865 - DNA, 25 bp, Rattus norvegicus
atgttcgtgtctctgctcatgaaac

SEQ ID NO: 203866 - DNA, 25 bp, Rattus norvegicus
atgttcgtgtctgtgctcatgaaac

SEQ ID NO: 203867 - DNA, 25 bp, Rattus norvegicus
atgttcgttgtgactttagcttgtg

SEQ ID NO: 203868 - DNA, 25 bp, Rattus norvegicus
atgttcgttgtgtctttagcttgtg

SEQ ID NO: 203869 - DNA, 25 bp, Rattus norvegicus
atgttctaaacacccctttgagtgg

SEQ ID NO: 203870 - DNA, 25 bp, Rattus norvegicus
atgttctaaacagccctttgagtgg

SEQ ID NO: 203871 - DNA, 25 bp, Rattus norvegicus
atgttctaatctctggcagctgccg

SEQ ID NO: 203872 - DNA, 25 bp, Rattus norvegicus
atgttctaatctgtggcagctgccg

SEQ ID NO: 203873 - DNA, 25 bp, Rattus norvegicus
atgttctacacaccaaaatcctctg

SEQ ID NO: 203874 - DNA, 25 bp, Rattus norvegicus
atgttctacacagcaaaatcctctg

SEQ ID NO: 203875 - DNA, 25 bp, Rattus norvegicus
atgttctagactaccatctgatcgg

SEQ ID NO: 203876 - DNA, 25 bp, Rattus norvegicus
atgttctagacttccatctgatcgg

SEQ ID NO: 203877 - DNA, 25 bp, Rattus norvegicus
atgttctagttgagtgaccttgttc

SEQ ID NO: 203878 - DNA, 25 bp, Rattus norvegicus
atgttctagttgctgttaggacccc

SEQ ID NO: 203879 - DNA, 25 bp, Rattus norvegicus
atgttctagttggtgttaggacccc

SEQ ID NO: 203880 - DNA, 25 bp, Rattus norvegicus
atgttctagttgtgtgaccttgttc

SEQ ID NO: 203881 - DNA, 25 bp, Rattus norvegicus
atgttctcaagtagcatgcctgtca

SEQ ID NO: 203882 - DNA, 25 bp, Rattus norvegicus
atgttctcaagtcagcgtcccggag

SEQ ID NO: 203883 - DNA, 25 bp, Rattus norvegicus
atgttctcaagtgagcgtcccggag

SEQ ID NO: 203884 - DNA, 25 bp, Rattus norvegicus
atgttctcaagttgcatgcctgtca

SEQ ID NO: 203885 - DNA, 25 bp, Rattus norvegicus
atgttctcagtcaccaaaactgtag

SEQ ID NO: 203886 - DNA, 25 bp, Rattus norvegicus
atgttctcagtctccaaaactgtag

SEQ ID NO: 203887 - DNA, 25 bp, Rattus norvegicus
atgttctccacgatttgggcatctg

SEQ ID NO: 203888 - DNA, 25 bp, Rattus norvegicus
atgttctccacgttttgggcatctg

SEQ ID NO: 203889 - DNA, 25 bp, Rattus norvegicus
atgttctcccatatactgttcagta

SEQ ID NO: 203890 - DNA, 25 bp, Rattus norvegicus
atgttctcccatctcagtgctggga

SEQ ID NO: 203891 - DNA, 25 bp, Rattus norvegicus
atgttctcccatgtcagtgctggga

SEQ ID NO: 203892 - DNA, 25 bp, Rattus norvegicus
atgttctcccatttactgttcagta

SEQ ID NO: 203893 - DNA, 25 bp, Rattus norvegicus
atgttctccccgcatgggtttttat

SEQ ID NO: 203894 - DNA, 25 bp, Rattus norvegicus
atgttctccccggatgggtttttat

SEQ ID NO: 203895 - DNA, 25 bp, Rattus norvegicus
atgttctccgtcactgggaagttgc

SEQ ID NO: 203896 - DNA, 25 bp, Rattus norvegicus
atgttctccgtctctgggaagttgc

SEQ ID NO: 203897 - DNA, 25 bp, Rattus norvegicus
atgttctccttcaagctcttcaagt

SEQ ID NO: 203898 - DNA, 25 bp, Rattus norvegicus
atgttctccttctagctcttcaagt

SEQ ID NO: 203899 - DNA, 25 bp, Rattus norvegicus
atgttctctctccttttgaggtgag

SEQ ID NO: 203900 - DNA, 25 bp, Rattus norvegicus
atgttctctctcgttttgaggtgag

SEQ ID NO: 203901 - DNA, 25 bp, Rattus norvegicus
atgttctctgtaacaccattcaccg

SEQ ID NO: 203902 - DNA, 25 bp, Rattus norvegicus
atgttctctgtatcaccattcaccg

SEQ ID NO: 203903 - DNA, 25 bp, Rattus norvegicus
atgttctcttctcccttttaagctc

SEQ ID NO: 203904 - DNA, 25 bp, Rattus norvegicus
atgttctcttctgccttttaagctc

SEQ ID NO: 203905 - DNA, 25 bp, Rattus norvegicus
atgttctcttgaagtaaagctggac

SEQ ID NO: 203906 - DNA, 25 bp, Rattus norvegicus
atgttctcttgatgtaaagctggac

SEQ ID NO: 203907 - DNA, 25 bp, Rattus norvegicus
atgttctctttaatggcgacccttg

SEQ ID NO: 203908 - DNA, 25 bp, Rattus norvegicus
atgttctctttattggcgacccttg

SEQ ID NO: 203909 - DNA, 25 bp, Rattus norvegicus
atgttctgaagcatgtgggttttga

SEQ ID NO: 203910 - DNA, 25 bp, Rattus norvegicus
atgttctgaagcttgtgggttttga

SEQ ID NO: 203911 - DNA, 25 bp, Rattus norvegicus
atgttctgacagaggctcatagcca

SEQ ID NO: 203912 - DNA, 25 bp, Rattus norvegicus
atgttctgacagtggctcatagcca

SEQ ID NO: 203913 - DNA, 25 bp, Rattus norvegicus
atgttctgactgcagttttccctca

SEQ ID NO: 203914 - DNA, 25 bp, Rattus norvegicus
atgttctgactggagttttccctca

SEQ ID NO: 203915 - DNA, 25 bp, Rattus norvegicus
atgttctgagccatgagtgtctttt

SEQ ID NO: 203916 - DNA, 25 bp, Rattus norvegicus
atgttctgagccttgagtgtctttt

SEQ ID NO: 203917 - DNA, 25 bp, Rattus norvegicus
atgttctgcaacctggagggcgcct

SEQ ID NO: 203918 - DNA, 25 bp, Rattus norvegicus
atgttctgcaacgtggagggcgcct

SEQ ID NO: 203919 - DNA, 25 bp, Rattus norvegicus
atgttctgcaagaaaacccgtgtta

SEQ ID NO: 203920 - DNA, 25 bp, Rattus norvegicus
atgttctgcaagtaaacccgtgtta

SEQ ID NO: 203921 - DNA, 25 bp, Rattus norvegicus
atgttctgcacaagacatcttccta

SEQ ID NO: 203922 - DNA, 25 bp, Rattus norvegicus
atgttctgcacatgacatcttccta

SEQ ID NO: 203923 - DNA, 25 bp, Rattus norvegicus
atgttctgcactaaacctggaggga

SEQ ID NO: 203924 - DNA, 25 bp, Rattus norvegicus
atgttctgcacttaacctggaggga

SEQ ID NO: 203925 - DNA, 25 bp, Rattus norvegicus
atgttctgcatgatctggtctagtc

SEQ ID NO: 203926 - DNA, 25 bp, Rattus norvegicus
atgttctgcatgttctggtctagtc

SEQ ID NO: 203927 - DNA, 25 bp, Rattus norvegicus
atgttctgcattatttttgtctcaa

SEQ ID NO: 203928 - DNA, 25 bp, Rattus norvegicus
atgttctgcattcaccaggctcaaa

SEQ ID NO: 203929 - DNA, 25 bp, Rattus norvegicus
atgttctgcattgaccaggctcaaa

SEQ ID NO: 203930 - DNA, 25 bp, Rattus norvegicus
atgttctgcattttttttgtctcaa

SEQ ID NO: 203931 - DNA, 25 bp, Rattus norvegicus
atgttctgccaacattccatgcttt

SEQ ID NO: 203932 - DNA, 25 bp, Rattus norvegicus
atgttctgccaagattccatgcttt

SEQ ID NO: 203933 - DNA, 25 bp, Rattus norvegicus
atgttctgccttatagagagctgag

SEQ ID NO: 203934 - DNA, 25 bp, Rattus norvegicus
atgttctgccttttagagagctgag

SEQ ID NO: 203935 - DNA, 25 bp, Rattus norvegicus
atgttctgcgtaatctgtgactgaa

SEQ ID NO: 203936 - DNA, 25 bp, Rattus norvegicus
atgttctgcgtattctgtgactgaa

SEQ ID NO: 203937 - DNA, 25 bp, Rattus norvegicus
atgttctgctggaatccccactggt

SEQ ID NO: 203938 - DNA, 25 bp, Rattus norvegicus
atgttctgctggtatccccactggt

SEQ ID NO: 203939 - DNA, 25 bp, Rattus norvegicus
atgttctggagcctgggtcctttcc

SEQ ID NO: 203940 - DNA, 25 bp, Rattus norvegicus
atgttctggagcgtgggtcctttcc

SEQ ID NO: 203941 - DNA, 25 bp, Rattus norvegicus
atgttctggcctcagtctaactacg

SEQ ID NO: 203942 - DNA, 25 bp, Rattus norvegicus
atgttctggcctgagtctaactacg

SEQ ID NO: 203943 - DNA, 25 bp, Rattus norvegicus
atgttctgggagcatcatcctgact

SEQ ID NO: 203944 - DNA, 25 bp, Rattus norvegicus
atgttctgggaggatcatcctgact

SEQ ID NO: 203945 - DNA, 25 bp, Rattus norvegicus
atgttctggtttcacagttctggta

SEQ ID NO: 203946 - DNA, 25 bp, Rattus norvegicus
atgttctggtttgacagttctggta

SEQ ID NO: 203947 - DNA, 25 bp, Rattus norvegicus
atgttctgtaccatacacaaaagga

SEQ ID NO: 203948 - DNA, 25 bp, Rattus norvegicus
atgttctgtaccttacacaaaagga

SEQ ID NO: 203949 - DNA, 25 bp, Rattus norvegicus
atgttctgtcatctctacgtaccaa

SEQ ID NO: 203950 - DNA, 25 bp, Rattus norvegicus
atgttctgtcatgtctacgtaccaa

SEQ ID NO: 203951 - DNA, 25 bp, Rattus norvegicus
atgttctgtctgaaaccttgtttgt

SEQ ID NO: 203952 - DNA, 25 bp, Rattus norvegicus
atgttctgtctgtaaccttgtttgt

SEQ ID NO: 203953 - DNA, 25 bp, Rattus norvegicus
atgttctgtggcctaactcgtgaga

SEQ ID NO: 203954 - DNA, 25 bp, Rattus norvegicus
atgttctgtggcgtaactcgtgaga

SEQ ID NO: 203955 - DNA, 25 bp, Rattus norvegicus
atgttcttagagacaaggcctggtg

SEQ ID NO: 203956 - DNA, 25 bp, Rattus norvegicus
atgttcttagagtcaaggcctggtg

SEQ ID NO: 203957 - DNA, 25 bp, Rattus norvegicus
atgttcttcaccattgaatttctag

SEQ ID NO: 203958 - DNA, 25 bp, Rattus norvegicus
atgttcttcacctttgaatttctag

SEQ ID NO: 203959 - DNA, 25 bp, Rattus norvegicus
atgttcttcactatcttcagttcct

SEQ ID NO: 203960 - DNA, 25 bp, Rattus norvegicus
atgttcttcactttcttcagttcct

SEQ ID NO: 203961 - DNA, 25 bp, Rattus norvegicus
atgttcttcagcacctacgacaggg

SEQ ID NO: 203962 - DNA, 25 bp, Rattus norvegicus
atgttcttcagctcctacgacaggg

SEQ ID NO: 203963 - DNA, 25 bp, Rattus norvegicus
atgttcttcatccaagcatgtcgtg

SEQ ID NO: 203964 - DNA, 25 bp, Rattus norvegicus
atgttcttcatcgaagcatgtcgtg

SEQ ID NO: 203965 - DNA, 25 bp, Rattus norvegicus
atgttcttgactacccttggcatca

SEQ ID NO: 203966 - DNA, 25 bp, Rattus norvegicus
atgttcttgacttcccttggcatca

SEQ ID NO: 203967 - DNA, 25 bp, Rattus norvegicus
atgttcttgagcacctccgtgttgg

SEQ ID NO: 203968 - DNA, 25 bp, Rattus norvegicus
atgttcttgagctcctccgtgttgg

SEQ ID NO: 203969 - DNA, 25 bp, Rattus norvegicus
atgttcttgggtcatctgtaataaa

SEQ ID NO: 203970 - DNA, 25 bp, Rattus norvegicus
atgttcttgggtgatctgtaataaa

SEQ ID NO: 203971 - DNA, 25 bp, Rattus norvegicus
atgttcttggtgattttctataatg

SEQ ID NO: 203972 - DNA, 25 bp, Rattus norvegicus
atgttcttggtgtttttctataatg

SEQ ID NO: 203973 - DNA, 25 bp, Rattus norvegicus
atgttctttagaagctaccaagcaa

SEQ ID NO: 203974 - DNA, 25 bp, Rattus norvegicus
atgttctttagatgctaccaagcaa

SEQ ID NO: 203975 - DNA, 25 bp, Rattus norvegicus
atgttctttctcatcgttggcaaat

SEQ ID NO: 203976 - DNA, 25 bp, Rattus norvegicus
atgttctttctcttcgttggcaaat

SEQ ID NO: 203977 - DNA, 25 bp, Rattus norvegicus
atgttcttttaccacttcagcatcc

SEQ ID NO: 203978 - DNA, 25 bp, Rattus norvegicus
atgttcttttacgacttcagcatcc

SEQ ID NO: 203979 - DNA, 25 bp, Rattus norvegicus
atgttctttttaagcctcccctagt

SEQ ID NO: 203980 - DNA, 25 bp, Rattus norvegicus
atgttctttttatgcctcccctagt

SEQ ID NO: 203981 - DNA, 25 bp, Rattus norvegicus
atgttgaaacaaatacttctactgt

SEQ ID NO: 203982 - DNA, 25 bp, Rattus norvegicus
atgttgaaacaattacttctactgt

SEQ ID NO: 203983 - DNA, 25 bp, Rattus norvegicus
atgttgaactagcaccttctctgta

SEQ ID NO: 203984 - DNA, 25 bp, Rattus norvegicus
atgttgaactaggaccttctctgta

SEQ ID NO: 203985 - DNA, 25 bp, Rattus norvegicus
atgttgaactttacctgttccacct

SEQ ID NO: 203986 - DNA, 25 bp, Rattus norvegicus
atgttgaacttttcctgttccacct

SEQ ID NO: 203987 - DNA, 25 bp, Rattus norvegicus
atgttgaagatgcaccagcctctgt

SEQ ID NO: 203988 - DNA, 25 bp, Rattus norvegicus
atgttgaagatggaccagcctctgt

SEQ ID NO: 203989 - DNA, 25 bp, Rattus norvegicus
atgttgacaacccaacctttgagga

SEQ ID NO: 203990 - DNA, 25 bp, Rattus norvegicus
atgttgacaaccctgaacccatacc

SEQ ID NO: 203991 - DNA, 25 bp, Rattus norvegicus
atgttgacaaccgaacctttgagga

SEQ ID NO: 203992 - DNA, 25 bp, Rattus norvegicus
atgttgacaaccgtgaacccatacc

SEQ ID NO: 203993 - DNA, 25 bp, Rattus norvegicus
atgttgacatcacggcaggttcgtg

SEQ ID NO: 203994 - DNA, 25 bp, Rattus norvegicus
atgttgacatcactgaactgcttga

SEQ ID NO: 203995 - DNA, 25 bp, Rattus norvegicus
atgttgacatcagggcaggttcgtg

SEQ ID NO: 203996 - DNA, 25 bp, Rattus norvegicus
atgttgacatcagtgaactgcttga

SEQ ID NO: 203997 - DNA, 25 bp, Rattus norvegicus
atgttgacatgtctcaggttcctgt

SEQ ID NO: 203998 - DNA, 25 bp, Rattus norvegicus
atgttgacatgtgtcaggttcctgt

SEQ ID NO: 203999 - DNA, 25 bp, Rattus norvegicus
atgttgaccaacctagagagcctct

SEQ ID NO: 204000 - DNA, 25 bp, Rattus norvegicus
atgttgaccaacgtagagagcctct

SEQ ID NO: 204001 - DNA, 25 bp, Rattus norvegicus
atgttgacggctatgtgattgattc

SEQ ID NO: 204002 - DNA, 25 bp, Rattus norvegicus
atgttgacggctttgtgattgattc

SEQ ID NO: 204003 - DNA, 25 bp, Rattus norvegicus
atgttgacgtcaaatccggttccca

SEQ ID NO: 204004 - DNA, 25 bp, Rattus norvegicus
atgttgacgtcatatccggttccca

SEQ ID NO: 204005 - DNA, 25 bp, Rattus norvegicus
atgttgacgtggatcaagctcccat

SEQ ID NO: 204006 - DNA, 25 bp, Rattus norvegicus
atgttgacgtggttcaagctcccat

SEQ ID NO: 204007 - DNA, 25 bp, Rattus norvegicus
atgttgactatcaggcgggtgactc

SEQ ID NO: 204008 - DNA, 25 bp, Rattus norvegicus
atgttgactatctggcgggtgactc

SEQ ID NO: 204009 - DNA, 25 bp, Rattus norvegicus
atgttgactgtgagtcggtccagca

SEQ ID NO: 204010 - DNA, 25 bp, Rattus norvegicus
atgttgactgtgtgtcggtccagca

SEQ ID NO: 204011 - DNA, 25 bp, Rattus norvegicus
atgttgacttgtcatgtccacccag

SEQ ID NO: 204012 - DNA, 25 bp, Rattus norvegicus
atgttgacttgtgatgtccacccag

SEQ ID NO: 204013 - DNA, 25 bp, Rattus norvegicus
atgttgagccacagttgtcatgcca

SEQ ID NO: 204014 - DNA, 25 bp, Rattus norvegicus
atgttgagccactgttgtcatgcca

SEQ ID NO: 204015 - DNA, 25 bp, Rattus norvegicus
atgttgagctccaccctgagaggaa

SEQ ID NO: 204016 - DNA, 25 bp, Rattus norvegicus
atgttgagctcctccctgagaggaa

SEQ ID NO: 204017 - DNA, 25 bp, Rattus norvegicus
atgttgaggatcactgagcccgcga

SEQ ID NO: 204018 - DNA, 25 bp, Rattus norvegicus
atgttgaggatctctgagcccgcga

SEQ ID NO: 204019 - DNA, 25 bp, Rattus norvegicus
atgttgagtctcagtcagtaactag

SEQ ID NO: 204020 - DNA, 25 bp, Rattus norvegicus
atgttgagtctctgtcagtaactag

SEQ ID NO: 204021 - DNA, 25 bp, Rattus norvegicus
atgttgagttttccccactaacctg

SEQ ID NO: 204022 - DNA, 25 bp, Rattus norvegicus
atgttgagttttgcccactaacctg

SEQ ID NO: 204023 - DNA, 25 bp, Rattus norvegicus
atgttgatacacaaccttgattctg

SEQ ID NO: 204024 - DNA, 25 bp, Rattus norvegicus
atgttgatacactaccttgattctg

SEQ ID NO: 204025 - DNA, 25 bp, Rattus norvegicus
atgttgatacccagcgcacggctat

SEQ ID NO: 204026 - DNA, 25 bp, Rattus norvegicus
atgttgataccctgcgcacggctat

SEQ ID NO: 204027 - DNA, 25 bp, Rattus norvegicus
atgttgatatctcagccctgagctg

SEQ ID NO: 204028 - DNA, 25 bp, Rattus norvegicus
atgttgatatctgagccctgagctg

SEQ ID NO: 204029 - DNA, 25 bp, Rattus norvegicus
atgttgatcttgaagccagttttat

SEQ ID NO: 204030 - DNA, 25 bp, Rattus norvegicus
atgttgatcttgtagccagttttat

SEQ ID NO: 204031 - DNA, 25 bp, Rattus norvegicus
atgttgatgactactctgcttgagc

SEQ ID NO: 204032 - DNA, 25 bp, Rattus norvegicus
atgttgatgacttctctgcttgagc

SEQ ID NO: 204033 - DNA, 25 bp, Rattus norvegicus
atgttgatgcctctttgcctctagt

SEQ ID NO: 204034 - DNA, 25 bp, Rattus norvegicus
atgttgatgcctgtttgcctctagt

SEQ ID NO: 204035 - DNA, 25 bp, Rattus norvegicus
atgttgattcttcagcatccgtggt

SEQ ID NO: 204036 - DNA, 25 bp, Rattus norvegicus
atgttgattcttgagcatccgtggt

SEQ ID NO: 204037 - DNA, 25 bp, Rattus norvegicus
atgttgattgataaccgcgtccacc

SEQ ID NO: 204038 - DNA, 25 bp, Rattus norvegicus
atgttgattgattaccgcgtccacc

SEQ ID NO: 204039 - DNA, 25 bp, Rattus norvegicus
atgttgcaaaccaaagagcctcttt

SEQ ID NO: 204040 - DNA, 25 bp, Rattus norvegicus
atgttgcaaacctaagagcctcttt

SEQ ID NO: 204041 - DNA, 25 bp, Rattus norvegicus
atgttgcaaagcagtcagccctctg

SEQ ID NO: 204042 - DNA, 25 bp, Rattus norvegicus
atgttgcaaagctgtcagccctctg

SEQ ID NO: 204043 - DNA, 25 bp, Rattus norvegicus
atgttgcacaccaaaggtctgtccc

SEQ ID NO: 204044 - DNA, 25 bp, Rattus norvegicus
atgttgcacacctaaggtctgtccc

SEQ ID NO: 204045 - DNA, 25 bp, Rattus norvegicus
atgttgcactgtcgagttctccact

SEQ ID NO: 204046 - DNA, 25 bp, Rattus norvegicus
atgttgcactgtggagttctccact

SEQ ID NO: 204047 - DNA, 25 bp, Rattus norvegicus
atgttgcagggcagctcagagcgtt

SEQ ID NO: 204048 - DNA, 25 bp, Rattus norvegicus
atgttgcagggctgctcagagcgtt

SEQ ID NO: 204049 - DNA, 25 bp, Rattus norvegicus
atgttgcaggtgcttttcttctttg

SEQ ID NO: 204050 - DNA, 25 bp, Rattus norvegicus
atgttgcaggtggttttcttctttg

SEQ ID NO: 204051 - DNA, 25 bp, Rattus norvegicus
atgttgcatgctaactctcagaaaa

SEQ ID NO: 204052 - DNA, 25 bp, Rattus norvegicus
atgttgcatgcttactctcagaaaa

SEQ ID NO: 204053 - DNA, 25 bp, Rattus norvegicus
atgttgcatttactgcagcagaact

SEQ ID NO: 204054 - DNA, 25 bp, Rattus norvegicus
atgttgcatttagtgcagcagaact

SEQ ID NO: 204055 - DNA, 25 bp, Rattus norvegicus
atgttgccaaatcctgacttcatag

SEQ ID NO: 204056 - DNA, 25 bp, Rattus norvegicus
atgttgccaaatgctgacttcatag

SEQ ID NO: 204057 - DNA, 25 bp, Rattus norvegicus
atgttgccaaggagtctggacaggt

SEQ ID NO: 204058 - DNA, 25 bp, Rattus norvegicus
atgttgccaaggtgtctggacaggt

SEQ ID NO: 204059 - DNA, 25 bp, Rattus norvegicus
atgttgccacttaaactacttttag

SEQ ID NO: 204060 - DNA, 25 bp, Rattus norvegicus
atgttgccactttaactacttttag

SEQ ID NO: 204061 - DNA, 25 bp, Rattus norvegicus
atgttgccagcacaatttctccgat

SEQ ID NO: 204062 - DNA, 25 bp, Rattus norvegicus
atgttgccagcagaatttctccgat

SEQ ID NO: 204063 - DNA, 25 bp, Rattus norvegicus
atgttgccgctacaacttccgcaaa

SEQ ID NO: 204064 - DNA, 25 bp, Rattus norvegicus
atgttgccgctagaacttccgcaaa

SEQ ID NO: 204065 - DNA, 25 bp, Rattus norvegicus
atgttgcctacactgctagactaca

SEQ ID NO: 204066 - DNA, 25 bp, Rattus norvegicus
atgttgcctacagtgctagactaca

SEQ ID NO: 204067 - DNA, 25 bp, Rattus norvegicus
atgttgcctagacaacgcttcttta

SEQ ID NO: 204068 - DNA, 25 bp, Rattus norvegicus
atgttgcctagagaacgcttcttta

SEQ ID NO: 204069 - DNA, 25 bp, Rattus norvegicus
atgttgcctatgagatcttttgtta

SEQ ID NO: 204070 - DNA, 25 bp, Rattus norvegicus
atgttgcctatgtgatcttttgtta

SEQ ID NO: 204071 - DNA, 25 bp, Rattus norvegicus
atgttgcctctaagtctcttaaaat

SEQ ID NO: 204072 - DNA, 25 bp, Rattus norvegicus
atgttgcctctatgtctcttaaaat

SEQ ID NO: 204073 - DNA, 25 bp, Rattus norvegicus
atgttgcctggaacccttcaataaa

SEQ ID NO: 204074 - DNA, 25 bp, Rattus norvegicus
atgttgcctggatcccttcaataaa

SEQ ID NO: 204075 - DNA, 25 bp, Rattus norvegicus
atgttgccttggaaaagcttcgcga

SEQ ID NO: 204076 - DNA, 25 bp, Rattus norvegicus
atgttgccttggtaaagcttcgcga

SEQ ID NO: 204077 - DNA, 25 bp, Rattus norvegicus
atgttgccttgtattatgtgaccta

SEQ ID NO: 204078 - DNA, 25 bp, Rattus norvegicus
atgttgccttgttttatgtgaccta

SEQ ID NO: 204079 - DNA, 25 bp, Rattus norvegicus
atgttgcctttcacagcgttctttt

SEQ ID NO: 204080 - DNA, 25 bp, Rattus norvegicus
atgttgcctttctcagcgttctttt

SEQ ID NO: 204081 - DNA, 25 bp, Rattus norvegicus
atgttgcctttgacttgtgcagaac

SEQ ID NO: 204082 - DNA, 25 bp, Rattus norvegicus
atgttgcctttgatcactgtttctt

SEQ ID NO: 204083 - DNA, 25 bp, Rattus norvegicus
atgttgcctttgtcttgtgcagaac

SEQ ID NO: 204084 - DNA, 25 bp, Rattus norvegicus
atgttgcctttgttcactgtttctt

SEQ ID NO: 204085 - DNA, 25 bp, Rattus norvegicus
atgttgctaaccacttctgtaaatg

SEQ ID NO: 204086 - DNA, 25 bp, Rattus norvegicus
atgttgctaacctcttctgtaaatg

SEQ ID NO: 204087 - DNA, 25 bp, Rattus norvegicus
atgttgctactaacagactggtttg

SEQ ID NO: 204088 - DNA, 25 bp, Rattus norvegicus
atgttgctactatcagactggtttg

SEQ ID NO: 204089 - DNA, 25 bp, Rattus norvegicus
atgttgctactgctggctatttgcc

SEQ ID NO: 204090 - DNA, 25 bp, Rattus norvegicus
atgttgctactggtggctatttgcc

SEQ ID NO: 204091 - DNA, 25 bp, Rattus norvegicus
atgttgctccatacacgtgtactct

SEQ ID NO: 204092 - DNA, 25 bp, Rattus norvegicus
atgttgctccattcacgtgtactct

SEQ ID NO: 204093 - DNA, 25 bp, Rattus norvegicus
atgttgctccttcgcggtcggaacc

SEQ ID NO: 204094 - DNA, 25 bp, Rattus norvegicus
atgttgctccttggcggtcggaacc

SEQ ID NO: 204095 - DNA, 25 bp, Rattus norvegicus
atgttgctgaccaaaccaatcggga

SEQ ID NO: 204096 - DNA, 25 bp, Rattus norvegicus
atgttgctgacctaaccaatcggga

SEQ ID NO: 204097 - DNA, 25 bp, Rattus norvegicus
atgttgctgccacatctgggacact

SEQ ID NO: 204098 - DNA, 25 bp, Rattus norvegicus
atgttgctgccagatctgggacact

SEQ ID NO: 204099 - DNA, 25 bp, Rattus norvegicus
atgttgctgttccatgtcctctgca

SEQ ID NO: 204100 - DNA, 25 bp, Rattus norvegicus
atgttgctgttcgatgtcctctgca

SEQ ID NO: 204101 - DNA, 25 bp, Rattus norvegicus
atgttgcttcccaaaacctttagtg

SEQ ID NO: 204102 - DNA, 25 bp, Rattus norvegicus
atgttgcttccctaaacctttagtg

SEQ ID NO: 204103 - DNA, 25 bp, Rattus norvegicus
atgttgcttctcactataacctggt

SEQ ID NO: 204104 - DNA, 25 bp, Rattus norvegicus
atgttgcttctctctataacctggt

SEQ ID NO: 204105 - DNA, 25 bp, Rattus norvegicus
atgttgcttgaaccctgtgtcgtct

SEQ ID NO: 204106 - DNA, 25 bp, Rattus norvegicus
atgttgcttgaagcctgtgtcgtct

SEQ ID NO: 204107 - DNA, 25 bp, Rattus norvegicus
atgttgcttttcatgctcagtgatt

SEQ ID NO: 204108 - DNA, 25 bp, Rattus norvegicus
atgttgcttttcttgctcagtgatt

SEQ ID NO: 204109 - DNA, 25 bp, Rattus norvegicus
atgttggaaaatagcctcttaagtt

SEQ ID NO: 204110 - DNA, 25 bp, Rattus norvegicus
atgttggaaaattgcctcttaagtt

SEQ ID NO: 204111 - DNA, 25 bp, Rattus norvegicus
atgttggaaacaagtgcacacctgt

SEQ ID NO: 204112 - DNA, 25 bp, Rattus norvegicus
atgttggaaacatgtgcacacctgt

SEQ ID NO: 204113 - DNA, 25 bp, Rattus norvegicus
atgttggaagccaagtgacttttaa

SEQ ID NO: 204114 - DNA, 25 bp, Rattus norvegicus
atgttggaagcctagtgacttttaa

SEQ ID NO: 204115 - DNA, 25 bp, Rattus norvegicus
atgttggaagtccatctgccagcac

SEQ ID NO: 204116 - DNA, 25 bp, Rattus norvegicus
atgttggaagtcgatctgccagcac

SEQ ID NO: 204117 - DNA, 25 bp, Rattus norvegicus
atgttggacagtatgccggtctgcc

SEQ ID NO: 204118 - DNA, 25 bp, Rattus norvegicus
atgttggacagtttgccggtctgcc

SEQ ID NO: 204119 - DNA, 25 bp, Rattus norvegicus
atgttggacccacctaagcgaatta

SEQ ID NO: 204120 - DNA, 25 bp, Rattus norvegicus
atgttggacccagctaagcgaatta

SEQ ID NO: 204121 - DNA, 25 bp, Rattus norvegicus
atgttggagaccaacagtcacctcg

SEQ ID NO: 204122 - DNA, 25 bp, Rattus norvegicus
atgttggagacctacagtcacctcg

SEQ ID NO: 204123 - DNA, 25 bp, Rattus norvegicus
atgttggagcctccatcggtgccaa

SEQ ID NO: 204124 - DNA, 25 bp, Rattus norvegicus
atgttggagcctgcatcggtgccaa

SEQ ID NO: 204125 - DNA, 25 bp, Rattus norvegicus
atgttggcacgtactagggcttgtt

SEQ ID NO: 204126 - DNA, 25 bp, Rattus norvegicus
atgttggcacgttctagggcttgtt

SEQ ID NO: 204127 - DNA, 25 bp, Rattus norvegicus
atgttggcatcccatgagcttgaca

SEQ ID NO: 204128 - DNA, 25 bp, Rattus norvegicus
atgttggcatccgatgagcttgaca

SEQ ID NO: 204129 - DNA, 25 bp, Rattus norvegicus
atgttggccactcaggacctgcctg

SEQ ID NO: 204130 - DNA, 25 bp, Rattus norvegicus
atgttggccactgaggacctgcctg

SEQ ID NO: 204131 - DNA, 25 bp, Rattus norvegicus
atgttggcggcgctaagcgcgcccg

SEQ ID NO: 204132 - DNA, 25 bp, Rattus norvegicus
atgttggcggcggtaagcgcgcccg

SEQ ID NO: 204133 - DNA, 25 bp, Rattus norvegicus
atgttggcgtcgcaaggagtccttc

SEQ ID NO: 204134 - DNA, 25 bp, Rattus norvegicus
atgttggcgtcggaaggagtccttc

SEQ ID NO: 204135 - DNA, 25 bp, Rattus norvegicus
atgttggctaagacccacacagcaa

SEQ ID NO: 204136 - DNA, 25 bp, Rattus norvegicus
atgttggctaagtcccacacagcaa

SEQ ID NO: 204137 - DNA, 25 bp, Rattus norvegicus
atgttggctaggcaagttcagttaa

SEQ ID NO: 204138 - DNA, 25 bp, Rattus norvegicus
atgttggctagggaagttcagttaa

SEQ ID NO: 204139 - DNA, 25 bp, Rattus norvegicus
atgttggctccaccttctagtgagg

SEQ ID NO: 204140 - DNA, 25 bp, Rattus norvegicus
atgttggctccagcttctagtgagg

SEQ ID NO: 204141 - DNA, 25 bp, Rattus norvegicus
atgttgggaagacgcagccaccgct

SEQ ID NO: 204142 - DNA, 25 bp, Rattus norvegicus
atgttgggaagaggcagccaccgct

SEQ ID NO: 204143 - DNA, 25 bp, Rattus norvegicus
atgttgggcacaaatcaggatccta

SEQ ID NO: 204144 - DNA, 25 bp, Rattus norvegicus
atgttgggcacatatcaggatccta

SEQ ID NO: 204145 - DNA, 25 bp, Rattus norvegicus
atgttgggccgcactcaaggtgacc

SEQ ID NO: 204146 - DNA, 25 bp, Rattus norvegicus
atgttgggccgctctcaaggtgacc

SEQ ID NO: 204147 - DNA, 25 bp, Rattus norvegicus
atgttgggtctgatggagtaatctc

SEQ ID NO: 204148 - DNA, 25 bp, Rattus norvegicus
atgttgggtctgttggagtaatctc

SEQ ID NO: 204149 - DNA, 25 bp, Rattus norvegicus
atgttgggtgaacggctgtttcctc

SEQ ID NO: 204150 - DNA, 25 bp, Rattus norvegicus
atgttgggtgaagggctgtttcctc

SEQ ID NO: 204151 - DNA, 25 bp, Rattus norvegicus
atgttggtacgtaatgtcctggttt

SEQ ID NO: 204152 - DNA, 25 bp, Rattus norvegicus
atgttggtacgttatgtcctggttt

SEQ ID NO: 204153 - DNA, 25 bp, Rattus norvegicus
atgttggtacttcttacgtgtccca

SEQ ID NO: 204154 - DNA, 25 bp, Rattus norvegicus
atgttggtacttgttacgtgtccca

SEQ ID NO: 204155 - DNA, 25 bp, Rattus norvegicus
atgttggtcaccacttcagtgcggg

SEQ ID NO: 204156 - DNA, 25 bp, Rattus norvegicus
atgttggtcacctcttcagtgcggg

SEQ ID NO: 204157 - DNA, 25 bp, Rattus norvegicus
atgttggtgaccagcaacgggctaa

SEQ ID NO: 204158 - DNA, 25 bp, Rattus norvegicus
atgttggtgacctgcaacgggctaa

SEQ ID NO: 204159 - DNA, 25 bp, Rattus norvegicus
atgttggtggccaacagcctgggaa

SEQ ID NO: 204160 - DNA, 25 bp, Rattus norvegicus
atgttggtggcctacagcctgggaa

SEQ ID NO: 204161 - DNA, 25 bp, Rattus norvegicus
atgttggtggcgaggccctgggcag

SEQ ID NO: 204162 - DNA, 25 bp, Rattus norvegicus
atgttggtggcgtggccctgggcag

SEQ ID NO: 204163 - DNA, 25 bp, Rattus norvegicus
atgttggttcttactgtgtgtcagc

SEQ ID NO: 204164 - DNA, 25 bp, Rattus norvegicus
atgttggttctttctgtgtgtcagc

SEQ ID NO: 204165 - DNA, 25 bp, Rattus norvegicus
atgttgtaacctattcccgaatgcc

SEQ ID NO: 204166 - DNA, 25 bp, Rattus norvegicus
atgttgtaaccttttcccgaatgcc

SEQ ID NO: 204167 - DNA, 25 bp, Rattus norvegicus
atgttgtacaacagataccttctat

SEQ ID NO: 204168 - DNA, 25 bp, Rattus norvegicus
atgttgtacaactgataccttctat

SEQ ID NO: 204169 - DNA, 25 bp, Rattus norvegicus
atgttgtaccatatgccctgtgagc

SEQ ID NO: 204170 - DNA, 25 bp, Rattus norvegicus
atgttgtaccatttgccctgtgagc

SEQ ID NO: 204171 - DNA, 25 bp, Rattus norvegicus
atgttgtacctaagtcgtatgtata

SEQ ID NO: 204172 - DNA, 25 bp, Rattus norvegicus
atgttgtacctatgtcgtatgtata

SEQ ID NO: 204173 - DNA, 25 bp, Rattus norvegicus
atgttgtaccttcagggcattgcac

SEQ ID NO: 204174 - DNA, 25 bp, Rattus norvegicus
atgttgtaccttgagggcattgcac

SEQ ID NO: 204175 - DNA, 25 bp, Rattus norvegicus
atgttgtactcacaggtcatgttta

SEQ ID NO: 204176 - DNA, 25 bp, Rattus norvegicus
atgttgtactcagaggtcatgttta

SEQ ID NO: 204177 - DNA, 25 bp, Rattus norvegicus
atgttgtagctgctgtttctcaggc

SEQ ID NO: 204178 - DNA, 25 bp, Rattus norvegicus
atgttgtagctggtgtttctcaggc

SEQ ID NO: 204179 - DNA, 25 bp, Rattus norvegicus
atgttgtagggcactgtcttagttc

SEQ ID NO: 204180 - DNA, 25 bp, Rattus norvegicus
atgttgtagggctctgtcttagttc

SEQ ID NO: 204181 - DNA, 25 bp, Rattus norvegicus
atgttgtagtttctatgcctgctga

SEQ ID NO: 204182 - DNA, 25 bp, Rattus norvegicus
atgttgtagtttgtatgcctgctga

SEQ ID NO: 204183 - DNA, 25 bp, Rattus norvegicus
atgttgtcattactggttacacgca

SEQ ID NO: 204184 - DNA, 25 bp, Rattus norvegicus
atgttgtcattagtggttacacgca

SEQ ID NO: 204185 - DNA, 25 bp, Rattus norvegicus
atgttgtccctgactctgcagtact

SEQ ID NO: 204186 - DNA, 25 bp, Rattus norvegicus
atgttgtccctgtctctgcagtact

SEQ ID NO: 204187 - DNA, 25 bp, Rattus norvegicus
atgttgtccgcaagcacgtcggtga

SEQ ID NO: 204188 - DNA, 25 bp, Rattus norvegicus
atgttgtccgcatgcacgtcggtga

SEQ ID NO: 204189 - DNA, 25 bp, Rattus norvegicus
atgttgtccgttctgcaagcatgta

SEQ ID NO: 204190 - DNA, 25 bp, Rattus norvegicus
atgttgtccgttgtgcaagcatgta

SEQ ID NO: 204191 - DNA, 25 bp, Rattus norvegicus
atgttgtcctcgaatgcaggcggat

SEQ ID NO: 204192 - DNA, 25 bp, Rattus norvegicus
atgttgtcctcgtatgcaggcggat

SEQ ID NO: 204193 - DNA, 25 bp, Rattus norvegicus
atgttgtccttgacagctatgtgcc

SEQ ID NO: 204194 - DNA, 25 bp, Rattus norvegicus
atgttgtccttgtcagctatgtgcc

SEQ ID NO: 204195 - DNA, 25 bp, Rattus norvegicus
atgttgtcgaggctgttcttcaaga

SEQ ID NO: 204196 - DNA, 25 bp, Rattus norvegicus
atgttgtcgagggtgttcttcaaga

SEQ ID NO: 204197 - DNA, 25 bp, Rattus norvegicus
atgttgtctcggcttctactgtatc

SEQ ID NO: 204198 - DNA, 25 bp, Rattus norvegicus
atgttgtctcgggttctactgtatc

SEQ ID NO: 204199 - DNA, 25 bp, Rattus norvegicus
atgttgtctgaaatacttcctccag

SEQ ID NO: 204200 - DNA, 25 bp, Rattus norvegicus
atgttgtctgaattacttcctccag

SEQ ID NO: 204201 - DNA, 25 bp, Rattus norvegicus
atgttgtcttccacattgcaataat

SEQ ID NO: 204202 - DNA, 25 bp, Rattus norvegicus
atgttgtcttcctcattgcaataat

SEQ ID NO: 204203 - DNA, 25 bp, Rattus norvegicus
atgttgtgagcactgtacctctcct

SEQ ID NO: 204204 - DNA, 25 bp, Rattus norvegicus
atgttgtgagcagtgtacctctcct

SEQ ID NO: 204205 - DNA, 25 bp, Rattus norvegicus
atgttgtgcagtcatgttctcccta

SEQ ID NO: 204206 - DNA, 25 bp, Rattus norvegicus
atgttgtgcagtgatgttctcccta

SEQ ID NO: 204207 - DNA, 25 bp, Rattus norvegicus
atgttgtgcccaaggcaagtgcctc

SEQ ID NO: 204208 - DNA, 25 bp, Rattus norvegicus
atgttgtgcccacctttggcaagaa

SEQ ID NO: 204209 - DNA, 25 bp, Rattus norvegicus
atgttgtgcccagctttggcaagaa

SEQ ID NO: 204210 - DNA, 25 bp, Rattus norvegicus
atgttgtgcccatggcaagtgcctc

SEQ ID NO: 204211 - DNA, 25 bp, Rattus norvegicus
atgttgtgctatacaggctggctca

SEQ ID NO: 204212 - DNA, 25 bp, Rattus norvegicus
atgttgtgctattcaggctggctca

SEQ ID NO: 204213 - DNA, 25 bp, Rattus norvegicus
atgttgtgtcctagacctttctctt

SEQ ID NO: 204214 - DNA, 25 bp, Rattus norvegicus
atgttgtgtccttgacctttctctt

SEQ ID NO: 204215 - DNA, 25 bp, Rattus norvegicus
atgttgtgtgtacatatgtaatgcc

SEQ ID NO: 204216 - DNA, 25 bp, Rattus norvegicus
atgttgtgtgtagatatgtaatgcc

SEQ ID NO: 204217 - DNA, 25 bp, Rattus norvegicus
atgttgtgtttgaactcggcgtcga

SEQ ID NO: 204218 - DNA, 25 bp, Rattus norvegicus
atgttgtgtttgtactcggcgtcga

SEQ ID NO: 204219 - DNA, 25 bp, Rattus norvegicus
atgttgtgttttatcctccactact

SEQ ID NO: 204220 - DNA, 25 bp, Rattus norvegicus
atgttgtgttttttcctccactact

SEQ ID NO: 204221 - DNA, 25 bp, Rattus norvegicus
atgttgttgagccatcaccacaccg

SEQ ID NO: 204222 - DNA, 25 bp, Rattus norvegicus
atgttgttgagcgatcaccacaccg

SEQ ID NO: 204223 - DNA, 25 bp, Rattus norvegicus
atgttgtttcctcaaaacttggcta

SEQ ID NO: 204224 - DNA, 25 bp, Rattus norvegicus
atgttgtttcctgaaaacttggcta

SEQ ID NO: 204225 - DNA, 25 bp, Rattus norvegicus
atgttgtttggactctgtgtgcagc

SEQ ID NO: 204226 - DNA, 25 bp, Rattus norvegicus
atgttgtttggagtctgtgtgcagc

SEQ ID NO: 204227 - DNA, 25 bp, Rattus norvegicus
atgtttaaactgatctttgcaccaa

SEQ ID NO: 204228 - DNA, 25 bp, Rattus norvegicus
atgtttaaactgttctttgcaccaa

SEQ ID NO: 204229 - DNA, 25 bp, Rattus norvegicus
atgtttaaatcaattgacctggcaa

SEQ ID NO: 204230 - DNA, 25 bp, Rattus norvegicus
atgtttaaatcatttgacctggcaa

SEQ ID NO: 204231 - DNA, 25 bp, Rattus norvegicus
atgtttaaatctctgtggcactgta

SEQ ID NO: 204232 - DNA, 25 bp, Rattus norvegicus
atgtttaaatctgtgtggcactgta

SEQ ID NO: 204233 - DNA, 25 bp, Rattus norvegicus
atgtttaaccacattgctgctgact

SEQ ID NO: 204234 - DNA, 25 bp, Rattus norvegicus
atgtttaaccactttgctgctgact

SEQ ID NO: 204235 - DNA, 25 bp, Rattus norvegicus
atgtttaactgtcatcgccgctggg

SEQ ID NO: 204236 - DNA, 25 bp, Rattus norvegicus
atgtttaactgtgatcgccgctggg

SEQ ID NO: 204237 - DNA, 25 bp, Rattus norvegicus
atgtttaactttccaggcctgttct

SEQ ID NO: 204238 - DNA, 25 bp, Rattus norvegicus
atgtttaactttgcaggcctgttct

SEQ ID NO: 204239 - DNA, 25 bp, Rattus norvegicus
atgtttaatagcacccagagcctcc

SEQ ID NO: 204240 - DNA, 25 bp, Rattus norvegicus
atgtttaatagctcccagagcctcc

SEQ ID NO: 204241 - DNA, 25 bp, Rattus norvegicus
atgtttaatcagctcctagtcttaa

SEQ ID NO: 204242 - DNA, 25 bp, Rattus norvegicus
atgtttaatcaggtcctagtcttaa

SEQ ID NO: 204243 - DNA, 25 bp, Rattus norvegicus
atgtttacaagaacataccacactg

SEQ ID NO: 204244 - DNA, 25 bp, Rattus norvegicus
atgtttacaagatcataccacactg

SEQ ID NO: 204245 - DNA, 25 bp, Rattus norvegicus
atgtttacaaggacctcctctggtt

SEQ ID NO: 204246 - DNA, 25 bp, Rattus norvegicus
atgtttacaaggtcctcctctggtt

SEQ ID NO: 204247 - DNA, 25 bp, Rattus norvegicus
atgtttacaataatttctcttccaa

SEQ ID NO: 204248 - DNA, 25 bp, Rattus norvegicus
atgtttacaatattttctcttccaa

SEQ ID NO: 204249 - DNA, 25 bp, Rattus norvegicus
atgtttacacatagcttgcctgcta

SEQ ID NO: 204250 - DNA, 25 bp, Rattus norvegicus
atgtttacacattgcttgcctgcta

SEQ ID NO: 204251 - DNA, 25 bp, Rattus norvegicus
atgtttacactcagtctgttaggcc

SEQ ID NO: 204252 - DNA, 25 bp, Rattus norvegicus
atgtttacactctgtctgttaggcc

SEQ ID NO: 204253 - DNA, 25 bp, Rattus norvegicus
atgtttacattcacttctgtcttgg

SEQ ID NO: 204254 - DNA, 25 bp, Rattus norvegicus
atgtttacattctcttctgtcttgg

SEQ ID NO: 204255 - DNA, 25 bp, Rattus norvegicus
atgtttaccctgagtttgctgctgc

SEQ ID NO: 204256 - DNA, 25 bp, Rattus norvegicus
atgtttaccctgtgtttgctgctgc

SEQ ID NO: 204257 - DNA, 25 bp, Rattus norvegicus
atgtttacctggatttcctcacatg

SEQ ID NO: 204258 - DNA, 25 bp, Rattus norvegicus
atgtttacctggttttcctcacatg

SEQ ID NO: 204259 - DNA, 25 bp, Rattus norvegicus
atgtttacgaatactgccatgcagc

SEQ ID NO: 204260 - DNA, 25 bp, Rattus norvegicus
atgtttacgaattctgccatgcagc

SEQ ID NO: 204261 - DNA, 25 bp, Rattus norvegicus
atgtttacgaccaagttcacaaagg

SEQ ID NO: 204262 - DNA, 25 bp, Rattus norvegicus
atgtttacgacctagttcacaaagg

SEQ ID NO: 204263 - DNA, 25 bp, Rattus norvegicus
atgtttacttaaagagccggctctt

SEQ ID NO: 204264 - DNA, 25 bp, Rattus norvegicus
atgtttacttaatgagccggctctt

SEQ ID NO: 204265 - DNA, 25 bp, Rattus norvegicus
atgtttacttgtccctttgctttaa

SEQ ID NO: 204266 - DNA, 25 bp, Rattus norvegicus
atgtttacttgtgcctttgctttaa

SEQ ID NO: 204267 - DNA, 25 bp, Rattus norvegicus
atgtttagaagaccagccaatgctt

SEQ ID NO: 204268 - DNA, 25 bp, Rattus norvegicus
atgtttagaagagcagccaatgctt

SEQ ID NO: 204269 - DNA, 25 bp, Rattus norvegicus
atgtttagctctagttgtcatttgc

SEQ ID NO: 204270 - DNA, 25 bp, Rattus norvegicus
atgtttagctcttgttgtcatttgc

SEQ ID NO: 204271 - DNA, 25 bp, Rattus norvegicus
atgtttagctgtatccatcagttgc

SEQ ID NO: 204272 - DNA, 25 bp, Rattus norvegicus
atgtttagctgtttccatcagttgc

SEQ ID NO: 204273 - DNA, 25 bp, Rattus norvegicus
atgtttaggtaaactccttccccag

SEQ ID NO: 204274 - DNA, 25 bp, Rattus norvegicus
atgtttaggtaatctccttccccag

SEQ ID NO: 204275 - DNA, 25 bp, Rattus norvegicus
atgtttaggtgccattgcctccata

SEQ ID NO: 204276 - DNA, 25 bp, Rattus norvegicus
atgtttaggtgcgattgcctccata

SEQ ID NO: 204277 - DNA, 25 bp, Rattus norvegicus
atgtttagtacccacagcccaaggc

SEQ ID NO: 204278 - DNA, 25 bp, Rattus norvegicus
atgtttagtaccgacagcccaaggc

SEQ ID NO: 204279 - DNA, 25 bp, Rattus norvegicus
atgtttagtctcacaacattgttaa

SEQ ID NO: 204280 - DNA, 25 bp, Rattus norvegicus
atgtttagtctctcaacattgttaa

SEQ ID NO: 204281 - DNA, 25 bp, Rattus norvegicus
atgtttagtgatcagttccttctct

SEQ ID NO: 204282 - DNA, 25 bp, Rattus norvegicus
atgtttagtgatgagttccttctct

SEQ ID NO: 204283 - DNA, 25 bp, Rattus norvegicus
atgtttataggcagtctggctggct

SEQ ID NO: 204284 - DNA, 25 bp, Rattus norvegicus
atgtttataggctgtctggctggct

SEQ ID NO: 204285 - DNA, 25 bp, Rattus norvegicus
atgtttatcacccattcaacctata

SEQ ID NO: 204286 - DNA, 25 bp, Rattus norvegicus
atgtttatcaccgattcaacctata

SEQ ID NO: 204287 - DNA, 25 bp, Rattus norvegicus
atgtttatccagattcctatttgaa

SEQ ID NO: 204288 - DNA, 25 bp, Rattus norvegicus
atgtttatccagtttcctatttgaa

SEQ ID NO: 204289 - DNA, 25 bp, Rattus norvegicus
atgtttatgacactgctcggcagtt

SEQ ID NO: 204290 - DNA, 25 bp, Rattus norvegicus
atgtttatgacagtgctcggcagtt

SEQ ID NO: 204291 - DNA, 25 bp, Rattus norvegicus
atgtttatggtgatgaccctggctc

SEQ ID NO: 204292 - DNA, 25 bp, Rattus norvegicus
atgtttatggtgttgaccctggctc

SEQ ID NO: 204293 - DNA, 25 bp, Rattus norvegicus
atgtttattgacactagggatctct

SEQ ID NO: 204294 - DNA, 25 bp, Rattus norvegicus
atgtttattgactctagggatctct

SEQ ID NO: 204295 - DNA, 25 bp, Rattus norvegicus
atgtttattgtcatgtagcctatga

SEQ ID NO: 204296 - DNA, 25 bp, Rattus norvegicus
atgtttattgtcttgtagcctatga

SEQ ID NO: 204297 - DNA, 25 bp, Rattus norvegicus
atgtttcaccccaagttttatgtct

SEQ ID NO: 204298 - DNA, 25 bp, Rattus norvegicus
atgtttcacccctagttttatgtct

SEQ ID NO: 204299 - DNA, 25 bp, Rattus norvegicus
atgtttcactctatgtgttttcaga

SEQ ID NO: 204300 - DNA, 25 bp, Rattus norvegicus
atgtttcactctttgtgttttcaga

SEQ ID NO: 204301 - DNA, 25 bp, Rattus norvegicus
atgtttcactgcagtgttctgttga

SEQ ID NO: 204302 - DNA, 25 bp, Rattus norvegicus
atgtttcactgctgtgttctgttga

SEQ ID NO: 204303 - DNA, 25 bp, Rattus norvegicus
atgtttcagaatcctggccttcaga

SEQ ID NO: 204304 - DNA, 25 bp, Rattus norvegicus
atgtttcagaatgctggccttcaga

SEQ ID NO: 204305 - DNA, 25 bp, Rattus norvegicus
atgtttcagggcactgcgagtctcc

SEQ ID NO: 204306 - DNA, 25 bp, Rattus norvegicus
atgtttcagggctctgcgagtctcc

SEQ ID NO: 204307 - DNA, 25 bp, Rattus norvegicus
atgtttcagtccacttgatcatccg

SEQ ID NO: 204308 - DNA, 25 bp, Rattus norvegicus
atgtttcagtcctcttgatcatccg

SEQ ID NO: 204309 - DNA, 25 bp, Rattus norvegicus
atgtttcagtgacatttaatcaggt

SEQ ID NO: 204310 - DNA, 25 bp, Rattus norvegicus
atgtttcagtgagatttaatcaggt

SEQ ID NO: 204311 - DNA, 25 bp, Rattus norvegicus
atgtttcagtgcagcatggtcacta

SEQ ID NO: 204312 - DNA, 25 bp, Rattus norvegicus
atgtttcagtgctgcatggtcacta

SEQ ID NO: 204313 - DNA, 25 bp, Rattus norvegicus
atgtttcatcagcatagactgtgga

SEQ ID NO: 204314 - DNA, 25 bp, Rattus norvegicus
atgtttcatcaggatagactgtgga

SEQ ID NO: 204315 - DNA, 25 bp, Rattus norvegicus
atgtttcatggcatctacctcaaaa

SEQ ID NO: 204316 - DNA, 25 bp, Rattus norvegicus
atgtttcatggcttctacctcaaaa

SEQ ID NO: 204317 - DNA, 25 bp, Rattus norvegicus
atgtttccaactctacaggctctct

SEQ ID NO: 204318 - DNA, 25 bp, Rattus norvegicus
atgtttccaactgtacaggctctct

SEQ ID NO: 204319 - DNA, 25 bp, Rattus norvegicus
atgtttccatccatataccgcaact

SEQ ID NO: 204320 - DNA, 25 bp, Rattus norvegicus
atgtttccatccttataccgcaact

SEQ ID NO: 204321 - DNA, 25 bp, Rattus norvegicus
atgtttccatggatttgcctttggg

SEQ ID NO: 204322 - DNA, 25 bp, Rattus norvegicus
atgtttccatggttttgcctttggg

SEQ ID NO: 204323 - DNA, 25 bp, Rattus norvegicus
atgtttcccagtcatctgttggtta

SEQ ID NO: 204324 - DNA, 25 bp, Rattus norvegicus
atgtttcccagtgatctgttggtta

SEQ ID NO: 204325 - DNA, 25 bp, Rattus norvegicus
atgtttcccatgctgttctcaggaa

SEQ ID NO: 204326 - DNA, 25 bp, Rattus norvegicus
atgtttcccatggtgttctcaggaa

SEQ ID NO: 204327 - DNA, 25 bp, Rattus norvegicus
atgtttcccgtaatcatgtttcaaa

SEQ ID NO: 204328 - DNA, 25 bp, Rattus norvegicus
atgtttcccgtattcatgtttcaaa

SEQ ID NO: 204329 - DNA, 25 bp, Rattus norvegicus
atgtttcctcaaatcattggtcttt

SEQ ID NO: 204330 - DNA, 25 bp, Rattus norvegicus
atgtttcctcaattcattggtcttt

SEQ ID NO: 204331 - DNA, 25 bp, Rattus norvegicus
atgtttcctccgcatgtatcttttc

SEQ ID NO: 204332 - DNA, 25 bp, Rattus norvegicus
atgtttcctccggatgtatcttttc

SEQ ID NO: 204333 - DNA, 25 bp, Rattus norvegicus
atgtttcctggcatcatctgtatat

SEQ ID NO: 204334 - DNA, 25 bp, Rattus norvegicus
atgtttcctggcttcatctgtatat

SEQ ID NO: 204335 - DNA, 25 bp, Rattus norvegicus
atgtttccttagactctgatggtag

SEQ ID NO: 204336 - DNA, 25 bp, Rattus norvegicus
atgtttccttagtctctgatggtag

SEQ ID NO: 204337 - DNA, 25 bp, Rattus norvegicus
atgtttccttcacagggataccctg

SEQ ID NO: 204338 - DNA, 25 bp, Rattus norvegicus
atgtttccttcagagggataccctg

SEQ ID NO: 204339 - DNA, 25 bp, Rattus norvegicus
atgtttcgacatctgtgctgttgta

SEQ ID NO: 204340 - DNA, 25 bp, Rattus norvegicus
atgtttcgacatgtgtgctgttgta

SEQ ID NO: 204341 - DNA, 25 bp, Rattus norvegicus
atgtttcggctcagcttggtgctgc

SEQ ID NO: 204342 - DNA, 25 bp, Rattus norvegicus
atgtttcggctctgcttggtgctgc

SEQ ID NO: 204343 - DNA, 25 bp, Rattus norvegicus
atgtttcggtacagtgttttcactc

SEQ ID NO: 204344 - DNA, 25 bp, Rattus norvegicus
atgtttcggtactgtgttttcactc

SEQ ID NO: 204345 - DNA, 25 bp, Rattus norvegicus
atgtttctaactctgtgcaatggta

SEQ ID NO: 204346 - DNA, 25 bp, Rattus norvegicus
atgtttctaactgtgtgcaatggta

SEQ ID NO: 204347 - DNA, 25 bp, Rattus norvegicus
atgtttctactaacctgtactgcag

SEQ ID NO: 204348 - DNA, 25 bp, Rattus norvegicus
atgtttctactatcctgtactgcag

SEQ ID NO: 204349 - DNA, 25 bp, Rattus norvegicus
atgtttctacttacatggctgtgag

SEQ ID NO: 204350 - DNA, 25 bp, Rattus norvegicus
atgtttctactttcatggctgtgag

SEQ ID NO: 204351 - DNA, 25 bp, Rattus norvegicus
atgtttctatacaccttctcctact

SEQ ID NO: 204352 - DNA, 25 bp, Rattus norvegicus
atgtttctatactccttctcctact

SEQ ID NO: 204353 - DNA, 25 bp, Rattus norvegicus
atgtttctcaaaacctgatggtcag

SEQ ID NO: 204354 - DNA, 25 bp, Rattus norvegicus
atgtttctcaaaatggcctcttacc

SEQ ID NO: 204355 - DNA, 25 bp, Rattus norvegicus
atgtttctcaaatcctgatggtcag

SEQ ID NO: 204356 - DNA, 25 bp, Rattus norvegicus
atgtttctcaaattggcctcttacc

SEQ ID NO: 204357 - DNA, 25 bp, Rattus norvegicus
atgtttctcatccttcaatatgcag

SEQ ID NO: 204358 - DNA, 25 bp, Rattus norvegicus
atgtttctcatcgttcaatatgcag

SEQ ID NO: 204359 - DNA, 25 bp, Rattus norvegicus
atgtttctcatgatgcacccctggt

SEQ ID NO: 204360 - DNA, 25 bp, Rattus norvegicus
atgtttctcatgttgcacccctggt

SEQ ID NO: 204361 - DNA, 25 bp, Rattus norvegicus
atgtttctccagaattacctcaacg

SEQ ID NO: 204362 - DNA, 25 bp, Rattus norvegicus
atgtttctccagtattacctcaacg

SEQ ID NO: 204363 - DNA, 25 bp, Rattus norvegicus
atgtttctcgatcagctaagtgcag

SEQ ID NO: 204364 - DNA, 25 bp, Rattus norvegicus
atgtttctcgatgagctaagtgcag

SEQ ID NO: 204365 - DNA, 25 bp, Rattus norvegicus
atgtttctctacaggcattagcttg

SEQ ID NO: 204366 - DNA, 25 bp, Rattus norvegicus
atgtttctctactggcattagcttg

SEQ ID NO: 204367 - DNA, 25 bp, Rattus norvegicus
atgtttctcttcatcatctcgtcct

SEQ ID NO: 204368 - DNA, 25 bp, Rattus norvegicus
atgtttctcttcttcatctcgtcct

SEQ ID NO: 204369 - DNA, 25 bp, Rattus norvegicus
atgtttctcttgctcacacggcaga

SEQ ID NO: 204370 - DNA, 25 bp, Rattus norvegicus
atgtttctcttggtcacacggcaga

SEQ ID NO: 204371 - DNA, 25 bp, Rattus norvegicus
atgtttctggaactcacactcgcca

SEQ ID NO: 204372 - DNA, 25 bp, Rattus norvegicus
atgtttctggaagtcacactcgcca

SEQ ID NO: 204373 - DNA, 25 bp, Rattus norvegicus
atgtttctgggcactggtgggaatc

SEQ ID NO: 204374 - DNA, 25 bp, Rattus norvegicus
atgtttctgggctctggtgggaatc

SEQ ID NO: 204375 - DNA, 25 bp, Rattus norvegicus
atgtttctggtcatcgggatgtcaa

SEQ ID NO: 204376 - DNA, 25 bp, Rattus norvegicus
atgtttctggtcttcgggatgtcaa

SEQ ID NO: 204377 - DNA, 25 bp, Rattus norvegicus
atgtttctgtagagcccttaactca

SEQ ID NO: 204378 - DNA, 25 bp, Rattus norvegicus
atgtttctgtagtgcccttaactca

SEQ ID NO: 204379 - DNA, 25 bp, Rattus norvegicus
atgtttcttaagatgtcagtcacct

SEQ ID NO: 204380 - DNA, 25 bp, Rattus norvegicus
atgtttcttaagttgtcagtcacct

SEQ ID NO: 204381 - DNA, 25 bp, Rattus norvegicus
atgtttcttaatctgttgtcttttc

SEQ ID NO: 204382 - DNA, 25 bp, Rattus norvegicus
atgtttcttaatgtgttgtcttttc

SEQ ID NO: 204383 - DNA, 25 bp, Rattus norvegicus
atgtttcttggcacaagactctgcc

SEQ ID NO: 204384 - DNA, 25 bp, Rattus norvegicus
atgtttcttggctcaagactctgcc

SEQ ID NO: 204385 - DNA, 25 bp, Rattus norvegicus
atgtttcttgtcatgtgctgcttgt

SEQ ID NO: 204386 - DNA, 25 bp, Rattus norvegicus
atgtttcttgtcttgtgctgcttgt

SEQ ID NO: 204387 - DNA, 25 bp, Rattus norvegicus
atgtttcttgttagtccatcctttt

SEQ ID NO: 204388 - DNA, 25 bp, Rattus norvegicus
atgtttcttgtttgtccatcctttt

SEQ ID NO: 204389 - DNA, 25 bp, Rattus norvegicus
atgtttctttaccttagtttgcaat

SEQ ID NO: 204390 - DNA, 25 bp, Rattus norvegicus
atgtttctttacgttagtttgcaat

SEQ ID NO: 204391 - DNA, 25 bp, Rattus norvegicus
atgtttctttccctatcttctgtca

SEQ ID NO: 204392 - DNA, 25 bp, Rattus norvegicus
atgtttctttccgtatcttctgtca

SEQ ID NO: 204393 - DNA, 25 bp, Rattus norvegicus
atgtttgaaagcacaccgggtggca

SEQ ID NO: 204394 - DNA, 25 bp, Rattus norvegicus
atgtttgaaagctcaccgggtggca

SEQ ID NO: 204395 - DNA, 25 bp, Rattus norvegicus
atgtttgaatggatttggctatgcc

SEQ ID NO: 204396 - DNA, 25 bp, Rattus norvegicus
atgtttgaatggttttggctatgcc

SEQ ID NO: 204397 - DNA, 25 bp, Rattus norvegicus
atgtttgaatgtctactgagttttt

SEQ ID NO: 204398 - DNA, 25 bp, Rattus norvegicus
atgtttgaatgtgtactgagttttt

SEQ ID NO: 204399 - DNA, 25 bp, Rattus norvegicus
atgtttgagatgctgcctccttgct

SEQ ID NO: 204400 - DNA, 25 bp, Rattus norvegicus
atgtttgagatggtgcctccttgct

SEQ ID NO: 204401 - DNA, 25 bp, Rattus norvegicus
atgtttgatgcgctgagtttaccct

SEQ ID NO: 204402 - DNA, 25 bp, Rattus norvegicus
atgtttgatgcggtgagtttaccct

SEQ ID NO: 204403 - DNA, 25 bp, Rattus norvegicus
atgtttgcaaatatggcctctagaa

SEQ ID NO: 204404 - DNA, 25 bp, Rattus norvegicus
atgtttgcaaatattgccgcccgtt

SEQ ID NO: 204405 - DNA, 25 bp, Rattus norvegicus
atgtttgcaaatctcctgtctttta

SEQ ID NO: 204406 - DNA, 25 bp, Rattus norvegicus
atgtttgcaaatgtcctgtctttta

SEQ ID NO: 204407 - DNA, 25 bp, Rattus norvegicus
atgtttgcaaatttggcctctagaa

SEQ ID NO: 204408 - DNA, 25 bp, Rattus norvegicus
atgtttgcaaattttgccgcccgtt

SEQ ID NO: 204409 - DNA, 25 bp, Rattus norvegicus
atgtttgcagataacccctttaaag

SEQ ID NO: 204410 - DNA, 25 bp, Rattus norvegicus
atgtttgcagattacccctttaaag

SEQ ID NO: 204411 - DNA, 25 bp, Rattus norvegicus
atgtttgcaggcatacttgcttgct

SEQ ID NO: 204412 - DNA, 25 bp, Rattus norvegicus
atgtttgcaggcttacttgcttgct

SEQ ID NO: 204413 - DNA, 25 bp, Rattus norvegicus
atgtttgcataaccccaggaaccca

SEQ ID NO: 204414 - DNA, 25 bp, Rattus norvegicus
atgtttgcataagcccaggaaccca

SEQ ID NO: 204415 - DNA, 25 bp, Rattus norvegicus
atgtttgcatctctgtccttcgaaa

SEQ ID NO: 204416 - DNA, 25 bp, Rattus norvegicus
atgtttgcatctgtgtccttcgaaa

SEQ ID NO: 204417 - DNA, 25 bp, Rattus norvegicus
atgtttgccacaatctttgctttgt

SEQ ID NO: 204418 - DNA, 25 bp, Rattus norvegicus
atgtttgccacattctttgctttgt

SEQ ID NO: 204419 - DNA, 25 bp, Rattus norvegicus
atgtttgccgtgagcattcttgtgc

SEQ ID NO: 204420 - DNA, 25 bp, Rattus norvegicus
atgtttgccgtgtgcattcttgtgc

SEQ ID NO: 204421 - DNA, 25 bp, Rattus norvegicus
atgtttgcgggaatgggcgacccct

SEQ ID NO: 204422 - DNA, 25 bp, Rattus norvegicus
atgtttgcgggattgggcgacccct

SEQ ID NO: 204423 - DNA, 25 bp, Rattus norvegicus
atgtttgctaatagggctacaggcc

SEQ ID NO: 204424 - DNA, 25 bp, Rattus norvegicus
atgtttgctaattgggctacaggcc

SEQ ID NO: 204425 - DNA, 25 bp, Rattus norvegicus
atgtttgctctcatagtttctttat

SEQ ID NO: 204426 - DNA, 25 bp, Rattus norvegicus
atgtttgctctcctgggcagcgtgt

SEQ ID NO: 204427 - DNA, 25 bp, Rattus norvegicus
atgtttgctctcgtgggcagcgtgt

SEQ ID NO: 204428 - DNA, 25 bp, Rattus norvegicus
atgtttgctctcttagtttctttat

SEQ ID NO: 204429 - DNA, 25 bp, Rattus norvegicus
atgtttgctcttcatgcatctgtaa

SEQ ID NO: 204430 - DNA, 25 bp, Rattus norvegicus
atgtttgctcttgatgcatctgtaa

SEQ ID NO: 204431 - DNA, 25 bp, Rattus norvegicus
atgtttgctgagaaacctgttccac

SEQ ID NO: 204432 - DNA, 25 bp, Rattus norvegicus
atgtttgctgagtaacctgttccac

SEQ ID NO: 204433 - DNA, 25 bp, Rattus norvegicus
atgtttgctgatctgtgccgagtga

SEQ ID NO: 204434 - DNA, 25 bp, Rattus norvegicus
atgtttgctgatgtgtgccgagtga

SEQ ID NO: 204435 - DNA, 25 bp, Rattus norvegicus
atgtttgctgtgaacttgacctccc

SEQ ID NO: 204436 - DNA, 25 bp, Rattus norvegicus
atgtttgctgtgtacttgacctccc

SEQ ID NO: 204437 - DNA, 25 bp, Rattus norvegicus
atgtttgcttttcgcagcactcact

SEQ ID NO: 204438 - DNA, 25 bp, Rattus norvegicus
atgtttgcttttggcagcactcact

SEQ ID NO: 204439 - DNA, 25 bp, Rattus norvegicus
atgtttggagccatgtcctctcaga

SEQ ID NO: 204440 - DNA, 25 bp, Rattus norvegicus
atgtttggagccttgtcctctcaga

SEQ ID NO: 204441 - DNA, 25 bp, Rattus norvegicus
atgtttggcaagaaatcccctgatt

SEQ ID NO: 204442 - DNA, 25 bp, Rattus norvegicus
atgtttggcaagtaatcccctgatt

SEQ ID NO: 204443 - DNA, 25 bp, Rattus norvegicus
atgtttggcatcacggtctcgcagg

SEQ ID NO: 204444 - DNA, 25 bp, Rattus norvegicus
atgtttggcatctcggtctcgcagg

SEQ ID NO: 204445 - DNA, 25 bp, Rattus norvegicus
atgtttggccagcttcgggatcagt

SEQ ID NO: 204446 - DNA, 25 bp, Rattus norvegicus
atgtttggccaggttcgggatcagt

SEQ ID NO: 204447 - DNA, 25 bp, Rattus norvegicus
atgtttggcttgctgatcttttgga

SEQ ID NO: 204448 - DNA, 25 bp, Rattus norvegicus
atgtttggcttggtgatcttttgga

SEQ ID NO: 204449 - DNA, 25 bp, Rattus norvegicus
atgtttgggcctctgccaatgccag

SEQ ID NO: 204450 - DNA, 25 bp, Rattus norvegicus
atgtttgggcctgtgccaatgccag

SEQ ID NO: 204451 - DNA, 25 bp, Rattus norvegicus
atgtttggtccacatcaggttcctg

SEQ ID NO: 204452 - DNA, 25 bp, Rattus norvegicus
atgtttggtccagatcaggttcctg

SEQ ID NO: 204453 - DNA, 25 bp, Rattus norvegicus
atgtttggtttgaacagactttgac

SEQ ID NO: 204454 - DNA, 25 bp, Rattus norvegicus
atgtttggtttgtacagactttgac

SEQ ID NO: 204455 - DNA, 25 bp, Rattus norvegicus
atgtttgtaatgactggccctgcac

SEQ ID NO: 204456 - DNA, 25 bp, Rattus norvegicus
atgtttgtaatgtctggccctgcac

SEQ ID NO: 204457 - DNA, 25 bp, Rattus norvegicus
atgtttgtagtcaacagttcacaca

SEQ ID NO: 204458 - DNA, 25 bp, Rattus norvegicus
atgtttgtagtctacagttcacaca

SEQ ID NO: 204459 - DNA, 25 bp, Rattus norvegicus
atgtttgtatataggcacacgcccc

SEQ ID NO: 204460 - DNA, 25 bp, Rattus norvegicus
atgtttgtatattggcacacgcccc

SEQ ID NO: 204461 - DNA, 25 bp, Rattus norvegicus
atgtttgtcaccaatgagcagctca

SEQ ID NO: 204462 - DNA, 25 bp, Rattus norvegicus
atgtttgtcacctatgagcagctca

SEQ ID NO: 204463 - DNA, 25 bp, Rattus norvegicus
atgtttgtcatactggcctttcagc

SEQ ID NO: 204464 - DNA, 25 bp, Rattus norvegicus
atgtttgtcatagtggcctttcagc

SEQ ID NO: 204465 - DNA, 25 bp, Rattus norvegicus
atgtttgtcgccacgatgggcatga

SEQ ID NO: 204466 - DNA, 25 bp, Rattus norvegicus
atgtttgtcgcctcgatgggcatga

SEQ ID NO: 204467 - DNA, 25 bp, Rattus norvegicus
atgtttgtcttgagaccatgtgctt

SEQ ID NO: 204468 - DNA, 25 bp, Rattus norvegicus
atgtttgtcttgtgaccatgtgctt

SEQ ID NO: 204469 - DNA, 25 bp, Rattus norvegicus
atgtttgtgaacagtcttgtggatg

SEQ ID NO: 204470 - DNA, 25 bp, Rattus norvegicus
atgtttgtgaactgtcttgtggatg

SEQ ID NO: 204471 - DNA, 25 bp, Rattus norvegicus
atgtttgtgagcaacagacccatgg

SEQ ID NO: 204472 - DNA, 25 bp, Rattus norvegicus
atgtttgtgagctacagacccatgg

SEQ ID NO: 204473 - DNA, 25 bp, Rattus norvegicus
atgtttgtgcttattcttgtgtgaa

SEQ ID NO: 204474 - DNA, 25 bp, Rattus norvegicus
atgtttgtgctttttcttgtgtgaa

SEQ ID NO: 204475 - DNA, 25 bp, Rattus norvegicus
atgtttgtgtccacccacagtacac

SEQ ID NO: 204476 - DNA, 25 bp, Rattus norvegicus
atgtttgtgtcctcccacagtacac

SEQ ID NO: 204477 - DNA, 25 bp, Rattus norvegicus
atgtttgtgtggagtcagtgtgcta

SEQ ID NO: 204478 - DNA, 25 bp, Rattus norvegicus
atgtttgtgtggtgtcagtgtgcta

SEQ ID NO: 204479 - DNA, 25 bp, Rattus norvegicus
atgtttgttctcactactaatggtg

SEQ ID NO: 204480 - DNA, 25 bp, Rattus norvegicus
atgtttgttctctctactaatggtg

SEQ ID NO: 204481 - DNA, 25 bp, Rattus norvegicus
atgtttgtttccctccagtgtgtca

SEQ ID NO: 204482 - DNA, 25 bp, Rattus norvegicus
atgtttgtttccgtccagtgtgtca

SEQ ID NO: 204483 - DNA, 25 bp, Rattus norvegicus
atgtttgtttctatcacagcaaata

SEQ ID NO: 204484 - DNA, 25 bp, Rattus norvegicus
atgtttgtttctttcacagcaaata

SEQ ID NO: 204485 - DNA, 25 bp, Rattus norvegicus
atgttttaagcactttctgaggcaa

SEQ ID NO: 204486 - DNA, 25 bp, Rattus norvegicus
atgttttaagcagtttctgaggcaa

SEQ ID NO: 204487 - DNA, 25 bp, Rattus norvegicus
atgttttacaacactgtactcccac

SEQ ID NO: 204488 - DNA, 25 bp, Rattus norvegicus
atgttttacaactctgtactcccac

SEQ ID NO: 204489 - DNA, 25 bp, Rattus norvegicus
atgttttacaatattgctttgctaa

SEQ ID NO: 204490 - DNA, 25 bp, Rattus norvegicus
atgttttacaattttgctttgctaa

SEQ ID NO: 204491 - DNA, 25 bp, Rattus norvegicus
atgttttagacaatcttacttgaag

SEQ ID NO: 204492 - DNA, 25 bp, Rattus norvegicus
atgttttagacattcttacttgaag

SEQ ID NO: 204493 - DNA, 25 bp, Rattus norvegicus
atgttttattgcatcccatttggga

SEQ ID NO: 204494 - DNA, 25 bp, Rattus norvegicus
atgttttattgcttcccatttggga

SEQ ID NO: 204495 - DNA, 25 bp, Rattus norvegicus
atgttttcaacaagtacacttcaaa

SEQ ID NO: 204496 - DNA, 25 bp, Rattus norvegicus
atgttttcaacatgtacacttcaaa

SEQ ID NO: 204497 - DNA, 25 bp, Rattus norvegicus
atgttttcaactaacccttcaagag

SEQ ID NO: 204498 - DNA, 25 bp, Rattus norvegicus
atgttttcaacttacccttcaagag

SEQ ID NO: 204499 - DNA, 25 bp, Rattus norvegicus
atgttttcaagaacagcttttcctg

SEQ ID NO: 204500 - DNA, 25 bp, Rattus norvegicus
atgttttcaagatcagcttttcctg

SEQ ID NO: 204501 - DNA, 25 bp, Rattus norvegicus
atgttttcacagacctttgtctaga

SEQ ID NO: 204502 - DNA, 25 bp, Rattus norvegicus
atgttttcacagtcctttgtctaga

SEQ ID NO: 204503 - DNA, 25 bp, Rattus norvegicus
atgttttcactcagcaagtcccaag

SEQ ID NO: 204504 - DNA, 25 bp, Rattus norvegicus
atgttttcactctgcaagtcccaag

SEQ ID NO: 204505 - DNA, 25 bp, Rattus norvegicus
atgttttcagacagagctcggctca

SEQ ID NO: 204506 - DNA, 25 bp, Rattus norvegicus
atgttttcagactgagctcggctca

SEQ ID NO: 204507 - DNA, 25 bp, Rattus norvegicus
atgttttcatatctaccggttgggt

SEQ ID NO: 204508 - DNA, 25 bp, Rattus norvegicus
atgttttcatatgtaccggttgggt

SEQ ID NO: 204509 - DNA, 25 bp, Rattus norvegicus
atgttttcatgactgatcgctggta

SEQ ID NO: 204510 - DNA, 25 bp, Rattus norvegicus
atgttttcatgagtgatcgctggta

SEQ ID NO: 204511 - DNA, 25 bp, Rattus norvegicus
atgttttcatgcatgatccctggat

SEQ ID NO: 204512 - DNA, 25 bp, Rattus norvegicus
atgttttcatgcttgatccctggat

SEQ ID NO: 204513 - DNA, 25 bp, Rattus norvegicus
atgttttccacaccaatggccatca

SEQ ID NO: 204514 - DNA, 25 bp, Rattus norvegicus
atgttttccacagcaatggccatca

SEQ ID NO: 204515 - DNA, 25 bp, Rattus norvegicus
atgttttcccaccttaagcgagaga

SEQ ID NO: 204516 - DNA, 25 bp, Rattus norvegicus
atgttttcccacgttaagcgagaga

SEQ ID NO: 204517 - DNA, 25 bp, Rattus norvegicus
atgttttcccagacttccttggaga

SEQ ID NO: 204518 - DNA, 25 bp, Rattus norvegicus
atgttttcccagtcttccttggaga

SEQ ID NO: 204519 - DNA, 25 bp, Rattus norvegicus
atgttttcccgcatgacttttcagt

SEQ ID NO: 204520 - DNA, 25 bp, Rattus norvegicus
atgttttcccgcttgacttttcagt

SEQ ID NO: 204521 - DNA, 25 bp, Rattus norvegicus
atgttttccctccagatgtgtgtta

SEQ ID NO: 204522 - DNA, 25 bp, Rattus norvegicus
atgttttccctcgagatgtgtgtta

SEQ ID NO: 204523 - DNA, 25 bp, Rattus norvegicus
atgttttcccttagctatttgccaa

SEQ ID NO: 204524 - DNA, 25 bp, Rattus norvegicus
atgttttccctttgctatttgccaa

SEQ ID NO: 204525 - DNA, 25 bp, Rattus norvegicus
atgttttccttcatgcaagtgcctg

SEQ ID NO: 204526 - DNA, 25 bp, Rattus norvegicus
atgttttccttcttgcaagtgcctg

SEQ ID NO: 204527 - DNA, 25 bp, Rattus norvegicus
atgttttctcagctctaaggcttgt

SEQ ID NO: 204528 - DNA, 25 bp, Rattus norvegicus
atgttttctcaggtctaaggcttgt

SEQ ID NO: 204529 - DNA, 25 bp, Rattus norvegicus
atgttttctcatagcacttttggtg

SEQ ID NO: 204530 - DNA, 25 bp, Rattus norvegicus
atgttttctcattgcacttttggtg

SEQ ID NO: 204531 - DNA, 25 bp, Rattus norvegicus
atgttttctgacaactgtgcctatt

SEQ ID NO: 204532 - DNA, 25 bp, Rattus norvegicus
atgttttctgactactgtgcctatt

SEQ ID NO: 204533 - DNA, 25 bp, Rattus norvegicus
atgttttcttggattgttgtcttta

SEQ ID NO: 204534 - DNA, 25 bp, Rattus norvegicus
atgttttcttggtttgttgtcttta

SEQ ID NO: 204535 - DNA, 25 bp, Rattus norvegicus
atgttttcttttctaaggcatcaat

SEQ ID NO: 204536 - DNA, 25 bp, Rattus norvegicus
atgttttcttttgtaaggcatcaat

SEQ ID NO: 204537 - DNA, 25 bp, Rattus norvegicus
atgttttgagttaagcgcgcttgtc

SEQ ID NO: 204538 - DNA, 25 bp, Rattus norvegicus
atgttttgagtttagcgcgcttgtc

SEQ ID NO: 204539 - DNA, 25 bp, Rattus norvegicus
atgttttgatctctagttcctgaaa

SEQ ID NO: 204540 - DNA, 25 bp, Rattus norvegicus
atgttttgatctgtagttcctgaaa

SEQ ID NO: 204541 - DNA, 25 bp, Rattus norvegicus
atgttttgccatatcctctaaaccc

SEQ ID NO: 204542 - DNA, 25 bp, Rattus norvegicus
atgttttgccatttcctctaaaccc

SEQ ID NO: 204543 - DNA, 25 bp, Rattus norvegicus
atgttttggatgcttagcttgccta

SEQ ID NO: 204544 - DNA, 25 bp, Rattus norvegicus
atgttttggatggttagcttgccta

SEQ ID NO: 204545 - DNA, 25 bp, Rattus norvegicus
atgttttggcatacatcctaccact

SEQ ID NO: 204546 - DNA, 25 bp, Rattus norvegicus
atgttttggcattcatcctaccact

SEQ ID NO: 204547 - DNA, 25 bp, Rattus norvegicus
atgttttgtcatatcttctctgcac

SEQ ID NO: 204548 - DNA, 25 bp, Rattus norvegicus
atgttttgtcatctcgcaaccagaa

SEQ ID NO: 204549 - DNA, 25 bp, Rattus norvegicus
atgttttgtcatgtcgcaaccagaa

SEQ ID NO: 204550 - DNA, 25 bp, Rattus norvegicus
atgttttgtcatttcttctctgcac

SEQ ID NO: 204551 - DNA, 25 bp, Rattus norvegicus
atgttttgtgccagatttaccatct

SEQ ID NO: 204552 - DNA, 25 bp, Rattus norvegicus
atgttttgtgcctgatttaccatct

SEQ ID NO: 204553 - DNA, 25 bp, Rattus norvegicus
atgttttgttgtatgctctctttcc

SEQ ID NO: 204554 - DNA, 25 bp, Rattus norvegicus
atgttttgttgtttgctctctttcc

SEQ ID NO: 204555 - DNA, 25 bp, Rattus norvegicus
atgtttttcactagatgctattata

SEQ ID NO: 204556 - DNA, 25 bp, Rattus norvegicus
atgtttttcacttgatgctattata

SEQ ID NO: 204557 - DNA, 25 bp, Rattus norvegicus
atgtttttcattctgacttgttgtc

SEQ ID NO: 204558 - DNA, 25 bp, Rattus norvegicus
atgtttttcattgtgacttgttgtc

SEQ ID NO: 204559 - DNA, 25 bp, Rattus norvegicus
atgtttttcctgcatcctttttcaa

SEQ ID NO: 204560 - DNA, 25 bp, Rattus norvegicus
atgtttttcctggatcctttttcaa

SEQ ID NO: 204561 - DNA, 25 bp, Rattus norvegicus
atgtttttgaggatggtgtcccatc

SEQ ID NO: 204562 - DNA, 25 bp, Rattus norvegicus
atgtttttgaggttggtgtcccatc

SEQ ID NO: 204563 - DNA, 25 bp, Rattus norvegicus
atgtttttggctcctagaaccctct

SEQ ID NO: 204564 - DNA, 25 bp, Rattus norvegicus
atgtttttggctgctagaaccctct

SEQ ID NO: 204565 - DNA, 25 bp, Rattus norvegicus
atgtttttgggaaaagtcctgctca

SEQ ID NO: 204566 - DNA, 25 bp, Rattus norvegicus
atgtttttgggataagtcctgctca

SEQ ID NO: 204567 - DNA, 25 bp, Rattus norvegicus
atgttttttaacagcccatatctac

SEQ ID NO: 204568 - DNA, 25 bp, Rattus norvegicus
atgttttttaactgcccatatctac

SEQ ID NO: 204569 - DNA, 25 bp, Rattus norvegicus
atgttttttcccaatatactgatta

SEQ ID NO: 204570 - DNA, 25 bp, Rattus norvegicus
atgttttttccctatatactgatta

SEQ ID NO: 204571 - DNA, 25 bp, Rattus norvegicus
attaaaaacgctccagctgcctctg

SEQ ID NO: 204572 - DNA, 25 bp, Rattus norvegicus
attaaaaacgctgcagctgcctctg

SEQ ID NO: 204573 - DNA, 25 bp, Rattus norvegicus
attaaaaccacccacattataagca

SEQ ID NO: 204574 - DNA, 25 bp, Rattus norvegicus
attaaaaccaccgacattataagca

SEQ ID NO: 204575 - DNA, 25 bp, Rattus norvegicus
attaaaaggcagacattgggctgga

SEQ ID NO: 204576 - DNA, 25 bp, Rattus norvegicus
attaaaaggcagtcattgggctgga

SEQ ID NO: 204577 - DNA, 25 bp, Rattus norvegicus
attaaaagtgtcacatctcagcccg

SEQ ID NO: 204578 - DNA, 25 bp, Rattus norvegicus
attaaaagtgtctcatctcagcccg

SEQ ID NO: 204579 - DNA, 25 bp, Rattus norvegicus
attaaaataattctgcttccgtact

SEQ ID NO: 204580 - DNA, 25 bp, Rattus norvegicus
attaaaataattgtgcttccgtact

SEQ ID NO: 204581 - DNA, 25 bp, Rattus norvegicus
attaaaatcactccaagcgtgcaat

SEQ ID NO: 204582 - DNA, 25 bp, Rattus norvegicus
attaaaatcactgcaagcgtgcaat

SEQ ID NO: 204583 - DNA, 25 bp, Rattus norvegicus
attaaaatgcttccctgcggattgg

SEQ ID NO: 204584 - DNA, 25 bp, Rattus norvegicus
attaaaatgcttgcctgcggattgg

SEQ ID NO: 204585 - DNA, 25 bp, Rattus norvegicus
attaaaatgtccaatcgctgccctt

SEQ ID NO: 204586 - DNA, 25 bp, Rattus norvegicus
attaaaatgtcctatcgctgccctt

SEQ ID NO: 204587 - DNA, 25 bp, Rattus norvegicus
attaaaatgtcgactgtactgcagc

SEQ ID NO: 204588 - DNA, 25 bp, Rattus norvegicus
attaaaatgtcgtctgtactgcagc

SEQ ID NO: 204589 - DNA, 25 bp, Rattus norvegicus
attaaaattactaaccatgctgggc

SEQ ID NO: 204590 - DNA, 25 bp, Rattus norvegicus
attaaaattacttaccatgctgggc

SEQ ID NO: 204591 - DNA, 25 bp, Rattus norvegicus
attaaaattcctagatgcgcctgct

SEQ ID NO: 204592 - DNA, 25 bp, Rattus norvegicus
attaaaattccttgatgcgcctgct

SEQ ID NO: 204593 - DNA, 25 bp, Rattus norvegicus
attaaacaactcaactctgtcctcc

SEQ ID NO: 204594 - DNA, 25 bp, Rattus norvegicus
attaaacaactctactctgtcctcc

SEQ ID NO: 204595 - DNA, 25 bp, Rattus norvegicus
attaaacactgactgtcctgtccag

SEQ ID NO: 204596 - DNA, 25 bp, Rattus norvegicus
attaaacactgagtgtcctgtccag

SEQ ID NO: 204597 - DNA, 25 bp, Rattus norvegicus
attaaacaggcaacgcccagtggcg

SEQ ID NO: 204598 - DNA, 25 bp, Rattus norvegicus
attaaacaggcatcgcccagtggcg

SEQ ID NO: 204599 - DNA, 25 bp, Rattus norvegicus
attaaacattaactcccatactcct

SEQ ID NO: 204600 - DNA, 25 bp, Rattus norvegicus
attaaacattaagtcccatactcct

SEQ ID NO: 204601 - DNA, 25 bp, Rattus norvegicus
attaaaccattaaaggctccatcgg

SEQ ID NO: 204602 - DNA, 25 bp, Rattus norvegicus
attaaaccattataggctccatcgg

SEQ ID NO: 204603 - DNA, 25 bp, Rattus norvegicus
attaaaccctggctgttacttctca

SEQ ID NO: 204604 - DNA, 25 bp, Rattus norvegicus
attaaaccctgggtgttacttctca

SEQ ID NO: 204605 - DNA, 25 bp, Rattus norvegicus
attaaacctaccagcaagcaatttg

SEQ ID NO: 204606 - DNA, 25 bp, Rattus norvegicus
attaaacctacctgcaagcaatttg

SEQ ID NO: 204607 - DNA, 25 bp, Rattus norvegicus
attaaacctcatccgagatcatgga

SEQ ID NO: 204608 - DNA, 25 bp, Rattus norvegicus
attaaacctcatgcgagatcatgga

SEQ ID NO: 204609 - DNA, 25 bp, Rattus norvegicus
attaaacctcttagaccctgtagca

SEQ ID NO: 204610 - DNA, 25 bp, Rattus norvegicus
attaaacctctttgaccctgtagca

SEQ ID NO: 204611 - DNA, 25 bp, Rattus norvegicus
attaaacctggacgcggagcattac

SEQ ID NO: 204612 - DNA, 25 bp, Rattus norvegicus
attaaacctggaggcggagcattac

SEQ ID NO: 204613 - DNA, 25 bp, Rattus norvegicus
attaaacgggaaagtgtgctcgctc

SEQ ID NO: 204614 - DNA, 25 bp, Rattus norvegicus
attaaacgggaatgtgtgctcgctc

SEQ ID NO: 204615 - DNA, 25 bp, Rattus norvegicus
attaaactacctccttgtccaaaag

SEQ ID NO: 204616 - DNA, 25 bp, Rattus norvegicus
attaaactacctgcttgtccaaaag

SEQ ID NO: 204617 - DNA, 25 bp, Rattus norvegicus
attaaactatgacgccagtcaccag

SEQ ID NO: 204618 - DNA, 25 bp, Rattus norvegicus
attaaactatgaggccagtcaccag

SEQ ID NO: 204619 - DNA, 25 bp, Rattus norvegicus
attaaactccatcagctcacctcaa

SEQ ID NO: 204620 - DNA, 25 bp, Rattus norvegicus
attaaactccatgagctcacctcaa

SEQ ID NO: 204621 - DNA, 25 bp, Rattus norvegicus
attaaactggttagcctaagattgg

SEQ ID NO: 204622 - DNA, 25 bp, Rattus norvegicus
attaaactggtttgcctaagattgg

SEQ ID NO: 204623 - DNA, 25 bp, Rattus norvegicus
attaaactgtgtccggttccctggt

SEQ ID NO: 204624 - DNA, 25 bp, Rattus norvegicus
attaaactgtgtgcggttccctggt

SEQ ID NO: 204625 - DNA, 25 bp, Rattus norvegicus
attaaacttgtactcttcctgcctc

SEQ ID NO: 204626 - DNA, 25 bp, Rattus norvegicus
attaaacttgtagtcttcctgcctc

SEQ ID NO: 204627 - DNA, 25 bp, Rattus norvegicus
attaaagactttcccatgaccctag

SEQ ID NO: 204628 - DNA, 25 bp, Rattus norvegicus
attaaagactttgccatgaccctag

SEQ ID NO: 204629 - DNA, 25 bp, Rattus norvegicus
attaaagatgaacctgcagccctct

SEQ ID NO: 204630 - DNA, 25 bp, Rattus norvegicus
attaaagatgaagctgcagccctct

SEQ ID NO: 204631 - DNA, 25 bp, Rattus norvegicus
attaaagcaaccaggatgccccaaa

SEQ ID NO: 204632 - DNA, 25 bp, Rattus norvegicus
attaaagcaacctggatgccccaaa

SEQ ID NO: 204633 - DNA, 25 bp, Rattus norvegicus
attaaagcagggaatatcctcctca

SEQ ID NO: 204634 - DNA, 25 bp, Rattus norvegicus
attaaagcagggtatatcctcctca

SEQ ID NO: 204635 - DNA, 25 bp, Rattus norvegicus
attaaagccctgagttctctgcact

SEQ ID NO: 204636 - DNA, 25 bp, Rattus norvegicus
attaaagccctgtgttctctgcact

SEQ ID NO: 204637 - DNA, 25 bp, Rattus norvegicus
attaaaggacgcactggctggcctc

SEQ ID NO: 204638 - DNA, 25 bp, Rattus norvegicus
attaaaggacgctctggctggcctc

SEQ ID NO: 204639 - DNA, 25 bp, Rattus norvegicus
attaaaggaggcctgcaagcccctc

SEQ ID NO: 204640 - DNA, 25 bp, Rattus norvegicus
attaaaggaggcgtgcaagcccctc

SEQ ID NO: 204641 - DNA, 25 bp, Rattus norvegicus
attaaaggcttccacctcacatggc

SEQ ID NO: 204642 - DNA, 25 bp, Rattus norvegicus
attaaaggcttcgacctcacatggc

SEQ ID NO: 204643 - DNA, 25 bp, Rattus norvegicus
attaaagtcttaagccacctccgcc

SEQ ID NO: 204644 - DNA, 25 bp, Rattus norvegicus
attaaagtcttatgccacctccgcc

SEQ ID NO: 204645 - DNA, 25 bp, Rattus norvegicus
attaaataaccaagtcctccggcgt

SEQ ID NO: 204646 - DNA, 25 bp, Rattus norvegicus
attaaataaccatgtcctccggcgt

SEQ ID NO: 204647 - DNA, 25 bp, Rattus norvegicus
attaaatagctgaccttcacccgga

SEQ ID NO: 204648 - DNA, 25 bp, Rattus norvegicus
attaaatagctgtccttcacccgga

SEQ ID NO: 204649 - DNA, 25 bp, Rattus norvegicus
attaaatcaacgaggtcctcaggcc

SEQ ID NO: 204650 - DNA, 25 bp, Rattus norvegicus
attaaatcaacgtggtcctcaggcc

SEQ ID NO: 204651 - DNA, 25 bp, Rattus norvegicus
attaaatcagcacaagggcccggaa

SEQ ID NO: 204652 - DNA, 25 bp, Rattus norvegicus
attaaatcagcagaagggcccggaa

SEQ ID NO: 204653 - DNA, 25 bp, Rattus norvegicus
attaaatctgtcacccacaaggctc

SEQ ID NO: 204654 - DNA, 25 bp, Rattus norvegicus
attaaatctgtctcccacaaggctc

SEQ ID NO: 204655 - DNA, 25 bp, Rattus norvegicus
attaaatcttcaagtccccaggaca

SEQ ID NO: 204656 - DNA, 25 bp, Rattus norvegicus
attaaatcttcatgtccccaggaca

SEQ ID NO: 204657 - DNA, 25 bp, Rattus norvegicus
attaaatgctgtattccttatcccc

SEQ ID NO: 204658 - DNA, 25 bp, Rattus norvegicus
attaaatgctgttttccttatcccc

SEQ ID NO: 204659 - DNA, 25 bp, Rattus norvegicus
attaaatgttctccctatcctgttg

SEQ ID NO: 204660 - DNA, 25 bp, Rattus norvegicus
attaaatgttctgcctatcctgttg

SEQ ID NO: 204661 - DNA, 25 bp, Rattus norvegicus
attaaattccaacgcttcctcatcc

SEQ ID NO: 204662 - DNA, 25 bp, Rattus norvegicus
attaaattccaaggcttcctcatcc

SEQ ID NO: 204663 - DNA, 25 bp, Rattus norvegicus
attaaattccataaatccagaccag

SEQ ID NO: 204664 - DNA, 25 bp, Rattus norvegicus
attaaattccattaatccagaccag

SEQ ID NO: 204665 - DNA, 25 bp, Rattus norvegicus
attaaattcccaccagattcctact

SEQ ID NO: 204666 - DNA, 25 bp, Rattus norvegicus
attaaattcccagcagattcctact

SEQ ID NO: 204667 - DNA, 25 bp, Rattus norvegicus
attaaattctttcacagcctgccat

SEQ ID NO: 204668 - DNA, 25 bp, Rattus norvegicus
attaaattctttgacagcctgccat

SEQ ID NO: 204669 - DNA, 25 bp, Rattus norvegicus
attaacaagctccttaggcccctga

SEQ ID NO: 204670 - DNA, 25 bp, Rattus norvegicus
attaacaagctcgttaggcccctga

SEQ ID NO: 204671 - DNA, 25 bp, Rattus norvegicus
attaacacacgtcactaataagcgt

SEQ ID NO: 204672 - DNA, 25 bp, Rattus norvegicus
attaacacacgtgactaataagcgt

SEQ ID NO: 204673 - DNA, 25 bp, Rattus norvegicus
attaacacagacaggaagcaggcag

SEQ ID NO: 204674 - DNA, 25 bp, Rattus norvegicus
attaacacagactggaagcaggcag

SEQ ID NO: 204675 - DNA, 25 bp, Rattus norvegicus
attaacacagccaactcttgcaaat

SEQ ID NO: 204676 - DNA, 25 bp, Rattus norvegicus
attaacacagcctactcttgcaaat

SEQ ID NO: 204677 - DNA, 25 bp, Rattus norvegicus
attaacaccaccatccaggatgtca

SEQ ID NO: 204678 - DNA, 25 bp, Rattus norvegicus
attaacaccaccttccaggatgtca

SEQ ID NO: 204679 - DNA, 25 bp, Rattus norvegicus
attaacacccagacaggtggctgac

SEQ ID NO: 204680 - DNA, 25 bp, Rattus norvegicus
attaacacccagtcaggtggctgac

SEQ ID NO: 204681 - DNA, 25 bp, Rattus norvegicus
attaacactcggatgcattgcaagc

SEQ ID NO: 204682 - DNA, 25 bp, Rattus norvegicus
attaacactcggttgcattgcaagc

SEQ ID NO: 204683 - DNA, 25 bp, Rattus norvegicus
attaacactctgcaggagcgcctgg

SEQ ID NO: 204684 - DNA, 25 bp, Rattus norvegicus
attaacactctggaggagcgcctgg

SEQ ID NO: 204685 - DNA, 25 bp, Rattus norvegicus
attaacagacccatgggcgtctttg

SEQ ID NO: 204686 - DNA, 25 bp, Rattus norvegicus
attaacagacccttgggcgtctttg

SEQ ID NO: 204687 - DNA, 25 bp, Rattus norvegicus
attaacagacttctccgtctttgcc

SEQ ID NO: 204688 - DNA, 25 bp, Rattus norvegicus
attaacagacttgtccgtctttgcc

SEQ ID NO: 204689 - DNA, 25 bp, Rattus norvegicus
attaacagccaacctgtgcaacctg

SEQ ID NO: 204690 - DNA, 25 bp, Rattus norvegicus
attaacagccaagctgtgcaacctg

SEQ ID NO: 204691 - DNA, 25 bp, Rattus norvegicus
attaacagttgtcgagtgtgtcctc

SEQ ID NO: 204692 - DNA, 25 bp, Rattus norvegicus
attaacagttgtggagtgtgtcctc

SEQ ID NO: 204693 - DNA, 25 bp, Rattus norvegicus
attaacagttttatgcgatacagca

SEQ ID NO: 204694 - DNA, 25 bp, Rattus norvegicus
attaacagttttttgcgatacagca

SEQ ID NO: 204695 - DNA, 25 bp, Rattus norvegicus
attaacatcggaccgcagatgcctc

SEQ ID NO: 204696 - DNA, 25 bp, Rattus norvegicus
attaacatcggagcgcagatgcctc

SEQ ID NO: 204697 - DNA, 25 bp, Rattus norvegicus
attaacattgtcaggaagcactagg

SEQ ID NO: 204698 - DNA, 25 bp, Rattus norvegicus
attaacattgtctggaagcactagg

SEQ ID NO: 204699 - DNA, 25 bp, Rattus norvegicus
attaaccacctaagtgactggcctg

SEQ ID NO: 204700 - DNA, 25 bp, Rattus norvegicus
attaaccacctatgtgactggcctg

SEQ ID NO: 204701 - DNA, 25 bp, Rattus norvegicus
attaacccagctcgacatgggcctg

SEQ ID NO: 204702 - DNA, 25 bp, Rattus norvegicus
attaacccagctggacatgggcctg

SEQ ID NO: 204703 - DNA, 25 bp, Rattus norvegicus
attaacccgctcagaggtcgcattt

SEQ ID NO: 204704 - DNA, 25 bp, Rattus norvegicus
attaacccgctctgaggtcgcattt

SEQ ID NO: 204705 - DNA, 25 bp, Rattus norvegicus
attaaccctgtgacacccatgttgt

SEQ ID NO: 204706 - DNA, 25 bp, Rattus norvegicus
attaaccctgtgtcacccatgttgt

SEQ ID NO: 204707 - DNA, 25 bp, Rattus norvegicus
attaaccgacgtagtcagcgacaga

SEQ ID NO: 204708 - DNA, 25 bp, Rattus norvegicus
attaaccgacgttgtcagcgacaga

SEQ ID NO: 204709 - DNA, 25 bp, Rattus norvegicus
attaacctcatacctcagggtctcg

SEQ ID NO: 204710 - DNA, 25 bp, Rattus norvegicus
attaacctcatagctcagggtctcg

SEQ ID NO: 204711 - DNA, 25 bp, Rattus norvegicus
attaacctccatccctatatcactt

SEQ ID NO: 204712 - DNA, 25 bp, Rattus norvegicus
attaacctccatgcctatatcactt

SEQ ID NO: 204713 - DNA, 25 bp, Rattus norvegicus
attaacctctaaaagcctcagtctc

SEQ ID NO: 204714 - DNA, 25 bp, Rattus norvegicus
attaacctctaatagcctcagtctc

SEQ ID NO: 204715 - DNA, 25 bp, Rattus norvegicus
attaacctgcgaagcccacatgggc

SEQ ID NO: 204716 - DNA, 25 bp, Rattus norvegicus
attaacctgcgatgcccacatgggc

SEQ ID NO: 204717 - DNA, 25 bp, Rattus norvegicus
attaaccttgttactccagaaaatg

SEQ ID NO: 204718 - DNA, 25 bp, Rattus norvegicus
attaaccttgtttctccagaaaatg

SEQ ID NO: 204719 - DNA, 25 bp, Rattus norvegicus
attaacgaccatccagacatccctg

SEQ ID NO: 204720 - DNA, 25 bp, Rattus norvegicus
attaacgaccatgcagacatccctg

SEQ ID NO: 204721 - DNA, 25 bp, Rattus norvegicus
attaacgatgtgctccctctgggaa

SEQ ID NO: 204722 - DNA, 25 bp, Rattus norvegicus
attaacgatgtggtccctctgggaa

SEQ ID NO: 204723 - DNA, 25 bp, Rattus norvegicus
attaacgcatagctttaagcccagg

SEQ ID NO: 204724 - DNA, 25 bp, Rattus norvegicus
attaacgcataggtttaagcccagg

SEQ ID NO: 204725 - DNA, 25 bp, Rattus norvegicus
attaacgcgttcccagttgcagcga

SEQ ID NO: 204726 - DNA, 25 bp, Rattus norvegicus
attaacgcgttcgcagttgcagcga

SEQ ID NO: 204727 - DNA, 25 bp, Rattus norvegicus
attaacgctgtgagtgccttgcatg

SEQ ID NO: 204728 - DNA, 25 bp, Rattus norvegicus
attaacgctgtgtgtgccttgcatg

SEQ ID NO: 204729 - DNA, 25 bp, Rattus norvegicus
attaacggcttgatacagtgccaga

SEQ ID NO: 204730 - DNA, 25 bp, Rattus norvegicus
attaacggcttgttacagtgccaga

SEQ ID NO: 204731 - DNA, 25 bp, Rattus norvegicus
attaacgtctagatgttctatatta

SEQ ID NO: 204732 - DNA, 25 bp, Rattus norvegicus
attaacgtctagttgttctatatta

SEQ ID NO: 204733 - DNA, 25 bp, Rattus norvegicus
attaacgtgacaagcctggctttct

SEQ ID NO: 204734 - DNA, 25 bp, Rattus norvegicus
attaacgtgacatgcctggctttct

SEQ ID NO: 204735 - DNA, 25 bp, Rattus norvegicus
attaactatctcagcaggtgtaccc

SEQ ID NO: 204736 - DNA, 25 bp, Rattus norvegicus
attaactatctctgcaggtgtaccc

SEQ ID NO: 204737 - DNA, 25 bp, Rattus norvegicus
attaactatcttacagctctctggt

SEQ ID NO: 204738 - DNA, 25 bp, Rattus norvegicus
attaactatctttcagctctctggt

SEQ ID NO: 204739 - DNA, 25 bp, Rattus norvegicus
attaactcaggcatttcttccttct

SEQ ID NO: 204740 - DNA, 25 bp, Rattus norvegicus
attaactcaggcttttcttccttct

SEQ ID NO: 204741 - DNA, 25 bp, Rattus norvegicus
attaactcatccaacaactgcgcgg

SEQ ID NO: 204742 - DNA, 25 bp, Rattus norvegicus
attaactcatcctacaactgcgcgg

SEQ ID NO: 204743 - DNA, 25 bp, Rattus norvegicus
attaactcctgcctttcagtgtaca

SEQ ID NO: 204744 - DNA, 25 bp, Rattus norvegicus
attaactcctgcgtttcagtgtaca

SEQ ID NO: 204745 - DNA, 25 bp, Rattus norvegicus
attaactcgggcctcgccttatctc

SEQ ID NO: 204746 - DNA, 25 bp, Rattus norvegicus
attaactcgggcgtcgccttatctc

SEQ ID NO: 204747 - DNA, 25 bp, Rattus norvegicus
attaactctgcacgaatttcacatt

SEQ ID NO: 204748 - DNA, 25 bp, Rattus norvegicus
attaactctgcaggaatttcacatt

SEQ ID NO: 204749 - DNA, 25 bp, Rattus norvegicus
attaactctgggatactactggctg

SEQ ID NO: 204750 - DNA, 25 bp, Rattus norvegicus
attaactctgggttactactggctg

SEQ ID NO: 204751 - DNA, 25 bp, Rattus norvegicus
attaactgagtgactcaccctggat

SEQ ID NO: 204752 - DNA, 25 bp, Rattus norvegicus
attaactgagtgtctcaccctggat

SEQ ID NO: 204753 - DNA, 25 bp, Rattus norvegicus
attaactggctacgctactccaact

SEQ ID NO: 204754 - DNA, 25 bp, Rattus norvegicus
attaactggctaggctactccaact

SEQ ID NO: 204755 - DNA, 25 bp, Rattus norvegicus
attaacttcaaaaccatcctccttg

SEQ ID NO: 204756 - DNA, 25 bp, Rattus norvegicus
attaacttcaaatccatcctccttg

SEQ ID NO: 204757 - DNA, 25 bp, Rattus norvegicus
attaacttcacacacaccgtttcct

SEQ ID NO: 204758 - DNA, 25 bp, Rattus norvegicus
attaacttcacagacaccgtttcct

SEQ ID NO: 204759 - DNA, 25 bp, Rattus norvegicus
attaacttcaccattcactccatag

SEQ ID NO: 204760 - DNA, 25 bp, Rattus norvegicus
attaacttcacctttcactccatag

SEQ ID NO: 204761 - DNA, 25 bp, Rattus norvegicus
attaacttcactctccataatggac

SEQ ID NO: 204762 - DNA, 25 bp, Rattus norvegicus
attaacttcactgtccataatggac

SEQ ID NO: 204763 - DNA, 25 bp, Rattus norvegicus
attaacttctctcgtccttgtgatt

SEQ ID NO: 204764 - DNA, 25 bp, Rattus norvegicus
attaacttctctggtccttgtgatt

SEQ ID NO: 204765 - DNA, 25 bp, Rattus norvegicus
attaacttgtaaagtcagccaccat

SEQ ID NO: 204766 - DNA, 25 bp, Rattus norvegicus
attaacttgtaatgtcagccaccat

SEQ ID NO: 204767 - DNA, 25 bp, Rattus norvegicus
attaacttgtttatgagtctccaga

SEQ ID NO: 204768 - DNA, 25 bp, Rattus norvegicus
attaacttgtttttgagtctccaga

SEQ ID NO: 204769 - DNA, 25 bp, Rattus norvegicus
attaactttaagacctccgctgctg

SEQ ID NO: 204770 - DNA, 25 bp, Rattus norvegicus
attaactttaagtcctccgctgctg

SEQ ID NO: 204771 - DNA, 25 bp, Rattus norvegicus
attaactttcacaacactcactagc

SEQ ID NO: 204772 - DNA, 25 bp, Rattus norvegicus
attaactttcactacactcactagc

SEQ ID NO: 204773 - DNA, 25 bp, Rattus norvegicus
attaacttttgtacagtctgggcat

SEQ ID NO: 204774 - DNA, 25 bp, Rattus norvegicus
attaacttttgttcagtctgggcat

SEQ ID NO: 204775 - DNA, 25 bp, Rattus norvegicus
attaagaaactcctaactccagcca

SEQ ID NO: 204776 - DNA, 25 bp, Rattus norvegicus
attaagaaactcgtaactccagcca

SEQ ID NO: 204777 - DNA, 25 bp, Rattus norvegicus
attaagactattaccttccataagg

SEQ ID NO: 204778 - DNA, 25 bp, Rattus norvegicus
attaagactatttccttccataagg

SEQ ID NO: 204779 - DNA, 25 bp, Rattus norvegicus
attaagactgagatggccgcgctcc

SEQ ID NO: 204780 - DNA, 25 bp, Rattus norvegicus
attaagactgagttggccgcgctcc

SEQ ID NO: 204781 - DNA, 25 bp, Rattus norvegicus
attaagaggactccagggcagagct

SEQ ID NO: 204782 - DNA, 25 bp, Rattus norvegicus
attaagaggactgcagggcagagct

SEQ ID NO: 204783 - DNA, 25 bp, Rattus norvegicus
attaagaggatcacctccatttcgt

SEQ ID NO: 204784 - DNA, 25 bp, Rattus norvegicus
attaagaggatctcctccatttcgt

SEQ ID NO: 204785 - DNA, 25 bp, Rattus norvegicus
attaagatctaccagctaacctgca

SEQ ID NO: 204786 - DNA, 25 bp, Rattus norvegicus
attaagatctacgagctaacctgca

SEQ ID NO: 204787 - DNA, 25 bp, Rattus norvegicus
attaagcaaaacaccctcccaggtg

SEQ ID NO: 204788 - DNA, 25 bp, Rattus norvegicus
attaagcaaaactccctcccaggtg

SEQ ID NO: 204789 - DNA, 25 bp, Rattus norvegicus
attaagcaatgaaacgcccgtgaag

SEQ ID NO: 204790 - DNA, 25 bp, Rattus norvegicus
attaagcaatgatacgcccgtgaag

SEQ ID NO: 204791 - DNA, 25 bp, Rattus norvegicus
attaagcacacccattctgtgaaaa

SEQ ID NO: 204792 - DNA, 25 bp, Rattus norvegicus
attaagcacaccgattctgtgaaaa

SEQ ID NO: 204793 - DNA, 25 bp, Rattus norvegicus
attaagcagaggctggctcgactcc

SEQ ID NO: 204794 - DNA, 25 bp, Rattus norvegicus
attaagcagagggtggctcgactcc

SEQ ID NO: 204795 - DNA, 25 bp, Rattus norvegicus
attaagcatattatgtgactactat

SEQ ID NO: 204796 - DNA, 25 bp, Rattus norvegicus
attaagcatattttgtgactactat

SEQ ID NO: 204797 - DNA, 25 bp, Rattus norvegicus
attaagccacatctatcaaaggaat

SEQ ID NO: 204798 - DNA, 25 bp, Rattus norvegicus
attaagccacatgtatcaaaggaat

SEQ ID NO: 204799 - DNA, 25 bp, Rattus norvegicus
attaagccaggccaggaggacaaag

SEQ ID NO: 204800 - DNA, 25 bp, Rattus norvegicus
attaagccaggcgaggaggacaaag

SEQ ID NO: 204801 - DNA, 25 bp, Rattus norvegicus
attaagccatttagacatcacacag

SEQ ID NO: 204802 - DNA, 25 bp, Rattus norvegicus
attaagccattttgacatcacacag

SEQ ID NO: 204803 - DNA, 25 bp, Rattus norvegicus
attaagccctgacccctcattaaga

SEQ ID NO: 204804 - DNA, 25 bp, Rattus norvegicus
attaagccctgagccctcattaaga

SEQ ID NO: 204805 - DNA, 25 bp, Rattus norvegicus
attaagccgtggctgtgctgtgcac

SEQ ID NO: 204806 - DNA, 25 bp, Rattus norvegicus
attaagccgtgggtgtgctgtgcac

SEQ ID NO: 204807 - DNA, 25 bp, Rattus norvegicus
attaagcctcaaacgttaccactgc

SEQ ID NO: 204808 - DNA, 25 bp, Rattus norvegicus
attaagcctcaatcgttaccactgc

SEQ ID NO: 204809 - DNA, 25 bp, Rattus norvegicus
attaagcgggccatttacaatcaat

SEQ ID NO: 204810 - DNA, 25 bp, Rattus norvegicus
attaagcgggccttttacaatcaat

SEQ ID NO: 204811 - DNA, 25 bp, Rattus norvegicus
attaagctcttccttggtaatttca

SEQ ID NO: 204812 - DNA, 25 bp, Rattus norvegicus
attaagctcttcgttggtaatttca

SEQ ID NO: 204813 - DNA, 25 bp, Rattus norvegicus
attaagctgcacaccttttctaaga

SEQ ID NO: 204814 - DNA, 25 bp, Rattus norvegicus
attaagctgcactccttttctaaga

SEQ ID NO: 204815 - DNA, 25 bp, Rattus norvegicus
attaagctgcttaagaccatggtct

SEQ ID NO: 204816 - DNA, 25 bp, Rattus norvegicus
attaagctgctttagaccatggtct

SEQ ID NO: 204817 - DNA, 25 bp, Rattus norvegicus
attaaggaccctactaatctcagaa

SEQ ID NO: 204818 - DNA, 25 bp, Rattus norvegicus
attaaggacccttctaatctcagaa

SEQ ID NO: 204819 - DNA, 25 bp, Rattus norvegicus
attaaggactgtcgcactgtgctgg

SEQ ID NO: 204820 - DNA, 25 bp, Rattus norvegicus
attaaggactgtggcactgtgctgg

SEQ ID NO: 204821 - DNA, 25 bp, Rattus norvegicus
attaaggagccaactgtggtgccca

SEQ ID NO: 204822 - DNA, 25 bp, Rattus norvegicus
attaaggagccatctgtggtgccca

SEQ ID NO: 204823 - DNA, 25 bp, Rattus norvegicus
attaaggatagtacccatgtttgga

SEQ ID NO: 204824 - DNA, 25 bp, Rattus norvegicus
attaaggatagttcccatgtttgga

SEQ ID NO: 204825 - DNA, 25 bp, Rattus norvegicus
attaaggatctgctccccgactaat

SEQ ID NO: 204826 - DNA, 25 bp, Rattus norvegicus
attaaggatctggtccccgactaat

SEQ ID NO: 204827 - DNA, 25 bp, Rattus norvegicus
attaaggcaaaaaccaatcagtcac

SEQ ID NO: 204828 - DNA, 25 bp, Rattus norvegicus
attaaggcaaaatccaatcagtcac

SEQ ID NO: 204829 - DNA, 25 bp, Rattus norvegicus
attaaggcacttctctctctatctt

SEQ ID NO: 204830 - DNA, 25 bp, Rattus norvegicus
attaaggcacttgtctctctatctt

SEQ ID NO: 204831 - DNA, 25 bp, Rattus norvegicus
attaaggcattaaccctgggttgaa

SEQ ID NO: 204832 - DNA, 25 bp, Rattus norvegicus
attaaggcattatccctgggttgaa

SEQ ID NO: 204833 - DNA, 25 bp, Rattus norvegicus
attaaggctataaccccagtttagt

SEQ ID NO: 204834 - DNA, 25 bp, Rattus norvegicus
attaaggctatatccccagtttagt

SEQ ID NO: 204835 - DNA, 25 bp, Rattus norvegicus
attaaggctcttatttcacctggca

SEQ ID NO: 204836 - DNA, 25 bp, Rattus norvegicus
attaaggctcttttttcacctggca

SEQ ID NO: 204837 - DNA, 25 bp, Rattus norvegicus
attaagggcttcatgattcagacag

SEQ ID NO: 204838 - DNA, 25 bp, Rattus norvegicus
attaagggcttcttgattcagacag

SEQ ID NO: 204839 - DNA, 25 bp, Rattus norvegicus
attaaggtaccaaccctgtgcttct

SEQ ID NO: 204840 - DNA, 25 bp, Rattus norvegicus
attaaggtaccatccctgtgcttct

SEQ ID NO: 204841 - DNA, 25 bp, Rattus norvegicus
attaaggtccaaatgattgcccatt

SEQ ID NO: 204842 - DNA, 25 bp, Rattus norvegicus
attaaggtccaattgattgcccatt

SEQ ID NO: 204843 - DNA, 25 bp, Rattus norvegicus
attaaggtctttcgtgtgagcacac

SEQ ID NO: 204844 - DNA, 25 bp, Rattus norvegicus
attaaggtctttggtgtgagcacac

SEQ ID NO: 204845 - DNA, 25 bp, Rattus norvegicus
attaaggtggccacttgtctcgaga

SEQ ID NO: 204846 - DNA, 25 bp, Rattus norvegicus
attaaggtggcctcttgtctcgaga

SEQ ID NO: 204847 - DNA, 25 bp, Rattus norvegicus
attaaggtgtcccatcaagctctac

SEQ ID NO: 204848 - DNA, 25 bp, Rattus norvegicus
attaaggtgtccgatcaagctctac

SEQ ID NO: 204849 - DNA, 25 bp, Rattus norvegicus
attaaggttgttctgtatgcactcc

SEQ ID NO: 204850 - DNA, 25 bp, Rattus norvegicus
attaaggttgttgtgtatgcactcc

SEQ ID NO: 204851 - DNA, 25 bp, Rattus norvegicus
attaagtacgtgatcaggtcaggtt

SEQ ID NO: 204852 - DNA, 25 bp, Rattus norvegicus
attaagtacgtgttcaggtcaggtt

SEQ ID NO: 204853 - DNA, 25 bp, Rattus norvegicus
attaagtcatttagcccactcttgt

SEQ ID NO: 204854 - DNA, 25 bp, Rattus norvegicus
attaagtcattttgcccactcttgt

SEQ ID NO: 204855 - DNA, 25 bp, Rattus norvegicus
attaagtccccaagcacgtaatcag

SEQ ID NO: 204856 - DNA, 25 bp, Rattus norvegicus
attaagtccccatgcacgtaatcag

SEQ ID NO: 204857 - DNA, 25 bp, Rattus norvegicus
attaagtctggcacagcagcatgct

SEQ ID NO: 204858 - DNA, 25 bp, Rattus norvegicus
attaagtctggctcagcagcatgct

SEQ ID NO: 204859 - DNA, 25 bp, Rattus norvegicus
attaagtggaatcttctcaactggg

SEQ ID NO: 204860 - DNA, 25 bp, Rattus norvegicus
attaagtggaatgttctcaactggg

SEQ ID NO: 204861 - DNA, 25 bp, Rattus norvegicus
attaagttctccctgtggtcagctc

SEQ ID NO: 204862 - DNA, 25 bp, Rattus norvegicus
attaagttctccgtgtggtcagctc

SEQ ID NO: 204863 - DNA, 25 bp, Rattus norvegicus
attaagttgctcacttctaatccaa

SEQ ID NO: 204864 - DNA, 25 bp, Rattus norvegicus
attaagttgctctcttctaatccaa

SEQ ID NO: 204865 - DNA, 25 bp, Rattus norvegicus
attaagtttgctcctgctggtctga

SEQ ID NO: 204866 - DNA, 25 bp, Rattus norvegicus
attaagtttgctgctgctggtctga

SEQ ID NO: 204867 - DNA, 25 bp, Rattus norvegicus
attaagtttgttaagctccttgcta

SEQ ID NO: 204868 - DNA, 25 bp, Rattus norvegicus
attaagtttgtttagctccttgcta

SEQ ID NO: 204869 - DNA, 25 bp, Rattus norvegicus
attaataatctaaagcctcggcttc

SEQ ID NO: 204870 - DNA, 25 bp, Rattus norvegicus
attaataatctatagcctcggcttc

SEQ ID NO: 204871 - DNA, 25 bp, Rattus norvegicus
attaataatggcatgctcttggaga

SEQ ID NO: 204872 - DNA, 25 bp, Rattus norvegicus
attaataatggcttgctcttggaga

SEQ ID NO: 204873 - DNA, 25 bp, Rattus norvegicus
attaatacctatccccattaacctg

SEQ ID NO: 204874 - DNA, 25 bp, Rattus norvegicus
attaatacctatgcccattaacctg

SEQ ID NO: 204875 - DNA, 25 bp, Rattus norvegicus
attaatactgtcaccatatgccctt

SEQ ID NO: 204876 - DNA, 25 bp, Rattus norvegicus
attaatactgtctccatatgccctt

SEQ ID NO: 204877 - DNA, 25 bp, Rattus norvegicus
attaataggaaaaacatctgcactt

SEQ ID NO: 204878 - DNA, 25 bp, Rattus norvegicus
attaataggaaatacatctgcactt

SEQ ID NO: 204879 - DNA, 25 bp, Rattus norvegicus
attaatatccgtcctgattcctttg

SEQ ID NO: 204880 - DNA, 25 bp, Rattus norvegicus
attaatatccgtgctgattcctttg

SEQ ID NO: 204881 - DNA, 25 bp, Rattus norvegicus
attaatcaacttactgaggccctgc

SEQ ID NO: 204882 - DNA, 25 bp, Rattus norvegicus
attaatcaactttctgaggccctgc

SEQ ID NO: 204883 - DNA, 25 bp, Rattus norvegicus
attaatcagagcactaaaggcatag

SEQ ID NO: 204884 - DNA, 25 bp, Rattus norvegicus
attaatcagagctctaaaggcatag

SEQ ID NO: 204885 - DNA, 25 bp, Rattus norvegicus
attaatccagttctatttcagagct

SEQ ID NO: 204886 - DNA, 25 bp, Rattus norvegicus
attaatccagttgtatttcagagct

SEQ ID NO: 204887 - DNA, 25 bp, Rattus norvegicus
attaatcctaacactgtttcccctg

SEQ ID NO: 204888 - DNA, 25 bp, Rattus norvegicus
attaatcctaactctgtttcccctg

SEQ ID NO: 204889 - DNA, 25 bp, Rattus norvegicus
attaatcctcacatgttagcacctc

SEQ ID NO: 204890 - DNA, 25 bp, Rattus norvegicus
attaatcctcacttgttagcacctc

SEQ ID NO: 204891 - DNA, 25 bp, Rattus norvegicus
attaatcctggcatgtggttcttcc

SEQ ID NO: 204892 - DNA, 25 bp, Rattus norvegicus
attaatcctggcttgtggttcttcc

SEQ ID NO: 204893 - DNA, 25 bp, Rattus norvegicus
attaatctcttcatgcatagcatca

SEQ ID NO: 204894 - DNA, 25 bp, Rattus norvegicus
attaatctcttcttgcatagcatca

SEQ ID NO: 204895 - DNA, 25 bp, Rattus norvegicus
attaatctgtcccttttagacctcg

SEQ ID NO: 204896 - DNA, 25 bp, Rattus norvegicus
attaatctgtccgttttagacctcg

SEQ ID NO: 204897 - DNA, 25 bp, Rattus norvegicus
attaatcttactacccacttcctgg

SEQ ID NO: 204898 - DNA, 25 bp, Rattus norvegicus
attaatcttacttcccacttcctgg

SEQ ID NO: 204899 - DNA, 25 bp, Rattus norvegicus
attaatcttcagagggtcttaccct

SEQ ID NO: 204900 - DNA, 25 bp, Rattus norvegicus
attaatcttcagtgggtcttaccct

SEQ ID NO: 204901 - DNA, 25 bp, Rattus norvegicus
attaatcttcttcttatgccgttcg

SEQ ID NO: 204902 - DNA, 25 bp, Rattus norvegicus
attaatcttcttgttatgccgttcg

SEQ ID NO: 204903 - DNA, 25 bp, Rattus norvegicus
attaatctttccatgcctgagacca

SEQ ID NO: 204904 - DNA, 25 bp, Rattus norvegicus
attaatctttccttgcctgagacca

SEQ ID NO: 204905 - DNA, 25 bp, Rattus norvegicus
attaatctttgaaccctgggctgat

SEQ ID NO: 204906 - DNA, 25 bp, Rattus norvegicus
attaatctttgatccctgggctgat

SEQ ID NO: 204907 - DNA, 25 bp, Rattus norvegicus
attaatgacccgcagcatccactga

SEQ ID NO: 204908 - DNA, 25 bp, Rattus norvegicus
attaatgacccggagcatccactga

SEQ ID NO: 204909 - DNA, 25 bp, Rattus norvegicus
attaatgatcgcatctctgcttgtt

SEQ ID NO: 204910 - DNA, 25 bp, Rattus norvegicus
attaatgatcgcttctctgcttgtt

SEQ ID NO: 204911 - DNA, 25 bp, Rattus norvegicus
attaatgatggcatcttgacagagg

SEQ ID NO: 204912 - DNA, 25 bp, Rattus norvegicus
attaatgatggcttcttgacagagg

SEQ ID NO: 204913 - DNA, 25 bp, Rattus norvegicus
attaatgccaccacatgctctgata

SEQ ID NO: 204914 - DNA, 25 bp, Rattus norvegicus
attaatgccacctcatgctctgata

SEQ ID NO: 204915 - DNA, 25 bp, Rattus norvegicus
attaatgccgtcatgtttacagtat

SEQ ID NO: 204916 - DNA, 25 bp, Rattus norvegicus
attaatgccgtcttgtttacagtat

SEQ ID NO: 204917 - DNA, 25 bp, Rattus norvegicus
attaatgcgggccaacgtctgtctt

SEQ ID NO: 204918 - DNA, 25 bp, Rattus norvegicus
attaatgcgggcgaacgtctgtctt

SEQ ID NO: 204919 - DNA, 25 bp, Rattus norvegicus
attaatggctctcatctgactcttg

SEQ ID NO: 204920 - DNA, 25 bp, Rattus norvegicus
attaatggctctgatctgactcttg

SEQ ID NO: 204921 - DNA, 25 bp, Rattus norvegicus
attaatgtaaccagtcctgctggct

SEQ ID NO: 204922 - DNA, 25 bp, Rattus norvegicus
attaatgtaacctgtcctgctggct

SEQ ID NO: 204923 - DNA, 25 bp, Rattus norvegicus
attaatgtatgcctcatcttttcta

SEQ ID NO: 204924 - DNA, 25 bp, Rattus norvegicus
attaatgtatgcgtcatcttttcta

SEQ ID NO: 204925 - DNA, 25 bp, Rattus norvegicus
attaatgtcatgatgcgtgttgctt

SEQ ID NO: 204926 - DNA, 25 bp, Rattus norvegicus
attaatgtcatgttgcgtgttgctt

SEQ ID NO: 204927 - DNA, 25 bp, Rattus norvegicus
attaatgtctcaacactaaggctga

SEQ ID NO: 204928 - DNA, 25 bp, Rattus norvegicus
attaatgtctcatcactaaggctga

SEQ ID NO: 204929 - DNA, 25 bp, Rattus norvegicus
attaatgtgcagatccttgtttagt

SEQ ID NO: 204930 - DNA, 25 bp, Rattus norvegicus
attaatgtgcagttccttgtttagt

SEQ ID NO: 204931 - DNA, 25 bp, Rattus norvegicus
attaatgtgggcatgtctgtgtccc

SEQ ID NO: 204932 - DNA, 25 bp, Rattus norvegicus
attaatgtgggcttgtctgtgtccc

SEQ ID NO: 204933 - DNA, 25 bp, Rattus norvegicus
attaatgttctcacagccacaactc

SEQ ID NO: 204934 - DNA, 25 bp, Rattus norvegicus
attaatgttctctcagccacaactc

SEQ ID NO: 204935 - DNA, 25 bp, Rattus norvegicus
attaattacccaacagtgcctcgtg

SEQ ID NO: 204936 - DNA, 25 bp, Rattus norvegicus
attaattacccatcagtgcctcgtg

SEQ ID NO: 204937 - DNA, 25 bp, Rattus norvegicus
attaattatatgctcaggccctcct

SEQ ID NO: 204938 - DNA, 25 bp, Rattus norvegicus
attaattatatggtcaggccctcct

SEQ ID NO: 204939 - DNA, 25 bp, Rattus norvegicus
attaattcaactagctatctaggtt

SEQ ID NO: 204940 - DNA, 25 bp, Rattus norvegicus
attaattcaacttgctatctaggtt

SEQ ID NO: 204941 - DNA, 25 bp, Rattus norvegicus
attaattcatgcaccctgtgggagc

SEQ ID NO: 204942 - DNA, 25 bp, Rattus norvegicus
attaattcatgctccctgtgggagc

SEQ ID NO: 204943 - DNA, 25 bp, Rattus norvegicus
attaattccacaaaactaccctctt

SEQ ID NO: 204944 - DNA, 25 bp, Rattus norvegicus
attaattccacataactaccctctt

SEQ ID NO: 204945 - DNA, 25 bp, Rattus norvegicus
attaattccttcctctcatgtaaag

SEQ ID NO: 204946 - DNA, 25 bp, Rattus norvegicus
attaattccttcgtctcatgtaaag

SEQ ID NO: 204947 - DNA, 25 bp, Rattus norvegicus
attaattctcagagtggctcttggc

SEQ ID NO: 204948 - DNA, 25 bp, Rattus norvegicus
attaattctcagtgtggctcttggc

SEQ ID NO: 204949 - DNA, 25 bp, Rattus norvegicus
attaattgccttcaagtccctgggt

SEQ ID NO: 204950 - DNA, 25 bp, Rattus norvegicus
attaattgccttgaagtccctgggt

SEQ ID NO: 204951 - DNA, 25 bp, Rattus norvegicus
attaattgctatcttgtctcaggta

SEQ ID NO: 204952 - DNA, 25 bp, Rattus norvegicus
attaattgctatgttgtctcaggta

SEQ ID NO: 204953 - DNA, 25 bp, Rattus norvegicus
attaattggcccatgcagaagtcag

SEQ ID NO: 204954 - DNA, 25 bp, Rattus norvegicus
attaattggcccttgcagaagtcag

SEQ ID NO: 204955 - DNA, 25 bp, Rattus norvegicus
attaattgttcaaggcttgaaatta

SEQ ID NO: 204956 - DNA, 25 bp, Rattus norvegicus
attaattgttcatggcttgaaatta

SEQ ID NO: 204957 - DNA, 25 bp, Rattus norvegicus
attaatttccaacctccggtggcaa

SEQ ID NO: 204958 - DNA, 25 bp, Rattus norvegicus
attaatttccaagctccggtggcaa

SEQ ID NO: 204959 - DNA, 25 bp, Rattus norvegicus
attaatttcgctatctgtgcctcag

SEQ ID NO: 204960 - DNA, 25 bp, Rattus norvegicus
attaatttcgctttctgtgcctcag

SEQ ID NO: 204961 - DNA, 25 bp, Rattus norvegicus
attaatttgctgattgtgtgcccta

SEQ ID NO: 204962 - DNA, 25 bp, Rattus norvegicus
attaatttgctgtttgtgtgcccta

SEQ ID NO: 204963 - DNA, 25 bp, Rattus norvegicus
attaattttcccagttcataggcag

SEQ ID NO: 204964 - DNA, 25 bp, Rattus norvegicus
attaattttccctgttcataggcag

SEQ ID NO: 204965 - DNA, 25 bp, Rattus norvegicus
attaattttctcagtcaagtcttag

SEQ ID NO: 204966 - DNA, 25 bp, Rattus norvegicus
attaattttctctgtcaagtcttag

SEQ ID NO: 204967 - DNA, 25 bp, Rattus norvegicus
attacaaacgtacaacctagcccag

SEQ ID NO: 204968 - DNA, 25 bp, Rattus norvegicus
attacaaacgtagaacctagcccag

SEQ ID NO: 204969 - DNA, 25 bp, Rattus norvegicus
attacaaagaatagccctgtcctcc

SEQ ID NO: 204970 - DNA, 25 bp, Rattus norvegicus
attacaaagaattgccctgtcctcc

SEQ ID NO: 204971 - DNA, 25 bp, Rattus norvegicus
attacaaagctcaggctggtgctgc

SEQ ID NO: 204972 - DNA, 25 bp, Rattus norvegicus
attacaaagctctggctggtgctgc

SEQ ID NO: 204973 - DNA, 25 bp, Rattus norvegicus
attacaaagggcatgttatctgggc

SEQ ID NO: 204974 - DNA, 25 bp, Rattus norvegicus
attacaaagggcttgttatctgggc

SEQ ID NO: 204975 - DNA, 25 bp, Rattus norvegicus
attacaacaacgaatgtcctgcatt

SEQ ID NO: 204976 - DNA, 25 bp, Rattus norvegicus
attacaacaacgtatgtcctgcatt

SEQ ID NO: 204977 - DNA, 25 bp, Rattus norvegicus
attacaacagagctggaatgcccaa

SEQ ID NO: 204978 - DNA, 25 bp, Rattus norvegicus
attacaacagaggtggaatgcccaa

SEQ ID NO: 204979 - DNA, 25 bp, Rattus norvegicus
attacaacagctccagatctcgatt

SEQ ID NO: 204980 - DNA, 25 bp, Rattus norvegicus
attacaacagctgcagatctcgatt

SEQ ID NO: 204981 - DNA, 25 bp, Rattus norvegicus
attacaacctcccatttttgtgtga

SEQ ID NO: 204982 - DNA, 25 bp, Rattus norvegicus
attacaacctccgatttttgtgtga

SEQ ID NO: 204983 - DNA, 25 bp, Rattus norvegicus
attacaacgtatagggaggtctctc

SEQ ID NO: 204984 - DNA, 25 bp, Rattus norvegicus
attacaacgtattgggaggtctctc

SEQ ID NO: 204985 - DNA, 25 bp, Rattus norvegicus
attacaagctctctcattgctaatg

SEQ ID NO: 204986 - DNA, 25 bp, Rattus norvegicus
attacaagctctgtcattgctaatg

SEQ ID NO: 204987 - DNA, 25 bp, Rattus norvegicus
attacaagtactcagttaagggcca

SEQ ID NO: 204988 - DNA, 25 bp, Rattus norvegicus
attacaagtactgagttaagggcca

SEQ ID NO: 204989 - DNA, 25 bp, Rattus norvegicus
attacaatagcgagccttctcagag

SEQ ID NO: 204990 - DNA, 25 bp, Rattus norvegicus
attacaatagcgtgccttctcagag

SEQ ID NO: 204991 - DNA, 25 bp, Rattus norvegicus
attacaatcagtcttccatgcctta

SEQ ID NO: 204992 - DNA, 25 bp, Rattus norvegicus
attacaatcagtgttccatgcctta

SEQ ID NO: 204993 - DNA, 25 bp, Rattus norvegicus
attacaatcggaacacattcagctg

SEQ ID NO: 204994 - DNA, 25 bp, Rattus norvegicus
attacaatcggatcacattcagctg

SEQ ID NO: 204995 - DNA, 25 bp, Rattus norvegicus
attacaatgctcaatttcctgtccc

SEQ ID NO: 204996 - DNA, 25 bp, Rattus norvegicus
attacaatgctctatttcctgtccc

SEQ ID NO: 204997 - DNA, 25 bp, Rattus norvegicus
attacaatgggaactgtctggacag

SEQ ID NO: 204998 - DNA, 25 bp, Rattus norvegicus
attacaatgggatctgtctggacag

SEQ ID NO: 204999 - DNA, 25 bp, Rattus norvegicus
attacaatgtacaactgttcccaca

SEQ ID NO: 205000 - DNA, 25 bp, Rattus norvegicus
attacaatgtactactgttcccaca

SEQ ID NO: 205001 - DNA, 25 bp, Rattus norvegicus
attacaattaccaatctgagaagac

SEQ ID NO: 205002 - DNA, 25 bp, Rattus norvegicus
attacaattacctatctgagaagac

SEQ ID NO: 205003 - DNA, 25 bp, Rattus norvegicus
attacacacgtgacacctgccagga

SEQ ID NO: 205004 - DNA, 25 bp, Rattus norvegicus
attacacacgtgtcacctgccagga

SEQ ID NO: 205005 - DNA, 25 bp, Rattus norvegicus
attacacagccccttctgcagggaa

SEQ ID NO: 205006 - DNA, 25 bp, Rattus norvegicus
attacacagcccgttctgcagggaa

SEQ ID NO: 205007 - DNA, 25 bp, Rattus norvegicus
attacacatcttacagccgattcct

SEQ ID NO: 205008 - DNA, 25 bp, Rattus norvegicus
attacacatctttcagccgattcct

SEQ ID NO: 205009 - DNA, 25 bp, Rattus norvegicus
attacaccccagaggcaacagtgac

SEQ ID NO: 205010 - DNA, 25 bp, Rattus norvegicus
attacaccccagtggcaacagtgac

SEQ ID NO: 205011 - DNA, 25 bp, Rattus norvegicus
attacacccggactccaatgtttag

SEQ ID NO: 205012 - DNA, 25 bp, Rattus norvegicus
attacacccggagtccaatgtttag

SEQ ID NO: 205013 - DNA, 25 bp, Rattus norvegicus
attacaccttcaacatcttctattg

SEQ ID NO: 205014 - DNA, 25 bp, Rattus norvegicus
attacaccttcatcatcttctattg

SEQ ID NO: 205015 - DNA, 25 bp, Rattus norvegicus
attacacgaatccacatccatgttc

SEQ ID NO: 205016 - DNA, 25 bp, Rattus norvegicus
attacacgaatcgacatccatgttc

SEQ ID NO: 205017 - DNA, 25 bp, Rattus norvegicus
attacacgtctacagtttctttatg

SEQ ID NO: 205018 - DNA, 25 bp, Rattus norvegicus
attacacgtctagagtttctttatg

SEQ ID NO: 205019 - DNA, 25 bp, Rattus norvegicus
attacactctgcagggctatcttta

SEQ ID NO: 205020 - DNA, 25 bp, Rattus norvegicus
attacactctgctgggctatcttta

SEQ ID NO: 205021 - DNA, 25 bp, Rattus norvegicus
attacactgtttaccggagagccat

SEQ ID NO: 205022 - DNA, 25 bp, Rattus norvegicus
attacactgttttccggagagccat

SEQ ID NO: 205023 - DNA, 25 bp, Rattus norvegicus
attacacttcacctgggtggttgct

SEQ ID NO: 205024 - DNA, 25 bp, Rattus norvegicus
attacacttcacgtgggtggttgct

SEQ ID NO: 205025 - DNA, 25 bp, Rattus norvegicus
attacacttgggacatctattattg

SEQ ID NO: 205026 - DNA, 25 bp, Rattus norvegicus
attacacttgggtcatctattattg

SEQ ID NO: 205027 - DNA, 25 bp, Rattus norvegicus
attacactttgacatgactcgtagg

SEQ ID NO: 205028 - DNA, 25 bp, Rattus norvegicus
attacactttgagatgactcgtagg

SEQ ID NO: 205029 - DNA, 25 bp, Rattus norvegicus
attacagaacttcatctccgtcacc

SEQ ID NO: 205030 - DNA, 25 bp, Rattus norvegicus
attacagaacttgatctccgtcacc

SEQ ID NO: 205031 - DNA, 25 bp, Rattus norvegicus
attacagaatgtattagccttgata

SEQ ID NO: 205032 - DNA, 25 bp, Rattus norvegicus
attacagaatgttttagccttgata

SEQ ID NO: 205033 - DNA, 25 bp, Rattus norvegicus
attacagacatgagctatcacgttg

SEQ ID NO: 205034 - DNA, 25 bp, Rattus norvegicus
attacagacatgtgctatcacgttg

SEQ ID NO: 205035 - DNA, 25 bp, Rattus norvegicus
attacagacattagtgaggcaccat

SEQ ID NO: 205036 - DNA, 25 bp, Rattus norvegicus
attacagacatttgtgaggcaccat

SEQ ID NO: 205037 - DNA, 25 bp, Rattus norvegicus
attacagactaaacaccaaggagct

SEQ ID NO: 205038 - DNA, 25 bp, Rattus norvegicus
attacagactaatcaccaaggagct

SEQ ID NO: 205039 - DNA, 25 bp, Rattus norvegicus
attacagatgttagctacctcctgc

SEQ ID NO: 205040 - DNA, 25 bp, Rattus norvegicus
attacagatgtttgctacctcctgc

SEQ ID NO: 205041 - DNA, 25 bp, Rattus norvegicus
attacagattatcagcccctggcta

SEQ ID NO: 205042 - DNA, 25 bp, Rattus norvegicus
attacagattatgagcccctggcta

SEQ ID NO: 205043 - DNA, 25 bp, Rattus norvegicus
attacagattctatgagggccctca

SEQ ID NO: 205044 - DNA, 25 bp, Rattus norvegicus
attacagattctttgagggccctca

SEQ ID NO: 205045 - DNA, 25 bp, Rattus norvegicus
attacagattgtctttccctctcag

SEQ ID NO: 205046 - DNA, 25 bp, Rattus norvegicus
attacagattgtgtttccctctcag

SEQ ID NO: 205047 - DNA, 25 bp, Rattus norvegicus
attacagcagctcacgtgatggata

SEQ ID NO: 205048 - DNA, 25 bp, Rattus norvegicus
attacagcagctgacgtgatggata

SEQ ID NO: 205049 - DNA, 25 bp, Rattus norvegicus
attacagcatctaaggaaccctcgg

SEQ ID NO: 205050 - DNA, 25 bp, Rattus norvegicus
attacagcatcttaggaaccctcgg

SEQ ID NO: 205051 - DNA, 25 bp, Rattus norvegicus
attacagcccggaatcagcagcttg

SEQ ID NO: 205052 - DNA, 25 bp, Rattus norvegicus
attacagcccggtatcagcagcttg

SEQ ID NO: 205053 - DNA, 25 bp, Rattus norvegicus
attacagcgcttccatctcaggcta

SEQ ID NO: 205054 - DNA, 25 bp, Rattus norvegicus
attacagcgcttgcatctcaggcta

SEQ ID NO: 205055 - DNA, 25 bp, Rattus norvegicus
attacagctctacaacaaggccaag

SEQ ID NO: 205056 - DNA, 25 bp, Rattus norvegicus
attacagctctagaacaaggccaag

SEQ ID NO: 205057 - DNA, 25 bp, Rattus norvegicus
attacagcttcacttgagaccttgt

SEQ ID NO: 205058 - DNA, 25 bp, Rattus norvegicus
attacagcttcagttgagaccttgt

SEQ ID NO: 205059 - DNA, 25 bp, Rattus norvegicus
attacaggaaaccagggccgcattt

SEQ ID NO: 205060 - DNA, 25 bp, Rattus norvegicus
attacaggaaacgagggccgcattt

SEQ ID NO: 205061 - DNA, 25 bp, Rattus norvegicus
attacaggacaactcttatctagat

SEQ ID NO: 205062 - DNA, 25 bp, Rattus norvegicus
attacaggacaagtcttatctagat

SEQ ID NO: 205063 - DNA, 25 bp, Rattus norvegicus
attacaggacagatcgtacagtctt

SEQ ID NO: 205064 - DNA, 25 bp, Rattus norvegicus
attacaggacagttcgtacagtctt

SEQ ID NO: 205065 - DNA, 25 bp, Rattus norvegicus
attacaggtgtacgcctctgggctc

SEQ ID NO: 205066 - DNA, 25 bp, Rattus norvegicus
attacaggtgtaggcctctgggctc

SEQ ID NO: 205067 - DNA, 25 bp, Rattus norvegicus
attacagtaagtcctaggccaatct

SEQ ID NO: 205068 - DNA, 25 bp, Rattus norvegicus
attacagtaagtgctaggccaatct

SEQ ID NO: 205069 - DNA, 25 bp, Rattus norvegicus
attacagtagttcagcatcgcacag

SEQ ID NO: 205070 - DNA, 25 bp, Rattus norvegicus
attacagtagttgagcatcgcacag

SEQ ID NO: 205071 - DNA, 25 bp, Rattus norvegicus
attacatatgctcccaaaggctggc

SEQ ID NO: 205072 - DNA, 25 bp, Rattus norvegicus
attacatatgctgccaaaggctggc

SEQ ID NO: 205073 - DNA, 25 bp, Rattus norvegicus
attacatcaccaccaactttcaaag

SEQ ID NO: 205074 - DNA, 25 bp, Rattus norvegicus
attacatcaccagcaactttcaaag

SEQ ID NO: 205075 - DNA, 25 bp, Rattus norvegicus
attacatcctctaaggctcctgctc

SEQ ID NO: 205076 - DNA, 25 bp, Rattus norvegicus
attacatcctcttaggctcctgctc

SEQ ID NO: 205077 - DNA, 25 bp, Rattus norvegicus
attacatcctgacagccgctttgag

SEQ ID NO: 205078 - DNA, 25 bp, Rattus norvegicus
attacatcctgagagccgctttgag

SEQ ID NO: 205079 - DNA, 25 bp, Rattus norvegicus
attacatctaacatctagcgctgcc

SEQ ID NO: 205080 - DNA, 25 bp, Rattus norvegicus
attacatctaacttctagcgctgcc

SEQ ID NO: 205081 - DNA, 25 bp, Rattus norvegicus
attacatcttgcatggttcctactt

SEQ ID NO: 205082 - DNA, 25 bp, Rattus norvegicus
attacatcttgcttggttcctactt

SEQ ID NO: 205083 - DNA, 25 bp, Rattus norvegicus
attacatcttgtacactaattggaa

SEQ ID NO: 205084 - DNA, 25 bp, Rattus norvegicus
attacatcttgttcactaattggaa

SEQ ID NO: 205085 - DNA, 25 bp, Rattus norvegicus
attacatgcatgactgtttactaca

SEQ ID NO: 205086 - DNA, 25 bp, Rattus norvegicus
attacatgcatgtctgtttactaca

SEQ ID NO: 205087 - DNA, 25 bp, Rattus norvegicus
attacatggtggactcctcagagtt

SEQ ID NO: 205088 - DNA, 25 bp, Rattus norvegicus
attacatggtggtctcctcagagtt

SEQ ID NO: 205089 - DNA, 25 bp, Rattus norvegicus
attacatgtcatatgctctcttctc

SEQ ID NO: 205090 - DNA, 25 bp, Rattus norvegicus
attacatgtcatttgctctcttctc

SEQ ID NO: 205091 - DNA, 25 bp, Rattus norvegicus
attacatttctactattcgacctag

SEQ ID NO: 205092 - DNA, 25 bp, Rattus norvegicus
attacatttctagtattcgacctag

SEQ ID NO: 205093 - DNA, 25 bp, Rattus norvegicus
attacatttgcactttgaattccag

SEQ ID NO: 205094 - DNA, 25 bp, Rattus norvegicus
attacatttgcagtttgaattccag

SEQ ID NO: 205095 - DNA, 25 bp, Rattus norvegicus
attaccaacctaattgttctcatgg

SEQ ID NO: 205096 - DNA, 25 bp, Rattus norvegicus
attaccaacctatttgttctcatgg

SEQ ID NO: 205097 - DNA, 25 bp, Rattus norvegicus
attaccaagtacacctacgtgggct

SEQ ID NO: 205098 - DNA, 25 bp, Rattus norvegicus
attaccaagtactcctacgtgggct

SEQ ID NO: 205099 - DNA, 25 bp, Rattus norvegicus
attaccacacccagcggatcggcgg

SEQ ID NO: 205100 - DNA, 25 bp, Rattus norvegicus
attaccacacccagtcagcagtaag

SEQ ID NO: 205101 - DNA, 25 bp, Rattus norvegicus
attaccacaccctgcggatcggcgg

SEQ ID NO: 205102 - DNA, 25 bp, Rattus norvegicus
attaccacaccctgtcagcagtaag

SEQ ID NO: 205103 - DNA, 25 bp, Rattus norvegicus
attaccacaggtccaccattaacat

SEQ ID NO: 205104 - DNA, 25 bp, Rattus norvegicus
attaccacaggtgcaccattaacat

SEQ ID NO: 205105 - DNA, 25 bp, Rattus norvegicus
attaccacatcgcactccgcggtag

SEQ ID NO: 205106 - DNA, 25 bp, Rattus norvegicus
attaccacatcggactccgcggtag

SEQ ID NO: 205107 - DNA, 25 bp, Rattus norvegicus
attaccacatctcctaatacatcag

SEQ ID NO: 205108 - DNA, 25 bp, Rattus norvegicus
attaccacatctgctaatacatcag

SEQ ID NO: 205109 - DNA, 25 bp, Rattus norvegicus
attaccacatgcatctttctgattc

SEQ ID NO: 205110 - DNA, 25 bp, Rattus norvegicus
attaccacatgcttctttctgattc

SEQ ID NO: 205111 - DNA, 25 bp, Rattus norvegicus
attaccaccatcagcagttcatcca

SEQ ID NO: 205112 - DNA, 25 bp, Rattus norvegicus
attaccaccatctgcagttcatcca

SEQ ID NO: 205113 - DNA, 25 bp, Rattus norvegicus
attaccacctcacttcctaaacgag

SEQ ID NO: 205114 - DNA, 25 bp, Rattus norvegicus
attaccacctcagttcctaaacgag

SEQ ID NO: 205115 - DNA, 25 bp, Rattus norvegicus
attaccaccttcagatccgtcagga

SEQ ID NO: 205116 - DNA, 25 bp, Rattus norvegicus
attaccaccttctgatccgtcagga

SEQ ID NO: 205117 - DNA, 25 bp, Rattus norvegicus
attaccactgacacacacatgttca

SEQ ID NO: 205118 - DNA, 25 bp, Rattus norvegicus
attaccactgactcacacatgttca

SEQ ID NO: 205119 - DNA, 25 bp, Rattus norvegicus
attaccactgtaagtctgtcctttc

SEQ ID NO: 205120 - DNA, 25 bp, Rattus norvegicus
attaccactgtatgtctgtcctttc

SEQ ID NO: 205121 - DNA, 25 bp, Rattus norvegicus
attaccagagccctgcttttgttaa

SEQ ID NO: 205122 - DNA, 25 bp, Rattus norvegicus
attaccagagccgtgcttttgttaa

SEQ ID NO: 205123 - DNA, 25 bp, Rattus norvegicus
attaccagagtacaatattttcccg

SEQ ID NO: 205124 - DNA, 25 bp, Rattus norvegicus
attaccagagtagaatattttcccg

SEQ ID NO: 205125 - DNA, 25 bp, Rattus norvegicus
attaccagatatagtccggctcctg

SEQ ID NO: 205126 - DNA, 25 bp, Rattus norvegicus
attaccagatattgtccggctcctg

SEQ ID NO: 205127 - DNA, 25 bp, Rattus norvegicus
attaccaggaacagaccagtgggct

SEQ ID NO: 205128 - DNA, 25 bp, Rattus norvegicus
attaccaggaactgaccagtgggct

SEQ ID NO: 205129 - DNA, 25 bp, Rattus norvegicus
attaccaggatcagccacacacgtg

SEQ ID NO: 205130 - DNA, 25 bp, Rattus norvegicus
attaccaggatctgccacacacgtg

SEQ ID NO: 205131 - DNA, 25 bp, Rattus norvegicus
attaccagtctgaaccgggagtcca

SEQ ID NO: 205132 - DNA, 25 bp, Rattus norvegicus
attaccagtctgtaccgggagtcca

SEQ ID NO: 205133 - DNA, 25 bp, Rattus norvegicus
attaccatagcactaatttgataga

SEQ ID NO: 205134 - DNA, 25 bp, Rattus norvegicus
attaccatagcagtaatttgataga

SEQ ID NO: 205135 - DNA, 25 bp, Rattus norvegicus
attaccatcatgcaaccaacctggt

SEQ ID NO: 205136 - DNA, 25 bp, Rattus norvegicus
attaccatcatggaaccaacctggt

SEQ ID NO: 205137 - DNA, 25 bp, Rattus norvegicus
attaccatccataggtctgcagagc

SEQ ID NO: 205138 - DNA, 25 bp, Rattus norvegicus
attaccatccattggtctgcagagc

SEQ ID NO: 205139 - DNA, 25 bp, Rattus norvegicus
attaccatgtctctctggacactgc

SEQ ID NO: 205140 - DNA, 25 bp, Rattus norvegicus
attaccatgtctgtctggacactgc

SEQ ID NO: 205141 - DNA, 25 bp, Rattus norvegicus
attaccattctaagagtctgctctc

SEQ ID NO: 205142 - DNA, 25 bp, Rattus norvegicus
attaccattctatgagtctgctctc

SEQ ID NO: 205143 - DNA, 25 bp, Rattus norvegicus
attaccattttgaacttgatacctt

SEQ ID NO: 205144 - DNA, 25 bp, Rattus norvegicus
attaccattttgtacttgatacctt

SEQ ID NO: 205145 - DNA, 25 bp, Rattus norvegicus
attacccaagggatgctgctattca

SEQ ID NO: 205146 - DNA, 25 bp, Rattus norvegicus
attacccaagggttgctgctattca

SEQ ID NO: 205147 - DNA, 25 bp, Rattus norvegicus
attacccactggaccctgtgttgtg

SEQ ID NO: 205148 - DNA, 25 bp, Rattus norvegicus
attacccactggtccctgtgttgtg

SEQ ID NO: 205149 - DNA, 25 bp, Rattus norvegicus
attacccactttatgtatgcttcat

SEQ ID NO: 205150 - DNA, 25 bp, Rattus norvegicus
attacccactttttgtatgcttcat

SEQ ID NO: 205151 - DNA, 25 bp, Rattus norvegicus
attacccagcccattgcagcatgga

SEQ ID NO: 205152 - DNA, 25 bp, Rattus norvegicus
attacccagccctttgcagcatgga

SEQ ID NO: 205153 - DNA, 25 bp, Rattus norvegicus
attacccatgggaccagttatccag

SEQ ID NO: 205154 - DNA, 25 bp, Rattus norvegicus
attacccatgggtccagttatccag

SEQ ID NO: 205155 - DNA, 25 bp, Rattus norvegicus
attacccatggtactgatagtttgt

SEQ ID NO: 205156 - DNA, 25 bp, Rattus norvegicus
attacccatggttctgatagtttgt

SEQ ID NO: 205157 - DNA, 25 bp, Rattus norvegicus
attacccctgagcagaactgagcag

SEQ ID NO: 205158 - DNA, 25 bp, Rattus norvegicus
attacccctgaggagaactgagcag

SEQ ID NO: 205159 - DNA, 25 bp, Rattus norvegicus
attaccccttctacagcacaggatt

SEQ ID NO: 205160 - DNA, 25 bp, Rattus norvegicus
attaccccttcttcagcacaggatt

SEQ ID NO: 205161 - DNA, 25 bp, Rattus norvegicus
attacccgctctaagcagggctagg

SEQ ID NO: 205162 - DNA, 25 bp, Rattus norvegicus
attacccgctcttagcagggctagg

SEQ ID NO: 205163 - DNA, 25 bp, Rattus norvegicus
attaccctccaaactatatcctgtt

SEQ ID NO: 205164 - DNA, 25 bp, Rattus norvegicus
attaccctccaatctatatcctgtt

SEQ ID NO: 205165 - DNA, 25 bp, Rattus norvegicus
attaccctgtttccgctgatgttga

SEQ ID NO: 205166 - DNA, 25 bp, Rattus norvegicus
attaccctgtttgcgctgatgttga

SEQ ID NO: 205167 - DNA, 25 bp, Rattus norvegicus
attacccttaataccttcagattgg

SEQ ID NO: 205168 - DNA, 25 bp, Rattus norvegicus
attacccttaattccttcagattgg

SEQ ID NO: 205169 - DNA, 25 bp, Rattus norvegicus
attacccttgggagccattagatgg

SEQ ID NO: 205170 - DNA, 25 bp, Rattus norvegicus
attacccttgggtgccattagatgg

SEQ ID NO: 205171 - DNA, 25 bp, Rattus norvegicus
attaccgatcccacttgtaatgcgg

SEQ ID NO: 205172 - DNA, 25 bp, Rattus norvegicus
attaccgatccctcttgtaatgcgg

SEQ ID NO: 205173 - DNA, 25 bp, Rattus norvegicus
attaccgattttaagtgcacttcaa

SEQ ID NO: 205174 - DNA, 25 bp, Rattus norvegicus
attaccgatttttagtgcacttcaa

SEQ ID NO: 205175 - DNA, 25 bp, Rattus norvegicus
attaccgcatggctggcgacgtaac

SEQ ID NO: 205176 - DNA, 25 bp, Rattus norvegicus
attaccgcatgggtggcgacgtaac

SEQ ID NO: 205177 - DNA, 25 bp, Rattus norvegicus
attaccggatgaaggatttccctcg

SEQ ID NO: 205178 - DNA, 25 bp, Rattus norvegicus
attaccggatgatggatttccctcg

SEQ ID NO: 205179 - DNA, 25 bp, Rattus norvegicus
attaccgggactcggtccgccgcag

SEQ ID NO: 205180 - DNA, 25 bp, Rattus norvegicus
attaccgggactgggtccgccgcag

SEQ ID NO: 205181 - DNA, 25 bp, Rattus norvegicus
attaccgtcggtcgcactcaaaggt

SEQ ID NO: 205182 - DNA, 25 bp, Rattus norvegicus
attaccgtcggtggcactcaaaggt

SEQ ID NO: 205183 - DNA, 25 bp, Rattus norvegicus
attaccgtgtgaacacctctgtata

SEQ ID NO: 205184 - DNA, 25 bp, Rattus norvegicus
attaccgtgtgatcacctctgtata

SEQ ID NO: 205185 - DNA, 25 bp, Rattus norvegicus
attacctacagtacaacaccagcag

SEQ ID NO: 205186 - DNA, 25 bp, Rattus norvegicus
attacctacagttcaacaccagcag

SEQ ID NO: 205187 - DNA, 25 bp, Rattus norvegicus
attacctcagagactttacaccaca

SEQ ID NO: 205188 - DNA, 25 bp, Rattus norvegicus
attacctcagagtctttacaccaca

SEQ ID NO: 205189 - DNA, 25 bp, Rattus norvegicus
attacctcagcacgtttggtgccca

SEQ ID NO: 205190 - DNA, 25 bp, Rattus norvegicus
attacctcagcaggtttggtgccca

SEQ ID NO: 205191 - DNA, 25 bp, Rattus norvegicus
attacctccttgcagtccattttca

SEQ ID NO: 205192 - DNA, 25 bp, Rattus norvegicus
attacctccttggagtccattttca

SEQ ID NO: 205193 - DNA, 25 bp, Rattus norvegicus
attacctcctttacccaacagcagt

SEQ ID NO: 205194 - DNA, 25 bp, Rattus norvegicus
attacctccttttcccaacagcagt

SEQ ID NO: 205195 - DNA, 25 bp, Rattus norvegicus
attacctcggttatgcagttgcctt

SEQ ID NO: 205196 - DNA, 25 bp, Rattus norvegicus
attacctcggttttgcagttgcctt

SEQ ID NO: 205197 - DNA, 25 bp, Rattus norvegicus
attacctctccgctcgcgatctgag

SEQ ID NO: 205198 - DNA, 25 bp, Rattus norvegicus
attacctctccggtcgcgatctgag

SEQ ID NO: 205199 - DNA, 25 bp, Rattus norvegicus
attacctctgcgaactaccgtggtg

SEQ ID NO: 205200 - DNA, 25 bp, Rattus norvegicus
attacctctgcgtactaccgtggtg

SEQ ID NO: 205201 - DNA, 25 bp, Rattus norvegicus
attacctctgttaaggtgtttagca

SEQ ID NO: 205202 - DNA, 25 bp, Rattus norvegicus
attacctctgtttaggtgtttagca

SEQ ID NO: 205203 - DNA, 25 bp, Rattus norvegicus
attacctctttgagtacagttgtga

SEQ ID NO: 205204 - DNA, 25 bp, Rattus norvegicus
attacctctttgtgtacagttgtga

SEQ ID NO: 205205 - DNA, 25 bp, Rattus norvegicus
attacctgaccgctctccttggaga

SEQ ID NO: 205206 - DNA, 25 bp, Rattus norvegicus
attacctgaccggtctccttggaga

SEQ ID NO: 205207 - DNA, 25 bp, Rattus norvegicus
attacctgaggtactgcgaaatcat

SEQ ID NO: 205208 - DNA, 25 bp, Rattus norvegicus
attacctgaggttctgcgaaatcat

SEQ ID NO: 205209 - DNA, 25 bp, Rattus norvegicus
attacctgatcacaaccagcacagt

SEQ ID NO: 205210 - DNA, 25 bp, Rattus norvegicus
attacctgatcagaaccagcacagt

SEQ ID NO: 205211 - DNA, 25 bp, Rattus norvegicus
attacctgcctcactagtgtagaaa

SEQ ID NO: 205212 - DNA, 25 bp, Rattus norvegicus
attacctgcctctctagtgtagaaa

SEQ ID NO: 205213 - DNA, 25 bp, Rattus norvegicus
attacctggataacgtgctggctga

SEQ ID NO: 205214 - DNA, 25 bp, Rattus norvegicus
attacctggatatcgtgctggctga

SEQ ID NO: 205215 - DNA, 25 bp, Rattus norvegicus
attacctggatcctacgtgcttcat

SEQ ID NO: 205216 - DNA, 25 bp, Rattus norvegicus
attacctggatcgtacgtgcttcat

SEQ ID NO: 205217 - DNA, 25 bp, Rattus norvegicus
attacctggcctaggaactgtccaa

SEQ ID NO: 205218 - DNA, 25 bp, Rattus norvegicus
attacctggccttggaactgtccaa

SEQ ID NO: 205219 - DNA, 25 bp, Rattus norvegicus
attacctggctaacatctgtgcact

SEQ ID NO: 205220 - DNA, 25 bp, Rattus norvegicus
attacctggctatcatctgtgcact

SEQ ID NO: 205221 - DNA, 25 bp, Rattus norvegicus
attacctggctcaaagtggttgttc

SEQ ID NO: 205222 - DNA, 25 bp, Rattus norvegicus
attacctggctctaagtggttgttc

SEQ ID NO: 205223 - DNA, 25 bp, Rattus norvegicus
attacctgtcctcaatttatcctag

SEQ ID NO: 205224 - DNA, 25 bp, Rattus norvegicus
attacctgtcctgaatttatcctag

SEQ ID NO: 205225 - DNA, 25 bp, Rattus norvegicus
attacctgttttacagccagcggca

SEQ ID NO: 205226 - DNA, 25 bp, Rattus norvegicus
attacctgtttttcagccagcggca

SEQ ID NO: 205227 - DNA, 25 bp, Rattus norvegicus
attaccttaacactcttcgggcata

SEQ ID NO: 205228 - DNA, 25 bp, Rattus norvegicus
attaccttaacagtcttcgggcata

SEQ ID NO: 205229 - DNA, 25 bp, Rattus norvegicus
attaccttagtgacactgtccgtga

SEQ ID NO: 205230 - DNA, 25 bp, Rattus norvegicus
attaccttagtgagtattttccata

SEQ ID NO: 205231 - DNA, 25 bp, Rattus norvegicus
attaccttagtgtcactgtccgtga

SEQ ID NO: 205232 - DNA, 25 bp, Rattus norvegicus
attaccttagtgtgtattttccata

SEQ ID NO: 205233 - DNA, 25 bp, Rattus norvegicus
attaccttccgcacagagatctgag

SEQ ID NO: 205234 - DNA, 25 bp, Rattus norvegicus
attaccttccgctcagagatctgag

SEQ ID NO: 205235 - DNA, 25 bp, Rattus norvegicus
attaccttgaccataccagtagcat

SEQ ID NO: 205236 - DNA, 25 bp, Rattus norvegicus
attaccttgaccttaccagtagcat

SEQ ID NO: 205237 - DNA, 25 bp, Rattus norvegicus
attaccttgcagaggtgtgtttgac

SEQ ID NO: 205238 - DNA, 25 bp, Rattus norvegicus
attaccttgcagtggtgtgtttgac

SEQ ID NO: 205239 - DNA, 25 bp, Rattus norvegicus
attaccttggacagattgctggccc

SEQ ID NO: 205240 - DNA, 25 bp, Rattus norvegicus
attaccttggactgattgctggccc

SEQ ID NO: 205241 - DNA, 25 bp, Rattus norvegicus
attaccttttcaatccgtagttctg

SEQ ID NO: 205242 - DNA, 25 bp, Rattus norvegicus
attaccttttcattccgtagttctg

SEQ ID NO: 205243 - DNA, 25 bp, Rattus norvegicus
attacgcagatgctcatcggcctca

SEQ ID NO: 205244 - DNA, 25 bp, Rattus norvegicus
attacgcagatggtcatcggcctca

SEQ ID NO: 205245 - DNA, 25 bp, Rattus norvegicus
attacgccagctcaggttggtgtcc

SEQ ID NO: 205246 - DNA, 25 bp, Rattus norvegicus
attacgccagctgaggttggtgtcc

SEQ ID NO: 205247 - DNA, 25 bp, Rattus norvegicus
attacgccaggcctgatagtgtcag

SEQ ID NO: 205248 - DNA, 25 bp, Rattus norvegicus
attacgccaggcgtgatagtgtcag

SEQ ID NO: 205249 - DNA, 25 bp, Rattus norvegicus
attacgcctaatcctgtgttccttt

SEQ ID NO: 205250 - DNA, 25 bp, Rattus norvegicus
attacgcctaatgctgtgttccttt

SEQ ID NO: 205251 - DNA, 25 bp, Rattus norvegicus
attacgcttggacaggcttctatgc

SEQ ID NO: 205252 - DNA, 25 bp, Rattus norvegicus
attacgcttggagaggcttctatgc

SEQ ID NO: 205253 - DNA, 25 bp, Rattus norvegicus
attacggaaaataagcttctgtgaa

SEQ ID NO: 205254 - DNA, 25 bp, Rattus norvegicus
attacggaaaattagcttctgtgaa

SEQ ID NO: 205255 - DNA, 25 bp, Rattus norvegicus
attacggaatgaactgcagacagat

SEQ ID NO: 205256 - DNA, 25 bp, Rattus norvegicus
attacggaatgatctgcagacagat

SEQ ID NO: 205257 - DNA, 25 bp, Rattus norvegicus
attacggcagacaggcttgtcaagg

SEQ ID NO: 205258 - DNA, 25 bp, Rattus norvegicus
attacggcagactggcttgtcaagg

SEQ ID NO: 205259 - DNA, 25 bp, Rattus norvegicus
attacggcccttactgttctctcat

SEQ ID NO: 205260 - DNA, 25 bp, Rattus norvegicus
attacggccctttctgttctctcat

SEQ ID NO: 205261 - DNA, 25 bp, Rattus norvegicus
attacgggagttctaccaccatgcc

SEQ ID NO: 205262 - DNA, 25 bp, Rattus norvegicus
attacgggagttgtaccaccatgcc

SEQ ID NO: 205263 - DNA, 25 bp, Rattus norvegicus
attacggtcacactgctcatgactg

SEQ ID NO: 205264 - DNA, 25 bp, Rattus norvegicus
attacggtcacagtgctcatgactg

SEQ ID NO: 205265 - DNA, 25 bp, Rattus norvegicus
attacggtcactattaaacatcatg

SEQ ID NO: 205266 - DNA, 25 bp, Rattus norvegicus
attacggtcacttttaaacatcatg

SEQ ID NO: 205267 - DNA, 25 bp, Rattus norvegicus
attacggtctgtctgtcgagttgca

SEQ ID NO: 205268 - DNA, 25 bp, Rattus norvegicus
attacggtctgtgtgtcgagttgca

SEQ ID NO: 205269 - DNA, 25 bp, Rattus norvegicus
attacgtagccaaaatctcatttgg

SEQ ID NO: 205270 - DNA, 25 bp, Rattus norvegicus
attacgtagccataatctcatttgg

SEQ ID NO: 205271 - DNA, 25 bp, Rattus norvegicus
attacgtctgacagtctgtgcttta

SEQ ID NO: 205272 - DNA, 25 bp, Rattus norvegicus
attacgtctgactgtctgtgcttta

SEQ ID NO: 205273 - DNA, 25 bp, Rattus norvegicus
attacgtgaatgaccctgagagcga

SEQ ID NO: 205274 - DNA, 25 bp, Rattus norvegicus
attacgtgaatgtccctgagagcga

SEQ ID NO: 205275 - DNA, 25 bp, Rattus norvegicus
attacgtgccccattggtagagtcg

SEQ ID NO: 205276 - DNA, 25 bp, Rattus norvegicus
attacgtgcccctttggtagagtcg

SEQ ID NO: 205277 - DNA, 25 bp, Rattus norvegicus
attacgtgggcacatacttaatggt

SEQ ID NO: 205278 - DNA, 25 bp, Rattus norvegicus
attacgtgggcagatacttaatggt

SEQ ID NO: 205279 - DNA, 25 bp, Rattus norvegicus
attacgtgtgaacaacggcccaaag

SEQ ID NO: 205280 - DNA, 25 bp, Rattus norvegicus
attacgtgtgaagaacggcccaaag

SEQ ID NO: 205281 - DNA, 25 bp, Rattus norvegicus
attactaacattctgtcagcccact

SEQ ID NO: 205282 - DNA, 25 bp, Rattus norvegicus
attactaacattgtgtcagcccact

SEQ ID NO: 205283 - DNA, 25 bp, Rattus norvegicus
attactaatctactgtctctgctta

SEQ ID NO: 205284 - DNA, 25 bp, Rattus norvegicus
attactaatctagtgtctctgctta

SEQ ID NO: 205285 - DNA, 25 bp, Rattus norvegicus
attactacatcgcacaggttcagcc

SEQ ID NO: 205286 - DNA, 25 bp, Rattus norvegicus
attactacatcggacaggttcagcc

SEQ ID NO: 205287 - DNA, 25 bp, Rattus norvegicus
attactacctagagattcaactggg

SEQ ID NO: 205288 - DNA, 25 bp, Rattus norvegicus
attactacctagtgattcaactggg

SEQ ID NO: 205289 - DNA, 25 bp, Rattus norvegicus
attactactcgccattaagaccaag

SEQ ID NO: 205290 - DNA, 25 bp, Rattus norvegicus
attactactcgcgattaagaccaag

SEQ ID NO: 205291 - DNA, 25 bp, Rattus norvegicus
attactactgtactcgtgatggccg

SEQ ID NO: 205292 - DNA, 25 bp, Rattus norvegicus
attactactgtagtcgtgatggccg

SEQ ID NO: 205293 - DNA, 25 bp, Rattus norvegicus
attactactttaaagctctcatggt

SEQ ID NO: 205294 - DNA, 25 bp, Rattus norvegicus
attactactttatagctctcatggt

SEQ ID NO: 205295 - DNA, 25 bp, Rattus norvegicus
attactagtgacatcatgactggag

SEQ ID NO: 205296 - DNA, 25 bp, Rattus norvegicus
attactagtgacttcatgactggag

SEQ ID NO: 205297 - DNA, 25 bp, Rattus norvegicus
attactatacagatggtgttggttt

SEQ ID NO: 205298 - DNA, 25 bp, Rattus norvegicus
attactatacagttggtgttggttt

SEQ ID NO: 205299 - DNA, 25 bp, Rattus norvegicus
attactatcagtaaggtctgccata

SEQ ID NO: 205300 - DNA, 25 bp, Rattus norvegicus
attactatcagttaggtctgccata

SEQ ID NO: 205301 - DNA, 25 bp, Rattus norvegicus
attactatctgaacctttcgagcaa

SEQ ID NO: 205302 - DNA, 25 bp, Rattus norvegicus
attactatctgatcctttcgagcaa

SEQ ID NO: 205303 - DNA, 25 bp, Rattus norvegicus
attactatgatgatctttactgtgg

SEQ ID NO: 205304 - DNA, 25 bp, Rattus norvegicus
attactatgatgttctttactgtgg

SEQ ID NO: 205305 - DNA, 25 bp, Rattus norvegicus
attactatgcacagaaggagaacga

SEQ ID NO: 205306 - DNA, 25 bp, Rattus norvegicus
attactatgcactgaaggagaacga

SEQ ID NO: 205307 - DNA, 25 bp, Rattus norvegicus
attactatgctcaatgtgtgggctt

SEQ ID NO: 205308 - DNA, 25 bp, Rattus norvegicus
attactatgctctatgtgtgggctt

SEQ ID NO: 205309 - DNA, 25 bp, Rattus norvegicus
attactatggagacctggcagccca

SEQ ID NO: 205310 - DNA, 25 bp, Rattus norvegicus
attactatggagtcctggcagccca

SEQ ID NO: 205311 - DNA, 25 bp, Rattus norvegicus
attactatgtgtctaggtccttccc

SEQ ID NO: 205312 - DNA, 25 bp, Rattus norvegicus
attactatgtgtgtaggtccttccc

SEQ ID NO: 205313 - DNA, 25 bp, Rattus norvegicus
attactattgctattgccaaaggca

SEQ ID NO: 205314 - DNA, 25 bp, Rattus norvegicus
attactattgcttttgccaaaggca

SEQ ID NO: 205315 - DNA, 25 bp, Rattus norvegicus
attactcagctgctggctgctaatc

SEQ ID NO: 205316 - DNA, 25 bp, Rattus norvegicus
attactcagctggtggctgctaatc

SEQ ID NO: 205317 - DNA, 25 bp, Rattus norvegicus
attactcatattctcatcaactttg

SEQ ID NO: 205318 - DNA, 25 bp, Rattus norvegicus
attactcatattgtcatcaactttg

SEQ ID NO: 205319 - DNA, 25 bp, Rattus norvegicus
attactccggagacagggtttggct

SEQ ID NO: 205320 - DNA, 25 bp, Rattus norvegicus
attactccggagtcagggtttggct

SEQ ID NO: 205321 - DNA, 25 bp, Rattus norvegicus
attactcctgtcacacagttgaatg

SEQ ID NO: 205322 - DNA, 25 bp, Rattus norvegicus
attactcctgtctcacagttgaatg

SEQ ID NO: 205323 - DNA, 25 bp, Rattus norvegicus
attactcctgtgatgcttggtgaaa

SEQ ID NO: 205324 - DNA, 25 bp, Rattus norvegicus
attactcctgtgttgcttggtgaaa

SEQ ID NO: 205325 - DNA, 25 bp, Rattus norvegicus
attactccttagcagtggttgttac

SEQ ID NO: 205326 - DNA, 25 bp, Rattus norvegicus
attactccttaggagtggttgttac

SEQ ID NO: 205327 - DNA, 25 bp, Rattus norvegicus
attactccttttcccagattactgt

SEQ ID NO: 205328 - DNA, 25 bp, Rattus norvegicus
attactccttttgccagattactgt

SEQ ID NO: 205329 - DNA, 25 bp, Rattus norvegicus
attactcgagacagtgcacactgat

SEQ ID NO: 205330 - DNA, 25 bp, Rattus norvegicus
attactcgagactgtgcacactgat

SEQ ID NO: 205331 - DNA, 25 bp, Rattus norvegicus
attactcggacaaacagctcttgac

SEQ ID NO: 205332 - DNA, 25 bp, Rattus norvegicus
attactcggacatacagctcttgac

SEQ ID NO: 205333 - DNA, 25 bp, Rattus norvegicus
attactcggagcacgtttctacagt

SEQ ID NO: 205334 - DNA, 25 bp, Rattus norvegicus
attactcggagctcgtttctacagt

SEQ ID NO: 205335 - DNA, 25 bp, Rattus norvegicus
attactctaatacctgcccaatggg

SEQ ID NO: 205336 - DNA, 25 bp, Rattus norvegicus
attactctaatagctgcccaatggg

SEQ ID NO: 205337 - DNA, 25 bp, Rattus norvegicus
attactctatgcattttcatctcag

SEQ ID NO: 205338 - DNA, 25 bp, Rattus norvegicus
attactctatgctttttcatctcag

SEQ ID NO: 205339 - DNA, 25 bp, Rattus norvegicus
attactctcaaacccaagttcttgt

SEQ ID NO: 205340 - DNA, 25 bp, Rattus norvegicus
attactctcaaagccaagttcttgt

SEQ ID NO: 205341 - DNA, 25 bp, Rattus norvegicus
attactctgagaattatcaacagcc

SEQ ID NO: 205342 - DNA, 25 bp, Rattus norvegicus
attactctgagatttatcaacagcc

SEQ ID NO: 205343 - DNA, 25 bp, Rattus norvegicus
attactctgctaatatgctgacctg

SEQ ID NO: 205344 - DNA, 25 bp, Rattus norvegicus
attactctgctattatgctgacctg

SEQ ID NO: 205345 - DNA, 25 bp, Rattus norvegicus
attactctgctgagtatgtatagga

SEQ ID NO: 205346 - DNA, 25 bp, Rattus norvegicus
attactctgctgtgtatgtatagga

SEQ ID NO: 205347 - DNA, 25 bp, Rattus norvegicus
attactctgtaaatgtgcattggaa

SEQ ID NO: 205348 - DNA, 25 bp, Rattus norvegicus
attactctgtaattgtgcattggaa

SEQ ID NO: 205349 - DNA, 25 bp, Rattus norvegicus
attactcttctcagcgtggtacaca

SEQ ID NO: 205350 - DNA, 25 bp, Rattus norvegicus
attactcttctctgcgtggtacaca

SEQ ID NO: 205351 - DNA, 25 bp, Rattus norvegicus
attactcttgagagctctgctgtct

SEQ ID NO: 205352 - DNA, 25 bp, Rattus norvegicus
attactcttgagtgctctgctgtct

SEQ ID NO: 205353 - DNA, 25 bp, Rattus norvegicus
attactctttccaagcctggtaaag

SEQ ID NO: 205354 - DNA, 25 bp, Rattus norvegicus
attactctttcctagcctggtaaag

SEQ ID NO: 205355 - DNA, 25 bp, Rattus norvegicus
attactctttgtatcccaaatcctg

SEQ ID NO: 205356 - DNA, 25 bp, Rattus norvegicus
attactctttgtttcccaaatcctg

SEQ ID NO: 205357 - DNA, 25 bp, Rattus norvegicus
attactgacaagagtgcgtttccta

SEQ ID NO: 205358 - DNA, 25 bp, Rattus norvegicus
attactgacaagtgtgcgtttccta

SEQ ID NO: 205359 - DNA, 25 bp, Rattus norvegicus
attactgacatcagggccttcacag

SEQ ID NO: 205360 - DNA, 25 bp, Rattus norvegicus
attactgacatctgggccttcacag

SEQ ID NO: 205361 - DNA, 25 bp, Rattus norvegicus
attactgaccgcctctttagttaca

SEQ ID NO: 205362 - DNA, 25 bp, Rattus norvegicus
attactgaccgcgtctttagttaca

SEQ ID NO: 205363 - DNA, 25 bp, Rattus norvegicus
attactgactacattgtggacatga

SEQ ID NO: 205364 - DNA, 25 bp, Rattus norvegicus
attactgactactttgtggacatga

SEQ ID NO: 205365 - DNA, 25 bp, Rattus norvegicus
attactgacttacatatggtggaca

SEQ ID NO: 205366 - DNA, 25 bp, Rattus norvegicus
attactgacttagatatggtggaca

SEQ ID NO: 205367 - DNA, 25 bp, Rattus norvegicus
attactgagctgatgcaggtcgaga

SEQ ID NO: 205368 - DNA, 25 bp, Rattus norvegicus
attactgagctgttgcaggtcgaga

SEQ ID NO: 205369 - DNA, 25 bp, Rattus norvegicus
attactgagtcacactcttagcctc

SEQ ID NO: 205370 - DNA, 25 bp, Rattus norvegicus
attactgagtcagactcttagcctc

SEQ ID NO: 205371 - DNA, 25 bp, Rattus norvegicus
attactgatgctattctgtcctgag

SEQ ID NO: 205372 - DNA, 25 bp, Rattus norvegicus
attactgatgcttttctgtcctgag

SEQ ID NO: 205373 - DNA, 25 bp, Rattus norvegicus
attactgatgttagtggtgtttcta

SEQ ID NO: 205374 - DNA, 25 bp, Rattus norvegicus
attactgatgtttgtggtgtttcta

SEQ ID NO: 205375 - DNA, 25 bp, Rattus norvegicus
attactgattcacctacgcagcaga

SEQ ID NO: 205376 - DNA, 25 bp, Rattus norvegicus
attactgattcagctacgcagcaga

SEQ ID NO: 205377 - DNA, 25 bp, Rattus norvegicus
attactgcaactagacctagccgga

SEQ ID NO: 205378 - DNA, 25 bp, Rattus norvegicus
attactgcaacttgacctagccgga

SEQ ID NO: 205379 - DNA, 25 bp, Rattus norvegicus
attactgccatgagtacttcatccg

SEQ ID NO: 205380 - DNA, 25 bp, Rattus norvegicus
attactgccatgtgtacttcatccg

SEQ ID NO: 205381 - DNA, 25 bp, Rattus norvegicus
attactgccttgagctttctgaaac

SEQ ID NO: 205382 - DNA, 25 bp, Rattus norvegicus
attactgccttgctgtaactgccct

SEQ ID NO: 205383 - DNA, 25 bp, Rattus norvegicus
attactgccttggtgtaactgccct

SEQ ID NO: 205384 - DNA, 25 bp, Rattus norvegicus
attactgccttgtgctttctgaaac

SEQ ID NO: 205385 - DNA, 25 bp, Rattus norvegicus
attactgctccaaatcccaatgcct

SEQ ID NO: 205386 - DNA, 25 bp, Rattus norvegicus
attactgctccatatcccaatgcct

SEQ ID NO: 205387 - DNA, 25 bp, Rattus norvegicus
attactgctgctcatatactcatga

SEQ ID NO: 205388 - DNA, 25 bp, Rattus norvegicus
attactgctgctgatatactcatga

SEQ ID NO: 205389 - DNA, 25 bp, Rattus norvegicus
attactggaacaacttacaaggcta

SEQ ID NO: 205390 - DNA, 25 bp, Rattus norvegicus
attactggaacatcttacaaggcta

SEQ ID NO: 205391 - DNA, 25 bp, Rattus norvegicus
attactggagctatattttcacttg

SEQ ID NO: 205392 - DNA, 25 bp, Rattus norvegicus
attactggagctttattttcacttg

SEQ ID NO: 205393 - DNA, 25 bp, Rattus norvegicus
attactggatcccagtctggccttg

SEQ ID NO: 205394 - DNA, 25 bp, Rattus norvegicus
attactggatccgagtctggccttg

SEQ ID NO: 205395 - DNA, 25 bp, Rattus norvegicus
attactggattgcattttcatatga

SEQ ID NO: 205396 - DNA, 25 bp, Rattus norvegicus
attactggattggattttcatatga

SEQ ID NO: 205397 - DNA, 25 bp, Rattus norvegicus
attactggcaagctctctatcaagg

SEQ ID NO: 205398 - DNA, 25 bp, Rattus norvegicus
attactggcaaggtctctatcaagg

SEQ ID NO: 205399 - DNA, 25 bp, Rattus norvegicus
attactggctacaccttcagagaat

SEQ ID NO: 205400 - DNA, 25 bp, Rattus norvegicus
attactggctactccttcagagaat

SEQ ID NO: 205401 - DNA, 25 bp, Rattus norvegicus
attactgggtgccagcaacgtgctg

SEQ ID NO: 205402 - DNA, 25 bp, Rattus norvegicus
attactgggtgcgagcaacgtgctg

SEQ ID NO: 205403 - DNA, 25 bp, Rattus norvegicus
attactggtcaacgtgtgggctttc

SEQ ID NO: 205404 - DNA, 25 bp, Rattus norvegicus
attactggtcaaggtgtgggctttc

SEQ ID NO: 205405 - DNA, 25 bp, Rattus norvegicus
attactgtatctcacagacttcaca

SEQ ID NO: 205406 - DNA, 25 bp, Rattus norvegicus
attactgtatctgacagacttcaca

SEQ ID NO: 205407 - DNA, 25 bp, Rattus norvegicus
attactgtcacgcaactaccgtatc

SEQ ID NO: 205408 - DNA, 25 bp, Rattus norvegicus
attactgtcacggaactaccgtatc

SEQ ID NO: 205409 - DNA, 25 bp, Rattus norvegicus
attactgtcatcatgttaatgtcta

SEQ ID NO: 205410 - DNA, 25 bp, Rattus norvegicus
attactgtcatcttgttaatgtcta

SEQ ID NO: 205411 - DNA, 25 bp, Rattus norvegicus
attactgtccctattactgttttga

SEQ ID NO: 205412 - DNA, 25 bp, Rattus norvegicus
attactgtcccttttactgttttga

SEQ ID NO: 205413 - DNA, 25 bp, Rattus norvegicus
attactgtcctaaaaagggatcacc

SEQ ID NO: 205414 - DNA, 25 bp, Rattus norvegicus
attactgtcctataaagggatcacc

SEQ ID NO: 205415 - DNA, 25 bp, Rattus norvegicus
attactgtcgacacaattctggccg

SEQ ID NO: 205416 - DNA, 25 bp, Rattus norvegicus
attactgtcgactcaattctggccg

SEQ ID NO: 205417 - DNA, 25 bp, Rattus norvegicus
attactgtcgctcttactgtcgtta

SEQ ID NO: 205418 - DNA, 25 bp, Rattus norvegicus
attactgtcgctgttactgtcgtta

SEQ ID NO: 205419 - DNA, 25 bp, Rattus norvegicus
attactgtctacataatccctgatg

SEQ ID NO: 205420 - DNA, 25 bp, Rattus norvegicus
attactgtctacttaatccctgatg

SEQ ID NO: 205421 - DNA, 25 bp, Rattus norvegicus
attactgtgctgaagaatcacccag

SEQ ID NO: 205422 - DNA, 25 bp, Rattus norvegicus
attactgtgctgtagaatcacccag

SEQ ID NO: 205423 - DNA, 25 bp, Rattus norvegicus
attactgtgtatcctagttggcctc

SEQ ID NO: 205424 - DNA, 25 bp, Rattus norvegicus
attactgtgtatgctagttggcctc

SEQ ID NO: 205425 - DNA, 25 bp, Rattus norvegicus
attactgtttatcactaccaaatgt

SEQ ID NO: 205426 - DNA, 25 bp, Rattus norvegicus
attactgtttatgactaccaaatgt

SEQ ID NO: 205427 - DNA, 25 bp, Rattus norvegicus
attactgtttggcactctgagagct

SEQ ID NO: 205428 - DNA, 25 bp, Rattus norvegicus
attactgtttgggactctgagagct

SEQ ID NO: 205429 - DNA, 25 bp, Rattus norvegicus
attacttaagctcagcatggtgaca

SEQ ID NO: 205430 - DNA, 25 bp, Rattus norvegicus
attacttaagctgagcatggtgaca

SEQ ID NO: 205431 - DNA, 25 bp, Rattus norvegicus
attacttaccttccaactttcatgt

SEQ ID NO: 205432 - DNA, 25 bp, Rattus norvegicus
attacttaccttgcaactttcatgt

SEQ ID NO: 205433 - DNA, 25 bp, Rattus norvegicus
attacttactctctagttcttgctc

SEQ ID NO: 205434 - DNA, 25 bp, Rattus norvegicus
attacttactctgtagttcttgctc

SEQ ID NO: 205435 - DNA, 25 bp, Rattus norvegicus
attacttatgctatgacatgtgaag

SEQ ID NO: 205436 - DNA, 25 bp, Rattus norvegicus
attacttatgctttgacatgtgaag

SEQ ID NO: 205437 - DNA, 25 bp, Rattus norvegicus
attacttcagacaatgctcttcaaa

SEQ ID NO: 205438 - DNA, 25 bp, Rattus norvegicus
attacttcagactatgctcttcaaa

SEQ ID NO: 205439 - DNA, 25 bp, Rattus norvegicus
attacttccatgattgattcccttt

SEQ ID NO: 205440 - DNA, 25 bp, Rattus norvegicus
attacttccatgtttgattcccttt

SEQ ID NO: 205441 - DNA, 25 bp, Rattus norvegicus
attacttctatgacctgctgtaggc

SEQ ID NO: 205442 - DNA, 25 bp, Rattus norvegicus
attacttctatgtcctgctgtaggc

SEQ ID NO: 205443 - DNA, 25 bp, Rattus norvegicus
attacttctgataggcggtctattt

SEQ ID NO: 205444 - DNA, 25 bp, Rattus norvegicus
attacttctgattggcggtctattt

SEQ ID NO: 205445 - DNA, 25 bp, Rattus norvegicus
attacttctgcactagagttcttaa

SEQ ID NO: 205446 - DNA, 25 bp, Rattus norvegicus
attacttctgcagtagagttcttaa

SEQ ID NO: 205447 - DNA, 25 bp, Rattus norvegicus
attacttcttggctttgtgttcagc

SEQ ID NO: 205448 - DNA, 25 bp, Rattus norvegicus
attacttcttgggtttgtgttcagc

SEQ ID NO: 205449 - DNA, 25 bp, Rattus norvegicus
attacttgcgatcctgatgccctgc

SEQ ID NO: 205450 - DNA, 25 bp, Rattus norvegicus
attacttgcgatgctgatgccctgc

SEQ ID NO: 205451 - DNA, 25 bp, Rattus norvegicus
attactttacttcttgtttgcaggg

SEQ ID NO: 205452 - DNA, 25 bp, Rattus norvegicus
attactttacttgttgtttgcaggg

SEQ ID NO: 205453 - DNA, 25 bp, Rattus norvegicus
attactttatttacttgctctattt

SEQ ID NO: 205454 - DNA, 25 bp, Rattus norvegicus
attactttattttcttgctctattt

SEQ ID NO: 205455 - DNA, 25 bp, Rattus norvegicus
attactttctatatgtcacgatcag

SEQ ID NO: 205456 - DNA, 25 bp, Rattus norvegicus
attactttctatttgtcacgatcag

SEQ ID NO: 205457 - DNA, 25 bp, Rattus norvegicus
attactttgctgagaatttttctat

SEQ ID NO: 205458 - DNA, 25 bp, Rattus norvegicus
attactttgctgtgaatttttctat

SEQ ID NO: 205459 - DNA, 25 bp, Rattus norvegicus
attactttgcttatgcatcggaaaa

SEQ ID NO: 205460 - DNA, 25 bp, Rattus norvegicus
attactttgcttttgcatcggaaaa

SEQ ID NO: 205461 - DNA, 25 bp, Rattus norvegicus
attactttggacatctaatcctcct

SEQ ID NO: 205462 - DNA, 25 bp, Rattus norvegicus
attactttggacttctaatcctcct

SEQ ID NO: 205463 - DNA, 25 bp, Rattus norvegicus
attactttggtcaagtggccatgac

SEQ ID NO: 205464 - DNA, 25 bp, Rattus norvegicus
attactttggtctagtggccatgac

SEQ ID NO: 205465 - DNA, 25 bp, Rattus norvegicus
attactttgtgtatccacacccgag

SEQ ID NO: 205466 - DNA, 25 bp, Rattus norvegicus
attactttgtgtttccacacccgag

SEQ ID NO: 205467 - DNA, 25 bp, Rattus norvegicus
attacttttattactcctacagtat

SEQ ID NO: 205468 - DNA, 25 bp, Rattus norvegicus
attacttttatttctcctacagtat

SEQ ID NO: 205469 - DNA, 25 bp, Rattus norvegicus
attagaaacccacaagcaagtcatg

SEQ ID NO: 205470 - DNA, 25 bp, Rattus norvegicus
attagaaacccagaagcaagtcatg

SEQ ID NO: 205471 - DNA, 25 bp, Rattus norvegicus
attagaacgattccctgccaaggac

SEQ ID NO: 205472 - DNA, 25 bp, Rattus norvegicus
attagaacgattgcctgccaaggac

SEQ ID NO: 205473 - DNA, 25 bp, Rattus norvegicus
attagaacgcgtcggaatatccgac

SEQ ID NO: 205474 - DNA, 25 bp, Rattus norvegicus
attagaacgcgtgggaatatccgac

SEQ ID NO: 205475 - DNA, 25 bp, Rattus norvegicus
attagaaggcgcctgcagctcaatg

SEQ ID NO: 205476 - DNA, 25 bp, Rattus norvegicus
attagaaggcgcgtgcagctcaatg

SEQ ID NO: 205477 - DNA, 25 bp, Rattus norvegicus
attagaagtgacagccacgcccatg

SEQ ID NO: 205478 - DNA, 25 bp, Rattus norvegicus
attagaagtgactgccacgcccatg

SEQ ID NO: 205479 - DNA, 25 bp, Rattus norvegicus
attagaatgtgcaggtctgtggatt

SEQ ID NO: 205480 - DNA, 25 bp, Rattus norvegicus
attagaatgtgctggtctgtggatt

SEQ ID NO: 205481 - DNA, 25 bp, Rattus norvegicus
attagacaatctaccccagagtcct

SEQ ID NO: 205482 - DNA, 25 bp, Rattus norvegicus
attagacaatcttccccagagtcct

SEQ ID NO: 205483 - DNA, 25 bp, Rattus norvegicus
attagacacgagacccagggagaca

SEQ ID NO: 205484 - DNA, 25 bp, Rattus norvegicus
attagacacgagtcccagggagaca

SEQ ID NO: 205485 - DNA, 25 bp, Rattus norvegicus
attagacagtcacatttcccactct

SEQ ID NO: 205486 - DNA, 25 bp, Rattus norvegicus
attagacagtcagatttcccactct

SEQ ID NO: 205487 - DNA, 25 bp, Rattus norvegicus
attagacatctgaacctgggcatag

SEQ ID NO: 205488 - DNA, 25 bp, Rattus norvegicus
attagacatctgtacctgggcatag

SEQ ID NO: 205489 - DNA, 25 bp, Rattus norvegicus
attagacatcttacaactctgtgat

SEQ ID NO: 205490 - DNA, 25 bp, Rattus norvegicus
attagacatctttcaactctgtgat

SEQ ID NO: 205491 - DNA, 25 bp, Rattus norvegicus
attagacatgcgctcagatcccaag

SEQ ID NO: 205492 - DNA, 25 bp, Rattus norvegicus
attagacatgcggtcagatcccaag

SEQ ID NO: 205493 - DNA, 25 bp, Rattus norvegicus
attagacgaggcaagtccctaccac

SEQ ID NO: 205494 - DNA, 25 bp, Rattus norvegicus
attagacgaggctagtccctaccac

SEQ ID NO: 205495 - DNA, 25 bp, Rattus norvegicus
attagacggtggcaaagctcacgga

SEQ ID NO: 205496 - DNA, 25 bp, Rattus norvegicus
attagacggtgggaaagctcacgga

SEQ ID NO: 205497 - DNA, 25 bp, Rattus norvegicus
attagactaacaacacctcatcacc

SEQ ID NO: 205498 - DNA, 25 bp, Rattus norvegicus
attagactaacatcacctcatcacc

SEQ ID NO: 205499 - DNA, 25 bp, Rattus norvegicus
attagactactgcaccctagtgggt

SEQ ID NO: 205500 - DNA, 25 bp, Rattus norvegicus
attagactactggaccctagtgggt

SEQ ID NO: 205501 - DNA, 25 bp, Rattus norvegicus
attagacttgccacaaggcaccgtt

SEQ ID NO: 205502 - DNA, 25 bp, Rattus norvegicus
attagacttgcctcaaggcaccgtt

SEQ ID NO: 205503 - DNA, 25 bp, Rattus norvegicus
attagactttgcagagagccctcat

SEQ ID NO: 205504 - DNA, 25 bp, Rattus norvegicus
attagactttgctgagagccctcat

SEQ ID NO: 205505 - DNA, 25 bp, Rattus norvegicus
attagagaaatgacacccttcactt

SEQ ID NO: 205506 - DNA, 25 bp, Rattus norvegicus
attagagaaatgtcacccttcactt

SEQ ID NO: 205507 - DNA, 25 bp, Rattus norvegicus
attagagaacgcaccagcaaccacg

SEQ ID NO: 205508 - DNA, 25 bp, Rattus norvegicus
attagagaacgctccagcaaccacg

SEQ ID NO: 205509 - DNA, 25 bp, Rattus norvegicus
attagagagcaccatctcccttggt

SEQ ID NO: 205510 - DNA, 25 bp, Rattus norvegicus
attagagagcacgatctcccttggt

SEQ ID NO: 205511 - DNA, 25 bp, Rattus norvegicus
attagagagtggaagaaaatgctgc

SEQ ID NO: 205512 - DNA, 25 bp, Rattus norvegicus
attagagagtggtagaaaatgctgc

SEQ ID NO: 205513 - DNA, 25 bp, Rattus norvegicus
attagagatcaccatgctgtcccag

SEQ ID NO: 205514 - DNA, 25 bp, Rattus norvegicus
attagagatcacgatgctgtcccag

SEQ ID NO: 205515 - DNA, 25 bp, Rattus norvegicus
attagagccaaaaacttcccttcat

SEQ ID NO: 205516 - DNA, 25 bp, Rattus norvegicus
attagagccaaatacttcccttcat

SEQ ID NO: 205517 - DNA, 25 bp, Rattus norvegicus
attagagccaacaatcgggcgctag

SEQ ID NO: 205518 - DNA, 25 bp, Rattus norvegicus
attagagccaactatcgggcgctag

SEQ ID NO: 205519 - DNA, 25 bp, Rattus norvegicus
attagagccactcttttgtctgtct

SEQ ID NO: 205520 - DNA, 25 bp, Rattus norvegicus
attagagccactgttttgtctgtct

SEQ ID NO: 205521 - DNA, 25 bp, Rattus norvegicus
attagagccagtacacacactggga

SEQ ID NO: 205522 - DNA, 25 bp, Rattus norvegicus
attagagccagttcacacactggga

SEQ ID NO: 205523 - DNA, 25 bp, Rattus norvegicus
attagagccttaagtcaaccccaga

SEQ ID NO: 205524 - DNA, 25 bp, Rattus norvegicus
attagagccttacagtgccccacca

SEQ ID NO: 205525 - DNA, 25 bp, Rattus norvegicus
attagagccttagagtgccccacca

SEQ ID NO: 205526 - DNA, 25 bp, Rattus norvegicus
attagagccttatgtcaaccccaga

SEQ ID NO: 205527 - DNA, 25 bp, Rattus norvegicus
attagagcgtagcacttcaccattc

SEQ ID NO: 205528 - DNA, 25 bp, Rattus norvegicus
attagagcgtaggacttcaccattc

SEQ ID NO: 205529 - DNA, 25 bp, Rattus norvegicus
attagagctgccacgaactgtgtca

SEQ ID NO: 205530 - DNA, 25 bp, Rattus norvegicus
attagagctgcctcgaactgtgtca

SEQ ID NO: 205531 - DNA, 25 bp, Rattus norvegicus
attagagctgctcgccaatagaccg

SEQ ID NO: 205532 - DNA, 25 bp, Rattus norvegicus
attagagctgctggccaatagaccg

SEQ ID NO: 205533 - DNA, 25 bp, Rattus norvegicus
attagaggcagaccagcccagggca

SEQ ID NO: 205534 - DNA, 25 bp, Rattus norvegicus
attagaggcagagcagcccagggca

SEQ ID NO: 205535 - DNA, 25 bp, Rattus norvegicus
attagaggcgagcaccaccatggtc

SEQ ID NO: 205536 - DNA, 25 bp, Rattus norvegicus
attagaggcgaggaccaccatggtc

SEQ ID NO: 205537 - DNA, 25 bp, Rattus norvegicus
attagaggtggcagccatggccctc

SEQ ID NO: 205538 - DNA, 25 bp, Rattus norvegicus
attagaggtggctgccatggccctc

SEQ ID NO: 205539 - DNA, 25 bp, Rattus norvegicus
attagagtcagtcgcctctactgca

SEQ ID NO: 205540 - DNA, 25 bp, Rattus norvegicus
attagagtcagtggcctctactgca

SEQ ID NO: 205541 - DNA, 25 bp, Rattus norvegicus
attagagtctacatttggccatgaa

SEQ ID NO: 205542 - DNA, 25 bp, Rattus norvegicus
attagagtctacttttggccatgaa

SEQ ID NO: 205543 - DNA, 25 bp, Rattus norvegicus
attagataagttctgtatcctggga

SEQ ID NO: 205544 - DNA, 25 bp, Rattus norvegicus
attagataagttgtgtatcctggga

SEQ ID NO: 205545 - DNA, 25 bp, Rattus norvegicus
attagatcacttccaaagggtgaga

SEQ ID NO: 205546 - DNA, 25 bp, Rattus norvegicus
attagatcacttgcaaagggtgaga

SEQ ID NO: 205547 - DNA, 25 bp, Rattus norvegicus
attagatcagctacccagagccaat

SEQ ID NO: 205548 - DNA, 25 bp, Rattus norvegicus
attagatcagcttcccagagccaat

SEQ ID NO: 205549 - DNA, 25 bp, Rattus norvegicus
attagatcaggtccctcactgtgtc

SEQ ID NO: 205550 - DNA, 25 bp, Rattus norvegicus
attagatcaggtgcctcactgtgtc

SEQ ID NO: 205551 - DNA, 25 bp, Rattus norvegicus
attagatccgttaccattgaagaat

SEQ ID NO: 205552 - DNA, 25 bp, Rattus norvegicus
attagatccgtttccattgaagaat

SEQ ID NO: 205553 - DNA, 25 bp, Rattus norvegicus
attagatgctatcttcccagaagga

SEQ ID NO: 205554 - DNA, 25 bp, Rattus norvegicus
attagatgctatgttcccagaagga

SEQ ID NO: 205555 - DNA, 25 bp, Rattus norvegicus
attagatgctgcagcctcaggcagg

SEQ ID NO: 205556 - DNA, 25 bp, Rattus norvegicus
attagatgctgctgcctcaggcagg

SEQ ID NO: 205557 - DNA, 25 bp, Rattus norvegicus
attagatggagcacttcccagccaa

SEQ ID NO: 205558 - DNA, 25 bp, Rattus norvegicus
attagatggagctcttcccagccaa

SEQ ID NO: 205559 - DNA, 25 bp, Rattus norvegicus
attagatggtgcctgtccctgagac

SEQ ID NO: 205560 - DNA, 25 bp, Rattus norvegicus
attagatggtgcgtgtccctgagac

SEQ ID NO: 205561 - DNA, 25 bp, Rattus norvegicus
attagatggtggctctcgcaggtcc

SEQ ID NO: 205562 - DNA, 25 bp, Rattus norvegicus
attagatggtgggtctcgcaggtcc

SEQ ID NO: 205563 - DNA, 25 bp, Rattus norvegicus
attagatggtttagtgccctgggct

SEQ ID NO: 205564 - DNA, 25 bp, Rattus norvegicus
attagatggttttgtgccctgggct

SEQ ID NO: 205565 - DNA, 25 bp, Rattus norvegicus
attagattcttgaatcttcttccac

SEQ ID NO: 205566 - DNA, 25 bp, Rattus norvegicus
attagattcttgtatcttcttccac

SEQ ID NO: 205567 - DNA, 25 bp, Rattus norvegicus
attagattgcttacttcctccagcg

SEQ ID NO: 205568 - DNA, 25 bp, Rattus norvegicus
attagattgctttcttcctccagcg

SEQ ID NO: 205569 - DNA, 25 bp, Rattus norvegicus
attagcaaactgctcctcaatcttc

SEQ ID NO: 205570 - DNA, 25 bp, Rattus norvegicus
attagcaaactggtcctcaatcttc

SEQ ID NO: 205571 - DNA, 25 bp, Rattus norvegicus
attagcaaccaccagaatgacttct

SEQ ID NO: 205572 - DNA, 25 bp, Rattus norvegicus
attagcaaccacgagaatgacttct

SEQ ID NO: 205573 - DNA, 25 bp, Rattus norvegicus
attagcaaccagatgcagcattttt

SEQ ID NO: 205574 - DNA, 25 bp, Rattus norvegicus
attagcaaccagttgcagcattttt

SEQ ID NO: 205575 - DNA, 25 bp, Rattus norvegicus
attagcaatctactattcaagccag

SEQ ID NO: 205576 - DNA, 25 bp, Rattus norvegicus
attagcaatctagtattcaagccag

SEQ ID NO: 205577 - DNA, 25 bp, Rattus norvegicus
attagcaatgctcagctgcagactg

SEQ ID NO: 205578 - DNA, 25 bp, Rattus norvegicus
attagcaatgctgagctgcagactg

SEQ ID NO: 205579 - DNA, 25 bp, Rattus norvegicus
attagcacaagtcacagcatccggc

SEQ ID NO: 205580 - DNA, 25 bp, Rattus norvegicus
attagcacaagtgacagcatccggc

SEQ ID NO: 205581 - DNA, 25 bp, Rattus norvegicus
attagcacactcaatgactgtttat

SEQ ID NO: 205582 - DNA, 25 bp, Rattus norvegicus
attagcacactctatgactgtttat

SEQ ID NO: 205583 - DNA, 25 bp, Rattus norvegicus
attagcactcaaatatcctcaagga

SEQ ID NO: 205584 - DNA, 25 bp, Rattus norvegicus
attagcactcaattatcctcaagga

SEQ ID NO: 205585 - DNA, 25 bp, Rattus norvegicus
attagcactcgtaagagcaattttt

SEQ ID NO: 205586 - DNA, 25 bp, Rattus norvegicus
attagcactcgttagagcaattttt

SEQ ID NO: 205587 - DNA, 25 bp, Rattus norvegicus
attagcactgtgcttactctcttca

SEQ ID NO: 205588 - DNA, 25 bp, Rattus norvegicus
attagcactgtggttactctcttca

SEQ ID NO: 205589 - DNA, 25 bp, Rattus norvegicus
attagcagcccgatgtcatgtggac

SEQ ID NO: 205590 - DNA, 25 bp, Rattus norvegicus
attagcagcccgttgtcatgtggac

SEQ ID NO: 205591 - DNA, 25 bp, Rattus norvegicus
attagcaggcaacttcttcatcaca

SEQ ID NO: 205592 - DNA, 25 bp, Rattus norvegicus
attagcaggcaagttcttcatcaca

SEQ ID NO: 205593 - DNA, 25 bp, Rattus norvegicus
attagcagtccgcttgcttctggaa

SEQ ID NO: 205594 - DNA, 25 bp, Rattus norvegicus
attagcagtccggttgcttctggaa

SEQ ID NO: 205595 - DNA, 25 bp, Rattus norvegicus
attagcatccagctggtgttccgtg

SEQ ID NO: 205596 - DNA, 25 bp, Rattus norvegicus
attagcatccaggtggtgttccgtg

SEQ ID NO: 205597 - DNA, 25 bp, Rattus norvegicus
attagcatcctaactcacgaccgag

SEQ ID NO: 205598 - DNA, 25 bp, Rattus norvegicus
attagcatcctatctcacgaccgag

SEQ ID NO: 205599 - DNA, 25 bp, Rattus norvegicus
attagcatctgcacttaccggaggg

SEQ ID NO: 205600 - DNA, 25 bp, Rattus norvegicus
attagcatctgctcttaccggaggg

SEQ ID NO: 205601 - DNA, 25 bp, Rattus norvegicus
attagcatcttcaactcaagcgttg

SEQ ID NO: 205602 - DNA, 25 bp, Rattus norvegicus
attagcatcttctactcaagcgttg

SEQ ID NO: 205603 - DNA, 25 bp, Rattus norvegicus
attagcatgattccccaaatctcag

SEQ ID NO: 205604 - DNA, 25 bp, Rattus norvegicus
attagcatgattgcccaaatctcag

SEQ ID NO: 205605 - DNA, 25 bp, Rattus norvegicus
attagccaatcaatactctgccttg

SEQ ID NO: 205606 - DNA, 25 bp, Rattus norvegicus
attagccaatcattactctgccttg

SEQ ID NO: 205607 - DNA, 25 bp, Rattus norvegicus
attagcccagaacctctctgacttc

SEQ ID NO: 205608 - DNA, 25 bp, Rattus norvegicus
attagcccagaagctctctgacttc

SEQ ID NO: 205609 - DNA, 25 bp, Rattus norvegicus
attagcccaggtcgccaaagctgtg

SEQ ID NO: 205610 - DNA, 25 bp, Rattus norvegicus
attagcccaggtggccaaagctgtg

SEQ ID NO: 205611 - DNA, 25 bp, Rattus norvegicus
attagccccaagaaatccaagctga

SEQ ID NO: 205612 - DNA, 25 bp, Rattus norvegicus
attagccccaagtaatccaagctga

SEQ ID NO: 205613 - DNA, 25 bp, Rattus norvegicus
attagccctggcacgagtgacggat

SEQ ID NO: 205614 - DNA, 25 bp, Rattus norvegicus
attagccctggctcgagtgacggat

SEQ ID NO: 205615 - DNA, 25 bp, Rattus norvegicus
attagcccttgtccaaagagccagg

SEQ ID NO: 205616 - DNA, 25 bp, Rattus norvegicus
attagcccttgtgcaaagagccagg

SEQ ID NO: 205617 - DNA, 25 bp, Rattus norvegicus
attagccctttgcagacttgggtcc

SEQ ID NO: 205618 - DNA, 25 bp, Rattus norvegicus
attagccctttggagacttgggtcc

SEQ ID NO: 205619 - DNA, 25 bp, Rattus norvegicus
attagccgatatctggtcctttgag

SEQ ID NO: 205620 - DNA, 25 bp, Rattus norvegicus
attagccgatatgtggtcctttgag

SEQ ID NO: 205621 - DNA, 25 bp, Rattus norvegicus
attagccgtattacattaccgagta

SEQ ID NO: 205622 - DNA, 25 bp, Rattus norvegicus
attagccgtatttcattaccgagta

SEQ ID NO: 205623 - DNA, 25 bp, Rattus norvegicus
attagccgtgtgagtttgagctctg

SEQ ID NO: 205624 - DNA, 25 bp, Rattus norvegicus
attagccgtgtgtgtttgagctctg

SEQ ID NO: 205625 - DNA, 25 bp, Rattus norvegicus
attagcctagccatgtcagtcgctt

SEQ ID NO: 205626 - DNA, 25 bp, Rattus norvegicus
attagcctagccttgtcagtcgctt

SEQ ID NO: 205627 - DNA, 25 bp, Rattus norvegicus
attagcctcctaaaagcctcatgtg

SEQ ID NO: 205628 - DNA, 25 bp, Rattus norvegicus
attagcctcctataagcctcatgtg

SEQ ID NO: 205629 - DNA, 25 bp, Rattus norvegicus
attagcctctagagtgattgtcata

SEQ ID NO: 205630 - DNA, 25 bp, Rattus norvegicus
attagcctctagtgtgattgtcata

SEQ ID NO: 205631 - DNA, 25 bp, Rattus norvegicus
attagcctctcgacttgtctggaga

SEQ ID NO: 205632 - DNA, 25 bp, Rattus norvegicus
attagcctctcgtcttgtctggaga

SEQ ID NO: 205633 - DNA, 25 bp, Rattus norvegicus
attagcctgctacctgagagagcct

SEQ ID NO: 205634 - DNA, 25 bp, Rattus norvegicus
attagcctgctagctgagagagcct

SEQ ID NO: 205635 - DNA, 25 bp, Rattus norvegicus
attagcctggctctttttgtcttac

SEQ ID NO: 205636 - DNA, 25 bp, Rattus norvegicus
attagcctggctgtttttgtcttac

SEQ ID NO: 205637 - DNA, 25 bp, Rattus norvegicus
attagcctgtatagtctccaagcct

SEQ ID NO: 205638 - DNA, 25 bp, Rattus norvegicus
attagcctgtattgtctccaagcct

SEQ ID NO: 205639 - DNA, 25 bp, Rattus norvegicus
attagccttagaatctacctcacct

SEQ ID NO: 205640 - DNA, 25 bp, Rattus norvegicus
attagccttagattctacctcacct

SEQ ID NO: 205641 - DNA, 25 bp, Rattus norvegicus
attagccttcaacggtcaccacaga

SEQ ID NO: 205642 - DNA, 25 bp, Rattus norvegicus
attagccttcaagggtcaccacaga

SEQ ID NO: 205643 - DNA, 25 bp, Rattus norvegicus
attagcctttctacattttcaccat

SEQ ID NO: 205644 - DNA, 25 bp, Rattus norvegicus
attagcctttcttcattttcaccat

SEQ ID NO: 205645 - DNA, 25 bp, Rattus norvegicus
attagcgacgagctggaccacgccc

SEQ ID NO: 205646 - DNA, 25 bp, Rattus norvegicus
attagcgacgaggtggaccacgccc

SEQ ID NO: 205647 - DNA, 25 bp, Rattus norvegicus
attagcggacgaaagactcaccttc

SEQ ID NO: 205648 - DNA, 25 bp, Rattus norvegicus
attagcggacgatagactcaccttc

SEQ ID NO: 205649 - DNA, 25 bp, Rattus norvegicus
attagcgtatttacaacagcagtta

SEQ ID NO: 205650 - DNA, 25 bp, Rattus norvegicus
attagcgtattttcaacagcagtta

SEQ ID NO: 205651 - DNA, 25 bp, Rattus norvegicus
attagctacacactcccatattgaa

SEQ ID NO: 205652 - DNA, 25 bp, Rattus norvegicus
attagctacacagtcccatattgaa

SEQ ID NO: 205653 - DNA, 25 bp, Rattus norvegicus
attagctactgccagtaaattaaaa

SEQ ID NO: 205654 - DNA, 25 bp, Rattus norvegicus
attagctactgcgagtaaattaaaa

SEQ ID NO: 205655 - DNA, 25 bp, Rattus norvegicus
attagctattctattttcccctgag

SEQ ID NO: 205656 - DNA, 25 bp, Rattus norvegicus
attagctattcttttttcccctgag

SEQ ID NO: 205657 - DNA, 25 bp, Rattus norvegicus
attagctattggatttcttctggat

SEQ ID NO: 205658 - DNA, 25 bp, Rattus norvegicus
attagctattggttttcttctggat

SEQ ID NO: 205659 - DNA, 25 bp, Rattus norvegicus
attagctcaagtctgaccagtgtga

SEQ ID NO: 205660 - DNA, 25 bp, Rattus norvegicus
attagctcaagtgtgaccagtgtga

SEQ ID NO: 205661 - DNA, 25 bp, Rattus norvegicus
attagctcatcccagtgagttccag

SEQ ID NO: 205662 - DNA, 25 bp, Rattus norvegicus
attagctcatccgagtgagttccag

SEQ ID NO: 205663 - DNA, 25 bp, Rattus norvegicus
attagctcattgacaccagtctcca

SEQ ID NO: 205664 - DNA, 25 bp, Rattus norvegicus
attagctcattgtcaccagtctcca

SEQ ID NO: 205665 - DNA, 25 bp, Rattus norvegicus
attagctccattactcacaatcata

SEQ ID NO: 205666 - DNA, 25 bp, Rattus norvegicus
attagctccatttctcacaatcata

SEQ ID NO: 205667 - DNA, 25 bp, Rattus norvegicus
attagctcctgcattgagtcctaac

SEQ ID NO: 205668 - DNA, 25 bp, Rattus norvegicus
attagctcctgctttgagtcctaac

SEQ ID NO: 205669 - DNA, 25 bp, Rattus norvegicus
attagctctgggaatgactcccaag

SEQ ID NO: 205670 - DNA, 25 bp, Rattus norvegicus
attagctctgggtatgactcccaag

SEQ ID NO: 205671 - DNA, 25 bp, Rattus norvegicus
attagctctgttaggaacctcttgc

SEQ ID NO: 205672 - DNA, 25 bp, Rattus norvegicus
attagctctgtttggaacctcttgc

SEQ ID NO: 205673 - DNA, 25 bp, Rattus norvegicus
attagctgcaatctgggttcctgga

SEQ ID NO: 205674 - DNA, 25 bp, Rattus norvegicus
attagctgcaatgtgggttcctgga

SEQ ID NO: 205675 - DNA, 25 bp, Rattus norvegicus
attagctgcactatatataccataa

SEQ ID NO: 205676 - DNA, 25 bp, Rattus norvegicus
attagctgcactttatataccataa

SEQ ID NO: 205677 - DNA, 25 bp, Rattus norvegicus
attagctggaagacccatccttggc

SEQ ID NO: 205678 - DNA, 25 bp, Rattus norvegicus
attagctggaagtcccatccttggc

SEQ ID NO: 205679 - DNA, 25 bp, Rattus norvegicus
attagcttacataacccacttctta

SEQ ID NO: 205680 - DNA, 25 bp, Rattus norvegicus
attagcttacattacccacttctta

SEQ ID NO: 205681 - DNA, 25 bp, Rattus norvegicus
attagcttcatcactcaacatgcgc

SEQ ID NO: 205682 - DNA, 25 bp, Rattus norvegicus
attagcttcatctctcaacatgcgc

SEQ ID NO: 205683 - DNA, 25 bp, Rattus norvegicus
attagcttccaaaggtgctcagcca

SEQ ID NO: 205684 - DNA, 25 bp, Rattus norvegicus
attagcttccaatggtgctcagcca

SEQ ID NO: 205685 - DNA, 25 bp, Rattus norvegicus
attagcttcggcatcgatcagatac

SEQ ID NO: 205686 - DNA, 25 bp, Rattus norvegicus
attagcttcggcttcgatcagatac

SEQ ID NO: 205687 - DNA, 25 bp, Rattus norvegicus
attagctttctgaggctctgctaca

SEQ ID NO: 205688 - DNA, 25 bp, Rattus norvegicus
attagctttctgtggctctgctaca

SEQ ID NO: 205689 - DNA, 25 bp, Rattus norvegicus
attagctttgctattggctcagtct

SEQ ID NO: 205690 - DNA, 25 bp, Rattus norvegicus
attagctttgcttttggctcagtct

SEQ ID NO: 205691 - DNA, 25 bp, Rattus norvegicus
attagctttgtgaagggataccctc

SEQ ID NO: 205692 - DNA, 25 bp, Rattus norvegicus
attagctttgtgtagggataccctc

SEQ ID NO: 205693 - DNA, 25 bp, Rattus norvegicus
attaggaagtgcacccgctcttgac

SEQ ID NO: 205694 - DNA, 25 bp, Rattus norvegicus
attaggaagtgctcccgctcttgac

SEQ ID NO: 205695 - DNA, 25 bp, Rattus norvegicus
attaggacagtccatgcttggtggt

SEQ ID NO: 205696 - DNA, 25 bp, Rattus norvegicus
attaggacagtcgatgcttggtggt

SEQ ID NO: 205697 - DNA, 25 bp, Rattus norvegicus
attaggactgctcaggtgccagacc

SEQ ID NO: 205698 - DNA, 25 bp, Rattus norvegicus
attaggactgctgaggtgccagacc

SEQ ID NO: 205699 - DNA, 25 bp, Rattus norvegicus
attaggagttggagccacaggcccc

SEQ ID NO: 205700 - DNA, 25 bp, Rattus norvegicus
attaggagttggtgccacaggcccc

SEQ ID NO: 205701 - DNA, 25 bp, Rattus norvegicus
attaggatcagtataacgccttggg

SEQ ID NO: 205702 - DNA, 25 bp, Rattus norvegicus
attaggatcagtttaacgccttggg

SEQ ID NO: 205703 - DNA, 25 bp, Rattus norvegicus
attaggatgtatcgccccatgcctg

SEQ ID NO: 205704 - DNA, 25 bp, Rattus norvegicus
attaggatgtatggccccatgcctg

SEQ ID NO: 205705 - DNA, 25 bp, Rattus norvegicus
attaggatgtttacttgttacccag

SEQ ID NO: 205706 - DNA, 25 bp, Rattus norvegicus
attaggatgttttcttgttacccag

SEQ ID NO: 205707 - DNA, 25 bp, Rattus norvegicus
attaggattgttagctctcctgtct

SEQ ID NO: 205708 - DNA, 25 bp, Rattus norvegicus
attaggattgtttgctctcctgtct

SEQ ID NO: 205709 - DNA, 25 bp, Rattus norvegicus
attaggcacttgcagcgtttttgct

SEQ ID NO: 205710 - DNA, 25 bp, Rattus norvegicus
attaggcacttggagcgtttttgct

SEQ ID NO: 205711 - DNA, 25 bp, Rattus norvegicus
attaggcagagcctgctcactggat

SEQ ID NO: 205712 - DNA, 25 bp, Rattus norvegicus
attaggcagagcgtgctcactggat

SEQ ID NO: 205713 - DNA, 25 bp, Rattus norvegicus
attaggcagcatacacttctcaaat

SEQ ID NO: 205714 - DNA, 25 bp, Rattus norvegicus
attaggcagcattcacttctcaaat

SEQ ID NO: 205715 - DNA, 25 bp, Rattus norvegicus
attaggccgtcgacccagactgtcg

SEQ ID NO: 205716 - DNA, 25 bp, Rattus norvegicus
attaggccgtcgtcccagactgtcg

SEQ ID NO: 205717 - DNA, 25 bp, Rattus norvegicus
attaggcgcacgcaagtcattctct

SEQ ID NO: 205718 - DNA, 25 bp, Rattus norvegicus
attaggcgcacggaagtcattctct

SEQ ID NO: 205719 - DNA, 25 bp, Rattus norvegicus
attaggctagatcaacttccccttt

SEQ ID NO: 205720 - DNA, 25 bp, Rattus norvegicus
attaggctagatgaacttccccttt

SEQ ID NO: 205721 - DNA, 25 bp, Rattus norvegicus
attaggctcatcctcttggtggttg

SEQ ID NO: 205722 - DNA, 25 bp, Rattus norvegicus
attaggctcatcgtcttggtggttg

SEQ ID NO: 205723 - DNA, 25 bp, Rattus norvegicus
attaggctcttgcacagggctgcat

SEQ ID NO: 205724 - DNA, 25 bp, Rattus norvegicus
attaggctcttggacagggctgcat

SEQ ID NO: 205725 - DNA, 25 bp, Rattus norvegicus
attaggctgccacaagcacacacag

SEQ ID NO: 205726 - DNA, 25 bp, Rattus norvegicus
attaggctgccagaagcacacacag

SEQ ID NO: 205727 - DNA, 25 bp, Rattus norvegicus
attaggctgtacaatcaatttgacc

SEQ ID NO: 205728 - DNA, 25 bp, Rattus norvegicus
attaggctgtactatcaatttgacc

SEQ ID NO: 205729 - DNA, 25 bp, Rattus norvegicus
attaggcttgtgctcatagggaaga

SEQ ID NO: 205730 - DNA, 25 bp, Rattus norvegicus
attaggcttgtggtcatagggaaga

SEQ ID NO: 205731 - DNA, 25 bp, Rattus norvegicus
attagggcacggatgccctgctaca

SEQ ID NO: 205732 - DNA, 25 bp, Rattus norvegicus
attagggcacggttgccctgctaca

SEQ ID NO: 205733 - DNA, 25 bp, Rattus norvegicus
attagggctgttcgaggagtttcat

SEQ ID NO: 205734 - DNA, 25 bp, Rattus norvegicus
attagggctgttggaggagtttcat

SEQ ID NO: 205735 - DNA, 25 bp, Rattus norvegicus
attagggtcccacaggtggctttgc

SEQ ID NO: 205736 - DNA, 25 bp, Rattus norvegicus
attagggtcccagaggtggctttgc

SEQ ID NO: 205737 - DNA, 25 bp, Rattus norvegicus
attagggtctctacggaccgtgacg

SEQ ID NO: 205738 - DNA, 25 bp, Rattus norvegicus
attagggtctcttcggaccgtgacg

SEQ ID NO: 205739 - DNA, 25 bp, Rattus norvegicus
attaggtagaccacaggcctcaaac

SEQ ID NO: 205740 - DNA, 25 bp, Rattus norvegicus
attaggtagacctcaggcctcaaac

SEQ ID NO: 205741 - DNA, 25 bp, Rattus norvegicus
attaggtagtgtctgagcccagcaa

SEQ ID NO: 205742 - DNA, 25 bp, Rattus norvegicus
attaggtagtgtgtgagcccagcaa

SEQ ID NO: 205743 - DNA, 25 bp, Rattus norvegicus
attaggtagttgaccttggaaccat

SEQ ID NO: 205744 - DNA, 25 bp, Rattus norvegicus
attaggtagttgtccttggaaccat

SEQ ID NO: 205745 - DNA, 25 bp, Rattus norvegicus
attaggtatcagctaaacttctcca

SEQ ID NO: 205746 - DNA, 25 bp, Rattus norvegicus
attaggtatcaggtaaacttctcca

SEQ ID NO: 205747 - DNA, 25 bp, Rattus norvegicus
attaggtatcgtcttgtctcactaa

SEQ ID NO: 205748 - DNA, 25 bp, Rattus norvegicus
attaggtatcgtgttgtctcactaa

SEQ ID NO: 205749 - DNA, 25 bp, Rattus norvegicus
attaggtcacaaccctcgagtcacc

SEQ ID NO: 205750 - DNA, 25 bp, Rattus norvegicus
attaggtcacaagcctcgagtcacc

SEQ ID NO: 205751 - DNA, 25 bp, Rattus norvegicus
attaggtcagctccaacccatgatt

SEQ ID NO: 205752 - DNA, 25 bp, Rattus norvegicus
attaggtcagctgcaacccatgatt

SEQ ID NO: 205753 - DNA, 25 bp, Rattus norvegicus
attaggtcattactgtactgtcaca

SEQ ID NO: 205754 - DNA, 25 bp, Rattus norvegicus
attaggtcattagtgtactgtcaca

SEQ ID NO: 205755 - DNA, 25 bp, Rattus norvegicus
attaggtgaggcactgagcctgctg

SEQ ID NO: 205756 - DNA, 25 bp, Rattus norvegicus
attaggtgaggctctgagcctgctg

SEQ ID NO: 205757 - DNA, 25 bp, Rattus norvegicus
attaggtgggatatgctcccattgg

SEQ ID NO: 205758 - DNA, 25 bp, Rattus norvegicus
attaggtgggatttgctcccattgg

SEQ ID NO: 205759 - DNA, 25 bp, Rattus norvegicus
attaggtgtcaccactcacggatga

SEQ ID NO: 205760 - DNA, 25 bp, Rattus norvegicus
attaggtgtcacgactcacggatga

SEQ ID NO: 205761 - DNA, 25 bp, Rattus norvegicus
attaggtgttccatctggatgcagg

SEQ ID NO: 205762 - DNA, 25 bp, Rattus norvegicus
attaggtgttccttctggatgcagg

SEQ ID NO: 205763 - DNA, 25 bp, Rattus norvegicus
attaggttgtatcgaggttagaagc

SEQ ID NO: 205764 - DNA, 25 bp, Rattus norvegicus
attaggttgtatggaggttagaagc

SEQ ID NO: 205765 - DNA, 25 bp, Rattus norvegicus
attaggtttccaactgacagtgtta

SEQ ID NO: 205766 - DNA, 25 bp, Rattus norvegicus
attaggtttccatctgacagtgtta

SEQ ID NO: 205767 - DNA, 25 bp, Rattus norvegicus
attaggtttgccatgtcatctggaa

SEQ ID NO: 205768 - DNA, 25 bp, Rattus norvegicus
attaggtttgccttgtcatctggaa

SEQ ID NO: 205769 - DNA, 25 bp, Rattus norvegicus
attagtaaatgtcttgcctccacgg

SEQ ID NO: 205770 - DNA, 25 bp, Rattus norvegicus
attagtaaatgtgttgcctccacgg

SEQ ID NO: 205771 - DNA, 25 bp, Rattus norvegicus
attagtaagcatacctgaccacagg

SEQ ID NO: 205772 - DNA, 25 bp, Rattus norvegicus
attagtaagcattcctgaccacagg

SEQ ID NO: 205773 - DNA, 25 bp, Rattus norvegicus
attagtacaaacacagcaacagctg

SEQ ID NO: 205774 - DNA, 25 bp, Rattus norvegicus
attagtacaaactcagcaacagctg

SEQ ID NO: 205775 - DNA, 25 bp, Rattus norvegicus
attagtacacctcaacttctgggcg

SEQ ID NO: 205776 - DNA, 25 bp, Rattus norvegicus
attagtacacctgaacttctgggcg

SEQ ID NO: 205777 - DNA, 25 bp, Rattus norvegicus
attagtagcagtctgagtcccctgg

SEQ ID NO: 205778 - DNA, 25 bp, Rattus norvegicus
attagtagcagtgtgagtcccctgg

SEQ ID NO: 205779 - DNA, 25 bp, Rattus norvegicus
attagtagctctcaaccgtccatga

SEQ ID NO: 205780 - DNA, 25 bp, Rattus norvegicus
attagtagctctgaaccgtccatga

SEQ ID NO: 205781 - DNA, 25 bp, Rattus norvegicus
attagtagctggctgcagcgccaca

SEQ ID NO: 205782 - DNA, 25 bp, Rattus norvegicus
attagtagctgggtgcagcgccaca

SEQ ID NO: 205783 - DNA, 25 bp, Rattus norvegicus
attagtcacatccaatcttcaaagg

SEQ ID NO: 205784 - DNA, 25 bp, Rattus norvegicus
attagtcacatcgaatcttcaaagg

SEQ ID NO: 205785 - DNA, 25 bp, Rattus norvegicus
attagtcagcttacccagccatagt

SEQ ID NO: 205786 - DNA, 25 bp, Rattus norvegicus
attagtcagctttcccagccatagt

SEQ ID NO: 205787 - DNA, 25 bp, Rattus norvegicus
attagtcaggaaagccctccttggc

SEQ ID NO: 205788 - DNA, 25 bp, Rattus norvegicus
attagtcaggaatgccctccttggc

SEQ ID NO: 205789 - DNA, 25 bp, Rattus norvegicus
attagtcaggcaacatacccaaaag

SEQ ID NO: 205790 - DNA, 25 bp, Rattus norvegicus
attagtcaggcaagtgtccttcgtt

SEQ ID NO: 205791 - DNA, 25 bp, Rattus norvegicus
attagtcaggcatcatacccaaaag

SEQ ID NO: 205792 - DNA, 25 bp, Rattus norvegicus
attagtcaggcatgtgtccttcgtt

SEQ ID NO: 205793 - DNA, 25 bp, Rattus norvegicus
attagtcatcggcaactttgtaaga

SEQ ID NO: 205794 - DNA, 25 bp, Rattus norvegicus
attagtcatcgggaactttgtaaga

SEQ ID NO: 205795 - DNA, 25 bp, Rattus norvegicus
attagtcccaggacacctacatcat

SEQ ID NO: 205796 - DNA, 25 bp, Rattus norvegicus
attagtcccaggtcacctacatcat

SEQ ID NO: 205797 - DNA, 25 bp, Rattus norvegicus
attagtcgctgcatctagctttaga

SEQ ID NO: 205798 - DNA, 25 bp, Rattus norvegicus
attagtcgctgcttctagctttaga

SEQ ID NO: 205799 - DNA, 25 bp, Rattus norvegicus
attagtctccacatccattaatctc

SEQ ID NO: 205800 - DNA, 25 bp, Rattus norvegicus
attagtctccacttccattaatctc

SEQ ID NO: 205801 - DNA, 25 bp, Rattus norvegicus
attagtctgattcttcagtgccacg

SEQ ID NO: 205802 - DNA, 25 bp, Rattus norvegicus
attagtctgattgttcagtgccacg

SEQ ID NO: 205803 - DNA, 25 bp, Rattus norvegicus
attagtcttgttatgtgtttcctca

SEQ ID NO: 205804 - DNA, 25 bp, Rattus norvegicus
attagtcttgttttgtgtttcctca

SEQ ID NO: 205805 - DNA, 25 bp, Rattus norvegicus
attagtgacagtccacgccggcgtt

SEQ ID NO: 205806 - DNA, 25 bp, Rattus norvegicus
attagtgacagtgcacgccggcgtt

SEQ ID NO: 205807 - DNA, 25 bp, Rattus norvegicus
attagtgactccagagcatgcccag

SEQ ID NO: 205808 - DNA, 25 bp, Rattus norvegicus
attagtgactcctgagcatgcccag

SEQ ID NO: 205809 - DNA, 25 bp, Rattus norvegicus
attagtgagtgccaactttccccag

SEQ ID NO: 205810 - DNA, 25 bp, Rattus norvegicus
attagtgagtgcgaactttccccag

SEQ ID NO: 205811 - DNA, 25 bp, Rattus norvegicus
attagtgatggtagctcagcctgaa

SEQ ID NO: 205812 - DNA, 25 bp, Rattus norvegicus
attagtgatggttgctcagcctgaa

SEQ ID NO: 205813 - DNA, 25 bp, Rattus norvegicus
attagtgatttaagcccctttatta

SEQ ID NO: 205814 - DNA, 25 bp, Rattus norvegicus
attagtgatttatgcccctttatta

SEQ ID NO: 205815 - DNA, 25 bp, Rattus norvegicus
attagtgcagagaacgtgtcaccac

SEQ ID NO: 205816 - DNA, 25 bp, Rattus norvegicus
attagtgcagagtacgtgtcaccac

SEQ ID NO: 205817 - DNA, 25 bp, Rattus norvegicus
attagtgccattaacagctttgtag

SEQ ID NO: 205818 - DNA, 25 bp, Rattus norvegicus
attagtgccatttacagctttgtag

SEQ ID NO: 205819 - DNA, 25 bp, Rattus norvegicus
attagtgcccagaaggagttcgcta

SEQ ID NO: 205820 - DNA, 25 bp, Rattus norvegicus
attagtgcccagtaggagttcgcta

SEQ ID NO: 205821 - DNA, 25 bp, Rattus norvegicus
attagtgccctgcaaacttttttct

SEQ ID NO: 205822 - DNA, 25 bp, Rattus norvegicus
attagtgccctgctcatgcacacct

SEQ ID NO: 205823 - DNA, 25 bp, Rattus norvegicus
attagtgccctggaaacttttttct

SEQ ID NO: 205824 - DNA, 25 bp, Rattus norvegicus
attagtgccctggtcatgcacacct

SEQ ID NO: 205825 - DNA, 25 bp, Rattus norvegicus
attagtgccttgctttgggccctgc

SEQ ID NO: 205826 - DNA, 25 bp, Rattus norvegicus
attagtgccttggtttgggccctgc

SEQ ID NO: 205827 - DNA, 25 bp, Rattus norvegicus
attagtgcgtggactcttggaggac

SEQ ID NO: 205828 - DNA, 25 bp, Rattus norvegicus
attagtgcgtggtctcttggaggac

SEQ ID NO: 205829 - DNA, 25 bp, Rattus norvegicus
attagtgctggcactgaaggacacg

SEQ ID NO: 205830 - DNA, 25 bp, Rattus norvegicus
attagtgctggctctgaaggacacg

SEQ ID NO: 205831 - DNA, 25 bp, Rattus norvegicus
attagtggaggcatcgctcaccgaa

SEQ ID NO: 205832 - DNA, 25 bp, Rattus norvegicus
attagtggaggcttcgctcaccgaa

SEQ ID NO: 205833 - DNA, 25 bp, Rattus norvegicus
attagtggccttagtgtttctctag

SEQ ID NO: 205834 - DNA, 25 bp, Rattus norvegicus
attagtggcctttgtgtttctctag

SEQ ID NO: 205835 - DNA, 25 bp, Rattus norvegicus
attagtggctccctccgagtgaatg

SEQ ID NO: 205836 - DNA, 25 bp, Rattus norvegicus
attagtggctccgtccgagtgaatg

SEQ ID NO: 205837 - DNA, 25 bp, Rattus norvegicus
attagtgtccatcgctgtttgctgt

SEQ ID NO: 205838 - DNA, 25 bp, Rattus norvegicus
attagtgtccatggctgtttgctgt

SEQ ID NO: 205839 - DNA, 25 bp, Rattus norvegicus
attagtgtctagaaatgccctcccc

SEQ ID NO: 205840 - DNA, 25 bp, Rattus norvegicus
attagtgtctagtaatgccctcccc

SEQ ID NO: 205841 - DNA, 25 bp, Rattus norvegicus
attagtgtgtaaagccaactgctac

SEQ ID NO: 205842 - DNA, 25 bp, Rattus norvegicus
attagtgtgtaatgccaactgctac

SEQ ID NO: 205843 - DNA, 25 bp, Rattus norvegicus
attagtgtgtgcagttcccaatggc

SEQ ID NO: 205844 - DNA, 25 bp, Rattus norvegicus
attagtgtgtgctgttcccaatggc

SEQ ID NO: 205845 - DNA, 25 bp, Rattus norvegicus
attagtgtgtttctttggtccagaa

SEQ ID NO: 205846 - DNA, 25 bp, Rattus norvegicus
attagtgtgtttgtttggtccagaa

SEQ ID NO: 205847 - DNA, 25 bp, Rattus norvegicus
attagtgttcttagagccttggtgg

SEQ ID NO: 205848 - DNA, 25 bp, Rattus norvegicus
attagtgttctttgagccttggtgg

SEQ ID NO: 205849 - DNA, 25 bp, Rattus norvegicus
attagttaacttaccatcactgtaa

SEQ ID NO: 205850 - DNA, 25 bp, Rattus norvegicus
attagttaactttccatcactgtaa

SEQ ID NO: 205851 - DNA, 25 bp, Rattus norvegicus
attagttaccggaagcctattcgct

SEQ ID NO: 205852 - DNA, 25 bp, Rattus norvegicus
attagttaccggtagcctattcgct

SEQ ID NO: 205853 - DNA, 25 bp, Rattus norvegicus
attagttattctctgacctcggcat

SEQ ID NO: 205854 - DNA, 25 bp, Rattus norvegicus
attagttattctgtgacctcggcat

SEQ ID NO: 205855 - DNA, 25 bp, Rattus norvegicus
attagttcagaaaccaccgatcatg

SEQ ID NO: 205856 - DNA, 25 bp, Rattus norvegicus
attagttcagaatccaccgatcatg

SEQ ID NO: 205857 - DNA, 25 bp, Rattus norvegicus
attagttcccagaacacattgtctc

SEQ ID NO: 205858 - DNA, 25 bp, Rattus norvegicus
attagttcccagtacacattgtctc

SEQ ID NO: 205859 - DNA, 25 bp, Rattus norvegicus
attagttccctgagaagtctgttcc

SEQ ID NO: 205860 - DNA, 25 bp, Rattus norvegicus
attagttccctgtgaagtctgttcc

SEQ ID NO: 205861 - DNA, 25 bp, Rattus norvegicus
attagttcggttcagctgggttagt

SEQ ID NO: 205862 - DNA, 25 bp, Rattus norvegicus
attagttcggttgagctgggttagt

SEQ ID NO: 205863 - DNA, 25 bp, Rattus norvegicus
attagttctcctcttcccagtgtgc

SEQ ID NO: 205864 - DNA, 25 bp, Rattus norvegicus
attagttctcctgttcccagtgtgc

SEQ ID NO: 205865 - DNA, 25 bp, Rattus norvegicus
attagttctttcagcccttaatgaa

SEQ ID NO: 205866 - DNA, 25 bp, Rattus norvegicus
attagttctttctgcccttaatgaa

SEQ ID NO: 205867 - DNA, 25 bp, Rattus norvegicus
attagttgctgcattgacgttcttc

SEQ ID NO: 205868 - DNA, 25 bp, Rattus norvegicus
attagttgctgctttgacgttcttc

SEQ ID NO: 205869 - DNA, 25 bp, Rattus norvegicus
attagttgtgtcaggaggtgttgca

SEQ ID NO: 205870 - DNA, 25 bp, Rattus norvegicus
attagttgtgtctggaggtgttgca

SEQ ID NO: 205871 - DNA, 25 bp, Rattus norvegicus
attagtttcaatccctcgactttca

SEQ ID NO: 205872 - DNA, 25 bp, Rattus norvegicus
attagtttcaatgcctcgactttca

SEQ ID NO: 205873 - DNA, 25 bp, Rattus norvegicus
attagtttcaccaagtcaccatgca

SEQ ID NO: 205874 - DNA, 25 bp, Rattus norvegicus
attagtttcacctagtcaccatgca

SEQ ID NO: 205875 - DNA, 25 bp, Rattus norvegicus
attagtttccaacgtcagtctcaag

SEQ ID NO: 205876 - DNA, 25 bp, Rattus norvegicus
attagtttccaaggtcagtctcaag

SEQ ID NO: 205877 - DNA, 25 bp, Rattus norvegicus
attagtttgggcattggtttgctac

SEQ ID NO: 205878 - DNA, 25 bp, Rattus norvegicus
attagtttgggctttggtttgctac

SEQ ID NO: 205879 - DNA, 25 bp, Rattus norvegicus
attagtttgttcaatctgttgtaac

SEQ ID NO: 205880 - DNA, 25 bp, Rattus norvegicus
attagtttgttctatctgttgtaac

SEQ ID NO: 205881 - DNA, 25 bp, Rattus norvegicus
attagttttccacggcacagtcacc

SEQ ID NO: 205882 - DNA, 25 bp, Rattus norvegicus
attagttttccagggcacagtcacc

SEQ ID NO: 205883 - DNA, 25 bp, Rattus norvegicus
attagttttgtgagggctcctttca

SEQ ID NO: 205884 - DNA, 25 bp, Rattus norvegicus
attagttttgtgtgggctcctttca

SEQ ID NO: 205885 - DNA, 25 bp, Rattus norvegicus
attataaaggctactgcctgtccgc

SEQ ID NO: 205886 - DNA, 25 bp, Rattus norvegicus
attataaaggcttctgcctgtccgc

SEQ ID NO: 205887 - DNA, 25 bp, Rattus norvegicus
attataacgctaacctcaggatcca

SEQ ID NO: 205888 - DNA, 25 bp, Rattus norvegicus
attataacgctatcctcaggatcca

SEQ ID NO: 205889 - DNA, 25 bp, Rattus norvegicus
attataacgtccaatgaggctgaag

SEQ ID NO: 205890 - DNA, 25 bp, Rattus norvegicus
attataacgtcctatgaggctgaag

SEQ ID NO: 205891 - DNA, 25 bp, Rattus norvegicus
attataactacaacatttcctcctc

SEQ ID NO: 205892 - DNA, 25 bp, Rattus norvegicus
attataactacatcatttcctcctc

SEQ ID NO: 205893 - DNA, 25 bp, Rattus norvegicus
attataataaccacccagttctagg

SEQ ID NO: 205894 - DNA, 25 bp, Rattus norvegicus
attataataacctcccagttctagg

SEQ ID NO: 205895 - DNA, 25 bp, Rattus norvegicus
attataatctatattcctgcggtta

SEQ ID NO: 205896 - DNA, 25 bp, Rattus norvegicus
attataatctattttcctgcggtta

SEQ ID NO: 205897 - DNA, 25 bp, Rattus norvegicus
attataatctctctcttttctgctc

SEQ ID NO: 205898 - DNA, 25 bp, Rattus norvegicus
attataatctctgtcttttctgctc

SEQ ID NO: 205899 - DNA, 25 bp, Rattus norvegicus
attatacacacaaggcctcattgtt

SEQ ID NO: 205900 - DNA, 25 bp, Rattus norvegicus
attatacacacatggcctcattgtt

SEQ ID NO: 205901 - DNA, 25 bp, Rattus norvegicus
attatacagggtacgtgtgcgtgcc

SEQ ID NO: 205902 - DNA, 25 bp, Rattus norvegicus
attatacagggttcgtgtgcgtgcc

SEQ ID NO: 205903 - DNA, 25 bp, Rattus norvegicus
attatacatttgcaaatcctggtct

SEQ ID NO: 205904 - DNA, 25 bp, Rattus norvegicus
attatacatttggaaatcctggtct

SEQ ID NO: 205905 - DNA, 25 bp, Rattus norvegicus
attatacattttacgttctctgtgg

SEQ ID NO: 205906 - DNA, 25 bp, Rattus norvegicus
attatacatttttcgttctctgtgg

SEQ ID NO: 205907 - DNA, 25 bp, Rattus norvegicus
attataccagtgagtgcacccctga

SEQ ID NO: 205908 - DNA, 25 bp, Rattus norvegicus
attataccagtgtgtgcacccctga

SEQ ID NO: 205909 - DNA, 25 bp, Rattus norvegicus
attatacctcaacctattctgggac

SEQ ID NO: 205910 - DNA, 25 bp, Rattus norvegicus
attatacctcaagctattctgggac

SEQ ID NO: 205911 - DNA, 25 bp, Rattus norvegicus
attataccttctaatgccattgaga

SEQ ID NO: 205912 - DNA, 25 bp, Rattus norvegicus
attataccttcttatgccattgaga

SEQ ID NO: 205913 - DNA, 25 bp, Rattus norvegicus
attatactgattcgtctacgagact

SEQ ID NO: 205914 - DNA, 25 bp, Rattus norvegicus
attatactgattggtctacgagact

SEQ ID NO: 205915 - DNA, 25 bp, Rattus norvegicus
attatactgctgaacaacacaccaa

SEQ ID NO: 205916 - DNA, 25 bp, Rattus norvegicus
attatactgctgtacaacacaccaa

SEQ ID NO: 205917 - DNA, 25 bp, Rattus norvegicus
attatacttaacattcccatgtgag

SEQ ID NO: 205918 - DNA, 25 bp, Rattus norvegicus
attatacttaactttcccatgtgag

SEQ ID NO: 205919 - DNA, 25 bp, Rattus norvegicus
attatacttgtactgtttctgtgca

SEQ ID NO: 205920 - DNA, 25 bp, Rattus norvegicus
attatacttgtagtgtttctgtgca

SEQ ID NO: 205921 - DNA, 25 bp, Rattus norvegicus
attatagaacctctgtccatctgtc

SEQ ID NO: 205922 - DNA, 25 bp, Rattus norvegicus
attatagaacctgtgtccatctgtc

SEQ ID NO: 205923 - DNA, 25 bp, Rattus norvegicus
attatagaggccacgtctggtggct

SEQ ID NO: 205924 - DNA, 25 bp, Rattus norvegicus
attatagaggcctcgtctggtggct

SEQ ID NO: 205925 - DNA, 25 bp, Rattus norvegicus
attatagccacactgactgcactgc

SEQ ID NO: 205926 - DNA, 25 bp, Rattus norvegicus
attatagccacagtgactgcactgc

SEQ ID NO: 205927 - DNA, 25 bp, Rattus norvegicus
attatagccgtgaccctggccttct

SEQ ID NO: 205928 - DNA, 25 bp, Rattus norvegicus
attatagccgtgtccctggccttct

SEQ ID NO: 205929 - DNA, 25 bp, Rattus norvegicus
attatagcctatcaagcccttctaa

SEQ ID NO: 205930 - DNA, 25 bp, Rattus norvegicus
attatagcctatgaagcccttctaa

SEQ ID NO: 205931 - DNA, 25 bp, Rattus norvegicus
attatagcctgtatgcattcactga

SEQ ID NO: 205932 - DNA, 25 bp, Rattus norvegicus
attatagcctgtttgcattcactga

SEQ ID NO: 205933 - DNA, 25 bp, Rattus norvegicus
attatagcttcaatcgcttgccttt

SEQ ID NO: 205934 - DNA, 25 bp, Rattus norvegicus
attatagcttcattcgcttgccttt

SEQ ID NO: 205935 - DNA, 25 bp, Rattus norvegicus
attataggatgcactgcaccacact

SEQ ID NO: 205936 - DNA, 25 bp, Rattus norvegicus
attataggatgctctgcaccacact

SEQ ID NO: 205937 - DNA, 25 bp, Rattus norvegicus
attataggcgagcaccacctgtgga

SEQ ID NO: 205938 - DNA, 25 bp, Rattus norvegicus
attataggcgaggaccacctgtgga

SEQ ID NO: 205939 - DNA, 25 bp, Rattus norvegicus
attataggcgtcaggaatcgggctt

SEQ ID NO: 205940 - DNA, 25 bp, Rattus norvegicus
attataggcgtctggaatcgggctt

SEQ ID NO: 205941 - DNA, 25 bp, Rattus norvegicus
attatagtggatcctcaagttctga

SEQ ID NO: 205942 - DNA, 25 bp, Rattus norvegicus
attatagtggatgctcaagttctga

SEQ ID NO: 205943 - DNA, 25 bp, Rattus norvegicus
attatagtttaaattctcatctgag

SEQ ID NO: 205944 - DNA, 25 bp, Rattus norvegicus
attatagtttaatttctcatctgag

SEQ ID NO: 205945 - DNA, 25 bp, Rattus norvegicus
attatatatgcaataggccagtaca

SEQ ID NO: 205946 - DNA, 25 bp, Rattus norvegicus
attatatatgcattaggccagtaca

SEQ ID NO: 205947 - DNA, 25 bp, Rattus norvegicus
attatatattaccattctcctccga

SEQ ID NO: 205948 - DNA, 25 bp, Rattus norvegicus
attatatattacgattctcctccga

SEQ ID NO: 205949 - DNA, 25 bp, Rattus norvegicus
attatatctagactttctcttcccc

SEQ ID NO: 205950 - DNA, 25 bp, Rattus norvegicus
attatatctagagtttctcttcccc

SEQ ID NO: 205951 - DNA, 25 bp, Rattus norvegicus
attatatctcagcactacctgggtc

SEQ ID NO: 205952 - DNA, 25 bp, Rattus norvegicus
attatatctcaggactacctgggtc

SEQ ID NO: 205953 - DNA, 25 bp, Rattus norvegicus
attatatgcccgcaaactgctgcac

SEQ ID NO: 205954 - DNA, 25 bp, Rattus norvegicus
attatatgcccggaaactgctgcac

SEQ ID NO: 205955 - DNA, 25 bp, Rattus norvegicus
attatatggactaggctcctggtta

SEQ ID NO: 205956 - DNA, 25 bp, Rattus norvegicus
attatatggacttggctcctggtta

SEQ ID NO: 205957 - DNA, 25 bp, Rattus norvegicus
attatatgtctcatggcctctcaac

SEQ ID NO: 205958 - DNA, 25 bp, Rattus norvegicus
attatatgtctcttggcctctcaac

SEQ ID NO: 205959 - DNA, 25 bp, Rattus norvegicus
attatattgcctctgcttcatcctc

SEQ ID NO: 205960 - DNA, 25 bp, Rattus norvegicus
attatattgcctgtgcttcatcctc

SEQ ID NO: 205961 - DNA, 25 bp, Rattus norvegicus
attatattggccacaggccttggta

SEQ ID NO: 205962 - DNA, 25 bp, Rattus norvegicus
attatattggcctcaggccttggta

SEQ ID NO: 205963 - DNA, 25 bp, Rattus norvegicus
attatatttattcctacctcctgga

SEQ ID NO: 205964 - DNA, 25 bp, Rattus norvegicus
attatatttattgctacctcctgga

SEQ ID NO: 205965 - DNA, 25 bp, Rattus norvegicus
attatcaacctgactcatcacttca

SEQ ID NO: 205966 - DNA, 25 bp, Rattus norvegicus
attatcaacctgtctcatcacttca

SEQ ID NO: 205967 - DNA, 25 bp, Rattus norvegicus
attatcacatatccctggttccaga

SEQ ID NO: 205968 - DNA, 25 bp, Rattus norvegicus
attatcacatatgcctggttccaga

SEQ ID NO: 205969 - DNA, 25 bp, Rattus norvegicus
attatcagctcgctggcggccttca

SEQ ID NO: 205970 - DNA, 25 bp, Rattus norvegicus
attatcagctcggtggcggccttca

SEQ ID NO: 205971 - DNA, 25 bp, Rattus norvegicus
attatcaggatcctttggcgctacg

SEQ ID NO: 205972 - DNA, 25 bp, Rattus norvegicus
attatcaggatcgtttggcgctacg

SEQ ID NO: 205973 - DNA, 25 bp, Rattus norvegicus
attatcagtcatccttggaccgacg

SEQ ID NO: 205974 - DNA, 25 bp, Rattus norvegicus
attatcagtcatgcttggaccgacg

SEQ ID NO: 205975 - DNA, 25 bp, Rattus norvegicus
attatcagttctacctgcggttcgg

SEQ ID NO: 205976 - DNA, 25 bp, Rattus norvegicus
attatcagttcttcctgcggttcgg

SEQ ID NO: 205977 - DNA, 25 bp, Rattus norvegicus
attatcatgaggcagcatcttgggc

SEQ ID NO: 205978 - DNA, 25 bp, Rattus norvegicus
attatcatgagggagcatcttgggc

SEQ ID NO: 205979 - DNA, 25 bp, Rattus norvegicus
attatcatgcctctcaacccttaca

SEQ ID NO: 205980 - DNA, 25 bp, Rattus norvegicus
attatcatgcctgtcaacccttaca

SEQ ID NO: 205981 - DNA, 25 bp, Rattus norvegicus
attatccacatcatattgcacctac

SEQ ID NO: 205982 - DNA, 25 bp, Rattus norvegicus
attatccacatcttattgcacctac

SEQ ID NO: 205983 - DNA, 25 bp, Rattus norvegicus
attatccaggtgctgaccccttatt

SEQ ID NO: 205984 - DNA, 25 bp, Rattus norvegicus
attatccaggtggtgaccccttatt

SEQ ID NO: 205985 - DNA, 25 bp, Rattus norvegicus
attatccattatatggtacggacca

SEQ ID NO: 205986 - DNA, 25 bp, Rattus norvegicus
attatccattatttggtacggacca

SEQ ID NO: 205987 - DNA, 25 bp, Rattus norvegicus
attatcccacttctctgtaaaatca

SEQ ID NO: 205988 - DNA, 25 bp, Rattus norvegicus
attatcccacttgtctgtaaaatca

SEQ ID NO: 205989 - DNA, 25 bp, Rattus norvegicus
attatcccatatatgtttgagccat

SEQ ID NO: 205990 - DNA, 25 bp, Rattus norvegicus
attatcccatatttgtttgagccat

SEQ ID NO: 205991 - DNA, 25 bp, Rattus norvegicus
attatccccattcccagctgagctg

SEQ ID NO: 205992 - DNA, 25 bp, Rattus norvegicus
attatccccattgccagctgagctg

SEQ ID NO: 205993 - DNA, 25 bp, Rattus norvegicus
attatcccctgcaatgtgaagtaca

SEQ ID NO: 205994 - DNA, 25 bp, Rattus norvegicus
attatcccctgctatgtgaagtaca

SEQ ID NO: 205995 - DNA, 25 bp, Rattus norvegicus
attatccctcttccttctgaattgg

SEQ ID NO: 205996 - DNA, 25 bp, Rattus norvegicus
attatccctcttgcttctgaattgg

SEQ ID NO: 205997 - DNA, 25 bp, Rattus norvegicus
attatccctgtgactggacctgtgg

SEQ ID NO: 205998 - DNA, 25 bp, Rattus norvegicus
attatccctgtgtctggacctgtgg

SEQ ID NO: 205999 - DNA, 25 bp, Rattus norvegicus
attatccgttacaccttttacacat

SEQ ID NO: 206000 - DNA, 25 bp, Rattus norvegicus
attatccgttactccttttacacat

SEQ ID NO: 206001 - DNA, 25 bp, Rattus norvegicus
attatcctaagactgccctggcaag

SEQ ID NO: 206002 - DNA, 25 bp, Rattus norvegicus
attatcctaagagtgccctggcaag

SEQ ID NO: 206003 - DNA, 25 bp, Rattus norvegicus
attatcctccgaatccagattcaag

SEQ ID NO: 206004 - DNA, 25 bp, Rattus norvegicus
attatcctccgattccagattcaag

SEQ ID NO: 206005 - DNA, 25 bp, Rattus norvegicus
attatcctgcccaaaaatgttgtag

SEQ ID NO: 206006 - DNA, 25 bp, Rattus norvegicus
attatcctgccctaaaatgttgtag

SEQ ID NO: 206007 - DNA, 25 bp, Rattus norvegicus
attatcctgctcctgttctagaaga

SEQ ID NO: 206008 - DNA, 25 bp, Rattus norvegicus
attatcctgctcgtgttctagaaga

SEQ ID NO: 206009 - DNA, 25 bp, Rattus norvegicus
attatcctgtggcaaacaacctgtt

SEQ ID NO: 206010 - DNA, 25 bp, Rattus norvegicus
attatcctgtgggaaacaacctgtt

SEQ ID NO: 206011 - DNA, 25 bp, Rattus norvegicus
attatccttgacagtgtttttcctc

SEQ ID NO: 206012 - DNA, 25 bp, Rattus norvegicus
attatccttgactgtgtttttcctc

SEQ ID NO: 206013 - DNA, 25 bp, Rattus norvegicus
attatccttgttactgctttgccag

SEQ ID NO: 206014 - DNA, 25 bp, Rattus norvegicus
attatccttgtttctgctttgccag

SEQ ID NO: 206015 - DNA, 25 bp, Rattus norvegicus
attatcgacaatctggctgctggcc

SEQ ID NO: 206016 - DNA, 25 bp, Rattus norvegicus
attatcgacaatgtggctgctggcc

SEQ ID NO: 206017 - DNA, 25 bp, Rattus norvegicus
attatcgccatcatacaccgtattt

SEQ ID NO: 206018 - DNA, 25 bp, Rattus norvegicus
attatcgccatcttacaccgtattt

SEQ ID NO: 206019 - DNA, 25 bp, Rattus norvegicus
attatcgctgacacttctcttgtaa

SEQ ID NO: 206020 - DNA, 25 bp, Rattus norvegicus
attatcgctgactcttctcttgtaa

SEQ ID NO: 206021 - DNA, 25 bp, Rattus norvegicus
attatcgtgtccaatagggcttcta

SEQ ID NO: 206022 - DNA, 25 bp, Rattus norvegicus
attatcgtgtcctatagggcttcta

SEQ ID NO: 206023 - DNA, 25 bp, Rattus norvegicus
attatctaaataagcatgtgctaac

SEQ ID NO: 206024 - DNA, 25 bp, Rattus norvegicus
attatctaaatatgcatgtgctaac

SEQ ID NO: 206025 - DNA, 25 bp, Rattus norvegicus
attatctataacctcctgtctcggc

SEQ ID NO: 206026 - DNA, 25 bp, Rattus norvegicus
attatctataacgtcctgtctcggc

SEQ ID NO: 206027 - DNA, 25 bp, Rattus norvegicus
attatctatatcatcaccttcttcc

SEQ ID NO: 206028 - DNA, 25 bp, Rattus norvegicus
attatctatatcttcaccttcttcc

SEQ ID NO: 206029 - DNA, 25 bp, Rattus norvegicus
attatctatcccaagaagtgcatgc

SEQ ID NO: 206030 - DNA, 25 bp, Rattus norvegicus
attatctatccctagaagtgcatgc

SEQ ID NO: 206031 - DNA, 25 bp, Rattus norvegicus
attatctatgtacctgtttcccttc

SEQ ID NO: 206032 - DNA, 25 bp, Rattus norvegicus
attatctatgtagctgtttcccttc

SEQ ID NO: 206033 - DNA, 25 bp, Rattus norvegicus
attatctcaaacacctcggcaaggg

SEQ ID NO: 206034 - DNA, 25 bp, Rattus norvegicus
attatctcaaactcctcggcaaggg

SEQ ID NO: 206035 - DNA, 25 bp, Rattus norvegicus
attatctcaagcacctgtgtgccag

SEQ ID NO: 206036 - DNA, 25 bp, Rattus norvegicus
attatctcaagctcctgtgtgccag

SEQ ID NO: 206037 - DNA, 25 bp, Rattus norvegicus
attatctcagtacagcagccttcaa

SEQ ID NO: 206038 - DNA, 25 bp, Rattus norvegicus
attatctcagtagagcagccttcaa

SEQ ID NO: 206039 - DNA, 25 bp, Rattus norvegicus
attatctcatgcactctctgattca

SEQ ID NO: 206040 - DNA, 25 bp, Rattus norvegicus
attatctcatgctctctctgattca

SEQ ID NO: 206041 - DNA, 25 bp, Rattus norvegicus
attatctcattgactagacgctccc

SEQ ID NO: 206042 - DNA, 25 bp, Rattus norvegicus
attatctcattgtctagacgctccc

SEQ ID NO: 206043 - DNA, 25 bp, Rattus norvegicus
attatctccactcagctagttcaag

SEQ ID NO: 206044 - DNA, 25 bp, Rattus norvegicus
attatctccactgagctagttcaag

SEQ ID NO: 206045 - DNA, 25 bp, Rattus norvegicus
attatctcctaaacctagcatccat

SEQ ID NO: 206046 - DNA, 25 bp, Rattus norvegicus
attatctcctaatcctagcatccat

SEQ ID NO: 206047 - DNA, 25 bp, Rattus norvegicus
attatctccttgctgacctagctgg

SEQ ID NO: 206048 - DNA, 25 bp, Rattus norvegicus
attatctccttggtgacctagctgg

SEQ ID NO: 206049 - DNA, 25 bp, Rattus norvegicus
attatctcgtgcagcccttcatgga

SEQ ID NO: 206050 - DNA, 25 bp, Rattus norvegicus
attatctcgtgctgcccttcatgga

SEQ ID NO: 206051 - DNA, 25 bp, Rattus norvegicus
attatctgatgtcatgcctgttgag

SEQ ID NO: 206052 - DNA, 25 bp, Rattus norvegicus
attatctgatgtgatgcctgttgag

SEQ ID NO: 206053 - DNA, 25 bp, Rattus norvegicus
attatctgccttcttcttatcacac

SEQ ID NO: 206054 - DNA, 25 bp, Rattus norvegicus
attatctgccttgttcttatcacac

SEQ ID NO: 206055 - DNA, 25 bp, Rattus norvegicus
attatctgggcgattccttatttat

SEQ ID NO: 206056 - DNA, 25 bp, Rattus norvegicus
attatctgggcgtttccttatttat

SEQ ID NO: 206057 - DNA, 25 bp, Rattus norvegicus
attatctggttaaggtggccactgt

SEQ ID NO: 206058 - DNA, 25 bp, Rattus norvegicus
attatctggttatggtggccactgt

SEQ ID NO: 206059 - DNA, 25 bp, Rattus norvegicus
attatctgttttcttaaaagtgaga

SEQ ID NO: 206060 - DNA, 25 bp, Rattus norvegicus
attatctgttttgttaaaagtgaga

SEQ ID NO: 206061 - DNA, 25 bp, Rattus norvegicus
attatcttcctaacatctcttctct

SEQ ID NO: 206062 - DNA, 25 bp, Rattus norvegicus
attatcttcctatcatctcttctct

SEQ ID NO: 206063 - DNA, 25 bp, Rattus norvegicus
attatcttggacagaggaaccctaa

SEQ ID NO: 206064 - DNA, 25 bp, Rattus norvegicus
attatcttggactgaggaaccctaa

SEQ ID NO: 206065 - DNA, 25 bp, Rattus norvegicus
attatcttgggtaccgatctgatct

SEQ ID NO: 206066 - DNA, 25 bp, Rattus norvegicus
attatcttgggttccgatctgatct

SEQ ID NO: 206067 - DNA, 25 bp, Rattus norvegicus
attatcttggtcatcagcctgatcc

SEQ ID NO: 206068 - DNA, 25 bp, Rattus norvegicus
attatcttggtcttcagcctgatcc

SEQ ID NO: 206069 - DNA, 25 bp, Rattus norvegicus
attatgaagggcacactgccctgca

SEQ ID NO: 206070 - DNA, 25 bp, Rattus norvegicus
attatgaagggctcactgccctgca

SEQ ID NO: 206071 - DNA, 25 bp, Rattus norvegicus
attatgacagtcactcttggcatct

SEQ ID NO: 206072 - DNA, 25 bp, Rattus norvegicus
attatgacagtctctcttggcatct

SEQ ID NO: 206073 - DNA, 25 bp, Rattus norvegicus
attatgaccatcaccttcgctgtat

SEQ ID NO: 206074 - DNA, 25 bp, Rattus norvegicus
attatgaccatctccttcgctgtat

SEQ ID NO: 206075 - DNA, 25 bp, Rattus norvegicus
attatgaccgtgagtggcaggccaa

SEQ ID NO: 206076 - DNA, 25 bp, Rattus norvegicus
attatgaccgtgtgtggcaggccaa

SEQ ID NO: 206077 - DNA, 25 bp, Rattus norvegicus
attatgactgaacctttgcctcctg

SEQ ID NO: 206078 - DNA, 25 bp, Rattus norvegicus
attatgactgaagctttgcctcctg

SEQ ID NO: 206079 - DNA, 25 bp, Rattus norvegicus
attatgagacgtagcatcctctgcc

SEQ ID NO: 206080 - DNA, 25 bp, Rattus norvegicus
attatgagacgttgcatcctctgcc

SEQ ID NO: 206081 - DNA, 25 bp, Rattus norvegicus
attatgagcccacggaatgagacga

SEQ ID NO: 206082 - DNA, 25 bp, Rattus norvegicus
attatgagcccagggaatgagacga

SEQ ID NO: 206083 - DNA, 25 bp, Rattus norvegicus
attatgagcgccacagcagcaacag

SEQ ID NO: 206084 - DNA, 25 bp, Rattus norvegicus
attatgagcgcctcagcagcaacag

SEQ ID NO: 206085 - DNA, 25 bp, Rattus norvegicus
attatgaggcaaaaaaccccttcct

SEQ ID NO: 206086 - DNA, 25 bp, Rattus norvegicus
attatgaggcaataaaccccttcct

SEQ ID NO: 206087 - DNA, 25 bp, Rattus norvegicus
attatgaggcccatccagaactgaa

SEQ ID NO: 206088 - DNA, 25 bp, Rattus norvegicus
attatgaggcccttccagaactgaa

SEQ ID NO: 206089 - DNA, 25 bp, Rattus norvegicus
attatgatgcttcgttattcctcct

SEQ ID NO: 206090 - DNA, 25 bp, Rattus norvegicus
attatgatgcttggttattcctcct

SEQ ID NO: 206091 - DNA, 25 bp, Rattus norvegicus
attatgatggccattttgatgcccc

SEQ ID NO: 206092 - DNA, 25 bp, Rattus norvegicus
attatgatggcctttttgatgcccc

SEQ ID NO: 206093 - DNA, 25 bp, Rattus norvegicus
attatgatggtgcttttcttccgtg

SEQ ID NO: 206094 - DNA, 25 bp, Rattus norvegicus
attatgatggtggttttcttccgtg

SEQ ID NO: 206095 - DNA, 25 bp, Rattus norvegicus
attatgattgctattccttgtgaaa

SEQ ID NO: 206096 - DNA, 25 bp, Rattus norvegicus
attatgattgcttttccttgtgaaa

SEQ ID NO: 206097 - DNA, 25 bp, Rattus norvegicus
attatgcaaaccactttagcgctct

SEQ ID NO: 206098 - DNA, 25 bp, Rattus norvegicus
attatgcaaacctctttagcgctct

SEQ ID NO: 206099 - DNA, 25 bp, Rattus norvegicus
attatgcatcagaggtcgctgggct

SEQ ID NO: 206100 - DNA, 25 bp, Rattus norvegicus
attatgcatcagtggtcgctgggct

SEQ ID NO: 206101 - DNA, 25 bp, Rattus norvegicus
attatgcatgagctactctctgccc

SEQ ID NO: 206102 - DNA, 25 bp, Rattus norvegicus
attatgcatgaggtactctctgccc

SEQ ID NO: 206103 - DNA, 25 bp, Rattus norvegicus
attatgcattgcaacttcctgcctt

SEQ ID NO: 206104 - DNA, 25 bp, Rattus norvegicus
attatgcattgctacttcctgcctt

SEQ ID NO: 206105 - DNA, 25 bp, Rattus norvegicus
attatgccaaaaactgctcccacac

SEQ ID NO: 206106 - DNA, 25 bp, Rattus norvegicus
attatgccaaaatctgctcccacac

SEQ ID NO: 206107 - DNA, 25 bp, Rattus norvegicus
attatgccctgtcatgtaagtcccc

SEQ ID NO: 206108 - DNA, 25 bp, Rattus norvegicus
attatgccctgtgatgtaagtcccc

SEQ ID NO: 206109 - DNA, 25 bp, Rattus norvegicus
attatgcctgagctctggcagacac

SEQ ID NO: 206110 - DNA, 25 bp, Rattus norvegicus
attatgcctgaggtctggcagacac

SEQ ID NO: 206111 - DNA, 25 bp, Rattus norvegicus
attatgccttagacagttaccccag

SEQ ID NO: 206112 - DNA, 25 bp, Rattus norvegicus
attatgccttagtcagttaccccag

SEQ ID NO: 206113 - DNA, 25 bp, Rattus norvegicus
attatgcctttacatgtcgctttag

SEQ ID NO: 206114 - DNA, 25 bp, Rattus norvegicus
attatgcctttagatgtcgctttag

SEQ ID NO: 206115 - DNA, 25 bp, Rattus norvegicus
attatgctcggaacttttctctcct

SEQ ID NO: 206116 - DNA, 25 bp, Rattus norvegicus
attatgctcggatcttttctctcct

SEQ ID NO: 206117 - DNA, 25 bp, Rattus norvegicus
attatgctcttgatgctcttattca

SEQ ID NO: 206118 - DNA, 25 bp, Rattus norvegicus
attatgctcttgttgctcttattca

SEQ ID NO: 206119 - DNA, 25 bp, Rattus norvegicus
attatgctgacaacagttcccgtgc

SEQ ID NO: 206120 - DNA, 25 bp, Rattus norvegicus
attatgctgacatcagttcccgtgc

SEQ ID NO: 206121 - DNA, 25 bp, Rattus norvegicus
attatgctttataggcctgaggctg

SEQ ID NO: 206122 - DNA, 25 bp, Rattus norvegicus
attatgctttattggcctgaggctg

SEQ ID NO: 206123 - DNA, 25 bp, Rattus norvegicus
attatggaccttcttacacggtaat

SEQ ID NO: 206124 - DNA, 25 bp, Rattus norvegicus
attatggaccttgttacacggtaat

SEQ ID NO: 206125 - DNA, 25 bp, Rattus norvegicus
attatggagactatcctccttccag

SEQ ID NO: 206126 - DNA, 25 bp, Rattus norvegicus
attatggagactttcctccttccag

SEQ ID NO: 206127 - DNA, 25 bp, Rattus norvegicus
attatggccatcagttcgggtctaa

SEQ ID NO: 206128 - DNA, 25 bp, Rattus norvegicus
attatggccatctgttcgggtctaa

SEQ ID NO: 206129 - DNA, 25 bp, Rattus norvegicus
attatggctcccagactgaggccag

SEQ ID NO: 206130 - DNA, 25 bp, Rattus norvegicus
attatggctccctgactgaggccag

SEQ ID NO: 206131 - DNA, 25 bp, Rattus norvegicus
attatggctcctccaaagcctgtaa

SEQ ID NO: 206132 - DNA, 25 bp, Rattus norvegicus
attatggctcctgcaaagcctgtaa

SEQ ID NO: 206133 - DNA, 25 bp, Rattus norvegicus
attatggcttggacattttccctct

SEQ ID NO: 206134 - DNA, 25 bp, Rattus norvegicus
attatggcttggtcattttccctct

SEQ ID NO: 206135 - DNA, 25 bp, Rattus norvegicus
attatgggatgcatcctcaaatgca

SEQ ID NO: 206136 - DNA, 25 bp, Rattus norvegicus
attatgggatgcttcctcaaatgca

SEQ ID NO: 206137 - DNA, 25 bp, Rattus norvegicus
attatggtcagacgcctgtgtgtct

SEQ ID NO: 206138 - DNA, 25 bp, Rattus norvegicus
attatggtcagaggcctgtgtgtct

SEQ ID NO: 206139 - DNA, 25 bp, Rattus norvegicus
attatggtttctctagtgtcctgca

SEQ ID NO: 206140 - DNA, 25 bp, Rattus norvegicus
attatggtttctgtagtgtcctgca

SEQ ID NO: 206141 - DNA, 25 bp, Rattus norvegicus
attatgtaaagtagccgctccctaa

SEQ ID NO: 206142 - DNA, 25 bp, Rattus norvegicus
attatgtaaagttgccgctccctaa

SEQ ID NO: 206143 - DNA, 25 bp, Rattus norvegicus
attatgtacatcagagctccttccc

SEQ ID NO: 206144 - DNA, 25 bp, Rattus norvegicus
attatgtacatctgagctccttccc

SEQ ID NO: 206145 - DNA, 25 bp, Rattus norvegicus
attatgtactctccattgtctttga

SEQ ID NO: 206146 - DNA, 25 bp, Rattus norvegicus
attatgtactctgcattgtctttga

SEQ ID NO: 206147 - DNA, 25 bp, Rattus norvegicus
attatgtattatcccggcgtttagt

SEQ ID NO: 206148 - DNA, 25 bp, Rattus norvegicus
attatgtattatgccggcgtttagt

SEQ ID NO: 206149 - DNA, 25 bp, Rattus norvegicus
attatgtcaccccagtgaaccggaa

SEQ ID NO: 206150 - DNA, 25 bp, Rattus norvegicus
attatgtcacccgagtgaaccggaa

SEQ ID NO: 206151 - DNA, 25 bp, Rattus norvegicus
attatgtcatctcagaagggttcct

SEQ ID NO: 206152 - DNA, 25 bp, Rattus norvegicus
attatgtcatctgagaagggttcct

SEQ ID NO: 206153 - DNA, 25 bp, Rattus norvegicus
attatgtccactctgaggtcttggt

SEQ ID NO: 206154 - DNA, 25 bp, Rattus norvegicus
attatgtccactgtgaggtcttggt

SEQ ID NO: 206155 - DNA, 25 bp, Rattus norvegicus
attatgtctctcacgatttcaactc

SEQ ID NO: 206156 - DNA, 25 bp, Rattus norvegicus
attatgtctctctcgatttcaactc

SEQ ID NO: 206157 - DNA, 25 bp, Rattus norvegicus
attatgtctgctagggctatgctct

SEQ ID NO: 206158 - DNA, 25 bp, Rattus norvegicus
attatgtctgcttgggctatgctct

SEQ ID NO: 206159 - DNA, 25 bp, Rattus norvegicus
attatgtctggacgatgcttctgga

SEQ ID NO: 206160 - DNA, 25 bp, Rattus norvegicus
attatgtctggaggatgcttctgga

SEQ ID NO: 206161 - DNA, 25 bp, Rattus norvegicus
attatgtgacacaccagtgcctagc

SEQ ID NO: 206162 - DNA, 25 bp, Rattus norvegicus
attatgtgacactccagtgcctagc

SEQ ID NO: 206163 - DNA, 25 bp, Rattus norvegicus
attatgtgcctgataacttatttga

SEQ ID NO: 206164 - DNA, 25 bp, Rattus norvegicus
attatgtgcctgttaacttatttga

SEQ ID NO: 206165 - DNA, 25 bp, Rattus norvegicus
attatgtgccttattatgtgcttaa

SEQ ID NO: 206166 - DNA, 25 bp, Rattus norvegicus
attatgtgccttcctccctgattgt

SEQ ID NO: 206167 - DNA, 25 bp, Rattus norvegicus
attatgtgccttgctccctgattgt

SEQ ID NO: 206168 - DNA, 25 bp, Rattus norvegicus
attatgtgcctttttatgtgcttaa

SEQ ID NO: 206169 - DNA, 25 bp, Rattus norvegicus
attatgttccagcaaggcggccagg

SEQ ID NO: 206170 - DNA, 25 bp, Rattus norvegicus
attatgttccaggaaggcggccagg

SEQ ID NO: 206171 - DNA, 25 bp, Rattus norvegicus
attatgttgccaaggtgctccgaaa

SEQ ID NO: 206172 - DNA, 25 bp, Rattus norvegicus
attatgttgccatggtgctccgaaa

SEQ ID NO: 206173 - DNA, 25 bp, Rattus norvegicus
attatgttgctgcaagactgtctac

SEQ ID NO: 206174 - DNA, 25 bp, Rattus norvegicus
attatgttgctggaagactgtctac

SEQ ID NO: 206175 - DNA, 25 bp, Rattus norvegicus
attattaacgctcccatacctcagt

SEQ ID NO: 206176 - DNA, 25 bp, Rattus norvegicus
attattaacgctgccatacctcagt

SEQ ID NO: 206177 - DNA, 25 bp, Rattus norvegicus
attattaatctgctgaggtttcaaa

SEQ ID NO: 206178 - DNA, 25 bp, Rattus norvegicus
attattaatctggtgaggtttcaaa

SEQ ID NO: 206179 - DNA, 25 bp, Rattus norvegicus
attattacccaacatggcaccaggc

SEQ ID NO: 206180 - DNA, 25 bp, Rattus norvegicus
attattacccaagatggcaccaggc

SEQ ID NO: 206181 - DNA, 25 bp, Rattus norvegicus
attattagccttatgcctgttgctg

SEQ ID NO: 206182 - DNA, 25 bp, Rattus norvegicus
attattagccttttgcctgttgctg

SEQ ID NO: 206183 - DNA, 25 bp, Rattus norvegicus
attattagtcagactcaggcctagt

SEQ ID NO: 206184 - DNA, 25 bp, Rattus norvegicus
attattagtcagtctcaggcctagt

SEQ ID NO: 206185 - DNA, 25 bp, Rattus norvegicus
attattagtgtgactgattctctga

SEQ ID NO: 206186 - DNA, 25 bp, Rattus norvegicus
attattagtgtgtctgattctctga

SEQ ID NO: 206187 - DNA, 25 bp, Rattus norvegicus
attattatcattactcccttttctc

SEQ ID NO: 206188 - DNA, 25 bp, Rattus norvegicus
attattatcatttctcccttttctc

SEQ ID NO: 206189 - DNA, 25 bp, Rattus norvegicus
attattcacaataaactgtcccctt

SEQ ID NO: 206190 - DNA, 25 bp, Rattus norvegicus
attattcacaattaactgtcccctt

SEQ ID NO: 206191 - DNA, 25 bp, Rattus norvegicus
attattcatctcaccaaacacttta

SEQ ID NO: 206192 - DNA, 25 bp, Rattus norvegicus
attattcatctctccaaacacttta

SEQ ID NO: 206193 - DNA, 25 bp, Rattus norvegicus
attattcattcgctgctagtattag

SEQ ID NO: 206194 - DNA, 25 bp, Rattus norvegicus
attattcattcggtgctagtattag

SEQ ID NO: 206195 - DNA, 25 bp, Rattus norvegicus
attattccagaaagatgcccgcaac

SEQ ID NO: 206196 - DNA, 25 bp, Rattus norvegicus
attattccagaatgatgcccgcaac

SEQ ID NO: 206197 - DNA, 25 bp, Rattus norvegicus
attattccattcatcctcattgtta

SEQ ID NO: 206198 - DNA, 25 bp, Rattus norvegicus
attattccattcttcctcattgtta

SEQ ID NO: 206199 - DNA, 25 bp, Rattus norvegicus
attattccattgagtgggacgcctc

SEQ ID NO: 206200 - DNA, 25 bp, Rattus norvegicus
attattccattgtgtgggacgcctc

SEQ ID NO: 206201 - DNA, 25 bp, Rattus norvegicus
attattcctttcactctttactatg

SEQ ID NO: 206202 - DNA, 25 bp, Rattus norvegicus
attattcctttctctctttactatg

SEQ ID NO: 206203 - DNA, 25 bp, Rattus norvegicus
attattcggacgcttgctcccagcc

SEQ ID NO: 206204 - DNA, 25 bp, Rattus norvegicus
attattcggacggttgctcccagcc

SEQ ID NO: 206205 - DNA, 25 bp, Rattus norvegicus
attattctaagaaagcctgtgtttg

SEQ ID NO: 206206 - DNA, 25 bp, Rattus norvegicus
attattctaagatagcctgtgtttg

SEQ ID NO: 206207 - DNA, 25 bp, Rattus norvegicus
attattctcagtcgagaccgcccag

SEQ ID NO: 206208 - DNA, 25 bp, Rattus norvegicus
attattctcagtggagaccgcccag

SEQ ID NO: 206209 - DNA, 25 bp, Rattus norvegicus
attattctcataatcacctccttcc

SEQ ID NO: 206210 - DNA, 25 bp, Rattus norvegicus
attattctcatattcacctccttcc

SEQ ID NO: 206211 - DNA, 25 bp, Rattus norvegicus
attattctctagcttgtcccttcaa

SEQ ID NO: 206212 - DNA, 25 bp, Rattus norvegicus
attattctctaggttgtcccttcaa

SEQ ID NO: 206213 - DNA, 25 bp, Rattus norvegicus
attattctggaaacaattactaaaa

SEQ ID NO: 206214 - DNA, 25 bp, Rattus norvegicus
attattctggaatcaattactaaaa

SEQ ID NO: 206215 - DNA, 25 bp, Rattus norvegicus
attattctttctaaagccacattga

SEQ ID NO: 206216 - DNA, 25 bp, Rattus norvegicus
attattctttcttaagccacattga

SEQ ID NO: 206217 - DNA, 25 bp, Rattus norvegicus
attattctttgtcctggcatcccaa

SEQ ID NO: 206218 - DNA, 25 bp, Rattus norvegicus
attattctttgtgctggcatcccaa

SEQ ID NO: 206219 - DNA, 25 bp, Rattus norvegicus
attattgaagtgagcctggccctaa

SEQ ID NO: 206220 - DNA, 25 bp, Rattus norvegicus
attattgaagtgtgcctggccctaa

SEQ ID NO: 206221 - DNA, 25 bp, Rattus norvegicus
attattgaccccatgtgctaggcga

SEQ ID NO: 206222 - DNA, 25 bp, Rattus norvegicus
attattgaccccttgtgctaggcga

SEQ ID NO: 206223 - DNA, 25 bp, Rattus norvegicus
attattgaccttctacagtctgctt

SEQ ID NO: 206224 - DNA, 25 bp, Rattus norvegicus
attattgaccttgtacagtctgctt

SEQ ID NO: 206225 - DNA, 25 bp, Rattus norvegicus
attattgacgatccatctgtgccgt

SEQ ID NO: 206226 - DNA, 25 bp, Rattus norvegicus
attattgacgatgcatctgtgccgt

SEQ ID NO: 206227 - DNA, 25 bp, Rattus norvegicus
attattgagctgagtggcccctctc

SEQ ID NO: 206228 - DNA, 25 bp, Rattus norvegicus
attattgagctgtgtggcccctctc

SEQ ID NO: 206229 - DNA, 25 bp, Rattus norvegicus
attattgagtgtcgcctttctccca

SEQ ID NO: 206230 - DNA, 25 bp, Rattus norvegicus
attattgagtgtggcctttctccca

SEQ ID NO: 206231 - DNA, 25 bp, Rattus norvegicus
attattgcagttatctctagaaggc

SEQ ID NO: 206232 - DNA, 25 bp, Rattus norvegicus
attattgcagttttctctagaaggc

SEQ ID NO: 206233 - DNA, 25 bp, Rattus norvegicus
attattgcataaactccaccagctt

SEQ ID NO: 206234 - DNA, 25 bp, Rattus norvegicus
attattgcataatctccaccagctt

SEQ ID NO: 206235 - DNA, 25 bp, Rattus norvegicus
attattgccacaactacctgggcgg

SEQ ID NO: 206236 - DNA, 25 bp, Rattus norvegicus
attattgccacatctacctgggcgg

SEQ ID NO: 206237 - DNA, 25 bp, Rattus norvegicus
attattgcctttactgttctcctag

SEQ ID NO: 206238 - DNA, 25 bp, Rattus norvegicus
attattgccttttctgttctcctag

SEQ ID NO: 206239 - DNA, 25 bp, Rattus norvegicus
attattgcgatcaatagcaccccgc

SEQ ID NO: 206240 - DNA, 25 bp, Rattus norvegicus
attattgcgatctatagcaccccgc

SEQ ID NO: 206241 - DNA, 25 bp, Rattus norvegicus
attattgctaatattctgtgtgcag

SEQ ID NO: 206242 - DNA, 25 bp, Rattus norvegicus
attattgctaattttctgtgtgcag

SEQ ID NO: 206243 - DNA, 25 bp, Rattus norvegicus
attattggacctcttcgctttccga

SEQ ID NO: 206244 - DNA, 25 bp, Rattus norvegicus
attattggacctgttcgctttccga

SEQ ID NO: 206245 - DNA, 25 bp, Rattus norvegicus
attattggttgtctattccctcagt

SEQ ID NO: 206246 - DNA, 25 bp, Rattus norvegicus
attattggttgtgtattccctcagt

SEQ ID NO: 206247 - DNA, 25 bp, Rattus norvegicus
attattgtaactactgtgtggacag

SEQ ID NO: 206248 - DNA, 25 bp, Rattus norvegicus
attattgtaacttctgtgtggacag

SEQ ID NO: 206249 - DNA, 25 bp, Rattus norvegicus
attattgtcctccaaactctgatga

SEQ ID NO: 206250 - DNA, 25 bp, Rattus norvegicus
attattgtcctcgaaactctgatga

SEQ ID NO: 206251 - DNA, 25 bp, Rattus norvegicus
attattgtcttgattccaggtctaa

SEQ ID NO: 206252 - DNA, 25 bp, Rattus norvegicus
attattgtcttgtttccaggtctaa

SEQ ID NO: 206253 - DNA, 25 bp, Rattus norvegicus
attattgtgtggcactgtgctgact

SEQ ID NO: 206254 - DNA, 25 bp, Rattus norvegicus
attattgtgtgggactgtgctgact

SEQ ID NO: 206255 - DNA, 25 bp, Rattus norvegicus
attatttaaatcaaccatcacttcg

SEQ ID NO: 206256 - DNA, 25 bp, Rattus norvegicus
attatttaaatctaccatcacttcg

SEQ ID NO: 206257 - DNA, 25 bp, Rattus norvegicus
attatttaacccagtggcctcatta

SEQ ID NO: 206258 - DNA, 25 bp, Rattus norvegicus
attatttaaccctgtggcctcatta

SEQ ID NO: 206259 - DNA, 25 bp, Rattus norvegicus
attatttaaggccactctgccgctc

SEQ ID NO: 206260 - DNA, 25 bp, Rattus norvegicus
attatttaaggcgactctgccgctc

SEQ ID NO: 206261 - DNA, 25 bp, Rattus norvegicus
attatttaccctcactattctctct

SEQ ID NO: 206262 - DNA, 25 bp, Rattus norvegicus
attatttaccctgactattctctct

SEQ ID NO: 206263 - DNA, 25 bp, Rattus norvegicus
attatttacctcaatctgctgctta

SEQ ID NO: 206264 - DNA, 25 bp, Rattus norvegicus
attatttacctctatctgctgctta

SEQ ID NO: 206265 - DNA, 25 bp, Rattus norvegicus
attatttagtgtacctgttgtctca

SEQ ID NO: 206266 - DNA, 25 bp, Rattus norvegicus
attatttagtgttcctgttgtctca

SEQ ID NO: 206267 - DNA, 25 bp, Rattus norvegicus
attatttatttcacgcaacacaccc

SEQ ID NO: 206268 - DNA, 25 bp, Rattus norvegicus
attatttatttctcgcaacacaccc

SEQ ID NO: 206269 - DNA, 25 bp, Rattus norvegicus
attatttcattcacctcatttatca

SEQ ID NO: 206270 - DNA, 25 bp, Rattus norvegicus
attatttcattctcctcatttatca

SEQ ID NO: 206271 - DNA, 25 bp, Rattus norvegicus
attatttcctccatcgaattccttc

SEQ ID NO: 206272 - DNA, 25 bp, Rattus norvegicus
attatttcctccttcgaattccttc

SEQ ID NO: 206273 - DNA, 25 bp, Rattus norvegicus
attatttcctgtcattttcctcctt

SEQ ID NO: 206274 - DNA, 25 bp, Rattus norvegicus
attatttcctgtgattttcctcctt

SEQ ID NO: 206275 - DNA, 25 bp, Rattus norvegicus
attatttccttaacctagcagtgag

SEQ ID NO: 206276 - DNA, 25 bp, Rattus norvegicus
attatttccttatcctagcagtgag

SEQ ID NO: 206277 - DNA, 25 bp, Rattus norvegicus
attatttctcaaccatcgcccattt

SEQ ID NO: 206278 - DNA, 25 bp, Rattus norvegicus
attatttctcaagcatcgcccattt

SEQ ID NO: 206279 - DNA, 25 bp, Rattus norvegicus
attatttctgatagtcccacttcca

SEQ ID NO: 206280 - DNA, 25 bp, Rattus norvegicus
attatttctgattgtcccacttcca

SEQ ID NO: 206281 - DNA, 25 bp, Rattus norvegicus
attatttctgccagtacagatgcta

SEQ ID NO: 206282 - DNA, 25 bp, Rattus norvegicus
attatttctgcctgtacagatgcta

SEQ ID NO: 206283 - DNA, 25 bp, Rattus norvegicus
attatttgacgcagtcttacctcca

SEQ ID NO: 206284 - DNA, 25 bp, Rattus norvegicus
attatttgacgctgtcttacctcca

SEQ ID NO: 206285 - DNA, 25 bp, Rattus norvegicus
attatttgcactactggctttctca

SEQ ID NO: 206286 - DNA, 25 bp, Rattus norvegicus
attatttgcacttctggctttctca

SEQ ID NO: 206287 - DNA, 25 bp, Rattus norvegicus
attatttgggttagtcttagtgcca

SEQ ID NO: 206288 - DNA, 25 bp, Rattus norvegicus
attatttgggtttgtcttagtgcca

SEQ ID NO: 206289 - DNA, 25 bp, Rattus norvegicus
attatttgtcccctgaatgtcagag

SEQ ID NO: 206290 - DNA, 25 bp, Rattus norvegicus
attatttgtcccgtgaatgtcagag

SEQ ID NO: 206291 - DNA, 25 bp, Rattus norvegicus
attatttgtcttcggtagagcgacg

SEQ ID NO: 206292 - DNA, 25 bp, Rattus norvegicus
attatttgtcttgggtagagcgacg

SEQ ID NO: 206293 - DNA, 25 bp, Rattus norvegicus
attatttgttaacccctgaatcagc

SEQ ID NO: 206294 - DNA, 25 bp, Rattus norvegicus
attatttgttaagccctgaatcagc

SEQ ID NO: 206295 - DNA, 25 bp, Rattus norvegicus
attatttgttgtagacctgtcaggc

SEQ ID NO: 206296 - DNA, 25 bp, Rattus norvegicus
attatttgttgttgacctgtcaggc

SEQ ID NO: 206297 - DNA, 25 bp, Rattus norvegicus
attatttgtttaatggtgcctattt

SEQ ID NO: 206298 - DNA, 25 bp, Rattus norvegicus
attatttgtttattggtgcctattt

SEQ ID NO: 206299 - DNA, 25 bp, Rattus norvegicus
attatttgtttccagatcccttagc

SEQ ID NO: 206300 - DNA, 25 bp, Rattus norvegicus
attatttgtttcgagatcccttagc

SEQ ID NO: 206301 - DNA, 25 bp, Rattus norvegicus
attatttgttttaactcagctctga

SEQ ID NO: 206302 - DNA, 25 bp, Rattus norvegicus
attatttgtttttactcagctctga

SEQ ID NO: 206303 - DNA, 25 bp, Rattus norvegicus
attattttacaacagcgggcaggcg

SEQ ID NO: 206304 - DNA, 25 bp, Rattus norvegicus
attattttacaagagcgggcaggcg

SEQ ID NO: 206305 - DNA, 25 bp, Rattus norvegicus
attattttccctctgatgcttgtgg

SEQ ID NO: 206306 - DNA, 25 bp, Rattus norvegicus
attattttccctgtgatgcttgtgg

SEQ ID NO: 206307 - DNA, 25 bp, Rattus norvegicus
attattttcgagacggtgtctcgct

SEQ ID NO: 206308 - DNA, 25 bp, Rattus norvegicus
attattttcgagtcggtgtctcgct

SEQ ID NO: 206309 - DNA, 25 bp, Rattus norvegicus
attattttgggcaggtgcaggctcc

SEQ ID NO: 206310 - DNA, 25 bp, Rattus norvegicus
attattttgggctggtgcaggctcc

SEQ ID NO: 206311 - DNA, 25 bp, Rattus norvegicus
attatttttagtctctgcgttgtag

SEQ ID NO: 206312 - DNA, 25 bp, Rattus norvegicus
attatttttagtgtctgcgttgtag

SEQ ID NO: 206313 - DNA, 25 bp, Rattus norvegicus
attatttttatacactgccctttct

SEQ ID NO: 206314 - DNA, 25 bp, Rattus norvegicus
attatttttatagactgccctttct

SEQ ID NO: 206315 - DNA, 25 bp, Rattus norvegicus
attatttttgggatccagacactga

SEQ ID NO: 206316 - DNA, 25 bp, Rattus norvegicus
attatttttgggttccagacactga

SEQ ID NO: 206317 - DNA, 25 bp, Rattus norvegicus
attattttttgtactctctcatttt

SEQ ID NO: 206318 - DNA, 25 bp, Rattus norvegicus
attattttttgttctctctcatttt

SEQ ID NO: 206319 - DNA, 25 bp, Rattus norvegicus
attcaaaaagctaccagctaatggg

SEQ ID NO: 206320 - DNA, 25 bp, Rattus norvegicus
attcaaaaagcttccagctaatggg

SEQ ID NO: 206321 - DNA, 25 bp, Rattus norvegicus
attcaaaagagacacaccctggcct

SEQ ID NO: 206322 - DNA, 25 bp, Rattus norvegicus
attcaaaagagagacaccctggcct

SEQ ID NO: 206323 - DNA, 25 bp, Rattus norvegicus
attcaaaatatacaagactctctca

SEQ ID NO: 206324 - DNA, 25 bp, Rattus norvegicus
attcaaaatatagaagactctctca

SEQ ID NO: 206325 - DNA, 25 bp, Rattus norvegicus
attcaaaattttatctccagcccaa

SEQ ID NO: 206326 - DNA, 25 bp, Rattus norvegicus
attcaaaattttttctccagcccaa

SEQ ID NO: 206327 - DNA, 25 bp, Rattus norvegicus
attcaaacacttctgtggcatacaa

SEQ ID NO: 206328 - DNA, 25 bp, Rattus norvegicus
attcaaacacttgtgtggcatacaa

SEQ ID NO: 206329 - DNA, 25 bp, Rattus norvegicus
attcaaacccagcaggtctggctct

SEQ ID NO: 206330 - DNA, 25 bp, Rattus norvegicus
attcaaacccaggaggtctggctct

SEQ ID NO: 206331 - DNA, 25 bp, Rattus norvegicus
attcaaacccctacgttcgatagat

SEQ ID NO: 206332 - DNA, 25 bp, Rattus norvegicus
attcaaaccccttcgttcgatagat

SEQ ID NO: 206333 - DNA, 25 bp, Rattus norvegicus
attcaaaccttgacacactgtggga

SEQ ID NO: 206334 - DNA, 25 bp, Rattus norvegicus
attcaaaccttgtcacactgtggga

SEQ ID NO: 206335 - DNA, 25 bp, Rattus norvegicus
attcaaactaaactgcacctcttca

SEQ ID NO: 206336 - DNA, 25 bp, Rattus norvegicus
attcaaactaaagtgcacctcttca

SEQ ID NO: 206337 - DNA, 25 bp, Rattus norvegicus
attcaaacttcactgcattgcacat

SEQ ID NO: 206338 - DNA, 25 bp, Rattus norvegicus
attcaaacttcagtgcattgcacat

SEQ ID NO: 206339 - DNA, 25 bp, Rattus norvegicus
attcaaacttgtctaggccctaacg

SEQ ID NO: 206340 - DNA, 25 bp, Rattus norvegicus
attcaaacttgtgtaggccctaacg

SEQ ID NO: 206341 - DNA, 25 bp, Rattus norvegicus
attcaaagtgcactactgcctcatg

SEQ ID NO: 206342 - DNA, 25 bp, Rattus norvegicus
attcaaagtgcagtactgcctcatg

SEQ ID NO: 206343 - DNA, 25 bp, Rattus norvegicus
attcaaatacagacagggcctcact

SEQ ID NO: 206344 - DNA, 25 bp, Rattus norvegicus
attcaaatacagtcagggcctcact

SEQ ID NO: 206345 - DNA, 25 bp, Rattus norvegicus
attcaaatccgcacagtagccacag

SEQ ID NO: 206346 - DNA, 25 bp, Rattus norvegicus
attcaaatccgctcagtagccacag

SEQ ID NO: 206347 - DNA, 25 bp, Rattus norvegicus
attcaaatgttcagtccttccactg

SEQ ID NO: 206348 - DNA, 25 bp, Rattus norvegicus
attcaaatgttctgtccttccactg

SEQ ID NO: 206349 - DNA, 25 bp, Rattus norvegicus
attcaaattatcacattagcctgga

SEQ ID NO: 206350 - DNA, 25 bp, Rattus norvegicus
attcaaattatctcattagcctgga

SEQ ID NO: 206351 - DNA, 25 bp, Rattus norvegicus
attcaaatttgtagctcagtccaaa

SEQ ID NO: 206352 - DNA, 25 bp, Rattus norvegicus
attcaaatttgttgctcagtccaaa

SEQ ID NO: 206353 - DNA, 25 bp, Rattus norvegicus
attcaacactgcatcaaggcttctg

SEQ ID NO: 206354 - DNA, 25 bp, Rattus norvegicus
attcaacactgcttcaaggcttctg

SEQ ID NO: 206355 - DNA, 25 bp, Rattus norvegicus
attcaacaggataaggatcagccgg

SEQ ID NO: 206356 - DNA, 25 bp, Rattus norvegicus
attcaacaggattaggatcagccgg

SEQ ID NO: 206357 - DNA, 25 bp, Rattus norvegicus
attcaacaggccagtcagcttcaga

SEQ ID NO: 206358 - DNA, 25 bp, Rattus norvegicus
attcaacaggcctgtcagcttcaga

SEQ ID NO: 206359 - DNA, 25 bp, Rattus norvegicus
attcaacatagcatgtgtgtctcca

SEQ ID NO: 206360 - DNA, 25 bp, Rattus norvegicus
attcaacatagcttgtgtgtctcca

SEQ ID NO: 206361 - DNA, 25 bp, Rattus norvegicus
attcaaccaacaattgctcttaggg

SEQ ID NO: 206362 - DNA, 25 bp, Rattus norvegicus
attcaaccaacatttgctcttaggg

SEQ ID NO: 206363 - DNA, 25 bp, Rattus norvegicus
attcaaccagagattccctcttgta

SEQ ID NO: 206364 - DNA, 25 bp, Rattus norvegicus
attcaaccagagtttccctcttgta

SEQ ID NO: 206365 - DNA, 25 bp, Rattus norvegicus
attcaacctgcaatgagccgggatt

SEQ ID NO: 206366 - DNA, 25 bp, Rattus norvegicus
attcaacctgcattgagccgggatt

SEQ ID NO: 206367 - DNA, 25 bp, Rattus norvegicus
attcaaccttgtaatctcagcactc

SEQ ID NO: 206368 - DNA, 25 bp, Rattus norvegicus
attcaaccttgttatctcagcactc

SEQ ID NO: 206369 - DNA, 25 bp, Rattus norvegicus
attcaacgaacaacacagacccttt

SEQ ID NO: 206370 - DNA, 25 bp, Rattus norvegicus
attcaacgaacatcacagacccttt

SEQ ID NO: 206371 - DNA, 25 bp, Rattus norvegicus
attcaactaataatgctgctcaaga

SEQ ID NO: 206372 - DNA, 25 bp, Rattus norvegicus
attcaactaatattgctgctcaaga

SEQ ID NO: 206373 - DNA, 25 bp, Rattus norvegicus
attcaactcaccagttctgatgcat

SEQ ID NO: 206374 - DNA, 25 bp, Rattus norvegicus
attcaactcacctgttctgatgcat

SEQ ID NO: 206375 - DNA, 25 bp, Rattus norvegicus
attcaactccacatgatggtttgct

SEQ ID NO: 206376 - DNA, 25 bp, Rattus norvegicus
attcaactccacttgatggtttgct

SEQ ID NO: 206377 - DNA, 25 bp, Rattus norvegicus
attcaactcgtgcttcttgtgggat

SEQ ID NO: 206378 - DNA, 25 bp, Rattus norvegicus
attcaactcgtggttcttgtgggat

SEQ ID NO: 206379 - DNA, 25 bp, Rattus norvegicus
attcaactctcaccattgcaaaaat

SEQ ID NO: 206380 - DNA, 25 bp, Rattus norvegicus
attcaactctcagcattgcaaaaat

SEQ ID NO: 206381 - DNA, 25 bp, Rattus norvegicus
attcaactctgacaggcaggagtgt

SEQ ID NO: 206382 - DNA, 25 bp, Rattus norvegicus
attcaactctgagaggcaggagtgt

SEQ ID NO: 206383 - DNA, 25 bp, Rattus norvegicus
attcaactctggaacactcatctag

SEQ ID NO: 206384 - DNA, 25 bp, Rattus norvegicus
attcaactctggtacactcatctag

SEQ ID NO: 206385 - DNA, 25 bp, Rattus norvegicus
attcaacttggaacctactcctgac

SEQ ID NO: 206386 - DNA, 25 bp, Rattus norvegicus
attcaacttggatcctactcctgac

SEQ ID NO: 206387 - DNA, 25 bp, Rattus norvegicus
attcaacttttaacacccgtggcat

SEQ ID NO: 206388 - DNA, 25 bp, Rattus norvegicus
attcaacttttatcacccgtggcat

SEQ ID NO: 206389 - DNA, 25 bp, Rattus norvegicus
attcaagaattcctcccaaagaaca

SEQ ID NO: 206390 - DNA, 25 bp, Rattus norvegicus
attcaagaattcgtcccaaagaaca

SEQ ID NO: 206391 - DNA, 25 bp, Rattus norvegicus
attcaagacaccagttaacccctgg

SEQ ID NO: 206392 - DNA, 25 bp, Rattus norvegicus
attcaagacacctgttaacccctgg

SEQ ID NO: 206393 - DNA, 25 bp, Rattus norvegicus
attcaagacttcaatggtccccaca

SEQ ID NO: 206394 - DNA, 25 bp, Rattus norvegicus
attcaagacttctatggtccccaca

SEQ ID NO: 206395 - DNA, 25 bp, Rattus norvegicus
attcaagagcatatccacatactgg

SEQ ID NO: 206396 - DNA, 25 bp, Rattus norvegicus
attcaagagcatttccacatactgg

SEQ ID NO: 206397 - DNA, 25 bp, Rattus norvegicus
attcaagaggccctgagaagcctgg

SEQ ID NO: 206398 - DNA, 25 bp, Rattus norvegicus
attcaagaggccgtgagaagcctgg

SEQ ID NO: 206399 - DNA, 25 bp, Rattus norvegicus
attcaagagttcattgcttcacaaa

SEQ ID NO: 206400 - DNA, 25 bp, Rattus norvegicus
attcaagagttctttgcttcacaaa

SEQ ID NO: 206401 - DNA, 25 bp, Rattus norvegicus
attcaagatcctcttgtcttggcct

SEQ ID NO: 206402 - DNA, 25 bp, Rattus norvegicus
attcaagatcctgttgtcttggcct

SEQ ID NO: 206403 - DNA, 25 bp, Rattus norvegicus
attcaagcactcaggacaatccatt

SEQ ID NO: 206404 - DNA, 25 bp, Rattus norvegicus
attcaagcactctggacaatccatt

SEQ ID NO: 206405 - DNA, 25 bp, Rattus norvegicus
attcaagccaacaactcgctgatgg

SEQ ID NO: 206406 - DNA, 25 bp, Rattus norvegicus
attcaagccaactactcgctgatgg

SEQ ID NO: 206407 - DNA, 25 bp, Rattus norvegicus
attcaagctcttccttctagtggct

SEQ ID NO: 206408 - DNA, 25 bp, Rattus norvegicus
attcaagctcttgcttctagtggct

SEQ ID NO: 206409 - DNA, 25 bp, Rattus norvegicus
attcaagctgtgattcttttctttc

SEQ ID NO: 206410 - DNA, 25 bp, Rattus norvegicus
attcaagctgtgtttcttttctttc

SEQ ID NO: 206411 - DNA, 25 bp, Rattus norvegicus
attcaaggcccaccataaattccac

SEQ ID NO: 206412 - DNA, 25 bp, Rattus norvegicus
attcaaggcccagcataaattccac

SEQ ID NO: 206413 - DNA, 25 bp, Rattus norvegicus
attcaaggcggtatgcaatggtaaa

SEQ ID NO: 206414 - DNA, 25 bp, Rattus norvegicus
attcaaggcggtttgcaatggtaaa

SEQ ID NO: 206415 - DNA, 25 bp, Rattus norvegicus
attcaaggttctattactggttctg

SEQ ID NO: 206416 - DNA, 25 bp, Rattus norvegicus
attcaaggttcttttactggttctg

SEQ ID NO: 206417 - DNA, 25 bp, Rattus norvegicus
attcaaggtttgctactttgtgtta

SEQ ID NO: 206418 - DNA, 25 bp, Rattus norvegicus
attcaaggtttggtactttgtgtta

SEQ ID NO: 206419 - DNA, 25 bp, Rattus norvegicus
attcaagtgccaaattccacctttc

SEQ ID NO: 206420 - DNA, 25 bp, Rattus norvegicus
attcaagtgccatattccacctttc

SEQ ID NO: 206421 - DNA, 25 bp, Rattus norvegicus
attcaagtgggcacaacagactcag

SEQ ID NO: 206422 - DNA, 25 bp, Rattus norvegicus
attcaagtgggctcaacagactcag

SEQ ID NO: 206423 - DNA, 25 bp, Rattus norvegicus
attcaagttcgaatgatttcctgct

SEQ ID NO: 206424 - DNA, 25 bp, Rattus norvegicus
attcaagttcgattgatttcctgct

SEQ ID NO: 206425 - DNA, 25 bp, Rattus norvegicus
attcaagttgcgaatttctaaagga

SEQ ID NO: 206426 - DNA, 25 bp, Rattus norvegicus
attcaagttgcgtatttctaaagga

SEQ ID NO: 206427 - DNA, 25 bp, Rattus norvegicus
attcaataacggagccctcattagc

SEQ ID NO: 206428 - DNA, 25 bp, Rattus norvegicus
attcaataacggtgccctcattagc

SEQ ID NO: 206429 - DNA, 25 bp, Rattus norvegicus
attcaatacacacttcagtgcatga

SEQ ID NO: 206430 - DNA, 25 bp, Rattus norvegicus
attcaatacacagttcagtgcatga

SEQ ID NO: 206431 - DNA, 25 bp, Rattus norvegicus
attcaatagcttctaatgtcttatg

SEQ ID NO: 206432 - DNA, 25 bp, Rattus norvegicus
attcaatagcttgtaatgtcttatg

SEQ ID NO: 206433 - DNA, 25 bp, Rattus norvegicus
attcaatccaccacagtggtacagg

SEQ ID NO: 206434 - DNA, 25 bp, Rattus norvegicus
attcaatccacctcagtggtacagg

SEQ ID NO: 206435 - DNA, 25 bp, Rattus norvegicus
attcaatgacttaacaccttgtctg

SEQ ID NO: 206436 - DNA, 25 bp, Rattus norvegicus
attcaatgactttacaccttgtctg

SEQ ID NO: 206437 - DNA, 25 bp, Rattus norvegicus
attcaatgcactcgatctcatggag

SEQ ID NO: 206438 - DNA, 25 bp, Rattus norvegicus
attcaatgcactggatctcatggag

SEQ ID NO: 206439 - DNA, 25 bp, Rattus norvegicus
attcaatgcagtccttgtgattccc

SEQ ID NO: 206440 - DNA, 25 bp, Rattus norvegicus
attcaatgcagtgcttgtgattccc

SEQ ID NO: 206441 - DNA, 25 bp, Rattus norvegicus
attcaatgtcaactttccgcctgtg

SEQ ID NO: 206442 - DNA, 25 bp, Rattus norvegicus
attcaatgtcaagtttccgcctgtg

SEQ ID NO: 206443 - DNA, 25 bp, Rattus norvegicus
attcaatgtcatactgagctatgga

SEQ ID NO: 206444 - DNA, 25 bp, Rattus norvegicus
attcaatgtcattctgagctatgga

SEQ ID NO: 206445 - DNA, 25 bp, Rattus norvegicus
attcaattaagacctcctttccaag

SEQ ID NO: 206446 - DNA, 25 bp, Rattus norvegicus
attcaattaagagctcctttccaag

SEQ ID NO: 206447 - DNA, 25 bp, Rattus norvegicus
attcaattccatcatgaagtgtgac

SEQ ID NO: 206448 - DNA, 25 bp, Rattus norvegicus
attcaattccatgatgaagtgtgac

SEQ ID NO: 206449 - DNA, 25 bp, Rattus norvegicus
attcaattctaaactcgtcatgatt

SEQ ID NO: 206450 - DNA, 25 bp, Rattus norvegicus
attcaattctaatctcgtcatgatt

SEQ ID NO: 206451 - DNA, 25 bp, Rattus norvegicus
attcaattttttcgccccacatgac

SEQ ID NO: 206452 - DNA, 25 bp, Rattus norvegicus
attcaattttttggccccacatgac

SEQ ID NO: 206453 - DNA, 25 bp, Rattus norvegicus
attcacaaacgtctgggtccaatca

SEQ ID NO: 206454 - DNA, 25 bp, Rattus norvegicus
attcacaaacgtgtgggtccaatca

SEQ ID NO: 206455 - DNA, 25 bp, Rattus norvegicus
attcacaatcagagtttgccacagg

SEQ ID NO: 206456 - DNA, 25 bp, Rattus norvegicus
attcacaatcagtgtttgccacagg

SEQ ID NO: 206457 - DNA, 25 bp, Rattus norvegicus
attcacacagaaagtatctcggtgg

SEQ ID NO: 206458 - DNA, 25 bp, Rattus norvegicus
attcacacagaatgtatctcggtgg

SEQ ID NO: 206459 - DNA, 25 bp, Rattus norvegicus
attcacacagtcatcgccagggagg

SEQ ID NO: 206460 - DNA, 25 bp, Rattus norvegicus
attcacacagtcttcgccagggagg

SEQ ID NO: 206461 - DNA, 25 bp, Rattus norvegicus
attcacaccataagcatgatgctgc

SEQ ID NO: 206462 - DNA, 25 bp, Rattus norvegicus
attcacaccatatgcatgatgctgc

SEQ ID NO: 206463 - DNA, 25 bp, Rattus norvegicus
attcacacgctaacaggacaccagt

SEQ ID NO: 206464 - DNA, 25 bp, Rattus norvegicus
attcacacgctatcaggacaccagt

SEQ ID NO: 206465 - DNA, 25 bp, Rattus norvegicus
attcacactcggatgtcttgtaaac

SEQ ID NO: 206466 - DNA, 25 bp, Rattus norvegicus
attcacactcggttgtcttgtaaac

SEQ ID NO: 206467 - DNA, 25 bp, Rattus norvegicus
attcacagaatgatgtcagcctgag

SEQ ID NO: 206468 - DNA, 25 bp, Rattus norvegicus
attcacagaatgttgtcagcctgag

SEQ ID NO: 206469 - DNA, 25 bp, Rattus norvegicus
attcacagaggtcaataacatggca

SEQ ID NO: 206470 - DNA, 25 bp, Rattus norvegicus
attcacagaggtgaataacatggca

SEQ ID NO: 206471 - DNA, 25 bp, Rattus norvegicus
attcacagcctgatgtggtcctgag

SEQ ID NO: 206472 - DNA, 25 bp, Rattus norvegicus
attcacagcctgttgtggtcctgag

SEQ ID NO: 206473 - DNA, 25 bp, Rattus norvegicus
attcacagctgcctgtctgcatggt

SEQ ID NO: 206474 - DNA, 25 bp, Rattus norvegicus
attcacagctgcgtgtctgcatggt

SEQ ID NO: 206475 - DNA, 25 bp, Rattus norvegicus
attcacaggaccatggcaattcaca

SEQ ID NO: 206476 - DNA, 25 bp, Rattus norvegicus
attcacaggaccttggcaattcaca

SEQ ID NO: 206477 - DNA, 25 bp, Rattus norvegicus
attcacaggctgaccaaaaccatag

SEQ ID NO: 206478 - DNA, 25 bp, Rattus norvegicus
attcacaggctgtccaaaaccatag

SEQ ID NO: 206479 - DNA, 25 bp, Rattus norvegicus
attcacagtaatatggttcccaatg

SEQ ID NO: 206480 - DNA, 25 bp, Rattus norvegicus
attcacagtaatttggttcccaatg

SEQ ID NO: 206481 - DNA, 25 bp, Rattus norvegicus
attcacagtaggagccagtcacttc

SEQ ID NO: 206482 - DNA, 25 bp, Rattus norvegicus
attcacagtaggtgccagtcacttc

SEQ ID NO: 206483 - DNA, 25 bp, Rattus norvegicus
attcacagtgaaacgtcagactgag

SEQ ID NO: 206484 - DNA, 25 bp, Rattus norvegicus
attcacagtgaatcgtcagactgag

SEQ ID NO: 206485 - DNA, 25 bp, Rattus norvegicus
attcacagtgtgcttggtgctgact

SEQ ID NO: 206486 - DNA, 25 bp, Rattus norvegicus
attcacagtgtggttggtgctgact

SEQ ID NO: 206487 - DNA, 25 bp, Rattus norvegicus
attcacagttcgaaactaggcatgt

SEQ ID NO: 206488 - DNA, 25 bp, Rattus norvegicus
attcacagttcgtaactaggcatgt

SEQ ID NO: 206489 - DNA, 25 bp, Rattus norvegicus
attcacatacctcccttttggagct

SEQ ID NO: 206490 - DNA, 25 bp, Rattus norvegicus
attcacatacctgccttttggagct

SEQ ID NO: 206491 - DNA, 25 bp, Rattus norvegicus
attcacatatgtcgcctgttcagag

SEQ ID NO: 206492 - DNA, 25 bp, Rattus norvegicus
attcacatatgtggcctgttcagag

SEQ ID NO: 206493 - DNA, 25 bp, Rattus norvegicus
attcacatcatcaacgttgccaagg

SEQ ID NO: 206494 - DNA, 25 bp, Rattus norvegicus
attcacatcatctacgttgccaagg

SEQ ID NO: 206495 - DNA, 25 bp, Rattus norvegicus
attcacatgcagctaattaaagaga

SEQ ID NO: 206496 - DNA, 25 bp, Rattus norvegicus
attcacatgcaggtaattaaagaga

SEQ ID NO: 206497 - DNA, 25 bp, Rattus norvegicus
attcacatgggcctgtgctcttggt

SEQ ID NO: 206498 - DNA, 25 bp, Rattus norvegicus
attcacatgggcgtgtgctcttggt

SEQ ID NO: 206499 - DNA, 25 bp, Rattus norvegicus
attcacatgttcaaccacggagcta

SEQ ID NO: 206500 - DNA, 25 bp, Rattus norvegicus
attcacatgttctaccacggagcta

SEQ ID NO: 206501 - DNA, 25 bp, Rattus norvegicus
attcacattataaataggtccccgg

SEQ ID NO: 206502 - DNA, 25 bp, Rattus norvegicus
attcacattatatataggtccccgg

SEQ ID NO: 206503 - DNA, 25 bp, Rattus norvegicus
attcacatttcgatcctaggtgact

SEQ ID NO: 206504 - DNA, 25 bp, Rattus norvegicus
attcacatttcgttcctaggtgact

SEQ ID NO: 206505 - DNA, 25 bp, Rattus norvegicus
attcaccaagtgcatcaatagccca

SEQ ID NO: 206506 - DNA, 25 bp, Rattus norvegicus
attcaccaagtggatcaatagccca

SEQ ID NO: 206507 - DNA, 25 bp, Rattus norvegicus
attcaccaattccatgtagttactc

SEQ ID NO: 206508 - DNA, 25 bp, Rattus norvegicus
attcaccaattcgatgtagttactc

SEQ ID NO: 206509 - DNA, 25 bp, Rattus norvegicus
attcaccactttccctctgaattaa

SEQ ID NO: 206510 - DNA, 25 bp, Rattus norvegicus
attcaccactttgcctctgaattaa

SEQ ID NO: 206511 - DNA, 25 bp, Rattus norvegicus
attcaccagaggaatatgtactgca

SEQ ID NO: 206512 - DNA, 25 bp, Rattus norvegicus
attcaccagaggtatatgtactgca

SEQ ID NO: 206513 - DNA, 25 bp, Rattus norvegicus
attcaccagctcctttcgaaagtgt

SEQ ID NO: 206514 - DNA, 25 bp, Rattus norvegicus
attcaccagctcgtttcgaaagtgt

SEQ ID NO: 206515 - DNA, 25 bp, Rattus norvegicus
attcaccagtcacggtgcttcttct

SEQ ID NO: 206516 - DNA, 25 bp, Rattus norvegicus
attcaccagtcagggtgcttcttct

SEQ ID NO: 206517 - DNA, 25 bp, Rattus norvegicus
attcaccatgatattgaccgctgca

SEQ ID NO: 206518 - DNA, 25 bp, Rattus norvegicus
attcaccatgattttgaccgctgca

SEQ ID NO: 206519 - DNA, 25 bp, Rattus norvegicus
attcaccattcaccctaagcaactt

SEQ ID NO: 206520 - DNA, 25 bp, Rattus norvegicus
attcaccattcagcctaagcaactt

SEQ ID NO: 206521 - DNA, 25 bp, Rattus norvegicus
attcaccattgtaggcatgcgagcc

SEQ ID NO: 206522 - DNA, 25 bp, Rattus norvegicus
attcaccattgttggcatgcgagcc

SEQ ID NO: 206523 - DNA, 25 bp, Rattus norvegicus
attcacccaccaacagcaatttgaa

SEQ ID NO: 206524 - DNA, 25 bp, Rattus norvegicus
attcacccaccatcagcaatttgaa

SEQ ID NO: 206525 - DNA, 25 bp, Rattus norvegicus
attcacccacccatgtcttgaagga

SEQ ID NO: 206526 - DNA, 25 bp, Rattus norvegicus
attcacccacccttgtcttgaagga

SEQ ID NO: 206527 - DNA, 25 bp, Rattus norvegicus
attcaccccaagctttcattaatgc

SEQ ID NO: 206528 - DNA, 25 bp, Rattus norvegicus
attcaccccaaggtttcattaatgc

SEQ ID NO: 206529 - DNA, 25 bp, Rattus norvegicus
attcaccctattacctatttactct

SEQ ID NO: 206530 - DNA, 25 bp, Rattus norvegicus
attcaccctatttcctatttactct

SEQ ID NO: 206531 - DNA, 25 bp, Rattus norvegicus
attcaccctttacaagagggcgcag

SEQ ID NO: 206532 - DNA, 25 bp, Rattus norvegicus
attcaccctttagaagagggcgcag

SEQ ID NO: 206533 - DNA, 25 bp, Rattus norvegicus
attcacctcaaaaactacccagcat

SEQ ID NO: 206534 - DNA, 25 bp, Rattus norvegicus
attcacctcaaatactacccagcat

SEQ ID NO: 206535 - DNA, 25 bp, Rattus norvegicus
attcacctgaccatattttgaccta

SEQ ID NO: 206536 - DNA, 25 bp, Rattus norvegicus
attcacctgaccttattttgaccta

SEQ ID NO: 206537 - DNA, 25 bp, Rattus norvegicus
attcacctgccaagtggtatcacaa

SEQ ID NO: 206538 - DNA, 25 bp, Rattus norvegicus
attcacctgccatgtggtatcacaa

SEQ ID NO: 206539 - DNA, 25 bp, Rattus norvegicus
attcacctggagatcccctggataa

SEQ ID NO: 206540 - DNA, 25 bp, Rattus norvegicus
attcacctggagttcccctggataa

SEQ ID NO: 206541 - DNA, 25 bp, Rattus norvegicus
attcacctggttcttgatttctgga

SEQ ID NO: 206542 - DNA, 25 bp, Rattus norvegicus
attcacctggttgttgatttctgga

SEQ ID NO: 206543 - DNA, 25 bp, Rattus norvegicus
attcaccttctacggataactgcag

SEQ ID NO: 206544 - DNA, 25 bp, Rattus norvegicus
attcaccttctagggataactgcag

SEQ ID NO: 206545 - DNA, 25 bp, Rattus norvegicus
attcacctttgtccttttcacgtag

SEQ ID NO: 206546 - DNA, 25 bp, Rattus norvegicus
attcacctttgtgcttttcacgtag

SEQ ID NO: 206547 - DNA, 25 bp, Rattus norvegicus
attcacgcatacctgagcacgcctt

SEQ ID NO: 206548 - DNA, 25 bp, Rattus norvegicus
attcacgcatacgtgagcacgcctt

SEQ ID NO: 206549 - DNA, 25 bp, Rattus norvegicus
attcacgccgtaattctttctgtct

SEQ ID NO: 206550 - DNA, 25 bp, Rattus norvegicus
attcacgccgtatttctttctgtct

SEQ ID NO: 206551 - DNA, 25 bp, Rattus norvegicus
attcacgcgtttcaccattgccggg

SEQ ID NO: 206552 - DNA, 25 bp, Rattus norvegicus
attcacgcgtttgaccattgccggg

SEQ ID NO: 206553 - DNA, 25 bp, Rattus norvegicus
attcacggaatgatttcagcaacaa

SEQ ID NO: 206554 - DNA, 25 bp, Rattus norvegicus
attcacggaatgttttcagcaacaa

SEQ ID NO: 206555 - DNA, 25 bp, Rattus norvegicus
attcacggaccgacactgtgggtgt

SEQ ID NO: 206556 - DNA, 25 bp, Rattus norvegicus
attcacggaccgtcactgtgggtgt

SEQ ID NO: 206557 - DNA, 25 bp, Rattus norvegicus
attcacgtatttatctcaagttctg

SEQ ID NO: 206558 - DNA, 25 bp, Rattus norvegicus
attcacgtatttttctcaagttctg

SEQ ID NO: 206559 - DNA, 25 bp, Rattus norvegicus
attcacgtttagcttttgtctcttg

SEQ ID NO: 206560 - DNA, 25 bp, Rattus norvegicus
attcacgtttaggttttgtctcttg

SEQ ID NO: 206561 - DNA, 25 bp, Rattus norvegicus
attcactaaagcacctgacgtcaga

SEQ ID NO: 206562 - DNA, 25 bp, Rattus norvegicus
attcactaaagctcctgacgtcaga

SEQ ID NO: 206563 - DNA, 25 bp, Rattus norvegicus
attcactaaggtctctaagctgccc

SEQ ID NO: 206564 - DNA, 25 bp, Rattus norvegicus
attcactaaggtgtctaagctgccc

SEQ ID NO: 206565 - DNA, 25 bp, Rattus norvegicus
attcactacatacgcctgaactttg

SEQ ID NO: 206566 - DNA, 25 bp, Rattus norvegicus
attcactacataggcctgaactttg

SEQ ID NO: 206567 - DNA, 25 bp, Rattus norvegicus
attcactactgtacagtgcacgctg

SEQ ID NO: 206568 - DNA, 25 bp, Rattus norvegicus
attcactactgttcagtgcacgctg

SEQ ID NO: 206569 - DNA, 25 bp, Rattus norvegicus
attcactagccaatatttactacga

SEQ ID NO: 206570 - DNA, 25 bp, Rattus norvegicus
attcactagccattatttactacga

SEQ ID NO: 206571 - DNA, 25 bp, Rattus norvegicus
attcactcactgctgcacactgaaa

SEQ ID NO: 206572 - DNA, 25 bp, Rattus norvegicus
attcactcactggtgcacactgaaa

SEQ ID NO: 206573 - DNA, 25 bp, Rattus norvegicus
attcactcaggccattgaccaggag

SEQ ID NO: 206574 - DNA, 25 bp, Rattus norvegicus
attcactcaggcgattgaccaggag

SEQ ID NO: 206575 - DNA, 25 bp, Rattus norvegicus
attcactcatgaccgatgtgtcttg

SEQ ID NO: 206576 - DNA, 25 bp, Rattus norvegicus
attcactcatgagcgatgtgtcttg

SEQ ID NO: 206577 - DNA, 25 bp, Rattus norvegicus
attcactcattcatggccccactat

SEQ ID NO: 206578 - DNA, 25 bp, Rattus norvegicus
attcactcattcttggccccactat

SEQ ID NO: 206579 - DNA, 25 bp, Rattus norvegicus
attcactccaagaggcctagcatta

SEQ ID NO: 206580 - DNA, 25 bp, Rattus norvegicus
attcactccaagtggcctagcatta

SEQ ID NO: 206581 - DNA, 25 bp, Rattus norvegicus
attcactcctcacggacaggtacct

SEQ ID NO: 206582 - DNA, 25 bp, Rattus norvegicus
attcactcctcagggacaggtacct

SEQ ID NO: 206583 - DNA, 25 bp, Rattus norvegicus
attcactccttgcaccttttaagaa

SEQ ID NO: 206584 - DNA, 25 bp, Rattus norvegicus
attcactccttggaccttttaagaa

SEQ ID NO: 206585 - DNA, 25 bp, Rattus norvegicus
attcactcgccaagatgattctctg

SEQ ID NO: 206586 - DNA, 25 bp, Rattus norvegicus
attcactcgccatgatgattctctg

SEQ ID NO: 206587 - DNA, 25 bp, Rattus norvegicus
attcactcggctatctttggataac

SEQ ID NO: 206588 - DNA, 25 bp, Rattus norvegicus
attcactcggctttctttggataac

SEQ ID NO: 206589 - DNA, 25 bp, Rattus norvegicus
attcactctaccattctgtggtgtt

SEQ ID NO: 206590 - DNA, 25 bp, Rattus norvegicus
attcactctacctttctgtggtgtt

SEQ ID NO: 206591 - DNA, 25 bp, Rattus norvegicus
attcactgaatgctcctctgcagac

SEQ ID NO: 206592 - DNA, 25 bp, Rattus norvegicus
attcactgaatggtcctctgcagac

SEQ ID NO: 206593 - DNA, 25 bp, Rattus norvegicus
attcactgagagacctccagaaaga

SEQ ID NO: 206594 - DNA, 25 bp, Rattus norvegicus
attcactgagagtcctccagaaaga

SEQ ID NO: 206595 - DNA, 25 bp, Rattus norvegicus
attcactgctacctacacaggtttg

SEQ ID NO: 206596 - DNA, 25 bp, Rattus norvegicus
attcactgctacgtacacaggtttg

SEQ ID NO: 206597 - DNA, 25 bp, Rattus norvegicus
attcactggcagacaagactctcct

SEQ ID NO: 206598 - DNA, 25 bp, Rattus norvegicus
attcactggcagtcaagactctcct

SEQ ID NO: 206599 - DNA, 25 bp, Rattus norvegicus
attcactgggtgaactctgaaccga

SEQ ID NO: 206600 - DNA, 25 bp, Rattus norvegicus
attcactgggtgtactctgaaccga

SEQ ID NO: 206601 - DNA, 25 bp, Rattus norvegicus
attcactgggttctctctgaccttt

SEQ ID NO: 206602 - DNA, 25 bp, Rattus norvegicus
attcactgggttgtctctgaccttt

SEQ ID NO: 206603 - DNA, 25 bp, Rattus norvegicus
attcactggttaagcttcgttccca

SEQ ID NO: 206604 - DNA, 25 bp, Rattus norvegicus
attcactggttatgcttcgttccca

SEQ ID NO: 206605 - DNA, 25 bp, Rattus norvegicus
attcactgtcaacatccgtgtccag

SEQ ID NO: 206606 - DNA, 25 bp, Rattus norvegicus
attcactgtcaagatccgtgtccag

SEQ ID NO: 206607 - DNA, 25 bp, Rattus norvegicus
attcactgtgcgatggtttcatcta

SEQ ID NO: 206608 - DNA, 25 bp, Rattus norvegicus
attcactgtgcgttggtttcatcta

SEQ ID NO: 206609 - DNA, 25 bp, Rattus norvegicus
attcactgtgtaatctagctttgcc

SEQ ID NO: 206610 - DNA, 25 bp, Rattus norvegicus
attcactgtgtattctagctttgcc

SEQ ID NO: 206611 - DNA, 25 bp, Rattus norvegicus
attcactgtgtcattcttttctaaa

SEQ ID NO: 206612 - DNA, 25 bp, Rattus norvegicus
attcactgtgtctttcttttctaaa

SEQ ID NO: 206613 - DNA, 25 bp, Rattus norvegicus
attcacttcatcaccctgtattaat

SEQ ID NO: 206614 - DNA, 25 bp, Rattus norvegicus
attcacttcatctccctgtattaat

SEQ ID NO: 206615 - DNA, 25 bp, Rattus norvegicus
attcacttcctaaccactggtttag

SEQ ID NO: 206616 - DNA, 25 bp, Rattus norvegicus
attcacttcctatccactggtttag

SEQ ID NO: 206617 - DNA, 25 bp, Rattus norvegicus
attcactttactacgcaggagaggc

SEQ ID NO: 206618 - DNA, 25 bp, Rattus norvegicus
attcactttacttcgcaggagaggc

SEQ ID NO: 206619 - DNA, 25 bp, Rattus norvegicus
attcactttcatcgttttctcacta

SEQ ID NO: 206620 - DNA, 25 bp, Rattus norvegicus
attcactttcatggttttctcacta

SEQ ID NO: 206621 - DNA, 25 bp, Rattus norvegicus
attcactttcggctgtcgacagtaa

SEQ ID NO: 206622 - DNA, 25 bp, Rattus norvegicus
attcactttcgggtgtcgacagtaa

SEQ ID NO: 206623 - DNA, 25 bp, Rattus norvegicus
attcactttgcaaacctcatggtta

SEQ ID NO: 206624 - DNA, 25 bp, Rattus norvegicus
attcactttgcatacctcatggtta

SEQ ID NO: 206625 - DNA, 25 bp, Rattus norvegicus
attcactttgtcatgtactcactta

SEQ ID NO: 206626 - DNA, 25 bp, Rattus norvegicus
attcactttgtcttgtactcactta

SEQ ID NO: 206627 - DNA, 25 bp, Rattus norvegicus
attcagaaatgtatgtattagtcac

SEQ ID NO: 206628 - DNA, 25 bp, Rattus norvegicus
attcagaaatgtttgtattagtcac

SEQ ID NO: 206629 - DNA, 25 bp, Rattus norvegicus
attcagaacaggcattgtgtccgta

SEQ ID NO: 206630 - DNA, 25 bp, Rattus norvegicus
attcagaacagggattgtgtccgta

SEQ ID NO: 206631 - DNA, 25 bp, Rattus norvegicus
attcagaactatctggaccccacgc

SEQ ID NO: 206632 - DNA, 25 bp, Rattus norvegicus
attcagaactatgtggaccccacgc

SEQ ID NO: 206633 - DNA, 25 bp, Rattus norvegicus
attcagaagtgtctctgttcagccc

SEQ ID NO: 206634 - DNA, 25 bp, Rattus norvegicus
attcagaagtgtgtctgttcagccc

SEQ ID NO: 206635 - DNA, 25 bp, Rattus norvegicus
attcagaatatgagggtgtccccat

SEQ ID NO: 206636 - DNA, 25 bp, Rattus norvegicus
attcagaatatgtgggtgtccccat

SEQ ID NO: 206637 - DNA, 25 bp, Rattus norvegicus
attcagaatattagagagctcccat

SEQ ID NO: 206638 - DNA, 25 bp, Rattus norvegicus
attcagaatatttgagagctcccat

SEQ ID NO: 206639 - DNA, 25 bp, Rattus norvegicus
attcagaatgatccactgctctcag

SEQ ID NO: 206640 - DNA, 25 bp, Rattus norvegicus
attcagaatgatgcactgctctcag

SEQ ID NO: 206641 - DNA, 25 bp, Rattus norvegicus
attcagaatgcccaggctgcgttct

SEQ ID NO: 206642 - DNA, 25 bp, Rattus norvegicus
attcagaatgccgaggctgcgttct

SEQ ID NO: 206643 - DNA, 25 bp, Rattus norvegicus
attcagacacatcctcgtatacata

SEQ ID NO: 206644 - DNA, 25 bp, Rattus norvegicus
attcagacacatgctcgtatacata

SEQ ID NO: 206645 - DNA, 25 bp, Rattus norvegicus
attcagacatgcctgatcattcagg

SEQ ID NO: 206646 - DNA, 25 bp, Rattus norvegicus
attcagacatgcgtgatcattcagg

SEQ ID NO: 206647 - DNA, 25 bp, Rattus norvegicus
attcagaccctgaagtgctcactgg

SEQ ID NO: 206648 - DNA, 25 bp, Rattus norvegicus
attcagaccctgtagtgctcactgg

SEQ ID NO: 206649 - DNA, 25 bp, Rattus norvegicus
attcagacctttcgctgcccgagtt

SEQ ID NO: 206650 - DNA, 25 bp, Rattus norvegicus
attcagacctttggctgcccgagtt

SEQ ID NO: 206651 - DNA, 25 bp, Rattus norvegicus
attcagactctgagcgcttcattga

SEQ ID NO: 206652 - DNA, 25 bp, Rattus norvegicus
attcagactctgtgcgcttcattga

SEQ ID NO: 206653 - DNA, 25 bp, Rattus norvegicus
attcagactgagaagcctccggtac

SEQ ID NO: 206654 - DNA, 25 bp, Rattus norvegicus
attcagactgagtagcctccggtac

SEQ ID NO: 206655 - DNA, 25 bp, Rattus norvegicus
attcagactgtaagtttgcctcctt

SEQ ID NO: 206656 - DNA, 25 bp, Rattus norvegicus
attcagactgtatgtttgcctcctt

SEQ ID NO: 206657 - DNA, 25 bp, Rattus norvegicus
attcagactttacacattgtgactc

SEQ ID NO: 206658 - DNA, 25 bp, Rattus norvegicus
attcagactttagacattgtgactc

SEQ ID NO: 206659 - DNA, 25 bp, Rattus norvegicus
attcagagacaaacttcttccgccc

SEQ ID NO: 206660 - DNA, 25 bp, Rattus norvegicus
attcagagacaatcttcttccgccc

SEQ ID NO: 206661 - DNA, 25 bp, Rattus norvegicus
attcagagccttaatacctagttgg

SEQ ID NO: 206662 - DNA, 25 bp, Rattus norvegicus
attcagagcctttatacctagttgg

SEQ ID NO: 206663 - DNA, 25 bp, Rattus norvegicus
attcagaggcaaccatggtccaccc

SEQ ID NO: 206664 - DNA, 25 bp, Rattus norvegicus
attcagaggcaagcatggtccaccc

SEQ ID NO: 206665 - DNA, 25 bp, Rattus norvegicus
attcagagttcaaggttgccctcag

SEQ ID NO: 206666 - DNA, 25 bp, Rattus norvegicus
attcagagttcatggttgccctcag

SEQ ID NO: 206667 - DNA, 25 bp, Rattus norvegicus
attcagagtttaacgctttggacaa

SEQ ID NO: 206668 - DNA, 25 bp, Rattus norvegicus
attcagagtttatcgctttggacaa

SEQ ID NO: 206669 - DNA, 25 bp, Rattus norvegicus
attcagatcatgctgtcaagacccc

SEQ ID NO: 206670 - DNA, 25 bp, Rattus norvegicus
attcagatcatggtgtcaagacccc

SEQ ID NO: 206671 - DNA, 25 bp, Rattus norvegicus
attcagatcctgaccatcactagac

SEQ ID NO: 206672 - DNA, 25 bp, Rattus norvegicus
attcagatcctgtccatcactagac

SEQ ID NO: 206673 - DNA, 25 bp, Rattus norvegicus
attcagatgatgagccaatggtgct

SEQ ID NO: 206674 - DNA, 25 bp, Rattus norvegicus
attcagatgatgtgccaatggtgct

SEQ ID NO: 206675 - DNA, 25 bp, Rattus norvegicus
attcagatggtgctggttcatgtcc

SEQ ID NO: 206676 - DNA, 25 bp, Rattus norvegicus
attcagatggtggtggttcatgtcc

SEQ ID NO: 206677 - DNA, 25 bp, Rattus norvegicus
attcagatgtgaacctactctagag

SEQ ID NO: 206678 - DNA, 25 bp, Rattus norvegicus
attcagatgtgatcctactctagag

SEQ ID NO: 206679 - DNA, 25 bp, Rattus norvegicus
attcagattcaactcctctacaaaa

SEQ ID NO: 206680 - DNA, 25 bp, Rattus norvegicus
attcagattcaagtcctctacaaaa

SEQ ID NO: 206681 - DNA, 25 bp, Rattus norvegicus
attcagcaagaaaggcgcctaggcc

SEQ ID NO: 206682 - DNA, 25 bp, Rattus norvegicus
attcagcaagaatggcgcctaggcc

SEQ ID NO: 206683 - DNA, 25 bp, Rattus norvegicus
attcagcaagatcctgataggccca

SEQ ID NO: 206684 - DNA, 25 bp, Rattus norvegicus
attcagcaagatgctgataggccca

SEQ ID NO: 206685 - DNA, 25 bp, Rattus norvegicus
attcagcaagtaatctcctaccctg

SEQ ID NO: 206686 - DNA, 25 bp, Rattus norvegicus
attcagcaagtattctcctaccctg

SEQ ID NO: 206687 - DNA, 25 bp, Rattus norvegicus
attcagcactggaccaaattccaag

SEQ ID NO: 206688 - DNA, 25 bp, Rattus norvegicus
attcagcactggtccaaattccaag

SEQ ID NO: 206689 - DNA, 25 bp, Rattus norvegicus
attcagcagtaaatagtttttgttg

SEQ ID NO: 206690 - DNA, 25 bp, Rattus norvegicus
attcagcagtaattagtttttgttg

SEQ ID NO: 206691 - DNA, 25 bp, Rattus norvegicus
attcagcattctctttaccagtgac

SEQ ID NO: 206692 - DNA, 25 bp, Rattus norvegicus
attcagcattctgtttaccagtgac

SEQ ID NO: 206693 - DNA, 25 bp, Rattus norvegicus
attcagccagagacctgcatagcca

SEQ ID NO: 206694 - DNA, 25 bp, Rattus norvegicus
attcagccagagtcctgcatagcca

SEQ ID NO: 206695 - DNA, 25 bp, Rattus norvegicus
attcagccggcgaatcagccacttg

SEQ ID NO: 206696 - DNA, 25 bp, Rattus norvegicus
attcagccggcgtatcagccacttg

SEQ ID NO: 206697 - DNA, 25 bp, Rattus norvegicus
attcagcctcatacagaaagtcgga

SEQ ID NO: 206698 - DNA, 25 bp, Rattus norvegicus
attcagcctcattcagaaagtcgga

SEQ ID NO: 206699 - DNA, 25 bp, Rattus norvegicus
attcagccttacataatcttgccct

SEQ ID NO: 206700 - DNA, 25 bp, Rattus norvegicus
attcagccttacttaatcttgccct

SEQ ID NO: 206701 - DNA, 25 bp, Rattus norvegicus
attcagcgacccatactgtacagag

SEQ ID NO: 206702 - DNA, 25 bp, Rattus norvegicus
attcagcgacccttactgtacagag

SEQ ID NO: 206703 - DNA, 25 bp, Rattus norvegicus
attcagcgctgcaagacgttggact

SEQ ID NO: 206704 - DNA, 25 bp, Rattus norvegicus
attcagcgctgcaggaggcgactcc

SEQ ID NO: 206705 - DNA, 25 bp, Rattus norvegicus
attcagcgctgctagacgttggact

SEQ ID NO: 206706 - DNA, 25 bp, Rattus norvegicus
attcagcgctgctggaggcgactcc

SEQ ID NO: 206707 - DNA, 25 bp, Rattus norvegicus
attcagcgggatcaactggcaccag

SEQ ID NO: 206708 - DNA, 25 bp, Rattus norvegicus
attcagcgggatgaactggcaccag

SEQ ID NO: 206709 - DNA, 25 bp, Rattus norvegicus
attcagctacaacacaggttcccag

SEQ ID NO: 206710 - DNA, 25 bp, Rattus norvegicus
attcagctacaagacaggttcccag

SEQ ID NO: 206711 - DNA, 25 bp, Rattus norvegicus
attcagcttgttacctttgctctgc

SEQ ID NO: 206712 - DNA, 25 bp, Rattus norvegicus
attcagcttgtttcctttgctctgc

SEQ ID NO: 206713 - DNA, 25 bp, Rattus norvegicus
attcagctttttccaaaccaggcag

SEQ ID NO: 206714 - DNA, 25 bp, Rattus norvegicus
attcagctttttgcaaaccaggcag

SEQ ID NO: 206715 - DNA, 25 bp, Rattus norvegicus
attcaggaacaacgctcatctcatg

SEQ ID NO: 206716 - DNA, 25 bp, Rattus norvegicus
attcaggaacaaggctcatctcatg

SEQ ID NO: 206717 - DNA, 25 bp, Rattus norvegicus
attcaggaagcgcaacttgcccact

SEQ ID NO: 206718 - DNA, 25 bp, Rattus norvegicus
attcaggaagcggaacttgcccact

SEQ ID NO: 206719 - DNA, 25 bp, Rattus norvegicus
attcaggaccctctagaaggatcac

SEQ ID NO: 206720 - DNA, 25 bp, Rattus norvegicus
attcaggaccctgtagaaggatcac

SEQ ID NO: 206721 - DNA, 25 bp, Rattus norvegicus
attcaggacgggacttcacacctaa

SEQ ID NO: 206722 - DNA, 25 bp, Rattus norvegicus
attcaggacgggtcttcacacctaa

SEQ ID NO: 206723 - DNA, 25 bp, Rattus norvegicus
attcaggactacactggtttacccg

SEQ ID NO: 206724 - DNA, 25 bp, Rattus norvegicus
attcaggactactctggtttacccg

SEQ ID NO: 206725 - DNA, 25 bp, Rattus norvegicus
attcaggagaacacgcagacgccga

SEQ ID NO: 206726 - DNA, 25 bp, Rattus norvegicus
attcaggagaactcgcagacgccga

SEQ ID NO: 206727 - DNA, 25 bp, Rattus norvegicus
attcaggcagcccatgactccgtgg

SEQ ID NO: 206728 - DNA, 25 bp, Rattus norvegicus
attcaggcagccgatgactccgtgg

SEQ ID NO: 206729 - DNA, 25 bp, Rattus norvegicus
attcaggccgccagcaggcctttgg

SEQ ID NO: 206730 - DNA, 25 bp, Rattus norvegicus
attcaggccgcctgcaggcctttgg

SEQ ID NO: 206731 - DNA, 25 bp, Rattus norvegicus
attcaggcctgaattccaagcagct

SEQ ID NO: 206732 - DNA, 25 bp, Rattus norvegicus
attcaggcctgatttccaagcagct

SEQ ID NO: 206733 - DNA, 25 bp, Rattus norvegicus
attcaggctcctcaaaacaggcagt

SEQ ID NO: 206734 - DNA, 25 bp, Rattus norvegicus
attcaggctcctgaaaacaggcagt

SEQ ID NO: 206735 - DNA, 25 bp, Rattus norvegicus
attcaggctgatattgcgtgcaaga

SEQ ID NO: 206736 - DNA, 25 bp, Rattus norvegicus
attcaggctgatccccagacagtta

SEQ ID NO: 206737 - DNA, 25 bp, Rattus norvegicus
attcaggctgatgcccagacagtta

SEQ ID NO: 206738 - DNA, 25 bp, Rattus norvegicus
attcaggctgattttgcgtgcaaga

SEQ ID NO: 206739 - DNA, 25 bp, Rattus norvegicus
attcagggaccacctagattctcag

SEQ ID NO: 206740 - DNA, 25 bp, Rattus norvegicus
attcagggaccagctagattctcag

SEQ ID NO: 206741 - DNA, 25 bp, Rattus norvegicus
attcagggacctctgtatcagagat

SEQ ID NO: 206742 - DNA, 25 bp, Rattus norvegicus
attcagggacctgtgtatcagagat

SEQ ID NO: 206743 - DNA, 25 bp, Rattus norvegicus
attcagggactacggcatggctcat

SEQ ID NO: 206744 - DNA, 25 bp, Rattus norvegicus
attcagggactagggcatggctcat

SEQ ID NO: 206745 - DNA, 25 bp, Rattus norvegicus
attcagggcactagtgtggcttttc

SEQ ID NO: 206746 - DNA, 25 bp, Rattus norvegicus
attcagggcacttgtgtggcttttc

SEQ ID NO: 206747 - DNA, 25 bp, Rattus norvegicus
attcagggcctcatttggaacgctt

SEQ ID NO: 206748 - DNA, 25 bp, Rattus norvegicus
attcagggcctcttttggaacgctt

SEQ ID NO: 206749 - DNA, 25 bp, Rattus norvegicus
attcagggctgcatgctgtggactc

SEQ ID NO: 206750 - DNA, 25 bp, Rattus norvegicus
attcagggctgcttgctgtggactc

SEQ ID NO: 206751 - DNA, 25 bp, Rattus norvegicus
attcagggtgaaacactttctcccc

SEQ ID NO: 206752 - DNA, 25 bp, Rattus norvegicus
attcagggtgaatcactttctcccc

SEQ ID NO: 206753 - DNA, 25 bp, Rattus norvegicus
attcagggttcaattccacccattt

SEQ ID NO: 206754 - DNA, 25 bp, Rattus norvegicus
attcagggttcatttccacccattt

SEQ ID NO: 206755 - DNA, 25 bp, Rattus norvegicus
attcaggtaaacagctgcaccccgt

SEQ ID NO: 206756 - DNA, 25 bp, Rattus norvegicus
attcaggtaaactgctgcaccccgt

SEQ ID NO: 206757 - DNA, 25 bp, Rattus norvegicus
attcaggtacaacagctacccttgg

SEQ ID NO: 206758 - DNA, 25 bp, Rattus norvegicus
attcaggtacaagagctacccttgg

SEQ ID NO: 206759 - DNA, 25 bp, Rattus norvegicus
attcaggtatctacaactttagtta

SEQ ID NO: 206760 - DNA, 25 bp, Rattus norvegicus
attcaggtatcttcaactttagtta

SEQ ID NO: 206761 - DNA, 25 bp, Rattus norvegicus
attcaggtcaagatggcctctacat

SEQ ID NO: 206762 - DNA, 25 bp, Rattus norvegicus
attcaggtcaagttggcctctacat

SEQ ID NO: 206763 - DNA, 25 bp, Rattus norvegicus
attcaggttctaaacaacattcaga

SEQ ID NO: 206764 - DNA, 25 bp, Rattus norvegicus
attcaggttctatacaacattcaga

SEQ ID NO: 206765 - DNA, 25 bp, Rattus norvegicus
attcaggttgctataggatcttttc

SEQ ID NO: 206766 - DNA, 25 bp, Rattus norvegicus
attcaggttgctttaggatcttttc

SEQ ID NO: 206767 - DNA, 25 bp, Rattus norvegicus
attcagtaaaccctcatctcattca

SEQ ID NO: 206768 - DNA, 25 bp, Rattus norvegicus
attcagtaaaccgtcatctcattca

SEQ ID NO: 206769 - DNA, 25 bp, Rattus norvegicus
attcagtactatctctttgatgaca

SEQ ID NO: 206770 - DNA, 25 bp, Rattus norvegicus
attcagtactatgtctttgatgaca

SEQ ID NO: 206771 - DNA, 25 bp, Rattus norvegicus
attcagtactgaatcctctgccaag

SEQ ID NO: 206772 - DNA, 25 bp, Rattus norvegicus
attcagtactgattcctctgccaag

SEQ ID NO: 206773 - DNA, 25 bp, Rattus norvegicus
attcagtagatcaggctgccctcaa

SEQ ID NO: 206774 - DNA, 25 bp, Rattus norvegicus
attcagtagatctggctgccctcaa

SEQ ID NO: 206775 - DNA, 25 bp, Rattus norvegicus
attcagtcatcgacagtgcctgtgt

SEQ ID NO: 206776 - DNA, 25 bp, Rattus norvegicus
attcagtcatcgtcagtgcctgtgt

SEQ ID NO: 206777 - DNA, 25 bp, Rattus norvegicus
attcagtccataattgtgcttgtaa

SEQ ID NO: 206778 - DNA, 25 bp, Rattus norvegicus
attcagtccatatttgtgcttgtaa

SEQ ID NO: 206779 - DNA, 25 bp, Rattus norvegicus
attcagtcctttccgtttttgtcag

SEQ ID NO: 206780 - DNA, 25 bp, Rattus norvegicus
attcagtcctttgcgtttttgtcag

SEQ ID NO: 206781 - DNA, 25 bp, Rattus norvegicus
attcagtctctgatggatgagccga

SEQ ID NO: 206782 - DNA, 25 bp, Rattus norvegicus
attcagtctctgttggatgagccga

SEQ ID NO: 206783 - DNA, 25 bp, Rattus norvegicus
attcagtctgtgaccagtcagttta

SEQ ID NO: 206784 - DNA, 25 bp, Rattus norvegicus
attcagtctgtgtccagtcagttta

SEQ ID NO: 206785 - DNA, 25 bp, Rattus norvegicus
attcagtcttacatcccaggatttt

SEQ ID NO: 206786 - DNA, 25 bp, Rattus norvegicus
attcagtcttacttcccaggatttt

SEQ ID NO: 206787 - DNA, 25 bp, Rattus norvegicus
attcagtgccttaatcgtcctagag

SEQ ID NO: 206788 - DNA, 25 bp, Rattus norvegicus
attcagtgcctttatcgtcctagag

SEQ ID NO: 206789 - DNA, 25 bp, Rattus norvegicus
attcagtggaccatgacgggttccc

SEQ ID NO: 206790 - DNA, 25 bp, Rattus norvegicus
attcagtggaccttgacgggttccc

SEQ ID NO: 206791 - DNA, 25 bp, Rattus norvegicus
attcagtgggagctggcacctcttc

SEQ ID NO: 206792 - DNA, 25 bp, Rattus norvegicus
attcagtgggaggtggcacctcttc

SEQ ID NO: 206793 - DNA, 25 bp, Rattus norvegicus
attcagtggtatctgtgtgcccacc

SEQ ID NO: 206794 - DNA, 25 bp, Rattus norvegicus
attcagtggtatgtgtgtgcccacc

SEQ ID NO: 206795 - DNA, 25 bp, Rattus norvegicus
attcagtgtctaacctttcttttat

SEQ ID NO: 206796 - DNA, 25 bp, Rattus norvegicus
attcagtgtctatcctttcttttat

SEQ ID NO: 206797 - DNA, 25 bp, Rattus norvegicus
attcagtgttccaagatcccagagc

SEQ ID NO: 206798 - DNA, 25 bp, Rattus norvegicus
attcagtgttcctagatcccagagc

SEQ ID NO: 206799 - DNA, 25 bp, Rattus norvegicus
attcagtgtttcacctgtacatacc

SEQ ID NO: 206800 - DNA, 25 bp, Rattus norvegicus
attcagtgtttctcctgtacatacc

SEQ ID NO: 206801 - DNA, 25 bp, Rattus norvegicus
attcagttaacccaaatagctgtaa

SEQ ID NO: 206802 - DNA, 25 bp, Rattus norvegicus
attcagttaaccgaaatagctgtaa

SEQ ID NO: 206803 - DNA, 25 bp, Rattus norvegicus
attcagttacctaccagaaaagagt

SEQ ID NO: 206804 - DNA, 25 bp, Rattus norvegicus
attcagttaccttccagaaaagagt

SEQ ID NO: 206805 - DNA, 25 bp, Rattus norvegicus
attcagttcaatctcctttttacat

SEQ ID NO: 206806 - DNA, 25 bp, Rattus norvegicus
attcagttcaatgtcctttttacat

SEQ ID NO: 206807 - DNA, 25 bp, Rattus norvegicus
attcagttcacacgtcggcaggcag

SEQ ID NO: 206808 - DNA, 25 bp, Rattus norvegicus
attcagttcacaggtcggcaggcag

SEQ ID NO: 206809 - DNA, 25 bp, Rattus norvegicus
attcagttcagcagcgaagggccct

SEQ ID NO: 206810 - DNA, 25 bp, Rattus norvegicus
attcagttcagctgcgaagggccct

SEQ ID NO: 206811 - DNA, 25 bp, Rattus norvegicus
attcagttcatcacaggcgacagta

SEQ ID NO: 206812 - DNA, 25 bp, Rattus norvegicus
attcagttcatcattatttgtccaa

SEQ ID NO: 206813 - DNA, 25 bp, Rattus norvegicus
attcagttcatctcaggcgacagta

SEQ ID NO: 206814 - DNA, 25 bp, Rattus norvegicus
attcagttcatctttatttgtccaa

SEQ ID NO: 206815 - DNA, 25 bp, Rattus norvegicus
attcagttccacagacgtccagaaa

SEQ ID NO: 206816 - DNA, 25 bp, Rattus norvegicus
attcagttccactgacgtccagaaa

SEQ ID NO: 206817 - DNA, 25 bp, Rattus norvegicus
attcagttcctacatccaggttcct

SEQ ID NO: 206818 - DNA, 25 bp, Rattus norvegicus
attcagttcctagatccaggttcct

SEQ ID NO: 206819 - DNA, 25 bp, Rattus norvegicus
attcagttcttgatcttccttgcat

SEQ ID NO: 206820 - DNA, 25 bp, Rattus norvegicus
attcagttcttgttcttccttgcat

SEQ ID NO: 206821 - DNA, 25 bp, Rattus norvegicus
attcagttgccaatctaagttcata

SEQ ID NO: 206822 - DNA, 25 bp, Rattus norvegicus
attcagttgccattctaagttcata

SEQ ID NO: 206823 - DNA, 25 bp, Rattus norvegicus
attcagttgggaccatatcagacgc

SEQ ID NO: 206824 - DNA, 25 bp, Rattus norvegicus
attcagttgggagcatatcagacgc

SEQ ID NO: 206825 - DNA, 25 bp, Rattus norvegicus
attcagttgtagcagcactatctaa

SEQ ID NO: 206826 - DNA, 25 bp, Rattus norvegicus
attcagttgtaggagcactatctaa

SEQ ID NO: 206827 - DNA, 25 bp, Rattus norvegicus
attcagtttccccttgccttgtgtg

SEQ ID NO: 206828 - DNA, 25 bp, Rattus norvegicus
attcagtttcccgttgccttgtgtg

SEQ ID NO: 206829 - DNA, 25 bp, Rattus norvegicus
attcagtttgcaagctgcattcccc

SEQ ID NO: 206830 - DNA, 25 bp, Rattus norvegicus
attcagtttgcatgctgcattcccc

SEQ ID NO: 206831 - DNA, 25 bp, Rattus norvegicus
attcataaagttatcctgggctccc

SEQ ID NO: 206832 - DNA, 25 bp, Rattus norvegicus
attcataaagttttcctgggctccc

SEQ ID NO: 206833 - DNA, 25 bp, Rattus norvegicus
attcataaattcaccgtcggctccg

SEQ ID NO: 206834 - DNA, 25 bp, Rattus norvegicus
attcataaattctccgtcggctccg

SEQ ID NO: 206835 - DNA, 25 bp, Rattus norvegicus
attcataaccccagagacaccaaga

SEQ ID NO: 206836 - DNA, 25 bp, Rattus norvegicus
attcataacccctgagacaccaaga

SEQ ID NO: 206837 - DNA, 25 bp, Rattus norvegicus
attcataacttgaagcttcgcccac

SEQ ID NO: 206838 - DNA, 25 bp, Rattus norvegicus
attcataacttgtagcttcgcccac

SEQ ID NO: 206839 - DNA, 25 bp, Rattus norvegicus
attcataatgtgacggttccaagtg

SEQ ID NO: 206840 - DNA, 25 bp, Rattus norvegicus
attcataatgtgtcggttccaagtg

SEQ ID NO: 206841 - DNA, 25 bp, Rattus norvegicus
attcatacaactagaggcgctcccc

SEQ ID NO: 206842 - DNA, 25 bp, Rattus norvegicus
attcatacaacttgaggcgctcccc

SEQ ID NO: 206843 - DNA, 25 bp, Rattus norvegicus
attcatacattccatagccatctac

SEQ ID NO: 206844 - DNA, 25 bp, Rattus norvegicus
attcatacattcgatagccatctac

SEQ ID NO: 206845 - DNA, 25 bp, Rattus norvegicus
attcatacccacactaaagctgctg

SEQ ID NO: 206846 - DNA, 25 bp, Rattus norvegicus
attcatacccactctaaagctgctg

SEQ ID NO: 206847 - DNA, 25 bp, Rattus norvegicus
attcatacttggctttccctgaaag

SEQ ID NO: 206848 - DNA, 25 bp, Rattus norvegicus
attcatacttgggtttccctgaaag

SEQ ID NO: 206849 - DNA, 25 bp, Rattus norvegicus
attcatagacacagagctcgtgccc

SEQ ID NO: 206850 - DNA, 25 bp, Rattus norvegicus
attcatagacactgagctcgtgccc

SEQ ID NO: 206851 - DNA, 25 bp, Rattus norvegicus
attcatagagaaacaatggccgaag

SEQ ID NO: 206852 - DNA, 25 bp, Rattus norvegicus
attcatagagaatcaatggccgaag

SEQ ID NO: 206853 - DNA, 25 bp, Rattus norvegicus
attcatagctgtaacctacctgggc

SEQ ID NO: 206854 - DNA, 25 bp, Rattus norvegicus
attcatagctgttacctacctgggc

SEQ ID NO: 206855 - DNA, 25 bp, Rattus norvegicus
attcataggagaaggcagccccgct

SEQ ID NO: 206856 - DNA, 25 bp, Rattus norvegicus
attcataggagatggcagccccgct

SEQ ID NO: 206857 - DNA, 25 bp, Rattus norvegicus
attcatagtggaaagcgaactgcta

SEQ ID NO: 206858 - DNA, 25 bp, Rattus norvegicus
attcatagtggatagcgaactgcta

SEQ ID NO: 206859 - DNA, 25 bp, Rattus norvegicus
attcatatacttctgcggcctgagc

SEQ ID NO: 206860 - DNA, 25 bp, Rattus norvegicus
attcatatacttgtgcggcctgagc

SEQ ID NO: 206861 - DNA, 25 bp, Rattus norvegicus
attcatatcgctctgtgggagccca

SEQ ID NO: 206862 - DNA, 25 bp, Rattus norvegicus
attcatatcgctgtgtgggagccca

SEQ ID NO: 206863 - DNA, 25 bp, Rattus norvegicus
attcatatcttactgtggacactct

SEQ ID NO: 206864 - DNA, 25 bp, Rattus norvegicus
attcatatcttagtgtggacactct

SEQ ID NO: 206865 - DNA, 25 bp, Rattus norvegicus
attcatatggtcaggtaccctggca

SEQ ID NO: 206866 - DNA, 25 bp, Rattus norvegicus
attcatatggtctggtaccctggca

SEQ ID NO: 206867 - DNA, 25 bp, Rattus norvegicus
attcatattatccatccatgccaca

SEQ ID NO: 206868 - DNA, 25 bp, Rattus norvegicus
attcatattatcgatccatgccaca

SEQ ID NO: 206869 - DNA, 25 bp, Rattus norvegicus
attcatattcatatgtatccaaggt

SEQ ID NO: 206870 - DNA, 25 bp, Rattus norvegicus
attcatattcatttgtatccaaggt

SEQ ID NO: 206871 - DNA, 25 bp, Rattus norvegicus
attcatatttatcacggacaacttg

SEQ ID NO: 206872 - DNA, 25 bp, Rattus norvegicus
attcatatttatgacggacaacttg

SEQ ID NO: 206873 - DNA, 25 bp, Rattus norvegicus
attcatatttctcttctggcaacta

SEQ ID NO: 206874 - DNA, 25 bp, Rattus norvegicus
attcatatttctgttctggcaacta

SEQ ID NO: 206875 - DNA, 25 bp, Rattus norvegicus
attcatcactctcagcatcgtgctg

SEQ ID NO: 206876 - DNA, 25 bp, Rattus norvegicus
attcatcactctgagcatcgtgctg

SEQ ID NO: 206877 - DNA, 25 bp, Rattus norvegicus
attcatcagcacacctgcagttgac

SEQ ID NO: 206878 - DNA, 25 bp, Rattus norvegicus
attcatcagcactcctgcagttgac

SEQ ID NO: 206879 - DNA, 25 bp, Rattus norvegicus
attcatcatgcacatggtccccatg

SEQ ID NO: 206880 - DNA, 25 bp, Rattus norvegicus
attcatcatgcagatggtccccatg

SEQ ID NO: 206881 - DNA, 25 bp, Rattus norvegicus
attcatcatgctatggtcacagggc

SEQ ID NO: 206882 - DNA, 25 bp, Rattus norvegicus
attcatcatgctttggtcacagggc

SEQ ID NO: 206883 - DNA, 25 bp, Rattus norvegicus
attcatcattctccattttaacgcc

SEQ ID NO: 206884 - DNA, 25 bp, Rattus norvegicus
attcatcattctgcattttaacgcc

SEQ ID NO: 206885 - DNA, 25 bp, Rattus norvegicus
attcatccatgcctatggtgtggga

SEQ ID NO: 206886 - DNA, 25 bp, Rattus norvegicus
attcatccatgcgtatggtgtggga

SEQ ID NO: 206887 - DNA, 25 bp, Rattus norvegicus
attcatcccgatccagaccaagaag

SEQ ID NO: 206888 - DNA, 25 bp, Rattus norvegicus
attcatcccgatgcagaccaagaag

SEQ ID NO: 206889 - DNA, 25 bp, Rattus norvegicus
attcatcccttccttatccttttgc

SEQ ID NO: 206890 - DNA, 25 bp, Rattus norvegicus
attcatcccttcgttatccttttgc

SEQ ID NO: 206891 - DNA, 25 bp, Rattus norvegicus
attcatccgtgtatgttgtagccat

SEQ ID NO: 206892 - DNA, 25 bp, Rattus norvegicus
attcatccgtgtttgttgtagccat

SEQ ID NO: 206893 - DNA, 25 bp, Rattus norvegicus
attcatcctctgagggtaaagattc

SEQ ID NO: 206894 - DNA, 25 bp, Rattus norvegicus
attcatcctctgtgggtaaagattc

SEQ ID NO: 206895 - DNA, 25 bp, Rattus norvegicus
attcatcctggaacctctgcataat

SEQ ID NO: 206896 - DNA, 25 bp, Rattus norvegicus
attcatcctggatcctctgcataat

SEQ ID NO: 206897 - DNA, 25 bp, Rattus norvegicus
attcatcgcatgaccatcaatgtgg

SEQ ID NO: 206898 - DNA, 25 bp, Rattus norvegicus
attcatcgcatgtccatcaatgtgg

SEQ ID NO: 206899 - DNA, 25 bp, Rattus norvegicus
attcatctaagacttgtgctttatc

SEQ ID NO: 206900 - DNA, 25 bp, Rattus norvegicus
attcatctaagagttgtgctttatc

SEQ ID NO: 206901 - DNA, 25 bp, Rattus norvegicus
attcatctacacagccttactacat

SEQ ID NO: 206902 - DNA, 25 bp, Rattus norvegicus
attcatctacactgccttactacat

SEQ ID NO: 206903 - DNA, 25 bp, Rattus norvegicus
attcatctagatatcaagcattcag

SEQ ID NO: 206904 - DNA, 25 bp, Rattus norvegicus
attcatctagatttcaagcattcag

SEQ ID NO: 206905 - DNA, 25 bp, Rattus norvegicus
attcatctcggtattggacactagg

SEQ ID NO: 206906 - DNA, 25 bp, Rattus norvegicus
attcatctcggttttggacactagg

SEQ ID NO: 206907 - DNA, 25 bp, Rattus norvegicus
attcatctcttcatttgtgctcaca

SEQ ID NO: 206908 - DNA, 25 bp, Rattus norvegicus
attcatctcttcttttgtgctcaca

SEQ ID NO: 206909 - DNA, 25 bp, Rattus norvegicus
attcatctctttatgcttccttctg

SEQ ID NO: 206910 - DNA, 25 bp, Rattus norvegicus
attcatctctttttgcttccttctg

SEQ ID NO: 206911 - DNA, 25 bp, Rattus norvegicus
attcatctgaaaaacagtacatttg

SEQ ID NO: 206912 - DNA, 25 bp, Rattus norvegicus
attcatctgaaatacagtacatttg

SEQ ID NO: 206913 - DNA, 25 bp, Rattus norvegicus
attcatctgcatagtagtcactcct

SEQ ID NO: 206914 - DNA, 25 bp, Rattus norvegicus
attcatctgcattgtagtcactcct

SEQ ID NO: 206915 - DNA, 25 bp, Rattus norvegicus
attcatctggacagttggttgttct

SEQ ID NO: 206916 - DNA, 25 bp, Rattus norvegicus
attcatctggactgttggttgttct

SEQ ID NO: 206917 - DNA, 25 bp, Rattus norvegicus
attcatcttacacacttgcaggcta

SEQ ID NO: 206918 - DNA, 25 bp, Rattus norvegicus
attcatcttacagacttgcaggcta

SEQ ID NO: 206919 - DNA, 25 bp, Rattus norvegicus
attcatcttctgaggcactggagat

SEQ ID NO: 206920 - DNA, 25 bp, Rattus norvegicus
attcatcttctgtggcactggagat

SEQ ID NO: 206921 - DNA, 25 bp, Rattus norvegicus
attcatcttgagcatggccagcagg

SEQ ID NO: 206922 - DNA, 25 bp, Rattus norvegicus
attcatcttgaggatggccagcagg

SEQ ID NO: 206923 - DNA, 25 bp, Rattus norvegicus
attcatcttgtgactaatttccttt

SEQ ID NO: 206924 - DNA, 25 bp, Rattus norvegicus
attcatcttgtgtctaatttccttt

SEQ ID NO: 206925 - DNA, 25 bp, Rattus norvegicus
attcatgaaatgctgccacccacat

SEQ ID NO: 206926 - DNA, 25 bp, Rattus norvegicus
attcatgaaatggtgccacccacat

SEQ ID NO: 206927 - DNA, 25 bp, Rattus norvegicus
attcatgaagagcatccttcccttc

SEQ ID NO: 206928 - DNA, 25 bp, Rattus norvegicus
attcatgaagaggatccttcccttc

SEQ ID NO: 206929 - DNA, 25 bp, Rattus norvegicus
attcatgaatgtcaccccacgctga

SEQ ID NO: 206930 - DNA, 25 bp, Rattus norvegicus
attcatgaatgtgaccccacgctga

SEQ ID NO: 206931 - DNA, 25 bp, Rattus norvegicus
attcatgaccacagcaggcaggtag

SEQ ID NO: 206932 - DNA, 25 bp, Rattus norvegicus
attcatgaccactgcaggcaggtag

SEQ ID NO: 206933 - DNA, 25 bp, Rattus norvegicus
attcatgaggagatctctagggcct

SEQ ID NO: 206934 - DNA, 25 bp, Rattus norvegicus
attcatgaggagttctctagggcct

SEQ ID NO: 206935 - DNA, 25 bp, Rattus norvegicus
attcatgagttgcacatccacttca

SEQ ID NO: 206936 - DNA, 25 bp, Rattus norvegicus
attcatgagttggacatccacttca

SEQ ID NO: 206937 - DNA, 25 bp, Rattus norvegicus
attcatgatgaactctagcacagac

SEQ ID NO: 206938 - DNA, 25 bp, Rattus norvegicus
attcatgatgaagtctagcacagac

SEQ ID NO: 206939 - DNA, 25 bp, Rattus norvegicus
attcatgatgacattgacgacaatg

SEQ ID NO: 206940 - DNA, 25 bp, Rattus norvegicus
attcatgatgactttgacgacaatg

SEQ ID NO: 206941 - DNA, 25 bp, Rattus norvegicus
attcatgcattccaaatgccccttt

SEQ ID NO: 206942 - DNA, 25 bp, Rattus norvegicus
attcatgcattcgaaatgccccttt

SEQ ID NO: 206943 - DNA, 25 bp, Rattus norvegicus
attcatgccaaacttcagcgctgag

SEQ ID NO: 206944 - DNA, 25 bp, Rattus norvegicus
attcatgccaaagttcagcgctgag

SEQ ID NO: 206945 - DNA, 25 bp, Rattus norvegicus
attcatgcctttaaatttgtggttg

SEQ ID NO: 206946 - DNA, 25 bp, Rattus norvegicus
attcatgccttttaatttgtggttg

SEQ ID NO: 206947 - DNA, 25 bp, Rattus norvegicus
attcatgctagccattccgtggacg

SEQ ID NO: 206948 - DNA, 25 bp, Rattus norvegicus
attcatgctagcgattccgtggacg

SEQ ID NO: 206949 - DNA, 25 bp, Rattus norvegicus
attcatgctcagaagacaccccaat

SEQ ID NO: 206950 - DNA, 25 bp, Rattus norvegicus
attcatgctcagtagacaccccaat

SEQ ID NO: 206951 - DNA, 25 bp, Rattus norvegicus
attcatgctgaaaaacctgtagttt

SEQ ID NO: 206952 - DNA, 25 bp, Rattus norvegicus
attcatgctgaataacctgtagttt

SEQ ID NO: 206953 - DNA, 25 bp, Rattus norvegicus
attcatgctgctagctcgggtgagc

SEQ ID NO: 206954 - DNA, 25 bp, Rattus norvegicus
attcatgctgcttgctcgggtgagc

SEQ ID NO: 206955 - DNA, 25 bp, Rattus norvegicus
attcatgctttacatctctgctcct

SEQ ID NO: 206956 - DNA, 25 bp, Rattus norvegicus
attcatgctttagatctctgctcct

SEQ ID NO: 206957 - DNA, 25 bp, Rattus norvegicus
attcatgctttgagctgaccgagcc

SEQ ID NO: 206958 - DNA, 25 bp, Rattus norvegicus
attcatgctttgtgctgaccgagcc

SEQ ID NO: 206959 - DNA, 25 bp, Rattus norvegicus
attcatggaaaacagctggcaggac

SEQ ID NO: 206960 - DNA, 25 bp, Rattus norvegicus
attcatggaaaagagctggcaggac

SEQ ID NO: 206961 - DNA, 25 bp, Rattus norvegicus
attcatggacttcctgttcctgtgt

SEQ ID NO: 206962 - DNA, 25 bp, Rattus norvegicus
attcatggacttgctgttcctgtgt

SEQ ID NO: 206963 - DNA, 25 bp, Rattus norvegicus
attcatggagctcttttcctagcct

SEQ ID NO: 206964 - DNA, 25 bp, Rattus norvegicus
attcatggagctgttttcctagcct

SEQ ID NO: 206965 - DNA, 25 bp, Rattus norvegicus
attcatggccaaatgtgggtgctca

SEQ ID NO: 206966 - DNA, 25 bp, Rattus norvegicus
attcatggccaattgtgggtgctca

SEQ ID NO: 206967 - DNA, 25 bp, Rattus norvegicus
attcatggcccacaaaggagtcagc

SEQ ID NO: 206968 - DNA, 25 bp, Rattus norvegicus
attcatggcccagaaaggagtcagc

SEQ ID NO: 206969 - DNA, 25 bp, Rattus norvegicus
attcatggccccactatatgtagcc

SEQ ID NO: 206970 - DNA, 25 bp, Rattus norvegicus
attcatggcccctctatatgtagcc

SEQ ID NO: 206971 - DNA, 25 bp, Rattus norvegicus
attcatggccgcagtgttggagtct

SEQ ID NO: 206972 - DNA, 25 bp, Rattus norvegicus
attcatggccgctgtgttggagtct

SEQ ID NO: 206973 - DNA, 25 bp, Rattus norvegicus
attcatggcgtacggaacagacact

SEQ ID NO: 206974 - DNA, 25 bp, Rattus norvegicus
attcatggcgtagggaacagacact

SEQ ID NO: 206975 - DNA, 25 bp, Rattus norvegicus
attcatggctctcctaagggcggtc

SEQ ID NO: 206976 - DNA, 25 bp, Rattus norvegicus
attcatggctctgctaagggcggtc

SEQ ID NO: 206977 - DNA, 25 bp, Rattus norvegicus
attcatgggccaagccaatgtggag

SEQ ID NO: 206978 - DNA, 25 bp, Rattus norvegicus
attcatgggccatgccaatgtggag

SEQ ID NO: 206979 - DNA, 25 bp, Rattus norvegicus
attcatggtctcatgtaggctccgc

SEQ ID NO: 206980 - DNA, 25 bp, Rattus norvegicus
attcatggtctcttgtaggctccgc

SEQ ID NO: 206981 - DNA, 25 bp, Rattus norvegicus
attcatgtatttattccacgtatta

SEQ ID NO: 206982 - DNA, 25 bp, Rattus norvegicus
attcatgtattttttccacgtatta

SEQ ID NO: 206983 - DNA, 25 bp, Rattus norvegicus
attcatgtctgtcaagctttttaac

SEQ ID NO: 206984 - DNA, 25 bp, Rattus norvegicus
attcatgtctgtgaagctttttaac

SEQ ID NO: 206985 - DNA, 25 bp, Rattus norvegicus
attcatgtcttaagtctcaccatcc

SEQ ID NO: 206986 - DNA, 25 bp, Rattus norvegicus
attcatgtcttatgtctcaccatcc

SEQ ID NO: 206987 - DNA, 25 bp, Rattus norvegicus
attcatgtgatcatattcccgcttg

SEQ ID NO: 206988 - DNA, 25 bp, Rattus norvegicus
attcatgtgatcttattcccgcttg

SEQ ID NO: 206989 - DNA, 25 bp, Rattus norvegicus
attcatgtgggtctggtgcctaaca

SEQ ID NO: 206990 - DNA, 25 bp, Rattus norvegicus
attcatgtgggtgtggtgcctaaca

SEQ ID NO: 206991 - DNA, 25 bp, Rattus norvegicus
attcatgtgtctctggagcagccct

SEQ ID NO: 206992 - DNA, 25 bp, Rattus norvegicus
attcatgtgtctgtggagcagccct

SEQ ID NO: 206993 - DNA, 25 bp, Rattus norvegicus
attcatgttcttatgggagcttaca

SEQ ID NO: 206994 - DNA, 25 bp, Rattus norvegicus
attcatgttcttttgggagcttaca

SEQ ID NO: 206995 - DNA, 25 bp, Rattus norvegicus
attcatgttgctctgagggagtgct

SEQ ID NO: 206996 - DNA, 25 bp, Rattus norvegicus
attcatgttgctgtgagggagtgct

SEQ ID NO: 206997 - DNA, 25 bp, Rattus norvegicus
attcatgtttctcttgttctccctt

SEQ ID NO: 206998 - DNA, 25 bp, Rattus norvegicus
attcatgtttctgttgttctccctt

SEQ ID NO: 206999 - DNA, 25 bp, Rattus norvegicus
attcatgtttgtcatcttgacccaa

SEQ ID NO: 207000 - DNA, 25 bp, Rattus norvegicus
attcatgtttgtgatcttgacccaa

SEQ ID NO: 207001 - DNA, 25 bp, Rattus norvegicus
attcattaacatccccagcgtgcag

SEQ ID NO: 207002 - DNA, 25 bp, Rattus norvegicus
attcattaacatgcccagcgtgcag

SEQ ID NO: 207003 - DNA, 25 bp, Rattus norvegicus
attcattaagtgacccaggtcccca

SEQ ID NO: 207004 - DNA, 25 bp, Rattus norvegicus
attcattaagtgtcccaggtcccca

SEQ ID NO: 207005 - DNA, 25 bp, Rattus norvegicus
attcattagctgaagacctgtgcct

SEQ ID NO: 207006 - DNA, 25 bp, Rattus norvegicus
attcattagctgtagacctgtgcct

SEQ ID NO: 207007 - DNA, 25 bp, Rattus norvegicus
attcattatgtaatatgccggcgtt

SEQ ID NO: 207008 - DNA, 25 bp, Rattus norvegicus
attcattatgtattatgccggcgtt

SEQ ID NO: 207009 - DNA, 25 bp, Rattus norvegicus
attcattatgtgagcctctactgcg

SEQ ID NO: 207010 - DNA, 25 bp, Rattus norvegicus
attcattatgtgtgcctctactgcg

SEQ ID NO: 207011 - DNA, 25 bp, Rattus norvegicus
attcattcacagcttgtctgctagc

SEQ ID NO: 207012 - DNA, 25 bp, Rattus norvegicus
attcattcacaggttgtctgctagc

SEQ ID NO: 207013 - DNA, 25 bp, Rattus norvegicus
attcattcacctcccaatcactaat

SEQ ID NO: 207014 - DNA, 25 bp, Rattus norvegicus
attcattcacctgccaatcactaat

SEQ ID NO: 207015 - DNA, 25 bp, Rattus norvegicus
attcattcacttcatgtcttacgga

SEQ ID NO: 207016 - DNA, 25 bp, Rattus norvegicus
attcattcacttgatgtcttacgga

SEQ ID NO: 207017 - DNA, 25 bp, Rattus norvegicus
attcattcaggtaaacttccccatg

SEQ ID NO: 207018 - DNA, 25 bp, Rattus norvegicus
attcattcaggttaacttccccatg

SEQ ID NO: 207019 - DNA, 25 bp, Rattus norvegicus
attcattccaagatactctttctcc

SEQ ID NO: 207020 - DNA, 25 bp, Rattus norvegicus
attcattccaagttactctttctcc

SEQ ID NO: 207021 - DNA, 25 bp, Rattus norvegicus
attcattccctgatctcaaggccgg

SEQ ID NO: 207022 - DNA, 25 bp, Rattus norvegicus
attcattccctgttctcaaggccgg

SEQ ID NO: 207023 - DNA, 25 bp, Rattus norvegicus
attcattctagaattggcaccaggt

SEQ ID NO: 207024 - DNA, 25 bp, Rattus norvegicus
attcattctagatttggcaccaggt

SEQ ID NO: 207025 - DNA, 25 bp, Rattus norvegicus
attcattctcaacaaggaggctctt

SEQ ID NO: 207026 - DNA, 25 bp, Rattus norvegicus
attcattctcaagaaggaggctctt

SEQ ID NO: 207027 - DNA, 25 bp, Rattus norvegicus
attcattctcagaatctgccagtgt

SEQ ID NO: 207028 - DNA, 25 bp, Rattus norvegicus
attcattctcagtatctgccagtgt

SEQ ID NO: 207029 - DNA, 25 bp, Rattus norvegicus
attcattctctcaacactgactggg

SEQ ID NO: 207030 - DNA, 25 bp, Rattus norvegicus
attcattctctctacactgactggg

SEQ ID NO: 207031 - DNA, 25 bp, Rattus norvegicus
attcattctgacacgtggtccttct

SEQ ID NO: 207032 - DNA, 25 bp, Rattus norvegicus
attcattctgactcgtggtccttct

SEQ ID NO: 207033 - DNA, 25 bp, Rattus norvegicus
attcattgacgcagttgtgctcgaa

SEQ ID NO: 207034 - DNA, 25 bp, Rattus norvegicus
attcattgacgctgttgtgctcgaa

SEQ ID NO: 207035 - DNA, 25 bp, Rattus norvegicus
attcattgagctaagtgaggcctac

SEQ ID NO: 207036 - DNA, 25 bp, Rattus norvegicus
attcattgagcttagtgaggcctac

SEQ ID NO: 207037 - DNA, 25 bp, Rattus norvegicus
attcattgcaaactccagaccagac

SEQ ID NO: 207038 - DNA, 25 bp, Rattus norvegicus
attcattgcaaagtccagaccagac

SEQ ID NO: 207039 - DNA, 25 bp, Rattus norvegicus
attcattgctccaaccaacctcgag

SEQ ID NO: 207040 - DNA, 25 bp, Rattus norvegicus
attcattgctcctaccaacctcgag

SEQ ID NO: 207041 - DNA, 25 bp, Rattus norvegicus
attcattggccactgcgcgagtcac

SEQ ID NO: 207042 - DNA, 25 bp, Rattus norvegicus
attcattggccagtgcgcgagtcac

SEQ ID NO: 207043 - DNA, 25 bp, Rattus norvegicus
attcattgtaccatccggacttcgt

SEQ ID NO: 207044 - DNA, 25 bp, Rattus norvegicus
attcattgtaccttccggacttcgt

SEQ ID NO: 207045 - DNA, 25 bp, Rattus norvegicus
attcatttcctccatctctaatgta

SEQ ID NO: 207046 - DNA, 25 bp, Rattus norvegicus
attcatttcctcgatctctaatgta

SEQ ID NO: 207047 - DNA, 25 bp, Rattus norvegicus
attcatttctatatcctgttccctc

SEQ ID NO: 207048 - DNA, 25 bp, Rattus norvegicus
attcatttctatttcctgttccctc

SEQ ID NO: 207049 - DNA, 25 bp, Rattus norvegicus
attcatttctccataccttttgaag

SEQ ID NO: 207050 - DNA, 25 bp, Rattus norvegicus
attcatttctccttaccttttgaag

SEQ ID NO: 207051 - DNA, 25 bp, Rattus norvegicus
attcatttctgtctcttcatttatc

SEQ ID NO: 207052 - DNA, 25 bp, Rattus norvegicus
attcatttctgtgtcttcatttatc

SEQ ID NO: 207053 - DNA, 25 bp, Rattus norvegicus
attcatttgcaactaccataccacc

SEQ ID NO: 207054 - DNA, 25 bp, Rattus norvegicus
attcatttgcaagtaccataccacc

SEQ ID NO: 207055 - DNA, 25 bp, Rattus norvegicus
attcatttgcagagtgctccatcag

SEQ ID NO: 207056 - DNA, 25 bp, Rattus norvegicus
attcatttgcagtgtgctccatcag

SEQ ID NO: 207057 - DNA, 25 bp, Rattus norvegicus
attcatttgtctcatcttttccttc

SEQ ID NO: 207058 - DNA, 25 bp, Rattus norvegicus
attcatttgtctgatcttttccttc

SEQ ID NO: 207059 - DNA, 25 bp, Rattus norvegicus
attcatttgtttattaagcgagagc

SEQ ID NO: 207060 - DNA, 25 bp, Rattus norvegicus
attcatttgttttttaagcgagagc

SEQ ID NO: 207061 - DNA, 25 bp, Rattus norvegicus
attcattttatacatgtcatggtca

SEQ ID NO: 207062 - DNA, 25 bp, Rattus norvegicus
attcattttatagatgtcatggtca

SEQ ID NO: 207063 - DNA, 25 bp, Rattus norvegicus
attcattttcagctatctggcaagt

SEQ ID NO: 207064 - DNA, 25 bp, Rattus norvegicus
attcattttcaggtatctggcaagt

SEQ ID NO: 207065 - DNA, 25 bp, Rattus norvegicus
attcattttcttcattcggcacaac

SEQ ID NO: 207066 - DNA, 25 bp, Rattus norvegicus
attcattttcttcccagtgacctca

SEQ ID NO: 207067 - DNA, 25 bp, Rattus norvegicus
attcattttcttgattcggcacaac

SEQ ID NO: 207068 - DNA, 25 bp, Rattus norvegicus
attcattttcttgccagtgacctca

SEQ ID NO: 207069 - DNA, 25 bp, Rattus norvegicus
attcattttgtaaggctggctcacc

SEQ ID NO: 207070 - DNA, 25 bp, Rattus norvegicus
attcattttgtatggctggctcacc

SEQ ID NO: 207071 - DNA, 25 bp, Rattus norvegicus
attcatttttgtagtactactgtac

SEQ ID NO: 207072 - DNA, 25 bp, Rattus norvegicus
attcatttttgttgtactactgtac

SEQ ID NO: 207073 - DNA, 25 bp, Rattus norvegicus
attccaaaagatacagtaggctact

SEQ ID NO: 207074 - DNA, 25 bp, Rattus norvegicus
attccaaaagattcagtaggctact

SEQ ID NO: 207075 - DNA, 25 bp, Rattus norvegicus
attccaaaccccatggttagggcag

SEQ ID NO: 207076 - DNA, 25 bp, Rattus norvegicus
attccaaaccccttggttagggcag

SEQ ID NO: 207077 - DNA, 25 bp, Rattus norvegicus
attccaaagacgatagagggctaat

SEQ ID NO: 207078 - DNA, 25 bp, Rattus norvegicus
attccaaagacgttagagggctaat

SEQ ID NO: 207079 - DNA, 25 bp, Rattus norvegicus
attccaaagagactcctggccgtct

SEQ ID NO: 207080 - DNA, 25 bp, Rattus norvegicus
attccaaagagagtcctggccgtct

SEQ ID NO: 207081 - DNA, 25 bp, Rattus norvegicus
attccaaaggcccagcaaatgcata

SEQ ID NO: 207082 - DNA, 25 bp, Rattus norvegicus
attccaaaggccgagcaaatgcata

SEQ ID NO: 207083 - DNA, 25 bp, Rattus norvegicus
attccaaccgctcataattcgtagg

SEQ ID NO: 207084 - DNA, 25 bp, Rattus norvegicus
attccaaccgctgataattcgtagg

SEQ ID NO: 207085 - DNA, 25 bp, Rattus norvegicus
attccaaccttacagtgccgtctgg

SEQ ID NO: 207086 - DNA, 25 bp, Rattus norvegicus
attccaaccttagagtgccgtctgg

SEQ ID NO: 207087 - DNA, 25 bp, Rattus norvegicus
attccaaccttccatgtgcctatgt

SEQ ID NO: 207088 - DNA, 25 bp, Rattus norvegicus
attccaaccttcgatgtgcctatgt

SEQ ID NO: 207089 - DNA, 25 bp, Rattus norvegicus
attccaacgagcaccgaagtcaggt

SEQ ID NO: 207090 - DNA, 25 bp, Rattus norvegicus
attccaacgagctccgaagtcaggt

SEQ ID NO: 207091 - DNA, 25 bp, Rattus norvegicus
attccaactgcccataccagtaaat

SEQ ID NO: 207092 - DNA, 25 bp, Rattus norvegicus
attccaactgccgataccagtaaat

SEQ ID NO: 207093 - DNA, 25 bp, Rattus norvegicus
attccaactgtcatagggagtccag

SEQ ID NO: 207094 - DNA, 25 bp, Rattus norvegicus
attccaactgtcttagggagtccag

SEQ ID NO: 207095 - DNA, 25 bp, Rattus norvegicus
attccaagacatcagcttaagttct

SEQ ID NO: 207096 - DNA, 25 bp, Rattus norvegicus
attccaagacatgagcttaagttct

SEQ ID NO: 207097 - DNA, 25 bp, Rattus norvegicus
attccaagactaaggcctcgggcaa

SEQ ID NO: 207098 - DNA, 25 bp, Rattus norvegicus
attccaagactatggcctcgggcaa

SEQ ID NO: 207099 - DNA, 25 bp, Rattus norvegicus
attccaaggaatatgcgcccaaccg

SEQ ID NO: 207100 - DNA, 25 bp, Rattus norvegicus
attccaaggaatttgcgcccaaccg

SEQ ID NO: 207101 - DNA, 25 bp, Rattus norvegicus
attccaagggatcagttgaccacca

SEQ ID NO: 207102 - DNA, 25 bp, Rattus norvegicus
attccaagggatgagttgaccacca

SEQ ID NO: 207103 - DNA, 25 bp, Rattus norvegicus
attccaagtataattgtgcttctag

SEQ ID NO: 207104 - DNA, 25 bp, Rattus norvegicus
attccaagtatatttgtgcttctag

SEQ ID NO: 207105 - DNA, 25 bp, Rattus norvegicus
attccaagtatgatgcccagaggct

SEQ ID NO: 207106 - DNA, 25 bp, Rattus norvegicus
attccaagtatgttgcccagaggct

SEQ ID NO: 207107 - DNA, 25 bp, Rattus norvegicus
attccaagttcccatgttagcattg

SEQ ID NO: 207108 - DNA, 25 bp, Rattus norvegicus
attccaagttccgatgttagcattg

SEQ ID NO: 207109 - DNA, 25 bp, Rattus norvegicus
attccaataagcatcttttccctca

SEQ ID NO: 207110 - DNA, 25 bp, Rattus norvegicus
attccaataagcttcttttccctca

SEQ ID NO: 207111 - DNA, 25 bp, Rattus norvegicus
attccaatataaacacagaggctgt

SEQ ID NO: 207112 - DNA, 25 bp, Rattus norvegicus
attccaatataatcacagaggctgt

SEQ ID NO: 207113 - DNA, 25 bp, Rattus norvegicus
attccaatccacatgtttgacctac

SEQ ID NO: 207114 - DNA, 25 bp, Rattus norvegicus
attccaatccacttgtttgacctac

SEQ ID NO: 207115 - DNA, 25 bp, Rattus norvegicus
attccaatccatccaaacggtgttt

SEQ ID NO: 207116 - DNA, 25 bp, Rattus norvegicus
attccaatccatgcaaacggtgttt

SEQ ID NO: 207117 - DNA, 25 bp, Rattus norvegicus
attccaatcctcaatacgattctct

SEQ ID NO: 207118 - DNA, 25 bp, Rattus norvegicus
attccaatcctctatacgattctct

SEQ ID NO: 207119 - DNA, 25 bp, Rattus norvegicus
attccaatgctgctgtcgtcctcat

SEQ ID NO: 207120 - DNA, 25 bp, Rattus norvegicus
attccaatgctggtgtcgtcctcat

SEQ ID NO: 207121 - DNA, 25 bp, Rattus norvegicus
attccacaagctaaactttcatttg

SEQ ID NO: 207122 - DNA, 25 bp, Rattus norvegicus
attccacaagcttaactttcatttg

SEQ ID NO: 207123 - DNA, 25 bp, Rattus norvegicus
attccacaatgtccctggtatcttg

SEQ ID NO: 207124 - DNA, 25 bp, Rattus norvegicus
attccacaatgtctatagcttcaat

SEQ ID NO: 207125 - DNA, 25 bp, Rattus norvegicus
attccacaatgtgcctggtatcttg

SEQ ID NO: 207126 - DNA, 25 bp, Rattus norvegicus
attccacaatgtgtatagcttcaat

SEQ ID NO: 207127 - DNA, 25 bp, Rattus norvegicus
attccacacaccaaactggccaaag

SEQ ID NO: 207128 - DNA, 25 bp, Rattus norvegicus
attccacacacctaactggccaaag

SEQ ID NO: 207129 - DNA, 25 bp, Rattus norvegicus
attccacactatctgacctctgctg

SEQ ID NO: 207130 - DNA, 25 bp, Rattus norvegicus
attccacactatgtgacctctgctg

SEQ ID NO: 207131 - DNA, 25 bp, Rattus norvegicus
attccacactccatttatgactgct

SEQ ID NO: 207132 - DNA, 25 bp, Rattus norvegicus
attccacactccttttatgactgct

SEQ ID NO: 207133 - DNA, 25 bp, Rattus norvegicus
attccacagccaactgatcctatat

SEQ ID NO: 207134 - DNA, 25 bp, Rattus norvegicus
attccacagccacttttatttcaac

SEQ ID NO: 207135 - DNA, 25 bp, Rattus norvegicus
attccacagccagttttatttcaac

SEQ ID NO: 207136 - DNA, 25 bp, Rattus norvegicus
attccacagccatctgatcctatat

SEQ ID NO: 207137 - DNA, 25 bp, Rattus norvegicus
attccacagcgtctacttttactca

SEQ ID NO: 207138 - DNA, 25 bp, Rattus norvegicus
attccacagcgtgtacttttactca

SEQ ID NO: 207139 - DNA, 25 bp, Rattus norvegicus
attccacagtatccacgtgctggcc

SEQ ID NO: 207140 - DNA, 25 bp, Rattus norvegicus
attccacagtatgcacgtgctggcc

SEQ ID NO: 207141 - DNA, 25 bp, Rattus norvegicus
attccacatagcagggacccttggg

SEQ ID NO: 207142 - DNA, 25 bp, Rattus norvegicus
attccacatagctgggacccttggg

SEQ ID NO: 207143 - DNA, 25 bp, Rattus norvegicus
attccaccaagcagctggctacaga

SEQ ID NO: 207144 - DNA, 25 bp, Rattus norvegicus
attccaccaagctgctggctacaga

SEQ ID NO: 207145 - DNA, 25 bp, Rattus norvegicus
attccaccaatgagagattttcctg

SEQ ID NO: 207146 - DNA, 25 bp, Rattus norvegicus
attccaccaatgtgagattttcctg

SEQ ID NO: 207147 - DNA, 25 bp, Rattus norvegicus
attccaccactacagaatgctcaag

SEQ ID NO: 207148 - DNA, 25 bp, Rattus norvegicus
attccaccactagagaatgctcaag

SEQ ID NO: 207149 - DNA, 25 bp, Rattus norvegicus
attccacccaatccaactctgatgt

SEQ ID NO: 207150 - DNA, 25 bp, Rattus norvegicus
attccacccaatgcaactctgatgt

SEQ ID NO: 207151 - DNA, 25 bp, Rattus norvegicus
attccacccctaagtgtacaagttg

SEQ ID NO: 207152 - DNA, 25 bp, Rattus norvegicus
attccacccctatgtgtacaagttg

SEQ ID NO: 207153 - DNA, 25 bp, Rattus norvegicus
attccaccggcacctttacttgcta

SEQ ID NO: 207154 - DNA, 25 bp, Rattus norvegicus
attccaccggcagctttacttgcta

SEQ ID NO: 207155 - DNA, 25 bp, Rattus norvegicus
attccacctgctcatggagcctaca

SEQ ID NO: 207156 - DNA, 25 bp, Rattus norvegicus
attccacctgctgatggagcctaca

SEQ ID NO: 207157 - DNA, 25 bp, Rattus norvegicus
attccaccttataccaatcacaatg

SEQ ID NO: 207158 - DNA, 25 bp, Rattus norvegicus
attccaccttattccaatcacaatg

SEQ ID NO: 207159 - DNA, 25 bp, Rattus norvegicus
attccacgcagtctaagtcccagta

SEQ ID NO: 207160 - DNA, 25 bp, Rattus norvegicus
attccacgcagtgtaagtcccagta

SEQ ID NO: 207161 - DNA, 25 bp, Rattus norvegicus
attccacgctgtcccgaaagtttgt

SEQ ID NO: 207162 - DNA, 25 bp, Rattus norvegicus
attccacgctgtgccgaaagtttgt

SEQ ID NO: 207163 - DNA, 25 bp, Rattus norvegicus
attccactcaaaccatgggtccctg

SEQ ID NO: 207164 - DNA, 25 bp, Rattus norvegicus
attccactcaaagcatgggtccctg

SEQ ID NO: 207165 - DNA, 25 bp, Rattus norvegicus
attccactcatcctgtttgttgttc

SEQ ID NO: 207166 - DNA, 25 bp, Rattus norvegicus
attccactcatcgtgtttgttgttc

SEQ ID NO: 207167 - DNA, 25 bp, Rattus norvegicus
attccactcattaagtcactgtctc

SEQ ID NO: 207168 - DNA, 25 bp, Rattus norvegicus
attccactcatttagtcactgtctc

SEQ ID NO: 207169 - DNA, 25 bp, Rattus norvegicus
attccactcctgacccaaacaaggg

SEQ ID NO: 207170 - DNA, 25 bp, Rattus norvegicus
attccactcctgtcccaaacaaggg

SEQ ID NO: 207171 - DNA, 25 bp, Rattus norvegicus
attccactcgcccacttgcgcagtg

SEQ ID NO: 207172 - DNA, 25 bp, Rattus norvegicus
attccactcgccgacttgcgcagtg

SEQ ID NO: 207173 - DNA, 25 bp, Rattus norvegicus
attccactgaccataatttctgtta

SEQ ID NO: 207174 - DNA, 25 bp, Rattus norvegicus
attccactgaccttaatttctgtta

SEQ ID NO: 207175 - DNA, 25 bp, Rattus norvegicus
attccactgagcataggtcttgcac

SEQ ID NO: 207176 - DNA, 25 bp, Rattus norvegicus
attccactgagcttaggtcttgcac

SEQ ID NO: 207177 - DNA, 25 bp, Rattus norvegicus
attccactgatacttgtttccttga

SEQ ID NO: 207178 - DNA, 25 bp, Rattus norvegicus
attccactgatagttgtttccttga

SEQ ID NO: 207179 - DNA, 25 bp, Rattus norvegicus
attccactgggtcatagcggcagca

SEQ ID NO: 207180 - DNA, 25 bp, Rattus norvegicus
attccactgggtgatagcggcagca

SEQ ID NO: 207181 - DNA, 25 bp, Rattus norvegicus
attccactgtggctcataatactag

SEQ ID NO: 207182 - DNA, 25 bp, Rattus norvegicus
attccactgtgggtcataatactag

SEQ ID NO: 207183 - DNA, 25 bp, Rattus norvegicus
attccacttgataaaacttcttcca

SEQ ID NO: 207184 - DNA, 25 bp, Rattus norvegicus
attccacttgattaaacttcttcca

SEQ ID NO: 207185 - DNA, 25 bp, Rattus norvegicus
attccacttggaattcctctagcaa

SEQ ID NO: 207186 - DNA, 25 bp, Rattus norvegicus
attccacttggatttcctctagcaa

SEQ ID NO: 207187 - DNA, 25 bp, Rattus norvegicus
attccacttgtgcagagccctactg

SEQ ID NO: 207188 - DNA, 25 bp, Rattus norvegicus
attccacttgtggagagccctactg

SEQ ID NO: 207189 - DNA, 25 bp, Rattus norvegicus
attccacttgttatctgtcacttac

SEQ ID NO: 207190 - DNA, 25 bp, Rattus norvegicus
attccacttgttttctgtcacttac

SEQ ID NO: 207191 - DNA, 25 bp, Rattus norvegicus
attccagaacatacgatgagactta

SEQ ID NO: 207192 - DNA, 25 bp, Rattus norvegicus
attccagaacattcgatgagactta

SEQ ID NO: 207193 - DNA, 25 bp, Rattus norvegicus
attccagaaggcatatcagtcccgt

SEQ ID NO: 207194 - DNA, 25 bp, Rattus norvegicus
attccagaaggcttatcagtcccgt

SEQ ID NO: 207195 - DNA, 25 bp, Rattus norvegicus
attccagaaggtcacctcctccaag

SEQ ID NO: 207196 - DNA, 25 bp, Rattus norvegicus
attccagaaggtgacctcctccaag

SEQ ID NO: 207197 - DNA, 25 bp, Rattus norvegicus
attccagaccttctgggtcatctcg

SEQ ID NO: 207198 - DNA, 25 bp, Rattus norvegicus
attccagaccttgtgggtcatctcg

SEQ ID NO: 207199 - DNA, 25 bp, Rattus norvegicus
attccagagcagaaacccagcaggg

SEQ ID NO: 207200 - DNA, 25 bp, Rattus norvegicus
attccagagcagtaacccagcaggg

SEQ ID NO: 207201 - DNA, 25 bp, Rattus norvegicus
attccagagttccaaagtgtttcat

SEQ ID NO: 207202 - DNA, 25 bp, Rattus norvegicus
attccagagttcgaaagtgtttcat

SEQ ID NO: 207203 - DNA, 25 bp, Rattus norvegicus
attccagatcacaattagactccag

SEQ ID NO: 207204 - DNA, 25 bp, Rattus norvegicus
attccagatcactattagactccag

SEQ ID NO: 207205 - DNA, 25 bp, Rattus norvegicus
attccagatcttagctgaggtcttt

SEQ ID NO: 207206 - DNA, 25 bp, Rattus norvegicus
attccagatctttgctgaggtcttt

SEQ ID NO: 207207 - DNA, 25 bp, Rattus norvegicus
attccagattgcacatgtggtgcca

SEQ ID NO: 207208 - DNA, 25 bp, Rattus norvegicus
attccagattgctcatgtggtgcca

SEQ ID NO: 207209 - DNA, 25 bp, Rattus norvegicus
attccagcaattctcatgtgtcatg

SEQ ID NO: 207210 - DNA, 25 bp, Rattus norvegicus
attccagcaattgtcatgtgtcatg

SEQ ID NO: 207211 - DNA, 25 bp, Rattus norvegicus
attccagcagttcctattgtgcctg

SEQ ID NO: 207212 - DNA, 25 bp, Rattus norvegicus
attccagcagttgctattgtgcctg

SEQ ID NO: 207213 - DNA, 25 bp, Rattus norvegicus
attccagccatgctagtagaccggt

SEQ ID NO: 207214 - DNA, 25 bp, Rattus norvegicus
attccagccatggtagtagaccggt

SEQ ID NO: 207215 - DNA, 25 bp, Rattus norvegicus
attccagcccaaaggtatagcctca

SEQ ID NO: 207216 - DNA, 25 bp, Rattus norvegicus
attccagcccaatggtatagcctca

SEQ ID NO: 207217 - DNA, 25 bp, Rattus norvegicus
attccagccggaaggacgtcacagc

SEQ ID NO: 207218 - DNA, 25 bp, Rattus norvegicus
attccagccggatggacgtcacagc

SEQ ID NO: 207219 - DNA, 25 bp, Rattus norvegicus
attccagcctttacccaggcaggaa

SEQ ID NO: 207220 - DNA, 25 bp, Rattus norvegicus
attccagccttttcccaggcaggaa

SEQ ID NO: 207221 - DNA, 25 bp, Rattus norvegicus
attccagcggaaaacaaaggcgaca

SEQ ID NO: 207222 - DNA, 25 bp, Rattus norvegicus
attccagcggaatacaaaggcgaca

SEQ ID NO: 207223 - DNA, 25 bp, Rattus norvegicus
attccagcgtatacaacacacttct

SEQ ID NO: 207224 - DNA, 25 bp, Rattus norvegicus
attccagcgtattcaacacacttct

SEQ ID NO: 207225 - DNA, 25 bp, Rattus norvegicus
attccagctcaaaactttacaccac

SEQ ID NO: 207226 - DNA, 25 bp, Rattus norvegicus
attccagctcaatactttacaccac

SEQ ID NO: 207227 - DNA, 25 bp, Rattus norvegicus
attccagctcagcttgcatttccag

SEQ ID NO: 207228 - DNA, 25 bp, Rattus norvegicus
attccagctcaggttgcatttccag

SEQ ID NO: 207229 - DNA, 25 bp, Rattus norvegicus
attccagctggtagttttatgcaca

SEQ ID NO: 207230 - DNA, 25 bp, Rattus norvegicus
attccagctggttgttttatgcaca

SEQ ID NO: 207231 - DNA, 25 bp, Rattus norvegicus
attccaggaaggatttctgtcacct

SEQ ID NO: 207232 - DNA, 25 bp, Rattus norvegicus
attccaggaaggttttctgtcacct

SEQ ID NO: 207233 - DNA, 25 bp, Rattus norvegicus
attccaggaatgagcggaacacccc

SEQ ID NO: 207234 - DNA, 25 bp, Rattus norvegicus
attccaggaatgtgcggaacacccc

SEQ ID NO: 207235 - DNA, 25 bp, Rattus norvegicus
attccaggctccaaaatcacagtgt

SEQ ID NO: 207236 - DNA, 25 bp, Rattus norvegicus
attccaggctccaactacccagggt

SEQ ID NO: 207237 - DNA, 25 bp, Rattus norvegicus
attccaggctcctaaatcacagtgt

SEQ ID NO: 207238 - DNA, 25 bp, Rattus norvegicus
attccaggctcctactacccagggt

SEQ ID NO: 207239 - DNA, 25 bp, Rattus norvegicus
attccagggaaacctctgaggccaa

SEQ ID NO: 207240 - DNA, 25 bp, Rattus norvegicus
attccagggaaagctctgaggccaa

SEQ ID NO: 207241 - DNA, 25 bp, Rattus norvegicus
attccagggaccattgtgcatcctt

SEQ ID NO: 207242 - DNA, 25 bp, Rattus norvegicus
attccagggacctttgtgcatcctt

SEQ ID NO: 207243 - DNA, 25 bp, Rattus norvegicus
attccagggatcctacagagagctg

SEQ ID NO: 207244 - DNA, 25 bp, Rattus norvegicus
attccagggatcgtacagagagctg

SEQ ID NO: 207245 - DNA, 25 bp, Rattus norvegicus
attccagggcagattttaattattt

SEQ ID NO: 207246 - DNA, 25 bp, Rattus norvegicus
attccagggcagtttttaattattt

SEQ ID NO: 207247 - DNA, 25 bp, Rattus norvegicus
attccagggtctagtaggacagcta

SEQ ID NO: 207248 - DNA, 25 bp, Rattus norvegicus
attccagggtcttgtaggacagcta

SEQ ID NO: 207249 - DNA, 25 bp, Rattus norvegicus
attccaggtattatgtcacacttaa

SEQ ID NO: 207250 - DNA, 25 bp, Rattus norvegicus
attccaggtattttgtcacacttaa

SEQ ID NO: 207251 - DNA, 25 bp, Rattus norvegicus
attccaggtctgacagctatccagt

SEQ ID NO: 207252 - DNA, 25 bp, Rattus norvegicus
attccaggtctgtcagctatccagt

SEQ ID NO: 207253 - DNA, 25 bp, Rattus norvegicus
attccaggtgaaaccaatgcccttg

SEQ ID NO: 207254 - DNA, 25 bp, Rattus norvegicus
attccaggtgaatccaatgcccttg

SEQ ID NO: 207255 - DNA, 25 bp, Rattus norvegicus
attccagtaaggcagttagacactt

SEQ ID NO: 207256 - DNA, 25 bp, Rattus norvegicus
attccagtaagggagttagacactt

SEQ ID NO: 207257 - DNA, 25 bp, Rattus norvegicus
attccagtagatcaactttcctcaa

SEQ ID NO: 207258 - DNA, 25 bp, Rattus norvegicus
attccagtagatgaactttcctcaa

SEQ ID NO: 207259 - DNA, 25 bp, Rattus norvegicus
attccagtattcagcagaaggtgct

SEQ ID NO: 207260 - DNA, 25 bp, Rattus norvegicus
attccagtattctgcagaaggtgct

SEQ ID NO: 207261 - DNA, 25 bp, Rattus norvegicus
attccagtccttcctgggaatggcc

SEQ ID NO: 207262 - DNA, 25 bp, Rattus norvegicus
attccagtccttgctgggaatggcc

SEQ ID NO: 207263 - DNA, 25 bp, Rattus norvegicus
attccagtcttcagattgtcttcag

SEQ ID NO: 207264 - DNA, 25 bp, Rattus norvegicus
attccagtcttctgattgtcttcag

SEQ ID NO: 207265 - DNA, 25 bp, Rattus norvegicus
attccagtctttctcgcagtggtaa

SEQ ID NO: 207266 - DNA, 25 bp, Rattus norvegicus
attccagtctttgtcgcagtggtaa

SEQ ID NO: 207267 - DNA, 25 bp, Rattus norvegicus
attccagtgcctactcagtcaataa

SEQ ID NO: 207268 - DNA, 25 bp, Rattus norvegicus
attccagtgcctatgccaatgtttt

SEQ ID NO: 207269 - DNA, 25 bp, Rattus norvegicus
attccagtgccttctcagtcaataa

SEQ ID NO: 207270 - DNA, 25 bp, Rattus norvegicus
attccagtgcctttgccaatgtttt

SEQ ID NO: 207271 - DNA, 25 bp, Rattus norvegicus
attccagtggctctctgggcatcca

SEQ ID NO: 207272 - DNA, 25 bp, Rattus norvegicus
attccagtggctgtctgggcatcca

SEQ ID NO: 207273 - DNA, 25 bp, Rattus norvegicus
attccagtgtctcttgcacaactga

SEQ ID NO: 207274 - DNA, 25 bp, Rattus norvegicus
attccagtgtctgttgcacaactga

SEQ ID NO: 207275 - DNA, 25 bp, Rattus norvegicus
attccagttactccagcaatgcagg

SEQ ID NO: 207276 - DNA, 25 bp, Rattus norvegicus
attccagttactgcagcaatgcagg

SEQ ID NO: 207277 - DNA, 25 bp, Rattus norvegicus
attccagttccgcacgcgttgggat

SEQ ID NO: 207278 - DNA, 25 bp, Rattus norvegicus
attccagttccggacgcgttgggat

SEQ ID NO: 207279 - DNA, 25 bp, Rattus norvegicus
attccagttcctagacctcatggct

SEQ ID NO: 207280 - DNA, 25 bp, Rattus norvegicus
attccagttccttgacctcatggct

SEQ ID NO: 207281 - DNA, 25 bp, Rattus norvegicus
attccagttcttccgaaagctcttg

SEQ ID NO: 207282 - DNA, 25 bp, Rattus norvegicus
attccagttcttgcgaaagctcttg

SEQ ID NO: 207283 - DNA, 25 bp, Rattus norvegicus
attccagtttataagccttcccgag

SEQ ID NO: 207284 - DNA, 25 bp, Rattus norvegicus
attccagtttattagccttcccgag

SEQ ID NO: 207285 - DNA, 25 bp, Rattus norvegicus
attccagttttacatcattgcagac

SEQ ID NO: 207286 - DNA, 25 bp, Rattus norvegicus
attccagttttagatcattgcagac

SEQ ID NO: 207287 - DNA, 25 bp, Rattus norvegicus
attccatacttcacgttcctagata

SEQ ID NO: 207288 - DNA, 25 bp, Rattus norvegicus
attccatacttctcgttcctagata

SEQ ID NO: 207289 - DNA, 25 bp, Rattus norvegicus
attccatagtccatagtcaacctca

SEQ ID NO: 207290 - DNA, 25 bp, Rattus norvegicus
attccatagtccttagtcaacctca

SEQ ID NO: 207291 - DNA, 25 bp, Rattus norvegicus
attccatatcctcattatgcactcc

SEQ ID NO: 207292 - DNA, 25 bp, Rattus norvegicus
attccatatcctgattatgcactcc

SEQ ID NO: 207293 - DNA, 25 bp, Rattus norvegicus
attccatcaagactacatctaccgc

SEQ ID NO: 207294 - DNA, 25 bp, Rattus norvegicus
attccatcaagagtacatctaccgc

SEQ ID NO: 207295 - DNA, 25 bp, Rattus norvegicus
attccatccagtcaaggctgtggca

SEQ ID NO: 207296 - DNA, 25 bp, Rattus norvegicus
attccatccagtgaaggctgtggca

SEQ ID NO: 207297 - DNA, 25 bp, Rattus norvegicus
attccatccattaaccatttgctac

SEQ ID NO: 207298 - DNA, 25 bp, Rattus norvegicus
attccatccatttaccatttgctac

SEQ ID NO: 207299 - DNA, 25 bp, Rattus norvegicus
attccatcccctattcatggaggaa

SEQ ID NO: 207300 - DNA, 25 bp, Rattus norvegicus
attccatccccttttcatggaggaa

SEQ ID NO: 207301 - DNA, 25 bp, Rattus norvegicus
attccatccctaatttcagcagagt

SEQ ID NO: 207302 - DNA, 25 bp, Rattus norvegicus
attccatccctattttcagcagagt

SEQ ID NO: 207303 - DNA, 25 bp, Rattus norvegicus
attccatctcaccacccatgaggta

SEQ ID NO: 207304 - DNA, 25 bp, Rattus norvegicus
attccatctcacgacccatgaggta

SEQ ID NO: 207305 - DNA, 25 bp, Rattus norvegicus
attccatctgacatcagcttggcga

SEQ ID NO: 207306 - DNA, 25 bp, Rattus norvegicus
attccatctgacttcagcttggcga

SEQ ID NO: 207307 - DNA, 25 bp, Rattus norvegicus
attccatctgccagtatacctacaa

SEQ ID NO: 207308 - DNA, 25 bp, Rattus norvegicus
attccatctgcctgtatacctacaa

SEQ ID NO: 207309 - DNA, 25 bp, Rattus norvegicus
attccatctgtgatgtcgtttctga

SEQ ID NO: 207310 - DNA, 25 bp, Rattus norvegicus
attccatctgtgttgtcgtttctga

SEQ ID NO: 207311 - DNA, 25 bp, Rattus norvegicus
attccatgagtcacatagctactta

SEQ ID NO: 207312 - DNA, 25 bp, Rattus norvegicus
attccatgagtctcatagctactta

SEQ ID NO: 207313 - DNA, 25 bp, Rattus norvegicus
attccatgagttaaagggcttgtct

SEQ ID NO: 207314 - DNA, 25 bp, Rattus norvegicus
attccatgagtttaagggcttgtct

SEQ ID NO: 207315 - DNA, 25 bp, Rattus norvegicus
attccatgattgctgggcaggccta

SEQ ID NO: 207316 - DNA, 25 bp, Rattus norvegicus
attccatgattggtgggcaggccta

SEQ ID NO: 207317 - DNA, 25 bp, Rattus norvegicus
attccatgccagcacagggatgatt

SEQ ID NO: 207318 - DNA, 25 bp, Rattus norvegicus
attccatgccaggacagggatgatt

SEQ ID NO: 207319 - DNA, 25 bp, Rattus norvegicus
attccatgctttcaggtgtcccaag

SEQ ID NO: 207320 - DNA, 25 bp, Rattus norvegicus
attccatgctttgaggtgtcccaag

SEQ ID NO: 207321 - DNA, 25 bp, Rattus norvegicus
attccatgggacaagacacatttat

SEQ ID NO: 207322 - DNA, 25 bp, Rattus norvegicus
attccatgggactagacacatttat

SEQ ID NO: 207323 - DNA, 25 bp, Rattus norvegicus
attccatgtacacggcagcaacggt

SEQ ID NO: 207324 - DNA, 25 bp, Rattus norvegicus
attccatgtacagggcagcaacggt

SEQ ID NO: 207325 - DNA, 25 bp, Rattus norvegicus
attccatgtgataagctctcaaccc

SEQ ID NO: 207326 - DNA, 25 bp, Rattus norvegicus
attccatgtgattagctctcaaccc

SEQ ID NO: 207327 - DNA, 25 bp, Rattus norvegicus
attccattcactcttgctttatcca

SEQ ID NO: 207328 - DNA, 25 bp, Rattus norvegicus
attccattcactgttgctttatcca

SEQ ID NO: 207329 - DNA, 25 bp, Rattus norvegicus
attccattcggaattgttgaaccaa

SEQ ID NO: 207330 - DNA, 25 bp, Rattus norvegicus
attccattcggatttgttgaaccaa

SEQ ID NO: 207331 - DNA, 25 bp, Rattus norvegicus
attccattctatcatcttttttcag

SEQ ID NO: 207332 - DNA, 25 bp, Rattus norvegicus
attccattctatgatcttttttcag

SEQ ID NO: 207333 - DNA, 25 bp, Rattus norvegicus
attccattctctctgtgtcctaaaa

SEQ ID NO: 207334 - DNA, 25 bp, Rattus norvegicus
attccattctctgtgtgtcctaaaa

SEQ ID NO: 207335 - DNA, 25 bp, Rattus norvegicus
attccattctttagcacttaccttg

SEQ ID NO: 207336 - DNA, 25 bp, Rattus norvegicus
attccattcttttgcacttaccttg

SEQ ID NO: 207337 - DNA, 25 bp, Rattus norvegicus
attccatttcccacagctgaatact

SEQ ID NO: 207338 - DNA, 25 bp, Rattus norvegicus
attccatttccctcagctgaatact

SEQ ID NO: 207339 - DNA, 25 bp, Rattus norvegicus
attccattttccagactgggatcca

SEQ ID NO: 207340 - DNA, 25 bp, Rattus norvegicus
attccattttcctgactgggatcca

SEQ ID NO: 207341 - DNA, 25 bp, Rattus norvegicus
attccattttgaactccaggatgtc

SEQ ID NO: 207342 - DNA, 25 bp, Rattus norvegicus
attccattttgatctccaggatgtc

SEQ ID NO: 207343 - DNA, 25 bp, Rattus norvegicus
attcccaagtagaagacagtctcca

SEQ ID NO: 207344 - DNA, 25 bp, Rattus norvegicus
attcccaagtagtagacagtctcca

SEQ ID NO: 207345 - DNA, 25 bp, Rattus norvegicus
attcccaatagtagccaggctagaa

SEQ ID NO: 207346 - DNA, 25 bp, Rattus norvegicus
attcccaatagttgccaggctagaa

SEQ ID NO: 207347 - DNA, 25 bp, Rattus norvegicus
attcccaattctattcttttcctgt

SEQ ID NO: 207348 - DNA, 25 bp, Rattus norvegicus
attcccaattcttttcttttcctgt

SEQ ID NO: 207349 - DNA, 25 bp, Rattus norvegicus
attcccacaccaacaaggctaaaga

SEQ ID NO: 207350 - DNA, 25 bp, Rattus norvegicus
attcccacaccatcaaggctaaaga

SEQ ID NO: 207351 - DNA, 25 bp, Rattus norvegicus
attcccaccactcaggcgttggtta

SEQ ID NO: 207352 - DNA, 25 bp, Rattus norvegicus
attcccaccactgaggcgttggtta

SEQ ID NO: 207353 - DNA, 25 bp, Rattus norvegicus
attcccacgggtcgcttgatctatg

SEQ ID NO: 207354 - DNA, 25 bp, Rattus norvegicus
attcccacgggtggcttgatctatg

SEQ ID NO: 207355 - DNA, 25 bp, Rattus norvegicus
attcccactcttatagagattgttt

SEQ ID NO: 207356 - DNA, 25 bp, Rattus norvegicus
attcccactcttcattcttgatggg

SEQ ID NO: 207357 - DNA, 25 bp, Rattus norvegicus
attcccactcttgattcttgatggg

SEQ ID NO: 207358 - DNA, 25 bp, Rattus norvegicus
attcccactcttttagagattgttt

SEQ ID NO: 207359 - DNA, 25 bp, Rattus norvegicus
attcccactggtcattaccgcaagg

SEQ ID NO: 207360 - DNA, 25 bp, Rattus norvegicus
attcccactggtgattaccgcaagg

SEQ ID NO: 207361 - DNA, 25 bp, Rattus norvegicus
attcccacttgcatccaacttgatt

SEQ ID NO: 207362 - DNA, 25 bp, Rattus norvegicus
attcccacttgcttccaacttgatt

SEQ ID NO: 207363 - DNA, 25 bp, Rattus norvegicus
attcccagagctagtccagggctga

SEQ ID NO: 207364 - DNA, 25 bp, Rattus norvegicus
attcccagagctagttccctgagtg

SEQ ID NO: 207365 - DNA, 25 bp, Rattus norvegicus
attcccagagcttgtccagggctga

SEQ ID NO: 207366 - DNA, 25 bp, Rattus norvegicus
attcccagagcttgttccctgagtg

SEQ ID NO: 207367 - DNA, 25 bp, Rattus norvegicus
attcccagataaagcacacatgatt

SEQ ID NO: 207368 - DNA, 25 bp, Rattus norvegicus
attcccagataatgcacacatgatt

SEQ ID NO: 207369 - DNA, 25 bp, Rattus norvegicus
attcccagatgaattcgtctttgat

SEQ ID NO: 207370 - DNA, 25 bp, Rattus norvegicus
attcccagatgatttcgtctttgat

SEQ ID NO: 207371 - DNA, 25 bp, Rattus norvegicus
attcccagcagcctgaatctactta

SEQ ID NO: 207372 - DNA, 25 bp, Rattus norvegicus
attcccagcagcgtgaatctactta

SEQ ID NO: 207373 - DNA, 25 bp, Rattus norvegicus
attcccagcggccaggatcttggag

SEQ ID NO: 207374 - DNA, 25 bp, Rattus norvegicus
attcccagcggcgaggatcttggag

SEQ ID NO: 207375 - DNA, 25 bp, Rattus norvegicus
attcccagcttcagaccagggtaaa

SEQ ID NO: 207376 - DNA, 25 bp, Rattus norvegicus
attcccagcttctgaccagggtaaa

SEQ ID NO: 207377 - DNA, 25 bp, Rattus norvegicus
attcccaggctgctattaatccatc

SEQ ID NO: 207378 - DNA, 25 bp, Rattus norvegicus
attcccaggctggtattaatccatc

SEQ ID NO: 207379 - DNA, 25 bp, Rattus norvegicus
attcccagggacattcgatcattgc

SEQ ID NO: 207380 - DNA, 25 bp, Rattus norvegicus
attcccagggactttcgatcattgc

SEQ ID NO: 207381 - DNA, 25 bp, Rattus norvegicus
attcccagggccatattatgcctag

SEQ ID NO: 207382 - DNA, 25 bp, Rattus norvegicus
attcccagggccttattatgcctag

SEQ ID NO: 207383 - DNA, 25 bp, Rattus norvegicus
attcccagtagaccgcgtggacggt

SEQ ID NO: 207384 - DNA, 25 bp, Rattus norvegicus
attcccagtagagcgcgtggacggt

SEQ ID NO: 207385 - DNA, 25 bp, Rattus norvegicus
attcccagtagcaaatgctaggtta

SEQ ID NO: 207386 - DNA, 25 bp, Rattus norvegicus
attcccagtagctaatgctaggtta

SEQ ID NO: 207387 - DNA, 25 bp, Rattus norvegicus
attcccagtccaacacaagaacgtg

SEQ ID NO: 207388 - DNA, 25 bp, Rattus norvegicus
attcccagtccatcacaagaacgtg

SEQ ID NO: 207389 - DNA, 25 bp, Rattus norvegicus
attcccagtgagaatgtttggtcct

SEQ ID NO: 207390 - DNA, 25 bp, Rattus norvegicus
attcccagtgagtatgtttggtcct

SEQ ID NO: 207391 - DNA, 25 bp, Rattus norvegicus
attcccagtttaaagtccaagtgct

SEQ ID NO: 207392 - DNA, 25 bp, Rattus norvegicus
attcccagtttatagtccaagtgct

SEQ ID NO: 207393 - DNA, 25 bp, Rattus norvegicus
attcccatagttctctctgcatttc

SEQ ID NO: 207394 - DNA, 25 bp, Rattus norvegicus
attcccatagttgtctctgcatttc

SEQ ID NO: 207395 - DNA, 25 bp, Rattus norvegicus
attcccatatccacagtatgcactc

SEQ ID NO: 207396 - DNA, 25 bp, Rattus norvegicus
attcccatatcctcagtatgcactc

SEQ ID NO: 207397 - DNA, 25 bp, Rattus norvegicus
attcccatccatatgccaagacttt

SEQ ID NO: 207398 - DNA, 25 bp, Rattus norvegicus
attcccatccatttgccaagacttt

SEQ ID NO: 207399 - DNA, 25 bp, Rattus norvegicus
attcccatctgtaattttatctgag

SEQ ID NO: 207400 - DNA, 25 bp, Rattus norvegicus
attcccatctgttattttatctgag

SEQ ID NO: 207401 - DNA, 25 bp, Rattus norvegicus
attcccatcttgcttcatgctgaac

SEQ ID NO: 207402 - DNA, 25 bp, Rattus norvegicus
attcccatcttggttcatgctgaac

SEQ ID NO: 207403 - DNA, 25 bp, Rattus norvegicus
attcccatgagtatccgtcgtgttc

SEQ ID NO: 207404 - DNA, 25 bp, Rattus norvegicus
attcccatgagtttccgtcgtgttc

SEQ ID NO: 207405 - DNA, 25 bp, Rattus norvegicus
attcccatggatatgttgccttgcg

SEQ ID NO: 207406 - DNA, 25 bp, Rattus norvegicus
attcccatggatttgttgccttgcg

SEQ ID NO: 207407 - DNA, 25 bp, Rattus norvegicus
attcccatgggcatctcagttgctg

SEQ ID NO: 207408 - DNA, 25 bp, Rattus norvegicus
attcccatgggcttctcagttgctg

SEQ ID NO: 207409 - DNA, 25 bp, Rattus norvegicus
attcccattgaacatctcagtgctg

SEQ ID NO: 207410 - DNA, 25 bp, Rattus norvegicus
attcccattgaagatctcagtgctg

SEQ ID NO: 207411 - DNA, 25 bp, Rattus norvegicus
attcccattgatctttccttgttac

SEQ ID NO: 207412 - DNA, 25 bp, Rattus norvegicus
attcccattgatgtttccttgttac

SEQ ID NO: 207413 - DNA, 25 bp, Rattus norvegicus
attcccatttccagttggagcctgt

SEQ ID NO: 207414 - DNA, 25 bp, Rattus norvegicus
attcccatttcctgttggagcctgt

SEQ ID NO: 207415 - DNA, 25 bp, Rattus norvegicus
attccccaaccaactacttgaggta

SEQ ID NO: 207416 - DNA, 25 bp, Rattus norvegicus
attccccaaccatctacttgaggta

SEQ ID NO: 207417 - DNA, 25 bp, Rattus norvegicus
attccccaagaaattcatgtcagtg

SEQ ID NO: 207418 - DNA, 25 bp, Rattus norvegicus
attccccaagaatttcatgtcagtg

SEQ ID NO: 207419 - DNA, 25 bp, Rattus norvegicus
attccccacaatactgatgcacttt

SEQ ID NO: 207420 - DNA, 25 bp, Rattus norvegicus
attccccacaattctgatgcacttt

SEQ ID NO: 207421 - DNA, 25 bp, Rattus norvegicus
attccccaccttagtaatacatttg

SEQ ID NO: 207422 - DNA, 25 bp, Rattus norvegicus
attccccacctttgtaatacatttg

SEQ ID NO: 207423 - DNA, 25 bp, Rattus norvegicus
attccccactttccctagacaaggt

SEQ ID NO: 207424 - DNA, 25 bp, Rattus norvegicus
attccccactttgcctagacaaggt

SEQ ID NO: 207425 - DNA, 25 bp, Rattus norvegicus
attccccagcttagcttgtgggtca

SEQ ID NO: 207426 - DNA, 25 bp, Rattus norvegicus
attccccagctttgcttgtgggtca

SEQ ID NO: 207427 - DNA, 25 bp, Rattus norvegicus
attccccaggacatctgcatattta

SEQ ID NO: 207428 - DNA, 25 bp, Rattus norvegicus
attccccaggacttctgcatattta

SEQ ID NO: 207429 - DNA, 25 bp, Rattus norvegicus
attccccagggtacagtgttaccat

SEQ ID NO: 207430 - DNA, 25 bp, Rattus norvegicus
attccccagggttcagtgttaccat

SEQ ID NO: 207431 - DNA, 25 bp, Rattus norvegicus
attccccatcttaccacatttaatg

SEQ ID NO: 207432 - DNA, 25 bp, Rattus norvegicus
attccccatctttccacatttaatg

SEQ ID NO: 207433 - DNA, 25 bp, Rattus norvegicus
attccccatgacagaaagcccttct

SEQ ID NO: 207434 - DNA, 25 bp, Rattus norvegicus
attccccatgactgaaagcccttct

SEQ ID NO: 207435 - DNA, 25 bp, Rattus norvegicus
attccccatggaactctgaattcct

SEQ ID NO: 207436 - DNA, 25 bp, Rattus norvegicus
attccccatggatctctgaattcct

SEQ ID NO: 207437 - DNA, 25 bp, Rattus norvegicus
attccccgagatactaatgcaagag

SEQ ID NO: 207438 - DNA, 25 bp, Rattus norvegicus
attccccgagattctaatgcaagag

SEQ ID NO: 207439 - DNA, 25 bp, Rattus norvegicus
attccccgcactcagttgagcagct

SEQ ID NO: 207440 - DNA, 25 bp, Rattus norvegicus
attccccgcactgagttgagcagct

SEQ ID NO: 207441 - DNA, 25 bp, Rattus norvegicus
attccccggattctcggccaggaga

SEQ ID NO: 207442 - DNA, 25 bp, Rattus norvegicus
attccccggattgtcggccaggaga

SEQ ID NO: 207443 - DNA, 25 bp, Rattus norvegicus
attccccgtaggcaaaggtcgctag

SEQ ID NO: 207444 - DNA, 25 bp, Rattus norvegicus
attccccgtaggctagagtgtctaa

SEQ ID NO: 207445 - DNA, 25 bp, Rattus norvegicus
attccccgtagggaaaggtcgctag

SEQ ID NO: 207446 - DNA, 25 bp, Rattus norvegicus
attccccgtagggtagagtgtctaa

SEQ ID NO: 207447 - DNA, 25 bp, Rattus norvegicus
attcccctacgaacatgcactgaag

SEQ ID NO: 207448 - DNA, 25 bp, Rattus norvegicus
attcccctacgatcatgcactgaag

SEQ ID NO: 207449 - DNA, 25 bp, Rattus norvegicus
attcccctcctcatgaatctagaag

SEQ ID NO: 207450 - DNA, 25 bp, Rattus norvegicus
attcccctcctcttgaatctagaag

SEQ ID NO: 207451 - DNA, 25 bp, Rattus norvegicus
attcccctgaaaagctttgtataac

SEQ ID NO: 207452 - DNA, 25 bp, Rattus norvegicus
attcccctgaaatgctttgtataac

SEQ ID NO: 207453 - DNA, 25 bp, Rattus norvegicus
attcccctgattaatttcctgagtg

SEQ ID NO: 207454 - DNA, 25 bp, Rattus norvegicus
attcccctgattctcccagggcttt

SEQ ID NO: 207455 - DNA, 25 bp, Rattus norvegicus
attcccctgattgtcccagggcttt

SEQ ID NO: 207456 - DNA, 25 bp, Rattus norvegicus
attcccctgatttatttcctgagtg

SEQ ID NO: 207457 - DNA, 25 bp, Rattus norvegicus
attcccctgtagatggttgtgtgcc

SEQ ID NO: 207458 - DNA, 25 bp, Rattus norvegicus
attcccctgtagttggttgtgtgcc

SEQ ID NO: 207459 - DNA, 25 bp, Rattus norvegicus
attcccctgtgcaagaaacatctgg

SEQ ID NO: 207460 - DNA, 25 bp, Rattus norvegicus
attcccctgtgctagaaacatctgg

SEQ ID NO: 207461 - DNA, 25 bp, Rattus norvegicus
attccccttatccaaactgtgcaaa

SEQ ID NO: 207462 - DNA, 25 bp, Rattus norvegicus
attccccttatcgaaactgtgcaaa

SEQ ID NO: 207463 - DNA, 25 bp, Rattus norvegicus
attccccttgaccagcaggttgaag

SEQ ID NO: 207464 - DNA, 25 bp, Rattus norvegicus
attccccttgacgagcaggttgaag

SEQ ID NO: 207465 - DNA, 25 bp, Rattus norvegicus
attccccttgcccatcagagaggag

SEQ ID NO: 207466 - DNA, 25 bp, Rattus norvegicus
attccccttgccgatcagagaggag

SEQ ID NO: 207467 - DNA, 25 bp, Rattus norvegicus
attccccttgggagaggatgactgt

SEQ ID NO: 207468 - DNA, 25 bp, Rattus norvegicus
attccccttgggtgaggatgactgt

SEQ ID NO: 207469 - DNA, 25 bp, Rattus norvegicus
attcccctttggaacacgtgacttg

SEQ ID NO: 207470 - DNA, 25 bp, Rattus norvegicus
attcccctttggtacacgtgacttg

SEQ ID NO: 207471 - DNA, 25 bp, Rattus norvegicus
attcccgacagacactgccttgttt

SEQ ID NO: 207472 - DNA, 25 bp, Rattus norvegicus
attcccgacagagactgccttgttt

SEQ ID NO: 207473 - DNA, 25 bp, Rattus norvegicus
attcccgaggcaatgcaagtgccca

SEQ ID NO: 207474 - DNA, 25 bp, Rattus norvegicus
attcccgaggcattgcaagtgccca

SEQ ID NO: 207475 - DNA, 25 bp, Rattus norvegicus
attcccgaggctcatcagactatga

SEQ ID NO: 207476 - DNA, 25 bp, Rattus norvegicus
attcccgaggctgatcagactatga

SEQ ID NO: 207477 - DNA, 25 bp, Rattus norvegicus
attcccgagtagattttcctcatag

SEQ ID NO: 207478 - DNA, 25 bp, Rattus norvegicus
attcccgagtagtttttcctcatag

SEQ ID NO: 207479 - DNA, 25 bp, Rattus norvegicus
attcccgatcagactctcttacttc

SEQ ID NO: 207480 - DNA, 25 bp, Rattus norvegicus
attcccgatcagtctctcttacttc

SEQ ID NO: 207481 - DNA, 25 bp, Rattus norvegicus
attcccgatgacatacacgtttgag

SEQ ID NO: 207482 - DNA, 25 bp, Rattus norvegicus
attcccgatgacttacacgtttgag

SEQ ID NO: 207483 - DNA, 25 bp, Rattus norvegicus
attcccgcagcaagtatactggttg

SEQ ID NO: 207484 - DNA, 25 bp, Rattus norvegicus
attcccgcagcatgtatactggttg

SEQ ID NO: 207485 - DNA, 25 bp, Rattus norvegicus
attcccgcaggcagaaccagaagag

SEQ ID NO: 207486 - DNA, 25 bp, Rattus norvegicus
attcccgcaggctgaaccagaagag

SEQ ID NO: 207487 - DNA, 25 bp, Rattus norvegicus
attcccgcagttagcaagaccagga

SEQ ID NO: 207488 - DNA, 25 bp, Rattus norvegicus
attcccgcagtttgcaagaccagga

SEQ ID NO: 207489 - DNA, 25 bp, Rattus norvegicus
attcccgcccaactgagaatgtaca

SEQ ID NO: 207490 - DNA, 25 bp, Rattus norvegicus
attcccgcccaagtgagaatgtaca

SEQ ID NO: 207491 - DNA, 25 bp, Rattus norvegicus
attcccgcctagacatggctctgag

SEQ ID NO: 207492 - DNA, 25 bp, Rattus norvegicus
attcccgcctagtcatggctctgag

SEQ ID NO: 207493 - DNA, 25 bp, Rattus norvegicus
attcccggaaggctatgaggagtta

SEQ ID NO: 207494 - DNA, 25 bp, Rattus norvegicus
attcccggaagggtatgaggagtta

SEQ ID NO: 207495 - DNA, 25 bp, Rattus norvegicus
attcccggcctgacgctatggcgat

SEQ ID NO: 207496 - DNA, 25 bp, Rattus norvegicus
attcccggcctgtcgctatggcgat

SEQ ID NO: 207497 - DNA, 25 bp, Rattus norvegicus
attcccggccttactgatcacagta

SEQ ID NO: 207498 - DNA, 25 bp, Rattus norvegicus
attcccggcctttctgatcacagta

SEQ ID NO: 207499 - DNA, 25 bp, Rattus norvegicus
attcccgggcttcaatcacagtgca

SEQ ID NO: 207500 - DNA, 25 bp, Rattus norvegicus
attcccgggcttgaatcacagtgca

SEQ ID NO: 207501 - DNA, 25 bp, Rattus norvegicus
attcccggtagaataatgttgtgac

SEQ ID NO: 207502 - DNA, 25 bp, Rattus norvegicus
attcccggtagattaatgttgtgac

SEQ ID NO: 207503 - DNA, 25 bp, Rattus norvegicus
attcccggttgcatcggtggccaca

SEQ ID NO: 207504 - DNA, 25 bp, Rattus norvegicus
attcccggttgcttcggtggccaca

SEQ ID NO: 207505 - DNA, 25 bp, Rattus norvegicus
attcccgtcacaatacatcaggttg

SEQ ID NO: 207506 - DNA, 25 bp, Rattus norvegicus
attcccgtcacattacatcaggttg

SEQ ID NO: 207507 - DNA, 25 bp, Rattus norvegicus
attcccgtgggtcttatcatccctg

SEQ ID NO: 207508 - DNA, 25 bp, Rattus norvegicus
attcccgtgggtgttatcatccctg

SEQ ID NO: 207509 - DNA, 25 bp, Rattus norvegicus
attcccgtgtacatgacacaaggtt

SEQ ID NO: 207510 - DNA, 25 bp, Rattus norvegicus
attcccgtgtacttgacacaaggtt

SEQ ID NO: 207511 - DNA, 25 bp, Rattus norvegicus
attcccgtgtgtcacatgtgcacat

SEQ ID NO: 207512 - DNA, 25 bp, Rattus norvegicus
attcccgtgtgtgacatgtgcacat

SEQ ID NO: 207513 - DNA, 25 bp, Rattus norvegicus
attcccgttgaaaactattgcgcag

SEQ ID NO: 207514 - DNA, 25 bp, Rattus norvegicus
attcccgttgaatactattgcgcag

SEQ ID NO: 207515 - DNA, 25 bp, Rattus norvegicus
attccctaaccactcaaagcattgt

SEQ ID NO: 207516 - DNA, 25 bp, Rattus norvegicus
attccctaaccagtcaaagcattgt

SEQ ID NO: 207517 - DNA, 25 bp, Rattus norvegicus
attccctaagagatccgagctgttt

SEQ ID NO: 207518 - DNA, 25 bp, Rattus norvegicus
attccctaagagttccgagctgttt

SEQ ID NO: 207519 - DNA, 25 bp, Rattus norvegicus
attccctactgccagagccaatcag

SEQ ID NO: 207520 - DNA, 25 bp, Rattus norvegicus
attccctactgcgagagccaatcag

SEQ ID NO: 207521 - DNA, 25 bp, Rattus norvegicus
attccctagcgactagacattcagt

SEQ ID NO: 207522 - DNA, 25 bp, Rattus norvegicus
attccctagcgagtagacattcagt

SEQ ID NO: 207523 - DNA, 25 bp, Rattus norvegicus
attccctagggtacttcatatggtg

SEQ ID NO: 207524 - DNA, 25 bp, Rattus norvegicus
attccctagggttcttcatatggtg

SEQ ID NO: 207525 - DNA, 25 bp, Rattus norvegicus
attccctagtccctttggctgtgtt

SEQ ID NO: 207526 - DNA, 25 bp, Rattus norvegicus
attccctagtccgtttggctgtgtt

SEQ ID NO: 207527 - DNA, 25 bp, Rattus norvegicus
attccctatgtgctctgagtctcag

SEQ ID NO: 207528 - DNA, 25 bp, Rattus norvegicus
attccctatgtggtctgagtctcag

SEQ ID NO: 207529 - DNA, 25 bp, Rattus norvegicus
attccctcatcgcacagcacagaga

SEQ ID NO: 207530 - DNA, 25 bp, Rattus norvegicus
attccctcatcggacagcacagaga

SEQ ID NO: 207531 - DNA, 25 bp, Rattus norvegicus
attccctcatctctataactctaaa

SEQ ID NO: 207532 - DNA, 25 bp, Rattus norvegicus
attccctcatctgtataactctaaa

SEQ ID NO: 207533 - DNA, 25 bp, Rattus norvegicus
attccctcctaaactactgatctga

SEQ ID NO: 207534 - DNA, 25 bp, Rattus norvegicus
attccctcctaatctactgatctga

SEQ ID NO: 207535 - DNA, 25 bp, Rattus norvegicus
attccctcctgtcaagtgagtctca

SEQ ID NO: 207536 - DNA, 25 bp, Rattus norvegicus
attccctcctgtgaagtgagtctca

SEQ ID NO: 207537 - DNA, 25 bp, Rattus norvegicus
attccctctcatctgttcatctgtt

SEQ ID NO: 207538 - DNA, 25 bp, Rattus norvegicus
attccctctcatgtgttcatctgtt

SEQ ID NO: 207539 - DNA, 25 bp, Rattus norvegicus
attccctctcgcctgagttaagtaa

SEQ ID NO: 207540 - DNA, 25 bp, Rattus norvegicus
attccctctcgcgtgagttaagtaa

SEQ ID NO: 207541 - DNA, 25 bp, Rattus norvegicus
attccctctggaacccagtattagg

SEQ ID NO: 207542 - DNA, 25 bp, Rattus norvegicus
attccctctggatcccagtattagg

SEQ ID NO: 207543 - DNA, 25 bp, Rattus norvegicus
attccctctgtcagcctgtgtaagt

SEQ ID NO: 207544 - DNA, 25 bp, Rattus norvegicus
attccctctgtctgcctgtgtaagt

SEQ ID NO: 207545 - DNA, 25 bp, Rattus norvegicus
attccctctgtgctactggaaggct

SEQ ID NO: 207546 - DNA, 25 bp, Rattus norvegicus
attccctctgtggtactggaaggct

SEQ ID NO: 207547 - DNA, 25 bp, Rattus norvegicus
attccctcttaactgttcctcatgt

SEQ ID NO: 207548 - DNA, 25 bp, Rattus norvegicus
attccctcttaagtgttcctcatgt

SEQ ID NO: 207549 - DNA, 25 bp, Rattus norvegicus
attccctgacccagaaattgtagga

SEQ ID NO: 207550 - DNA, 25 bp, Rattus norvegicus
attccctgaccctgaaattgtagga

SEQ ID NO: 207551 - DNA, 25 bp, Rattus norvegicus
attccctgaggtccctaggtcaagg

SEQ ID NO: 207552 - DNA, 25 bp, Rattus norvegicus
attccctgaggtgcctaggtcaagg

SEQ ID NO: 207553 - DNA, 25 bp, Rattus norvegicus
attccctgatctatagcactttctt

SEQ ID NO: 207554 - DNA, 25 bp, Rattus norvegicus
attccctgatctttagcactttctt

SEQ ID NO: 207555 - DNA, 25 bp, Rattus norvegicus
attccctgctttcgagaacccttag

SEQ ID NO: 207556 - DNA, 25 bp, Rattus norvegicus
attccctgctttggagaacccttag

SEQ ID NO: 207557 - DNA, 25 bp, Rattus norvegicus
attccctggcctctgccataatttg

SEQ ID NO: 207558 - DNA, 25 bp, Rattus norvegicus
attccctggcctgtgccataatttg

SEQ ID NO: 207559 - DNA, 25 bp, Rattus norvegicus
attccctgtcatatcttgagcgtga

SEQ ID NO: 207560 - DNA, 25 bp, Rattus norvegicus
attccctgtcatttcttgagcgtga

SEQ ID NO: 207561 - DNA, 25 bp, Rattus norvegicus
attccctgtctgaaagttgcactgt

SEQ ID NO: 207562 - DNA, 25 bp, Rattus norvegicus
attccctgtctgtaagttgcactgt

SEQ ID NO: 207563 - DNA, 25 bp, Rattus norvegicus
attccctgtggaaacttagccattt

SEQ ID NO: 207564 - DNA, 25 bp, Rattus norvegicus
attccctgtggatacttagccattt

SEQ ID NO: 207565 - DNA, 25 bp, Rattus norvegicus
attccctgtgttaagcagatgtgtt

SEQ ID NO: 207566 - DNA, 25 bp, Rattus norvegicus
attccctgtgtttagcagatgtgtt

SEQ ID NO: 207567 - DNA, 25 bp, Rattus norvegicus
attccctgttctaaagttcatgcgg

SEQ ID NO: 207568 - DNA, 25 bp, Rattus norvegicus
attccctgttcttaagttcatgcgg

SEQ ID NO: 207569 - DNA, 25 bp, Rattus norvegicus
attccctgtttacgcagctcctgca

SEQ ID NO: 207570 - DNA, 25 bp, Rattus norvegicus
attccctgtttaggcagctcctgca

SEQ ID NO: 207571 - DNA, 25 bp, Rattus norvegicus
attcccttaaggatgagactgtagt

SEQ ID NO: 207572 - DNA, 25 bp, Rattus norvegicus
attcccttaaggttgagactgtagt

SEQ ID NO: 207573 - DNA, 25 bp, Rattus norvegicus
attcccttaccaccatggcagtgtg

SEQ ID NO: 207574 - DNA, 25 bp, Rattus norvegicus
attcccttaccagcatggcagtgtg

SEQ ID NO: 207575 - DNA, 25 bp, Rattus norvegicus
attcccttcaagcagggcactgctt

SEQ ID NO: 207576 - DNA, 25 bp, Rattus norvegicus
attcccttcaaggagggcactgctt

SEQ ID NO: 207577 - DNA, 25 bp, Rattus norvegicus
attcccttcactctgattcccagtg

SEQ ID NO: 207578 - DNA, 25 bp, Rattus norvegicus
attcccttcactgtgattcccagtg

SEQ ID NO: 207579 - DNA, 25 bp, Rattus norvegicus
attcccttcatcctgcatgtgtgta

SEQ ID NO: 207580 - DNA, 25 bp, Rattus norvegicus
attcccttcatcgtgcatgtgtgta

SEQ ID NO: 207581 - DNA, 25 bp, Rattus norvegicus
attcccttcatgacagtagcgtagc

SEQ ID NO: 207582 - DNA, 25 bp, Rattus norvegicus
attcccttcatgtcagtagcgtagc

SEQ ID NO: 207583 - DNA, 25 bp, Rattus norvegicus
attcccttcgcaactggcagtaaag

SEQ ID NO: 207584 - DNA, 25 bp, Rattus norvegicus
attcccttcgcatctggcagtaaag

SEQ ID NO: 207585 - DNA, 25 bp, Rattus norvegicus
attcccttctttcagatatctctag

SEQ ID NO: 207586 - DNA, 25 bp, Rattus norvegicus
attcccttctttgagatatctctag

SEQ ID NO: 207587 - DNA, 25 bp, Rattus norvegicus
attcccttgtcgcatcagactgaac

SEQ ID NO: 207588 - DNA, 25 bp, Rattus norvegicus
attcccttgtcggatcagactgaac

SEQ ID NO: 207589 - DNA, 25 bp, Rattus norvegicus
attccctttgacaggaagtcactca

SEQ ID NO: 207590 - DNA, 25 bp, Rattus norvegicus
attccctttgactggaagtcactca

SEQ ID NO: 207591 - DNA, 25 bp, Rattus norvegicus
attccctttgtgatgttgtcattac

SEQ ID NO: 207592 - DNA, 25 bp, Rattus norvegicus
attccctttgtgttgttgtcattac

SEQ ID NO: 207593 - DNA, 25 bp, Rattus norvegicus
attccgaaaactcagtcaagccttg

SEQ ID NO: 207594 - DNA, 25 bp, Rattus norvegicus
attccgaaaactgagtcaagccttg

SEQ ID NO: 207595 - DNA, 25 bp, Rattus norvegicus
attccgaaagctcaagggaccacgt

SEQ ID NO: 207596 - DNA, 25 bp, Rattus norvegicus
attccgaaagctgaagggaccacgt

SEQ ID NO: 207597 - DNA, 25 bp, Rattus norvegicus
attccgaacttgcaggtgctttcag

SEQ ID NO: 207598 - DNA, 25 bp, Rattus norvegicus
attccgaacttggaggtgctttcag

SEQ ID NO: 207599 - DNA, 25 bp, Rattus norvegicus
attccgagcatcacttttccaaaga

SEQ ID NO: 207600 - DNA, 25 bp, Rattus norvegicus
attccgagcatctcttttccaaaga

SEQ ID NO: 207601 - DNA, 25 bp, Rattus norvegicus
attccgccacatattcctaggcaag

SEQ ID NO: 207602 - DNA, 25 bp, Rattus norvegicus
attccgccacattttcctaggcaag

SEQ ID NO: 207603 - DNA, 25 bp, Rattus norvegicus
attccgcgtgcgaaatggcggctta

SEQ ID NO: 207604 - DNA, 25 bp, Rattus norvegicus
attccgcgtgcgtaatggcggctta

SEQ ID NO: 207605 - DNA, 25 bp, Rattus norvegicus
attccgctctttcccaggaggtgag

SEQ ID NO: 207606 - DNA, 25 bp, Rattus norvegicus
attccgctctttgccaggaggtgag

SEQ ID NO: 207607 - DNA, 25 bp, Rattus norvegicus
attccggaactcaggaggctggcat

SEQ ID NO: 207608 - DNA, 25 bp, Rattus norvegicus
attccggaactctggaggctggcat

SEQ ID NO: 207609 - DNA, 25 bp, Rattus norvegicus
attccggcacatcttcaagcatctg

SEQ ID NO: 207610 - DNA, 25 bp, Rattus norvegicus
attccggcacatgttcaagcatctg

SEQ ID NO: 207611 - DNA, 25 bp, Rattus norvegicus
attccggcagtgagggcttacagta

SEQ ID NO: 207612 - DNA, 25 bp, Rattus norvegicus
attccggcagtgtgggcttacagta

SEQ ID NO: 207613 - DNA, 25 bp, Rattus norvegicus
attccgggcactcgtaaggtcgctc

SEQ ID NO: 207614 - DNA, 25 bp, Rattus norvegicus
attccgggcactggtaaggtcgctc

SEQ ID NO: 207615 - DNA, 25 bp, Rattus norvegicus
attccgggcattcctgcgcacagaa

SEQ ID NO: 207616 - DNA, 25 bp, Rattus norvegicus
attccgggcattgctgcgcacagaa

SEQ ID NO: 207617 - DNA, 25 bp, Rattus norvegicus
attccggtccgtatcagcaaggcaa

SEQ ID NO: 207618 - DNA, 25 bp, Rattus norvegicus
attccggtccgtttcagcaaggcaa

SEQ ID NO: 207619 - DNA, 25 bp, Rattus norvegicus
attccggtgctacacaagccaggtg

SEQ ID NO: 207620 - DNA, 25 bp, Rattus norvegicus
attccggtgctagacaagccaggtg

SEQ ID NO: 207621 - DNA, 25 bp, Rattus norvegicus
attccgtaattcatggtcgtacctg

SEQ ID NO: 207622 - DNA, 25 bp, Rattus norvegicus
attccgtaattcttggtcgtacctg

SEQ ID NO: 207623 - DNA, 25 bp, Rattus norvegicus
attccgtactgaacatcccaaatga

SEQ ID NO: 207624 - DNA, 25 bp, Rattus norvegicus
attccgtactgatcatcccaaatga

SEQ ID NO: 207625 - DNA, 25 bp, Rattus norvegicus
attccgtatcagctcccctacagga

SEQ ID NO: 207626 - DNA, 25 bp, Rattus norvegicus
attccgtatcaggtcccctacagga

SEQ ID NO: 207627 - DNA, 25 bp, Rattus norvegicus
attccgtcaatgatcatggctttaa

SEQ ID NO: 207628 - DNA, 25 bp, Rattus norvegicus
attccgtcaatgttcatggctttaa

SEQ ID NO: 207629 - DNA, 25 bp, Rattus norvegicus
attccgtcagcaataagagatttac

SEQ ID NO: 207630 - DNA, 25 bp, Rattus norvegicus
attccgtcagcattaagagatttac

SEQ ID NO: 207631 - DNA, 25 bp, Rattus norvegicus
attccgtcccaacatgtgctcatga

SEQ ID NO: 207632 - DNA, 25 bp, Rattus norvegicus
attccgtcccaagatgtgctcatga

SEQ ID NO: 207633 - DNA, 25 bp, Rattus norvegicus
attccgtcctacatccggtgatagt

SEQ ID NO: 207634 - DNA, 25 bp, Rattus norvegicus
attccgtcctacttccggtgatagt

SEQ ID NO: 207635 - DNA, 25 bp, Rattus norvegicus
attccgtggtccagaaggctgcctg

SEQ ID NO: 207636 - DNA, 25 bp, Rattus norvegicus
attccgtggtcctgaaggctgcctg

SEQ ID NO: 207637 - DNA, 25 bp, Rattus norvegicus
attccgtgtacccatagctgtagag

SEQ ID NO: 207638 - DNA, 25 bp, Rattus norvegicus
attccgtgtaccgatagctgtagag

SEQ ID NO: 207639 - DNA, 25 bp, Rattus norvegicus
attccgttgaacaagctgagacttt

SEQ ID NO: 207640 - DNA, 25 bp, Rattus norvegicus
attccgttgaactagctgagacttt

SEQ ID NO: 207641 - DNA, 25 bp, Rattus norvegicus
attccgtttcaactactgtgtgtaa

SEQ ID NO: 207642 - DNA, 25 bp, Rattus norvegicus
attccgtttcaagtactgtgtgtaa

SEQ ID NO: 207643 - DNA, 25 bp, Rattus norvegicus
attccgtttctcagcttctgtcttt

SEQ ID NO: 207644 - DNA, 25 bp, Rattus norvegicus
attccgtttctctgcttctgtcttt

SEQ ID NO: 207645 - DNA, 25 bp, Rattus norvegicus
attccgtttcttcatgttctcaatg

SEQ ID NO: 207646 - DNA, 25 bp, Rattus norvegicus
attccgtttcttgatgttctcaatg

SEQ ID NO: 207647 - DNA, 25 bp, Rattus norvegicus
attcctaaagaaaccatcatgtgtt

SEQ ID NO: 207648 - DNA, 25 bp, Rattus norvegicus
attcctaaagaatccatcatgtgtt

SEQ ID NO: 207649 - DNA, 25 bp, Rattus norvegicus
attcctaaatagctactggcagtta

SEQ ID NO: 207650 - DNA, 25 bp, Rattus norvegicus
attcctaaataggtactggcagtta

SEQ ID NO: 207651 - DNA, 25 bp, Rattus norvegicus
attcctaacctgatatgtttgcaga

SEQ ID NO: 207652 - DNA, 25 bp, Rattus norvegicus
attcctaacctgttatgtttgcaga

SEQ ID NO: 207653 - DNA, 25 bp, Rattus norvegicus
attcctaagcacatgagttggtcta

SEQ ID NO: 207654 - DNA, 25 bp, Rattus norvegicus
attcctaagcacttgagttggtcta

SEQ ID NO: 207655 - DNA, 25 bp, Rattus norvegicus
attcctaagcctagactgatgcatt

SEQ ID NO: 207656 - DNA, 25 bp, Rattus norvegicus
attcctaagccttgactgatgcatt

SEQ ID NO: 207657 - DNA, 25 bp, Rattus norvegicus
attcctacaactaccttttttgctg

SEQ ID NO: 207658 - DNA, 25 bp, Rattus norvegicus
attcctacaacttccttttttgctg

SEQ ID NO: 207659 - DNA, 25 bp, Rattus norvegicus
attcctacagttctatgggcggcat

SEQ ID NO: 207660 - DNA, 25 bp, Rattus norvegicus
attcctacagttgtatgggcggcat

SEQ ID NO: 207661 - DNA, 25 bp, Rattus norvegicus
attcctaccacccagattagcaggg

SEQ ID NO: 207662 - DNA, 25 bp, Rattus norvegicus
attcctaccaccgagattagcaggg

SEQ ID NO: 207663 - DNA, 25 bp, Rattus norvegicus
attcctacccttcctggaagactgt

SEQ ID NO: 207664 - DNA, 25 bp, Rattus norvegicus
attcctacccttgctggaagactgt

SEQ ID NO: 207665 - DNA, 25 bp, Rattus norvegicus
attcctaccgcccagaggaagcggt

SEQ ID NO: 207666 - DNA, 25 bp, Rattus norvegicus
attcctaccgccgagaggaagcggt

SEQ ID NO: 207667 - DNA, 25 bp, Rattus norvegicus
attcctacctagacaagtcccatga

SEQ ID NO: 207668 - DNA, 25 bp, Rattus norvegicus
attcctacctagtcaagtcccatga

SEQ ID NO: 207669 - DNA, 25 bp, Rattus norvegicus
attcctacctgaagccaaagccatt

SEQ ID NO: 207670 - DNA, 25 bp, Rattus norvegicus
attcctacctgatgccaaagccatt

SEQ ID NO: 207671 - DNA, 25 bp, Rattus norvegicus
attcctacgcaacttcattgtcaac

SEQ ID NO: 207672 - DNA, 25 bp, Rattus norvegicus
attcctacgcaagttcattgtcaac

SEQ ID NO: 207673 - DNA, 25 bp, Rattus norvegicus
attcctactacacccatcattttag

SEQ ID NO: 207674 - DNA, 25 bp, Rattus norvegicus
attcctactacagccatcattttag

SEQ ID NO: 207675 - DNA, 25 bp, Rattus norvegicus
attcctactggacattgcaccttgg

SEQ ID NO: 207676 - DNA, 25 bp, Rattus norvegicus
attcctactggagattgcaccttgg

SEQ ID NO: 207677 - DNA, 25 bp, Rattus norvegicus
attcctactggtatatcacggttga

SEQ ID NO: 207678 - DNA, 25 bp, Rattus norvegicus
attcctactggtttatcacggttga

SEQ ID NO: 207679 - DNA, 25 bp, Rattus norvegicus
attcctacttgtagggactctttgc

SEQ ID NO: 207680 - DNA, 25 bp, Rattus norvegicus
attcctacttgttgggactctttgc

SEQ ID NO: 207681 - DNA, 25 bp, Rattus norvegicus
attcctactttcctgtgtggcagtc

SEQ ID NO: 207682 - DNA, 25 bp, Rattus norvegicus
attcctactttcgtgtgtggcagtc

SEQ ID NO: 207683 - DNA, 25 bp, Rattus norvegicus
attcctagaatgacatcctgtcctg

SEQ ID NO: 207684 - DNA, 25 bp, Rattus norvegicus
attcctagaatgtcatcctgtcctg

SEQ ID NO: 207685 - DNA, 25 bp, Rattus norvegicus
attcctagagctacactgtcactaa

SEQ ID NO: 207686 - DNA, 25 bp, Rattus norvegicus
attcctagagcttcactgtcactaa

SEQ ID NO: 207687 - DNA, 25 bp, Rattus norvegicus
attcctagaggtagctcagcccttg

SEQ ID NO: 207688 - DNA, 25 bp, Rattus norvegicus
attcctagaggttgctcagcccttg

SEQ ID NO: 207689 - DNA, 25 bp, Rattus norvegicus
attcctagagttctgctgtctgacc

SEQ ID NO: 207690 - DNA, 25 bp, Rattus norvegicus
attcctagagttgtgctgtctgacc

SEQ ID NO: 207691 - DNA, 25 bp, Rattus norvegicus
attcctagcatccatgtcaagcagt

SEQ ID NO: 207692 - DNA, 25 bp, Rattus norvegicus
attcctagcatcgatgtcaagcagt

SEQ ID NO: 207693 - DNA, 25 bp, Rattus norvegicus
attcctaggtggctcagttgtccaa

SEQ ID NO: 207694 - DNA, 25 bp, Rattus norvegicus
attcctaggtgggtcagttgtccaa

SEQ ID NO: 207695 - DNA, 25 bp, Rattus norvegicus
attcctagtctaagccacattcaga

SEQ ID NO: 207696 - DNA, 25 bp, Rattus norvegicus
attcctagtctatgccacattcaga

SEQ ID NO: 207697 - DNA, 25 bp, Rattus norvegicus
attcctagtggccttgtctgacaca

SEQ ID NO: 207698 - DNA, 25 bp, Rattus norvegicus
attcctagtggcgttgtctgacaca

SEQ ID NO: 207699 - DNA, 25 bp, Rattus norvegicus
attcctataacaagaagcaccactg

SEQ ID NO: 207700 - DNA, 25 bp, Rattus norvegicus
attcctataacatgaagcaccactg

SEQ ID NO: 207701 - DNA, 25 bp, Rattus norvegicus
attcctattagtcttctctcttctt

SEQ ID NO: 207702 - DNA, 25 bp, Rattus norvegicus
attcctattagtgttctctcttctt

SEQ ID NO: 207703 - DNA, 25 bp, Rattus norvegicus
attcctattcaccatatcctcattt

SEQ ID NO: 207704 - DNA, 25 bp, Rattus norvegicus
attcctattcacgatatcctcattt

SEQ ID NO: 207705 - DNA, 25 bp, Rattus norvegicus
attcctattttcatctttcacttgt

SEQ ID NO: 207706 - DNA, 25 bp, Rattus norvegicus
attcctattttcttctttcacttgt

SEQ ID NO: 207707 - DNA, 25 bp, Rattus norvegicus
attcctcagcagaaactagataggt

SEQ ID NO: 207708 - DNA, 25 bp, Rattus norvegicus
attcctcagcagtaactagataggt

SEQ ID NO: 207709 - DNA, 25 bp, Rattus norvegicus
attcctcaggtactccagggatgga

SEQ ID NO: 207710 - DNA, 25 bp, Rattus norvegicus
attcctcaggtagtccagggatgga

SEQ ID NO: 207711 - DNA, 25 bp, Rattus norvegicus
attcctcagtatcgcagggttcaac

SEQ ID NO: 207712 - DNA, 25 bp, Rattus norvegicus
attcctcagtatggcagggttcaac

SEQ ID NO: 207713 - DNA, 25 bp, Rattus norvegicus
attcctcatcttagaggtccccaga

SEQ ID NO: 207714 - DNA, 25 bp, Rattus norvegicus
attcctcatctttgaggtccccaga

SEQ ID NO: 207715 - DNA, 25 bp, Rattus norvegicus
attcctcatgaaagctctctgaacc

SEQ ID NO: 207716 - DNA, 25 bp, Rattus norvegicus
attcctcatgaatgctctctgaacc

SEQ ID NO: 207717 - DNA, 25 bp, Rattus norvegicus
attcctcatgttctgctggacagta

SEQ ID NO: 207718 - DNA, 25 bp, Rattus norvegicus
attcctcatgttgtgctggacagta

SEQ ID NO: 207719 - DNA, 25 bp, Rattus norvegicus
attcctccagcacgcaggtgggtag

SEQ ID NO: 207720 - DNA, 25 bp, Rattus norvegicus
attcctccagcaggcaggtgggtag

SEQ ID NO: 207721 - DNA, 25 bp, Rattus norvegicus
attcctccagtgatagggactccac

SEQ ID NO: 207722 - DNA, 25 bp, Rattus norvegicus
attcctccagtgttagggactccac

SEQ ID NO: 207723 - DNA, 25 bp, Rattus norvegicus
attcctccattgatgggtagaaaaa

SEQ ID NO: 207724 - DNA, 25 bp, Rattus norvegicus
attcctccattgttgggtagaaaaa

SEQ ID NO: 207725 - DNA, 25 bp, Rattus norvegicus
attcctcccgtcatctaatagttga

SEQ ID NO: 207726 - DNA, 25 bp, Rattus norvegicus
attcctcccgtcttctaatagttga

SEQ ID NO: 207727 - DNA, 25 bp, Rattus norvegicus
attcctccgaagcatcttttggtga

SEQ ID NO: 207728 - DNA, 25 bp, Rattus norvegicus
attcctccgaaggatcttttggtga

SEQ ID NO: 207729 - DNA, 25 bp, Rattus norvegicus
attcctcctcggaacataatgtgtt

SEQ ID NO: 207730 - DNA, 25 bp, Rattus norvegicus
attcctcctcggtacataatgtgtt

SEQ ID NO: 207731 - DNA, 25 bp, Rattus norvegicus
attcctcgatggctaatgcactgtt

SEQ ID NO: 207732 - DNA, 25 bp, Rattus norvegicus
attcctcgatgggtaatgcactgtt

SEQ ID NO: 207733 - DNA, 25 bp, Rattus norvegicus
attcctcggtggacagtttatcatc

SEQ ID NO: 207734 - DNA, 25 bp, Rattus norvegicus
attcctcggtggtcagtttatcatc

SEQ ID NO: 207735 - DNA, 25 bp, Rattus norvegicus
attcctcgtgaaccgaactaaacgc

SEQ ID NO: 207736 - DNA, 25 bp, Rattus norvegicus
attcctcgtgaagcgaactaaacgc

SEQ ID NO: 207737 - DNA, 25 bp, Rattus norvegicus
attcctcgtgagagtagctgtttgc

SEQ ID NO: 207738 - DNA, 25 bp, Rattus norvegicus
attcctcgtgagtgtagctgtttgc

SEQ ID NO: 207739 - DNA, 25 bp, Rattus norvegicus
attcctctaaaactcctgcctttga

SEQ ID NO: 207740 - DNA, 25 bp, Rattus norvegicus
attcctctaaaagtcctgcctttga

SEQ ID NO: 207741 - DNA, 25 bp, Rattus norvegicus
attcctctacatacagcttggtggc

SEQ ID NO: 207742 - DNA, 25 bp, Rattus norvegicus
attcctctacattcagcttggtggc

SEQ ID NO: 207743 - DNA, 25 bp, Rattus norvegicus
attcctctcatgatcattattcaga

SEQ ID NO: 207744 - DNA, 25 bp, Rattus norvegicus
attcctctcatgttcattattcaga

SEQ ID NO: 207745 - DNA, 25 bp, Rattus norvegicus
attcctctctgtccatctgaattta

SEQ ID NO: 207746 - DNA, 25 bp, Rattus norvegicus
attcctctctgtgcatctgaattta

SEQ ID NO: 207747 - DNA, 25 bp, Rattus norvegicus
attcctctgatcctggacagcagca

SEQ ID NO: 207748 - DNA, 25 bp, Rattus norvegicus
attcctctgatcgtggacagcagca

SEQ ID NO: 207749 - DNA, 25 bp, Rattus norvegicus
attcctctgctcactatcattagat

SEQ ID NO: 207750 - DNA, 25 bp, Rattus norvegicus
attcctctgctctctatcattagat

SEQ ID NO: 207751 - DNA, 25 bp, Rattus norvegicus
attcctctggataattcacttgtct

SEQ ID NO: 207752 - DNA, 25 bp, Rattus norvegicus
attcctctggatattgttggtgcaa

SEQ ID NO: 207753 - DNA, 25 bp, Rattus norvegicus
attcctctggattattcacttgtct

SEQ ID NO: 207754 - DNA, 25 bp, Rattus norvegicus
attcctctggattttgttggtgcaa

SEQ ID NO: 207755 - DNA, 25 bp, Rattus norvegicus
attcctctgggcacctgttttaaat

SEQ ID NO: 207756 - DNA, 25 bp, Rattus norvegicus
attcctctgggctcctgttttaaat

SEQ ID NO: 207757 - DNA, 25 bp, Rattus norvegicus
attcctctgtagatgcatggcttag

SEQ ID NO: 207758 - DNA, 25 bp, Rattus norvegicus
attcctctgtagttgcatggcttag

SEQ ID NO: 207759 - DNA, 25 bp, Rattus norvegicus
attcctctgttcatctgaccctggt

SEQ ID NO: 207760 - DNA, 25 bp, Rattus norvegicus
attcctctgttcttctgaccctggt

SEQ ID NO: 207761 - DNA, 25 bp, Rattus norvegicus
attcctcttagaagaccagtgattg

SEQ ID NO: 207762 - DNA, 25 bp, Rattus norvegicus
attcctcttagatgaccagtgattg

SEQ ID NO: 207763 - DNA, 25 bp, Rattus norvegicus
attcctcttggtcaaattgctgtgt

SEQ ID NO: 207764 - DNA, 25 bp, Rattus norvegicus
attcctcttggtgaaattgctgtgt

SEQ ID NO: 207765 - DNA, 25 bp, Rattus norvegicus
attcctctttccctacttgacttag

SEQ ID NO: 207766 - DNA, 25 bp, Rattus norvegicus
attcctctttccgtacttgacttag

SEQ ID NO: 207767 - DNA, 25 bp, Rattus norvegicus
attcctctttttcatccgacacaac

SEQ ID NO: 207768 - DNA, 25 bp, Rattus norvegicus
attcctctttttgatccgacacaac

SEQ ID NO: 207769 - DNA, 25 bp, Rattus norvegicus
attcctgaaaggcttactgactctc

SEQ ID NO: 207770 - DNA, 25 bp, Rattus norvegicus
attcctgaaagggttactgactctc

SEQ ID NO: 207771 - DNA, 25 bp, Rattus norvegicus
attcctgaagcgctgggttctatcc

SEQ ID NO: 207772 - DNA, 25 bp, Rattus norvegicus
attcctgaagcggtgggttctatcc

SEQ ID NO: 207773 - DNA, 25 bp, Rattus norvegicus
attcctgaatgaatgcctgctctgc

SEQ ID NO: 207774 - DNA, 25 bp, Rattus norvegicus
attcctgaatgattgcctgctctgc

SEQ ID NO: 207775 - DNA, 25 bp, Rattus norvegicus
attcctgaccagaccttgaggttgt

SEQ ID NO: 207776 - DNA, 25 bp, Rattus norvegicus
attcctgaccagtccttgaggttgt

SEQ ID NO: 207777 - DNA, 25 bp, Rattus norvegicus
attcctgaccttatctcattcacaa

SEQ ID NO: 207778 - DNA, 25 bp, Rattus norvegicus
attcctgaccttttctcattcacaa

SEQ ID NO: 207779 - DNA, 25 bp, Rattus norvegicus
attcctgacttgaaagcagcagggt

SEQ ID NO: 207780 - DNA, 25 bp, Rattus norvegicus
attcctgacttgtaagcagcagggt

SEQ ID NO: 207781 - DNA, 25 bp, Rattus norvegicus
attcctgagacactaagatcccctt

SEQ ID NO: 207782 - DNA, 25 bp, Rattus norvegicus
attcctgagacagtaagatcccctt

SEQ ID NO: 207783 - DNA, 25 bp, Rattus norvegicus
attcctgagcaaacaaatcttcttt

SEQ ID NO: 207784 - DNA, 25 bp, Rattus norvegicus
attcctgagcaatcaaatcttcttt

SEQ ID NO: 207785 - DNA, 25 bp, Rattus norvegicus
attcctgagtttagtatgtcctgtg

SEQ ID NO: 207786 - DNA, 25 bp, Rattus norvegicus
attcctgagttttgtatgtcctgtg

SEQ ID NO: 207787 - DNA, 25 bp, Rattus norvegicus
attcctgatcaaatattctctgtta

SEQ ID NO: 207788 - DNA, 25 bp, Rattus norvegicus
attcctgatcaattattctctgtta

SEQ ID NO: 207789 - DNA, 25 bp, Rattus norvegicus
attcctgatcagattccctcaaggt

SEQ ID NO: 207790 - DNA, 25 bp, Rattus norvegicus
attcctgatcagtttccctcaaggt

SEQ ID NO: 207791 - DNA, 25 bp, Rattus norvegicus
attcctgatcctcgcaagattttta

SEQ ID NO: 207792 - DNA, 25 bp, Rattus norvegicus
attcctgatcctggcaagattttta

SEQ ID NO: 207793 - DNA, 25 bp, Rattus norvegicus
attcctgcaggcactgaagggtctg

SEQ ID NO: 207794 - DNA, 25 bp, Rattus norvegicus
attcctgcaggctctgaagggtctg

SEQ ID NO: 207795 - DNA, 25 bp, Rattus norvegicus
attcctgccatgaaagcaacttccc

SEQ ID NO: 207796 - DNA, 25 bp, Rattus norvegicus
attcctgccatgtaagcaacttccc

SEQ ID NO: 207797 - DNA, 25 bp, Rattus norvegicus
attcctgccgtactggtggtgctag

SEQ ID NO: 207798 - DNA, 25 bp, Rattus norvegicus
attcctgccgtagtggtggtgctag

SEQ ID NO: 207799 - DNA, 25 bp, Rattus norvegicus
attcctgccttacaatccatcaagc

SEQ ID NO: 207800 - DNA, 25 bp, Rattus norvegicus
attcctgccttagaatccatcaagc

SEQ ID NO: 207801 - DNA, 25 bp, Rattus norvegicus
attcctgccttgcagaaaagacttg

SEQ ID NO: 207802 - DNA, 25 bp, Rattus norvegicus
attcctgccttggagaaaagacttg

SEQ ID NO: 207803 - DNA, 25 bp, Rattus norvegicus
attcctgctcaaaaactgctcactt

SEQ ID NO: 207804 - DNA, 25 bp, Rattus norvegicus
attcctgctcaataactgctcactt

SEQ ID NO: 207805 - DNA, 25 bp, Rattus norvegicus
attcctgctccaaatgaggtgctga

SEQ ID NO: 207806 - DNA, 25 bp, Rattus norvegicus
attcctgctccatatgaggtgctga

SEQ ID NO: 207807 - DNA, 25 bp, Rattus norvegicus
attcctgctctgctctctagcgagt

SEQ ID NO: 207808 - DNA, 25 bp, Rattus norvegicus
attcctgctctggtctctagcgagt

SEQ ID NO: 207809 - DNA, 25 bp, Rattus norvegicus
attcctgctggaagacaaccgagta

SEQ ID NO: 207810 - DNA, 25 bp, Rattus norvegicus
attcctgctggatgacaaccgagta

SEQ ID NO: 207811 - DNA, 25 bp, Rattus norvegicus
attcctgctgtgacgattttcattt

SEQ ID NO: 207812 - DNA, 25 bp, Rattus norvegicus
attcctgctgtgtcgattttcattt

SEQ ID NO: 207813 - DNA, 25 bp, Rattus norvegicus
attcctggaagcagtcgtctgatct

SEQ ID NO: 207814 - DNA, 25 bp, Rattus norvegicus
attcctggaagctgtcgtctgatct

SEQ ID NO: 207815 - DNA, 25 bp, Rattus norvegicus
attcctggaaggagctcgcacacag

SEQ ID NO: 207816 - DNA, 25 bp, Rattus norvegicus
attcctggaaggatctctgggcaaa

SEQ ID NO: 207817 - DNA, 25 bp, Rattus norvegicus
attcctggaaggtgctcgcacacag

SEQ ID NO: 207818 - DNA, 25 bp, Rattus norvegicus
attcctggaaggttctctgggcaaa

SEQ ID NO: 207819 - DNA, 25 bp, Rattus norvegicus
attcctggaccaatgctctaaatca

SEQ ID NO: 207820 - DNA, 25 bp, Rattus norvegicus
attcctggaccattgctctaaatca

SEQ ID NO: 207821 - DNA, 25 bp, Rattus norvegicus
attcctggagaaccggcgtatacct

SEQ ID NO: 207822 - DNA, 25 bp, Rattus norvegicus
attcctggagaagcggcgtatacct

SEQ ID NO: 207823 - DNA, 25 bp, Rattus norvegicus
attcctggagccacaagacttggga

SEQ ID NO: 207824 - DNA, 25 bp, Rattus norvegicus
attcctggagcctcaagacttggga

SEQ ID NO: 207825 - DNA, 25 bp, Rattus norvegicus
attcctggcatccacgtgctgaata

SEQ ID NO: 207826 - DNA, 25 bp, Rattus norvegicus
attcctggcatcgacgtgctgaata

SEQ ID NO: 207827 - DNA, 25 bp, Rattus norvegicus
attcctggcccacaggttagatcag

SEQ ID NO: 207828 - DNA, 25 bp, Rattus norvegicus
attcctggcccagaggttagatcag

SEQ ID NO: 207829 - DNA, 25 bp, Rattus norvegicus
attcctggctggagcgtttcctcga

SEQ ID NO: 207830 - DNA, 25 bp, Rattus norvegicus
attcctggctggtgcgtttcctcga

SEQ ID NO: 207831 - DNA, 25 bp, Rattus norvegicus
attcctgggcctcgatggctcagag

SEQ ID NO: 207832 - DNA, 25 bp, Rattus norvegicus
attcctgggcctggatggctcagag

SEQ ID NO: 207833 - DNA, 25 bp, Rattus norvegicus
attcctgggctgagggctggaccac

SEQ ID NO: 207834 - DNA, 25 bp, Rattus norvegicus
attcctgggctgtgggctggaccac

SEQ ID NO: 207835 - DNA, 25 bp, Rattus norvegicus
attcctgggttgaccagttggccga

SEQ ID NO: 207836 - DNA, 25 bp, Rattus norvegicus
attcctgggttgtccagttggccga

SEQ ID NO: 207837 - DNA, 25 bp, Rattus norvegicus
attcctggtaatctggtttgttcca

SEQ ID NO: 207838 - DNA, 25 bp, Rattus norvegicus
attcctggtaatgtggtttgttcca

SEQ ID NO: 207839 - DNA, 25 bp, Rattus norvegicus
attcctggtcctcagctgaaaccgt

SEQ ID NO: 207840 - DNA, 25 bp, Rattus norvegicus
attcctggtcctgagctgaaaccgt

SEQ ID NO: 207841 - DNA, 25 bp, Rattus norvegicus
attcctggtcttactatgctaccat

SEQ ID NO: 207842 - DNA, 25 bp, Rattus norvegicus
attcctggtctttctatgctaccat

SEQ ID NO: 207843 - DNA, 25 bp, Rattus norvegicus
attcctggtgcgagtcccatgtctt

SEQ ID NO: 207844 - DNA, 25 bp, Rattus norvegicus
attcctggtgcgtgtcccatgtctt

SEQ ID NO: 207845 - DNA, 25 bp, Rattus norvegicus
attcctgtaaatatggctgcatgta

SEQ ID NO: 207846 - DNA, 25 bp, Rattus norvegicus
attcctgtaaatttggctgcatgta

SEQ ID NO: 207847 - DNA, 25 bp, Rattus norvegicus
attcctgtaataaaagcctccatga

SEQ ID NO: 207848 - DNA, 25 bp, Rattus norvegicus
attcctgtaatataagcctccatga

SEQ ID NO: 207849 - DNA, 25 bp, Rattus norvegicus
attcctgtaatgcttgcctggcacc

SEQ ID NO: 207850 - DNA, 25 bp, Rattus norvegicus
attcctgtaatggttgcctggcacc

SEQ ID NO: 207851 - DNA, 25 bp, Rattus norvegicus
attcctgtatgtccggtgagcatct

SEQ ID NO: 207852 - DNA, 25 bp, Rattus norvegicus
attcctgtatgtgcggtgagcatct

SEQ ID NO: 207853 - DNA, 25 bp, Rattus norvegicus
attcctgtattccattctgttcttg

SEQ ID NO: 207854 - DNA, 25 bp, Rattus norvegicus
attcctgtattcgattctgttcttg

SEQ ID NO: 207855 - DNA, 25 bp, Rattus norvegicus
attcctgtatttatagccttcctgt

SEQ ID NO: 207856 - DNA, 25 bp, Rattus norvegicus
attcctgtatttttagccttcctgt

SEQ ID NO: 207857 - DNA, 25 bp, Rattus norvegicus
attcctgtcagccagagtttgctct

SEQ ID NO: 207858 - DNA, 25 bp, Rattus norvegicus
attcctgtcagcgagagtttgctct

SEQ ID NO: 207859 - DNA, 25 bp, Rattus norvegicus
attcctgtcaggcttatctcgtgtt

SEQ ID NO: 207860 - DNA, 25 bp, Rattus norvegicus
attcctgtcagggttatctcgtgtt

SEQ ID NO: 207861 - DNA, 25 bp, Rattus norvegicus
attcctgtcatcaccaaagtctcaa

SEQ ID NO: 207862 - DNA, 25 bp, Rattus norvegicus
attcctgtcatctccaaagtctcaa

SEQ ID NO: 207863 - DNA, 25 bp, Rattus norvegicus
attcctgtcccgctgtgaaaagtaa

SEQ ID NO: 207864 - DNA, 25 bp, Rattus norvegicus
attcctgtcccggtgtgaaaagtaa

SEQ ID NO: 207865 - DNA, 25 bp, Rattus norvegicus
attcctgtccttcgctgagggtgag

SEQ ID NO: 207866 - DNA, 25 bp, Rattus norvegicus
attcctgtccttggctgagggtgag

SEQ ID NO: 207867 - DNA, 25 bp, Rattus norvegicus
attcctgtctgtatgagtgcctcat

SEQ ID NO: 207868 - DNA, 25 bp, Rattus norvegicus
attcctgtctgtttgagtgcctcat

SEQ ID NO: 207869 - DNA, 25 bp, Rattus norvegicus
attcctgtcttaacaaactactttg

SEQ ID NO: 207870 - DNA, 25 bp, Rattus norvegicus
attcctgtcttatcaaactactttg

SEQ ID NO: 207871 - DNA, 25 bp, Rattus norvegicus
attcctgtgatgactttcttagctg

SEQ ID NO: 207872 - DNA, 25 bp, Rattus norvegicus
attcctgtgatgtctttcttagctg

SEQ ID NO: 207873 - DNA, 25 bp, Rattus norvegicus
attcctgtgcctctgttctggatgc

SEQ ID NO: 207874 - DNA, 25 bp, Rattus norvegicus
attcctgtgcctgtgttctggatgc

SEQ ID NO: 207875 - DNA, 25 bp, Rattus norvegicus
attcctgtggccatatggatgggtt

SEQ ID NO: 207876 - DNA, 25 bp, Rattus norvegicus
attcctgtggccttatggatgggtt

SEQ ID NO: 207877 - DNA, 25 bp, Rattus norvegicus
attcctgtggttaccagaatggtca

SEQ ID NO: 207878 - DNA, 25 bp, Rattus norvegicus
attcctgtggtttccagaatggtca

SEQ ID NO: 207879 - DNA, 25 bp, Rattus norvegicus
attcctgtgtagatgatcggattcc

SEQ ID NO: 207880 - DNA, 25 bp, Rattus norvegicus
attcctgtgtagttgatcggattcc

SEQ ID NO: 207881 - DNA, 25 bp, Rattus norvegicus
attcctgtgtctctcgtgtattgaa

SEQ ID NO: 207882 - DNA, 25 bp, Rattus norvegicus
attcctgtgtctgtcgtgtattgaa

SEQ ID NO: 207883 - DNA, 25 bp, Rattus norvegicus
attcctgttgctccaactgttgtaa

SEQ ID NO: 207884 - DNA, 25 bp, Rattus norvegicus
attcctgttgctgcaactgttgtaa

SEQ ID NO: 207885 - DNA, 25 bp, Rattus norvegicus
attcctgttttcatacagctgccaa

SEQ ID NO: 207886 - DNA, 25 bp, Rattus norvegicus
attcctgttttcttacagctgccaa

SEQ ID NO: 207887 - DNA, 25 bp, Rattus norvegicus
attccttaattcactttggtatctc

SEQ ID NO: 207888 - DNA, 25 bp, Rattus norvegicus
attccttaattctctttggtatctc

SEQ ID NO: 207889 - DNA, 25 bp, Rattus norvegicus
attccttagatactcatttgctgtc

SEQ ID NO: 207890 - DNA, 25 bp, Rattus norvegicus
attccttagatagtcatttgctgtc

SEQ ID NO: 207891 - DNA, 25 bp, Rattus norvegicus
attccttatgtgcagtcccactgag

SEQ ID NO: 207892 - DNA, 25 bp, Rattus norvegicus
attccttatgtggagtcccactgag

SEQ ID NO: 207893 - DNA, 25 bp, Rattus norvegicus
attccttattatacagatacagggt

SEQ ID NO: 207894 - DNA, 25 bp, Rattus norvegicus
attccttattattcagatacagggt

SEQ ID NO: 207895 - DNA, 25 bp, Rattus norvegicus
attccttattgacggtccagaccga

SEQ ID NO: 207896 - DNA, 25 bp, Rattus norvegicus
attccttattgagggtccagaccga

SEQ ID NO: 207897 - DNA, 25 bp, Rattus norvegicus
attccttcagctcattttggtgtgt

SEQ ID NO: 207898 - DNA, 25 bp, Rattus norvegicus
attccttcagctgattttggtgtgt

SEQ ID NO: 207899 - DNA, 25 bp, Rattus norvegicus
attccttcaggtctaatcttgtttt

SEQ ID NO: 207900 - DNA, 25 bp, Rattus norvegicus
attccttcaggtgtaatcttgtttt

SEQ ID NO: 207901 - DNA, 25 bp, Rattus norvegicus
attccttcagttactcttgggcagc

SEQ ID NO: 207902 - DNA, 25 bp, Rattus norvegicus
attccttcagtttctcttgggcagc

SEQ ID NO: 207903 - DNA, 25 bp, Rattus norvegicus
attccttccaaaactgctctggagc

SEQ ID NO: 207904 - DNA, 25 bp, Rattus norvegicus
attccttccaaacctattgcggctg

SEQ ID NO: 207905 - DNA, 25 bp, Rattus norvegicus
attccttccaaagctattgcggctg

SEQ ID NO: 207906 - DNA, 25 bp, Rattus norvegicus
attccttccaaatctgctctggagc

SEQ ID NO: 207907 - DNA, 25 bp, Rattus norvegicus
attccttccacaagatggcttacct

SEQ ID NO: 207908 - DNA, 25 bp, Rattus norvegicus
attccttccacatgatggcttacct

SEQ ID NO: 207909 - DNA, 25 bp, Rattus norvegicus
attccttccaccatgaggtctttaa

SEQ ID NO: 207910 - DNA, 25 bp, Rattus norvegicus
attccttccaccttgaggtctttaa

SEQ ID NO: 207911 - DNA, 25 bp, Rattus norvegicus
attccttcccagctgacatgcttgt

SEQ ID NO: 207912 - DNA, 25 bp, Rattus norvegicus
attccttcccaggtgacatgcttgt

SEQ ID NO: 207913 - DNA, 25 bp, Rattus norvegicus
attccttcctatatttcttgctttg

SEQ ID NO: 207914 - DNA, 25 bp, Rattus norvegicus
attccttcctatttttcttgctttg

SEQ ID NO: 207915 - DNA, 25 bp, Rattus norvegicus
attccttcctcaacagtgcaagcga

SEQ ID NO: 207916 - DNA, 25 bp, Rattus norvegicus
attccttcctcatcagtgcaagcga

SEQ ID NO: 207917 - DNA, 25 bp, Rattus norvegicus
attccttcctgacatgtaaaattgc

SEQ ID NO: 207918 - DNA, 25 bp, Rattus norvegicus
attccttcctgagatgtaaaattgc

SEQ ID NO: 207919 - DNA, 25 bp, Rattus norvegicus
attccttcctgccaaaacatcaaag

SEQ ID NO: 207920 - DNA, 25 bp, Rattus norvegicus
attccttcctgcgaaaacatcaaag

SEQ ID NO: 207921 - DNA, 25 bp, Rattus norvegicus
attccttcctgtcgcaggctggtaa

SEQ ID NO: 207922 - DNA, 25 bp, Rattus norvegicus
attccttcctgtggcaggctggtaa

SEQ ID NO: 207923 - DNA, 25 bp, Rattus norvegicus
attccttcctttcattctgtggtag

SEQ ID NO: 207924 - DNA, 25 bp, Rattus norvegicus
attccttcctttgattctgtggtag

SEQ ID NO: 207925 - DNA, 25 bp, Rattus norvegicus
attccttcgctcatggttggaccag

SEQ ID NO: 207926 - DNA, 25 bp, Rattus norvegicus
attccttcgctcttggttggaccag

SEQ ID NO: 207927 - DNA, 25 bp, Rattus norvegicus
attccttctacaattcctgtggtgc

SEQ ID NO: 207928 - DNA, 25 bp, Rattus norvegicus
attccttctacatttcctgtggtgc

SEQ ID NO: 207929 - DNA, 25 bp, Rattus norvegicus
attccttctatcaacattggctagc

SEQ ID NO: 207930 - DNA, 25 bp, Rattus norvegicus
attccttctatctacattggctagc

SEQ ID NO: 207931 - DNA, 25 bp, Rattus norvegicus
attccttctcgcattcaactcggga

SEQ ID NO: 207932 - DNA, 25 bp, Rattus norvegicus
attccttctcgctttcaactcggga

SEQ ID NO: 207933 - DNA, 25 bp, Rattus norvegicus
attccttgagaaagttacgttagca

SEQ ID NO: 207934 - DNA, 25 bp, Rattus norvegicus
attccttgagaacttcatatatgta

SEQ ID NO: 207935 - DNA, 25 bp, Rattus norvegicus
attccttgagaagttcatatatgta

SEQ ID NO: 207936 - DNA, 25 bp, Rattus norvegicus
attccttgagaatgttacgttagca

SEQ ID NO: 207937 - DNA, 25 bp, Rattus norvegicus
attccttgcgcaactggacatttga

SEQ ID NO: 207938 - DNA, 25 bp, Rattus norvegicus
attccttgcgcatctggacatttga

SEQ ID NO: 207939 - DNA, 25 bp, Rattus norvegicus
attccttgctccagcttgtaataaa

SEQ ID NO: 207940 - DNA, 25 bp, Rattus norvegicus
attccttgctcctgcttgtaataaa

SEQ ID NO: 207941 - DNA, 25 bp, Rattus norvegicus
attccttggatacttaagctgtttc

SEQ ID NO: 207942 - DNA, 25 bp, Rattus norvegicus
attccttggatagttaagctgtttc

SEQ ID NO: 207943 - DNA, 25 bp, Rattus norvegicus
attccttggcccacaggtacattgg

SEQ ID NO: 207944 - DNA, 25 bp, Rattus norvegicus
attccttggccctcaggtacattgg

SEQ ID NO: 207945 - DNA, 25 bp, Rattus norvegicus
attccttgggcaaagggcgttggat

SEQ ID NO: 207946 - DNA, 25 bp, Rattus norvegicus
attccttgggcatagggcgttggat

SEQ ID NO: 207947 - DNA, 25 bp, Rattus norvegicus
attccttggtagacagacagctgct

SEQ ID NO: 207948 - DNA, 25 bp, Rattus norvegicus
attccttggtagtcagacagctgct

SEQ ID NO: 207949 - DNA, 25 bp, Rattus norvegicus
attccttggtgtcttgtggcacata

SEQ ID NO: 207950 - DNA, 25 bp, Rattus norvegicus
attccttggtgtgttgtggcacata

SEQ ID NO: 207951 - DNA, 25 bp, Rattus norvegicus
attccttgtacaactgctgcatcaa

SEQ ID NO: 207952 - DNA, 25 bp, Rattus norvegicus
attccttgtacaatggctcatgccg

SEQ ID NO: 207953 - DNA, 25 bp, Rattus norvegicus
attccttgtacatctgctgcatcaa

SEQ ID NO: 207954 - DNA, 25 bp, Rattus norvegicus
attccttgtacattggctcatgccg

SEQ ID NO: 207955 - DNA, 25 bp, Rattus norvegicus
attccttgttcaaatcactgcagcc

SEQ ID NO: 207956 - DNA, 25 bp, Rattus norvegicus
attccttgttcatatcactgcagcc

SEQ ID NO: 207957 - DNA, 25 bp, Rattus norvegicus
attccttgttccaggtgccttagag

SEQ ID NO: 207958 - DNA, 25 bp, Rattus norvegicus
attccttgttcctggtgccttagag

SEQ ID NO: 207959 - DNA, 25 bp, Rattus norvegicus
attcctttaagaaatttggcattgt

SEQ ID NO: 207960 - DNA, 25 bp, Rattus norvegicus
attcctttaagatatttggcattgt

SEQ ID NO: 207961 - DNA, 25 bp, Rattus norvegicus
attcctttatacctagatacagttg

SEQ ID NO: 207962 - DNA, 25 bp, Rattus norvegicus
attcctttatacgtagatacagttg

SEQ ID NO: 207963 - DNA, 25 bp, Rattus norvegicus
attcctttcattagcttcttgtcca

SEQ ID NO: 207964 - DNA, 25 bp, Rattus norvegicus
attcctttcatttgcttcttgtcca

SEQ ID NO: 207965 - DNA, 25 bp, Rattus norvegicus
attcctttcctgagacttccagact

SEQ ID NO: 207966 - DNA, 25 bp, Rattus norvegicus
attcctttcctgtgacttccagact

SEQ ID NO: 207967 - DNA, 25 bp, Rattus norvegicus
attcctttctgtcacatgagtctga

SEQ ID NO: 207968 - DNA, 25 bp, Rattus norvegicus
attcctttctgtgacatgagtctga

SEQ ID NO: 207969 - DNA, 25 bp, Rattus norvegicus
attcctttgaagaggccttccctgt

SEQ ID NO: 207970 - DNA, 25 bp, Rattus norvegicus
attcctttgaagtggccttccctgt

SEQ ID NO: 207971 - DNA, 25 bp, Rattus norvegicus
attcctttgagcagcaccagcccaa

SEQ ID NO: 207972 - DNA, 25 bp, Rattus norvegicus
attcctttgagctgcaccagcccaa

SEQ ID NO: 207973 - DNA, 25 bp, Rattus norvegicus
attcctttgctcatctgtgtaatgc

SEQ ID NO: 207974 - DNA, 25 bp, Rattus norvegicus
attcctttgctcttctgtgtaatgc

SEQ ID NO: 207975 - DNA, 25 bp, Rattus norvegicus
attcctttgctgctgtctactatag

SEQ ID NO: 207976 - DNA, 25 bp, Rattus norvegicus
attcctttgctggtgtctactatag

SEQ ID NO: 207977 - DNA, 25 bp, Rattus norvegicus
attcctttgggtctagtatgcctag

SEQ ID NO: 207978 - DNA, 25 bp, Rattus norvegicus
attcctttgggtgtagtatgcctag

SEQ ID NO: 207979 - DNA, 25 bp, Rattus norvegicus
attcctttgtggagggcactaccca

SEQ ID NO: 207980 - DNA, 25 bp, Rattus norvegicus
attcctttgtggtgggcactaccca

SEQ ID NO: 207981 - DNA, 25 bp, Rattus norvegicus
attcctttgtttacttttgcctcag

SEQ ID NO: 207982 - DNA, 25 bp, Rattus norvegicus
attcctttgttttcttttgcctcag

SEQ ID NO: 207983 - DNA, 25 bp, Rattus norvegicus
attccttttagcatccttcaaggcc

SEQ ID NO: 207984 - DNA, 25 bp, Rattus norvegicus
attccttttagcttccttcaaggcc

SEQ ID NO: 207985 - DNA, 25 bp, Rattus norvegicus
attccttttatcaattgccatgcac

SEQ ID NO: 207986 - DNA, 25 bp, Rattus norvegicus
attccttttatctattgccatgcac

SEQ ID NO: 207987 - DNA, 25 bp, Rattus norvegicus
attccttttattatctgggtcacga

SEQ ID NO: 207988 - DNA, 25 bp, Rattus norvegicus
attccttttattttctgggtcacga

SEQ ID NO: 207989 - DNA, 25 bp, Rattus norvegicus
attccttttcagcatctttttcttt

SEQ ID NO: 207990 - DNA, 25 bp, Rattus norvegicus
attccttttcaggatctttttcttt

SEQ ID NO: 207991 - DNA, 25 bp, Rattus norvegicus
attccttttcctccaaatgaagcgt

SEQ ID NO: 207992 - DNA, 25 bp, Rattus norvegicus
attccttttcctgcaaatgaagcgt

SEQ ID NO: 207993 - DNA, 25 bp, Rattus norvegicus
attccttttctaatgacccctagtg

SEQ ID NO: 207994 - DNA, 25 bp, Rattus norvegicus
attccttttctactagtggcagcat

SEQ ID NO: 207995 - DNA, 25 bp, Rattus norvegicus
attccttttctagtagtggcagcat

SEQ ID NO: 207996 - DNA, 25 bp, Rattus norvegicus
attccttttctattgacccctagtg

SEQ ID NO: 207997 - DNA, 25 bp, Rattus norvegicus
attcctttttatctctacttctgtg

SEQ ID NO: 207998 - DNA, 25 bp, Rattus norvegicus
attcctttttatgtctacttctgtg

SEQ ID NO: 207999 - DNA, 25 bp, Rattus norvegicus
attcctttttcaaatgccatctctc

SEQ ID NO: 208000 - DNA, 25 bp, Rattus norvegicus
attcctttttcatatgccatctctc

SEQ ID NO: 208001 - DNA, 25 bp, Rattus norvegicus
attcgaaaccccagagcgcgagcgg

SEQ ID NO: 208002 - DNA, 25 bp, Rattus norvegicus
attcgaaacccctgagcgcgagcgg

SEQ ID NO: 208003 - DNA, 25 bp, Rattus norvegicus
attcgaaatgtcacaagtcctcgcc

SEQ ID NO: 208004 - DNA, 25 bp, Rattus norvegicus
attcgaaatgtctcaagtcctcgcc

SEQ ID NO: 208005 - DNA, 25 bp, Rattus norvegicus
attcgaaatgtgacgtgcccgaagg

SEQ ID NO: 208006 - DNA, 25 bp, Rattus norvegicus
attcgaaatgtgtcgtgcccgaagg

SEQ ID NO: 208007 - DNA, 25 bp, Rattus norvegicus
attcgaacgatgcagtttggcttct

SEQ ID NO: 208008 - DNA, 25 bp, Rattus norvegicus
attcgaacgatggagtttggcttct

SEQ ID NO: 208009 - DNA, 25 bp, Rattus norvegicus
attcgaagacggatgatctggactt

SEQ ID NO: 208010 - DNA, 25 bp, Rattus norvegicus
attcgaagacggttgatctggactt

SEQ ID NO: 208011 - DNA, 25 bp, Rattus norvegicus
attcgaagcgttcctctgcggcagc

SEQ ID NO: 208012 - DNA, 25 bp, Rattus norvegicus
attcgaagcgttgctctgcggcagc

SEQ ID NO: 208013 - DNA, 25 bp, Rattus norvegicus
attcgaagctacatggccaagggtc

SEQ ID NO: 208014 - DNA, 25 bp, Rattus norvegicus
attcgaagctacttggccaagggtc

SEQ ID NO: 208015 - DNA, 25 bp, Rattus norvegicus
attcgaagcttcctgtccaaattag

SEQ ID NO: 208016 - DNA, 25 bp, Rattus norvegicus
attcgaagcttcgtgtccaaattag

SEQ ID NO: 208017 - DNA, 25 bp, Rattus norvegicus
attcgaagggacagtgcacgctcta

SEQ ID NO: 208018 - DNA, 25 bp, Rattus norvegicus
attcgaagggactgtgcacgctcta

SEQ ID NO: 208019 - DNA, 25 bp, Rattus norvegicus
attcgacaggtcacagttttgatga

SEQ ID NO: 208020 - DNA, 25 bp, Rattus norvegicus
attcgacaggtctcagttttgatga

SEQ ID NO: 208021 - DNA, 25 bp, Rattus norvegicus
attcgaccagaaaagcaggccccta

SEQ ID NO: 208022 - DNA, 25 bp, Rattus norvegicus
attcgaccagaatagcaggccccta

SEQ ID NO: 208023 - DNA, 25 bp, Rattus norvegicus
attcgacggctcagttcgggcaagg

SEQ ID NO: 208024 - DNA, 25 bp, Rattus norvegicus
attcgacggctctgttcgggcaagg

SEQ ID NO: 208025 - DNA, 25 bp, Rattus norvegicus
attcgactccccattggtgagattt

SEQ ID NO: 208026 - DNA, 25 bp, Rattus norvegicus
attcgactcccctttggtgagattt

SEQ ID NO: 208027 - DNA, 25 bp, Rattus norvegicus
attcgactccggaagggcttagctt

SEQ ID NO: 208028 - DNA, 25 bp, Rattus norvegicus
attcgactccggtagggcttagctt

SEQ ID NO: 208029 - DNA, 25 bp, Rattus norvegicus
attcgactgtctacccaatgaaacc

SEQ ID NO: 208030 - DNA, 25 bp, Rattus norvegicus
attcgactgtcttcccaatgaaacc

SEQ ID NO: 208031 - DNA, 25 bp, Rattus norvegicus
attcgactgtgaatctactgtagca

SEQ ID NO: 208032 - DNA, 25 bp, Rattus norvegicus
attcgactgtgattctactgtagca

SEQ ID NO: 208033 - DNA, 25 bp, Rattus norvegicus
attcgagacatgattgccaaggcca

SEQ ID NO: 208034 - DNA, 25 bp, Rattus norvegicus
attcgagacatgtttgccaaggcca

SEQ ID NO: 208035 - DNA, 25 bp, Rattus norvegicus
attcgagagcttcgcagcacacttt

SEQ ID NO: 208036 - DNA, 25 bp, Rattus norvegicus
attcgagagcttggcagcacacttt

SEQ ID NO: 208037 - DNA, 25 bp, Rattus norvegicus
attcgagatcccagatgtcttcgtg

SEQ ID NO: 208038 - DNA, 25 bp, Rattus norvegicus
attcgagatccctgatgtcttcgtg

SEQ ID NO: 208039 - DNA, 25 bp, Rattus norvegicus
attcgagatgctctctcaaccttaa

SEQ ID NO: 208040 - DNA, 25 bp, Rattus norvegicus
attcgagatgctgtctcaaccttaa

SEQ ID NO: 208041 - DNA, 25 bp, Rattus norvegicus
attcgaggccctcagaagaggctaa

SEQ ID NO: 208042 - DNA, 25 bp, Rattus norvegicus
attcgaggccctgagaagaggctaa

SEQ ID NO: 208043 - DNA, 25 bp, Rattus norvegicus
attcgagggatgaccctggtttcct

SEQ ID NO: 208044 - DNA, 25 bp, Rattus norvegicus
attcgagggatgtccctggtttcct

SEQ ID NO: 208045 - DNA, 25 bp, Rattus norvegicus
attcgaggtgcgagcccagctacgg

SEQ ID NO: 208046 - DNA, 25 bp, Rattus norvegicus
attcgaggtgcgtgcccagctacgg

SEQ ID NO: 208047 - DNA, 25 bp, Rattus norvegicus
attcgagtcgccaatatcacagtca

SEQ ID NO: 208048 - DNA, 25 bp, Rattus norvegicus
attcgagtcgcctatatcacagtca

SEQ ID NO: 208049 - DNA, 25 bp, Rattus norvegicus
attcgagttctgatctcccagcatg

SEQ ID NO: 208050 - DNA, 25 bp, Rattus norvegicus
attcgagttctgttctcccagcatg

SEQ ID NO: 208051 - DNA, 25 bp, Rattus norvegicus
attcgagttgcacacttggctagac

SEQ ID NO: 208052 - DNA, 25 bp, Rattus norvegicus
attcgagttgcagacttggctagac

SEQ ID NO: 208053 - DNA, 25 bp, Rattus norvegicus
attcgagtttccctcgagattccgt

SEQ ID NO: 208054 - DNA, 25 bp, Rattus norvegicus
attcgagtttccgtcgagattccgt

SEQ ID NO: 208055 - DNA, 25 bp, Rattus norvegicus
attcgataactgagagaagccctca

SEQ ID NO: 208056 - DNA, 25 bp, Rattus norvegicus
attcgataactgtgagaagccctca

SEQ ID NO: 208057 - DNA, 25 bp, Rattus norvegicus
attcgatctcatacagtattaaggg

SEQ ID NO: 208058 - DNA, 25 bp, Rattus norvegicus
attcgatctcattcagtattaaggg

SEQ ID NO: 208059 - DNA, 25 bp, Rattus norvegicus
attcgatgcagaaccgcattcactc

SEQ ID NO: 208060 - DNA, 25 bp, Rattus norvegicus
attcgatgcagatccgcattcactc

SEQ ID NO: 208061 - DNA, 25 bp, Rattus norvegicus
attcgatggctaatgctcatttctg

SEQ ID NO: 208062 - DNA, 25 bp, Rattus norvegicus
attcgatggctattgctcatttctg

SEQ ID NO: 208063 - DNA, 25 bp, Rattus norvegicus
attcgattctcaccgttaacatttc

SEQ ID NO: 208064 - DNA, 25 bp, Rattus norvegicus
attcgattctcagcgttaacatttc

SEQ ID NO: 208065 - DNA, 25 bp, Rattus norvegicus
attcgattctttcagtggaggaacc

SEQ ID NO: 208066 - DNA, 25 bp, Rattus norvegicus
attcgattctttgagtggaggaacc

SEQ ID NO: 208067 - DNA, 25 bp, Rattus norvegicus
attcgattgtgaccgcccaggcagg

SEQ ID NO: 208068 - DNA, 25 bp, Rattus norvegicus
attcgattgtgagcgcccaggcagg

SEQ ID NO: 208069 - DNA, 25 bp, Rattus norvegicus
attcgcaccacccaggagagttaaa

SEQ ID NO: 208070 - DNA, 25 bp, Rattus norvegicus
attcgcaccaccgaggagagttaaa

SEQ ID NO: 208071 - DNA, 25 bp, Rattus norvegicus
attcgcactcaaagtccagagcttg

SEQ ID NO: 208072 - DNA, 25 bp, Rattus norvegicus
attcgcactcaatgtccagagcttg

SEQ ID NO: 208073 - DNA, 25 bp, Rattus norvegicus
attcgcactcctcgcagatggttga

SEQ ID NO: 208074 - DNA, 25 bp, Rattus norvegicus
attcgcactcctggcagatggttga

SEQ ID NO: 208075 - DNA, 25 bp, Rattus norvegicus
attcgcagccatacctggatacatg

SEQ ID NO: 208076 - DNA, 25 bp, Rattus norvegicus
attcgcagccattcctggatacatg

SEQ ID NO: 208077 - DNA, 25 bp, Rattus norvegicus
attcgcatgatgacaactggctcta

SEQ ID NO: 208078 - DNA, 25 bp, Rattus norvegicus
attcgcatgatgtcaactggctcta

SEQ ID NO: 208079 - DNA, 25 bp, Rattus norvegicus
attcgcattgtgagagcagttcctt

SEQ ID NO: 208080 - DNA, 25 bp, Rattus norvegicus
attcgcattgtgtgagcagttcctt

SEQ ID NO: 208081 - DNA, 25 bp, Rattus norvegicus
attcgccagccccacacggagggaa

SEQ ID NO: 208082 - DNA, 25 bp, Rattus norvegicus
attcgccagcccgacacggagggaa

SEQ ID NO: 208083 - DNA, 25 bp, Rattus norvegicus
attcgcctcggtcgattgtacatct

SEQ ID NO: 208084 - DNA, 25 bp, Rattus norvegicus
attcgcctcggtggattgtacatct

SEQ ID NO: 208085 - DNA, 25 bp, Rattus norvegicus
attcgctaggcactctttgtaacag

SEQ ID NO: 208086 - DNA, 25 bp, Rattus norvegicus
attcgctaggcagtctttgtaacag

SEQ ID NO: 208087 - DNA, 25 bp, Rattus norvegicus
attcgctccagtctgcagaaagcct

SEQ ID NO: 208088 - DNA, 25 bp, Rattus norvegicus
attcgctccagtgtgcagaaagcct

SEQ ID NO: 208089 - DNA, 25 bp, Rattus norvegicus
attcgctcccttcagcaatgcagag

SEQ ID NO: 208090 - DNA, 25 bp, Rattus norvegicus
attcgctcccttgagcaatgcagag

SEQ ID NO: 208091 - DNA, 25 bp, Rattus norvegicus
attcgctgacaaaaatcttccccat

SEQ ID NO: 208092 - DNA, 25 bp, Rattus norvegicus
attcgctgacaataatcttccccat

SEQ ID NO: 208093 - DNA, 25 bp, Rattus norvegicus
attcgctgctatactcatgggtcac

SEQ ID NO: 208094 - DNA, 25 bp, Rattus norvegicus
attcgctgctattctcatgggtcac

SEQ ID NO: 208095 - DNA, 25 bp, Rattus norvegicus
attcgctgggcacaggacctgatca

SEQ ID NO: 208096 - DNA, 25 bp, Rattus norvegicus
attcgctgggcagaggacctgatca

SEQ ID NO: 208097 - DNA, 25 bp, Rattus norvegicus
attcgcttacgtacacagtgtttca

SEQ ID NO: 208098 - DNA, 25 bp, Rattus norvegicus
attcgcttacgttcacagtgtttca

SEQ ID NO: 208099 - DNA, 25 bp, Rattus norvegicus
attcgcttgactcggaaaggcatcc

SEQ ID NO: 208100 - DNA, 25 bp, Rattus norvegicus
attcgcttgactgggaaaggcatcc

SEQ ID NO: 208101 - DNA, 25 bp, Rattus norvegicus
attcggaaactcatctgtggtggtt

SEQ ID NO: 208102 - DNA, 25 bp, Rattus norvegicus
attcggaaactcttctgtggtggtt

SEQ ID NO: 208103 - DNA, 25 bp, Rattus norvegicus
attcggaacttcctcatctacgtgg

SEQ ID NO: 208104 - DNA, 25 bp, Rattus norvegicus
attcggaacttcgtcatctacgtgg

SEQ ID NO: 208105 - DNA, 25 bp, Rattus norvegicus
attcggaatggacattggccctgcc

SEQ ID NO: 208106 - DNA, 25 bp, Rattus norvegicus
attcggaatggagattggccctgcc

SEQ ID NO: 208107 - DNA, 25 bp, Rattus norvegicus
attcggagaccgatgctgacttact

SEQ ID NO: 208108 - DNA, 25 bp, Rattus norvegicus
attcggagaccgttgctgacttact

SEQ ID NO: 208109 - DNA, 25 bp, Rattus norvegicus
attcggagagctcgccaagtgcttt

SEQ ID NO: 208110 - DNA, 25 bp, Rattus norvegicus
attcggagagctggccaagtgcttt

SEQ ID NO: 208111 - DNA, 25 bp, Rattus norvegicus
attcggatgcagagggcaacccatt

SEQ ID NO: 208112 - DNA, 25 bp, Rattus norvegicus
attcggatgcagtgggcaacccatt

SEQ ID NO: 208113 - DNA, 25 bp, Rattus norvegicus
attcggattcgacaaggccagcagt

SEQ ID NO: 208114 - DNA, 25 bp, Rattus norvegicus
attcggattcgagaaggccagcagt

SEQ ID NO: 208115 - DNA, 25 bp, Rattus norvegicus
attcggcaccttctggaacgtgatc

SEQ ID NO: 208116 - DNA, 25 bp, Rattus norvegicus
attcggcaccttgtggaacgtgatc

SEQ ID NO: 208117 - DNA, 25 bp, Rattus norvegicus
attcggcagccgacacaaggacagt

SEQ ID NO: 208118 - DNA, 25 bp, Rattus norvegicus
attcggcagccgtcacaaggacagt

SEQ ID NO: 208119 - DNA, 25 bp, Rattus norvegicus
attcggcaggtgaatcttccttaaa

SEQ ID NO: 208120 - DNA, 25 bp, Rattus norvegicus
attcggcaggtgtatcttccttaaa

SEQ ID NO: 208121 - DNA, 25 bp, Rattus norvegicus
attcggcatgcccaacgtggtaatt

SEQ ID NO: 208122 - DNA, 25 bp, Rattus norvegicus
attcggcatgccgaacgtggtaatt

SEQ ID NO: 208123 - DNA, 25 bp, Rattus norvegicus
attcggcattatatccttccttata

SEQ ID NO: 208124 - DNA, 25 bp, Rattus norvegicus
attcggcattatttccttccttata

SEQ ID NO: 208125 - DNA, 25 bp, Rattus norvegicus
attcggcctccacgttcctagtgga

SEQ ID NO: 208126 - DNA, 25 bp, Rattus norvegicus
attcggcctccaggttcctagtgga

SEQ ID NO: 208127 - DNA, 25 bp, Rattus norvegicus
attcggcctgtgacttcagacagca

SEQ ID NO: 208128 - DNA, 25 bp, Rattus norvegicus
attcggcctgtgtcttcagacagca

SEQ ID NO: 208129 - DNA, 25 bp, Rattus norvegicus
attcggcgcaagacagagctggctg

SEQ ID NO: 208130 - DNA, 25 bp, Rattus norvegicus
attcggcgcaagtcagagctggctg

SEQ ID NO: 208131 - DNA, 25 bp, Rattus norvegicus
attcggcggcccagtcgacagcttg

SEQ ID NO: 208132 - DNA, 25 bp, Rattus norvegicus
attcggcggccctgtcgacagcttg

SEQ ID NO: 208133 - DNA, 25 bp, Rattus norvegicus
attcggctcacacagtacatggatg

SEQ ID NO: 208134 - DNA, 25 bp, Rattus norvegicus
attcggctcacagagtacatggatg

SEQ ID NO: 208135 - DNA, 25 bp, Rattus norvegicus
attcggctgagtacgtcctaagtca

SEQ ID NO: 208136 - DNA, 25 bp, Rattus norvegicus
attcggctgagttcgtcctaagtca

SEQ ID NO: 208137 - DNA, 25 bp, Rattus norvegicus
attcggctgctacctgcttagtgac

SEQ ID NO: 208138 - DNA, 25 bp, Rattus norvegicus
attcggctgctagctgcttagtgac

SEQ ID NO: 208139 - DNA, 25 bp, Rattus norvegicus
attcggctgtcgacggctttgttcc

SEQ ID NO: 208140 - DNA, 25 bp, Rattus norvegicus
attcggctgtcgtcggctttgttcc

SEQ ID NO: 208141 - DNA, 25 bp, Rattus norvegicus
attcggcttatcaggtgcggctatc

SEQ ID NO: 208142 - DNA, 25 bp, Rattus norvegicus
attcggcttatctggtgcggctatc

SEQ ID NO: 208143 - DNA, 25 bp, Rattus norvegicus
attcggcttccgaagcagagtttgt

SEQ ID NO: 208144 - DNA, 25 bp, Rattus norvegicus
attcggcttccgtagcagagtttgt

SEQ ID NO: 208145 - DNA, 25 bp, Rattus norvegicus
attcgggaaggaagctccaggccct

SEQ ID NO: 208146 - DNA, 25 bp, Rattus norvegicus
attcgggaaggatgctccaggccct

SEQ ID NO: 208147 - DNA, 25 bp, Rattus norvegicus
attcgggacaccaggagactgattc

SEQ ID NO: 208148 - DNA, 25 bp, Rattus norvegicus
attcgggacacctggagactgattc

SEQ ID NO: 208149 - DNA, 25 bp, Rattus norvegicus
attcgggaccaaagcatgttcataa

SEQ ID NO: 208150 - DNA, 25 bp, Rattus norvegicus
attcgggaccaatgcatgttcataa

SEQ ID NO: 208151 - DNA, 25 bp, Rattus norvegicus
attcgggaccgcctctggcagatcc

SEQ ID NO: 208152 - DNA, 25 bp, Rattus norvegicus
attcgggaccgcgtctggcagatcc

SEQ ID NO: 208153 - DNA, 25 bp, Rattus norvegicus
attcgggagcgcatggaagagatcc

SEQ ID NO: 208154 - DNA, 25 bp, Rattus norvegicus
attcgggagcgcttggaagagatcc

SEQ ID NO: 208155 - DNA, 25 bp, Rattus norvegicus
attcgggagtgactctcagtttctt

SEQ ID NO: 208156 - DNA, 25 bp, Rattus norvegicus
attcgggagtgagtctcagtttctt

SEQ ID NO: 208157 - DNA, 25 bp, Rattus norvegicus
attcgggatgtcacacctctgtaat

SEQ ID NO: 208158 - DNA, 25 bp, Rattus norvegicus
attcgggatgtctcacctctgtaat

SEQ ID NO: 208159 - DNA, 25 bp, Rattus norvegicus
attcgggctaggaacgctgccgcag

SEQ ID NO: 208160 - DNA, 25 bp, Rattus norvegicus
attcgggctaggtacgctgccgcag

SEQ ID NO: 208161 - DNA, 25 bp, Rattus norvegicus
attcgggctgacatgactgcctcgg

SEQ ID NO: 208162 - DNA, 25 bp, Rattus norvegicus
attcgggctgacttgactgcctcgg

SEQ ID NO: 208163 - DNA, 25 bp, Rattus norvegicus
attcgggtctctaacagctctcaaa

SEQ ID NO: 208164 - DNA, 25 bp, Rattus norvegicus
attcgggtctcttacagctctcaaa

SEQ ID NO: 208165 - DNA, 25 bp, Rattus norvegicus
attcggtagagtcataaaggcaagc

SEQ ID NO: 208166 - DNA, 25 bp, Rattus norvegicus
attcggtagagtgataaaggcaagc

SEQ ID NO: 208167 - DNA, 25 bp, Rattus norvegicus
attcggtatttcatgggtaactctt

SEQ ID NO: 208168 - DNA, 25 bp, Rattus norvegicus
attcggtatttcttgggtaactctt

SEQ ID NO: 208169 - DNA, 25 bp, Rattus norvegicus
attcggtcaattctcactgtcatca

SEQ ID NO: 208170 - DNA, 25 bp, Rattus norvegicus
attcggtcaattgtcactgtcatca

SEQ ID NO: 208171 - DNA, 25 bp, Rattus norvegicus
attcggtccactccttacatgtgta

SEQ ID NO: 208172 - DNA, 25 bp, Rattus norvegicus
attcggtccactgcttacatgtgta

SEQ ID NO: 208173 - DNA, 25 bp, Rattus norvegicus
attcggtctgtcagcagctgttgag

SEQ ID NO: 208174 - DNA, 25 bp, Rattus norvegicus
attcggtctgtctgcagctgttgag

SEQ ID NO: 208175 - DNA, 25 bp, Rattus norvegicus
attcggtgctgacgctgcatccaaa

SEQ ID NO: 208176 - DNA, 25 bp, Rattus norvegicus
attcggtgctgaggctgcatccaaa

SEQ ID NO: 208177 - DNA, 25 bp, Rattus norvegicus
attcggttccttctggcctttgtgg

SEQ ID NO: 208178 - DNA, 25 bp, Rattus norvegicus
attcggttccttgtggcctttgtgg

SEQ ID NO: 208179 - DNA, 25 bp, Rattus norvegicus
attcggttgtggctctgatcagcaa

SEQ ID NO: 208180 - DNA, 25 bp, Rattus norvegicus
attcggttgtgggtctgatcagcaa

SEQ ID NO: 208181 - DNA, 25 bp, Rattus norvegicus
attcgtacaagtcctcttcgtcatt

SEQ ID NO: 208182 - DNA, 25 bp, Rattus norvegicus
attcgtacaagtgctcttcgtcatt

SEQ ID NO: 208183 - DNA, 25 bp, Rattus norvegicus
attcgtaccacacagtttcctttgc

SEQ ID NO: 208184 - DNA, 25 bp, Rattus norvegicus
attcgtaccacagagtttcctttgc

SEQ ID NO: 208185 - DNA, 25 bp, Rattus norvegicus
attcgtacttcgctgcgacgctcaa

SEQ ID NO: 208186 - DNA, 25 bp, Rattus norvegicus
attcgtacttcggtgcgacgctcaa

SEQ ID NO: 208187 - DNA, 25 bp, Rattus norvegicus
attcgtagttgtctgattccgtagt

SEQ ID NO: 208188 - DNA, 25 bp, Rattus norvegicus
attcgtagttgtgtgattccgtagt

SEQ ID NO: 208189 - DNA, 25 bp, Rattus norvegicus
attcgtataaatcacctgcctggct

SEQ ID NO: 208190 - DNA, 25 bp, Rattus norvegicus
attcgtataaatgacctgcctggct

SEQ ID NO: 208191 - DNA, 25 bp, Rattus norvegicus
attcgtcacaatccctattgtcccg

SEQ ID NO: 208192 - DNA, 25 bp, Rattus norvegicus
attcgtcacaatgcctattgtcccg

SEQ ID NO: 208193 - DNA, 25 bp, Rattus norvegicus
attcgtcacctacggaatggagcct

SEQ ID NO: 208194 - DNA, 25 bp, Rattus norvegicus
attcgtcacctagggaatggagcct

SEQ ID NO: 208195 - DNA, 25 bp, Rattus norvegicus
attcgtcaggccagccaggcaggtc

SEQ ID NO: 208196 - DNA, 25 bp, Rattus norvegicus
attcgtcaggcctgccaggcaggtc

SEQ ID NO: 208197 - DNA, 25 bp, Rattus norvegicus
attcgtcatctaagcatcaactgta

SEQ ID NO: 208198 - DNA, 25 bp, Rattus norvegicus
attcgtcatctatgcatcaactgta

SEQ ID NO: 208199 - DNA, 25 bp, Rattus norvegicus
attcgtcattaaattcctacctgcc

SEQ ID NO: 208200 - DNA, 25 bp, Rattus norvegicus
attcgtcattaatttcctacctgcc

SEQ ID NO: 208201 - DNA, 25 bp, Rattus norvegicus
attcgtccaacaccaagaaggcctt

SEQ ID NO: 208202 - DNA, 25 bp, Rattus norvegicus
attcgtccaacagcaagaaggcctt

SEQ ID NO: 208203 - DNA, 25 bp, Rattus norvegicus
attcgtcccaccaacaatggcagtt

SEQ ID NO: 208204 - DNA, 25 bp, Rattus norvegicus
attcgtcccacctacaatggcagtt

SEQ ID NO: 208205 - DNA, 25 bp, Rattus norvegicus
attcgtctggtgcagaatcccctga

SEQ ID NO: 208206 - DNA, 25 bp, Rattus norvegicus
attcgtctggtggagaatcccctga

SEQ ID NO: 208207 - DNA, 25 bp, Rattus norvegicus
attcgtctgttcctctagtgggaag

SEQ ID NO: 208208 - DNA, 25 bp, Rattus norvegicus
attcgtctgttcgtctagtgggaag

SEQ ID NO: 208209 - DNA, 25 bp, Rattus norvegicus
attcgtgaacttagccaaggaccaa

SEQ ID NO: 208210 - DNA, 25 bp, Rattus norvegicus
attcgtgaactttgccaaggaccaa

SEQ ID NO: 208211 - DNA, 25 bp, Rattus norvegicus
attcgtgagcaactacgccaaggcc

SEQ ID NO: 208212 - DNA, 25 bp, Rattus norvegicus
attcgtgagcaagtacgccaaggcc

SEQ ID NO: 208213 - DNA, 25 bp, Rattus norvegicus
attcgtgagtctcagttccattgtc

SEQ ID NO: 208214 - DNA, 25 bp, Rattus norvegicus
attcgtgagtctgagttccattgtc

SEQ ID NO: 208215 - DNA, 25 bp, Rattus norvegicus
attcgtgcagttctcgtaacacaga

SEQ ID NO: 208216 - DNA, 25 bp, Rattus norvegicus
attcgtgcagttgtcgtaacacaga

SEQ ID NO: 208217 - DNA, 25 bp, Rattus norvegicus
attcgtggatttcatttccttctca

SEQ ID NO: 208218 - DNA, 25 bp, Rattus norvegicus
attcgtggatttgatttccttctca

SEQ ID NO: 208219 - DNA, 25 bp, Rattus norvegicus
attcgtgtaatcaaagttcctaaga

SEQ ID NO: 208220 - DNA, 25 bp, Rattus norvegicus
attcgtgtaatctaagttcctaaga

SEQ ID NO: 208221 - DNA, 25 bp, Rattus norvegicus
attcgtgtagccagcattgcaggtt

SEQ ID NO: 208222 - DNA, 25 bp, Rattus norvegicus
attcgtgtagcctgcattgcaggtt

SEQ ID NO: 208223 - DNA, 25 bp, Rattus norvegicus
attcgtgtccctagacgatctgtgt

SEQ ID NO: 208224 - DNA, 25 bp, Rattus norvegicus
attcgtgtcccttgacgatctgtgt

SEQ ID NO: 208225 - DNA, 25 bp, Rattus norvegicus
attcgtgtttttcaacatccctcag

SEQ ID NO: 208226 - DNA, 25 bp, Rattus norvegicus
attcgtgtttttgaacatccctcag

SEQ ID NO: 208227 - DNA, 25 bp, Rattus norvegicus
attcgttaccatccatgttctcaag

SEQ ID NO: 208228 - DNA, 25 bp, Rattus norvegicus
attcgttaccatgcatgttctcaag

SEQ ID NO: 208229 - DNA, 25 bp, Rattus norvegicus
attcgttattgcctgccgatattat

SEQ ID NO: 208230 - DNA, 25 bp, Rattus norvegicus
attcgttattgcgtgccgatattat

SEQ ID NO: 208231 - DNA, 25 bp, Rattus norvegicus
attcgttcaaacattcctgtcttcc

SEQ ID NO: 208232 - DNA, 25 bp, Rattus norvegicus
attcgttcaaactttcctgtcttcc

SEQ ID NO: 208233 - DNA, 25 bp, Rattus norvegicus
attcgttcaactagtaaacctgcct

SEQ ID NO: 208234 - DNA, 25 bp, Rattus norvegicus
attcgttcaacttgtaaacctgcct

SEQ ID NO: 208235 - DNA, 25 bp, Rattus norvegicus
attcgttcctaacggcatgtccaaa

SEQ ID NO: 208236 - DNA, 25 bp, Rattus norvegicus
attcgttcctaagggcatgtccaaa

SEQ ID NO: 208237 - DNA, 25 bp, Rattus norvegicus
attcgttcctgtcccgtgtcctgtt

SEQ ID NO: 208238 - DNA, 25 bp, Rattus norvegicus
attcgttcctgtgccgtgtcctgtt

SEQ ID NO: 208239 - DNA, 25 bp, Rattus norvegicus
attcgttggcacacttgtacagtca

SEQ ID NO: 208240 - DNA, 25 bp, Rattus norvegicus
attcgttggcacatctgctgggtga

SEQ ID NO: 208241 - DNA, 25 bp, Rattus norvegicus
attcgttggcactcttgtacagtca

SEQ ID NO: 208242 - DNA, 25 bp, Rattus norvegicus
attcgttggcacttctgctgggtga

SEQ ID NO: 208243 - DNA, 25 bp, Rattus norvegicus
attcgttgtaacacagatctgggta

SEQ ID NO: 208244 - DNA, 25 bp, Rattus norvegicus
attcgttgtaactcagatctgggta

SEQ ID NO: 208245 - DNA, 25 bp, Rattus norvegicus
attcgtttcaggatctccactgagg

SEQ ID NO: 208246 - DNA, 25 bp, Rattus norvegicus
attcgtttcaggttctccactgagg

SEQ ID NO: 208247 - DNA, 25 bp, Rattus norvegicus
attctaaaatctcttgggcactgga

SEQ ID NO: 208248 - DNA, 25 bp, Rattus norvegicus
attctaaaatctgttgggcactgga

SEQ ID NO: 208249 - DNA, 25 bp, Rattus norvegicus
attctaaacccacaaccagttccag

SEQ ID NO: 208250 - DNA, 25 bp, Rattus norvegicus
attctaaacccagaaccagttccag

SEQ ID NO: 208251 - DNA, 25 bp, Rattus norvegicus
attctaacaaagctcttcccgcctg

SEQ ID NO: 208252 - DNA, 25 bp, Rattus norvegicus
attctaacaaaggtcttcccgcctg

SEQ ID NO: 208253 - DNA, 25 bp, Rattus norvegicus
attctaaccaagaagggctgtcttt

SEQ ID NO: 208254 - DNA, 25 bp, Rattus norvegicus
attctaaccaagtagggctgtcttt

SEQ ID NO: 208255 - DNA, 25 bp, Rattus norvegicus
attctaaccacgaatggcgtccagg

SEQ ID NO: 208256 - DNA, 25 bp, Rattus norvegicus
attctaaccacgtatggcgtccagg

SEQ ID NO: 208257 - DNA, 25 bp, Rattus norvegicus
attctaaccatcacatagcatgcta

SEQ ID NO: 208258 - DNA, 25 bp, Rattus norvegicus
attctaaccatctcatagcatgcta

SEQ ID NO: 208259 - DNA, 25 bp, Rattus norvegicus
attctaactggtatggtgctgccta

SEQ ID NO: 208260 - DNA, 25 bp, Rattus norvegicus
attctaactggtttggtgctgccta

SEQ ID NO: 208261 - DNA, 25 bp, Rattus norvegicus
attctaacttcgctgccttcatcga

SEQ ID NO: 208262 - DNA, 25 bp, Rattus norvegicus
attctaacttcggtgccttcatcga

SEQ ID NO: 208263 - DNA, 25 bp, Rattus norvegicus
attctaagccttctgccagtgggct

SEQ ID NO: 208264 - DNA, 25 bp, Rattus norvegicus
attctaagccttgtgccagtgggct

SEQ ID NO: 208265 - DNA, 25 bp, Rattus norvegicus
attctaagctagattcacccttctc

SEQ ID NO: 208266 - DNA, 25 bp, Rattus norvegicus
attctaagctagtttcacccttctc

SEQ ID NO: 208267 - DNA, 25 bp, Rattus norvegicus
attctaaggcggagtcacagctcta

SEQ ID NO: 208268 - DNA, 25 bp, Rattus norvegicus
attctaaggcggtgtcacagctcta

SEQ ID NO: 208269 - DNA, 25 bp, Rattus norvegicus
attctaagttttagaaagtctgcac

SEQ ID NO: 208270 - DNA, 25 bp, Rattus norvegicus
attctaagtttttgaaagtctgcac

SEQ ID NO: 208271 - DNA, 25 bp, Rattus norvegicus
attctaatcagtattgtctcttgga

SEQ ID NO: 208272 - DNA, 25 bp, Rattus norvegicus
attctaatcagttttgtctcttgga

SEQ ID NO: 208273 - DNA, 25 bp, Rattus norvegicus
attctaatccccatcagttttactg

SEQ ID NO: 208274 - DNA, 25 bp, Rattus norvegicus
attctaatccccttcagttttactg

SEQ ID NO: 208275 - DNA, 25 bp, Rattus norvegicus
attctaatcctactgggttccatca

SEQ ID NO: 208276 - DNA, 25 bp, Rattus norvegicus
attctaatcctagtgggttccatca

SEQ ID NO: 208277 - DNA, 25 bp, Rattus norvegicus
attctaatcttccacattcgtttgc

SEQ ID NO: 208278 - DNA, 25 bp, Rattus norvegicus
attctaatcttcgacattcgtttgc

SEQ ID NO: 208279 - DNA, 25 bp, Rattus norvegicus
attctaatggcgacttgtgggtcca

SEQ ID NO: 208280 - DNA, 25 bp, Rattus norvegicus
attctaatggcgtcttgtgggtcca

SEQ ID NO: 208281 - DNA, 25 bp, Rattus norvegicus
attctaatgtccctagtcacaaggg

SEQ ID NO: 208282 - DNA, 25 bp, Rattus norvegicus
attctaatgtccgtagtcacaaggg

SEQ ID NO: 208283 - DNA, 25 bp, Rattus norvegicus
attctacaaagtcctctgtgtctct

SEQ ID NO: 208284 - DNA, 25 bp, Rattus norvegicus
attctacaaagtgctctgtgtctct

SEQ ID NO: 208285 - DNA, 25 bp, Rattus norvegicus
attctacaagcacaccatgattctg

SEQ ID NO: 208286 - DNA, 25 bp, Rattus norvegicus
attctacaagcagaccatgattctg

SEQ ID NO: 208287 - DNA, 25 bp, Rattus norvegicus
attctacaagtacggcccgaggtgc

SEQ ID NO: 208288 - DNA, 25 bp, Rattus norvegicus
attctacaagtagggcccgaggtgc

SEQ ID NO: 208289 - DNA, 25 bp, Rattus norvegicus
attctacaggttagcatgtttcgtc

SEQ ID NO: 208290 - DNA, 25 bp, Rattus norvegicus
attctacaggtttgcatgtttcgtc

SEQ ID NO: 208291 - DNA, 25 bp, Rattus norvegicus
attctaccaactcaacttcatcctg

SEQ ID NO: 208292 - DNA, 25 bp, Rattus norvegicus
attctaccaactgaacttcatcctg

SEQ ID NO: 208293 - DNA, 25 bp, Rattus norvegicus
attctaccctcgaggtgtcaagtgt

SEQ ID NO: 208294 - DNA, 25 bp, Rattus norvegicus
attctaccctcgtggtgtcaagtgt

SEQ ID NO: 208295 - DNA, 25 bp, Rattus norvegicus
attctacctaccactgtttgtgaga

SEQ ID NO: 208296 - DNA, 25 bp, Rattus norvegicus
attctacctacctctgtttgtgaga

SEQ ID NO: 208297 - DNA, 25 bp, Rattus norvegicus
attctacctgtaccatagtcctgtt

SEQ ID NO: 208298 - DNA, 25 bp, Rattus norvegicus
attctacctgtagcatagtcctgtt

SEQ ID NO: 208299 - DNA, 25 bp, Rattus norvegicus
attctacgagtgcacaacatcatca

SEQ ID NO: 208300 - DNA, 25 bp, Rattus norvegicus
attctacgagtggacaacatcatca

SEQ ID NO: 208301 - DNA, 25 bp, Rattus norvegicus
attctacgccataattgtctgtgcg

SEQ ID NO: 208302 - DNA, 25 bp, Rattus norvegicus
attctacgccattattgtctgtgcg

SEQ ID NO: 208303 - DNA, 25 bp, Rattus norvegicus
attctactagggacacggctcctaa

SEQ ID NO: 208304 - DNA, 25 bp, Rattus norvegicus
attctactagggtcacggctcctaa

SEQ ID NO: 208305 - DNA, 25 bp, Rattus norvegicus
attctactccaacttccatgggcta

SEQ ID NO: 208306 - DNA, 25 bp, Rattus norvegicus
attctactccaagttccatgggcta

SEQ ID NO: 208307 - DNA, 25 bp, Rattus norvegicus
attctactccagattttgacacgta

SEQ ID NO: 208308 - DNA, 25 bp, Rattus norvegicus
attctactccagtttttgacacgta

SEQ ID NO: 208309 - DNA, 25 bp, Rattus norvegicus
attctactccttctgtatacttcac

SEQ ID NO: 208310 - DNA, 25 bp, Rattus norvegicus
attctactccttgtgtatacttcac

SEQ ID NO: 208311 - DNA, 25 bp, Rattus norvegicus
attctactcggacctacggagcgtc

SEQ ID NO: 208312 - DNA, 25 bp, Rattus norvegicus
attctactcggagctacggagcgtc

SEQ ID NO: 208313 - DNA, 25 bp, Rattus norvegicus
attctactctatacttgccaacgtg

SEQ ID NO: 208314 - DNA, 25 bp, Rattus norvegicus
attctactctattcttgccaacgtg

SEQ ID NO: 208315 - DNA, 25 bp, Rattus norvegicus
attctactgttcagcagctcgactg

SEQ ID NO: 208316 - DNA, 25 bp, Rattus norvegicus
attctactgttctgcagctcgactg

SEQ ID NO: 208317 - DNA, 25 bp, Rattus norvegicus
attctactgtttctctgtgcttaaa

SEQ ID NO: 208318 - DNA, 25 bp, Rattus norvegicus
attctactgtttgtctgtgcttaaa

SEQ ID NO: 208319 - DNA, 25 bp, Rattus norvegicus
attctacttgttaatcttgttgcca

SEQ ID NO: 208320 - DNA, 25 bp, Rattus norvegicus
attctacttgtttatcttgttgcca

SEQ ID NO: 208321 - DNA, 25 bp, Rattus norvegicus
attctagaacgcagtctgtagacca

SEQ ID NO: 208322 - DNA, 25 bp, Rattus norvegicus
attctagaacgctgtctgtagacca

SEQ ID NO: 208323 - DNA, 25 bp, Rattus norvegicus
attctagaccccagaggctgcaatt

SEQ ID NO: 208324 - DNA, 25 bp, Rattus norvegicus
attctagacccctgaggctgcaatt

SEQ ID NO: 208325 - DNA, 25 bp, Rattus norvegicus
attctagagcagcatcttagcccct

SEQ ID NO: 208326 - DNA, 25 bp, Rattus norvegicus
attctagagcaggatcttagcccct

SEQ ID NO: 208327 - DNA, 25 bp, Rattus norvegicus
attctagctctaaggctgtggccaa

SEQ ID NO: 208328 - DNA, 25 bp, Rattus norvegicus
attctagctctatggctgtggccaa

SEQ ID NO: 208329 - DNA, 25 bp, Rattus norvegicus
attctagctttacccttctgcagtt

SEQ ID NO: 208330 - DNA, 25 bp, Rattus norvegicus
attctagctttagccttctgcagtt

SEQ ID NO: 208331 - DNA, 25 bp, Rattus norvegicus
attctagcttttacttttctctgta

SEQ ID NO: 208332 - DNA, 25 bp, Rattus norvegicus
attctagctttttcttttctctgta

SEQ ID NO: 208333 - DNA, 25 bp, Rattus norvegicus
attctaggggtgctccaggctgtca

SEQ ID NO: 208334 - DNA, 25 bp, Rattus norvegicus
attctaggggtggtccaggctgtca

SEQ ID NO: 208335 - DNA, 25 bp, Rattus norvegicus
attctaggtactctgctttggcttc

SEQ ID NO: 208336 - DNA, 25 bp, Rattus norvegicus
attctaggtactgtgctttggcttc

SEQ ID NO: 208337 - DNA, 25 bp, Rattus norvegicus
attctagttcataccatccatcgtg

SEQ ID NO: 208338 - DNA, 25 bp, Rattus norvegicus
attctagttcattccatccatcgtg

SEQ ID NO: 208339 - DNA, 25 bp, Rattus norvegicus
attctagttctaatgctgtgggcaa

SEQ ID NO: 208340 - DNA, 25 bp, Rattus norvegicus
attctagttctattgctgtgggcaa

SEQ ID NO: 208341 - DNA, 25 bp, Rattus norvegicus
attctagtttgtcctgtggcccaaa

SEQ ID NO: 208342 - DNA, 25 bp, Rattus norvegicus
attctagtttgtgctgtggcccaaa

SEQ ID NO: 208343 - DNA, 25 bp, Rattus norvegicus
attctataaactagcgttcctccct

SEQ ID NO: 208344 - DNA, 25 bp, Rattus norvegicus
attctataaacttgcgttcctccct

SEQ ID NO: 208345 - DNA, 25 bp, Rattus norvegicus
attctataaatccaccctgggctac

SEQ ID NO: 208346 - DNA, 25 bp, Rattus norvegicus
attctataaatcgaccctgggctac

SEQ ID NO: 208347 - DNA, 25 bp, Rattus norvegicus
attctataacttcccttgaacaggt

SEQ ID NO: 208348 - DNA, 25 bp, Rattus norvegicus
attctataacttgccttgaacaggt

SEQ ID NO: 208349 - DNA, 25 bp, Rattus norvegicus
attctatagcctactttccaggagg

SEQ ID NO: 208350 - DNA, 25 bp, Rattus norvegicus
attctatagccttctttccaggagg

SEQ ID NO: 208351 - DNA, 25 bp, Rattus norvegicus
attctataggatccaattctcggct

SEQ ID NO: 208352 - DNA, 25 bp, Rattus norvegicus
attctataggatgcaattctcggct

SEQ ID NO: 208353 - DNA, 25 bp, Rattus norvegicus
attctatagtgtctctacctctgga

SEQ ID NO: 208354 - DNA, 25 bp, Rattus norvegicus
attctatagtgtgtctacctctgga

SEQ ID NO: 208355 - DNA, 25 bp, Rattus norvegicus
attctatatatcattctggcttttt

SEQ ID NO: 208356 - DNA, 25 bp, Rattus norvegicus
attctatatatctttctggcttttt

SEQ ID NO: 208357 - DNA, 25 bp, Rattus norvegicus
attctatcaagaaggtttcccgccc

SEQ ID NO: 208358 - DNA, 25 bp, Rattus norvegicus
attctatcaagatggtttcccgccc

SEQ ID NO: 208359 - DNA, 25 bp, Rattus norvegicus
attctatcatcgcacagtctccgtg

SEQ ID NO: 208360 - DNA, 25 bp, Rattus norvegicus
attctatcatcggacagtctccgtg

SEQ ID NO: 208361 - DNA, 25 bp, Rattus norvegicus
attctatcccttaatgccagacaga

SEQ ID NO: 208362 - DNA, 25 bp, Rattus norvegicus
attctatccctttatgccagacaga

SEQ ID NO: 208363 - DNA, 25 bp, Rattus norvegicus
attctatccttgacgagcatgccag

SEQ ID NO: 208364 - DNA, 25 bp, Rattus norvegicus
attctatccttgtcgagcatgccag

SEQ ID NO: 208365 - DNA, 25 bp, Rattus norvegicus
attctatctacactccacattggag

SEQ ID NO: 208366 - DNA, 25 bp, Rattus norvegicus
attctatctacagtccacattggag

SEQ ID NO: 208367 - DNA, 25 bp, Rattus norvegicus
attctatctatgagtttgtcctcct

SEQ ID NO: 208368 - DNA, 25 bp, Rattus norvegicus
attctatctatgtgtttgtcctcct

SEQ ID NO: 208369 - DNA, 25 bp, Rattus norvegicus
attctatcttgcctgttgtattgta

SEQ ID NO: 208370 - DNA, 25 bp, Rattus norvegicus
attctatcttgcgtgttgtattgta

SEQ ID NO: 208371 - DNA, 25 bp, Rattus norvegicus
attctatgcacacgtacggcttggg

SEQ ID NO: 208372 - DNA, 25 bp, Rattus norvegicus
attctatgcacaggtacggcttggg

SEQ ID NO: 208373 - DNA, 25 bp, Rattus norvegicus
attctatgctctactatactatcca

SEQ ID NO: 208374 - DNA, 25 bp, Rattus norvegicus
attctatgctcttctatactatcca

SEQ ID NO: 208375 - DNA, 25 bp, Rattus norvegicus
attctatgctgtaactctcaagttc

SEQ ID NO: 208376 - DNA, 25 bp, Rattus norvegicus
attctatgctgttactctcaagttc

SEQ ID NO: 208377 - DNA, 25 bp, Rattus norvegicus
attctatgtcttctctgtaaggcac

SEQ ID NO: 208378 - DNA, 25 bp, Rattus norvegicus
attctatgtcttgtctgtaaggcac

SEQ ID NO: 208379 - DNA, 25 bp, Rattus norvegicus
attctatgtggtcttgagtgcttca

SEQ ID NO: 208380 - DNA, 25 bp, Rattus norvegicus
attctatgtggtgttgagtgcttca

SEQ ID NO: 208381 - DNA, 25 bp, Rattus norvegicus
attctattaactccatcgtctccta

SEQ ID NO: 208382 - DNA, 25 bp, Rattus norvegicus
attctattaactgcatcgtctccta

SEQ ID NO: 208383 - DNA, 25 bp, Rattus norvegicus
attctattacctcactttggacgca

SEQ ID NO: 208384 - DNA, 25 bp, Rattus norvegicus
attctattacctgactttggacgca

SEQ ID NO: 208385 - DNA, 25 bp, Rattus norvegicus
attctattcagtaggctctgtgccc

SEQ ID NO: 208386 - DNA, 25 bp, Rattus norvegicus
attctattcagttggctctgtgccc

SEQ ID NO: 208387 - DNA, 25 bp, Rattus norvegicus
attctattccacacagtgccgcaaa

SEQ ID NO: 208388 - DNA, 25 bp, Rattus norvegicus
attctattccactcagtgccgcaaa

SEQ ID NO: 208389 - DNA, 25 bp, Rattus norvegicus
attctattccatatatttcaatttg

SEQ ID NO: 208390 - DNA, 25 bp, Rattus norvegicus
attctattccatttatttcaatttg

SEQ ID NO: 208391 - DNA, 25 bp, Rattus norvegicus
attctattcccaacaaaccttagcc

SEQ ID NO: 208392 - DNA, 25 bp, Rattus norvegicus
attctattcccatcaaaccttagcc

SEQ ID NO: 208393 - DNA, 25 bp, Rattus norvegicus
attctattctcacactgtatccagg

SEQ ID NO: 208394 - DNA, 25 bp, Rattus norvegicus
attctattctcagactgtatccagg

SEQ ID NO: 208395 - DNA, 25 bp, Rattus norvegicus
attctattgaccatgcaaccacctg

SEQ ID NO: 208396 - DNA, 25 bp, Rattus norvegicus
attctattgaccttgcaaccacctg

SEQ ID NO: 208397 - DNA, 25 bp, Rattus norvegicus
attctattgggccaccagtgtatga

SEQ ID NO: 208398 - DNA, 25 bp, Rattus norvegicus
attctattgggcgaccagtgtatga

SEQ ID NO: 208399 - DNA, 25 bp, Rattus norvegicus
attctattttgtacgtttgatggtc

SEQ ID NO: 208400 - DNA, 25 bp, Rattus norvegicus
attctattttgttcgtttgatggtc

SEQ ID NO: 208401 - DNA, 25 bp, Rattus norvegicus
attctatttttgataggcgtctcta

SEQ ID NO: 208402 - DNA, 25 bp, Rattus norvegicus
attctatttttgttaggcgtctcta

SEQ ID NO: 208403 - DNA, 25 bp, Rattus norvegicus
attctcaaacatctccatctgctat

SEQ ID NO: 208404 - DNA, 25 bp, Rattus norvegicus
attctcaaacatgtccatctgctat

SEQ ID NO: 208405 - DNA, 25 bp, Rattus norvegicus
attctcaaagatatctcagccttag

SEQ ID NO: 208406 - DNA, 25 bp, Rattus norvegicus
attctcaaagatttctcagccttag

SEQ ID NO: 208407 - DNA, 25 bp, Rattus norvegicus
attctcaaagtgacccatctgtggg

SEQ ID NO: 208408 - DNA, 25 bp, Rattus norvegicus
attctcaaagtgtcccatctgtggg

SEQ ID NO: 208409 - DNA, 25 bp, Rattus norvegicus
attctcaacttgagtgctattcgta

SEQ ID NO: 208410 - DNA, 25 bp, Rattus norvegicus
attctcaacttgtgtgctattcgta

SEQ ID NO: 208411 - DNA, 25 bp, Rattus norvegicus
attctcaagatgataattgtgcagt

SEQ ID NO: 208412 - DNA, 25 bp, Rattus norvegicus
attctcaagatgttaattgtgcagt

SEQ ID NO: 208413 - DNA, 25 bp, Rattus norvegicus
attctcaaggctcttaactcccttt

SEQ ID NO: 208414 - DNA, 25 bp, Rattus norvegicus
attctcaaggctgttaactcccttt

SEQ ID NO: 208415 - DNA, 25 bp, Rattus norvegicus
attctcaatgttccgtattctgtgg

SEQ ID NO: 208416 - DNA, 25 bp, Rattus norvegicus
attctcaatgttgcgtattctgtgg

SEQ ID NO: 208417 - DNA, 25 bp, Rattus norvegicus
attctcacagggagctgggcaagca

SEQ ID NO: 208418 - DNA, 25 bp, Rattus norvegicus
attctcacagggtgctgggcaagca

SEQ ID NO: 208419 - DNA, 25 bp, Rattus norvegicus
attctcacataaaccaaccagtcag

SEQ ID NO: 208420 - DNA, 25 bp, Rattus norvegicus
attctcacataatccaaccagtcag

SEQ ID NO: 208421 - DNA, 25 bp, Rattus norvegicus
attctcaccctcagtggtccactgt

SEQ ID NO: 208422 - DNA, 25 bp, Rattus norvegicus
attctcaccctctgtggtccactgt

SEQ ID NO: 208423 - DNA, 25 bp, Rattus norvegicus
attctcacctctcaacacatacaag

SEQ ID NO: 208424 - DNA, 25 bp, Rattus norvegicus
attctcacctctgaacacatacaag

SEQ ID NO: 208425 - DNA, 25 bp, Rattus norvegicus
attctcactgaaaaccatgcgtctg

SEQ ID NO: 208426 - DNA, 25 bp, Rattus norvegicus
attctcactgaataccatgcgtctg

SEQ ID NO: 208427 - DNA, 25 bp, Rattus norvegicus
attctcactgccctatatcaagagt

SEQ ID NO: 208428 - DNA, 25 bp, Rattus norvegicus
attctcactgccgtatatcaagagt

SEQ ID NO: 208429 - DNA, 25 bp, Rattus norvegicus
attctcagactgactttcaaggtgg

SEQ ID NO: 208430 - DNA, 25 bp, Rattus norvegicus
attctcagactgtctttcaaggtgg

SEQ ID NO: 208431 - DNA, 25 bp, Rattus norvegicus
attctcagccagcaagtgtcttgtg

SEQ ID NO: 208432 - DNA, 25 bp, Rattus norvegicus
attctcagccaggaagtgtcttgtg

SEQ ID NO: 208433 - DNA, 25 bp, Rattus norvegicus
attctcagccgcctggcaaacaggg

SEQ ID NO: 208434 - DNA, 25 bp, Rattus norvegicus
attctcagccgcgtggcaaacaggg

SEQ ID NO: 208435 - DNA, 25 bp, Rattus norvegicus
attctcagcctcaccaagcattaaa

SEQ ID NO: 208436 - DNA, 25 bp, Rattus norvegicus
attctcagcctctccaagcattaaa

SEQ ID NO: 208437 - DNA, 25 bp, Rattus norvegicus
attctcagcggcctgtcagcatgag

SEQ ID NO: 208438 - DNA, 25 bp, Rattus norvegicus
attctcagcggcgtgtcagcatgag

SEQ ID NO: 208439 - DNA, 25 bp, Rattus norvegicus
attctcagctacatctcgagcatca

SEQ ID NO: 208440 - DNA, 25 bp, Rattus norvegicus
attctcagctacttctcgagcatca

SEQ ID NO: 208441 - DNA, 25 bp, Rattus norvegicus
attctcagtagtactttctcacatt

SEQ ID NO: 208442 - DNA, 25 bp, Rattus norvegicus
attctcagtagttctttctcacatt

SEQ ID NO: 208443 - DNA, 25 bp, Rattus norvegicus
attctcagtcccagtgtgatcagcc

SEQ ID NO: 208444 - DNA, 25 bp, Rattus norvegicus
attctcagtccctgtgtgatcagcc

SEQ ID NO: 208445 - DNA, 25 bp, Rattus norvegicus
attctcagtgttcgtgaggcgacca

SEQ ID NO: 208446 - DNA, 25 bp, Rattus norvegicus
attctcagtgttggtgaggcgacca

SEQ ID NO: 208447 - DNA, 25 bp, Rattus norvegicus
attctcagtttcacagagtcattta

SEQ ID NO: 208448 - DNA, 25 bp, Rattus norvegicus
attctcagtttctcagagtcattta

SEQ ID NO: 208449 - DNA, 25 bp, Rattus norvegicus
attctcataatacttcccctaatag

SEQ ID NO: 208450 - DNA, 25 bp, Rattus norvegicus
attctcataatagttcccctaatag

SEQ ID NO: 208451 - DNA, 25 bp, Rattus norvegicus
attctcatatttcgttgtggacccc

SEQ ID NO: 208452 - DNA, 25 bp, Rattus norvegicus
attctcatatttggttgtggacccc

SEQ ID NO: 208453 - DNA, 25 bp, Rattus norvegicus
attctcatcaaccagtacatcgcag

SEQ ID NO: 208454 - DNA, 25 bp, Rattus norvegicus
attctcatcaacgagtacatcgcag

SEQ ID NO: 208455 - DNA, 25 bp, Rattus norvegicus
attctcatcctcatcatactctttg

SEQ ID NO: 208456 - DNA, 25 bp, Rattus norvegicus
attctcatcctcttcatactctttg

SEQ ID NO: 208457 - DNA, 25 bp, Rattus norvegicus
attctcatctccatcgttcaaaaaa

SEQ ID NO: 208458 - DNA, 25 bp, Rattus norvegicus
attctcatctccttcgttcaaaaaa

SEQ ID NO: 208459 - DNA, 25 bp, Rattus norvegicus
attctcatctgtaagtcagtctcca

SEQ ID NO: 208460 - DNA, 25 bp, Rattus norvegicus
attctcatctgttagtcagtctcca

SEQ ID NO: 208461 - DNA, 25 bp, Rattus norvegicus
attctcatgagaacaccccattaga

SEQ ID NO: 208462 - DNA, 25 bp, Rattus norvegicus
attctcatgagatcaccccattaga

SEQ ID NO: 208463 - DNA, 25 bp, Rattus norvegicus
attctcatggtcatccggctatact

SEQ ID NO: 208464 - DNA, 25 bp, Rattus norvegicus
attctcatggtcttccggctatact

SEQ ID NO: 208465 - DNA, 25 bp, Rattus norvegicus
attctcattagcacctgacatcctg

SEQ ID NO: 208466 - DNA, 25 bp, Rattus norvegicus
attctcattagctcctgacatcctg

SEQ ID NO: 208467 - DNA, 25 bp, Rattus norvegicus
attctcattcaaactctcacacatg

SEQ ID NO: 208468 - DNA, 25 bp, Rattus norvegicus
attctcattcaatctctcacacatg

SEQ ID NO: 208469 - DNA, 25 bp, Rattus norvegicus
attctcattcttctcattgggtgac

SEQ ID NO: 208470 - DNA, 25 bp, Rattus norvegicus
attctcattcttgtcattgggtgac

SEQ ID NO: 208471 - DNA, 25 bp, Rattus norvegicus
attctcatttctcctggtgatgctg

SEQ ID NO: 208472 - DNA, 25 bp, Rattus norvegicus
attctcatttctgctggtgatgctg

SEQ ID NO: 208473 - DNA, 25 bp, Rattus norvegicus
attctccaaagtacaaaccactctt

SEQ ID NO: 208474 - DNA, 25 bp, Rattus norvegicus
attctccaaagttcaaaccactctt

SEQ ID NO: 208475 - DNA, 25 bp, Rattus norvegicus
attctccaaggcaggagcctctcaa

SEQ ID NO: 208476 - DNA, 25 bp, Rattus norvegicus
attctccaaggctggagcctctcaa

SEQ ID NO: 208477 - DNA, 25 bp, Rattus norvegicus
attctccaagttaacttcctccacg

SEQ ID NO: 208478 - DNA, 25 bp, Rattus norvegicus
attctccaagtttacttcctccacg

SEQ ID NO: 208479 - DNA, 25 bp, Rattus norvegicus
attctccaccgacgccttggaaaag

SEQ ID NO: 208480 - DNA, 25 bp, Rattus norvegicus
attctccaccgaggccttggaaaag

SEQ ID NO: 208481 - DNA, 25 bp, Rattus norvegicus
attctccactgtaaatagcccgtta

SEQ ID NO: 208482 - DNA, 25 bp, Rattus norvegicus
attctccactgttaatagcccgtta

SEQ ID NO: 208483 - DNA, 25 bp, Rattus norvegicus
attctccagaagacacatgctctct

SEQ ID NO: 208484 - DNA, 25 bp, Rattus norvegicus
attctccagaagtcacatgctctct

SEQ ID NO: 208485 - DNA, 25 bp, Rattus norvegicus
attctccagcaccaaccagttaaat

SEQ ID NO: 208486 - DNA, 25 bp, Rattus norvegicus
attctccagcacgaaccagttaaat

SEQ ID NO: 208487 - DNA, 25 bp, Rattus norvegicus
attctccagctgcactgactgctgg

SEQ ID NO: 208488 - DNA, 25 bp, Rattus norvegicus
attctccagctggactgactgctgg

SEQ ID NO: 208489 - DNA, 25 bp, Rattus norvegicus
attctccagcttcaaaaggcagggc

SEQ ID NO: 208490 - DNA, 25 bp, Rattus norvegicus
attctccagcttgaaaaggcagggc

SEQ ID NO: 208491 - DNA, 25 bp, Rattus norvegicus
attctccagtctccacgtgtctggg

SEQ ID NO: 208492 - DNA, 25 bp, Rattus norvegicus
attctccagtctgcacgtgtctggg

SEQ ID NO: 208493 - DNA, 25 bp, Rattus norvegicus
attctccataaacgccaggtatttg

SEQ ID NO: 208494 - DNA, 25 bp, Rattus norvegicus
attctccataaaggccaggtatttg

SEQ ID NO: 208495 - DNA, 25 bp, Rattus norvegicus
attctccatcaacactttcttcaga

SEQ ID NO: 208496 - DNA, 25 bp, Rattus norvegicus
attctccatcaagactttcttcaga

SEQ ID NO: 208497 - DNA, 25 bp, Rattus norvegicus
attctccatgagcataaggcttcac

SEQ ID NO: 208498 - DNA, 25 bp, Rattus norvegicus
attctccatgaggataaggcttcac

SEQ ID NO: 208499 - DNA, 25 bp, Rattus norvegicus
attctccatgctctggatttcctgg

SEQ ID NO: 208500 - DNA, 25 bp, Rattus norvegicus
attctccatgctgtggatttcctgg

SEQ ID NO: 208501 - DNA, 25 bp, Rattus norvegicus
attctcccaaggagaccacatggtg

SEQ ID NO: 208502 - DNA, 25 bp, Rattus norvegicus
attctcccaaggtgaccacatggtg

SEQ ID NO: 208503 - DNA, 25 bp, Rattus norvegicus
attctcccaattaagccttctgtat

SEQ ID NO: 208504 - DNA, 25 bp, Rattus norvegicus
attctcccaatttagccttctgtat

SEQ ID NO: 208505 - DNA, 25 bp, Rattus norvegicus
attctcccagagagagccgcggata

SEQ ID NO: 208506 - DNA, 25 bp, Rattus norvegicus
attctcccagagtgagccgcggata

SEQ ID NO: 208507 - DNA, 25 bp, Rattus norvegicus
attctcccagtcagaccaggaacta

SEQ ID NO: 208508 - DNA, 25 bp, Rattus norvegicus
attctcccagtctgaccaggaacta

SEQ ID NO: 208509 - DNA, 25 bp, Rattus norvegicus
attctccccaagagctttccaagaa

SEQ ID NO: 208510 - DNA, 25 bp, Rattus norvegicus
attctccccaagtgctttccaagaa

SEQ ID NO: 208511 - DNA, 25 bp, Rattus norvegicus
attctcccttcgcaggaaccacaga

SEQ ID NO: 208512 - DNA, 25 bp, Rattus norvegicus
attctcccttcggaggaaccacaga

SEQ ID NO: 208513 - DNA, 25 bp, Rattus norvegicus
attctccgtttgcttctgtaatgcg

SEQ ID NO: 208514 - DNA, 25 bp, Rattus norvegicus
attctccgtttggttctgtaatgcg

SEQ ID NO: 208515 - DNA, 25 bp, Rattus norvegicus
attctcctagcaacggaagcgtcac

SEQ ID NO: 208516 - DNA, 25 bp, Rattus norvegicus
attctcctagcatcggaagcgtcac

SEQ ID NO: 208517 - DNA, 25 bp, Rattus norvegicus
attctcctcatgctgttactgtata

SEQ ID NO: 208518 - DNA, 25 bp, Rattus norvegicus
attctcctcatggtgttactgtata

SEQ ID NO: 208519 - DNA, 25 bp, Rattus norvegicus
attctcctccagcacagcggagctg

SEQ ID NO: 208520 - DNA, 25 bp, Rattus norvegicus
attctcctccaggacagcggagctg

SEQ ID NO: 208521 - DNA, 25 bp, Rattus norvegicus
attctcctccgaagtattatcaaga

SEQ ID NO: 208522 - DNA, 25 bp, Rattus norvegicus
attctcctccgatgtattatcaaga

SEQ ID NO: 208523 - DNA, 25 bp, Rattus norvegicus
attctcctcctaccttatagtctaa

SEQ ID NO: 208524 - DNA, 25 bp, Rattus norvegicus
attctcctcctagcttatagtctaa

SEQ ID NO: 208525 - DNA, 25 bp, Rattus norvegicus
attctcctcttccatggttgagatg

SEQ ID NO: 208526 - DNA, 25 bp, Rattus norvegicus
attctcctcttcgatggttgagatg

SEQ ID NO: 208527 - DNA, 25 bp, Rattus norvegicus
attctcctgcgtaactttgacatgg

SEQ ID NO: 208528 - DNA, 25 bp, Rattus norvegicus
attctcctgcgttactttgacatgg

SEQ ID NO: 208529 - DNA, 25 bp, Rattus norvegicus
attctcctgcttacgattctattgt

SEQ ID NO: 208530 - DNA, 25 bp, Rattus norvegicus
attctcctgcttacgttcctgtggg

SEQ ID NO: 208531 - DNA, 25 bp, Rattus norvegicus
attctcctgctttcgattctattgt

SEQ ID NO: 208532 - DNA, 25 bp, Rattus norvegicus
attctcctgctttcgttcctgtggg

SEQ ID NO: 208533 - DNA, 25 bp, Rattus norvegicus
attctcctgggtcgctttagactgc

SEQ ID NO: 208534 - DNA, 25 bp, Rattus norvegicus
attctcctgggtggctttagactgc

SEQ ID NO: 208535 - DNA, 25 bp, Rattus norvegicus
attctccttaagaaggcctgtgtgc

SEQ ID NO: 208536 - DNA, 25 bp, Rattus norvegicus
attctccttaagtaggcctgtgtgc

SEQ ID NO: 208537 - DNA, 25 bp, Rattus norvegicus
attctccttagtcgacattgaagcc

SEQ ID NO: 208538 - DNA, 25 bp, Rattus norvegicus
attctccttagtggacattgaagcc

SEQ ID NO: 208539 - DNA, 25 bp, Rattus norvegicus
attctccttcacatccacttattca

SEQ ID NO: 208540 - DNA, 25 bp, Rattus norvegicus
attctccttcacttccacttattca

SEQ ID NO: 208541 - DNA, 25 bp, Rattus norvegicus
attctccttcgaagtcacagtcagg

SEQ ID NO: 208542 - DNA, 25 bp, Rattus norvegicus
attctccttcgatgtcacagtcagg

SEQ ID NO: 208543 - DNA, 25 bp, Rattus norvegicus
attctccttgacagtgggattgcat

SEQ ID NO: 208544 - DNA, 25 bp, Rattus norvegicus
attctccttgactgtgggattgcat

SEQ ID NO: 208545 - DNA, 25 bp, Rattus norvegicus
attctcctttcaagtttctttagtg

SEQ ID NO: 208546 - DNA, 25 bp, Rattus norvegicus
attctcctttcatgtttctttagtg

SEQ ID NO: 208547 - DNA, 25 bp, Rattus norvegicus
attctcctttctcccaagatttact

SEQ ID NO: 208548 - DNA, 25 bp, Rattus norvegicus
attctcctttctgccaagatttact

SEQ ID NO: 208549 - DNA, 25 bp, Rattus norvegicus
attctcctttgtcctaattgggttc

SEQ ID NO: 208550 - DNA, 25 bp, Rattus norvegicus
attctcctttgtgctaattgggttc

SEQ ID NO: 208551 - DNA, 25 bp, Rattus norvegicus
attctccttttgaatctacttgtag

SEQ ID NO: 208552 - DNA, 25 bp, Rattus norvegicus
attctccttttgagttggcctctaa

SEQ ID NO: 208553 - DNA, 25 bp, Rattus norvegicus
attctccttttgtatctacttgtag

SEQ ID NO: 208554 - DNA, 25 bp, Rattus norvegicus
attctccttttgtgttggcctctaa

SEQ ID NO: 208555 - DNA, 25 bp, Rattus norvegicus
attctcgagcgaattatacatccgt

SEQ ID NO: 208556 - DNA, 25 bp, Rattus norvegicus
attctcgagcgatttatacatccgt

SEQ ID NO: 208557 - DNA, 25 bp, Rattus norvegicus
attctcgcctagctgaaccaaggtg

SEQ ID NO: 208558 - DNA, 25 bp, Rattus norvegicus
attctcgcctaggtgaaccaaggtg

SEQ ID NO: 208559 - DNA, 25 bp, Rattus norvegicus
attctcggacagagaaaccagcatg

SEQ ID NO: 208560 - DNA, 25 bp, Rattus norvegicus
attctcggacagtgaaaccagcatg

SEQ ID NO: 208561 - DNA, 25 bp, Rattus norvegicus
attctcggatgacctcacatgtccc

SEQ ID NO: 208562 - DNA, 25 bp, Rattus norvegicus
attctcggatgagctcacatgtccc

SEQ ID NO: 208563 - DNA, 25 bp, Rattus norvegicus
attctcggtaggcagacagttgttt

SEQ ID NO: 208564 - DNA, 25 bp, Rattus norvegicus
attctcggtagggagacagttgttt

SEQ ID NO: 208565 - DNA, 25 bp, Rattus norvegicus
attctcggtgcaaatgacttcgtga

SEQ ID NO: 208566 - DNA, 25 bp, Rattus norvegicus
attctcggtgcatatgacttcgtga

SEQ ID NO: 208567 - DNA, 25 bp, Rattus norvegicus
attctcgttccaatgtgtgtatttt

SEQ ID NO: 208568 - DNA, 25 bp, Rattus norvegicus
attctcgttccattgtgtgtatttt

SEQ ID NO: 208569 - DNA, 25 bp, Rattus norvegicus
attctcgtttttctcaggactgttg

SEQ ID NO: 208570 - DNA, 25 bp, Rattus norvegicus
attctcgtttttgtcaggactgttg

SEQ ID NO: 208571 - DNA, 25 bp, Rattus norvegicus
attctctaacatatggtaccagggc

SEQ ID NO: 208572 - DNA, 25 bp, Rattus norvegicus
attctctaacatttggtaccagggc

SEQ ID NO: 208573 - DNA, 25 bp, Rattus norvegicus
attctctaactcagtactgttccta

SEQ ID NO: 208574 - DNA, 25 bp, Rattus norvegicus
attctctaactctgtactgttccta

SEQ ID NO: 208575 - DNA, 25 bp, Rattus norvegicus
attctctacagccacgttatagtta

SEQ ID NO: 208576 - DNA, 25 bp, Rattus norvegicus
attctctacagcgacgttatagtta

SEQ ID NO: 208577 - DNA, 25 bp, Rattus norvegicus
attctctacatcagacacagatttt

SEQ ID NO: 208578 - DNA, 25 bp, Rattus norvegicus
attctctacatctgacacagatttt

SEQ ID NO: 208579 - DNA, 25 bp, Rattus norvegicus
attctctacattctacacatctgtc

SEQ ID NO: 208580 - DNA, 25 bp, Rattus norvegicus
attctctacattgtacacatctgtc

SEQ ID NO: 208581 - DNA, 25 bp, Rattus norvegicus
attctctacctccatggttgttctg

SEQ ID NO: 208582 - DNA, 25 bp, Rattus norvegicus
attctctacctcgatggttgttctg

SEQ ID NO: 208583 - DNA, 25 bp, Rattus norvegicus
attctctaggcgatggttggtgagt

SEQ ID NO: 208584 - DNA, 25 bp, Rattus norvegicus
attctctaggcgttggttggtgagt

SEQ ID NO: 208585 - DNA, 25 bp, Rattus norvegicus
attctctatgagatgttagccggat

SEQ ID NO: 208586 - DNA, 25 bp, Rattus norvegicus
attctctatgagttgttagccggat

SEQ ID NO: 208587 - DNA, 25 bp, Rattus norvegicus
attctctatgcaataagtccattga

SEQ ID NO: 208588 - DNA, 25 bp, Rattus norvegicus
attctctatgcattaagtccattga

SEQ ID NO: 208589 - DNA, 25 bp, Rattus norvegicus
attctctatgttattcacctcttgt

SEQ ID NO: 208590 - DNA, 25 bp, Rattus norvegicus
attctctatgtttttcacctcttgt

SEQ ID NO: 208591 - DNA, 25 bp, Rattus norvegicus
attctctatttcagcagtgctcagg

SEQ ID NO: 208592 - DNA, 25 bp, Rattus norvegicus
attctctatttctgcagtgctcagg

SEQ ID NO: 208593 - DNA, 25 bp, Rattus norvegicus
attctctcaaaaaattctacagctt

SEQ ID NO: 208594 - DNA, 25 bp, Rattus norvegicus
attctctcaaaatattctacagctt

SEQ ID NO: 208595 - DNA, 25 bp, Rattus norvegicus
attctctcatctaggtgtgtagctc

SEQ ID NO: 208596 - DNA, 25 bp, Rattus norvegicus
attctctcatcttggtgtgtagctc

SEQ ID NO: 208597 - DNA, 25 bp, Rattus norvegicus
attctctcatgaatctggtggccag

SEQ ID NO: 208598 - DNA, 25 bp, Rattus norvegicus
attctctcatgattctggtggccag

SEQ ID NO: 208599 - DNA, 25 bp, Rattus norvegicus
attctctccccaatgatcattagtc

SEQ ID NO: 208600 - DNA, 25 bp, Rattus norvegicus
attctctccccattgatcattagtc

SEQ ID NO: 208601 - DNA, 25 bp, Rattus norvegicus
attctctcctctctagattcagcat

SEQ ID NO: 208602 - DNA, 25 bp, Rattus norvegicus
attctctcctctgtagattcagcat

SEQ ID NO: 208603 - DNA, 25 bp, Rattus norvegicus
attctctcggctctggtacagcaga

SEQ ID NO: 208604 - DNA, 25 bp, Rattus norvegicus
attctctcggctgtggtacagcaga

SEQ ID NO: 208605 - DNA, 25 bp, Rattus norvegicus
attctctcgtttccattacagacag

SEQ ID NO: 208606 - DNA, 25 bp, Rattus norvegicus
attctctcgtttgcattacagacag

SEQ ID NO: 208607 - DNA, 25 bp, Rattus norvegicus
attctctctattctcactcatctga

SEQ ID NO: 208608 - DNA, 25 bp, Rattus norvegicus
attctctctattgtcactcatctga

SEQ ID NO: 208609 - DNA, 25 bp, Rattus norvegicus
attctctctcatcattgcagttcag

SEQ ID NO: 208610 - DNA, 25 bp, Rattus norvegicus
attctctctcatgattgcagttcag

SEQ ID NO: 208611 - DNA, 25 bp, Rattus norvegicus
attctctctcttatattcatactga

SEQ ID NO: 208612 - DNA, 25 bp, Rattus norvegicus
attctctctcttttattcatactga

SEQ ID NO: 208613 - DNA, 25 bp, Rattus norvegicus
attctctctgtaaggtagttgtgca

SEQ ID NO: 208614 - DNA, 25 bp, Rattus norvegicus
attctctctgtatggtagttgtgca

SEQ ID NO: 208615 - DNA, 25 bp, Rattus norvegicus
attctctctgtcatggcagctctgc

SEQ ID NO: 208616 - DNA, 25 bp, Rattus norvegicus
attctctctgtcttggcagctctgc

SEQ ID NO: 208617 - DNA, 25 bp, Rattus norvegicus
attctctgaagactcgggcccggaa

SEQ ID NO: 208618 - DNA, 25 bp, Rattus norvegicus
attctctgaagagtcgggcccggaa

SEQ ID NO: 208619 - DNA, 25 bp, Rattus norvegicus
attctctgaagcagccattgaggct

SEQ ID NO: 208620 - DNA, 25 bp, Rattus norvegicus
attctctgaagctgccattgaggct

SEQ ID NO: 208621 - DNA, 25 bp, Rattus norvegicus
attctctgaggtcttggttccagca

SEQ ID NO: 208622 - DNA, 25 bp, Rattus norvegicus
attctctgaggtgttggttccagca

SEQ ID NO: 208623 - DNA, 25 bp, Rattus norvegicus
attctctgatcaagaagcccctgaa

SEQ ID NO: 208624 - DNA, 25 bp, Rattus norvegicus
attctctgatcatgaagcccctgaa

SEQ ID NO: 208625 - DNA, 25 bp, Rattus norvegicus
attctctgatgcatcgtgactcgct

SEQ ID NO: 208626 - DNA, 25 bp, Rattus norvegicus
attctctgatgcttcgtgactcgct

SEQ ID NO: 208627 - DNA, 25 bp, Rattus norvegicus
attctctgattaccagtggcttcac

SEQ ID NO: 208628 - DNA, 25 bp, Rattus norvegicus
attctctgattagcagtggcttcac

SEQ ID NO: 208629 - DNA, 25 bp, Rattus norvegicus
attctctgcaccattgtttgtctaa

SEQ ID NO: 208630 - DNA, 25 bp, Rattus norvegicus
attctctgcacctttgtttgtctaa

SEQ ID NO: 208631 - DNA, 25 bp, Rattus norvegicus
attctctgcagcaatctgagcgagc

SEQ ID NO: 208632 - DNA, 25 bp, Rattus norvegicus
attctctgcagctatctgagcgagc

SEQ ID NO: 208633 - DNA, 25 bp, Rattus norvegicus
attctctgccctcagggaatctgga

SEQ ID NO: 208634 - DNA, 25 bp, Rattus norvegicus
attctctgccctgagggaatctgga

SEQ ID NO: 208635 - DNA, 25 bp, Rattus norvegicus
attctctgctacactaatcctttaa

SEQ ID NO: 208636 - DNA, 25 bp, Rattus norvegicus
attctctgctactctaatcctttaa

SEQ ID NO: 208637 - DNA, 25 bp, Rattus norvegicus
attctctgcttacccaaagtcacct

SEQ ID NO: 208638 - DNA, 25 bp, Rattus norvegicus
attctctgcttagccaaagtcacct

SEQ ID NO: 208639 - DNA, 25 bp, Rattus norvegicus
attctctggaaccaagtcccctgaa

SEQ ID NO: 208640 - DNA, 25 bp, Rattus norvegicus
attctctggaacgaagtcccctgaa

SEQ ID NO: 208641 - DNA, 25 bp, Rattus norvegicus
attctctggaccacaagctctaggg

SEQ ID NO: 208642 - DNA, 25 bp, Rattus norvegicus
attctctggacctcaagctctaggg

SEQ ID NO: 208643 - DNA, 25 bp, Rattus norvegicus
attctctggattcagactgcctcct

SEQ ID NO: 208644 - DNA, 25 bp, Rattus norvegicus
attctctggattgagactgcctcct

SEQ ID NO: 208645 - DNA, 25 bp, Rattus norvegicus
attctctgtatcagtgcttttcatc

SEQ ID NO: 208646 - DNA, 25 bp, Rattus norvegicus
attctctgtatctgtgcttttcatc

SEQ ID NO: 208647 - DNA, 25 bp, Rattus norvegicus
attctctgtgaaccggcacgttgca

SEQ ID NO: 208648 - DNA, 25 bp, Rattus norvegicus
attctctgtgaagcggcacgttgca

SEQ ID NO: 208649 - DNA, 25 bp, Rattus norvegicus
attctctgtgccactgagcaagttt

SEQ ID NO: 208650 - DNA, 25 bp, Rattus norvegicus
attctctgtgcctctgagcaagttt

SEQ ID NO: 208651 - DNA, 25 bp, Rattus norvegicus
attctctgttgaaggatctctctgt

SEQ ID NO: 208652 - DNA, 25 bp, Rattus norvegicus
attctctgttgatggatctctctgt

SEQ ID NO: 208653 - DNA, 25 bp, Rattus norvegicus
attctcttacttattccagtgctgg

SEQ ID NO: 208654 - DNA, 25 bp, Rattus norvegicus
attctcttactttttccagtgctgg

SEQ ID NO: 208655 - DNA, 25 bp, Rattus norvegicus
attctcttatttattgcctgttccc

SEQ ID NO: 208656 - DNA, 25 bp, Rattus norvegicus
attctcttattttttgcctgttccc

SEQ ID NO: 208657 - DNA, 25 bp, Rattus norvegicus
attctcttcagcaactactatgcct

SEQ ID NO: 208658 - DNA, 25 bp, Rattus norvegicus
attctcttcagctactactatgcct

SEQ ID NO: 208659 - DNA, 25 bp, Rattus norvegicus
attctcttccccaaggagccaggaa

SEQ ID NO: 208660 - DNA, 25 bp, Rattus norvegicus
attctcttcccctaggagccaggaa

SEQ ID NO: 208661 - DNA, 25 bp, Rattus norvegicus
attctcttccctacaagtcttacaa

SEQ ID NO: 208662 - DNA, 25 bp, Rattus norvegicus
attctcttcccttcaagtcttacaa

SEQ ID NO: 208663 - DNA, 25 bp, Rattus norvegicus
attctcttcggaaactgttaatctt

SEQ ID NO: 208664 - DNA, 25 bp, Rattus norvegicus
attctcttcggatactgttaatctt

SEQ ID NO: 208665 - DNA, 25 bp, Rattus norvegicus
attctcttctcaactgcactctaaa

SEQ ID NO: 208666 - DNA, 25 bp, Rattus norvegicus
attctcttctcatctgcactctaaa

SEQ ID NO: 208667 - DNA, 25 bp, Rattus norvegicus
attctcttctccataggtctctgaa

SEQ ID NO: 208668 - DNA, 25 bp, Rattus norvegicus
attctcttctccttaggtctctgaa

SEQ ID NO: 208669 - DNA, 25 bp, Rattus norvegicus
attctcttgctcaggttgaccagta

SEQ ID NO: 208670 - DNA, 25 bp, Rattus norvegicus
attctcttgctctggttgaccagta

SEQ ID NO: 208671 - DNA, 25 bp, Rattus norvegicus
attctctttacccactgttgggcat

SEQ ID NO: 208672 - DNA, 25 bp, Rattus norvegicus
attctctttaccgactgttgggcat

SEQ ID NO: 208673 - DNA, 25 bp, Rattus norvegicus
attctctttaggctctcttcaattc

SEQ ID NO: 208674 - DNA, 25 bp, Rattus norvegicus
attctctttagggtctcttcaattc

SEQ ID NO: 208675 - DNA, 25 bp, Rattus norvegicus
attctctttcctcatgagcctttca

SEQ ID NO: 208676 - DNA, 25 bp, Rattus norvegicus
attctctttcctgatgagcctttca

SEQ ID NO: 208677 - DNA, 25 bp, Rattus norvegicus
attctctttgccctgctcatggagg

SEQ ID NO: 208678 - DNA, 25 bp, Rattus norvegicus
attctctttgccgtgctcatggagg

SEQ ID NO: 208679 - DNA, 25 bp, Rattus norvegicus
attctctttgtgactcttgacggtt

SEQ ID NO: 208680 - DNA, 25 bp, Rattus norvegicus
attctctttgtgtctcttgacggtt

SEQ ID NO: 208681 - DNA, 25 bp, Rattus norvegicus
attctcttttgtagtacgctgtcct

SEQ ID NO: 208682 - DNA, 25 bp, Rattus norvegicus
attctcttttgttgtacgctgtcct

SEQ ID NO: 208683 - DNA, 25 bp, Rattus norvegicus
attctgaaatggctctgttgcaatg

SEQ ID NO: 208684 - DNA, 25 bp, Rattus norvegicus
attctgaaatgggtctgttgcaatg

SEQ ID NO: 208685 - DNA, 25 bp, Rattus norvegicus
attctgaacccaaatgcagcgatca

SEQ ID NO: 208686 - DNA, 25 bp, Rattus norvegicus
attctgaacccatatgcagcgatca

SEQ ID NO: 208687 - DNA, 25 bp, Rattus norvegicus
attctgaagattatcactgctcccc

SEQ ID NO: 208688 - DNA, 25 bp, Rattus norvegicus
attctgaagattttcactgctcccc

SEQ ID NO: 208689 - DNA, 25 bp, Rattus norvegicus
attctgaaggagaacctgttccctc

SEQ ID NO: 208690 - DNA, 25 bp, Rattus norvegicus
attctgaaggagtacctgttccctc

SEQ ID NO: 208691 - DNA, 25 bp, Rattus norvegicus
attctgaagggcatctcctcagatg

SEQ ID NO: 208692 - DNA, 25 bp, Rattus norvegicus
attctgaagggcttctcctcagatg

SEQ ID NO: 208693 - DNA, 25 bp, Rattus norvegicus
attctgaatcacacctctgtattag

SEQ ID NO: 208694 - DNA, 25 bp, Rattus norvegicus
attctgaatcactcctctgtattag

SEQ ID NO: 208695 - DNA, 25 bp, Rattus norvegicus
attctgaatcccattctcgatcaag

SEQ ID NO: 208696 - DNA, 25 bp, Rattus norvegicus
attctgaatccctttctcgatcaag

SEQ ID NO: 208697 - DNA, 25 bp, Rattus norvegicus
attctgacagctcttaaacactttg

SEQ ID NO: 208698 - DNA, 25 bp, Rattus norvegicus
attctgacagctgttaaacactttg

SEQ ID NO: 208699 - DNA, 25 bp, Rattus norvegicus
attctgaccagaactgactttgctc

SEQ ID NO: 208700 - DNA, 25 bp, Rattus norvegicus
attctgaccagatctgactttgctc

SEQ ID NO: 208701 - DNA, 25 bp, Rattus norvegicus
attctgacccagatacaccctattt

SEQ ID NO: 208702 - DNA, 25 bp, Rattus norvegicus
attctgacccagttacaccctattt

SEQ ID NO: 208703 - DNA, 25 bp, Rattus norvegicus
attctgacctttaactgagacctcg

SEQ ID NO: 208704 - DNA, 25 bp, Rattus norvegicus
attctgacctttcctctggatagtg

SEQ ID NO: 208705 - DNA, 25 bp, Rattus norvegicus
attctgacctttgctctggatagtg

SEQ ID NO: 208706 - DNA, 25 bp, Rattus norvegicus
attctgaccttttactgagacctcg

SEQ ID NO: 208707 - DNA, 25 bp, Rattus norvegicus
attctgactagtcccatgttctgtg

SEQ ID NO: 208708 - DNA, 25 bp, Rattus norvegicus
attctgactagtgccatgttctgtg

SEQ ID NO: 208709 - DNA, 25 bp, Rattus norvegicus
attctgactgagctaaagttaagac

SEQ ID NO: 208710 - DNA, 25 bp, Rattus norvegicus
attctgactgaggtaaagttaagac

SEQ ID NO: 208711 - DNA, 25 bp, Rattus norvegicus
attctgactgtcatctcacattgtt

SEQ ID NO: 208712 - DNA, 25 bp, Rattus norvegicus
attctgactgtcttctcacattgtt

SEQ ID NO: 208713 - DNA, 25 bp, Rattus norvegicus
attctgagcactattgagcctcgga

SEQ ID NO: 208714 - DNA, 25 bp, Rattus norvegicus
attctgagcacttttgagcctcgga

SEQ ID NO: 208715 - DNA, 25 bp, Rattus norvegicus
attctgaggctgactcctgggaaca

SEQ ID NO: 208716 - DNA, 25 bp, Rattus norvegicus
attctgaggctgtctcctgggaaca

SEQ ID NO: 208717 - DNA, 25 bp, Rattus norvegicus
attctgagggacacaatgccctgag

SEQ ID NO: 208718 - DNA, 25 bp, Rattus norvegicus
attctgagggactcaatgccctgag

SEQ ID NO: 208719 - DNA, 25 bp, Rattus norvegicus
attctgagggagcagcagtcacacc

SEQ ID NO: 208720 - DNA, 25 bp, Rattus norvegicus
attctgagggaggagcagtcacacc

SEQ ID NO: 208721 - DNA, 25 bp, Rattus norvegicus
attctgagttgccatatgagttcca

SEQ ID NO: 208722 - DNA, 25 bp, Rattus norvegicus
attctgagttgcgatatgagttcca

SEQ ID NO: 208723 - DNA, 25 bp, Rattus norvegicus
attctgatagaaacctttcccacac

SEQ ID NO: 208724 - DNA, 25 bp, Rattus norvegicus
attctgatagaatcctttcccacac

SEQ ID NO: 208725 - DNA, 25 bp, Rattus norvegicus
attctgatccagaagccatgcctgc

SEQ ID NO: 208726 - DNA, 25 bp, Rattus norvegicus
attctgatccagtagccatgcctgc

SEQ ID NO: 208727 - DNA, 25 bp, Rattus norvegicus
attctgatcccacgtctgtatacca

SEQ ID NO: 208728 - DNA, 25 bp, Rattus norvegicus
attctgatcccaggtctgtatacca

SEQ ID NO: 208729 - DNA, 25 bp, Rattus norvegicus
attctgatcggtctctgtactcatc

SEQ ID NO: 208730 - DNA, 25 bp, Rattus norvegicus
attctgatcggtgtctgtactcatc

SEQ ID NO: 208731 - DNA, 25 bp, Rattus norvegicus
attctgatctccatggaaagcccct

SEQ ID NO: 208732 - DNA, 25 bp, Rattus norvegicus
attctgatctccttggaaagcccct

SEQ ID NO: 208733 - DNA, 25 bp, Rattus norvegicus
attctgatctgtctcactaaatttg

SEQ ID NO: 208734 - DNA, 25 bp, Rattus norvegicus
attctgatctgtgtcactaaatttg

SEQ ID NO: 208735 - DNA, 25 bp, Rattus norvegicus
attctgatgaacatgggtcccaccg

SEQ ID NO: 208736 - DNA, 25 bp, Rattus norvegicus
attctgatgaacttgggtcccaccg

SEQ ID NO: 208737 - DNA, 25 bp, Rattus norvegicus
attctgatggttataggtgacccct

SEQ ID NO: 208738 - DNA, 25 bp, Rattus norvegicus
attctgatggttttaggtgacccct

SEQ ID NO: 208739 - DNA, 25 bp, Rattus norvegicus
attctgatgtgaacttttctccgct

SEQ ID NO: 208740 - DNA, 25 bp, Rattus norvegicus
attctgatgtgatcttttctccgct

SEQ ID NO: 208741 - DNA, 25 bp, Rattus norvegicus
attctgattcgtccaacccggagag

SEQ ID NO: 208742 - DNA, 25 bp, Rattus norvegicus
attctgattcgtgcaacccggagag

SEQ ID NO: 208743 - DNA, 25 bp, Rattus norvegicus
attctgattctgaccttttgatgtg

SEQ ID NO: 208744 - DNA, 25 bp, Rattus norvegicus
attctgattctgtccttttgatgtg

SEQ ID NO: 208745 - DNA, 25 bp, Rattus norvegicus
attctgatttctactgatgtctgga

SEQ ID NO: 208746 - DNA, 25 bp, Rattus norvegicus
attctgatttcttctgatgtctgga

SEQ ID NO: 208747 - DNA, 25 bp, Rattus norvegicus
attctgcaaacactccctctagtgg

SEQ ID NO: 208748 - DNA, 25 bp, Rattus norvegicus
attctgcaaacagtccctctagtgg

SEQ ID NO: 208749 - DNA, 25 bp, Rattus norvegicus
attctgcaaatactgtctttcctgg

SEQ ID NO: 208750 - DNA, 25 bp, Rattus norvegicus
attctgcaaatagtgtctttcctgg

SEQ ID NO: 208751 - DNA, 25 bp, Rattus norvegicus
attctgcaacctcggtaaaccttgg

SEQ ID NO: 208752 - DNA, 25 bp, Rattus norvegicus
attctgcaacctgggtaaaccttgg

SEQ ID NO: 208753 - DNA, 25 bp, Rattus norvegicus
attctgcacaacaccatggagtctt

SEQ ID NO: 208754 - DNA, 25 bp, Rattus norvegicus
attctgcacaactccatggagtctt

SEQ ID NO: 208755 - DNA, 25 bp, Rattus norvegicus
attctgcaccatactctagacgtta

SEQ ID NO: 208756 - DNA, 25 bp, Rattus norvegicus
attctgcaccattctctagacgtta

SEQ ID NO: 208757 - DNA, 25 bp, Rattus norvegicus
attctgcagcagatcgtgaacctta

SEQ ID NO: 208758 - DNA, 25 bp, Rattus norvegicus
attctgcagcagttcgtgaacctta

SEQ ID NO: 208759 - DNA, 25 bp, Rattus norvegicus
attctgcagcatacaaattgtgtat

SEQ ID NO: 208760 - DNA, 25 bp, Rattus norvegicus
attctgcagcattcaaattgtgtat

SEQ ID NO: 208761 - DNA, 25 bp, Rattus norvegicus
attctgcagctgaactagagctcca

SEQ ID NO: 208762 - DNA, 25 bp, Rattus norvegicus
attctgcagctgtactagagctcca

SEQ ID NO: 208763 - DNA, 25 bp, Rattus norvegicus
attctgcagtgaaaaggcttgcctt

SEQ ID NO: 208764 - DNA, 25 bp, Rattus norvegicus
attctgcagtgataaggcttgcctt

SEQ ID NO: 208765 - DNA, 25 bp, Rattus norvegicus
attctgcatgggaattttttcacta

SEQ ID NO: 208766 - DNA, 25 bp, Rattus norvegicus
attctgcatgggtattttttcacta

SEQ ID NO: 208767 - DNA, 25 bp, Rattus norvegicus
attctgcatgttcctgcccgaagaa

SEQ ID NO: 208768 - DNA, 25 bp, Rattus norvegicus
attctgcatgttgctgcccgaagaa

SEQ ID NO: 208769 - DNA, 25 bp, Rattus norvegicus
attctgcatttgctaatcgtcgtta

SEQ ID NO: 208770 - DNA, 25 bp, Rattus norvegicus
attctgcatttggtaatcgtcgtta

SEQ ID NO: 208771 - DNA, 25 bp, Rattus norvegicus
attctgccaaaacgccactgctgga

SEQ ID NO: 208772 - DNA, 25 bp, Rattus norvegicus
attctgccaaaaggccactgctgga

SEQ ID NO: 208773 - DNA, 25 bp, Rattus norvegicus
attctgccatgtacagttcctgaca

SEQ ID NO: 208774 - DNA, 25 bp, Rattus norvegicus
attctgccatgttcagttcctgaca

SEQ ID NO: 208775 - DNA, 25 bp, Rattus norvegicus
attctgcccggaaaatcgtctctcc

SEQ ID NO: 208776 - DNA, 25 bp, Rattus norvegicus
attctgcccggataatcgtctctcc

SEQ ID NO: 208777 - DNA, 25 bp, Rattus norvegicus
attctgccgcttatatatttatgta

SEQ ID NO: 208778 - DNA, 25 bp, Rattus norvegicus
attctgccgcttttatatttatgta

SEQ ID NO: 208779 - DNA, 25 bp, Rattus norvegicus
attctgccggatccgctgtaggaac

SEQ ID NO: 208780 - DNA, 25 bp, Rattus norvegicus
attctgccggatgcgctgtaggaac

SEQ ID NO: 208781 - DNA, 25 bp, Rattus norvegicus
attctgcctagactacgactctttc

SEQ ID NO: 208782 - DNA, 25 bp, Rattus norvegicus
attctgcctagagtacgactctttc

SEQ ID NO: 208783 - DNA, 25 bp, Rattus norvegicus
attctgcctcctaagaagtctggct

SEQ ID NO: 208784 - DNA, 25 bp, Rattus norvegicus
attctgcctccttagaagtctggct

SEQ ID NO: 208785 - DNA, 25 bp, Rattus norvegicus
attctgcctctgaatgcgatgtctt

SEQ ID NO: 208786 - DNA, 25 bp, Rattus norvegicus
attctgcctctgtatgcgatgtctt

SEQ ID NO: 208787 - DNA, 25 bp, Rattus norvegicus
attctgcctcttaatgtgctccagc

SEQ ID NO: 208788 - DNA, 25 bp, Rattus norvegicus
attctgcctctttatgtgctccagc

SEQ ID NO: 208789 - DNA, 25 bp, Rattus norvegicus
attctgcctgacattcttactccct

SEQ ID NO: 208790 - DNA, 25 bp, Rattus norvegicus
attctgcctgactttcttactccct

SEQ ID NO: 208791 - DNA, 25 bp, Rattus norvegicus
attctgccttagcatctgtgactct

SEQ ID NO: 208792 - DNA, 25 bp, Rattus norvegicus
attctgccttaggatctgtgactct

SEQ ID NO: 208793 - DNA, 25 bp, Rattus norvegicus
attctgcctttaacacatctatcca

SEQ ID NO: 208794 - DNA, 25 bp, Rattus norvegicus
attctgcctttatcacatctatcca

SEQ ID NO: 208795 - DNA, 25 bp, Rattus norvegicus
attctgcgcatgaccttctgtgaaa

SEQ ID NO: 208796 - DNA, 25 bp, Rattus norvegicus
attctgcgcatgtccttctgtgaaa

SEQ ID NO: 208797 - DNA, 25 bp, Rattus norvegicus
attctgcggctaacaaacgtttcta

SEQ ID NO: 208798 - DNA, 25 bp, Rattus norvegicus
attctgcggctatcaaacgtttcta

SEQ ID NO: 208799 - DNA, 25 bp, Rattus norvegicus
attctgctcacaaaggcccagcaaa

SEQ ID NO: 208800 - DNA, 25 bp, Rattus norvegicus
attctgctcacataggcccagcaaa

SEQ ID NO: 208801 - DNA, 25 bp, Rattus norvegicus
attctgctcagcactcaagcaaatc

SEQ ID NO: 208802 - DNA, 25 bp, Rattus norvegicus
attctgctcagctctcaagcaaatc

SEQ ID NO: 208803 - DNA, 25 bp, Rattus norvegicus
attctgctcatcatgatgggctgca

SEQ ID NO: 208804 - DNA, 25 bp, Rattus norvegicus
attctgctcatcttgatgggctgca

SEQ ID NO: 208805 - DNA, 25 bp, Rattus norvegicus
attctgctcattattgggttgcgct

SEQ ID NO: 208806 - DNA, 25 bp, Rattus norvegicus
attctgctcatttttgggttgcgct

SEQ ID NO: 208807 - DNA, 25 bp, Rattus norvegicus
attctgctcgcaatgttttcttaag

SEQ ID NO: 208808 - DNA, 25 bp, Rattus norvegicus
attctgctcgcattgttttcttaag

SEQ ID NO: 208809 - DNA, 25 bp, Rattus norvegicus
attctgctctacatgtcctggtcag

SEQ ID NO: 208810 - DNA, 25 bp, Rattus norvegicus
attctgctctacttgtcctggtcag

SEQ ID NO: 208811 - DNA, 25 bp, Rattus norvegicus
attctgctctcaatgtgaccttggg

SEQ ID NO: 208812 - DNA, 25 bp, Rattus norvegicus
attctgctctcattgtgaccttggg

SEQ ID NO: 208813 - DNA, 25 bp, Rattus norvegicus
attctgctctttataactagggctg

SEQ ID NO: 208814 - DNA, 25 bp, Rattus norvegicus
attctgctctttttaactagggctg

SEQ ID NO: 208815 - DNA, 25 bp, Rattus norvegicus
attctgctgacaatcttagttgtgg

SEQ ID NO: 208816 - DNA, 25 bp, Rattus norvegicus
attctgctgacattcttagttgtgg

SEQ ID NO: 208817 - DNA, 25 bp, Rattus norvegicus
attctgctgagcagcggatgggtta

SEQ ID NO: 208818 - DNA, 25 bp, Rattus norvegicus
attctgctgagctgcggatgggtta

SEQ ID NO: 208819 - DNA, 25 bp, Rattus norvegicus
attctgctgatactgctatccttta

SEQ ID NO: 208820 - DNA, 25 bp, Rattus norvegicus
attctgctgatagtgctatccttta

SEQ ID NO: 208821 - DNA, 25 bp, Rattus norvegicus
attctgctgcccagtctgggtgcgg

SEQ ID NO: 208822 - DNA, 25 bp, Rattus norvegicus
attctgctgccctgtctgggtgcgg

SEQ ID NO: 208823 - DNA, 25 bp, Rattus norvegicus
attctgctgcctatgggacactgtt

SEQ ID NO: 208824 - DNA, 25 bp, Rattus norvegicus
attctgctgcctttgggacactgtt

SEQ ID NO: 208825 - DNA, 25 bp, Rattus norvegicus
attctgcttcgccaacagtgggcaa

SEQ ID NO: 208826 - DNA, 25 bp, Rattus norvegicus
attctgcttcgcgaacagtgggcaa

SEQ ID NO: 208827 - DNA, 25 bp, Rattus norvegicus
attctgcttgaaatgtcttgattgc

SEQ ID NO: 208828 - DNA, 25 bp, Rattus norvegicus
attctgcttgaattgtcttgattgc

SEQ ID NO: 208829 - DNA, 25 bp, Rattus norvegicus
attctgcttgctcgacagggacttc

SEQ ID NO: 208830 - DNA, 25 bp, Rattus norvegicus
attctgcttgctggacagggacttc

SEQ ID NO: 208831 - DNA, 25 bp, Rattus norvegicus
attctgcttggcctcacgtgggttt

SEQ ID NO: 208832 - DNA, 25 bp, Rattus norvegicus
attctgcttggcgtcacgtgggttt

SEQ ID NO: 208833 - DNA, 25 bp, Rattus norvegicus
attctgcttgttattaatgcctctt

SEQ ID NO: 208834 - DNA, 25 bp, Rattus norvegicus
attctgcttgtttttaatgcctctt

SEQ ID NO: 208835 - DNA, 25 bp, Rattus norvegicus
attctgctttaaacacatctcccat

SEQ ID NO: 208836 - DNA, 25 bp, Rattus norvegicus
attctgctttaatcacatctcccat

SEQ ID NO: 208837 - DNA, 25 bp, Rattus norvegicus
attctgctttacagccttaatccgt

SEQ ID NO: 208838 - DNA, 25 bp, Rattus norvegicus
attctgctttactgccttaatccgt

SEQ ID NO: 208839 - DNA, 25 bp, Rattus norvegicus
attctgctttctagtctgcttgtga

SEQ ID NO: 208840 - DNA, 25 bp, Rattus norvegicus
attctgctttcttgtctgcttgtga

SEQ ID NO: 208841 - DNA, 25 bp, Rattus norvegicus
attctgctttgacgtgcaccgggca

SEQ ID NO: 208842 - DNA, 25 bp, Rattus norvegicus
attctgctttgaggtgcaccgggca

SEQ ID NO: 208843 - DNA, 25 bp, Rattus norvegicus
attctgctttgtagccatagtttta

SEQ ID NO: 208844 - DNA, 25 bp, Rattus norvegicus
attctgctttgttgccatagtttta

SEQ ID NO: 208845 - DNA, 25 bp, Rattus norvegicus
attctgcttttgaaatgagcccaag

SEQ ID NO: 208846 - DNA, 25 bp, Rattus norvegicus
attctgcttttgtaatgagcccaag

SEQ ID NO: 208847 - DNA, 25 bp, Rattus norvegicus
attctggaatgtatgctcacagctt

SEQ ID NO: 208848 - DNA, 25 bp, Rattus norvegicus
attctggaatgtttgctcacagctt

SEQ ID NO: 208849 - DNA, 25 bp, Rattus norvegicus
attctggacaagagccccattctaa

SEQ ID NO: 208850 - DNA, 25 bp, Rattus norvegicus
attctggacaagtgccccattctaa

SEQ ID NO: 208851 - DNA, 25 bp, Rattus norvegicus
attctggaccttccgggagagacat

SEQ ID NO: 208852 - DNA, 25 bp, Rattus norvegicus
attctggaccttgcgggagagacat

SEQ ID NO: 208853 - DNA, 25 bp, Rattus norvegicus
attctggactgaccagggatcctcc

SEQ ID NO: 208854 - DNA, 25 bp, Rattus norvegicus
attctggactgagcagggatcctcc

SEQ ID NO: 208855 - DNA, 25 bp, Rattus norvegicus
attctggagcgcctggtctgagccc

SEQ ID NO: 208856 - DNA, 25 bp, Rattus norvegicus
attctggagcgcgtggtctgagccc

SEQ ID NO: 208857 - DNA, 25 bp, Rattus norvegicus
attctggagggacaggactgatctt

SEQ ID NO: 208858 - DNA, 25 bp, Rattus norvegicus
attctggagggagaggactgatctt

SEQ ID NO: 208859 - DNA, 25 bp, Rattus norvegicus
attctggaggttaccatgacactgg

SEQ ID NO: 208860 - DNA, 25 bp, Rattus norvegicus
attctggaggtttccatgacactgg

SEQ ID NO: 208861 - DNA, 25 bp, Rattus norvegicus
attctggatatgattctgtgtgctc

SEQ ID NO: 208862 - DNA, 25 bp, Rattus norvegicus
attctggatatgtttctgtgtgctc

SEQ ID NO: 208863 - DNA, 25 bp, Rattus norvegicus
attctggcagccctagagttcataa

SEQ ID NO: 208864 - DNA, 25 bp, Rattus norvegicus
attctggcagccgtagagttcataa

SEQ ID NO: 208865 - DNA, 25 bp, Rattus norvegicus
attctggcagctaccaagtcagcca

SEQ ID NO: 208866 - DNA, 25 bp, Rattus norvegicus
attctggcagcttccaagtcagcca

SEQ ID NO: 208867 - DNA, 25 bp, Rattus norvegicus
attctggccctgagtctatggcagc

SEQ ID NO: 208868 - DNA, 25 bp, Rattus norvegicus
attctggccctgtgtctatggcagc

SEQ ID NO: 208869 - DNA, 25 bp, Rattus norvegicus
attctggccgttatgacctcatagc

SEQ ID NO: 208870 - DNA, 25 bp, Rattus norvegicus
attctggccgttttgacctcatagc

SEQ ID NO: 208871 - DNA, 25 bp, Rattus norvegicus
attctggcggtgaccagtgtgtgac

SEQ ID NO: 208872 - DNA, 25 bp, Rattus norvegicus
attctggcggtgtccagtgtgtgac

SEQ ID NO: 208873 - DNA, 25 bp, Rattus norvegicus
attctggctccactgaactctgtgg

SEQ ID NO: 208874 - DNA, 25 bp, Rattus norvegicus
attctggctccagtgaactctgtgg

SEQ ID NO: 208875 - DNA, 25 bp, Rattus norvegicus
attctggctcctctgtcatggtgaa

SEQ ID NO: 208876 - DNA, 25 bp, Rattus norvegicus
attctggctcctgtgtcatggtgaa

SEQ ID NO: 208877 - DNA, 25 bp, Rattus norvegicus
attctggctgaaaactcggtaccac

SEQ ID NO: 208878 - DNA, 25 bp, Rattus norvegicus
attctggctgaaaatcctgacggta

SEQ ID NO: 208879 - DNA, 25 bp, Rattus norvegicus
attctggctgaatactcggtaccac

SEQ ID NO: 208880 - DNA, 25 bp, Rattus norvegicus
attctggctgaatatcctgacggta

SEQ ID NO: 208881 - DNA, 25 bp, Rattus norvegicus
attctggctggcacatagaggctgc

SEQ ID NO: 208882 - DNA, 25 bp, Rattus norvegicus
attctggctggctcatagaggctgc

SEQ ID NO: 208883 - DNA, 25 bp, Rattus norvegicus
attctggctgtgactgaaactgtag

SEQ ID NO: 208884 - DNA, 25 bp, Rattus norvegicus
attctggctgtgtctgaaactgtag

SEQ ID NO: 208885 - DNA, 25 bp, Rattus norvegicus
attctgggccaaccgtaagccttag

SEQ ID NO: 208886 - DNA, 25 bp, Rattus norvegicus
attctgggccaagcgtaagccttag

SEQ ID NO: 208887 - DNA, 25 bp, Rattus norvegicus
attctgggcctcctgttccttcatc

SEQ ID NO: 208888 - DNA, 25 bp, Rattus norvegicus
attctgggcctcgtgttccttcatc

SEQ ID NO: 208889 - DNA, 25 bp, Rattus norvegicus
attctgggcttgataccagcctgat

SEQ ID NO: 208890 - DNA, 25 bp, Rattus norvegicus
attctgggcttgttaccagcctgat

SEQ ID NO: 208891 - DNA, 25 bp, Rattus norvegicus
attctgggtaccacactgcttgtgc

SEQ ID NO: 208892 - DNA, 25 bp, Rattus norvegicus
attctgggtacctcactgcttgtgc

SEQ ID NO: 208893 - DNA, 25 bp, Rattus norvegicus
attctgggtgcaactctgtggctct

SEQ ID NO: 208894 - DNA, 25 bp, Rattus norvegicus
attctgggtgcatctctgtggctct

SEQ ID NO: 208895 - DNA, 25 bp, Rattus norvegicus
attctgggtgccaaccactgaggag

SEQ ID NO: 208896 - DNA, 25 bp, Rattus norvegicus
attctgggtgcctaccactgaggag

SEQ ID NO: 208897 - DNA, 25 bp, Rattus norvegicus
attctggtagagcctgcagctgctg

SEQ ID NO: 208898 - DNA, 25 bp, Rattus norvegicus
attctggtagaggctgcagctgctg

SEQ ID NO: 208899 - DNA, 25 bp, Rattus norvegicus
attctggtcaggacacagctaacct

SEQ ID NO: 208900 - DNA, 25 bp, Rattus norvegicus
attctggtcaggtcacagctaacct

SEQ ID NO: 208901 - DNA, 25 bp, Rattus norvegicus
attctggtccatataatgatgtaac

SEQ ID NO: 208902 - DNA, 25 bp, Rattus norvegicus
attctggtccatttaatgatgtaac

SEQ ID NO: 208903 - DNA, 25 bp, Rattus norvegicus
attctggtcccaataactccaagtg

SEQ ID NO: 208904 - DNA, 25 bp, Rattus norvegicus
attctggtcccattaactccaagtg

SEQ ID NO: 208905 - DNA, 25 bp, Rattus norvegicus
attctggtctcaccggaaaggttct

SEQ ID NO: 208906 - DNA, 25 bp, Rattus norvegicus
attctggtctcagcggaaaggttct

SEQ ID NO: 208907 - DNA, 25 bp, Rattus norvegicus
attctggtgactaccccggagcagt

SEQ ID NO: 208908 - DNA, 25 bp, Rattus norvegicus
attctggtgacttccccggagcagt

SEQ ID NO: 208909 - DNA, 25 bp, Rattus norvegicus
attctggtggttactttcgcaagga

SEQ ID NO: 208910 - DNA, 25 bp, Rattus norvegicus
attctggtggtttctttcgcaagga

SEQ ID NO: 208911 - DNA, 25 bp, Rattus norvegicus
attctggttagtctgctactggcta

SEQ ID NO: 208912 - DNA, 25 bp, Rattus norvegicus
attctggttagtgtgctactggcta

SEQ ID NO: 208913 - DNA, 25 bp, Rattus norvegicus
attctggttggcatgcgaagacttc

SEQ ID NO: 208914 - DNA, 25 bp, Rattus norvegicus
attctggttggcttgcgaagacttc

SEQ ID NO: 208915 - DNA, 25 bp, Rattus norvegicus
attctggttttcaaatctgacggat

SEQ ID NO: 208916 - DNA, 25 bp, Rattus norvegicus
attctggttttctaatctgacggat

SEQ ID NO: 208917 - DNA, 25 bp, Rattus norvegicus
attctggtttttagccctttctctg

SEQ ID NO: 208918 - DNA, 25 bp, Rattus norvegicus
attctggtttttcctgagtgagcct

SEQ ID NO: 208919 - DNA, 25 bp, Rattus norvegicus
attctggtttttgctgagtgagcct

SEQ ID NO: 208920 - DNA, 25 bp, Rattus norvegicus
attctggttttttgccctttctctg

SEQ ID NO: 208921 - DNA, 25 bp, Rattus norvegicus
attctgtacaaaacagctcactcgg

SEQ ID NO: 208922 - DNA, 25 bp, Rattus norvegicus
attctgtacaaatcagctcactcgg

SEQ ID NO: 208923 - DNA, 25 bp, Rattus norvegicus
attctgtacagtcgtggtccaaacc

SEQ ID NO: 208924 - DNA, 25 bp, Rattus norvegicus
attctgtacagtggtggtccaaacc

SEQ ID NO: 208925 - DNA, 25 bp, Rattus norvegicus
attctgtactggatgggtctgctga

SEQ ID NO: 208926 - DNA, 25 bp, Rattus norvegicus
attctgtactggttgggtctgctga

SEQ ID NO: 208927 - DNA, 25 bp, Rattus norvegicus
attctgtagactaagttggccttta

SEQ ID NO: 208928 - DNA, 25 bp, Rattus norvegicus
attctgtagacttagttggccttta

SEQ ID NO: 208929 - DNA, 25 bp, Rattus norvegicus
attctgtagataccatgccctactg

SEQ ID NO: 208930 - DNA, 25 bp, Rattus norvegicus
attctgtagatagcatgccctactg

SEQ ID NO: 208931 - DNA, 25 bp, Rattus norvegicus
attctgtagcagatgtttcccgaaa

SEQ ID NO: 208932 - DNA, 25 bp, Rattus norvegicus
attctgtagcagttgtttcccgaaa

SEQ ID NO: 208933 - DNA, 25 bp, Rattus norvegicus
attctgtagcccaaatatagcgttc

SEQ ID NO: 208934 - DNA, 25 bp, Rattus norvegicus
attctgtagccctaatatagcgttc

SEQ ID NO: 208935 - DNA, 25 bp, Rattus norvegicus
attctgtagggtacttacctggcac

SEQ ID NO: 208936 - DNA, 25 bp, Rattus norvegicus
attctgtagggttcttacctggcac

SEQ ID NO: 208937 - DNA, 25 bp, Rattus norvegicus
attctgtagttgcttgtctctagct

SEQ ID NO: 208938 - DNA, 25 bp, Rattus norvegicus
attctgtagttggttgtctctagct

SEQ ID NO: 208939 - DNA, 25 bp, Rattus norvegicus
attctgtatatgaatagcagcacat

SEQ ID NO: 208940 - DNA, 25 bp, Rattus norvegicus
attctgtatatgtatagcagcacat

SEQ ID NO: 208941 - DNA, 25 bp, Rattus norvegicus
attctgtatcaaactgccttgggcc

SEQ ID NO: 208942 - DNA, 25 bp, Rattus norvegicus
attctgtatcaatctgccttgggcc

SEQ ID NO: 208943 - DNA, 25 bp, Rattus norvegicus
attctgtatcagagtgtcctccttc

SEQ ID NO: 208944 - DNA, 25 bp, Rattus norvegicus
attctgtatcagtgtgtcctccttc

SEQ ID NO: 208945 - DNA, 25 bp, Rattus norvegicus
attctgtcaaacagcaagactgatg

SEQ ID NO: 208946 - DNA, 25 bp, Rattus norvegicus
attctgtcaaactgcaagactgatg

SEQ ID NO: 208947 - DNA, 25 bp, Rattus norvegicus
attctgtcaacaatagcctattccc

SEQ ID NO: 208948 - DNA, 25 bp, Rattus norvegicus
attctgtcaacacccacactcaaga

SEQ ID NO: 208949 - DNA, 25 bp, Rattus norvegicus
attctgtcaacagccacactcaaga

SEQ ID NO: 208950 - DNA, 25 bp, Rattus norvegicus
attctgtcaacattagcctattccc

SEQ ID NO: 208951 - DNA, 25 bp, Rattus norvegicus
attctgtcacagatccttttggttt

SEQ ID NO: 208952 - DNA, 25 bp, Rattus norvegicus
attctgtcacagttccttttggttt

SEQ ID NO: 208953 - DNA, 25 bp, Rattus norvegicus
attctgtcactgagggctcaggtgc

SEQ ID NO: 208954 - DNA, 25 bp, Rattus norvegicus
attctgtcactgattctcataggga

SEQ ID NO: 208955 - DNA, 25 bp, Rattus norvegicus
attctgtcactgtgggctcaggtgc

SEQ ID NO: 208956 - DNA, 25 bp, Rattus norvegicus
attctgtcactgtttctcataggga

SEQ ID NO: 208957 - DNA, 25 bp, Rattus norvegicus
attctgtcagacacctttgcaatgt

SEQ ID NO: 208958 - DNA, 25 bp, Rattus norvegicus
attctgtcagactcctttgcaatgt

SEQ ID NO: 208959 - DNA, 25 bp, Rattus norvegicus
attctgtcagatcggtgtcctttca

SEQ ID NO: 208960 - DNA, 25 bp, Rattus norvegicus
attctgtcagatctggagccttacc

SEQ ID NO: 208961 - DNA, 25 bp, Rattus norvegicus
attctgtcagatgggtgtcctttca

SEQ ID NO: 208962 - DNA, 25 bp, Rattus norvegicus
attctgtcagatgtggagccttacc

SEQ ID NO: 208963 - DNA, 25 bp, Rattus norvegicus
attctgtcatgcctttaccctgagt

SEQ ID NO: 208964 - DNA, 25 bp, Rattus norvegicus
attctgtcatgcgtttaccctgagt

SEQ ID NO: 208965 - DNA, 25 bp, Rattus norvegicus
attctgtccataacatttcctttct

SEQ ID NO: 208966 - DNA, 25 bp, Rattus norvegicus
attctgtccatatcatttcctttct

SEQ ID NO: 208967 - DNA, 25 bp, Rattus norvegicus
attctgtcccgaattcaggatctta

SEQ ID NO: 208968 - DNA, 25 bp, Rattus norvegicus
attctgtcccgatttcaggatctta

SEQ ID NO: 208969 - DNA, 25 bp, Rattus norvegicus
attctgtcttcaaacacctttctgg

SEQ ID NO: 208970 - DNA, 25 bp, Rattus norvegicus
attctgtcttcaagaggtctcacca

SEQ ID NO: 208971 - DNA, 25 bp, Rattus norvegicus
attctgtcttcatacacctttctgg

SEQ ID NO: 208972 - DNA, 25 bp, Rattus norvegicus
attctgtcttcatgaggtctcacca

SEQ ID NO: 208973 - DNA, 25 bp, Rattus norvegicus
attctgtcttttccattcatccttg

SEQ ID NO: 208974 - DNA, 25 bp, Rattus norvegicus
attctgtcttttgcattcatccttg

SEQ ID NO: 208975 - DNA, 25 bp, Rattus norvegicus
attctgtgaacaacggagcccaagc

SEQ ID NO: 208976 - DNA, 25 bp, Rattus norvegicus
attctgtgaacatcggagcccaagc

SEQ ID NO: 208977 - DNA, 25 bp, Rattus norvegicus
attctgtgagaaccctgtgtgatta

SEQ ID NO: 208978 - DNA, 25 bp, Rattus norvegicus
attctgtgagaagcctgtgtgatta

SEQ ID NO: 208979 - DNA, 25 bp, Rattus norvegicus
attctgtgaggtcctgcccaaggac

SEQ ID NO: 208980 - DNA, 25 bp, Rattus norvegicus
attctgtgaggtgctgcccaaggac

SEQ ID NO: 208981 - DNA, 25 bp, Rattus norvegicus
attctgtgcccaacagggtgattca

SEQ ID NO: 208982 - DNA, 25 bp, Rattus norvegicus
attctgtgcccatcagggtgattca

SEQ ID NO: 208983 - DNA, 25 bp, Rattus norvegicus
attctgtgccttatgctgggacgag

SEQ ID NO: 208984 - DNA, 25 bp, Rattus norvegicus
attctgtgccttttgctgggacgag

SEQ ID NO: 208985 - DNA, 25 bp, Rattus norvegicus
attctgtgcttgaaggagtgtctta

SEQ ID NO: 208986 - DNA, 25 bp, Rattus norvegicus
attctgtgcttgtaggagtgtctta

SEQ ID NO: 208987 - DNA, 25 bp, Rattus norvegicus
attctgtggcctagaagactcccat

SEQ ID NO: 208988 - DNA, 25 bp, Rattus norvegicus
attctgtggccttgaagactcccat

SEQ ID NO: 208989 - DNA, 25 bp, Rattus norvegicus
attctgtggcgcatccagattgtga

SEQ ID NO: 208990 - DNA, 25 bp, Rattus norvegicus
attctgtggcgcttccagattgtga

SEQ ID NO: 208991 - DNA, 25 bp, Rattus norvegicus
attctgtggctgaggatgttgttcc

SEQ ID NO: 208992 - DNA, 25 bp, Rattus norvegicus
attctgtggctgtggatgttgttcc

SEQ ID NO: 208993 - DNA, 25 bp, Rattus norvegicus
attctgtgggagacctggtatacca

SEQ ID NO: 208994 - DNA, 25 bp, Rattus norvegicus
attctgtgggagtcctggtatacca

SEQ ID NO: 208995 - DNA, 25 bp, Rattus norvegicus
attctgtggttgactcggtgtgcta

SEQ ID NO: 208996 - DNA, 25 bp, Rattus norvegicus
attctgtggttgtctcggtgtgcta

SEQ ID NO: 208997 - DNA, 25 bp, Rattus norvegicus
attctgtgtctgcttggtgaggcct

SEQ ID NO: 208998 - DNA, 25 bp, Rattus norvegicus
attctgtgtctggttggtgaggcct

SEQ ID NO: 208999 - DNA, 25 bp, Rattus norvegicus
attctgtgtgttatgatctttcctt

SEQ ID NO: 209000 - DNA, 25 bp, Rattus norvegicus
attctgtgtgttttgatctttcctt

SEQ ID NO: 209001 - DNA, 25 bp, Rattus norvegicus
attctgttacagattcttgcccaat

SEQ ID NO: 209002 - DNA, 25 bp, Rattus norvegicus
attctgttacagtttcttgcccaat

SEQ ID NO: 209003 - DNA, 25 bp, Rattus norvegicus
attctgttaccaaaatagctgccta

SEQ ID NO: 209004 - DNA, 25 bp, Rattus norvegicus
attctgttaccataatagctgccta

SEQ ID NO: 209005 - DNA, 25 bp, Rattus norvegicus
attctgttagtcatggccaaagccc

SEQ ID NO: 209006 - DNA, 25 bp, Rattus norvegicus
attctgttagtcttggccaaagccc

SEQ ID NO: 209007 - DNA, 25 bp, Rattus norvegicus
attctgttatcgcttaatctcctct

SEQ ID NO: 209008 - DNA, 25 bp, Rattus norvegicus
attctgttatcggttaatctcctct

SEQ ID NO: 209009 - DNA, 25 bp, Rattus norvegicus
attctgttcaggagataacggtgct

SEQ ID NO: 209010 - DNA, 25 bp, Rattus norvegicus
attctgttcaggtgataacggtgct

SEQ ID NO: 209011 - DNA, 25 bp, Rattus norvegicus
attctgttcctgattgtgctcgtat

SEQ ID NO: 209012 - DNA, 25 bp, Rattus norvegicus
attctgttcctgtttgtgctcgtat

SEQ ID NO: 209013 - DNA, 25 bp, Rattus norvegicus
attctgttctgtcctcctgaaggag

SEQ ID NO: 209014 - DNA, 25 bp, Rattus norvegicus
attctgttctgtgctcctgaaggag

SEQ ID NO: 209015 - DNA, 25 bp, Rattus norvegicus
attctgttgagacccagaggccccg

SEQ ID NO: 209016 - DNA, 25 bp, Rattus norvegicus
attctgttgagagccagaggccccg

SEQ ID NO: 209017 - DNA, 25 bp, Rattus norvegicus
attctgttgaggcaccagtatcccg

SEQ ID NO: 209018 - DNA, 25 bp, Rattus norvegicus
attctgttgagggaccagtatcccg

SEQ ID NO: 209019 - DNA, 25 bp, Rattus norvegicus
attctgttgctgaatctgctgtgca

SEQ ID NO: 209020 - DNA, 25 bp, Rattus norvegicus
attctgttgctgtatctgctgtgca

SEQ ID NO: 209021 - DNA, 25 bp, Rattus norvegicus
attctgtttattatagcttgctgtc

SEQ ID NO: 209022 - DNA, 25 bp, Rattus norvegicus
attctgtttattttagcttgctgtc

SEQ ID NO: 209023 - DNA, 25 bp, Rattus norvegicus
attctgtttcctaatttcacacccg

SEQ ID NO: 209024 - DNA, 25 bp, Rattus norvegicus
attctgtttcctaggacgagtacaa

SEQ ID NO: 209025 - DNA, 25 bp, Rattus norvegicus
attctgtttccttatttcacacccg

SEQ ID NO: 209026 - DNA, 25 bp, Rattus norvegicus
attctgtttccttggacgagtacaa

SEQ ID NO: 209027 - DNA, 25 bp, Rattus norvegicus
attctgtttgttagatctgtccgtc

SEQ ID NO: 209028 - DNA, 25 bp, Rattus norvegicus
attctgtttgtttgatctgtccgtc

SEQ ID NO: 209029 - DNA, 25 bp, Rattus norvegicus
attctgttttaacactgcctctcct

SEQ ID NO: 209030 - DNA, 25 bp, Rattus norvegicus
attctgttttaagactgcctctcct

SEQ ID NO: 209031 - DNA, 25 bp, Rattus norvegicus
attctgttttacagtgctttcatag

SEQ ID NO: 209032 - DNA, 25 bp, Rattus norvegicus
attctgttttactgtgctttcatag

SEQ ID NO: 209033 - DNA, 25 bp, Rattus norvegicus
attctgttttgccttagagtcccca

SEQ ID NO: 209034 - DNA, 25 bp, Rattus norvegicus
attctgttttgcgttagagtcccca

SEQ ID NO: 209035 - DNA, 25 bp, Rattus norvegicus
attctgtttttgctagggtcatcac

SEQ ID NO: 209036 - DNA, 25 bp, Rattus norvegicus
attctgtttttggtagggtcatcac

SEQ ID NO: 209037 - DNA, 25 bp, Rattus norvegicus
attcttaaccacctttcctgcaagg

SEQ ID NO: 209038 - DNA, 25 bp, Rattus norvegicus
attcttaaccacgtttcctgcaagg

SEQ ID NO: 209039 - DNA, 25 bp, Rattus norvegicus
attcttaactcaatttgcctcatcc

SEQ ID NO: 209040 - DNA, 25 bp, Rattus norvegicus
attcttaactcattttgcctcatcc

SEQ ID NO: 209041 - DNA, 25 bp, Rattus norvegicus
attcttacccagcattctgtacttc

SEQ ID NO: 209042 - DNA, 25 bp, Rattus norvegicus
attcttacccaggattctgtacttc

SEQ ID NO: 209043 - DNA, 25 bp, Rattus norvegicus
attcttaccgtaacttctgcaaggg

SEQ ID NO: 209044 - DNA, 25 bp, Rattus norvegicus
attcttaccgtatcttctgcaaggg

SEQ ID NO: 209045 - DNA, 25 bp, Rattus norvegicus
attcttactatgcaccagtgacctc

SEQ ID NO: 209046 - DNA, 25 bp, Rattus norvegicus
attcttactatggaccagtgacctc

SEQ ID NO: 209047 - DNA, 25 bp, Rattus norvegicus
attcttactgtactggcatgcgcaa

SEQ ID NO: 209048 - DNA, 25 bp, Rattus norvegicus
attcttactgtagtggcatgcgcaa

SEQ ID NO: 209049 - DNA, 25 bp, Rattus norvegicus
attcttaggccgcatatccttacgc

SEQ ID NO: 209050 - DNA, 25 bp, Rattus norvegicus
attcttaggccggatatccttacgc

SEQ ID NO: 209051 - DNA, 25 bp, Rattus norvegicus
attcttaggcttatcaggctggtgc

SEQ ID NO: 209052 - DNA, 25 bp, Rattus norvegicus
attcttaggcttttcaggctggtgc

SEQ ID NO: 209053 - DNA, 25 bp, Rattus norvegicus
attcttatctccaatctgtgtctct

SEQ ID NO: 209054 - DNA, 25 bp, Rattus norvegicus
attcttatctcctatctgtgtctct

SEQ ID NO: 209055 - DNA, 25 bp, Rattus norvegicus
attcttatgatgattgtcactttaa

SEQ ID NO: 209056 - DNA, 25 bp, Rattus norvegicus
attcttatgatgtttgtcactttaa

SEQ ID NO: 209057 - DNA, 25 bp, Rattus norvegicus
attcttatgcgcaaacgggtgatgt

SEQ ID NO: 209058 - DNA, 25 bp, Rattus norvegicus
attcttatgcgctaacgggtgatgt

SEQ ID NO: 209059 - DNA, 25 bp, Rattus norvegicus
attcttatggatatcaagggcctca

SEQ ID NO: 209060 - DNA, 25 bp, Rattus norvegicus
attcttatggatttcaagggcctca

SEQ ID NO: 209061 - DNA, 25 bp, Rattus norvegicus
attcttcaaccaagcagacttccat

SEQ ID NO: 209062 - DNA, 25 bp, Rattus norvegicus
attcttcaaccatgcagacttccat

SEQ ID NO: 209063 - DNA, 25 bp, Rattus norvegicus
attcttcaactaaaactgccagggt

SEQ ID NO: 209064 - DNA, 25 bp, Rattus norvegicus
attcttcaactataactgccagggt

SEQ ID NO: 209065 - DNA, 25 bp, Rattus norvegicus
attcttcaagctcaaaccgtaccgt

SEQ ID NO: 209066 - DNA, 25 bp, Rattus norvegicus
attcttcaagctgaaaccgtaccgt

SEQ ID NO: 209067 - DNA, 25 bp, Rattus norvegicus
attcttcaccttcctatgtttactg

SEQ ID NO: 209068 - DNA, 25 bp, Rattus norvegicus
attcttcaccttgctatgtttactg

SEQ ID NO: 209069 - DNA, 25 bp, Rattus norvegicus
attcttcagctccagttatgtcctt

SEQ ID NO: 209070 - DNA, 25 bp, Rattus norvegicus
attcttcagctcgagttatgtcctt

SEQ ID NO: 209071 - DNA, 25 bp, Rattus norvegicus
attcttcaggtgatgtacttttgtc

SEQ ID NO: 209072 - DNA, 25 bp, Rattus norvegicus
attcttcaggtgttgtacttttgtc

SEQ ID NO: 209073 - DNA, 25 bp, Rattus norvegicus
attcttcagtgtaattcttgcccta

SEQ ID NO: 209074 - DNA, 25 bp, Rattus norvegicus
attcttcagtgttattcttgcccta

SEQ ID NO: 209075 - DNA, 25 bp, Rattus norvegicus
attcttcatacaccatcttggcacc

SEQ ID NO: 209076 - DNA, 25 bp, Rattus norvegicus
attcttcatacagcatcttggcacc

SEQ ID NO: 209077 - DNA, 25 bp, Rattus norvegicus
attcttcatgagacatccagccttt

SEQ ID NO: 209078 - DNA, 25 bp, Rattus norvegicus
attcttcatgagatcatgcccctca

SEQ ID NO: 209079 - DNA, 25 bp, Rattus norvegicus
attcttcatgagtcatccagccttt

SEQ ID NO: 209080 - DNA, 25 bp, Rattus norvegicus
attcttcatgagttcatgcccctca

SEQ ID NO: 209081 - DNA, 25 bp, Rattus norvegicus
attcttcatggaccatctttccaga

SEQ ID NO: 209082 - DNA, 25 bp, Rattus norvegicus
attcttcatggagcatctttccaga

SEQ ID NO: 209083 - DNA, 25 bp, Rattus norvegicus
attcttcatgtgaactggttctgcc

SEQ ID NO: 209084 - DNA, 25 bp, Rattus norvegicus
attcttcatgtgtactggttctgcc

SEQ ID NO: 209085 - DNA, 25 bp, Rattus norvegicus
attcttcattctccagctggactga

SEQ ID NO: 209086 - DNA, 25 bp, Rattus norvegicus
attcttcattctgcagctggactga

SEQ ID NO: 209087 - DNA, 25 bp, Rattus norvegicus
attcttcattggatttgtgctgctt

SEQ ID NO: 209088 - DNA, 25 bp, Rattus norvegicus
attcttcattggttttgtgctgctt

SEQ ID NO: 209089 - DNA, 25 bp, Rattus norvegicus
attcttccagtgctatacacctaga

SEQ ID NO: 209090 - DNA, 25 bp, Rattus norvegicus
attcttccagtggtatacacctaga

SEQ ID NO: 209091 - DNA, 25 bp, Rattus norvegicus
attcttccagttcccatttaactct

SEQ ID NO: 209092 - DNA, 25 bp, Rattus norvegicus
attcttccagttgccatttaactct

SEQ ID NO: 209093 - DNA, 25 bp, Rattus norvegicus
attcttccctaacgtgaaaggactg

SEQ ID NO: 209094 - DNA, 25 bp, Rattus norvegicus
attcttccctaaggtgaaaggactg

SEQ ID NO: 209095 - DNA, 25 bp, Rattus norvegicus
attcttccctggacggtgtgccgag

SEQ ID NO: 209096 - DNA, 25 bp, Rattus norvegicus
attcttccctggtcggtgtgccgag

SEQ ID NO: 209097 - DNA, 25 bp, Rattus norvegicus
attcttcccttcactctaattgtta

SEQ ID NO: 209098 - DNA, 25 bp, Rattus norvegicus
attcttcccttctctctaattgtta

SEQ ID NO: 209099 - DNA, 25 bp, Rattus norvegicus
attcttccgagaagttccttgacct

SEQ ID NO: 209100 - DNA, 25 bp, Rattus norvegicus
attcttccgagatgttccttgacct

SEQ ID NO: 209101 - DNA, 25 bp, Rattus norvegicus
attcttcctccaagtagtttcttgg

SEQ ID NO: 209102 - DNA, 25 bp, Rattus norvegicus
attcttcctccatgtagtttcttgg

SEQ ID NO: 209103 - DNA, 25 bp, Rattus norvegicus
attcttcctcctcttgccagagaga

SEQ ID NO: 209104 - DNA, 25 bp, Rattus norvegicus
attcttcctcctgttgccagagaga

SEQ ID NO: 209105 - DNA, 25 bp, Rattus norvegicus
attcttcctgagcttacagccgttt

SEQ ID NO: 209106 - DNA, 25 bp, Rattus norvegicus
attcttcctgaggttacagccgttt

SEQ ID NO: 209107 - DNA, 25 bp, Rattus norvegicus
attcttcctgcaacaatggaggcgg

SEQ ID NO: 209108 - DNA, 25 bp, Rattus norvegicus
attcttcctgcatcaatggaggcgg

SEQ ID NO: 209109 - DNA, 25 bp, Rattus norvegicus
attcttcctgtccttgatggctgca

SEQ ID NO: 209110 - DNA, 25 bp, Rattus norvegicus
attcttcctgtcgttgatggctgca

SEQ ID NO: 209111 - DNA, 25 bp, Rattus norvegicus
attcttcctgtgagttcaagttttc

SEQ ID NO: 209112 - DNA, 25 bp, Rattus norvegicus
attcttcctgtgtgttcaagttttc

SEQ ID NO: 209113 - DNA, 25 bp, Rattus norvegicus
attcttccttgtaaacatattatgg

SEQ ID NO: 209114 - DNA, 25 bp, Rattus norvegicus
attcttccttgtcagtcttgaccca

SEQ ID NO: 209115 - DNA, 25 bp, Rattus norvegicus
attcttccttgtctttaccatctcc

SEQ ID NO: 209116 - DNA, 25 bp, Rattus norvegicus
attcttccttgtgagtcttgaccca

SEQ ID NO: 209117 - DNA, 25 bp, Rattus norvegicus
attcttccttgtgtttaccatctcc

SEQ ID NO: 209118 - DNA, 25 bp, Rattus norvegicus
attcttccttgttaacatattatgg

SEQ ID NO: 209119 - DNA, 25 bp, Rattus norvegicus
attcttcgctctccacaaagctgtg

SEQ ID NO: 209120 - DNA, 25 bp, Rattus norvegicus
attcttcgctctgcacaaagctgtg

SEQ ID NO: 209121 - DNA, 25 bp, Rattus norvegicus
attcttcggtgcatacatagctggc

SEQ ID NO: 209122 - DNA, 25 bp, Rattus norvegicus
attcttcggtgcttacatagctggc

SEQ ID NO: 209123 - DNA, 25 bp, Rattus norvegicus
attcttctaaccctatttccatcct

SEQ ID NO: 209124 - DNA, 25 bp, Rattus norvegicus
attcttctaaccgtatttccatcct

SEQ ID NO: 209125 - DNA, 25 bp, Rattus norvegicus
attcttctcagcctttatcacatga

SEQ ID NO: 209126 - DNA, 25 bp, Rattus norvegicus
attcttctcagcgtttatcacatga

SEQ ID NO: 209127 - DNA, 25 bp, Rattus norvegicus
attcttctcatcacagtcagcttca

SEQ ID NO: 209128 - DNA, 25 bp, Rattus norvegicus
attcttctcatctcagtcagcttca

SEQ ID NO: 209129 - DNA, 25 bp, Rattus norvegicus
attcttctcttacctgtccagtagt

SEQ ID NO: 209130 - DNA, 25 bp, Rattus norvegicus
attcttctcttagctgtccagtagt

SEQ ID NO: 209131 - DNA, 25 bp, Rattus norvegicus
attcttctgcatagaggcctcccct

SEQ ID NO: 209132 - DNA, 25 bp, Rattus norvegicus
attcttctgcattgaggcctcccct

SEQ ID NO: 209133 - DNA, 25 bp, Rattus norvegicus
attcttctggagaagtttctcatct

SEQ ID NO: 209134 - DNA, 25 bp, Rattus norvegicus
attcttctggagtagtttctcatct

SEQ ID NO: 209135 - DNA, 25 bp, Rattus norvegicus
attcttctgggtccgccaagatggg

SEQ ID NO: 209136 - DNA, 25 bp, Rattus norvegicus
attcttctgggtgcgccaagatggg

SEQ ID NO: 209137 - DNA, 25 bp, Rattus norvegicus
attcttctgtatcgttgtggatgac

SEQ ID NO: 209138 - DNA, 25 bp, Rattus norvegicus
attcttctgtatggttgtggatgac

SEQ ID NO: 209139 - DNA, 25 bp, Rattus norvegicus
attcttcttaagacttcgtaggcca

SEQ ID NO: 209140 - DNA, 25 bp, Rattus norvegicus
attcttcttaagtcttcgtaggcca

SEQ ID NO: 209141 - DNA, 25 bp, Rattus norvegicus
attcttcttgctctcaacggcagaa

SEQ ID NO: 209142 - DNA, 25 bp, Rattus norvegicus
attcttcttgctgtcaacggcagaa

SEQ ID NO: 209143 - DNA, 25 bp, Rattus norvegicus
attcttgaacttcctttcgttgtca

SEQ ID NO: 209144 - DNA, 25 bp, Rattus norvegicus
attcttgaacttgctttcgttgtca

SEQ ID NO: 209145 - DNA, 25 bp, Rattus norvegicus
attcttgaagttacccactcatggc

SEQ ID NO: 209146 - DNA, 25 bp, Rattus norvegicus
attcttgaagtttcccactcatggc

SEQ ID NO: 209147 - DNA, 25 bp, Rattus norvegicus
attcttgaccatccacttattttga

SEQ ID NO: 209148 - DNA, 25 bp, Rattus norvegicus
attcttgaccatgcacttattttga

SEQ ID NO: 209149 - DNA, 25 bp, Rattus norvegicus
attcttgacgtcctcatggatgcag

SEQ ID NO: 209150 - DNA, 25 bp, Rattus norvegicus
attcttgacgtcgtcatggatgcag

SEQ ID NO: 209151 - DNA, 25 bp, Rattus norvegicus
attcttgagccccatggagtcttgt

SEQ ID NO: 209152 - DNA, 25 bp, Rattus norvegicus
attcttgagcccgatggagtcttgt

SEQ ID NO: 209153 - DNA, 25 bp, Rattus norvegicus
attcttgatcccaagatggtgttgc

SEQ ID NO: 209154 - DNA, 25 bp, Rattus norvegicus
attcttgatcccagttggtggctgt

SEQ ID NO: 209155 - DNA, 25 bp, Rattus norvegicus
attcttgatccctagatggtgttgc

SEQ ID NO: 209156 - DNA, 25 bp, Rattus norvegicus
attcttgatccctgttggtggctgt

SEQ ID NO: 209157 - DNA, 25 bp, Rattus norvegicus
attcttgattgactcatggtctaac

SEQ ID NO: 209158 - DNA, 25 bp, Rattus norvegicus
attcttgattgagtcatggtctaac

SEQ ID NO: 209159 - DNA, 25 bp, Rattus norvegicus
attcttgcaaagaatcccttctgta

SEQ ID NO: 209160 - DNA, 25 bp, Rattus norvegicus
attcttgcaaagtatcccttctgta

SEQ ID NO: 209161 - DNA, 25 bp, Rattus norvegicus
attcttgcctgactcgccagggcta

SEQ ID NO: 209162 - DNA, 25 bp, Rattus norvegicus
attcttgcctgagtcgccagggcta

SEQ ID NO: 209163 - DNA, 25 bp, Rattus norvegicus
attcttgccttcctcttacaggttt

SEQ ID NO: 209164 - DNA, 25 bp, Rattus norvegicus
attcttgccttcgtcttacaggttt

SEQ ID NO: 209165 - DNA, 25 bp, Rattus norvegicus
attcttgccttgaacctcggccggc

SEQ ID NO: 209166 - DNA, 25 bp, Rattus norvegicus
attcttgccttgtacctcggccggc

SEQ ID NO: 209167 - DNA, 25 bp, Rattus norvegicus
attcttgctaccctgactagtttga

SEQ ID NO: 209168 - DNA, 25 bp, Rattus norvegicus
attcttgctaccgtgactagtttga

SEQ ID NO: 209169 - DNA, 25 bp, Rattus norvegicus
attcttggaacacccatgccttcca

SEQ ID NO: 209170 - DNA, 25 bp, Rattus norvegicus
attcttggaacagccatgccttcca

SEQ ID NO: 209171 - DNA, 25 bp, Rattus norvegicus
attcttggacttaaactactctgag

SEQ ID NO: 209172 - DNA, 25 bp, Rattus norvegicus
attcttggactttaactactctgag

SEQ ID NO: 209173 - DNA, 25 bp, Rattus norvegicus
attcttggagaccacacctatgcgg

SEQ ID NO: 209174 - DNA, 25 bp, Rattus norvegicus
attcttggagacgacacctatgcgg

SEQ ID NO: 209175 - DNA, 25 bp, Rattus norvegicus
attcttggatctcactcggcttcac

SEQ ID NO: 209176 - DNA, 25 bp, Rattus norvegicus
attcttggatctgactcggcttcac

SEQ ID NO: 209177 - DNA, 25 bp, Rattus norvegicus
attcttggatggaaaccccgccgag

SEQ ID NO: 209178 - DNA, 25 bp, Rattus norvegicus
attcttggatggtaaccccgccgag

SEQ ID NO: 209179 - DNA, 25 bp, Rattus norvegicus
attcttggattgagctgggccgcat

SEQ ID NO: 209180 - DNA, 25 bp, Rattus norvegicus
attcttggattgtgctgggccgcat

SEQ ID NO: 209181 - DNA, 25 bp, Rattus norvegicus
attcttggccacacagggcttgctt

SEQ ID NO: 209182 - DNA, 25 bp, Rattus norvegicus
attcttggccactcagggcttgctt

SEQ ID NO: 209183 - DNA, 25 bp, Rattus norvegicus
attcttggccctattatctctgcaa

SEQ ID NO: 209184 - DNA, 25 bp, Rattus norvegicus
attcttggcccttttatctctgcaa

SEQ ID NO: 209185 - DNA, 25 bp, Rattus norvegicus
attcttgggcaaaatatactgattt

SEQ ID NO: 209186 - DNA, 25 bp, Rattus norvegicus
attcttgggcaatatatactgattt

SEQ ID NO: 209187 - DNA, 25 bp, Rattus norvegicus
attcttgggctcacttgagcatata

SEQ ID NO: 209188 - DNA, 25 bp, Rattus norvegicus
attcttgggctctcttgagcatata

SEQ ID NO: 209189 - DNA, 25 bp, Rattus norvegicus
attcttgggtttcgcaaggtctcta

SEQ ID NO: 209190 - DNA, 25 bp, Rattus norvegicus
attcttgggtttggcaaggtctcta

SEQ ID NO: 209191 - DNA, 25 bp, Rattus norvegicus
attcttggtcctatgctgccaactg

SEQ ID NO: 209192 - DNA, 25 bp, Rattus norvegicus
attcttggtcctttgctgccaactg

SEQ ID NO: 209193 - DNA, 25 bp, Rattus norvegicus
attcttgtcacaattgcctcatgca

SEQ ID NO: 209194 - DNA, 25 bp, Rattus norvegicus
attcttgtcacatttgcctcatgca

SEQ ID NO: 209195 - DNA, 25 bp, Rattus norvegicus
attcttgtcatgaactcgtgtggct

SEQ ID NO: 209196 - DNA, 25 bp, Rattus norvegicus
attcttgtcatgtactcgtgtggct

SEQ ID NO: 209197 - DNA, 25 bp, Rattus norvegicus
attcttgtccatcttttgtaatcaa

SEQ ID NO: 209198 - DNA, 25 bp, Rattus norvegicus
attcttgtccatgttttgtaatcaa

SEQ ID NO: 209199 - DNA, 25 bp, Rattus norvegicus
attcttgtctcacgctctcttaagc

SEQ ID NO: 209200 - DNA, 25 bp, Rattus norvegicus
attcttgtctcaggctctcttaagc

SEQ ID NO: 209201 - DNA, 25 bp, Rattus norvegicus
attcttgtcttgcttttcgtggcca

SEQ ID NO: 209202 - DNA, 25 bp, Rattus norvegicus
attcttgtcttggttttcgtggcca

SEQ ID NO: 209203 - DNA, 25 bp, Rattus norvegicus
attcttgtgctgagggcctttggaa

SEQ ID NO: 209204 - DNA, 25 bp, Rattus norvegicus
attcttgtgctgtgggcctttggaa

SEQ ID NO: 209205 - DNA, 25 bp, Rattus norvegicus
attcttgtgttaactatccacccca

SEQ ID NO: 209206 - DNA, 25 bp, Rattus norvegicus
attcttgtgttatctatccacccca

SEQ ID NO: 209207 - DNA, 25 bp, Rattus norvegicus
attcttgtgttcattaccctccctg

SEQ ID NO: 209208 - DNA, 25 bp, Rattus norvegicus
attcttgtgttctttaccctccctg

SEQ ID NO: 209209 - DNA, 25 bp, Rattus norvegicus
attcttgtgttgattcgcagtagat

SEQ ID NO: 209210 - DNA, 25 bp, Rattus norvegicus
attcttgtgttgtttcgcagtagat

SEQ ID NO: 209211 - DNA, 25 bp, Rattus norvegicus
attcttgttcgtctaggttgctaaa

SEQ ID NO: 209212 - DNA, 25 bp, Rattus norvegicus
attcttgttcgtgtaggttgctaaa

SEQ ID NO: 209213 - DNA, 25 bp, Rattus norvegicus
attcttgttctaaagctcatcgcag

SEQ ID NO: 209214 - DNA, 25 bp, Rattus norvegicus
attcttgttctatagctcatcgcag

SEQ ID NO: 209215 - DNA, 25 bp, Rattus norvegicus
attctttaacaccaaggctttcatc

SEQ ID NO: 209216 - DNA, 25 bp, Rattus norvegicus
attctttaacacgaaggctttcatc

SEQ ID NO: 209217 - DNA, 25 bp, Rattus norvegicus
attctttaagccacctagttcatag

SEQ ID NO: 209218 - DNA, 25 bp, Rattus norvegicus
attctttaagcctcctagttcatag

SEQ ID NO: 209219 - DNA, 25 bp, Rattus norvegicus
attctttacacaaaatcttcctgag

SEQ ID NO: 209220 - DNA, 25 bp, Rattus norvegicus
attctttacacataatcttcctgag

SEQ ID NO: 209221 - DNA, 25 bp, Rattus norvegicus
attctttactagcagctcatatctt

SEQ ID NO: 209222 - DNA, 25 bp, Rattus norvegicus
attctttactaggagctcatatctt

SEQ ID NO: 209223 - DNA, 25 bp, Rattus norvegicus
attctttacttcctccttacataat

SEQ ID NO: 209224 - DNA, 25 bp, Rattus norvegicus
attctttacttcgtccttacataat

SEQ ID NO: 209225 - DNA, 25 bp, Rattus norvegicus
attctttagagccatatgcccaatg

SEQ ID NO: 209226 - DNA, 25 bp, Rattus norvegicus
attctttagagcgatatgcccaatg

SEQ ID NO: 209227 - DNA, 25 bp, Rattus norvegicus
attctttagttcatacctgctcagg

SEQ ID NO: 209228 - DNA, 25 bp, Rattus norvegicus
attctttagttcttacctgctcagg

SEQ ID NO: 209229 - DNA, 25 bp, Rattus norvegicus
attctttataaacccagacagaccc

SEQ ID NO: 209230 - DNA, 25 bp, Rattus norvegicus
attctttataaagccagacagaccc

SEQ ID NO: 209231 - DNA, 25 bp, Rattus norvegicus
attctttatcagagttggcccttcc

SEQ ID NO: 209232 - DNA, 25 bp, Rattus norvegicus
attctttatcagtgttggcccttcc

SEQ ID NO: 209233 - DNA, 25 bp, Rattus norvegicus
attctttcaaggaaatccacgttct

SEQ ID NO: 209234 - DNA, 25 bp, Rattus norvegicus
attctttcaaggtaatccacgttct

SEQ ID NO: 209235 - DNA, 25 bp, Rattus norvegicus
attctttccataatgctttccttgc

SEQ ID NO: 209236 - DNA, 25 bp, Rattus norvegicus
attctttccatattgctttccttgc

SEQ ID NO: 209237 - DNA, 25 bp, Rattus norvegicus
attctttccctcaagcaagtaatta

SEQ ID NO: 209238 - DNA, 25 bp, Rattus norvegicus
attctttccctctagcaagtaatta

SEQ ID NO: 209239 - DNA, 25 bp, Rattus norvegicus
attctttccgaaatagcctccattt

SEQ ID NO: 209240 - DNA, 25 bp, Rattus norvegicus
attctttccgaattagcctccattt

SEQ ID NO: 209241 - DNA, 25 bp, Rattus norvegicus
attctttcctgcaatgtattttcta

SEQ ID NO: 209242 - DNA, 25 bp, Rattus norvegicus
attctttcctgcctcaatgacagtg

SEQ ID NO: 209243 - DNA, 25 bp, Rattus norvegicus
attctttcctgcgtcaatgacagtg

SEQ ID NO: 209244 - DNA, 25 bp, Rattus norvegicus
attctttcctgctatgtattttcta

SEQ ID NO: 209245 - DNA, 25 bp, Rattus norvegicus
attctttcctttctgaatcagcctt

SEQ ID NO: 209246 - DNA, 25 bp, Rattus norvegicus
attctttcctttgtgaatcagcctt

SEQ ID NO: 209247 - DNA, 25 bp, Rattus norvegicus
attctttctctcctgtcagcaaact

SEQ ID NO: 209248 - DNA, 25 bp, Rattus norvegicus
attctttctctcgtgtcagcaaact

SEQ ID NO: 209249 - DNA, 25 bp, Rattus norvegicus
attctttctggtcccactatactgt

SEQ ID NO: 209250 - DNA, 25 bp, Rattus norvegicus
attctttctggtgccactatactgt

SEQ ID NO: 209251 - DNA, 25 bp, Rattus norvegicus
attctttcttgactccataacactc

SEQ ID NO: 209252 - DNA, 25 bp, Rattus norvegicus
attctttcttgagtccataacactc

SEQ ID NO: 209253 - DNA, 25 bp, Rattus norvegicus
attctttctttcaagtcgcctctta

SEQ ID NO: 209254 - DNA, 25 bp, Rattus norvegicus
attctttctttctagtcgcctctta

SEQ ID NO: 209255 - DNA, 25 bp, Rattus norvegicus
attctttgcactaagctgcaggagg

SEQ ID NO: 209256 - DNA, 25 bp, Rattus norvegicus
attctttgcacttagctgcaggagg

SEQ ID NO: 209257 - DNA, 25 bp, Rattus norvegicus
attctttgcattaaactgccagtgc

SEQ ID NO: 209258 - DNA, 25 bp, Rattus norvegicus
attctttgcatttaactgccagtgc

SEQ ID NO: 209259 - DNA, 25 bp, Rattus norvegicus
attctttgccgcagcagtgggagtt

SEQ ID NO: 209260 - DNA, 25 bp, Rattus norvegicus
attctttgccgctgcagtgggagtt

SEQ ID NO: 209261 - DNA, 25 bp, Rattus norvegicus
attctttgcctgatatatttgtgac

SEQ ID NO: 209262 - DNA, 25 bp, Rattus norvegicus
attctttgcctgttatatttgtgac

SEQ ID NO: 209263 - DNA, 25 bp, Rattus norvegicus
attctttgctctcagtctctttgtg

SEQ ID NO: 209264 - DNA, 25 bp, Rattus norvegicus
attctttgctctgagtctctttgtg

SEQ ID NO: 209265 - DNA, 25 bp, Rattus norvegicus
attctttgtagtagagaccttgcga

SEQ ID NO: 209266 - DNA, 25 bp, Rattus norvegicus
attctttgtagttgagaccttgcga

SEQ ID NO: 209267 - DNA, 25 bp, Rattus norvegicus
attctttgtcgcatggaaatcctgt

SEQ ID NO: 209268 - DNA, 25 bp, Rattus norvegicus
attctttgtcgcttggaaatcctgt

SEQ ID NO: 209269 - DNA, 25 bp, Rattus norvegicus
attcttttatctattcagaccagag

SEQ ID NO: 209270 - DNA, 25 bp, Rattus norvegicus
attcttttatcttttcagaccagag

SEQ ID NO: 209271 - DNA, 25 bp, Rattus norvegicus
attcttttatgtctagggctggaaa

SEQ ID NO: 209272 - DNA, 25 bp, Rattus norvegicus
attcttttatgtgtagggctggaaa

SEQ ID NO: 209273 - DNA, 25 bp, Rattus norvegicus
attcttttcattagtcgcagtgatg

SEQ ID NO: 209274 - DNA, 25 bp, Rattus norvegicus
attcttttcatttgtcgcagtgatg

SEQ ID NO: 209275 - DNA, 25 bp, Rattus norvegicus
attcttttccaaaccttagcgccat

SEQ ID NO: 209276 - DNA, 25 bp, Rattus norvegicus
attcttttccaaatgcactttctaa

SEQ ID NO: 209277 - DNA, 25 bp, Rattus norvegicus
attcttttccaatccttagcgccat

SEQ ID NO: 209278 - DNA, 25 bp, Rattus norvegicus
attcttttccaattgcactttctaa

SEQ ID NO: 209279 - DNA, 25 bp, Rattus norvegicus
attcttttctagaccttccgaacat

SEQ ID NO: 209280 - DNA, 25 bp, Rattus norvegicus
attcttttctagtccttccgaacat

SEQ ID NO: 209281 - DNA, 25 bp, Rattus norvegicus
attcttttcttaccagcggcttagg

SEQ ID NO: 209282 - DNA, 25 bp, Rattus norvegicus
attcttttcttagcagcggcttagg

SEQ ID NO: 209283 - DNA, 25 bp, Rattus norvegicus
attcttttctttctgccaagttttg

SEQ ID NO: 209284 - DNA, 25 bp, Rattus norvegicus
attcttttctttgtgccaagttttg

SEQ ID NO: 209285 - DNA, 25 bp, Rattus norvegicus
attcttttgcagctcatgcaggaga

SEQ ID NO: 209286 - DNA, 25 bp, Rattus norvegicus
attcttttgcaggtcatgcaggaga

SEQ ID NO: 209287 - DNA, 25 bp, Rattus norvegicus
attctttttattactgctggtttca

SEQ ID NO: 209288 - DNA, 25 bp, Rattus norvegicus
attctttttatttctgctggtttca

SEQ ID NO: 209289 - DNA, 25 bp, Rattus norvegicus
attctttttgttcgtttcactgttg

SEQ ID NO: 209290 - DNA, 25 bp, Rattus norvegicus
attctttttgttggtttcactgttg

SEQ ID NO: 209291 - DNA, 25 bp, Rattus norvegicus
attcttttttttccagtttgctgag

SEQ ID NO: 209292 - DNA, 25 bp, Rattus norvegicus
attcttttttttgcagtttgctgag

SEQ ID NO: 209293 - DNA, 25 bp, Rattus norvegicus
attgaaaaccatccctccaggaaag

SEQ ID NO: 209294 - DNA, 25 bp, Rattus norvegicus
attgaaaaccatgcctccaggaaag

SEQ ID NO: 209295 - DNA, 25 bp, Rattus norvegicus
attgaaaatgctaacactccctgtg

SEQ ID NO: 209296 - DNA, 25 bp, Rattus norvegicus
attgaaaatgcttacactccctgtg

SEQ ID NO: 209297 - DNA, 25 bp, Rattus norvegicus
attgaaacaagcagacctctcacct

SEQ ID NO: 209298 - DNA, 25 bp, Rattus norvegicus
attgaaacaagctgacctctcacct

SEQ ID NO: 209299 - DNA, 25 bp, Rattus norvegicus
attgaaacagccatctttcctacag

SEQ ID NO: 209300 - DNA, 25 bp, Rattus norvegicus
attgaaacagccttctttcctacag

SEQ ID NO: 209301 - DNA, 25 bp, Rattus norvegicus
attgaaacagctccggacagccagg

SEQ ID NO: 209302 - DNA, 25 bp, Rattus norvegicus
attgaaacagctgcggacagccagg

SEQ ID NO: 209303 - DNA, 25 bp, Rattus norvegicus
attgaaactgttcgtctcaccaggc

SEQ ID NO: 209304 - DNA, 25 bp, Rattus norvegicus
attgaaactgttggtctcaccaggc

SEQ ID NO: 209305 - DNA, 25 bp, Rattus norvegicus
attgaaagagccaccagggatgact

SEQ ID NO: 209306 - DNA, 25 bp, Rattus norvegicus
attgaaagagcctccagggatgact

SEQ ID NO: 209307 - DNA, 25 bp, Rattus norvegicus
attgaaatatcccacccatcagttt

SEQ ID NO: 209308 - DNA, 25 bp, Rattus norvegicus
attgaaatatccgacccatcagttt

SEQ ID NO: 209309 - DNA, 25 bp, Rattus norvegicus
attgaaatcctgagtccatccttta

SEQ ID NO: 209310 - DNA, 25 bp, Rattus norvegicus
attgaaatcctgtgtccatccttta

SEQ ID NO: 209311 - DNA, 25 bp, Rattus norvegicus
attgaaatgtggactctcagctgcc

SEQ ID NO: 209312 - DNA, 25 bp, Rattus norvegicus
attgaaatgtggtctctcagctgcc

SEQ ID NO: 209313 - DNA, 25 bp, Rattus norvegicus
attgaaattacacctccacctcttt

SEQ ID NO: 209314 - DNA, 25 bp, Rattus norvegicus
attgaaattacagctccacctcttt

SEQ ID NO: 209315 - DNA, 25 bp, Rattus norvegicus
attgaaattactcccgtgacggccg

SEQ ID NO: 209316 - DNA, 25 bp, Rattus norvegicus
attgaaattactgccgtgacggccg

SEQ ID NO: 209317 - DNA, 25 bp, Rattus norvegicus
attgaacactccacttgacaggcat

SEQ ID NO: 209318 - DNA, 25 bp, Rattus norvegicus
attgaacactcctcttgacaggcat

SEQ ID NO: 209319 - DNA, 25 bp, Rattus norvegicus
attgaacacttcctcatggacctgg

SEQ ID NO: 209320 - DNA, 25 bp, Rattus norvegicus
attgaacacttcgtcatggacctgg

SEQ ID NO: 209321 - DNA, 25 bp, Rattus norvegicus
attgaacagcttctctgtgcaccat

SEQ ID NO: 209322 - DNA, 25 bp, Rattus norvegicus
attgaacagcttgtctgtgcaccat

SEQ ID NO: 209323 - DNA, 25 bp, Rattus norvegicus
attgaacaggctcacccaaggattc

SEQ ID NO: 209324 - DNA, 25 bp, Rattus norvegicus
attgaacaggctgacccaaggattc

SEQ ID NO: 209325 - DNA, 25 bp, Rattus norvegicus
attgaaccagcgctggacaccccag

SEQ ID NO: 209326 - DNA, 25 bp, Rattus norvegicus
attgaaccagcggtggacaccccag

SEQ ID NO: 209327 - DNA, 25 bp, Rattus norvegicus
attgaacccaccaactcaaaagcta

SEQ ID NO: 209328 - DNA, 25 bp, Rattus norvegicus
attgaacccacctactcaaaagcta

SEQ ID NO: 209329 - DNA, 25 bp, Rattus norvegicus
attgaacccagcacctctggagtaa

SEQ ID NO: 209330 - DNA, 25 bp, Rattus norvegicus
attgaacccagctcctctggagtaa

SEQ ID NO: 209331 - DNA, 25 bp, Rattus norvegicus
attgaacccgggactttgcaagagc

SEQ ID NO: 209332 - DNA, 25 bp, Rattus norvegicus
attgaacccgggtctttgcaagagc

SEQ ID NO: 209333 - DNA, 25 bp, Rattus norvegicus
attgaacctagacctgtgtgcctcc

SEQ ID NO: 209334 - DNA, 25 bp, Rattus norvegicus
attgaacctagagctgtgtgcctcc

SEQ ID NO: 209335 - DNA, 25 bp, Rattus norvegicus
attgaacctaggcaggtctttctgt

SEQ ID NO: 209336 - DNA, 25 bp, Rattus norvegicus
attgaacctagggaggtctttctgt

SEQ ID NO: 209337 - DNA, 25 bp, Rattus norvegicus
attgaacctgaaatctttctggcaa

SEQ ID NO: 209338 - DNA, 25 bp, Rattus norvegicus
attgaacctgaacaccccatgaaag

SEQ ID NO: 209339 - DNA, 25 bp, Rattus norvegicus
attgaacctgaagaccccatgaaag

SEQ ID NO: 209340 - DNA, 25 bp, Rattus norvegicus
attgaacctgaattctttctggcaa

SEQ ID NO: 209341 - DNA, 25 bp, Rattus norvegicus
attgaactcagaacaccaggaaaga

SEQ ID NO: 209342 - DNA, 25 bp, Rattus norvegicus
attgaactcagatcaccaggaaaga

SEQ ID NO: 209343 - DNA, 25 bp, Rattus norvegicus
attgaactctggatctctggaatat

SEQ ID NO: 209344 - DNA, 25 bp, Rattus norvegicus
attgaactctggttctctggaatat

SEQ ID NO: 209345 - DNA, 25 bp, Rattus norvegicus
attgaactgcttcgatatactttaa

SEQ ID NO: 209346 - DNA, 25 bp, Rattus norvegicus
attgaactgcttggatatactttaa

SEQ ID NO: 209347 - DNA, 25 bp, Rattus norvegicus
attgaactggatacacggccttcgg

SEQ ID NO: 209348 - DNA, 25 bp, Rattus norvegicus
attgaactggattcacggccttcgg

SEQ ID NO: 209349 - DNA, 25 bp, Rattus norvegicus
attgaactgtacactagtggctgtt

SEQ ID NO: 209350 - DNA, 25 bp, Rattus norvegicus
attgaactgtactctagtggctgtt

SEQ ID NO: 209351 - DNA, 25 bp, Rattus norvegicus
attgaactgttcacgaaggccgcct

SEQ ID NO: 209352 - DNA, 25 bp, Rattus norvegicus
attgaactgttctcgaaggccgcct

SEQ ID NO: 209353 - DNA, 25 bp, Rattus norvegicus
attgaacttcctattgctagtgaca

SEQ ID NO: 209354 - DNA, 25 bp, Rattus norvegicus
attgaacttcctcaggcatggcaaa

SEQ ID NO: 209355 - DNA, 25 bp, Rattus norvegicus
attgaacttcctgaggcatggcaaa

SEQ ID NO: 209356 - DNA, 25 bp, Rattus norvegicus
attgaacttccttttgctagtgaca

SEQ ID NO: 209357 - DNA, 25 bp, Rattus norvegicus
attgaacttgggatctctgcaaaag

SEQ ID NO: 209358 - DNA, 25 bp, Rattus norvegicus
attgaacttgggttctctgcaaaag

SEQ ID NO: 209359 - DNA, 25 bp, Rattus norvegicus
attgaagaagagatccgggcagccc

SEQ ID NO: 209360 - DNA, 25 bp, Rattus norvegicus
attgaagaagagttccgggcagccc

SEQ ID NO: 209361 - DNA, 25 bp, Rattus norvegicus
attgaagaatggcagccagagcccc

SEQ ID NO: 209362 - DNA, 25 bp, Rattus norvegicus
attgaagaatgggagccagagcccc

SEQ ID NO: 209363 - DNA, 25 bp, Rattus norvegicus
attgaagagatcctagcagccagag

SEQ ID NO: 209364 - DNA, 25 bp, Rattus norvegicus
attgaagagatcgtagcagccagag

SEQ ID NO: 209365 - DNA, 25 bp, Rattus norvegicus
attgaagagcccaaatccggcggcc

SEQ ID NO: 209366 - DNA, 25 bp, Rattus norvegicus
attgaagagccctaatccggcggcc

SEQ ID NO: 209367 - DNA, 25 bp, Rattus norvegicus
attgaagcacttctcctaggaattt

SEQ ID NO: 209368 - DNA, 25 bp, Rattus norvegicus
attgaagcacttgtcctaggaattt

SEQ ID NO: 209369 - DNA, 25 bp, Rattus norvegicus
attgaagccacccatgaccgaaata

SEQ ID NO: 209370 - DNA, 25 bp, Rattus norvegicus
attgaagccaccgatgaccgaaata

SEQ ID NO: 209371 - DNA, 25 bp, Rattus norvegicus
attgaagcccatacaccgatggata

SEQ ID NO: 209372 - DNA, 25 bp, Rattus norvegicus
attgaagcccattcaccgatggata

SEQ ID NO: 209373 - DNA, 25 bp, Rattus norvegicus
attgaagcccttctggagtcaagcc

SEQ ID NO: 209374 - DNA, 25 bp, Rattus norvegicus
attgaagcccttgtggagtcaagcc

SEQ ID NO: 209375 - DNA, 25 bp, Rattus norvegicus
attgaagccgaaatacagcccctac

SEQ ID NO: 209376 - DNA, 25 bp, Rattus norvegicus
attgaagccgaattacagcccctac

SEQ ID NO: 209377 - DNA, 25 bp, Rattus norvegicus
attgaagcctgcattaaaccctctc

SEQ ID NO: 209378 - DNA, 25 bp, Rattus norvegicus
attgaagcctgctttaaaccctctc

SEQ ID NO: 209379 - DNA, 25 bp, Rattus norvegicus
attgaagctagcatgcattctcccc

SEQ ID NO: 209380 - DNA, 25 bp, Rattus norvegicus
attgaagctagcttgcattctcccc

SEQ ID NO: 209381 - DNA, 25 bp, Rattus norvegicus
attgaagctgctagcccgtaggtgg

SEQ ID NO: 209382 - DNA, 25 bp, Rattus norvegicus
attgaagctgcttgcccgtaggtgg

SEQ ID NO: 209383 - DNA, 25 bp, Rattus norvegicus
attgaaggccttacctctctgagta

SEQ ID NO: 209384 - DNA, 25 bp, Rattus norvegicus
attgaaggcctttcctctctgagta

SEQ ID NO: 209385 - DNA, 25 bp, Rattus norvegicus
attgaaggcgcgactcttactctgc

SEQ ID NO: 209386 - DNA, 25 bp, Rattus norvegicus
attgaaggcgcgtctcttactctgc

SEQ ID NO: 209387 - DNA, 25 bp, Rattus norvegicus
attgaaggtacaccactgggtggct

SEQ ID NO: 209388 - DNA, 25 bp, Rattus norvegicus
attgaaggtacagcactgggtggct

SEQ ID NO: 209389 - DNA, 25 bp, Rattus norvegicus
attgaaggtgagacgctggcatgaa

SEQ ID NO: 209390 - DNA, 25 bp, Rattus norvegicus
attgaaggtgagtcgctggcatgaa

SEQ ID NO: 209391 - DNA, 25 bp, Rattus norvegicus
attgaagtagctacgtgcctccaag

SEQ ID NO: 209392 - DNA, 25 bp, Rattus norvegicus
attgaagtagcttcgtgcctccaag

SEQ ID NO: 209393 - DNA, 25 bp, Rattus norvegicus
attgaagtccacatgatcccaggtc

SEQ ID NO: 209394 - DNA, 25 bp, Rattus norvegicus
attgaagtccacttgatcccaggtc

SEQ ID NO: 209395 - DNA, 25 bp, Rattus norvegicus
attgaagtccggaatgcgtgtgtgt

SEQ ID NO: 209396 - DNA, 25 bp, Rattus norvegicus
attgaagtccggtatgcgtgtgtgt

SEQ ID NO: 209397 - DNA, 25 bp, Rattus norvegicus
attgaagtggataagctgcccctgc

SEQ ID NO: 209398 - DNA, 25 bp, Rattus norvegicus
attgaagtggattagctgcccctgc

SEQ ID NO: 209399 - DNA, 25 bp, Rattus norvegicus
attgaagttatcactcagcccatga

SEQ ID NO: 209400 - DNA, 25 bp, Rattus norvegicus
attgaagttatctctcagcccatga

SEQ ID NO: 209401 - DNA, 25 bp, Rattus norvegicus
attgaagttgatattgctcacggtt

SEQ ID NO: 209402 - DNA, 25 bp, Rattus norvegicus
attgaagttgattttgctcacggtt

SEQ ID NO: 209403 - DNA, 25 bp, Rattus norvegicus
attgaagttggaagccctcacccag

SEQ ID NO: 209404 - DNA, 25 bp, Rattus norvegicus
attgaagttggatgccctcacccag

SEQ ID NO: 209405 - DNA, 25 bp, Rattus norvegicus
attgaagttttcaccaccgtgatcc

SEQ ID NO: 209406 - DNA, 25 bp, Rattus norvegicus
attgaagttttctccaccgtgatcc

SEQ ID NO: 209407 - DNA, 25 bp, Rattus norvegicus
attgaatacctccaacccaatccag

SEQ ID NO: 209408 - DNA, 25 bp, Rattus norvegicus
attgaatacctcgaacccaatccag

SEQ ID NO: 209409 - DNA, 25 bp, Rattus norvegicus
attgaatatcatccactagtccctt

SEQ ID NO: 209410 - DNA, 25 bp, Rattus norvegicus
attgaatatcatgcactagtccctt

SEQ ID NO: 209411 - DNA, 25 bp, Rattus norvegicus
attgaatatgctcctctgtctccag

SEQ ID NO: 209412 - DNA, 25 bp, Rattus norvegicus
attgaatatgctgctctgtctccag

SEQ ID NO: 209413 - DNA, 25 bp, Rattus norvegicus
attgaatattatatcccctcccagg

SEQ ID NO: 209414 - DNA, 25 bp, Rattus norvegicus
attgaatattatttcccctcccagg

SEQ ID NO: 209415 - DNA, 25 bp, Rattus norvegicus
attgaatcccacattataaagcagg

SEQ ID NO: 209416 - DNA, 25 bp, Rattus norvegicus
attgaatcccactttataaagcagg

SEQ ID NO: 209417 - DNA, 25 bp, Rattus norvegicus
attgaatcctaaactctagctgccg

SEQ ID NO: 209418 - DNA, 25 bp, Rattus norvegicus
attgaatcctaatctctagctgccg

SEQ ID NO: 209419 - DNA, 25 bp, Rattus norvegicus
attgaatctcaacacatccaccttc

SEQ ID NO: 209420 - DNA, 25 bp, Rattus norvegicus
attgaatctcaagacatccaccttc

SEQ ID NO: 209421 - DNA, 25 bp, Rattus norvegicus
attgaatctgaactcaccaccatcc

SEQ ID NO: 209422 - DNA, 25 bp, Rattus norvegicus
attgaatctgaagtcaccaccatcc

SEQ ID NO: 209423 - DNA, 25 bp, Rattus norvegicus
attgaatctgacaatgtgtgtgagt

SEQ ID NO: 209424 - DNA, 25 bp, Rattus norvegicus
attgaatctgactatgtgtgtgagt

SEQ ID NO: 209425 - DNA, 25 bp, Rattus norvegicus
attgaatgatctattccccatccct

SEQ ID NO: 209426 - DNA, 25 bp, Rattus norvegicus
attgaatgatcttttccccatccct

SEQ ID NO: 209427 - DNA, 25 bp, Rattus norvegicus
attgaatgcatcacccaaggccgtg

SEQ ID NO: 209428 - DNA, 25 bp, Rattus norvegicus
attgaatgcatctcccaaggccgtg

SEQ ID NO: 209429 - DNA, 25 bp, Rattus norvegicus
attgaatggcctctgtaaccaaaag

SEQ ID NO: 209430 - DNA, 25 bp, Rattus norvegicus
attgaatggcctgtgtaaccaaaag

SEQ ID NO: 209431 - DNA, 25 bp, Rattus norvegicus
attgaattaagaatgggatccacaa

SEQ ID NO: 209432 - DNA, 25 bp, Rattus norvegicus
attgaattaagattgggatccacaa

SEQ ID NO: 209433 - DNA, 25 bp, Rattus norvegicus
attgaattccacaccttgcttttat

SEQ ID NO: 209434 - DNA, 25 bp, Rattus norvegicus
attgaattccactccttgcttttat

SEQ ID NO: 209435 - DNA, 25 bp, Rattus norvegicus
attgaattcgggacgtctggtttga

SEQ ID NO: 209436 - DNA, 25 bp, Rattus norvegicus
attgaattcgggtcgtctggtttga

SEQ ID NO: 209437 - DNA, 25 bp, Rattus norvegicus
attgaatttcttagatggcccaagc

SEQ ID NO: 209438 - DNA, 25 bp, Rattus norvegicus
attgaatttctttgatggcccaagc

SEQ ID NO: 209439 - DNA, 25 bp, Rattus norvegicus
attgaattttccctctgcataagcc

SEQ ID NO: 209440 - DNA, 25 bp, Rattus norvegicus
attgaattttccgtctgcataagcc

SEQ ID NO: 209441 - DNA, 25 bp, Rattus norvegicus
attgaattttgtagcgaatgaacgc

SEQ ID NO: 209442 - DNA, 25 bp, Rattus norvegicus
attgaattttgttgcgaatgaacgc

SEQ ID NO: 209443 - DNA, 25 bp, Rattus norvegicus
attgacaaacttatcctggacacct

SEQ ID NO: 209444 - DNA, 25 bp, Rattus norvegicus
attgacaaacttttcctggacacct

SEQ ID NO: 209445 - DNA, 25 bp, Rattus norvegicus
attgacaaccaactagtgagcacca

SEQ ID NO: 209446 - DNA, 25 bp, Rattus norvegicus
attgacaaccaagtagtgagcacca

SEQ ID NO: 209447 - DNA, 25 bp, Rattus norvegicus
attgacaactcaactttgcttctgt

SEQ ID NO: 209448 - DNA, 25 bp, Rattus norvegicus
attgacaactcatctttgcttctgt

SEQ ID NO: 209449 - DNA, 25 bp, Rattus norvegicus
attgacaagcacagttacaccgtga

SEQ ID NO: 209450 - DNA, 25 bp, Rattus norvegicus
attgacaagcactgttacaccgtga

SEQ ID NO: 209451 - DNA, 25 bp, Rattus norvegicus
attgacaccttcctcatggagatgt

SEQ ID NO: 209452 - DNA, 25 bp, Rattus norvegicus
attgacaccttcgtcatggagatgt

SEQ ID NO: 209453 - DNA, 25 bp, Rattus norvegicus
attgacacgatcatgggttcactcc

SEQ ID NO: 209454 - DNA, 25 bp, Rattus norvegicus
attgacacgatcttgggttcactcc

SEQ ID NO: 209455 - DNA, 25 bp, Rattus norvegicus
attgacactctgcttaactttccat

SEQ ID NO: 209456 - DNA, 25 bp, Rattus norvegicus
attgacactctggttaactttccat

SEQ ID NO: 209457 - DNA, 25 bp, Rattus norvegicus
attgacagagaacgctgggcccacc

SEQ ID NO: 209458 - DNA, 25 bp, Rattus norvegicus
attgacagagaaggctgggcccacc

SEQ ID NO: 209459 - DNA, 25 bp, Rattus norvegicus
attgacataccactaggcctggtga

SEQ ID NO: 209460 - DNA, 25 bp, Rattus norvegicus
attgacataccagtaggcctggtga

SEQ ID NO: 209461 - DNA, 25 bp, Rattus norvegicus
attgacatatttctgctggagccta

SEQ ID NO: 209462 - DNA, 25 bp, Rattus norvegicus
attgacatatttgtgctggagccta

SEQ ID NO: 209463 - DNA, 25 bp, Rattus norvegicus
attgacatcatcatcactgtactcg

SEQ ID NO: 209464 - DNA, 25 bp, Rattus norvegicus
attgacatcatcttcactgtactcg

SEQ ID NO: 209465 - DNA, 25 bp, Rattus norvegicus
attgacatccagaagaccatccaga

SEQ ID NO: 209466 - DNA, 25 bp, Rattus norvegicus
attgacatccagtagaccatccaga

SEQ ID NO: 209467 - DNA, 25 bp, Rattus norvegicus
attgacatcgtcatgtttaagcata

SEQ ID NO: 209468 - DNA, 25 bp, Rattus norvegicus
attgacatcgtcttgtttaagcata

SEQ ID NO: 209469 - DNA, 25 bp, Rattus norvegicus
attgacatcttcagggtctgcactg

SEQ ID NO: 209470 - DNA, 25 bp, Rattus norvegicus
attgacatcttctgggtctgcactg

SEQ ID NO: 209471 - DNA, 25 bp, Rattus norvegicus
attgacatgatcagtgccatcctgg

SEQ ID NO: 209472 - DNA, 25 bp, Rattus norvegicus
attgacatgatctgtgccatcctgg

SEQ ID NO: 209473 - DNA, 25 bp, Rattus norvegicus
attgacatgctcactaaaccactgt

SEQ ID NO: 209474 - DNA, 25 bp, Rattus norvegicus
attgacatgctctctaaaccactgt

SEQ ID NO: 209475 - DNA, 25 bp, Rattus norvegicus
attgacatggctcacctgaatatct

SEQ ID NO: 209476 - DNA, 25 bp, Rattus norvegicus
attgacatggctgacctgaatatct

SEQ ID NO: 209477 - DNA, 25 bp, Rattus norvegicus
attgacattgacatgggttctccag

SEQ ID NO: 209478 - DNA, 25 bp, Rattus norvegicus
attgacattgacttgggttctccag

SEQ ID NO: 209479 - DNA, 25 bp, Rattus norvegicus
attgacatttgtctctggcttccat

SEQ ID NO: 209480 - DNA, 25 bp, Rattus norvegicus
attgacatttgtgtctggcttccat

SEQ ID NO: 209481 - DNA, 25 bp, Rattus norvegicus
attgacatttttaatctcactgaat

SEQ ID NO: 209482 - DNA, 25 bp, Rattus norvegicus
attgacattttttatctcactgaat

SEQ ID NO: 209483 - DNA, 25 bp, Rattus norvegicus
attgaccaatggaggctcgctccaa

SEQ ID NO: 209484 - DNA, 25 bp, Rattus norvegicus
attgaccaatggtggctcgctccaa

SEQ ID NO: 209485 - DNA, 25 bp, Rattus norvegicus
attgaccagaaaaccctattcagta

SEQ ID NO: 209486 - DNA, 25 bp, Rattus norvegicus
attgaccagaaatccctattcagta

SEQ ID NO: 209487 - DNA, 25 bp, Rattus norvegicus
attgaccagacacccacctatgaag

SEQ ID NO: 209488 - DNA, 25 bp, Rattus norvegicus
attgaccagacagccacctatgaag

SEQ ID NO: 209489 - DNA, 25 bp, Rattus norvegicus
attgaccatcagcttactggactct

SEQ ID NO: 209490 - DNA, 25 bp, Rattus norvegicus
attgaccatcaggttactggactct

SEQ ID NO: 209491 - DNA, 25 bp, Rattus norvegicus
attgaccatgctcagcgagagctcc

SEQ ID NO: 209492 - DNA, 25 bp, Rattus norvegicus
attgaccatgctgagcgagagctcc

SEQ ID NO: 209493 - DNA, 25 bp, Rattus norvegicus
attgaccccatccatcaaggagttg

SEQ ID NO: 209494 - DNA, 25 bp, Rattus norvegicus
attgaccccatcgatcaaggagttg

SEQ ID NO: 209495 - DNA, 25 bp, Rattus norvegicus
attgaccgaatcatcctctggatgt

SEQ ID NO: 209496 - DNA, 25 bp, Rattus norvegicus
attgaccgaatcttcctctggatgt

SEQ ID NO: 209497 - DNA, 25 bp, Rattus norvegicus
attgaccgttacacagaggctttgc

SEQ ID NO: 209498 - DNA, 25 bp, Rattus norvegicus
attgaccgttactcagaggctttgc

SEQ ID NO: 209499 - DNA, 25 bp, Rattus norvegicus
attgacctagataagcccttggccg

SEQ ID NO: 209500 - DNA, 25 bp, Rattus norvegicus
attgacctagattagcccttggccg

SEQ ID NO: 209501 - DNA, 25 bp, Rattus norvegicus
attgacctccttatcagtatcttga

SEQ ID NO: 209502 - DNA, 25 bp, Rattus norvegicus
attgacctccttttcagtatcttga

SEQ ID NO: 209503 - DNA, 25 bp, Rattus norvegicus
attgacctcggaaggccacgtagta

SEQ ID NO: 209504 - DNA, 25 bp, Rattus norvegicus
attgacctcggatggccacgtagta

SEQ ID NO: 209505 - DNA, 25 bp, Rattus norvegicus
attgacctctgcagttgccaggatg

SEQ ID NO: 209506 - DNA, 25 bp, Rattus norvegicus
attgacctctgctgttgccaggatg

SEQ ID NO: 209507 - DNA, 25 bp, Rattus norvegicus
attgacctcttcatggacttcgtta

SEQ ID NO: 209508 - DNA, 25 bp, Rattus norvegicus
attgacctcttcttggacttcgtta

SEQ ID NO: 209509 - DNA, 25 bp, Rattus norvegicus
attgacctgagcacggtggacctga

SEQ ID NO: 209510 - DNA, 25 bp, Rattus norvegicus
attgacctgagctcggtggacctga

SEQ ID NO: 209511 - DNA, 25 bp, Rattus norvegicus
attgacctgaggaacgctcgtttga

SEQ ID NO: 209512 - DNA, 25 bp, Rattus norvegicus
attgacctgaggtacgctcgtttga

SEQ ID NO: 209513 - DNA, 25 bp, Rattus norvegicus
attgacctgatcattttagctgaga

SEQ ID NO: 209514 - DNA, 25 bp, Rattus norvegicus
attgacctgatctttttagctgaga

SEQ ID NO: 209515 - DNA, 25 bp, Rattus norvegicus
attgaccttgagaatgtgccccgaa

SEQ ID NO: 209516 - DNA, 25 bp, Rattus norvegicus
attgaccttgagtatgtgccccgaa

SEQ ID NO: 209517 - DNA, 25 bp, Rattus norvegicus
attgaccttgatcacttctctgtga

SEQ ID NO: 209518 - DNA, 25 bp, Rattus norvegicus
attgaccttgatgacttctctgtga

SEQ ID NO: 209519 - DNA, 25 bp, Rattus norvegicus
attgacgagtgactgccgaggccct

SEQ ID NO: 209520 - DNA, 25 bp, Rattus norvegicus
attgacgagtgagtgccgaggccct

SEQ ID NO: 209521 - DNA, 25 bp, Rattus norvegicus
attgacgcgtccacaactgcttttt

SEQ ID NO: 209522 - DNA, 25 bp, Rattus norvegicus
attgacgcgtcctcaactgcttttt

SEQ ID NO: 209523 - DNA, 25 bp, Rattus norvegicus
attgacgctgctctggctccgtgga

SEQ ID NO: 209524 - DNA, 25 bp, Rattus norvegicus
attgacgctgctgtggctccgtgga

SEQ ID NO: 209525 - DNA, 25 bp, Rattus norvegicus
attgacggcattctgtcctccaagt

SEQ ID NO: 209526 - DNA, 25 bp, Rattus norvegicus
attgacggcattgtgtcctccaagt

SEQ ID NO: 209527 - DNA, 25 bp, Rattus norvegicus
attgacggctgccagctactgtgct

SEQ ID NO: 209528 - DNA, 25 bp, Rattus norvegicus
attgacggctgcgagctactgtgct

SEQ ID NO: 209529 - DNA, 25 bp, Rattus norvegicus
attgacgggagtccctgggaaccat

SEQ ID NO: 209530 - DNA, 25 bp, Rattus norvegicus
attgacgggagtgcctgggaaccat

SEQ ID NO: 209531 - DNA, 25 bp, Rattus norvegicus
attgacgtcacgagctgcagcagta

SEQ ID NO: 209532 - DNA, 25 bp, Rattus norvegicus
attgacgtcacgtgctgcagcagta

SEQ ID NO: 209533 - DNA, 25 bp, Rattus norvegicus
attgactacctgaggaaatgtgacc

SEQ ID NO: 209534 - DNA, 25 bp, Rattus norvegicus
attgactacctgtggaaatgtgacc

SEQ ID NO: 209535 - DNA, 25 bp, Rattus norvegicus
attgactaggatatttctccccacc

SEQ ID NO: 209536 - DNA, 25 bp, Rattus norvegicus
attgactaggatttttctccccacc

SEQ ID NO: 209537 - DNA, 25 bp, Rattus norvegicus
attgactccaaaatcatcagcctct

SEQ ID NO: 209538 - DNA, 25 bp, Rattus norvegicus
attgactccaaattcatcagcctct

SEQ ID NO: 209539 - DNA, 25 bp, Rattus norvegicus
attgactccaagagtctgcacttca

SEQ ID NO: 209540 - DNA, 25 bp, Rattus norvegicus
attgactccaagtgtctgcacttca

SEQ ID NO: 209541 - DNA, 25 bp, Rattus norvegicus
attgactccagtaagctacacttcc

SEQ ID NO: 209542 - DNA, 25 bp, Rattus norvegicus
attgactccagttagctacacttcc

SEQ ID NO: 209543 - DNA, 25 bp, Rattus norvegicus
attgactgagcacctccttactggg

SEQ ID NO: 209544 - DNA, 25 bp, Rattus norvegicus
attgactgagcagctccttactggg

SEQ ID NO: 209545 - DNA, 25 bp, Rattus norvegicus
attgactgctcccaggcctggtgga

SEQ ID NO: 209546 - DNA, 25 bp, Rattus norvegicus
attgactgctccgaggcctggtgga

SEQ ID NO: 209547 - DNA, 25 bp, Rattus norvegicus
attgactggaatcattcccacccac

SEQ ID NO: 209548 - DNA, 25 bp, Rattus norvegicus
attgactggaatgattcccacccac

SEQ ID NO: 209549 - DNA, 25 bp, Rattus norvegicus
attgactgggctcaacactccaatt

SEQ ID NO: 209550 - DNA, 25 bp, Rattus norvegicus
attgactgggctgaacactccaatt

SEQ ID NO: 209551 - DNA, 25 bp, Rattus norvegicus
attgactggtgcaaattgaattgcc

SEQ ID NO: 209552 - DNA, 25 bp, Rattus norvegicus
attgactggtgctaattgaattgcc

SEQ ID NO: 209553 - DNA, 25 bp, Rattus norvegicus
attgactgtgagaaggacatcatac

SEQ ID NO: 209554 - DNA, 25 bp, Rattus norvegicus
attgactgtgagtaggacatcatac

SEQ ID NO: 209555 - DNA, 25 bp, Rattus norvegicus
attgactgtgcacgatgtcaatctg

SEQ ID NO: 209556 - DNA, 25 bp, Rattus norvegicus
attgactgtgcaggatgtcaatctg

SEQ ID NO: 209557 - DNA, 25 bp, Rattus norvegicus
attgacttatgaatattttactagc

SEQ ID NO: 209558 - DNA, 25 bp, Rattus norvegicus
attgacttatgattattttactagc

SEQ ID NO: 209559 - DNA, 25 bp, Rattus norvegicus
attgacttatgccttgtagcctttc

SEQ ID NO: 209560 - DNA, 25 bp, Rattus norvegicus
attgacttatgcgttgtagcctttc

SEQ ID NO: 209561 - DNA, 25 bp, Rattus norvegicus
attgacttccctcctgggtgtgaac

SEQ ID NO: 209562 - DNA, 25 bp, Rattus norvegicus
attgacttccctgctgggtgtgaac

SEQ ID NO: 209563 - DNA, 25 bp, Rattus norvegicus
attgacttcttacgccttgttgttc

SEQ ID NO: 209564 - DNA, 25 bp, Rattus norvegicus
attgacttcttaggccttgttgttc

SEQ ID NO: 209565 - DNA, 25 bp, Rattus norvegicus
attgacttcttcacgggcctctttt

SEQ ID NO: 209566 - DNA, 25 bp, Rattus norvegicus
attgacttcttctcgggcctctttt

SEQ ID NO: 209567 - DNA, 25 bp, Rattus norvegicus
attgactttaagctgatcctgagaa

SEQ ID NO: 209568 - DNA, 25 bp, Rattus norvegicus
attgactttaaggtgatcctgagaa

SEQ ID NO: 209569 - DNA, 25 bp, Rattus norvegicus
attgactttatgatgtgtgattcca

SEQ ID NO: 209570 - DNA, 25 bp, Rattus norvegicus
attgactttatgttgtgtgattcca

SEQ ID NO: 209571 - DNA, 25 bp, Rattus norvegicus
attgactttgccctgatattgacca

SEQ ID NO: 209572 - DNA, 25 bp, Rattus norvegicus
attgactttgccgtgatattgacca

SEQ ID NO: 209573 - DNA, 25 bp, Rattus norvegicus
attgactttgttcctgtattatgta

SEQ ID NO: 209574 - DNA, 25 bp, Rattus norvegicus
attgactttgttgctgtattatgta

SEQ ID NO: 209575 - DNA, 25 bp, Rattus norvegicus
attgagaaacccatttgttgccatg

SEQ ID NO: 209576 - DNA, 25 bp, Rattus norvegicus
attgagaaacccttttgttgccatg

SEQ ID NO: 209577 - DNA, 25 bp, Rattus norvegicus
attgagaacacgcagtaccccttgt

SEQ ID NO: 209578 - DNA, 25 bp, Rattus norvegicus
attgagaacacggagtaccccttgt

SEQ ID NO: 209579 - DNA, 25 bp, Rattus norvegicus
attgagaacttgcagtcatcatgaa

SEQ ID NO: 209580 - DNA, 25 bp, Rattus norvegicus
attgagaacttggagtcatcatgaa

SEQ ID NO: 209581 - DNA, 25 bp, Rattus norvegicus
attgagaagtcccacagtagtcctg

SEQ ID NO: 209582 - DNA, 25 bp, Rattus norvegicus
attgagaagtccgacagtagtcctg

SEQ ID NO: 209583 - DNA, 25 bp, Rattus norvegicus
attgagaatctgcacccttactgtc

SEQ ID NO: 209584 - DNA, 25 bp, Rattus norvegicus
attgagaatctggacccttactgtc

SEQ ID NO: 209585 - DNA, 25 bp, Rattus norvegicus
attgagacagatctcacgctgtgtg

SEQ ID NO: 209586 - DNA, 25 bp, Rattus norvegicus
attgagacagatgtcacgctgtgtg

SEQ ID NO: 209587 - DNA, 25 bp, Rattus norvegicus
attgagacagtgaccctattccttc

SEQ ID NO: 209588 - DNA, 25 bp, Rattus norvegicus
attgagacagtgtccctattccttc

SEQ ID NO: 209589 - DNA, 25 bp, Rattus norvegicus
attgagacctcacccttggattcca

SEQ ID NO: 209590 - DNA, 25 bp, Rattus norvegicus
attgagacctcagccttggattcca

SEQ ID NO: 209591 - DNA, 25 bp, Rattus norvegicus
attgagacctgcaatgatggctgtt

SEQ ID NO: 209592 - DNA, 25 bp, Rattus norvegicus
attgagacctgctatgatggctgtt

SEQ ID NO: 209593 - DNA, 25 bp, Rattus norvegicus
attgagactgttactcctgaggcct

SEQ ID NO: 209594 - DNA, 25 bp, Rattus norvegicus
attgagactgtttctcctgaggcct

SEQ ID NO: 209595 - DNA, 25 bp, Rattus norvegicus
attgagagatgcatgggcctgttgt

SEQ ID NO: 209596 - DNA, 25 bp, Rattus norvegicus
attgagagatgcttgggcctgttgt

SEQ ID NO: 209597 - DNA, 25 bp, Rattus norvegicus
attgagagtataaacctgcaaagct

SEQ ID NO: 209598 - DNA, 25 bp, Rattus norvegicus
attgagagtatatacctgcaaagct

SEQ ID NO: 209599 - DNA, 25 bp, Rattus norvegicus
attgagatctctcctcctagattgc

SEQ ID NO: 209600 - DNA, 25 bp, Rattus norvegicus
attgagatctctgctcctagattgc

SEQ ID NO: 209601 - DNA, 25 bp, Rattus norvegicus
attgagatgcccaaacactgatgga

SEQ ID NO: 209602 - DNA, 25 bp, Rattus norvegicus
attgagatgccctaacactgatgga

SEQ ID NO: 209603 - DNA, 25 bp, Rattus norvegicus
attgagatgctcctggacctgatca

SEQ ID NO: 209604 - DNA, 25 bp, Rattus norvegicus
attgagatgctcgtggacctgatca

SEQ ID NO: 209605 - DNA, 25 bp, Rattus norvegicus
attgagatgtctacaggctgtgcaa

SEQ ID NO: 209606 - DNA, 25 bp, Rattus norvegicus
attgagatgtcttcaggctgtgcaa

SEQ ID NO: 209607 - DNA, 25 bp, Rattus norvegicus
attgagcaagcgatgttagagataa

SEQ ID NO: 209608 - DNA, 25 bp, Rattus norvegicus
attgagcaagcgttgttagagataa

SEQ ID NO: 209609 - DNA, 25 bp, Rattus norvegicus
attgagcacatcagaatttctatct

SEQ ID NO: 209610 - DNA, 25 bp, Rattus norvegicus
attgagcacatctgaatttctatct

SEQ ID NO: 209611 - DNA, 25 bp, Rattus norvegicus
attgagcagtgccaggatagcccca

SEQ ID NO: 209612 - DNA, 25 bp, Rattus norvegicus
attgagcagtgcgaggatagcccca

SEQ ID NO: 209613 - DNA, 25 bp, Rattus norvegicus
attgagcatgtacacagcttcgcgc

SEQ ID NO: 209614 - DNA, 25 bp, Rattus norvegicus
attgagcatgtagacagcttcgcgc

SEQ ID NO: 209615 - DNA, 25 bp, Rattus norvegicus
attgagccacctagaacagtctgat

SEQ ID NO: 209616 - DNA, 25 bp, Rattus norvegicus
attgagccaccttgaacagtctgat

SEQ ID NO: 209617 - DNA, 25 bp, Rattus norvegicus
attgagccacgtcaggacctgggcc

SEQ ID NO: 209618 - DNA, 25 bp, Rattus norvegicus
attgagccacgtgaggacctgggcc

SEQ ID NO: 209619 - DNA, 25 bp, Rattus norvegicus
attgagcccaggcattactgctcct

SEQ ID NO: 209620 - DNA, 25 bp, Rattus norvegicus
attgagcccagggattactgctcct

SEQ ID NO: 209621 - DNA, 25 bp, Rattus norvegicus
attgagcccctaaacagagactatg

SEQ ID NO: 209622 - DNA, 25 bp, Rattus norvegicus
attgagcccctatacagagactatg

SEQ ID NO: 209623 - DNA, 25 bp, Rattus norvegicus
attgagccgaggacttggtagctgt

SEQ ID NO: 209624 - DNA, 25 bp, Rattus norvegicus
attgagccgaggtcttggtagctgt

SEQ ID NO: 209625 - DNA, 25 bp, Rattus norvegicus
attgagcctcagagttttctgtgta

SEQ ID NO: 209626 - DNA, 25 bp, Rattus norvegicus
attgagcctcagtgttttctgtgta

SEQ ID NO: 209627 - DNA, 25 bp, Rattus norvegicus
attgagcgcattaaactccgccgtg

SEQ ID NO: 209628 - DNA, 25 bp, Rattus norvegicus
attgagcgcatttaactccgccgtg

SEQ ID NO: 209629 - DNA, 25 bp, Rattus norvegicus
attgagcgcctcacaaagacagctg

SEQ ID NO: 209630 - DNA, 25 bp, Rattus norvegicus
attgagcgcctctcaaagacagctg

SEQ ID NO: 209631 - DNA, 25 bp, Rattus norvegicus
attgagctaaccctgttcacattgg

SEQ ID NO: 209632 - DNA, 25 bp, Rattus norvegicus
attgagctaaccgtgttcacattgg

SEQ ID NO: 209633 - DNA, 25 bp, Rattus norvegicus
attgagctatttacacttactgtgt

SEQ ID NO: 209634 - DNA, 25 bp, Rattus norvegicus
attgagctattttcacttactgtgt

SEQ ID NO: 209635 - DNA, 25 bp, Rattus norvegicus
attgagctcactcggacattcgtca

SEQ ID NO: 209636 - DNA, 25 bp, Rattus norvegicus
attgagctcactgggacattcgtca

SEQ ID NO: 209637 - DNA, 25 bp, Rattus norvegicus
attgagctccatagtacctctcaac

SEQ ID NO: 209638 - DNA, 25 bp, Rattus norvegicus
attgagctccattgtacctctcaac

SEQ ID NO: 209639 - DNA, 25 bp, Rattus norvegicus
attgagctcccgctttgcagtaagg

SEQ ID NO: 209640 - DNA, 25 bp, Rattus norvegicus
attgagctcccggtttgcagtaagg

SEQ ID NO: 209641 - DNA, 25 bp, Rattus norvegicus
attgagctctagaacagtcaggact

SEQ ID NO: 209642 - DNA, 25 bp, Rattus norvegicus
attgagctctagtacagtcaggact

SEQ ID NO: 209643 - DNA, 25 bp, Rattus norvegicus
attgagctgaatctcttcgtcgatt

SEQ ID NO: 209644 - DNA, 25 bp, Rattus norvegicus
attgagctgaatgtcttcgtcgatt

SEQ ID NO: 209645 - DNA, 25 bp, Rattus norvegicus
attgagctgcagagacagcggccca

SEQ ID NO: 209646 - DNA, 25 bp, Rattus norvegicus
attgagctgcagtgacagcggccca

SEQ ID NO: 209647 - DNA, 25 bp, Rattus norvegicus
attgagctgctcaaggccgagtatg

SEQ ID NO: 209648 - DNA, 25 bp, Rattus norvegicus
attgagctgctctaggccgagtatg

SEQ ID NO: 209649 - DNA, 25 bp, Rattus norvegicus
attgagctgtaaacctttttaaggc

SEQ ID NO: 209650 - DNA, 25 bp, Rattus norvegicus
attgagctgtaatcctttttaaggc

SEQ ID NO: 209651 - DNA, 25 bp, Rattus norvegicus
attgagcttcatccaaactctgctt

SEQ ID NO: 209652 - DNA, 25 bp, Rattus norvegicus
attgagcttcatgcaaactctgctt

SEQ ID NO: 209653 - DNA, 25 bp, Rattus norvegicus
attgagcttgtccacatcgaggttc

SEQ ID NO: 209654 - DNA, 25 bp, Rattus norvegicus
attgagcttgtcgacatcgaggttc

SEQ ID NO: 209655 - DNA, 25 bp, Rattus norvegicus
attgagctttctattgctgcctata

SEQ ID NO: 209656 - DNA, 25 bp, Rattus norvegicus
attgagctttcttttgctgcctata

SEQ ID NO: 209657 - DNA, 25 bp, Rattus norvegicus
attgaggaagacatcgagcagcatc

SEQ ID NO: 209658 - DNA, 25 bp, Rattus norvegicus
attgaggaagacttcgagcagcatc

SEQ ID NO: 209659 - DNA, 25 bp, Rattus norvegicus
attgaggacactatgcgctgtgctc

SEQ ID NO: 209660 - DNA, 25 bp, Rattus norvegicus
attgaggacactttgcgctgtgctc

SEQ ID NO: 209661 - DNA, 25 bp, Rattus norvegicus
attgaggaggagacttctgccccag

SEQ ID NO: 209662 - DNA, 25 bp, Rattus norvegicus
attgaggaggagtcttctgccccag

SEQ ID NO: 209663 - DNA, 25 bp, Rattus norvegicus
attgaggagtccacagccctggagt

SEQ ID NO: 209664 - DNA, 25 bp, Rattus norvegicus
attgaggagtcctcagccctggagt

SEQ ID NO: 209665 - DNA, 25 bp, Rattus norvegicus
attgaggatgctaccactggtcagc

SEQ ID NO: 209666 - DNA, 25 bp, Rattus norvegicus
attgaggatgcttccactggtcagc

SEQ ID NO: 209667 - DNA, 25 bp, Rattus norvegicus
attgaggcaagcctggcctacatga

SEQ ID NO: 209668 - DNA, 25 bp, Rattus norvegicus
attgaggcaagcgtggcctacatga

SEQ ID NO: 209669 - DNA, 25 bp, Rattus norvegicus
attgaggcacgcaggcacgacgaga

SEQ ID NO: 209670 - DNA, 25 bp, Rattus norvegicus
attgaggcacgctggcacgacgaga

SEQ ID NO: 209671 - DNA, 25 bp, Rattus norvegicus
attgaggccagcatgtgccggataa

SEQ ID NO: 209672 - DNA, 25 bp, Rattus norvegicus
attgaggccagcttgtgccggataa

SEQ ID NO: 209673 - DNA, 25 bp, Rattus norvegicus
attgaggctgaacttcctgctgtaa

SEQ ID NO: 209674 - DNA, 25 bp, Rattus norvegicus
attgaggctgaagttcctgctgtaa

SEQ ID NO: 209675 - DNA, 25 bp, Rattus norvegicus
attgagggataaccctctgctcttc

SEQ ID NO: 209676 - DNA, 25 bp, Rattus norvegicus
attgagggataagcctctgctcttc

SEQ ID NO: 209677 - DNA, 25 bp, Rattus norvegicus
attgaggtatggatccctgtggtct

SEQ ID NO: 209678 - DNA, 25 bp, Rattus norvegicus
attgaggtatggttccctgtggtct

SEQ ID NO: 209679 - DNA, 25 bp, Rattus norvegicus
attgaggtccatccaaagccccaac

SEQ ID NO: 209680 - DNA, 25 bp, Rattus norvegicus
attgaggtccatgcaaagccccaac

SEQ ID NO: 209681 - DNA, 25 bp, Rattus norvegicus
attgaggttcaaaaggctggccgct

SEQ ID NO: 209682 - DNA, 25 bp, Rattus norvegicus
attgaggttcaataggctggccgct

SEQ ID NO: 209683 - DNA, 25 bp, Rattus norvegicus
attgagtaccttattgctagcctga

SEQ ID NO: 209684 - DNA, 25 bp, Rattus norvegicus
attgagtacctttttgctagcctga

SEQ ID NO: 209685 - DNA, 25 bp, Rattus norvegicus
attgagtatccgactgcaatgcaga

SEQ ID NO: 209686 - DNA, 25 bp, Rattus norvegicus
attgagtatccgtctgcaatgcaga

SEQ ID NO: 209687 - DNA, 25 bp, Rattus norvegicus
attgagtccctactgtgtcaaccac

SEQ ID NO: 209688 - DNA, 25 bp, Rattus norvegicus
attgagtccctagtgtgtcaaccac

SEQ ID NO: 209689 - DNA, 25 bp, Rattus norvegicus
attgagtcctttcttttatccctgt

SEQ ID NO: 209690 - DNA, 25 bp, Rattus norvegicus
attgagtcctttgttttatccctgt

SEQ ID NO: 209691 - DNA, 25 bp, Rattus norvegicus
attgagtctcagacccaagtctgta

SEQ ID NO: 209692 - DNA, 25 bp, Rattus norvegicus
attgagtctcagtcccaagtctgta

SEQ ID NO: 209693 - DNA, 25 bp, Rattus norvegicus
attgagtctctcactggtctagaac

SEQ ID NO: 209694 - DNA, 25 bp, Rattus norvegicus
attgagtctctctctggtctagaac

SEQ ID NO: 209695 - DNA, 25 bp, Rattus norvegicus
attgagtctgcacatcaccagttgc

SEQ ID NO: 209696 - DNA, 25 bp, Rattus norvegicus
attgagtctgcagatcaccagttgc

SEQ ID NO: 209697 - DNA, 25 bp, Rattus norvegicus
attgagtgacttatcgctgtaccgt

SEQ ID NO: 209698 - DNA, 25 bp, Rattus norvegicus
attgagtgacttttcgctgtaccgt

SEQ ID NO: 209699 - DNA, 25 bp, Rattus norvegicus
attgagtgatcacggtcatcttaaa

SEQ ID NO: 209700 - DNA, 25 bp, Rattus norvegicus
attgagtgatcagggtcatcttaaa

SEQ ID NO: 209701 - DNA, 25 bp, Rattus norvegicus
attgagtgctcccacccttcgaagg

SEQ ID NO: 209702 - DNA, 25 bp, Rattus norvegicus
attgagtgctccgacccttcgaagg

SEQ ID NO: 209703 - DNA, 25 bp, Rattus norvegicus
attgagtgctgtcctctgctgtcac

SEQ ID NO: 209704 - DNA, 25 bp, Rattus norvegicus
attgagtgctgtgctctgctgtcac

SEQ ID NO: 209705 - DNA, 25 bp, Rattus norvegicus
attgagtgcttaccactaacattaa

SEQ ID NO: 209706 - DNA, 25 bp, Rattus norvegicus
attgagtgcttagcactaacattaa

SEQ ID NO: 209707 - DNA, 25 bp, Rattus norvegicus
attgagtgttcgctaggccaggctc

SEQ ID NO: 209708 - DNA, 25 bp, Rattus norvegicus
attgagtgttcggtaggccaggctc

SEQ ID NO: 209709 - DNA, 25 bp, Rattus norvegicus
attgagttatttaagcccagattgc

SEQ ID NO: 209710 - DNA, 25 bp, Rattus norvegicus
attgagttattttagcccagattgc

SEQ ID NO: 209711 - DNA, 25 bp, Rattus norvegicus
attgagttgcatacacctaagagat

SEQ ID NO: 209712 - DNA, 25 bp, Rattus norvegicus
attgagttgcattcacctaagagat

SEQ ID NO: 209713 - DNA, 25 bp, Rattus norvegicus
attgagtttaatccgatccgagtgc

SEQ ID NO: 209714 - DNA, 25 bp, Rattus norvegicus
attgagtttaatgcgatccgagtgc

SEQ ID NO: 209715 - DNA, 25 bp, Rattus norvegicus
attgagtttggaagctctgtaaaag

SEQ ID NO: 209716 - DNA, 25 bp, Rattus norvegicus
attgagtttggatgctctgtaaaag

SEQ ID NO: 209717 - DNA, 25 bp, Rattus norvegicus
attgataaataaactttctccccag

SEQ ID NO: 209718 - DNA, 25 bp, Rattus norvegicus
attgataaataatctttctccccag

SEQ ID NO: 209719 - DNA, 25 bp, Rattus norvegicus
attgataatcatacgccgcactggc

SEQ ID NO: 209720 - DNA, 25 bp, Rattus norvegicus
attgataatcattcgccgcactggc

SEQ ID NO: 209721 - DNA, 25 bp, Rattus norvegicus
attgatacacgcagccatgttaggc

SEQ ID NO: 209722 - DNA, 25 bp, Rattus norvegicus
attgatacacgctgccatgttaggc

SEQ ID NO: 209723 - DNA, 25 bp, Rattus norvegicus
attgatagcgcacacctacaaggtt

SEQ ID NO: 209724 - DNA, 25 bp, Rattus norvegicus
attgatagcgcagacctacaaggtt

SEQ ID NO: 209725 - DNA, 25 bp, Rattus norvegicus
attgatagtgttaagcccgaggctg

SEQ ID NO: 209726 - DNA, 25 bp, Rattus norvegicus
attgatagtgtttagcccgaggctg

SEQ ID NO: 209727 - DNA, 25 bp, Rattus norvegicus
attgatatagatctgggctcctcca

SEQ ID NO: 209728 - DNA, 25 bp, Rattus norvegicus
attgatatagatgtgggctcctcca

SEQ ID NO: 209729 - DNA, 25 bp, Rattus norvegicus
attgatatcaaacatgctcccagtt

SEQ ID NO: 209730 - DNA, 25 bp, Rattus norvegicus
attgatatcaaagatgctcccagtt

SEQ ID NO: 209731 - DNA, 25 bp, Rattus norvegicus
attgatattgccagtcggtcctgca

SEQ ID NO: 209732 - DNA, 25 bp, Rattus norvegicus
attgatattgcctgtcggtcctgca

SEQ ID NO: 209733 - DNA, 25 bp, Rattus norvegicus
attgatcacccgcacattaactgcc

SEQ ID NO: 209734 - DNA, 25 bp, Rattus norvegicus
attgatcacccggacattaactgcc

SEQ ID NO: 209735 - DNA, 25 bp, Rattus norvegicus
attgatcacctgcaaagtttcgaaa

SEQ ID NO: 209736 - DNA, 25 bp, Rattus norvegicus
attgatcacctggaaagtttcgaaa

SEQ ID NO: 209737 - DNA, 25 bp, Rattus norvegicus
attgatcactttattgcactccttc

SEQ ID NO: 209738 - DNA, 25 bp, Rattus norvegicus
attgatcacttttttgcactccttc

SEQ ID NO: 209739 - DNA, 25 bp, Rattus norvegicus
attgatcagatacacgaggccgggt

SEQ ID NO: 209740 - DNA, 25 bp, Rattus norvegicus
attgatcagatagacgaggccgggt

SEQ ID NO: 209741 - DNA, 25 bp, Rattus norvegicus
attgatcagatgaccagctcctgta

SEQ ID NO: 209742 - DNA, 25 bp, Rattus norvegicus
attgatcagatgtccagctcctgta

SEQ ID NO: 209743 - DNA, 25 bp, Rattus norvegicus
attgatcatacaagttaggccattt

SEQ ID NO: 209744 - DNA, 25 bp, Rattus norvegicus
attgatcatacatgttaggccattt

SEQ ID NO: 209745 - DNA, 25 bp, Rattus norvegicus
attgatcatctgaccagacgccaag

SEQ ID NO: 209746 - DNA, 25 bp, Rattus norvegicus
attgatcatctgtccagacgccaag

SEQ ID NO: 209747 - DNA, 25 bp, Rattus norvegicus
attgatcatgtaactgtccccgtaa

SEQ ID NO: 209748 - DNA, 25 bp, Rattus norvegicus
attgatcatgtatctgtccccgtaa

SEQ ID NO: 209749 - DNA, 25 bp, Rattus norvegicus
attgatcattatacttcctttcaga

SEQ ID NO: 209750 - DNA, 25 bp, Rattus norvegicus
attgatcattattcttcctttcaga

SEQ ID NO: 209751 - DNA, 25 bp, Rattus norvegicus
attgatccacaaaatgtgtactgta

SEQ ID NO: 209752 - DNA, 25 bp, Rattus norvegicus
attgatccacaatatgtgtactgta

SEQ ID NO: 209753 - DNA, 25 bp, Rattus norvegicus
attgatccagctaaggcaccacaga

SEQ ID NO: 209754 - DNA, 25 bp, Rattus norvegicus
attgatccagcttaggcaccacaga

SEQ ID NO: 209755 - DNA, 25 bp, Rattus norvegicus
attgatcccagtaatttctctcagc

SEQ ID NO: 209756 - DNA, 25 bp, Rattus norvegicus
attgatcccagttatttctctcagc

SEQ ID NO: 209757 - DNA, 25 bp, Rattus norvegicus
attgatccccagaagccatgttgag

SEQ ID NO: 209758 - DNA, 25 bp, Rattus norvegicus
attgatccccagtagccatgttgag

SEQ ID NO: 209759 - DNA, 25 bp, Rattus norvegicus
attgatcccgatctggttgaggccc

SEQ ID NO: 209760 - DNA, 25 bp, Rattus norvegicus
attgatcccgatgtggttgaggccc

SEQ ID NO: 209761 - DNA, 25 bp, Rattus norvegicus
attgatcctagtattcttctctctc

SEQ ID NO: 209762 - DNA, 25 bp, Rattus norvegicus
attgatcctagttttcttctctctc

SEQ ID NO: 209763 - DNA, 25 bp, Rattus norvegicus
attgatcgggcaaccttgacaagat

SEQ ID NO: 209764 - DNA, 25 bp, Rattus norvegicus
attgatcgggcatccttgacaagat

SEQ ID NO: 209765 - DNA, 25 bp, Rattus norvegicus
attgatctacacagttgttggccgc

SEQ ID NO: 209766 - DNA, 25 bp, Rattus norvegicus
attgatctacactgttgttggccgc

SEQ ID NO: 209767 - DNA, 25 bp, Rattus norvegicus
attgatctaccgataccagttatag

SEQ ID NO: 209768 - DNA, 25 bp, Rattus norvegicus
attgatctaccgttaccagttatag

SEQ ID NO: 209769 - DNA, 25 bp, Rattus norvegicus
attgatctaggcattcgggcctgct

SEQ ID NO: 209770 - DNA, 25 bp, Rattus norvegicus
attgatctaggctttcgggcctgct

SEQ ID NO: 209771 - DNA, 25 bp, Rattus norvegicus
attgatcttctgcaaaggccttctc

SEQ ID NO: 209772 - DNA, 25 bp, Rattus norvegicus
attgatcttctggaaaggccttctc

SEQ ID NO: 209773 - DNA, 25 bp, Rattus norvegicus
attgatctttgtacgtgaaccacag

SEQ ID NO: 209774 - DNA, 25 bp, Rattus norvegicus
attgatctttgttcgtgaaccacag

SEQ ID NO: 209775 - DNA, 25 bp, Rattus norvegicus
attgatgacagcagggcccgcaagc

SEQ ID NO: 209776 - DNA, 25 bp, Rattus norvegicus
attgatgacagctgggcccgcaagc

SEQ ID NO: 209777 - DNA, 25 bp, Rattus norvegicus
attgatgacagtccctgcttgttga

SEQ ID NO: 209778 - DNA, 25 bp, Rattus norvegicus
attgatgacagtgcctgcttgttga

SEQ ID NO: 209779 - DNA, 25 bp, Rattus norvegicus
attgatgacgacatctgcgggcagg

SEQ ID NO: 209780 - DNA, 25 bp, Rattus norvegicus
attgatgacgacttctgcgggcagg

SEQ ID NO: 209781 - DNA, 25 bp, Rattus norvegicus
attgatgaggctctctcggttctac

SEQ ID NO: 209782 - DNA, 25 bp, Rattus norvegicus
attgatgaggctgtctcggttctac

SEQ ID NO: 209783 - DNA, 25 bp, Rattus norvegicus
attgatgagtgacctgctgccggct

SEQ ID NO: 209784 - DNA, 25 bp, Rattus norvegicus
attgatgagtgagctgctgccggct

SEQ ID NO: 209785 - DNA, 25 bp, Rattus norvegicus
attgatgatctcagcctagcctaat

SEQ ID NO: 209786 - DNA, 25 bp, Rattus norvegicus
attgatgatctctgcctagcctaat

SEQ ID NO: 209787 - DNA, 25 bp, Rattus norvegicus
attgatgattgactcccagaagccc

SEQ ID NO: 209788 - DNA, 25 bp, Rattus norvegicus
attgatgattgagtcccagaagccc

SEQ ID NO: 209789 - DNA, 25 bp, Rattus norvegicus
attgatgcaaggcacccactgtagt

SEQ ID NO: 209790 - DNA, 25 bp, Rattus norvegicus
attgatgcaagggacccactgtagt

SEQ ID NO: 209791 - DNA, 25 bp, Rattus norvegicus
attgatgccagccaaacctgtaaac

SEQ ID NO: 209792 - DNA, 25 bp, Rattus norvegicus
attgatgccagcgaaacctgtaaac

SEQ ID NO: 209793 - DNA, 25 bp, Rattus norvegicus
attgatgccccaatgctgctgctat

SEQ ID NO: 209794 - DNA, 25 bp, Rattus norvegicus
attgatgccccattgctgctgctat

SEQ ID NO: 209795 - DNA, 25 bp, Rattus norvegicus
attgatgccctcacagaagacttgg

SEQ ID NO: 209796 - DNA, 25 bp, Rattus norvegicus
attgatgccctctcagaagacttgg

SEQ ID NO: 209797 - DNA, 25 bp, Rattus norvegicus
attgatgccttgagggtctgtcgtc

SEQ ID NO: 209798 - DNA, 25 bp, Rattus norvegicus
attgatgccttgtgggtctgtcgtc

SEQ ID NO: 209799 - DNA, 25 bp, Rattus norvegicus
attgatgcgttgagtgttgcaccaa

SEQ ID NO: 209800 - DNA, 25 bp, Rattus norvegicus
attgatgcgttgtgtgttgcaccaa

SEQ ID NO: 209801 - DNA, 25 bp, Rattus norvegicus
attgatgctcgacccatttggagtt

SEQ ID NO: 209802 - DNA, 25 bp, Rattus norvegicus
attgatgctcgagccatttggagtt

SEQ ID NO: 209803 - DNA, 25 bp, Rattus norvegicus
attgatgctctacgtgctgtcttca

SEQ ID NO: 209804 - DNA, 25 bp, Rattus norvegicus
attgatgctctaggtgctgtcttca

SEQ ID NO: 209805 - DNA, 25 bp, Rattus norvegicus
attgatgctgacacagcctcggcag

SEQ ID NO: 209806 - DNA, 25 bp, Rattus norvegicus
attgatgctgactcagcctcggcag

SEQ ID NO: 209807 - DNA, 25 bp, Rattus norvegicus
attgatgctgccacttgctgaactt

SEQ ID NO: 209808 - DNA, 25 bp, Rattus norvegicus
attgatgctgcctcttgctgaactt

SEQ ID NO: 209809 - DNA, 25 bp, Rattus norvegicus
attgatgcttagatcctgtcctcat

SEQ ID NO: 209810 - DNA, 25 bp, Rattus norvegicus
attgatgcttagttcctgtcctcat

SEQ ID NO: 209811 - DNA, 25 bp, Rattus norvegicus
attgatgcttctcatgactctttca

SEQ ID NO: 209812 - DNA, 25 bp, Rattus norvegicus
attgatgcttctgatgactctttca

SEQ ID NO: 209813 - DNA, 25 bp, Rattus norvegicus
attgatggagggacctggcctctcc

SEQ ID NO: 209814 - DNA, 25 bp, Rattus norvegicus
attgatggagggtcctggcctctcc

SEQ ID NO: 209815 - DNA, 25 bp, Rattus norvegicus
attgatggcccacaccacaagctgc

SEQ ID NO: 209816 - DNA, 25 bp, Rattus norvegicus
attgatggcccagaccacaagctgc

SEQ ID NO: 209817 - DNA, 25 bp, Rattus norvegicus
attgatggcgtccacactgactata

SEQ ID NO: 209818 - DNA, 25 bp, Rattus norvegicus
attgatggcgtcgacactgactata

SEQ ID NO: 209819 - DNA, 25 bp, Rattus norvegicus
attgatgggccacctcagcacggag

SEQ ID NO: 209820 - DNA, 25 bp, Rattus norvegicus
attgatgggccagctcagcacggag

SEQ ID NO: 209821 - DNA, 25 bp, Rattus norvegicus
attgatgtagacactttgtgtgtcc

SEQ ID NO: 209822 - DNA, 25 bp, Rattus norvegicus
attgatgtagactctttgtgtgtcc

SEQ ID NO: 209823 - DNA, 25 bp, Rattus norvegicus
attgatgtgagtcaaggccctctta

SEQ ID NO: 209824 - DNA, 25 bp, Rattus norvegicus
attgatgtgagtgaaggccctctta

SEQ ID NO: 209825 - DNA, 25 bp, Rattus norvegicus
attgatgtgatcctgttttgtcgca

SEQ ID NO: 209826 - DNA, 25 bp, Rattus norvegicus
attgatgtgatcgtgttttgtcgca

SEQ ID NO: 209827 - DNA, 25 bp, Rattus norvegicus
attgatgtgcagacctttccaagcg

SEQ ID NO: 209828 - DNA, 25 bp, Rattus norvegicus
attgatgtgcagtcctttccaagcg

SEQ ID NO: 209829 - DNA, 25 bp, Rattus norvegicus
attgatgtgttcagccttggaggga

SEQ ID NO: 209830 - DNA, 25 bp, Rattus norvegicus
attgatgtgttctgccttggaggga

SEQ ID NO: 209831 - DNA, 25 bp, Rattus norvegicus
attgatgttgaactgcttgccgtca

SEQ ID NO: 209832 - DNA, 25 bp, Rattus norvegicus
attgatgttgaagtgcttgccgtca

SEQ ID NO: 209833 - DNA, 25 bp, Rattus norvegicus
attgatgttttcaatggcactccca

SEQ ID NO: 209834 - DNA, 25 bp, Rattus norvegicus
attgatgttttctatggcactccca

SEQ ID NO: 209835 - DNA, 25 bp, Rattus norvegicus
attgatgttttgattgattccttac

SEQ ID NO: 209836 - DNA, 25 bp, Rattus norvegicus
attgatgttttgtttgattccttac

SEQ ID NO: 209837 - DNA, 25 bp, Rattus norvegicus
attgattataacctggtgcagccat

SEQ ID NO: 209838 - DNA, 25 bp, Rattus norvegicus
attgattataacgtggtgcagccat

SEQ ID NO: 209839 - DNA, 25 bp, Rattus norvegicus
attgattatactacgcttgagctat

SEQ ID NO: 209840 - DNA, 25 bp, Rattus norvegicus
attgattatacttcgcttgagctat

SEQ ID NO: 209841 - DNA, 25 bp, Rattus norvegicus
attgattatttcctgctgtctgctc

SEQ ID NO: 209842 - DNA, 25 bp, Rattus norvegicus
attgattatttcgtgctgtctgctc

SEQ ID NO: 209843 - DNA, 25 bp, Rattus norvegicus
attgattcacagcagtatctcccta

SEQ ID NO: 209844 - DNA, 25 bp, Rattus norvegicus
attgattcacaggagtatctcccta

SEQ ID NO: 209845 - DNA, 25 bp, Rattus norvegicus
attgattcagaacctaagcccttcc

SEQ ID NO: 209846 - DNA, 25 bp, Rattus norvegicus
attgattcagaagctaagcccttcc

SEQ ID NO: 209847 - DNA, 25 bp, Rattus norvegicus
attgattcagtaatgtatcatgtgc

SEQ ID NO: 209848 - DNA, 25 bp, Rattus norvegicus
attgattcagtattgtatcatgtgc

SEQ ID NO: 209849 - DNA, 25 bp, Rattus norvegicus
attgattcctgtctccctagtgtct

SEQ ID NO: 209850 - DNA, 25 bp, Rattus norvegicus
attgattcctgtgtccctagtgtct

SEQ ID NO: 209851 - DNA, 25 bp, Rattus norvegicus
attgattctgcccaactcaagcatc

SEQ ID NO: 209852 - DNA, 25 bp, Rattus norvegicus
attgattctgccgaactcaagcatc

SEQ ID NO: 209853 - DNA, 25 bp, Rattus norvegicus
attgattgcccaataaattcatggc

SEQ ID NO: 209854 - DNA, 25 bp, Rattus norvegicus
attgattgcccaatgtgtactgtcc

SEQ ID NO: 209855 - DNA, 25 bp, Rattus norvegicus
attgattgcccattaaattcatggc

SEQ ID NO: 209856 - DNA, 25 bp, Rattus norvegicus
attgattgcccattgtgtactgtcc

SEQ ID NO: 209857 - DNA, 25 bp, Rattus norvegicus
attgattgccctaaaatattagaca

SEQ ID NO: 209858 - DNA, 25 bp, Rattus norvegicus
attgattgcccttaaatattagaca

SEQ ID NO: 209859 - DNA, 25 bp, Rattus norvegicus
attgattgctccattaactgtccct

SEQ ID NO: 209860 - DNA, 25 bp, Rattus norvegicus
attgattgctcctttaactgtccct

SEQ ID NO: 209861 - DNA, 25 bp, Rattus norvegicus
attgattggctcaaatcctggctcc

SEQ ID NO: 209862 - DNA, 25 bp, Rattus norvegicus
attgattggctctaatcctggctcc

SEQ ID NO: 209863 - DNA, 25 bp, Rattus norvegicus
attgattgtaggcaacctccagtta

SEQ ID NO: 209864 - DNA, 25 bp, Rattus norvegicus
attgattgtagggaacctccagtta

SEQ ID NO: 209865 - DNA, 25 bp, Rattus norvegicus
attgattgtattaccgtcctcatcg

SEQ ID NO: 209866 - DNA, 25 bp, Rattus norvegicus
attgattgtatttccgtcctcatcg

SEQ ID NO: 209867 - DNA, 25 bp, Rattus norvegicus
attgattgtgggagggcagcctatt

SEQ ID NO: 209868 - DNA, 25 bp, Rattus norvegicus
attgattgtgggtgggcagcctatt

SEQ ID NO: 209869 - DNA, 25 bp, Rattus norvegicus
attgattgtttcactgttgtcctgt

SEQ ID NO: 209870 - DNA, 25 bp, Rattus norvegicus
attgattgtttctctgttgtcctgt

SEQ ID NO: 209871 - DNA, 25 bp, Rattus norvegicus
attgatttatctccctcttttcttt

SEQ ID NO: 209872 - DNA, 25 bp, Rattus norvegicus
attgatttatctgcctcttttcttt

SEQ ID NO: 209873 - DNA, 25 bp, Rattus norvegicus
attgatttcaggacttgcttgaggt

SEQ ID NO: 209874 - DNA, 25 bp, Rattus norvegicus
attgatttcaggtcttgcttgaggt

SEQ ID NO: 209875 - DNA, 25 bp, Rattus norvegicus
attgatttcagtctcctttgtggca

SEQ ID NO: 209876 - DNA, 25 bp, Rattus norvegicus
attgatttcagtgtcctttgtggca

SEQ ID NO: 209877 - DNA, 25 bp, Rattus norvegicus
attgatttcatgatgtgctaagcta

SEQ ID NO: 209878 - DNA, 25 bp, Rattus norvegicus
attgatttcatgttgtgctaagcta

SEQ ID NO: 209879 - DNA, 25 bp, Rattus norvegicus
attgatttcctaatagtctcccagc

SEQ ID NO: 209880 - DNA, 25 bp, Rattus norvegicus
attgatttcctattagtctcccagc

SEQ ID NO: 209881 - DNA, 25 bp, Rattus norvegicus
attgatttcctgattggttgtacca

SEQ ID NO: 209882 - DNA, 25 bp, Rattus norvegicus
attgatttcctgctgatgtgtacat

SEQ ID NO: 209883 - DNA, 25 bp, Rattus norvegicus
attgatttcctggtgatgtgtacat

SEQ ID NO: 209884 - DNA, 25 bp, Rattus norvegicus
attgatttcctgtttggttgtacca

SEQ ID NO: 209885 - DNA, 25 bp, Rattus norvegicus
attgattttaggctcctctcaacca

SEQ ID NO: 209886 - DNA, 25 bp, Rattus norvegicus
attgattttagggtcctctcaacca

SEQ ID NO: 209887 - DNA, 25 bp, Rattus norvegicus
attgattttcacatctccctttatc

SEQ ID NO: 209888 - DNA, 25 bp, Rattus norvegicus
attgattttcacttctccctttatc

SEQ ID NO: 209889 - DNA, 25 bp, Rattus norvegicus
attgcaaacatgcaaggattacttt

SEQ ID NO: 209890 - DNA, 25 bp, Rattus norvegicus
attgcaaacatggaaggattacttt

SEQ ID NO: 209891 - DNA, 25 bp, Rattus norvegicus
attgcaaactaactgaaccccatct

SEQ ID NO: 209892 - DNA, 25 bp, Rattus norvegicus
attgcaaactaagtgaaccccatct

SEQ ID NO: 209893 - DNA, 25 bp, Rattus norvegicus
attgcaaagcagagtctcccataac

SEQ ID NO: 209894 - DNA, 25 bp, Rattus norvegicus
attgcaaagcagtgtctcccataac

SEQ ID NO: 209895 - DNA, 25 bp, Rattus norvegicus
attgcaaatgcaaccagtcagtaat

SEQ ID NO: 209896 - DNA, 25 bp, Rattus norvegicus
attgcaaatgcatccagtcagtaat

SEQ ID NO: 209897 - DNA, 25 bp, Rattus norvegicus
attgcaacagaaagacacccgattt

SEQ ID NO: 209898 - DNA, 25 bp, Rattus norvegicus
attgcaacagaatgacacccgattt

SEQ ID NO: 209899 - DNA, 25 bp, Rattus norvegicus
attgcaacccggagaggagtccaat

SEQ ID NO: 209900 - DNA, 25 bp, Rattus norvegicus
attgcaacccggtgaggagtccaat

SEQ ID NO: 209901 - DNA, 25 bp, Rattus norvegicus
attgcaacttccatgtaacccaggc

SEQ ID NO: 209902 - DNA, 25 bp, Rattus norvegicus
attgcaacttccttgtaacccaggc

SEQ ID NO: 209903 - DNA, 25 bp, Rattus norvegicus
attgcaagcagaatgcctctttgtt

SEQ ID NO: 209904 - DNA, 25 bp, Rattus norvegicus
attgcaagcagattgcctctttgtt

SEQ ID NO: 209905 - DNA, 25 bp, Rattus norvegicus
attgcaagcaggactcagttccaaa

SEQ ID NO: 209906 - DNA, 25 bp, Rattus norvegicus
attgcaagcaggtctcagttccaaa

SEQ ID NO: 209907 - DNA, 25 bp, Rattus norvegicus
attgcaagccaaactgtgactcggt

SEQ ID NO: 209908 - DNA, 25 bp, Rattus norvegicus
attgcaagccaatctgtgactcggt

SEQ ID NO: 209909 - DNA, 25 bp, Rattus norvegicus
attgcaaggaaacagtcaccagact

SEQ ID NO: 209910 - DNA, 25 bp, Rattus norvegicus
attgcaaggaaagagtcaccagact

SEQ ID NO: 209911 - DNA, 25 bp, Rattus norvegicus
attgcaaggcacctgacccttcaaa

SEQ ID NO: 209912 - DNA, 25 bp, Rattus norvegicus
attgcaaggcacgtgacccttcaaa

SEQ ID NO: 209913 - DNA, 25 bp, Rattus norvegicus
attgcaaggtgtatctcagggctaa

SEQ ID NO: 209914 - DNA, 25 bp, Rattus norvegicus
attgcaaggtgtttctcagggctaa

SEQ ID NO: 209915 - DNA, 25 bp, Rattus norvegicus
attgcaagtattacctagccttcgg

SEQ ID NO: 209916 - DNA, 25 bp, Rattus norvegicus
attgcaagtatttcctagccttcgg

SEQ ID NO: 209917 - DNA, 25 bp, Rattus norvegicus
attgcaatagcacccaccgaggtca

SEQ ID NO: 209918 - DNA, 25 bp, Rattus norvegicus
attgcaatagcagccaccgaggtca

SEQ ID NO: 209919 - DNA, 25 bp, Rattus norvegicus
attgcaatccggactttacagtcca

SEQ ID NO: 209920 - DNA, 25 bp, Rattus norvegicus
attgcaatccggtctttacagtcca

SEQ ID NO: 209921 - DNA, 25 bp, Rattus norvegicus
attgcaatggacacagttgtttttt

SEQ ID NO: 209922 - DNA, 25 bp, Rattus norvegicus
attgcaatggactcagttgtttttt

SEQ ID NO: 209923 - DNA, 25 bp, Rattus norvegicus
attgcacaacacatgaggacctgga

SEQ ID NO: 209924 - DNA, 25 bp, Rattus norvegicus
attgcacaacacctcatcatgagag

SEQ ID NO: 209925 - DNA, 25 bp, Rattus norvegicus
attgcacaacacgtcatcatgagag

SEQ ID NO: 209926 - DNA, 25 bp, Rattus norvegicus
attgcacaacacttgaggacctgga

SEQ ID NO: 209927 - DNA, 25 bp, Rattus norvegicus
attgcacaagtcagcgtggtctcag

SEQ ID NO: 209928 - DNA, 25 bp, Rattus norvegicus
attgcacaagtctgcgtggtctcag

SEQ ID NO: 209929 - DNA, 25 bp, Rattus norvegicus
attgcacaatgcacaggactatctg

SEQ ID NO: 209930 - DNA, 25 bp, Rattus norvegicus
attgcacaatgctcaggactatctg

SEQ ID NO: 209931 - DNA, 25 bp, Rattus norvegicus
attgcacagtgcacactttactgaa

SEQ ID NO: 209932 - DNA, 25 bp, Rattus norvegicus
attgcacagtgctcactttactgaa

SEQ ID NO: 209933 - DNA, 25 bp, Rattus norvegicus
attgcacatgggagctctagccacc

SEQ ID NO: 209934 - DNA, 25 bp, Rattus norvegicus
attgcacatgggtgctctagccacc

SEQ ID NO: 209935 - DNA, 25 bp, Rattus norvegicus
attgcaccatttaccattggagcgt

SEQ ID NO: 209936 - DNA, 25 bp, Rattus norvegicus
attgcaccattttccattggagcgt

SEQ ID NO: 209937 - DNA, 25 bp, Rattus norvegicus
attgcacctacactttgactgccac

SEQ ID NO: 209938 - DNA, 25 bp, Rattus norvegicus
attgcacctacagtttgactgccac

SEQ ID NO: 209939 - DNA, 25 bp, Rattus norvegicus
attgcacctcctatgcttaagcgga

SEQ ID NO: 209940 - DNA, 25 bp, Rattus norvegicus
attgcacctcctttgcttaagcgga

SEQ ID NO: 209941 - DNA, 25 bp, Rattus norvegicus
attgcacctgcaacagttacgtcaa

SEQ ID NO: 209942 - DNA, 25 bp, Rattus norvegicus
attgcacctgcatcagttacgtcaa

SEQ ID NO: 209943 - DNA, 25 bp, Rattus norvegicus
attgcacctgtacgccaaccgagca

SEQ ID NO: 209944 - DNA, 25 bp, Rattus norvegicus
attgcacctgtaggccaaccgagca

SEQ ID NO: 209945 - DNA, 25 bp, Rattus norvegicus
attgcacgctttcgagggcgtcact

SEQ ID NO: 209946 - DNA, 25 bp, Rattus norvegicus
attgcacgctttggagggcgtcact

SEQ ID NO: 209947 - DNA, 25 bp, Rattus norvegicus
attgcacgggcactgttctgaggat

SEQ ID NO: 209948 - DNA, 25 bp, Rattus norvegicus
attgcacgggcagtgttctgaggat

SEQ ID NO: 209949 - DNA, 25 bp, Rattus norvegicus
attgcacgtacaatgattcctgtaa

SEQ ID NO: 209950 - DNA, 25 bp, Rattus norvegicus
attgcacgtacattgattcctgtaa

SEQ ID NO: 209951 - DNA, 25 bp, Rattus norvegicus
attgcactaagtcctattcccaaag

SEQ ID NO: 209952 - DNA, 25 bp, Rattus norvegicus
attgcactaagtgctattcccaaag

SEQ ID NO: 209953 - DNA, 25 bp, Rattus norvegicus
attgcactagtcagctcagaactgt

SEQ ID NO: 209954 - DNA, 25 bp, Rattus norvegicus
attgcactagtctgctcagaactgt

SEQ ID NO: 209955 - DNA, 25 bp, Rattus norvegicus
attgcactcacgaactaaccagtag

SEQ ID NO: 209956 - DNA, 25 bp, Rattus norvegicus
attgcactcacgtactaaccagtag

SEQ ID NO: 209957 - DNA, 25 bp, Rattus norvegicus
attgcactctggcaatatcttactt

SEQ ID NO: 209958 - DNA, 25 bp, Rattus norvegicus
attgcactctgggaatatcttactt

SEQ ID NO: 209959 - DNA, 25 bp, Rattus norvegicus
attgcactctgtaaagaattctttg

SEQ ID NO: 209960 - DNA, 25 bp, Rattus norvegicus
attgcactctgtattcattgaagcc

SEQ ID NO: 209961 - DNA, 25 bp, Rattus norvegicus
attgcactctgttaagaattctttg

SEQ ID NO: 209962 - DNA, 25 bp, Rattus norvegicus
attgcactctgttttcattgaagcc

SEQ ID NO: 209963 - DNA, 25 bp, Rattus norvegicus
attgcactgcaaccagtattgtttg

SEQ ID NO: 209964 - DNA, 25 bp, Rattus norvegicus
attgcactgcaagcagtattgtttg

SEQ ID NO: 209965 - DNA, 25 bp, Rattus norvegicus
attgcactggacacacatcgccaag

SEQ ID NO: 209966 - DNA, 25 bp, Rattus norvegicus
attgcactggactcacatcgccaag

SEQ ID NO: 209967 - DNA, 25 bp, Rattus norvegicus
attgcactgggactacaggcaggaa

SEQ ID NO: 209968 - DNA, 25 bp, Rattus norvegicus
attgcactgggagtacaggcaggaa

SEQ ID NO: 209969 - DNA, 25 bp, Rattus norvegicus
attgcactggtaccagctcatttcc

SEQ ID NO: 209970 - DNA, 25 bp, Rattus norvegicus
attgcactggtagcagctcatttcc

SEQ ID NO: 209971 - DNA, 25 bp, Rattus norvegicus
attgcactgtttagggacacacaca

SEQ ID NO: 209972 - DNA, 25 bp, Rattus norvegicus
attgcactgttttgggacacacaca

SEQ ID NO: 209973 - DNA, 25 bp, Rattus norvegicus
attgcacttacaatttcagtattag

SEQ ID NO: 209974 - DNA, 25 bp, Rattus norvegicus
attgcacttacattttcagtattag

SEQ ID NO: 209975 - DNA, 25 bp, Rattus norvegicus
attgcacttaccacacatcatgtct

SEQ ID NO: 209976 - DNA, 25 bp, Rattus norvegicus
attgcacttacctcacatcatgtct

SEQ ID NO: 209977 - DNA, 25 bp, Rattus norvegicus
attgcacttcacactgttttcaggg

SEQ ID NO: 209978 - DNA, 25 bp, Rattus norvegicus
attgcacttcactctgttttcaggg

SEQ ID NO: 209979 - DNA, 25 bp, Rattus norvegicus
attgcacttgatccatattcttcct

SEQ ID NO: 209980 - DNA, 25 bp, Rattus norvegicus
attgcacttgatgcatattcttcct

SEQ ID NO: 209981 - DNA, 25 bp, Rattus norvegicus
attgcacttttgatgagggaagcca

SEQ ID NO: 209982 - DNA, 25 bp, Rattus norvegicus
attgcacttttgttgagggaagcca

SEQ ID NO: 209983 - DNA, 25 bp, Rattus norvegicus
attgcagaatcgcagcctgtgtttc

SEQ ID NO: 209984 - DNA, 25 bp, Rattus norvegicus
attgcagaatcggagcctgtgtttc

SEQ ID NO: 209985 - DNA, 25 bp, Rattus norvegicus
attgcagaccacctcaaggcagaag

SEQ ID NO: 209986 - DNA, 25 bp, Rattus norvegicus
attgcagaccacgtcaaggcagaag

SEQ ID NO: 209987 - DNA, 25 bp, Rattus norvegicus
attgcagaccagactgaaccctcag

SEQ ID NO: 209988 - DNA, 25 bp, Rattus norvegicus
attgcagaccagtctgaaccctcag

SEQ ID NO: 209989 - DNA, 25 bp, Rattus norvegicus
attgcagaccttatgggtggtccct

SEQ ID NO: 209990 - DNA, 25 bp, Rattus norvegicus
attgcagaccttttgggtggtccct

SEQ ID NO: 209991 - DNA, 25 bp, Rattus norvegicus
attgcagacgccagtgacccagtga

SEQ ID NO: 209992 - DNA, 25 bp, Rattus norvegicus
attgcagacgcctgtgacccagtga

SEQ ID NO: 209993 - DNA, 25 bp, Rattus norvegicus
attgcagactgcagcctgcaacaca

SEQ ID NO: 209994 - DNA, 25 bp, Rattus norvegicus
attgcagactgctgcctgcaacaca

SEQ ID NO: 209995 - DNA, 25 bp, Rattus norvegicus
attgcagactggaggcatgagcccc

SEQ ID NO: 209996 - DNA, 25 bp, Rattus norvegicus
attgcagactggtggcatgagcccc

SEQ ID NO: 209997 - DNA, 25 bp, Rattus norvegicus
attgcagactgtcttcattcccact

SEQ ID NO: 209998 - DNA, 25 bp, Rattus norvegicus
attgcagactgtgttcattcccact

SEQ ID NO: 209999 - DNA, 25 bp, Rattus norvegicus
attgcagagatcaggtatggactag

SEQ ID NO: 210000 - DNA, 25 bp, Rattus norvegicus
attgcagagatctggtatggactag

SEQ ID NO: 210001 - DNA, 25 bp, Rattus norvegicus
attgcagagctgatccgtgaacggc

SEQ ID NO: 210002 - DNA, 25 bp, Rattus norvegicus
attgcagagctgttccgtgaacggc

SEQ ID NO: 210003 - DNA, 25 bp, Rattus norvegicus
attgcagatttgaatcctgtgtcaa

SEQ ID NO: 210004 - DNA, 25 bp, Rattus norvegicus
attgcagatttgtatcctgtgtcaa

SEQ ID NO: 210005 - DNA, 25 bp, Rattus norvegicus
attgcagcacttccggtcactaatt

SEQ ID NO: 210006 - DNA, 25 bp, Rattus norvegicus
attgcagcacttgcggtcactaatt

SEQ ID NO: 210007 - DNA, 25 bp, Rattus norvegicus
attgcagcaggcatgggcgtctatc

SEQ ID NO: 210008 - DNA, 25 bp, Rattus norvegicus
attgcagcaggcttgggcgtctatc

SEQ ID NO: 210009 - DNA, 25 bp, Rattus norvegicus
attgcagcatatcccttcttcaaag

SEQ ID NO: 210010 - DNA, 25 bp, Rattus norvegicus
attgcagcatatgccttcttcaaag

SEQ ID NO: 210011 - DNA, 25 bp, Rattus norvegicus
attgcagccctccaggaacaggtgt

SEQ ID NO: 210012 - DNA, 25 bp, Rattus norvegicus
attgcagccctcgaggaacaggtgt

SEQ ID NO: 210013 - DNA, 25 bp, Rattus norvegicus
attgcagcctcacagacaagcgtgc

SEQ ID NO: 210014 - DNA, 25 bp, Rattus norvegicus
attgcagcctcagagacaagcgtgc

SEQ ID NO: 210015 - DNA, 25 bp, Rattus norvegicus
attgcagcctgaacgtcgcacggcg

SEQ ID NO: 210016 - DNA, 25 bp, Rattus norvegicus
attgcagcctgatcgtcgcacggcg

SEQ ID NO: 210017 - DNA, 25 bp, Rattus norvegicus
attgcagctcctatgctagaactgt

SEQ ID NO: 210018 - DNA, 25 bp, Rattus norvegicus
attgcagctcctttgctagaactgt

SEQ ID NO: 210019 - DNA, 25 bp, Rattus norvegicus
attgcagctgctatgccacagtatt

SEQ ID NO: 210020 - DNA, 25 bp, Rattus norvegicus
attgcagctgctttgccacagtatt

SEQ ID NO: 210021 - DNA, 25 bp, Rattus norvegicus
attgcaggacgcacctataacgacc

SEQ ID NO: 210022 - DNA, 25 bp, Rattus norvegicus
attgcaggacgctcctataacgacc

SEQ ID NO: 210023 - DNA, 25 bp, Rattus norvegicus
attgcaggccagattaacacttact

SEQ ID NO: 210024 - DNA, 25 bp, Rattus norvegicus
attgcaggccagtttaacacttact

SEQ ID NO: 210025 - DNA, 25 bp, Rattus norvegicus
attgcaggctagaatataccgaggg

SEQ ID NO: 210026 - DNA, 25 bp, Rattus norvegicus
attgcaggctagtatataccgaggg

SEQ ID NO: 210027 - DNA, 25 bp, Rattus norvegicus
attgcagggctgaacatctgccagc

SEQ ID NO: 210028 - DNA, 25 bp, Rattus norvegicus
attgcagggctgtacatctgccagc

SEQ ID NO: 210029 - DNA, 25 bp, Rattus norvegicus
attgcaggtgctcgctactgtacca

SEQ ID NO: 210030 - DNA, 25 bp, Rattus norvegicus
attgcaggtgctggctactgtacca

SEQ ID NO: 210031 - DNA, 25 bp, Rattus norvegicus
attgcaggtggtatctgtccctaca

SEQ ID NO: 210032 - DNA, 25 bp, Rattus norvegicus
attgcaggtggtttctgtccctaca

SEQ ID NO: 210033 - DNA, 25 bp, Rattus norvegicus
attgcagtaactagccttgcctttc

SEQ ID NO: 210034 - DNA, 25 bp, Rattus norvegicus
attgcagtaacttgccttgcctttc

SEQ ID NO: 210035 - DNA, 25 bp, Rattus norvegicus
attgcagtaatacccaatcctgtat

SEQ ID NO: 210036 - DNA, 25 bp, Rattus norvegicus
attgcagtaatagccaatcctgtat

SEQ ID NO: 210037 - DNA, 25 bp, Rattus norvegicus
attgcagtagacacagacagggcca

SEQ ID NO: 210038 - DNA, 25 bp, Rattus norvegicus
attgcagtagactcagacagggcca

SEQ ID NO: 210039 - DNA, 25 bp, Rattus norvegicus
attgcagtccttcgcttacagagag

SEQ ID NO: 210040 - DNA, 25 bp, Rattus norvegicus
attgcagtccttggcttacagagag

SEQ ID NO: 210041 - DNA, 25 bp, Rattus norvegicus
attgcagtctggattctgctctagc

SEQ ID NO: 210042 - DNA, 25 bp, Rattus norvegicus
attgcagtctggtttctgctctagc

SEQ ID NO: 210043 - DNA, 25 bp, Rattus norvegicus
attgcagtgactatcggaggagacg

SEQ ID NO: 210044 - DNA, 25 bp, Rattus norvegicus
attgcagtgactttcggaggagacg

SEQ ID NO: 210045 - DNA, 25 bp, Rattus norvegicus
attgcagttatgattgtccgttcta

SEQ ID NO: 210046 - DNA, 25 bp, Rattus norvegicus
attgcagttatgtttgtccgttcta

SEQ ID NO: 210047 - DNA, 25 bp, Rattus norvegicus
attgcagttcttctcaatgacctgg

SEQ ID NO: 210048 - DNA, 25 bp, Rattus norvegicus
attgcagttcttgtcaatgacctgg

SEQ ID NO: 210049 - DNA, 25 bp, Rattus norvegicus
attgcagttttcatgaccagcttcc

SEQ ID NO: 210050 - DNA, 25 bp, Rattus norvegicus
attgcagttttcttgaccagcttcc

SEQ ID NO: 210051 - DNA, 25 bp, Rattus norvegicus
attgcatacaagattgaggaggaca

SEQ ID NO: 210052 - DNA, 25 bp, Rattus norvegicus
attgcatacaagtttgaggaggaca

SEQ ID NO: 210053 - DNA, 25 bp, Rattus norvegicus
attgcatacatgaaatcgctccgtg

SEQ ID NO: 210054 - DNA, 25 bp, Rattus norvegicus
attgcatacatgtaatcgctccgtg

SEQ ID NO: 210055 - DNA, 25 bp, Rattus norvegicus
attgcatacgctaacccaaggacaa

SEQ ID NO: 210056 - DNA, 25 bp, Rattus norvegicus
attgcatacgcttacccaaggacaa

SEQ ID NO: 210057 - DNA, 25 bp, Rattus norvegicus
attgcatagcctcactgtacttgtg

SEQ ID NO: 210058 - DNA, 25 bp, Rattus norvegicus
attgcatagcctgactgtacttgtg

SEQ ID NO: 210059 - DNA, 25 bp, Rattus norvegicus
attgcataggtgagcagtctgcaca

SEQ ID NO: 210060 - DNA, 25 bp, Rattus norvegicus
attgcataggtgtgcagtctgcaca

SEQ ID NO: 210061 - DNA, 25 bp, Rattus norvegicus
attgcatatgtacctgagcactccc

SEQ ID NO: 210062 - DNA, 25 bp, Rattus norvegicus
attgcatatgtagctgagcactccc

SEQ ID NO: 210063 - DNA, 25 bp, Rattus norvegicus
attgcatcacttagctcatgacctt

SEQ ID NO: 210064 - DNA, 25 bp, Rattus norvegicus
attgcatcactttgctcatgacctt

SEQ ID NO: 210065 - DNA, 25 bp, Rattus norvegicus
attgcatccatcacctgcctgcatt

SEQ ID NO: 210066 - DNA, 25 bp, Rattus norvegicus
attgcatccatctcctgcctgcatt

SEQ ID NO: 210067 - DNA, 25 bp, Rattus norvegicus
attgcatcctacctacatccgaatg

SEQ ID NO: 210068 - DNA, 25 bp, Rattus norvegicus
attgcatcctacgtacatccgaatg

SEQ ID NO: 210069 - DNA, 25 bp, Rattus norvegicus
attgcatcctgcactagcctagtta

SEQ ID NO: 210070 - DNA, 25 bp, Rattus norvegicus
attgcatcctgctctagcctagtta

SEQ ID NO: 210071 - DNA, 25 bp, Rattus norvegicus
attgcatctcttatatcatcttctc

SEQ ID NO: 210072 - DNA, 25 bp, Rattus norvegicus
attgcatctcttttatcatcttctc

SEQ ID NO: 210073 - DNA, 25 bp, Rattus norvegicus
attgcatctgacctcattcctgtta

SEQ ID NO: 210074 - DNA, 25 bp, Rattus norvegicus
attgcatctgacgtcattcctgtta

SEQ ID NO: 210075 - DNA, 25 bp, Rattus norvegicus
attgcatgaccaataatgaacttgt

SEQ ID NO: 210076 - DNA, 25 bp, Rattus norvegicus
attgcatgaccattaatgaacttgt

SEQ ID NO: 210077 - DNA, 25 bp, Rattus norvegicus
attgcatgacctacagattggagag

SEQ ID NO: 210078 - DNA, 25 bp, Rattus norvegicus
attgcatgaccttcagattggagag

SEQ ID NO: 210079 - DNA, 25 bp, Rattus norvegicus
attgcatgcgccctaggtgacccct

SEQ ID NO: 210080 - DNA, 25 bp, Rattus norvegicus
attgcatgcgccgtaggtgacccct

SEQ ID NO: 210081 - DNA, 25 bp, Rattus norvegicus
attgcatgctggcattcagctccta

SEQ ID NO: 210082 - DNA, 25 bp, Rattus norvegicus
attgcatgctgggattcagctccta

SEQ ID NO: 210083 - DNA, 25 bp, Rattus norvegicus
attgcatggactctggctgtcgtcg

SEQ ID NO: 210084 - DNA, 25 bp, Rattus norvegicus
attgcatggactgtggctgtcgtcg

SEQ ID NO: 210085 - DNA, 25 bp, Rattus norvegicus
attgcatggtgcaggccaggttatt

SEQ ID NO: 210086 - DNA, 25 bp, Rattus norvegicus
attgcatggtgctggccaggttatt

SEQ ID NO: 210087 - DNA, 25 bp, Rattus norvegicus
attgcattaactagctgaggtgaat

SEQ ID NO: 210088 - DNA, 25 bp, Rattus norvegicus
attgcattaacttgctgaggtgaat

SEQ ID NO: 210089 - DNA, 25 bp, Rattus norvegicus
attgcattcactcttaaccaagctc

SEQ ID NO: 210090 - DNA, 25 bp, Rattus norvegicus
attgcattcactgttaaccaagctc

SEQ ID NO: 210091 - DNA, 25 bp, Rattus norvegicus
attgcattctttcgtcattacaggg

SEQ ID NO: 210092 - DNA, 25 bp, Rattus norvegicus
attgcattctttggtcattacaggg

SEQ ID NO: 210093 - DNA, 25 bp, Rattus norvegicus
attgcattgccaagaactccccgtg

SEQ ID NO: 210094 - DNA, 25 bp, Rattus norvegicus
attgcattgccatgaactccccgtg

SEQ ID NO: 210095 - DNA, 25 bp, Rattus norvegicus
attgcattggcaacttggttctcga

SEQ ID NO: 210096 - DNA, 25 bp, Rattus norvegicus
attgcattggcatcttggttctcga

SEQ ID NO: 210097 - DNA, 25 bp, Rattus norvegicus
attgcatttactacactgtttccat

SEQ ID NO: 210098 - DNA, 25 bp, Rattus norvegicus
attgcatttacttcactgtttccat

SEQ ID NO: 210099 - DNA, 25 bp, Rattus norvegicus
attgcatttatgaaggtacccggat

SEQ ID NO: 210100 - DNA, 25 bp, Rattus norvegicus
attgcatttatgtaggtacccggat

SEQ ID NO: 210101 - DNA, 25 bp, Rattus norvegicus
attgcatttcttagaattcacgatg

SEQ ID NO: 210102 - DNA, 25 bp, Rattus norvegicus
attgcatttctttgaattcacgatg

SEQ ID NO: 210103 - DNA, 25 bp, Rattus norvegicus
attgcatttgagctgacactccctg

SEQ ID NO: 210104 - DNA, 25 bp, Rattus norvegicus
attgcatttgaggtgacactccctg

SEQ ID NO: 210105 - DNA, 25 bp, Rattus norvegicus
attgcatttgctcttgtttctataa

SEQ ID NO: 210106 - DNA, 25 bp, Rattus norvegicus
attgcatttgctgttgtttctataa

SEQ ID NO: 210107 - DNA, 25 bp, Rattus norvegicus
attgcatttgtgaacgccgactctg

SEQ ID NO: 210108 - DNA, 25 bp, Rattus norvegicus
attgcatttgtgtacgccgactctg

SEQ ID NO: 210109 - DNA, 25 bp, Rattus norvegicus
attgccaaagtactcctcggtatta

SEQ ID NO: 210110 - DNA, 25 bp, Rattus norvegicus
attgccaaagtagtcctcggtatta

SEQ ID NO: 210111 - DNA, 25 bp, Rattus norvegicus
attgccaacccactggaaggctctt

SEQ ID NO: 210112 - DNA, 25 bp, Rattus norvegicus
attgccaacccagtggaaggctctt

SEQ ID NO: 210113 - DNA, 25 bp, Rattus norvegicus
attgccaagaacattagccctgagg

SEQ ID NO: 210114 - DNA, 25 bp, Rattus norvegicus
attgccaagaactttagccctgagg

SEQ ID NO: 210115 - DNA, 25 bp, Rattus norvegicus
attgccaagacgcttctgaagcatt

SEQ ID NO: 210116 - DNA, 25 bp, Rattus norvegicus
attgccaagacggttctgaagcatt

SEQ ID NO: 210117 - DNA, 25 bp, Rattus norvegicus
attgccaagagcagcgcatcagcta

SEQ ID NO: 210118 - DNA, 25 bp, Rattus norvegicus
attgccaagagctgcgcatcagcta

SEQ ID NO: 210119 - DNA, 25 bp, Rattus norvegicus
attgccaatatgacttctggaacca

SEQ ID NO: 210120 - DNA, 25 bp, Rattus norvegicus
attgccaatatgtcttctggaacca

SEQ ID NO: 210121 - DNA, 25 bp, Rattus norvegicus
attgccaattaccattctgaatttc

SEQ ID NO: 210122 - DNA, 25 bp, Rattus norvegicus
attgccaattacgattctgaatttc

SEQ ID NO: 210123 - DNA, 25 bp, Rattus norvegicus
attgccacacttcacagagtttagg

SEQ ID NO: 210124 - DNA, 25 bp, Rattus norvegicus
attgccacacttgacagagtttagg

SEQ ID NO: 210125 - DNA, 25 bp, Rattus norvegicus
attgccacagcaaaccttattccag

SEQ ID NO: 210126 - DNA, 25 bp, Rattus norvegicus
attgccacagcataccttattccag

SEQ ID NO: 210127 - DNA, 25 bp, Rattus norvegicus
attgccacattacctcattgacacc

SEQ ID NO: 210128 - DNA, 25 bp, Rattus norvegicus
attgccacattagctcattgacacc

SEQ ID NO: 210129 - DNA, 25 bp, Rattus norvegicus
attgccaccaagagattcgatgccc

SEQ ID NO: 210130 - DNA, 25 bp, Rattus norvegicus
attgccaccaagtgattcgatgccc

SEQ ID NO: 210131 - DNA, 25 bp, Rattus norvegicus
attgccaccagaattccttcatatt

SEQ ID NO: 210132 - DNA, 25 bp, Rattus norvegicus
attgccaccagatttccttcatatt

SEQ ID NO: 210133 - DNA, 25 bp, Rattus norvegicus
attgccaccctgatgtgtcttagcc

SEQ ID NO: 210134 - DNA, 25 bp, Rattus norvegicus
attgccaccctgttgtgtcttagcc

SEQ ID NO: 210135 - DNA, 25 bp, Rattus norvegicus
attgccacctgtctggaggtttgac

SEQ ID NO: 210136 - DNA, 25 bp, Rattus norvegicus
attgccacctgtgtggaggtttgac

SEQ ID NO: 210137 - DNA, 25 bp, Rattus norvegicus
attgccaccttcaaaattgcctagc

SEQ ID NO: 210138 - DNA, 25 bp, Rattus norvegicus
attgccaccttctaaattgcctagc

SEQ ID NO: 210139 - DNA, 25 bp, Rattus norvegicus
attgccacgtagactttccattcaa

SEQ ID NO: 210140 - DNA, 25 bp, Rattus norvegicus
attgccacgtagtctttccattcaa

SEQ ID NO: 210141 - DNA, 25 bp, Rattus norvegicus
attgccactcagcagactgtcagga

SEQ ID NO: 210142 - DNA, 25 bp, Rattus norvegicus
attgccactcaggagactgtcagga

SEQ ID NO: 210143 - DNA, 25 bp, Rattus norvegicus
attgccactttccaagatacccttg

SEQ ID NO: 210144 - DNA, 25 bp, Rattus norvegicus
attgccactttcgaagatacccttg

SEQ ID NO: 210145 - DNA, 25 bp, Rattus norvegicus
attgccagaagcaggctggctgcat

SEQ ID NO: 210146 - DNA, 25 bp, Rattus norvegicus
attgccagaagctggctggctgcat

SEQ ID NO: 210147 - DNA, 25 bp, Rattus norvegicus
attgccagactgacttgaaatgttt

SEQ ID NO: 210148 - DNA, 25 bp, Rattus norvegicus
attgccagactgtcttgaaatgttt

SEQ ID NO: 210149 - DNA, 25 bp, Rattus norvegicus
attgccagcagccacatcagtaact

SEQ ID NO: 210150 - DNA, 25 bp, Rattus norvegicus
attgccagcagcgacatcagtaact

SEQ ID NO: 210151 - DNA, 25 bp, Rattus norvegicus
attgccagcatcaagaggaacatct

SEQ ID NO: 210152 - DNA, 25 bp, Rattus norvegicus
attgccagcatctagaggaacatct

SEQ ID NO: 210153 - DNA, 25 bp, Rattus norvegicus
attgccagctgcactcaggatgggc

SEQ ID NO: 210154 - DNA, 25 bp, Rattus norvegicus
attgccagctgctctcaggatgggc

SEQ ID NO: 210155 - DNA, 25 bp, Rattus norvegicus
attgccagctttaaagaccctaggg

SEQ ID NO: 210156 - DNA, 25 bp, Rattus norvegicus
attgccagcttttaagaccctaggg

SEQ ID NO: 210157 - DNA, 25 bp, Rattus norvegicus
attgccaggaggaaagcccttcacc

SEQ ID NO: 210158 - DNA, 25 bp, Rattus norvegicus
attgccaggaggtaagcccttcacc

SEQ ID NO: 210159 - DNA, 25 bp, Rattus norvegicus
attgccaggattccagattccgtga

SEQ ID NO: 210160 - DNA, 25 bp, Rattus norvegicus
attgccaggattgcagattccgtga

SEQ ID NO: 210161 - DNA, 25 bp, Rattus norvegicus
attgccaggcaaaataagaactcac

SEQ ID NO: 210162 - DNA, 25 bp, Rattus norvegicus
attgccaggcaatataagaactcac

SEQ ID NO: 210163 - DNA, 25 bp, Rattus norvegicus
attgccagggctaccggaaagaaat

SEQ ID NO: 210164 - DNA, 25 bp, Rattus norvegicus
attgccagggcttccggaaagaaat

SEQ ID NO: 210165 - DNA, 25 bp, Rattus norvegicus
attgccaggtaaattttcactccag

SEQ ID NO: 210166 - DNA, 25 bp, Rattus norvegicus
attgccaggtaatttttcactccag

SEQ ID NO: 210167 - DNA, 25 bp, Rattus norvegicus
attgccaggtttaaccagtgtgctc

SEQ ID NO: 210168 - DNA, 25 bp, Rattus norvegicus
attgccaggttttaccagtgtgctc

SEQ ID NO: 210169 - DNA, 25 bp, Rattus norvegicus
attgccagtcttacacaaattctcc

SEQ ID NO: 210170 - DNA, 25 bp, Rattus norvegicus
attgccagtctttcacaaattctcc

SEQ ID NO: 210171 - DNA, 25 bp, Rattus norvegicus
attgccagtgcaagctggtggctca

SEQ ID NO: 210172 - DNA, 25 bp, Rattus norvegicus
attgccagtgcatgctggtggctca

SEQ ID NO: 210173 - DNA, 25 bp, Rattus norvegicus
attgccagttacaccacagccttac

SEQ ID NO: 210174 - DNA, 25 bp, Rattus norvegicus
attgccagttactccacagccttac

SEQ ID NO: 210175 - DNA, 25 bp, Rattus norvegicus
attgccagttttctgagtctccagt

SEQ ID NO: 210176 - DNA, 25 bp, Rattus norvegicus
attgccagttttgtgagtctccagt

SEQ ID NO: 210177 - DNA, 25 bp, Rattus norvegicus
attgccatacagagtttcaaaacgt

SEQ ID NO: 210178 - DNA, 25 bp, Rattus norvegicus
attgccatacagtgtttcaaaacgt

SEQ ID NO: 210179 - DNA, 25 bp, Rattus norvegicus
attgccatcccaagcaacaacaagg

SEQ ID NO: 210180 - DNA, 25 bp, Rattus norvegicus
attgccatcccatgcaacaacaagg

SEQ ID NO: 210181 - DNA, 25 bp, Rattus norvegicus
attgccatcctcaagcatgccaagg

SEQ ID NO: 210182 - DNA, 25 bp, Rattus norvegicus
attgccatcctctagcatgccaagg

SEQ ID NO: 210183 - DNA, 25 bp, Rattus norvegicus
attgccatcgttatttgcctcttga

SEQ ID NO: 210184 - DNA, 25 bp, Rattus norvegicus
attgccatcgttttttgcctcttga

SEQ ID NO: 210185 - DNA, 25 bp, Rattus norvegicus
attgccatgcctcaccagtgactgt

SEQ ID NO: 210186 - DNA, 25 bp, Rattus norvegicus
attgccatgcctcctagtttcccag

SEQ ID NO: 210187 - DNA, 25 bp, Rattus norvegicus
attgccatgcctgaccagtgactgt

SEQ ID NO: 210188 - DNA, 25 bp, Rattus norvegicus
attgccatgcctgctagtttcccag

SEQ ID NO: 210189 - DNA, 25 bp, Rattus norvegicus
attgccatgcgacacagagcacgat

SEQ ID NO: 210190 - DNA, 25 bp, Rattus norvegicus
attgccatgcgagacagagcacgat

SEQ ID NO: 210191 - DNA, 25 bp, Rattus norvegicus
attgccatgtgcacaccttaaggtg

SEQ ID NO: 210192 - DNA, 25 bp, Rattus norvegicus
attgccatgtgctcaccttaaggtg

SEQ ID NO: 210193 - DNA, 25 bp, Rattus norvegicus
attgccatgttcagtgggaagctga

SEQ ID NO: 210194 - DNA, 25 bp, Rattus norvegicus
attgccatgttctgtgggaagctga

SEQ ID NO: 210195 - DNA, 25 bp, Rattus norvegicus
attgccattgtgattgggtcagaat

SEQ ID NO: 210196 - DNA, 25 bp, Rattus norvegicus
attgccattgtgtttgggtcagaat

SEQ ID NO: 210197 - DNA, 25 bp, Rattus norvegicus
attgcccaagtcaacttcttctgta

SEQ ID NO: 210198 - DNA, 25 bp, Rattus norvegicus
attgcccaagtctacttcttctgta

SEQ ID NO: 210199 - DNA, 25 bp, Rattus norvegicus
attgcccacagccagactaaagttg

SEQ ID NO: 210200 - DNA, 25 bp, Rattus norvegicus
attgcccacagcgagactaaagttg

SEQ ID NO: 210201 - DNA, 25 bp, Rattus norvegicus
attgcccacatgacgcgttgtacgc

SEQ ID NO: 210202 - DNA, 25 bp, Rattus norvegicus
attgcccacatgtcgcgttgtacgc

SEQ ID NO: 210203 - DNA, 25 bp, Rattus norvegicus
attgcccaccagagcctgtaggtat

SEQ ID NO: 210204 - DNA, 25 bp, Rattus norvegicus
attgcccaccagtgcctgtaggtat

SEQ ID NO: 210205 - DNA, 25 bp, Rattus norvegicus
attgcccactttcaaccctaagttg

SEQ ID NO: 210206 - DNA, 25 bp, Rattus norvegicus
attgcccactttgaaccctaagttg

SEQ ID NO: 210207 - DNA, 25 bp, Rattus norvegicus
attgcccagacccttgtataggctg

SEQ ID NO: 210208 - DNA, 25 bp, Rattus norvegicus
attgcccagaccgttgtataggctg

SEQ ID NO: 210209 - DNA, 25 bp, Rattus norvegicus
attgcccagcaaaaatgtcaccagg

SEQ ID NO: 210210 - DNA, 25 bp, Rattus norvegicus
attgcccagcaataatgtcaccagg

SEQ ID NO: 210211 - DNA, 25 bp, Rattus norvegicus
attgcccagtgaagtacagtccctt

SEQ ID NO: 210212 - DNA, 25 bp, Rattus norvegicus
attgcccagtgatgtacagtccctt

SEQ ID NO: 210213 - DNA, 25 bp, Rattus norvegicus
attgcccatattacccttaacaggt

SEQ ID NO: 210214 - DNA, 25 bp, Rattus norvegicus
attgcccatatttcccttaacaggt

SEQ ID NO: 210215 - DNA, 25 bp, Rattus norvegicus
attgcccatcccatgtgtgctctga

SEQ ID NO: 210216 - DNA, 25 bp, Rattus norvegicus
attgcccatcccttgtgtgctctga

SEQ ID NO: 210217 - DNA, 25 bp, Rattus norvegicus
attgcccatggcacacacttaaaac

SEQ ID NO: 210218 - DNA, 25 bp, Rattus norvegicus
attgcccatggcatttataagatta

SEQ ID NO: 210219 - DNA, 25 bp, Rattus norvegicus
attgcccatggctcacacttaaaac

SEQ ID NO: 210220 - DNA, 25 bp, Rattus norvegicus
attgcccatggcttttataagatta

SEQ ID NO: 210221 - DNA, 25 bp, Rattus norvegicus
attgcccattgccatgtacagacat

SEQ ID NO: 210222 - DNA, 25 bp, Rattus norvegicus
attgcccattgcgatgtacagacat

SEQ ID NO: 210223 - DNA, 25 bp, Rattus norvegicus
attgccccagagatcattgcttatc

SEQ ID NO: 210224 - DNA, 25 bp, Rattus norvegicus
attgccccagagttcattgcttatc

SEQ ID NO: 210225 - DNA, 25 bp, Rattus norvegicus
attgccccagcgcagagaaatgccc

SEQ ID NO: 210226 - DNA, 25 bp, Rattus norvegicus
attgccccagcggagagaaatgccc

SEQ ID NO: 210227 - DNA, 25 bp, Rattus norvegicus
attgccccaggacttggagctttta

SEQ ID NO: 210228 - DNA, 25 bp, Rattus norvegicus
attgccccaggagttggagctttta

SEQ ID NO: 210229 - DNA, 25 bp, Rattus norvegicus
attgccccctgcaactgcagaaagc

SEQ ID NO: 210230 - DNA, 25 bp, Rattus norvegicus
attgccccctgctactgcagaaagc

SEQ ID NO: 210231 - DNA, 25 bp, Rattus norvegicus
attgcccctaaaactgctacagtga

SEQ ID NO: 210232 - DNA, 25 bp, Rattus norvegicus
attgcccctaaatctgctacagtga

SEQ ID NO: 210233 - DNA, 25 bp, Rattus norvegicus
attgcccctgttactggacttgttg

SEQ ID NO: 210234 - DNA, 25 bp, Rattus norvegicus
attgcccctgtttctggacttgttg

SEQ ID NO: 210235 - DNA, 25 bp, Rattus norvegicus
attgccccttctctctttttaagag

SEQ ID NO: 210236 - DNA, 25 bp, Rattus norvegicus
attgccccttctgtctttttaagag

SEQ ID NO: 210237 - DNA, 25 bp, Rattus norvegicus
attgcccgcaatcagttgttccttt

SEQ ID NO: 210238 - DNA, 25 bp, Rattus norvegicus
attgcccgcaatgagttgttccttt

SEQ ID NO: 210239 - DNA, 25 bp, Rattus norvegicus
attgcccgcgtgcaccccaagaaga

SEQ ID NO: 210240 - DNA, 25 bp, Rattus norvegicus
attgcccgcgtggaccccaagaaga

SEQ ID NO: 210241 - DNA, 25 bp, Rattus norvegicus
attgccctccatcatttaacagact

SEQ ID NO: 210242 - DNA, 25 bp, Rattus norvegicus
attgccctccatgatttaacagact

SEQ ID NO: 210243 - DNA, 25 bp, Rattus norvegicus
attgccctcctcagaggaagtcttg

SEQ ID NO: 210244 - DNA, 25 bp, Rattus norvegicus
attgccctcctccagatatgtggca

SEQ ID NO: 210245 - DNA, 25 bp, Rattus norvegicus
attgccctcctcgagatatgtggca

SEQ ID NO: 210246 - DNA, 25 bp, Rattus norvegicus
attgccctcctctgaggaagtcttg

SEQ ID NO: 210247 - DNA, 25 bp, Rattus norvegicus
attgccctgactcccattttatcaa

SEQ ID NO: 210248 - DNA, 25 bp, Rattus norvegicus
attgccctgactgccattttatcaa

SEQ ID NO: 210249 - DNA, 25 bp, Rattus norvegicus
attgccctgatgactacagtctatg

SEQ ID NO: 210250 - DNA, 25 bp, Rattus norvegicus
attgccctgatgtctacagtctatg

SEQ ID NO: 210251 - DNA, 25 bp, Rattus norvegicus
attgccctgctgctactggtctgta

SEQ ID NO: 210252 - DNA, 25 bp, Rattus norvegicus
attgccctgctggtactggtctgta

SEQ ID NO: 210253 - DNA, 25 bp, Rattus norvegicus
attgccctggacagagcagcaccct

SEQ ID NO: 210254 - DNA, 25 bp, Rattus norvegicus
attgccctggactgagcagcaccct

SEQ ID NO: 210255 - DNA, 25 bp, Rattus norvegicus
attgccctggctcttgtagcagtcc

SEQ ID NO: 210256 - DNA, 25 bp, Rattus norvegicus
attgccctggctgttgtagcagtcc

SEQ ID NO: 210257 - DNA, 25 bp, Rattus norvegicus
attgccctggtacaaaaggccctga

SEQ ID NO: 210258 - DNA, 25 bp, Rattus norvegicus
attgccctggtagaaaaggccctga

SEQ ID NO: 210259 - DNA, 25 bp, Rattus norvegicus
attgcccttaaaaattagacagtta

SEQ ID NO: 210260 - DNA, 25 bp, Rattus norvegicus
attgcccttaaaacttgctttgcgt

SEQ ID NO: 210261 - DNA, 25 bp, Rattus norvegicus
attgcccttaaatattagacagtta

SEQ ID NO: 210262 - DNA, 25 bp, Rattus norvegicus
attgcccttaaatcttgctttgcgt

SEQ ID NO: 210263 - DNA, 25 bp, Rattus norvegicus
attgcccttcctaggagccaggact

SEQ ID NO: 210264 - DNA, 25 bp, Rattus norvegicus
attgcccttccttggagccaggact

SEQ ID NO: 210265 - DNA, 25 bp, Rattus norvegicus
attgcccttgctacagacagttgtg

SEQ ID NO: 210266 - DNA, 25 bp, Rattus norvegicus
attgcccttgctatatgtgccacgt

SEQ ID NO: 210267 - DNA, 25 bp, Rattus norvegicus
attgcccttgcttcagacagttgtg

SEQ ID NO: 210268 - DNA, 25 bp, Rattus norvegicus
attgcccttgctttatgtgccacgt

SEQ ID NO: 210269 - DNA, 25 bp, Rattus norvegicus
attgcccttgtcattcttcagatta

SEQ ID NO: 210270 - DNA, 25 bp, Rattus norvegicus
attgcccttgtctttcttcagatta

SEQ ID NO: 210271 - DNA, 25 bp, Rattus norvegicus
attgccctttgcagcgactgacttg

SEQ ID NO: 210272 - DNA, 25 bp, Rattus norvegicus
attgccctttgctgcgactgacttg

SEQ ID NO: 210273 - DNA, 25 bp, Rattus norvegicus
attgccgaagatatcctggagggaa

SEQ ID NO: 210274 - DNA, 25 bp, Rattus norvegicus
attgccgaagatttcctggagggaa

SEQ ID NO: 210275 - DNA, 25 bp, Rattus norvegicus
attgccgaagcaatccactgggtat

SEQ ID NO: 210276 - DNA, 25 bp, Rattus norvegicus
attgccgaagcattccactgggtat

SEQ ID NO: 210277 - DNA, 25 bp, Rattus norvegicus
attgccgaatggatcttttgctgct

SEQ ID NO: 210278 - DNA, 25 bp, Rattus norvegicus
attgccgaatggttcttttgctgct

SEQ ID NO: 210279 - DNA, 25 bp, Rattus norvegicus
attgccgacgcgattttaagtactg

SEQ ID NO: 210280 - DNA, 25 bp, Rattus norvegicus
attgccgacgcgtttttaagtactg

SEQ ID NO: 210281 - DNA, 25 bp, Rattus norvegicus
attgccgactttcatgagctgctct

SEQ ID NO: 210282 - DNA, 25 bp, Rattus norvegicus
attgccgactttgatgagctgctct

SEQ ID NO: 210283 - DNA, 25 bp, Rattus norvegicus
attgccgagagtagaagccccgagt

SEQ ID NO: 210284 - DNA, 25 bp, Rattus norvegicus
attgccgagagttgaagccccgagt

SEQ ID NO: 210285 - DNA, 25 bp, Rattus norvegicus
attgccgcccgtaggaagaatttgc

SEQ ID NO: 210286 - DNA, 25 bp, Rattus norvegicus
attgccgcccgttggaagaatttgc

SEQ ID NO: 210287 - DNA, 25 bp, Rattus norvegicus
attgccgccgtactgcgccttgaag

SEQ ID NO: 210288 - DNA, 25 bp, Rattus norvegicus
attgccgccgtagtgcgccttgaag

SEQ ID NO: 210289 - DNA, 25 bp, Rattus norvegicus
attgccgccttcagttgctttttca

SEQ ID NO: 210290 - DNA, 25 bp, Rattus norvegicus
attgccgccttctgttgctttttca

SEQ ID NO: 210291 - DNA, 25 bp, Rattus norvegicus
attgccggcaatcggtgtctcttgg

SEQ ID NO: 210292 - DNA, 25 bp, Rattus norvegicus
attgccggcaatgggtgtctcttgg

SEQ ID NO: 210293 - DNA, 25 bp, Rattus norvegicus
attgccggcccgagtgtacgttgta

SEQ ID NO: 210294 - DNA, 25 bp, Rattus norvegicus
attgccggcccgtgtgtacgttgta

SEQ ID NO: 210295 - DNA, 25 bp, Rattus norvegicus
attgccgggcacctctggtatacag

SEQ ID NO: 210296 - DNA, 25 bp, Rattus norvegicus
attgccgggcacgtctggtatacag

SEQ ID NO: 210297 - DNA, 25 bp, Rattus norvegicus
attgccgggttaatcttccgcacta

SEQ ID NO: 210298 - DNA, 25 bp, Rattus norvegicus
attgccgggttattcttccgcacta

SEQ ID NO: 210299 - DNA, 25 bp, Rattus norvegicus
attgccgtagctcctcatcagtgag

SEQ ID NO: 210300 - DNA, 25 bp, Rattus norvegicus
attgccgtagctgctcatcagtgag

SEQ ID NO: 210301 - DNA, 25 bp, Rattus norvegicus
attgcctaccatcatctcctagtta

SEQ ID NO: 210302 - DNA, 25 bp, Rattus norvegicus
attgcctaccatgatctcctagtta

SEQ ID NO: 210303 - DNA, 25 bp, Rattus norvegicus
attgcctagcccacaggcagggaaa

SEQ ID NO: 210304 - DNA, 25 bp, Rattus norvegicus
attgcctagccctcaggcagggaaa

SEQ ID NO: 210305 - DNA, 25 bp, Rattus norvegicus
attgcctagctcagtgcggcggagc

SEQ ID NO: 210306 - DNA, 25 bp, Rattus norvegicus
attgcctagctctgtgcggcggagc

SEQ ID NO: 210307 - DNA, 25 bp, Rattus norvegicus
attgcctagtgcagtgcagtcacat

SEQ ID NO: 210308 - DNA, 25 bp, Rattus norvegicus
attgcctagtgctgtgcagtcacat

SEQ ID NO: 210309 - DNA, 25 bp, Rattus norvegicus
attgcctataggcaagcccctgcag

SEQ ID NO: 210310 - DNA, 25 bp, Rattus norvegicus
attgcctatagggaagcccctgcag

SEQ ID NO: 210311 - DNA, 25 bp, Rattus norvegicus
attgcctatggccttcatgaccagg

SEQ ID NO: 210312 - DNA, 25 bp, Rattus norvegicus
attgcctatggcgttcatgaccagg

SEQ ID NO: 210313 - DNA, 25 bp, Rattus norvegicus
attgcctatgtgcatctggttacta

SEQ ID NO: 210314 - DNA, 25 bp, Rattus norvegicus
attgcctatgtggatctggttacta

SEQ ID NO: 210315 - DNA, 25 bp, Rattus norvegicus
attgcctattccagttaagtcctca

SEQ ID NO: 210316 - DNA, 25 bp, Rattus norvegicus
attgcctattcctgttaagtcctca

SEQ ID NO: 210317 - DNA, 25 bp, Rattus norvegicus
attgcctcaaggacagtagttcagt

SEQ ID NO: 210318 - DNA, 25 bp, Rattus norvegicus
attgcctcaaggtcagtagttcagt

SEQ ID NO: 210319 - DNA, 25 bp, Rattus norvegicus
attgcctcagggacgcctgggaagt

SEQ ID NO: 210320 - DNA, 25 bp, Rattus norvegicus
attgcctcagggtcgcctgggaagt

SEQ ID NO: 210321 - DNA, 25 bp, Rattus norvegicus
attgcctccaatcaaagtgacccag

SEQ ID NO: 210322 - DNA, 25 bp, Rattus norvegicus
attgcctccaatgaaagtgacccag

SEQ ID NO: 210323 - DNA, 25 bp, Rattus norvegicus
attgcctccagtcaatgacaaactt

SEQ ID NO: 210324 - DNA, 25 bp, Rattus norvegicus
attgcctccagtgaatgacaaactt

SEQ ID NO: 210325 - DNA, 25 bp, Rattus norvegicus
attgcctcctcacggcttgatttga

SEQ ID NO: 210326 - DNA, 25 bp, Rattus norvegicus
attgcctcctcagggcttgatttga

SEQ ID NO: 210327 - DNA, 25 bp, Rattus norvegicus
attgcctctcaacctagtggttctg

SEQ ID NO: 210328 - DNA, 25 bp, Rattus norvegicus
attgcctctcaagctagtggttctg

SEQ ID NO: 210329 - DNA, 25 bp, Rattus norvegicus
attgcctctgtgcactcagatctgt

SEQ ID NO: 210330 - DNA, 25 bp, Rattus norvegicus
attgcctctgtgctaggattctgcc

SEQ ID NO: 210331 - DNA, 25 bp, Rattus norvegicus
attgcctctgtggactcagatctgt

SEQ ID NO: 210332 - DNA, 25 bp, Rattus norvegicus
attgcctctgtggtaggattctgcc

SEQ ID NO: 210333 - DNA, 25 bp, Rattus norvegicus
attgcctgaagtcttggtactagcc

SEQ ID NO: 210334 - DNA, 25 bp, Rattus norvegicus
attgcctgaagtgttggtactagcc

SEQ ID NO: 210335 - DNA, 25 bp, Rattus norvegicus
attgcctgagccatagaccgtggtc

SEQ ID NO: 210336 - DNA, 25 bp, Rattus norvegicus
attgcctgagccttagaccgtggtc

SEQ ID NO: 210337 - DNA, 25 bp, Rattus norvegicus
attgcctgaggtcagcttacactca

SEQ ID NO: 210338 - DNA, 25 bp, Rattus norvegicus
attgcctgaggtgagcttacactca

SEQ ID NO: 210339 - DNA, 25 bp, Rattus norvegicus
attgcctgcaccatttttttcctta

SEQ ID NO: 210340 - DNA, 25 bp, Rattus norvegicus
attgcctgcaccttttttttcctta

SEQ ID NO: 210341 - DNA, 25 bp, Rattus norvegicus
attgcctgcctcaagaacctgcaga

SEQ ID NO: 210342 - DNA, 25 bp, Rattus norvegicus
attgcctgcctctagaacctgcaga

SEQ ID NO: 210343 - DNA, 25 bp, Rattus norvegicus
attgcctgctacacccaagaaagaa

SEQ ID NO: 210344 - DNA, 25 bp, Rattus norvegicus
attgcctgctactcccaagaaagaa

SEQ ID NO: 210345 - DNA, 25 bp, Rattus norvegicus
attgcctgctatctctccgttagtc

SEQ ID NO: 210346 - DNA, 25 bp, Rattus norvegicus
attgcctgctatgtctccgttagtc

SEQ ID NO: 210347 - DNA, 25 bp, Rattus norvegicus
attgcctgctcaccattgtggtcaa

SEQ ID NO: 210348 - DNA, 25 bp, Rattus norvegicus
attgcctgctcagcattgtggtcaa

SEQ ID NO: 210349 - DNA, 25 bp, Rattus norvegicus
attgcctgctgaaggtcatggatcg

SEQ ID NO: 210350 - DNA, 25 bp, Rattus norvegicus
attgcctgctgaaggttgaaacact

SEQ ID NO: 210351 - DNA, 25 bp, Rattus norvegicus
attgcctgctgatggtcatggatcg

SEQ ID NO: 210352 - DNA, 25 bp, Rattus norvegicus
attgcctgctgatggttgaaacact

SEQ ID NO: 210353 - DNA, 25 bp, Rattus norvegicus
attgcctgctgcagaaggtcaacca

SEQ ID NO: 210354 - DNA, 25 bp, Rattus norvegicus
attgcctgctgctgaaggtcaacca

SEQ ID NO: 210355 - DNA, 25 bp, Rattus norvegicus
attgcctgctgtagggctcttccag

SEQ ID NO: 210356 - DNA, 25 bp, Rattus norvegicus
attgcctgctgttgggctcttccag

SEQ ID NO: 210357 - DNA, 25 bp, Rattus norvegicus
attgcctgctttatggtatttcctg

SEQ ID NO: 210358 - DNA, 25 bp, Rattus norvegicus
attgcctgctttttggtatttcctg

SEQ ID NO: 210359 - DNA, 25 bp, Rattus norvegicus
attgcctggaaactttgtgtactag

SEQ ID NO: 210360 - DNA, 25 bp, Rattus norvegicus
attgcctggaaagtttgtgtactag

SEQ ID NO: 210361 - DNA, 25 bp, Rattus norvegicus
attgcctggcaaatgctgatatcag

SEQ ID NO: 210362 - DNA, 25 bp, Rattus norvegicus
attgcctggcaattgctgatatcag

SEQ ID NO: 210363 - DNA, 25 bp, Rattus norvegicus
attgcctggctgagggttttgtaaa

SEQ ID NO: 210364 - DNA, 25 bp, Rattus norvegicus
attgcctggctgtgggttttgtaaa

SEQ ID NO: 210365 - DNA, 25 bp, Rattus norvegicus
attgcctgggccagattcaccagac

SEQ ID NO: 210366 - DNA, 25 bp, Rattus norvegicus
attgcctgggcctgattcaccagac

SEQ ID NO: 210367 - DNA, 25 bp, Rattus norvegicus
attgcctgtagactggttaagccat

SEQ ID NO: 210368 - DNA, 25 bp, Rattus norvegicus
attgcctgtagagtggttaagccat

SEQ ID NO: 210369 - DNA, 25 bp, Rattus norvegicus
attgcctgtattactacctctagta

SEQ ID NO: 210370 - DNA, 25 bp, Rattus norvegicus
attgcctgtattagataaccatgac

SEQ ID NO: 210371 - DNA, 25 bp, Rattus norvegicus
attgcctgtatttctacctctagta

SEQ ID NO: 210372 - DNA, 25 bp, Rattus norvegicus
attgcctgtatttgataaccatgac

SEQ ID NO: 210373 - DNA, 25 bp, Rattus norvegicus
attgcctgtctcagctagtctgaat

SEQ ID NO: 210374 - DNA, 25 bp, Rattus norvegicus
attgcctgtctctgctagtctgaat

SEQ ID NO: 210375 - DNA, 25 bp, Rattus norvegicus
attgcctgttagctaaatccctgtt

SEQ ID NO: 210376 - DNA, 25 bp, Rattus norvegicus
attgcctgttaggtaaatccctgtt

SEQ ID NO: 210377 - DNA, 25 bp, Rattus norvegicus
attgccttaataactgtatctggtt

SEQ ID NO: 210378 - DNA, 25 bp, Rattus norvegicus
attgccttaatatctgtatctggtt

SEQ ID NO: 210379 - DNA, 25 bp, Rattus norvegicus
attgccttaatgactcttaaccctg

SEQ ID NO: 210380 - DNA, 25 bp, Rattus norvegicus
attgccttaatgtctcttaaccctg

SEQ ID NO: 210381 - DNA, 25 bp, Rattus norvegicus
attgccttacctcttccttatagaa

SEQ ID NO: 210382 - DNA, 25 bp, Rattus norvegicus
attgccttacctgttccttatagaa

SEQ ID NO: 210383 - DNA, 25 bp, Rattus norvegicus
attgccttcaacatgtacacgccag

SEQ ID NO: 210384 - DNA, 25 bp, Rattus norvegicus
attgccttcaacttgtacacgccag

SEQ ID NO: 210385 - DNA, 25 bp, Rattus norvegicus
attgccttcactacatgtttttggg

SEQ ID NO: 210386 - DNA, 25 bp, Rattus norvegicus
attgccttcacttcatgtttttggg

SEQ ID NO: 210387 - DNA, 25 bp, Rattus norvegicus
attgccttcaggctaaatgatccac

SEQ ID NO: 210388 - DNA, 25 bp, Rattus norvegicus
attgccttcagggtaaatgatccac

SEQ ID NO: 210389 - DNA, 25 bp, Rattus norvegicus
attgccttcatgctgtagggttctg

SEQ ID NO: 210390 - DNA, 25 bp, Rattus norvegicus
attgccttcatggtgtagggttctg

SEQ ID NO: 210391 - DNA, 25 bp, Rattus norvegicus
attgccttcctgatctaaccaatag

SEQ ID NO: 210392 - DNA, 25 bp, Rattus norvegicus
attgccttcctgttctaaccaatag

SEQ ID NO: 210393 - DNA, 25 bp, Rattus norvegicus
attgccttgagaagaccacctttgg

SEQ ID NO: 210394 - DNA, 25 bp, Rattus norvegicus
attgccttgagatgaccacctttgg

SEQ ID NO: 210395 - DNA, 25 bp, Rattus norvegicus
attgccttgggcagacaactacatt

SEQ ID NO: 210396 - DNA, 25 bp, Rattus norvegicus
attgccttgggctgacaactacatt

SEQ ID NO: 210397 - DNA, 25 bp, Rattus norvegicus
attgccttgttgaagtagtctcact

SEQ ID NO: 210398 - DNA, 25 bp, Rattus norvegicus
attgccttgttgtagtagtctcact

SEQ ID NO: 210399 - DNA, 25 bp, Rattus norvegicus
attgcctttacaatgcttagtcttg

SEQ ID NO: 210400 - DNA, 25 bp, Rattus norvegicus
attgcctttacattgcttagtcttg

SEQ ID NO: 210401 - DNA, 25 bp, Rattus norvegicus
attgcctttgaaaaactatcgctcc

SEQ ID NO: 210402 - DNA, 25 bp, Rattus norvegicus
attgcctttgaataactatcgctcc

SEQ ID NO: 210403 - DNA, 25 bp, Rattus norvegicus
attgcctttgccactcagaagacct

SEQ ID NO: 210404 - DNA, 25 bp, Rattus norvegicus
attgcctttgcctctcagaagacct

SEQ ID NO: 210405 - DNA, 25 bp, Rattus norvegicus
attgcctttgttctgtatgcctaaa

SEQ ID NO: 210406 - DNA, 25 bp, Rattus norvegicus
attgcctttgttgtgtatgcctaaa

SEQ ID NO: 210407 - DNA, 25 bp, Rattus norvegicus
attgccttttaccacctgggcgatt

SEQ ID NO: 210408 - DNA, 25 bp, Rattus norvegicus
attgccttttacgacctgggcgatt

SEQ ID NO: 210409 - DNA, 25 bp, Rattus norvegicus
attgcctttttgagataagtgccca

SEQ ID NO: 210410 - DNA, 25 bp, Rattus norvegicus
attgcctttttgtgataagtgccca

SEQ ID NO: 210411 - DNA, 25 bp, Rattus norvegicus
attgcgaacaaactccatcctgtgc

SEQ ID NO: 210412 - DNA, 25 bp, Rattus norvegicus
attgcgaacaaagtccatcctgtgc

SEQ ID NO: 210413 - DNA, 25 bp, Rattus norvegicus
attgcgaagtgaatctgcccctcca

SEQ ID NO: 210414 - DNA, 25 bp, Rattus norvegicus
attgcgaagtgattctgcccctcca

SEQ ID NO: 210415 - DNA, 25 bp, Rattus norvegicus
attgcgacacatccctacatagtgg

SEQ ID NO: 210416 - DNA, 25 bp, Rattus norvegicus
attgcgacacatgcctacatagtgg

SEQ ID NO: 210417 - DNA, 25 bp, Rattus norvegicus
attgcgagccaaacggaccagtgat

SEQ ID NO: 210418 - DNA, 25 bp, Rattus norvegicus
attgcgagccaatcggaccagtgat

SEQ ID NO: 210419 - DNA, 25 bp, Rattus norvegicus
attgcgaggctgcaaggcactgtcc

SEQ ID NO: 210420 - DNA, 25 bp, Rattus norvegicus
attgcgaggctggaaggcactgtcc

SEQ ID NO: 210421 - DNA, 25 bp, Rattus norvegicus
attgcgattctaagcacacctcttc

SEQ ID NO: 210422 - DNA, 25 bp, Rattus norvegicus
attgcgattctatgcacacctcttc

SEQ ID NO: 210423 - DNA, 25 bp, Rattus norvegicus
attgcgcaatgccataaatttcttc

SEQ ID NO: 210424 - DNA, 25 bp, Rattus norvegicus
attgcgcaatgcgataaatttcttc

SEQ ID NO: 210425 - DNA, 25 bp, Rattus norvegicus
attgcgcaattactttcctttatga

SEQ ID NO: 210426 - DNA, 25 bp, Rattus norvegicus
attgcgcaattagtttcctttatga

SEQ ID NO: 210427 - DNA, 25 bp, Rattus norvegicus
attgcgcagcctcaacagggtcaga

SEQ ID NO: 210428 - DNA, 25 bp, Rattus norvegicus
attgcgcagcctgaacagggtcaga

SEQ ID NO: 210429 - DNA, 25 bp, Rattus norvegicus
attgcgcatttcattcagtcatctc

SEQ ID NO: 210430 - DNA, 25 bp, Rattus norvegicus
attgcgcatttctttcagtcatctc

SEQ ID NO: 210431 - DNA, 25 bp, Rattus norvegicus
attgcgccacggagccacctgttgg

SEQ ID NO: 210432 - DNA, 25 bp, Rattus norvegicus
attgcgccacggtgccacctgttgg

SEQ ID NO: 210433 - DNA, 25 bp, Rattus norvegicus
attgcgcctccacgaattagctttg

SEQ ID NO: 210434 - DNA, 25 bp, Rattus norvegicus
attgcgcctccaggaattagctttg

SEQ ID NO: 210435 - DNA, 25 bp, Rattus norvegicus
attgcggagcctctacgccagaaga

SEQ ID NO: 210436 - DNA, 25 bp, Rattus norvegicus
attgcggagcctgtacgccagaaga

SEQ ID NO: 210437 - DNA, 25 bp, Rattus norvegicus
attgcggatgtgatcattgaagcta

SEQ ID NO: 210438 - DNA, 25 bp, Rattus norvegicus
attgcggatgtgttcattgaagcta

SEQ ID NO: 210439 - DNA, 25 bp, Rattus norvegicus
attgcggctatccagcgtgacgctg

SEQ ID NO: 210440 - DNA, 25 bp, Rattus norvegicus
attgcggctatcgagcgtgacgctg

SEQ ID NO: 210441 - DNA, 25 bp, Rattus norvegicus
attgcggctttcaggctgttttgtc

SEQ ID NO: 210442 - DNA, 25 bp, Rattus norvegicus
attgcggctttctggctgttttgtc

SEQ ID NO: 210443 - DNA, 25 bp, Rattus norvegicus
attgcggtaggaaggcttcacctcg

SEQ ID NO: 210444 - DNA, 25 bp, Rattus norvegicus
attgcggtaggatggcttcacctcg

SEQ ID NO: 210445 - DNA, 25 bp, Rattus norvegicus
attgcgtacagcatccgaggacagc

SEQ ID NO: 210446 - DNA, 25 bp, Rattus norvegicus
attgcgtacagcttccgaggacagc

SEQ ID NO: 210447 - DNA, 25 bp, Rattus norvegicus
attgcgtactggctcagactcatgc

SEQ ID NO: 210448 - DNA, 25 bp, Rattus norvegicus
attgcgtactgggtcagactcatgc

SEQ ID NO: 210449 - DNA, 25 bp, Rattus norvegicus
attgcgttctccatggtaaaccctg

SEQ ID NO: 210450 - DNA, 25 bp, Rattus norvegicus
attgcgttctccttggtaaaccctg

SEQ ID NO: 210451 - DNA, 25 bp, Rattus norvegicus
attgcgttgatccagtcacgggttc

SEQ ID NO: 210452 - DNA, 25 bp, Rattus norvegicus
attgcgttgatcgagtcacgggttc

SEQ ID NO: 210453 - DNA, 25 bp, Rattus norvegicus
attgcgttgccaccttgtgtctgtc

SEQ ID NO: 210454 - DNA, 25 bp, Rattus norvegicus
attgcgttgccagcttgtgtctgtc

SEQ ID NO: 210455 - DNA, 25 bp, Rattus norvegicus
attgctaaaacacttgctacccttc

SEQ ID NO: 210456 - DNA, 25 bp, Rattus norvegicus
attgctaaaacagttgctacccttc

SEQ ID NO: 210457 - DNA, 25 bp, Rattus norvegicus
attgctaacacacctcttggttcta

SEQ ID NO: 210458 - DNA, 25 bp, Rattus norvegicus
attgctaacacagctcttggttcta

SEQ ID NO: 210459 - DNA, 25 bp, Rattus norvegicus
attgctaacaccactgagccactat

SEQ ID NO: 210460 - DNA, 25 bp, Rattus norvegicus
attgctaacacctctgagccactat

SEQ ID NO: 210461 - DNA, 25 bp, Rattus norvegicus
attgctaaccagacccttggagctg

SEQ ID NO: 210462 - DNA, 25 bp, Rattus norvegicus
attgctaaccagtcccttggagctg

SEQ ID NO: 210463 - DNA, 25 bp, Rattus norvegicus
attgctacacccaaacagttactgc

SEQ ID NO: 210464 - DNA, 25 bp, Rattus norvegicus
attgctacaccctaacagttactgc

SEQ ID NO: 210465 - DNA, 25 bp, Rattus norvegicus
attgctacacttagccaccaagaaa

SEQ ID NO: 210466 - DNA, 25 bp, Rattus norvegicus
attgctacactttgccaccaagaaa

SEQ ID NO: 210467 - DNA, 25 bp, Rattus norvegicus
attgctacctccaggagatttccag

SEQ ID NO: 210468 - DNA, 25 bp, Rattus norvegicus
attgctacctcctggagatttccag

SEQ ID NO: 210469 - DNA, 25 bp, Rattus norvegicus
attgctacggaaccctgccagagga

SEQ ID NO: 210470 - DNA, 25 bp, Rattus norvegicus
attgctacggaagcctgccagagga

SEQ ID NO: 210471 - DNA, 25 bp, Rattus norvegicus
attgctacgtcacgcttacttcaaa

SEQ ID NO: 210472 - DNA, 25 bp, Rattus norvegicus
attgctacgtcaggcttacttcaaa

SEQ ID NO: 210473 - DNA, 25 bp, Rattus norvegicus
attgctactgaaagctaccccaggt

SEQ ID NO: 210474 - DNA, 25 bp, Rattus norvegicus
attgctactgaatgctaccccaggt

SEQ ID NO: 210475 - DNA, 25 bp, Rattus norvegicus
attgctactgtaacatcgcgtcata

SEQ ID NO: 210476 - DNA, 25 bp, Rattus norvegicus
attgctactgtatcatcgcgtcata

SEQ ID NO: 210477 - DNA, 25 bp, Rattus norvegicus
attgctacttctaaaccctctggtt

SEQ ID NO: 210478 - DNA, 25 bp, Rattus norvegicus
attgctacttcttaaccctctggtt

SEQ ID NO: 210479 - DNA, 25 bp, Rattus norvegicus
attgctagagagagtgggacctttc

SEQ ID NO: 210480 - DNA, 25 bp, Rattus norvegicus
attgctagagagtgtgggacctttc

SEQ ID NO: 210481 - DNA, 25 bp, Rattus norvegicus
attgctatccacagttcagaacata

SEQ ID NO: 210482 - DNA, 25 bp, Rattus norvegicus
attgctatccactgttcagaacata

SEQ ID NO: 210483 - DNA, 25 bp, Rattus norvegicus
attgctatcgagagctgcttctgac

SEQ ID NO: 210484 - DNA, 25 bp, Rattus norvegicus
attgctatcgagtgctgcttctgac

SEQ ID NO: 210485 - DNA, 25 bp, Rattus norvegicus
attgctatctccactttgtctgatt

SEQ ID NO: 210486 - DNA, 25 bp, Rattus norvegicus
attgctatctcctctttgtctgatt

SEQ ID NO: 210487 - DNA, 25 bp, Rattus norvegicus
attgctatgcaaagcctggccagcc

SEQ ID NO: 210488 - DNA, 25 bp, Rattus norvegicus
attgctatgcaatgcctggccagcc

SEQ ID NO: 210489 - DNA, 25 bp, Rattus norvegicus
attgctatgcacagacttgctgcca

SEQ ID NO: 210490 - DNA, 25 bp, Rattus norvegicus
attgctatgcacattatacttgtac

SEQ ID NO: 210491 - DNA, 25 bp, Rattus norvegicus
attgctatgcactgacttgctgcca

SEQ ID NO: 210492 - DNA, 25 bp, Rattus norvegicus
attgctatgcactttatacttgtac

SEQ ID NO: 210493 - DNA, 25 bp, Rattus norvegicus
attgctatggcgcttttccgatagg

SEQ ID NO: 210494 - DNA, 25 bp, Rattus norvegicus
attgctatggcggttttccgatagg

SEQ ID NO: 210495 - DNA, 25 bp, Rattus norvegicus
attgctattatgatggatgctggcc

SEQ ID NO: 210496 - DNA, 25 bp, Rattus norvegicus
attgctattatgttggatgctggcc

SEQ ID NO: 210497 - DNA, 25 bp, Rattus norvegicus
attgctattcaactcctgcttaagg

SEQ ID NO: 210498 - DNA, 25 bp, Rattus norvegicus
attgctattcaagtcctgcttaagg

SEQ ID NO: 210499 - DNA, 25 bp, Rattus norvegicus
attgctcaaactatctgctactggg

SEQ ID NO: 210500 - DNA, 25 bp, Rattus norvegicus
attgctcaaactttctgctactggg

SEQ ID NO: 210501 - DNA, 25 bp, Rattus norvegicus
attgctcaaaggaacagtgtgtgct

SEQ ID NO: 210502 - DNA, 25 bp, Rattus norvegicus
attgctcaaaggtacagtgtgtgct

SEQ ID NO: 210503 - DNA, 25 bp, Rattus norvegicus
attgctcaacaacaccatgcgtatt

SEQ ID NO: 210504 - DNA, 25 bp, Rattus norvegicus
attgctcaacaagaccatgcgtatt

SEQ ID NO: 210505 - DNA, 25 bp, Rattus norvegicus
attgctcaaggtcgctttttctaca

SEQ ID NO: 210506 - DNA, 25 bp, Rattus norvegicus
attgctcaaggtggctttttctaca

SEQ ID NO: 210507 - DNA, 25 bp, Rattus norvegicus
attgctcacaatcgttggcctcttt

SEQ ID NO: 210508 - DNA, 25 bp, Rattus norvegicus
attgctcacaatggttggcctcttt

SEQ ID NO: 210509 - DNA, 25 bp, Rattus norvegicus
attgctcaccgcctttggatttgaa

SEQ ID NO: 210510 - DNA, 25 bp, Rattus norvegicus
attgctcaccgcgtttggatttgaa

SEQ ID NO: 210511 - DNA, 25 bp, Rattus norvegicus
attgctcacggtatttaaaactctg

SEQ ID NO: 210512 - DNA, 25 bp, Rattus norvegicus
attgctcacggtttttaaaactctg

SEQ ID NO: 210513 - DNA, 25 bp, Rattus norvegicus
attgctcagcttctacagatccttt

SEQ ID NO: 210514 - DNA, 25 bp, Rattus norvegicus
attgctcagcttgtacagatccttt

SEQ ID NO: 210515 - DNA, 25 bp, Rattus norvegicus
attgctcagggacctccaggaggca

SEQ ID NO: 210516 - DNA, 25 bp, Rattus norvegicus
attgctcagggagctccaggaggca

SEQ ID NO: 210517 - DNA, 25 bp, Rattus norvegicus
attgctcagtccacgtcaaagatgg

SEQ ID NO: 210518 - DNA, 25 bp, Rattus norvegicus
attgctcagtcctcgtcaaagatgg

SEQ ID NO: 210519 - DNA, 25 bp, Rattus norvegicus
attgctcatgagaacacctgccctg

SEQ ID NO: 210520 - DNA, 25 bp, Rattus norvegicus
attgctcatgagtacacctgccctg

SEQ ID NO: 210521 - DNA, 25 bp, Rattus norvegicus
attgctcattttacaccctcattaa

SEQ ID NO: 210522 - DNA, 25 bp, Rattus norvegicus
attgctcatttttcaccctcattaa

SEQ ID NO: 210523 - DNA, 25 bp, Rattus norvegicus
attgctccaatcctccctttaattt

SEQ ID NO: 210524 - DNA, 25 bp, Rattus norvegicus
attgctccaatcgtccctttaattt

SEQ ID NO: 210525 - DNA, 25 bp, Rattus norvegicus
attgctccaattctcaaggccatca

SEQ ID NO: 210526 - DNA, 25 bp, Rattus norvegicus
attgctccaattgtcaaggccatca

SEQ ID NO: 210527 - DNA, 25 bp, Rattus norvegicus
attgctccagaaaagagatccattc

SEQ ID NO: 210528 - DNA, 25 bp, Rattus norvegicus
attgctccagaaccgtcatggtcag

SEQ ID NO: 210529 - DNA, 25 bp, Rattus norvegicus
attgctccagaagcgtcatggtcag

SEQ ID NO: 210530 - DNA, 25 bp, Rattus norvegicus
attgctccagaatagagatccattc

SEQ ID NO: 210531 - DNA, 25 bp, Rattus norvegicus
attgctccagctacagagactaagg

SEQ ID NO: 210532 - DNA, 25 bp, Rattus norvegicus
attgctccagcttcagagactaagg

SEQ ID NO: 210533 - DNA, 25 bp, Rattus norvegicus
attgctccaggaacgctctttataa

SEQ ID NO: 210534 - DNA, 25 bp, Rattus norvegicus
attgctccaggatcgctctttataa

SEQ ID NO: 210535 - DNA, 25 bp, Rattus norvegicus
attgctcccagtccctggcaggtgc

SEQ ID NO: 210536 - DNA, 25 bp, Rattus norvegicus
attgctcccagtgcctggcaggtgc

SEQ ID NO: 210537 - DNA, 25 bp, Rattus norvegicus
attgctccctccaccaaaaatggaa

SEQ ID NO: 210538 - DNA, 25 bp, Rattus norvegicus
attgctccctcctccaaaaatggaa

SEQ ID NO: 210539 - DNA, 25 bp, Rattus norvegicus
attgctcctctgaacaagtgcctac

SEQ ID NO: 210540 - DNA, 25 bp, Rattus norvegicus
attgctcctctgtacaagtgcctac

SEQ ID NO: 210541 - DNA, 25 bp, Rattus norvegicus
attgctcctgagaagttccctgtaa

SEQ ID NO: 210542 - DNA, 25 bp, Rattus norvegicus
attgctcctgagaggaacgagccct

SEQ ID NO: 210543 - DNA, 25 bp, Rattus norvegicus
attgctcctgagtagttccctgtaa

SEQ ID NO: 210544 - DNA, 25 bp, Rattus norvegicus
attgctcctgagtggaacgagccct

SEQ ID NO: 210545 - DNA, 25 bp, Rattus norvegicus
attgctcctttgacagctgcctggt

SEQ ID NO: 210546 - DNA, 25 bp, Rattus norvegicus
attgctcctttgtcagctgcctggt

SEQ ID NO: 210547 - DNA, 25 bp, Rattus norvegicus
attgctcgaatcaccagatgccagc

SEQ ID NO: 210548 - DNA, 25 bp, Rattus norvegicus
attgctcgaatctccagatgccagc

SEQ ID NO: 210549 - DNA, 25 bp, Rattus norvegicus
attgctcgagatctggctcctatag

SEQ ID NO: 210550 - DNA, 25 bp, Rattus norvegicus
attgctcgagatgtggctcctatag

SEQ ID NO: 210551 - DNA, 25 bp, Rattus norvegicus
attgctcgctgcaccctatgggaat

SEQ ID NO: 210552 - DNA, 25 bp, Rattus norvegicus
attgctcgctgctccctatgggaat

SEQ ID NO: 210553 - DNA, 25 bp, Rattus norvegicus
attgctcgcttcatatttttgccca

SEQ ID NO: 210554 - DNA, 25 bp, Rattus norvegicus
attgctcgcttcttatttttgccca

SEQ ID NO: 210555 - DNA, 25 bp, Rattus norvegicus
attgctcgctttccttggaaggttt

SEQ ID NO: 210556 - DNA, 25 bp, Rattus norvegicus
attgctcgctttgcttggaaggttt

SEQ ID NO: 210557 - DNA, 25 bp, Rattus norvegicus
attgctcggatccacgacatctacg

SEQ ID NO: 210558 - DNA, 25 bp, Rattus norvegicus
attgctcggatcgacgacatctacg

SEQ ID NO: 210559 - DNA, 25 bp, Rattus norvegicus
attgctcgtggcactaagttgtaaa

SEQ ID NO: 210560 - DNA, 25 bp, Rattus norvegicus
attgctcgtggctctaagttgtaaa

SEQ ID NO: 210561 - DNA, 25 bp, Rattus norvegicus
attgctctaggaaatgaccgccagg

SEQ ID NO: 210562 - DNA, 25 bp, Rattus norvegicus
attgctctaggatatgaccgccagg

SEQ ID NO: 210563 - DNA, 25 bp, Rattus norvegicus
attgctctatcaacacccagagact

SEQ ID NO: 210564 - DNA, 25 bp, Rattus norvegicus
attgctctatcatcacccagagact

SEQ ID NO: 210565 - DNA, 25 bp, Rattus norvegicus
attgctctatggatccttttactgg

SEQ ID NO: 210566 - DNA, 25 bp, Rattus norvegicus
attgctctatggttccttttactgg

SEQ ID NO: 210567 - DNA, 25 bp, Rattus norvegicus
attgctctcaatcacaacattgtga

SEQ ID NO: 210568 - DNA, 25 bp, Rattus norvegicus
attgctctcaatgacaacattgtga

SEQ ID NO: 210569 - DNA, 25 bp, Rattus norvegicus
attgctctccctcaatctgattgag

SEQ ID NO: 210570 - DNA, 25 bp, Rattus norvegicus
attgctctccctgaatctgattgag

SEQ ID NO: 210571 - DNA, 25 bp, Rattus norvegicus
attgctctcctaatagcttgtgctg

SEQ ID NO: 210572 - DNA, 25 bp, Rattus norvegicus
attgctctcctattagcttgtgctg

SEQ ID NO: 210573 - DNA, 25 bp, Rattus norvegicus
attgctctctcaaagccatgcgttt

SEQ ID NO: 210574 - DNA, 25 bp, Rattus norvegicus
attgctctctcatagccatgcgttt

SEQ ID NO: 210575 - DNA, 25 bp, Rattus norvegicus
attgctctctctacaagggtgcggc

SEQ ID NO: 210576 - DNA, 25 bp, Rattus norvegicus
attgctctctcttcaagggtgcggc

SEQ ID NO: 210577 - DNA, 25 bp, Rattus norvegicus
attgctctctgtagtctgctcacaa

SEQ ID NO: 210578 - DNA, 25 bp, Rattus norvegicus
attgctctctgttgtctgctcacaa

SEQ ID NO: 210579 - DNA, 25 bp, Rattus norvegicus
attgctctgagcatgtcctaaaaca

SEQ ID NO: 210580 - DNA, 25 bp, Rattus norvegicus
attgctctgagcttgtcctaaaaca

SEQ ID NO: 210581 - DNA, 25 bp, Rattus norvegicus
attgctctgcaaaacaaacaacaac

SEQ ID NO: 210582 - DNA, 25 bp, Rattus norvegicus
attgctctgcaatacaaacaacaac

SEQ ID NO: 210583 - DNA, 25 bp, Rattus norvegicus
attgctctgcagactagtgagcatt

SEQ ID NO: 210584 - DNA, 25 bp, Rattus norvegicus
attgctctgcagtctagtgagcatt

SEQ ID NO: 210585 - DNA, 25 bp, Rattus norvegicus
attgctctgctaatcggctgctggt

SEQ ID NO: 210586 - DNA, 25 bp, Rattus norvegicus
attgctctgctattcggctgctggt

SEQ ID NO: 210587 - DNA, 25 bp, Rattus norvegicus
attgctctgctgacctggagtcaga

SEQ ID NO: 210588 - DNA, 25 bp, Rattus norvegicus
attgctctgctgtcctggagtcaga

SEQ ID NO: 210589 - DNA, 25 bp, Rattus norvegicus
attgctctgtacacacatgctgaga

SEQ ID NO: 210590 - DNA, 25 bp, Rattus norvegicus
attgctctgtactcacatgctgaga

SEQ ID NO: 210591 - DNA, 25 bp, Rattus norvegicus
attgctctgtgccattgagtcctac

SEQ ID NO: 210592 - DNA, 25 bp, Rattus norvegicus
attgctctgtgcgattgagtcctac

SEQ ID NO: 210593 - DNA, 25 bp, Rattus norvegicus
attgctcttatgaagctgcagacac

SEQ ID NO: 210594 - DNA, 25 bp, Rattus norvegicus
attgctcttatgtagctgcagacac

SEQ ID NO: 210595 - DNA, 25 bp, Rattus norvegicus
attgctcttggtcccatgctgagaa

SEQ ID NO: 210596 - DNA, 25 bp, Rattus norvegicus
attgctcttggtgccatgctgagaa

SEQ ID NO: 210597 - DNA, 25 bp, Rattus norvegicus
attgctgaaccccatgctgctggac

SEQ ID NO: 210598 - DNA, 25 bp, Rattus norvegicus
attgctgaacccgatgctgctggac

SEQ ID NO: 210599 - DNA, 25 bp, Rattus norvegicus
attgctgaacgcctgggatgcacac

SEQ ID NO: 210600 - DNA, 25 bp, Rattus norvegicus
attgctgaacgcgtgggatgcacac

SEQ ID NO: 210601 - DNA, 25 bp, Rattus norvegicus
attgctgacaacctgcctgtggcca

SEQ ID NO: 210602 - DNA, 25 bp, Rattus norvegicus
attgctgacaacgtgcctgtggcca

SEQ ID NO: 210603 - DNA, 25 bp, Rattus norvegicus
attgctgacctcaggccaagagctg

SEQ ID NO: 210604 - DNA, 25 bp, Rattus norvegicus
attgctgacctctggccaagagctg

SEQ ID NO: 210605 - DNA, 25 bp, Rattus norvegicus
attgctgagcacacatgtctgtcca

SEQ ID NO: 210606 - DNA, 25 bp, Rattus norvegicus
attgctgagcactcatgtctgtcca

SEQ ID NO: 210607 - DNA, 25 bp, Rattus norvegicus
attgctgagcttccgcgtactaatg

SEQ ID NO: 210608 - DNA, 25 bp, Rattus norvegicus
attgctgagcttgcgcgtactaatg

SEQ ID NO: 210609 - DNA, 25 bp, Rattus norvegicus
attgctgatcttctggtgggactct

SEQ ID NO: 210610 - DNA, 25 bp, Rattus norvegicus
attgctgatcttgtggtgggactct

SEQ ID NO: 210611 - DNA, 25 bp, Rattus norvegicus
attgctgatgtgaagatgctctctg

SEQ ID NO: 210612 - DNA, 25 bp, Rattus norvegicus
attgctgatgtgtagatgctctctg

SEQ ID NO: 210613 - DNA, 25 bp, Rattus norvegicus
attgctgcaactcgcaaacctgccg

SEQ ID NO: 210614 - DNA, 25 bp, Rattus norvegicus
attgctgcaactcgccatgaaacta

SEQ ID NO: 210615 - DNA, 25 bp, Rattus norvegicus
attgctgcaactggcaaacctgccg

SEQ ID NO: 210616 - DNA, 25 bp, Rattus norvegicus
attgctgcaactggccatgaaacta

SEQ ID NO: 210617 - DNA, 25 bp, Rattus norvegicus
attgctgcagcaaaagaggcaacca

SEQ ID NO: 210618 - DNA, 25 bp, Rattus norvegicus
attgctgcagcataagaggcaacca

SEQ ID NO: 210619 - DNA, 25 bp, Rattus norvegicus
attgctgcaggaattctcagtggga

SEQ ID NO: 210620 - DNA, 25 bp, Rattus norvegicus
attgctgcaggatttctcagtggga

SEQ ID NO: 210621 - DNA, 25 bp, Rattus norvegicus
attgctgccaaccacagtgagaagt

SEQ ID NO: 210622 - DNA, 25 bp, Rattus norvegicus
attgctgccaacgacagtgagaagt

SEQ ID NO: 210623 - DNA, 25 bp, Rattus norvegicus
attgctgccagcattttagtcagaa

SEQ ID NO: 210624 - DNA, 25 bp, Rattus norvegicus
attgctgccagctttttagtcagaa

SEQ ID NO: 210625 - DNA, 25 bp, Rattus norvegicus
attgctgccattattcctccaaaaa

SEQ ID NO: 210626 - DNA, 25 bp, Rattus norvegicus
attgctgccatttttcctccaaaaa

SEQ ID NO: 210627 - DNA, 25 bp, Rattus norvegicus
attgctgcccttctgcttagttggc

SEQ ID NO: 210628 - DNA, 25 bp, Rattus norvegicus
attgctgcccttgtgcttagttggc

SEQ ID NO: 210629 - DNA, 25 bp, Rattus norvegicus
attgctgccgaaagccataacactg

SEQ ID NO: 210630 - DNA, 25 bp, Rattus norvegicus
attgctgccgaatgccataacactg

SEQ ID NO: 210631 - DNA, 25 bp, Rattus norvegicus
attgctgccgccacatcagagcctg

SEQ ID NO: 210632 - DNA, 25 bp, Rattus norvegicus
attgctgccgcctcatcagagcctg

SEQ ID NO: 210633 - DNA, 25 bp, Rattus norvegicus
attgctgccgttcaggcttgtagaa

SEQ ID NO: 210634 - DNA, 25 bp, Rattus norvegicus
attgctgccgttgaggcttgtagaa

SEQ ID NO: 210635 - DNA, 25 bp, Rattus norvegicus
attgctgccttcagaaacctgagag

SEQ ID NO: 210636 - DNA, 25 bp, Rattus norvegicus
attgctgccttctgaaacctgagag

SEQ ID NO: 210637 - DNA, 25 bp, Rattus norvegicus
attgctgcgcggctcattgtgaaac

SEQ ID NO: 210638 - DNA, 25 bp, Rattus norvegicus
attgctgcgcgggtcattgtgaaac

SEQ ID NO: 210639 - DNA, 25 bp, Rattus norvegicus
attgctgcggctattgctgctgtca

SEQ ID NO: 210640 - DNA, 25 bp, Rattus norvegicus
attgctgcggcttttgctgctgtca

SEQ ID NO: 210641 - DNA, 25 bp, Rattus norvegicus
attgctgctaccagcgccagatgtc

SEQ ID NO: 210642 - DNA, 25 bp, Rattus norvegicus
attgctgctacctgcgccagatgtc

SEQ ID NO: 210643 - DNA, 25 bp, Rattus norvegicus
attgctgctatgaactttgacctga

SEQ ID NO: 210644 - DNA, 25 bp, Rattus norvegicus
attgctgctatgtactttgacctga

SEQ ID NO: 210645 - DNA, 25 bp, Rattus norvegicus
attgctgctgcgctacagcacgcaa

SEQ ID NO: 210646 - DNA, 25 bp, Rattus norvegicus
attgctgctgcggtacagcacgcaa

SEQ ID NO: 210647 - DNA, 25 bp, Rattus norvegicus
attgctgctgctaccagcgtcagat

SEQ ID NO: 210648 - DNA, 25 bp, Rattus norvegicus
attgctgctgctattgtcgtctccc

SEQ ID NO: 210649 - DNA, 25 bp, Rattus norvegicus
attgctgctgcttccagcgtcagat

SEQ ID NO: 210650 - DNA, 25 bp, Rattus norvegicus
attgctgctgcttttgtcgtctccc

SEQ ID NO: 210651 - DNA, 25 bp, Rattus norvegicus
attgctgctggaagactacactgta

SEQ ID NO: 210652 - DNA, 25 bp, Rattus norvegicus
attgctgctggatgactacactgta

SEQ ID NO: 210653 - DNA, 25 bp, Rattus norvegicus
attgctgctggcaatgggaagtccc

SEQ ID NO: 210654 - DNA, 25 bp, Rattus norvegicus
attgctgctggctatgggaagtccc

SEQ ID NO: 210655 - DNA, 25 bp, Rattus norvegicus
attgctgctggtacacaggtgtcta

SEQ ID NO: 210656 - DNA, 25 bp, Rattus norvegicus
attgctgctggttcacaggtgtcta

SEQ ID NO: 210657 - DNA, 25 bp, Rattus norvegicus
attgctgcttggaactagagccatt

SEQ ID NO: 210658 - DNA, 25 bp, Rattus norvegicus
attgctgcttggtactagagccatt

SEQ ID NO: 210659 - DNA, 25 bp, Rattus norvegicus
attgctggaaccatgctgggtgaga

SEQ ID NO: 210660 - DNA, 25 bp, Rattus norvegicus
attgctggaaccttgctgggtgaga

SEQ ID NO: 210661 - DNA, 25 bp, Rattus norvegicus
attgctggacagatcgaccccatga

SEQ ID NO: 210662 - DNA, 25 bp, Rattus norvegicus
attgctggacagttcgaccccatga

SEQ ID NO: 210663 - DNA, 25 bp, Rattus norvegicus
attgctggagtcagcagcagcctga

SEQ ID NO: 210664 - DNA, 25 bp, Rattus norvegicus
attgctggagtctgcagcagcctga

SEQ ID NO: 210665 - DNA, 25 bp, Rattus norvegicus
attgctggatgcctctgtctagaga

SEQ ID NO: 210666 - DNA, 25 bp, Rattus norvegicus
attgctggatgcgtctgtctagaga

SEQ ID NO: 210667 - DNA, 25 bp, Rattus norvegicus
attgctggcatcatcaaggctcaca

SEQ ID NO: 210668 - DNA, 25 bp, Rattus norvegicus
attgctggcatcttcaaggctcaca

SEQ ID NO: 210669 - DNA, 25 bp, Rattus norvegicus
attgctggcatgaaagctttggctt

SEQ ID NO: 210670 - DNA, 25 bp, Rattus norvegicus
attgctggcatgctgactatggcta

SEQ ID NO: 210671 - DNA, 25 bp, Rattus norvegicus
attgctggcatggtgactatggcta

SEQ ID NO: 210672 - DNA, 25 bp, Rattus norvegicus
attgctggcatgtaagctttggctt

SEQ ID NO: 210673 - DNA, 25 bp, Rattus norvegicus
attgctggcgacaggcgtgccactt

SEQ ID NO: 210674 - DNA, 25 bp, Rattus norvegicus
attgctggcgactggcgtgccactt

SEQ ID NO: 210675 - DNA, 25 bp, Rattus norvegicus
attgctggctacacagtcattttta

SEQ ID NO: 210676 - DNA, 25 bp, Rattus norvegicus
attgctggctactcagtcattttta

SEQ ID NO: 210677 - DNA, 25 bp, Rattus norvegicus
attgctggctgcacataaaaccctc

SEQ ID NO: 210678 - DNA, 25 bp, Rattus norvegicus
attgctggctgctcataaaaccctc

SEQ ID NO: 210679 - DNA, 25 bp, Rattus norvegicus
attgctgggaaaacaactctcgttg

SEQ ID NO: 210680 - DNA, 25 bp, Rattus norvegicus
attgctgggaaatcaactctcgttg

SEQ ID NO: 210681 - DNA, 25 bp, Rattus norvegicus
attgctgggctacatagttggctca

SEQ ID NO: 210682 - DNA, 25 bp, Rattus norvegicus
attgctgggctagatagttggctca

SEQ ID NO: 210683 - DNA, 25 bp, Rattus norvegicus
attgctggtaatcccttgctatgta

SEQ ID NO: 210684 - DNA, 25 bp, Rattus norvegicus
attgctggtaatgccttgctatgta

SEQ ID NO: 210685 - DNA, 25 bp, Rattus norvegicus
attgctggtctgagttcctaaacta

SEQ ID NO: 210686 - DNA, 25 bp, Rattus norvegicus
attgctggtctgtgttcctaaacta

SEQ ID NO: 210687 - DNA, 25 bp, Rattus norvegicus
attgctggtgacagcttcagaggac

SEQ ID NO: 210688 - DNA, 25 bp, Rattus norvegicus
attgctggtgactgcttcagaggac

SEQ ID NO: 210689 - DNA, 25 bp, Rattus norvegicus
attgctggttctacatggctatgac

SEQ ID NO: 210690 - DNA, 25 bp, Rattus norvegicus
attgctggttcttcatggctatgac

SEQ ID NO: 210691 - DNA, 25 bp, Rattus norvegicus
attgctggtttaagtacagacttta

SEQ ID NO: 210692 - DNA, 25 bp, Rattus norvegicus
attgctggtttatgtacagacttta

SEQ ID NO: 210693 - DNA, 25 bp, Rattus norvegicus
attgctgtaattactgacatcccaa

SEQ ID NO: 210694 - DNA, 25 bp, Rattus norvegicus
attgctgtaatttctgacatcccaa

SEQ ID NO: 210695 - DNA, 25 bp, Rattus norvegicus
attgctgtacaaataaaggaccctg

SEQ ID NO: 210696 - DNA, 25 bp, Rattus norvegicus
attgctgtacaattaaaggaccctg

SEQ ID NO: 210697 - DNA, 25 bp, Rattus norvegicus
attgctgtactcacataattttgga

SEQ ID NO: 210698 - DNA, 25 bp, Rattus norvegicus
attgctgtactctcataattttgga

SEQ ID NO: 210699 - DNA, 25 bp, Rattus norvegicus
attgctgtagacaaagccacctatt

SEQ ID NO: 210700 - DNA, 25 bp, Rattus norvegicus
attgctgtagactaagccacctatt

SEQ ID NO: 210701 - DNA, 25 bp, Rattus norvegicus
attgctgtagcaacccgtactataa

SEQ ID NO: 210702 - DNA, 25 bp, Rattus norvegicus
attgctgtagcatcccgtactataa

SEQ ID NO: 210703 - DNA, 25 bp, Rattus norvegicus
attgctgtattgataacgtgtgttc

SEQ ID NO: 210704 - DNA, 25 bp, Rattus norvegicus
attgctgtattgttaacgtgtgttc

SEQ ID NO: 210705 - DNA, 25 bp, Rattus norvegicus
attgctgtcagtcggcttgctatga

SEQ ID NO: 210706 - DNA, 25 bp, Rattus norvegicus
attgctgtcagtgggcttgctatga

SEQ ID NO: 210707 - DNA, 25 bp, Rattus norvegicus
attgctgtcccactgatgtggaatc

SEQ ID NO: 210708 - DNA, 25 bp, Rattus norvegicus
attgctgtcccagtgatgtggaatc

SEQ ID NO: 210709 - DNA, 25 bp, Rattus norvegicus
attgctgtcctacctggcgatgaga

SEQ ID NO: 210710 - DNA, 25 bp, Rattus norvegicus
attgctgtcctagctggcgatgaga

SEQ ID NO: 210711 - DNA, 25 bp, Rattus norvegicus
attgctgtcgttaggtgttggatgc

SEQ ID NO: 210712 - DNA, 25 bp, Rattus norvegicus
attgctgtcgtttggtgttggatgc

SEQ ID NO: 210713 - DNA, 25 bp, Rattus norvegicus
attgctgtctgaacgcaccagttag

SEQ ID NO: 210714 - DNA, 25 bp, Rattus norvegicus
attgctgtctgatcgcaccagttag

SEQ ID NO: 210715 - DNA, 25 bp, Rattus norvegicus
attgctgtctgtccagattcctaaa

SEQ ID NO: 210716 - DNA, 25 bp, Rattus norvegicus
attgctgtctgtgcagattcctaaa

SEQ ID NO: 210717 - DNA, 25 bp, Rattus norvegicus
attgctgtgaatacccctgaccaag

SEQ ID NO: 210718 - DNA, 25 bp, Rattus norvegicus
attgctgtgaattcccctgaccaag

SEQ ID NO: 210719 - DNA, 25 bp, Rattus norvegicus
attgctgtgattattatgaccgaga

SEQ ID NO: 210720 - DNA, 25 bp, Rattus norvegicus
attgctgtgatttttatgaccgaga

SEQ ID NO: 210721 - DNA, 25 bp, Rattus norvegicus
attgctgtgcagagtatctttgtta

SEQ ID NO: 210722 - DNA, 25 bp, Rattus norvegicus
attgctgtgcagtgtatctttgtta

SEQ ID NO: 210723 - DNA, 25 bp, Rattus norvegicus
attgctgtgtggattggtgcgctcc

SEQ ID NO: 210724 - DNA, 25 bp, Rattus norvegicus
attgctgtgtggtttggtgcgctcc

SEQ ID NO: 210725 - DNA, 25 bp, Rattus norvegicus
attgctgttacgagttacatccgca

SEQ ID NO: 210726 - DNA, 25 bp, Rattus norvegicus
attgctgttacgtgttacatccgca

SEQ ID NO: 210727 - DNA, 25 bp, Rattus norvegicus
attgctgttgtccagcggatcccaa

SEQ ID NO: 210728 - DNA, 25 bp, Rattus norvegicus
attgctgttgtcgagcggatcccaa

SEQ ID NO: 210729 - DNA, 25 bp, Rattus norvegicus
attgctgtttccaatcactatggag

SEQ ID NO: 210730 - DNA, 25 bp, Rattus norvegicus
attgctgtttcctatcactatggag

SEQ ID NO: 210731 - DNA, 25 bp, Rattus norvegicus
attgctgtttctatatttcctcgta

SEQ ID NO: 210732 - DNA, 25 bp, Rattus norvegicus
attgctgtttctttatttcctcgta

SEQ ID NO: 210733 - DNA, 25 bp, Rattus norvegicus
attgcttaaaatcctgaaccccgtg

SEQ ID NO: 210734 - DNA, 25 bp, Rattus norvegicus
attgcttaaaatgctgaaccccgtg

SEQ ID NO: 210735 - DNA, 25 bp, Rattus norvegicus
attgcttaagaacatttgctgggcc

SEQ ID NO: 210736 - DNA, 25 bp, Rattus norvegicus
attgcttaagaagatttgctgggcc

SEQ ID NO: 210737 - DNA, 25 bp, Rattus norvegicus
attgcttattgtagacttcctgtta

SEQ ID NO: 210738 - DNA, 25 bp, Rattus norvegicus
attgcttattgttgacttcctgtta

SEQ ID NO: 210739 - DNA, 25 bp, Rattus norvegicus
attgcttcacgacaagcccggaaag

SEQ ID NO: 210740 - DNA, 25 bp, Rattus norvegicus
attgcttcacgagaagcccggaaag

SEQ ID NO: 210741 - DNA, 25 bp, Rattus norvegicus
attgcttcactcagccaaagctcag

SEQ ID NO: 210742 - DNA, 25 bp, Rattus norvegicus
attgcttcactctgccaaagctcag

SEQ ID NO: 210743 - DNA, 25 bp, Rattus norvegicus
attgcttcacttatcctcagaagga

SEQ ID NO: 210744 - DNA, 25 bp, Rattus norvegicus
attgcttcacttttcctcagaagga

SEQ ID NO: 210745 - DNA, 25 bp, Rattus norvegicus
attgcttcagtcaagccgttgaggg

SEQ ID NO: 210746 - DNA, 25 bp, Rattus norvegicus
attgcttcagtctagccgttgaggg

SEQ ID NO: 210747 - DNA, 25 bp, Rattus norvegicus
attgcttcagttcgtggatgtccct

SEQ ID NO: 210748 - DNA, 25 bp, Rattus norvegicus
attgcttcagttggtggatgtccct

SEQ ID NO: 210749 - DNA, 25 bp, Rattus norvegicus
attgcttcccctacactgtatttta

SEQ ID NO: 210750 - DNA, 25 bp, Rattus norvegicus
attgcttccccttcactgtatttta

SEQ ID NO: 210751 - DNA, 25 bp, Rattus norvegicus
attgcttccctgatctagtcaaggc

SEQ ID NO: 210752 - DNA, 25 bp, Rattus norvegicus
attgcttccctgcttgttgggccat

SEQ ID NO: 210753 - DNA, 25 bp, Rattus norvegicus
attgcttccctggttgttgggccat

SEQ ID NO: 210754 - DNA, 25 bp, Rattus norvegicus
attgcttccctgttctagtcaaggc

SEQ ID NO: 210755 - DNA, 25 bp, Rattus norvegicus
attgcttccttccagttagaagtgc

SEQ ID NO: 210756 - DNA, 25 bp, Rattus norvegicus
attgcttccttcgagttagaagtgc

SEQ ID NO: 210757 - DNA, 25 bp, Rattus norvegicus
attgcttctccgaatcataataggg

SEQ ID NO: 210758 - DNA, 25 bp, Rattus norvegicus
attgcttctccgtatcataataggg

SEQ ID NO: 210759 - DNA, 25 bp, Rattus norvegicus
attgcttctcggatttgggattcca

SEQ ID NO: 210760 - DNA, 25 bp, Rattus norvegicus
attgcttctcggttttgggattcca

SEQ ID NO: 210761 - DNA, 25 bp, Rattus norvegicus
attgcttctgaccaaaacacccact

SEQ ID NO: 210762 - DNA, 25 bp, Rattus norvegicus
attgcttctgacgaaaacacccact

SEQ ID NO: 210763 - DNA, 25 bp, Rattus norvegicus
attgcttctgagactggcggaggcc

SEQ ID NO: 210764 - DNA, 25 bp, Rattus norvegicus
attgcttctgagtctggcggaggcc

SEQ ID NO: 210765 - DNA, 25 bp, Rattus norvegicus
attgcttctggaaattgcttcccac

SEQ ID NO: 210766 - DNA, 25 bp, Rattus norvegicus
attgcttctggatattgcttcccac

SEQ ID NO: 210767 - DNA, 25 bp, Rattus norvegicus
attgcttctggcctgctttaaatta

SEQ ID NO: 210768 - DNA, 25 bp, Rattus norvegicus
attgcttctggcgtgctttaaatta

SEQ ID NO: 210769 - DNA, 25 bp, Rattus norvegicus
attgcttcttccctttcaggtctca

SEQ ID NO: 210770 - DNA, 25 bp, Rattus norvegicus
attgcttcttccgtttcaggtctca

SEQ ID NO: 210771 - DNA, 25 bp, Rattus norvegicus
attgcttctttaaccagctcagatg

SEQ ID NO: 210772 - DNA, 25 bp, Rattus norvegicus
attgcttctttatccagctcagatg

SEQ ID NO: 210773 - DNA, 25 bp, Rattus norvegicus
attgcttctttcacttttgtgttac

SEQ ID NO: 210774 - DNA, 25 bp, Rattus norvegicus
attgcttctttctcttttgtgttac

SEQ ID NO: 210775 - DNA, 25 bp, Rattus norvegicus
attgcttgattcacttcggaaactg

SEQ ID NO: 210776 - DNA, 25 bp, Rattus norvegicus
attgcttgattctcttcggaaactg

SEQ ID NO: 210777 - DNA, 25 bp, Rattus norvegicus
attgcttgcaccctgaatcttgtga

SEQ ID NO: 210778 - DNA, 25 bp, Rattus norvegicus
attgcttgcaccgtgaatcttgtga

SEQ ID NO: 210779 - DNA, 25 bp, Rattus norvegicus
attgcttgcactcttggagaagccc

SEQ ID NO: 210780 - DNA, 25 bp, Rattus norvegicus
attgcttgcactgttggagaagccc

SEQ ID NO: 210781 - DNA, 25 bp, Rattus norvegicus
attgcttgctaacatgtggctgcct

SEQ ID NO: 210782 - DNA, 25 bp, Rattus norvegicus
attgcttgctaagatgtggctgcct

SEQ ID NO: 210783 - DNA, 25 bp, Rattus norvegicus
attgcttgctttatgagtcgtgtct

SEQ ID NO: 210784 - DNA, 25 bp, Rattus norvegicus
attgcttgctttttgagtcgtgtct

SEQ ID NO: 210785 - DNA, 25 bp, Rattus norvegicus
attgcttggcaactagaccttctct

SEQ ID NO: 210786 - DNA, 25 bp, Rattus norvegicus
attgcttggcaagtagaccttctct

SEQ ID NO: 210787 - DNA, 25 bp, Rattus norvegicus
attgcttggcctcattgtgcagaag

SEQ ID NO: 210788 - DNA, 25 bp, Rattus norvegicus
attgcttggcctgattgtgcagaag

SEQ ID NO: 210789 - DNA, 25 bp, Rattus norvegicus
attgcttggtgccacttcagttcta

SEQ ID NO: 210790 - DNA, 25 bp, Rattus norvegicus
attgcttggtgcgacttcagttcta

SEQ ID NO: 210791 - DNA, 25 bp, Rattus norvegicus
attgcttgtataatggtgctggcca

SEQ ID NO: 210792 - DNA, 25 bp, Rattus norvegicus
attgcttgtatattggtgctggcca

SEQ ID NO: 210793 - DNA, 25 bp, Rattus norvegicus
attgcttgtttgatgccagctttct

SEQ ID NO: 210794 - DNA, 25 bp, Rattus norvegicus
attgcttgtttgttgccagctttct

SEQ ID NO: 210795 - DNA, 25 bp, Rattus norvegicus
attgctttaatcacagcgacacagg

SEQ ID NO: 210796 - DNA, 25 bp, Rattus norvegicus
attgctttaatctcagcgacacagg

SEQ ID NO: 210797 - DNA, 25 bp, Rattus norvegicus
attgctttaggacatatctggacac

SEQ ID NO: 210798 - DNA, 25 bp, Rattus norvegicus
attgctttaggagatatctggacac

SEQ ID NO: 210799 - DNA, 25 bp, Rattus norvegicus
attgctttcagcatgcagaggctct

SEQ ID NO: 210800 - DNA, 25 bp, Rattus norvegicus
attgctttcagcttgcagaggctct

SEQ ID NO: 210801 - DNA, 25 bp, Rattus norvegicus
attgctttcatgatggctgttctca

SEQ ID NO: 210802 - DNA, 25 bp, Rattus norvegicus
attgctttcatgttggctgttctca

SEQ ID NO: 210803 - DNA, 25 bp, Rattus norvegicus
attgctttcctacctttccgtatag

SEQ ID NO: 210804 - DNA, 25 bp, Rattus norvegicus
attgctttcctagctttccgtatag

SEQ ID NO: 210805 - DNA, 25 bp, Rattus norvegicus
attgctttctttagcatcaaactgt

SEQ ID NO: 210806 - DNA, 25 bp, Rattus norvegicus
attgctttcttttgcatcaaactgt

SEQ ID NO: 210807 - DNA, 25 bp, Rattus norvegicus
attgctttgaaccaagcacctcgga

SEQ ID NO: 210808 - DNA, 25 bp, Rattus norvegicus
attgctttgaaccatagtctcctct

SEQ ID NO: 210809 - DNA, 25 bp, Rattus norvegicus
attgctttgaacgaagcacctcgga

SEQ ID NO: 210810 - DNA, 25 bp, Rattus norvegicus
attgctttgaacgatagtctcctct

SEQ ID NO: 210811 - DNA, 25 bp, Rattus norvegicus
attgctttgcccagccattgttttt

SEQ ID NO: 210812 - DNA, 25 bp, Rattus norvegicus
attgctttgccctgccattgttttt

SEQ ID NO: 210813 - DNA, 25 bp, Rattus norvegicus
attgctttgctgatacggtgtttcc

SEQ ID NO: 210814 - DNA, 25 bp, Rattus norvegicus
attgctttgctgttacggtgtttcc

SEQ ID NO: 210815 - DNA, 25 bp, Rattus norvegicus
attgctttgcttacagtcaacacgg

SEQ ID NO: 210816 - DNA, 25 bp, Rattus norvegicus
attgctttgctttcagtcaacacgg

SEQ ID NO: 210817 - DNA, 25 bp, Rattus norvegicus
attgctttgtgtatgtaggcccgac

SEQ ID NO: 210818 - DNA, 25 bp, Rattus norvegicus
attgctttgtgtttgtaggcccgac

SEQ ID NO: 210819 - DNA, 25 bp, Rattus norvegicus
attgctttgttcatctgactgtgct

SEQ ID NO: 210820 - DNA, 25 bp, Rattus norvegicus
attgctttgttcttctgactgtgct

SEQ ID NO: 210821 - DNA, 25 bp, Rattus norvegicus
attgcttttttgatgggagtgatgc

SEQ ID NO: 210822 - DNA, 25 bp, Rattus norvegicus
attgcttttttgttgggagtgatgc

SEQ ID NO: 210823 - DNA, 25 bp, Rattus norvegicus
attggaacacggcaacagctctgaa

SEQ ID NO: 210824 - DNA, 25 bp, Rattus norvegicus
attggaacacgggaacagctctgaa

SEQ ID NO: 210825 - DNA, 25 bp, Rattus norvegicus
attggaacccacaccatctggttgg

SEQ ID NO: 210826 - DNA, 25 bp, Rattus norvegicus
attggaacccactccatctggttgg

SEQ ID NO: 210827 - DNA, 25 bp, Rattus norvegicus
attggaaccttgagatacatgaatt

SEQ ID NO: 210828 - DNA, 25 bp, Rattus norvegicus
attggaaccttgtgatacatgaatt

SEQ ID NO: 210829 - DNA, 25 bp, Rattus norvegicus
attggaacgggtcttcagtcctgca

SEQ ID NO: 210830 - DNA, 25 bp, Rattus norvegicus
attggaacgggtgttcagtcctgca

SEQ ID NO: 210831 - DNA, 25 bp, Rattus norvegicus
attggaacgttgacccacagagctg

SEQ ID NO: 210832 - DNA, 25 bp, Rattus norvegicus
attggaacgttgtcccacagagctg

SEQ ID NO: 210833 - DNA, 25 bp, Rattus norvegicus
attggaactattactgtacctagtg

SEQ ID NO: 210834 - DNA, 25 bp, Rattus norvegicus
attggaactatttctgtacctagtg

SEQ ID NO: 210835 - DNA, 25 bp, Rattus norvegicus
attggaactgccctgccaccttagc

SEQ ID NO: 210836 - DNA, 25 bp, Rattus norvegicus
attggaactgccgtgccaccttagc

SEQ ID NO: 210837 - DNA, 25 bp, Rattus norvegicus
attggaactgttactgtcgagcctc

SEQ ID NO: 210838 - DNA, 25 bp, Rattus norvegicus
attggaactgtttctgtcgagcctc

SEQ ID NO: 210839 - DNA, 25 bp, Rattus norvegicus
attggaagacgcattttccgggtga

SEQ ID NO: 210840 - DNA, 25 bp, Rattus norvegicus
attggaagacgctttttccgggtga

SEQ ID NO: 210841 - DNA, 25 bp, Rattus norvegicus
attggaagagttctggagctcccca

SEQ ID NO: 210842 - DNA, 25 bp, Rattus norvegicus
attggaagagttgtggagctcccca

SEQ ID NO: 210843 - DNA, 25 bp, Rattus norvegicus
attggaagccagctgcaatacctga

SEQ ID NO: 210844 - DNA, 25 bp, Rattus norvegicus
attggaagccaggtgcaatacctga

SEQ ID NO: 210845 - DNA, 25 bp, Rattus norvegicus
attggaagcctcaaggctgagccct

SEQ ID NO: 210846 - DNA, 25 bp, Rattus norvegicus
attggaagcctctaggctgagccct

SEQ ID NO: 210847 - DNA, 25 bp, Rattus norvegicus
attggaagccttctgtattactagt

SEQ ID NO: 210848 - DNA, 25 bp, Rattus norvegicus
attggaagccttgtgtattactagt

SEQ ID NO: 210849 - DNA, 25 bp, Rattus norvegicus
attggaaggcgacacactctatcac

SEQ ID NO: 210850 - DNA, 25 bp, Rattus norvegicus
attggaaggcgagacactctatcac

SEQ ID NO: 210851 - DNA, 25 bp, Rattus norvegicus
attggaaggttcaattcgttcttga

SEQ ID NO: 210852 - DNA, 25 bp, Rattus norvegicus
attggaaggttctattcgttcttga

SEQ ID NO: 210853 - DNA, 25 bp, Rattus norvegicus
attggaagtaaacccatttaagcat

SEQ ID NO: 210854 - DNA, 25 bp, Rattus norvegicus
attggaagtaaagccatttaagcat

SEQ ID NO: 210855 - DNA, 25 bp, Rattus norvegicus
attggaagtcggatggccttcacgc

SEQ ID NO: 210856 - DNA, 25 bp, Rattus norvegicus
attggaagtcggttggccttcacgc

SEQ ID NO: 210857 - DNA, 25 bp, Rattus norvegicus
attggaagtgccaacatactcgtgc

SEQ ID NO: 210858 - DNA, 25 bp, Rattus norvegicus
attggaagtgcctacatactcgtgc

SEQ ID NO: 210859 - DNA, 25 bp, Rattus norvegicus
attggaatcatgagaccatattgtc

SEQ ID NO: 210860 - DNA, 25 bp, Rattus norvegicus
attggaatcatgtgaccatattgtc

SEQ ID NO: 210861 - DNA, 25 bp, Rattus norvegicus
attggaatccggctattgtggcgct

SEQ ID NO: 210862 - DNA, 25 bp, Rattus norvegicus
attggaatccgggtattgtggcgct

SEQ ID NO: 210863 - DNA, 25 bp, Rattus norvegicus
attggaatccttcgaagctggcccc

SEQ ID NO: 210864 - DNA, 25 bp, Rattus norvegicus
attggaatccttggaagctggcccc

SEQ ID NO: 210865 - DNA, 25 bp, Rattus norvegicus
attggaatcgtacccacttctgtgc

SEQ ID NO: 210866 - DNA, 25 bp, Rattus norvegicus
attggaatcgtagccacttctgtgc

SEQ ID NO: 210867 - DNA, 25 bp, Rattus norvegicus
attggaatctgaccatcacgctgga

SEQ ID NO: 210868 - DNA, 25 bp, Rattus norvegicus
attggaatctgagcatcacgctgga

SEQ ID NO: 210869 - DNA, 25 bp, Rattus norvegicus
attggaatcttcacctcagagtgga

SEQ ID NO: 210870 - DNA, 25 bp, Rattus norvegicus
attggaatcttctcctcagagtgga

SEQ ID NO: 210871 - DNA, 25 bp, Rattus norvegicus
attggaatgggcaccacgccgattt

SEQ ID NO: 210872 - DNA, 25 bp, Rattus norvegicus
attggaatgggctccacgccgattt

SEQ ID NO: 210873 - DNA, 25 bp, Rattus norvegicus
attggaatgtctctgtactctactc

SEQ ID NO: 210874 - DNA, 25 bp, Rattus norvegicus
attggaatgtctgtgtactctactc

SEQ ID NO: 210875 - DNA, 25 bp, Rattus norvegicus
attggaattaagagatgatctccag

SEQ ID NO: 210876 - DNA, 25 bp, Rattus norvegicus
attggaattaagtgatgatctccag

SEQ ID NO: 210877 - DNA, 25 bp, Rattus norvegicus
attggaattcccatcgctgctggag

SEQ ID NO: 210878 - DNA, 25 bp, Rattus norvegicus
attggaattcccttcgctgctggag

SEQ ID NO: 210879 - DNA, 25 bp, Rattus norvegicus
attggacaacacaggccagctcagt

SEQ ID NO: 210880 - DNA, 25 bp, Rattus norvegicus
attggacaacactggccagctcagt

SEQ ID NO: 210881 - DNA, 25 bp, Rattus norvegicus
attggacaccttacatgctaccttc

SEQ ID NO: 210882 - DNA, 25 bp, Rattus norvegicus
attggacaccttagacctcagggta

SEQ ID NO: 210883 - DNA, 25 bp, Rattus norvegicus
attggacacctttcatgctaccttc

SEQ ID NO: 210884 - DNA, 25 bp, Rattus norvegicus
attggacacctttgacctcagggta

SEQ ID NO: 210885 - DNA, 25 bp, Rattus norvegicus
attggacactacaagcaaaactata

SEQ ID NO: 210886 - DNA, 25 bp, Rattus norvegicus
attggacactactagcaaaactata

SEQ ID NO: 210887 - DNA, 25 bp, Rattus norvegicus
attggacagacacctgagcctcaga

SEQ ID NO: 210888 - DNA, 25 bp, Rattus norvegicus
attggacagacagctgagcctcaga

SEQ ID NO: 210889 - DNA, 25 bp, Rattus norvegicus
attggacagcacagcccgtgatgag

SEQ ID NO: 210890 - DNA, 25 bp, Rattus norvegicus
attggacagcactgcccgtgatgag

SEQ ID NO: 210891 - DNA, 25 bp, Rattus norvegicus
attggacatctcaccagcggcagcg

SEQ ID NO: 210892 - DNA, 25 bp, Rattus norvegicus
attggacatctctccagcggcagcg

SEQ ID NO: 210893 - DNA, 25 bp, Rattus norvegicus
attggaccaacgcactgtatgaata

SEQ ID NO: 210894 - DNA, 25 bp, Rattus norvegicus
attggaccaacggactgtatgaata

SEQ ID NO: 210895 - DNA, 25 bp, Rattus norvegicus
attggaccagcgaagcctcagtaat

SEQ ID NO: 210896 - DNA, 25 bp, Rattus norvegicus
attggaccagcgtagcctcagtaat

SEQ ID NO: 210897 - DNA, 25 bp, Rattus norvegicus
attggaccccttagtattcacagag

SEQ ID NO: 210898 - DNA, 25 bp, Rattus norvegicus
attggacccctttgtattcacagag

SEQ ID NO: 210899 - DNA, 25 bp, Rattus norvegicus
attggaccgtggcagctaattttgt

SEQ ID NO: 210900 - DNA, 25 bp, Rattus norvegicus
attggaccgtgggagctaattttgt

SEQ ID NO: 210901 - DNA, 25 bp, Rattus norvegicus
attggacctactcaaggccttccat

SEQ ID NO: 210902 - DNA, 25 bp, Rattus norvegicus
attggacctactgaaggccttccat

SEQ ID NO: 210903 - DNA, 25 bp, Rattus norvegicus
attggacctatcatggcttctcgac

SEQ ID NO: 210904 - DNA, 25 bp, Rattus norvegicus
attggacctatcttggcttctcgac

SEQ ID NO: 210905 - DNA, 25 bp, Rattus norvegicus
attggacctgtcacaaagctggcac

SEQ ID NO: 210906 - DNA, 25 bp, Rattus norvegicus
attggacctgtctcaaagctggcac

SEQ ID NO: 210907 - DNA, 25 bp, Rattus norvegicus
attggaccttcaaagctctgtgtat

SEQ ID NO: 210908 - DNA, 25 bp, Rattus norvegicus
attggaccttcatagctctgtgtat

SEQ ID NO: 210909 - DNA, 25 bp, Rattus norvegicus
attggacgtcaaaagtgacaacgca

SEQ ID NO: 210910 - DNA, 25 bp, Rattus norvegicus
attggacgtcaatagtgacaacgca

SEQ ID NO: 210911 - DNA, 25 bp, Rattus norvegicus
attggactatgaacttggaccgcta

SEQ ID NO: 210912 - DNA, 25 bp, Rattus norvegicus
attggactatgatcttggaccgcta

SEQ ID NO: 210913 - DNA, 25 bp, Rattus norvegicus
attggactccatagaggatctggac

SEQ ID NO: 210914 - DNA, 25 bp, Rattus norvegicus
attggactccattgaggatctggac

SEQ ID NO: 210915 - DNA, 25 bp, Rattus norvegicus
attggactctatcaccagcattcag

SEQ ID NO: 210916 - DNA, 25 bp, Rattus norvegicus
attggactctatgaccagcattcag

SEQ ID NO: 210917 - DNA, 25 bp, Rattus norvegicus
attggactctgcaaatgacttgcct

SEQ ID NO: 210918 - DNA, 25 bp, Rattus norvegicus
attggactctgctaatgacttgcct

SEQ ID NO: 210919 - DNA, 25 bp, Rattus norvegicus
attggactggacaggcggccttaga

SEQ ID NO: 210920 - DNA, 25 bp, Rattus norvegicus
attggactggactggcggccttaga

SEQ ID NO: 210921 - DNA, 25 bp, Rattus norvegicus
attggactggcacacgcgaatcttc

SEQ ID NO: 210922 - DNA, 25 bp, Rattus norvegicus
attggactggcagacgcgaatcttc

SEQ ID NO: 210923 - DNA, 25 bp, Rattus norvegicus
attggactgggacccaacgcccttt

SEQ ID NO: 210924 - DNA, 25 bp, Rattus norvegicus
attggactgggagccaacgcccttt

SEQ ID NO: 210925 - DNA, 25 bp, Rattus norvegicus
attggacttaacacgagtagcagta

SEQ ID NO: 210926 - DNA, 25 bp, Rattus norvegicus
attggacttaactcgagtagcagta

SEQ ID NO: 210927 - DNA, 25 bp, Rattus norvegicus
attggacttttgcaattgcccctga

SEQ ID NO: 210928 - DNA, 25 bp, Rattus norvegicus
attggacttttggaattgcccctga

SEQ ID NO: 210929 - DNA, 25 bp, Rattus norvegicus
attggactttttccacagcttcacc

SEQ ID NO: 210930 - DNA, 25 bp, Rattus norvegicus
attggactttttcctgtgtgttcac

SEQ ID NO: 210931 - DNA, 25 bp, Rattus norvegicus
attggactttttgcacagcttcacc

SEQ ID NO: 210932 - DNA, 25 bp, Rattus norvegicus
attggactttttgctgtgtgttcac

SEQ ID NO: 210933 - DNA, 25 bp, Rattus norvegicus
attggagaaatgacttattagtgac

SEQ ID NO: 210934 - DNA, 25 bp, Rattus norvegicus
attggagaaatgtcttattagtgac

SEQ ID NO: 210935 - DNA, 25 bp, Rattus norvegicus
attggagagatgcttcgttcttttc

SEQ ID NO: 210936 - DNA, 25 bp, Rattus norvegicus
attggagagatggttcgttcttttc

SEQ ID NO: 210937 - DNA, 25 bp, Rattus norvegicus
attggagagctcctatttgtcacag

SEQ ID NO: 210938 - DNA, 25 bp, Rattus norvegicus
attggagagctcgtatttgtcacag

SEQ ID NO: 210939 - DNA, 25 bp, Rattus norvegicus
attggagcagcacttacactcggcg

SEQ ID NO: 210940 - DNA, 25 bp, Rattus norvegicus
attggagcagcagttacactcggcg

SEQ ID NO: 210941 - DNA, 25 bp, Rattus norvegicus
attggagcatgtatacggatgacgt

SEQ ID NO: 210942 - DNA, 25 bp, Rattus norvegicus
attggagcatgtttacggatgacgt

SEQ ID NO: 210943 - DNA, 25 bp, Rattus norvegicus
attggagcatttccattcatcagca

SEQ ID NO: 210944 - DNA, 25 bp, Rattus norvegicus
attggagcatttgcattcatcagca

SEQ ID NO: 210945 - DNA, 25 bp, Rattus norvegicus
attggagcccagatgtaacttggta

SEQ ID NO: 210946 - DNA, 25 bp, Rattus norvegicus
attggagcccagttgtaacttggta

SEQ ID NO: 210947 - DNA, 25 bp, Rattus norvegicus
attggagccccactctgtaatctaa

SEQ ID NO: 210948 - DNA, 25 bp, Rattus norvegicus
attggagccccagtctgtaatctaa

SEQ ID NO: 210949 - DNA, 25 bp, Rattus norvegicus
attggagcccctcgtgaggttacat

SEQ ID NO: 210950 - DNA, 25 bp, Rattus norvegicus
attggagcccctctcttcggagaaa

SEQ ID NO: 210951 - DNA, 25 bp, Rattus norvegicus
attggagcccctggtgaggttacat

SEQ ID NO: 210952 - DNA, 25 bp, Rattus norvegicus
attggagcccctgtcttcggagaaa

SEQ ID NO: 210953 - DNA, 25 bp, Rattus norvegicus
attggagccgctcggactggaatta

SEQ ID NO: 210954 - DNA, 25 bp, Rattus norvegicus
attggagccgctgggactggaatta

SEQ ID NO: 210955 - DNA, 25 bp, Rattus norvegicus
attggagccgtcctgaatttcaata

SEQ ID NO: 210956 - DNA, 25 bp, Rattus norvegicus
attggagccgtcgtgaatttcaata

SEQ ID NO: 210957 - DNA, 25 bp, Rattus norvegicus
attggagcctgacctgccggtgtct

SEQ ID NO: 210958 - DNA, 25 bp, Rattus norvegicus
attggagcctgagctgccggtgtct

SEQ ID NO: 210959 - DNA, 25 bp, Rattus norvegicus
attggagcgtctacagaggcgtcct

SEQ ID NO: 210960 - DNA, 25 bp, Rattus norvegicus
attggagcgtcttcagaggcgtcct

SEQ ID NO: 210961 - DNA, 25 bp, Rattus norvegicus
attggagctaccacatctggtcaat

SEQ ID NO: 210962 - DNA, 25 bp, Rattus norvegicus
attggagctacctcatctggtcaat

SEQ ID NO: 210963 - DNA, 25 bp, Rattus norvegicus
attggagcttccagaacccagaata

SEQ ID NO: 210964 - DNA, 25 bp, Rattus norvegicus
attggagcttcctgaacccagaata

SEQ ID NO: 210965 - DNA, 25 bp, Rattus norvegicus
attggaggccacacatggctaaata

SEQ ID NO: 210966 - DNA, 25 bp, Rattus norvegicus
attggaggccacattcccggagctc

SEQ ID NO: 210967 - DNA, 25 bp, Rattus norvegicus
attggaggccactcatggctaaata

SEQ ID NO: 210968 - DNA, 25 bp, Rattus norvegicus
attggaggccactttcccggagctc

SEQ ID NO: 210969 - DNA, 25 bp, Rattus norvegicus
attggaggctacactggcaaccact

SEQ ID NO: 210970 - DNA, 25 bp, Rattus norvegicus
attggaggctactctggcaaccact

SEQ ID NO: 210971 - DNA, 25 bp, Rattus norvegicus
attggaggctgcaatgggacctgat

SEQ ID NO: 210972 - DNA, 25 bp, Rattus norvegicus
attggaggctgctatgggacctgat

SEQ ID NO: 210973 - DNA, 25 bp, Rattus norvegicus
attggagggcaccagacctatgttc

SEQ ID NO: 210974 - DNA, 25 bp, Rattus norvegicus
attggagggcacgagacctatgttc

SEQ ID NO: 210975 - DNA, 25 bp, Rattus norvegicus
attggagtcatcatcaactggaact

SEQ ID NO: 210976 - DNA, 25 bp, Rattus norvegicus
attggagtcatcttcaactggaact

SEQ ID NO: 210977 - DNA, 25 bp, Rattus norvegicus
attggagtcctacagcttccagagt

SEQ ID NO: 210978 - DNA, 25 bp, Rattus norvegicus
attggagtcctagagcttccagagt

SEQ ID NO: 210979 - DNA, 25 bp, Rattus norvegicus
attggagttaacatgcacagttgta

SEQ ID NO: 210980 - DNA, 25 bp, Rattus norvegicus
attggagttaacttgcacagttgta

SEQ ID NO: 210981 - DNA, 25 bp, Rattus norvegicus
attggagttgtcactccccaccact

SEQ ID NO: 210982 - DNA, 25 bp, Rattus norvegicus
attggagttgtctctccccaccact

SEQ ID NO: 210983 - DNA, 25 bp, Rattus norvegicus
attggatccccaagctgctgcacag

SEQ ID NO: 210984 - DNA, 25 bp, Rattus norvegicus
attggatccccatgctgctgcacag

SEQ ID NO: 210985 - DNA, 25 bp, Rattus norvegicus
attggatcctgtctttgctggtggc

SEQ ID NO: 210986 - DNA, 25 bp, Rattus norvegicus
attggatcctgtgtttgctggtggc

SEQ ID NO: 210987 - DNA, 25 bp, Rattus norvegicus
attggatcgcctacctgtagctggg

SEQ ID NO: 210988 - DNA, 25 bp, Rattus norvegicus
attggatcgccttcctgtagctggg

SEQ ID NO: 210989 - DNA, 25 bp, Rattus norvegicus
attggatctcctcagtatctatctc

SEQ ID NO: 210990 - DNA, 25 bp, Rattus norvegicus
attggatctcctgagtatctatctc

SEQ ID NO: 210991 - DNA, 25 bp, Rattus norvegicus
attggatcttcgagatgctgtcctt

SEQ ID NO: 210992 - DNA, 25 bp, Rattus norvegicus
attggatcttcgtgatgctgtcctt

SEQ ID NO: 210993 - DNA, 25 bp, Rattus norvegicus
attggatcttctcggtaggaccgct

SEQ ID NO: 210994 - DNA, 25 bp, Rattus norvegicus
attggatcttctgggtaggaccgct

SEQ ID NO: 210995 - DNA, 25 bp, Rattus norvegicus
attggatgatataccactttcggaa

SEQ ID NO: 210996 - DNA, 25 bp, Rattus norvegicus
attggatgatattccactttcggaa

SEQ ID NO: 210997 - DNA, 25 bp, Rattus norvegicus
attggatggctgaccattctcagct

SEQ ID NO: 210998 - DNA, 25 bp, Rattus norvegicus
attggatggctgtccattctcagct

SEQ ID NO: 210999 - DNA, 25 bp, Rattus norvegicus
attggatgggctctggtcctcccct

SEQ ID NO: 211000 - DNA, 25 bp, Rattus norvegicus
attggatgggctgtggtcctcccct

SEQ ID NO: 211001 - DNA, 25 bp, Rattus norvegicus
attggatggtctattggcttcccac

SEQ ID NO: 211002 - DNA, 25 bp, Rattus norvegicus
attggatggtcttttggcttcccac

SEQ ID NO: 211003 - DNA, 25 bp, Rattus norvegicus
attggatgtcaccaccttacagtaa

SEQ ID NO: 211004 - DNA, 25 bp, Rattus norvegicus
attggatgtcacgaccttacagtaa

SEQ ID NO: 211005 - DNA, 25 bp, Rattus norvegicus
attggatgtgtgcttacttttcctt

SEQ ID NO: 211006 - DNA, 25 bp, Rattus norvegicus
attggatgtgtggttacttttcctt

SEQ ID NO: 211007 - DNA, 25 bp, Rattus norvegicus
attggatgtttcctacagaccgttc

SEQ ID NO: 211008 - DNA, 25 bp, Rattus norvegicus
attggatgtttcgtacagaccgttc

SEQ ID NO: 211009 - DNA, 25 bp, Rattus norvegicus
attggattcctgctcacctgttttg

SEQ ID NO: 211010 - DNA, 25 bp, Rattus norvegicus
attggattcctggtcacctgttttg

SEQ ID NO: 211011 - DNA, 25 bp, Rattus norvegicus
attggattctgcatgatgctatcac

SEQ ID NO: 211012 - DNA, 25 bp, Rattus norvegicus
attggattctgcttgatgctatcac

SEQ ID NO: 211013 - DNA, 25 bp, Rattus norvegicus
attggattgcaaatccctgtcctga

SEQ ID NO: 211014 - DNA, 25 bp, Rattus norvegicus
attggattgcaattccctgtcctga

SEQ ID NO: 211015 - DNA, 25 bp, Rattus norvegicus
attggattgcgcctttgtattataa

SEQ ID NO: 211016 - DNA, 25 bp, Rattus norvegicus
attggattgcgcgtttgtattataa

SEQ ID NO: 211017 - DNA, 25 bp, Rattus norvegicus
attggattgtcccttgggctgaaat

SEQ ID NO: 211018 - DNA, 25 bp, Rattus norvegicus
attggattgtccgttgggctgaaat

SEQ ID NO: 211019 - DNA, 25 bp, Rattus norvegicus
attggatttccgctgtccagaagca

SEQ ID NO: 211020 - DNA, 25 bp, Rattus norvegicus
attggatttccggtgtccagaagca

SEQ ID NO: 211021 - DNA, 25 bp, Rattus norvegicus
attggattttgcaaacgtgagtgta

SEQ ID NO: 211022 - DNA, 25 bp, Rattus norvegicus
attggattttgctaacgtgagtgta

SEQ ID NO: 211023 - DNA, 25 bp, Rattus norvegicus
attggatttttaccagactggcaac

SEQ ID NO: 211024 - DNA, 25 bp, Rattus norvegicus
attggatttttagcagactggcaac

SEQ ID NO: 211025 - DNA, 25 bp, Rattus norvegicus
attggcaaagccactcaccatatgg

SEQ ID NO: 211026 - DNA, 25 bp, Rattus norvegicus
attggcaaagcctctcaccatatgg

SEQ ID NO: 211027 - DNA, 25 bp, Rattus norvegicus
attggcaacagcacggctattcagg

SEQ ID NO: 211028 - DNA, 25 bp, Rattus norvegicus
attggcaacagctcggctattcagg

SEQ ID NO: 211029 - DNA, 25 bp, Rattus norvegicus
attggcaagataactccctggatga

SEQ ID NO: 211030 - DNA, 25 bp, Rattus norvegicus
attggcaagatatctccctggatga

SEQ ID NO: 211031 - DNA, 25 bp, Rattus norvegicus
attggcaagccccacactgtgccat

SEQ ID NO: 211032 - DNA, 25 bp, Rattus norvegicus
attggcaagcccgacactgtgccat

SEQ ID NO: 211033 - DNA, 25 bp, Rattus norvegicus
attggcaattgtatcccagtcttac

SEQ ID NO: 211034 - DNA, 25 bp, Rattus norvegicus
attggcaattgtttcccagtcttac

SEQ ID NO: 211035 - DNA, 25 bp, Rattus norvegicus
attggcacacatcgttaaagaacag

SEQ ID NO: 211036 - DNA, 25 bp, Rattus norvegicus
attggcacacatggttaaagaacag

SEQ ID NO: 211037 - DNA, 25 bp, Rattus norvegicus
attggcacagatctctacctacggc

SEQ ID NO: 211038 - DNA, 25 bp, Rattus norvegicus
attggcacagatgtctacctacggc

SEQ ID NO: 211039 - DNA, 25 bp, Rattus norvegicus
attggcaccaacagtgaacacttta

SEQ ID NO: 211040 - DNA, 25 bp, Rattus norvegicus
attggcaccaactgtgaacacttta

SEQ ID NO: 211041 - DNA, 25 bp, Rattus norvegicus
attggcaccttcattgctgggtctc

SEQ ID NO: 211042 - DNA, 25 bp, Rattus norvegicus
attggcaccttctttgctgggtctc

SEQ ID NO: 211043 - DNA, 25 bp, Rattus norvegicus
attggcacggccatctgtgtgacca

SEQ ID NO: 211044 - DNA, 25 bp, Rattus norvegicus
attggcacggccttctgtgtgacca

SEQ ID NO: 211045 - DNA, 25 bp, Rattus norvegicus
attggcactctacgcccttagaagg

SEQ ID NO: 211046 - DNA, 25 bp, Rattus norvegicus
attggcactctaggcccttagaagg

SEQ ID NO: 211047 - DNA, 25 bp, Rattus norvegicus
attggcagaaccacggccccaggtg

SEQ ID NO: 211048 - DNA, 25 bp, Rattus norvegicus
attggcagaacctcggccccaggtg

SEQ ID NO: 211049 - DNA, 25 bp, Rattus norvegicus
attggcagagagaacagactacatt

SEQ ID NO: 211050 - DNA, 25 bp, Rattus norvegicus
attggcagagagtacagactacatt

SEQ ID NO: 211051 - DNA, 25 bp, Rattus norvegicus
attggcagagctctccacgagttca

SEQ ID NO: 211052 - DNA, 25 bp, Rattus norvegicus
attggcagagctgtccacgagttca

SEQ ID NO: 211053 - DNA, 25 bp, Rattus norvegicus
attggcagcagtatcggaggcctcc

SEQ ID NO: 211054 - DNA, 25 bp, Rattus norvegicus
attggcagcagtttcggaggcctcc

SEQ ID NO: 211055 - DNA, 25 bp, Rattus norvegicus
attggcagccatcggattgcaagct

SEQ ID NO: 211056 - DNA, 25 bp, Rattus norvegicus
attggcagccatgggattgcaagct

SEQ ID NO: 211057 - DNA, 25 bp, Rattus norvegicus
attggcagccgcattgaaactaacg

SEQ ID NO: 211058 - DNA, 25 bp, Rattus norvegicus
attggcagccgctttgaaactaacg

SEQ ID NO: 211059 - DNA, 25 bp, Rattus norvegicus
attggcagcctaagtgaccttagtc

SEQ ID NO: 211060 - DNA, 25 bp, Rattus norvegicus
attggcagcctatgtgaccttagtc

SEQ ID NO: 211061 - DNA, 25 bp, Rattus norvegicus
attggcatcacaaacaagctctctc

SEQ ID NO: 211062 - DNA, 25 bp, Rattus norvegicus
attggcatcacatacaagctctctc

SEQ ID NO: 211063 - DNA, 25 bp, Rattus norvegicus
attggcatcccgatctgtaccaatc

SEQ ID NO: 211064 - DNA, 25 bp, Rattus norvegicus
attggcatcccgttctgtaccaatc

SEQ ID NO: 211065 - DNA, 25 bp, Rattus norvegicus
attggcatcctgcttgtagccctgg

SEQ ID NO: 211066 - DNA, 25 bp, Rattus norvegicus
attggcatcctggttgtagccctgg

SEQ ID NO: 211067 - DNA, 25 bp, Rattus norvegicus
attggcatcgcacacatattactga

SEQ ID NO: 211068 - DNA, 25 bp, Rattus norvegicus
attggcatcgcagacatattactga

SEQ ID NO: 211069 - DNA, 25 bp, Rattus norvegicus
attggcatctatcgcctggatttct

SEQ ID NO: 211070 - DNA, 25 bp, Rattus norvegicus
attggcatctatggcctggatttct

SEQ ID NO: 211071 - DNA, 25 bp, Rattus norvegicus
attggcatcttcactctgctctaca

SEQ ID NO: 211072 - DNA, 25 bp, Rattus norvegicus
attggcatcttctctctgctctaca

SEQ ID NO: 211073 - DNA, 25 bp, Rattus norvegicus
attggcatgctgcttcgcagtacaa

SEQ ID NO: 211074 - DNA, 25 bp, Rattus norvegicus
attggcatgctggttcgcagtacaa

SEQ ID NO: 211075 - DNA, 25 bp, Rattus norvegicus
attggcatgtatcaaccacttggtt

SEQ ID NO: 211076 - DNA, 25 bp, Rattus norvegicus
attggcatgtatgaaccacttggtt

SEQ ID NO: 211077 - DNA, 25 bp, Rattus norvegicus
attggcattaacctggcaaccatga

SEQ ID NO: 211078 - DNA, 25 bp, Rattus norvegicus
attggcattaacgtggcaaccatga

SEQ ID NO: 211079 - DNA, 25 bp, Rattus norvegicus
attggcattggacgtgaccctttta

SEQ ID NO: 211080 - DNA, 25 bp, Rattus norvegicus
attggcattggaggtgaccctttta

SEQ ID NO: 211081 - DNA, 25 bp, Rattus norvegicus
attggcatttacagaggcttgtagt

SEQ ID NO: 211082 - DNA, 25 bp, Rattus norvegicus
attggcatttactgaggcttgtagt

SEQ ID NO: 211083 - DNA, 25 bp, Rattus norvegicus
attggcatttccacaatgtcctaga

SEQ ID NO: 211084 - DNA, 25 bp, Rattus norvegicus
attggcatttcctcaatgtcctaga

SEQ ID NO: 211085 - DNA, 25 bp, Rattus norvegicus
attggccaacaaagccatgctcagg

SEQ ID NO: 211086 - DNA, 25 bp, Rattus norvegicus
attggccaacaatgccatgctcagg

SEQ ID NO: 211087 - DNA, 25 bp, Rattus norvegicus
attggccaagcacgccgtttccgag

SEQ ID NO: 211088 - DNA, 25 bp, Rattus norvegicus
attggccaagcaggccgtttccgag

SEQ ID NO: 211089 - DNA, 25 bp, Rattus norvegicus
attggccaagccacaggccttggaa

SEQ ID NO: 211090 - DNA, 25 bp, Rattus norvegicus
attggccaagcctcaggccttggaa

SEQ ID NO: 211091 - DNA, 25 bp, Rattus norvegicus
attggccaagctcacagtggcgtca

SEQ ID NO: 211092 - DNA, 25 bp, Rattus norvegicus
attggccaagctgacagtggcgtca

SEQ ID NO: 211093 - DNA, 25 bp, Rattus norvegicus
attggccaccaactgtagatgtata

SEQ ID NO: 211094 - DNA, 25 bp, Rattus norvegicus
attggccaccaagtgtagatgtata

SEQ ID NO: 211095 - DNA, 25 bp, Rattus norvegicus
attggccaccagcaggtctttgggt

SEQ ID NO: 211096 - DNA, 25 bp, Rattus norvegicus
attggccaccaggaggtctttgggt

SEQ ID NO: 211097 - DNA, 25 bp, Rattus norvegicus
attggccactgtcttcatcctggag

SEQ ID NO: 211098 - DNA, 25 bp, Rattus norvegicus
attggccactgtgttcatcctggag

SEQ ID NO: 211099 - DNA, 25 bp, Rattus norvegicus
attggccagcataaggagacttcga

SEQ ID NO: 211100 - DNA, 25 bp, Rattus norvegicus
attggccagcattaggagacttcga

SEQ ID NO: 211101 - DNA, 25 bp, Rattus norvegicus
attggccagctcaacagctttctcc

SEQ ID NO: 211102 - DNA, 25 bp, Rattus norvegicus
attggccagctctacagctttctcc

SEQ ID NO: 211103 - DNA, 25 bp, Rattus norvegicus
attggccagtcaatggtgctgtact

SEQ ID NO: 211104 - DNA, 25 bp, Rattus norvegicus
attggccagtcattggtgctgtact

SEQ ID NO: 211105 - DNA, 25 bp, Rattus norvegicus
attggccatagtaacgggtcaacgt

SEQ ID NO: 211106 - DNA, 25 bp, Rattus norvegicus
attggccatagttacgggtcaacgt

SEQ ID NO: 211107 - DNA, 25 bp, Rattus norvegicus
attggccatgatatatccagggact

SEQ ID NO: 211108 - DNA, 25 bp, Rattus norvegicus
attggccatgatttatccagggact

SEQ ID NO: 211109 - DNA, 25 bp, Rattus norvegicus
attggcccaacacgaatggcttcag

SEQ ID NO: 211110 - DNA, 25 bp, Rattus norvegicus
attggcccaacaggaatggcttcag

SEQ ID NO: 211111 - DNA, 25 bp, Rattus norvegicus
attggcccagtccttacttggtaga

SEQ ID NO: 211112 - DNA, 25 bp, Rattus norvegicus
attggcccagtcgttacttggtaga

SEQ ID NO: 211113 - DNA, 25 bp, Rattus norvegicus
attggccccaaaacactgcattgta

SEQ ID NO: 211114 - DNA, 25 bp, Rattus norvegicus
attggccccaaacgacttcacagca

SEQ ID NO: 211115 - DNA, 25 bp, Rattus norvegicus
attggccccaaaggacttcacagca

SEQ ID NO: 211116 - DNA, 25 bp, Rattus norvegicus
attggccccaaatcactgcattgta

SEQ ID NO: 211117 - DNA, 25 bp, Rattus norvegicus
attggccccactatcagaggatgac

SEQ ID NO: 211118 - DNA, 25 bp, Rattus norvegicus
attggccccactttcagaggatgac

SEQ ID NO: 211119 - DNA, 25 bp, Rattus norvegicus
attggccccgctcagacaagtcagg

SEQ ID NO: 211120 - DNA, 25 bp, Rattus norvegicus
attggccccgctgagacaagtcagg

SEQ ID NO: 211121 - DNA, 25 bp, Rattus norvegicus
attggccctcagaagcatcctaggt

SEQ ID NO: 211122 - DNA, 25 bp, Rattus norvegicus
attggccctcagtagcatcctaggt

SEQ ID NO: 211123 - DNA, 25 bp, Rattus norvegicus
attggccctcgacaggctgcctgga

SEQ ID NO: 211124 - DNA, 25 bp, Rattus norvegicus
attggccctcgagaggctgcctgga

SEQ ID NO: 211125 - DNA, 25 bp, Rattus norvegicus
attggccctcttcatttttgtcgtt

SEQ ID NO: 211126 - DNA, 25 bp, Rattus norvegicus
attggccctcttgatttttgtcgtt

SEQ ID NO: 211127 - DNA, 25 bp, Rattus norvegicus
attggccctggacacaatatctttc

SEQ ID NO: 211128 - DNA, 25 bp, Rattus norvegicus
attggccctggagacaatatctttc

SEQ ID NO: 211129 - DNA, 25 bp, Rattus norvegicus
attggccgagatacatcctttattg

SEQ ID NO: 211130 - DNA, 25 bp, Rattus norvegicus
attggccgagattcatcctttattg

SEQ ID NO: 211131 - DNA, 25 bp, Rattus norvegicus
attggccggatccatcaactcggca

SEQ ID NO: 211132 - DNA, 25 bp, Rattus norvegicus
attggccggatcgatcaactcggca

SEQ ID NO: 211133 - DNA, 25 bp, Rattus norvegicus
attggcctagctacttcaagtgttc

SEQ ID NO: 211134 - DNA, 25 bp, Rattus norvegicus
attggcctagcttcttcaagtgttc

SEQ ID NO: 211135 - DNA, 25 bp, Rattus norvegicus
attggcctagtacctgaaacccacc

SEQ ID NO: 211136 - DNA, 25 bp, Rattus norvegicus
attggcctagtagctgaaacccacc

SEQ ID NO: 211137 - DNA, 25 bp, Rattus norvegicus
attggcctatgtagactctcatcag

SEQ ID NO: 211138 - DNA, 25 bp, Rattus norvegicus
attggcctatgttgactctcatcag

SEQ ID NO: 211139 - DNA, 25 bp, Rattus norvegicus
attggcctcagcctttcatagcgga

SEQ ID NO: 211140 - DNA, 25 bp, Rattus norvegicus
attggcctcagcgtttcatagcgga

SEQ ID NO: 211141 - DNA, 25 bp, Rattus norvegicus
attggcctgatgattttctttgtct

SEQ ID NO: 211142 - DNA, 25 bp, Rattus norvegicus
attggcctgatgtttttctttgtct

SEQ ID NO: 211143 - DNA, 25 bp, Rattus norvegicus
attggcctgccactatagtgctttg

SEQ ID NO: 211144 - DNA, 25 bp, Rattus norvegicus
attggcctgccagtatagtgctttg

SEQ ID NO: 211145 - DNA, 25 bp, Rattus norvegicus
attggcctgcccaggaggctggaaa

SEQ ID NO: 211146 - DNA, 25 bp, Rattus norvegicus
attggcctgccctggaggctggaaa

SEQ ID NO: 211147 - DNA, 25 bp, Rattus norvegicus
attggcctggatctggatacttaca

SEQ ID NO: 211148 - DNA, 25 bp, Rattus norvegicus
attggcctggatgtggatacttaca

SEQ ID NO: 211149 - DNA, 25 bp, Rattus norvegicus
attggcctggcaagcataatcgtga

SEQ ID NO: 211150 - DNA, 25 bp, Rattus norvegicus
attggcctggcatgcataatcgtga

SEQ ID NO: 211151 - DNA, 25 bp, Rattus norvegicus
attggcctggccatgtctctgattc

SEQ ID NO: 211152 - DNA, 25 bp, Rattus norvegicus
attggcctggccttgtctctgattc

SEQ ID NO: 211153 - DNA, 25 bp, Rattus norvegicus
attggcctggttccttagtgctaac

SEQ ID NO: 211154 - DNA, 25 bp, Rattus norvegicus
attggcctggttgcttagtgctaac

SEQ ID NO: 211155 - DNA, 25 bp, Rattus norvegicus
attggcctgtgtacagcctttcacc

SEQ ID NO: 211156 - DNA, 25 bp, Rattus norvegicus
attggcctgtgttcagcctttcacc

SEQ ID NO: 211157 - DNA, 25 bp, Rattus norvegicus
attggcctttgacttcagctatgac

SEQ ID NO: 211158 - DNA, 25 bp, Rattus norvegicus
attggcctttgagttcagctatgac

SEQ ID NO: 211159 - DNA, 25 bp, Rattus norvegicus
attggcctttgtcatcagaatccga

SEQ ID NO: 211160 - DNA, 25 bp, Rattus norvegicus
attggcctttgtgatcagaatccga

SEQ ID NO: 211161 - DNA, 25 bp, Rattus norvegicus
attggccttttgacagcagtaacct

SEQ ID NO: 211162 - DNA, 25 bp, Rattus norvegicus
attggccttttgtcagcagtaacct

SEQ ID NO: 211163 - DNA, 25 bp, Rattus norvegicus
attggcgaagcgaggagtctcccag

SEQ ID NO: 211164 - DNA, 25 bp, Rattus norvegicus
attggcgaagcgtggagtctcccag

SEQ ID NO: 211165 - DNA, 25 bp, Rattus norvegicus
attggcgagaacaccggactggtct

SEQ ID NO: 211166 - DNA, 25 bp, Rattus norvegicus
attggcgagaactccggactggtct

SEQ ID NO: 211167 - DNA, 25 bp, Rattus norvegicus
attggcgagtgacctcttcagcttc

SEQ ID NO: 211168 - DNA, 25 bp, Rattus norvegicus
attggcgagtgagctcttcagcttc

SEQ ID NO: 211169 - DNA, 25 bp, Rattus norvegicus
attggcgcaggcagcactgtcaaca

SEQ ID NO: 211170 - DNA, 25 bp, Rattus norvegicus
attggcgcaggctgcactgtcaaca

SEQ ID NO: 211171 - DNA, 25 bp, Rattus norvegicus
attggcgcagtcagtcgtttgggct

SEQ ID NO: 211172 - DNA, 25 bp, Rattus norvegicus
attggcgcagtctgtcgtttgggct

SEQ ID NO: 211173 - DNA, 25 bp, Rattus norvegicus
attggcggaagccaccccagcctta

SEQ ID NO: 211174 - DNA, 25 bp, Rattus norvegicus
attggcggaagcgaccccagcctta

SEQ ID NO: 211175 - DNA, 25 bp, Rattus norvegicus
attggcggccatagaggacttcttc

SEQ ID NO: 211176 - DNA, 25 bp, Rattus norvegicus
attggcggccattgaggacttcttc

SEQ ID NO: 211177 - DNA, 25 bp, Rattus norvegicus
attggcggttggaacccaagcacga

SEQ ID NO: 211178 - DNA, 25 bp, Rattus norvegicus
attggcggttggtacccaagcacga

SEQ ID NO: 211179 - DNA, 25 bp, Rattus norvegicus
attggcggttttatagcctccttga

SEQ ID NO: 211180 - DNA, 25 bp, Rattus norvegicus
attggcggttttttagcctccttga

SEQ ID NO: 211181 - DNA, 25 bp, Rattus norvegicus
attggcgtctttccaaagggtcaca

SEQ ID NO: 211182 - DNA, 25 bp, Rattus norvegicus
attggcgtctttgcaaagggtcaca

SEQ ID NO: 211183 - DNA, 25 bp, Rattus norvegicus
attggcgtggtgcaggctccttaac

SEQ ID NO: 211184 - DNA, 25 bp, Rattus norvegicus
attggcgtggtggaggctccttaac

SEQ ID NO: 211185 - DNA, 25 bp, Rattus norvegicus
attggctacactcccgctgtatggg

SEQ ID NO: 211186 - DNA, 25 bp, Rattus norvegicus
attggctacactgccgctgtatggg

SEQ ID NO: 211187 - DNA, 25 bp, Rattus norvegicus
attggctacatgaatcttccttctt

SEQ ID NO: 211188 - DNA, 25 bp, Rattus norvegicus
attggctacatgtatcttccttctt

SEQ ID NO: 211189 - DNA, 25 bp, Rattus norvegicus
attggctaccagatgctcatgaaga

SEQ ID NO: 211190 - DNA, 25 bp, Rattus norvegicus
attggctaccagttgctcatgaaga

SEQ ID NO: 211191 - DNA, 25 bp, Rattus norvegicus
attggctacggcagctacaggccga

SEQ ID NO: 211192 - DNA, 25 bp, Rattus norvegicus
attggctacggctgctacaggccga

SEQ ID NO: 211193 - DNA, 25 bp, Rattus norvegicus
attggctactttcctctctttgtaa

SEQ ID NO: 211194 - DNA, 25 bp, Rattus norvegicus
attggctactttgctctctttgtaa

SEQ ID NO: 211195 - DNA, 25 bp, Rattus norvegicus
attggctagccaagtttctaatgta

SEQ ID NO: 211196 - DNA, 25 bp, Rattus norvegicus
attggctagccatgtttctaatgta

SEQ ID NO: 211197 - DNA, 25 bp, Rattus norvegicus
attggctaggctagggcgcaaatac

SEQ ID NO: 211198 - DNA, 25 bp, Rattus norvegicus
attggctaggcttgggcgcaaatac

SEQ ID NO: 211199 - DNA, 25 bp, Rattus norvegicus
attggctcacacaaagctctgctga

SEQ ID NO: 211200 - DNA, 25 bp, Rattus norvegicus
attggctcacactaagctctgctga

SEQ ID NO: 211201 - DNA, 25 bp, Rattus norvegicus
attggctcagagcacgctttattag

SEQ ID NO: 211202 - DNA, 25 bp, Rattus norvegicus
attggctcagaggacgctttattag

SEQ ID NO: 211203 - DNA, 25 bp, Rattus norvegicus
attggctcagatcagcttggctggt

SEQ ID NO: 211204 - DNA, 25 bp, Rattus norvegicus
attggctcagatgagcttggctggt

SEQ ID NO: 211205 - DNA, 25 bp, Rattus norvegicus
attggctcccacctggactgtgaga

SEQ ID NO: 211206 - DNA, 25 bp, Rattus norvegicus
attggctcccacgtggactgtgaga

SEQ ID NO: 211207 - DNA, 25 bp, Rattus norvegicus
attggctcctgtaaatcagtgctag

SEQ ID NO: 211208 - DNA, 25 bp, Rattus norvegicus
attggctcctgttaatcagtgctag

SEQ ID NO: 211209 - DNA, 25 bp, Rattus norvegicus
attggctcgtttacccatatctaaa

SEQ ID NO: 211210 - DNA, 25 bp, Rattus norvegicus
attggctcgttttcccatatctaaa

SEQ ID NO: 211211 - DNA, 25 bp, Rattus norvegicus
attggctctattcatacacatgtaa

SEQ ID NO: 211212 - DNA, 25 bp, Rattus norvegicus
attggctctattgatacacatgtaa

SEQ ID NO: 211213 - DNA, 25 bp, Rattus norvegicus
attggctgacgtccctgtatatcat

SEQ ID NO: 211214 - DNA, 25 bp, Rattus norvegicus
attggctgacgtgcctgtatatcat

SEQ ID NO: 211215 - DNA, 25 bp, Rattus norvegicus
attggctgacttagtcgtcactgac

SEQ ID NO: 211216 - DNA, 25 bp, Rattus norvegicus
attggctgactttgtcgtcactgac

SEQ ID NO: 211217 - DNA, 25 bp, Rattus norvegicus
attggctgagaaatgtcattcattt

SEQ ID NO: 211218 - DNA, 25 bp, Rattus norvegicus
attggctgagaattgtcattcattt

SEQ ID NO: 211219 - DNA, 25 bp, Rattus norvegicus
attggctgcaggcttactttagaca

SEQ ID NO: 211220 - DNA, 25 bp, Rattus norvegicus
attggctgcagggttactttagaca

SEQ ID NO: 211221 - DNA, 25 bp, Rattus norvegicus
attggctgcgggagttctgctcaca

SEQ ID NO: 211222 - DNA, 25 bp, Rattus norvegicus
attggctgcgggtgttctgctcaca

SEQ ID NO: 211223 - DNA, 25 bp, Rattus norvegicus
attggctgctgccatggcaactctg

SEQ ID NO: 211224 - DNA, 25 bp, Rattus norvegicus
attggctgctgcgatggcaactctg

SEQ ID NO: 211225 - DNA, 25 bp, Rattus norvegicus
attggctggaatacccagacctagc

SEQ ID NO: 211226 - DNA, 25 bp, Rattus norvegicus
attggctggaattcccagacctagc

SEQ ID NO: 211227 - DNA, 25 bp, Rattus norvegicus
attggctggttgactttttggctcc

SEQ ID NO: 211228 - DNA, 25 bp, Rattus norvegicus
attggctggttgtctttttggctcc

SEQ ID NO: 211229 - DNA, 25 bp, Rattus norvegicus
attggctgtatcacttcccagaatt

SEQ ID NO: 211230 - DNA, 25 bp, Rattus norvegicus
attggctgtatctcttcccagaatt

SEQ ID NO: 211231 - DNA, 25 bp, Rattus norvegicus
attggctgtattacagtcactccag

SEQ ID NO: 211232 - DNA, 25 bp, Rattus norvegicus
attggctgtatttcagtcactccag

SEQ ID NO: 211233 - DNA, 25 bp, Rattus norvegicus
attggctgtcaaactaacttcctga

SEQ ID NO: 211234 - DNA, 25 bp, Rattus norvegicus
attggctgtcaatctaacttcctga

SEQ ID NO: 211235 - DNA, 25 bp, Rattus norvegicus
attggctgtcatagcatcggaccta

SEQ ID NO: 211236 - DNA, 25 bp, Rattus norvegicus
attggctgtcattgcatcggaccta

SEQ ID NO: 211237 - DNA, 25 bp, Rattus norvegicus
attggctgtccactcgatcctgaat

SEQ ID NO: 211238 - DNA, 25 bp, Rattus norvegicus
attggctgtccagtcgatcctgaat

SEQ ID NO: 211239 - DNA, 25 bp, Rattus norvegicus
attggcttagacagctgagccttgc

SEQ ID NO: 211240 - DNA, 25 bp, Rattus norvegicus
attggcttagactgctgagccttgc

SEQ ID NO: 211241 - DNA, 25 bp, Rattus norvegicus
attggcttagcactttctcatatcc

SEQ ID NO: 211242 - DNA, 25 bp, Rattus norvegicus
attggcttagcagtttctcatatcc

SEQ ID NO: 211243 - DNA, 25 bp, Rattus norvegicus
attggcttagtgctgtactcggtgc

SEQ ID NO: 211244 - DNA, 25 bp, Rattus norvegicus
attggcttagtggtgtactcggtgc

SEQ ID NO: 211245 - DNA, 25 bp, Rattus norvegicus
attggcttatgactaacgaccgaaa

SEQ ID NO: 211246 - DNA, 25 bp, Rattus norvegicus
attggcttatgagtaacgaccgaaa

SEQ ID NO: 211247 - DNA, 25 bp, Rattus norvegicus
attggcttcaacctggcagtgctgc

SEQ ID NO: 211248 - DNA, 25 bp, Rattus norvegicus
attggcttcaacgtggcagtgctgc

SEQ ID NO: 211249 - DNA, 25 bp, Rattus norvegicus
attggcttcagcactctcagagtta

SEQ ID NO: 211250 - DNA, 25 bp, Rattus norvegicus
attggcttcagctctctcagagtta

SEQ ID NO: 211251 - DNA, 25 bp, Rattus norvegicus
attggcttgaccatgcgcaggcaag

SEQ ID NO: 211252 - DNA, 25 bp, Rattus norvegicus
attggcttgaccttgcgcaggcaag

SEQ ID NO: 211253 - DNA, 25 bp, Rattus norvegicus
attggcttgagtagcctatgctggc

SEQ ID NO: 211254 - DNA, 25 bp, Rattus norvegicus
attggcttgagttgcctatgctggc

SEQ ID NO: 211255 - DNA, 25 bp, Rattus norvegicus
attggcttggctagctatggttacc

SEQ ID NO: 211256 - DNA, 25 bp, Rattus norvegicus
attggcttggcttgctatggttacc

SEQ ID NO: 211257 - DNA, 25 bp, Rattus norvegicus
attggcttggtcattggccctagga

SEQ ID NO: 211258 - DNA, 25 bp, Rattus norvegicus
attggcttggtctttggccctagga

SEQ ID NO: 211259 - DNA, 25 bp, Rattus norvegicus
attggcttgtaaccactgctctgct

SEQ ID NO: 211260 - DNA, 25 bp, Rattus norvegicus
attggcttgtaagcactgctctgct

SEQ ID NO: 211261 - DNA, 25 bp, Rattus norvegicus
attggcttgtcgagagctctgcatt

SEQ ID NO: 211262 - DNA, 25 bp, Rattus norvegicus
attggcttgtcgtgagctctgcatt

SEQ ID NO: 211263 - DNA, 25 bp, Rattus norvegicus
attggcttgtttccatacgtgtctt

SEQ ID NO: 211264 - DNA, 25 bp, Rattus norvegicus
attggcttgtttgcatacgtgtctt

SEQ ID NO: 211265 - DNA, 25 bp, Rattus norvegicus
attggctttaccatcttggctttag

SEQ ID NO: 211266 - DNA, 25 bp, Rattus norvegicus
attggctttaccttcttggctttag

SEQ ID NO: 211267 - DNA, 25 bp, Rattus norvegicus
attggctttattcttgatctgtgga

SEQ ID NO: 211268 - DNA, 25 bp, Rattus norvegicus
attggctttattgttgatctgtgga

SEQ ID NO: 211269 - DNA, 25 bp, Rattus norvegicus
attggcttttgcagtttcttcggca

SEQ ID NO: 211270 - DNA, 25 bp, Rattus norvegicus
attggcttttgctgtttcttcggca

SEQ ID NO: 211271 - DNA, 25 bp, Rattus norvegicus
attggctttttcagactgtttgtta

SEQ ID NO: 211272 - DNA, 25 bp, Rattus norvegicus
attggctttttctgactgtttgtta

SEQ ID NO: 211273 - DNA, 25 bp, Rattus norvegicus
attgggaacactaaccatgccctgc

SEQ ID NO: 211274 - DNA, 25 bp, Rattus norvegicus
attgggaacacttaccatgccctgc

SEQ ID NO: 211275 - DNA, 25 bp, Rattus norvegicus
attgggaaggcaccgaacatctgga

SEQ ID NO: 211276 - DNA, 25 bp, Rattus norvegicus
attgggaaggcagcgaacatctgga

SEQ ID NO: 211277 - DNA, 25 bp, Rattus norvegicus
attgggaatctccactccagaggaa

SEQ ID NO: 211278 - DNA, 25 bp, Rattus norvegicus
attgggaatctcgactccagaggaa

SEQ ID NO: 211279 - DNA, 25 bp, Rattus norvegicus
attgggacctgcagacgctgctgga

SEQ ID NO: 211280 - DNA, 25 bp, Rattus norvegicus
attgggacctgctgacgctgctgga

SEQ ID NO: 211281 - DNA, 25 bp, Rattus norvegicus
attgggacggtacacttctcatcag

SEQ ID NO: 211282 - DNA, 25 bp, Rattus norvegicus
attgggacggtagacttctcatcag

SEQ ID NO: 211283 - DNA, 25 bp, Rattus norvegicus
attgggagcaccaaatggtcacaat

SEQ ID NO: 211284 - DNA, 25 bp, Rattus norvegicus
attgggagcacctaatggtcacaat

SEQ ID NO: 211285 - DNA, 25 bp, Rattus norvegicus
attgggagggcgataacttcaccct

SEQ ID NO: 211286 - DNA, 25 bp, Rattus norvegicus
attgggagggcgttaacttcaccct

SEQ ID NO: 211287 - DNA, 25 bp, Rattus norvegicus
attgggagtgtgaaagccttgaaat

SEQ ID NO: 211288 - DNA, 25 bp, Rattus norvegicus
attgggagtgtgtaagccttgaaat

SEQ ID NO: 211289 - DNA, 25 bp, Rattus norvegicus
attgggatcaaactgtctccccagg

SEQ ID NO: 211290 - DNA, 25 bp, Rattus norvegicus
attgggatcaaagtgtctccccagg

SEQ ID NO: 211291 - DNA, 25 bp, Rattus norvegicus
attgggatcctaacctaaatgcctt

SEQ ID NO: 211292 - DNA, 25 bp, Rattus norvegicus
attgggatcctatcctaaatgcctt

SEQ ID NO: 211293 - DNA, 25 bp, Rattus norvegicus
attgggatctgcattctgtgattca

SEQ ID NO: 211294 - DNA, 25 bp, Rattus norvegicus
attgggatctgctttctgtgattca

SEQ ID NO: 211295 - DNA, 25 bp, Rattus norvegicus
attgggatctggctcttgatcagcc

SEQ ID NO: 211296 - DNA, 25 bp, Rattus norvegicus
attgggatctgggtcttgatcagcc

SEQ ID NO: 211297 - DNA, 25 bp, Rattus norvegicus
attgggatgccacatttctagcaac

SEQ ID NO: 211298 - DNA, 25 bp, Rattus norvegicus
attgggatgccagatttctagcaac

SEQ ID NO: 211299 - DNA, 25 bp, Rattus norvegicus
attgggatggaacgactctgaatcc

SEQ ID NO: 211300 - DNA, 25 bp, Rattus norvegicus
attgggatggaaggactctgaatcc

SEQ ID NO: 211301 - DNA, 25 bp, Rattus norvegicus
attgggatgtgtctcagttcctctg

SEQ ID NO: 211302 - DNA, 25 bp, Rattus norvegicus
attgggatgtgtgtcagttcctctg

SEQ ID NO: 211303 - DNA, 25 bp, Rattus norvegicus
attgggcaacatactgtactgctgt

SEQ ID NO: 211304 - DNA, 25 bp, Rattus norvegicus
attgggcaacattctgtactgctgt

SEQ ID NO: 211305 - DNA, 25 bp, Rattus norvegicus
attgggcacctcagaaaactgggct

SEQ ID NO: 211306 - DNA, 25 bp, Rattus norvegicus
attgggcacctctgaaaactgggct

SEQ ID NO: 211307 - DNA, 25 bp, Rattus norvegicus
attgggcagtgacgccacagtgtct

SEQ ID NO: 211308 - DNA, 25 bp, Rattus norvegicus
attgggcagtgaggccacagtgtct

SEQ ID NO: 211309 - DNA, 25 bp, Rattus norvegicus
attgggcatgcaaaggctgctcttc

SEQ ID NO: 211310 - DNA, 25 bp, Rattus norvegicus
attgggcatgcataggctgctcttc

SEQ ID NO: 211311 - DNA, 25 bp, Rattus norvegicus
attgggcatggcatattgaatcaca

SEQ ID NO: 211312 - DNA, 25 bp, Rattus norvegicus
attgggcatggcttattgaatcaca

SEQ ID NO: 211313 - DNA, 25 bp, Rattus norvegicus
attgggcattgtctactgcactcgc

SEQ ID NO: 211314 - DNA, 25 bp, Rattus norvegicus
attgggcattgtgtactgcactcgc

SEQ ID NO: 211315 - DNA, 25 bp, Rattus norvegicus
attgggccagccatcttgttgacca

SEQ ID NO: 211316 - DNA, 25 bp, Rattus norvegicus
attgggccagccttcttgttgacca

SEQ ID NO: 211317 - DNA, 25 bp, Rattus norvegicus
attgggccagctaaatgttttcttt

SEQ ID NO: 211318 - DNA, 25 bp, Rattus norvegicus
attgggccagcttaatgttttcttt

SEQ ID NO: 211319 - DNA, 25 bp, Rattus norvegicus
attgggccatgcctggtaaactgga

SEQ ID NO: 211320 - DNA, 25 bp, Rattus norvegicus
attgggccatgcgtggtaaactgga

SEQ ID NO: 211321 - DNA, 25 bp, Rattus norvegicus
attgggccatgtacagacagtgtta

SEQ ID NO: 211322 - DNA, 25 bp, Rattus norvegicus
attgggccatgttcagacagtgtta

SEQ ID NO: 211323 - DNA, 25 bp, Rattus norvegicus
attgggcccaatactaagctcaacc

SEQ ID NO: 211324 - DNA, 25 bp, Rattus norvegicus
attgggcccaattctaagctcaacc

SEQ ID NO: 211325 - DNA, 25 bp, Rattus norvegicus
attgggccctcgactgagagaccag

SEQ ID NO: 211326 - DNA, 25 bp, Rattus norvegicus
attgggccctcgtctgagagaccag

SEQ ID NO: 211327 - DNA, 25 bp, Rattus norvegicus
attgggcccttacatgtggctcagc

SEQ ID NO: 211328 - DNA, 25 bp, Rattus norvegicus
attgggcccttagatgtggctcagc

SEQ ID NO: 211329 - DNA, 25 bp, Rattus norvegicus
attgggcgcacacgccgctttggca

SEQ ID NO: 211330 - DNA, 25 bp, Rattus norvegicus
attgggcgcacaggccgctttggca

SEQ ID NO: 211331 - DNA, 25 bp, Rattus norvegicus
attgggcgtggtcggacacacactt

SEQ ID NO: 211332 - DNA, 25 bp, Rattus norvegicus
attgggcgtggtgggacacacactt

SEQ ID NO: 211333 - DNA, 25 bp, Rattus norvegicus
attgggctaagcagtgggactcttg

SEQ ID NO: 211334 - DNA, 25 bp, Rattus norvegicus
attgggctaagctgtgggactcttg

SEQ ID NO: 211335 - DNA, 25 bp, Rattus norvegicus
attgggctcaaaacatgtttctttt

SEQ ID NO: 211336 - DNA, 25 bp, Rattus norvegicus
attgggctcaaatcatgtttctttt

SEQ ID NO: 211337 - DNA, 25 bp, Rattus norvegicus
attgggctcatgagtagaccaggtt

SEQ ID NO: 211338 - DNA, 25 bp, Rattus norvegicus
attgggctcatgtgtagaccaggtt

SEQ ID NO: 211339 - DNA, 25 bp, Rattus norvegicus
attgggctcattctgccactattct

SEQ ID NO: 211340 - DNA, 25 bp, Rattus norvegicus
attgggctcattgtgccactattct

SEQ ID NO: 211341 - DNA, 25 bp, Rattus norvegicus
attgggctgctcaatgtccgtctgg

SEQ ID NO: 211342 - DNA, 25 bp, Rattus norvegicus
attgggctgctctatgtccgtctgg

SEQ ID NO: 211343 - DNA, 25 bp, Rattus norvegicus
attgggctggagcacactgcctaga

SEQ ID NO: 211344 - DNA, 25 bp, Rattus norvegicus
attgggctggaggacactgcctaga

SEQ ID NO: 211345 - DNA, 25 bp, Rattus norvegicus
attgggctgttgagatgggccactt

SEQ ID NO: 211346 - DNA, 25 bp, Rattus norvegicus
attgggctgttgtgatgggccactt

SEQ ID NO: 211347 - DNA, 25 bp, Rattus norvegicus
attgggcttatcaccatggtttcgg

SEQ ID NO: 211348 - DNA, 25 bp, Rattus norvegicus
attgggcttatctccatggtttcgg

SEQ ID NO: 211349 - DNA, 25 bp, Rattus norvegicus
attgggcttcagagtaggttcaggc

SEQ ID NO: 211350 - DNA, 25 bp, Rattus norvegicus
attgggcttcagtgtaggttcaggc

SEQ ID NO: 211351 - DNA, 25 bp, Rattus norvegicus
attgggctttgactctgttctgcta

SEQ ID NO: 211352 - DNA, 25 bp, Rattus norvegicus
attgggctttgagtctgttctgcta

SEQ ID NO: 211353 - DNA, 25 bp, Rattus norvegicus
attgggcttttgagtccatgtgaag

SEQ ID NO: 211354 - DNA, 25 bp, Rattus norvegicus
attgggcttttgtgtccatgtgaag

SEQ ID NO: 211355 - DNA, 25 bp, Rattus norvegicus
attgggctttttaatgccaccttct

SEQ ID NO: 211356 - DNA, 25 bp, Rattus norvegicus
attgggcttttttatgccaccttct

SEQ ID NO: 211357 - DNA, 25 bp, Rattus norvegicus
attggggacgtcagcatcctgtcac

SEQ ID NO: 211358 - DNA, 25 bp, Rattus norvegicus
attggggacgtctgcatcctgtcac

SEQ ID NO: 211359 - DNA, 25 bp, Rattus norvegicus
attgggtagcataggccgtgccgtt

SEQ ID NO: 211360 - DNA, 25 bp, Rattus norvegicus
attgggtagcattggccgtgccgtt

SEQ ID NO: 211361 - DNA, 25 bp, Rattus norvegicus
attgggtcatatctaccagctgaag

SEQ ID NO: 211362 - DNA, 25 bp, Rattus norvegicus
attgggtcatatgtaccagctgaag

SEQ ID NO: 211363 - DNA, 25 bp, Rattus norvegicus
attgggtcatgcagtggtccttcct

SEQ ID NO: 211364 - DNA, 25 bp, Rattus norvegicus
attgggtcatgctgtggtccttcct

SEQ ID NO: 211365 - DNA, 25 bp, Rattus norvegicus
attgggtcctcaccactacagaaag

SEQ ID NO: 211366 - DNA, 25 bp, Rattus norvegicus
attgggtcctcagcactacagaaag

SEQ ID NO: 211367 - DNA, 25 bp, Rattus norvegicus
attgggtctgtaactccaggttacc

SEQ ID NO: 211368 - DNA, 25 bp, Rattus norvegicus
attgggtctgtatctccaggttacc

SEQ ID NO: 211369 - DNA, 25 bp, Rattus norvegicus
attgggtgtgctagtactcagttcc

SEQ ID NO: 211370 - DNA, 25 bp, Rattus norvegicus
attgggtgtgcttgtactcagttcc

SEQ ID NO: 211371 - DNA, 25 bp, Rattus norvegicus
attgggttacaaacacagctggaaa

SEQ ID NO: 211372 - DNA, 25 bp, Rattus norvegicus
attgggttacaatcacagctggaaa

SEQ ID NO: 211373 - DNA, 25 bp, Rattus norvegicus
attgggttcattacttcccagatgc

SEQ ID NO: 211374 - DNA, 25 bp, Rattus norvegicus
attgggttcatttcttcccagatgc

SEQ ID NO: 211375 - DNA, 25 bp, Rattus norvegicus
attgggttgcaaagttgcttacttc

SEQ ID NO: 211376 - DNA, 25 bp, Rattus norvegicus
attgggttgcaatgttgcttacttc

SEQ ID NO: 211377 - DNA, 25 bp, Rattus norvegicus
attgggttgccaccttattacacac

SEQ ID NO: 211378 - DNA, 25 bp, Rattus norvegicus
attgggttgccagcttattacacac

SEQ ID NO: 211379 - DNA, 25 bp, Rattus norvegicus
attgggtttctgctttgttctcaca

SEQ ID NO: 211380 - DNA, 25 bp, Rattus norvegicus
attgggtttctggtttgttctcaca

SEQ ID NO: 211381 - DNA, 25 bp, Rattus norvegicus
attgggtttcttactgtgactgcct

SEQ ID NO: 211382 - DNA, 25 bp, Rattus norvegicus
attgggtttctttctgtgactgcct

SEQ ID NO: 211383 - DNA, 25 bp, Rattus norvegicus
attggtaccccacttcgagattcct

SEQ ID NO: 211384 - DNA, 25 bp, Rattus norvegicus
attggtaccccagttcgagattcct

SEQ ID NO: 211385 - DNA, 25 bp, Rattus norvegicus
attggtagcgcacgcttgtcacgcc

SEQ ID NO: 211386 - DNA, 25 bp, Rattus norvegicus
attggtagcgcaggcttgtcacgcc

SEQ ID NO: 211387 - DNA, 25 bp, Rattus norvegicus
attggtatccaaatccttccgaatc

SEQ ID NO: 211388 - DNA, 25 bp, Rattus norvegicus
attggtatccaattccttccgaatc

SEQ ID NO: 211389 - DNA, 25 bp, Rattus norvegicus
attggtatccatctcctatctgcag

SEQ ID NO: 211390 - DNA, 25 bp, Rattus norvegicus
attggtatccatgtcctatctgcag

SEQ ID NO: 211391 - DNA, 25 bp, Rattus norvegicus
attggtatggagactgccggcattc

SEQ ID NO: 211392 - DNA, 25 bp, Rattus norvegicus
attggtatggagtctgccggcattc

SEQ ID NO: 211393 - DNA, 25 bp, Rattus norvegicus
attggtcaaatgagtgtagcaggtc

SEQ ID NO: 211394 - DNA, 25 bp, Rattus norvegicus
attggtcaaatgtgtgtagcaggtc

SEQ ID NO: 211395 - DNA, 25 bp, Rattus norvegicus
attggtcacaggctaaaagctccct

SEQ ID NO: 211396 - DNA, 25 bp, Rattus norvegicus
attggtcacagggtaaaagctccct

SEQ ID NO: 211397 - DNA, 25 bp, Rattus norvegicus
attggtcaccttaaactctccatgg

SEQ ID NO: 211398 - DNA, 25 bp, Rattus norvegicus
attggtcacctttaactctccatgg

SEQ ID NO: 211399 - DNA, 25 bp, Rattus norvegicus
attggtcactttatacgtgagcgta

SEQ ID NO: 211400 - DNA, 25 bp, Rattus norvegicus
attggtcactttttacgtgagcgta

SEQ ID NO: 211401 - DNA, 25 bp, Rattus norvegicus
attggtcagattacttgtcactcaa

SEQ ID NO: 211402 - DNA, 25 bp, Rattus norvegicus
attggtcagatttcttgtcactcaa

SEQ ID NO: 211403 - DNA, 25 bp, Rattus norvegicus
attggtcagcagatcccatgagtga

SEQ ID NO: 211404 - DNA, 25 bp, Rattus norvegicus
attggtcagcagttcccatgagtga

SEQ ID NO: 211405 - DNA, 25 bp, Rattus norvegicus
attggtcagctcagggcctttagca

SEQ ID NO: 211406 - DNA, 25 bp, Rattus norvegicus
attggtcagctctgggcctttagca

SEQ ID NO: 211407 - DNA, 25 bp, Rattus norvegicus
attggtcaggatacaagcacagcta

SEQ ID NO: 211408 - DNA, 25 bp, Rattus norvegicus
attggtcaggattcaagcacagcta

SEQ ID NO: 211409 - DNA, 25 bp, Rattus norvegicus
attggtcatctcatttcctttcatg

SEQ ID NO: 211410 - DNA, 25 bp, Rattus norvegicus
attggtcatctcttttcctttcatg

SEQ ID NO: 211411 - DNA, 25 bp, Rattus norvegicus
attggtcatgtgctcctgtagaaga

SEQ ID NO: 211412 - DNA, 25 bp, Rattus norvegicus
attggtcatgtggtcctgtagaaga

SEQ ID NO: 211413 - DNA, 25 bp, Rattus norvegicus
attggtccacgtatctttctttgat

SEQ ID NO: 211414 - DNA, 25 bp, Rattus norvegicus
attggtccacgtttctttctttgat

SEQ ID NO: 211415 - DNA, 25 bp, Rattus norvegicus
attggtccagacaagcttctttctt

SEQ ID NO: 211416 - DNA, 25 bp, Rattus norvegicus
attggtccagactagcttctttctt

SEQ ID NO: 211417 - DNA, 25 bp, Rattus norvegicus
attggtccagttatacaaacaacag

SEQ ID NO: 211418 - DNA, 25 bp, Rattus norvegicus
attggtccagttttacaaacaacag

SEQ ID NO: 211419 - DNA, 25 bp, Rattus norvegicus
attggtcccaagcatggaatgcaga

SEQ ID NO: 211420 - DNA, 25 bp, Rattus norvegicus
attggtcccaaggatggaatgcaga

SEQ ID NO: 211421 - DNA, 25 bp, Rattus norvegicus
attggtccggctcctgataggtgat

SEQ ID NO: 211422 - DNA, 25 bp, Rattus norvegicus
attggtccggctgctgataggtgat

SEQ ID NO: 211423 - DNA, 25 bp, Rattus norvegicus
attggtcctattctacgtgctcttg

SEQ ID NO: 211424 - DNA, 25 bp, Rattus norvegicus
attggtcctattgtacgtgctcttg

SEQ ID NO: 211425 - DNA, 25 bp, Rattus norvegicus
attggtcctcagcattgtacagcac

SEQ ID NO: 211426 - DNA, 25 bp, Rattus norvegicus
attggtcctcaggattgtacagcac

SEQ ID NO: 211427 - DNA, 25 bp, Rattus norvegicus
attggtcgctttaatctttaccctg

SEQ ID NO: 211428 - DNA, 25 bp, Rattus norvegicus
attggtcgcttttatctttaccctg

SEQ ID NO: 211429 - DNA, 25 bp, Rattus norvegicus
attggtctcattcgcctgtccagtg

SEQ ID NO: 211430 - DNA, 25 bp, Rattus norvegicus
attggtctcattggcctgtccagtg

SEQ ID NO: 211431 - DNA, 25 bp, Rattus norvegicus
attggtctccacactccatggagat

SEQ ID NO: 211432 - DNA, 25 bp, Rattus norvegicus
attggtctccactctccatggagat

SEQ ID NO: 211433 - DNA, 25 bp, Rattus norvegicus
attggtctccttatgttatctggtc

SEQ ID NO: 211434 - DNA, 25 bp, Rattus norvegicus
attggtctccttttgttatctggtc

SEQ ID NO: 211435 - DNA, 25 bp, Rattus norvegicus
attggtctgataaacccaaaggtgg

SEQ ID NO: 211436 - DNA, 25 bp, Rattus norvegicus
attggtctgatatacccaaaggtgg

SEQ ID NO: 211437 - DNA, 25 bp, Rattus norvegicus
attggtctgcagaagcaggcttccc

SEQ ID NO: 211438 - DNA, 25 bp, Rattus norvegicus
attggtctgcagtagcaggcttccc

SEQ ID NO: 211439 - DNA, 25 bp, Rattus norvegicus
attggtctgcctatctctgcaggag

SEQ ID NO: 211440 - DNA, 25 bp, Rattus norvegicus
attggtctgcctttctctgcaggag

SEQ ID NO: 211441 - DNA, 25 bp, Rattus norvegicus
attggtctgggcagtattgctccta

SEQ ID NO: 211442 - DNA, 25 bp, Rattus norvegicus
attggtctgggctgtattgctccta

SEQ ID NO: 211443 - DNA, 25 bp, Rattus norvegicus
attggtcttaccaaacagctatctc

SEQ ID NO: 211444 - DNA, 25 bp, Rattus norvegicus
attggtcttacctaacagctatctc

SEQ ID NO: 211445 - DNA, 25 bp, Rattus norvegicus
attggtcttaggatctcggaggaac

SEQ ID NO: 211446 - DNA, 25 bp, Rattus norvegicus
attggtcttaggttctcggaggaac

SEQ ID NO: 211447 - DNA, 25 bp, Rattus norvegicus
attggtgaacacagaggatctcgat

SEQ ID NO: 211448 - DNA, 25 bp, Rattus norvegicus
attggtgaacactgaggatctcgat

SEQ ID NO: 211449 - DNA, 25 bp, Rattus norvegicus
attggtgaatgtactggaatctgga

SEQ ID NO: 211450 - DNA, 25 bp, Rattus norvegicus
attggtgaatgttctggaatctgga

SEQ ID NO: 211451 - DNA, 25 bp, Rattus norvegicus
attggtgaccacatgattcctataa

SEQ ID NO: 211452 - DNA, 25 bp, Rattus norvegicus
attggtgaccacttgattcctataa

SEQ ID NO: 211453 - DNA, 25 bp, Rattus norvegicus
attggtgaccctaccaggcagacag

SEQ ID NO: 211454 - DNA, 25 bp, Rattus norvegicus
attggtgacccttccaggcagacag

SEQ ID NO: 211455 - DNA, 25 bp, Rattus norvegicus
attggtgacctaacaagtgcctggc

SEQ ID NO: 211456 - DNA, 25 bp, Rattus norvegicus
attggtgacctatcaagtgcctggc

SEQ ID NO: 211457 - DNA, 25 bp, Rattus norvegicus
attggtgactgtatttaccctcctg

SEQ ID NO: 211458 - DNA, 25 bp, Rattus norvegicus
attggtgactgtttttaccctcctg

SEQ ID NO: 211459 - DNA, 25 bp, Rattus norvegicus
attggtgagcacatcgtggacagaa

SEQ ID NO: 211460 - DNA, 25 bp, Rattus norvegicus
attggtgagcacttcgtggacagaa

SEQ ID NO: 211461 - DNA, 25 bp, Rattus norvegicus
attggtgagctcaggcacttgagat

SEQ ID NO: 211462 - DNA, 25 bp, Rattus norvegicus
attggtgagctctggcacttgagat

SEQ ID NO: 211463 - DNA, 25 bp, Rattus norvegicus
attggtgagttacggcttctgtaca

SEQ ID NO: 211464 - DNA, 25 bp, Rattus norvegicus
attggtgagttagggcttctgtaca

SEQ ID NO: 211465 - DNA, 25 bp, Rattus norvegicus
attggtgatcttcttttctttgttg

SEQ ID NO: 211466 - DNA, 25 bp, Rattus norvegicus
attggtgatcttgttttctttgttg

SEQ ID NO: 211467 - DNA, 25 bp, Rattus norvegicus
attggtgatttacactggaagtgtt

SEQ ID NO: 211468 - DNA, 25 bp, Rattus norvegicus
attggtgatttagactggaagtgtt

SEQ ID NO: 211469 - DNA, 25 bp, Rattus norvegicus
attggtgcacacaaacctcagtgga

SEQ ID NO: 211470 - DNA, 25 bp, Rattus norvegicus
attggtgcacactaacctcagtgga

SEQ ID NO: 211471 - DNA, 25 bp, Rattus norvegicus
attggtgcagccagtattcccagcg

SEQ ID NO: 211472 - DNA, 25 bp, Rattus norvegicus
attggtgcagcctgtattcccagcg

SEQ ID NO: 211473 - DNA, 25 bp, Rattus norvegicus
attggtgcatctctatccagcgata

SEQ ID NO: 211474 - DNA, 25 bp, Rattus norvegicus
attggtgcatctgtatccagcgata

SEQ ID NO: 211475 - DNA, 25 bp, Rattus norvegicus
attggtgccagtagtctccgagtac

SEQ ID NO: 211476 - DNA, 25 bp, Rattus norvegicus
attggtgccagtcgagtccttcaaa

SEQ ID NO: 211477 - DNA, 25 bp, Rattus norvegicus
attggtgccagtggagtccttcaaa

SEQ ID NO: 211478 - DNA, 25 bp, Rattus norvegicus
attggtgccagttgtctccgagtac

SEQ ID NO: 211479 - DNA, 25 bp, Rattus norvegicus
attggtgccccacgcgtgggtcaca

SEQ ID NO: 211480 - DNA, 25 bp, Rattus norvegicus
attggtgccccaggcgtgggtcaca

SEQ ID NO: 211481 - DNA, 25 bp, Rattus norvegicus
attggtgccgttcttctgttttgtc

SEQ ID NO: 211482 - DNA, 25 bp, Rattus norvegicus
attggtgccgttgttctgttttgtc

SEQ ID NO: 211483 - DNA, 25 bp, Rattus norvegicus
attggtgcctccaacaggaatctaa

SEQ ID NO: 211484 - DNA, 25 bp, Rattus norvegicus
attggtgcctcctacaggaatctaa

SEQ ID NO: 211485 - DNA, 25 bp, Rattus norvegicus
attggtgcgaggagtcttttcagtc

SEQ ID NO: 211486 - DNA, 25 bp, Rattus norvegicus
attggtgcgaggtgtcttttcagtc

SEQ ID NO: 211487 - DNA, 25 bp, Rattus norvegicus
attggtgcgctgaattttccatgcc

SEQ ID NO: 211488 - DNA, 25 bp, Rattus norvegicus
attggtgcgctgtattttccatgcc

SEQ ID NO: 211489 - DNA, 25 bp, Rattus norvegicus
attggtgctaatcgtggacagttaa

SEQ ID NO: 211490 - DNA, 25 bp, Rattus norvegicus
attggtgctaatggtggacagttaa

SEQ ID NO: 211491 - DNA, 25 bp, Rattus norvegicus
attggtgctcaaaaagtaacttctg

SEQ ID NO: 211492 - DNA, 25 bp, Rattus norvegicus
attggtgctcaataagtaacttctg

SEQ ID NO: 211493 - DNA, 25 bp, Rattus norvegicus
attggtgggaatccaccgtcctacg

SEQ ID NO: 211494 - DNA, 25 bp, Rattus norvegicus
attggtgggaatgcaccgtcctacg

SEQ ID NO: 211495 - DNA, 25 bp, Rattus norvegicus
attggtgggtctctgacatcataca

SEQ ID NO: 211496 - DNA, 25 bp, Rattus norvegicus
attggtgggtctgtgacatcataca

SEQ ID NO: 211497 - DNA, 25 bp, Rattus norvegicus
attggtgggtttacctgttcacaga

SEQ ID NO: 211498 - DNA, 25 bp, Rattus norvegicus
attggtgggttttcctgttcacaga

SEQ ID NO: 211499 - DNA, 25 bp, Rattus norvegicus
attggtggtattatactactgtcgt

SEQ ID NO: 211500 - DNA, 25 bp, Rattus norvegicus
attggtggtattttactactgtcgt

SEQ ID NO: 211501 - DNA, 25 bp, Rattus norvegicus
attggtggtgcaccggaacctctca

SEQ ID NO: 211502 - DNA, 25 bp, Rattus norvegicus
attggtggtgcagcggaacctctca

SEQ ID NO: 211503 - DNA, 25 bp, Rattus norvegicus
attggtggtggcagactctcggacc

SEQ ID NO: 211504 - DNA, 25 bp, Rattus norvegicus
attggtggtggctgactctcggacc

SEQ ID NO: 211505 - DNA, 25 bp, Rattus norvegicus
attggtggttggatcaatcactacc

SEQ ID NO: 211506 - DNA, 25 bp, Rattus norvegicus
attggtggttggttcaatcactacc

SEQ ID NO: 211507 - DNA, 25 bp, Rattus norvegicus
attggtgtaacacccttcattatgc

SEQ ID NO: 211508 - DNA, 25 bp, Rattus norvegicus
attggtgtaacagccttcattatgc

SEQ ID NO: 211509 - DNA, 25 bp, Rattus norvegicus
attggtgtaagtaccggaatgcaca

SEQ ID NO: 211510 - DNA, 25 bp, Rattus norvegicus
attggtgtaagttccggaatgcaca

SEQ ID NO: 211511 - DNA, 25 bp, Rattus norvegicus
attggtgtagtgacctggtttatca

SEQ ID NO: 211512 - DNA, 25 bp, Rattus norvegicus
attggtgtagtgtcctggtttatca

SEQ ID NO: 211513 - DNA, 25 bp, Rattus norvegicus
attggtgtcactacttttctgctac

SEQ ID NO: 211514 - DNA, 25 bp, Rattus norvegicus
attggtgtcacttcttttctgctac

SEQ ID NO: 211515 - DNA, 25 bp, Rattus norvegicus
attggtgtcatgactctgattcgaa

SEQ ID NO: 211516 - DNA, 25 bp, Rattus norvegicus
attggtgtcatgatcagtgttctaa

SEQ ID NO: 211517 - DNA, 25 bp, Rattus norvegicus
attggtgtcatgtctctgattcgaa

SEQ ID NO: 211518 - DNA, 25 bp, Rattus norvegicus
attggtgtcatgttcagtgttctaa

SEQ ID NO: 211519 - DNA, 25 bp, Rattus norvegicus
attggtgtgatgcttctgctccctc

SEQ ID NO: 211520 - DNA, 25 bp, Rattus norvegicus
attggtgtgatggttctgctccctc

SEQ ID NO: 211521 - DNA, 25 bp, Rattus norvegicus
attggtgtggaaatcatcgactggt

SEQ ID NO: 211522 - DNA, 25 bp, Rattus norvegicus
attggtgtggaattcatcgactggt

SEQ ID NO: 211523 - DNA, 25 bp, Rattus norvegicus
attggtgtggagaccctcgagcctt

SEQ ID NO: 211524 - DNA, 25 bp, Rattus norvegicus
attggtgtggagtccctcgagcctt

SEQ ID NO: 211525 - DNA, 25 bp, Rattus norvegicus
attggtgtggctcccagctctgtgc

SEQ ID NO: 211526 - DNA, 25 bp, Rattus norvegicus
attggtgtggctgccagctctgtgc

SEQ ID NO: 211527 - DNA, 25 bp, Rattus norvegicus
attggtgtgttgactgaatgtctgg

SEQ ID NO: 211528 - DNA, 25 bp, Rattus norvegicus
attggtgtgttgtctgaatgtctgg

SEQ ID NO: 211529 - DNA, 25 bp, Rattus norvegicus
attggtgttacacctgtggcgttta

SEQ ID NO: 211530 - DNA, 25 bp, Rattus norvegicus
attggtgttacagctgtggcgttta

SEQ ID NO: 211531 - DNA, 25 bp, Rattus norvegicus
attggttaaatgatgcccttgtgca

SEQ ID NO: 211532 - DNA, 25 bp, Rattus norvegicus
attggttaaatgttgcccttgtgca

SEQ ID NO: 211533 - DNA, 25 bp, Rattus norvegicus
attggttacctgaagctcttcattg

SEQ ID NO: 211534 - DNA, 25 bp, Rattus norvegicus
attggttacctgtagctcttcattg

SEQ ID NO: 211535 - DNA, 25 bp, Rattus norvegicus
attggttactccattgtcaaactgg

SEQ ID NO: 211536 - DNA, 25 bp, Rattus norvegicus
attggttactcctttgtcaaactgg

SEQ ID NO: 211537 - DNA, 25 bp, Rattus norvegicus
attggttaggacagtcttccagctg

SEQ ID NO: 211538 - DNA, 25 bp, Rattus norvegicus
attggttaggactgtcttccagctg

SEQ ID NO: 211539 - DNA, 25 bp, Rattus norvegicus
attggttatctaactcaagggcata

SEQ ID NO: 211540 - DNA, 25 bp, Rattus norvegicus
attggttatctatctcaagggcata

SEQ ID NO: 211541 - DNA, 25 bp, Rattus norvegicus
attggttatgctacccacaggccaa

SEQ ID NO: 211542 - DNA, 25 bp, Rattus norvegicus
attggttatgcttcccacaggccaa

SEQ ID NO: 211543 - DNA, 25 bp, Rattus norvegicus
attggttcagacacctctgttgaca

SEQ ID NO: 211544 - DNA, 25 bp, Rattus norvegicus
attggttcagactcctctgttgaca

SEQ ID NO: 211545 - DNA, 25 bp, Rattus norvegicus
attggttcccagagtcttgaagcct

SEQ ID NO: 211546 - DNA, 25 bp, Rattus norvegicus
attggttcccagtgtcttgaagcct

SEQ ID NO: 211547 - DNA, 25 bp, Rattus norvegicus
attggttccttgatcgacttcgtac

SEQ ID NO: 211548 - DNA, 25 bp, Rattus norvegicus
attggttccttgttcgacttcgtac

SEQ ID NO: 211549 - DNA, 25 bp, Rattus norvegicus
attggttcgggtacctgaactctgc

SEQ ID NO: 211550 - DNA, 25 bp, Rattus norvegicus
attggttcgggttcctgaactctgc

SEQ ID NO: 211551 - DNA, 25 bp, Rattus norvegicus
attggttctacccagagcgactttc

SEQ ID NO: 211552 - DNA, 25 bp, Rattus norvegicus
attggttctaccgagagcgactttc

SEQ ID NO: 211553 - DNA, 25 bp, Rattus norvegicus
attggttctactcggttcctaatgc

SEQ ID NO: 211554 - DNA, 25 bp, Rattus norvegicus
attggttctactgggttcctaatgc

SEQ ID NO: 211555 - DNA, 25 bp, Rattus norvegicus
attggttctaggacaactggcctca

SEQ ID NO: 211556 - DNA, 25 bp, Rattus norvegicus
attggttctaggtcaactggcctca

SEQ ID NO: 211557 - DNA, 25 bp, Rattus norvegicus
attggttctgtaatcctggactcta

SEQ ID NO: 211558 - DNA, 25 bp, Rattus norvegicus
attggttctgtattcctggactcta

SEQ ID NO: 211559 - DNA, 25 bp, Rattus norvegicus
attggttgccaactttgcgttgtta

SEQ ID NO: 211560 - DNA, 25 bp, Rattus norvegicus
attggttgccaagtttgcgttgtta

SEQ ID NO: 211561 - DNA, 25 bp, Rattus norvegicus
attggttgctgaacattgaatgctt

SEQ ID NO: 211562 - DNA, 25 bp, Rattus norvegicus
attggttgctgatcattgaatgctt

SEQ ID NO: 211563 - DNA, 25 bp, Rattus norvegicus
attggttggtctcgagagaccctcc

SEQ ID NO: 211564 - DNA, 25 bp, Rattus norvegicus
attggttggtctggagagaccctcc

SEQ ID NO: 211565 - DNA, 25 bp, Rattus norvegicus
attggttgttaacgaggcctgctac

SEQ ID NO: 211566 - DNA, 25 bp, Rattus norvegicus
attggttgttaaggaggcctgctac

SEQ ID NO: 211567 - DNA, 25 bp, Rattus norvegicus
attggtttaagcatcttcccttatg

SEQ ID NO: 211568 - DNA, 25 bp, Rattus norvegicus
attggtttaagcttcttcccttatg

SEQ ID NO: 211569 - DNA, 25 bp, Rattus norvegicus
attggtttacttctgagtgttgcta

SEQ ID NO: 211570 - DNA, 25 bp, Rattus norvegicus
attggtttacttgtgagtgttgcta

SEQ ID NO: 211571 - DNA, 25 bp, Rattus norvegicus
attggtttatgccttgtaatcccag

SEQ ID NO: 211572 - DNA, 25 bp, Rattus norvegicus
attggtttatgcgttgtaatcccag

SEQ ID NO: 211573 - DNA, 25 bp, Rattus norvegicus
attggtttcaatatcatgacacatg

SEQ ID NO: 211574 - DNA, 25 bp, Rattus norvegicus
attggtttcaatttcatgacacatg

SEQ ID NO: 211575 - DNA, 25 bp, Rattus norvegicus
attggtttccaacttactgccgcct

SEQ ID NO: 211576 - DNA, 25 bp, Rattus norvegicus
attggtttccaagttactgccgcct

SEQ ID NO: 211577 - DNA, 25 bp, Rattus norvegicus
attggtttccccagtatcttaatgc

SEQ ID NO: 211578 - DNA, 25 bp, Rattus norvegicus
attggtttcccctgtatcttaatgc

SEQ ID NO: 211579 - DNA, 25 bp, Rattus norvegicus
attggtttctagaactctcttcctc

SEQ ID NO: 211580 - DNA, 25 bp, Rattus norvegicus
attggtttctagtactctcttcctc

SEQ ID NO: 211581 - DNA, 25 bp, Rattus norvegicus
attggtttctcaaagtcactgccca

SEQ ID NO: 211582 - DNA, 25 bp, Rattus norvegicus
attggtttctcatagtcactgccca

SEQ ID NO: 211583 - DNA, 25 bp, Rattus norvegicus
attggtttgttgatggagggttcat

SEQ ID NO: 211584 - DNA, 25 bp, Rattus norvegicus
attggtttgttgttggagggttcat

SEQ ID NO: 211585 - DNA, 25 bp, Rattus norvegicus
attggttttgtgatcacagctgccc

SEQ ID NO: 211586 - DNA, 25 bp, Rattus norvegicus
attggttttgtgttcacagctgccc

SEQ ID NO: 211587 - DNA, 25 bp, Rattus norvegicus
attgtaaccaagagtctcctgattc

SEQ ID NO: 211588 - DNA, 25 bp, Rattus norvegicus
attgtaaccaagtgtctcctgattc

SEQ ID NO: 211589 - DNA, 25 bp, Rattus norvegicus
attgtaaccagtattctaccgaatg

SEQ ID NO: 211590 - DNA, 25 bp, Rattus norvegicus
attgtaaccagttttctaccgaatg

SEQ ID NO: 211591 - DNA, 25 bp, Rattus norvegicus
attgtaaccatgacttcaagcacag

SEQ ID NO: 211592 - DNA, 25 bp, Rattus norvegicus
attgtaaccatgtcttcaagcacag

SEQ ID NO: 211593 - DNA, 25 bp, Rattus norvegicus
attgtaagacccaggacccgtgctg

SEQ ID NO: 211594 - DNA, 25 bp, Rattus norvegicus
attgtaagaccctggacccgtgctg

SEQ ID NO: 211595 - DNA, 25 bp, Rattus norvegicus
attgtaatatttctcacctaccctc

SEQ ID NO: 211596 - DNA, 25 bp, Rattus norvegicus
attgtaatatttgtcacctaccctc

SEQ ID NO: 211597 - DNA, 25 bp, Rattus norvegicus
attgtaatgtccacatcttccagtg

SEQ ID NO: 211598 - DNA, 25 bp, Rattus norvegicus
attgtaatgtcctcatcttccagtg

SEQ ID NO: 211599 - DNA, 25 bp, Rattus norvegicus
attgtacaacgtaaagagcatcttt

SEQ ID NO: 211600 - DNA, 25 bp, Rattus norvegicus
attgtacaacgttaagagcatcttt

SEQ ID NO: 211601 - DNA, 25 bp, Rattus norvegicus
attgtacaattgaccttttcactgt

SEQ ID NO: 211602 - DNA, 25 bp, Rattus norvegicus
attgtacaattgtccttttcactgt

SEQ ID NO: 211603 - DNA, 25 bp, Rattus norvegicus
attgtacagcagagcattgcagtga

SEQ ID NO: 211604 - DNA, 25 bp, Rattus norvegicus
attgtacagcagtgcattgcagtga

SEQ ID NO: 211605 - DNA, 25 bp, Rattus norvegicus
attgtaccccaacatttccagttat

SEQ ID NO: 211606 - DNA, 25 bp, Rattus norvegicus
attgtaccccaacgcatgttctgga

SEQ ID NO: 211607 - DNA, 25 bp, Rattus norvegicus
attgtaccccaagatttccagttat

SEQ ID NO: 211608 - DNA, 25 bp, Rattus norvegicus
attgtaccccaaggcatgttctgga

SEQ ID NO: 211609 - DNA, 25 bp, Rattus norvegicus
attgtaccgttgatcaatcccatca

SEQ ID NO: 211610 - DNA, 25 bp, Rattus norvegicus
attgtaccgttgttcaatcccatca

SEQ ID NO: 211611 - DNA, 25 bp, Rattus norvegicus
attgtacctcgaacttaccattggc

SEQ ID NO: 211612 - DNA, 25 bp, Rattus norvegicus
attgtacctcgatcttaccattggc

SEQ ID NO: 211613 - DNA, 25 bp, Rattus norvegicus
attgtacctgatcttccagtatgta

SEQ ID NO: 211614 - DNA, 25 bp, Rattus norvegicus
attgtacctgatgttccagtatgta

SEQ ID NO: 211615 - DNA, 25 bp, Rattus norvegicus
attgtacctgtcagcatcctgttgg

SEQ ID NO: 211616 - DNA, 25 bp, Rattus norvegicus
attgtacctgtctgcatcctgttgg

SEQ ID NO: 211617 - DNA, 25 bp, Rattus norvegicus
attgtactagctctgacttctctgg

SEQ ID NO: 211618 - DNA, 25 bp, Rattus norvegicus
attgtactagctgtgacttctctgg

SEQ ID NO: 211619 - DNA, 25 bp, Rattus norvegicus
attgtactcaatctgtccttcttta

SEQ ID NO: 211620 - DNA, 25 bp, Rattus norvegicus
attgtactcaatgtgtccttcttta

SEQ ID NO: 211621 - DNA, 25 bp, Rattus norvegicus
attgtactcagaacattccatatgt

SEQ ID NO: 211622 - DNA, 25 bp, Rattus norvegicus
attgtactcagatcattccatatgt

SEQ ID NO: 211623 - DNA, 25 bp, Rattus norvegicus
attgtactcctgcttttgttccgtt

SEQ ID NO: 211624 - DNA, 25 bp, Rattus norvegicus
attgtactcctggttttgttccgtt

SEQ ID NO: 211625 - DNA, 25 bp, Rattus norvegicus
attgtactcttcaatgctggaccga

SEQ ID NO: 211626 - DNA, 25 bp, Rattus norvegicus
attgtactcttctatgctggaccga

SEQ ID NO: 211627 - DNA, 25 bp, Rattus norvegicus
attgtactgagaattgggttctact

SEQ ID NO: 211628 - DNA, 25 bp, Rattus norvegicus
attgtactgagatttgggttctact

SEQ ID NO: 211629 - DNA, 25 bp, Rattus norvegicus
attgtactgcagcagcttcttgctc

SEQ ID NO: 211630 - DNA, 25 bp, Rattus norvegicus
attgtactgcaggagcttcttgctc

SEQ ID NO: 211631 - DNA, 25 bp, Rattus norvegicus
attgtactgtatctagctgcactac

SEQ ID NO: 211632 - DNA, 25 bp, Rattus norvegicus
attgtactgtatgtagctgcactac

SEQ ID NO: 211633 - DNA, 25 bp, Rattus norvegicus
attgtacttgcaccatgcttcctgg

SEQ ID NO: 211634 - DNA, 25 bp, Rattus norvegicus
attgtacttgcagcatgcttcctgg

SEQ ID NO: 211635 - DNA, 25 bp, Rattus norvegicus
attgtagacgttacccactgttatc

SEQ ID NO: 211636 - DNA, 25 bp, Rattus norvegicus
attgtagacgtttcccactgttatc

SEQ ID NO: 211637 - DNA, 25 bp, Rattus norvegicus
attgtagactgtccagcctttcact

SEQ ID NO: 211638 - DNA, 25 bp, Rattus norvegicus
attgtagactgtgcagcctttcact

SEQ ID NO: 211639 - DNA, 25 bp, Rattus norvegicus
attgtagatttgacattttccatta

SEQ ID NO: 211640 - DNA, 25 bp, Rattus norvegicus
attgtagatttgtcattttccatta

SEQ ID NO: 211641 - DNA, 25 bp, Rattus norvegicus
attgtagcgttccaaggatcccctg

SEQ ID NO: 211642 - DNA, 25 bp, Rattus norvegicus
attgtagcgttcgaaggatcccctg

SEQ ID NO: 211643 - DNA, 25 bp, Rattus norvegicus
attgtagctactagtctacagccct

SEQ ID NO: 211644 - DNA, 25 bp, Rattus norvegicus
attgtagctacttgtctacagccct

SEQ ID NO: 211645 - DNA, 25 bp, Rattus norvegicus
attgtagctcttctcaattagcatt

SEQ ID NO: 211646 - DNA, 25 bp, Rattus norvegicus
attgtagctcttgtcaattagcatt

SEQ ID NO: 211647 - DNA, 25 bp, Rattus norvegicus
attgtagctgagcttcgttccacca

SEQ ID NO: 211648 - DNA, 25 bp, Rattus norvegicus
attgtagctgaggttcgttccacca

SEQ ID NO: 211649 - DNA, 25 bp, Rattus norvegicus
attgtagctttcaaatcattggaag

SEQ ID NO: 211650 - DNA, 25 bp, Rattus norvegicus
attgtagctttctaatcattggaag

SEQ ID NO: 211651 - DNA, 25 bp, Rattus norvegicus
attgtaggaaatcctgtgccttccc

SEQ ID NO: 211652 - DNA, 25 bp, Rattus norvegicus
attgtaggaaatgctgtgccttccc

SEQ ID NO: 211653 - DNA, 25 bp, Rattus norvegicus
attgtagggtcaaggccaagggcca

SEQ ID NO: 211654 - DNA, 25 bp, Rattus norvegicus
attgtagggtcatggccaagggcca

SEQ ID NO: 211655 - DNA, 25 bp, Rattus norvegicus
attgtaggtgctctggtcaaggccc

SEQ ID NO: 211656 - DNA, 25 bp, Rattus norvegicus
attgtaggtgctgtggtcaaggccc

SEQ ID NO: 211657 - DNA, 25 bp, Rattus norvegicus
attgtagtcactcctccctgatatg

SEQ ID NO: 211658 - DNA, 25 bp, Rattus norvegicus
attgtagtcactgctccctgatatg

SEQ ID NO: 211659 - DNA, 25 bp, Rattus norvegicus
attgtagtccaacagtgcattgagc

SEQ ID NO: 211660 - DNA, 25 bp, Rattus norvegicus
attgtagtccaagagtgcattgagc

SEQ ID NO: 211661 - DNA, 25 bp, Rattus norvegicus
attgtagtgtgtctacctgtcccca

SEQ ID NO: 211662 - DNA, 25 bp, Rattus norvegicus
attgtagtgtgtgtacctgtcccca

SEQ ID NO: 211663 - DNA, 25 bp, Rattus norvegicus
attgtagttgtacccgtcattagaa

SEQ ID NO: 211664 - DNA, 25 bp, Rattus norvegicus
attgtagttgtagccgtcattagaa

SEQ ID NO: 211665 - DNA, 25 bp, Rattus norvegicus
attgtagttttgattcgtcggttga

SEQ ID NO: 211666 - DNA, 25 bp, Rattus norvegicus
attgtagttttgtttcgtcggttga

SEQ ID NO: 211667 - DNA, 25 bp, Rattus norvegicus
attgtataacccaattcagcccata

SEQ ID NO: 211668 - DNA, 25 bp, Rattus norvegicus
attgtataaccctattcagcccata

SEQ ID NO: 211669 - DNA, 25 bp, Rattus norvegicus
attgtatattatactgctgccgatg

SEQ ID NO: 211670 - DNA, 25 bp, Rattus norvegicus
attgtatattattctgctgccgatg

SEQ ID NO: 211671 - DNA, 25 bp, Rattus norvegicus
attgtatcacatcggcaatccctgc

SEQ ID NO: 211672 - DNA, 25 bp, Rattus norvegicus
attgtatcacatgggcaatccctgc

SEQ ID NO: 211673 - DNA, 25 bp, Rattus norvegicus
attgtatccaccaagtgctcatggt

SEQ ID NO: 211674 - DNA, 25 bp, Rattus norvegicus
attgtatccacctagtgctcatggt

SEQ ID NO: 211675 - DNA, 25 bp, Rattus norvegicus
attgtatccgtgagagcctgtgcat

SEQ ID NO: 211676 - DNA, 25 bp, Rattus norvegicus
attgtatccgtgtgagcctgtgcat

SEQ ID NO: 211677 - DNA, 25 bp, Rattus norvegicus
attgtatcgattaaatttgagcttt

SEQ ID NO: 211678 - DNA, 25 bp, Rattus norvegicus
attgtatcgatttaatttgagcttt

SEQ ID NO: 211679 - DNA, 25 bp, Rattus norvegicus
attgtatcgcctctaaagttgccca

SEQ ID NO: 211680 - DNA, 25 bp, Rattus norvegicus
attgtatcgcctgtaaagttgccca

SEQ ID NO: 211681 - DNA, 25 bp, Rattus norvegicus
attgtatctgaaccgctagtggctt

SEQ ID NO: 211682 - DNA, 25 bp, Rattus norvegicus
attgtatctgaagcgctagtggctt

SEQ ID NO: 211683 - DNA, 25 bp, Rattus norvegicus
attgtatgcatgaatgaaagtcctc

SEQ ID NO: 211684 - DNA, 25 bp, Rattus norvegicus
attgtatgcatgtatgaaagtcctc

SEQ ID NO: 211685 - DNA, 25 bp, Rattus norvegicus
attgtatggccgattcttgagatga

SEQ ID NO: 211686 - DNA, 25 bp, Rattus norvegicus
attgtatggccgtttcttgagatga

SEQ ID NO: 211687 - DNA, 25 bp, Rattus norvegicus
attgtatgggctaattttcagtatt

SEQ ID NO: 211688 - DNA, 25 bp, Rattus norvegicus
attgtatgggcttattttcagtatt

SEQ ID NO: 211689 - DNA, 25 bp, Rattus norvegicus
attgtatgggttagtgagcttcttc

SEQ ID NO: 211690 - DNA, 25 bp, Rattus norvegicus
attgtatgggtttgtgagcttcttc

SEQ ID NO: 211691 - DNA, 25 bp, Rattus norvegicus
attgtatgtcccacagattagccac

SEQ ID NO: 211692 - DNA, 25 bp, Rattus norvegicus
attgtatgtccctcagattagccac

SEQ ID NO: 211693 - DNA, 25 bp, Rattus norvegicus
attgtattacctctggttgccaccc

SEQ ID NO: 211694 - DNA, 25 bp, Rattus norvegicus
attgtattacctgtggttgccaccc

SEQ ID NO: 211695 - DNA, 25 bp, Rattus norvegicus
attgtattactcctgcagtgcgaca

SEQ ID NO: 211696 - DNA, 25 bp, Rattus norvegicus
attgtattactcgtgcagtgcgaca

SEQ ID NO: 211697 - DNA, 25 bp, Rattus norvegicus
attgtattcattaaccacttggtgg

SEQ ID NO: 211698 - DNA, 25 bp, Rattus norvegicus
attgtattcatttaccacttggtgg

SEQ ID NO: 211699 - DNA, 25 bp, Rattus norvegicus
attgtattctgaacgaagccccacc

SEQ ID NO: 211700 - DNA, 25 bp, Rattus norvegicus
attgtattctgatcgaagccccacc

SEQ ID NO: 211701 - DNA, 25 bp, Rattus norvegicus
attgtattgcctctaaatcgattta

SEQ ID NO: 211702 - DNA, 25 bp, Rattus norvegicus
attgtattgcctgtaaatcgattta

SEQ ID NO: 211703 - DNA, 25 bp, Rattus norvegicus
attgtattgtgtctcttttccttcc

SEQ ID NO: 211704 - DNA, 25 bp, Rattus norvegicus
attgtattgtgtgtcttttccttcc

SEQ ID NO: 211705 - DNA, 25 bp, Rattus norvegicus
attgtatttagtccttttactgtga

SEQ ID NO: 211706 - DNA, 25 bp, Rattus norvegicus
attgtatttagtgcttttactgtga

SEQ ID NO: 211707 - DNA, 25 bp, Rattus norvegicus
attgtatttcatccttatgttttag

SEQ ID NO: 211708 - DNA, 25 bp, Rattus norvegicus
attgtatttcatgcttatgttttag

SEQ ID NO: 211709 - DNA, 25 bp, Rattus norvegicus
attgtatttgatcactcctgcctta

SEQ ID NO: 211710 - DNA, 25 bp, Rattus norvegicus
attgtatttgatgactcctgcctta

SEQ ID NO: 211711 - DNA, 25 bp, Rattus norvegicus
attgtatttgcaaccactccttgta

SEQ ID NO: 211712 - DNA, 25 bp, Rattus norvegicus
attgtatttgcatccactccttgta

SEQ ID NO: 211713 - DNA, 25 bp, Rattus norvegicus
attgtatttggacccacccttctgc

SEQ ID NO: 211714 - DNA, 25 bp, Rattus norvegicus
attgtatttggagccacccttctgc

SEQ ID NO: 211715 - DNA, 25 bp, Rattus norvegicus
attgtcaagctgctctccactgcta

SEQ ID NO: 211716 - DNA, 25 bp, Rattus norvegicus
attgtcaagctggtctccactgcta

SEQ ID NO: 211717 - DNA, 25 bp, Rattus norvegicus
attgtcaaggtcactggcagggtca

SEQ ID NO: 211718 - DNA, 25 bp, Rattus norvegicus
attgtcaaggtctctggcagggtca

SEQ ID NO: 211719 - DNA, 25 bp, Rattus norvegicus
attgtcaattttacattcggtgcta

SEQ ID NO: 211720 - DNA, 25 bp, Rattus norvegicus
attgtcaatttttcattcggtgcta

SEQ ID NO: 211721 - DNA, 25 bp, Rattus norvegicus
attgtcacaaggctcagtctcctgc

SEQ ID NO: 211722 - DNA, 25 bp, Rattus norvegicus
attgtcacaagggtcagtctcctgc

SEQ ID NO: 211723 - DNA, 25 bp, Rattus norvegicus
attgtcacagctctgcaccgtggac

SEQ ID NO: 211724 - DNA, 25 bp, Rattus norvegicus
attgtcacagctgtgcaccgtggac

SEQ ID NO: 211725 - DNA, 25 bp, Rattus norvegicus
attgtcacatccaactgccaatgtt

SEQ ID NO: 211726 - DNA, 25 bp, Rattus norvegicus
attgtcacatcctactgccaatgtt

SEQ ID NO: 211727 - DNA, 25 bp, Rattus norvegicus
attgtcaccattctagggacccggg

SEQ ID NO: 211728 - DNA, 25 bp, Rattus norvegicus
attgtcaccattgtagggacccggg

SEQ ID NO: 211729 - DNA, 25 bp, Rattus norvegicus
attgtcaccctaagcaagattggct

SEQ ID NO: 211730 - DNA, 25 bp, Rattus norvegicus
attgtcaccctatgcaagattggct

SEQ ID NO: 211731 - DNA, 25 bp, Rattus norvegicus
attgtcaccctcattaaaatgtact

SEQ ID NO: 211732 - DNA, 25 bp, Rattus norvegicus
attgtcaccctctttaaaatgtact

SEQ ID NO: 211733 - DNA, 25 bp, Rattus norvegicus
attgtcaccctgaagaacagtggag

SEQ ID NO: 211734 - DNA, 25 bp, Rattus norvegicus
attgtcaccctgtagaacagtggag

SEQ ID NO: 211735 - DNA, 25 bp, Rattus norvegicus
attgtcacctacacagttcgcattt

SEQ ID NO: 211736 - DNA, 25 bp, Rattus norvegicus
attgtcacctactcagttcgcattt

SEQ ID NO: 211737 - DNA, 25 bp, Rattus norvegicus
attgtcacctctcttgtccagatgg

SEQ ID NO: 211738 - DNA, 25 bp, Rattus norvegicus
attgtcacctctgttgtccagatgg

SEQ ID NO: 211739 - DNA, 25 bp, Rattus norvegicus
attgtcacctgtaccagtctggagc

SEQ ID NO: 211740 - DNA, 25 bp, Rattus norvegicus
attgtcacctgttccagtctggagc

SEQ ID NO: 211741 - DNA, 25 bp, Rattus norvegicus
attgtcaccttcatcaccaaagttc

SEQ ID NO: 211742 - DNA, 25 bp, Rattus norvegicus
attgtcaccttcttcaccaaagttc

SEQ ID NO: 211743 - DNA, 25 bp, Rattus norvegicus
attgtcacgaatctgcccatggtaa

SEQ ID NO: 211744 - DNA, 25 bp, Rattus norvegicus
attgtcacgaatgtgcccatggtaa

SEQ ID NO: 211745 - DNA, 25 bp, Rattus norvegicus
attgtcacgggccagcctgggccaa

SEQ ID NO: 211746 - DNA, 25 bp, Rattus norvegicus
attgtcacgggcgagcctgggccaa

SEQ ID NO: 211747 - DNA, 25 bp, Rattus norvegicus
attgtcactaatcttttacttcgaa

SEQ ID NO: 211748 - DNA, 25 bp, Rattus norvegicus
attgtcactaatgttttacttcgaa

SEQ ID NO: 211749 - DNA, 25 bp, Rattus norvegicus
attgtcactgagactggtcgccagc

SEQ ID NO: 211750 - DNA, 25 bp, Rattus norvegicus
attgtcactgagtctggtcgccagc

SEQ ID NO: 211751 - DNA, 25 bp, Rattus norvegicus
attgtcagatgcaggcactccacac

SEQ ID NO: 211752 - DNA, 25 bp, Rattus norvegicus
attgtcagatgctggcactccacac

SEQ ID NO: 211753 - DNA, 25 bp, Rattus norvegicus
attgtcagctaactggtccacatcc

SEQ ID NO: 211754 - DNA, 25 bp, Rattus norvegicus
attgtcagctaagtggtccacatcc

SEQ ID NO: 211755 - DNA, 25 bp, Rattus norvegicus
attgtcaggattctcggacccttgg

SEQ ID NO: 211756 - DNA, 25 bp, Rattus norvegicus
attgtcaggattgtcggacccttgg

SEQ ID NO: 211757 - DNA, 25 bp, Rattus norvegicus
attgtcagggttatgaggttgtcac

SEQ ID NO: 211758 - DNA, 25 bp, Rattus norvegicus
attgtcagggttttgaggttgtcac

SEQ ID NO: 211759 - DNA, 25 bp, Rattus norvegicus
attgtcatagtgagccttgtgttcc

SEQ ID NO: 211760 - DNA, 25 bp, Rattus norvegicus
attgtcatagtgtgccttgtgttcc

SEQ ID NO: 211761 - DNA, 25 bp, Rattus norvegicus
attgtcatcctacaacatccagtct

SEQ ID NO: 211762 - DNA, 25 bp, Rattus norvegicus
attgtcatcctagaacatccagtct

SEQ ID NO: 211763 - DNA, 25 bp, Rattus norvegicus
attgtcatcctgaactgactctgtg

SEQ ID NO: 211764 - DNA, 25 bp, Rattus norvegicus
attgtcatcctgtactgactctgtg

SEQ ID NO: 211765 - DNA, 25 bp, Rattus norvegicus
attgtcatctttccatccaaccgag

SEQ ID NO: 211766 - DNA, 25 bp, Rattus norvegicus
attgtcatctttctgttcccaagga

SEQ ID NO: 211767 - DNA, 25 bp, Rattus norvegicus
attgtcatctttgcatccaaccgag

SEQ ID NO: 211768 - DNA, 25 bp, Rattus norvegicus
attgtcatctttgtgttcccaagga

SEQ ID NO: 211769 - DNA, 25 bp, Rattus norvegicus
attgtcatggtgctggtgtcagcta

SEQ ID NO: 211770 - DNA, 25 bp, Rattus norvegicus
attgtcatggtggtggtgtcagcta

SEQ ID NO: 211771 - DNA, 25 bp, Rattus norvegicus
attgtcatgtacagttctgctggcc

SEQ ID NO: 211772 - DNA, 25 bp, Rattus norvegicus
attgtcatgtactgttctgctggcc

SEQ ID NO: 211773 - DNA, 25 bp, Rattus norvegicus
attgtcattgcaagcactgctggcc

SEQ ID NO: 211774 - DNA, 25 bp, Rattus norvegicus
attgtcattgcatgcactgctggcc

SEQ ID NO: 211775 - DNA, 25 bp, Rattus norvegicus
attgtcatttgaccaccttaccgta

SEQ ID NO: 211776 - DNA, 25 bp, Rattus norvegicus
attgtcatttgagcaccttaccgta

SEQ ID NO: 211777 - DNA, 25 bp, Rattus norvegicus
attgtccacagcatttacctcagca

SEQ ID NO: 211778 - DNA, 25 bp, Rattus norvegicus
attgtccacagcttttacctcagca

SEQ ID NO: 211779 - DNA, 25 bp, Rattus norvegicus
attgtccacatcagtgtgtgaccta

SEQ ID NO: 211780 - DNA, 25 bp, Rattus norvegicus
attgtccacatctgtgtgtgaccta

SEQ ID NO: 211781 - DNA, 25 bp, Rattus norvegicus
attgtccactatatgatgggacctg

SEQ ID NO: 211782 - DNA, 25 bp, Rattus norvegicus
attgtccactatttgatgggacctg

SEQ ID NO: 211783 - DNA, 25 bp, Rattus norvegicus
attgtccacttacatgtttcccatt

SEQ ID NO: 211784 - DNA, 25 bp, Rattus norvegicus
attgtccacttagatgtttcccatt

SEQ ID NO: 211785 - DNA, 25 bp, Rattus norvegicus
attgtccagatccaaaggctctacc

SEQ ID NO: 211786 - DNA, 25 bp, Rattus norvegicus
attgtccagatcgaaaggctctacc

SEQ ID NO: 211787 - DNA, 25 bp, Rattus norvegicus
attgtccagcaccacttagagccaa

SEQ ID NO: 211788 - DNA, 25 bp, Rattus norvegicus
attgtccagcacgacttagagccaa

SEQ ID NO: 211789 - DNA, 25 bp, Rattus norvegicus
attgtccagtggcatttgtctgctg

SEQ ID NO: 211790 - DNA, 25 bp, Rattus norvegicus
attgtccagtgggatttgtctgctg

SEQ ID NO: 211791 - DNA, 25 bp, Rattus norvegicus
attgtccatcgaagtccttgtagga

SEQ ID NO: 211792 - DNA, 25 bp, Rattus norvegicus
attgtccatcgatgtccttgtagga

SEQ ID NO: 211793 - DNA, 25 bp, Rattus norvegicus
attgtccatgagaagtgctcccagc

SEQ ID NO: 211794 - DNA, 25 bp, Rattus norvegicus
attgtccatgagtagtgctcccagc

SEQ ID NO: 211795 - DNA, 25 bp, Rattus norvegicus
attgtccatggaattgagtttccca

SEQ ID NO: 211796 - DNA, 25 bp, Rattus norvegicus
attgtccatggatttgagtttccca

SEQ ID NO: 211797 - DNA, 25 bp, Rattus norvegicus
attgtccattaccagttccaggtcc

SEQ ID NO: 211798 - DNA, 25 bp, Rattus norvegicus
attgtccattacgagttccaggtcc

SEQ ID NO: 211799 - DNA, 25 bp, Rattus norvegicus
attgtccattttagtaatcctcctg

SEQ ID NO: 211800 - DNA, 25 bp, Rattus norvegicus
attgtccatttttgtaatcctcctg

SEQ ID NO: 211801 - DNA, 25 bp, Rattus norvegicus
attgtcccaaggatctcagagctta

SEQ ID NO: 211802 - DNA, 25 bp, Rattus norvegicus
attgtcccaaggttctcagagctta

SEQ ID NO: 211803 - DNA, 25 bp, Rattus norvegicus
attgtcccaatgaatttgccacaca

SEQ ID NO: 211804 - DNA, 25 bp, Rattus norvegicus
attgtcccaatgtatttgccacaca

SEQ ID NO: 211805 - DNA, 25 bp, Rattus norvegicus
attgtcccattgattgacacccagt

SEQ ID NO: 211806 - DNA, 25 bp, Rattus norvegicus
attgtcccattgtttgacacccagt

SEQ ID NO: 211807 - DNA, 25 bp, Rattus norvegicus
attgtccccaagctctggatttttt

SEQ ID NO: 211808 - DNA, 25 bp, Rattus norvegicus
attgtccccaaggtctggatttttt

SEQ ID NO: 211809 - DNA, 25 bp, Rattus norvegicus
attgtcccccgcaagtgcttttggg

SEQ ID NO: 211810 - DNA, 25 bp, Rattus norvegicus
attgtcccccgctagtgcttttggg

SEQ ID NO: 211811 - DNA, 25 bp, Rattus norvegicus
attgtccctatcatataccctaaat

SEQ ID NO: 211812 - DNA, 25 bp, Rattus norvegicus
attgtccctatcttataccctaaat

SEQ ID NO: 211813 - DNA, 25 bp, Rattus norvegicus
attgtcccttggaacttttgcagtt

SEQ ID NO: 211814 - DNA, 25 bp, Rattus norvegicus
attgtcccttggtacttttgcagtt

SEQ ID NO: 211815 - DNA, 25 bp, Rattus norvegicus
attgtccgcatcagcagtccttggt

SEQ ID NO: 211816 - DNA, 25 bp, Rattus norvegicus
attgtccgcatctgcagtccttggt

SEQ ID NO: 211817 - DNA, 25 bp, Rattus norvegicus
attgtccgcttccaacaccagagga

SEQ ID NO: 211818 - DNA, 25 bp, Rattus norvegicus
attgtccgcttcgaacaccagagga

SEQ ID NO: 211819 - DNA, 25 bp, Rattus norvegicus
attgtccggaaacgcactggcgact

SEQ ID NO: 211820 - DNA, 25 bp, Rattus norvegicus
attgtccggaaaggcactggcgact

SEQ ID NO: 211821 - DNA, 25 bp, Rattus norvegicus
attgtccggttgctgcagtgtgacc

SEQ ID NO: 211822 - DNA, 25 bp, Rattus norvegicus
attgtccggttggtgcagtgtgacc

SEQ ID NO: 211823 - DNA, 25 bp, Rattus norvegicus
attgtcctaattctactgtttgctg

SEQ ID NO: 211824 - DNA, 25 bp, Rattus norvegicus
attgtcctaattgtactgtttgctg

SEQ ID NO: 211825 - DNA, 25 bp, Rattus norvegicus
attgtcctattcatggcccactgag

SEQ ID NO: 211826 - DNA, 25 bp, Rattus norvegicus
attgtcctattcttggcccactgag

SEQ ID NO: 211827 - DNA, 25 bp, Rattus norvegicus
attgtcctcagtctgtaagcctgcc

SEQ ID NO: 211828 - DNA, 25 bp, Rattus norvegicus
attgtcctcagtgtgtaagcctgcc

SEQ ID NO: 211829 - DNA, 25 bp, Rattus norvegicus
attgtcctctcgacatggtacatgg

SEQ ID NO: 211830 - DNA, 25 bp, Rattus norvegicus
attgtcctctcgtcatggtacatgg

SEQ ID NO: 211831 - DNA, 25 bp, Rattus norvegicus
attgtcctgcagaaccagtgagccc

SEQ ID NO: 211832 - DNA, 25 bp, Rattus norvegicus
attgtcctgcagtaccagtgagccc

SEQ ID NO: 211833 - DNA, 25 bp, Rattus norvegicus
attgtcctgctacagctagtgtgct

SEQ ID NO: 211834 - DNA, 25 bp, Rattus norvegicus
attgtcctgctagagctagtgtgct

SEQ ID NO: 211835 - DNA, 25 bp, Rattus norvegicus
attgtcctggatcccctagaacagc

SEQ ID NO: 211836 - DNA, 25 bp, Rattus norvegicus
attgtcctggatgccctagaacagc

SEQ ID NO: 211837 - DNA, 25 bp, Rattus norvegicus
attgtcctgggaaacccttccctga

SEQ ID NO: 211838 - DNA, 25 bp, Rattus norvegicus
attgtcctgggatacccttccctga

SEQ ID NO: 211839 - DNA, 25 bp, Rattus norvegicus
attgtcctggtgaagcagttccggc

SEQ ID NO: 211840 - DNA, 25 bp, Rattus norvegicus
attgtcctggtgtagcagttccggc

SEQ ID NO: 211841 - DNA, 25 bp, Rattus norvegicus
attgtcctgtatcgctaaccctagc

SEQ ID NO: 211842 - DNA, 25 bp, Rattus norvegicus
attgtcctgtatggctaaccctagc

SEQ ID NO: 211843 - DNA, 25 bp, Rattus norvegicus
attgtccttccgattgccatggtga

SEQ ID NO: 211844 - DNA, 25 bp, Rattus norvegicus
attgtccttccgtttgccatggtga

SEQ ID NO: 211845 - DNA, 25 bp, Rattus norvegicus
attgtccttgccacagctttgaaga

SEQ ID NO: 211846 - DNA, 25 bp, Rattus norvegicus
attgtccttgcctcagctttgaaga

SEQ ID NO: 211847 - DNA, 25 bp, Rattus norvegicus
attgtccttggaactgagcggcatt

SEQ ID NO: 211848 - DNA, 25 bp, Rattus norvegicus
attgtccttggatctgagcggcatt

SEQ ID NO: 211849 - DNA, 25 bp, Rattus norvegicus
attgtccttgtgaaccatttgggct

SEQ ID NO: 211850 - DNA, 25 bp, Rattus norvegicus
attgtccttgtgtaccatttgggct

SEQ ID NO: 211851 - DNA, 25 bp, Rattus norvegicus
attgtcctttccagacatggatgtc

SEQ ID NO: 211852 - DNA, 25 bp, Rattus norvegicus
attgtcctttcctgacatggatgtc

SEQ ID NO: 211853 - DNA, 25 bp, Rattus norvegicus
attgtcctttctactcattttgcca

SEQ ID NO: 211854 - DNA, 25 bp, Rattus norvegicus
attgtcctttcttctcattttgcca

SEQ ID NO: 211855 - DNA, 25 bp, Rattus norvegicus
attgtccttttcctgatgccatggg

SEQ ID NO: 211856 - DNA, 25 bp, Rattus norvegicus
attgtccttttcgtgatgccatggg

SEQ ID NO: 211857 - DNA, 25 bp, Rattus norvegicus
attgtcctttttaaccgaagacatg

SEQ ID NO: 211858 - DNA, 25 bp, Rattus norvegicus
attgtccttttttaccgaagacatg

SEQ ID NO: 211859 - DNA, 25 bp, Rattus norvegicus
attgtcgaagctcaacggtgattaa

SEQ ID NO: 211860 - DNA, 25 bp, Rattus norvegicus
attgtcgaagctgaacggtgattaa

SEQ ID NO: 211861 - DNA, 25 bp, Rattus norvegicus
attgtcgatctccattttccattat

SEQ ID NO: 211862 - DNA, 25 bp, Rattus norvegicus
attgtcgatctcgattttccattat

SEQ ID NO: 211863 - DNA, 25 bp, Rattus norvegicus
attgtcgcaagtcacagaattattt

SEQ ID NO: 211864 - DNA, 25 bp, Rattus norvegicus
attgtcgcaagtgacagaattattt

SEQ ID NO: 211865 - DNA, 25 bp, Rattus norvegicus
attgtcgcagacagtgtttcctttt

SEQ ID NO: 211866 - DNA, 25 bp, Rattus norvegicus
attgtcgcagactgtgtttcctttt

SEQ ID NO: 211867 - DNA, 25 bp, Rattus norvegicus
attgtcgcatatccataacagtgtt

SEQ ID NO: 211868 - DNA, 25 bp, Rattus norvegicus
attgtcgcatatgcataacagtgtt

SEQ ID NO: 211869 - DNA, 25 bp, Rattus norvegicus
attgtcgctcctctcagggccaaaa

SEQ ID NO: 211870 - DNA, 25 bp, Rattus norvegicus
attgtcgctcctgtcagggccaaaa

SEQ ID NO: 211871 - DNA, 25 bp, Rattus norvegicus
attgtcgggcgtcctcgtaaaactg

SEQ ID NO: 211872 - DNA, 25 bp, Rattus norvegicus
attgtcgggcgtgctcgtaaaactg

SEQ ID NO: 211873 - DNA, 25 bp, Rattus norvegicus
attgtcgtatagaaagcccatttag

SEQ ID NO: 211874 - DNA, 25 bp, Rattus norvegicus
attgtcgtatagtaagcccatttag

SEQ ID NO: 211875 - DNA, 25 bp, Rattus norvegicus
attgtcgtcgttcttccttggtctt

SEQ ID NO: 211876 - DNA, 25 bp, Rattus norvegicus
attgtcgtcgttgttccttggtctt

SEQ ID NO: 211877 - DNA, 25 bp, Rattus norvegicus
attgtcgtctatcctgtgcgatgct

SEQ ID NO: 211878 - DNA, 25 bp, Rattus norvegicus
attgtcgtctatgctgtgcgatgct

SEQ ID NO: 211879 - DNA, 25 bp, Rattus norvegicus
attgtcgtggaaagactgtgatcac

SEQ ID NO: 211880 - DNA, 25 bp, Rattus norvegicus
attgtcgtggaatgactgtgatcac

SEQ ID NO: 211881 - DNA, 25 bp, Rattus norvegicus
attgtcgttgtgagtcatcagaccc

SEQ ID NO: 211882 - DNA, 25 bp, Rattus norvegicus
attgtcgttgtgtgtcatcagaccc

SEQ ID NO: 211883 - DNA, 25 bp, Rattus norvegicus
attgtctaacctcaagcactgtcca

SEQ ID NO: 211884 - DNA, 25 bp, Rattus norvegicus
attgtctaacctgaagcactgtcca

SEQ ID NO: 211885 - DNA, 25 bp, Rattus norvegicus
attgtctaaggtcagccccaacatg

SEQ ID NO: 211886 - DNA, 25 bp, Rattus norvegicus
attgtctaaggtgagccccaacatg

SEQ ID NO: 211887 - DNA, 25 bp, Rattus norvegicus
attgtctacacacctgcatttcaag

SEQ ID NO: 211888 - DNA, 25 bp, Rattus norvegicus
attgtctacacagctgcatttcaag

SEQ ID NO: 211889 - DNA, 25 bp, Rattus norvegicus
attgtctacagccaattattggagg

SEQ ID NO: 211890 - DNA, 25 bp, Rattus norvegicus
attgtctacagcgaattattggagg

SEQ ID NO: 211891 - DNA, 25 bp, Rattus norvegicus
attgtctacccaagagtgtcagtgt

SEQ ID NO: 211892 - DNA, 25 bp, Rattus norvegicus
attgtctacccatgagtgtcagtgt

SEQ ID NO: 211893 - DNA, 25 bp, Rattus norvegicus
attgtctatgtcctgcctgcagatg

SEQ ID NO: 211894 - DNA, 25 bp, Rattus norvegicus
attgtctatgtcgtgcctgcagatg

SEQ ID NO: 211895 - DNA, 25 bp, Rattus norvegicus
attgtctcaaagagtcccagggcct

SEQ ID NO: 211896 - DNA, 25 bp, Rattus norvegicus
attgtctcaaagtgtcccagggcct

SEQ ID NO: 211897 - DNA, 25 bp, Rattus norvegicus
attgtctcagaacccttttacactt

SEQ ID NO: 211898 - DNA, 25 bp, Rattus norvegicus
attgtctcagaagccttttacactt

SEQ ID NO: 211899 - DNA, 25 bp, Rattus norvegicus
attgtctcagtcaagcccttcaggg

SEQ ID NO: 211900 - DNA, 25 bp, Rattus norvegicus
attgtctcagtcagctttagtcacc

SEQ ID NO: 211901 - DNA, 25 bp, Rattus norvegicus
attgtctcagtctagcccttcaggg

SEQ ID NO: 211902 - DNA, 25 bp, Rattus norvegicus
attgtctcagtctgctttagtcacc

SEQ ID NO: 211903 - DNA, 25 bp, Rattus norvegicus
attgtctcatcccagcactaggaag

SEQ ID NO: 211904 - DNA, 25 bp, Rattus norvegicus
attgtctcatccgagcactaggaag

SEQ ID NO: 211905 - DNA, 25 bp, Rattus norvegicus
attgtctccagactgtcactgttac

SEQ ID NO: 211906 - DNA, 25 bp, Rattus norvegicus
attgtctccagagtgtcactgttac

SEQ ID NO: 211907 - DNA, 25 bp, Rattus norvegicus
attgtctcccctctgtttctatatt

SEQ ID NO: 211908 - DNA, 25 bp, Rattus norvegicus
attgtctcccctgtgtttctatatt

SEQ ID NO: 211909 - DNA, 25 bp, Rattus norvegicus
attgtctcggttatatctggttgtt

SEQ ID NO: 211910 - DNA, 25 bp, Rattus norvegicus
attgtctcggttttatctggttgtt

SEQ ID NO: 211911 - DNA, 25 bp, Rattus norvegicus
attgtctctaacatcactcacatca

SEQ ID NO: 211912 - DNA, 25 bp, Rattus norvegicus
attgtctctaacttcactcacatca

SEQ ID NO: 211913 - DNA, 25 bp, Rattus norvegicus
attgtctctaccacacaccatagtc

SEQ ID NO: 211914 - DNA, 25 bp, Rattus norvegicus
attgtctctacctcacaccatagtc

SEQ ID NO: 211915 - DNA, 25 bp, Rattus norvegicus
attgtctctccactgaactaggctg

SEQ ID NO: 211916 - DNA, 25 bp, Rattus norvegicus
attgtctctccagtgaactaggctg

SEQ ID NO: 211917 - DNA, 25 bp, Rattus norvegicus
attgtctctcgaattttgtctgtca

SEQ ID NO: 211918 - DNA, 25 bp, Rattus norvegicus
attgtctctcgatttttgtctgtca

SEQ ID NO: 211919 - DNA, 25 bp, Rattus norvegicus
attgtctctcttcactttctgctat

SEQ ID NO: 211920 - DNA, 25 bp, Rattus norvegicus
attgtctctcttgactttctgctat

SEQ ID NO: 211921 - DNA, 25 bp, Rattus norvegicus
attgtctcttgtactgttcattccc

SEQ ID NO: 211922 - DNA, 25 bp, Rattus norvegicus
attgtctcttgttctgttcattccc

SEQ ID NO: 211923 - DNA, 25 bp, Rattus norvegicus
attgtctgacctatgcacatgcaca

SEQ ID NO: 211924 - DNA, 25 bp, Rattus norvegicus
attgtctgacctttgcacatgcaca

SEQ ID NO: 211925 - DNA, 25 bp, Rattus norvegicus
attgtctgagctcaggtgaccctga

SEQ ID NO: 211926 - DNA, 25 bp, Rattus norvegicus
attgtctgagctgaggtgaccctga

SEQ ID NO: 211927 - DNA, 25 bp, Rattus norvegicus
attgtctgaggccacataatcccag

SEQ ID NO: 211928 - DNA, 25 bp, Rattus norvegicus
attgtctgaggcgacataatcccag

SEQ ID NO: 211929 - DNA, 25 bp, Rattus norvegicus
attgtctgagttacacttgccacgt

SEQ ID NO: 211930 - DNA, 25 bp, Rattus norvegicus
attgtctgagtttcacttgccacgt

SEQ ID NO: 211931 - DNA, 25 bp, Rattus norvegicus
attgtctgcaagaaccacataggtc

SEQ ID NO: 211932 - DNA, 25 bp, Rattus norvegicus
attgtctgcaagtaccacataggtc

SEQ ID NO: 211933 - DNA, 25 bp, Rattus norvegicus
attgtctgcagcaactctccggaac

SEQ ID NO: 211934 - DNA, 25 bp, Rattus norvegicus
attgtctgcagctactctccggaac

SEQ ID NO: 211935 - DNA, 25 bp, Rattus norvegicus
attgtctgccttctgggcactgtgg

SEQ ID NO: 211936 - DNA, 25 bp, Rattus norvegicus
attgtctgccttgtgggcactgtgg

SEQ ID NO: 211937 - DNA, 25 bp, Rattus norvegicus
attgtctggagactgcagcccggca

SEQ ID NO: 211938 - DNA, 25 bp, Rattus norvegicus
attgtctggagagtgcagcccggca

SEQ ID NO: 211939 - DNA, 25 bp, Rattus norvegicus
attgtctggtacaatttgaacaaac

SEQ ID NO: 211940 - DNA, 25 bp, Rattus norvegicus
attgtctggtactatttgaacaaac

SEQ ID NO: 211941 - DNA, 25 bp, Rattus norvegicus
attgtctgtcttcttatccccagag

SEQ ID NO: 211942 - DNA, 25 bp, Rattus norvegicus
attgtctgtcttgttatccccagag

SEQ ID NO: 211943 - DNA, 25 bp, Rattus norvegicus
attgtctgtgacattctggagctgg

SEQ ID NO: 211944 - DNA, 25 bp, Rattus norvegicus
attgtctgtgactttctggagctgg

SEQ ID NO: 211945 - DNA, 25 bp, Rattus norvegicus
attgtcttaccacaccagtgctgat

SEQ ID NO: 211946 - DNA, 25 bp, Rattus norvegicus
attgtcttaccagaccagtgctgat

SEQ ID NO: 211947 - DNA, 25 bp, Rattus norvegicus
attgtcttactcattcagccttggt

SEQ ID NO: 211948 - DNA, 25 bp, Rattus norvegicus
attgtcttactctttcagccttggt

SEQ ID NO: 211949 - DNA, 25 bp, Rattus norvegicus
attgtcttcatgatggtcacggcca

SEQ ID NO: 211950 - DNA, 25 bp, Rattus norvegicus
attgtcttcatgttggtcacggcca

SEQ ID NO: 211951 - DNA, 25 bp, Rattus norvegicus
attgtcttccaaacaatcctcgtct

SEQ ID NO: 211952 - DNA, 25 bp, Rattus norvegicus
attgtcttccaaagttactaacagt

SEQ ID NO: 211953 - DNA, 25 bp, Rattus norvegicus
attgtcttccaatcaatcctcgtct

SEQ ID NO: 211954 - DNA, 25 bp, Rattus norvegicus
attgtcttccaatgttactaacagt

SEQ ID NO: 211955 - DNA, 25 bp, Rattus norvegicus
attgtcttcccaacagttttacata

SEQ ID NO: 211956 - DNA, 25 bp, Rattus norvegicus
attgtcttcccatcagttttacata

SEQ ID NO: 211957 - DNA, 25 bp, Rattus norvegicus
attgtcttccttagatcctaatgtg

SEQ ID NO: 211958 - DNA, 25 bp, Rattus norvegicus
attgtcttccttcttgccattgaaa

SEQ ID NO: 211959 - DNA, 25 bp, Rattus norvegicus
attgtcttccttgttgccattgaaa

SEQ ID NO: 211960 - DNA, 25 bp, Rattus norvegicus
attgtcttcctttgatcctaatgtg

SEQ ID NO: 211961 - DNA, 25 bp, Rattus norvegicus
attgtcttgtcaactgtccatcaac

SEQ ID NO: 211962 - DNA, 25 bp, Rattus norvegicus
attgtcttgtcatctgtccatcaac

SEQ ID NO: 211963 - DNA, 25 bp, Rattus norvegicus
attgtctttcatactaggaacctta

SEQ ID NO: 211964 - DNA, 25 bp, Rattus norvegicus
attgtctttcattctaggaacctta

SEQ ID NO: 211965 - DNA, 25 bp, Rattus norvegicus
attgtctttgtactggtgtcttatc

SEQ ID NO: 211966 - DNA, 25 bp, Rattus norvegicus
attgtctttgtagtggtgtcttatc

SEQ ID NO: 211967 - DNA, 25 bp, Rattus norvegicus
attgtcttttggaggtctgctcttc

SEQ ID NO: 211968 - DNA, 25 bp, Rattus norvegicus
attgtcttttggtggtctgctcttc

SEQ ID NO: 211969 - DNA, 25 bp, Rattus norvegicus
attgtgaacaccagagaaactccca

SEQ ID NO: 211970 - DNA, 25 bp, Rattus norvegicus
attgtgaacacctgagaaactccca

SEQ ID NO: 211971 - DNA, 25 bp, Rattus norvegicus
attgtgaacaggacttccagcgcac

SEQ ID NO: 211972 - DNA, 25 bp, Rattus norvegicus
attgtgaacaggtcttccagcgcac

SEQ ID NO: 211973 - DNA, 25 bp, Rattus norvegicus
attgtgaatccaatttttattgcat

SEQ ID NO: 211974 - DNA, 25 bp, Rattus norvegicus
attgtgaatccattttttattgcat

SEQ ID NO: 211975 - DNA, 25 bp, Rattus norvegicus
attgtgaatgtcaccagccaggcct

SEQ ID NO: 211976 - DNA, 25 bp, Rattus norvegicus
attgtgaatgtctccagccaggcct

SEQ ID NO: 211977 - DNA, 25 bp, Rattus norvegicus
attgtgaattgcatggctgcatgca

SEQ ID NO: 211978 - DNA, 25 bp, Rattus norvegicus
attgtgaattgcttggctgcatgca

SEQ ID NO: 211979 - DNA, 25 bp, Rattus norvegicus
attgtgacacccagaatcccggagt

SEQ ID NO: 211980 - DNA, 25 bp, Rattus norvegicus
attgtgacacccattgaagcccaaa

SEQ ID NO: 211981 - DNA, 25 bp, Rattus norvegicus
attgtgacaccctgaatcccggagt

SEQ ID NO: 211982 - DNA, 25 bp, Rattus norvegicus
attgtgacaccctttgaagcccaaa

SEQ ID NO: 211983 - DNA, 25 bp, Rattus norvegicus
attgtgacattcaacagtctgtatt

SEQ ID NO: 211984 - DNA, 25 bp, Rattus norvegicus
attgtgacattctacagtctgtatt

SEQ ID NO: 211985 - DNA, 25 bp, Rattus norvegicus
attgtgaccattagacctttcgttt

SEQ ID NO: 211986 - DNA, 25 bp, Rattus norvegicus
attgtgaccatttgacctttcgttt

SEQ ID NO: 211987 - DNA, 25 bp, Rattus norvegicus
attgtgactcatcgaatctttactc

SEQ ID NO: 211988 - DNA, 25 bp, Rattus norvegicus
attgtgactcatggaatctttactc

SEQ ID NO: 211989 - DNA, 25 bp, Rattus norvegicus
attgtgactgcgaccggatgggaaa

SEQ ID NO: 211990 - DNA, 25 bp, Rattus norvegicus
attgtgactgcgtccggatgggaaa

SEQ ID NO: 211991 - DNA, 25 bp, Rattus norvegicus
attgtgagccagaaacctccctgag

SEQ ID NO: 211992 - DNA, 25 bp, Rattus norvegicus
attgtgagccagtaacctccctgag

SEQ ID NO: 211993 - DNA, 25 bp, Rattus norvegicus
attgtgagcggtcccatccctgggt

SEQ ID NO: 211994 - DNA, 25 bp, Rattus norvegicus
attgtgagcggtgccatccctgggt

SEQ ID NO: 211995 - DNA, 25 bp, Rattus norvegicus
attgtgagtagtctcagcctgctgt

SEQ ID NO: 211996 - DNA, 25 bp, Rattus norvegicus
attgtgagtagtgtcagcctgctgt

SEQ ID NO: 211997 - DNA, 25 bp, Rattus norvegicus
attgtgatactgaggtcatatgccc

SEQ ID NO: 211998 - DNA, 25 bp, Rattus norvegicus
attgtgatactgtggtcatatgccc

SEQ ID NO: 211999 - DNA, 25 bp, Rattus norvegicus
attgtgatagaaagtccagggagca

SEQ ID NO: 212000 - DNA, 25 bp, Rattus norvegicus
attgtgatagaatgtccagggagca

SEQ ID NO: 212001 - DNA, 25 bp, Rattus norvegicus
attgtgatcaccatcgtgtgtcttt

SEQ ID NO: 212002 - DNA, 25 bp, Rattus norvegicus
attgtgatcaccttcgtgtgtcttt

SEQ ID NO: 212003 - DNA, 25 bp, Rattus norvegicus
attgtgatccacaagcactaggcag

SEQ ID NO: 212004 - DNA, 25 bp, Rattus norvegicus
attgtgatccactagcactaggcag

SEQ ID NO: 212005 - DNA, 25 bp, Rattus norvegicus
attgtgatccccattctctatgttg

SEQ ID NO: 212006 - DNA, 25 bp, Rattus norvegicus
attgtgatcccctttctctatgttg

SEQ ID NO: 212007 - DNA, 25 bp, Rattus norvegicus
attgtgattcatcccagtgtgccag

SEQ ID NO: 212008 - DNA, 25 bp, Rattus norvegicus
attgtgattcatcttatggctgagg

SEQ ID NO: 212009 - DNA, 25 bp, Rattus norvegicus
attgtgattcatgccagtgtgccag

SEQ ID NO: 212010 - DNA, 25 bp, Rattus norvegicus
attgtgattcatgttatggctgagg

SEQ ID NO: 212011 - DNA, 25 bp, Rattus norvegicus
attgtgcaaacaaggcgcccagggc

SEQ ID NO: 212012 - DNA, 25 bp, Rattus norvegicus
attgtgcaaacatggcgcccagggc

SEQ ID NO: 212013 - DNA, 25 bp, Rattus norvegicus
attgtgcagggcctcatggtctcag

SEQ ID NO: 212014 - DNA, 25 bp, Rattus norvegicus
attgtgcagggcgtcatggtctcag

SEQ ID NO: 212015 - DNA, 25 bp, Rattus norvegicus
attgtgcatctgatgtgaggatctc

SEQ ID NO: 212016 - DNA, 25 bp, Rattus norvegicus
attgtgcatctgttgtgaggatctc

SEQ ID NO: 212017 - DNA, 25 bp, Rattus norvegicus
attgtgcatgcaccacgggaggcca

SEQ ID NO: 212018 - DNA, 25 bp, Rattus norvegicus
attgtgcatgcagcacgggaggcca

SEQ ID NO: 212019 - DNA, 25 bp, Rattus norvegicus
attgtgcattgactctgttggatac

SEQ ID NO: 212020 - DNA, 25 bp, Rattus norvegicus
attgtgcattgagtctgttggatac

SEQ ID NO: 212021 - DNA, 25 bp, Rattus norvegicus
attgtgcccttcagcagggaggaca

SEQ ID NO: 212022 - DNA, 25 bp, Rattus norvegicus
attgtgcccttctgcagggaggaca

SEQ ID NO: 212023 - DNA, 25 bp, Rattus norvegicus
attgtgccctttaggtcatttctct

SEQ ID NO: 212024 - DNA, 25 bp, Rattus norvegicus
attgtgcccttttggtcatttctct

SEQ ID NO: 212025 - DNA, 25 bp, Rattus norvegicus
attgtgcctagtatagccaccacgg

SEQ ID NO: 212026 - DNA, 25 bp, Rattus norvegicus
attgtgcctagtttagccaccacgg

SEQ ID NO: 212027 - DNA, 25 bp, Rattus norvegicus
attgtgcctcagacttctcgaaagt

SEQ ID NO: 212028 - DNA, 25 bp, Rattus norvegicus
attgtgcctcagtcttctcgaaagt

SEQ ID NO: 212029 - DNA, 25 bp, Rattus norvegicus
attgtgcctctcaagcaatgggcca

SEQ ID NO: 212030 - DNA, 25 bp, Rattus norvegicus
attgtgcctctctagcaatgggcca

SEQ ID NO: 212031 - DNA, 25 bp, Rattus norvegicus
attgtgccttatatcacttccataa

SEQ ID NO: 212032 - DNA, 25 bp, Rattus norvegicus
attgtgccttatttcacttccataa

SEQ ID NO: 212033 - DNA, 25 bp, Rattus norvegicus
attgtgcgctaaagttatccctatg

SEQ ID NO: 212034 - DNA, 25 bp, Rattus norvegicus
attgtgcgctaatgttatccctatg

SEQ ID NO: 212035 - DNA, 25 bp, Rattus norvegicus
attgtgcgctttctcatggcaacca

SEQ ID NO: 212036 - DNA, 25 bp, Rattus norvegicus
attgtgcgctttgtcatggcaacca

SEQ ID NO: 212037 - DNA, 25 bp, Rattus norvegicus
attgtgctcatgactataatcacag

SEQ ID NO: 212038 - DNA, 25 bp, Rattus norvegicus
attgtgctcatgtctataatcacag

SEQ ID NO: 212039 - DNA, 25 bp, Rattus norvegicus
attgtgctcgctcacattttattgc

SEQ ID NO: 212040 - DNA, 25 bp, Rattus norvegicus
attgtgctcgctgacattttattgc

SEQ ID NO: 212041 - DNA, 25 bp, Rattus norvegicus
attgtgctgaaaacccttgtgctgt

SEQ ID NO: 212042 - DNA, 25 bp, Rattus norvegicus
attgtgctgaaatcccttgtgctgt

SEQ ID NO: 212043 - DNA, 25 bp, Rattus norvegicus
attgtgctgactcgatggcgccctg

SEQ ID NO: 212044 - DNA, 25 bp, Rattus norvegicus
attgtgctgactcgcccagacctgg

SEQ ID NO: 212045 - DNA, 25 bp, Rattus norvegicus
attgtgctgactggatggcgccctg

SEQ ID NO: 212046 - DNA, 25 bp, Rattus norvegicus
attgtgctgactggcccagacctgg

SEQ ID NO: 212047 - DNA, 25 bp, Rattus norvegicus
attgtgctgcatatctgattatagg

SEQ ID NO: 212048 - DNA, 25 bp, Rattus norvegicus
attgtgctgcatttctgattatagg

SEQ ID NO: 212049 - DNA, 25 bp, Rattus norvegicus
attgtgctgtgaattctactgtatt

SEQ ID NO: 212050 - DNA, 25 bp, Rattus norvegicus
attgtgctgtgatttctactgtatt

SEQ ID NO: 212051 - DNA, 25 bp, Rattus norvegicus
attgtgctgtgtcaactgaccacta

SEQ ID NO: 212052 - DNA, 25 bp, Rattus norvegicus
attgtgctgtgtgaactgaccacta

SEQ ID NO: 212053 - DNA, 25 bp, Rattus norvegicus
attgtgctgttaatgttgcctggaa

SEQ ID NO: 212054 - DNA, 25 bp, Rattus norvegicus
attgtgctgttattgttgcctggaa

SEQ ID NO: 212055 - DNA, 25 bp, Rattus norvegicus
attgtgcttaaaatccccatgtggg

SEQ ID NO: 212056 - DNA, 25 bp, Rattus norvegicus
attgtgcttaaattccccatgtggg

SEQ ID NO: 212057 - DNA, 25 bp, Rattus norvegicus
attgtgcttcacagatgtttgtggg

SEQ ID NO: 212058 - DNA, 25 bp, Rattus norvegicus
attgtgcttcactgatgtttgtggg

SEQ ID NO: 212059 - DNA, 25 bp, Rattus norvegicus
attgtgcttctaaccccagtagagt

SEQ ID NO: 212060 - DNA, 25 bp, Rattus norvegicus
attgtgcttctatccccagtagagt

SEQ ID NO: 212061 - DNA, 25 bp, Rattus norvegicus
attgtggaacagagcgtcctcgagc

SEQ ID NO: 212062 - DNA, 25 bp, Rattus norvegicus
attgtggaacagtgcgtcctcgagc

SEQ ID NO: 212063 - DNA, 25 bp, Rattus norvegicus
attgtggaacggacccacttggtgc

SEQ ID NO: 212064 - DNA, 25 bp, Rattus norvegicus
attgtggaacggtcccacttggtgc

SEQ ID NO: 212065 - DNA, 25 bp, Rattus norvegicus
attgtggacaccaactgcaacccat

SEQ ID NO: 212066 - DNA, 25 bp, Rattus norvegicus
attgtggacacctactgcaacccat

SEQ ID NO: 212067 - DNA, 25 bp, Rattus norvegicus
attgtggataccctgtgtgcgcact

SEQ ID NO: 212068 - DNA, 25 bp, Rattus norvegicus
attgtggataccgtgtgtgcgcact

SEQ ID NO: 212069 - DNA, 25 bp, Rattus norvegicus
attgtggatgttacgagcagtctca

SEQ ID NO: 212070 - DNA, 25 bp, Rattus norvegicus
attgtggatgtttcgagcagtctca

SEQ ID NO: 212071 - DNA, 25 bp, Rattus norvegicus
attgtggcaatgagttctcccttta

SEQ ID NO: 212072 - DNA, 25 bp, Rattus norvegicus
attgtggcaatgtgttctcccttta

SEQ ID NO: 212073 - DNA, 25 bp, Rattus norvegicus
attgtggcacacaggctacagagct

SEQ ID NO: 212074 - DNA, 25 bp, Rattus norvegicus
attgtggcacactggctacagagct

SEQ ID NO: 212075 - DNA, 25 bp, Rattus norvegicus
attgtggcagctcttggcctccaca

SEQ ID NO: 212076 - DNA, 25 bp, Rattus norvegicus
attgtggcagctgttggcctccaca

SEQ ID NO: 212077 - DNA, 25 bp, Rattus norvegicus
attgtggcaggtctcattcatctcg

SEQ ID NO: 212078 - DNA, 25 bp, Rattus norvegicus
attgtggcaggtgtcattcatctcg

SEQ ID NO: 212079 - DNA, 25 bp, Rattus norvegicus
attgtggcatagagtgcaccctgca

SEQ ID NO: 212080 - DNA, 25 bp, Rattus norvegicus
attgtggcatagtgtgcaccctgca

SEQ ID NO: 212081 - DNA, 25 bp, Rattus norvegicus
attgtggcatccctatttctatgtc

SEQ ID NO: 212082 - DNA, 25 bp, Rattus norvegicus
attgtggcatccgtatttctatgtc

SEQ ID NO: 212083 - DNA, 25 bp, Rattus norvegicus
attgtggcatgcagggtaactggaa

SEQ ID NO: 212084 - DNA, 25 bp, Rattus norvegicus
attgtggcatgctgggtaactggaa

SEQ ID NO: 212085 - DNA, 25 bp, Rattus norvegicus
attgtggccacacttgaccgtgacc

SEQ ID NO: 212086 - DNA, 25 bp, Rattus norvegicus
attgtggccacagttgaccgtgacc

SEQ ID NO: 212087 - DNA, 25 bp, Rattus norvegicus
attgtggccataaattcaggcttat

SEQ ID NO: 212088 - DNA, 25 bp, Rattus norvegicus
attgtggccatatattcaggcttat

SEQ ID NO: 212089 - DNA, 25 bp, Rattus norvegicus
attgtggctaaccacctggacgcgc

SEQ ID NO: 212090 - DNA, 25 bp, Rattus norvegicus
attgtggctaacgacctggacgcgc

SEQ ID NO: 212091 - DNA, 25 bp, Rattus norvegicus
attgtggctctgaactctctactac

SEQ ID NO: 212092 - DNA, 25 bp, Rattus norvegicus
attgtggctctgtactctctactac

SEQ ID NO: 212093 - DNA, 25 bp, Rattus norvegicus
attgtggcttcaccatcactgtggg

SEQ ID NO: 212094 - DNA, 25 bp, Rattus norvegicus
attgtggcttcagcatcactgtggg

SEQ ID NO: 212095 - DNA, 25 bp, Rattus norvegicus
attgtggctttcagttgcagtgtgt

SEQ ID NO: 212096 - DNA, 25 bp, Rattus norvegicus
attgtggctttctgttgcagtgtgt

SEQ ID NO: 212097 - DNA, 25 bp, Rattus norvegicus
attgtgggagcccagtcataccttg

SEQ ID NO: 212098 - DNA, 25 bp, Rattus norvegicus
attgtgggagccgagtcataccttg

SEQ ID NO: 212099 - DNA, 25 bp, Rattus norvegicus
attgtgggcagactatgtaatcgct

SEQ ID NO: 212100 - DNA, 25 bp, Rattus norvegicus
attgtgggcagagtatgtaatcgct

SEQ ID NO: 212101 - DNA, 25 bp, Rattus norvegicus
attgtgggtgtcaccttcacacagt

SEQ ID NO: 212102 - DNA, 25 bp, Rattus norvegicus
attgtgggtgtctccttcacacagt

SEQ ID NO: 212103 - DNA, 25 bp, Rattus norvegicus
attgtgggttctcgtttagctcttt

SEQ ID NO: 212104 - DNA, 25 bp, Rattus norvegicus
attgtgggttctggtttagctcttt

SEQ ID NO: 212105 - DNA, 25 bp, Rattus norvegicus
attgtgggtttaccccactggcttg

SEQ ID NO: 212106 - DNA, 25 bp, Rattus norvegicus
attgtgggtttagcccactggcttg

SEQ ID NO: 212107 - DNA, 25 bp, Rattus norvegicus
attgtggtacacagtcagcccattc

SEQ ID NO: 212108 - DNA, 25 bp, Rattus norvegicus
attgtggtacactgtcagcccattc

SEQ ID NO: 212109 - DNA, 25 bp, Rattus norvegicus
attgtggtccacagttgcctcggag

SEQ ID NO: 212110 - DNA, 25 bp, Rattus norvegicus
attgtggtccactgttgcctcggag

SEQ ID NO: 212111 - DNA, 25 bp, Rattus norvegicus
attgtggtgaccaagatggcgcttt

SEQ ID NO: 212112 - DNA, 25 bp, Rattus norvegicus
attgtggtgacctagatggcgcttt

SEQ ID NO: 212113 - DNA, 25 bp, Rattus norvegicus
attgtggtggagatgccccggctaa

SEQ ID NO: 212114 - DNA, 25 bp, Rattus norvegicus
attgtggtggagttgccccggctaa

SEQ ID NO: 212115 - DNA, 25 bp, Rattus norvegicus
attgtggttgctcgagctctgctcc

SEQ ID NO: 212116 - DNA, 25 bp, Rattus norvegicus
attgtggttgctggagctctgctcc

SEQ ID NO: 212117 - DNA, 25 bp, Rattus norvegicus
attgtgtacgcccaggtgaaaccct

SEQ ID NO: 212118 - DNA, 25 bp, Rattus norvegicus
attgtgtacgccgaggtgaaaccct

SEQ ID NO: 212119 - DNA, 25 bp, Rattus norvegicus
attgtgtactgtccacctgagtgtg

SEQ ID NO: 212120 - DNA, 25 bp, Rattus norvegicus
attgtgtactgtgcacctgagtgtg

SEQ ID NO: 212121 - DNA, 25 bp, Rattus norvegicus
attgtgtactttctgttgccatgaa

SEQ ID NO: 212122 - DNA, 25 bp, Rattus norvegicus
attgtgtactttgtgttgccatgaa

SEQ ID NO: 212123 - DNA, 25 bp, Rattus norvegicus
attgtgtagcccagccttttctatc

SEQ ID NO: 212124 - DNA, 25 bp, Rattus norvegicus
attgtgtagccctgccttttctatc

SEQ ID NO: 212125 - DNA, 25 bp, Rattus norvegicus
attgtgtataagacattctcataaa

SEQ ID NO: 212126 - DNA, 25 bp, Rattus norvegicus
attgtgtataagtcattctcataaa

SEQ ID NO: 212127 - DNA, 25 bp, Rattus norvegicus
attgtgtatacacactacaggcaaa

SEQ ID NO: 212128 - DNA, 25 bp, Rattus norvegicus
attgtgtatacagactacaggcaaa

SEQ ID NO: 212129 - DNA, 25 bp, Rattus norvegicus
attgtgtatagtactggctgaccca

SEQ ID NO: 212130 - DNA, 25 bp, Rattus norvegicus
attgtgtatagttctggctgaccca

SEQ ID NO: 212131 - DNA, 25 bp, Rattus norvegicus
attgtgtatcatcctttggcctcta

SEQ ID NO: 212132 - DNA, 25 bp, Rattus norvegicus
attgtgtatcatgctttggcctcta

SEQ ID NO: 212133 - DNA, 25 bp, Rattus norvegicus
attgtgtatctcagccatccttaaa

SEQ ID NO: 212134 - DNA, 25 bp, Rattus norvegicus
attgtgtatctctgccatccttaaa

SEQ ID NO: 212135 - DNA, 25 bp, Rattus norvegicus
attgtgtatgcaagcttctatagga

SEQ ID NO: 212136 - DNA, 25 bp, Rattus norvegicus
attgtgtatgcatgcttctatagga

SEQ ID NO: 212137 - DNA, 25 bp, Rattus norvegicus
attgtgtccagtcctgaggccctgc

SEQ ID NO: 212138 - DNA, 25 bp, Rattus norvegicus
attgtgtccagtgctgaggccctgc

SEQ ID NO: 212139 - DNA, 25 bp, Rattus norvegicus
attgtgtccataccaagccacctta

SEQ ID NO: 212140 - DNA, 25 bp, Rattus norvegicus
attgtgtccatagcaagccacctta

SEQ ID NO: 212141 - DNA, 25 bp, Rattus norvegicus
attgtgtcccaccatatagtgagtc

SEQ ID NO: 212142 - DNA, 25 bp, Rattus norvegicus
attgtgtcccacgatatagtgagtc

SEQ ID NO: 212143 - DNA, 25 bp, Rattus norvegicus
attgtgtcccgactgcctgaacgtt

SEQ ID NO: 212144 - DNA, 25 bp, Rattus norvegicus
attgtgtcccgagtgcctgaacgtt

SEQ ID NO: 212145 - DNA, 25 bp, Rattus norvegicus
attgtgtccgtacgcctgtaatccc

SEQ ID NO: 212146 - DNA, 25 bp, Rattus norvegicus
attgtgtccgtaggcctgtaatccc

SEQ ID NO: 212147 - DNA, 25 bp, Rattus norvegicus
attgtgtcctctatgtattgtgtcc

SEQ ID NO: 212148 - DNA, 25 bp, Rattus norvegicus
attgtgtcctctttgtattgtgtcc

SEQ ID NO: 212149 - DNA, 25 bp, Rattus norvegicus
attgtgtcctggagactcagtttcc

SEQ ID NO: 212150 - DNA, 25 bp, Rattus norvegicus
attgtgtcctggtgactcagtttcc

SEQ ID NO: 212151 - DNA, 25 bp, Rattus norvegicus
attgtgtcgcctacagctgtctaag

SEQ ID NO: 212152 - DNA, 25 bp, Rattus norvegicus
attgtgtcgccttcagctgtctaag

SEQ ID NO: 212153 - DNA, 25 bp, Rattus norvegicus
attgtgtctagaaatcttttcatta

SEQ ID NO: 212154 - DNA, 25 bp, Rattus norvegicus
attgtgtctagatatcttttcatta

SEQ ID NO: 212155 - DNA, 25 bp, Rattus norvegicus
attgtgtctgaaacgcttctggcgt

SEQ ID NO: 212156 - DNA, 25 bp, Rattus norvegicus
attgtgtctgaatcgcttctggcgt

SEQ ID NO: 212157 - DNA, 25 bp, Rattus norvegicus
attgtgtctgcactttcgcctgctg

SEQ ID NO: 212158 - DNA, 25 bp, Rattus norvegicus
attgtgtctgcagtttcgcctgctg

SEQ ID NO: 212159 - DNA, 25 bp, Rattus norvegicus
attgtgtctgttcatgttgcatccc

SEQ ID NO: 212160 - DNA, 25 bp, Rattus norvegicus
attgtgtctgttgatgttgcatccc

SEQ ID NO: 212161 - DNA, 25 bp, Rattus norvegicus
attgtgtgatggcattgtcgccttc

SEQ ID NO: 212162 - DNA, 25 bp, Rattus norvegicus
attgtgtgatgggattgtcgccttc

SEQ ID NO: 212163 - DNA, 25 bp, Rattus norvegicus
attgtgtgcaccaatgagattctca

SEQ ID NO: 212164 - DNA, 25 bp, Rattus norvegicus
attgtgtgcacctatgagattctca

SEQ ID NO: 212165 - DNA, 25 bp, Rattus norvegicus
attgtgtgcaggaacagtggccctc

SEQ ID NO: 212166 - DNA, 25 bp, Rattus norvegicus
attgtgtgcaggtacagtggccctc

SEQ ID NO: 212167 - DNA, 25 bp, Rattus norvegicus
attgtgtgctttatttcacccactg

SEQ ID NO: 212168 - DNA, 25 bp, Rattus norvegicus
attgtgtgctttttttcacccactg

SEQ ID NO: 212169 - DNA, 25 bp, Rattus norvegicus
attgtgtggcaaaaactgaatccta

SEQ ID NO: 212170 - DNA, 25 bp, Rattus norvegicus
attgtgtggcaataactgaatccta

SEQ ID NO: 212171 - DNA, 25 bp, Rattus norvegicus
attgtgtggctacgacccagtgcac

SEQ ID NO: 212172 - DNA, 25 bp, Rattus norvegicus
attgtgtggctaggacccagtgcac

SEQ ID NO: 212173 - DNA, 25 bp, Rattus norvegicus
attgtgtgtatccagctgtttctaa

SEQ ID NO: 212174 - DNA, 25 bp, Rattus norvegicus
attgtgtgtatcgagctgtttctaa

SEQ ID NO: 212175 - DNA, 25 bp, Rattus norvegicus
attgtgtgtctccttctgacacatg

SEQ ID NO: 212176 - DNA, 25 bp, Rattus norvegicus
attgtgtgtctcgttctgacacatg

SEQ ID NO: 212177 - DNA, 25 bp, Rattus norvegicus
attgtgtgtgcaccggctttgtgcc

SEQ ID NO: 212178 - DNA, 25 bp, Rattus norvegicus
attgtgtgtgcagcggctttgtgcc

SEQ ID NO: 212179 - DNA, 25 bp, Rattus norvegicus
attgtgttagtaattccaggaccga

SEQ ID NO: 212180 - DNA, 25 bp, Rattus norvegicus
attgtgttagtatttccaggaccga

SEQ ID NO: 212181 - DNA, 25 bp, Rattus norvegicus
attgtgttcaaaatggccctgacct

SEQ ID NO: 212182 - DNA, 25 bp, Rattus norvegicus
attgtgttcaaattggccctgacct

SEQ ID NO: 212183 - DNA, 25 bp, Rattus norvegicus
attgtgttcagtacaagctgtgaag

SEQ ID NO: 212184 - DNA, 25 bp, Rattus norvegicus
attgtgttcagttcaagctgtgaag

SEQ ID NO: 212185 - DNA, 25 bp, Rattus norvegicus
attgtgttcattagcactctgtgca

SEQ ID NO: 212186 - DNA, 25 bp, Rattus norvegicus
attgtgttcatttgcactctgtgca

SEQ ID NO: 212187 - DNA, 25 bp, Rattus norvegicus
attgtgttccatctgcctcctgggc

SEQ ID NO: 212188 - DNA, 25 bp, Rattus norvegicus
attgtgttccatgtgcctcctgggc

SEQ ID NO: 212189 - DNA, 25 bp, Rattus norvegicus
attgtgttcgtactgctcggagcaa

SEQ ID NO: 212190 - DNA, 25 bp, Rattus norvegicus
attgtgttcgtagtgctcggagcaa

SEQ ID NO: 212191 - DNA, 25 bp, Rattus norvegicus
attgtgttctccaaagtactttctg

SEQ ID NO: 212192 - DNA, 25 bp, Rattus norvegicus
attgtgttctcctaagtactttctg

SEQ ID NO: 212193 - DNA, 25 bp, Rattus norvegicus
attgtgttcttcagattcctttcag

SEQ ID NO: 212194 - DNA, 25 bp, Rattus norvegicus
attgtgttcttctgattcctttcag

SEQ ID NO: 212195 - DNA, 25 bp, Rattus norvegicus
attgtgttgtggactgtccctgcac

SEQ ID NO: 212196 - DNA, 25 bp, Rattus norvegicus
attgtgttgtggtctgtccctgcac

SEQ ID NO: 212197 - DNA, 25 bp, Rattus norvegicus
attgtgttgtgtatgcggaggccct

SEQ ID NO: 212198 - DNA, 25 bp, Rattus norvegicus
attgtgttgtgtttgcggaggccct

SEQ ID NO: 212199 - DNA, 25 bp, Rattus norvegicus
attgtgtttggcacttttagggtga

SEQ ID NO: 212200 - DNA, 25 bp, Rattus norvegicus
attgtgtttggctcttttagggtga

SEQ ID NO: 212201 - DNA, 25 bp, Rattus norvegicus
attgttaaagccacagtatcctttt

SEQ ID NO: 212202 - DNA, 25 bp, Rattus norvegicus
attgttaaagcctcagtatcctttt

SEQ ID NO: 212203 - DNA, 25 bp, Rattus norvegicus
attgttaaccttagtgtctccccag

SEQ ID NO: 212204 - DNA, 25 bp, Rattus norvegicus
attgttaacctttgtgtctccccag

SEQ ID NO: 212205 - DNA, 25 bp, Rattus norvegicus
attgttaagcaaatccccatcacct

SEQ ID NO: 212206 - DNA, 25 bp, Rattus norvegicus
attgttaagcaattccccatcacct

SEQ ID NO: 212207 - DNA, 25 bp, Rattus norvegicus
attgttaatttacctccatcctctt

SEQ ID NO: 212208 - DNA, 25 bp, Rattus norvegicus
attgttaatttagctccatcctctt

SEQ ID NO: 212209 - DNA, 25 bp, Rattus norvegicus
attgttacacacagaatccactaat

SEQ ID NO: 212210 - DNA, 25 bp, Rattus norvegicus
attgttacacactgaatccactaat

SEQ ID NO: 212211 - DNA, 25 bp, Rattus norvegicus
attgttacacagagcctgtcacttt

SEQ ID NO: 212212 - DNA, 25 bp, Rattus norvegicus
attgttacacagtgcctgtcacttt

SEQ ID NO: 212213 - DNA, 25 bp, Rattus norvegicus
attgttacctggaagcagccacaga

SEQ ID NO: 212214 - DNA, 25 bp, Rattus norvegicus
attgttacctggtagcagccacaga

SEQ ID NO: 212215 - DNA, 25 bp, Rattus norvegicus
attgttacggttctctacattctgc

SEQ ID NO: 212216 - DNA, 25 bp, Rattus norvegicus
attgttacggttgtctacattctgc

SEQ ID NO: 212217 - DNA, 25 bp, Rattus norvegicus
attgttacttttcacatgctcgctt

SEQ ID NO: 212218 - DNA, 25 bp, Rattus norvegicus
attgttacttttgacatgctcgctt

SEQ ID NO: 212219 - DNA, 25 bp, Rattus norvegicus
attgttagaatacccactgtccttt

SEQ ID NO: 212220 - DNA, 25 bp, Rattus norvegicus
attgttagaatagccactgtccttt

SEQ ID NO: 212221 - DNA, 25 bp, Rattus norvegicus
attgttagactacttttgctgatga

SEQ ID NO: 212222 - DNA, 25 bp, Rattus norvegicus
attgttagactagttttgctgatga

SEQ ID NO: 212223 - DNA, 25 bp, Rattus norvegicus
attgttaggccgagtaagtccaaat

SEQ ID NO: 212224 - DNA, 25 bp, Rattus norvegicus
attgttaggccgtgtaagtccaaat

SEQ ID NO: 212225 - DNA, 25 bp, Rattus norvegicus
attgttagggctcactgcatcgggc

SEQ ID NO: 212226 - DNA, 25 bp, Rattus norvegicus
attgttagggctgactgcatcgggc

SEQ ID NO: 212227 - DNA, 25 bp, Rattus norvegicus
attgttatatctccatgttatgtgg

SEQ ID NO: 212228 - DNA, 25 bp, Rattus norvegicus
attgttatatctgcatgttatgtgg

SEQ ID NO: 212229 - DNA, 25 bp, Rattus norvegicus
attgttatcagccaacatcgttgtt

SEQ ID NO: 212230 - DNA, 25 bp, Rattus norvegicus
attgttatcagcgaacatcgttgtt

SEQ ID NO: 212231 - DNA, 25 bp, Rattus norvegicus
attgttcaaaggagccaactcgccc

SEQ ID NO: 212232 - DNA, 25 bp, Rattus norvegicus
attgttcaaaggtgccaactcgccc

SEQ ID NO: 212233 - DNA, 25 bp, Rattus norvegicus
attgttcaaatgacgatgcctcctg

SEQ ID NO: 212234 - DNA, 25 bp, Rattus norvegicus
attgttcaaatgtcgatgcctcctg

SEQ ID NO: 212235 - DNA, 25 bp, Rattus norvegicus
attgttcaacggctgtcccctccag

SEQ ID NO: 212236 - DNA, 25 bp, Rattus norvegicus
attgttcaacgggtgtcccctccag

SEQ ID NO: 212237 - DNA, 25 bp, Rattus norvegicus
attgttcaactaaggccagggctgt

SEQ ID NO: 212238 - DNA, 25 bp, Rattus norvegicus
attgttcaactatggccagggctgt

SEQ ID NO: 212239 - DNA, 25 bp, Rattus norvegicus
attgttcaatgcagcctacccaggt

SEQ ID NO: 212240 - DNA, 25 bp, Rattus norvegicus
attgttcaatgctgcctacccaggt

SEQ ID NO: 212241 - DNA, 25 bp, Rattus norvegicus
attgttcagcagctcagggtttgga

SEQ ID NO: 212242 - DNA, 25 bp, Rattus norvegicus
attgttcagcaggtcagggtttgga

SEQ ID NO: 212243 - DNA, 25 bp, Rattus norvegicus
attgttccaaagcactacctcacca

SEQ ID NO: 212244 - DNA, 25 bp, Rattus norvegicus
attgttccaaaggactacctcacca

SEQ ID NO: 212245 - DNA, 25 bp, Rattus norvegicus
attgttccaacaagccagaggctgt

SEQ ID NO: 212246 - DNA, 25 bp, Rattus norvegicus
attgttccaacatgccagaggctgt

SEQ ID NO: 212247 - DNA, 25 bp, Rattus norvegicus
attgttccgagtcctagagcatcta

SEQ ID NO: 212248 - DNA, 25 bp, Rattus norvegicus
attgttccgagtgctagagcatcta

SEQ ID NO: 212249 - DNA, 25 bp, Rattus norvegicus
attgttcctggtcgtggatgtgcca

SEQ ID NO: 212250 - DNA, 25 bp, Rattus norvegicus
attgttcctggtggtggatgtgcca

SEQ ID NO: 212251 - DNA, 25 bp, Rattus norvegicus
attgttcctgttaggtacatcctcc

SEQ ID NO: 212252 - DNA, 25 bp, Rattus norvegicus
attgttcctgtttggtacatcctcc

SEQ ID NO: 212253 - DNA, 25 bp, Rattus norvegicus
attgttcctttccagtgttcagagt

SEQ ID NO: 212254 - DNA, 25 bp, Rattus norvegicus
attgttcctttcgagtgttcagagt

SEQ ID NO: 212255 - DNA, 25 bp, Rattus norvegicus
attgttcctttgatgtattctgtaa

SEQ ID NO: 212256 - DNA, 25 bp, Rattus norvegicus
attgttcctttgttgtattctgtaa

SEQ ID NO: 212257 - DNA, 25 bp, Rattus norvegicus
attgttctatttagccaagctggta

SEQ ID NO: 212258 - DNA, 25 bp, Rattus norvegicus
attgttctattttgccaagctggta

SEQ ID NO: 212259 - DNA, 25 bp, Rattus norvegicus
attgttctcccaccctcagtgttct

SEQ ID NO: 212260 - DNA, 25 bp, Rattus norvegicus
attgttctcccagcctcagtgttct

SEQ ID NO: 212261 - DNA, 25 bp, Rattus norvegicus
attgttctcctacacaaggccatga

SEQ ID NO: 212262 - DNA, 25 bp, Rattus norvegicus
attgttctcctagacaaggccatga

SEQ ID NO: 212263 - DNA, 25 bp, Rattus norvegicus
attgttctctttagtgatgtctgac

SEQ ID NO: 212264 - DNA, 25 bp, Rattus norvegicus
attgttctcttttgtgatgtctgac

SEQ ID NO: 212265 - DNA, 25 bp, Rattus norvegicus
attgttctgagcatcttggctgata

SEQ ID NO: 212266 - DNA, 25 bp, Rattus norvegicus
attgttctgagcttcttggctgata

SEQ ID NO: 212267 - DNA, 25 bp, Rattus norvegicus
attgttctgaggatcctgaagccca

SEQ ID NO: 212268 - DNA, 25 bp, Rattus norvegicus
attgttctgaggttcctgaagccca

SEQ ID NO: 212269 - DNA, 25 bp, Rattus norvegicus
attgttctggccatctttttcaagc

SEQ ID NO: 212270 - DNA, 25 bp, Rattus norvegicus
attgttctggccttctttttcaagc

SEQ ID NO: 212271 - DNA, 25 bp, Rattus norvegicus
attgttctgtctctctgtgttctta

SEQ ID NO: 212272 - DNA, 25 bp, Rattus norvegicus
attgttctgtctgtctgtgttctta

SEQ ID NO: 212273 - DNA, 25 bp, Rattus norvegicus
attgttcttactcgctacatttccc

SEQ ID NO: 212274 - DNA, 25 bp, Rattus norvegicus
attgttcttactggctacatttccc

SEQ ID NO: 212275 - DNA, 25 bp, Rattus norvegicus
attgttcttagtaggagtcttctcc

SEQ ID NO: 212276 - DNA, 25 bp, Rattus norvegicus
attgttcttagtcatccagatggtt

SEQ ID NO: 212277 - DNA, 25 bp, Rattus norvegicus
attgttcttagtgatccagatggtt

SEQ ID NO: 212278 - DNA, 25 bp, Rattus norvegicus
attgttcttagttggagtcttctcc

SEQ ID NO: 212279 - DNA, 25 bp, Rattus norvegicus
attgttcttcaaatgcctgactcag

SEQ ID NO: 212280 - DNA, 25 bp, Rattus norvegicus
attgttcttcaattgcctgactcag

SEQ ID NO: 212281 - DNA, 25 bp, Rattus norvegicus
attgttcttcttaaacctctagcag

SEQ ID NO: 212282 - DNA, 25 bp, Rattus norvegicus
attgttcttctttaacctctagcag

SEQ ID NO: 212283 - DNA, 25 bp, Rattus norvegicus
attgttcttgctctgtgttgccaaa

SEQ ID NO: 212284 - DNA, 25 bp, Rattus norvegicus
attgttcttgctgtgtgttgccaaa

SEQ ID NO: 212285 - DNA, 25 bp, Rattus norvegicus
attgttgaatcaaagagccctctta

SEQ ID NO: 212286 - DNA, 25 bp, Rattus norvegicus
attgttgaatcatagagccctctta

SEQ ID NO: 212287 - DNA, 25 bp, Rattus norvegicus
attgttgaggcgctatagactaagg

SEQ ID NO: 212288 - DNA, 25 bp, Rattus norvegicus
attgttgaggcggtatagactaagg

SEQ ID NO: 212289 - DNA, 25 bp, Rattus norvegicus
attgttgagggtccagcccaattac

SEQ ID NO: 212290 - DNA, 25 bp, Rattus norvegicus
attgttgagggtgcagcccaattac

SEQ ID NO: 212291 - DNA, 25 bp, Rattus norvegicus
attgttgagtcaagtagtctgtgaa

SEQ ID NO: 212292 - DNA, 25 bp, Rattus norvegicus
attgttgagtcatgtagtctgtgaa

SEQ ID NO: 212293 - DNA, 25 bp, Rattus norvegicus
attgttgagttacttcccagggcag

SEQ ID NO: 212294 - DNA, 25 bp, Rattus norvegicus
attgttgagttagttcccagggcag

SEQ ID NO: 212295 - DNA, 25 bp, Rattus norvegicus
attgttgatactattaccaccagaa

SEQ ID NO: 212296 - DNA, 25 bp, Rattus norvegicus
attgttgatacttttaccaccagaa

SEQ ID NO: 212297 - DNA, 25 bp, Rattus norvegicus
attgttgatgagcattcgccggtcc

SEQ ID NO: 212298 - DNA, 25 bp, Rattus norvegicus
attgttgatgaggattcgccggtcc

SEQ ID NO: 212299 - DNA, 25 bp, Rattus norvegicus
attgttgcagacctactctcagacc

SEQ ID NO: 212300 - DNA, 25 bp, Rattus norvegicus
attgttgcagacgtactctcagacc

SEQ ID NO: 212301 - DNA, 25 bp, Rattus norvegicus
attgttgcatcacaggccctggcta

SEQ ID NO: 212302 - DNA, 25 bp, Rattus norvegicus
attgttgcatcagaggccctggcta

SEQ ID NO: 212303 - DNA, 25 bp, Rattus norvegicus
attgttgcatgacccctgtctgcca

SEQ ID NO: 212304 - DNA, 25 bp, Rattus norvegicus
attgttgcatgagccctgtctgcca

SEQ ID NO: 212305 - DNA, 25 bp, Rattus norvegicus
attgttgccaaacacgtgtatacct

SEQ ID NO: 212306 - DNA, 25 bp, Rattus norvegicus
attgttgccaaagacgtgtatacct

SEQ ID NO: 212307 - DNA, 25 bp, Rattus norvegicus
attgttgccctgagacctaatgttc

SEQ ID NO: 212308 - DNA, 25 bp, Rattus norvegicus
attgttgccctgtgacctaatgttc

SEQ ID NO: 212309 - DNA, 25 bp, Rattus norvegicus
attgttgccgctctctttatccctg

SEQ ID NO: 212310 - DNA, 25 bp, Rattus norvegicus
attgttgccgctgtctttatccctg

SEQ ID NO: 212311 - DNA, 25 bp, Rattus norvegicus
attgttgcggatcgcccgcacccag

SEQ ID NO: 212312 - DNA, 25 bp, Rattus norvegicus
attgttgcggatggcccgcacccag

SEQ ID NO: 212313 - DNA, 25 bp, Rattus norvegicus
attgttgctactctcatctgagcct

SEQ ID NO: 212314 - DNA, 25 bp, Rattus norvegicus
attgttgctactgtcatctgagcct

SEQ ID NO: 212315 - DNA, 25 bp, Rattus norvegicus
attgttgctagactaatttcatcag

SEQ ID NO: 212316 - DNA, 25 bp, Rattus norvegicus
attgttgctagagtaatttcatcag

SEQ ID NO: 212317 - DNA, 25 bp, Rattus norvegicus
attgttgctatgctctgtcctggaa

SEQ ID NO: 212318 - DNA, 25 bp, Rattus norvegicus
attgttgctatggtctgtcctggaa

SEQ ID NO: 212319 - DNA, 25 bp, Rattus norvegicus
attgttgcttcactgtttggctcag

SEQ ID NO: 212320 - DNA, 25 bp, Rattus norvegicus
attgttgcttcagtgtttggctcag

SEQ ID NO: 212321 - DNA, 25 bp, Rattus norvegicus
attgttgctttcaattctgtgttct

SEQ ID NO: 212322 - DNA, 25 bp, Rattus norvegicus
attgttgctttctattctgtgttct

SEQ ID NO: 212323 - DNA, 25 bp, Rattus norvegicus
attgttggagtcatgtggcttctct

SEQ ID NO: 212324 - DNA, 25 bp, Rattus norvegicus
attgttggagtcttgtggcttctct

SEQ ID NO: 212325 - DNA, 25 bp, Rattus norvegicus
attgttggccttaaactgcgctagt

SEQ ID NO: 212326 - DNA, 25 bp, Rattus norvegicus
attgttggcctttaactgcgctagt

SEQ ID NO: 212327 - DNA, 25 bp, Rattus norvegicus
attgttggtaagctctgggaattcc

SEQ ID NO: 212328 - DNA, 25 bp, Rattus norvegicus
attgttggtaaggtctgggaattcc

SEQ ID NO: 212329 - DNA, 25 bp, Rattus norvegicus
attgttgtctggctgtttcctcgag

SEQ ID NO: 212330 - DNA, 25 bp, Rattus norvegicus
attgttgtctgggtgtttcctcgag

SEQ ID NO: 212331 - DNA, 25 bp, Rattus norvegicus
attgttgtgcaacttttttccgctt

SEQ ID NO: 212332 - DNA, 25 bp, Rattus norvegicus
attgttgtgcaagttttttccgctt

SEQ ID NO: 212333 - DNA, 25 bp, Rattus norvegicus
attgtttaaactcggcacttggctg

SEQ ID NO: 212334 - DNA, 25 bp, Rattus norvegicus
attgtttaaactgggcacttggctg

SEQ ID NO: 212335 - DNA, 25 bp, Rattus norvegicus
attgtttaagaccttgagtttctca

SEQ ID NO: 212336 - DNA, 25 bp, Rattus norvegicus
attgtttaagacgttgagtttctca

SEQ ID NO: 212337 - DNA, 25 bp, Rattus norvegicus
attgtttatgttatcctgtcactgg

SEQ ID NO: 212338 - DNA, 25 bp, Rattus norvegicus
attgtttatgttttcctgtcactgg

SEQ ID NO: 212339 - DNA, 25 bp, Rattus norvegicus
attgtttattgtattttctgcctct

SEQ ID NO: 212340 - DNA, 25 bp, Rattus norvegicus
attgtttattgttttttctgcctct

SEQ ID NO: 212341 - DNA, 25 bp, Rattus norvegicus
attgtttcaaccattattctctatg

SEQ ID NO: 212342 - DNA, 25 bp, Rattus norvegicus
attgtttcaacctttattctctatg

SEQ ID NO: 212343 - DNA, 25 bp, Rattus norvegicus
attgtttcccacagccttaagggct

SEQ ID NO: 212344 - DNA, 25 bp, Rattus norvegicus
attgtttcccactgccttaagggct

SEQ ID NO: 212345 - DNA, 25 bp, Rattus norvegicus
attgtttcccggctagacacctgga

SEQ ID NO: 212346 - DNA, 25 bp, Rattus norvegicus
attgtttcccgggtagacacctgga

SEQ ID NO: 212347 - DNA, 25 bp, Rattus norvegicus
attgtttcccgtagtaagcctgtgc

SEQ ID NO: 212348 - DNA, 25 bp, Rattus norvegicus
attgtttcccgttgtaagcctgtgc

SEQ ID NO: 212349 - DNA, 25 bp, Rattus norvegicus
attgtttcccttcaacatagtctaa

SEQ ID NO: 212350 - DNA, 25 bp, Rattus norvegicus
attgtttcccttcaatgtgcactaa

SEQ ID NO: 212351 - DNA, 25 bp, Rattus norvegicus
attgtttcccttgaacatagtctaa

SEQ ID NO: 212352 - DNA, 25 bp, Rattus norvegicus
attgtttcccttgaatgtgcactaa

SEQ ID NO: 212353 - DNA, 25 bp, Rattus norvegicus
attgtttccgaacgatccatcgccc

SEQ ID NO: 212354 - DNA, 25 bp, Rattus norvegicus
attgtttccgaaggatccatcgccc

SEQ ID NO: 212355 - DNA, 25 bp, Rattus norvegicus
attgtttcgagcagggaaccctcaa

SEQ ID NO: 212356 - DNA, 25 bp, Rattus norvegicus
attgtttcgagctgggaaccctcaa

SEQ ID NO: 212357 - DNA, 25 bp, Rattus norvegicus
attgtttcgcctccatgtatgtgta

SEQ ID NO: 212358 - DNA, 25 bp, Rattus norvegicus
attgtttcgcctgcatgtatgtgta

SEQ ID NO: 212359 - DNA, 25 bp, Rattus norvegicus
attgtttctcaaagttcttcgtagc

SEQ ID NO: 212360 - DNA, 25 bp, Rattus norvegicus
attgtttctcaatgttcttcgtagc

SEQ ID NO: 212361 - DNA, 25 bp, Rattus norvegicus
attgtttctcttcaagtttggtcca

SEQ ID NO: 212362 - DNA, 25 bp, Rattus norvegicus
attgtttctcttgaagtttggtcca

SEQ ID NO: 212363 - DNA, 25 bp, Rattus norvegicus
attgtttctggaactgctgggtgcc

SEQ ID NO: 212364 - DNA, 25 bp, Rattus norvegicus
attgtttctggatctgctgggtgcc

SEQ ID NO: 212365 - DNA, 25 bp, Rattus norvegicus
attgtttcttgccacttgtgtctcg

SEQ ID NO: 212366 - DNA, 25 bp, Rattus norvegicus
attgtttcttgcgacttgtgtctcg

SEQ ID NO: 212367 - DNA, 25 bp, Rattus norvegicus
attgtttgatttcgtcctgcctaaa

SEQ ID NO: 212368 - DNA, 25 bp, Rattus norvegicus
attgtttgatttggtcctgcctaaa

SEQ ID NO: 212369 - DNA, 25 bp, Rattus norvegicus
attgtttgctaacatgtcaccatgt

SEQ ID NO: 212370 - DNA, 25 bp, Rattus norvegicus
attgtttgctaagatgtcaccatgt

SEQ ID NO: 212371 - DNA, 25 bp, Rattus norvegicus
attgtttgctcactacattatgcta

SEQ ID NO: 212372 - DNA, 25 bp, Rattus norvegicus
attgtttgctcagtacattatgcta

SEQ ID NO: 212373 - DNA, 25 bp, Rattus norvegicus
attgtttgctctcataccactctaa

SEQ ID NO: 212374 - DNA, 25 bp, Rattus norvegicus
attgtttgctctgataccactctaa

SEQ ID NO: 212375 - DNA, 25 bp, Rattus norvegicus
attgtttgctggagcttttgtaggg

SEQ ID NO: 212376 - DNA, 25 bp, Rattus norvegicus
attgtttgctggtgcttttgtaggg

SEQ ID NO: 212377 - DNA, 25 bp, Rattus norvegicus
attgtttgtaaaatgcccagggcag

SEQ ID NO: 212378 - DNA, 25 bp, Rattus norvegicus
attgtttgtaaattgcccagggcag

SEQ ID NO: 212379 - DNA, 25 bp, Rattus norvegicus
attgtttgtatcctgtcgacttgta

SEQ ID NO: 212380 - DNA, 25 bp, Rattus norvegicus
attgtttgtatcgtgtcgacttgta

SEQ ID NO: 212381 - DNA, 25 bp, Rattus norvegicus
attgttttacaactgataatccctt

SEQ ID NO: 212382 - DNA, 25 bp, Rattus norvegicus
attgttttacaagtgataatccctt

SEQ ID NO: 212383 - DNA, 25 bp, Rattus norvegicus
attgttttatgccaggacactaggt

SEQ ID NO: 212384 - DNA, 25 bp, Rattus norvegicus
attgttttatgcgaggacactaggt

SEQ ID NO: 212385 - DNA, 25 bp, Rattus norvegicus
attgttttcaagatgggtccctttg

SEQ ID NO: 212386 - DNA, 25 bp, Rattus norvegicus
attgttttcaagttgggtccctttg

SEQ ID NO: 212387 - DNA, 25 bp, Rattus norvegicus
attgttttcattccttaaagtcctg

SEQ ID NO: 212388 - DNA, 25 bp, Rattus norvegicus
attgttttcattgcttaaagtcctg

SEQ ID NO: 212389 - DNA, 25 bp, Rattus norvegicus
attgttttccagattttcaaggtct

SEQ ID NO: 212390 - DNA, 25 bp, Rattus norvegicus
attgttttccagtttttcaaggtct

SEQ ID NO: 212391 - DNA, 25 bp, Rattus norvegicus
attgttttctctattctgatgtagc

SEQ ID NO: 212392 - DNA, 25 bp, Rattus norvegicus
attgttttctcttttctgatgtagc

SEQ ID NO: 212393 - DNA, 25 bp, Rattus norvegicus
attgttttctttctctccatttggg

SEQ ID NO: 212394 - DNA, 25 bp, Rattus norvegicus
attgttttctttgtctccatttggg

SEQ ID NO: 212395 - DNA, 25 bp, Rattus norvegicus
attgttttgacaccatgtctgtgta

SEQ ID NO: 212396 - DNA, 25 bp, Rattus norvegicus
attgttttgacagcatgtctgtgta

SEQ ID NO: 212397 - DNA, 25 bp, Rattus norvegicus
attgttttgattatccgtggtgagc

SEQ ID NO: 212398 - DNA, 25 bp, Rattus norvegicus
attgttttgattttccgtggtgagc

SEQ ID NO: 212399 - DNA, 25 bp, Rattus norvegicus
attgttttgcggactcttgttactt

SEQ ID NO: 212400 - DNA, 25 bp, Rattus norvegicus
attgttttgcggtctcttgttactt

SEQ ID NO: 212401 - DNA, 25 bp, Rattus norvegicus
attgttttgctgaagatcctctaag

SEQ ID NO: 212402 - DNA, 25 bp, Rattus norvegicus
attgttttgctgtagatcctctaag

SEQ ID NO: 212403 - DNA, 25 bp, Rattus norvegicus
attgttttggatcaccattctccct

SEQ ID NO: 212404 - DNA, 25 bp, Rattus norvegicus
attgttttggatgaccattctccct

SEQ ID NO: 212405 - DNA, 25 bp, Rattus norvegicus
attgttttgtatatcgtagcggtag

SEQ ID NO: 212406 - DNA, 25 bp, Rattus norvegicus
attgttttgtatttcgtagcggtag

SEQ ID NO: 212407 - DNA, 25 bp, Rattus norvegicus
attgttttgtcccaagaggctgcta

SEQ ID NO: 212408 - DNA, 25 bp, Rattus norvegicus
attgttttgtcccttatttccatct

SEQ ID NO: 212409 - DNA, 25 bp, Rattus norvegicus
attgttttgtccgaagaggctgcta

SEQ ID NO: 212410 - DNA, 25 bp, Rattus norvegicus
attgttttgtccgttatttccatct

SEQ ID NO: 212411 - DNA, 25 bp, Rattus norvegicus
attgttttgttcactatcctctgga

SEQ ID NO: 212412 - DNA, 25 bp, Rattus norvegicus
attgttttgttctctatcctctgga

SEQ ID NO: 212413 - DNA, 25 bp, Rattus norvegicus
attgtttttaccacccagtcaagag

SEQ ID NO: 212414 - DNA, 25 bp, Rattus norvegicus
attgtttttacctcccagtcaagag

SEQ ID NO: 212415 - DNA, 25 bp, Rattus norvegicus
attgtttttgaaactaccctctgaa

SEQ ID NO: 212416 - DNA, 25 bp, Rattus norvegicus
attgtttttgaatctaccctctgaa

SEQ ID NO: 212417 - DNA, 25 bp, Rattus norvegicus
attgtttttgcaaactcctgatggt

SEQ ID NO: 212418 - DNA, 25 bp, Rattus norvegicus
attgtttttgcatactcctgatggt

SEQ ID NO: 212419 - DNA, 25 bp, Rattus norvegicus
atttaaaaaccacgcatcccatggg

SEQ ID NO: 212420 - DNA, 25 bp, Rattus norvegicus
atttaaaaaccaggcatcccatggg

SEQ ID NO: 212421 - DNA, 25 bp, Rattus norvegicus
atttaaaccagcatagcccttcttg

SEQ ID NO: 212422 - DNA, 25 bp, Rattus norvegicus
atttaaaccagcttagcccttcttg

SEQ ID NO: 212423 - DNA, 25 bp, Rattus norvegicus
atttaaaccattacagctcccctga

SEQ ID NO: 212424 - DNA, 25 bp, Rattus norvegicus
atttaaaccatttcagctcccctga

SEQ ID NO: 212425 - DNA, 25 bp, Rattus norvegicus
atttaaaccgttactgtatctcata

SEQ ID NO: 212426 - DNA, 25 bp, Rattus norvegicus
atttaaaccgtttctgtatctcata

SEQ ID NO: 212427 - DNA, 25 bp, Rattus norvegicus
atttaaacgaacactctcgactgtt

SEQ ID NO: 212428 - DNA, 25 bp, Rattus norvegicus
atttaaacgaactctctcgactgtt

SEQ ID NO: 212429 - DNA, 25 bp, Rattus norvegicus
atttaaacgtgcaggaatcatcccg

SEQ ID NO: 212430 - DNA, 25 bp, Rattus norvegicus
atttaaacgtgctggaatcatcccg

SEQ ID NO: 212431 - DNA, 25 bp, Rattus norvegicus
atttaaactaacactaccagccagg

SEQ ID NO: 212432 - DNA, 25 bp, Rattus norvegicus
atttaaactaactctaccagccagg

SEQ ID NO: 212433 - DNA, 25 bp, Rattus norvegicus
atttaaacttatactgcccagggag

SEQ ID NO: 212434 - DNA, 25 bp, Rattus norvegicus
atttaaacttattctgcccagggag

SEQ ID NO: 212435 - DNA, 25 bp, Rattus norvegicus
atttaaagacccagttgctcctctg

SEQ ID NO: 212436 - DNA, 25 bp, Rattus norvegicus
atttaaagaccctgttgctcctctg

SEQ ID NO: 212437 - DNA, 25 bp, Rattus norvegicus
atttaaagccttctcatccaggttc

SEQ ID NO: 212438 - DNA, 25 bp, Rattus norvegicus
atttaaagccttgtcatccaggttc

SEQ ID NO: 212439 - DNA, 25 bp, Rattus norvegicus
atttaaaggcacactgttcacattg

SEQ ID NO: 212440 - DNA, 25 bp, Rattus norvegicus
atttaaaggcactctgttcacattg

SEQ ID NO: 212441 - DNA, 25 bp, Rattus norvegicus
atttaaaggcctctggcttcactcc

SEQ ID NO: 212442 - DNA, 25 bp, Rattus norvegicus
atttaaaggcctgtggcttcactcc

SEQ ID NO: 212443 - DNA, 25 bp, Rattus norvegicus
atttaaagtcccaaggcaagcgaat

SEQ ID NO: 212444 - DNA, 25 bp, Rattus norvegicus
atttaaagtccctaggcaagcgaat

SEQ ID NO: 212445 - DNA, 25 bp, Rattus norvegicus
atttaaatcatgaatctgtctgtag

SEQ ID NO: 212446 - DNA, 25 bp, Rattus norvegicus
atttaaatcatgtatctgtctgtag

SEQ ID NO: 212447 - DNA, 25 bp, Rattus norvegicus
atttaaatcctgaactgaagtctgt

SEQ ID NO: 212448 - DNA, 25 bp, Rattus norvegicus
atttaaatcctgtactgaagtctgt

SEQ ID NO: 212449 - DNA, 25 bp, Rattus norvegicus
atttaaatgttacactgctgcgcat

SEQ ID NO: 212450 - DNA, 25 bp, Rattus norvegicus
atttaaatgttagactgctgcgcat

SEQ ID NO: 212451 - DNA, 25 bp, Rattus norvegicus
atttaacaacggcagtgcacctttg

SEQ ID NO: 212452 - DNA, 25 bp, Rattus norvegicus
atttaacaacgggagtgcacctttg

SEQ ID NO: 212453 - DNA, 25 bp, Rattus norvegicus
atttaacacactcttgtcgtcttca

SEQ ID NO: 212454 - DNA, 25 bp, Rattus norvegicus
atttaacacactgttgtcgtcttca

SEQ ID NO: 212455 - DNA, 25 bp, Rattus norvegicus
atttaacacgttctcttctctgctc

SEQ ID NO: 212456 - DNA, 25 bp, Rattus norvegicus
atttaacacgttgtcttctctgctc

SEQ ID NO: 212457 - DNA, 25 bp, Rattus norvegicus
atttaacactatctgtgtgacacac

SEQ ID NO: 212458 - DNA, 25 bp, Rattus norvegicus
atttaacactatgtgtgtgacacac

SEQ ID NO: 212459 - DNA, 25 bp, Rattus norvegicus
atttaaccctggacatgctatcccg

SEQ ID NO: 212460 - DNA, 25 bp, Rattus norvegicus
atttaaccctggtcatgctatcccg

SEQ ID NO: 212461 - DNA, 25 bp, Rattus norvegicus
atttaaccctttctgtcctagattg

SEQ ID NO: 212462 - DNA, 25 bp, Rattus norvegicus
atttaaccctttgtgtcctagattg

SEQ ID NO: 212463 - DNA, 25 bp, Rattus norvegicus
atttaacctaagagcaatgcctgcc

SEQ ID NO: 212464 - DNA, 25 bp, Rattus norvegicus
atttaacctaagtgcaatgcctgcc

SEQ ID NO: 212465 - DNA, 25 bp, Rattus norvegicus
atttaacctgacaccctcttgagga

SEQ ID NO: 212466 - DNA, 25 bp, Rattus norvegicus
atttaacctgactccctcttgagga

SEQ ID NO: 212467 - DNA, 25 bp, Rattus norvegicus
atttaacctgtaattgtgctttggc

SEQ ID NO: 212468 - DNA, 25 bp, Rattus norvegicus
atttaacctgtatttgtgctttggc

SEQ ID NO: 212469 - DNA, 25 bp, Rattus norvegicus
atttaaccttaaatgcctgacctgt

SEQ ID NO: 212470 - DNA, 25 bp, Rattus norvegicus
atttaaccttaattgcctgacctgt

SEQ ID NO: 212471 - DNA, 25 bp, Rattus norvegicus
atttaaccttcaactggctcactgg

SEQ ID NO: 212472 - DNA, 25 bp, Rattus norvegicus
atttaaccttcatctggctcactgg

SEQ ID NO: 212473 - DNA, 25 bp, Rattus norvegicus
atttaactcccaacttcttgcaagt

SEQ ID NO: 212474 - DNA, 25 bp, Rattus norvegicus
atttaactcccatcttcttgcaagt

SEQ ID NO: 212475 - DNA, 25 bp, Rattus norvegicus
atttaactgtctacttagcccaaca

SEQ ID NO: 212476 - DNA, 25 bp, Rattus norvegicus
atttaactgtcttcttagcccaaca

SEQ ID NO: 212477 - DNA, 25 bp, Rattus norvegicus
atttaacttcagagtctctccctct

SEQ ID NO: 212478 - DNA, 25 bp, Rattus norvegicus
atttaacttcagtgtctctccctct

SEQ ID NO: 212479 - DNA, 25 bp, Rattus norvegicus
atttaacttgatcacggccatctgc

SEQ ID NO: 212480 - DNA, 25 bp, Rattus norvegicus
atttaacttgatgacggccatctgc

SEQ ID NO: 212481 - DNA, 25 bp, Rattus norvegicus
atttaagaactacagcacagtgctg

SEQ ID NO: 212482 - DNA, 25 bp, Rattus norvegicus
atttaagaactagagcacagtgctg

SEQ ID NO: 212483 - DNA, 25 bp, Rattus norvegicus
atttaagaccttcctgttctgtgag

SEQ ID NO: 212484 - DNA, 25 bp, Rattus norvegicus
atttaagaccttgctgttctgtgag

SEQ ID NO: 212485 - DNA, 25 bp, Rattus norvegicus
atttaagatctgacacacggcctct

SEQ ID NO: 212486 - DNA, 25 bp, Rattus norvegicus
atttaagatctgtcacacggcctct

SEQ ID NO: 212487 - DNA, 25 bp, Rattus norvegicus
atttaagcctccctctcgtaagtgt

SEQ ID NO: 212488 - DNA, 25 bp, Rattus norvegicus
atttaagcctccgtctcgtaagtgt

SEQ ID NO: 212489 - DNA, 25 bp, Rattus norvegicus
atttaagctctgcttcatgctacct

SEQ ID NO: 212490 - DNA, 25 bp, Rattus norvegicus
atttaagctctggttcatgctacct

SEQ ID NO: 212491 - DNA, 25 bp, Rattus norvegicus
atttaagctgagcaaacagccttcc

SEQ ID NO: 212492 - DNA, 25 bp, Rattus norvegicus
atttaagctgaggaaacagccttcc

SEQ ID NO: 212493 - DNA, 25 bp, Rattus norvegicus
atttaaggaagaaccccatgctttc

SEQ ID NO: 212494 - DNA, 25 bp, Rattus norvegicus
atttaaggaagatccccatgctttc

SEQ ID NO: 212495 - DNA, 25 bp, Rattus norvegicus
atttaaggcctgaccaagctgttgg

SEQ ID NO: 212496 - DNA, 25 bp, Rattus norvegicus
atttaaggcctgtccaagctgttgg

SEQ ID NO: 212497 - DNA, 25 bp, Rattus norvegicus
atttaaggcttaacggcagaggtct

SEQ ID NO: 212498 - DNA, 25 bp, Rattus norvegicus
atttaaggcttatcggcagaggtct

SEQ ID NO: 212499 - DNA, 25 bp, Rattus norvegicus
atttaagtcatcagccattgacagt

SEQ ID NO: 212500 - DNA, 25 bp, Rattus norvegicus
atttaagtcatctgccattgacagt

SEQ ID NO: 212501 - DNA, 25 bp, Rattus norvegicus
atttaagtcctaatggctctgccta

SEQ ID NO: 212502 - DNA, 25 bp, Rattus norvegicus
atttaagtcctattggctctgccta

SEQ ID NO: 212503 - DNA, 25 bp, Rattus norvegicus
atttaagtcttcatgccatgggtgg

SEQ ID NO: 212504 - DNA, 25 bp, Rattus norvegicus
atttaagtcttcttgccatgggtgg

SEQ ID NO: 212505 - DNA, 25 bp, Rattus norvegicus
atttaagtgcctagtcaccatccac

SEQ ID NO: 212506 - DNA, 25 bp, Rattus norvegicus
atttaagtgccttgtcaccatccac

SEQ ID NO: 212507 - DNA, 25 bp, Rattus norvegicus
atttaagtgttgatctgctagcaga

SEQ ID NO: 212508 - DNA, 25 bp, Rattus norvegicus
atttaagtgttgttctgctagcaga

SEQ ID NO: 212509 - DNA, 25 bp, Rattus norvegicus
atttaatacgggaggccggctgcag

SEQ ID NO: 212510 - DNA, 25 bp, Rattus norvegicus
atttaatacgggtggccggctgcag

SEQ ID NO: 212511 - DNA, 25 bp, Rattus norvegicus
atttaatatgttaccttctttcaag

SEQ ID NO: 212512 - DNA, 25 bp, Rattus norvegicus
atttaatatgtttccttctttcaag

SEQ ID NO: 212513 - DNA, 25 bp, Rattus norvegicus
atttaatcaagaagcctggcctggc

SEQ ID NO: 212514 - DNA, 25 bp, Rattus norvegicus
atttaatcaagatgcctggcctggc

SEQ ID NO: 212515 - DNA, 25 bp, Rattus norvegicus
atttaatcacctcccaatcatacct

SEQ ID NO: 212516 - DNA, 25 bp, Rattus norvegicus
atttaatcacctgccaatcatacct

SEQ ID NO: 212517 - DNA, 25 bp, Rattus norvegicus
atttaatccactcaactgtatgtat

SEQ ID NO: 212518 - DNA, 25 bp, Rattus norvegicus
atttaatccactgaactgtatgtat

SEQ ID NO: 212519 - DNA, 25 bp, Rattus norvegicus
atttaatcctgccagtcacggtgca

SEQ ID NO: 212520 - DNA, 25 bp, Rattus norvegicus
atttaatcctgcgagtcacggtgca

SEQ ID NO: 212521 - DNA, 25 bp, Rattus norvegicus
atttaatccttccagtgagcttaca

SEQ ID NO: 212522 - DNA, 25 bp, Rattus norvegicus
atttaatccttcgagtgagcttaca

SEQ ID NO: 212523 - DNA, 25 bp, Rattus norvegicus
atttaatcctttctacttgtcgcta

SEQ ID NO: 212524 - DNA, 25 bp, Rattus norvegicus
atttaatcctttgtacttgtcgcta

SEQ ID NO: 212525 - DNA, 25 bp, Rattus norvegicus
atttaatcttccactgtctggctga

SEQ ID NO: 212526 - DNA, 25 bp, Rattus norvegicus
atttaatcttcctctgtctggctga

SEQ ID NO: 212527 - DNA, 25 bp, Rattus norvegicus
atttaatgaccccagccctttgatt

SEQ ID NO: 212528 - DNA, 25 bp, Rattus norvegicus
atttaatgacccgagccctttgatt

SEQ ID NO: 212529 - DNA, 25 bp, Rattus norvegicus
atttaatgagacagagccgccacac

SEQ ID NO: 212530 - DNA, 25 bp, Rattus norvegicus
atttaatgagactgagccgccacac

SEQ ID NO: 212531 - DNA, 25 bp, Rattus norvegicus
atttaatgctcactgtggcctggac

SEQ ID NO: 212532 - DNA, 25 bp, Rattus norvegicus
atttaatgctcagtgtggcctggac

SEQ ID NO: 212533 - DNA, 25 bp, Rattus norvegicus
atttaatggccacctaaagtgagca

SEQ ID NO: 212534 - DNA, 25 bp, Rattus norvegicus
atttaatggccagctaaagtgagca

SEQ ID NO: 212535 - DNA, 25 bp, Rattus norvegicus
atttaattttgtctgctccatccgg

SEQ ID NO: 212536 - DNA, 25 bp, Rattus norvegicus
atttaattttgtgtgctccatccgg

SEQ ID NO: 212537 - DNA, 25 bp, Rattus norvegicus
atttacaacaagctctacctaaggg

SEQ ID NO: 212538 - DNA, 25 bp, Rattus norvegicus
atttacaacaaggtctacctaaggg

SEQ ID NO: 212539 - DNA, 25 bp, Rattus norvegicus
atttacaaggcgatcttcagttcta

SEQ ID NO: 212540 - DNA, 25 bp, Rattus norvegicus
atttacaaggcgttcttcagttcta

SEQ ID NO: 212541 - DNA, 25 bp, Rattus norvegicus
atttacaagttgatcccaagggctt

SEQ ID NO: 212542 - DNA, 25 bp, Rattus norvegicus
atttacaagttgttcccaagggctt

SEQ ID NO: 212543 - DNA, 25 bp, Rattus norvegicus
atttacacacatcctgacagttcat

SEQ ID NO: 212544 - DNA, 25 bp, Rattus norvegicus
atttacacacatgctgacagttcat

SEQ ID NO: 212545 - DNA, 25 bp, Rattus norvegicus
atttacacctgacggcagcagcact

SEQ ID NO: 212546 - DNA, 25 bp, Rattus norvegicus
atttacacctgagggcagcagcact

SEQ ID NO: 212547 - DNA, 25 bp, Rattus norvegicus
atttacacctttcagaaccgctgct

SEQ ID NO: 212548 - DNA, 25 bp, Rattus norvegicus
atttacacctttgagaaccgctgct

SEQ ID NO: 212549 - DNA, 25 bp, Rattus norvegicus
atttacacttacagcagggtctctc

SEQ ID NO: 212550 - DNA, 25 bp, Rattus norvegicus
atttacacttactgcagggtctctc

SEQ ID NO: 212551 - DNA, 25 bp, Rattus norvegicus
atttacagagtacatcccggcctca

SEQ ID NO: 212552 - DNA, 25 bp, Rattus norvegicus
atttacagagtagatcccggcctca

SEQ ID NO: 212553 - DNA, 25 bp, Rattus norvegicus
atttacagattcagtcagtggacca

SEQ ID NO: 212554 - DNA, 25 bp, Rattus norvegicus
atttacagattctgtcagtggacca

SEQ ID NO: 212555 - DNA, 25 bp, Rattus norvegicus
atttacagcgtacatttacatacta

SEQ ID NO: 212556 - DNA, 25 bp, Rattus norvegicus
atttacagcgtagatttacatacta

SEQ ID NO: 212557 - DNA, 25 bp, Rattus norvegicus
atttacagttctactcatgcccaat

SEQ ID NO: 212558 - DNA, 25 bp, Rattus norvegicus
atttacagttcttctcatgcccaat

SEQ ID NO: 212559 - DNA, 25 bp, Rattus norvegicus
atttacagttgtctgctgtctgcca

SEQ ID NO: 212560 - DNA, 25 bp, Rattus norvegicus
atttacagttgtgtgctgtctgcca

SEQ ID NO: 212561 - DNA, 25 bp, Rattus norvegicus
atttacatatgaaacaggacgggat

SEQ ID NO: 212562 - DNA, 25 bp, Rattus norvegicus
atttacatatgatacaggacgggat

SEQ ID NO: 212563 - DNA, 25 bp, Rattus norvegicus
atttacatcgctacatccagaggac

SEQ ID NO: 212564 - DNA, 25 bp, Rattus norvegicus
atttacatcgcttcatccagaggac

SEQ ID NO: 212565 - DNA, 25 bp, Rattus norvegicus
atttacatgcctacaatcctagcgc

SEQ ID NO: 212566 - DNA, 25 bp, Rattus norvegicus
atttacatgccttcaatcctagcgc

SEQ ID NO: 212567 - DNA, 25 bp, Rattus norvegicus
atttacatgtgacccatatccttcc

SEQ ID NO: 212568 - DNA, 25 bp, Rattus norvegicus
atttacatgtgagccatatccttcc

SEQ ID NO: 212569 - DNA, 25 bp, Rattus norvegicus
atttacattaccactgatctccttg

SEQ ID NO: 212570 - DNA, 25 bp, Rattus norvegicus
atttacattacctctgatctccttg

SEQ ID NO: 212571 - DNA, 25 bp, Rattus norvegicus
atttacattcacagtgttccccgac

SEQ ID NO: 212572 - DNA, 25 bp, Rattus norvegicus
atttacattcactgtgttccccgac

SEQ ID NO: 212573 - DNA, 25 bp, Rattus norvegicus
atttaccaaagaactgtgactattc

SEQ ID NO: 212574 - DNA, 25 bp, Rattus norvegicus
atttaccaaagatctgtgactattc

SEQ ID NO: 212575 - DNA, 25 bp, Rattus norvegicus
atttaccaaggcaccagaccagtta

SEQ ID NO: 212576 - DNA, 25 bp, Rattus norvegicus
atttaccaaggctccagaccagtta

SEQ ID NO: 212577 - DNA, 25 bp, Rattus norvegicus
atttaccaatctaccttgttctgag

SEQ ID NO: 212578 - DNA, 25 bp, Rattus norvegicus
atttaccaatcttccttgttctgag

SEQ ID NO: 212579 - DNA, 25 bp, Rattus norvegicus
atttaccaatttactctgctttcta

SEQ ID NO: 212580 - DNA, 25 bp, Rattus norvegicus
atttaccaattttctctgctttcta

SEQ ID NO: 212581 - DNA, 25 bp, Rattus norvegicus
atttaccacaacagctgactctggc

SEQ ID NO: 212582 - DNA, 25 bp, Rattus norvegicus
atttaccacaactgctgactctggc

SEQ ID NO: 212583 - DNA, 25 bp, Rattus norvegicus
atttaccagcacaggttttcctagt

SEQ ID NO: 212584 - DNA, 25 bp, Rattus norvegicus
atttaccagcactggttttcctagt

SEQ ID NO: 212585 - DNA, 25 bp, Rattus norvegicus
atttaccagcttactgtgggctatg

SEQ ID NO: 212586 - DNA, 25 bp, Rattus norvegicus
atttaccagctttctgtgggctatg

SEQ ID NO: 212587 - DNA, 25 bp, Rattus norvegicus
atttaccatttgcacttttagtcag

SEQ ID NO: 212588 - DNA, 25 bp, Rattus norvegicus
atttaccatttggacttttagtcag

SEQ ID NO: 212589 - DNA, 25 bp, Rattus norvegicus
atttacccaatcatgcagtgccaag

SEQ ID NO: 212590 - DNA, 25 bp, Rattus norvegicus
atttacccaatcttgcagtgccaag

SEQ ID NO: 212591 - DNA, 25 bp, Rattus norvegicus
atttacccagaaatgacctgccttg

SEQ ID NO: 212592 - DNA, 25 bp, Rattus norvegicus
atttacccagaattgacctgccttg

SEQ ID NO: 212593 - DNA, 25 bp, Rattus norvegicus
atttacccgatgctccacttcatgt

SEQ ID NO: 212594 - DNA, 25 bp, Rattus norvegicus
atttacccgatggtccacttcatgt

SEQ ID NO: 212595 - DNA, 25 bp, Rattus norvegicus
atttaccctagtcaacagtcctgtt

SEQ ID NO: 212596 - DNA, 25 bp, Rattus norvegicus
atttaccctagtgaacagtcctgtt

SEQ ID NO: 212597 - DNA, 25 bp, Rattus norvegicus
atttaccctcctattaatgtgctgc

SEQ ID NO: 212598 - DNA, 25 bp, Rattus norvegicus
atttaccctccttttaatgtgctgc

SEQ ID NO: 212599 - DNA, 25 bp, Rattus norvegicus
atttaccgaagcatcagtcgctggg

SEQ ID NO: 212600 - DNA, 25 bp, Rattus norvegicus
atttaccgaagcttcagtcgctggg

SEQ ID NO: 212601 - DNA, 25 bp, Rattus norvegicus
atttaccggctgagagatgcccacc

SEQ ID NO: 212602 - DNA, 25 bp, Rattus norvegicus
atttaccggctgtgagatgcccacc

SEQ ID NO: 212603 - DNA, 25 bp, Rattus norvegicus
atttaccgttgaatgctttggcttg

SEQ ID NO: 212604 - DNA, 25 bp, Rattus norvegicus
atttaccgttgattgctttggcttg

SEQ ID NO: 212605 - DNA, 25 bp, Rattus norvegicus
atttacctattccttttcagcatct

SEQ ID NO: 212606 - DNA, 25 bp, Rattus norvegicus
atttacctattcgttttcagcatct

SEQ ID NO: 212607 - DNA, 25 bp, Rattus norvegicus
atttacctcattatccacagggtgg

SEQ ID NO: 212608 - DNA, 25 bp, Rattus norvegicus
atttacctcattttccacagggtgg

SEQ ID NO: 212609 - DNA, 25 bp, Rattus norvegicus
atttacctccaactcaagcaagcag

SEQ ID NO: 212610 - DNA, 25 bp, Rattus norvegicus
atttacctccaagtcaagcaagcag

SEQ ID NO: 212611 - DNA, 25 bp, Rattus norvegicus
atttacctgggcagggcctgtgcct

SEQ ID NO: 212612 - DNA, 25 bp, Rattus norvegicus
atttacctgggctgggcctgtgcct

SEQ ID NO: 212613 - DNA, 25 bp, Rattus norvegicus
atttacctgggtccttactataagc

SEQ ID NO: 212614 - DNA, 25 bp, Rattus norvegicus
atttacctgggtgcttactataagc

SEQ ID NO: 212615 - DNA, 25 bp, Rattus norvegicus
atttacctgtccatcatcatgctct

SEQ ID NO: 212616 - DNA, 25 bp, Rattus norvegicus
atttacctgtccttcatcatgctct

SEQ ID NO: 212617 - DNA, 25 bp, Rattus norvegicus
atttacgaggctcctaaacacagag

SEQ ID NO: 212618 - DNA, 25 bp, Rattus norvegicus
atttacgaggctgctaaacacagag

SEQ ID NO: 212619 - DNA, 25 bp, Rattus norvegicus
atttacgatatcaacagctgtgttt

SEQ ID NO: 212620 - DNA, 25 bp, Rattus norvegicus
atttacgatatctacagctgtgttt

SEQ ID NO: 212621 - DNA, 25 bp, Rattus norvegicus
atttacgcttctaaatttgcattat

SEQ ID NO: 212622 - DNA, 25 bp, Rattus norvegicus
atttacgcttcttaatttgcattat

SEQ ID NO: 212623 - DNA, 25 bp, Rattus norvegicus
atttacgggagacacctgctgcctg

SEQ ID NO: 212624 - DNA, 25 bp, Rattus norvegicus
atttacgggagagacctgctgcctg

SEQ ID NO: 212625 - DNA, 25 bp, Rattus norvegicus
atttacggttatctggacgcagctt

SEQ ID NO: 212626 - DNA, 25 bp, Rattus norvegicus
atttacggttatgtggacgcagctt

SEQ ID NO: 212627 - DNA, 25 bp, Rattus norvegicus
atttacgtcatcacagggcagttcc

SEQ ID NO: 212628 - DNA, 25 bp, Rattus norvegicus
atttacgtcatctcagggcagttcc

SEQ ID NO: 212629 - DNA, 25 bp, Rattus norvegicus
atttacgtgtggatctgctcagctc

SEQ ID NO: 212630 - DNA, 25 bp, Rattus norvegicus
atttacgtgtggttctgctcagctc

SEQ ID NO: 212631 - DNA, 25 bp, Rattus norvegicus
atttactaactcagtccttgtgcca

SEQ ID NO: 212632 - DNA, 25 bp, Rattus norvegicus
atttactaactctgtccttgtgcca

SEQ ID NO: 212633 - DNA, 25 bp, Rattus norvegicus
atttactaccttagagtcccattca

SEQ ID NO: 212634 - DNA, 25 bp, Rattus norvegicus
atttactacctttgagtcccattca

SEQ ID NO: 212635 - DNA, 25 bp, Rattus norvegicus
atttactataccaaggaagcatctt

SEQ ID NO: 212636 - DNA, 25 bp, Rattus norvegicus
atttactatacctaggaagcatctt

SEQ ID NO: 212637 - DNA, 25 bp, Rattus norvegicus
atttactatctgctaggtcctgtgg

SEQ ID NO: 212638 - DNA, 25 bp, Rattus norvegicus
atttactatctggtaggtcctgtgg

SEQ ID NO: 212639 - DNA, 25 bp, Rattus norvegicus
atttactcaaccatacacgtctgta

SEQ ID NO: 212640 - DNA, 25 bp, Rattus norvegicus
atttactcaaccttacacgtctgta

SEQ ID NO: 212641 - DNA, 25 bp, Rattus norvegicus
atttactcatatctcccatggattg

SEQ ID NO: 212642 - DNA, 25 bp, Rattus norvegicus
atttactcatatgtcccatggattg

SEQ ID NO: 212643 - DNA, 25 bp, Rattus norvegicus
atttactccgagaattgtacttcgt

SEQ ID NO: 212644 - DNA, 25 bp, Rattus norvegicus
atttactccgagtattgtacttcgt

SEQ ID NO: 212645 - DNA, 25 bp, Rattus norvegicus
atttactcctgcagtaatcagcaca

SEQ ID NO: 212646 - DNA, 25 bp, Rattus norvegicus
atttactcctgctgtaatcagcaca

SEQ ID NO: 212647 - DNA, 25 bp, Rattus norvegicus
atttactctcttctgtttcccaaag

SEQ ID NO: 212648 - DNA, 25 bp, Rattus norvegicus
atttactctcttgtgtttcccaaag

SEQ ID NO: 212649 - DNA, 25 bp, Rattus norvegicus
atttactctggtagctcattattag

SEQ ID NO: 212650 - DNA, 25 bp, Rattus norvegicus
atttactctggttgctcattattag

SEQ ID NO: 212651 - DNA, 25 bp, Rattus norvegicus
atttactctgtgactctgtctgtac

SEQ ID NO: 212652 - DNA, 25 bp, Rattus norvegicus
atttactctgtgtctctgtctgtac

SEQ ID NO: 212653 - DNA, 25 bp, Rattus norvegicus
atttactgaagtagctctcgccaga

SEQ ID NO: 212654 - DNA, 25 bp, Rattus norvegicus
atttactgaagttgctctcgccaga

SEQ ID NO: 212655 - DNA, 25 bp, Rattus norvegicus
atttactgacttcatatcatttggg

SEQ ID NO: 212656 - DNA, 25 bp, Rattus norvegicus
atttactgacttgatatcatttggg

SEQ ID NO: 212657 - DNA, 25 bp, Rattus norvegicus
atttactgagccagagcgctgtctg

SEQ ID NO: 212658 - DNA, 25 bp, Rattus norvegicus
atttactgagcctgagcgctgtctg

SEQ ID NO: 212659 - DNA, 25 bp, Rattus norvegicus
atttactgtctccaggtgcagggca

SEQ ID NO: 212660 - DNA, 25 bp, Rattus norvegicus
atttactgtctcgaggtgcagggca

SEQ ID NO: 212661 - DNA, 25 bp, Rattus norvegicus
atttactgtgacaccgtgctgtcat

SEQ ID NO: 212662 - DNA, 25 bp, Rattus norvegicus
atttactgtgactccgtgctgtcat

SEQ ID NO: 212663 - DNA, 25 bp, Rattus norvegicus
atttactgtgttatatatcctgcct

SEQ ID NO: 212664 - DNA, 25 bp, Rattus norvegicus
atttactgtgttttatatcctgcct

SEQ ID NO: 212665 - DNA, 25 bp, Rattus norvegicus
atttactgtttgcttctgtttggaa

SEQ ID NO: 212666 - DNA, 25 bp, Rattus norvegicus
atttactgtttggttctgtttggaa

SEQ ID NO: 212667 - DNA, 25 bp, Rattus norvegicus
atttacttcagtatctacgaatcgg

SEQ ID NO: 212668 - DNA, 25 bp, Rattus norvegicus
atttacttcagtttctacgaatcgg

SEQ ID NO: 212669 - DNA, 25 bp, Rattus norvegicus
atttacttcatgaggcctatgttca

SEQ ID NO: 212670 - DNA, 25 bp, Rattus norvegicus
atttacttcatgctgcatatacgca

SEQ ID NO: 212671 - DNA, 25 bp, Rattus norvegicus
atttacttcatggtgcatatacgca

SEQ ID NO: 212672 - DNA, 25 bp, Rattus norvegicus
atttacttcatgtggcctatgttca

SEQ ID NO: 212673 - DNA, 25 bp, Rattus norvegicus
atttacttctccagagtcctgccag

SEQ ID NO: 212674 - DNA, 25 bp, Rattus norvegicus
atttacttctcctgagtcctgccag

SEQ ID NO: 212675 - DNA, 25 bp, Rattus norvegicus
atttacttctggatgactcttctga

SEQ ID NO: 212676 - DNA, 25 bp, Rattus norvegicus
atttacttctggttgactcttctga

SEQ ID NO: 212677 - DNA, 25 bp, Rattus norvegicus
atttacttcttcagaacggcctgcc

SEQ ID NO: 212678 - DNA, 25 bp, Rattus norvegicus
atttacttcttctgaacggcctgcc

SEQ ID NO: 212679 - DNA, 25 bp, Rattus norvegicus
atttacttggtgactggtggctgtc

SEQ ID NO: 212680 - DNA, 25 bp, Rattus norvegicus
atttacttggtgtctggtggctgtc

SEQ ID NO: 212681 - DNA, 25 bp, Rattus norvegicus
atttacttgtgacgtgtgcgcagct

SEQ ID NO: 212682 - DNA, 25 bp, Rattus norvegicus
atttacttgtgaggtgtgcgcagct

SEQ ID NO: 212683 - DNA, 25 bp, Rattus norvegicus
atttactttactactcactactggg

SEQ ID NO: 212684 - DNA, 25 bp, Rattus norvegicus
atttactttacttctcactactggg

SEQ ID NO: 212685 - DNA, 25 bp, Rattus norvegicus
atttactttataatgacctgactca

SEQ ID NO: 212686 - DNA, 25 bp, Rattus norvegicus
atttactttatattgacctgactca

SEQ ID NO: 212687 - DNA, 25 bp, Rattus norvegicus
atttactttcatacggagttccgag

SEQ ID NO: 212688 - DNA, 25 bp, Rattus norvegicus
atttactttcattcggagttccgag

SEQ ID NO: 212689 - DNA, 25 bp, Rattus norvegicus
atttagaaccctctggcaggaccaa

SEQ ID NO: 212690 - DNA, 25 bp, Rattus norvegicus
atttagaaccctgtggcaggaccaa

SEQ ID NO: 212691 - DNA, 25 bp, Rattus norvegicus
atttagaactcaatgccccagacac

SEQ ID NO: 212692 - DNA, 25 bp, Rattus norvegicus
atttagaactcattgccccagacac

SEQ ID NO: 212693 - DNA, 25 bp, Rattus norvegicus
atttagaagacacctagtcaccctt

SEQ ID NO: 212694 - DNA, 25 bp, Rattus norvegicus
atttagaagacagctagtcaccctt

SEQ ID NO: 212695 - DNA, 25 bp, Rattus norvegicus
atttagactccaccttacttgtgat

SEQ ID NO: 212696 - DNA, 25 bp, Rattus norvegicus
atttagactccagcttacttgtgat

SEQ ID NO: 212697 - DNA, 25 bp, Rattus norvegicus
atttagactgaaagccaaagaccaa

SEQ ID NO: 212698 - DNA, 25 bp, Rattus norvegicus
atttagactgaatgccaaagaccaa

SEQ ID NO: 212699 - DNA, 25 bp, Rattus norvegicus
atttagacttctctccaacactaat

SEQ ID NO: 212700 - DNA, 25 bp, Rattus norvegicus
atttagacttctgtccaacactaat

SEQ ID NO: 212701 - DNA, 25 bp, Rattus norvegicus
atttagaggactacaggaaaccgct

SEQ ID NO: 212702 - DNA, 25 bp, Rattus norvegicus
atttagaggacttcaggaaaccgct

SEQ ID NO: 212703 - DNA, 25 bp, Rattus norvegicus
atttagatatctccacaggccctgt

SEQ ID NO: 212704 - DNA, 25 bp, Rattus norvegicus
atttagatatctgcacaggccctgt

SEQ ID NO: 212705 - DNA, 25 bp, Rattus norvegicus
atttagatgcgcatggccgtggctt

SEQ ID NO: 212706 - DNA, 25 bp, Rattus norvegicus
atttagatgcgcttggccgtggctt

SEQ ID NO: 212707 - DNA, 25 bp, Rattus norvegicus
atttagattcaacccctaacctctg

SEQ ID NO: 212708 - DNA, 25 bp, Rattus norvegicus
atttagattcaagccctaacctctg

SEQ ID NO: 212709 - DNA, 25 bp, Rattus norvegicus
atttagcacagcatctgtctctctg

SEQ ID NO: 212710 - DNA, 25 bp, Rattus norvegicus
atttagcacagcttctgtctctctg

SEQ ID NO: 212711 - DNA, 25 bp, Rattus norvegicus
atttagcagttaacacccagccttg

SEQ ID NO: 212712 - DNA, 25 bp, Rattus norvegicus
atttagcagttatcacccagccttg

SEQ ID NO: 212713 - DNA, 25 bp, Rattus norvegicus
atttagcatatcaggaggtgtcggg

SEQ ID NO: 212714 - DNA, 25 bp, Rattus norvegicus
atttagcatatctggaggtgtcggg

SEQ ID NO: 212715 - DNA, 25 bp, Rattus norvegicus
atttagcatcccacagtgcacagtg

SEQ ID NO: 212716 - DNA, 25 bp, Rattus norvegicus
atttagcatccctcagtgcacagtg

SEQ ID NO: 212717 - DNA, 25 bp, Rattus norvegicus
atttagccatgcagaatacgtgacc

SEQ ID NO: 212718 - DNA, 25 bp, Rattus norvegicus
atttagccatgctgaatacgtgacc

SEQ ID NO: 212719 - DNA, 25 bp, Rattus norvegicus
atttagcccaagcatggacaggcca

SEQ ID NO: 212720 - DNA, 25 bp, Rattus norvegicus
atttagcccaaggatggacaggcca

SEQ ID NO: 212721 - DNA, 25 bp, Rattus norvegicus
atttagcctgcccaggtgtcaggac

SEQ ID NO: 212722 - DNA, 25 bp, Rattus norvegicus
atttagcctgccgaggtgtcaggac

SEQ ID NO: 212723 - DNA, 25 bp, Rattus norvegicus
atttagcctggcatctgttaagtgc

SEQ ID NO: 212724 - DNA, 25 bp, Rattus norvegicus
atttagcctggcttctgttaagtgc

SEQ ID NO: 212725 - DNA, 25 bp, Rattus norvegicus
atttagccttcaattctttcttggg

SEQ ID NO: 212726 - DNA, 25 bp, Rattus norvegicus
atttagccttcatttctttcttggg

SEQ ID NO: 212727 - DNA, 25 bp, Rattus norvegicus
atttagcgacaaccatggcctcaca

SEQ ID NO: 212728 - DNA, 25 bp, Rattus norvegicus
atttagcgacaagcatggcctcaca

SEQ ID NO: 212729 - DNA, 25 bp, Rattus norvegicus
atttagctcagcacggttaagaggc

SEQ ID NO: 212730 - DNA, 25 bp, Rattus norvegicus
atttagctcagctcggttaagaggc

SEQ ID NO: 212731 - DNA, 25 bp, Rattus norvegicus
atttagctcccaataacttcaccat

SEQ ID NO: 212732 - DNA, 25 bp, Rattus norvegicus
atttagctcccattaacttcaccat

SEQ ID NO: 212733 - DNA, 25 bp, Rattus norvegicus
atttagctgatgacttaggccatgc

SEQ ID NO: 212734 - DNA, 25 bp, Rattus norvegicus
atttagctgatgtcttaggccatgc

SEQ ID NO: 212735 - DNA, 25 bp, Rattus norvegicus
atttagctgcccaggtatcttggtc

SEQ ID NO: 212736 - DNA, 25 bp, Rattus norvegicus
atttagctgccctggtatcttggtc

SEQ ID NO: 212737 - DNA, 25 bp, Rattus norvegicus
atttagctgctaataatgggagaga

SEQ ID NO: 212738 - DNA, 25 bp, Rattus norvegicus
atttagctgctattaatgggagaga

SEQ ID NO: 212739 - DNA, 25 bp, Rattus norvegicus
atttagctgcttcgtgtgcatttgt

SEQ ID NO: 212740 - DNA, 25 bp, Rattus norvegicus
atttagctgcttggtgtgcatttgt

SEQ ID NO: 212741 - DNA, 25 bp, Rattus norvegicus
atttagcttgttccttgactcttcc

SEQ ID NO: 212742 - DNA, 25 bp, Rattus norvegicus
atttagcttgttgcttgactcttcc

SEQ ID NO: 212743 - DNA, 25 bp, Rattus norvegicus
atttagcttttcatgtgactgtaac

SEQ ID NO: 212744 - DNA, 25 bp, Rattus norvegicus
atttagcttttcttgtgactgtaac

SEQ ID NO: 212745 - DNA, 25 bp, Rattus norvegicus
atttaggaatgcctcctttgccttc

SEQ ID NO: 212746 - DNA, 25 bp, Rattus norvegicus
atttaggaatgcgtcctttgccttc

SEQ ID NO: 212747 - DNA, 25 bp, Rattus norvegicus
atttaggaggaaccggcgacatcac

SEQ ID NO: 212748 - DNA, 25 bp, Rattus norvegicus
atttaggaggaagcggcgacatcac

SEQ ID NO: 212749 - DNA, 25 bp, Rattus norvegicus
atttaggcccttcactatcagctgc

SEQ ID NO: 212750 - DNA, 25 bp, Rattus norvegicus
atttaggcccttgactatcagctgc

SEQ ID NO: 212751 - DNA, 25 bp, Rattus norvegicus
atttaggctgggaaagggcatgcat

SEQ ID NO: 212752 - DNA, 25 bp, Rattus norvegicus
atttaggctgggtaagggcatgcat

SEQ ID NO: 212753 - DNA, 25 bp, Rattus norvegicus
atttagggaggcaccacactgggaa

SEQ ID NO: 212754 - DNA, 25 bp, Rattus norvegicus
atttagggaggctccacactgggaa

SEQ ID NO: 212755 - DNA, 25 bp, Rattus norvegicus
atttagggatctcctgggctcaaat

SEQ ID NO: 212756 - DNA, 25 bp, Rattus norvegicus
atttagggatctgctgggctcaaat

SEQ ID NO: 212757 - DNA, 25 bp, Rattus norvegicus
atttagggtggccagtagaactctt

SEQ ID NO: 212758 - DNA, 25 bp, Rattus norvegicus
atttagggtggcgagtagaactctt

SEQ ID NO: 212759 - DNA, 25 bp, Rattus norvegicus
atttagggttacatgggttgccaat

SEQ ID NO: 212760 - DNA, 25 bp, Rattus norvegicus
atttagggttacttgggttgccaat

SEQ ID NO: 212761 - DNA, 25 bp, Rattus norvegicus
atttaggtaatgctgatccctcccc

SEQ ID NO: 212762 - DNA, 25 bp, Rattus norvegicus
atttaggtaatggtgatccctcccc

SEQ ID NO: 212763 - DNA, 25 bp, Rattus norvegicus
atttaggtccctctgctcagtccga

SEQ ID NO: 212764 - DNA, 25 bp, Rattus norvegicus
atttaggtccctgtgctcagtccga

SEQ ID NO: 212765 - DNA, 25 bp, Rattus norvegicus
atttaggttctaatcagtgagcaag

SEQ ID NO: 212766 - DNA, 25 bp, Rattus norvegicus
atttaggttctattcagtgagcaag

SEQ ID NO: 212767 - DNA, 25 bp, Rattus norvegicus
atttagtaagtgcttcggcctgtgc

SEQ ID NO: 212768 - DNA, 25 bp, Rattus norvegicus
atttagtaagtggttcggcctgtgc

SEQ ID NO: 212769 - DNA, 25 bp, Rattus norvegicus
atttagtaattcattgcctctcatg

SEQ ID NO: 212770 - DNA, 25 bp, Rattus norvegicus
atttagtaattctttgcctctcatg

SEQ ID NO: 212771 - DNA, 25 bp, Rattus norvegicus
atttagtcagcacacgttctggtct

SEQ ID NO: 212772 - DNA, 25 bp, Rattus norvegicus
atttagtcagcagacgttctggtct

SEQ ID NO: 212773 - DNA, 25 bp, Rattus norvegicus
atttagtccccgagagagcccgagg

SEQ ID NO: 212774 - DNA, 25 bp, Rattus norvegicus
atttagtccccgtgagagcccgagg

SEQ ID NO: 212775 - DNA, 25 bp, Rattus norvegicus
atttagtctctcacatacttgcctt

SEQ ID NO: 212776 - DNA, 25 bp, Rattus norvegicus
atttagtctctctcatacttgcctt

SEQ ID NO: 212777 - DNA, 25 bp, Rattus norvegicus
atttagtgacacaatagagccagat

SEQ ID NO: 212778 - DNA, 25 bp, Rattus norvegicus
atttagtgacactatagagccagat

SEQ ID NO: 212779 - DNA, 25 bp, Rattus norvegicus
atttagtgccttacctcaatggagc

SEQ ID NO: 212780 - DNA, 25 bp, Rattus norvegicus
atttagtgcctttcctcaatggagc

SEQ ID NO: 212781 - DNA, 25 bp, Rattus norvegicus
atttagtgtatcatctggtgtggct

SEQ ID NO: 212782 - DNA, 25 bp, Rattus norvegicus
atttagtgtatcttctggtgtggct

SEQ ID NO: 212783 - DNA, 25 bp, Rattus norvegicus
atttagtgtggtaatgtgcttcaga

SEQ ID NO: 212784 - DNA, 25 bp, Rattus norvegicus
atttagtgtggttatgtgcttcaga

SEQ ID NO: 212785 - DNA, 25 bp, Rattus norvegicus
atttagtgtttgatacaggcgccat

SEQ ID NO: 212786 - DNA, 25 bp, Rattus norvegicus
atttagtgtttgttacaggcgccat

SEQ ID NO: 212787 - DNA, 25 bp, Rattus norvegicus
atttagttcctaacacagacactgt

SEQ ID NO: 212788 - DNA, 25 bp, Rattus norvegicus
atttagttcctatcacagacactgt

SEQ ID NO: 212789 - DNA, 25 bp, Rattus norvegicus
atttagttgaccctgagtaagagct

SEQ ID NO: 212790 - DNA, 25 bp, Rattus norvegicus
atttagttgaccgtgagtaagagct

SEQ ID NO: 212791 - DNA, 25 bp, Rattus norvegicus
atttagttttctactcagccaaggg

SEQ ID NO: 212792 - DNA, 25 bp, Rattus norvegicus
atttagttttcttctcagccaaggg

SEQ ID NO: 212793 - DNA, 25 bp, Rattus norvegicus
atttagttttgccttgtggcttgct

SEQ ID NO: 212794 - DNA, 25 bp, Rattus norvegicus
atttagttttgcgttgtggcttgct

SEQ ID NO: 212795 - DNA, 25 bp, Rattus norvegicus
atttataacttcagatttcccacgt

SEQ ID NO: 212796 - DNA, 25 bp, Rattus norvegicus
atttataacttctgatttcccacgt

SEQ ID NO: 212797 - DNA, 25 bp, Rattus norvegicus
atttataagaccacctgttcagcct

SEQ ID NO: 212798 - DNA, 25 bp, Rattus norvegicus
atttataagacctcctgttcagcct

SEQ ID NO: 212799 - DNA, 25 bp, Rattus norvegicus
atttatacaaacacctttctcagag

SEQ ID NO: 212800 - DNA, 25 bp, Rattus norvegicus
atttatacaaactcctttctcagag

SEQ ID NO: 212801 - DNA, 25 bp, Rattus norvegicus
atttatacgaggacgttggcccagg

SEQ ID NO: 212802 - DNA, 25 bp, Rattus norvegicus
atttatacgaggtcgttggcccagg

SEQ ID NO: 212803 - DNA, 25 bp, Rattus norvegicus
atttatactttcacatttgtaacta

SEQ ID NO: 212804 - DNA, 25 bp, Rattus norvegicus
atttatactttctcatttgtaacta

SEQ ID NO: 212805 - DNA, 25 bp, Rattus norvegicus
atttatagatgcctcccaggccagc

SEQ ID NO: 212806 - DNA, 25 bp, Rattus norvegicus
atttatagatgcgtcccaggccagc

SEQ ID NO: 212807 - DNA, 25 bp, Rattus norvegicus
atttatagatgtacccttaatgttt

SEQ ID NO: 212808 - DNA, 25 bp, Rattus norvegicus
atttatagatgttcccttaatgttt

SEQ ID NO: 212809 - DNA, 25 bp, Rattus norvegicus
atttatagttcacagggctccatcc

SEQ ID NO: 212810 - DNA, 25 bp, Rattus norvegicus
atttatagttcagagggctccatcc

SEQ ID NO: 212811 - DNA, 25 bp, Rattus norvegicus
atttatatcaccaggccgctgttca

SEQ ID NO: 212812 - DNA, 25 bp, Rattus norvegicus
atttatatcaccagggcaaagcacc

SEQ ID NO: 212813 - DNA, 25 bp, Rattus norvegicus
atttatatcacctggccgctgttca

SEQ ID NO: 212814 - DNA, 25 bp, Rattus norvegicus
atttatatcacctgggcaaagcacc

SEQ ID NO: 212815 - DNA, 25 bp, Rattus norvegicus
atttatatccccacagcagtactgt

SEQ ID NO: 212816 - DNA, 25 bp, Rattus norvegicus
atttatatcccctcagcagtactgt

SEQ ID NO: 212817 - DNA, 25 bp, Rattus norvegicus
atttatatctagaccctgcactcgt

SEQ ID NO: 212818 - DNA, 25 bp, Rattus norvegicus
atttatatctagtccctgcactcgt

SEQ ID NO: 212819 - DNA, 25 bp, Rattus norvegicus
atttatatgcacaaagaggacaggt

SEQ ID NO: 212820 - DNA, 25 bp, Rattus norvegicus
atttatatgcactaagaggacaggt

SEQ ID NO: 212821 - DNA, 25 bp, Rattus norvegicus
atttatatgcctcctgcccggtgaa

SEQ ID NO: 212822 - DNA, 25 bp, Rattus norvegicus
atttatatgcctgctgcccggtgaa

SEQ ID NO: 212823 - DNA, 25 bp, Rattus norvegicus
atttatcaacttcccagctctgtgg

SEQ ID NO: 212824 - DNA, 25 bp, Rattus norvegicus
atttatcaacttgccagctctgtgg

SEQ ID NO: 212825 - DNA, 25 bp, Rattus norvegicus
atttatcacattcacccattttgga

SEQ ID NO: 212826 - DNA, 25 bp, Rattus norvegicus
atttatcacattgacccattttgga

SEQ ID NO: 212827 - DNA, 25 bp, Rattus norvegicus
atttatcacggccagcttcctgtaa

SEQ ID NO: 212828 - DNA, 25 bp, Rattus norvegicus
atttatcacggcgagcttcctgtaa

SEQ ID NO: 212829 - DNA, 25 bp, Rattus norvegicus
atttatcataatatgccgggcacgg

SEQ ID NO: 212830 - DNA, 25 bp, Rattus norvegicus
atttatcataatttgccgggcacgg

SEQ ID NO: 212831 - DNA, 25 bp, Rattus norvegicus
atttatcatcccaacttacttcagt

SEQ ID NO: 212832 - DNA, 25 bp, Rattus norvegicus
atttatcatccctacttacttcagt

SEQ ID NO: 212833 - DNA, 25 bp, Rattus norvegicus
atttatcatggactagcccgtgctc

SEQ ID NO: 212834 - DNA, 25 bp, Rattus norvegicus
atttatcatggagtagcccgtgctc

SEQ ID NO: 212835 - DNA, 25 bp, Rattus norvegicus
atttatcattcacattacctcccct

SEQ ID NO: 212836 - DNA, 25 bp, Rattus norvegicus
atttatcattcagattacctcccct

SEQ ID NO: 212837 - DNA, 25 bp, Rattus norvegicus
atttatccacggcactccgcgagct

SEQ ID NO: 212838 - DNA, 25 bp, Rattus norvegicus
atttatccacgggactccgcgagct

SEQ ID NO: 212839 - DNA, 25 bp, Rattus norvegicus
atttatcccgatactcaaattcctc

SEQ ID NO: 212840 - DNA, 25 bp, Rattus norvegicus
atttatcccgattctcaaattcctc

SEQ ID NO: 212841 - DNA, 25 bp, Rattus norvegicus
atttatccctctcgatgcaccaaag

SEQ ID NO: 212842 - DNA, 25 bp, Rattus norvegicus
atttatccctctggatgcaccaaag

SEQ ID NO: 212843 - DNA, 25 bp, Rattus norvegicus
atttatcctcatcgactgcatggag

SEQ ID NO: 212844 - DNA, 25 bp, Rattus norvegicus
atttatcctcatggactgcatggag

SEQ ID NO: 212845 - DNA, 25 bp, Rattus norvegicus
atttatcctgagatgtcactgagca

SEQ ID NO: 212846 - DNA, 25 bp, Rattus norvegicus
atttatcctgagttgtcactgagca

SEQ ID NO: 212847 - DNA, 25 bp, Rattus norvegicus
atttatctaggcataccagtaccag

SEQ ID NO: 212848 - DNA, 25 bp, Rattus norvegicus
atttatctaggcttaccagtaccag

SEQ ID NO: 212849 - DNA, 25 bp, Rattus norvegicus
atttatctatgcaatagctctacag

SEQ ID NO: 212850 - DNA, 25 bp, Rattus norvegicus
atttatctatgctatagctctacag

SEQ ID NO: 212851 - DNA, 25 bp, Rattus norvegicus
atttatctccttcatcatgggtcct

SEQ ID NO: 212852 - DNA, 25 bp, Rattus norvegicus
atttatctccttgatcatgggtcct

SEQ ID NO: 212853 - DNA, 25 bp, Rattus norvegicus
atttatctgcccaaacaaatggttt

SEQ ID NO: 212854 - DNA, 25 bp, Rattus norvegicus
atttatctgccctaacaaatggttt

SEQ ID NO: 212855 - DNA, 25 bp, Rattus norvegicus
atttatctgtgactgggagcggaac

SEQ ID NO: 212856 - DNA, 25 bp, Rattus norvegicus
atttatctgtgagtgggagcggaac

SEQ ID NO: 212857 - DNA, 25 bp, Rattus norvegicus
atttatgaagcccacatccatctga

SEQ ID NO: 212858 - DNA, 25 bp, Rattus norvegicus
atttatgaagccgacatccatctga

SEQ ID NO: 212859 - DNA, 25 bp, Rattus norvegicus
atttatgagcatatttcttactgag

SEQ ID NO: 212860 - DNA, 25 bp, Rattus norvegicus
atttatgagcatttttcttactgag

SEQ ID NO: 212861 - DNA, 25 bp, Rattus norvegicus
atttatgaggtacgcagaccctcct

SEQ ID NO: 212862 - DNA, 25 bp, Rattus norvegicus
atttatgaggtaggcagaccctcct

SEQ ID NO: 212863 - DNA, 25 bp, Rattus norvegicus
atttatgagtctcgctttgagaagc

SEQ ID NO: 212864 - DNA, 25 bp, Rattus norvegicus
atttatgagtctggctttgagaagc

SEQ ID NO: 212865 - DNA, 25 bp, Rattus norvegicus
atttatgagttcaatgatgtggtct

SEQ ID NO: 212866 - DNA, 25 bp, Rattus norvegicus
atttatgagttctatgatgtggtct

SEQ ID NO: 212867 - DNA, 25 bp, Rattus norvegicus
atttatgataacctggtccgtgact

SEQ ID NO: 212868 - DNA, 25 bp, Rattus norvegicus
atttatgataacgtggtccgtgact

SEQ ID NO: 212869 - DNA, 25 bp, Rattus norvegicus
atttatgatgacaccactctttgcc

SEQ ID NO: 212870 - DNA, 25 bp, Rattus norvegicus
atttatgatgactccactctttgcc

SEQ ID NO: 212871 - DNA, 25 bp, Rattus norvegicus
atttatgatgccactgattttcctt

SEQ ID NO: 212872 - DNA, 25 bp, Rattus norvegicus
atttatgatgcctctgattttcctt

SEQ ID NO: 212873 - DNA, 25 bp, Rattus norvegicus
atttatgcaactcctggcacaggct

SEQ ID NO: 212874 - DNA, 25 bp, Rattus norvegicus
atttatgcaactgctggcacaggct

SEQ ID NO: 212875 - DNA, 25 bp, Rattus norvegicus
atttatgcagataacagtgccttct

SEQ ID NO: 212876 - DNA, 25 bp, Rattus norvegicus
atttatgcagattacagtgccttct

SEQ ID NO: 212877 - DNA, 25 bp, Rattus norvegicus
atttatgcatttatcctttctccta

SEQ ID NO: 212878 - DNA, 25 bp, Rattus norvegicus
atttatgcatttttcctttctccta

SEQ ID NO: 212879 - DNA, 25 bp, Rattus norvegicus
atttatgccaagagcggtttcgaaa

SEQ ID NO: 212880 - DNA, 25 bp, Rattus norvegicus
atttatgccaagtgcggtttcgaaa

SEQ ID NO: 212881 - DNA, 25 bp, Rattus norvegicus
atttatgctcacaaagtccttctca

SEQ ID NO: 212882 - DNA, 25 bp, Rattus norvegicus
atttatgctcactaagtccttctca

SEQ ID NO: 212883 - DNA, 25 bp, Rattus norvegicus
atttatgctctgacttgctcctgaa

SEQ ID NO: 212884 - DNA, 25 bp, Rattus norvegicus
atttatgctctgtcttgctcctgaa

SEQ ID NO: 212885 - DNA, 25 bp, Rattus norvegicus
atttatgctgcactctacttactca

SEQ ID NO: 212886 - DNA, 25 bp, Rattus norvegicus
atttatgctgcagtctacttactca

SEQ ID NO: 212887 - DNA, 25 bp, Rattus norvegicus
atttatgcttctatgggttctgtac

SEQ ID NO: 212888 - DNA, 25 bp, Rattus norvegicus
atttatgcttctttgggttctgtac

SEQ ID NO: 212889 - DNA, 25 bp, Rattus norvegicus
atttatggcagaatgtatggcgact

SEQ ID NO: 212890 - DNA, 25 bp, Rattus norvegicus
atttatggcagattgtatggcgact

SEQ ID NO: 212891 - DNA, 25 bp, Rattus norvegicus
atttatggcctgagagagccagccc

SEQ ID NO: 212892 - DNA, 25 bp, Rattus norvegicus
atttatggcctgtgagagccagccc

SEQ ID NO: 212893 - DNA, 25 bp, Rattus norvegicus
atttatggcgcgatgcacatttaag

SEQ ID NO: 212894 - DNA, 25 bp, Rattus norvegicus
atttatggcgcgttgcacatttaag

SEQ ID NO: 212895 - DNA, 25 bp, Rattus norvegicus
atttatgggaacacctctgtgccac

SEQ ID NO: 212896 - DNA, 25 bp, Rattus norvegicus
atttatgggaactcctctgtgccac

SEQ ID NO: 212897 - DNA, 25 bp, Rattus norvegicus
atttatgggcttccctttgattcac

SEQ ID NO: 212898 - DNA, 25 bp, Rattus norvegicus
atttatgggcttgcctttgattcac

SEQ ID NO: 212899 - DNA, 25 bp, Rattus norvegicus
atttatggttagcatttcctggcca

SEQ ID NO: 212900 - DNA, 25 bp, Rattus norvegicus
atttatggttaggatttcctggcca

SEQ ID NO: 212901 - DNA, 25 bp, Rattus norvegicus
atttatgtatccctatgccagcctg

SEQ ID NO: 212902 - DNA, 25 bp, Rattus norvegicus
atttatgtatccgtatgccagcctg

SEQ ID NO: 212903 - DNA, 25 bp, Rattus norvegicus
atttatgtcagaaaccggcgtaccg

SEQ ID NO: 212904 - DNA, 25 bp, Rattus norvegicus
atttatgtcagataccggcgtaccg

SEQ ID NO: 212905 - DNA, 25 bp, Rattus norvegicus
atttatgtcattaccgttttctctc

SEQ ID NO: 212906 - DNA, 25 bp, Rattus norvegicus
atttatgtcatttccgttttctctc

SEQ ID NO: 212907 - DNA, 25 bp, Rattus norvegicus
atttatgtctacactcttgtcatag

SEQ ID NO: 212908 - DNA, 25 bp, Rattus norvegicus
atttatgtctactctcttgtcatag

SEQ ID NO: 212909 - DNA, 25 bp, Rattus norvegicus
atttatgttagcaccaagcggaccc

SEQ ID NO: 212910 - DNA, 25 bp, Rattus norvegicus
atttatgttagctccaagcggaccc

SEQ ID NO: 212911 - DNA, 25 bp, Rattus norvegicus
atttatgttctacagcgtgggcgct

SEQ ID NO: 212912 - DNA, 25 bp, Rattus norvegicus
atttatgttctagagcgtgggcgct

SEQ ID NO: 212913 - DNA, 25 bp, Rattus norvegicus
atttatgtttttacctgttgctgta

SEQ ID NO: 212914 - DNA, 25 bp, Rattus norvegicus
atttatgttttttcctgttgctgta

SEQ ID NO: 212915 - DNA, 25 bp, Rattus norvegicus
atttattatccacggtctctgcttc

SEQ ID NO: 212916 - DNA, 25 bp, Rattus norvegicus
atttattatccagggtctctgcttc

SEQ ID NO: 212917 - DNA, 25 bp, Rattus norvegicus
atttattccacgctagctctcacac

SEQ ID NO: 212918 - DNA, 25 bp, Rattus norvegicus
atttattccacggtagctctcacac

SEQ ID NO: 212919 - DNA, 25 bp, Rattus norvegicus
atttattccactctgttcacacctc

SEQ ID NO: 212920 - DNA, 25 bp, Rattus norvegicus
atttattccactgtgttcacacctc

SEQ ID NO: 212921 - DNA, 25 bp, Rattus norvegicus
atttattccgagacaggtttctgct

SEQ ID NO: 212922 - DNA, 25 bp, Rattus norvegicus
atttattccgagtcaggtttctgct

SEQ ID NO: 212923 - DNA, 25 bp, Rattus norvegicus
atttattccgctatggtgatgccag

SEQ ID NO: 212924 - DNA, 25 bp, Rattus norvegicus
atttattccgctttggtgatgccag

SEQ ID NO: 212925 - DNA, 25 bp, Rattus norvegicus
atttattcgagcacattgccttgcc

SEQ ID NO: 212926 - DNA, 25 bp, Rattus norvegicus
atttattcgagctcattgccttgcc

SEQ ID NO: 212927 - DNA, 25 bp, Rattus norvegicus
atttattctctgctacagtctttag

SEQ ID NO: 212928 - DNA, 25 bp, Rattus norvegicus
atttattctctggtacagtctttag

SEQ ID NO: 212929 - DNA, 25 bp, Rattus norvegicus
atttattctgtcagtgccagttctg

SEQ ID NO: 212930 - DNA, 25 bp, Rattus norvegicus
atttattctgtctgtgccagttctg

SEQ ID NO: 212931 - DNA, 25 bp, Rattus norvegicus
atttattgaaacctgccgttgccct

SEQ ID NO: 212932 - DNA, 25 bp, Rattus norvegicus
atttattgaaacgtgccgttgccct

SEQ ID NO: 212933 - DNA, 25 bp, Rattus norvegicus
atttattgcaagaccaccagctcct

SEQ ID NO: 212934 - DNA, 25 bp, Rattus norvegicus
atttattgcaagtccaccagctcct

SEQ ID NO: 212935 - DNA, 25 bp, Rattus norvegicus
atttattgccctactccaagtatta

SEQ ID NO: 212936 - DNA, 25 bp, Rattus norvegicus
atttattgcccttctccaagtatta

SEQ ID NO: 212937 - DNA, 25 bp, Rattus norvegicus
atttattgctagcttgcctgctcca

SEQ ID NO: 212938 - DNA, 25 bp, Rattus norvegicus
atttattgctaggttgcctgctcca

SEQ ID NO: 212939 - DNA, 25 bp, Rattus norvegicus
atttattggcccacttccatgtcgt

SEQ ID NO: 212940 - DNA, 25 bp, Rattus norvegicus
atttattggccctcttccatgtcgt

SEQ ID NO: 212941 - DNA, 25 bp, Rattus norvegicus
atttattgggttctcggctgcctaa

SEQ ID NO: 212942 - DNA, 25 bp, Rattus norvegicus
atttattgggttgtcggctgcctaa

SEQ ID NO: 212943 - DNA, 25 bp, Rattus norvegicus
atttattgtactctagttatccggg

SEQ ID NO: 212944 - DNA, 25 bp, Rattus norvegicus
atttattgtactgtagttatccggg

SEQ ID NO: 212945 - DNA, 25 bp, Rattus norvegicus
atttatttagatccatacatgcaag

SEQ ID NO: 212946 - DNA, 25 bp, Rattus norvegicus
atttatttagatgcatacatgcaag

SEQ ID NO: 212947 - DNA, 25 bp, Rattus norvegicus
atttatttatacctcccatcacacg

SEQ ID NO: 212948 - DNA, 25 bp, Rattus norvegicus
atttatttatacgtcccatcacacg

SEQ ID NO: 212949 - DNA, 25 bp, Rattus norvegicus
atttatttcactcttgggctgtcac

SEQ ID NO: 212950 - DNA, 25 bp, Rattus norvegicus
atttatttcactgttgggctgtcac

SEQ ID NO: 212951 - DNA, 25 bp, Rattus norvegicus
atttatttcttcacatttcccatcc

SEQ ID NO: 212952 - DNA, 25 bp, Rattus norvegicus
atttatttcttctcatttcccatcc

SEQ ID NO: 212953 - DNA, 25 bp, Rattus norvegicus
atttatttgcacagttagtttcgag

SEQ ID NO: 212954 - DNA, 25 bp, Rattus norvegicus
atttatttgcactgttagtttcgag

SEQ ID NO: 212955 - DNA, 25 bp, Rattus norvegicus
atttatttgcatacttggctctcaa

SEQ ID NO: 212956 - DNA, 25 bp, Rattus norvegicus
atttatttgcattcttggctctcaa

SEQ ID NO: 212957 - DNA, 25 bp, Rattus norvegicus
atttatttgcctccttggtacttgt

SEQ ID NO: 212958 - DNA, 25 bp, Rattus norvegicus
atttatttgcctgcttggtacttgt

SEQ ID NO: 212959 - DNA, 25 bp, Rattus norvegicus
atttatttgtttctggcttagcctc

SEQ ID NO: 212960 - DNA, 25 bp, Rattus norvegicus
atttatttgtttgtggcttagcctc

SEQ ID NO: 212961 - DNA, 25 bp, Rattus norvegicus
atttattttatcaatccctgtggga

SEQ ID NO: 212962 - DNA, 25 bp, Rattus norvegicus
atttattttatctatccctgtggga

SEQ ID NO: 212963 - DNA, 25 bp, Rattus norvegicus
atttattttcacagctctggattcc

SEQ ID NO: 212964 - DNA, 25 bp, Rattus norvegicus
atttattttcactgctctggattcc

SEQ ID NO: 212965 - DNA, 25 bp, Rattus norvegicus
atttattttgcaactccccagcaga

SEQ ID NO: 212966 - DNA, 25 bp, Rattus norvegicus
atttattttgcatctccccagcaga

SEQ ID NO: 212967 - DNA, 25 bp, Rattus norvegicus
atttattttgctccagttgatcctg

SEQ ID NO: 212968 - DNA, 25 bp, Rattus norvegicus
atttattttgctgcagttgatcctg

SEQ ID NO: 212969 - DNA, 25 bp, Rattus norvegicus
atttattttggaagccttctccacc

SEQ ID NO: 212970 - DNA, 25 bp, Rattus norvegicus
atttattttggatgccttctccacc

SEQ ID NO: 212971 - DNA, 25 bp, Rattus norvegicus
atttcaaacttgagctttcttagct

SEQ ID NO: 212972 - DNA, 25 bp, Rattus norvegicus
atttcaaacttgtgctttcttagct

SEQ ID NO: 212973 - DNA, 25 bp, Rattus norvegicus
atttcaaagaacatgagcgcccaca

SEQ ID NO: 212974 - DNA, 25 bp, Rattus norvegicus
atttcaaagaacttgagcgcccaca

SEQ ID NO: 212975 - DNA, 25 bp, Rattus norvegicus
atttcaaagtggactctggctccat

SEQ ID NO: 212976 - DNA, 25 bp, Rattus norvegicus
atttcaaagtggtctctggctccat

SEQ ID NO: 212977 - DNA, 25 bp, Rattus norvegicus
atttcaaatatcattcaggctgcag

SEQ ID NO: 212978 - DNA, 25 bp, Rattus norvegicus
atttcaaatatctttcaggctgcag

SEQ ID NO: 212979 - DNA, 25 bp, Rattus norvegicus
atttcaaatgaacatccctgcctta

SEQ ID NO: 212980 - DNA, 25 bp, Rattus norvegicus
atttcaaatgaagatccctgcctta

SEQ ID NO: 212981 - DNA, 25 bp, Rattus norvegicus
atttcaaatgtccatctccatcgtg

SEQ ID NO: 212982 - DNA, 25 bp, Rattus norvegicus
atttcaaatgtcgatctccatcgtg

SEQ ID NO: 212983 - DNA, 25 bp, Rattus norvegicus
atttcaacaagcatcaccgcagtgg

SEQ ID NO: 212984 - DNA, 25 bp, Rattus norvegicus
atttcaacaagcttcaccgcagtgg

SEQ ID NO: 212985 - DNA, 25 bp, Rattus norvegicus
atttcaacatgtcggctgtcacctc

SEQ ID NO: 212986 - DNA, 25 bp, Rattus norvegicus
atttcaacatgtgggctgtcacctc

SEQ ID NO: 212987 - DNA, 25 bp, Rattus norvegicus
atttcaacatttacccgatcttctt

SEQ ID NO: 212988 - DNA, 25 bp, Rattus norvegicus
atttcaacattttcccgatcttctt

SEQ ID NO: 212989 - DNA, 25 bp, Rattus norvegicus
atttcaacccagactgagatgccag

SEQ ID NO: 212990 - DNA, 25 bp, Rattus norvegicus
atttcaacccagtctgagatgccag

SEQ ID NO: 212991 - DNA, 25 bp, Rattus norvegicus
atttcaacccatatctgagggccca

SEQ ID NO: 212992 - DNA, 25 bp, Rattus norvegicus
atttcaacccatttctgagggccca

SEQ ID NO: 212993 - DNA, 25 bp, Rattus norvegicus
atttcaacgtctctctgcagatgta

SEQ ID NO: 212994 - DNA, 25 bp, Rattus norvegicus
atttcaacgtctgtctgcagatgta

SEQ ID NO: 212995 - DNA, 25 bp, Rattus norvegicus
atttcaactcttctgtgccttattt

SEQ ID NO: 212996 - DNA, 25 bp, Rattus norvegicus
atttcaactcttgtgtgccttattt

SEQ ID NO: 212997 - DNA, 25 bp, Rattus norvegicus
atttcaacttccaggatactctctc

SEQ ID NO: 212998 - DNA, 25 bp, Rattus norvegicus
atttcaacttcctggatactctctc

SEQ ID NO: 212999 - DNA, 25 bp, Rattus norvegicus
atttcaacttgtaaactggccagaa

SEQ ID NO: 213000 - DNA, 25 bp, Rattus norvegicus
atttcaacttgttaactggccagaa

SEQ ID NO: 213001 - DNA, 25 bp, Rattus norvegicus
atttcaagaatgacaggccacccca

SEQ ID NO: 213002 - DNA, 25 bp, Rattus norvegicus
atttcaagaatgtcaggccacccca

SEQ ID NO: 213003 - DNA, 25 bp, Rattus norvegicus
atttcaagcaaaactccacgtacat

SEQ ID NO: 213004 - DNA, 25 bp, Rattus norvegicus
atttcaagcaaatctccacgtacat

SEQ ID NO: 213005 - DNA, 25 bp, Rattus norvegicus
atttcaagcattaagtttgttaggg

SEQ ID NO: 213006 - DNA, 25 bp, Rattus norvegicus
atttcaagcatttagtttgttaggg

SEQ ID NO: 213007 - DNA, 25 bp, Rattus norvegicus
atttcaagccatcgctgcacccgga

SEQ ID NO: 213008 - DNA, 25 bp, Rattus norvegicus
atttcaagccatggctgcacccgga

SEQ ID NO: 213009 - DNA, 25 bp, Rattus norvegicus
atttcaagctttacgaagcccctga

SEQ ID NO: 213010 - DNA, 25 bp, Rattus norvegicus
atttcaagcttttcgaagcccctga

SEQ ID NO: 213011 - DNA, 25 bp, Rattus norvegicus
atttcaaggatcacctgctgcatga

SEQ ID NO: 213012 - DNA, 25 bp, Rattus norvegicus
atttcaaggatctcctgctgcatga

SEQ ID NO: 213013 - DNA, 25 bp, Rattus norvegicus
atttcaagggtcaccgtgcaatcac

SEQ ID NO: 213014 - DNA, 25 bp, Rattus norvegicus
atttcaagggtctccgtgcaatcac

SEQ ID NO: 213015 - DNA, 25 bp, Rattus norvegicus
atttcaataaacattctcactcatg

SEQ ID NO: 213016 - DNA, 25 bp, Rattus norvegicus
atttcaataaactttctcactcatg

SEQ ID NO: 213017 - DNA, 25 bp, Rattus norvegicus
atttcaataagcctcattccttctc

SEQ ID NO: 213018 - DNA, 25 bp, Rattus norvegicus
atttcaataagcgtcattccttctc

SEQ ID NO: 213019 - DNA, 25 bp, Rattus norvegicus
atttcaataattccgattccccaca

SEQ ID NO: 213020 - DNA, 25 bp, Rattus norvegicus
atttcaataattgcgattccccaca

SEQ ID NO: 213021 - DNA, 25 bp, Rattus norvegicus
atttcaatcccaccaatttcctgga

SEQ ID NO: 213022 - DNA, 25 bp, Rattus norvegicus
atttcaatcccagcaatttcctgga

SEQ ID NO: 213023 - DNA, 25 bp, Rattus norvegicus
atttcaatcgaaatctgagaccaag

SEQ ID NO: 213024 - DNA, 25 bp, Rattus norvegicus
atttcaatcgaattctgagaccaag

SEQ ID NO: 213025 - DNA, 25 bp, Rattus norvegicus
atttcaatgatcaccttcctttggt

SEQ ID NO: 213026 - DNA, 25 bp, Rattus norvegicus
atttcaatgatctccttcctttggt

SEQ ID NO: 213027 - DNA, 25 bp, Rattus norvegicus
atttcaatggagacgtggagggcac

SEQ ID NO: 213028 - DNA, 25 bp, Rattus norvegicus
atttcaatggagtcgtggagggcac

SEQ ID NO: 213029 - DNA, 25 bp, Rattus norvegicus
atttcaatgtttactaaatgccaca

SEQ ID NO: 213030 - DNA, 25 bp, Rattus norvegicus
atttcaatgtttcctctggtctcag

SEQ ID NO: 213031 - DNA, 25 bp, Rattus norvegicus
atttcaatgtttgctctggtctcag

SEQ ID NO: 213032 - DNA, 25 bp, Rattus norvegicus
atttcaatgttttctaaatgccaca

SEQ ID NO: 213033 - DNA, 25 bp, Rattus norvegicus
atttcaattgctactagtgccccac

SEQ ID NO: 213034 - DNA, 25 bp, Rattus norvegicus
atttcaattgcttctagtgccccac

SEQ ID NO: 213035 - DNA, 25 bp, Rattus norvegicus
atttcacaaagccacacccatatat

SEQ ID NO: 213036 - DNA, 25 bp, Rattus norvegicus
atttcacaaagcgacacccatatat

SEQ ID NO: 213037 - DNA, 25 bp, Rattus norvegicus
atttcacaccaaatactgtccgggc

SEQ ID NO: 213038 - DNA, 25 bp, Rattus norvegicus
atttcacaccaattactgtccgggc

SEQ ID NO: 213039 - DNA, 25 bp, Rattus norvegicus
atttcacacctaagctccagttgac

SEQ ID NO: 213040 - DNA, 25 bp, Rattus norvegicus
atttcacacctatgctccagttgac

SEQ ID NO: 213041 - DNA, 25 bp, Rattus norvegicus
atttcacacttcattctattggctc

SEQ ID NO: 213042 - DNA, 25 bp, Rattus norvegicus
atttcacacttctttctattggctc

SEQ ID NO: 213043 - DNA, 25 bp, Rattus norvegicus
atttcacagatccaagacttcccaa

SEQ ID NO: 213044 - DNA, 25 bp, Rattus norvegicus
atttcacagatcgaagacttcccaa

SEQ ID NO: 213045 - DNA, 25 bp, Rattus norvegicus
atttcacagccaatcagtgcttgga

SEQ ID NO: 213046 - DNA, 25 bp, Rattus norvegicus
atttcacagccattcagtgcttgga

SEQ ID NO: 213047 - DNA, 25 bp, Rattus norvegicus
atttcacagtatatccaaaccaccc

SEQ ID NO: 213048 - DNA, 25 bp, Rattus norvegicus
atttcacagtatttccaaaccaccc

SEQ ID NO: 213049 - DNA, 25 bp, Rattus norvegicus
atttcacatccgattcatcaggtta

SEQ ID NO: 213050 - DNA, 25 bp, Rattus norvegicus
atttcacatccgtttcatcaggtta

SEQ ID NO: 213051 - DNA, 25 bp, Rattus norvegicus
atttcacattatccaccctgatcac

SEQ ID NO: 213052 - DNA, 25 bp, Rattus norvegicus
atttcacattatgcaccctgatcac

SEQ ID NO: 213053 - DNA, 25 bp, Rattus norvegicus
atttcacattggactagctgcttca

SEQ ID NO: 213054 - DNA, 25 bp, Rattus norvegicus
atttcacattggtctagctgcttca

SEQ ID NO: 213055 - DNA, 25 bp, Rattus norvegicus
atttcaccacaactttcattctcag

SEQ ID NO: 213056 - DNA, 25 bp, Rattus norvegicus
atttcaccacaagtttcattctcag

SEQ ID NO: 213057 - DNA, 25 bp, Rattus norvegicus
atttcaccacttatcagtcgtctgt

SEQ ID NO: 213058 - DNA, 25 bp, Rattus norvegicus
atttcaccacttttcagtcgtctgt

SEQ ID NO: 213059 - DNA, 25 bp, Rattus norvegicus
atttcaccatggcttctgcgttagt

SEQ ID NO: 213060 - DNA, 25 bp, Rattus norvegicus
atttcaccatgggttctgcgttagt

SEQ ID NO: 213061 - DNA, 25 bp, Rattus norvegicus
atttcaccatgtcagttctctcctg

SEQ ID NO: 213062 - DNA, 25 bp, Rattus norvegicus
atttcaccatgtgagttctctcctg

SEQ ID NO: 213063 - DNA, 25 bp, Rattus norvegicus
atttcaccatttacaatcaccctgt

SEQ ID NO: 213064 - DNA, 25 bp, Rattus norvegicus
atttcaccatttccggaacacctgt

SEQ ID NO: 213065 - DNA, 25 bp, Rattus norvegicus
atttcaccatttgcggaacacctgt

SEQ ID NO: 213066 - DNA, 25 bp, Rattus norvegicus
atttcaccattttcaatcaccctgt

SEQ ID NO: 213067 - DNA, 25 bp, Rattus norvegicus
atttcacctgtgcattagctgcaaa

SEQ ID NO: 213068 - DNA, 25 bp, Rattus norvegicus
atttcacctgtggattagctgcaaa

SEQ ID NO: 213069 - DNA, 25 bp, Rattus norvegicus
atttcaccttccagctctgtagaga

SEQ ID NO: 213070 - DNA, 25 bp, Rattus norvegicus
atttcaccttcctgctctgtagaga

SEQ ID NO: 213071 - DNA, 25 bp, Rattus norvegicus
atttcacgattcagccgtacagagt

SEQ ID NO: 213072 - DNA, 25 bp, Rattus norvegicus
atttcacgattctgccgtacagagt

SEQ ID NO: 213073 - DNA, 25 bp, Rattus norvegicus
atttcacgcgaaagcacacagggta

SEQ ID NO: 213074 - DNA, 25 bp, Rattus norvegicus
atttcacgcgaatgcacacagggta

SEQ ID NO: 213075 - DNA, 25 bp, Rattus norvegicus
atttcacgctgtattgactactgta

SEQ ID NO: 213076 - DNA, 25 bp, Rattus norvegicus
atttcacgctgttttgactactgta

SEQ ID NO: 213077 - DNA, 25 bp, Rattus norvegicus
atttcacgtgccctaaccttcagac

SEQ ID NO: 213078 - DNA, 25 bp, Rattus norvegicus
atttcacgtgccgtaaccttcagac

SEQ ID NO: 213079 - DNA, 25 bp, Rattus norvegicus
atttcacgtgtgatagcatgcagct

SEQ ID NO: 213080 - DNA, 25 bp, Rattus norvegicus
atttcacgtgtgttagcatgcagct

SEQ ID NO: 213081 - DNA, 25 bp, Rattus norvegicus
atttcactacaaacgctacctgact

SEQ ID NO: 213082 - DNA, 25 bp, Rattus norvegicus
atttcactacaatcgctacctgact

SEQ ID NO: 213083 - DNA, 25 bp, Rattus norvegicus
atttcactagtgcatggttttaaaa

SEQ ID NO: 213084 - DNA, 25 bp, Rattus norvegicus
atttcactagtggatggttttaaaa

SEQ ID NO: 213085 - DNA, 25 bp, Rattus norvegicus
atttcactatgcatctggcactatg

SEQ ID NO: 213086 - DNA, 25 bp, Rattus norvegicus
atttcactatgcttctggcactatg

SEQ ID NO: 213087 - DNA, 25 bp, Rattus norvegicus
atttcactcgctctactgacatcat

SEQ ID NO: 213088 - DNA, 25 bp, Rattus norvegicus
atttcactcgctgtactgacatcat

SEQ ID NO: 213089 - DNA, 25 bp, Rattus norvegicus
atttcactctgtatcatccaggtca

SEQ ID NO: 213090 - DNA, 25 bp, Rattus norvegicus
atttcactctgtttcatccaggtca

SEQ ID NO: 213091 - DNA, 25 bp, Rattus norvegicus
atttcactgaaacactgctgcattt

SEQ ID NO: 213092 - DNA, 25 bp, Rattus norvegicus
atttcactgaaagactgctgcattt

SEQ ID NO: 213093 - DNA, 25 bp, Rattus norvegicus
atttcactgtgaagttggctcggcc

SEQ ID NO: 213094 - DNA, 25 bp, Rattus norvegicus
atttcactgtgatgttggctcggcc

SEQ ID NO: 213095 - DNA, 25 bp, Rattus norvegicus
atttcacttactactcctggaagca

SEQ ID NO: 213096 - DNA, 25 bp, Rattus norvegicus
atttcacttacttctcctggaagca

SEQ ID NO: 213097 - DNA, 25 bp, Rattus norvegicus
atttcacttttacgctgtagagtcc

SEQ ID NO: 213098 - DNA, 25 bp, Rattus norvegicus
atttcacttttaggctgtagagtcc

SEQ ID NO: 213099 - DNA, 25 bp, Rattus norvegicus
atttcagaactgacgcatcttcctg

SEQ ID NO: 213100 - DNA, 25 bp, Rattus norvegicus
atttcagaactgtcgcatcttcctg

SEQ ID NO: 213101 - DNA, 25 bp, Rattus norvegicus
atttcagaatctatcttcttccctg

SEQ ID NO: 213102 - DNA, 25 bp, Rattus norvegicus
atttcagaatctttcttcttccctg

SEQ ID NO: 213103 - DNA, 25 bp, Rattus norvegicus
atttcagagccaactatatcaccag

SEQ ID NO: 213104 - DNA, 25 bp, Rattus norvegicus
atttcagagccatctatatcaccag

SEQ ID NO: 213105 - DNA, 25 bp, Rattus norvegicus
atttcagagcccaacttctctgtgg

SEQ ID NO: 213106 - DNA, 25 bp, Rattus norvegicus
atttcagagccctacttctctgtgg

SEQ ID NO: 213107 - DNA, 25 bp, Rattus norvegicus
atttcagagcctacagtcatgtgag

SEQ ID NO: 213108 - DNA, 25 bp, Rattus norvegicus
atttcagagccttcagtcatgtgag

SEQ ID NO: 213109 - DNA, 25 bp, Rattus norvegicus
atttcagattgcctggtcaaatgta

SEQ ID NO: 213110 - DNA, 25 bp, Rattus norvegicus
atttcagattgcgtggtcaaatgta

SEQ ID NO: 213111 - DNA, 25 bp, Rattus norvegicus
atttcagcaagcaggctaccgggat

SEQ ID NO: 213112 - DNA, 25 bp, Rattus norvegicus
atttcagcaagctggctaccgggat

SEQ ID NO: 213113 - DNA, 25 bp, Rattus norvegicus
atttcagcagctatgtgccttctgt

SEQ ID NO: 213114 - DNA, 25 bp, Rattus norvegicus
atttcagcagctttgtgccttctgt

SEQ ID NO: 213115 - DNA, 25 bp, Rattus norvegicus
atttcagcatctagcatggccaggc

SEQ ID NO: 213116 - DNA, 25 bp, Rattus norvegicus
atttcagcatctctcctgtgtcttc

SEQ ID NO: 213117 - DNA, 25 bp, Rattus norvegicus
atttcagcatctgtcctgtgtcttc

SEQ ID NO: 213118 - DNA, 25 bp, Rattus norvegicus
atttcagcatcttgcatggccaggc

SEQ ID NO: 213119 - DNA, 25 bp, Rattus norvegicus
atttcagccctaatctctgtgtgga

SEQ ID NO: 213120 - DNA, 25 bp, Rattus norvegicus
atttcagccctattctctgtgtgga

SEQ ID NO: 213121 - DNA, 25 bp, Rattus norvegicus
atttcagcgtttcagagacagagac

SEQ ID NO: 213122 - DNA, 25 bp, Rattus norvegicus
atttcagcgtttgagagacagagac

SEQ ID NO: 213123 - DNA, 25 bp, Rattus norvegicus
atttcagctccacattatttataga

SEQ ID NO: 213124 - DNA, 25 bp, Rattus norvegicus
atttcagctccagattatttataga

SEQ ID NO: 213125 - DNA, 25 bp, Rattus norvegicus
atttcagctgtgaaccaattccagg

SEQ ID NO: 213126 - DNA, 25 bp, Rattus norvegicus
atttcagctgtgtaccaattccagg

SEQ ID NO: 213127 - DNA, 25 bp, Rattus norvegicus
atttcagcttgcagtcgggtcatga

SEQ ID NO: 213128 - DNA, 25 bp, Rattus norvegicus
atttcagcttgctgtcgggtcatga

SEQ ID NO: 213129 - DNA, 25 bp, Rattus norvegicus
atttcaggacacagccaaacggctc

SEQ ID NO: 213130 - DNA, 25 bp, Rattus norvegicus
atttcaggacactgccaaacggctc

SEQ ID NO: 213131 - DNA, 25 bp, Rattus norvegicus
atttcaggacctaggacagggcccg

SEQ ID NO: 213132 - DNA, 25 bp, Rattus norvegicus
atttcaggaccttggacagggcccg

SEQ ID NO: 213133 - DNA, 25 bp, Rattus norvegicus
atttcaggacggagccaggagatga

SEQ ID NO: 213134 - DNA, 25 bp, Rattus norvegicus
atttcaggacggtgccaggagatga

SEQ ID NO: 213135 - DNA, 25 bp, Rattus norvegicus
atttcaggagctcagcatggagcag

SEQ ID NO: 213136 - DNA, 25 bp, Rattus norvegicus
atttcaggagctgagcatggagcag

SEQ ID NO: 213137 - DNA, 25 bp, Rattus norvegicus
atttcaggagttcattgagcatcta

SEQ ID NO: 213138 - DNA, 25 bp, Rattus norvegicus
atttcaggagttgattgagcatcta

SEQ ID NO: 213139 - DNA, 25 bp, Rattus norvegicus
atttcaggcagcattccctatggga

SEQ ID NO: 213140 - DNA, 25 bp, Rattus norvegicus
atttcaggcagctttccctatggga

SEQ ID NO: 213141 - DNA, 25 bp, Rattus norvegicus
atttcaggctaaactgagctacaga

SEQ ID NO: 213142 - DNA, 25 bp, Rattus norvegicus
atttcaggctaatctgagctacaga

SEQ ID NO: 213143 - DNA, 25 bp, Rattus norvegicus
atttcaggtagccttgggaagcaag

SEQ ID NO: 213144 - DNA, 25 bp, Rattus norvegicus
atttcaggtagcgttgggaagcaag

SEQ ID NO: 213145 - DNA, 25 bp, Rattus norvegicus
atttcaggtatgctctgtgtgggta

SEQ ID NO: 213146 - DNA, 25 bp, Rattus norvegicus
atttcaggtatggtctgtgtgggta

SEQ ID NO: 213147 - DNA, 25 bp, Rattus norvegicus
atttcagtattaacatctcacaagg

SEQ ID NO: 213148 - DNA, 25 bp, Rattus norvegicus
atttcagtattatcatctcacaagg

SEQ ID NO: 213149 - DNA, 25 bp, Rattus norvegicus
atttcagtcaatagactccctgcct

SEQ ID NO: 213150 - DNA, 25 bp, Rattus norvegicus
atttcagtcaattgactccctgcct

SEQ ID NO: 213151 - DNA, 25 bp, Rattus norvegicus
atttcagtcgttcggtttctgagcc

SEQ ID NO: 213152 - DNA, 25 bp, Rattus norvegicus
atttcagtcgttgggtttctgagcc

SEQ ID NO: 213153 - DNA, 25 bp, Rattus norvegicus
atttcagtgaacaagtcagtggctt

SEQ ID NO: 213154 - DNA, 25 bp, Rattus norvegicus
atttcagtgaactagtcagtggctt

SEQ ID NO: 213155 - DNA, 25 bp, Rattus norvegicus
atttcagtgtttctcacccaaggtg

SEQ ID NO: 213156 - DNA, 25 bp, Rattus norvegicus
atttcagtgtttgtcacccaaggtg

SEQ ID NO: 213157 - DNA, 25 bp, Rattus norvegicus
atttcagttactcttaatgctcatg

SEQ ID NO: 213158 - DNA, 25 bp, Rattus norvegicus
atttcagttactgttaatgctcatg

SEQ ID NO: 213159 - DNA, 25 bp, Rattus norvegicus
atttcagttctgagccgtattctca

SEQ ID NO: 213160 - DNA, 25 bp, Rattus norvegicus
atttcagttctgtgccgtattctca

SEQ ID NO: 213161 - DNA, 25 bp, Rattus norvegicus
atttcagttggtctctgggtcacac

SEQ ID NO: 213162 - DNA, 25 bp, Rattus norvegicus
atttcagttggtgtctgggtcacac

SEQ ID NO: 213163 - DNA, 25 bp, Rattus norvegicus
atttcataaagtattcccacccaga

SEQ ID NO: 213164 - DNA, 25 bp, Rattus norvegicus
atttcataaagttttcccacccaga

SEQ ID NO: 213165 - DNA, 25 bp, Rattus norvegicus
atttcatactctctaactgggcccc

SEQ ID NO: 213166 - DNA, 25 bp, Rattus norvegicus
atttcatactctgtaactgggcccc

SEQ ID NO: 213167 - DNA, 25 bp, Rattus norvegicus
atttcatatagccagccacaaacct

SEQ ID NO: 213168 - DNA, 25 bp, Rattus norvegicus
atttcatatagcgagccacaaacct

SEQ ID NO: 213169 - DNA, 25 bp, Rattus norvegicus
atttcatatcaacctactgctgtcc

SEQ ID NO: 213170 - DNA, 25 bp, Rattus norvegicus
atttcatatcaagctactgctgtcc

SEQ ID NO: 213171 - DNA, 25 bp, Rattus norvegicus
atttcatatctcagttctggccctt

SEQ ID NO: 213172 - DNA, 25 bp, Rattus norvegicus
atttcatatctctgttctggccctt

SEQ ID NO: 213173 - DNA, 25 bp, Rattus norvegicus
atttcatatcttcttttcctcgtcc

SEQ ID NO: 213174 - DNA, 25 bp, Rattus norvegicus
atttcatatcttgttttcctcgtcc

SEQ ID NO: 213175 - DNA, 25 bp, Rattus norvegicus
atttcatcaagtagggttggcccac

SEQ ID NO: 213176 - DNA, 25 bp, Rattus norvegicus
atttcatcaagttgggttggcccac

SEQ ID NO: 213177 - DNA, 25 bp, Rattus norvegicus
atttcatcaggaatgctggtcttag

SEQ ID NO: 213178 - DNA, 25 bp, Rattus norvegicus
atttcatcaggattgctggtcttag

SEQ ID NO: 213179 - DNA, 25 bp, Rattus norvegicus
atttcatccacaacgcagacgagcg

SEQ ID NO: 213180 - DNA, 25 bp, Rattus norvegicus
atttcatccacatcgcagacgagcg

SEQ ID NO: 213181 - DNA, 25 bp, Rattus norvegicus
atttcatccaggaagctgaccccag

SEQ ID NO: 213182 - DNA, 25 bp, Rattus norvegicus
atttcatccaggtagctgaccccag

SEQ ID NO: 213183 - DNA, 25 bp, Rattus norvegicus
atttcatccccaagcttggagaact

SEQ ID NO: 213184 - DNA, 25 bp, Rattus norvegicus
atttcatccccatgcttggagaact

SEQ ID NO: 213185 - DNA, 25 bp, Rattus norvegicus
atttcatcctagctcaaggtccagg

SEQ ID NO: 213186 - DNA, 25 bp, Rattus norvegicus
atttcatcctaggtcaaggtccagg

SEQ ID NO: 213187 - DNA, 25 bp, Rattus norvegicus
atttcatccttgagtcctgttcaat

SEQ ID NO: 213188 - DNA, 25 bp, Rattus norvegicus
atttcatccttgtgtcctgttcaat

SEQ ID NO: 213189 - DNA, 25 bp, Rattus norvegicus
atttcatctattatattaccctatt

SEQ ID NO: 213190 - DNA, 25 bp, Rattus norvegicus
atttcatctattttattaccctatt

SEQ ID NO: 213191 - DNA, 25 bp, Rattus norvegicus
atttcatctcaacagccctgtttga

SEQ ID NO: 213192 - DNA, 25 bp, Rattus norvegicus
atttcatctcaagagccctgtttga

SEQ ID NO: 213193 - DNA, 25 bp, Rattus norvegicus
atttcatctccccagagctgtttga

SEQ ID NO: 213194 - DNA, 25 bp, Rattus norvegicus
atttcatctcccgagagctgtttga

SEQ ID NO: 213195 - DNA, 25 bp, Rattus norvegicus
atttcatctgctctcctttctgaat

SEQ ID NO: 213196 - DNA, 25 bp, Rattus norvegicus
atttcatctgctgtcctttctgaat

SEQ ID NO: 213197 - DNA, 25 bp, Rattus norvegicus
atttcatcttatatgtccacgtgac

SEQ ID NO: 213198 - DNA, 25 bp, Rattus norvegicus
atttcatcttatttgtccacgtgac

SEQ ID NO: 213199 - DNA, 25 bp, Rattus norvegicus
atttcatcttggatgctacagcttc

SEQ ID NO: 213200 - DNA, 25 bp, Rattus norvegicus
atttcatcttggttgctacagcttc

SEQ ID NO: 213201 - DNA, 25 bp, Rattus norvegicus
atttcatgagcgactagaccactag

SEQ ID NO: 213202 - DNA, 25 bp, Rattus norvegicus
atttcatgagcgtctagaccactag

SEQ ID NO: 213203 - DNA, 25 bp, Rattus norvegicus
atttcatgagtcagctccactgtgg

SEQ ID NO: 213204 - DNA, 25 bp, Rattus norvegicus
atttcatgagtctgctccactgtgg

SEQ ID NO: 213205 - DNA, 25 bp, Rattus norvegicus
atttcatgcatcaagtattttgtgt

SEQ ID NO: 213206 - DNA, 25 bp, Rattus norvegicus
atttcatgcatctagtattttgtgt

SEQ ID NO: 213207 - DNA, 25 bp, Rattus norvegicus
atttcatgctatcgttccagcccag

SEQ ID NO: 213208 - DNA, 25 bp, Rattus norvegicus
atttcatgctatggttccagcccag

SEQ ID NO: 213209 - DNA, 25 bp, Rattus norvegicus
atttcatgcttcaacaccgggtgta

SEQ ID NO: 213210 - DNA, 25 bp, Rattus norvegicus
atttcatgcttctacaccgggtgta

SEQ ID NO: 213211 - DNA, 25 bp, Rattus norvegicus
atttcatggaccctagagctctgga

SEQ ID NO: 213212 - DNA, 25 bp, Rattus norvegicus
atttcatggaccgtagagctctgga

SEQ ID NO: 213213 - DNA, 25 bp, Rattus norvegicus
atttcatggatcacagatggaggac

SEQ ID NO: 213214 - DNA, 25 bp, Rattus norvegicus
atttcatggatctcagatggaggac

SEQ ID NO: 213215 - DNA, 25 bp, Rattus norvegicus
atttcatggccgacaagtccaatgg

SEQ ID NO: 213216 - DNA, 25 bp, Rattus norvegicus
atttcatggccgtcaagtccaatgg

SEQ ID NO: 213217 - DNA, 25 bp, Rattus norvegicus
atttcatgggaaagcggcagatcga

SEQ ID NO: 213218 - DNA, 25 bp, Rattus norvegicus
atttcatgggaatgcggcagatcga

SEQ ID NO: 213219 - DNA, 25 bp, Rattus norvegicus
atttcatgggccactgggatcagat

SEQ ID NO: 213220 - DNA, 25 bp, Rattus norvegicus
atttcatgggcctctgggatcagat

SEQ ID NO: 213221 - DNA, 25 bp, Rattus norvegicus
atttcatgtcctagctctttgtgag

SEQ ID NO: 213222 - DNA, 25 bp, Rattus norvegicus
atttcatgtccttgctctttgtgag

SEQ ID NO: 213223 - DNA, 25 bp, Rattus norvegicus
atttcatgtgctcaggagccaccag

SEQ ID NO: 213224 - DNA, 25 bp, Rattus norvegicus
atttcatgtgctgaggagccaccag

SEQ ID NO: 213225 - DNA, 25 bp, Rattus norvegicus
atttcatgtgtaatcaaccctaagt

SEQ ID NO: 213226 - DNA, 25 bp, Rattus norvegicus
atttcatgtgtattcaaccctaagt

SEQ ID NO: 213227 - DNA, 25 bp, Rattus norvegicus
atttcattccccaatttgacggcag

SEQ ID NO: 213228 - DNA, 25 bp, Rattus norvegicus
atttcattcccctatttgacggcag

SEQ ID NO: 213229 - DNA, 25 bp, Rattus norvegicus
atttcattctcacattagcctgcta

SEQ ID NO: 213230 - DNA, 25 bp, Rattus norvegicus
atttcattctcagattagcctgcta

SEQ ID NO: 213231 - DNA, 25 bp, Rattus norvegicus
atttcattgggacatgcctgtgctt

SEQ ID NO: 213232 - DNA, 25 bp, Rattus norvegicus
atttcattgggagatgcctgtgctt

SEQ ID NO: 213233 - DNA, 25 bp, Rattus norvegicus
atttcattgggccatggaaagtgct

SEQ ID NO: 213234 - DNA, 25 bp, Rattus norvegicus
atttcattgggcgatggaaagtgct

SEQ ID NO: 213235 - DNA, 25 bp, Rattus norvegicus
atttcattgtgaatttcctttgaca

SEQ ID NO: 213236 - DNA, 25 bp, Rattus norvegicus
atttcattgtgattttcctttgaca

SEQ ID NO: 213237 - DNA, 25 bp, Rattus norvegicus
atttcatttaccacgtggtgcactc

SEQ ID NO: 213238 - DNA, 25 bp, Rattus norvegicus
atttcatttacctcgtggtgcactc

SEQ ID NO: 213239 - DNA, 25 bp, Rattus norvegicus
atttcatttccgactgtatggcctg

SEQ ID NO: 213240 - DNA, 25 bp, Rattus norvegicus
atttcatttccgtctgtatggcctg

SEQ ID NO: 213241 - DNA, 25 bp, Rattus norvegicus
atttcatttttacatcagagcttta

SEQ ID NO: 213242 - DNA, 25 bp, Rattus norvegicus
atttcatttttagatcagagcttta

SEQ ID NO: 213243 - DNA, 25 bp, Rattus norvegicus
atttccaaagcacaccgtcgggtag

SEQ ID NO: 213244 - DNA, 25 bp, Rattus norvegicus
atttccaaagcagaccgtcgggtag

SEQ ID NO: 213245 - DNA, 25 bp, Rattus norvegicus
atttccaacggcaacttcgtgtctc

SEQ ID NO: 213246 - DNA, 25 bp, Rattus norvegicus
atttccaacggctacttcgtgtctc

SEQ ID NO: 213247 - DNA, 25 bp, Rattus norvegicus
atttccaactggcttacttcaagat

SEQ ID NO: 213248 - DNA, 25 bp, Rattus norvegicus
atttccaactgggttacttcaagat

SEQ ID NO: 213249 - DNA, 25 bp, Rattus norvegicus
atttccaaggatcctctcttcaaaa

SEQ ID NO: 213250 - DNA, 25 bp, Rattus norvegicus
atttccaaggatgctctcttcaaaa

SEQ ID NO: 213251 - DNA, 25 bp, Rattus norvegicus
atttccaagtggagaggtctcactc

SEQ ID NO: 213252 - DNA, 25 bp, Rattus norvegicus
atttccaagtggtgaggtctcactc

SEQ ID NO: 213253 - DNA, 25 bp, Rattus norvegicus
atttccaatagcacttatccagtga

SEQ ID NO: 213254 - DNA, 25 bp, Rattus norvegicus
atttccaatagctcttatccagtga

SEQ ID NO: 213255 - DNA, 25 bp, Rattus norvegicus
atttccaatgatctgcttgcccagg

SEQ ID NO: 213256 - DNA, 25 bp, Rattus norvegicus
atttccaatgatgtgcttgcccagg

SEQ ID NO: 213257 - DNA, 25 bp, Rattus norvegicus
atttccaatggcctgggcacactgt

SEQ ID NO: 213258 - DNA, 25 bp, Rattus norvegicus
atttccaatggcgtgggcacactgt

SEQ ID NO: 213259 - DNA, 25 bp, Rattus norvegicus
atttccacagttccaaatggccttt

SEQ ID NO: 213260 - DNA, 25 bp, Rattus norvegicus
atttccacagttgcaaatggccttt

SEQ ID NO: 213261 - DNA, 25 bp, Rattus norvegicus
atttccacatctattgctttcagtc

SEQ ID NO: 213262 - DNA, 25 bp, Rattus norvegicus
atttccacatcttttgctttcagtc

SEQ ID NO: 213263 - DNA, 25 bp, Rattus norvegicus
atttccaccttcacttttgtagcat

SEQ ID NO: 213264 - DNA, 25 bp, Rattus norvegicus
atttccaccttctcttttgtagcat

SEQ ID NO: 213265 - DNA, 25 bp, Rattus norvegicus
atttccacggctcgcttattggcca

SEQ ID NO: 213266 - DNA, 25 bp, Rattus norvegicus
atttccacggctggcttattggcca

SEQ ID NO: 213267 - DNA, 25 bp, Rattus norvegicus
atttccactaagcagctaccgagta

SEQ ID NO: 213268 - DNA, 25 bp, Rattus norvegicus
atttccactaaggagctaccgagta

SEQ ID NO: 213269 - DNA, 25 bp, Rattus norvegicus
atttccactgtcacacgcatagatc

SEQ ID NO: 213270 - DNA, 25 bp, Rattus norvegicus
atttccactgtctcacgcatagatc

SEQ ID NO: 213271 - DNA, 25 bp, Rattus norvegicus
atttccacttgcacagccttattgt

SEQ ID NO: 213272 - DNA, 25 bp, Rattus norvegicus
atttccacttgctcagccttattgt

SEQ ID NO: 213273 - DNA, 25 bp, Rattus norvegicus
atttccagaaccaagagacctctct

SEQ ID NO: 213274 - DNA, 25 bp, Rattus norvegicus
atttccagaacctagagacctctct

SEQ ID NO: 213275 - DNA, 25 bp, Rattus norvegicus
atttccagaccccacacggcggaag

SEQ ID NO: 213276 - DNA, 25 bp, Rattus norvegicus
atttccagacccgacacggcggaag

SEQ ID NO: 213277 - DNA, 25 bp, Rattus norvegicus
atttccagatgcagtgttctctatt

SEQ ID NO: 213278 - DNA, 25 bp, Rattus norvegicus
atttccagatgctgtgttctctatt

SEQ ID NO: 213279 - DNA, 25 bp, Rattus norvegicus
atttccagcactctccatgctgcag

SEQ ID NO: 213280 - DNA, 25 bp, Rattus norvegicus
atttccagcactgtccatgctgcag

SEQ ID NO: 213281 - DNA, 25 bp, Rattus norvegicus
atttccagcatcagacattgtcttg

SEQ ID NO: 213282 - DNA, 25 bp, Rattus norvegicus
atttccagcatctgacattgtcttg

SEQ ID NO: 213283 - DNA, 25 bp, Rattus norvegicus
atttccagccatattctgtaagcca

SEQ ID NO: 213284 - DNA, 25 bp, Rattus norvegicus
atttccagccattttctgtaagcca

SEQ ID NO: 213285 - DNA, 25 bp, Rattus norvegicus
atttccagcctaactgtatgacctt

SEQ ID NO: 213286 - DNA, 25 bp, Rattus norvegicus
atttccagcctatctgtatgacctt

SEQ ID NO: 213287 - DNA, 25 bp, Rattus norvegicus
atttccagctggaacccagcctggt

SEQ ID NO: 213288 - DNA, 25 bp, Rattus norvegicus
atttccagctggtacccagcctggt

SEQ ID NO: 213289 - DNA, 25 bp, Rattus norvegicus
atttccagcttgaaagcccagccat

SEQ ID NO: 213290 - DNA, 25 bp, Rattus norvegicus
atttccagcttgtaagcccagccat

SEQ ID NO: 213291 - DNA, 25 bp, Rattus norvegicus
atttccagggatactttgtcgcgac

SEQ ID NO: 213292 - DNA, 25 bp, Rattus norvegicus
atttccagggattctttgtcgcgac

SEQ ID NO: 213293 - DNA, 25 bp, Rattus norvegicus
atttccagggtgacctctttctgtg

SEQ ID NO: 213294 - DNA, 25 bp, Rattus norvegicus
atttccagggtgtcctctttctgtg

SEQ ID NO: 213295 - DNA, 25 bp, Rattus norvegicus
atttccagtaacatcctacataggg

SEQ ID NO: 213296 - DNA, 25 bp, Rattus norvegicus
atttccagtaacttcctacataggg

SEQ ID NO: 213297 - DNA, 25 bp, Rattus norvegicus
atttccagtaccattgtcacaaact

SEQ ID NO: 213298 - DNA, 25 bp, Rattus norvegicus
atttccagtacctttgtcacaaact

SEQ ID NO: 213299 - DNA, 25 bp, Rattus norvegicus
atttccagtattaaatctagcacag

SEQ ID NO: 213300 - DNA, 25 bp, Rattus norvegicus
atttccagtatttaatctagcacag

SEQ ID NO: 213301 - DNA, 25 bp, Rattus norvegicus
atttccagtgttatatgccttccat

SEQ ID NO: 213302 - DNA, 25 bp, Rattus norvegicus
atttccagtgttttatgccttccat

SEQ ID NO: 213303 - DNA, 25 bp, Rattus norvegicus
atttccagtttcatctgagtcgtta

SEQ ID NO: 213304 - DNA, 25 bp, Rattus norvegicus
atttccagtttcttctgagtcgtta

SEQ ID NO: 213305 - DNA, 25 bp, Rattus norvegicus
atttccataagcagaagtgccctgg

SEQ ID NO: 213306 - DNA, 25 bp, Rattus norvegicus
atttccataagctgaagtgccctgg

SEQ ID NO: 213307 - DNA, 25 bp, Rattus norvegicus
atttccatctcaccgaagctaacat

SEQ ID NO: 213308 - DNA, 25 bp, Rattus norvegicus
atttccatctcagcgaagctaacat

SEQ ID NO: 213309 - DNA, 25 bp, Rattus norvegicus
atttccatgctacacggttctttgc

SEQ ID NO: 213310 - DNA, 25 bp, Rattus norvegicus
atttccatgctagacggttctttgc

SEQ ID NO: 213311 - DNA, 25 bp, Rattus norvegicus
atttccatgctcagagtctgggtgt

SEQ ID NO: 213312 - DNA, 25 bp, Rattus norvegicus
atttccatgctctgagtctgggtgt

SEQ ID NO: 213313 - DNA, 25 bp, Rattus norvegicus
atttccatgcttcagttctgtgcaa

SEQ ID NO: 213314 - DNA, 25 bp, Rattus norvegicus
atttccatgcttgagttctgtgcaa

SEQ ID NO: 213315 - DNA, 25 bp, Rattus norvegicus
atttccatggaaacactgctcaaag

SEQ ID NO: 213316 - DNA, 25 bp, Rattus norvegicus
atttccatggaatcactgctcaaag

SEQ ID NO: 213317 - DNA, 25 bp, Rattus norvegicus
atttccatgtgtagaaacggcaatc

SEQ ID NO: 213318 - DNA, 25 bp, Rattus norvegicus
atttccatgtgttgaaacggcaatc

SEQ ID NO: 213319 - DNA, 25 bp, Rattus norvegicus
atttccattcacacctggctaggtg

SEQ ID NO: 213320 - DNA, 25 bp, Rattus norvegicus
atttccattcactcctggctaggtg

SEQ ID NO: 213321 - DNA, 25 bp, Rattus norvegicus
atttccattcttcctgagttactac

SEQ ID NO: 213322 - DNA, 25 bp, Rattus norvegicus
atttccattcttgctgagttactac

SEQ ID NO: 213323 - DNA, 25 bp, Rattus norvegicus
atttccatttttcctgactgcatac

SEQ ID NO: 213324 - DNA, 25 bp, Rattus norvegicus
atttccatttttgctgactgcatac

SEQ ID NO: 213325 - DNA, 25 bp, Rattus norvegicus
atttcccaatgccagaacttcagct

SEQ ID NO: 213326 - DNA, 25 bp, Rattus norvegicus
atttcccaatgcgagaacttcagct

SEQ ID NO: 213327 - DNA, 25 bp, Rattus norvegicus
atttcccacactcagatctaaagca

SEQ ID NO: 213328 - DNA, 25 bp, Rattus norvegicus
atttcccacactgagatctaaagca

SEQ ID NO: 213329 - DNA, 25 bp, Rattus norvegicus
atttcccacagtatcttcaatagcc

SEQ ID NO: 213330 - DNA, 25 bp, Rattus norvegicus
atttcccacagtttcttcaatagcc

SEQ ID NO: 213331 - DNA, 25 bp, Rattus norvegicus
atttcccacctaacgagtaacattc

SEQ ID NO: 213332 - DNA, 25 bp, Rattus norvegicus
atttcccacctatcgagtaacattc

SEQ ID NO: 213333 - DNA, 25 bp, Rattus norvegicus
atttcccactatctagatgctgcca

SEQ ID NO: 213334 - DNA, 25 bp, Rattus norvegicus
atttcccactatgtagatgctgcca

SEQ ID NO: 213335 - DNA, 25 bp, Rattus norvegicus
atttcccacttcatttgattcacct

SEQ ID NO: 213336 - DNA, 25 bp, Rattus norvegicus
atttcccacttcttttgattcacct

SEQ ID NO: 213337 - DNA, 25 bp, Rattus norvegicus
atttcccacttgacattagggcctt

SEQ ID NO: 213338 - DNA, 25 bp, Rattus norvegicus
atttcccacttgactggactggctc

SEQ ID NO: 213339 - DNA, 25 bp, Rattus norvegicus
atttcccacttgtcattagggcctt

SEQ ID NO: 213340 - DNA, 25 bp, Rattus norvegicus
atttcccacttgtctggactggctc

SEQ ID NO: 213341 - DNA, 25 bp, Rattus norvegicus
atttcccagctgcttgatgccaagg

SEQ ID NO: 213342 - DNA, 25 bp, Rattus norvegicus
atttcccagctggttgatgccaagg

SEQ ID NO: 213343 - DNA, 25 bp, Rattus norvegicus
atttcccatcagcaagatgacacag

SEQ ID NO: 213344 - DNA, 25 bp, Rattus norvegicus
atttcccatcaggaagatgacacag

SEQ ID NO: 213345 - DNA, 25 bp, Rattus norvegicus
atttcccatccacttagctgaagtt

SEQ ID NO: 213346 - DNA, 25 bp, Rattus norvegicus
atttcccatccagttagctgaagtt

SEQ ID NO: 213347 - DNA, 25 bp, Rattus norvegicus
atttcccatgaaactcagacattac

SEQ ID NO: 213348 - DNA, 25 bp, Rattus norvegicus
atttcccatgaatctcagacattac

SEQ ID NO: 213349 - DNA, 25 bp, Rattus norvegicus
atttcccatgcaccgaatgctgtga

SEQ ID NO: 213350 - DNA, 25 bp, Rattus norvegicus
atttcccatgcagcgaatgctgtga

SEQ ID NO: 213351 - DNA, 25 bp, Rattus norvegicus
atttcccatgtaaccccgtatgagg

SEQ ID NO: 213352 - DNA, 25 bp, Rattus norvegicus
atttcccatgtatccccgtatgagg

SEQ ID NO: 213353 - DNA, 25 bp, Rattus norvegicus
atttcccatgtgagcagttagtgtg

SEQ ID NO: 213354 - DNA, 25 bp, Rattus norvegicus
atttcccatgtgtgcagttagtgtg

SEQ ID NO: 213355 - DNA, 25 bp, Rattus norvegicus
atttccccaaggctaacgcggactg

SEQ ID NO: 213356 - DNA, 25 bp, Rattus norvegicus
atttccccaagggtaacgcggactg

SEQ ID NO: 213357 - DNA, 25 bp, Rattus norvegicus
atttccccaattatcttccatggct

SEQ ID NO: 213358 - DNA, 25 bp, Rattus norvegicus
atttccccaattttcttccatggct

SEQ ID NO: 213359 - DNA, 25 bp, Rattus norvegicus
atttccccagcaatgtcaatctcat

SEQ ID NO: 213360 - DNA, 25 bp, Rattus norvegicus
atttccccagcattgtcaatctcat

SEQ ID NO: 213361 - DNA, 25 bp, Rattus norvegicus
atttccccataaactgaggcgcagg

SEQ ID NO: 213362 - DNA, 25 bp, Rattus norvegicus
atttccccataatctgaggcgcagg

SEQ ID NO: 213363 - DNA, 25 bp, Rattus norvegicus
atttcccctctgctcatgaagcaaa

SEQ ID NO: 213364 - DNA, 25 bp, Rattus norvegicus
atttcccctctggtcatgaagcaaa

SEQ ID NO: 213365 - DNA, 25 bp, Rattus norvegicus
atttccccttccattgcttgaaaat

SEQ ID NO: 213366 - DNA, 25 bp, Rattus norvegicus
atttccccttcctttgcttgaaaat

SEQ ID NO: 213367 - DNA, 25 bp, Rattus norvegicus
atttcccggtcccataagggccatg

SEQ ID NO: 213368 - DNA, 25 bp, Rattus norvegicus
atttcccggtccgataagggccatg

SEQ ID NO: 213369 - DNA, 25 bp, Rattus norvegicus
atttcccgtggcagcagaaaggctt

SEQ ID NO: 213370 - DNA, 25 bp, Rattus norvegicus
atttcccgtggctgcagaaaggctt

SEQ ID NO: 213371 - DNA, 25 bp, Rattus norvegicus
atttccctaaaactactcaagctgt

SEQ ID NO: 213372 - DNA, 25 bp, Rattus norvegicus
atttccctaaaagtactcaagctgt

SEQ ID NO: 213373 - DNA, 25 bp, Rattus norvegicus
atttccctaaatatctggctctgcc

SEQ ID NO: 213374 - DNA, 25 bp, Rattus norvegicus
atttccctaaatttctggctctgcc

SEQ ID NO: 213375 - DNA, 25 bp, Rattus norvegicus
atttccctaacacagatggtcccat

SEQ ID NO: 213376 - DNA, 25 bp, Rattus norvegicus
atttccctaacagagatggtcccat

SEQ ID NO: 213377 - DNA, 25 bp, Rattus norvegicus
atttccctagcgacatcaggttgtc

SEQ ID NO: 213378 - DNA, 25 bp, Rattus norvegicus
atttccctagcgtcatcaggttgtc

SEQ ID NO: 213379 - DNA, 25 bp, Rattus norvegicus
atttccctcaagcatggctacgtgc

SEQ ID NO: 213380 - DNA, 25 bp, Rattus norvegicus
atttccctcaaggatggctacgtgc

SEQ ID NO: 213381 - DNA, 25 bp, Rattus norvegicus
atttccctcgatcacatttggtagt

SEQ ID NO: 213382 - DNA, 25 bp, Rattus norvegicus
atttccctcgatgacatttggtagt

SEQ ID NO: 213383 - DNA, 25 bp, Rattus norvegicus
atttccctcgtcagatcatttacag

SEQ ID NO: 213384 - DNA, 25 bp, Rattus norvegicus
atttccctcgtctgatcatttacag

SEQ ID NO: 213385 - DNA, 25 bp, Rattus norvegicus
atttccctctaacttaccaggcaca

SEQ ID NO: 213386 - DNA, 25 bp, Rattus norvegicus
atttccctctaagttaccaggcaca

SEQ ID NO: 213387 - DNA, 25 bp, Rattus norvegicus
atttccctctttcccactagaagaa

SEQ ID NO: 213388 - DNA, 25 bp, Rattus norvegicus
atttccctctttgccactagaagaa

SEQ ID NO: 213389 - DNA, 25 bp, Rattus norvegicus
atttccctgaagacactgatctacc

SEQ ID NO: 213390 - DNA, 25 bp, Rattus norvegicus
atttccctgaagtcactgatctacc

SEQ ID NO: 213391 - DNA, 25 bp, Rattus norvegicus
atttccctgaggctgttgcttgctc

SEQ ID NO: 213392 - DNA, 25 bp, Rattus norvegicus
atttccctgagggtgttgcttgctc

SEQ ID NO: 213393 - DNA, 25 bp, Rattus norvegicus
atttccctgcccacacaatgtttta

SEQ ID NO: 213394 - DNA, 25 bp, Rattus norvegicus
atttccctgccctcacaatgtttta

SEQ ID NO: 213395 - DNA, 25 bp, Rattus norvegicus
atttccctggacaacttcacaaggt

SEQ ID NO: 213396 - DNA, 25 bp, Rattus norvegicus
atttccctggactacttcacaaggt

SEQ ID NO: 213397 - DNA, 25 bp, Rattus norvegicus
atttccctggccagtatggagcagc

SEQ ID NO: 213398 - DNA, 25 bp, Rattus norvegicus
atttccctggcctgtatggagcagc

SEQ ID NO: 213399 - DNA, 25 bp, Rattus norvegicus
atttccctggttcaggagcacagct

SEQ ID NO: 213400 - DNA, 25 bp, Rattus norvegicus
atttccctggttgaggagcacagct

SEQ ID NO: 213401 - DNA, 25 bp, Rattus norvegicus
atttccctgtgtctggctagagcca

SEQ ID NO: 213402 - DNA, 25 bp, Rattus norvegicus
atttccctgtgtgtggctagagcca

SEQ ID NO: 213403 - DNA, 25 bp, Rattus norvegicus
atttccctgttacttacatctggtg

SEQ ID NO: 213404 - DNA, 25 bp, Rattus norvegicus
atttccctgttagttacatctggtg

SEQ ID NO: 213405 - DNA, 25 bp, Rattus norvegicus
atttcccttcccacagtcctctctt

SEQ ID NO: 213406 - DNA, 25 bp, Rattus norvegicus
atttcccttccctcagtcctctctt

SEQ ID NO: 213407 - DNA, 25 bp, Rattus norvegicus
atttcccttccgcaggatggacagg

SEQ ID NO: 213408 - DNA, 25 bp, Rattus norvegicus
atttcccttccggaggatggacagg

SEQ ID NO: 213409 - DNA, 25 bp, Rattus norvegicus
atttcccttggcagatgcccaggta

SEQ ID NO: 213410 - DNA, 25 bp, Rattus norvegicus
atttcccttggctgatgcccaggta

SEQ ID NO: 213411 - DNA, 25 bp, Rattus norvegicus
atttccctttggagacacagcaagt

SEQ ID NO: 213412 - DNA, 25 bp, Rattus norvegicus
atttccctttggtgacacagcaagt

SEQ ID NO: 213413 - DNA, 25 bp, Rattus norvegicus
atttccctttgtcccagattctgtg

SEQ ID NO: 213414 - DNA, 25 bp, Rattus norvegicus
atttccctttgtgccagattctgtg

SEQ ID NO: 213415 - DNA, 25 bp, Rattus norvegicus
atttcccttttgcttgtgcggctgt

SEQ ID NO: 213416 - DNA, 25 bp, Rattus norvegicus
atttcccttttggttgtgcggctgt

SEQ ID NO: 213417 - DNA, 25 bp, Rattus norvegicus
atttccctttttctggctgctataa

SEQ ID NO: 213418 - DNA, 25 bp, Rattus norvegicus
atttccctttttgtggctgctataa

SEQ ID NO: 213419 - DNA, 25 bp, Rattus norvegicus
atttccgaaggcagaagtacctgat

SEQ ID NO: 213420 - DNA, 25 bp, Rattus norvegicus
atttccgaaggctgaagtacctgat

SEQ ID NO: 213421 - DNA, 25 bp, Rattus norvegicus
atttccgaataaagtattgtccagc

SEQ ID NO: 213422 - DNA, 25 bp, Rattus norvegicus
atttccgaataatgtattgtccagc

SEQ ID NO: 213423 - DNA, 25 bp, Rattus norvegicus
atttccgaatgcaacagttcatctg

SEQ ID NO: 213424 - DNA, 25 bp, Rattus norvegicus
atttccgaatgctacagttcatctg

SEQ ID NO: 213425 - DNA, 25 bp, Rattus norvegicus
atttccgagcacatattagtgccca

SEQ ID NO: 213426 - DNA, 25 bp, Rattus norvegicus
atttccgagcacttattagtgccca

SEQ ID NO: 213427 - DNA, 25 bp, Rattus norvegicus
atttccgcaattccacaacatatct

SEQ ID NO: 213428 - DNA, 25 bp, Rattus norvegicus
atttccgcaattgcacaacatatct

SEQ ID NO: 213429 - DNA, 25 bp, Rattus norvegicus
atttccgccggaagtgatctgctgt

SEQ ID NO: 213430 - DNA, 25 bp, Rattus norvegicus
atttccgccggatgtgatctgctgt

SEQ ID NO: 213431 - DNA, 25 bp, Rattus norvegicus
atttccgcctgactggtccaggaaa

SEQ ID NO: 213432 - DNA, 25 bp, Rattus norvegicus
atttccgcctgagtggtccaggaaa

SEQ ID NO: 213433 - DNA, 25 bp, Rattus norvegicus
atttccggcctgcagtgacacactg

SEQ ID NO: 213434 - DNA, 25 bp, Rattus norvegicus
atttccggcctggagtgacacactg

SEQ ID NO: 213435 - DNA, 25 bp, Rattus norvegicus
atttccggcttcagtgtgtcatggc

SEQ ID NO: 213436 - DNA, 25 bp, Rattus norvegicus
atttccggcttctgtgtgtcatggc

SEQ ID NO: 213437 - DNA, 25 bp, Rattus norvegicus
atttccgtgtctcttctcatacagc

SEQ ID NO: 213438 - DNA, 25 bp, Rattus norvegicus
atttccgtgtctgttctcatacagc

SEQ ID NO: 213439 - DNA, 25 bp, Rattus norvegicus
atttccgttcatactggtatcataa

SEQ ID NO: 213440 - DNA, 25 bp, Rattus norvegicus
atttccgttcattctggtatcataa

SEQ ID NO: 213441 - DNA, 25 bp, Rattus norvegicus
atttcctaatacagtagcttcccca

SEQ ID NO: 213442 - DNA, 25 bp, Rattus norvegicus
atttcctaatactgtagcttcccca

SEQ ID NO: 213443 - DNA, 25 bp, Rattus norvegicus
atttcctacggcaggttggcgtgac

SEQ ID NO: 213444 - DNA, 25 bp, Rattus norvegicus
atttcctacggctggttggcgtgac

SEQ ID NO: 213445 - DNA, 25 bp, Rattus norvegicus
atttcctacggtcttctgtttgtat

SEQ ID NO: 213446 - DNA, 25 bp, Rattus norvegicus
atttcctacggtgttctgtttgtat

SEQ ID NO: 213447 - DNA, 25 bp, Rattus norvegicus
atttcctactgcctcaaatacagct

SEQ ID NO: 213448 - DNA, 25 bp, Rattus norvegicus
atttcctactgcgtcaaatacagct

SEQ ID NO: 213449 - DNA, 25 bp, Rattus norvegicus
atttcctactgtatagtcacatggc

SEQ ID NO: 213450 - DNA, 25 bp, Rattus norvegicus
atttcctactgtttagtcacatggc

SEQ ID NO: 213451 - DNA, 25 bp, Rattus norvegicus
atttcctagcccaggttgttacaga

SEQ ID NO: 213452 - DNA, 25 bp, Rattus norvegicus
atttcctagccctggttgttacaga

SEQ ID NO: 213453 - DNA, 25 bp, Rattus norvegicus
atttcctaggcaccggatagttgga

SEQ ID NO: 213454 - DNA, 25 bp, Rattus norvegicus
atttcctaggcagcggatagttgga

SEQ ID NO: 213455 - DNA, 25 bp, Rattus norvegicus
atttcctaggttatcaactctgtca

SEQ ID NO: 213456 - DNA, 25 bp, Rattus norvegicus
atttcctaggttttcaactctgtca

SEQ ID NO: 213457 - DNA, 25 bp, Rattus norvegicus
atttcctagtacaccataagttgag

SEQ ID NO: 213458 - DNA, 25 bp, Rattus norvegicus
atttcctagtactccataagttgag

SEQ ID NO: 213459 - DNA, 25 bp, Rattus norvegicus
atttcctatgcaaatatcagcaagc

SEQ ID NO: 213460 - DNA, 25 bp, Rattus norvegicus
atttcctatgcatatatcagcaagc

SEQ ID NO: 213461 - DNA, 25 bp, Rattus norvegicus
atttcctattccacagatatcgtgg

SEQ ID NO: 213462 - DNA, 25 bp, Rattus norvegicus
atttcctattcctcagatatcgtgg

SEQ ID NO: 213463 - DNA, 25 bp, Rattus norvegicus
atttcctcaatcacagcaaagctac

SEQ ID NO: 213464 - DNA, 25 bp, Rattus norvegicus
atttcctcaatctcagcaaagctac

SEQ ID NO: 213465 - DNA, 25 bp, Rattus norvegicus
atttcctcagagatcacacggcata

SEQ ID NO: 213466 - DNA, 25 bp, Rattus norvegicus
atttcctcagagttcacacggcata

SEQ ID NO: 213467 - DNA, 25 bp, Rattus norvegicus
atttcctcagatctggtggtgtcga

SEQ ID NO: 213468 - DNA, 25 bp, Rattus norvegicus
atttcctcagatgtggtggtgtcga

SEQ ID NO: 213469 - DNA, 25 bp, Rattus norvegicus
atttcctcagctccttgcagggcat

SEQ ID NO: 213470 - DNA, 25 bp, Rattus norvegicus
atttcctcagctgcttgcagggcat

SEQ ID NO: 213471 - DNA, 25 bp, Rattus norvegicus
atttcctcatcaacagagtgcccga

SEQ ID NO: 213472 - DNA, 25 bp, Rattus norvegicus
atttcctcatcatcagagtgcccga

SEQ ID NO: 213473 - DNA, 25 bp, Rattus norvegicus
atttcctccttgcttttctagtcta

SEQ ID NO: 213474 - DNA, 25 bp, Rattus norvegicus
atttcctccttggttttctagtcta

SEQ ID NO: 213475 - DNA, 25 bp, Rattus norvegicus
atttcctcggaaacactttgcacaa

SEQ ID NO: 213476 - DNA, 25 bp, Rattus norvegicus
atttcctcggaatcactttgcacaa

SEQ ID NO: 213477 - DNA, 20 bp, Rattus norvegicus
atttcctctagtcttctgga

SEQ ID NO: 213478 - DNA, 25 bp, Rattus norvegicus
atttcctctcacagtaccatgtaag

SEQ ID NO: 213479 - DNA, 25 bp, Rattus norvegicus
atttcctctcactgtaccatgtaag

SEQ ID NO: 213480 - DNA, 20 bp, Rattus norvegicus
atttcctctcgtcttctgga

SEQ ID NO: 213481 - DNA, 25 bp, Rattus norvegicus
atttcctctgagctggtatctgctg

SEQ ID NO: 213482 - DNA, 25 bp, Rattus norvegicus
atttcctctgaggtggtatctgctg

SEQ ID NO: 213483 - DNA, 25 bp, Rattus norvegicus
atttcctctgccctgacttcagcta

SEQ ID NO: 213484 - DNA, 25 bp, Rattus norvegicus
atttcctctgccgtgacttcagcta

SEQ ID NO: 213485 - DNA, 25 bp, Rattus norvegicus
atttcctctgctaaccgagctgttg

SEQ ID NO: 213486 - DNA, 25 bp, Rattus norvegicus
atttcctctgcttaccgagctgttg

SEQ ID NO: 213487 - DNA, 25 bp, Rattus norvegicus
atttcctctgggacatcgtggagaa

SEQ ID NO: 213488 - DNA, 25 bp, Rattus norvegicus
atttcctctgggtcatcgtggagaa

SEQ ID NO: 213489 - DNA, 20 bp, Rattus norvegicus
atttcctctggtcttctgga

SEQ ID NO: 213490 - DNA, 25 bp, Rattus norvegicus
atttcctctgtcaggctgtccagat

SEQ ID NO: 213491 - DNA, 25 bp, Rattus norvegicus
atttcctctgtctggctgtccagat

SEQ ID NO: 213492 - DNA, 20 bp, Rattus norvegicus
atttcctcttgtcttctgga

SEQ ID NO: 213493 - DNA, 25 bp, Rattus norvegicus
atttcctctttcctctttgactaag

SEQ ID NO: 213494 - DNA, 25 bp, Rattus norvegicus
atttcctctttcgtctttgactaag

SEQ ID NO: 213495 - DNA, 25 bp, Rattus norvegicus
atttcctgaggtcggaatgcccgcc

SEQ ID NO: 213496 - DNA, 25 bp, Rattus norvegicus
atttcctgaggtgggaatgcccgcc

SEQ ID NO: 213497 - DNA, 25 bp, Rattus norvegicus
atttcctgatcccacaaggttggtc

SEQ ID NO: 213498 - DNA, 25 bp, Rattus norvegicus
atttcctgatccgacaaggttggtc

SEQ ID NO: 213499 - DNA, 25 bp, Rattus norvegicus
atttcctgcagtctacaaatcgtac

SEQ ID NO: 213500 - DNA, 25 bp, Rattus norvegicus
atttcctgcagtgtacaaatcgtac

SEQ ID NO: 213501 - DNA, 25 bp, Rattus norvegicus
atttcctgccaaccatgtgtagggt

SEQ ID NO: 213502 - DNA, 25 bp, Rattus norvegicus
atttcctgccaagcatgtgtagggt

SEQ ID NO: 213503 - DNA, 25 bp, Rattus norvegicus
atttcctgccatatgccagtgatct

SEQ ID NO: 213504 - DNA, 25 bp, Rattus norvegicus
atttcctgccatttgccagtgatct

SEQ ID NO: 213505 - DNA, 25 bp, Rattus norvegicus
atttcctgcccactgctgtgtgtac

SEQ ID NO: 213506 - DNA, 25 bp, Rattus norvegicus
atttcctgcccagtgctgtgtgtac

SEQ ID NO: 213507 - DNA, 25 bp, Rattus norvegicus
atttcctgccccatatactgagatt

SEQ ID NO: 213508 - DNA, 25 bp, Rattus norvegicus
atttcctgccccttatactgagatt

SEQ ID NO: 213509 - DNA, 25 bp, Rattus norvegicus
atttcctgccttacataattggtta

SEQ ID NO: 213510 - DNA, 25 bp, Rattus norvegicus
atttcctgcctttcataattggtta

SEQ ID NO: 213511 - DNA, 25 bp, Rattus norvegicus
atttcctgctgacttgggccggttc

SEQ ID NO: 213512 - DNA, 25 bp, Rattus norvegicus
atttcctgctgagttgggccggttc

SEQ ID NO: 213513 - DNA, 25 bp, Rattus norvegicus
atttcctggaatctcttttcatgca

SEQ ID NO: 213514 - DNA, 25 bp, Rattus norvegicus
atttcctggaatgtcttttcatgca

SEQ ID NO: 213515 - DNA, 25 bp, Rattus norvegicus
atttcctggagaaagagttatgggc

SEQ ID NO: 213516 - DNA, 25 bp, Rattus norvegicus
atttcctggagatagagttatgggc

SEQ ID NO: 213517 - DNA, 25 bp, Rattus norvegicus
atttcctggcaaatacgtgtcattt

SEQ ID NO: 213518 - DNA, 25 bp, Rattus norvegicus
atttcctggcaattacgtgtcattt

SEQ ID NO: 213519 - DNA, 25 bp, Rattus norvegicus
atttcctggtagcattccctctggg

SEQ ID NO: 213520 - DNA, 25 bp, Rattus norvegicus
atttcctggtaggattccctctggg

SEQ ID NO: 213521 - DNA, 25 bp, Rattus norvegicus
atttcctggtatcacaatgaatatg

SEQ ID NO: 213522 - DNA, 25 bp, Rattus norvegicus
atttcctggtatgacaatgaatatg

SEQ ID NO: 213523 - DNA, 25 bp, Rattus norvegicus
atttcctgtggcagaacattctcct

SEQ ID NO: 213524 - DNA, 25 bp, Rattus norvegicus
atttcctgtggctgaacattctcct

SEQ ID NO: 213525 - DNA, 25 bp, Rattus norvegicus
atttcctgtttcatggccttacctg

SEQ ID NO: 213526 - DNA, 25 bp, Rattus norvegicus
atttcctgtttcttggccttacctg

SEQ ID NO: 213527 - DNA, 25 bp, Rattus norvegicus
atttccttagctctcataacatgcc

SEQ ID NO: 213528 - DNA, 25 bp, Rattus norvegicus
atttccttagctgtcataacatgcc

SEQ ID NO: 213529 - DNA, 25 bp, Rattus norvegicus
atttccttccccatttagatcacat

SEQ ID NO: 213530 - DNA, 25 bp, Rattus norvegicus
atttccttccccttttagatcacat

SEQ ID NO: 213531 - DNA, 25 bp, Rattus norvegicus
atttccttcggaaccagtgaacatc

SEQ ID NO: 213532 - DNA, 25 bp, Rattus norvegicus
atttccttcggacattggctgctgc

SEQ ID NO: 213533 - DNA, 25 bp, Rattus norvegicus
atttccttcggagattggctgctgc

SEQ ID NO: 213534 - DNA, 25 bp, Rattus norvegicus
atttccttcggatccagtgaacatc

SEQ ID NO: 213535 - DNA, 25 bp, Rattus norvegicus
atttccttctaacctcctatgtctg

SEQ ID NO: 213536 - DNA, 25 bp, Rattus norvegicus
atttccttctaagctcctatgtctg

SEQ ID NO: 213537 - DNA, 25 bp, Rattus norvegicus
atttccttctgccattctgatatgc

SEQ ID NO: 213538 - DNA, 25 bp, Rattus norvegicus
atttccttctgcgattctgatatgc

SEQ ID NO: 213539 - DNA, 25 bp, Rattus norvegicus
atttccttctttaaagtcagtcaca

SEQ ID NO: 213540 - DNA, 25 bp, Rattus norvegicus
atttccttctttactgtctctctta

SEQ ID NO: 213541 - DNA, 25 bp, Rattus norvegicus
atttccttctttagcttatctccta

SEQ ID NO: 213542 - DNA, 25 bp, Rattus norvegicus
atttccttcttttaagtcagtcaca

SEQ ID NO: 213543 - DNA, 25 bp, Rattus norvegicus
atttccttcttttctgtctctctta

SEQ ID NO: 213544 - DNA, 25 bp, Rattus norvegicus
atttccttcttttgcttatctccta

SEQ ID NO: 213545 - DNA, 25 bp, Rattus norvegicus
atttccttgaatattgccttccagt

SEQ ID NO: 213546 - DNA, 25 bp, Rattus norvegicus
atttccttgaattttgccttccagt

SEQ ID NO: 213547 - DNA, 25 bp, Rattus norvegicus
atttccttgatgcatgctctgctta

SEQ ID NO: 213548 - DNA, 25 bp, Rattus norvegicus
atttccttgatggatgctctgctta

SEQ ID NO: 213549 - DNA, 25 bp, Rattus norvegicus
atttccttgcagacacaacacgtgt

SEQ ID NO: 213550 - DNA, 25 bp, Rattus norvegicus
atttccttgcagtcacaacacgtgt

SEQ ID NO: 213551 - DNA, 25 bp, Rattus norvegicus
atttccttggacatcgtacctgaga

SEQ ID NO: 213552 - DNA, 25 bp, Rattus norvegicus
atttccttggacttcgtacctgaga

SEQ ID NO: 213553 - DNA, 25 bp, Rattus norvegicus
atttccttgtataagccttccctag

SEQ ID NO: 213554 - DNA, 25 bp, Rattus norvegicus
atttccttgtatccatttctgtttt

SEQ ID NO: 213555 - DNA, 25 bp, Rattus norvegicus
atttccttgtatgcatttctgtttt

SEQ ID NO: 213556 - DNA, 25 bp, Rattus norvegicus
atttccttgtattagccttccctag

SEQ ID NO: 213557 - DNA, 25 bp, Rattus norvegicus
atttccttgtggaactgagtgtccc

SEQ ID NO: 213558 - DNA, 25 bp, Rattus norvegicus
atttccttgtggtactgagtgtccc

SEQ ID NO: 213559 - DNA, 25 bp, Rattus norvegicus
atttccttgttcactgcttagtttt

SEQ ID NO: 213560 - DNA, 25 bp, Rattus norvegicus
atttccttgttctctgcttagtttt

SEQ ID NO: 213561 - DNA, 25 bp, Rattus norvegicus
atttcctttaatcttgttcttatag

SEQ ID NO: 213562 - DNA, 25 bp, Rattus norvegicus
atttcctttaatgttgttcttatag

SEQ ID NO: 213563 - DNA, 25 bp, Rattus norvegicus
atttcctttcatcagagggcttcct

SEQ ID NO: 213564 - DNA, 25 bp, Rattus norvegicus
atttcctttcatgagagggcttcct

SEQ ID NO: 213565 - DNA, 25 bp, Rattus norvegicus
atttcctttccacctgacttgagtt

SEQ ID NO: 213566 - DNA, 25 bp, Rattus norvegicus
atttcctttccagctgacttgagtt

SEQ ID NO: 213567 - DNA, 25 bp, Rattus norvegicus
atttcctttcctcattgcagcatgt

SEQ ID NO: 213568 - DNA, 25 bp, Rattus norvegicus
atttcctttcctgattgcagcatgt

SEQ ID NO: 213569 - DNA, 25 bp, Rattus norvegicus
atttcctttctaagttatgctttat

SEQ ID NO: 213570 - DNA, 25 bp, Rattus norvegicus
atttcctttctatgttatgctttat

SEQ ID NO: 213571 - DNA, 25 bp, Rattus norvegicus
atttcctttgcacacgccatgtaat

SEQ ID NO: 213572 - DNA, 25 bp, Rattus norvegicus
atttcctttgcagacgccatgtaat

SEQ ID NO: 213573 - DNA, 25 bp, Rattus norvegicus
atttcctttgtcatcacagcttgca

SEQ ID NO: 213574 - DNA, 25 bp, Rattus norvegicus
atttcctttgtcttcacagcttgca

SEQ ID NO: 213575 - DNA, 25 bp, Rattus norvegicus
atttcctttgtgactggtctcacct

SEQ ID NO: 213576 - DNA, 25 bp, Rattus norvegicus
atttcctttgtgtctggtctcacct

SEQ ID NO: 213577 - DNA, 25 bp, Rattus norvegicus
atttccttttccatgacataatgtg

SEQ ID NO: 213578 - DNA, 25 bp, Rattus norvegicus
atttccttttccttgacataatgtg

SEQ ID NO: 213579 - DNA, 25 bp, Rattus norvegicus
atttccttttctctcattgttctat

SEQ ID NO: 213580 - DNA, 25 bp, Rattus norvegicus
atttccttttctgtcattgttctat

SEQ ID NO: 213581 - DNA, 25 bp, Rattus norvegicus
atttccttttggacctactactgca

SEQ ID NO: 213582 - DNA, 25 bp, Rattus norvegicus
atttccttttggtcctactactgca

SEQ ID NO: 213583 - DNA, 25 bp, Rattus norvegicus
atttcctttttgattattagcatgt

SEQ ID NO: 213584 - DNA, 25 bp, Rattus norvegicus
atttcctttttgtttattagcatgt

SEQ ID NO: 213585 - DNA, 25 bp, Rattus norvegicus
atttcgaacaataccagtggcctac

SEQ ID NO: 213586 - DNA, 25 bp, Rattus norvegicus
atttcgaacaattccagtggcctac

SEQ ID NO: 213587 - DNA, 25 bp, Rattus norvegicus
atttcgaaccatagtcatgagcaga

SEQ ID NO: 213588 - DNA, 25 bp, Rattus norvegicus
atttcgaaccattgtcatgagcaga

SEQ ID NO: 213589 - DNA, 25 bp, Rattus norvegicus
atttcgaagaggactgggctccttc

SEQ ID NO: 213590 - DNA, 25 bp, Rattus norvegicus
atttcgaagaggtctgggctccttc

SEQ ID NO: 213591 - DNA, 25 bp, Rattus norvegicus
atttcgaccgcaacgcacagatggg

SEQ ID NO: 213592 - DNA, 25 bp, Rattus norvegicus
atttcgaccgcatcgcacagatggg

SEQ ID NO: 213593 - DNA, 25 bp, Rattus norvegicus
atttcgagagtgctgctgtgttata

SEQ ID NO: 213594 - DNA, 25 bp, Rattus norvegicus
atttcgagagtggtgctgtgttata

SEQ ID NO: 213595 - DNA, 25 bp, Rattus norvegicus
atttcgagctttactgcaacggcag

SEQ ID NO: 213596 - DNA, 25 bp, Rattus norvegicus
atttcgagcttttctgcaacggcag

SEQ ID NO: 213597 - DNA, 25 bp, Rattus norvegicus
atttcgaggtggagcttagccctgg

SEQ ID NO: 213598 - DNA, 25 bp, Rattus norvegicus
atttcgaggtggtgcttagccctgg

SEQ ID NO: 213599 - DNA, 25 bp, Rattus norvegicus
atttcgagttaaagcctggcatggt

SEQ ID NO: 213600 - DNA, 25 bp, Rattus norvegicus
atttcgagttaatgcctggcatggt

SEQ ID NO: 213601 - DNA, 25 bp, Rattus norvegicus
atttcgatggccatgtagttacaca

SEQ ID NO: 213602 - DNA, 25 bp, Rattus norvegicus
atttcgatggccttgtagttacaca

SEQ ID NO: 213603 - DNA, 25 bp, Rattus norvegicus
atttcgatgtaacggtgaacattca

SEQ ID NO: 213604 - DNA, 25 bp, Rattus norvegicus
atttcgatgtaagggtgaacattca

SEQ ID NO: 213605 - DNA, 25 bp, Rattus norvegicus
atttcgattcttcgagtttctgagc

SEQ ID NO: 213606 - DNA, 25 bp, Rattus norvegicus
atttcgattcttggagtttctgagc

SEQ ID NO: 213607 - DNA, 25 bp, Rattus norvegicus
atttcgcatgctcttaggagcctcg

SEQ ID NO: 213608 - DNA, 25 bp, Rattus norvegicus
atttcgcatgctgttaggagcctcg

SEQ ID NO: 213609 - DNA, 25 bp, Rattus norvegicus
atttcgcccttactgttactctaga

SEQ ID NO: 213610 - DNA, 25 bp, Rattus norvegicus
atttcgcccttagtgttactctaga

SEQ ID NO: 213611 - DNA, 25 bp, Rattus norvegicus
atttcgcgcacaccaaaactctttg

SEQ ID NO: 213612 - DNA, 25 bp, Rattus norvegicus
atttcgcgcacagcaaaactctttg

SEQ ID NO: 213613 - DNA, 25 bp, Rattus norvegicus
atttcgcttgcgcacagaggaatag

SEQ ID NO: 213614 - DNA, 25 bp, Rattus norvegicus
atttcgcttgcggacagaggaatag

SEQ ID NO: 213615 - DNA, 25 bp, Rattus norvegicus
atttcgctttccaaagatcctcatc

SEQ ID NO: 213616 - DNA, 25 bp, Rattus norvegicus
atttcgctttcctaagatcctcatc

SEQ ID NO: 213617 - DNA, 25 bp, Rattus norvegicus
atttcggatctgacactcatttgtt

SEQ ID NO: 213618 - DNA, 25 bp, Rattus norvegicus
atttcggatctgtcactcatttgtt

SEQ ID NO: 213619 - DNA, 25 bp, Rattus norvegicus
atttcgggacgacacatctgacagc

SEQ ID NO: 213620 - DNA, 25 bp, Rattus norvegicus
atttcgggacgagacatctgacagc

SEQ ID NO: 213621 - DNA, 25 bp, Rattus norvegicus
atttcgggctataatcatatctgga

SEQ ID NO: 213622 - DNA, 25 bp, Rattus norvegicus
atttcgggctattatcatatctgga

SEQ ID NO: 213623 - DNA, 25 bp, Rattus norvegicus
atttcggtaactaacttctctctgg

SEQ ID NO: 213624 - DNA, 25 bp, Rattus norvegicus
atttcggtaacttacttctctctgg

SEQ ID NO: 213625 - DNA, 25 bp, Rattus norvegicus
atttcgtactacaattatggctaaa

SEQ ID NO: 213626 - DNA, 25 bp, Rattus norvegicus
atttcgtactactattatggctaaa

SEQ ID NO: 213627 - DNA, 25 bp, Rattus norvegicus
atttcgtatattatttccagctcct

SEQ ID NO: 213628 - DNA, 25 bp, Rattus norvegicus
atttcgtatattttttccagctcct

SEQ ID NO: 213629 - DNA, 25 bp, Rattus norvegicus
atttcgtcagacacctcagatgcgc

SEQ ID NO: 213630 - DNA, 25 bp, Rattus norvegicus
atttcgtcagactcctcagatgcgc

SEQ ID NO: 213631 - DNA, 25 bp, Rattus norvegicus
atttcgtgaatactgagccgaatat

SEQ ID NO: 213632 - DNA, 25 bp, Rattus norvegicus
atttcgtgaatagtgagccgaatat

SEQ ID NO: 213633 - DNA, 25 bp, Rattus norvegicus
atttcgtgatcacagactccagctt

SEQ ID NO: 213634 - DNA, 25 bp, Rattus norvegicus
atttcgtgatcagagactccagctt

SEQ ID NO: 213635 - DNA, 25 bp, Rattus norvegicus
atttcgtgcctcaatttccccatct

SEQ ID NO: 213636 - DNA, 25 bp, Rattus norvegicus
atttcgtgcctctatttccccatct

SEQ ID NO: 213637 - DNA, 25 bp, Rattus norvegicus
atttcgtgtacgcatttcgttcggg

SEQ ID NO: 213638 - DNA, 25 bp, Rattus norvegicus
atttcgtgtacggatttcgttcggg

SEQ ID NO: 213639 - DNA, 25 bp, Rattus norvegicus
atttcgtgtgtcatctctgtcatac

SEQ ID NO: 213640 - DNA, 25 bp, Rattus norvegicus
atttcgtgtgtcttctctgtcatac

SEQ ID NO: 213641 - DNA, 25 bp, Rattus norvegicus
atttcgtgttcaatttttctggtgc

SEQ ID NO: 213642 - DNA, 25 bp, Rattus norvegicus
atttcgtgttcattttttctggtgc

SEQ ID NO: 213643 - DNA, 25 bp, Rattus norvegicus
atttcgttactacattatatcacaa

SEQ ID NO: 213644 - DNA, 25 bp, Rattus norvegicus
atttcgttactagattatatcacaa

SEQ ID NO: 213645 - DNA, 25 bp, Rattus norvegicus
atttcgttcgacaaggaatcctttg

SEQ ID NO: 213646 - DNA, 25 bp, Rattus norvegicus
atttcgttcgactaggaatcctttg

SEQ ID NO: 213647 - DNA, 25 bp, Rattus norvegicus
atttcgttcttgctacagctggact

SEQ ID NO: 213648 - DNA, 25 bp, Rattus norvegicus
atttcgttcttggtacagctggact

SEQ ID NO: 213649 - DNA, 25 bp, Rattus norvegicus
atttcgttgcggaggctcttaggaa

SEQ ID NO: 213650 - DNA, 25 bp, Rattus norvegicus
atttcgttgcggtggctcttaggaa

SEQ ID NO: 213651 - DNA, 25 bp, Rattus norvegicus
atttcgtttcacctatgctttccct

SEQ ID NO: 213652 - DNA, 25 bp, Rattus norvegicus
atttcgtttcacgtatgctttccct

SEQ ID NO: 213653 - DNA, 25 bp, Rattus norvegicus
atttctaaacttagccatactgagg

SEQ ID NO: 213654 - DNA, 25 bp, Rattus norvegicus
atttctaaactttgccatactgagg

SEQ ID NO: 213655 - DNA, 25 bp, Rattus norvegicus
atttctaaatctaccaacctgtcaa

SEQ ID NO: 213656 - DNA, 25 bp, Rattus norvegicus
atttctaaatcttccaacctgtcaa

SEQ ID NO: 213657 - DNA, 25 bp, Rattus norvegicus
atttctaaatgtatctagtgtttct

SEQ ID NO: 213658 - DNA, 25 bp, Rattus norvegicus
atttctaaatgtttctagtgtttct

SEQ ID NO: 213659 - DNA, 25 bp, Rattus norvegicus
atttctaacattcctcgtcctgtaa

SEQ ID NO: 213660 - DNA, 25 bp, Rattus norvegicus
atttctaacattgctcgtcctgtaa

SEQ ID NO: 213661 - DNA, 25 bp, Rattus norvegicus
atttctaagggcattcctggtctag

SEQ ID NO: 213662 - DNA, 25 bp, Rattus norvegicus
atttctaagggctttcctggtctag

SEQ ID NO: 213663 - DNA, 25 bp, Rattus norvegicus
atttctaatgtacctcttgtgacac

SEQ ID NO: 213664 - DNA, 25 bp, Rattus norvegicus
atttctaatgtagctcttgtgacac

SEQ ID NO: 213665 - DNA, 25 bp, Rattus norvegicus
atttctaatttaacttcatgtcata

SEQ ID NO: 213666 - DNA, 25 bp, Rattus norvegicus
atttctaatttatcttcatgtcata

SEQ ID NO: 213667 - DNA, 25 bp, Rattus norvegicus
atttctacacttcttgtccacaatg

SEQ ID NO: 213668 - DNA, 25 bp, Rattus norvegicus
atttctacacttgttgtccacaatg

SEQ ID NO: 213669 - DNA, 25 bp, Rattus norvegicus
atttctacatagacagccaaacagc

SEQ ID NO: 213670 - DNA, 25 bp, Rattus norvegicus
atttctacatagtcagccaaacagc

SEQ ID NO: 213671 - DNA, 25 bp, Rattus norvegicus
atttctaccaaaacttctctctgtg

SEQ ID NO: 213672 - DNA, 25 bp, Rattus norvegicus
atttctaccaaatcttctctctgtg

SEQ ID NO: 213673 - DNA, 25 bp, Rattus norvegicus
atttctacctgcatgctacacggag

SEQ ID NO: 213674 - DNA, 25 bp, Rattus norvegicus
atttctacctgcattgctcacagta

SEQ ID NO: 213675 - DNA, 25 bp, Rattus norvegicus
atttctacctgcttgctacacggag

SEQ ID NO: 213676 - DNA, 25 bp, Rattus norvegicus
atttctacctgctttgctcacagta

SEQ ID NO: 213677 - DNA, 25 bp, Rattus norvegicus
atttctactcctaaatctggtgacc

SEQ ID NO: 213678 - DNA, 25 bp, Rattus norvegicus
atttctactccttaatctggtgacc

SEQ ID NO: 213679 - DNA, 25 bp, Rattus norvegicus
atttctactgagacatgcccagcag

SEQ ID NO: 213680 - DNA, 25 bp, Rattus norvegicus
atttctactgagtcatgcccagcag

SEQ ID NO: 213681 - DNA, 25 bp, Rattus norvegicus
atttctactgccactttgtgggtac

SEQ ID NO: 213682 - DNA, 25 bp, Rattus norvegicus
atttctactgcctctttgtgggtac

SEQ ID NO: 213683 - DNA, 25 bp, Rattus norvegicus
atttctactgctaatgaccccttag

SEQ ID NO: 213684 - DNA, 25 bp, Rattus norvegicus
atttctactgcttatgaccccttag

SEQ ID NO: 213685 - DNA, 25 bp, Rattus norvegicus
atttctacttcacaccaactgggat

SEQ ID NO: 213686 - DNA, 25 bp, Rattus norvegicus
atttctacttcagaccaactgggat

SEQ ID NO: 213687 - DNA, 25 bp, Rattus norvegicus
atttctagaataaaccctggttgag

SEQ ID NO: 213688 - DNA, 25 bp, Rattus norvegicus
atttctagaatataccctggttgag

SEQ ID NO: 213689 - DNA, 25 bp, Rattus norvegicus
atttctagagctaggtgccgtcgcc

SEQ ID NO: 213690 - DNA, 25 bp, Rattus norvegicus
atttctagagcttggtgccgtcgcc

SEQ ID NO: 213691 - DNA, 25 bp, Rattus norvegicus
atttctagagttcggctgcggagca

SEQ ID NO: 213692 - DNA, 25 bp, Rattus norvegicus
atttctagagttgggctgcggagca

SEQ ID NO: 213693 - DNA, 25 bp, Rattus norvegicus
atttctagcatgacagtcacgtgct

SEQ ID NO: 213694 - DNA, 25 bp, Rattus norvegicus
atttctagcatgtcagtcacgtgct

SEQ ID NO: 213695 - DNA, 25 bp, Rattus norvegicus
atttctagcttgatttcccagatcc

SEQ ID NO: 213696 - DNA, 25 bp, Rattus norvegicus
atttctagcttgttttcccagatcc

SEQ ID NO: 213697 - DNA, 25 bp, Rattus norvegicus
atttctaggccactgagagctatgc

SEQ ID NO: 213698 - DNA, 25 bp, Rattus norvegicus
atttctaggccagtgagagctatgc

SEQ ID NO: 213699 - DNA, 25 bp, Rattus norvegicus
atttctagtcttcctcagctgctga

SEQ ID NO: 213700 - DNA, 25 bp, Rattus norvegicus
atttctagtcttgctcagctgctga

SEQ ID NO: 213701 - DNA, 25 bp, Rattus norvegicus
atttctagttctagctgttacttga

SEQ ID NO: 213702 - DNA, 25 bp, Rattus norvegicus
atttctagttcttgctgttacttga

SEQ ID NO: 213703 - DNA, 25 bp, Rattus norvegicus
atttctatatttcctgtcactttca

SEQ ID NO: 213704 - DNA, 25 bp, Rattus norvegicus
atttctatatttgctgtcactttca

SEQ ID NO: 213705 - DNA, 25 bp, Rattus norvegicus
atttctatcaaaatagtgctatggt

SEQ ID NO: 213706 - DNA, 25 bp, Rattus norvegicus
atttctatcaaattagtgctatggt

SEQ ID NO: 213707 - DNA, 25 bp, Rattus norvegicus
atttctatcagtatatctccatgag

SEQ ID NO: 213708 - DNA, 25 bp, Rattus norvegicus
atttctatcagtttatctccatgag

SEQ ID NO: 213709 - DNA, 25 bp, Rattus norvegicus
atttctatcatgcattccggtgtca

SEQ ID NO: 213710 - DNA, 25 bp, Rattus norvegicus
atttctatcatggattccggtgtca

SEQ ID NO: 213711 - DNA, 25 bp, Rattus norvegicus
atttctatcattacccatcttacgt

SEQ ID NO: 213712 - DNA, 25 bp, Rattus norvegicus
atttctatcatttcccatcttacgt

SEQ ID NO: 213713 - DNA, 25 bp, Rattus norvegicus
atttctatccagcaccttgaagtct

SEQ ID NO: 213714 - DNA, 25 bp, Rattus norvegicus
atttctatccaggaccttgaagtct

SEQ ID NO: 213715 - DNA, 25 bp, Rattus norvegicus
atttctatccatatttctcatccaa

SEQ ID NO: 213716 - DNA, 25 bp, Rattus norvegicus
atttctatccatttttctcatccaa

SEQ ID NO: 213717 - DNA, 25 bp, Rattus norvegicus
atttctatccccattggttctgtgc

SEQ ID NO: 213718 - DNA, 25 bp, Rattus norvegicus
atttctatcccctttggttctgtgc

SEQ ID NO: 213719 - DNA, 25 bp, Rattus norvegicus
atttctatccttattctcttcattt

SEQ ID NO: 213720 - DNA, 25 bp, Rattus norvegicus
atttctatcctttttctcttcattt

SEQ ID NO: 213721 - DNA, 25 bp, Rattus norvegicus
atttctatctctaccctgttagcaa

SEQ ID NO: 213722 - DNA, 25 bp, Rattus norvegicus
atttctatctcttccctgttagcaa

SEQ ID NO: 213723 - DNA, 25 bp, Rattus norvegicus
atttctatctgcatgtcagcacctg

SEQ ID NO: 213724 - DNA, 25 bp, Rattus norvegicus
atttctatctgcttgtcagcacctg

SEQ ID NO: 213725 - DNA, 25 bp, Rattus norvegicus
atttctatctgtacgaacttccaaa

SEQ ID NO: 213726 - DNA, 25 bp, Rattus norvegicus
atttctatctgttcgaacttccaaa

SEQ ID NO: 213727 - DNA, 25 bp, Rattus norvegicus
atttctatgaaaacgcgcttcttga

SEQ ID NO: 213728 - DNA, 25 bp, Rattus norvegicus
atttctatgaaatcgcgcttcttga

SEQ ID NO: 213729 - DNA, 25 bp, Rattus norvegicus
atttctatgactactaagtgaccag

SEQ ID NO: 213730 - DNA, 25 bp, Rattus norvegicus
atttctatgacttctaagtgaccag

SEQ ID NO: 213731 - DNA, 25 bp, Rattus norvegicus
atttctatgcacagttccctgtcat

SEQ ID NO: 213732 - DNA, 25 bp, Rattus norvegicus
atttctatgcactgttccctgtcat

SEQ ID NO: 213733 - DNA, 25 bp, Rattus norvegicus
atttctattcaccttgtatacttta

SEQ ID NO: 213734 - DNA, 25 bp, Rattus norvegicus
atttctattcacgttgtatacttta

SEQ ID NO: 213735 - DNA, 25 bp, Rattus norvegicus
atttctattcagaaggcacttgcta

SEQ ID NO: 213736 - DNA, 25 bp, Rattus norvegicus
atttctattcagtaggcacttgcta

SEQ ID NO: 213737 - DNA, 25 bp, Rattus norvegicus
atttctcaccagatgatggctttga

SEQ ID NO: 213738 - DNA, 25 bp, Rattus norvegicus
atttctcaccagttgatggctttga

SEQ ID NO: 213739 - DNA, 25 bp, Rattus norvegicus
atttctcacctaaagacttaagctg

SEQ ID NO: 213740 - DNA, 25 bp, Rattus norvegicus
atttctcacctatagacttaagctg

SEQ ID NO: 213741 - DNA, 25 bp, Rattus norvegicus
atttctcacgtccattggtttctca

SEQ ID NO: 213742 - DNA, 25 bp, Rattus norvegicus
atttctcacgtcgattggtttctca

SEQ ID NO: 213743 - DNA, 25 bp, Rattus norvegicus
atttctcactatcctttaatccctc

SEQ ID NO: 213744 - DNA, 25 bp, Rattus norvegicus
atttctcactatgctttaatccctc

SEQ ID NO: 213745 - DNA, 25 bp, Rattus norvegicus
atttctcactgtaaccaacaccaag

SEQ ID NO: 213746 - DNA, 25 bp, Rattus norvegicus
atttctcactgttaccaacaccaag

SEQ ID NO: 213747 - DNA, 25 bp, Rattus norvegicus
atttctcactttatgtgctatttaa

SEQ ID NO: 213748 - DNA, 25 bp, Rattus norvegicus
atttctcactttttgtgctatttaa

SEQ ID NO: 213749 - DNA, 25 bp, Rattus norvegicus
atttctcagacaccatttctttatg

SEQ ID NO: 213750 - DNA, 25 bp, Rattus norvegicus
atttctcagacagcatttctttatg

SEQ ID NO: 213751 - DNA, 25 bp, Rattus norvegicus
atttctcagattctgttctgccagg

SEQ ID NO: 213752 - DNA, 25 bp, Rattus norvegicus
atttctcagattgtgttctgccagg

SEQ ID NO: 213753 - DNA, 25 bp, Rattus norvegicus
atttctcagtcgcattgtgacgtgg

SEQ ID NO: 213754 - DNA, 25 bp, Rattus norvegicus
atttctcagtcggattgtgacgtgg

SEQ ID NO: 213755 - DNA, 25 bp, Rattus norvegicus
atttctcagtgactatgtctgtact

SEQ ID NO: 213756 - DNA, 25 bp, Rattus norvegicus
atttctcagtgagtatgtctgtact

SEQ ID NO: 213757 - DNA, 25 bp, Rattus norvegicus
atttctcataccagtgcttgtacta

SEQ ID NO: 213758 - DNA, 25 bp, Rattus norvegicus
atttctcatacctgtgcttgtacta

SEQ ID NO: 213759 - DNA, 25 bp, Rattus norvegicus
atttctcatgcacttcatcatccac

SEQ ID NO: 213760 - DNA, 25 bp, Rattus norvegicus
atttctcatgcagttcatcatccac

SEQ ID NO: 213761 - DNA, 25 bp, Rattus norvegicus
atttctccaatcattccctgagata

SEQ ID NO: 213762 - DNA, 25 bp, Rattus norvegicus
atttctccaatctttccctgagata

SEQ ID NO: 213763 - DNA, 25 bp, Rattus norvegicus
atttctccagccagtgaatgagggt

SEQ ID NO: 213764 - DNA, 25 bp, Rattus norvegicus
atttctccagcctgtgaatgagggt

SEQ ID NO: 213765 - DNA, 25 bp, Rattus norvegicus
atttctccagctcaaattttggtca

SEQ ID NO: 213766 - DNA, 25 bp, Rattus norvegicus
atttctccagctgaaattttggtca

SEQ ID NO: 213767 - DNA, 25 bp, Rattus norvegicus
atttctccaggaagacctcagaggg

SEQ ID NO: 213768 - DNA, 25 bp, Rattus norvegicus
atttctccaggacgacgactcagtg

SEQ ID NO: 213769 - DNA, 25 bp, Rattus norvegicus
atttctccaggaggacgactcagtg

SEQ ID NO: 213770 - DNA, 25 bp, Rattus norvegicus
atttctccaggatgacctcagaggg

SEQ ID NO: 213771 - DNA, 25 bp, Rattus norvegicus
atttctccatatactacataccctg

SEQ ID NO: 213772 - DNA, 25 bp, Rattus norvegicus
atttctccatattctacataccctg

SEQ ID NO: 213773 - DNA, 25 bp, Rattus norvegicus
atttctcccactctgaaaagccgtt

SEQ ID NO: 213774 - DNA, 25 bp, Rattus norvegicus
atttctcccactgtgaaaagccgtt

SEQ ID NO: 213775 - DNA, 25 bp, Rattus norvegicus
atttctcccagcagaggtagacgta

SEQ ID NO: 213776 - DNA, 25 bp, Rattus norvegicus
atttctcccagctgaggtagacgta

SEQ ID NO: 213777 - DNA, 25 bp, Rattus norvegicus
atttctccccggaaggccacaagca

SEQ ID NO: 213778 - DNA, 25 bp, Rattus norvegicus
atttctccccggtaggccacaagca

SEQ ID NO: 213779 - DNA, 25 bp, Rattus norvegicus
atttctcccgtacgctgtgtatata

SEQ ID NO: 213780 - DNA, 25 bp, Rattus norvegicus
atttctcccgtaggctgtgtatata

SEQ ID NO: 213781 - DNA, 25 bp, Rattus norvegicus
atttctccctacctgtttgtgttga

SEQ ID NO: 213782 - DNA, 25 bp, Rattus norvegicus
atttctccctacgtgtttgtgttga

SEQ ID NO: 213783 - DNA, 25 bp, Rattus norvegicus
atttctccctccaggtggagcaacc

SEQ ID NO: 213784 - DNA, 25 bp, Rattus norvegicus
atttctccctcctggtggagcaacc

SEQ ID NO: 213785 - DNA, 25 bp, Rattus norvegicus
atttctcccttcatttctaccattt

SEQ ID NO: 213786 - DNA, 25 bp, Rattus norvegicus
atttctcccttcttttctaccattt

SEQ ID NO: 213787 - DNA, 25 bp, Rattus norvegicus
atttctccggaaatcttgaagggca

SEQ ID NO: 213788 - DNA, 25 bp, Rattus norvegicus
atttctccggaattcttgaagggca

SEQ ID NO: 213789 - DNA, 25 bp, Rattus norvegicus
atttctcctaacaagattctcttca

SEQ ID NO: 213790 - DNA, 25 bp, Rattus norvegicus
atttctcctaactagattctcttca

SEQ ID NO: 213791 - DNA, 25 bp, Rattus norvegicus
atttctcctcaacagtttcagtctc

SEQ ID NO: 213792 - DNA, 25 bp, Rattus norvegicus
atttctcctcaagagtttcagtctc

SEQ ID NO: 213793 - DNA, 25 bp, Rattus norvegicus
atttctcctcccaaagatggagcca

SEQ ID NO: 213794 - DNA, 25 bp, Rattus norvegicus
atttctcctccctaagatggagcca

SEQ ID NO: 213795 - DNA, 25 bp, Rattus norvegicus
atttctcctgctatcatgtactttt

SEQ ID NO: 213796 - DNA, 25 bp, Rattus norvegicus
atttctcctgctttcatgtactttt

SEQ ID NO: 213797 - DNA, 25 bp, Rattus norvegicus
atttctcctggtcttcagagtctgt

SEQ ID NO: 213798 - DNA, 25 bp, Rattus norvegicus
atttctcctggtgttcagagtctgt

SEQ ID NO: 213799 - DNA, 25 bp, Rattus norvegicus
atttctcctgttcccatgatttatt

SEQ ID NO: 213800 - DNA, 25 bp, Rattus norvegicus
atttctcctgttgccatgatttatt

SEQ ID NO: 213801 - DNA, 25 bp, Rattus norvegicus
atttctccttagcacaggtggttgc

SEQ ID NO: 213802 - DNA, 25 bp, Rattus norvegicus
atttctccttaggacaggtggttgc

SEQ ID NO: 213803 - DNA, 25 bp, Rattus norvegicus
atttctccttcgactagcattcggt

SEQ ID NO: 213804 - DNA, 25 bp, Rattus norvegicus
atttctccttcgtctagcattcggt

SEQ ID NO: 213805 - DNA, 25 bp, Rattus norvegicus
atttctccttgaagcatggtgcatg

SEQ ID NO: 213806 - DNA, 25 bp, Rattus norvegicus
atttctccttgatgcatggtgcatg

SEQ ID NO: 213807 - DNA, 25 bp, Rattus norvegicus
atttctcgggagcattgcaaggcga

SEQ ID NO: 213808 - DNA, 25 bp, Rattus norvegicus
atttctcgggaggattgcaaggcga

SEQ ID NO: 213809 - DNA, 25 bp, Rattus norvegicus
atttctcgggatacctaggcagcaa

SEQ ID NO: 213810 - DNA, 25 bp, Rattus norvegicus
atttctcgggattcctaggcagcaa

SEQ ID NO: 213811 - DNA, 25 bp, Rattus norvegicus
atttctcgtgcaatgtgggtttcct

SEQ ID NO: 213812 - DNA, 25 bp, Rattus norvegicus
atttctcgtgcattgtgggtttcct

SEQ ID NO: 213813 - DNA, 25 bp, Rattus norvegicus
atttctctaactatgtttccagctg

SEQ ID NO: 213814 - DNA, 25 bp, Rattus norvegicus
atttctctaactttgtttccagctg

SEQ ID NO: 213815 - DNA, 25 bp, Rattus norvegicus
atttctctacagctgtgtcatgtac

SEQ ID NO: 213816 - DNA, 25 bp, Rattus norvegicus
atttctctacaggtgtgtcatgtac

SEQ ID NO: 213817 - DNA, 25 bp, Rattus norvegicus
atttctctagctcctaaagcccttt

SEQ ID NO: 213818 - DNA, 25 bp, Rattus norvegicus
atttctctagctgctaaagcccttt

SEQ ID NO: 213819 - DNA, 25 bp, Rattus norvegicus
atttctctaggcatcactcttgttt

SEQ ID NO: 213820 - DNA, 25 bp, Rattus norvegicus
atttctctaggcttcactcttgttt

SEQ ID NO: 213821 - DNA, 25 bp, Rattus norvegicus
atttctctcacgaaggaccagcttt

SEQ ID NO: 213822 - DNA, 25 bp, Rattus norvegicus
atttctctcacgtaggaccagcttt

SEQ ID NO: 213823 - DNA, 25 bp, Rattus norvegicus
atttctctcaggaatcaagcagatc

SEQ ID NO: 213824 - DNA, 25 bp, Rattus norvegicus
atttctctcaggtatcaagcagatc

SEQ ID NO: 213825 - DNA, 25 bp, Rattus norvegicus
atttctctccctatgctgctttaaa

SEQ ID NO: 213826 - DNA, 25 bp, Rattus norvegicus
atttctctccctttgctgctttaaa

SEQ ID NO: 213827 - DNA, 25 bp, Rattus norvegicus
atttctctcctgcagtgcggcgaat

SEQ ID NO: 213828 - DNA, 25 bp, Rattus norvegicus
atttctctcctggagtgcggcgaat

SEQ ID NO: 213829 - DNA, 25 bp, Rattus norvegicus
atttctctcgaccttggctgaggct

SEQ ID NO: 213830 - DNA, 25 bp, Rattus norvegicus
atttctctcgacgttggctgaggct

SEQ ID NO: 213831 - DNA, 25 bp, Rattus norvegicus
atttctctctgactcctttcttcct

SEQ ID NO: 213832 - DNA, 25 bp, Rattus norvegicus
atttctctctgagtcctttcttcct

SEQ ID NO: 213833 - DNA, 25 bp, Rattus norvegicus
atttctctctgtagtatttaagacc

SEQ ID NO: 213834 - DNA, 25 bp, Rattus norvegicus
atttctctctgttgtatttaagacc

SEQ ID NO: 213835 - DNA, 25 bp, Rattus norvegicus
atttctctcttcctttcaactggag

SEQ ID NO: 213836 - DNA, 25 bp, Rattus norvegicus
atttctctcttcgtttcaactggag

SEQ ID NO: 213837 - DNA, 25 bp, Rattus norvegicus
atttctctcttgatcatgaccttaa

SEQ ID NO: 213838 - DNA, 25 bp, Rattus norvegicus
atttctctcttgttcatgaccttaa

SEQ ID NO: 213839 - DNA, 25 bp, Rattus norvegicus
atttctctgatgctcctttgtattt

SEQ ID NO: 213840 - DNA, 25 bp, Rattus norvegicus
atttctctgatggtcctttgtattt

SEQ ID NO: 213841 - DNA, 25 bp, Rattus norvegicus
atttctctgcaaagaactctctgga

SEQ ID NO: 213842 - DNA, 25 bp, Rattus norvegicus
atttctctgcaatgaactctctgga

SEQ ID NO: 213843 - DNA, 25 bp, Rattus norvegicus
atttctctggatactgacccaggct

SEQ ID NO: 213844 - DNA, 25 bp, Rattus norvegicus
atttctctggattctgacccaggct

SEQ ID NO: 213845 - DNA, 25 bp, Rattus norvegicus
atttctctgtacattctttacgcac

SEQ ID NO: 213846 - DNA, 25 bp, Rattus norvegicus
atttctctgtactttctttacgcac

SEQ ID NO: 213847 - DNA, 25 bp, Rattus norvegicus
atttctctgtgactggttgggccca

SEQ ID NO: 213848 - DNA, 25 bp, Rattus norvegicus
atttctctgtgagtggttgggccca

SEQ ID NO: 213849 - DNA, 25 bp, Rattus norvegicus
atttctctgtgtcgcagttgtacca

SEQ ID NO: 213850 - DNA, 25 bp, Rattus norvegicus
atttctctgtgtggcagttgtacca

SEQ ID NO: 213851 - DNA, 25 bp, Rattus norvegicus
atttctctgttaccacgtcaattac

SEQ ID NO: 213852 - DNA, 25 bp, Rattus norvegicus
atttctctgttagcacgtcaattac

SEQ ID NO: 213853 - DNA, 25 bp, Rattus norvegicus
atttctctgttcaagggttagcctc

SEQ ID NO: 213854 - DNA, 25 bp, Rattus norvegicus
atttctctgttctagggttagcctc

SEQ ID NO: 213855 - DNA, 25 bp, Rattus norvegicus
atttctctgtttatgcaatgtgctc

SEQ ID NO: 213856 - DNA, 25 bp, Rattus norvegicus
atttctctgtttttgcaatgtgctc

SEQ ID NO: 213857 - DNA, 25 bp, Rattus norvegicus
atttctcttccccttagaaacactg

SEQ ID NO: 213858 - DNA, 25 bp, Rattus norvegicus
atttctcttccccttgcaatggaag

SEQ ID NO: 213859 - DNA, 25 bp, Rattus norvegicus
atttctcttcccgttagaaacactg

SEQ ID NO: 213860 - DNA, 25 bp, Rattus norvegicus
atttctcttcccgttgcaatggaag

SEQ ID NO: 213861 - DNA, 25 bp, Rattus norvegicus
atttctcttcttaaacttcctgcat

SEQ ID NO: 213862 - DNA, 25 bp, Rattus norvegicus
atttctcttctttaacttcctgcat

SEQ ID NO: 213863 - DNA, 25 bp, Rattus norvegicus
atttctcttttcaggcatcattttg

SEQ ID NO: 213864 - DNA, 25 bp, Rattus norvegicus
atttctcttttctggcatcattttg

SEQ ID NO: 213865 - DNA, 25 bp, Rattus norvegicus
atttctgaaccaactgtagtggcta

SEQ ID NO: 213866 - DNA, 25 bp, Rattus norvegicus
atttctgaaccatctgtagtggcta

SEQ ID NO: 213867 - DNA, 25 bp, Rattus norvegicus
atttctgaacttcaggacagcctgg

SEQ ID NO: 213868 - DNA, 25 bp, Rattus norvegicus
atttctgaacttgaggacagcctgg

SEQ ID NO: 213869 - DNA, 25 bp, Rattus norvegicus
atttctgaagatcccgggtgttctc

SEQ ID NO: 213870 - DNA, 25 bp, Rattus norvegicus
atttctgaagatgccgggtgttctc

SEQ ID NO: 213871 - DNA, 25 bp, Rattus norvegicus
atttctgaagggactgagcctctcc

SEQ ID NO: 213872 - DNA, 25 bp, Rattus norvegicus
atttctgaagggtctgagcctctcc

SEQ ID NO: 213873 - DNA, 25 bp, Rattus norvegicus
atttctgaaggtcatgttcaatggt

SEQ ID NO: 213874 - DNA, 25 bp, Rattus norvegicus
atttctgaaggtgatgttcaatggt

SEQ ID NO: 213875 - DNA, 25 bp, Rattus norvegicus
atttctgaagtcaaaccaccttcct

SEQ ID NO: 213876 - DNA, 25 bp, Rattus norvegicus
atttctgaagtctaaccaccttcct

SEQ ID NO: 213877 - DNA, 25 bp, Rattus norvegicus
atttctgacccaatagcagtcttta

SEQ ID NO: 213878 - DNA, 25 bp, Rattus norvegicus
atttctgacccattagcagtcttta

SEQ ID NO: 213879 - DNA, 25 bp, Rattus norvegicus
atttctgaggctaggttctggcagc

SEQ ID NO: 213880 - DNA, 25 bp, Rattus norvegicus
atttctgaggcttggttctggcagc

SEQ ID NO: 213881 - DNA, 25 bp, Rattus norvegicus
atttctgagtaactccttgtctgcc

SEQ ID NO: 213882 - DNA, 25 bp, Rattus norvegicus
atttctgagtaagtccttgtctgcc

SEQ ID NO: 213883 - DNA, 25 bp, Rattus norvegicus
atttctgagtcacgcctggtggtgc

SEQ ID NO: 213884 - DNA, 25 bp, Rattus norvegicus
atttctgagtcaggcctggtggtgc

SEQ ID NO: 213885 - DNA, 25 bp, Rattus norvegicus
atttctgatcctagctctgtattcg

SEQ ID NO: 213886 - DNA, 25 bp, Rattus norvegicus
atttctgatccttgctctgtattcg

SEQ ID NO: 213887 - DNA, 25 bp, Rattus norvegicus
atttctgatgcacggcctttttata

SEQ ID NO: 213888 - DNA, 25 bp, Rattus norvegicus
atttctgatgcagggcctttttata

SEQ ID NO: 213889 - DNA, 25 bp, Rattus norvegicus
atttctgatgctatttactgttgtg

SEQ ID NO: 213890 - DNA, 25 bp, Rattus norvegicus
atttctgatgctttttactgttgtg

SEQ ID NO: 213891 - DNA, 25 bp, Rattus norvegicus
atttctgatgggacttaggcttctc

SEQ ID NO: 213892 - DNA, 25 bp, Rattus norvegicus
atttctgatgggtcttaggcttctc

SEQ ID NO: 213893 - DNA, 25 bp, Rattus norvegicus
atttctgcaaccatcttttcactga

SEQ ID NO: 213894 - DNA, 25 bp, Rattus norvegicus
atttctgcaaccttcttttcactga

SEQ ID NO: 213895 - DNA, 25 bp, Rattus norvegicus
atttctgcaagtactgaacctgtga

SEQ ID NO: 213896 - DNA, 25 bp, Rattus norvegicus
atttctgcaagttctgaacctgtga

SEQ ID NO: 213897 - DNA, 25 bp, Rattus norvegicus
atttctgcacatcatcaagagttta

SEQ ID NO: 213898 - DNA, 25 bp, Rattus norvegicus
atttctgcacatgatcaagagttta

SEQ ID NO: 213899 - DNA, 25 bp, Rattus norvegicus
atttctgcagcaccggcaagaatgc

SEQ ID NO: 213900 - DNA, 25 bp, Rattus norvegicus
atttctgcagcagcggcaagaatgc

SEQ ID NO: 213901 - DNA, 25 bp, Rattus norvegicus
atttctgcagctctaattccaggga

SEQ ID NO: 213902 - DNA, 25 bp, Rattus norvegicus
atttctgcagctgtaattccaggga

SEQ ID NO: 213903 - DNA, 25 bp, Rattus norvegicus
atttctgcattccagtcttaaccat

SEQ ID NO: 213904 - DNA, 25 bp, Rattus norvegicus
atttctgcattccatctagtttcct

SEQ ID NO: 213905 - DNA, 25 bp, Rattus norvegicus
atttctgcattcgagtcttaaccat

SEQ ID NO: 213906 - DNA, 25 bp, Rattus norvegicus
atttctgcattcgatctagtttcct

SEQ ID NO: 213907 - DNA, 25 bp, Rattus norvegicus
atttctgccatcacggaggtgtata

SEQ ID NO: 213908 - DNA, 25 bp, Rattus norvegicus
atttctgccatctcggaggtgtata

SEQ ID NO: 213909 - DNA, 25 bp, Rattus norvegicus
atttctgcccacagtgtcgagcaaa

SEQ ID NO: 213910 - DNA, 25 bp, Rattus norvegicus
atttctgcccactgtgtcgagcaaa

SEQ ID NO: 213911 - DNA, 25 bp, Rattus norvegicus
atttctgcctttaacgtgccatcat

SEQ ID NO: 213912 - DNA, 25 bp, Rattus norvegicus
atttctgccttttacgtgccatcat

SEQ ID NO: 213913 - DNA, 25 bp, Rattus norvegicus
atttctgcgaaaactcccaatctat

SEQ ID NO: 213914 - DNA, 25 bp, Rattus norvegicus
atttctgcgaaatctcccaatctat

SEQ ID NO: 213915 - DNA, 25 bp, Rattus norvegicus
atttctgcggcacctgtttgtccca

SEQ ID NO: 213916 - DNA, 25 bp, Rattus norvegicus
atttctgcggcagctgtttgtccca

SEQ ID NO: 213917 - DNA, 25 bp, Rattus norvegicus
atttctgctgctattgatgttgcaa

SEQ ID NO: 213918 - DNA, 25 bp, Rattus norvegicus
atttctgctgcttttgatgttgcaa

SEQ ID NO: 213919 - DNA, 25 bp, Rattus norvegicus
atttctgcttggagatttccatcca

SEQ ID NO: 213920 - DNA, 25 bp, Rattus norvegicus
atttctgcttggtgatttccatcca

SEQ ID NO: 213921 - DNA, 25 bp, Rattus norvegicus
atttctggagacaaagtcgatggca

SEQ ID NO: 213922 - DNA, 25 bp, Rattus norvegicus
atttctggagactaagtcgatggca

SEQ ID NO: 213923 - DNA, 25 bp, Rattus norvegicus
atttctggatgtctcatttgcttca

SEQ ID NO: 213924 - DNA, 25 bp, Rattus norvegicus
atttctggatgtgtcatttgcttca

SEQ ID NO: 213925 - DNA, 25 bp, Rattus norvegicus
atttctggcactaggcagctaacaa

SEQ ID NO: 213926 - DNA, 25 bp, Rattus norvegicus
atttctggcacttggcagctaacaa

SEQ ID NO: 213927 - DNA, 25 bp, Rattus norvegicus
atttctggctccatgatgctgcttt

SEQ ID NO: 213928 - DNA, 25 bp, Rattus norvegicus
atttctggctccttgatgctgcttt

SEQ ID NO: 213929 - DNA, 25 bp, Rattus norvegicus
atttctgggctactgagagggttca

SEQ ID NO: 213930 - DNA, 25 bp, Rattus norvegicus
atttctgggctagtgagagggttca

SEQ ID NO: 213931 - DNA, 25 bp, Rattus norvegicus
atttctgggcttcggatgttcaggt

SEQ ID NO: 213932 - DNA, 25 bp, Rattus norvegicus
atttctgggcttgggatgttcaggt

SEQ ID NO: 213933 - DNA, 25 bp, Rattus norvegicus
atttctgggttgctcattggatctg

SEQ ID NO: 213934 - DNA, 25 bp, Rattus norvegicus
atttctgggttggtcattggatctg

SEQ ID NO: 213935 - DNA, 25 bp, Rattus norvegicus
atttctggtctgaattttgcctaaa

SEQ ID NO: 213936 - DNA, 25 bp, Rattus norvegicus
atttctggtctgtattttgcctaaa

SEQ ID NO: 213937 - DNA, 25 bp, Rattus norvegicus
atttctgtaaacagggcagctagcc

SEQ ID NO: 213938 - DNA, 25 bp, Rattus norvegicus
atttctgtaaacatggagtcctctg

SEQ ID NO: 213939 - DNA, 25 bp, Rattus norvegicus
atttctgtaaactgggcagctagcc

SEQ ID NO: 213940 - DNA, 25 bp, Rattus norvegicus
atttctgtaaacttggagtcctctg

SEQ ID NO: 213941 - DNA, 25 bp, Rattus norvegicus
atttctgtaagacctggagtgccca

SEQ ID NO: 213942 - DNA, 25 bp, Rattus norvegicus
atttctgtaagagctggagtgccca

SEQ ID NO: 213943 - DNA, 25 bp, Rattus norvegicus
atttctgtacctatgtgtcttcctg

SEQ ID NO: 213944 - DNA, 25 bp, Rattus norvegicus
atttctgtacctttgtgtcttcctg

SEQ ID NO: 213945 - DNA, 25 bp, Rattus norvegicus
atttctgtagacattcatctggcaa

SEQ ID NO: 213946 - DNA, 25 bp, Rattus norvegicus
atttctgtagactttcatctggcaa

SEQ ID NO: 213947 - DNA, 25 bp, Rattus norvegicus
atttctgtagctattcctccagact

SEQ ID NO: 213948 - DNA, 25 bp, Rattus norvegicus
atttctgtagcttttcctccagact

SEQ ID NO: 213949 - DNA, 25 bp, Rattus norvegicus
atttctgtattgagtcttttcctcc

SEQ ID NO: 213950 - DNA, 25 bp, Rattus norvegicus
atttctgtattgatgcacccgaagg

SEQ ID NO: 213951 - DNA, 25 bp, Rattus norvegicus
atttctgtattgtgtcttttcctcc

SEQ ID NO: 213952 - DNA, 25 bp, Rattus norvegicus
atttctgtattgttgcacccgaagg

SEQ ID NO: 213953 - DNA, 25 bp, Rattus norvegicus
atttctgtccaaatgtgcccatcat

SEQ ID NO: 213954 - DNA, 25 bp, Rattus norvegicus
atttctgtccaattgtgcccatcat

SEQ ID NO: 213955 - DNA, 25 bp, Rattus norvegicus
atttctgtccctcgcaccctgatgg

SEQ ID NO: 213956 - DNA, 25 bp, Rattus norvegicus
atttctgtccctcttagctactaag

SEQ ID NO: 213957 - DNA, 25 bp, Rattus norvegicus
atttctgtccctggcaccctgatgg

SEQ ID NO: 213958 - DNA, 25 bp, Rattus norvegicus
atttctgtccctgttagctactaag

SEQ ID NO: 213959 - DNA, 25 bp, Rattus norvegicus
atttctgtcctgaaattttggcttc

SEQ ID NO: 213960 - DNA, 25 bp, Rattus norvegicus
atttctgtcctgatcggagtgatcg

SEQ ID NO: 213961 - DNA, 25 bp, Rattus norvegicus
atttctgtcctgtaattttggcttc

SEQ ID NO: 213962 - DNA, 25 bp, Rattus norvegicus
atttctgtcctgttcggagtgatcg

SEQ ID NO: 213963 - DNA, 25 bp, Rattus norvegicus
atttctgtcggtctcagtactgctg

SEQ ID NO: 213964 - DNA, 25 bp, Rattus norvegicus
atttctgtcggtgtcagtactgctg

SEQ ID NO: 213965 - DNA, 25 bp, Rattus norvegicus
atttctgtctatatagaccctgtgt

SEQ ID NO: 213966 - DNA, 25 bp, Rattus norvegicus
atttctgtctatttagaccctgtgt

SEQ ID NO: 213967 - DNA, 25 bp, Rattus norvegicus
atttctgtgggacctcagagtcctc

SEQ ID NO: 213968 - DNA, 25 bp, Rattus norvegicus
atttctgtgggagctcagagtcctc

SEQ ID NO: 213969 - DNA, 25 bp, Rattus norvegicus
atttctgtgtaaacttgtgctcaac

SEQ ID NO: 213970 - DNA, 25 bp, Rattus norvegicus
atttctgtgtaatcttgtgctcaac

SEQ ID NO: 213971 - DNA, 25 bp, Rattus norvegicus
atttctgtgtgaatcttggcgcctc

SEQ ID NO: 213972 - DNA, 25 bp, Rattus norvegicus
atttctgtgtgattcttggcgcctc

SEQ ID NO: 213973 - DNA, 25 bp, Rattus norvegicus
atttctgtgtgtatatcgttttatg

SEQ ID NO: 213974 - DNA, 25 bp, Rattus norvegicus
atttctgtgtgtttatcgttttatg

SEQ ID NO: 213975 - DNA, 25 bp, Rattus norvegicus
atttctgtgttcagatgccgcagta

SEQ ID NO: 213976 - DNA, 25 bp, Rattus norvegicus
atttctgtgttctgatgccgcagta

SEQ ID NO: 213977 - DNA, 25 bp, Rattus norvegicus
atttctgttcttacaggagttcctg

SEQ ID NO: 213978 - DNA, 25 bp, Rattus norvegicus
atttctgttctttcaggagttcctg

SEQ ID NO: 213979 - DNA, 25 bp, Rattus norvegicus
atttctgtttacagctcttggtttt

SEQ ID NO: 213980 - DNA, 25 bp, Rattus norvegicus
atttctgtttaccacttctgttcaa

SEQ ID NO: 213981 - DNA, 25 bp, Rattus norvegicus
atttctgtttacgacttctgttcaa

SEQ ID NO: 213982 - DNA, 25 bp, Rattus norvegicus
atttctgtttactgctcttggtttt

SEQ ID NO: 213983 - DNA, 25 bp, Rattus norvegicus
atttctgtttgaattgccccagtgc

SEQ ID NO: 213984 - DNA, 25 bp, Rattus norvegicus
atttctgtttgatttgccccagtgc

SEQ ID NO: 213985 - DNA, 25 bp, Rattus norvegicus
atttcttaaatgctcctatgtcagt

SEQ ID NO: 213986 - DNA, 25 bp, Rattus norvegicus
atttcttaaatggtcctatgtcagt

SEQ ID NO: 213987 - DNA, 25 bp, Rattus norvegicus
atttcttaactcactccaggtcata

SEQ ID NO: 213988 - DNA, 25 bp, Rattus norvegicus
atttcttaactctctccaggtcata

SEQ ID NO: 213989 - DNA, 25 bp, Rattus norvegicus
atttcttacactactagggctgtta

SEQ ID NO: 213990 - DNA, 25 bp, Rattus norvegicus
atttcttacacttctagggctgtta

SEQ ID NO: 213991 - DNA, 25 bp, Rattus norvegicus
atttcttactgtcccgagaagccgc

SEQ ID NO: 213992 - DNA, 25 bp, Rattus norvegicus
atttcttactgtgccgagaagccgc

SEQ ID NO: 213993 - DNA, 25 bp, Rattus norvegicus
atttcttactttagtgctgataggc

SEQ ID NO: 213994 - DNA, 25 bp, Rattus norvegicus
atttcttacttttgtgctgataggc

SEQ ID NO: 213995 - DNA, 25 bp, Rattus norvegicus
atttcttaggtaccacccacgtgta

SEQ ID NO: 213996 - DNA, 25 bp, Rattus norvegicus
atttcttaggtagcacccacgtgta

SEQ ID NO: 213997 - DNA, 25 bp, Rattus norvegicus
atttcttaggtgagcacacccttga

SEQ ID NO: 213998 - DNA, 25 bp, Rattus norvegicus
atttcttaggtgtgcacacccttga

SEQ ID NO: 213999 - DNA, 25 bp, Rattus norvegicus
atttcttagtccatttgggcctcct

SEQ ID NO: 214000 - DNA, 25 bp, Rattus norvegicus
atttcttagtccttttgggcctcct

SEQ ID NO: 214001 - DNA, 25 bp, Rattus norvegicus
atttcttatctgagcctcattttac

SEQ ID NO: 214002 - DNA, 25 bp, Rattus norvegicus
atttcttatctgtgcctcattttac

SEQ ID NO: 214003 - DNA, 25 bp, Rattus norvegicus
atttcttatggcctgttttctccgg

SEQ ID NO: 214004 - DNA, 25 bp, Rattus norvegicus
atttcttatggcgtgttttctccgg

SEQ ID NO: 214005 - DNA, 25 bp, Rattus norvegicus
atttcttatgtgatcttccaagtaa

SEQ ID NO: 214006 - DNA, 25 bp, Rattus norvegicus
atttcttatgtgttcttccaagtaa

SEQ ID NO: 214007 - DNA, 25 bp, Rattus norvegicus
atttcttattttctcttattgtcag

SEQ ID NO: 214008 - DNA, 25 bp, Rattus norvegicus
atttcttattttgtcttattgtcag

SEQ ID NO: 214009 - DNA, 25 bp, Rattus norvegicus
atttcttcaagactggtgtgctaaa

SEQ ID NO: 214010 - DNA, 25 bp, Rattus norvegicus
atttcttcaagagtggtgtgctaaa

SEQ ID NO: 214011 - DNA, 25 bp, Rattus norvegicus
atttcttcactgatgtacctgtgga

SEQ ID NO: 214012 - DNA, 25 bp, Rattus norvegicus
atttcttcactgcagtaccaaaagg

SEQ ID NO: 214013 - DNA, 25 bp, Rattus norvegicus
atttcttcactggagtaccaaaagg

SEQ ID NO: 214014 - DNA, 25 bp, Rattus norvegicus
atttcttcactgttgtacctgtgga

SEQ ID NO: 214015 - DNA, 25 bp, Rattus norvegicus
atttcttcacttattgggtcctatg

SEQ ID NO: 214016 - DNA, 25 bp, Rattus norvegicus
atttcttcactttttgggtcctatg

SEQ ID NO: 214017 - DNA, 25 bp, Rattus norvegicus
atttcttcatccattgttctataca

SEQ ID NO: 214018 - DNA, 25 bp, Rattus norvegicus
atttcttcatcctttgttctataca

SEQ ID NO: 214019 - DNA, 25 bp, Rattus norvegicus
atttcttcatcgacattttccttcc

SEQ ID NO: 214020 - DNA, 25 bp, Rattus norvegicus
atttcttcatcgtcattttccttcc

SEQ ID NO: 214021 - DNA, 25 bp, Rattus norvegicus
atttcttcatggaaccaagcggttt

SEQ ID NO: 214022 - DNA, 25 bp, Rattus norvegicus
atttcttcatggtaccaagcggttt

SEQ ID NO: 214023 - DNA, 25 bp, Rattus norvegicus
atttcttccagcactaagttggccg

SEQ ID NO: 214024 - DNA, 25 bp, Rattus norvegicus
atttcttccagctctaagttggccg

SEQ ID NO: 214025 - DNA, 25 bp, Rattus norvegicus
atttcttccatcaactatcagttga

SEQ ID NO: 214026 - DNA, 25 bp, Rattus norvegicus
atttcttccatctactatcagttga

SEQ ID NO: 214027 - DNA, 25 bp, Rattus norvegicus
atttcttcccagctagttaccagtg

SEQ ID NO: 214028 - DNA, 25 bp, Rattus norvegicus
atttcttcccaggtagttaccagtg

SEQ ID NO: 214029 - DNA, 25 bp, Rattus norvegicus
atttcttccccgaggatatctctgt

SEQ ID NO: 214030 - DNA, 25 bp, Rattus norvegicus
atttcttccccgtggatatctctgt

SEQ ID NO: 214031 - DNA, 25 bp, Rattus norvegicus
atttcttcctcacaaggtggccaag

SEQ ID NO: 214032 - DNA, 25 bp, Rattus norvegicus
atttcttcctcagaaggtggccaag

SEQ ID NO: 214033 - DNA, 25 bp, Rattus norvegicus
atttcttcggatatggattttcaca

SEQ ID NO: 214034 - DNA, 25 bp, Rattus norvegicus
atttcttcggatttggattttcaca

SEQ ID NO: 214035 - DNA, 25 bp, Rattus norvegicus
atttcttctaacaaccagcagtgac

SEQ ID NO: 214036 - DNA, 25 bp, Rattus norvegicus
atttcttctaactaccagcagtgac

SEQ ID NO: 214037 - DNA, 25 bp, Rattus norvegicus
atttcttctcacatcgaaccttggg

SEQ ID NO: 214038 - DNA, 25 bp, Rattus norvegicus
atttcttctcacttcgaaccttggg

SEQ ID NO: 214039 - DNA, 25 bp, Rattus norvegicus
atttcttctcatattgtggcctcag

SEQ ID NO: 214040 - DNA, 25 bp, Rattus norvegicus
atttcttctcattttgtggcctcag

SEQ ID NO: 214041 - DNA, 25 bp, Rattus norvegicus
atttcttctccgctttcagccctga

SEQ ID NO: 214042 - DNA, 25 bp, Rattus norvegicus
atttcttctccggtttcagccctga

SEQ ID NO: 214043 - DNA, 25 bp, Rattus norvegicus
atttcttctcgtcctcctttaattg

SEQ ID NO: 214044 - DNA, 25 bp, Rattus norvegicus
atttcttctcgtgctcctttaattg

SEQ ID NO: 214045 - DNA, 25 bp, Rattus norvegicus
atttcttctgaaagtgagcctgcag

SEQ ID NO: 214046 - DNA, 25 bp, Rattus norvegicus
atttcttctgaatgtgagcctgcag

SEQ ID NO: 214047 - DNA, 25 bp, Rattus norvegicus
atttcttctgccaattgttttctaa

SEQ ID NO: 214048 - DNA, 25 bp, Rattus norvegicus
atttcttctgcctattgttttctaa

SEQ ID NO: 214049 - DNA, 25 bp, Rattus norvegicus
atttcttctgctataggcttggtat

SEQ ID NO: 214050 - DNA, 25 bp, Rattus norvegicus
atttcttctgctttaggcttggtat

SEQ ID NO: 214051 - DNA, 25 bp, Rattus norvegicus
atttcttcttgtattgttggccctg

SEQ ID NO: 214052 - DNA, 25 bp, Rattus norvegicus
atttcttcttgttttgttggccctg

SEQ ID NO: 214053 - DNA, 25 bp, Rattus norvegicus
atttcttgctgactcttattagggt

SEQ ID NO: 214054 - DNA, 25 bp, Rattus norvegicus
atttcttgctgagtcttattagggt

SEQ ID NO: 214055 - DNA, 25 bp, Rattus norvegicus
atttcttgcttaaatcatcacaggc

SEQ ID NO: 214056 - DNA, 25 bp, Rattus norvegicus
atttcttgcttatatcatcacaggc

SEQ ID NO: 214057 - DNA, 25 bp, Rattus norvegicus
atttcttggagaagtcatccctgaa

SEQ ID NO: 214058 - DNA, 25 bp, Rattus norvegicus
atttcttggagatgtcatccctgaa

SEQ ID NO: 214059 - DNA, 25 bp, Rattus norvegicus
atttcttggcatactggtcttccgg

SEQ ID NO: 214060 - DNA, 25 bp, Rattus norvegicus
atttcttggcattctggtcttccgg

SEQ ID NO: 214061 - DNA, 25 bp, Rattus norvegicus
atttcttggtctattgctgcttaaa

SEQ ID NO: 214062 - DNA, 25 bp, Rattus norvegicus
atttcttggtcttttgctgcttaaa

SEQ ID NO: 214063 - DNA, 25 bp, Rattus norvegicus
atttcttgtcatatagtggctctac

SEQ ID NO: 214064 - DNA, 25 bp, Rattus norvegicus
atttcttgtcatttagtggctctac

SEQ ID NO: 214065 - DNA, 25 bp, Rattus norvegicus
atttctttaattctcttggaccctg

SEQ ID NO: 214066 - DNA, 25 bp, Rattus norvegicus
atttctttaattgtcttggaccctg

SEQ ID NO: 214067 - DNA, 25 bp, Rattus norvegicus
atttctttacagcacatgataggag

SEQ ID NO: 214068 - DNA, 25 bp, Rattus norvegicus
atttctttacaggacatgataggag

SEQ ID NO: 214069 - DNA, 25 bp, Rattus norvegicus
atttctttacatctcaggttactca

SEQ ID NO: 214070 - DNA, 25 bp, Rattus norvegicus
atttctttacatgtcaggttactca

SEQ ID NO: 214071 - DNA, 25 bp, Rattus norvegicus
atttctttagtcctagcacctggga

SEQ ID NO: 214072 - DNA, 25 bp, Rattus norvegicus
atttctttagtcgtagcacctggga

SEQ ID NO: 214073 - DNA, 25 bp, Rattus norvegicus
atttctttcaggacaaggctgggca

SEQ ID NO: 214074 - DNA, 25 bp, Rattus norvegicus
atttctttcaggtcaaggctgggca

SEQ ID NO: 214075 - DNA, 25 bp, Rattus norvegicus
atttctttgcctctagtcagcagtg

SEQ ID NO: 214076 - DNA, 25 bp, Rattus norvegicus
atttctttgcctgtagtcagcagtg

SEQ ID NO: 214077 - DNA, 25 bp, Rattus norvegicus
atttctttgggtatgttttcagagt

SEQ ID NO: 214078 - DNA, 25 bp, Rattus norvegicus
atttctttgggtttgttttcagagt

SEQ ID NO: 214079 - DNA, 25 bp, Rattus norvegicus
atttcttttatgaagcactgggagt

SEQ ID NO: 214080 - DNA, 25 bp, Rattus norvegicus
atttcttttatgtagcactgggagt

SEQ ID NO: 214081 - DNA, 25 bp, Rattus norvegicus
atttcttttctcctgctaatcttct

SEQ ID NO: 214082 - DNA, 25 bp, Rattus norvegicus
atttcttttctcgtgctaatcttct

SEQ ID NO: 214083 - DNA, 25 bp, Rattus norvegicus
atttcttttcttagctaattcttga

SEQ ID NO: 214084 - DNA, 25 bp, Rattus norvegicus
atttcttttctttgctaattcttga

SEQ ID NO: 214085 - DNA, 25 bp, Rattus norvegicus
atttcttttggcagtatgtgtccta

SEQ ID NO: 214086 - DNA, 25 bp, Rattus norvegicus
atttcttttggctgtatgtgtccta

SEQ ID NO: 214087 - DNA, 25 bp, Rattus norvegicus
atttcttttgttattgtcagggtct

SEQ ID NO: 214088 - DNA, 25 bp, Rattus norvegicus
atttcttttgtttttgtcagggtct

SEQ ID NO: 214089 - DNA, 25 bp, Rattus norvegicus
atttctttttcactgacttgtccga

SEQ ID NO: 214090 - DNA, 25 bp, Rattus norvegicus
atttctttttcagtgacttgtccga

SEQ ID NO: 214091 - DNA, 25 bp, Rattus norvegicus
atttgaaaccttcgtcagttcaggg

SEQ ID NO: 214092 - DNA, 25 bp, Rattus norvegicus
atttgaaaccttggtcagttcaggg

SEQ ID NO: 214093 - DNA, 25 bp, Rattus norvegicus
atttgaaagcctacagatggagggc

SEQ ID NO: 214094 - DNA, 25 bp, Rattus norvegicus
atttgaaagccttcagatggagggc

SEQ ID NO: 214095 - DNA, 25 bp, Rattus norvegicus
atttgaacaatgatggacccactag

SEQ ID NO: 214096 - DNA, 25 bp, Rattus norvegicus
atttgaacaatgttggacccactag

SEQ ID NO: 214097 - DNA, 25 bp, Rattus norvegicus
atttgaacagacagcacacggaccc

SEQ ID NO: 214098 - DNA, 25 bp, Rattus norvegicus
atttgaacagactgcacacggaccc

SEQ ID NO: 214099 - DNA, 25 bp, Rattus norvegicus
atttgaacagtgagccatggccatg

SEQ ID NO: 214100 - DNA, 25 bp, Rattus norvegicus
atttgaacagtgtgccatggccatg

SEQ ID NO: 214101 - DNA, 25 bp, Rattus norvegicus
atttgaacatagacaggacaggcct

SEQ ID NO: 214102 - DNA, 25 bp, Rattus norvegicus
atttgaacatagtcaggacaggcct

SEQ ID NO: 214103 - DNA, 25 bp, Rattus norvegicus
atttgaacatggactccttagcccc

SEQ ID NO: 214104 - DNA, 25 bp, Rattus norvegicus
atttgaacatggtctccttagcccc

SEQ ID NO: 214105 - DNA, 25 bp, Rattus norvegicus
atttgaaccatgctgctgttgtacc

SEQ ID NO: 214106 - DNA, 25 bp, Rattus norvegicus
atttgaaccatggtgctgttgtacc

SEQ ID NO: 214107 - DNA, 25 bp, Rattus norvegicus
atttgaactagtctggcctcgtatc

SEQ ID NO: 214108 - DNA, 25 bp, Rattus norvegicus
atttgaactagtgtggcctcgtatc

SEQ ID NO: 214109 - DNA, 25 bp, Rattus norvegicus
atttgaactgctctatttctccttg

SEQ ID NO: 214110 - DNA, 25 bp, Rattus norvegicus
atttgaactgctgtatttctccttg

SEQ ID NO: 214111 - DNA, 25 bp, Rattus norvegicus
atttgaagatgtcttccctccacga

SEQ ID NO: 214112 - DNA, 25 bp, Rattus norvegicus
atttgaagatgtgttccctccacga

SEQ ID NO: 214113 - DNA, 25 bp, Rattus norvegicus
atttgaagctataccacgggcactg

SEQ ID NO: 214114 - DNA, 25 bp, Rattus norvegicus
atttgaagctattccacgggcactg

SEQ ID NO: 214115 - DNA, 25 bp, Rattus norvegicus
atttgaagtagacctttcccacgtg

SEQ ID NO: 214116 - DNA, 25 bp, Rattus norvegicus
atttgaagtagagctttcccacgtg

SEQ ID NO: 214117 - DNA, 25 bp, Rattus norvegicus
atttgaagtcacaccctcagagagg

SEQ ID NO: 214118 - DNA, 25 bp, Rattus norvegicus
atttgaagtcactccctcagagagg

SEQ ID NO: 214119 - DNA, 25 bp, Rattus norvegicus
atttgaataccactgcatccgagtg

SEQ ID NO: 214120 - DNA, 25 bp, Rattus norvegicus
atttgaataccagtgcatccgagtg

SEQ ID NO: 214121 - DNA, 25 bp, Rattus norvegicus
atttgaatagggaggctcagttggt

SEQ ID NO: 214122 - DNA, 25 bp, Rattus norvegicus
atttgaatagggtggctcagttggt

SEQ ID NO: 214123 - DNA, 25 bp, Rattus norvegicus
atttgaatcctacacattacagtta

SEQ ID NO: 214124 - DNA, 25 bp, Rattus norvegicus
atttgaatcctagacattacagtta

SEQ ID NO: 214125 - DNA, 25 bp, Rattus norvegicus
atttgaatcctcaccattgccagag

SEQ ID NO: 214126 - DNA, 25 bp, Rattus norvegicus
atttgaatcctctccattgccagag

SEQ ID NO: 214127 - DNA, 25 bp, Rattus norvegicus
atttgaatcttcatccatttcctcc

SEQ ID NO: 214128 - DNA, 25 bp, Rattus norvegicus
atttgaatcttcttccatttcctcc

SEQ ID NO: 214129 - DNA, 25 bp, Rattus norvegicus
atttgaatgactagtggcgggccgc

SEQ ID NO: 214130 - DNA, 25 bp, Rattus norvegicus
atttgaatgacttgtggcgggccgc

SEQ ID NO: 214131 - DNA, 25 bp, Rattus norvegicus
atttgaatgcccctgtaacaccctg

SEQ ID NO: 214132 - DNA, 25 bp, Rattus norvegicus
atttgaatgcccgtgtaacaccctg

SEQ ID NO: 214133 - DNA, 25 bp, Rattus norvegicus
atttgaatgtacaacctcccataag

SEQ ID NO: 214134 - DNA, 25 bp, Rattus norvegicus
atttgaatgtactacctcccataag

SEQ ID NO: 214135 - DNA, 25 bp, Rattus norvegicus
atttgaatgtgtctctctttttggg

SEQ ID NO: 214136 - DNA, 25 bp, Rattus norvegicus
atttgaatgtgtgtctctttttggg

SEQ ID NO: 214137 - DNA, 25 bp, Rattus norvegicus
atttgaattcatccagcgcgccctt

SEQ ID NO: 214138 - DNA, 25 bp, Rattus norvegicus
atttgaattcatccctagatcccac

SEQ ID NO: 214139 - DNA, 25 bp, Rattus norvegicus
atttgaattcatgcagcgcgccctt

SEQ ID NO: 214140 - DNA, 25 bp, Rattus norvegicus
atttgaattcatgcctagatcccac

SEQ ID NO: 214141 - DNA, 25 bp, Rattus norvegicus
atttgacaacgtagctgccaagcag

SEQ ID NO: 214142 - DNA, 25 bp, Rattus norvegicus
atttgacaacgttgctgccaagcag

SEQ ID NO: 214143 - DNA, 25 bp, Rattus norvegicus
atttgacaatgaaaggtgcttccag

SEQ ID NO: 214144 - DNA, 25 bp, Rattus norvegicus
atttgacaatgataggtgcttccag

SEQ ID NO: 214145 - DNA, 25 bp, Rattus norvegicus
atttgacagactattccactctctt

SEQ ID NO: 214146 - DNA, 25 bp, Rattus norvegicus
atttgacagacttttccactctctt

SEQ ID NO: 214147 - DNA, 25 bp, Rattus norvegicus
atttgaccatttcctggctaggcca

SEQ ID NO: 214148 - DNA, 25 bp, Rattus norvegicus
atttgaccatttgctggctaggcca

SEQ ID NO: 214149 - DNA, 25 bp, Rattus norvegicus
atttgacccaggcaaccttcacatc

SEQ ID NO: 214150 - DNA, 25 bp, Rattus norvegicus
atttgacccagggaaccttcacatc

SEQ ID NO: 214151 - DNA, 25 bp, Rattus norvegicus
atttgacccctgagccagtgatgga

SEQ ID NO: 214152 - DNA, 25 bp, Rattus norvegicus
atttgacccctgtgccagtgatgga

SEQ ID NO: 214153 - DNA, 25 bp, Rattus norvegicus
atttgacctctgagtgcctcaactt

SEQ ID NO: 214154 - DNA, 25 bp, Rattus norvegicus
atttgacctctgtgtgcctcaactt

SEQ ID NO: 214155 - DNA, 25 bp, Rattus norvegicus
atttgacgacaaagacccaccagga

SEQ ID NO: 214156 - DNA, 25 bp, Rattus norvegicus
atttgacgacaatgacccaccagga

SEQ ID NO: 214157 - DNA, 25 bp, Rattus norvegicus
atttgacggcacagaggttctgaag

SEQ ID NO: 214158 - DNA, 25 bp, Rattus norvegicus
atttgacggcactgaggttctgaag

SEQ ID NO: 214159 - DNA, 25 bp, Rattus norvegicus
atttgacggtgcactagttgttcct

SEQ ID NO: 214160 - DNA, 25 bp, Rattus norvegicus
atttgacggtgctctagttgttcct

SEQ ID NO: 214161 - DNA, 25 bp, Rattus norvegicus
atttgacgttgcaaccatgggtggg

SEQ ID NO: 214162 - DNA, 25 bp, Rattus norvegicus
atttgacgttgctaccatgggtggg

SEQ ID NO: 214163 - DNA, 25 bp, Rattus norvegicus
atttgactaatgattgtactgtaca

SEQ ID NO: 214164 - DNA, 25 bp, Rattus norvegicus
atttgactaatgtttgtactgtaca

SEQ ID NO: 214165 - DNA, 25 bp, Rattus norvegicus
atttgactccccagggaaacctgat

SEQ ID NO: 214166 - DNA, 25 bp, Rattus norvegicus
atttgactcccctgggaaacctgat

SEQ ID NO: 214167 - DNA, 25 bp, Rattus norvegicus
atttgactgaccaactgagccaggt

SEQ ID NO: 214168 - DNA, 25 bp, Rattus norvegicus
atttgactgacctactgagccaggt

SEQ ID NO: 214169 - DNA, 25 bp, Rattus norvegicus
atttgactgcaaaacttcttcctcc

SEQ ID NO: 214170 - DNA, 25 bp, Rattus norvegicus
atttgactgcaatacttcttcctcc

SEQ ID NO: 214171 - DNA, 25 bp, Rattus norvegicus
atttgactgtgccactgggagaccg

SEQ ID NO: 214172 - DNA, 25 bp, Rattus norvegicus
atttgactgtgcgactgggagaccg

SEQ ID NO: 214173 - DNA, 25 bp, Rattus norvegicus
atttgacttctgaaatgtcggcgat

SEQ ID NO: 214174 - DNA, 25 bp, Rattus norvegicus
atttgacttctgtaatgtcggcgat

SEQ ID NO: 214175 - DNA, 25 bp, Rattus norvegicus
atttgactttaacactgccacccag

SEQ ID NO: 214176 - DNA, 25 bp, Rattus norvegicus
atttgactttaagactgccacccag

SEQ ID NO: 214177 - DNA, 25 bp, Rattus norvegicus
atttgactttgtcaatctccgcctg

SEQ ID NO: 214178 - DNA, 25 bp, Rattus norvegicus
atttgactttgtgaatctccgcctg

SEQ ID NO: 214179 - DNA, 25 bp, Rattus norvegicus
atttgagaaagcactcaccttcctc

SEQ ID NO: 214180 - DNA, 25 bp, Rattus norvegicus
atttgagaaagctctcaccttcctc

SEQ ID NO: 214181 - DNA, 25 bp, Rattus norvegicus
atttgagaaatcactggcaccatca

SEQ ID NO: 214182 - DNA, 25 bp, Rattus norvegicus
atttgagaaatctctggcaccatca

SEQ ID NO: 214183 - DNA, 25 bp, Rattus norvegicus
atttgagaaccaagcctgctccatg

SEQ ID NO: 214184 - DNA, 25 bp, Rattus norvegicus
atttgagaaccatgcctgctccatg

SEQ ID NO: 214185 - DNA, 25 bp, Rattus norvegicus
atttgagaagtgctgttggcctctt

SEQ ID NO: 214186 - DNA, 25 bp, Rattus norvegicus
atttgagaagtggtgttggcctctt

SEQ ID NO: 214187 - DNA, 25 bp, Rattus norvegicus
atttgagcaagccatagccctccag

SEQ ID NO: 214188 - DNA, 25 bp, Rattus norvegicus
atttgagcaagcgatagccctccag

SEQ ID NO: 214189 - DNA, 25 bp, Rattus norvegicus
atttgagcacttatcagttccacgg

SEQ ID NO: 214190 - DNA, 25 bp, Rattus norvegicus
atttgagcacttttcagttccacgg

SEQ ID NO: 214191 - DNA, 25 bp, Rattus norvegicus
atttgagcagtaaccaccgttccat

SEQ ID NO: 214192 - DNA, 25 bp, Rattus norvegicus
atttgagcagtatccaccgttccat

SEQ ID NO: 214193 - DNA, 25 bp, Rattus norvegicus
atttgagcattgagactttaccatc

SEQ ID NO: 214194 - DNA, 25 bp, Rattus norvegicus
atttgagcattgtgactttaccatc

SEQ ID NO: 214195 - DNA, 25 bp, Rattus norvegicus
atttgagccacgacagatgcccaag

SEQ ID NO: 214196 - DNA, 25 bp, Rattus norvegicus
atttgagccacgtcagatgcccaag

SEQ ID NO: 214197 - DNA, 25 bp, Rattus norvegicus
atttgagcctcactgcaatgttagt

SEQ ID NO: 214198 - DNA, 25 bp, Rattus norvegicus
atttgagcctcagtgcaatgttagt

SEQ ID NO: 214199 - DNA, 25 bp, Rattus norvegicus
atttgagccttgctgtacgtggaaa

SEQ ID NO: 214200 - DNA, 25 bp, Rattus norvegicus
atttgagccttggtgtacgtggaaa

SEQ ID NO: 214201 - DNA, 25 bp, Rattus norvegicus
atttgagcggctctatcacgcgtac

SEQ ID NO: 214202 - DNA, 25 bp, Rattus norvegicus
atttgagcggctgtatcacgcgtac

SEQ ID NO: 214203 - DNA, 25 bp, Rattus norvegicus
atttgagctcttattctcgcagcaa

SEQ ID NO: 214204 - DNA, 25 bp, Rattus norvegicus
atttgagctctttttctcgcagcaa

SEQ ID NO: 214205 - DNA, 25 bp, Rattus norvegicus
atttgagctgagaaattgctccaga

SEQ ID NO: 214206 - DNA, 25 bp, Rattus norvegicus
atttgagctgagtaattgctccaga

SEQ ID NO: 214207 - DNA, 25 bp, Rattus norvegicus
atttgagctgtgcagtcacgggtct

SEQ ID NO: 214208 - DNA, 25 bp, Rattus norvegicus
atttgagctgtggagtcacgggtct

SEQ ID NO: 214209 - DNA, 25 bp, Rattus norvegicus
atttgagcttgcacatatctcctga

SEQ ID NO: 214210 - DNA, 25 bp, Rattus norvegicus
atttgagcttgctcatatctcctga

SEQ ID NO: 214211 - DNA, 25 bp, Rattus norvegicus
atttgaggccatccctcaaccagcc

SEQ ID NO: 214212 - DNA, 25 bp, Rattus norvegicus
atttgaggccatgcctcaaccagcc

SEQ ID NO: 214213 - DNA, 25 bp, Rattus norvegicus
atttgaggccttctatgcagcggag

SEQ ID NO: 214214 - DNA, 25 bp, Rattus norvegicus
atttgaggccttgtatgcagcggag

SEQ ID NO: 214215 - DNA, 25 bp, Rattus norvegicus
atttgaggcgtaccgacatctggca

SEQ ID NO: 214216 - DNA, 25 bp, Rattus norvegicus
atttgaggcgtagcgacatctggca

SEQ ID NO: 214217 - DNA, 25 bp, Rattus norvegicus
atttgaggctcaagctattggttgt

SEQ ID NO: 214218 - DNA, 25 bp, Rattus norvegicus
atttgaggctcatgctattggttgt

SEQ ID NO: 214219 - DNA, 25 bp, Rattus norvegicus
atttgaggctttctcatctctgcag

SEQ ID NO: 214220 - DNA, 25 bp, Rattus norvegicus
atttgaggctttgtcatctctgcag

SEQ ID NO: 214221 - DNA, 25 bp, Rattus norvegicus
atttgagggattactctttcagcct

SEQ ID NO: 214222 - DNA, 25 bp, Rattus norvegicus
atttgagggatttctctttcagcct

SEQ ID NO: 214223 - DNA, 25 bp, Rattus norvegicus
atttgagggcagctagggttacaca

SEQ ID NO: 214224 - DNA, 25 bp, Rattus norvegicus
atttgagggcaggtagggttacaca

SEQ ID NO: 214225 - DNA, 25 bp, Rattus norvegicus
atttgaggttctccatctcccggtt

SEQ ID NO: 214226 - DNA, 25 bp, Rattus norvegicus
atttgaggttctgcatctcccggtt

SEQ ID NO: 214227 - DNA, 25 bp, Rattus norvegicus
atttgaggttgaccttcgcttggcg

SEQ ID NO: 214228 - DNA, 25 bp, Rattus norvegicus
atttgaggttgagcttcgcttggcg

SEQ ID NO: 214229 - DNA, 25 bp, Rattus norvegicus
atttgagtagctctgtcttgtttta

SEQ ID NO: 214230 - DNA, 25 bp, Rattus norvegicus
atttgagtagctgtgtcttgtttta

SEQ ID NO: 214231 - DNA, 25 bp, Rattus norvegicus
atttgagtcaacatgcctagctgta

SEQ ID NO: 214232 - DNA, 25 bp, Rattus norvegicus
atttgagtcaacttgcctagctgta

SEQ ID NO: 214233 - DNA, 25 bp, Rattus norvegicus
atttgagtcagtcatagcctagctt

SEQ ID NO: 214234 - DNA, 25 bp, Rattus norvegicus
atttgagtcagtgatagcctagctt

SEQ ID NO: 214235 - DNA, 25 bp, Rattus norvegicus
atttgagtctcacttacattttaag

SEQ ID NO: 214236 - DNA, 25 bp, Rattus norvegicus
atttgagtctcagttacattttaag

SEQ ID NO: 214237 - DNA, 25 bp, Rattus norvegicus
atttgagttcagaatcttccttgcc

SEQ ID NO: 214238 - DNA, 25 bp, Rattus norvegicus
atttgagttcagtatcttccttgcc

SEQ ID NO: 214239 - DNA, 25 bp, Rattus norvegicus
atttgataccaaagtcaccgcagcc

SEQ ID NO: 214240 - DNA, 25 bp, Rattus norvegicus
atttgataccaatgtcaccgcagcc

SEQ ID NO: 214241 - DNA, 25 bp, Rattus norvegicus
atttgatacccgaaatgtcattaga

SEQ ID NO: 214242 - DNA, 25 bp, Rattus norvegicus
atttgatacccgtaatgtcattaga

SEQ ID NO: 214243 - DNA, 25 bp, Rattus norvegicus
atttgatagccaagccagccagctc

SEQ ID NO: 214244 - DNA, 25 bp, Rattus norvegicus
atttgatagccatgccagccagctc

SEQ ID NO: 214245 - DNA, 25 bp, Rattus norvegicus
atttgatagcttctttgggctccag

SEQ ID NO: 214246 - DNA, 25 bp, Rattus norvegicus
atttgatagcttgtttgggctccag

SEQ ID NO: 214247 - DNA, 25 bp, Rattus norvegicus
atttgatatcacagtgggcctgcct

SEQ ID NO: 214248 - DNA, 25 bp, Rattus norvegicus
atttgatatcactgtgggcctgcct

SEQ ID NO: 214249 - DNA, 25 bp, Rattus norvegicus
atttgatcagtcatttgtgccctag

SEQ ID NO: 214250 - DNA, 25 bp, Rattus norvegicus
atttgatcagtcttttgtgccctag

SEQ ID NO: 214251 - DNA, 25 bp, Rattus norvegicus
atttgatccctcactgttaatcgtc

SEQ ID NO: 214252 - DNA, 25 bp, Rattus norvegicus
atttgatccctctctgttaatcgtc

SEQ ID NO: 214253 - DNA, 25 bp, Rattus norvegicus
atttgatcctggacacctgcatgat

SEQ ID NO: 214254 - DNA, 25 bp, Rattus norvegicus
atttgatcctggtcacctgcatgat

SEQ ID NO: 214255 - DNA, 25 bp, Rattus norvegicus
atttgatcgtccacctacaatttgt

SEQ ID NO: 214256 - DNA, 25 bp, Rattus norvegicus
atttgatcgtcctcctacaatttgt

SEQ ID NO: 214257 - DNA, 25 bp, Rattus norvegicus
atttgatctaaaaacattcgtgttg

SEQ ID NO: 214258 - DNA, 25 bp, Rattus norvegicus
atttgatctaaatacattcgtgttg

SEQ ID NO: 214259 - DNA, 25 bp, Rattus norvegicus
atttgatgacctaagctcagcctga

SEQ ID NO: 214260 - DNA, 25 bp, Rattus norvegicus
atttgatgaccttagctcagcctga

SEQ ID NO: 214261 - DNA, 25 bp, Rattus norvegicus
atttgatgcaacaactgacttcagg

SEQ ID NO: 214262 - DNA, 25 bp, Rattus norvegicus
atttgatgcaactactgacttcagg

SEQ ID NO: 214263 - DNA, 25 bp, Rattus norvegicus
atttgatgcctactattgctccgga

SEQ ID NO: 214264 - DNA, 25 bp, Rattus norvegicus
atttgatgcctagtattgctccgga

SEQ ID NO: 214265 - DNA, 25 bp, Rattus norvegicus
atttgatggaccaggagattcccca

SEQ ID NO: 214266 - DNA, 25 bp, Rattus norvegicus
atttgatggacctggagattcccca

SEQ ID NO: 214267 - DNA, 25 bp, Rattus norvegicus
atttgatggagaaggcccagccctc

SEQ ID NO: 214268 - DNA, 25 bp, Rattus norvegicus
atttgatggagatggcccagccctc

SEQ ID NO: 214269 - DNA, 25 bp, Rattus norvegicus
atttgatgtacccactgagtgttta

SEQ ID NO: 214270 - DNA, 25 bp, Rattus norvegicus
atttgatgtaccgactgagtgttta

SEQ ID NO: 214271 - DNA, 25 bp, Rattus norvegicus
atttgatgtcttaattccctgagag

SEQ ID NO: 214272 - DNA, 25 bp, Rattus norvegicus
atttgatgtctttattccctgagag

SEQ ID NO: 214273 - DNA, 25 bp, Rattus norvegicus
atttgatgtgctataaccatgggag

SEQ ID NO: 214274 - DNA, 25 bp, Rattus norvegicus
atttgatgtgctttaaccatgggag

SEQ ID NO: 214275 - DNA, 25 bp, Rattus norvegicus
atttgatgttatctacccaactccc

SEQ ID NO: 214276 - DNA, 25 bp, Rattus norvegicus
atttgatgttatgtacccaactccc

SEQ ID NO: 214277 - DNA, 25 bp, Rattus norvegicus
atttgattacagacacccctgcatt

SEQ ID NO: 214278 - DNA, 25 bp, Rattus norvegicus
atttgattacagtcacccctgcatt

SEQ ID NO: 214279 - DNA, 25 bp, Rattus norvegicus
atttgattattcacgagtctctccc

SEQ ID NO: 214280 - DNA, 25 bp, Rattus norvegicus
atttgattattctcgagtctctccc

SEQ ID NO: 214281 - DNA, 25 bp, Rattus norvegicus
atttgattcagaattcgaggcgagc

SEQ ID NO: 214282 - DNA, 25 bp, Rattus norvegicus
atttgattcagatttcgaggcgagc

SEQ ID NO: 214283 - DNA, 25 bp, Rattus norvegicus
atttgattcccgagagcatacagtg

SEQ ID NO: 214284 - DNA, 25 bp, Rattus norvegicus
atttgattcccgtgagcatacagtg

SEQ ID NO: 214285 - DNA, 25 bp, Rattus norvegicus
atttgattcgctcttttctgcagta

SEQ ID NO: 214286 - DNA, 25 bp, Rattus norvegicus
atttgattcgctgttttctgcagta

SEQ ID NO: 214287 - DNA, 25 bp, Rattus norvegicus
atttgatttcacctttagtccagag

SEQ ID NO: 214288 - DNA, 25 bp, Rattus norvegicus
atttgatttcacgtttagtccagag

SEQ ID NO: 214289 - DNA, 25 bp, Rattus norvegicus
atttgatttggtctcttccgatccc

SEQ ID NO: 214290 - DNA, 25 bp, Rattus norvegicus
atttgatttggtgtcttccgatccc

SEQ ID NO: 214291 - DNA, 25 bp, Rattus norvegicus
atttgcaaactactcttaacttctt

SEQ ID NO: 214292 - DNA, 25 bp, Rattus norvegicus
atttgcaaactagtcttaacttctt

SEQ ID NO: 214293 - DNA, 25 bp, Rattus norvegicus
atttgcaagctcagttctgccagtc

SEQ ID NO: 214294 - DNA, 25 bp, Rattus norvegicus
atttgcaagctctgttctgccagtc

SEQ ID NO: 214295 - DNA, 25 bp, Rattus norvegicus
atttgcaaggccaaggtctggtgtc

SEQ ID NO: 214296 - DNA, 25 bp, Rattus norvegicus
atttgcaaggcctaggtctggtgtc

SEQ ID NO: 214297 - DNA, 25 bp, Rattus norvegicus
atttgcaatagtattccctgagtga

SEQ ID NO: 214298 - DNA, 25 bp, Rattus norvegicus
atttgcaatagttttccctgagtga

SEQ ID NO: 214299 - DNA, 25 bp, Rattus norvegicus
atttgcaatccccaaaagcttcttc

SEQ ID NO: 214300 - DNA, 25 bp, Rattus norvegicus
atttgcaatcccgaaaagcttcttc

SEQ ID NO: 214301 - DNA, 25 bp, Rattus norvegicus
atttgcaatcctaataccgggccag

SEQ ID NO: 214302 - DNA, 25 bp, Rattus norvegicus
atttgcaatccttataccgggccag

SEQ ID NO: 214303 - DNA, 25 bp, Rattus norvegicus
atttgcaatctaaatctttccatgt

SEQ ID NO: 214304 - DNA, 25 bp, Rattus norvegicus
atttgcaatctatatctttccatgt

SEQ ID NO: 214305 - DNA, 25 bp, Rattus norvegicus
atttgcacatgtcacccaaggccaa

SEQ ID NO: 214306 - DNA, 25 bp, Rattus norvegicus
atttgcacatgtgacccaaggccaa

SEQ ID NO: 214307 - DNA, 25 bp, Rattus norvegicus
atttgcacatttctctgggtttgga

SEQ ID NO: 214308 - DNA, 25 bp, Rattus norvegicus
atttgcacatttgtctgggtttgga

SEQ ID NO: 214309 - DNA, 25 bp, Rattus norvegicus
atttgcaccttgactgttgttgtta

SEQ ID NO: 214310 - DNA, 25 bp, Rattus norvegicus
atttgcaccttgtctgttgttgtta

SEQ ID NO: 214311 - DNA, 25 bp, Rattus norvegicus
atttgcacggaactcatcctcgggt

SEQ ID NO: 214312 - DNA, 25 bp, Rattus norvegicus
atttgcacggaagtcatcctcgggt

SEQ ID NO: 214313 - DNA, 25 bp, Rattus norvegicus
atttgcacgtatcccagaagagggc

SEQ ID NO: 214314 - DNA, 25 bp, Rattus norvegicus
atttgcacgtatgccagaagagggc

SEQ ID NO: 214315 - DNA, 25 bp, Rattus norvegicus
atttgcactggaccatgctttctgg

SEQ ID NO: 214316 - DNA, 25 bp, Rattus norvegicus
atttgcactggagcatgctttctgg

SEQ ID NO: 214317 - DNA, 25 bp, Rattus norvegicus
atttgcactttcaatcctgtgggtc

SEQ ID NO: 214318 - DNA, 25 bp, Rattus norvegicus
atttgcactttctatcctgtgggtc

SEQ ID NO: 214319 - DNA, 25 bp, Rattus norvegicus
atttgcagacttcgcttccgcagaa

SEQ ID NO: 214320 - DNA, 25 bp, Rattus norvegicus
atttgcagacttggcttccgcagaa

SEQ ID NO: 214321 - DNA, 25 bp, Rattus norvegicus
atttgcagatccactgatgcctgag

SEQ ID NO: 214322 - DNA, 25 bp, Rattus norvegicus
atttgcagatcctctgatgcctgag

SEQ ID NO: 214323 - DNA, 25 bp, Rattus norvegicus
atttgcagctccaggataattgctt

SEQ ID NO: 214324 - DNA, 25 bp, Rattus norvegicus
atttgcagctcctggataattgctt

SEQ ID NO: 214325 - DNA, 25 bp, Rattus norvegicus
atttgcagtagacctcagttttcag

SEQ ID NO: 214326 - DNA, 25 bp, Rattus norvegicus
atttgcagtagagctcagttttcag

SEQ ID NO: 214327 - DNA, 25 bp, Rattus norvegicus
atttgcatatcaagtactatcctcc

SEQ ID NO: 214328 - DNA, 25 bp, Rattus norvegicus
atttgcatatcatgtactatcctcc

SEQ ID NO: 214329 - DNA, 25 bp, Rattus norvegicus
atttgcatatgcatgttgtctcaca

SEQ ID NO: 214330 - DNA, 25 bp, Rattus norvegicus
atttgcatatgcttgttgtctcaca

SEQ ID NO: 214331 - DNA, 25 bp, Rattus norvegicus
atttgcatatttacagggtaggttc

SEQ ID NO: 214332 - DNA, 25 bp, Rattus norvegicus
atttgcatattttcagggtaggttc

SEQ ID NO: 214333 - DNA, 25 bp, Rattus norvegicus
atttgcatcaaaacgctgaacagcg

SEQ ID NO: 214334 - DNA, 25 bp, Rattus norvegicus
atttgcatcaaatcgctgaacagcg

SEQ ID NO: 214335 - DNA, 25 bp, Rattus norvegicus
atttgcatcatcatctaagccattt

SEQ ID NO: 214336 - DNA, 25 bp, Rattus norvegicus
atttgcatcatcttctaagccattt

SEQ ID NO: 214337 - DNA, 25 bp, Rattus norvegicus
atttgcatctcccagtgattcatga

SEQ ID NO: 214338 - DNA, 25 bp, Rattus norvegicus
atttgcatctccgagtgattcatga

SEQ ID NO: 214339 - DNA, 25 bp, Rattus norvegicus
atttgcatctgcatagcctagtccc

SEQ ID NO: 214340 - DNA, 25 bp, Rattus norvegicus
atttgcatctgcttagcctagtccc

SEQ ID NO: 214341 - DNA, 25 bp, Rattus norvegicus
atttgcatggcacaaactgatgaca

SEQ ID NO: 214342 - DNA, 25 bp, Rattus norvegicus
atttgcatggcagaaactgatgaca

SEQ ID NO: 214343 - DNA, 25 bp, Rattus norvegicus
atttgcatgtgtatcctgttttcca

SEQ ID NO: 214344 - DNA, 25 bp, Rattus norvegicus
atttgcatgtgtttcctgttttcca

SEQ ID NO: 214345 - DNA, 25 bp, Rattus norvegicus
atttgcattcccctgacaaaggcat

SEQ ID NO: 214346 - DNA, 25 bp, Rattus norvegicus
atttgcattcccgtgacaaaggcat

SEQ ID NO: 214347 - DNA, 25 bp, Rattus norvegicus
atttgcattgaaacactggtccagt

SEQ ID NO: 214348 - DNA, 25 bp, Rattus norvegicus
atttgcattgaatcactggtccagt

SEQ ID NO: 214349 - DNA, 25 bp, Rattus norvegicus
atttgccaatgacccaaacccaaga

SEQ ID NO: 214350 - DNA, 25 bp, Rattus norvegicus
atttgccaatgagccaaacccaaga

SEQ ID NO: 214351 - DNA, 25 bp, Rattus norvegicus
atttgccaggatacaagctttgatg

SEQ ID NO: 214352 - DNA, 25 bp, Rattus norvegicus
atttgccaggattcaagctttgatg

SEQ ID NO: 214353 - DNA, 25 bp, Rattus norvegicus
atttgccaggcaagtgaccttggcc

SEQ ID NO: 214354 - DNA, 25 bp, Rattus norvegicus
atttgccaggcatgtgaccttggcc

SEQ ID NO: 214355 - DNA, 25 bp, Rattus norvegicus
atttgccagtcccacattcaatttt

SEQ ID NO: 214356 - DNA, 25 bp, Rattus norvegicus
atttgccagtccgacattcaatttt

SEQ ID NO: 214357 - DNA, 25 bp, Rattus norvegicus
atttgcccacatacgaaaccattat

SEQ ID NO: 214358 - DNA, 25 bp, Rattus norvegicus
atttgcccacattcgaaaccattat

SEQ ID NO: 214359 - DNA, 25 bp, Rattus norvegicus
atttgcccacgaaccagagtaacaa

SEQ ID NO: 214360 - DNA, 25 bp, Rattus norvegicus
atttgcccacgatccagagtaacaa

SEQ ID NO: 214361 - DNA, 25 bp, Rattus norvegicus
atttgcccacttcaatgctgactac

SEQ ID NO: 214362 - DNA, 25 bp, Rattus norvegicus
atttgcccacttgaatgctgactac

SEQ ID NO: 214363 - DNA, 25 bp, Rattus norvegicus
atttgcccagggatctttatgttga

SEQ ID NO: 214364 - DNA, 25 bp, Rattus norvegicus
atttgcccagggttctttatgttga

SEQ ID NO: 214365 - DNA, 25 bp, Rattus norvegicus
atttgcccataaagttactacttgc

SEQ ID NO: 214366 - DNA, 25 bp, Rattus norvegicus
atttgcccataatgttactacttgc

SEQ ID NO: 214367 - DNA, 25 bp, Rattus norvegicus
atttgccccacgctgctcagtgtgt

SEQ ID NO: 214368 - DNA, 25 bp, Rattus norvegicus
atttgccccacggtgctcagtgtgt

SEQ ID NO: 214369 - DNA, 25 bp, Rattus norvegicus
atttgccctgaaagtggtcacctga

SEQ ID NO: 214370 - DNA, 25 bp, Rattus norvegicus
atttgccctgaatgtggtcacctga

SEQ ID NO: 214371 - DNA, 25 bp, Rattus norvegicus
atttgccctgcacccaacctagtaa

SEQ ID NO: 214372 - DNA, 25 bp, Rattus norvegicus
atttgccctgcagccaacctagtaa

SEQ ID NO: 214373 - DNA, 25 bp, Rattus norvegicus
atttgcccttatatctcctgtgata

SEQ ID NO: 214374 - DNA, 25 bp, Rattus norvegicus
atttgcccttatcacagcacacagc

SEQ ID NO: 214375 - DNA, 25 bp, Rattus norvegicus
atttgcccttatgacagcacacagc

SEQ ID NO: 214376 - DNA, 25 bp, Rattus norvegicus
atttgcccttatttctcctgtgata

SEQ ID NO: 214377 - DNA, 25 bp, Rattus norvegicus
atttgcccttcaattgcatatcctg

SEQ ID NO: 214378 - DNA, 25 bp, Rattus norvegicus
atttgcccttcatttgcatatcctg

SEQ ID NO: 214379 - DNA, 25 bp, Rattus norvegicus
atttgcccttgaagtcagcctgttt

SEQ ID NO: 214380 - DNA, 25 bp, Rattus norvegicus
atttgcccttgatgtcagcctgttt

SEQ ID NO: 214381 - DNA, 25 bp, Rattus norvegicus
atttgccgaagcctgtggaagcctt

SEQ ID NO: 214382 - DNA, 25 bp, Rattus norvegicus
atttgccgaagcgtgtggaagcctt

SEQ ID NO: 214383 - DNA, 25 bp, Rattus norvegicus
atttgccgaatgctatgaatgctgc

SEQ ID NO: 214384 - DNA, 25 bp, Rattus norvegicus
atttgccgaatggtatgaatgctgc

SEQ ID NO: 214385 - DNA, 25 bp, Rattus norvegicus
atttgccgggttcccaagagcaagc

SEQ ID NO: 214386 - DNA, 25 bp, Rattus norvegicus
atttgccgggttgccaagagcaagc

SEQ ID NO: 214387 - DNA, 25 bp, Rattus norvegicus
atttgcctacctcctgaacagtatg

SEQ ID NO: 214388 - DNA, 25 bp, Rattus norvegicus
atttgcctacctgctgaacagtatg

SEQ ID NO: 214389 - DNA, 25 bp, Rattus norvegicus
atttgcctcaaacatgctgtgctcc

SEQ ID NO: 214390 - DNA, 25 bp, Rattus norvegicus
atttgcctcaaagatgctgtgctcc

SEQ ID NO: 214391 - DNA, 25 bp, Rattus norvegicus
atttgcctctttagactccacaaag

SEQ ID NO: 214392 - DNA, 25 bp, Rattus norvegicus
atttgcctcttttgactccacaaag

SEQ ID NO: 214393 - DNA, 25 bp, Rattus norvegicus
atttgcctgaggcttgcaccaagga

SEQ ID NO: 214394 - DNA, 25 bp, Rattus norvegicus
atttgcctgagggttgcaccaagga

SEQ ID NO: 214395 - DNA, 25 bp, Rattus norvegicus
atttgcctgagtcccctggtcacag

SEQ ID NO: 214396 - DNA, 25 bp, Rattus norvegicus
atttgcctgagtccctggcgagcca

SEQ ID NO: 214397 - DNA, 25 bp, Rattus norvegicus
atttgcctgagtgccctggtcacag

SEQ ID NO: 214398 - DNA, 25 bp, Rattus norvegicus
atttgcctgagtgcctggcgagcca

SEQ ID NO: 214399 - DNA, 25 bp, Rattus norvegicus
atttgcctgcaaaggtactgtaatt

SEQ ID NO: 214400 - DNA, 25 bp, Rattus norvegicus
atttgcctgcaatggtactgtaatt

SEQ ID NO: 214401 - DNA, 25 bp, Rattus norvegicus
atttgcctgcataaccggtcgatgc

SEQ ID NO: 214402 - DNA, 25 bp, Rattus norvegicus
atttgcctgcattaccggtcgatgc

SEQ ID NO: 214403 - DNA, 25 bp, Rattus norvegicus
atttgcctgctcatcgtgcttttaa

SEQ ID NO: 214404 - DNA, 25 bp, Rattus norvegicus
atttgcctgctcttcgtgcttttaa

SEQ ID NO: 214405 - DNA, 25 bp, Rattus norvegicus
atttgcctggcccattggttcccaa

SEQ ID NO: 214406 - DNA, 25 bp, Rattus norvegicus
atttgcctggccgattggttcccaa

SEQ ID NO: 214407 - DNA, 25 bp, Rattus norvegicus
atttgccttcttaactttctatgtg

SEQ ID NO: 214408 - DNA, 25 bp, Rattus norvegicus
atttgccttctttactttctatgtg

SEQ ID NO: 214409 - DNA, 25 bp, Rattus norvegicus
atttgcgaagctatctgtgagcctc

SEQ ID NO: 214410 - DNA, 25 bp, Rattus norvegicus
atttgcgaagctttctgtgagcctc

SEQ ID NO: 214411 - DNA, 25 bp, Rattus norvegicus
atttgcggccacagatgggaggaac

SEQ ID NO: 214412 - DNA, 25 bp, Rattus norvegicus
atttgcggccactgatgggaggaac

SEQ ID NO: 214413 - DNA, 25 bp, Rattus norvegicus
atttgcgtccttaggtgctgtggcc

SEQ ID NO: 214414 - DNA, 25 bp, Rattus norvegicus
atttgcgtcctttggtgctgtggcc

SEQ ID NO: 214415 - DNA, 25 bp, Rattus norvegicus
atttgctaccacatcctgatctaat

SEQ ID NO: 214416 - DNA, 25 bp, Rattus norvegicus
atttgctaccacttcctgatctaat

SEQ ID NO: 214417 - DNA, 25 bp, Rattus norvegicus
atttgctagttcagctgccctctta

SEQ ID NO: 214418 - DNA, 25 bp, Rattus norvegicus
atttgctagttctgctgccctctta

SEQ ID NO: 214419 - DNA, 25 bp, Rattus norvegicus
atttgctattgacacaggctcctta

SEQ ID NO: 214420 - DNA, 25 bp, Rattus norvegicus
atttgctattgagacaggctcctta

SEQ ID NO: 214421 - DNA, 25 bp, Rattus norvegicus
atttgctcaattcctactgactgac

SEQ ID NO: 214422 - DNA, 25 bp, Rattus norvegicus
atttgctcaattgctactgactgac

SEQ ID NO: 214423 - DNA, 25 bp, Rattus norvegicus
atttgctcacacatacctacgcagg

SEQ ID NO: 214424 - DNA, 25 bp, Rattus norvegicus
atttgctcacacttacctacgcagg

SEQ ID NO: 214425 - DNA, 25 bp, Rattus norvegicus
atttgctcagcgctacctggctgac

SEQ ID NO: 214426 - DNA, 25 bp, Rattus norvegicus
atttgctcagcggtacctggctgac

SEQ ID NO: 214427 - DNA, 25 bp, Rattus norvegicus
atttgctcatctccttctgaggtca

SEQ ID NO: 214428 - DNA, 25 bp, Rattus norvegicus
atttgctcatctgcttctgaggtca

SEQ ID NO: 214429 - DNA, 25 bp, Rattus norvegicus
atttgctcccacctggccatgtatg

SEQ ID NO: 214430 - DNA, 25 bp, Rattus norvegicus
atttgctcccacgtggccatgtatg

SEQ ID NO: 214431 - DNA, 25 bp, Rattus norvegicus
atttgctccctcatggcagattcgg

SEQ ID NO: 214432 - DNA, 25 bp, Rattus norvegicus
atttgctccctcttggcagattcgg

SEQ ID NO: 214433 - DNA, 25 bp, Rattus norvegicus
atttgctcctgtagatttgcctgac

SEQ ID NO: 214434 - DNA, 25 bp, Rattus norvegicus
atttgctcctgttgatttgcctgac

SEQ ID NO: 214435 - DNA, 25 bp, Rattus norvegicus
atttgctccttcacagagtccctga

SEQ ID NO: 214436 - DNA, 25 bp, Rattus norvegicus
atttgctccttcaggctagatgtaa

SEQ ID NO: 214437 - DNA, 25 bp, Rattus norvegicus
atttgctccttctcagagtccctga

SEQ ID NO: 214438 - DNA, 25 bp, Rattus norvegicus
atttgctccttctggctagatgtaa

SEQ ID NO: 214439 - DNA, 25 bp, Rattus norvegicus
atttgctccttgaatgtctagggta

SEQ ID NO: 214440 - DNA, 25 bp, Rattus norvegicus
atttgctccttgtatgtctagggta

SEQ ID NO: 214441 - DNA, 25 bp, Rattus norvegicus
atttgctcgtaaagctaccacggtg

SEQ ID NO: 214442 - DNA, 25 bp, Rattus norvegicus
atttgctcgtaatgctaccacggtg

SEQ ID NO: 214443 - DNA, 25 bp, Rattus norvegicus
atttgctctcccaagatctttcatg

SEQ ID NO: 214444 - DNA, 25 bp, Rattus norvegicus
atttgctctccctagatctttcatg

SEQ ID NO: 214445 - DNA, 25 bp, Rattus norvegicus
atttgctctcctacagagggatgca

SEQ ID NO: 214446 - DNA, 25 bp, Rattus norvegicus
atttgctctccttcagagggatgca

SEQ ID NO: 214447 - DNA, 25 bp, Rattus norvegicus
atttgctctgcacttactggctggt

SEQ ID NO: 214448 - DNA, 25 bp, Rattus norvegicus
atttgctctgcagttactggctggt

SEQ ID NO: 214449 - DNA, 25 bp, Rattus norvegicus
atttgctctgctctgagacgtgctc

SEQ ID NO: 214450 - DNA, 25 bp, Rattus norvegicus
atttgctctgctgtgagacgtgctc

SEQ ID NO: 214451 - DNA, 25 bp, Rattus norvegicus
atttgctctggtatatggttctgta

SEQ ID NO: 214452 - DNA, 25 bp, Rattus norvegicus
atttgctctggtttatggttctgta

SEQ ID NO: 214453 - DNA, 25 bp, Rattus norvegicus
atttgctctgtcagcagttctggac

SEQ ID NO: 214454 - DNA, 25 bp, Rattus norvegicus
atttgctctgtctgcagttctggac

SEQ ID NO: 214455 - DNA, 25 bp, Rattus norvegicus
atttgctctgttatgtatccttccg

SEQ ID NO: 214456 - DNA, 25 bp, Rattus norvegicus
atttgctctgttttgtatccttccg

SEQ ID NO: 214457 - DNA, 25 bp, Rattus norvegicus
atttgctcttcaattccgcatgtgt

SEQ ID NO: 214458 - DNA, 25 bp, Rattus norvegicus
atttgctcttcatttccgcatgtgt

SEQ ID NO: 214459 - DNA, 25 bp, Rattus norvegicus
atttgctgagccatggcactcttgc

SEQ ID NO: 214460 - DNA, 25 bp, Rattus norvegicus
atttgctgagccttggcactcttgc

SEQ ID NO: 214461 - DNA, 25 bp, Rattus norvegicus
atttgctgcaatcctgatgcctcac

SEQ ID NO: 214462 - DNA, 25 bp, Rattus norvegicus
atttgctgcaatgctgatgcctcac

SEQ ID NO: 214463 - DNA, 25 bp, Rattus norvegicus
atttgctgccagaaccagatgtgtt

SEQ ID NO: 214464 - DNA, 25 bp, Rattus norvegicus
atttgctgccagtaccagatgtgtt

SEQ ID NO: 214465 - DNA, 25 bp, Rattus norvegicus
atttgctgcttgagttccctgtgaa

SEQ ID NO: 214466 - DNA, 25 bp, Rattus norvegicus
atttgctgcttgtgttccctgtgaa

SEQ ID NO: 214467 - DNA, 25 bp, Rattus norvegicus
atttgctggattattctggttttgt

SEQ ID NO: 214468 - DNA, 25 bp, Rattus norvegicus
atttgctggatttttctggttttgt

SEQ ID NO: 214469 - DNA, 25 bp, Rattus norvegicus
atttgctggcataccagcacctatt

SEQ ID NO: 214470 - DNA, 25 bp, Rattus norvegicus
atttgctggcattccagcacctatt

SEQ ID NO: 214471 - DNA, 25 bp, Rattus norvegicus
atttgctggctaatgtcggcctcta

SEQ ID NO: 214472 - DNA, 25 bp, Rattus norvegicus
atttgctggctattgtcggcctcta

SEQ ID NO: 214473 - DNA, 25 bp, Rattus norvegicus
atttgctgggcaaagctcacattct

SEQ ID NO: 214474 - DNA, 25 bp, Rattus norvegicus
atttgctgggcatagctcacattct

SEQ ID NO: 214475 - DNA, 25 bp, Rattus norvegicus
atttgctgtagacggaaacacttta

SEQ ID NO: 214476 - DNA, 25 bp, Rattus norvegicus
atttgctgtagagggaaacacttta

SEQ ID NO: 214477 - DNA, 25 bp, Rattus norvegicus
atttgctgtcttagacacgacctct

SEQ ID NO: 214478 - DNA, 25 bp, Rattus norvegicus
atttgctgtctttgacacgacctct

SEQ ID NO: 214479 - DNA, 25 bp, Rattus norvegicus
atttgctgtgacattacctgtattt

SEQ ID NO: 214480 - DNA, 25 bp, Rattus norvegicus
atttgctgtgactttacctgtattt

SEQ ID NO: 214481 - DNA, 25 bp, Rattus norvegicus
atttgctgtgctccatttcactgtt

SEQ ID NO: 214482 - DNA, 25 bp, Rattus norvegicus
atttgctgtgctgcatttcactgtt

SEQ ID NO: 214483 - DNA, 25 bp, Rattus norvegicus
atttgctgtgtaagccgggcagcct

SEQ ID NO: 214484 - DNA, 25 bp, Rattus norvegicus
atttgctgtgtactcttggtgtgga

SEQ ID NO: 214485 - DNA, 25 bp, Rattus norvegicus
atttgctgtgtagtcttggtgtgga

SEQ ID NO: 214486 - DNA, 25 bp, Rattus norvegicus
atttgctgtgtatgccgggcagcct

SEQ ID NO: 214487 - DNA, 25 bp, Rattus norvegicus
atttgctgtttgaagggactgctct

SEQ ID NO: 214488 - DNA, 25 bp, Rattus norvegicus
atttgctgtttgtagggactgctct

SEQ ID NO: 214489 - DNA, 25 bp, Rattus norvegicus
atttgcttacggactttacctggcg

SEQ ID NO: 214490 - DNA, 25 bp, Rattus norvegicus
atttgcttacggtctttacctggcg

SEQ ID NO: 214491 - DNA, 25 bp, Rattus norvegicus
atttgcttatgacaccgtgtgccgt

SEQ ID NO: 214492 - DNA, 25 bp, Rattus norvegicus
atttgcttatgagaccgtgtgccgt

SEQ ID NO: 214493 - DNA, 25 bp, Rattus norvegicus
atttgcttccagctacgcatggcat

SEQ ID NO: 214494 - DNA, 25 bp, Rattus norvegicus
atttgcttccaggtacgcatggcat

SEQ ID NO: 214495 - DNA, 25 bp, Rattus norvegicus
atttgcttcctgaatccagctacct

SEQ ID NO: 214496 - DNA, 25 bp, Rattus norvegicus
atttgcttcctgtatccagctacct

SEQ ID NO: 214497 - DNA, 25 bp, Rattus norvegicus
atttgcttctcgacaaggcctttag

SEQ ID NO: 214498 - DNA, 25 bp, Rattus norvegicus
atttgcttctcgtcaaggcctttag

SEQ ID NO: 214499 - DNA, 25 bp, Rattus norvegicus
atttgcttgatcctggcactaggca

SEQ ID NO: 214500 - DNA, 25 bp, Rattus norvegicus
atttgcttgatcgtggcactaggca

SEQ ID NO: 214501 - DNA, 25 bp, Rattus norvegicus
atttgcttgcaactaggaactacta

SEQ ID NO: 214502 - DNA, 25 bp, Rattus norvegicus
atttgcttgcaagtaggaactacta

SEQ ID NO: 214503 - DNA, 25 bp, Rattus norvegicus
atttgcttgcctatatcccagactg

SEQ ID NO: 214504 - DNA, 25 bp, Rattus norvegicus
atttgcttgcctttatcccagactg

SEQ ID NO: 214505 - DNA, 25 bp, Rattus norvegicus
atttgcttgtacatcagatcataaa

SEQ ID NO: 214506 - DNA, 25 bp, Rattus norvegicus
atttgcttgtacttcagatcataaa

SEQ ID NO: 214507 - DNA, 25 bp, Rattus norvegicus
atttgcttgttcaagacacttcgta

SEQ ID NO: 214508 - DNA, 25 bp, Rattus norvegicus
atttgcttgttctagacacttcgta

SEQ ID NO: 214509 - DNA, 25 bp, Rattus norvegicus
atttgctttacaagtcacccaaccg

SEQ ID NO: 214510 - DNA, 25 bp, Rattus norvegicus
atttgctttacatgtcacccaaccg

SEQ ID NO: 214511 - DNA, 25 bp, Rattus norvegicus
atttgctttcctatgcgttacacca

SEQ ID NO: 214512 - DNA, 25 bp, Rattus norvegicus
atttgctttcctttgcgttacacca

SEQ ID NO: 214513 - DNA, 25 bp, Rattus norvegicus
atttgctttggtctctcaagcgtag

SEQ ID NO: 214514 - DNA, 25 bp, Rattus norvegicus
atttgctttggtgtctcaagcgtag

SEQ ID NO: 214515 - DNA, 25 bp, Rattus norvegicus
atttgctttgtgcttttaattcatc

SEQ ID NO: 214516 - DNA, 25 bp, Rattus norvegicus
atttgctttgtggttttaattcatc

SEQ ID NO: 214517 - DNA, 25 bp, Rattus norvegicus
atttggaacctgaaatagcctttgt

SEQ ID NO: 214518 - DNA, 25 bp, Rattus norvegicus
atttggaacctgtaatagcctttgt

SEQ ID NO: 214519 - DNA, 25 bp, Rattus norvegicus
atttggaactgaatcctcctctagc

SEQ ID NO: 214520 - DNA, 25 bp, Rattus norvegicus
atttggaactgattcctcctctagc

SEQ ID NO: 214521 - DNA, 25 bp, Rattus norvegicus
atttggaatgccagccaagcaccag

SEQ ID NO: 214522 - DNA, 25 bp, Rattus norvegicus
atttggaatgcctgccaagcaccag

SEQ ID NO: 214523 - DNA, 25 bp, Rattus norvegicus
atttggacaacacaggccctaaact

SEQ ID NO: 214524 - DNA, 25 bp, Rattus norvegicus
atttggacaacagaggccctaaact

SEQ ID NO: 214525 - DNA, 25 bp, Rattus norvegicus
atttggacaactccttcttcgacta

SEQ ID NO: 214526 - DNA, 25 bp, Rattus norvegicus
atttggacaactgcttcttcgacta

SEQ ID NO: 214527 - DNA, 25 bp, Rattus norvegicus
atttggacactgctgacactgacac

SEQ ID NO: 214528 - DNA, 25 bp, Rattus norvegicus
atttggacactggtgacactgacac

SEQ ID NO: 214529 - DNA, 25 bp, Rattus norvegicus
atttggaccatgagtttagctgttt

SEQ ID NO: 214530 - DNA, 25 bp, Rattus norvegicus
atttggaccatgtgtttagctgttt

SEQ ID NO: 214531 - DNA, 25 bp, Rattus norvegicus
atttggaccgcactggacatttctc

SEQ ID NO: 214532 - DNA, 25 bp, Rattus norvegicus
atttggaccgcagtggacatttctc

SEQ ID NO: 214533 - DNA, 25 bp, Rattus norvegicus
atttggacctgaccagcgagacggc

SEQ ID NO: 214534 - DNA, 25 bp, Rattus norvegicus
atttggacctgagcagcgagacggc

SEQ ID NO: 214535 - DNA, 25 bp, Rattus norvegicus
atttggaccttcatctggccagaga

SEQ ID NO: 214536 - DNA, 25 bp, Rattus norvegicus
atttggaccttcttctggccagaga

SEQ ID NO: 214537 - DNA, 25 bp, Rattus norvegicus
atttggacgctactgagtcacctgg

SEQ ID NO: 214538 - DNA, 25 bp, Rattus norvegicus
atttggacgctagtgagtcacctgg

SEQ ID NO: 214539 - DNA, 25 bp, Rattus norvegicus
atttggactccaacctttcctgata

SEQ ID NO: 214540 - DNA, 25 bp, Rattus norvegicus
atttggactccatcctttcctgata

SEQ ID NO: 214541 - DNA, 25 bp, Rattus norvegicus
atttggactggaagtctgtctccag

SEQ ID NO: 214542 - DNA, 25 bp, Rattus norvegicus
atttggactggatgtctgtctccag

SEQ ID NO: 214543 - DNA, 25 bp, Rattus norvegicus
atttggactgttccagatgccactg

SEQ ID NO: 214544 - DNA, 25 bp, Rattus norvegicus
atttggactgttgcagatgccactg

SEQ ID NO: 214545 - DNA, 25 bp, Rattus norvegicus
atttggacttgcactctaatctctc

SEQ ID NO: 214546 - DNA, 25 bp, Rattus norvegicus
atttggacttgctctctaatctctc

SEQ ID NO: 214547 - DNA, 25 bp, Rattus norvegicus
atttggacttttatctgtcacgaat

SEQ ID NO: 214548 - DNA, 25 bp, Rattus norvegicus
atttggacttttccttttcctggca

SEQ ID NO: 214549 - DNA, 25 bp, Rattus norvegicus
atttggacttttgcttttcctggca

SEQ ID NO: 214550 - DNA, 25 bp, Rattus norvegicus
atttggacttttttctgtcacgaat

SEQ ID NO: 214551 - DNA, 25 bp, Rattus norvegicus
atttggagatcaagtgcaggctaac

SEQ ID NO: 214552 - DNA, 25 bp, Rattus norvegicus
atttggagatcatgtgcaggctaac

SEQ ID NO: 214553 - DNA, 25 bp, Rattus norvegicus
atttggagcctccaagctggacacg

SEQ ID NO: 214554 - DNA, 25 bp, Rattus norvegicus
atttggagcctcgaagctggacacg

SEQ ID NO: 214555 - DNA, 25 bp, Rattus norvegicus
atttggagcttacttttctctccca

SEQ ID NO: 214556 - DNA, 25 bp, Rattus norvegicus
atttggagcttagttttctctccca

SEQ ID NO: 214557 - DNA, 25 bp, Rattus norvegicus
atttggaggctccagctgctgtaga

SEQ ID NO: 214558 - DNA, 25 bp, Rattus norvegicus
atttggaggctcgagctgctgtaga

SEQ ID NO: 214559 - DNA, 25 bp, Rattus norvegicus
atttggagtgctattaatcctgatg

SEQ ID NO: 214560 - DNA, 25 bp, Rattus norvegicus
atttggagtgcttttaatcctgatg

SEQ ID NO: 214561 - DNA, 25 bp, Rattus norvegicus
atttggataccacttctgagcttgg

SEQ ID NO: 214562 - DNA, 25 bp, Rattus norvegicus
atttggataccagttctgagcttgg

SEQ ID NO: 214563 - DNA, 25 bp, Rattus norvegicus
atttggatatgcacttggcgcgacc

SEQ ID NO: 214564 - DNA, 25 bp, Rattus norvegicus
atttggatatgctcttggcgcgacc

SEQ ID NO: 214565 - DNA, 25 bp, Rattus norvegicus
atttggatcaaaatggcccatggga

SEQ ID NO: 214566 - DNA, 25 bp, Rattus norvegicus
atttggatcaaattggcccatggga

SEQ ID NO: 214567 - DNA, 25 bp, Rattus norvegicus
atttggatcattagacccttcctgt

SEQ ID NO: 214568 - DNA, 25 bp, Rattus norvegicus
atttggatcatttgacccttcctgt

SEQ ID NO: 214569 - DNA, 25 bp, Rattus norvegicus
atttggatccccatgcagtatctac

SEQ ID NO: 214570 - DNA, 25 bp, Rattus norvegicus
atttggatccccttgcagtatctac

SEQ ID NO: 214571 - DNA, 25 bp, Rattus norvegicus
atttggatcctgcagcaacagtagc

SEQ ID NO: 214572 - DNA, 25 bp, Rattus norvegicus
atttggatcctggagcaacagtagc

SEQ ID NO: 214573 - DNA, 25 bp, Rattus norvegicus
atttggatcgctaggttccccatta

SEQ ID NO: 214574 - DNA, 25 bp, Rattus norvegicus
atttggatcgcttggttccccatta

SEQ ID NO: 214575 - DNA, 25 bp, Rattus norvegicus
atttggatgaatatgttactgtgga

SEQ ID NO: 214576 - DNA, 25 bp, Rattus norvegicus
atttggatgaatttgttactgtgga

SEQ ID NO: 214577 - DNA, 25 bp, Rattus norvegicus
atttggatgccacgcttgtccagtg

SEQ ID NO: 214578 - DNA, 25 bp, Rattus norvegicus
atttggatgccaggcttgtccagtg

SEQ ID NO: 214579 - DNA, 25 bp, Rattus norvegicus
atttggatgtctacctgtaagctta

SEQ ID NO: 214580 - DNA, 25 bp, Rattus norvegicus
atttggatgtcttcctgtaagctta

SEQ ID NO: 214581 - DNA, 25 bp, Rattus norvegicus
atttggattaacctggaccttcagt

SEQ ID NO: 214582 - DNA, 25 bp, Rattus norvegicus
atttggattaacgtggaccttcagt

SEQ ID NO: 214583 - DNA, 25 bp, Rattus norvegicus
atttggattgttctggtgtatctac

SEQ ID NO: 214584 - DNA, 25 bp, Rattus norvegicus
atttggattgttgtggtgtatctac

SEQ ID NO: 214585 - DNA, 25 bp, Rattus norvegicus
atttggcaaaggcttgttgttggca

SEQ ID NO: 214586 - DNA, 25 bp, Rattus norvegicus
atttggcaaagggttgttgttggca

SEQ ID NO: 214587 - DNA, 25 bp, Rattus norvegicus
atttggcagagcaagtctccatgct

SEQ ID NO: 214588 - DNA, 25 bp, Rattus norvegicus
atttggcagagctagtctccatgct

SEQ ID NO: 214589 - DNA, 25 bp, Rattus norvegicus
atttggcagagtagactcctacctg

SEQ ID NO: 214590 - DNA, 25 bp, Rattus norvegicus
atttggcagagttgactcctacctg

SEQ ID NO: 214591 - DNA, 25 bp, Rattus norvegicus
atttggcagcttaagcacaggcctc

SEQ ID NO: 214592 - DNA, 25 bp, Rattus norvegicus
atttggcagctttagcacaggcctc

SEQ ID NO: 214593 - DNA, 25 bp, Rattus norvegicus
atttggcatggaattgctgccctca

SEQ ID NO: 214594 - DNA, 25 bp, Rattus norvegicus
atttggcatggatttgctgccctca

SEQ ID NO: 214595 - DNA, 25 bp, Rattus norvegicus
atttggccacatatcttggtctgga

SEQ ID NO: 214596 - DNA, 25 bp, Rattus norvegicus
atttggccacatttcttggtctgga

SEQ ID NO: 214597 - DNA, 25 bp, Rattus norvegicus
atttggccagagcagagctccgtag

SEQ ID NO: 214598 - DNA, 25 bp, Rattus norvegicus
atttggccagaggagagctccgtag

SEQ ID NO: 214599 - DNA, 25 bp, Rattus norvegicus
atttggccaggtcagcgtatatgtg

SEQ ID NO: 214600 - DNA, 25 bp, Rattus norvegicus
atttggccaggtgagcgtatatgtg

SEQ ID NO: 214601 - DNA, 25 bp, Rattus norvegicus
atttggcccaaacaatgctactagc

SEQ ID NO: 214602 - DNA, 25 bp, Rattus norvegicus
atttggcccaaagaatgctactagc

SEQ ID NO: 214603 - DNA, 25 bp, Rattus norvegicus
atttggccccaaataccagtttcag

SEQ ID NO: 214604 - DNA, 25 bp, Rattus norvegicus
atttggccccaattaccagtttcag

SEQ ID NO: 214605 - DNA, 25 bp, Rattus norvegicus
atttggccgatgctctgatgctcgt

SEQ ID NO: 214606 - DNA, 25 bp, Rattus norvegicus
atttggccgatggtctgatgctcgt

SEQ ID NO: 214607 - DNA, 25 bp, Rattus norvegicus
atttggccgggcatatgcactggca

SEQ ID NO: 214608 - DNA, 25 bp, Rattus norvegicus
atttggccgggcttatgcactggca

SEQ ID NO: 214609 - DNA, 25 bp, Rattus norvegicus
atttggcctcagaaagctttggttt

SEQ ID NO: 214610 - DNA, 25 bp, Rattus norvegicus
atttggcctcagtaagctttggttt

SEQ ID NO: 214611 - DNA, 25 bp, Rattus norvegicus
atttggcctctccataggcgaagaa

SEQ ID NO: 214612 - DNA, 25 bp, Rattus norvegicus
atttggcctctcgataggcgaagaa

SEQ ID NO: 214613 - DNA, 25 bp, Rattus norvegicus
atttggcctctgctgtgaagtggca

SEQ ID NO: 214614 - DNA, 25 bp, Rattus norvegicus
atttggcctctggtgtgaagtggca

SEQ ID NO: 214615 - DNA, 25 bp, Rattus norvegicus
atttggcctggaacttcccagctaa

SEQ ID NO: 214616 - DNA, 25 bp, Rattus norvegicus
atttggcctggatcttcccagctaa

SEQ ID NO: 214617 - DNA, 25 bp, Rattus norvegicus
atttggccttctagtgtttttagct

SEQ ID NO: 214618 - DNA, 25 bp, Rattus norvegicus
atttggccttcttgtgtttttagct

SEQ ID NO: 214619 - DNA, 25 bp, Rattus norvegicus
atttggcctttccttaattaatgtg

SEQ ID NO: 214620 - DNA, 25 bp, Rattus norvegicus
atttggcctttcgttaattaatgtg

SEQ ID NO: 214621 - DNA, 25 bp, Rattus norvegicus
atttggcgtcttctcagacacagct

SEQ ID NO: 214622 - DNA, 25 bp, Rattus norvegicus
atttggcgtcttgtcagacacagct

SEQ ID NO: 214623 - DNA, 25 bp, Rattus norvegicus
atttggcgttggcatcgacttcgat

SEQ ID NO: 214624 - DNA, 25 bp, Rattus norvegicus
atttggcgttgggatcgacttcgat

SEQ ID NO: 214625 - DNA, 25 bp, Rattus norvegicus
atttggctaccaacctgtgtgggag

SEQ ID NO: 214626 - DNA, 25 bp, Rattus norvegicus
atttggctaccatcctgtgtgggag

SEQ ID NO: 214627 - DNA, 25 bp, Rattus norvegicus
atttggctccaaatctgcagatgac

SEQ ID NO: 214628 - DNA, 25 bp, Rattus norvegicus
atttggctccaattctgcagatgac

SEQ ID NO: 214629 - DNA, 25 bp, Rattus norvegicus
atttggctccagctggacagtgaca

SEQ ID NO: 214630 - DNA, 25 bp, Rattus norvegicus
atttggctccaggtggacagtgaca

SEQ ID NO: 214631 - DNA, 25 bp, Rattus norvegicus
atttggctcccaaggacattgacct

SEQ ID NO: 214632 - DNA, 25 bp, Rattus norvegicus
atttggctcccatggacattgacct

SEQ ID NO: 214633 - DNA, 25 bp, Rattus norvegicus
atttggctcgctctattgaccagga

SEQ ID NO: 214634 - DNA, 25 bp, Rattus norvegicus
atttggctcgctgtattgaccagga

SEQ ID NO: 214635 - DNA, 25 bp, Rattus norvegicus
atttggctctctctagatagcctta

SEQ ID NO: 214636 - DNA, 25 bp, Rattus norvegicus
atttggctctctgtagatagcctta

SEQ ID NO: 214637 - DNA, 25 bp, Rattus norvegicus
atttggctgaatagcagtaactagc

SEQ ID NO: 214638 - DNA, 25 bp, Rattus norvegicus
atttggctgaattgcagtaactagc

SEQ ID NO: 214639 - DNA, 25 bp, Rattus norvegicus
atttggctgatgagagtcccttctg

SEQ ID NO: 214640 - DNA, 25 bp, Rattus norvegicus
atttggctgatgtgagtcccttctg

SEQ ID NO: 214641 - DNA, 25 bp, Rattus norvegicus
atttggctggcacaatggctcatct

SEQ ID NO: 214642 - DNA, 25 bp, Rattus norvegicus
atttggctggcagaatggctcatct

SEQ ID NO: 214643 - DNA, 25 bp, Rattus norvegicus
atttggcttcatcggtgtaaacacc

SEQ ID NO: 214644 - DNA, 25 bp, Rattus norvegicus
atttggcttcatgggtgtaaacacc

SEQ ID NO: 214645 - DNA, 25 bp, Rattus norvegicus
atttggcttcctcccagaagatgaa

SEQ ID NO: 214646 - DNA, 25 bp, Rattus norvegicus
atttggcttcctgccagaagatgaa

SEQ ID NO: 214647 - DNA, 25 bp, Rattus norvegicus
atttggcttgccacaccttctcttt

SEQ ID NO: 214648 - DNA, 25 bp, Rattus norvegicus
atttggcttgcctcaccttctcttt

SEQ ID NO: 214649 - DNA, 25 bp, Rattus norvegicus
atttgggaagcaccctgtcaaccta

SEQ ID NO: 214650 - DNA, 25 bp, Rattus norvegicus
atttgggaagcagcctgtcaaccta

SEQ ID NO: 214651 - DNA, 25 bp, Rattus norvegicus
atttgggacagaagcacctgcccac

SEQ ID NO: 214652 - DNA, 25 bp, Rattus norvegicus
atttgggacagatgcacctgcccac

SEQ ID NO: 214653 - DNA, 25 bp, Rattus norvegicus
atttgggacctaaaatactcctcag

SEQ ID NO: 214654 - DNA, 25 bp, Rattus norvegicus
atttgggacctataatactcctcag

SEQ ID NO: 214655 - DNA, 25 bp, Rattus norvegicus
atttgggagatcaaagcccctcttt

SEQ ID NO: 214656 - DNA, 25 bp, Rattus norvegicus
atttgggagatctaagcccctcttt

SEQ ID NO: 214657 - DNA, 25 bp, Rattus norvegicus
atttgggagcctagatttacagttc

SEQ ID NO: 214658 - DNA, 25 bp, Rattus norvegicus
atttgggagccttgatttacagttc

SEQ ID NO: 214659 - DNA, 25 bp, Rattus norvegicus
atttgggagggcactgtgcagcccc

SEQ ID NO: 214660 - DNA, 25 bp, Rattus norvegicus
atttgggagggctctgtgcagcccc

SEQ ID NO: 214661 - DNA, 25 bp, Rattus norvegicus
atttgggatcagaaacatgcctttt

SEQ ID NO: 214662 - DNA, 25 bp, Rattus norvegicus
atttgggatcagtaacatgcctttt

SEQ ID NO: 214663 - DNA, 25 bp, Rattus norvegicus
atttgggatgtgactgtgtgcccgt

SEQ ID NO: 214664 - DNA, 25 bp, Rattus norvegicus
atttgggatgtgtctgtgtgcccgt

SEQ ID NO: 214665 - DNA, 25 bp, Rattus norvegicus
atttgggattccacagtgccttgca

SEQ ID NO: 214666 - DNA, 25 bp, Rattus norvegicus
atttgggattcctcagtgccttgca

SEQ ID NO: 214667 - DNA, 25 bp, Rattus norvegicus
atttgggcacacagtcagttctata

SEQ ID NO: 214668 - DNA, 25 bp, Rattus norvegicus
atttgggcacactgtcagttctata

SEQ ID NO: 214669 - DNA, 25 bp, Rattus norvegicus
atttgggcatgacaggcctctgttc

SEQ ID NO: 214670 - DNA, 25 bp, Rattus norvegicus
atttgggcatgagaggcctctgttc

SEQ ID NO: 214671 - DNA, 25 bp, Rattus norvegicus
atttgggccaacattcatgccattt

SEQ ID NO: 214672 - DNA, 25 bp, Rattus norvegicus
atttgggccaactttcatgccattt

SEQ ID NO: 214673 - DNA, 25 bp, Rattus norvegicus
atttgggtaatgctgcacctagata

SEQ ID NO: 214674 - DNA, 25 bp, Rattus norvegicus
atttgggtaatggtgcacctagata

SEQ ID NO: 214675 - DNA, 25 bp, Rattus norvegicus
atttgggtgactcacatgcggttaa

SEQ ID NO: 214676 - DNA, 25 bp, Rattus norvegicus
atttgggtgactgacatgcggttaa

SEQ ID NO: 214677 - DNA, 25 bp, Rattus norvegicus
atttgggtggacactgccccaggag

SEQ ID NO: 214678 - DNA, 25 bp, Rattus norvegicus
atttgggtggactctgccccaggag

SEQ ID NO: 214679 - DNA, 25 bp, Rattus norvegicus
atttgggttgtcctcaaactcactg

SEQ ID NO: 214680 - DNA, 25 bp, Rattus norvegicus
atttgggttgtcgtcaaactcactg

SEQ ID NO: 214681 - DNA, 25 bp, Rattus norvegicus
atttgggtttcaacggcagctcgaa

SEQ ID NO: 214682 - DNA, 25 bp, Rattus norvegicus
atttgggtttcatcggcagctcgaa

SEQ ID NO: 214683 - DNA, 25 bp, Rattus norvegicus
atttggtaacgtagttctcctgctc

SEQ ID NO: 214684 - DNA, 25 bp, Rattus norvegicus
atttggtaacgttgttctcctgctc

SEQ ID NO: 214685 - DNA, 25 bp, Rattus norvegicus
atttggtaacttagtatctgtgtag

SEQ ID NO: 214686 - DNA, 25 bp, Rattus norvegicus
atttggtaactttgtatctgtgtag

SEQ ID NO: 214687 - DNA, 25 bp, Rattus norvegicus
atttggtaatctcgcttagctttgc

SEQ ID NO: 214688 - DNA, 25 bp, Rattus norvegicus
atttggtaatctggcttagctttgc

SEQ ID NO: 214689 - DNA, 25 bp, Rattus norvegicus
atttggtagtgcacaaccgcctgta

SEQ ID NO: 214690 - DNA, 25 bp, Rattus norvegicus
atttggtagtgctcaaccgcctgta

SEQ ID NO: 214691 - DNA, 25 bp, Rattus norvegicus
atttggtatgaccagttcacctgcc

SEQ ID NO: 214692 - DNA, 25 bp, Rattus norvegicus
atttggtatgacgagttcacctgcc

SEQ ID NO: 214693 - DNA, 25 bp, Rattus norvegicus
atttggtcagcccttgtccacttat

SEQ ID NO: 214694 - DNA, 25 bp, Rattus norvegicus
atttggtcagccgttgtccacttat

SEQ ID NO: 214695 - DNA, 25 bp, Rattus norvegicus
atttggtccatgaagcaggtcgata

SEQ ID NO: 214696 - DNA, 25 bp, Rattus norvegicus
atttggtccatgtagcaggtcgata

SEQ ID NO: 214697 - DNA, 25 bp, Rattus norvegicus
atttggtccctcactatggtagctt

SEQ ID NO: 214698 - DNA, 25 bp, Rattus norvegicus
atttggtccctctctatggtagctt

SEQ ID NO: 214699 - DNA, 25 bp, Rattus norvegicus
atttggtccctgatactgggcattc

SEQ ID NO: 214700 - DNA, 25 bp, Rattus norvegicus
atttggtccctgttactgggcattc

SEQ ID NO: 214701 - DNA, 25 bp, Rattus norvegicus
atttggtcctgaaaagggtgtctga

SEQ ID NO: 214702 - DNA, 25 bp, Rattus norvegicus
atttggtcctgataagggtgtctga

SEQ ID NO: 214703 - DNA, 25 bp, Rattus norvegicus
atttggtcctgcagctgcaggcaaa

SEQ ID NO: 214704 - DNA, 25 bp, Rattus norvegicus
atttggtcctgctgctgcaggcaaa

SEQ ID NO: 214705 - DNA, 25 bp, Rattus norvegicus
atttggtctacaagccaccccaagg

SEQ ID NO: 214706 - DNA, 25 bp, Rattus norvegicus
atttggtctacatgccaccccaagg

SEQ ID NO: 214707 - DNA, 25 bp, Rattus norvegicus
atttggtctcatacagcagccacag

SEQ ID NO: 214708 - DNA, 25 bp, Rattus norvegicus
atttggtctcattcagcagccacag

SEQ ID NO: 214709 - DNA, 25 bp, Rattus norvegicus
atttggtgaagtaggctcggctgct

SEQ ID NO: 214710 - DNA, 25 bp, Rattus norvegicus
atttggtgaagttggctcggctgct

SEQ ID NO: 214711 - DNA, 25 bp, Rattus norvegicus
atttggtgaccacgctgtcgctaca

SEQ ID NO: 214712 - DNA, 25 bp, Rattus norvegicus
atttggtgaccaggctgtcgctaca

SEQ ID NO: 214713 - DNA, 25 bp, Rattus norvegicus
atttggtgagtacctccgtgccctc

SEQ ID NO: 214714 - DNA, 25 bp, Rattus norvegicus
atttggtgagtagctccgtgccctc

SEQ ID NO: 214715 - DNA, 25 bp, Rattus norvegicus
atttggtgattcactgctaggccta

SEQ ID NO: 214716 - DNA, 25 bp, Rattus norvegicus
atttggtgattctctgctaggccta

SEQ ID NO: 214717 - DNA, 25 bp, Rattus norvegicus
atttggtgcacactggcgcatgtct

SEQ ID NO: 214718 - DNA, 25 bp, Rattus norvegicus
atttggtgcacagtggcgcatgtct

SEQ ID NO: 214719 - DNA, 25 bp, Rattus norvegicus
atttggtgccatcctggcctgttta

SEQ ID NO: 214720 - DNA, 25 bp, Rattus norvegicus
atttggtgccatgctggcctgttta

SEQ ID NO: 214721 - DNA, 25 bp, Rattus norvegicus
atttggtgctaacagctctcccctg

SEQ ID NO: 214722 - DNA, 25 bp, Rattus norvegicus
atttggtgctaagagctctcccctg

SEQ ID NO: 214723 - DNA, 25 bp, Rattus norvegicus
atttggtgctatcactcactcagtc

SEQ ID NO: 214724 - DNA, 25 bp, Rattus norvegicus
atttggtgctatgactcactcagtc

SEQ ID NO: 214725 - DNA, 25 bp, Rattus norvegicus
atttggtggcagatcttcccagaag

SEQ ID NO: 214726 - DNA, 25 bp, Rattus norvegicus
atttggtggcagttcttcccagaag

SEQ ID NO: 214727 - DNA, 25 bp, Rattus norvegicus
atttggtgtcgtcgaacctcttact

SEQ ID NO: 214728 - DNA, 25 bp, Rattus norvegicus
atttggtgtcgtggaacctcttact

SEQ ID NO: 214729 - DNA, 25 bp, Rattus norvegicus
atttggttacttaccatccactctg

SEQ ID NO: 214730 - DNA, 25 bp, Rattus norvegicus
atttggttactttccatccactctg

SEQ ID NO: 214731 - DNA, 25 bp, Rattus norvegicus
atttggttcattcctggtcttttta

SEQ ID NO: 214732 - DNA, 25 bp, Rattus norvegicus
atttggttcattgctggtcttttta

SEQ ID NO: 214733 - DNA, 25 bp, Rattus norvegicus
atttggttctatacctgataaacag

SEQ ID NO: 214734 - DNA, 25 bp, Rattus norvegicus
atttggttctattcctgataaacag

SEQ ID NO: 214735 - DNA, 25 bp, Rattus norvegicus
atttggttgcccacacaatttggtg

SEQ ID NO: 214736 - DNA, 25 bp, Rattus norvegicus
atttggttgccctcacaatttggtg

SEQ ID NO: 214737 - DNA, 25 bp, Rattus norvegicus
atttggtttcatattcctcgtgtaa

SEQ ID NO: 214738 - DNA, 25 bp, Rattus norvegicus
atttggtttcattttcctcgtgtaa

SEQ ID NO: 214739 - DNA, 25 bp, Rattus norvegicus
atttggtttgtgctgagcttgtctg

SEQ ID NO: 214740 - DNA, 25 bp, Rattus norvegicus
atttggtttgtggtgagcttgtctg

SEQ ID NO: 214741 - DNA, 25 bp, Rattus norvegicus
atttgtaaatatatgccataatttt

SEQ ID NO: 214742 - DNA, 25 bp, Rattus norvegicus
atttgtaaatatttgccataatttt

SEQ ID NO: 214743 - DNA, 25 bp, Rattus norvegicus
atttgtaaccatccccacatattta

SEQ ID NO: 214744 - DNA, 25 bp, Rattus norvegicus
atttgtaaccatgcccacatattta

SEQ ID NO: 214745 - DNA, 25 bp, Rattus norvegicus
atttgtaacctcacgatctggaaag

SEQ ID NO: 214746 - DNA, 25 bp, Rattus norvegicus
atttgtaacctctcgatctggaaag

SEQ ID NO: 214747 - DNA, 25 bp, Rattus norvegicus
atttgtaactgcagctccaccacaa

SEQ ID NO: 214748 - DNA, 25 bp, Rattus norvegicus
atttgtaactgctgctccaccacaa

SEQ ID NO: 214749 - DNA, 25 bp, Rattus norvegicus
atttgtaatatgatggttgcccttt

SEQ ID NO: 214750 - DNA, 25 bp, Rattus norvegicus
atttgtaatatgttggttgcccttt

SEQ ID NO: 214751 - DNA, 25 bp, Rattus norvegicus
atttgtaatcctagtctctgttcgc

SEQ ID NO: 214752 - DNA, 25 bp, Rattus norvegicus
atttgtaatccttgtctctgttcgc

SEQ ID NO: 214753 - DNA, 25 bp, Rattus norvegicus
atttgtaatgagacctttctttctg

SEQ ID NO: 214754 - DNA, 25 bp, Rattus norvegicus
atttgtaatgagtcctttctttctg

SEQ ID NO: 214755 - DNA, 25 bp, Rattus norvegicus
atttgtaatttcagtgtcactgtta

SEQ ID NO: 214756 - DNA, 25 bp, Rattus norvegicus
atttgtaatttctgtgtcactgtta

SEQ ID NO: 214757 - DNA, 25 bp, Rattus norvegicus
atttgtacaataaagcagttctcag

SEQ ID NO: 214758 - DNA, 25 bp, Rattus norvegicus
atttgtacaatatagcagttctcag

SEQ ID NO: 214759 - DNA, 25 bp, Rattus norvegicus
atttgtacacagctcacatcttgga

SEQ ID NO: 214760 - DNA, 25 bp, Rattus norvegicus
atttgtacacaggtcacatcttgga

SEQ ID NO: 214761 - DNA, 25 bp, Rattus norvegicus
atttgtacatcaccacacgagttcc

SEQ ID NO: 214762 - DNA, 25 bp, Rattus norvegicus
atttgtacatcagcacacgagttcc

SEQ ID NO: 214763 - DNA, 25 bp, Rattus norvegicus
atttgtaccacaacatgtgctccct

SEQ ID NO: 214764 - DNA, 25 bp, Rattus norvegicus
atttgtaccacatcatgtgctccct

SEQ ID NO: 214765 - DNA, 25 bp, Rattus norvegicus
atttgtaccatacaggactgtccgt

SEQ ID NO: 214766 - DNA, 25 bp, Rattus norvegicus
atttgtaccatagaggactgtccgt

SEQ ID NO: 214767 - DNA, 25 bp, Rattus norvegicus
atttgtacccttaactgtttcatat

SEQ ID NO: 214768 - DNA, 25 bp, Rattus norvegicus
atttgtaccctttactgtttcatat

SEQ ID NO: 214769 - DNA, 25 bp, Rattus norvegicus
atttgtacctcacattgaaccttta

SEQ ID NO: 214770 - DNA, 25 bp, Rattus norvegicus
atttgtacctcagattgaaccttta

SEQ ID NO: 214771 - DNA, 25 bp, Rattus norvegicus
atttgtacgctccaagcaggcttta

SEQ ID NO: 214772 - DNA, 25 bp, Rattus norvegicus
atttgtacgctcgaagcaggcttta

SEQ ID NO: 214773 - DNA, 25 bp, Rattus norvegicus
atttgtacggatctgcagcctggtc

SEQ ID NO: 214774 - DNA, 25 bp, Rattus norvegicus
atttgtacggatgtgcagcctggtc

SEQ ID NO: 214775 - DNA, 25 bp, Rattus norvegicus
atttgtactcaacatttcatgggaa

SEQ ID NO: 214776 - DNA, 25 bp, Rattus norvegicus
atttgtactcaagatttcatgggaa

SEQ ID NO: 214777 - DNA, 25 bp, Rattus norvegicus
atttgtactgaccactaagcacatg

SEQ ID NO: 214778 - DNA, 25 bp, Rattus norvegicus
atttgtactgacgactaagcacatg

SEQ ID NO: 214779 - DNA, 25 bp, Rattus norvegicus
atttgtactggtaatgcagattcca

SEQ ID NO: 214780 - DNA, 25 bp, Rattus norvegicus
atttgtactggttatgcagattcca

SEQ ID NO: 214781 - DNA, 25 bp, Rattus norvegicus
atttgtacttgtatttcctgctgga

SEQ ID NO: 214782 - DNA, 25 bp, Rattus norvegicus
atttgtacttgtttttcctgctgga

SEQ ID NO: 214783 - DNA, 25 bp, Rattus norvegicus
atttgtagcatcctttattctccta

SEQ ID NO: 214784 - DNA, 25 bp, Rattus norvegicus
atttgtagcatcgtttattctccta

SEQ ID NO: 214785 - DNA, 25 bp, Rattus norvegicus
atttgtagtttaaactgctgctctc

SEQ ID NO: 214786 - DNA, 25 bp, Rattus norvegicus
atttgtagtttatactgctgctctc

SEQ ID NO: 214787 - DNA, 25 bp, Rattus norvegicus
atttgtatagataacccctcgtgca

SEQ ID NO: 214788 - DNA, 25 bp, Rattus norvegicus
atttgtatagattacccctcgtgca

SEQ ID NO: 214789 - DNA, 25 bp, Rattus norvegicus
atttgtatatacacgtgtccgtaca

SEQ ID NO: 214790 - DNA, 25 bp, Rattus norvegicus
atttgtatatactcgtgtccgtaca

SEQ ID NO: 214791 - DNA, 25 bp, Rattus norvegicus
atttgtatctccattagctctcaag

SEQ ID NO: 214792 - DNA, 25 bp, Rattus norvegicus
atttgtatctcctttagctctcaag

SEQ ID NO: 214793 - DNA, 25 bp, Rattus norvegicus
atttgtatgcacatggccatcttgt

SEQ ID NO: 214794 - DNA, 25 bp, Rattus norvegicus
atttgtatgcacttggccatcttgt

SEQ ID NO: 214795 - DNA, 25 bp, Rattus norvegicus
atttgtatgtgtacggctgagggac

SEQ ID NO: 214796 - DNA, 25 bp, Rattus norvegicus
atttgtatgtgtatgaagcccgccc

SEQ ID NO: 214797 - DNA, 25 bp, Rattus norvegicus
atttgtatgtgttcggctgagggac

SEQ ID NO: 214798 - DNA, 25 bp, Rattus norvegicus
atttgtatgtgtttgaagcccgccc

SEQ ID NO: 214799 - DNA, 25 bp, Rattus norvegicus
atttgtattagtcaccgtcttcgga

SEQ ID NO: 214800 - DNA, 25 bp, Rattus norvegicus
atttgtattagtgaccgtcttcgga

SEQ ID NO: 214801 - DNA, 25 bp, Rattus norvegicus
atttgtattcatcaaatgtctcttt

SEQ ID NO: 214802 - DNA, 25 bp, Rattus norvegicus
atttgtattcatccctctttcaatc

SEQ ID NO: 214803 - DNA, 25 bp, Rattus norvegicus
atttgtattcatgaaatgtctcttt

SEQ ID NO: 214804 - DNA, 25 bp, Rattus norvegicus
atttgtattcatgcctctttcaatc

SEQ ID NO: 214805 - DNA, 25 bp, Rattus norvegicus
atttgtattgcactttccctggctt

SEQ ID NO: 214806 - DNA, 25 bp, Rattus norvegicus
atttgtattgcagtttccctggctt

SEQ ID NO: 214807 - DNA, 25 bp, Rattus norvegicus
atttgtattgcccttgttactgtta

SEQ ID NO: 214808 - DNA, 25 bp, Rattus norvegicus
atttgtattgccgttgttactgtta

SEQ ID NO: 214809 - DNA, 25 bp, Rattus norvegicus
atttgtatttagcttctggttggaa

SEQ ID NO: 214810 - DNA, 25 bp, Rattus norvegicus
atttgtatttaggttctggttggaa

SEQ ID NO: 214811 - DNA, 25 bp, Rattus norvegicus
atttgtattttgcactctgtatgtc

SEQ ID NO: 214812 - DNA, 25 bp, Rattus norvegicus
atttgtattttggactctgtatgtc

SEQ ID NO: 214813 - DNA, 25 bp, Rattus norvegicus
atttgtcaacttatggaagtgccca

SEQ ID NO: 214814 - DNA, 25 bp, Rattus norvegicus
atttgtcaacttttggaagtgccca

SEQ ID NO: 214815 - DNA, 25 bp, Rattus norvegicus
atttgtcacccaaccacagacagag

SEQ ID NO: 214816 - DNA, 25 bp, Rattus norvegicus
atttgtcacccaatgttggtctcta

SEQ ID NO: 214817 - DNA, 25 bp, Rattus norvegicus
atttgtcacccatccacagacagag

SEQ ID NO: 214818 - DNA, 25 bp, Rattus norvegicus
atttgtcacccattgttggtctcta

SEQ ID NO: 214819 - DNA, 25 bp, Rattus norvegicus
atttgtcacccgagcagagagtgca

SEQ ID NO: 214820 - DNA, 25 bp, Rattus norvegicus
atttgtcacccgtgcagagagtgca

SEQ ID NO: 214821 - DNA, 25 bp, Rattus norvegicus
atttgtcactgaagtctaggccctg

SEQ ID NO: 214822 - DNA, 25 bp, Rattus norvegicus
atttgtcactgatgtctaggccctg

SEQ ID NO: 214823 - DNA, 25 bp, Rattus norvegicus
atttgtcactttacctgtctttgaa

SEQ ID NO: 214824 - DNA, 25 bp, Rattus norvegicus
atttgtcacttttcctgtctttgaa

SEQ ID NO: 214825 - DNA, 25 bp, Rattus norvegicus
atttgtcagcaacctttgtagtggc

SEQ ID NO: 214826 - DNA, 25 bp, Rattus norvegicus
atttgtcagcaagctttgtagtggc

SEQ ID NO: 214827 - DNA, 25 bp, Rattus norvegicus
atttgtcagggaacctcttcactgt

SEQ ID NO: 214828 - DNA, 25 bp, Rattus norvegicus
atttgtcagggatcctcttcactgt

SEQ ID NO: 214829 - DNA, 25 bp, Rattus norvegicus
atttgtcatggcatccatctgtcct

SEQ ID NO: 214830 - DNA, 25 bp, Rattus norvegicus
atttgtcatggcttccatctgtcct

SEQ ID NO: 214831 - DNA, 25 bp, Rattus norvegicus
atttgtcatgttacggccacttgtc

SEQ ID NO: 214832 - DNA, 25 bp, Rattus norvegicus
atttgtcatgtttcggccacttgtc

SEQ ID NO: 214833 - DNA, 25 bp, Rattus norvegicus
atttgtccaaagctctgcactctgg

SEQ ID NO: 214834 - DNA, 25 bp, Rattus norvegicus
atttgtccaaaggtctgcactctgg

SEQ ID NO: 214835 - DNA, 25 bp, Rattus norvegicus
atttgtccacgacggcgcttgtatt

SEQ ID NO: 214836 - DNA, 25 bp, Rattus norvegicus
atttgtccacgagggcgcttgtatt

SEQ ID NO: 214837 - DNA, 25 bp, Rattus norvegicus
atttgtccactgctggtcaccagaa

SEQ ID NO: 214838 - DNA, 25 bp, Rattus norvegicus
atttgtccactggtggtcaccagaa

SEQ ID NO: 214839 - DNA, 25 bp, Rattus norvegicus
atttgtccagaacccaggatttccc

SEQ ID NO: 214840 - DNA, 25 bp, Rattus norvegicus
atttgtccagaagccaggatttccc

SEQ ID NO: 214841 - DNA, 25 bp, Rattus norvegicus
atttgtccagggactaggaaggcat

SEQ ID NO: 214842 - DNA, 25 bp, Rattus norvegicus
atttgtccagggtctaggaaggcat

SEQ ID NO: 214843 - DNA, 25 bp, Rattus norvegicus
atttgtccatcactaggcttgtcag

SEQ ID NO: 214844 - DNA, 25 bp, Rattus norvegicus
atttgtccatcagtaggcttgtcag

SEQ ID NO: 214845 - DNA, 25 bp, Rattus norvegicus
atttgtcctagcacaccatttagca

SEQ ID NO: 214846 - DNA, 25 bp, Rattus norvegicus
atttgtcctagctcaccatttagca

SEQ ID NO: 214847 - DNA, 25 bp, Rattus norvegicus
atttgtcctcctatctgtgtcgagt

SEQ ID NO: 214848 - DNA, 25 bp, Rattus norvegicus
atttgtcctcctttctgtgtcgagt

SEQ ID NO: 214849 - DNA, 25 bp, Rattus norvegicus
atttgtcctgacagtgttgcatcct

SEQ ID NO: 214850 - DNA, 25 bp, Rattus norvegicus
atttgtcctgactgtgttgcatcct

SEQ ID NO: 214851 - DNA, 25 bp, Rattus norvegicus
atttgtcctgtcacctgcgtaagca

SEQ ID NO: 214852 - DNA, 25 bp, Rattus norvegicus
atttgtcctgtctcctgcgtaagca

SEQ ID NO: 214853 - DNA, 25 bp, Rattus norvegicus
atttgtcctgtgaaagcaccccaat

SEQ ID NO: 214854 - DNA, 25 bp, Rattus norvegicus
atttgtcctgtgactatgtatctat

SEQ ID NO: 214855 - DNA, 25 bp, Rattus norvegicus
atttgtcctgtgtaagcaccccaat

SEQ ID NO: 214856 - DNA, 25 bp, Rattus norvegicus
atttgtcctgtgtctatgtatctat

SEQ ID NO: 214857 - DNA, 25 bp, Rattus norvegicus
atttgtcggaaactagcaccctcaa

SEQ ID NO: 214858 - DNA, 25 bp, Rattus norvegicus
atttgtcggaaagtagcaccctcaa

SEQ ID NO: 214859 - DNA, 25 bp, Rattus norvegicus
atttgtcggaagcacttgactccac

SEQ ID NO: 214860 - DNA, 25 bp, Rattus norvegicus
atttgtcggaaggacttgactccac

SEQ ID NO: 214861 - DNA, 25 bp, Rattus norvegicus
atttgtcggcctatatgtaatctgt

SEQ ID NO: 214862 - DNA, 25 bp, Rattus norvegicus
atttgtcggcctttatgtaatctgt

SEQ ID NO: 214863 - DNA, 25 bp, Rattus norvegicus
atttgtcgggcacggtagctttgta

SEQ ID NO: 214864 - DNA, 25 bp, Rattus norvegicus
atttgtcgggcagggtagctttgta

SEQ ID NO: 214865 - DNA, 25 bp, Rattus norvegicus
atttgtctaagtataagccacccag

SEQ ID NO: 214866 - DNA, 25 bp, Rattus norvegicus
atttgtctaagtttaagccacccag

SEQ ID NO: 214867 - DNA, 25 bp, Rattus norvegicus
atttgtctacaaagcagcctcctat

SEQ ID NO: 214868 - DNA, 25 bp, Rattus norvegicus
atttgtctacaatgcagcctcctat

SEQ ID NO: 214869 - DNA, 25 bp, Rattus norvegicus
atttgtctaggaataggcccgctca

SEQ ID NO: 214870 - DNA, 25 bp, Rattus norvegicus
atttgtctaggattaggcccgctca

SEQ ID NO: 214871 - DNA, 25 bp, Rattus norvegicus
atttgtctaggcctgtgtgtgctaa

SEQ ID NO: 214872 - DNA, 25 bp, Rattus norvegicus
atttgtctaggcgtgtgtgtgctaa

SEQ ID NO: 214873 - DNA, 25 bp, Rattus norvegicus
atttgtctccctctaaggcagtcta

SEQ ID NO: 214874 - DNA, 25 bp, Rattus norvegicus
atttgtctccctgtaaggcagtcta

SEQ ID NO: 214875 - DNA, 25 bp, Rattus norvegicus
atttgtctctatacttcattcttgt

SEQ ID NO: 214876 - DNA, 25 bp, Rattus norvegicus
atttgtctctattcttcattcttgt

SEQ ID NO: 214877 - DNA, 25 bp, Rattus norvegicus
atttgtctgcacatggtaactgaga

SEQ ID NO: 214878 - DNA, 25 bp, Rattus norvegicus
atttgtctgcacttggtaactgaga

SEQ ID NO: 214879 - DNA, 25 bp, Rattus norvegicus
atttgtcttacactctcttcagctt

SEQ ID NO: 214880 - DNA, 25 bp, Rattus norvegicus
atttgtcttacagtctcttcagctt

SEQ ID NO: 214881 - DNA, 25 bp, Rattus norvegicus
atttgtcttaccctccagattgtga

SEQ ID NO: 214882 - DNA, 25 bp, Rattus norvegicus
atttgtcttaccgtccagattgtga

SEQ ID NO: 214883 - DNA, 25 bp, Rattus norvegicus
atttgtcttattcgcgcttctcccc

SEQ ID NO: 214884 - DNA, 25 bp, Rattus norvegicus
atttgtcttattggcgcttctcccc

SEQ ID NO: 214885 - DNA, 25 bp, Rattus norvegicus
atttgtcttcccaagaaatcctcag

SEQ ID NO: 214886 - DNA, 25 bp, Rattus norvegicus
atttgtcttccctagaaatcctcag

SEQ ID NO: 214887 - DNA, 25 bp, Rattus norvegicus
atttgtcttcctaaattcatgtaga

SEQ ID NO: 214888 - DNA, 25 bp, Rattus norvegicus
atttgtcttccttaattcatgtaga

SEQ ID NO: 214889 - DNA, 25 bp, Rattus norvegicus
atttgtcttctcaggatggctctgt

SEQ ID NO: 214890 - DNA, 25 bp, Rattus norvegicus
atttgtcttctctggatggctctgt

SEQ ID NO: 214891 - DNA, 25 bp, Rattus norvegicus
atttgtcttgatactgctcgtcagc

SEQ ID NO: 214892 - DNA, 25 bp, Rattus norvegicus
atttgtcttgattctgctcgtcagc

SEQ ID NO: 214893 - DNA, 25 bp, Rattus norvegicus
atttgtgaaaggcaccccattgcta

SEQ ID NO: 214894 - DNA, 25 bp, Rattus norvegicus
atttgtgaaagggaccccattgcta

SEQ ID NO: 214895 - DNA, 25 bp, Rattus norvegicus
atttgtgaactcaagcctgcccagg

SEQ ID NO: 214896 - DNA, 25 bp, Rattus norvegicus
atttgtgaactctagcctgcccagg

SEQ ID NO: 214897 - DNA, 25 bp, Rattus norvegicus
atttgtgaatataaccaccgcctga

SEQ ID NO: 214898 - DNA, 25 bp, Rattus norvegicus
atttgtgaatattaccaccgcctga

SEQ ID NO: 214899 - DNA, 25 bp, Rattus norvegicus
atttgtgacagcctagcagactaca

SEQ ID NO: 214900 - DNA, 25 bp, Rattus norvegicus
atttgtgacagcgtagcagactaca

SEQ ID NO: 214901 - DNA, 25 bp, Rattus norvegicus
atttgtgacaggattgctctctgcg

SEQ ID NO: 214902 - DNA, 25 bp, Rattus norvegicus
atttgtgacaggtttgctctctgcg

SEQ ID NO: 214903 - DNA, 25 bp, Rattus norvegicus
atttgtgacctgactttgaaaatgt

SEQ ID NO: 214904 - DNA, 25 bp, Rattus norvegicus
atttgtgacctgtctttgaaaatgt

SEQ ID NO: 214905 - DNA, 25 bp, Rattus norvegicus
atttgtgactacacttcgacagcag

SEQ ID NO: 214906 - DNA, 25 bp, Rattus norvegicus
atttgtgactactcttcgacagcag

SEQ ID NO: 214907 - DNA, 25 bp, Rattus norvegicus
atttgtgagagcacgagcctgggat

SEQ ID NO: 214908 - DNA, 25 bp, Rattus norvegicus
atttgtgagagctcgagcctgggat

SEQ ID NO: 214909 - DNA, 25 bp, Rattus norvegicus
atttgtgagcacctgacctaaccgc

SEQ ID NO: 214910 - DNA, 25 bp, Rattus norvegicus
atttgtgagcacgtgacctaaccgc

SEQ ID NO: 214911 - DNA, 25 bp, Rattus norvegicus
atttgtgagcatcctcgtgctattt

SEQ ID NO: 214912 - DNA, 25 bp, Rattus norvegicus
atttgtgagcatgctcgtgctattt

SEQ ID NO: 214913 - DNA, 25 bp, Rattus norvegicus
atttgtgagcctcagtaagcccact

SEQ ID NO: 214914 - DNA, 25 bp, Rattus norvegicus
atttgtgagcctgagtaagcccact

SEQ ID NO: 214915 - DNA, 25 bp, Rattus norvegicus
atttgtgaggcaccatgtgtttgct

SEQ ID NO: 214916 - DNA, 25 bp, Rattus norvegicus
atttgtgaggcagcatgtgtttgct

SEQ ID NO: 214917 - DNA, 25 bp, Rattus norvegicus
atttgtgaggccacgaagtctctgc

SEQ ID NO: 214918 - DNA, 25 bp, Rattus norvegicus
atttgtgaggcctcgaagtctctgc

SEQ ID NO: 214919 - DNA, 25 bp, Rattus norvegicus
atttgtgaggtcaggatgcctgtga

SEQ ID NO: 214920 - DNA, 25 bp, Rattus norvegicus
atttgtgaggtctggatgcctgtga

SEQ ID NO: 214921 - DNA, 25 bp, Rattus norvegicus
atttgtgagtttctttccccattgt

SEQ ID NO: 214922 - DNA, 25 bp, Rattus norvegicus
atttgtgagtttgtttccccattgt

SEQ ID NO: 214923 - DNA, 25 bp, Rattus norvegicus
atttgtgatacaatgctgtgcccta

SEQ ID NO: 214924 - DNA, 25 bp, Rattus norvegicus
atttgtgatacattgctgtgcccta

SEQ ID NO: 214925 - DNA, 25 bp, Rattus norvegicus
atttgtgatggcatgttctccacca

SEQ ID NO: 214926 - DNA, 25 bp, Rattus norvegicus
atttgtgatggcttgttctccacca

SEQ ID NO: 214927 - DNA, 25 bp, Rattus norvegicus
atttgtgccgccagtacagtgatgc

SEQ ID NO: 214928 - DNA, 25 bp, Rattus norvegicus
atttgtgccgcctgtacagtgatgc

SEQ ID NO: 214929 - DNA, 25 bp, Rattus norvegicus
atttgtgctactacaaggtcttctt

SEQ ID NO: 214930 - DNA, 25 bp, Rattus norvegicus
atttgtgctacttcaaggtcttctt

SEQ ID NO: 214931 - DNA, 25 bp, Rattus norvegicus
atttgtgctggactctgtgaatcat

SEQ ID NO: 214932 - DNA, 25 bp, Rattus norvegicus
atttgtgctggagtctgtgaatcat

SEQ ID NO: 214933 - DNA, 25 bp, Rattus norvegicus
atttgtgctggtccatcgtgagtaa

SEQ ID NO: 214934 - DNA, 25 bp, Rattus norvegicus
atttgtgctggtgcatcgtgagtaa

SEQ ID NO: 214935 - DNA, 25 bp, Rattus norvegicus
atttgtgctgttaaatgctccgtca

SEQ ID NO: 214936 - DNA, 25 bp, Rattus norvegicus
atttgtgctgtttaatgctccgtca

SEQ ID NO: 214937 - DNA, 25 bp, Rattus norvegicus
atttgtgcttctattatccattagg

SEQ ID NO: 214938 - DNA, 25 bp, Rattus norvegicus
atttgtgcttcttttatccattagg

SEQ ID NO: 214939 - DNA, 25 bp, Rattus norvegicus
atttgtggagcacggtttaccttgc

SEQ ID NO: 214940 - DNA, 25 bp, Rattus norvegicus
atttgtggagcagggtttaccttgc

SEQ ID NO: 214941 - DNA, 25 bp, Rattus norvegicus
atttgtggatgtctcagcccctgca

SEQ ID NO: 214942 - DNA, 25 bp, Rattus norvegicus
atttgtggatgtgtcagcccctgca

SEQ ID NO: 214943 - DNA, 25 bp, Rattus norvegicus
atttgtggcactaaatctgatcctt

SEQ ID NO: 214944 - DNA, 25 bp, Rattus norvegicus
atttgtggcacttaatctgatcctt

SEQ ID NO: 214945 - DNA, 25 bp, Rattus norvegicus
atttgtggcaggattgtagcgaatt

SEQ ID NO: 214946 - DNA, 25 bp, Rattus norvegicus
atttgtggcaggtttgtagcgaatt

SEQ ID NO: 214947 - DNA, 25 bp, Rattus norvegicus
atttgtggcccactttaatccataa

SEQ ID NO: 214948 - DNA, 25 bp, Rattus norvegicus
atttgtggcccagtttaatccataa

SEQ ID NO: 214949 - DNA, 25 bp, Rattus norvegicus
atttgtggcgctatgtggctgatga

SEQ ID NO: 214950 - DNA, 25 bp, Rattus norvegicus
atttgtggcgctttgtggctgatga

SEQ ID NO: 214951 - DNA, 25 bp, Rattus norvegicus
atttgtggcgttcaagttggtctta

SEQ ID NO: 214952 - DNA, 25 bp, Rattus norvegicus
atttgtggcgttgaagttggtctta

SEQ ID NO: 214953 - DNA, 25 bp, Rattus norvegicus
atttgtgggcacatcgacactttga

SEQ ID NO: 214954 - DNA, 25 bp, Rattus norvegicus
atttgtgggcacttcgacactttga

SEQ ID NO: 214955 - DNA, 25 bp, Rattus norvegicus
atttgtgggtgcagggccttgcctc

SEQ ID NO: 214956 - DNA, 25 bp, Rattus norvegicus
atttgtgggtgctgggccttgcctc

SEQ ID NO: 214957 - DNA, 25 bp, Rattus norvegicus
atttgtggtgctctcaacctgtgtt

SEQ ID NO: 214958 - DNA, 25 bp, Rattus norvegicus
atttgtggtgctgtcaacctgtgtt

SEQ ID NO: 214959 - DNA, 25 bp, Rattus norvegicus
atttgtgtactacatccaggctggt

SEQ ID NO: 214960 - DNA, 25 bp, Rattus norvegicus
atttgtgtactagatccaggctggt

SEQ ID NO: 214961 - DNA, 25 bp, Rattus norvegicus
atttgtgtctggactcattcagaga

SEQ ID NO: 214962 - DNA, 25 bp, Rattus norvegicus
atttgtgtctggtctcattcagaga

SEQ ID NO: 214963 - DNA, 25 bp, Rattus norvegicus
atttgtgtgaatctattcccctctt

SEQ ID NO: 214964 - DNA, 25 bp, Rattus norvegicus
atttgtgtgaatgtattcccctctt

SEQ ID NO: 214965 - DNA, 25 bp, Rattus norvegicus
atttgtgtgatcaaggttcctccag

SEQ ID NO: 214966 - DNA, 25 bp, Rattus norvegicus
atttgtgtgatctaggttcctccag

SEQ ID NO: 214967 - DNA, 25 bp, Rattus norvegicus
atttgtgtggcacagagaggctact

SEQ ID NO: 214968 - DNA, 25 bp, Rattus norvegicus
atttgtgtggcagagagaggctact

SEQ ID NO: 214969 - DNA, 25 bp, Rattus norvegicus
atttgtgtgtgtcttctacctttct

SEQ ID NO: 214970 - DNA, 25 bp, Rattus norvegicus
atttgtgtgtgtgttctacctttct

SEQ ID NO: 214971 - DNA, 25 bp, Rattus norvegicus
atttgtgttgaccacatagcccaga

SEQ ID NO: 214972 - DNA, 25 bp, Rattus norvegicus
atttgtgttgacgacatagcccaga

SEQ ID NO: 214973 - DNA, 25 bp, Rattus norvegicus
atttgtgttgccaaatgactgtttc

SEQ ID NO: 214974 - DNA, 25 bp, Rattus norvegicus
atttgtgttgcctaatgactgtttc

SEQ ID NO: 214975 - DNA, 25 bp, Rattus norvegicus
atttgtgttggaacccaggtcacct

SEQ ID NO: 214976 - DNA, 25 bp, Rattus norvegicus
atttgtgttggatcccaggtcacct

SEQ ID NO: 214977 - DNA, 25 bp, Rattus norvegicus
atttgttaagccaccatttatcatg

SEQ ID NO: 214978 - DNA, 25 bp, Rattus norvegicus
atttgttaagcctccatttatcatg

SEQ ID NO: 214979 - DNA, 25 bp, Rattus norvegicus
atttgttaagtcatccaccgtctgg

SEQ ID NO: 214980 - DNA, 25 bp, Rattus norvegicus
atttgttaagtcttccaccgtctgg

SEQ ID NO: 214981 - DNA, 25 bp, Rattus norvegicus
atttgttatgtgattccacccctcc

SEQ ID NO: 214982 - DNA, 25 bp, Rattus norvegicus
atttgttatgtgtttccacccctcc

SEQ ID NO: 214983 - DNA, 25 bp, Rattus norvegicus
atttgttcatcacaggtggatccca

SEQ ID NO: 214984 - DNA, 25 bp, Rattus norvegicus
atttgttcatcagaggtggatccca

SEQ ID NO: 214985 - DNA, 25 bp, Rattus norvegicus
atttgttccggaactgctcgggttg

SEQ ID NO: 214986 - DNA, 25 bp, Rattus norvegicus
atttgttccggatctgctcgggttg

SEQ ID NO: 214987 - DNA, 25 bp, Rattus norvegicus
atttgttctcaaaccagggtgtcac

SEQ ID NO: 214988 - DNA, 25 bp, Rattus norvegicus
atttgttctcaatccagggtgtcac

SEQ ID NO: 214989 - DNA, 25 bp, Rattus norvegicus
atttgttctccaaatccccagagtt

SEQ ID NO: 214990 - DNA, 25 bp, Rattus norvegicus
atttgttctccatatccccagagtt

SEQ ID NO: 214991 - DNA, 25 bp, Rattus norvegicus
atttgttcttccaaatctctatgta

SEQ ID NO: 214992 - DNA, 25 bp, Rattus norvegicus
atttgttcttccctaggcgggcaag

SEQ ID NO: 214993 - DNA, 25 bp, Rattus norvegicus
atttgttcttccctttgagagttga

SEQ ID NO: 214994 - DNA, 25 bp, Rattus norvegicus
atttgttcttccgtaggcgggcaag

SEQ ID NO: 214995 - DNA, 25 bp, Rattus norvegicus
atttgttcttccgtttgagagttga

SEQ ID NO: 214996 - DNA, 25 bp, Rattus norvegicus
atttgttcttcctaatctctatgta

SEQ ID NO: 214997 - DNA, 25 bp, Rattus norvegicus
atttgttgaatgaacccgatcagag

SEQ ID NO: 214998 - DNA, 25 bp, Rattus norvegicus
atttgttgaatgtacccgatcagag

SEQ ID NO: 214999 - DNA, 25 bp, Rattus norvegicus
atttgttgacctaagtcccagcgaa

SEQ ID NO: 215000 - DNA, 25 bp, Rattus norvegicus
atttgttgaccttagtcccagcgaa

SEQ ID NO: 215001 - DNA, 25 bp, Rattus norvegicus
atttgttgagcaccttaacggccag

SEQ ID NO: 215002 - DNA, 25 bp, Rattus norvegicus
atttgttgagcagcttaacggccag

SEQ ID NO: 215003 - DNA, 25 bp, Rattus norvegicus
atttgttgagtgatacgtttctgac

SEQ ID NO: 215004 - DNA, 25 bp, Rattus norvegicus
atttgttgagtgttacgtttctgac

SEQ ID NO: 215005 - DNA, 25 bp, Rattus norvegicus
atttgttgcatactttgacttaaaa

SEQ ID NO: 215006 - DNA, 25 bp, Rattus norvegicus
atttgttgcatagtttgacttaaaa

SEQ ID NO: 215007 - DNA, 25 bp, Rattus norvegicus
atttgttgccatagattccttttta

SEQ ID NO: 215008 - DNA, 25 bp, Rattus norvegicus
atttgttgccattgattccttttta

SEQ ID NO: 215009 - DNA, 25 bp, Rattus norvegicus
atttgttgccccatatgggcagtta

SEQ ID NO: 215010 - DNA, 25 bp, Rattus norvegicus
atttgttgccccttatgggcagtta

SEQ ID NO: 215011 - DNA, 25 bp, Rattus norvegicus
atttgttgctaacgcagtcctcctg

SEQ ID NO: 215012 - DNA, 25 bp, Rattus norvegicus
atttgttgctaaggcagtcctcctg

SEQ ID NO: 215013 - DNA, 25 bp, Rattus norvegicus
atttgttgctctagcgaaggtccca

SEQ ID NO: 215014 - DNA, 25 bp, Rattus norvegicus
atttgttgctcttgcgaaggtccca

SEQ ID NO: 215015 - DNA, 25 bp, Rattus norvegicus
atttgttggaatctaccagcctcgt

SEQ ID NO: 215016 - DNA, 25 bp, Rattus norvegicus
atttgttggaatgtaccagcctcgt

SEQ ID NO: 215017 - DNA, 25 bp, Rattus norvegicus
atttgttgtataaggctatgctact

SEQ ID NO: 215018 - DNA, 25 bp, Rattus norvegicus
atttgttgtatatggctatgctact

SEQ ID NO: 215019 - DNA, 25 bp, Rattus norvegicus
atttgttgtgtcaaaagcctcccct

SEQ ID NO: 215020 - DNA, 25 bp, Rattus norvegicus
atttgttgtgtctaaagcctcccct

SEQ ID NO: 215021 - DNA, 25 bp, Rattus norvegicus
atttgttgtgtgacctccatcaagc

SEQ ID NO: 215022 - DNA, 25 bp, Rattus norvegicus
atttgttgtgtgtcctccatcaagc

SEQ ID NO: 215023 - DNA, 25 bp, Rattus norvegicus
atttgtttacataccactggtacct

SEQ ID NO: 215024 - DNA, 25 bp, Rattus norvegicus
atttgtttacattccactggtacct

SEQ ID NO: 215025 - DNA, 25 bp, Rattus norvegicus
atttgtttaccaatgaattttcaga

SEQ ID NO: 215026 - DNA, 25 bp, Rattus norvegicus
atttgtttaccattgaattttcaga

SEQ ID NO: 215027 - DNA, 25 bp, Rattus norvegicus
atttgtttcctgctcctgattatcc

SEQ ID NO: 215028 - DNA, 25 bp, Rattus norvegicus
atttgtttcctggtcctgattatcc

SEQ ID NO: 215029 - DNA, 25 bp, Rattus norvegicus
atttgtttctataccgtcactccat

SEQ ID NO: 215030 - DNA, 25 bp, Rattus norvegicus
atttgtttctattccgtcactccat

SEQ ID NO: 215031 - DNA, 25 bp, Rattus norvegicus
atttgtttctctattccagctttca

SEQ ID NO: 215032 - DNA, 25 bp, Rattus norvegicus
atttgtttctcttttccagctttca

SEQ ID NO: 215033 - DNA, 25 bp, Rattus norvegicus
atttgtttcttcaacagacctctcc

SEQ ID NO: 215034 - DNA, 25 bp, Rattus norvegicus
atttgtttcttctacagacctctcc

SEQ ID NO: 215035 - DNA, 25 bp, Rattus norvegicus
atttgtttctttcttggccagcaga

SEQ ID NO: 215036 - DNA, 25 bp, Rattus norvegicus
atttgtttctttgttggccagcaga

SEQ ID NO: 215037 - DNA, 25 bp, Rattus norvegicus
atttgtttgcatccgaattctacgt

SEQ ID NO: 215038 - DNA, 25 bp, Rattus norvegicus
atttgtttgcatgcgaattctacgt

SEQ ID NO: 215039 - DNA, 25 bp, Rattus norvegicus
atttgtttgtgtactcatttctcag

SEQ ID NO: 215040 - DNA, 25 bp, Rattus norvegicus
atttgtttgtgttctcatttctcag

SEQ ID NO: 215041 - DNA, 25 bp, Rattus norvegicus
atttgttttattaacctgtgcggtg

SEQ ID NO: 215042 - DNA, 25 bp, Rattus norvegicus
atttgttttatttacctgtgcggtg

SEQ ID NO: 215043 - DNA, 25 bp, Rattus norvegicus
attttaaactttctcatgctagggt

SEQ ID NO: 215044 - DNA, 25 bp, Rattus norvegicus
attttaaactttgtcatgctagggt

SEQ ID NO: 215045 - DNA, 25 bp, Rattus norvegicus
attttaaagaacacaggacctgcca

SEQ ID NO: 215046 - DNA, 25 bp, Rattus norvegicus
attttaaagaactcaggacctgcca

SEQ ID NO: 215047 - DNA, 25 bp, Rattus norvegicus
attttaaagttaaccttctgcctga

SEQ ID NO: 215048 - DNA, 25 bp, Rattus norvegicus
attttaaagttatccttctgcctga

SEQ ID NO: 215049 - DNA, 25 bp, Rattus norvegicus
attttaaatgatacctccccaacag

SEQ ID NO: 215050 - DNA, 25 bp, Rattus norvegicus
attttaaatgattcctccccaacag

SEQ ID NO: 215051 - DNA, 25 bp, Rattus norvegicus
attttaaccagactttctcaggccg

SEQ ID NO: 215052 - DNA, 25 bp, Rattus norvegicus
attttaaccagagtttctcaggccg

SEQ ID NO: 215053 - DNA, 25 bp, Rattus norvegicus
attttaacgccgatggcgctgctgc

SEQ ID NO: 215054 - DNA, 25 bp, Rattus norvegicus
attttaacgccgttggcgctgctgc

SEQ ID NO: 215055 - DNA, 25 bp, Rattus norvegicus
attttaactgatctacggactcaca

SEQ ID NO: 215056 - DNA, 25 bp, Rattus norvegicus
attttaactgatgtacggactcaca

SEQ ID NO: 215057 - DNA, 25 bp, Rattus norvegicus
attttaagcattatctcaatcatta

SEQ ID NO: 215058 - DNA, 25 bp, Rattus norvegicus
attttaagcattttctcaatcatta

SEQ ID NO: 215059 - DNA, 25 bp, Rattus norvegicus
attttaagttcgagcgggtgtgccg

SEQ ID NO: 215060 - DNA, 25 bp, Rattus norvegicus
attttaagttcgtgcgggtgtgccg

SEQ ID NO: 215061 - DNA, 25 bp, Rattus norvegicus
attttaataaacaccacctgattgg

SEQ ID NO: 215062 - DNA, 25 bp, Rattus norvegicus
attttaataaactccacctgattgg

SEQ ID NO: 215063 - DNA, 25 bp, Rattus norvegicus
attttaatccatcctttttgcactt

SEQ ID NO: 215064 - DNA, 25 bp, Rattus norvegicus
attttaatccatgctttttgcactt

SEQ ID NO: 215065 - DNA, 25 bp, Rattus norvegicus
attttaatgtctcgtggcatatgag

SEQ ID NO: 215066 - DNA, 25 bp, Rattus norvegicus
attttaatgtctggtggcatatgag

SEQ ID NO: 215067 - DNA, 25 bp, Rattus norvegicus
attttaattcacactgtctggtagg

SEQ ID NO: 215068 - DNA, 25 bp, Rattus norvegicus
attttaattcactctgtctggtagg

SEQ ID NO: 215069 - DNA, 25 bp, Rattus norvegicus
attttacaagccattccatcatcac

SEQ ID NO: 215070 - DNA, 25 bp, Rattus norvegicus
attttacaagcctttccatcatcac

SEQ ID NO: 215071 - DNA, 25 bp, Rattus norvegicus
attttacacattcctggagtcccga

SEQ ID NO: 215072 - DNA, 25 bp, Rattus norvegicus
attttacacattgctggagtcccga

SEQ ID NO: 215073 - DNA, 25 bp, Rattus norvegicus
attttacacccaatttgcccacagt

SEQ ID NO: 215074 - DNA, 25 bp, Rattus norvegicus
attttacacccattttgcccacagt

SEQ ID NO: 215075 - DNA, 25 bp, Rattus norvegicus
attttacacttgagctgctggctac

SEQ ID NO: 215076 - DNA, 25 bp, Rattus norvegicus
attttacacttgtgctgctggctac

SEQ ID NO: 215077 - DNA, 25 bp, Rattus norvegicus
attttacagcccacaaataatgcag

SEQ ID NO: 215078 - DNA, 25 bp, Rattus norvegicus
attttacagccctcaaataatgcag

SEQ ID NO: 215079 - DNA, 25 bp, Rattus norvegicus
attttacatgtactagcttctttat

SEQ ID NO: 215080 - DNA, 25 bp, Rattus norvegicus
attttacatgtagtagcttctttat

SEQ ID NO: 215081 - DNA, 25 bp, Rattus norvegicus
attttacattctcctttcatgaccc

SEQ ID NO: 215082 - DNA, 25 bp, Rattus norvegicus
attttacattctgctttcatgaccc

SEQ ID NO: 215083 - DNA, 25 bp, Rattus norvegicus
attttaccaactcggcttggcctca

SEQ ID NO: 215084 - DNA, 25 bp, Rattus norvegicus
attttaccaactgggcttggcctca

SEQ ID NO: 215085 - DNA, 25 bp, Rattus norvegicus
attttaccacctaggagggctctgc

SEQ ID NO: 215086 - DNA, 25 bp, Rattus norvegicus
attttaccaccttggagggctctgc

SEQ ID NO: 215087 - DNA, 25 bp, Rattus norvegicus
attttaccagcccatttcaggaaag

SEQ ID NO: 215088 - DNA, 25 bp, Rattus norvegicus
attttaccagccgatttcaggaaag

SEQ ID NO: 215089 - DNA, 25 bp, Rattus norvegicus
attttaccctttctcatcagtcttg

SEQ ID NO: 215090 - DNA, 25 bp, Rattus norvegicus
attttaccctttgtcatcagtcttg

SEQ ID NO: 215091 - DNA, 25 bp, Rattus norvegicus
attttaccgcatacctcatttttct

SEQ ID NO: 215092 - DNA, 25 bp, Rattus norvegicus
attttaccgcattcctcatttttct

SEQ ID NO: 215093 - DNA, 25 bp, Rattus norvegicus
attttacctatgactgtgactacca

SEQ ID NO: 215094 - DNA, 25 bp, Rattus norvegicus
attttacctatgtctgtgactacca

SEQ ID NO: 215095 - DNA, 25 bp, Rattus norvegicus
attttaccttcaagatgttctgcat

SEQ ID NO: 215096 - DNA, 25 bp, Rattus norvegicus
attttaccttcatgatgttctgcat

SEQ ID NO: 215097 - DNA, 25 bp, Rattus norvegicus
attttaccttttccacaattgtgct

SEQ ID NO: 215098 - DNA, 25 bp, Rattus norvegicus
attttaccttttgcacaattgtgct

SEQ ID NO: 215099 - DNA, 25 bp, Rattus norvegicus
attttactaccaactactactctgc

SEQ ID NO: 215100 - DNA, 25 bp, Rattus norvegicus
attttactaccatctactactctgc

SEQ ID NO: 215101 - DNA, 25 bp, Rattus norvegicus
attttactcagaccctgccaatgaa

SEQ ID NO: 215102 - DNA, 25 bp, Rattus norvegicus
attttactcagagcctgccaatgaa

SEQ ID NO: 215103 - DNA, 25 bp, Rattus norvegicus
attttactctgaaacgggccattgt

SEQ ID NO: 215104 - DNA, 25 bp, Rattus norvegicus
attttactctgatacgggccattgt

SEQ ID NO: 215105 - DNA, 25 bp, Rattus norvegicus
attttactgcccaactgaagtgtct

SEQ ID NO: 215106 - DNA, 25 bp, Rattus norvegicus
attttactgccctactgaagtgtct

SEQ ID NO: 215107 - DNA, 25 bp, Rattus norvegicus
attttactgttgaaacaaggccgag

SEQ ID NO: 215108 - DNA, 25 bp, Rattus norvegicus
attttactgttgtaacaaggccgag

SEQ ID NO: 215109 - DNA, 25 bp, Rattus norvegicus
attttacttatgacctgcccttcct

SEQ ID NO: 215110 - DNA, 25 bp, Rattus norvegicus
attttacttatgtcctgcccttcct

SEQ ID NO: 215111 - DNA, 25 bp, Rattus norvegicus
attttacttgcccaagcaggccaca

SEQ ID NO: 215112 - DNA, 25 bp, Rattus norvegicus
attttacttgccgaagcaggccaca

SEQ ID NO: 215113 - DNA, 25 bp, Rattus norvegicus
attttacttgtaagcgggagtgcct

SEQ ID NO: 215114 - DNA, 25 bp, Rattus norvegicus
attttacttgtatgcgggagtgcct

SEQ ID NO: 215115 - DNA, 25 bp, Rattus norvegicus
attttactttgcacttcatttcatg

SEQ ID NO: 215116 - DNA, 25 bp, Rattus norvegicus
attttactttgctcttcatttcatg

SEQ ID NO: 215117 - DNA, 25 bp, Rattus norvegicus
attttacttttcagccttgcttgat

SEQ ID NO: 215118 - DNA, 25 bp, Rattus norvegicus
attttacttttctgccttgcttgat

SEQ ID NO: 215119 - DNA, 25 bp, Rattus norvegicus
attttagaacaacctggcccgagtt

SEQ ID NO: 215120 - DNA, 25 bp, Rattus norvegicus
attttagaacaagctggcccgagtt

SEQ ID NO: 215121 - DNA, 25 bp, Rattus norvegicus
attttagaacccacaggcctttgct

SEQ ID NO: 215122 - DNA, 25 bp, Rattus norvegicus
attttagaaccctcaggcctttgct

SEQ ID NO: 215123 - DNA, 25 bp, Rattus norvegicus
attttagagggcacggccgctgtgc

SEQ ID NO: 215124 - DNA, 25 bp, Rattus norvegicus
attttagagggctcggccgctgtgc

SEQ ID NO: 215125 - DNA, 25 bp, Rattus norvegicus
attttagatgtaactggaccagttc

SEQ ID NO: 215126 - DNA, 25 bp, Rattus norvegicus
attttagatgtatctggaccagttc

SEQ ID NO: 215127 - DNA, 25 bp, Rattus norvegicus
attttagcaaggaggctggcatgta

SEQ ID NO: 215128 - DNA, 25 bp, Rattus norvegicus
attttagcaaggtggctggcatgta

SEQ ID NO: 215129 - DNA, 25 bp, Rattus norvegicus
attttagcactccagctagctttgg

SEQ ID NO: 215130 - DNA, 25 bp, Rattus norvegicus
attttagcactcgagctagctttgg

SEQ ID NO: 215131 - DNA, 25 bp, Rattus norvegicus
attttagcagccctggccgctttgg

SEQ ID NO: 215132 - DNA, 25 bp, Rattus norvegicus
attttagcagccgtggccgctttgg

SEQ ID NO: 215133 - DNA, 25 bp, Rattus norvegicus
attttagccaatcagtgagctctgt

SEQ ID NO: 215134 - DNA, 25 bp, Rattus norvegicus
attttagccaatgagtgagctctgt

SEQ ID NO: 215135 - DNA, 25 bp, Rattus norvegicus
attttagccattcgatccgcaacct

SEQ ID NO: 215136 - DNA, 25 bp, Rattus norvegicus
attttagccattggatccgcaacct

SEQ ID NO: 215137 - DNA, 25 bp, Rattus norvegicus
attttagctctgatctcactcttca

SEQ ID NO: 215138 - DNA, 25 bp, Rattus norvegicus
attttagctctgttctcactcttca

SEQ ID NO: 215139 - DNA, 25 bp, Rattus norvegicus
attttaggctggcagggtcctactt

SEQ ID NO: 215140 - DNA, 25 bp, Rattus norvegicus
attttaggctgggagggtcctactt

SEQ ID NO: 215141 - DNA, 25 bp, Rattus norvegicus
attttaggtcctactcacatacctg

SEQ ID NO: 215142 - DNA, 25 bp, Rattus norvegicus
attttaggtccttctcacatacctg

SEQ ID NO: 215143 - DNA, 25 bp, Rattus norvegicus
attttagtcattcgcgtctgcacct

SEQ ID NO: 215144 - DNA, 25 bp, Rattus norvegicus
attttagtcattggcgtctgcacct

SEQ ID NO: 215145 - DNA, 25 bp, Rattus norvegicus
attttataaatgcttcctaccgaga

SEQ ID NO: 215146 - DNA, 25 bp, Rattus norvegicus
attttataaatggttcctaccgaga

SEQ ID NO: 215147 - DNA, 25 bp, Rattus norvegicus
attttatagcatcatcttccactgg

SEQ ID NO: 215148 - DNA, 25 bp, Rattus norvegicus
attttatagcatgatcttccactgg

SEQ ID NO: 215149 - DNA, 25 bp, Rattus norvegicus
attttatatatccttacagctctaa

SEQ ID NO: 215150 - DNA, 25 bp, Rattus norvegicus
attttatatatcgttacagctctaa

SEQ ID NO: 215151 - DNA, 25 bp, Rattus norvegicus
attttatatcctcaagccccagatg

SEQ ID NO: 215152 - DNA, 25 bp, Rattus norvegicus
attttatatcctgaagccccagatg

SEQ ID NO: 215153 - DNA, 25 bp, Rattus norvegicus
attttatatgctcagggtagcccat

SEQ ID NO: 215154 - DNA, 25 bp, Rattus norvegicus
attttatatgctgagggtagcccat

SEQ ID NO: 215155 - DNA, 25 bp, Rattus norvegicus
attttatcaattacggccctttctg

SEQ ID NO: 215156 - DNA, 25 bp, Rattus norvegicus
attttatcaatttcggccctttctg

SEQ ID NO: 215157 - DNA, 25 bp, Rattus norvegicus
attttatcagaactgtctccctgtg

SEQ ID NO: 215158 - DNA, 25 bp, Rattus norvegicus
attttatcagaagtgtctccctgtg

SEQ ID NO: 215159 - DNA, 25 bp, Rattus norvegicus
attttatcagctatcagtcccttcc

SEQ ID NO: 215160 - DNA, 25 bp, Rattus norvegicus
attttatcagctttcagtcccttcc

SEQ ID NO: 215161 - DNA, 25 bp, Rattus norvegicus
attttatcaggcctctccttggtgg

SEQ ID NO: 215162 - DNA, 25 bp, Rattus norvegicus
attttatcaggcgtctccttggtgg

SEQ ID NO: 215163 - DNA, 25 bp, Rattus norvegicus
attttatcagttacacccttgccag

SEQ ID NO: 215164 - DNA, 25 bp, Rattus norvegicus
attttatcagtttcacccttgccag

SEQ ID NO: 215165 - DNA, 25 bp, Rattus norvegicus
attttatcatgtatactgccccgac

SEQ ID NO: 215166 - DNA, 25 bp, Rattus norvegicus
attttatcatgtttactgccccgac

SEQ ID NO: 215167 - DNA, 25 bp, Rattus norvegicus
attttatcctccacataatctgtcc

SEQ ID NO: 215168 - DNA, 25 bp, Rattus norvegicus
attttatcctcctcataatctgtcc

SEQ ID NO: 215169 - DNA, 25 bp, Rattus norvegicus
attttatcctctctgctgaagacag

SEQ ID NO: 215170 - DNA, 25 bp, Rattus norvegicus
attttatcctctgtgctgaagacag

SEQ ID NO: 215171 - DNA, 25 bp, Rattus norvegicus
attttatctgagacattcccagctc

SEQ ID NO: 215172 - DNA, 25 bp, Rattus norvegicus
attttatctgagtcattcccagctc

SEQ ID NO: 215173 - DNA, 25 bp, Rattus norvegicus
attttatctgtgagtcccatggtgc

SEQ ID NO: 215174 - DNA, 25 bp, Rattus norvegicus
attttatctgtgtgtcccatggtgc

SEQ ID NO: 215175 - DNA, 25 bp, Rattus norvegicus
attttatgaagtaagtgcgggcttt

SEQ ID NO: 215176 - DNA, 25 bp, Rattus norvegicus
attttatgaagttagtgcgggcttt

SEQ ID NO: 215177 - DNA, 25 bp, Rattus norvegicus
attttatgagccagctttgcttctc

SEQ ID NO: 215178 - DNA, 25 bp, Rattus norvegicus
attttatgagcctgctttgcttctc

SEQ ID NO: 215179 - DNA, 25 bp, Rattus norvegicus
attttatgcaccctgtggagtccat

SEQ ID NO: 215180 - DNA, 25 bp, Rattus norvegicus
attttatgcaccgtgtggagtccat

SEQ ID NO: 215181 - DNA, 25 bp, Rattus norvegicus
attttatgccctcagaacatgctaa

SEQ ID NO: 215182 - DNA, 25 bp, Rattus norvegicus
attttatgccctgagaacatgctaa

SEQ ID NO: 215183 - DNA, 25 bp, Rattus norvegicus
attttatggagtcaggagcttggct

SEQ ID NO: 215184 - DNA, 25 bp, Rattus norvegicus
attttatggagtgaggagcttggct

SEQ ID NO: 215185 - DNA, 25 bp, Rattus norvegicus
attttatggcctcagtccactagcc

SEQ ID NO: 215186 - DNA, 25 bp, Rattus norvegicus
attttatggcctgagtccactagcc

SEQ ID NO: 215187 - DNA, 25 bp, Rattus norvegicus
attttatggctactctcctggttac

SEQ ID NO: 215188 - DNA, 25 bp, Rattus norvegicus
attttatggctagtctcctggttac

SEQ ID NO: 215189 - DNA, 25 bp, Rattus norvegicus
attttatggtctatcttcctcaaag

SEQ ID NO: 215190 - DNA, 25 bp, Rattus norvegicus
attttatggtctttcttcctcaaag

SEQ ID NO: 215191 - DNA, 25 bp, Rattus norvegicus
attttatgttctacaggagcctagg

SEQ ID NO: 215192 - DNA, 25 bp, Rattus norvegicus
attttatgttcttcaggagcctagg

SEQ ID NO: 215193 - DNA, 25 bp, Rattus norvegicus
attttattgactcgttgcccttgcc

SEQ ID NO: 215194 - DNA, 25 bp, Rattus norvegicus
attttattgactggttgcccttgcc

SEQ ID NO: 215195 - DNA, 25 bp, Rattus norvegicus
attttattgcctccttaacggtcca

SEQ ID NO: 215196 - DNA, 25 bp, Rattus norvegicus
attttattgcctgcttaacggtcca

SEQ ID NO: 215197 - DNA, 25 bp, Rattus norvegicus
attttattgttaacttccaggtgtc

SEQ ID NO: 215198 - DNA, 25 bp, Rattus norvegicus
attttattgttatcttccaggtgtc

SEQ ID NO: 215199 - DNA, 25 bp, Rattus norvegicus
attttatttacccatgagcactcag

SEQ ID NO: 215200 - DNA, 25 bp, Rattus norvegicus
attttatttaccgatgagcactcag

SEQ ID NO: 215201 - DNA, 25 bp, Rattus norvegicus
attttatttctaactgcattgttca

SEQ ID NO: 215202 - DNA, 25 bp, Rattus norvegicus
attttatttctatctgcattgttca

SEQ ID NO: 215203 - DNA, 25 bp, Rattus norvegicus
attttattttcactcgccatgtttg

SEQ ID NO: 215204 - DNA, 25 bp, Rattus norvegicus
attttattttcagtcgccatgtttg

SEQ ID NO: 215205 - DNA, 25 bp, Rattus norvegicus
attttcaaaatcagtcctcccggag

SEQ ID NO: 215206 - DNA, 25 bp, Rattus norvegicus
attttcaaaatctgtcctcccggag

SEQ ID NO: 215207 - DNA, 25 bp, Rattus norvegicus
attttcaaactgctggacatcgaga

SEQ ID NO: 215208 - DNA, 25 bp, Rattus norvegicus
attttcaaactggtggacatcgaga

SEQ ID NO: 215209 - DNA, 25 bp, Rattus norvegicus
attttcaaacttaagagccccacag

SEQ ID NO: 215210 - DNA, 25 bp, Rattus norvegicus
attttcaaactttagagccccacag

SEQ ID NO: 215211 - DNA, 25 bp, Rattus norvegicus
attttcaacacccatgcctattttt

SEQ ID NO: 215212 - DNA, 25 bp, Rattus norvegicus
attttcaacaccgatgcctattttt

SEQ ID NO: 215213 - DNA, 25 bp, Rattus norvegicus
attttcaacgccctaatgcactgtc

SEQ ID NO: 215214 - DNA, 25 bp, Rattus norvegicus
attttcaacgccgtaatgcactgtc

SEQ ID NO: 215215 - DNA, 25 bp, Rattus norvegicus
attttcaagaaactctccatcccag

SEQ ID NO: 215216 - DNA, 25 bp, Rattus norvegicus
attttcaagaaagtctccatcccag

SEQ ID NO: 215217 - DNA, 25 bp, Rattus norvegicus
attttcaattagctactgccagtaa

SEQ ID NO: 215218 - DNA, 25 bp, Rattus norvegicus
attttcaattaggtactgccagtaa

SEQ ID NO: 215219 - DNA, 25 bp, Rattus norvegicus
attttcacaaagatcatgtatcatt

SEQ ID NO: 215220 - DNA, 25 bp, Rattus norvegicus
attttcacaaagttcatgtatcatt

SEQ ID NO: 215221 - DNA, 25 bp, Rattus norvegicus
attttcacacgtattgttgccacac

SEQ ID NO: 215222 - DNA, 25 bp, Rattus norvegicus
attttcacacgttttgttgccacac

SEQ ID NO: 215223 - DNA, 25 bp, Rattus norvegicus
attttcacattgaagtcaacctgaa

SEQ ID NO: 215224 - DNA, 25 bp, Rattus norvegicus
attttcacattgtagtcaacctgaa

SEQ ID NO: 215225 - DNA, 25 bp, Rattus norvegicus
attttcacctaaattgcccattctc

SEQ ID NO: 215226 - DNA, 25 bp, Rattus norvegicus
attttcacctaatttgcccattctc

SEQ ID NO: 215227 - DNA, 25 bp, Rattus norvegicus
attttcacggctccggttcagtcaa

SEQ ID NO: 215228 - DNA, 25 bp, Rattus norvegicus
attttcacggctgcggttcagtcaa

SEQ ID NO: 215229 - DNA, 25 bp, Rattus norvegicus
attttcacgtggagcctgactgcag

SEQ ID NO: 215230 - DNA, 25 bp, Rattus norvegicus
attttcacgtggtgcctgactgcag

SEQ ID NO: 215231 - DNA, 25 bp, Rattus norvegicus
attttcactattctgcctaggcttt

SEQ ID NO: 215232 - DNA, 25 bp, Rattus norvegicus
attttcactattgtgcctaggcttt

SEQ ID NO: 215233 - DNA, 25 bp, Rattus norvegicus
attttcagactgatcttccttctct

SEQ ID NO: 215234 - DNA, 25 bp, Rattus norvegicus
attttcagactgttcttccttctct

SEQ ID NO: 215235 - DNA, 25 bp, Rattus norvegicus
attttcagacttagcagtgcctcgg

SEQ ID NO: 215236 - DNA, 25 bp, Rattus norvegicus
attttcagactttgcagtgcctcgg

SEQ ID NO: 215237 - DNA, 25 bp, Rattus norvegicus
attttcagcagacccagtgagtcac

SEQ ID NO: 215238 - DNA, 25 bp, Rattus norvegicus
attttcagcagagccagtgagtcac

SEQ ID NO: 215239 - DNA, 25 bp, Rattus norvegicus
attttcagccttagatgcccactca

SEQ ID NO: 215240 - DNA, 25 bp, Rattus norvegicus
attttcagcctttgatgcccactca

SEQ ID NO: 215241 - DNA, 25 bp, Rattus norvegicus
attttcagctccacgctacaaatag

SEQ ID NO: 215242 - DNA, 25 bp, Rattus norvegicus
attttcagctcctcgctacaaatag

SEQ ID NO: 215243 - DNA, 25 bp, Rattus norvegicus
attttcagctctagtcatagccctt

SEQ ID NO: 215244 - DNA, 25 bp, Rattus norvegicus
attttcagctcttgtcatagccctt

SEQ ID NO: 215245 - DNA, 25 bp, Rattus norvegicus
attttcagcttaccatgccaaggca

SEQ ID NO: 215246 - DNA, 25 bp, Rattus norvegicus
attttcagcttagcatgccaaggca

SEQ ID NO: 215247 - DNA, 25 bp, Rattus norvegicus
attttcaggaaccaatgcttagtga

SEQ ID NO: 215248 - DNA, 25 bp, Rattus norvegicus
attttcaggaacgaatgcttagtga

SEQ ID NO: 215249 - DNA, 25 bp, Rattus norvegicus
attttcaggagaagccttccttctc

SEQ ID NO: 215250 - DNA, 25 bp, Rattus norvegicus
attttcaggagatgccttccttctc

SEQ ID NO: 215251 - DNA, 25 bp, Rattus norvegicus
attttcagggaaataccatgctcct

SEQ ID NO: 215252 - DNA, 25 bp, Rattus norvegicus
attttcagggaattaccatgctcct

SEQ ID NO: 215253 - DNA, 25 bp, Rattus norvegicus
attttcaggtttatgagccgagccg

SEQ ID NO: 215254 - DNA, 25 bp, Rattus norvegicus
attttcaggtttttgagccgagccg

SEQ ID NO: 215255 - DNA, 25 bp, Rattus norvegicus
attttcagtgtacctttgggtcctt

SEQ ID NO: 215256 - DNA, 25 bp, Rattus norvegicus
attttcagtgtagctttgggtcctt

SEQ ID NO: 215257 - DNA, 25 bp, Rattus norvegicus
attttcatacataaaagccggagca

SEQ ID NO: 215258 - DNA, 25 bp, Rattus norvegicus
attttcatacattaaagccggagca

SEQ ID NO: 215259 - DNA, 25 bp, Rattus norvegicus
attttcatactgatctctatttttg

SEQ ID NO: 215260 - DNA, 25 bp, Rattus norvegicus
attttcatactgttctctatttttg

SEQ ID NO: 215261 - DNA, 25 bp, Rattus norvegicus
attttcatattcactgatcgttgga

SEQ ID NO: 215262 - DNA, 25 bp, Rattus norvegicus
attttcatattctctgatcgttgga

SEQ ID NO: 215263 - DNA, 25 bp, Rattus norvegicus
attttcatatttaccagctctagat

SEQ ID NO: 215264 - DNA, 25 bp, Rattus norvegicus
attttcatattttccagctctagat

SEQ ID NO: 215265 - DNA, 25 bp, Rattus norvegicus
attttcatcattacagtcacctttg

SEQ ID NO: 215266 - DNA, 25 bp, Rattus norvegicus
attttcatcatttcagtcacctttg

SEQ ID NO: 215267 - DNA, 25 bp, Rattus norvegicus
attttcatccttacaatattcacta

SEQ ID NO: 215268 - DNA, 25 bp, Rattus norvegicus
attttcatcctttcaatattcacta

SEQ ID NO: 215269 - DNA, 25 bp, Rattus norvegicus
attttcatctggctaacatgctaat

SEQ ID NO: 215270 - DNA, 25 bp, Rattus norvegicus
attttcatctgggtaacatgctaat

SEQ ID NO: 215271 - DNA, 25 bp, Rattus norvegicus
attttcatcttcctgttttctaggc

SEQ ID NO: 215272 - DNA, 25 bp, Rattus norvegicus
attttcatcttcgtgttttctaggc

SEQ ID NO: 215273 - DNA, 25 bp, Rattus norvegicus
attttcatgaccatggcttcatcca

SEQ ID NO: 215274 - DNA, 25 bp, Rattus norvegicus
attttcatgaccttggcttcatcca

SEQ ID NO: 215275 - DNA, 25 bp, Rattus norvegicus
attttcattggtaattcagcagtgc

SEQ ID NO: 215276 - DNA, 25 bp, Rattus norvegicus
attttcattggttattcagcagtgc

SEQ ID NO: 215277 - DNA, 25 bp, Rattus norvegicus
attttcatttccatctttcaccttg

SEQ ID NO: 215278 - DNA, 25 bp, Rattus norvegicus
attttcatttccttctttcaccttg

SEQ ID NO: 215279 - DNA, 25 bp, Rattus norvegicus
attttccaaatgactgatacaccag

SEQ ID NO: 215280 - DNA, 25 bp, Rattus norvegicus
attttccaaatgtctgatacaccag

SEQ ID NO: 215281 - DNA, 25 bp, Rattus norvegicus
attttccaagccactgtggagccag

SEQ ID NO: 215282 - DNA, 25 bp, Rattus norvegicus
attttccaagcccaagcctggagcc

SEQ ID NO: 215283 - DNA, 25 bp, Rattus norvegicus
attttccaagccgaagcctggagcc

SEQ ID NO: 215284 - DNA, 25 bp, Rattus norvegicus
attttccaagcctctgtggagccag

SEQ ID NO: 215285 - DNA, 25 bp, Rattus norvegicus
attttccaagtacaagagccccact

SEQ ID NO: 215286 - DNA, 25 bp, Rattus norvegicus
attttccaagtagaagagccccact

SEQ ID NO: 215287 - DNA, 25 bp, Rattus norvegicus
attttccacagaaacactgcctttt

SEQ ID NO: 215288 - DNA, 25 bp, Rattus norvegicus
attttccacagatacactgcctttt

SEQ ID NO: 215289 - DNA, 25 bp, Rattus norvegicus
attttccacgcccatatggtgccca

SEQ ID NO: 215290 - DNA, 25 bp, Rattus norvegicus
attttccacgccgatatggtgccca

SEQ ID NO: 215291 - DNA, 25 bp, Rattus norvegicus
attttccacgtgaacaatagacctg

SEQ ID NO: 215292 - DNA, 25 bp, Rattus norvegicus
attttccacgtgtacaatagacctg

SEQ ID NO: 215293 - DNA, 25 bp, Rattus norvegicus
attttccagacaattcctagtgcta

SEQ ID NO: 215294 - DNA, 25 bp, Rattus norvegicus
attttccagacatttcctagtgcta

SEQ ID NO: 215295 - DNA, 25 bp, Rattus norvegicus
attttccagcaaagatgtatctctc

SEQ ID NO: 215296 - DNA, 25 bp, Rattus norvegicus
attttccagcaatgatgtatctctc

SEQ ID NO: 215297 - DNA, 25 bp, Rattus norvegicus
attttccagggcaatatcagactat

SEQ ID NO: 215298 - DNA, 25 bp, Rattus norvegicus
attttccagggctatatcagactat

SEQ ID NO: 215299 - DNA, 25 bp, Rattus norvegicus
attttccaggtgaccccactgagtg

SEQ ID NO: 215300 - DNA, 25 bp, Rattus norvegicus
attttccaggtgtccccactgagtg

SEQ ID NO: 215301 - DNA, 25 bp, Rattus norvegicus
attttccagtccaaagagtcttctt

SEQ ID NO: 215302 - DNA, 25 bp, Rattus norvegicus
attttccagtcctaagagtcttctt

SEQ ID NO: 215303 - DNA, 25 bp, Rattus norvegicus
attttccagtctacttccttcaatt

SEQ ID NO: 215304 - DNA, 25 bp, Rattus norvegicus
attttccagtcttcttccttcaatt

SEQ ID NO: 215305 - DNA, 25 bp, Rattus norvegicus
attttccatcttctattcagtttaa

SEQ ID NO: 215306 - DNA, 25 bp, Rattus norvegicus
attttccatcttgtattcagtttaa

SEQ ID NO: 215307 - DNA, 25 bp, Rattus norvegicus
attttccatggaaggctgcccctaa

SEQ ID NO: 215308 - DNA, 25 bp, Rattus norvegicus
attttccatggatggctgcccctaa

SEQ ID NO: 215309 - DNA, 25 bp, Rattus norvegicus
attttccattccagaaacggatgta

SEQ ID NO: 215310 - DNA, 25 bp, Rattus norvegicus
attttccattcctgaaacggatgta

SEQ ID NO: 215311 - DNA, 25 bp, Rattus norvegicus
attttccattgcaaaagcctcagag

SEQ ID NO: 215312 - DNA, 25 bp, Rattus norvegicus
attttccattgctaaagcctcagag

SEQ ID NO: 215313 - DNA, 25 bp, Rattus norvegicus
attttcccaccacctgggttcttag

SEQ ID NO: 215314 - DNA, 25 bp, Rattus norvegicus
attttcccaccagctgggttcttag

SEQ ID NO: 215315 - DNA, 25 bp, Rattus norvegicus
attttcccactacagttactctatc

SEQ ID NO: 215316 - DNA, 25 bp, Rattus norvegicus
attttcccactagagttactctatc

SEQ ID NO: 215317 - DNA, 25 bp, Rattus norvegicus
attttcccagatctttacagactgt

SEQ ID NO: 215318 - DNA, 25 bp, Rattus norvegicus
attttcccagatgtttacagactgt

SEQ ID NO: 215319 - DNA, 25 bp, Rattus norvegicus
attttcccatcaacctttgttctga

SEQ ID NO: 215320 - DNA, 25 bp, Rattus norvegicus
attttcccatcatcctttgttctga

SEQ ID NO: 215321 - DNA, 25 bp, Rattus norvegicus
attttcccatgaatcccgagatgta

SEQ ID NO: 215322 - DNA, 25 bp, Rattus norvegicus
attttcccatgattcccgagatgta

SEQ ID NO: 215323 - DNA, 25 bp, Rattus norvegicus
attttccccagtagagacagttcac

SEQ ID NO: 215324 - DNA, 25 bp, Rattus norvegicus
attttccccagttgagacagttcac

SEQ ID NO: 215325 - DNA, 25 bp, Rattus norvegicus
attttcccctagaatttcattcatg

SEQ ID NO: 215326 - DNA, 25 bp, Rattus norvegicus
attttcccctagtatttcattcatg

SEQ ID NO: 215327 - DNA, 25 bp, Rattus norvegicus
attttccctccacttcagtattgtg

SEQ ID NO: 215328 - DNA, 25 bp, Rattus norvegicus
attttccctccagttcagtattgtg

SEQ ID NO: 215329 - DNA, 25 bp, Rattus norvegicus
attttccctgagattctcaaggagt

SEQ ID NO: 215330 - DNA, 25 bp, Rattus norvegicus
attttccctgagtttctcaaggagt

SEQ ID NO: 215331 - DNA, 25 bp, Rattus norvegicus
attttccctggacatggtcacctgc

SEQ ID NO: 215332 - DNA, 25 bp, Rattus norvegicus
attttccctggagatggtcacctgc

SEQ ID NO: 215333 - DNA, 25 bp, Rattus norvegicus
attttccctgtgatgcttgtggtgc

SEQ ID NO: 215334 - DNA, 25 bp, Rattus norvegicus
attttccctgtgcaagtgcacttat

SEQ ID NO: 215335 - DNA, 25 bp, Rattus norvegicus
attttccctgtggaagtgcacttat

SEQ ID NO: 215336 - DNA, 25 bp, Rattus norvegicus
attttccctgtgttgcttgtggtgc

SEQ ID NO: 215337 - DNA, 25 bp, Rattus norvegicus
attttccgacaccagtgacgtcaag

SEQ ID NO: 215338 - DNA, 25 bp, Rattus norvegicus
attttccgacacgagtgacgtcaag

SEQ ID NO: 215339 - DNA, 25 bp, Rattus norvegicus
attttccgagagactgttcccttag

SEQ ID NO: 215340 - DNA, 25 bp, Rattus norvegicus
attttccgagagtctgttcccttag

SEQ ID NO: 215341 - DNA, 25 bp, Rattus norvegicus
attttccgagttatgtggccaccag

SEQ ID NO: 215342 - DNA, 25 bp, Rattus norvegicus
attttccgagttttgtggccaccag

SEQ ID NO: 215343 - DNA, 25 bp, Rattus norvegicus
attttccggcggatgccatagtata

SEQ ID NO: 215344 - DNA, 25 bp, Rattus norvegicus
attttccggcggttgccatagtata

SEQ ID NO: 215345 - DNA, 25 bp, Rattus norvegicus
attttccgtttaattattgctcagc

SEQ ID NO: 215346 - DNA, 25 bp, Rattus norvegicus
attttccgtttatttattgctcagc

SEQ ID NO: 215347 - DNA, 25 bp, Rattus norvegicus
attttcctatttaatgctctgctaa

SEQ ID NO: 215348 - DNA, 25 bp, Rattus norvegicus
attttcctattttatgctctgctaa

SEQ ID NO: 215349 - DNA, 25 bp, Rattus norvegicus
attttcctcaataccccataatggg

SEQ ID NO: 215350 - DNA, 25 bp, Rattus norvegicus
attttcctcaattccccataatggg

SEQ ID NO: 215351 - DNA, 25 bp, Rattus norvegicus
attttcctcatacctcttccaggtt

SEQ ID NO: 215352 - DNA, 25 bp, Rattus norvegicus
attttcctcatagctcttccaggtt

SEQ ID NO: 215353 - DNA, 25 bp, Rattus norvegicus
attttcctcccaagaagaactcgct

SEQ ID NO: 215354 - DNA, 25 bp, Rattus norvegicus
attttcctcccatgaagaactcgct

SEQ ID NO: 215355 - DNA, 25 bp, Rattus norvegicus
attttcctgaaaacttgagccattg

SEQ ID NO: 215356 - DNA, 25 bp, Rattus norvegicus
attttcctgaaatcttgagccattg

SEQ ID NO: 215357 - DNA, 25 bp, Rattus norvegicus
attttcctgcaaaggatgactccag

SEQ ID NO: 215358 - DNA, 25 bp, Rattus norvegicus
attttcctgcaatggatgactccag

SEQ ID NO: 215359 - DNA, 25 bp, Rattus norvegicus
attttcctggatactctggaggagc

SEQ ID NO: 215360 - DNA, 25 bp, Rattus norvegicus
attttcctggattctctggaggagc

SEQ ID NO: 215361 - DNA, 25 bp, Rattus norvegicus
attttcctgtccactcgagagcggg

SEQ ID NO: 215362 - DNA, 25 bp, Rattus norvegicus
attttcctgtcctctcgagagcggg

SEQ ID NO: 215363 - DNA, 25 bp, Rattus norvegicus
attttcctgtgtcccatcctgcttt

SEQ ID NO: 215364 - DNA, 25 bp, Rattus norvegicus
attttcctgtgtgccatcctgcttt

SEQ ID NO: 215365 - DNA, 25 bp, Rattus norvegicus
attttccttacccagaatgcctctg

SEQ ID NO: 215366 - DNA, 25 bp, Rattus norvegicus
attttccttaccgagaatgcctctg

SEQ ID NO: 215367 - DNA, 25 bp, Rattus norvegicus
attttcgacagcattgtctcctgtt

SEQ ID NO: 215368 - DNA, 25 bp, Rattus norvegicus
attttcgacagctttgtctcctgtt

SEQ ID NO: 215369 - DNA, 25 bp, Rattus norvegicus
attttcgagagcactttgaaccccg

SEQ ID NO: 215370 - DNA, 25 bp, Rattus norvegicus
attttcgagagctctttgaaccccg

SEQ ID NO: 215371 - DNA, 25 bp, Rattus norvegicus
attttcgatctcagagttgcacctc

SEQ ID NO: 215372 - DNA, 25 bp, Rattus norvegicus
attttcgatctctgagttgcacctc

SEQ ID NO: 215373 - DNA, 25 bp, Rattus norvegicus
attttcgcctacatcagtggttcta

SEQ ID NO: 215374 - DNA, 25 bp, Rattus norvegicus
attttcgcctacttcagtggttcta

SEQ ID NO: 215375 - DNA, 25 bp, Rattus norvegicus
attttcgcgtccaagatacacatga

SEQ ID NO: 215376 - DNA, 25 bp, Rattus norvegicus
attttcgcgtcctagatacacatga

SEQ ID NO: 215377 - DNA, 25 bp, Rattus norvegicus
attttcggccacagctgtgtttaat

SEQ ID NO: 215378 - DNA, 25 bp, Rattus norvegicus
attttcggccactgctgtgtttaat

SEQ ID NO: 215379 - DNA, 25 bp, Rattus norvegicus
attttcggcctgagacaaatgacag

SEQ ID NO: 215380 - DNA, 25 bp, Rattus norvegicus
attttcggcctgtgacaaatgacag

SEQ ID NO: 215381 - DNA, 25 bp, Rattus norvegicus
attttcgtaatgaattttcttgctg

SEQ ID NO: 215382 - DNA, 25 bp, Rattus norvegicus
attttcgtaatgtattttcttgctg

SEQ ID NO: 215383 - DNA, 25 bp, Rattus norvegicus
attttcgtattcataactgcacagg

SEQ ID NO: 215384 - DNA, 25 bp, Rattus norvegicus
attttcgtattcttaactgcacagg

SEQ ID NO: 215385 - DNA, 25 bp, Rattus norvegicus
attttcgtgcataagttcccatgac

SEQ ID NO: 215386 - DNA, 25 bp, Rattus norvegicus
attttcgtgcattagttcccatgac

SEQ ID NO: 215387 - DNA, 25 bp, Rattus norvegicus
attttcgtgtttccagagctctgag

SEQ ID NO: 215388 - DNA, 25 bp, Rattus norvegicus
attttcgtgtttgcagagctctgag

SEQ ID NO: 215389 - DNA, 25 bp, Rattus norvegicus
attttctacaccagatctgcttggc

SEQ ID NO: 215390 - DNA, 25 bp, Rattus norvegicus
attttctacacctgatctgcttggc

SEQ ID NO: 215391 - DNA, 25 bp, Rattus norvegicus
attttctacagactcacatgggcag

SEQ ID NO: 215392 - DNA, 25 bp, Rattus norvegicus
attttctacagagtcacatgggcag

SEQ ID NO: 215393 - DNA, 25 bp, Rattus norvegicus
attttctaccccattgaccatttct

SEQ ID NO: 215394 - DNA, 25 bp, Rattus norvegicus
attttctacccctttgaccatttct

SEQ ID NO: 215395 - DNA, 25 bp, Rattus norvegicus
attttctatcagacattcccaggga

SEQ ID NO: 215396 - DNA, 25 bp, Rattus norvegicus
attttctatcagtcattcccaggga

SEQ ID NO: 215397 - DNA, 25 bp, Rattus norvegicus
attttctatccactcgactgtgaca

SEQ ID NO: 215398 - DNA, 25 bp, Rattus norvegicus
attttctatccagtcgactgtgaca

SEQ ID NO: 215399 - DNA, 25 bp, Rattus norvegicus
attttctatggcaccagaactgctc

SEQ ID NO: 215400 - DNA, 25 bp, Rattus norvegicus
attttctatggctccagaactgctc

SEQ ID NO: 215401 - DNA, 25 bp, Rattus norvegicus
attttctatgggagacaggtgcccc

SEQ ID NO: 215402 - DNA, 25 bp, Rattus norvegicus
attttctatgggtgacaggtgcccc

SEQ ID NO: 215403 - DNA, 25 bp, Rattus norvegicus
attttctattatctcctgtgccctg

SEQ ID NO: 215404 - DNA, 25 bp, Rattus norvegicus
attttctattatgtcctgtgccctg

SEQ ID NO: 215405 - DNA, 25 bp, Rattus norvegicus
attttctcaatgatacagtgattca

SEQ ID NO: 215406 - DNA, 25 bp, Rattus norvegicus
attttctcaatgttacagtgattca

SEQ ID NO: 215407 - DNA, 25 bp, Rattus norvegicus
attttctcacatcgccactggactt

SEQ ID NO: 215408 - DNA, 25 bp, Rattus norvegicus
attttctcacatggccactggactt

SEQ ID NO: 215409 - DNA, 25 bp, Rattus norvegicus
attttctcagccaggcgacttattg

SEQ ID NO: 215410 - DNA, 25 bp, Rattus norvegicus
attttctcagcctggcgacttattg

SEQ ID NO: 215411 - DNA, 25 bp, Rattus norvegicus
attttctcataaaccaagtggctag

SEQ ID NO: 215412 - DNA, 25 bp, Rattus norvegicus
attttctcataatccaagtggctag

SEQ ID NO: 215413 - DNA, 25 bp, Rattus norvegicus
attttctcatgtccatacgtaacaa

SEQ ID NO: 215414 - DNA, 25 bp, Rattus norvegicus
attttctcatgtgcatacgtaacaa

SEQ ID NO: 215415 - DNA, 25 bp, Rattus norvegicus
attttctcattgactgaaccctctt

SEQ ID NO: 215416 - DNA, 25 bp, Rattus norvegicus
attttctcattgtctgaaccctctt

SEQ ID NO: 215417 - DNA, 25 bp, Rattus norvegicus
attttctccacacagccttcattag

SEQ ID NO: 215418 - DNA, 25 bp, Rattus norvegicus
attttctccacagagccttcattag

SEQ ID NO: 215419 - DNA, 25 bp, Rattus norvegicus
attttctccagtaggtgaatctcac

SEQ ID NO: 215420 - DNA, 25 bp, Rattus norvegicus
attttctccagtccccatgtgttca

SEQ ID NO: 215421 - DNA, 25 bp, Rattus norvegicus
attttctccagtgcccatgtgttca

SEQ ID NO: 215422 - DNA, 25 bp, Rattus norvegicus
attttctccagttggtgaatctcac

SEQ ID NO: 215423 - DNA, 25 bp, Rattus norvegicus
attttctccataaggcattccaggg

SEQ ID NO: 215424 - DNA, 25 bp, Rattus norvegicus
attttctccatatggcattccaggg

SEQ ID NO: 215425 - DNA, 25 bp, Rattus norvegicus
attttctccatcaattctctcggtg

SEQ ID NO: 215426 - DNA, 25 bp, Rattus norvegicus
attttctccatctattctctcggtg

SEQ ID NO: 215427 - DNA, 25 bp, Rattus norvegicus
attttctcccaaactaatagcttgt

SEQ ID NO: 215428 - DNA, 25 bp, Rattus norvegicus
attttctcccaatctaatagcttgt

SEQ ID NO: 215429 - DNA, 25 bp, Rattus norvegicus
attttctcccttatgaagctatccg

SEQ ID NO: 215430 - DNA, 25 bp, Rattus norvegicus
attttctcccttttgaagctatccg

SEQ ID NO: 215431 - DNA, 25 bp, Rattus norvegicus
attttctcctctagtctccatagct

SEQ ID NO: 215432 - DNA, 25 bp, Rattus norvegicus
attttctcctcttgtctccatagct

SEQ ID NO: 215433 - DNA, 25 bp, Rattus norvegicus
attttctcctgcctgttctagaaag

SEQ ID NO: 215434 - DNA, 25 bp, Rattus norvegicus
attttctcctgcgtgttctagaaag

SEQ ID NO: 215435 - DNA, 25 bp, Rattus norvegicus
attttctctaaaatcctttctgttg

SEQ ID NO: 215436 - DNA, 25 bp, Rattus norvegicus
attttctctaaattcctttctgttg

SEQ ID NO: 215437 - DNA, 25 bp, Rattus norvegicus
attttctctagaatttttcctcaga

SEQ ID NO: 215438 - DNA, 25 bp, Rattus norvegicus
attttctctagattttttcctcaga

SEQ ID NO: 215439 - DNA, 25 bp, Rattus norvegicus
attttctctatgcatcggttgctgg

SEQ ID NO: 215440 - DNA, 25 bp, Rattus norvegicus
attttctctatggatcggttgctgg

SEQ ID NO: 215441 - DNA, 25 bp, Rattus norvegicus
attttctctccaccattgatagtgc

SEQ ID NO: 215442 - DNA, 25 bp, Rattus norvegicus
attttctctccagcattgatagtgc

SEQ ID NO: 215443 - DNA, 25 bp, Rattus norvegicus
attttctctcttactggcaaatgag

SEQ ID NO: 215444 - DNA, 25 bp, Rattus norvegicus
attttctctctttctggcaaatgag

SEQ ID NO: 215445 - DNA, 25 bp, Rattus norvegicus
attttctctgacagaatgctcacca

SEQ ID NO: 215446 - DNA, 25 bp, Rattus norvegicus
attttctctgactgaatgctcacca

SEQ ID NO: 215447 - DNA, 25 bp, Rattus norvegicus
attttctcttctctaagtctcagct

SEQ ID NO: 215448 - DNA, 25 bp, Rattus norvegicus
attttctcttctgtaagtctcagct

SEQ ID NO: 215449 - DNA, 25 bp, Rattus norvegicus
attttctcttgtatctgttctctcc

SEQ ID NO: 215450 - DNA, 25 bp, Rattus norvegicus
attttctcttgtttctgttctctcc

SEQ ID NO: 215451 - DNA, 25 bp, Rattus norvegicus
attttctctttactggcagcttctc

SEQ ID NO: 215452 - DNA, 25 bp, Rattus norvegicus
attttctctttagtggcagcttctc

SEQ ID NO: 215453 - DNA, 25 bp, Rattus norvegicus
attttctcttttctgacctggagga

SEQ ID NO: 215454 - DNA, 25 bp, Rattus norvegicus
attttctcttttgtgacctggagga

SEQ ID NO: 215455 - DNA, 25 bp, Rattus norvegicus
attttctgacagaccttaggatcct

SEQ ID NO: 215456 - DNA, 25 bp, Rattus norvegicus
attttctgacagtccttaggatcct

SEQ ID NO: 215457 - DNA, 25 bp, Rattus norvegicus
attttctgagctattaattgccatg

SEQ ID NO: 215458 - DNA, 25 bp, Rattus norvegicus
attttctgagcttttaattgccatg

SEQ ID NO: 215459 - DNA, 25 bp, Rattus norvegicus
attttctgatttacctcgcacctcc

SEQ ID NO: 215460 - DNA, 25 bp, Rattus norvegicus
attttctgattttcctcgcacctcc

SEQ ID NO: 215461 - DNA, 25 bp, Rattus norvegicus
attttctgcgtccttgagactgagg

SEQ ID NO: 215462 - DNA, 25 bp, Rattus norvegicus
attttctgcgtcgttgagactgagg

SEQ ID NO: 215463 - DNA, 25 bp, Rattus norvegicus
attttctgctggactaagtcactat

SEQ ID NO: 215464 - DNA, 25 bp, Rattus norvegicus
attttctgctggtctaagtcactat

SEQ ID NO: 215465 - DNA, 25 bp, Rattus norvegicus
attttctgcttaatccaggccactg

SEQ ID NO: 215466 - DNA, 25 bp, Rattus norvegicus
attttctgcttattccaggccactg

SEQ ID NO: 215467 - DNA, 25 bp, Rattus norvegicus
attttctgctttagtctgttacaat

SEQ ID NO: 215468 - DNA, 25 bp, Rattus norvegicus
attttctgcttttgtctgttacaat

SEQ ID NO: 215469 - DNA, 25 bp, Rattus norvegicus
attttctggaagagtgccgacctag

SEQ ID NO: 215470 - DNA, 25 bp, Rattus norvegicus
attttctggaagtgtgccgacctag

SEQ ID NO: 215471 - DNA, 25 bp, Rattus norvegicus
attttctggcttccctggatagatt

SEQ ID NO: 215472 - DNA, 25 bp, Rattus norvegicus
attttctggcttgcctggatagatt

SEQ ID NO: 215473 - DNA, 25 bp, Rattus norvegicus
attttctgtcctcagtttctctatg

SEQ ID NO: 215474 - DNA, 25 bp, Rattus norvegicus
attttctgtcctgagtttctctatg

SEQ ID NO: 215475 - DNA, 25 bp, Rattus norvegicus
attttctgtcttacatgttctcgaa

SEQ ID NO: 215476 - DNA, 25 bp, Rattus norvegicus
attttctgtctttcatgttctcgaa

SEQ ID NO: 215477 - DNA, 25 bp, Rattus norvegicus
attttctgtttcatgctgtgggcat

SEQ ID NO: 215478 - DNA, 25 bp, Rattus norvegicus
attttctgtttcttgctgtgggcat

SEQ ID NO: 215479 - DNA, 25 bp, Rattus norvegicus
attttcttacctctcatcttattac

SEQ ID NO: 215480 - DNA, 25 bp, Rattus norvegicus
attttcttacctgtcatcttattac

SEQ ID NO: 215481 - DNA, 25 bp, Rattus norvegicus
attttcttactgactccacaaacca

SEQ ID NO: 215482 - DNA, 25 bp, Rattus norvegicus
attttcttactgtctccacaaacca

SEQ ID NO: 215483 - DNA, 25 bp, Rattus norvegicus
attttcttagtccacatgttctgtt

SEQ ID NO: 215484 - DNA, 25 bp, Rattus norvegicus
attttcttagtcgacatgttctgtt

SEQ ID NO: 215485 - DNA, 25 bp, Rattus norvegicus
attttcttatacatctggttgccca

SEQ ID NO: 215486 - DNA, 25 bp, Rattus norvegicus
attttcttatacttctggttgccca

SEQ ID NO: 215487 - DNA, 25 bp, Rattus norvegicus
attttcttattaaccctagctgtgg

SEQ ID NO: 215488 - DNA, 25 bp, Rattus norvegicus
attttcttattatccctagctgtgg

SEQ ID NO: 215489 - DNA, 25 bp, Rattus norvegicus
attttcttcacactgcagcttgcag

SEQ ID NO: 215490 - DNA, 25 bp, Rattus norvegicus
attttcttcacagtgcagcttgcag

SEQ ID NO: 215491 - DNA, 25 bp, Rattus norvegicus
attttcttcagtcataaccctaaag

SEQ ID NO: 215492 - DNA, 25 bp, Rattus norvegicus
attttcttcagtcccattgttcttg

SEQ ID NO: 215493 - DNA, 25 bp, Rattus norvegicus
attttcttcagtgataaccctaaag

SEQ ID NO: 215494 - DNA, 25 bp, Rattus norvegicus
attttcttcagtgccattgttcttg

SEQ ID NO: 215495 - DNA, 25 bp, Rattus norvegicus
attttcttcgcaattgtgatacatc

SEQ ID NO: 215496 - DNA, 25 bp, Rattus norvegicus
attttcttcgcatttgtgatacatc

SEQ ID NO: 215497 - DNA, 25 bp, Rattus norvegicus
attttcttctgaactcactttttat

SEQ ID NO: 215498 - DNA, 25 bp, Rattus norvegicus
attttcttctgatctcactttttat

SEQ ID NO: 215499 - DNA, 25 bp, Rattus norvegicus
attttcttctggcaacacggcaggt

SEQ ID NO: 215500 - DNA, 25 bp, Rattus norvegicus
attttcttctgggaacacggcaggt

SEQ ID NO: 215501 - DNA, 25 bp, Rattus norvegicus
attttcttctgtcagatgggcaggc

SEQ ID NO: 215502 - DNA, 25 bp, Rattus norvegicus
attttcttctgtgagatgggcaggc

SEQ ID NO: 215503 - DNA, 25 bp, Rattus norvegicus
attttcttctttcaaagatttccag

SEQ ID NO: 215504 - DNA, 25 bp, Rattus norvegicus
attttcttctttgaaagatttccag

SEQ ID NO: 215505 - DNA, 25 bp, Rattus norvegicus
attttcttgaatctctgaaacctga

SEQ ID NO: 215506 - DNA, 25 bp, Rattus norvegicus
attttcttgaatgtctgaaacctga

SEQ ID NO: 215507 - DNA, 25 bp, Rattus norvegicus
attttcttgctgagtagatatgatt

SEQ ID NO: 215508 - DNA, 25 bp, Rattus norvegicus
attttcttgctgtgtagatatgatt

SEQ ID NO: 215509 - DNA, 25 bp, Rattus norvegicus
attttcttggctctgtcccggctgt

SEQ ID NO: 215510 - DNA, 25 bp, Rattus norvegicus
attttcttggctgtgtcccggctgt

SEQ ID NO: 215511 - DNA, 25 bp, Rattus norvegicus
attttcttgggacctcttcagttgt

SEQ ID NO: 215512 - DNA, 25 bp, Rattus norvegicus
attttcttgggagctcttcagttgt

SEQ ID NO: 215513 - DNA, 25 bp, Rattus norvegicus
attttcttgtctatctctcctgcga

SEQ ID NO: 215514 - DNA, 25 bp, Rattus norvegicus
attttcttgtctttctctcctgcga

SEQ ID NO: 215515 - DNA, 25 bp, Rattus norvegicus
attttcttgttcaaatccatcagga

SEQ ID NO: 215516 - DNA, 25 bp, Rattus norvegicus
attttcttgttctaatccatcagga

SEQ ID NO: 215517 - DNA, 25 bp, Rattus norvegicus
attttctttatcactatatctgcta

SEQ ID NO: 215518 - DNA, 25 bp, Rattus norvegicus
attttctttatctctatatctgcta

SEQ ID NO: 215519 - DNA, 25 bp, Rattus norvegicus
attttctttcacacctgctaataac

SEQ ID NO: 215520 - DNA, 25 bp, Rattus norvegicus
attttctttcactcctgctaataac

SEQ ID NO: 215521 - DNA, 25 bp, Rattus norvegicus
attttctttcccagtagttgtgaag

SEQ ID NO: 215522 - DNA, 25 bp, Rattus norvegicus
attttctttccctgtagttgtgaag

SEQ ID NO: 215523 - DNA, 25 bp, Rattus norvegicus
attttctttcctactgtactgtaca

SEQ ID NO: 215524 - DNA, 25 bp, Rattus norvegicus
attttctttccttctgtactgtaca

SEQ ID NO: 215525 - DNA, 25 bp, Rattus norvegicus
attttctttcttcgtcggatgtgca

SEQ ID NO: 215526 - DNA, 25 bp, Rattus norvegicus
attttctttcttggtcggatgtgca

SEQ ID NO: 215527 - DNA, 25 bp, Rattus norvegicus
attttctttgagatgatcctggata

SEQ ID NO: 215528 - DNA, 25 bp, Rattus norvegicus
attttctttgagttgatcctggata

SEQ ID NO: 215529 - DNA, 25 bp, Rattus norvegicus
attttctttgtaagctgcctctctg

SEQ ID NO: 215530 - DNA, 25 bp, Rattus norvegicus
attttctttgtatgctgcctctctg

SEQ ID NO: 215531 - DNA, 25 bp, Rattus norvegicus
attttgaacgatccctgcaccctaa

SEQ ID NO: 215532 - DNA, 25 bp, Rattus norvegicus
attttgaacgatgcctgcaccctaa

SEQ ID NO: 215533 - DNA, 25 bp, Rattus norvegicus
attttgaagggcaactaattccata

SEQ ID NO: 215534 - DNA, 25 bp, Rattus norvegicus
attttgaagggctactaattccata

SEQ ID NO: 215535 - DNA, 25 bp, Rattus norvegicus
attttgaatcctaggtttccactgt

SEQ ID NO: 215536 - DNA, 25 bp, Rattus norvegicus
attttgaatccttggtttccactgt

SEQ ID NO: 215537 - DNA, 25 bp, Rattus norvegicus
attttgacactcactgttgccgggt

SEQ ID NO: 215538 - DNA, 25 bp, Rattus norvegicus
attttgacactctctgttgccgggt

SEQ ID NO: 215539 - DNA, 25 bp, Rattus norvegicus
attttgaccacgacagagattacga

SEQ ID NO: 215540 - DNA, 25 bp, Rattus norvegicus
attttgaccacgtcagagattacga

SEQ ID NO: 215541 - DNA, 25 bp, Rattus norvegicus
attttgacgagaaggacacctccag

SEQ ID NO: 215542 - DNA, 25 bp, Rattus norvegicus
attttgacgagatggacacctccag

SEQ ID NO: 215543 - DNA, 25 bp, Rattus norvegicus
attttgactttcaagttcttctgct

SEQ ID NO: 215544 - DNA, 25 bp, Rattus norvegicus
attttgactttctagttcttctgct

SEQ ID NO: 215545 - DNA, 25 bp, Rattus norvegicus
attttgagaaacatgcagctcttca

SEQ ID NO: 215546 - DNA, 25 bp, Rattus norvegicus
attttgagaaacttgcagctcttca

SEQ ID NO: 215547 - DNA, 25 bp, Rattus norvegicus
attttgagacaacgccaggctggct

SEQ ID NO: 215548 - DNA, 25 bp, Rattus norvegicus
attttgagacaaggccaggctggct

SEQ ID NO: 215549 - DNA, 25 bp, Rattus norvegicus
attttgaggagaaccagcggcgctt

SEQ ID NO: 215550 - DNA, 25 bp, Rattus norvegicus
attttgaggagatccagcggcgctt

SEQ ID NO: 215551 - DNA, 25 bp, Rattus norvegicus
attttgagtatcctgctttcggcaa

SEQ ID NO: 215552 - DNA, 25 bp, Rattus norvegicus
attttgagtatcgtgctttcggcaa

SEQ ID NO: 215553 - DNA, 25 bp, Rattus norvegicus
attttgagtggaaggatcttggccc

SEQ ID NO: 215554 - DNA, 25 bp, Rattus norvegicus
attttgagtggatggatcttggccc

SEQ ID NO: 215555 - DNA, 25 bp, Rattus norvegicus
attttgatccttagatacctctgaa

SEQ ID NO: 215556 - DNA, 25 bp, Rattus norvegicus
attttgatcctttgatacctctgaa

SEQ ID NO: 215557 - DNA, 25 bp, Rattus norvegicus
attttgatgatcatctggcggcctt

SEQ ID NO: 215558 - DNA, 25 bp, Rattus norvegicus
attttgatgatcttctggcggcctt

SEQ ID NO: 215559 - DNA, 25 bp, Rattus norvegicus
attttgatgttcagccttttaggca

SEQ ID NO: 215560 - DNA, 25 bp, Rattus norvegicus
attttgatgttctgccttttaggca

SEQ ID NO: 215561 - DNA, 25 bp, Rattus norvegicus
attttgattagccagcagaccaggg

SEQ ID NO: 215562 - DNA, 25 bp, Rattus norvegicus
attttgattagcgagcagaccaggg

SEQ ID NO: 215563 - DNA, 25 bp, Rattus norvegicus
attttgattcacaacatatctcagg

SEQ ID NO: 215564 - DNA, 25 bp, Rattus norvegicus
attttgattcactacatatctcagg

SEQ ID NO: 215565 - DNA, 25 bp, Rattus norvegicus
attttgatttttctgcctgtggctc

SEQ ID NO: 215566 - DNA, 25 bp, Rattus norvegicus
attttgatttttgtgcctgtggctc

SEQ ID NO: 215567 - DNA, 25 bp, Rattus norvegicus
attttgcaacatcttcagctatggg

SEQ ID NO: 215568 - DNA, 25 bp, Rattus norvegicus
attttgcaacatgttcagctatggg

SEQ ID NO: 215569 - DNA, 25 bp, Rattus norvegicus
attttgcaagctctggcgaggacca

SEQ ID NO: 215570 - DNA, 25 bp, Rattus norvegicus
attttgcaagctgtggcgaggacca

SEQ ID NO: 215571 - DNA, 25 bp, Rattus norvegicus
attttgcacactccctgttcacact

SEQ ID NO: 215572 - DNA, 25 bp, Rattus norvegicus
attttgcacactgcctgttcacact

SEQ ID NO: 215573 - DNA, 25 bp, Rattus norvegicus
attttgcactacaggcatcgatgga

SEQ ID NO: 215574 - DNA, 25 bp, Rattus norvegicus
attttgcactactggcatcgatgga

SEQ ID NO: 215575 - DNA, 25 bp, Rattus norvegicus
attttgcactagacacagttggtgt

SEQ ID NO: 215576 - DNA, 25 bp, Rattus norvegicus
attttgcactagtcacagttggtgt

SEQ ID NO: 215577 - DNA, 25 bp, Rattus norvegicus
attttgcactttagatattactaag

SEQ ID NO: 215578 - DNA, 25 bp, Rattus norvegicus
attttgcacttttgatattactaag

SEQ ID NO: 215579 - DNA, 25 bp, Rattus norvegicus
attttgcagaggatcttgttactgt

SEQ ID NO: 215580 - DNA, 25 bp, Rattus norvegicus
attttgcagaggttcttgttactgt

SEQ ID NO: 215581 - DNA, 25 bp, Rattus norvegicus
attttgcaggtaatcgtgacttttt

SEQ ID NO: 215582 - DNA, 25 bp, Rattus norvegicus
attttgcaggtattcgtgacttttt

SEQ ID NO: 215583 - DNA, 25 bp, Rattus norvegicus
attttgcagtgaccttcttttatat

SEQ ID NO: 215584 - DNA, 25 bp, Rattus norvegicus
attttgcagtgagcttcttttatat

SEQ ID NO: 215585 - DNA, 25 bp, Rattus norvegicus
attttgcatctgatctcgcattgcg

SEQ ID NO: 215586 - DNA, 25 bp, Rattus norvegicus
attttgcatctgttctcgcattgcg

SEQ ID NO: 215587 - DNA, 25 bp, Rattus norvegicus
attttgcatgctaggactgggttca

SEQ ID NO: 215588 - DNA, 25 bp, Rattus norvegicus
attttgcatgcttggactgggttca

SEQ ID NO: 215589 - DNA, 25 bp, Rattus norvegicus
attttgcattgcagggttcttttac

SEQ ID NO: 215590 - DNA, 25 bp, Rattus norvegicus
attttgcattgctgggttcttttac

SEQ ID NO: 215591 - DNA, 25 bp, Rattus norvegicus
attttgcatttactatcttcctcac

SEQ ID NO: 215592 - DNA, 25 bp, Rattus norvegicus
attttgcatttagtatcttcctcac

SEQ ID NO: 215593 - DNA, 25 bp, Rattus norvegicus
attttgcattttccacttcttccca

SEQ ID NO: 215594 - DNA, 25 bp, Rattus norvegicus
attttgcattttgcacttcttccca

SEQ ID NO: 215595 - DNA, 25 bp, Rattus norvegicus
attttgccaaccaggatccaatgct

SEQ ID NO: 215596 - DNA, 25 bp, Rattus norvegicus
attttgccaacctggatccaatgct

SEQ ID NO: 215597 - DNA, 25 bp, Rattus norvegicus
attttgccaaggctctggaactgag

SEQ ID NO: 215598 - DNA, 25 bp, Rattus norvegicus
attttgccaagggtctggaactgag

SEQ ID NO: 215599 - DNA, 25 bp, Rattus norvegicus
attttgccagaacctctccggaaaa

SEQ ID NO: 215600 - DNA, 25 bp, Rattus norvegicus
attttgccagaagctctccggaaaa

SEQ ID NO: 215601 - DNA, 25 bp, Rattus norvegicus
attttgccatgtagctcaagctgaa

SEQ ID NO: 215602 - DNA, 25 bp, Rattus norvegicus
attttgccatgttgctcaagctgaa

SEQ ID NO: 215603 - DNA, 25 bp, Rattus norvegicus
attttgccccttatatgaggatgtg

SEQ ID NO: 215604 - DNA, 25 bp, Rattus norvegicus
attttgccccttttatgaggatgtg

SEQ ID NO: 215605 - DNA, 25 bp, Rattus norvegicus
attttgcctccaactaaatggtaag

SEQ ID NO: 215606 - DNA, 25 bp, Rattus norvegicus
attttgcctccatctaaatggtaag

SEQ ID NO: 215607 - DNA, 25 bp, Rattus norvegicus
attttgccttcacttccaagtctgt

SEQ ID NO: 215608 - DNA, 25 bp, Rattus norvegicus
attttgccttcagttccaagtctgt

SEQ ID NO: 215609 - DNA, 25 bp, Rattus norvegicus
attttgccttctcaattgtgattag

SEQ ID NO: 215610 - DNA, 25 bp, Rattus norvegicus
attttgccttctgaattgtgattag

SEQ ID NO: 215611 - DNA, 25 bp, Rattus norvegicus
attttgcgatctcttttgaagtcca

SEQ ID NO: 215612 - DNA, 25 bp, Rattus norvegicus
attttgcgatctgttttgaagtcca

SEQ ID NO: 215613 - DNA, 25 bp, Rattus norvegicus
attttgcgccctcttgtcaagatca

SEQ ID NO: 215614 - DNA, 25 bp, Rattus norvegicus
attttgcgccctgttgtcaagatca

SEQ ID NO: 215615 - DNA, 25 bp, Rattus norvegicus
attttgcgctctattcactagatac

SEQ ID NO: 215616 - DNA, 25 bp, Rattus norvegicus
attttgcgctcttttcactagatac

SEQ ID NO: 215617 - DNA, 25 bp, Rattus norvegicus
attttgcggaatagggagcctaatt

SEQ ID NO: 215618 - DNA, 25 bp, Rattus norvegicus
attttgcggaattgggagcctaatt

SEQ ID NO: 215619 - DNA, 25 bp, Rattus norvegicus
attttgctactgatgcgactgtaaa

SEQ ID NO: 215620 - DNA, 25 bp, Rattus norvegicus
attttgctactgttgcgactgtaaa

SEQ ID NO: 215621 - DNA, 25 bp, Rattus norvegicus
attttgctagcaaccttttttcctc

SEQ ID NO: 215622 - DNA, 25 bp, Rattus norvegicus
attttgctagcatccttttttcctc

SEQ ID NO: 215623 - DNA, 25 bp, Rattus norvegicus
attttgctcagtatggccatgtaag

SEQ ID NO: 215624 - DNA, 25 bp, Rattus norvegicus
attttgctcagtttggccatgtaag

SEQ ID NO: 215625 - DNA, 25 bp, Rattus norvegicus
attttgctcatcatgtttgcacaaa

SEQ ID NO: 215626 - DNA, 25 bp, Rattus norvegicus
attttgctcatcttgtttgcacaaa

SEQ ID NO: 215627 - DNA, 25 bp, Rattus norvegicus
attttgctctttcatctactcttaa

SEQ ID NO: 215628 - DNA, 25 bp, Rattus norvegicus
attttgctctttgatctactcttaa

SEQ ID NO: 215629 - DNA, 25 bp, Rattus norvegicus
attttgctgctgaacgtctcacaca

SEQ ID NO: 215630 - DNA, 25 bp, Rattus norvegicus
attttgctgctgtacgtctcacaca

SEQ ID NO: 215631 - DNA, 25 bp, Rattus norvegicus
attttgctgtgaaccaaagctctaa

SEQ ID NO: 215632 - DNA, 25 bp, Rattus norvegicus
attttgctgtgatccaaagctctaa

SEQ ID NO: 215633 - DNA, 25 bp, Rattus norvegicus
attttgctgtgtatgtgaccactaa

SEQ ID NO: 215634 - DNA, 25 bp, Rattus norvegicus
attttgctgtgtttgtgaccactaa

SEQ ID NO: 215635 - DNA, 25 bp, Rattus norvegicus
attttgcttcatagtcttctggtgt

SEQ ID NO: 215636 - DNA, 25 bp, Rattus norvegicus
attttgcttcattgtcttctggtgt

SEQ ID NO: 215637 - DNA, 25 bp, Rattus norvegicus
attttgcttctaactttaccttcct

SEQ ID NO: 215638 - DNA, 25 bp, Rattus norvegicus
attttgcttctatctttaccttcct

SEQ ID NO: 215639 - DNA, 25 bp, Rattus norvegicus
attttgcttttcaatatccgacaac

SEQ ID NO: 215640 - DNA, 25 bp, Rattus norvegicus
attttgcttttctatatccgacaac

SEQ ID NO: 215641 - DNA, 25 bp, Rattus norvegicus
attttggaaaatctttgccctgctg

SEQ ID NO: 215642 - DNA, 25 bp, Rattus norvegicus
attttggaaaatgtttgccctgctg

SEQ ID NO: 215643 - DNA, 25 bp, Rattus norvegicus
attttggacctgaaactcgcattct

SEQ ID NO: 215644 - DNA, 25 bp, Rattus norvegicus
attttggacctgtaactcgcattct

SEQ ID NO: 215645 - DNA, 25 bp, Rattus norvegicus
attttggaccttcttcgtggctgga

SEQ ID NO: 215646 - DNA, 25 bp, Rattus norvegicus
attttggaccttgttcgtggctgga

SEQ ID NO: 215647 - DNA, 25 bp, Rattus norvegicus
attttggactgtcaagctggctcag

SEQ ID NO: 215648 - DNA, 25 bp, Rattus norvegicus
attttggactgtgaagctggctcag

SEQ ID NO: 215649 - DNA, 25 bp, Rattus norvegicus
attttggagatcattcctgcagtcc

SEQ ID NO: 215650 - DNA, 25 bp, Rattus norvegicus
attttggagatctttcctgcagtcc

SEQ ID NO: 215651 - DNA, 25 bp, Rattus norvegicus
attttggagcagcacttgagtgcca

SEQ ID NO: 215652 - DNA, 25 bp, Rattus norvegicus
attttggagcaggacttgagtgcca

SEQ ID NO: 215653 - DNA, 25 bp, Rattus norvegicus
attttggagcctactctttcatcat

SEQ ID NO: 215654 - DNA, 25 bp, Rattus norvegicus
attttggagccttctctttcatcat

SEQ ID NO: 215655 - DNA, 25 bp, Rattus norvegicus
attttggataccactgtctcacatg

SEQ ID NO: 215656 - DNA, 25 bp, Rattus norvegicus
attttggatacctctgtctcacatg

SEQ ID NO: 215657 - DNA, 25 bp, Rattus norvegicus
attttggatgggattctgggagcta

SEQ ID NO: 215658 - DNA, 25 bp, Rattus norvegicus
attttggatgggtttctgggagcta

SEQ ID NO: 215659 - DNA, 25 bp, Rattus norvegicus
attttggatttaagggctcccatct

SEQ ID NO: 215660 - DNA, 25 bp, Rattus norvegicus
attttggatttatgggctcccatct

SEQ ID NO: 215661 - DNA, 25 bp, Rattus norvegicus
attttggcagctatgtcacacacga

SEQ ID NO: 215662 - DNA, 25 bp, Rattus norvegicus
attttggcagctttgtcacacacga

SEQ ID NO: 215663 - DNA, 25 bp, Rattus norvegicus
attttggcggttactgtgcctttat

SEQ ID NO: 215664 - DNA, 25 bp, Rattus norvegicus
attttggcggtttctgtgcctttat

SEQ ID NO: 215665 - DNA, 25 bp, Rattus norvegicus
attttggcgtggctgtccaggaaaa

SEQ ID NO: 215666 - DNA, 25 bp, Rattus norvegicus
attttggcgtgggtgtccaggaaaa

SEQ ID NO: 215667 - DNA, 25 bp, Rattus norvegicus
attttggctaacctgtctcaccatc

SEQ ID NO: 215668 - DNA, 25 bp, Rattus norvegicus
attttggctaacgtgtctcaccatc

SEQ ID NO: 215669 - DNA, 25 bp, Rattus norvegicus
attttggctatactcctgttctggg

SEQ ID NO: 215670 - DNA, 25 bp, Rattus norvegicus
attttggctatagtcctgttctggg

SEQ ID NO: 215671 - DNA, 25 bp, Rattus norvegicus
attttggctgcacacatgtctttaa

SEQ ID NO: 215672 - DNA, 25 bp, Rattus norvegicus
attttggctgcagacatgtctttaa

SEQ ID NO: 215673 - DNA, 25 bp, Rattus norvegicus
attttggctggtaggcatgtctgca

SEQ ID NO: 215674 - DNA, 25 bp, Rattus norvegicus
attttggctggttggcatgtctgca

SEQ ID NO: 215675 - DNA, 25 bp, Rattus norvegicus
attttggcttcgattttgttgctat

SEQ ID NO: 215676 - DNA, 25 bp, Rattus norvegicus
attttggcttcgtttttgttgctat

SEQ ID NO: 215677 - DNA, 25 bp, Rattus norvegicus
attttggcttctcttggcctgagta

SEQ ID NO: 215678 - DNA, 25 bp, Rattus norvegicus
attttggcttctgttggcctgagta

SEQ ID NO: 215679 - DNA, 25 bp, Rattus norvegicus
attttggcttggatttgatcctccc

SEQ ID NO: 215680 - DNA, 25 bp, Rattus norvegicus
attttggcttggttttgatcctccc

SEQ ID NO: 215681 - DNA, 25 bp, Rattus norvegicus
attttgggccagatttggaccagag

SEQ ID NO: 215682 - DNA, 25 bp, Rattus norvegicus
attttgggccagttttggaccagag

SEQ ID NO: 215683 - DNA, 25 bp, Rattus norvegicus
attttgggtcaaaatcatggtgaca

SEQ ID NO: 215684 - DNA, 25 bp, Rattus norvegicus
attttgggtcaatatcatggtgaca

SEQ ID NO: 215685 - DNA, 25 bp, Rattus norvegicus
attttggtaagcacccagcagacac

SEQ ID NO: 215686 - DNA, 25 bp, Rattus norvegicus
attttggtaagctcccagcagacac

SEQ ID NO: 215687 - DNA, 25 bp, Rattus norvegicus
attttggtatctagctcaggaatta

SEQ ID NO: 215688 - DNA, 25 bp, Rattus norvegicus
attttggtatcttgctcaggaatta

SEQ ID NO: 215689 - DNA, 25 bp, Rattus norvegicus
attttggtcatactcacttctcctt

SEQ ID NO: 215690 - DNA, 25 bp, Rattus norvegicus
attttggtcatagtcacttctcctt

SEQ ID NO: 215691 - DNA, 25 bp, Rattus norvegicus
attttggtccagatttcttgagtca

SEQ ID NO: 215692 - DNA, 25 bp, Rattus norvegicus
attttggtccagttttcttgagtca

SEQ ID NO: 215693 - DNA, 25 bp, Rattus norvegicus
attttggtcctgatctatctgagtt

SEQ ID NO: 215694 - DNA, 25 bp, Rattus norvegicus
attttggtcctgttctatctgagtt

SEQ ID NO: 215695 - DNA, 25 bp, Rattus norvegicus
attttggtctagcaacttgtgatac

SEQ ID NO: 215696 - DNA, 25 bp, Rattus norvegicus
attttggtctaggaacttgtgatac

SEQ ID NO: 215697 - DNA, 25 bp, Rattus norvegicus
attttgtaatctcccacacgagctc

SEQ ID NO: 215698 - DNA, 25 bp, Rattus norvegicus
attttgtaatctgccacacgagctc

SEQ ID NO: 215699 - DNA, 25 bp, Rattus norvegicus
attttgtacagcaccaaacctgggc

SEQ ID NO: 215700 - DNA, 25 bp, Rattus norvegicus
attttgtacagcattttctccccat

SEQ ID NO: 215701 - DNA, 25 bp, Rattus norvegicus
attttgtacagctccaaacctgggc

SEQ ID NO: 215702 - DNA, 25 bp, Rattus norvegicus
attttgtacagctttttctccccat

SEQ ID NO: 215703 - DNA, 25 bp, Rattus norvegicus
attttgtacattaaaggtggcgata

SEQ ID NO: 215704 - DNA, 25 bp, Rattus norvegicus
attttgtacattaccctctgttctt

SEQ ID NO: 215705 - DNA, 25 bp, Rattus norvegicus
attttgtacatttaaggtggcgata

SEQ ID NO: 215706 - DNA, 25 bp, Rattus norvegicus
attttgtacatttccctctgttctt

SEQ ID NO: 215707 - DNA, 25 bp, Rattus norvegicus
attttgtacccgacaaccttcatga

SEQ ID NO: 215708 - DNA, 25 bp, Rattus norvegicus
attttgtacccgtcaaccttcatga

SEQ ID NO: 215709 - DNA, 25 bp, Rattus norvegicus
attttgtacctaaattgtgcaatac

SEQ ID NO: 215710 - DNA, 25 bp, Rattus norvegicus
attttgtacctatattgtgcaatac

SEQ ID NO: 215711 - DNA, 25 bp, Rattus norvegicus
attttgtacttgataccttctccat

SEQ ID NO: 215712 - DNA, 25 bp, Rattus norvegicus
attttgtacttgttaccttctccat

SEQ ID NO: 215713 - DNA, 25 bp, Rattus norvegicus
attttgtatataagtgtcctgccca

SEQ ID NO: 215714 - DNA, 25 bp, Rattus norvegicus
attttgtatatatgtgtcctgccca

SEQ ID NO: 215715 - DNA, 25 bp, Rattus norvegicus
attttgtatcatacgttttatccca

SEQ ID NO: 215716 - DNA, 25 bp, Rattus norvegicus
attttgtatcattcgttttatccca

SEQ ID NO: 215717 - DNA, 25 bp, Rattus norvegicus
attttgtattacaccaagtctgttg

SEQ ID NO: 215718 - DNA, 25 bp, Rattus norvegicus
attttgtattactccaagtctgttg

SEQ ID NO: 215719 - DNA, 25 bp, Rattus norvegicus
attttgtattgccatcaggtgccaa

SEQ ID NO: 215720 - DNA, 25 bp, Rattus norvegicus
attttgtattgcgatcaggtgccaa

SEQ ID NO: 215721 - DNA, 25 bp, Rattus norvegicus
attttgtattttagtgccttaattg

SEQ ID NO: 215722 - DNA, 25 bp, Rattus norvegicus
attttgtatttttgtgccttaattg

SEQ ID NO: 215723 - DNA, 25 bp, Rattus norvegicus
attttgtcactgctacggttgtata

SEQ ID NO: 215724 - DNA, 25 bp, Rattus norvegicus
attttgtcactggtacggttgtata

SEQ ID NO: 215725 - DNA, 25 bp, Rattus norvegicus
attttgtcacttaggccctaccact

SEQ ID NO: 215726 - DNA, 25 bp, Rattus norvegicus
attttgtcactttggccctaccact

SEQ ID NO: 215727 - DNA, 25 bp, Rattus norvegicus
attttgtccaaaaacctcttgtaat

SEQ ID NO: 215728 - DNA, 25 bp, Rattus norvegicus
attttgtccaaatacctcttgtaat

SEQ ID NO: 215729 - DNA, 25 bp, Rattus norvegicus
attttgtccgtcagagtctggtctc

SEQ ID NO: 215730 - DNA, 25 bp, Rattus norvegicus
attttgtccgtctgagtctggtctc

SEQ ID NO: 215731 - DNA, 25 bp, Rattus norvegicus
attttgtcctgtaactgaagtgtag

SEQ ID NO: 215732 - DNA, 25 bp, Rattus norvegicus
attttgtcctgttactgaagtgtag

SEQ ID NO: 215733 - DNA, 25 bp, Rattus norvegicus
attttgtctcatactactgttccca

SEQ ID NO: 215734 - DNA, 25 bp, Rattus norvegicus
attttgtctcattctactgttccca

SEQ ID NO: 215735 - DNA, 25 bp, Rattus norvegicus
attttgtctcctccactgccagtat

SEQ ID NO: 215736 - DNA, 25 bp, Rattus norvegicus
attttgtctcctgcactgccagtat

SEQ ID NO: 215737 - DNA, 25 bp, Rattus norvegicus
attttgtctctaattcagggatgga

SEQ ID NO: 215738 - DNA, 25 bp, Rattus norvegicus
attttgtctctatttcagggatgga

SEQ ID NO: 215739 - DNA, 25 bp, Rattus norvegicus
attttgtctgacagtggtccctccc

SEQ ID NO: 215740 - DNA, 25 bp, Rattus norvegicus
attttgtctgactgtggtccctccc

SEQ ID NO: 215741 - DNA, 25 bp, Rattus norvegicus
attttgtcttgccatcagcctacag

SEQ ID NO: 215742 - DNA, 25 bp, Rattus norvegicus
attttgtcttgcgatcagcctacag

SEQ ID NO: 215743 - DNA, 25 bp, Rattus norvegicus
attttgtgacacctaatctattgca

SEQ ID NO: 215744 - DNA, 25 bp, Rattus norvegicus
attttgtgacacgtaatctattgca

SEQ ID NO: 215745 - DNA, 25 bp, Rattus norvegicus
attttgtgaggtacttcttcaccct

SEQ ID NO: 215746 - DNA, 25 bp, Rattus norvegicus
attttgtgaggttcttcttcaccct

SEQ ID NO: 215747 - DNA, 25 bp, Rattus norvegicus
attttgtgggctatctgtctgaggc

SEQ ID NO: 215748 - DNA, 25 bp, Rattus norvegicus
attttgtgggctttctgtctgaggc

SEQ ID NO: 215749 - DNA, 25 bp, Rattus norvegicus
attttgtggtttctgggtttgcgca

SEQ ID NO: 215750 - DNA, 25 bp, Rattus norvegicus
attttgtggtttgtgggtttgcgca

SEQ ID NO: 215751 - DNA, 25 bp, Rattus norvegicus
attttgtgtaagactgtctaatttg

SEQ ID NO: 215752 - DNA, 25 bp, Rattus norvegicus
attttgtgtaagtctgtctaatttg

SEQ ID NO: 215753 - DNA, 25 bp, Rattus norvegicus
attttgtgtcgtcattgggaatcca

SEQ ID NO: 215754 - DNA, 25 bp, Rattus norvegicus
attttgtgtcgtgattgggaatcca

SEQ ID NO: 215755 - DNA, 25 bp, Rattus norvegicus
attttgtgtcttactctgagccctt

SEQ ID NO: 215756 - DNA, 25 bp, Rattus norvegicus
attttgtgtctttctctgagccctt

SEQ ID NO: 215757 - DNA, 25 bp, Rattus norvegicus
attttgttagatacagccctggcag

SEQ ID NO: 215758 - DNA, 25 bp, Rattus norvegicus
attttgttagattcagccctggcag

SEQ ID NO: 215759 - DNA, 25 bp, Rattus norvegicus
attttgttagccagttggacccaga

SEQ ID NO: 215760 - DNA, 25 bp, Rattus norvegicus
attttgttagcctgttggacccaga

SEQ ID NO: 215761 - DNA, 25 bp, Rattus norvegicus
attttgttccttccagaccctagaa

SEQ ID NO: 215762 - DNA, 25 bp, Rattus norvegicus
attttgttccttgcagaccctagaa

SEQ ID NO: 215763 - DNA, 25 bp, Rattus norvegicus
attttgttctctactgtacttgtgc

SEQ ID NO: 215764 - DNA, 25 bp, Rattus norvegicus
attttgttctctatcggcctgtgca

SEQ ID NO: 215765 - DNA, 25 bp, Rattus norvegicus
attttgttctcttctgtacttgtgc

SEQ ID NO: 215766 - DNA, 25 bp, Rattus norvegicus
attttgttctctttcggcctgtgca

SEQ ID NO: 215767 - DNA, 25 bp, Rattus norvegicus
attttgttgaagctattgactgtac

SEQ ID NO: 215768 - DNA, 25 bp, Rattus norvegicus
attttgttgaaggtattgactgtac

SEQ ID NO: 215769 - DNA, 25 bp, Rattus norvegicus
attttgttgaatatgacggagggaa

SEQ ID NO: 215770 - DNA, 25 bp, Rattus norvegicus
attttgttgaatttgacggagggaa

SEQ ID NO: 215771 - DNA, 25 bp, Rattus norvegicus
attttgttgctactcaagatctggg

SEQ ID NO: 215772 - DNA, 25 bp, Rattus norvegicus
attttgttgctagtcaagatctggg

SEQ ID NO: 215773 - DNA, 25 bp, Rattus norvegicus
attttgttgggacgaatgtggactt

SEQ ID NO: 215774 - DNA, 25 bp, Rattus norvegicus
attttgttgggaggaatgtggactt

SEQ ID NO: 215775 - DNA, 25 bp, Rattus norvegicus
attttgtttgctacatagtttccag

SEQ ID NO: 215776 - DNA, 25 bp, Rattus norvegicus
attttgtttgcttcatagtttccag

SEQ ID NO: 215777 - DNA, 25 bp, Rattus norvegicus
attttgttttagatgcgcaagggca

SEQ ID NO: 215778 - DNA, 25 bp, Rattus norvegicus
attttgttttagttgcgcaagggca

SEQ ID NO: 215779 - DNA, 25 bp, Rattus norvegicus
attttgttttcaatgtttgcagcgg

SEQ ID NO: 215780 - DNA, 25 bp, Rattus norvegicus
attttgttttcattgtttgcagcgg

SEQ ID NO: 215781 - DNA, 25 bp, Rattus norvegicus
attttgttttctatcactggctcag

SEQ ID NO: 215782 - DNA, 25 bp, Rattus norvegicus
attttgttttctttcactggctcag

SEQ ID NO: 215783 - DNA, 25 bp, Rattus norvegicus
attttgttttgcatcagtggctcac

SEQ ID NO: 215784 - DNA, 25 bp, Rattus norvegicus
attttgttttgcttcagtggctcac

SEQ ID NO: 215785 - DNA, 25 bp, Rattus norvegicus
atttttaacacaaaccactctgctg

SEQ ID NO: 215786 - DNA, 25 bp, Rattus norvegicus
atttttaacacacttggcccaggag

SEQ ID NO: 215787 - DNA, 25 bp, Rattus norvegicus
atttttaacacagttggcccaggag

SEQ ID NO: 215788 - DNA, 25 bp, Rattus norvegicus
atttttaacacataccactctgctg

SEQ ID NO: 215789 - DNA, 25 bp, Rattus norvegicus
atttttaaccgcaggatgtacgaat

SEQ ID NO: 215790 - DNA, 25 bp, Rattus norvegicus
atttttaaccgctggatgtacgaat

SEQ ID NO: 215791 - DNA, 25 bp, Rattus norvegicus
atttttaacctccacgatcttgata

SEQ ID NO: 215792 - DNA, 25 bp, Rattus norvegicus
atttttaacctcgacgatcttgata

SEQ ID NO: 215793 - DNA, 25 bp, Rattus norvegicus
atttttaagacacgtcctctcgctg

SEQ ID NO: 215794 - DNA, 25 bp, Rattus norvegicus
atttttaagacaggtcctctcgctg

SEQ ID NO: 215795 - DNA, 25 bp, Rattus norvegicus
atttttaagctccatatgttcaaga

SEQ ID NO: 215796 - DNA, 25 bp, Rattus norvegicus
atttttaagctccatgtgcatataa

SEQ ID NO: 215797 - DNA, 25 bp, Rattus norvegicus
atttttaagctcgatatgttcaaga

SEQ ID NO: 215798 - DNA, 25 bp, Rattus norvegicus
atttttaagctcgatgtgcatataa

SEQ ID NO: 215799 - DNA, 25 bp, Rattus norvegicus
atttttaatcttctcacctctcctg

SEQ ID NO: 215800 - DNA, 25 bp, Rattus norvegicus
atttttaatcttgtcacctctcctg

SEQ ID NO: 215801 - DNA, 25 bp, Rattus norvegicus
atttttacacctctgctatccttag

SEQ ID NO: 215802 - DNA, 25 bp, Rattus norvegicus
atttttacacctgtgctatccttag

SEQ ID NO: 215803 - DNA, 25 bp, Rattus norvegicus
atttttacagatcggtggccttggt

SEQ ID NO: 215804 - DNA, 25 bp, Rattus norvegicus
atttttacagatgggtggccttggt

SEQ ID NO: 215805 - DNA, 25 bp, Rattus norvegicus
atttttacctatccaagtccctggg

SEQ ID NO: 215806 - DNA, 25 bp, Rattus norvegicus
atttttacctatgcaagtccctggg

SEQ ID NO: 215807 - DNA, 25 bp, Rattus norvegicus
atttttacttttcatggttggctat

SEQ ID NO: 215808 - DNA, 25 bp, Rattus norvegicus
atttttacttttgatggttggctat

SEQ ID NO: 215809 - DNA, 25 bp, Rattus norvegicus
atttttagctctcatgttttgcctg

SEQ ID NO: 215810 - DNA, 25 bp, Rattus norvegicus
atttttagctctgatgttttgcctg

SEQ ID NO: 215811 - DNA, 25 bp, Rattus norvegicus
atttttagtgcacttctcatcctcc

SEQ ID NO: 215812 - DNA, 25 bp, Rattus norvegicus
atttttagtgcagttctcatcctcc

SEQ ID NO: 215813 - DNA, 25 bp, Rattus norvegicus
atttttatataccatccccagaggc

SEQ ID NO: 215814 - DNA, 25 bp, Rattus norvegicus
atttttatatacgatccccagaggc

SEQ ID NO: 215815 - DNA, 25 bp, Rattus norvegicus
atttttatcagcaccttcaaggcac

SEQ ID NO: 215816 - DNA, 25 bp, Rattus norvegicus
atttttatcagctccttcaaggcac

SEQ ID NO: 215817 - DNA, 25 bp, Rattus norvegicus
atttttatcttgactcagttcctgt

SEQ ID NO: 215818 - DNA, 25 bp, Rattus norvegicus
atttttatcttgtctcagttcctgt

SEQ ID NO: 215819 - DNA, 25 bp, Rattus norvegicus
atttttatgcgactctctggaaccc

SEQ ID NO: 215820 - DNA, 25 bp, Rattus norvegicus
atttttatgcgagtctctggaaccc

SEQ ID NO: 215821 - DNA, 25 bp, Rattus norvegicus
atttttattccgatgtcacctctct

SEQ ID NO: 215822 - DNA, 25 bp, Rattus norvegicus
atttttattccgttgtcacctctct

SEQ ID NO: 215823 - DNA, 25 bp, Rattus norvegicus
atttttattctgctgggaccgctct

SEQ ID NO: 215824 - DNA, 25 bp, Rattus norvegicus
atttttattctggtgggaccgctct

SEQ ID NO: 215825 - DNA, 25 bp, Rattus norvegicus
atttttatttgcatgtttgcgtgtg

SEQ ID NO: 215826 - DNA, 25 bp, Rattus norvegicus
atttttatttgcttgtttgcgtgtg

SEQ ID NO: 215827 - DNA, 25 bp, Rattus norvegicus
atttttcaacacacacaggacactg

SEQ ID NO: 215828 - DNA, 25 bp, Rattus norvegicus
atttttcaacactcacaggacactg

SEQ ID NO: 215829 - DNA, 25 bp, Rattus norvegicus
atttttcaagagatccccaccaaag

SEQ ID NO: 215830 - DNA, 25 bp, Rattus norvegicus
atttttcaagagttccccaccaaag

SEQ ID NO: 215831 - DNA, 25 bp, Rattus norvegicus
atttttcacaggctgaaccagtcct

SEQ ID NO: 215832 - DNA, 25 bp, Rattus norvegicus
atttttcacagggtgaaccagtcct

SEQ ID NO: 215833 - DNA, 25 bp, Rattus norvegicus
atttttcaccatccacatttccagc

SEQ ID NO: 215834 - DNA, 25 bp, Rattus norvegicus
atttttcaccatgcacatttccagc

SEQ ID NO: 215835 - DNA, 25 bp, Rattus norvegicus
atttttcacgacaacatgggctcag

SEQ ID NO: 215836 - DNA, 25 bp, Rattus norvegicus
atttttcacgactacatgggctcag

SEQ ID NO: 215837 - DNA, 25 bp, Rattus norvegicus
atttttcactgtagctagtctttta

SEQ ID NO: 215838 - DNA, 25 bp, Rattus norvegicus
atttttcactgttgctagtctttta

SEQ ID NO: 215839 - DNA, 25 bp, Rattus norvegicus
atttttcagaaacccggagccgcct

SEQ ID NO: 215840 - DNA, 25 bp, Rattus norvegicus
atttttcagaaagccggagccgcct

SEQ ID NO: 215841 - DNA, 25 bp, Rattus norvegicus
atttttcagcttctgagtgaaactg

SEQ ID NO: 215842 - DNA, 25 bp, Rattus norvegicus
atttttcagcttgtgagtgaaactg

SEQ ID NO: 215843 - DNA, 25 bp, Rattus norvegicus
atttttcatcatcgcggacagaccc

SEQ ID NO: 215844 - DNA, 25 bp, Rattus norvegicus
atttttcatcatggcggacagaccc

SEQ ID NO: 215845 - DNA, 25 bp, Rattus norvegicus
atttttcatcctaccacactcgaaa

SEQ ID NO: 215846 - DNA, 25 bp, Rattus norvegicus
atttttcatccttccacactcgaaa

SEQ ID NO: 215847 - DNA, 25 bp, Rattus norvegicus
atttttcatgccaagttgttttaca

SEQ ID NO: 215848 - DNA, 25 bp, Rattus norvegicus
atttttcatgcctagttgttttaca

SEQ ID NO: 215849 - DNA, 25 bp, Rattus norvegicus
atttttccacgaagccggaggtgtc

SEQ ID NO: 215850 - DNA, 25 bp, Rattus norvegicus
atttttccacgatgccggaggtgtc

SEQ ID NO: 215851 - DNA, 25 bp, Rattus norvegicus
atttttccacttccctctcagttca

SEQ ID NO: 215852 - DNA, 25 bp, Rattus norvegicus
atttttccacttgcctctcagttca

SEQ ID NO: 215853 - DNA, 25 bp, Rattus norvegicus
atttttccagatcactagcccattc

SEQ ID NO: 215854 - DNA, 25 bp, Rattus norvegicus
atttttccagatgactagcccattc

SEQ ID NO: 215855 - DNA, 25 bp, Rattus norvegicus
atttttccattgattcttgcgactt

SEQ ID NO: 215856 - DNA, 25 bp, Rattus norvegicus
atttttccattgtttcttgcgactt

SEQ ID NO: 215857 - DNA, 25 bp, Rattus norvegicus
atttttcccgtgaaatactctctcg

SEQ ID NO: 215858 - DNA, 25 bp, Rattus norvegicus
atttttcccgtgtaatactctctcg

SEQ ID NO: 215859 - DNA, 25 bp, Rattus norvegicus
atttttcccttcaaatctgcttgtg

SEQ ID NO: 215860 - DNA, 25 bp, Rattus norvegicus
atttttcccttctaatctgcttgtg

SEQ ID NO: 215861 - DNA, 25 bp, Rattus norvegicus
atttttcctagcattcagccattag

SEQ ID NO: 215862 - DNA, 25 bp, Rattus norvegicus
atttttcctagctttcagccattag

SEQ ID NO: 215863 - DNA, 25 bp, Rattus norvegicus
atttttcctattctatgcctgtcca

SEQ ID NO: 215864 - DNA, 25 bp, Rattus norvegicus
atttttcctattgtatgcctgtcca

SEQ ID NO: 215865 - DNA, 25 bp, Rattus norvegicus
atttttcctcatctacttgtcttag

SEQ ID NO: 215866 - DNA, 25 bp, Rattus norvegicus
atttttcctcatgtacttgtcttag

SEQ ID NO: 215867 - DNA, 25 bp, Rattus norvegicus
atttttcctgaaatgctgctttgag

SEQ ID NO: 215868 - DNA, 25 bp, Rattus norvegicus
atttttcctgaattgctgctttgag

SEQ ID NO: 215869 - DNA, 25 bp, Rattus norvegicus
atttttcctgctctggtgctaatat

SEQ ID NO: 215870 - DNA, 25 bp, Rattus norvegicus
atttttcctgctgtggtgctaatat

SEQ ID NO: 215871 - DNA, 25 bp, Rattus norvegicus
atttttcctggacgtgatagctctg

SEQ ID NO: 215872 - DNA, 25 bp, Rattus norvegicus
atttttcctggaggtgatagctctg

SEQ ID NO: 215873 - DNA, 25 bp, Rattus norvegicus
atttttccttaactatccctgatgt

SEQ ID NO: 215874 - DNA, 25 bp, Rattus norvegicus
atttttccttaagtatccctgatgt

SEQ ID NO: 215875 - DNA, 25 bp, Rattus norvegicus
atttttccttccacagatatctacc

SEQ ID NO: 215876 - DNA, 25 bp, Rattus norvegicus
atttttccttcctcagatatctacc

SEQ ID NO: 215877 - DNA, 25 bp, Rattus norvegicus
atttttcgttctacagagattggcg

SEQ ID NO: 215878 - DNA, 25 bp, Rattus norvegicus
atttttcgttcttcagagattggcg

SEQ ID NO: 215879 - DNA, 25 bp, Rattus norvegicus
atttttctaagcatagacggactta

SEQ ID NO: 215880 - DNA, 25 bp, Rattus norvegicus
atttttctaagcttagacggactta

SEQ ID NO: 215881 - DNA, 25 bp, Rattus norvegicus
atttttctatgaagaggttctcacc

SEQ ID NO: 215882 - DNA, 25 bp, Rattus norvegicus
atttttctatgatgaggttctcacc

SEQ ID NO: 215883 - DNA, 25 bp, Rattus norvegicus
atttttctcaagaatgtgtttccta

SEQ ID NO: 215884 - DNA, 25 bp, Rattus norvegicus
atttttctcaagtatgtgtttccta

SEQ ID NO: 215885 - DNA, 25 bp, Rattus norvegicus
atttttctctggattgatgcttggt

SEQ ID NO: 215886 - DNA, 25 bp, Rattus norvegicus
atttttctctggtttgatgcttggt

SEQ ID NO: 215887 - DNA, 25 bp, Rattus norvegicus
atttttctgacaattcccttgaaga

SEQ ID NO: 215888 - DNA, 25 bp, Rattus norvegicus
atttttctgacatttcccttgaaga

SEQ ID NO: 215889 - DNA, 25 bp, Rattus norvegicus
atttttctgagcaactgcctctttt

SEQ ID NO: 215890 - DNA, 25 bp, Rattus norvegicus
atttttctgagctactgcctctttt

SEQ ID NO: 215891 - DNA, 25 bp, Rattus norvegicus
atttttctgcccaatttgctccctc

SEQ ID NO: 215892 - DNA, 25 bp, Rattus norvegicus
atttttctgccctatttgctccctc

SEQ ID NO: 215893 - DNA, 25 bp, Rattus norvegicus
atttttctgcttcaggctgtttggt

SEQ ID NO: 215894 - DNA, 25 bp, Rattus norvegicus
atttttctgcttgaggctgtttggt

SEQ ID NO: 215895 - DNA, 25 bp, Rattus norvegicus
atttttctgtccaatgtttaccttg

SEQ ID NO: 215896 - DNA, 25 bp, Rattus norvegicus
atttttctgtccattatgttttcat

SEQ ID NO: 215897 - DNA, 25 bp, Rattus norvegicus
atttttctgtcctatgtttaccttg

SEQ ID NO: 215898 - DNA, 25 bp, Rattus norvegicus
atttttctgtcctttatgttttcat

SEQ ID NO: 215899 - DNA, 25 bp, Rattus norvegicus
atttttctgtttcctaccgtcacct

SEQ ID NO: 215900 - DNA, 25 bp, Rattus norvegicus
atttttctgtttcgttcattccagg

SEQ ID NO: 215901 - DNA, 25 bp, Rattus norvegicus
atttttctgtttgctaccgtcacct

SEQ ID NO: 215902 - DNA, 25 bp, Rattus norvegicus
atttttctgtttggttcattccagg

SEQ ID NO: 215903 - DNA, 25 bp, Rattus norvegicus
atttttcttatcatgctattggctt

SEQ ID NO: 215904 - DNA, 25 bp, Rattus norvegicus
atttttcttatcttgctattggctt

SEQ ID NO: 215905 - DNA, 25 bp, Rattus norvegicus
atttttcttgctacactggtgtaag

SEQ ID NO: 215906 - DNA, 25 bp, Rattus norvegicus
atttttcttgcttcactggtgtaag

SEQ ID NO: 215907 - DNA, 25 bp, Rattus norvegicus
atttttcttttaaatctcaaggaga

SEQ ID NO: 215908 - DNA, 25 bp, Rattus norvegicus
atttttcttttatatctcaaggaga

SEQ ID NO: 215909 - DNA, 25 bp, Rattus norvegicus
atttttgaaagtcagccggaggaca

SEQ ID NO: 215910 - DNA, 25 bp, Rattus norvegicus
atttttgaaagtgagccggaggaca

SEQ ID NO: 215911 - DNA, 25 bp, Rattus norvegicus
atttttgaagctcgctggtggacac

SEQ ID NO: 215912 - DNA, 25 bp, Rattus norvegicus
atttttgaagctggctggtggacac

SEQ ID NO: 215913 - DNA, 25 bp, Rattus norvegicus
atttttgaagtcacctgttgtctga

SEQ ID NO: 215914 - DNA, 25 bp, Rattus norvegicus
atttttgaagtctcctgttgtctga

SEQ ID NO: 215915 - DNA, 25 bp, Rattus norvegicus
atttttgaccagacttgaagcaagc

SEQ ID NO: 215916 - DNA, 25 bp, Rattus norvegicus
atttttgaccagtcttgaagcaagc

SEQ ID NO: 215917 - DNA, 25 bp, Rattus norvegicus
atttttgagtctcttgctggtgcca

SEQ ID NO: 215918 - DNA, 25 bp, Rattus norvegicus
atttttgagtctgttgctggtgcca

SEQ ID NO: 215919 - DNA, 25 bp, Rattus norvegicus
atttttgatgacatctcacactatg

SEQ ID NO: 215920 - DNA, 25 bp, Rattus norvegicus
atttttgatgacttctcacactatg

SEQ ID NO: 215921 - DNA, 25 bp, Rattus norvegicus
atttttgcagcaatccttgtcatca

SEQ ID NO: 215922 - DNA, 25 bp, Rattus norvegicus
atttttgcagcattccttgtcatca

SEQ ID NO: 215923 - DNA, 25 bp, Rattus norvegicus
atttttgcagggattgcacaggccc

SEQ ID NO: 215924 - DNA, 25 bp, Rattus norvegicus
atttttgcagggtttgcacaggccc

SEQ ID NO: 215925 - DNA, 25 bp, Rattus norvegicus
atttttgcagttactattggtccgc

SEQ ID NO: 215926 - DNA, 25 bp, Rattus norvegicus
atttttgcagtttctattggtccgc

SEQ ID NO: 215927 - DNA, 25 bp, Rattus norvegicus
atttttgcatttacctcggctgtat

SEQ ID NO: 215928 - DNA, 25 bp, Rattus norvegicus
atttttgcattttcctcggctgtat

SEQ ID NO: 215929 - DNA, 25 bp, Rattus norvegicus
atttttgccagtccggatttttctc

SEQ ID NO: 215930 - DNA, 25 bp, Rattus norvegicus
atttttgccagtgcggatttttctc

SEQ ID NO: 215931 - DNA, 25 bp, Rattus norvegicus
atttttgccctccaggaagacgaag

SEQ ID NO: 215932 - DNA, 25 bp, Rattus norvegicus
atttttgccctcgaggaagacgaag

SEQ ID NO: 215933 - DNA, 25 bp, Rattus norvegicus
atttttgcccttaagttgtctgata

SEQ ID NO: 215934 - DNA, 25 bp, Rattus norvegicus
atttttgccctttagttgtctgata

SEQ ID NO: 215935 - DNA, 25 bp, Rattus norvegicus
atttttgccttacctgagcttttct

SEQ ID NO: 215936 - DNA, 25 bp, Rattus norvegicus
atttttgccttagctgagcttttct

SEQ ID NO: 215937 - DNA, 25 bp, Rattus norvegicus
atttttgccttcagcagcgcttttc

SEQ ID NO: 215938 - DNA, 25 bp, Rattus norvegicus
atttttgccttctgcagcgcttttc

SEQ ID NO: 215939 - DNA, 25 bp, Rattus norvegicus
atttttgctactcaagcctcttata

SEQ ID NO: 215940 - DNA, 25 bp, Rattus norvegicus
atttttgctactgaagcctcttata

SEQ ID NO: 215941 - DNA, 25 bp, Rattus norvegicus
atttttgctgaaatcctttacaact

SEQ ID NO: 215942 - DNA, 25 bp, Rattus norvegicus
atttttgctgaattcctttacaact

SEQ ID NO: 215943 - DNA, 25 bp, Rattus norvegicus
atttttgctgagaacatgcctttaa

SEQ ID NO: 215944 - DNA, 25 bp, Rattus norvegicus
atttttgctgagtacatgcctttaa

SEQ ID NO: 215945 - DNA, 25 bp, Rattus norvegicus
atttttgctttgacatacctatctt

SEQ ID NO: 215946 - DNA, 25 bp, Rattus norvegicus
atttttgctttgtcatacctatctt

SEQ ID NO: 215947 - DNA, 25 bp, Rattus norvegicus
atttttggactcagctttttggtgg

SEQ ID NO: 215948 - DNA, 25 bp, Rattus norvegicus
atttttggactctgctttttggtgg

SEQ ID NO: 215949 - DNA, 25 bp, Rattus norvegicus
atttttggcaagatctgtcattttc

SEQ ID NO: 215950 - DNA, 25 bp, Rattus norvegicus
atttttggcaagttctgtcattttc

SEQ ID NO: 215951 - DNA, 25 bp, Rattus norvegicus
atttttggcattccaactggctgct

SEQ ID NO: 215952 - DNA, 25 bp, Rattus norvegicus
atttttggcattgcaactggctgct

SEQ ID NO: 215953 - DNA, 25 bp, Rattus norvegicus
atttttggctcacaggaggagtcta

SEQ ID NO: 215954 - DNA, 25 bp, Rattus norvegicus
atttttggctcagaggaggagtcta

SEQ ID NO: 215955 - DNA, 25 bp, Rattus norvegicus
atttttggctttccactgtgttctc

SEQ ID NO: 215956 - DNA, 25 bp, Rattus norvegicus
atttttggctttgcactgtgttctc

SEQ ID NO: 215957 - DNA, 25 bp, Rattus norvegicus
atttttgggatgaccttgttgacag

SEQ ID NO: 215958 - DNA, 25 bp, Rattus norvegicus
atttttgggatgtccttgttgacag

SEQ ID NO: 215959 - DNA, 25 bp, Rattus norvegicus
atttttggtgtcagcatggtttctg

SEQ ID NO: 215960 - DNA, 25 bp, Rattus norvegicus
atttttggtgtctgcatggtttctg

SEQ ID NO: 215961 - DNA, 25 bp, Rattus norvegicus
atttttgtaaaaatgctcgtgccta

SEQ ID NO: 215962 - DNA, 25 bp, Rattus norvegicus
atttttgtaaaattgctcgtgccta

SEQ ID NO: 215963 - DNA, 25 bp, Rattus norvegicus
atttttgtaacgatcagccttttgt

SEQ ID NO: 215964 - DNA, 25 bp, Rattus norvegicus
atttttgtaacgttcagccttttgt

SEQ ID NO: 215965 - DNA, 25 bp, Rattus norvegicus
atttttgtacagagcagcacacact

SEQ ID NO: 215966 - DNA, 25 bp, Rattus norvegicus
atttttgtacagtgcagcacacact

SEQ ID NO: 215967 - DNA, 25 bp, Rattus norvegicus
atttttgtatccaccacagtgccta

SEQ ID NO: 215968 - DNA, 25 bp, Rattus norvegicus
atttttgtatcctccacagtgccta

SEQ ID NO: 215969 - DNA, 25 bp, Rattus norvegicus
atttttgtcatccttcttgagcttc

SEQ ID NO: 215970 - DNA, 25 bp, Rattus norvegicus
atttttgtcatcgttcttgagcttc

SEQ ID NO: 215971 - DNA, 25 bp, Rattus norvegicus
atttttgtccctcgtgagcatgtga

SEQ ID NO: 215972 - DNA, 25 bp, Rattus norvegicus
atttttgtccctggtgagcatgtga

SEQ ID NO: 215973 - DNA, 25 bp, Rattus norvegicus
atttttgtctgactcatctgagcca

SEQ ID NO: 215974 - DNA, 25 bp, Rattus norvegicus
atttttgtctgagtcatctgagcca

SEQ ID NO: 215975 - DNA, 25 bp, Rattus norvegicus
atttttgtctttagcactgccaatg

SEQ ID NO: 215976 - DNA, 25 bp, Rattus norvegicus
atttttgtcttttgcactgccaatg

SEQ ID NO: 215977 - DNA, 25 bp, Rattus norvegicus
atttttgtgctgaagtttactccaa

SEQ ID NO: 215978 - DNA, 25 bp, Rattus norvegicus
atttttgtgctgtagtttactccaa

SEQ ID NO: 215979 - DNA, 25 bp, Rattus norvegicus
atttttgtgttacctgtcttctgaa

SEQ ID NO: 215980 - DNA, 25 bp, Rattus norvegicus
atttttgtgttagctgtcttctgaa

SEQ ID NO: 215981 - DNA, 25 bp, Rattus norvegicus
atttttgtgttgacttctctcttac

SEQ ID NO: 215982 - DNA, 25 bp, Rattus norvegicus
atttttgtgttgtcttctctcttac

SEQ ID NO: 215983 - DNA, 25 bp, Rattus norvegicus
atttttgttattcttgccatttcgc

SEQ ID NO: 215984 - DNA, 25 bp, Rattus norvegicus
atttttgttattgttgccatttcgc

SEQ ID NO: 215985 - DNA, 25 bp, Rattus norvegicus
atttttgttcaaatccaagcaggcc

SEQ ID NO: 215986 - DNA, 25 bp, Rattus norvegicus
atttttgttcaattccaagcaggcc

SEQ ID NO: 215987 - DNA, 25 bp, Rattus norvegicus
atttttgttctcatctaaatgtgca

SEQ ID NO: 215988 - DNA, 25 bp, Rattus norvegicus
atttttgttctcttctaaatgtgca

SEQ ID NO: 215989 - DNA, 25 bp, Rattus norvegicus
atttttgtttttcccactgcttgga

SEQ ID NO: 215990 - DNA, 25 bp, Rattus norvegicus
atttttgtttttgccactgcttgga

SEQ ID NO: 215991 - DNA, 25 bp, Rattus norvegicus
attttttaccatccaactgacagag

SEQ ID NO: 215992 - DNA, 25 bp, Rattus norvegicus
attttttaccatgcaactgacagag

SEQ ID NO: 215993 - DNA, 25 bp, Rattus norvegicus
attttttagactcctctgctccctg

SEQ ID NO: 215994 - DNA, 25 bp, Rattus norvegicus
attttttagactgctctgctccctg

SEQ ID NO: 215995 - DNA, 25 bp, Rattus norvegicus
attttttcagcacagcagacctacg

SEQ ID NO: 215996 - DNA, 25 bp, Rattus norvegicus
attttttcagcagagcagacctacg

SEQ ID NO: 215997 - DNA, 25 bp, Rattus norvegicus
attttttcatgtctgccctaaggga

SEQ ID NO: 215998 - DNA, 25 bp, Rattus norvegicus
attttttcatgtgtgccctaaggga

SEQ ID NO: 215999 - DNA, 25 bp, Rattus norvegicus
attttttccttcatgctgggactac

SEQ ID NO: 216000 - DNA, 25 bp, Rattus norvegicus
attttttccttcttgctgggactac

SEQ ID NO: 216001 - DNA, 25 bp, Rattus norvegicus
attttttcgtctagtcattttgcca

SEQ ID NO: 216002 - DNA, 25 bp, Rattus norvegicus
attttttcgtcttgtcattttgcca

SEQ ID NO: 216003 - DNA, 25 bp, Rattus norvegicus
attttttctggtccacagttaagag

SEQ ID NO: 216004 - DNA, 25 bp, Rattus norvegicus
attttttctggtgcacagttaagag

SEQ ID NO: 216005 - DNA, 25 bp, Rattus norvegicus
attttttctgttacactggtgatca

SEQ ID NO: 216006 - DNA, 25 bp, Rattus norvegicus
attttttctgtttcactggtgatca

SEQ ID NO: 216007 - DNA, 25 bp, Rattus norvegicus
attttttgcaacatggatttccagt

SEQ ID NO: 216008 - DNA, 25 bp, Rattus norvegicus
attttttgcaacttggatttccagt

SEQ ID NO: 216009 - DNA, 25 bp, Rattus norvegicus
attttttgctaaaacccatttggag

SEQ ID NO: 216010 - DNA, 25 bp, Rattus norvegicus
attttttgctaatacccatttggag

SEQ ID NO: 216011 - DNA, 25 bp, Rattus norvegicus
attttttggcacagcgcagtcagca

SEQ ID NO: 216012 - DNA, 25 bp, Rattus norvegicus
attttttggcactgcgcagtcagca

SEQ ID NO: 216013 - DNA, 25 bp, Rattus norvegicus
attttttggcatcgcttggttacct

SEQ ID NO: 216014 - DNA, 25 bp, Rattus norvegicus
attttttggcatggcttggttacct

SEQ ID NO: 216015 - DNA, 25 bp, Rattus norvegicus
attttttgtatcagggtgcattctc

SEQ ID NO: 216016 - DNA, 25 bp, Rattus norvegicus
attttttgtatctgggtgcattctc

SEQ ID NO: 216017 - DNA, 25 bp, Rattus norvegicus
attttttgtcatacttgccgaccac

SEQ ID NO: 216018 - DNA, 25 bp, Rattus norvegicus
attttttgtcattcttgccgaccac

SEQ ID NO: 216019 - DNA, 25 bp, Rattus norvegicus
attttttgtctgattactgctcctc

SEQ ID NO: 216020 - DNA, 25 bp, Rattus norvegicus
attttttgtctgtttactgctcctc

SEQ ID NO: 216021 - DNA, 25 bp, Rattus norvegicus
caaaaaaaaatcatctcggagtcct

SEQ ID NO: 216022 - DNA, 25 bp, Rattus norvegicus
caaaaaaaaatcttctcggagtcct

SEQ ID NO: 216023 - DNA, 25 bp, Rattus norvegicus
caaaaaagctcgctcctgaggactg

SEQ ID NO: 216024 - DNA, 25 bp, Rattus norvegicus
caaaaaagctcggtcctgaggactg

SEQ ID NO: 216025 - DNA, 25 bp, Rattus norvegicus
caaaaaaggcttatctcagccgtgg

SEQ ID NO: 216026 - DNA, 25 bp, Rattus norvegicus
caaaaaaggcttttctcagccgtgg

SEQ ID NO: 216027 - DNA, 25 bp, Rattus norvegicus
caaaaaaggtctagcctctgtccct

SEQ ID NO: 216028 - DNA, 25 bp, Rattus norvegicus
caaaaaaggtcttgcctctgtccct

SEQ ID NO: 216029 - DNA, 25 bp, Rattus norvegicus
caaaaaagttaaatagtcagcaaga

SEQ ID NO: 216030 - DNA, 25 bp, Rattus norvegicus
caaaaaagttaattagtcagcaaga

SEQ ID NO: 216031 - DNA, 25 bp, Rattus norvegicus
caaaaaattcttcactcaaggttgg

SEQ ID NO: 216032 - DNA, 25 bp, Rattus norvegicus
caaaaaattcttgactcaaggttgg

SEQ ID NO: 216033 - DNA, 25 bp, Rattus norvegicus
caaaaacaatgcactggtctcacag

SEQ ID NO: 216034 - DNA, 25 bp, Rattus norvegicus
caaaaacaatgctctggtctcacag

SEQ ID NO: 216035 - DNA, 25 bp, Rattus norvegicus
caaaaacatcctcagcagcggcgcg

SEQ ID NO: 216036 - DNA, 25 bp, Rattus norvegicus
caaaaacatcctgagcagcggcgcg

SEQ ID NO: 216037 - DNA, 25 bp, Rattus norvegicus
caaaaaccagtgatggatactaggg

SEQ ID NO: 216038 - DNA, 25 bp, Rattus norvegicus
caaaaaccagtgttggatactaggg

SEQ ID NO: 216039 - DNA, 25 bp, Rattus norvegicus
caaaaaccctttcgtcaggctgtgg

SEQ ID NO: 216040 - DNA, 25 bp, Rattus norvegicus
caaaaaccctttggtcaggctgtgg

SEQ ID NO: 216041 - DNA, 25 bp, Rattus norvegicus
caaaaactctctacagtcctaaggt

SEQ ID NO: 216042 - DNA, 25 bp, Rattus norvegicus
caaaaactctcttcagtcctaaggt

SEQ ID NO: 216043 - DNA, 25 bp, Rattus norvegicus
caaaaagaacagctactcctacggc

SEQ ID NO: 216044 - DNA, 25 bp, Rattus norvegicus
caaaaagaacaggtactcctacggc

SEQ ID NO: 216045 - DNA, 25 bp, Rattus norvegicus
caaaaagaccaccaggaagccacct

SEQ ID NO: 216046 - DNA, 25 bp, Rattus norvegicus
caaaaagaccacgaggaagccacct

SEQ ID NO: 216047 - DNA, 25 bp, Rattus norvegicus
caaaaagagcgcaaccccaaagagt

SEQ ID NO: 216048 - DNA, 25 bp, Rattus norvegicus
caaaaagagcgctaccccaaagagt

SEQ ID NO: 216049 - DNA, 25 bp, Rattus norvegicus
caaaaagcagagcatccaggcatgg

SEQ ID NO: 216050 - DNA, 25 bp, Rattus norvegicus
caaaaagcagaggatccaggcatgg

SEQ ID NO: 216051 - DNA, 25 bp, Rattus norvegicus
caaaaaggctctaagtccctatcgg

SEQ ID NO: 216052 - DNA, 25 bp, Rattus norvegicus
caaaaaggctcttagtccctatcgg

SEQ ID NO: 216053 - DNA, 25 bp, Rattus norvegicus
caaaaaggctttcccagagtgctga

SEQ ID NO: 216054 - DNA, 25 bp, Rattus norvegicus
caaaaaggctttgccagagtgctga

SEQ ID NO: 216055 - DNA, 25 bp, Rattus norvegicus
caaaaagggcttacctgttgccgct

SEQ ID NO: 216056 - DNA, 25 bp, Rattus norvegicus
caaaaagggctttcctgttgccgct

SEQ ID NO: 216057 - DNA, 25 bp, Rattus norvegicus
caaaaagtagccatcatggtcccgt

SEQ ID NO: 216058 - DNA, 25 bp, Rattus norvegicus
caaaaagtagccttcatggtcccgt

SEQ ID NO: 216059 - DNA, 25 bp, Rattus norvegicus
caaaaagtccggacttacgtgtctg

SEQ ID NO: 216060 - DNA, 25 bp, Rattus norvegicus
caaaaagtccggtcttacgtgtctg

SEQ ID NO: 216061 - DNA, 25 bp, Rattus norvegicus
caaaaagttttgctccatgggctga

SEQ ID NO: 216062 - DNA, 25 bp, Rattus norvegicus
caaaaagttttggtccatgggctga

SEQ ID NO: 216063 - DNA, 25 bp, Rattus norvegicus
caaaaatacatacctgtcctttgct

SEQ ID NO: 216064 - DNA, 25 bp, Rattus norvegicus
caaaaatacatagctgtcctttgct

SEQ ID NO: 216065 - DNA, 25 bp, Rattus norvegicus
caaaaataggttactggcctctaca

SEQ ID NO: 216066 - DNA, 25 bp, Rattus norvegicus
caaaaataggtttctggcctctaca

SEQ ID NO: 216067 - DNA, 25 bp, Rattus norvegicus
caaaaatccccactagttgctgtac

SEQ ID NO: 216068 - DNA, 25 bp, Rattus norvegicus
caaaaatccccagtagttgctgtac

SEQ ID NO: 216069 - DNA, 25 bp, Rattus norvegicus
caaaaatgaagtctcccgacgggag

SEQ ID NO: 216070 - DNA, 25 bp, Rattus norvegicus
caaaaatgaagtgtcccgacgggag

SEQ ID NO: 216071 - DNA, 25 bp, Rattus norvegicus
caaaaatggagacccgggcgcagct

SEQ ID NO: 216072 - DNA, 25 bp, Rattus norvegicus
caaaaatggagagccgggcgcagct

SEQ ID NO: 216073 - DNA, 25 bp, Rattus norvegicus
caaaaatggcagcagtgagcacaga

SEQ ID NO: 216074 - DNA, 25 bp, Rattus norvegicus
caaaaatggcaggagtgagcacaga

SEQ ID NO: 216075 - DNA, 25 bp, Rattus norvegicus
caaaaatggcatacggtccgtccgc

SEQ ID NO: 216076 - DNA, 25 bp, Rattus norvegicus
caaaaatggcatctcctggtctcac

SEQ ID NO: 216077 - DNA, 25 bp, Rattus norvegicus
caaaaatggcatgtcctggtctcac

SEQ ID NO: 216078 - DNA, 25 bp, Rattus norvegicus
caaaaatggcattcggtccgtccgc

SEQ ID NO: 216079 - DNA, 25 bp, Rattus norvegicus
caaaaatggccacgtattgttcctt

SEQ ID NO: 216080 - DNA, 25 bp, Rattus norvegicus
caaaaatggccaggtattgttcctt

SEQ ID NO: 216081 - DNA, 25 bp, Rattus norvegicus
caaaaatgtctccttgcctgacaaa

SEQ ID NO: 216082 - DNA, 25 bp, Rattus norvegicus
caaaaatgtctcgttgcctgacaaa

SEQ ID NO: 216083 - DNA, 25 bp, Rattus norvegicus
caaaacaacgggatctgagagggta

SEQ ID NO: 216084 - DNA, 25 bp, Rattus norvegicus
caaaacaacgggttctgagagggta

SEQ ID NO: 216085 - DNA, 25 bp, Rattus norvegicus
caaaacaagtgcactgtcctccaga

SEQ ID NO: 216086 - DNA, 25 bp, Rattus norvegicus
caaaacaagtgctctgtcctccaga

SEQ ID NO: 216087 - DNA, 25 bp, Rattus norvegicus
caaaacaccggaagtccctgagcag

SEQ ID NO: 216088 - DNA, 25 bp, Rattus norvegicus
caaaacaccggatgtccctgagcag

SEQ ID NO: 216089 - DNA, 25 bp, Rattus norvegicus
caaaacacggccatgctgcatatgt

SEQ ID NO: 216090 - DNA, 25 bp, Rattus norvegicus
caaaacacggccttgctgcatatgt

SEQ ID NO: 216091 - DNA, 25 bp, Rattus norvegicus
caaaacatgatgaccaactccagcc

SEQ ID NO: 216092 - DNA, 25 bp, Rattus norvegicus
caaaacatgatgtccaactccagcc

SEQ ID NO: 216093 - DNA, 25 bp, Rattus norvegicus
caaaacatgggactgccctgaacag

SEQ ID NO: 216094 - DNA, 25 bp, Rattus norvegicus
caaaacatgggagtgccctgaacag

SEQ ID NO: 216095 - DNA, 25 bp, Rattus norvegicus
caaaacattgggatgcaaagttgct

SEQ ID NO: 216096 - DNA, 25 bp, Rattus norvegicus
caaaacattgggttgcaaagttgct

SEQ ID NO: 216097 - DNA, 25 bp, Rattus norvegicus
caaaaccaactccaactgtagtctt

SEQ ID NO: 216098 - DNA, 25 bp, Rattus norvegicus
caaaaccaactcgaactgtagtctt

SEQ ID NO: 216099 - DNA, 25 bp, Rattus norvegicus
caaaaccaccatatcctcttgtaga

SEQ ID NO: 216100 - DNA, 25 bp, Rattus norvegicus
caaaaccaccatttcctcttgtaga

SEQ ID NO: 216101 - DNA, 25 bp, Rattus norvegicus
caaaaccactctcttgtctaccttt

SEQ ID NO: 216102 - DNA, 25 bp, Rattus norvegicus
caaaaccactctgttgtctaccttt

SEQ ID NO: 216103 - DNA, 25 bp, Rattus norvegicus
caaaacccaaaaatgccttctacag

SEQ ID NO: 216104 - DNA, 25 bp, Rattus norvegicus
caaaacccaaaattgccttctacag

SEQ ID NO: 216105 - DNA, 25 bp, Rattus norvegicus
caaaaccctcaacctgcgtttgtat

SEQ ID NO: 216106 - DNA, 25 bp, Rattus norvegicus
caaaaccctcaagctgcgtttgtat

SEQ ID NO: 216107 - DNA, 25 bp, Rattus norvegicus
caaaaccggaagagtctacaatgtc

SEQ ID NO: 216108 - DNA, 25 bp, Rattus norvegicus
caaaaccggaagtgtctacaatgtc

SEQ ID NO: 216109 - DNA, 25 bp, Rattus norvegicus
caaaaccggctacatttttgcatga

SEQ ID NO: 216110 - DNA, 25 bp, Rattus norvegicus
caaaaccggctagatttttgcatga

SEQ ID NO: 216111 - DNA, 25 bp, Rattus norvegicus
caaaacctatgcactagtcaccgtt

SEQ ID NO: 216112 - DNA, 25 bp, Rattus norvegicus
caaaacctatgctctagtcaccgtt

SEQ ID NO: 216113 - DNA, 25 bp, Rattus norvegicus
caaaacctcaagaggcggtctccaa

SEQ ID NO: 216114 - DNA, 25 bp, Rattus norvegicus
caaaacctcaagtggcggtctccaa

SEQ ID NO: 216115 - DNA, 25 bp, Rattus norvegicus
caaaacctcgctccacatgctagag

SEQ ID NO: 216116 - DNA, 25 bp, Rattus norvegicus
caaaacctcgctgcacatgctagag

SEQ ID NO: 216117 - DNA, 25 bp, Rattus norvegicus
caaaacctctacacatggatgctcc

SEQ ID NO: 216118 - DNA, 25 bp, Rattus norvegicus
caaaacctctactcatggatgctcc

SEQ ID NO: 216119 - DNA, 25 bp, Rattus norvegicus
caaaacctcttgctgactatactac

SEQ ID NO: 216120 - DNA, 25 bp, Rattus norvegicus
caaaacctcttggtgactatactac

SEQ ID NO: 216121 - DNA, 25 bp, Rattus norvegicus
caaaacctgtgtctgggccaatgtc

SEQ ID NO: 216122 - DNA, 25 bp, Rattus norvegicus
caaaacctgtgtgtgggccaatgtc

SEQ ID NO: 216123 - DNA, 25 bp, Rattus norvegicus
caaaaccttgagagtctacaatgtc

SEQ ID NO: 216124 - DNA, 25 bp, Rattus norvegicus
caaaaccttgagtgtctacaatgtc

SEQ ID NO: 216125 - DNA, 25 bp, Rattus norvegicus
caaaacgtgttcactttgtaggaca

SEQ ID NO: 216126 - DNA, 25 bp, Rattus norvegicus
caaaacgtgttctctttgtaggaca

SEQ ID NO: 216127 - DNA, 25 bp, Rattus norvegicus
caaaactatcttagtggaggtcaca

SEQ ID NO: 216128 - DNA, 25 bp, Rattus norvegicus
caaaactatctttgtggaggtcaca

SEQ ID NO: 216129 - DNA, 25 bp, Rattus norvegicus
caaaactgattaagagggacgagac

SEQ ID NO: 216130 - DNA, 25 bp, Rattus norvegicus
caaaactgattatgagggacgagac

SEQ ID NO: 216131 - DNA, 25 bp, Rattus norvegicus
caaaactgctaacggtctcaagaca

SEQ ID NO: 216132 - DNA, 25 bp, Rattus norvegicus
caaaactgctaagggtctcaagaca

SEQ ID NO: 216133 - DNA, 25 bp, Rattus norvegicus
caaaactggatccatgctcatgcat

SEQ ID NO: 216134 - DNA, 25 bp, Rattus norvegicus
caaaactggatcgatgctcatgcat

SEQ ID NO: 216135 - DNA, 25 bp, Rattus norvegicus
caaaactggctcatttgttggcttc

SEQ ID NO: 216136 - DNA, 25 bp, Rattus norvegicus
caaaactggctcttttgttggcttc

SEQ ID NO: 216137 - DNA, 25 bp, Rattus norvegicus
caaaactgtaggcatcttctttctc

SEQ ID NO: 216138 - DNA, 25 bp, Rattus norvegicus
caaaactgtagggatcttctttctc

SEQ ID NO: 216139 - DNA, 25 bp, Rattus norvegicus
caaaactgtcatatcccatgggatg

SEQ ID NO: 216140 - DNA, 25 bp, Rattus norvegicus
caaaactgtcatttcccatgggatg

SEQ ID NO: 216141 - DNA, 25 bp, Rattus norvegicus
caaaactgtgagacgcgtatgccaa

SEQ ID NO: 216142 - DNA, 25 bp, Rattus norvegicus
caaaactgtgagtcgcgtatgccaa

SEQ ID NO: 216143 - DNA, 25 bp, Rattus norvegicus
caaaactgtttcatctttgtgcacc

SEQ ID NO: 216144 - DNA, 25 bp, Rattus norvegicus
caaaactgtttcttctttgtgcacc

SEQ ID NO: 216145 - DNA, 25 bp, Rattus norvegicus
caaaacttacttctggagagtccgg

SEQ ID NO: 216146 - DNA, 25 bp, Rattus norvegicus
caaaacttacttgtggagagtccgg

SEQ ID NO: 216147 - DNA, 25 bp, Rattus norvegicus
caaaacttcatcagtcgtgtggctc

SEQ ID NO: 216148 - DNA, 25 bp, Rattus norvegicus
caaaacttcatctgtcgtgtggctc

SEQ ID NO: 216149 - DNA, 25 bp, Rattus norvegicus
caaaacttgcacctgactctgaatc

SEQ ID NO: 216150 - DNA, 25 bp, Rattus norvegicus
caaaacttgcacgtgactctgaatc

SEQ ID NO: 216151 - DNA, 25 bp, Rattus norvegicus
caaaacttggccagactagttctaa

SEQ ID NO: 216152 - DNA, 25 bp, Rattus norvegicus
caaaacttggcctgactagttctaa

SEQ ID NO: 216153 - DNA, 25 bp, Rattus norvegicus
caaaagaaaggtactcaggctggcc

SEQ ID NO: 216154 - DNA, 25 bp, Rattus norvegicus
caaaagaaaggttctcaggctggcc

SEQ ID NO: 216155 - DNA, 25 bp, Rattus norvegicus
caaaagaacggtcggcctggcctga

SEQ ID NO: 216156 - DNA, 25 bp, Rattus norvegicus
caaaagaacggtgggcctggcctga

SEQ ID NO: 216157 - DNA, 25 bp, Rattus norvegicus
caaaagaaggctccctggtgcggct

SEQ ID NO: 216158 - DNA, 25 bp, Rattus norvegicus
caaaagaaggctgcctggtgcggct

SEQ ID NO: 216159 - DNA, 25 bp, Rattus norvegicus
caaaagagaataatcaggctttatt

SEQ ID NO: 216160 - DNA, 25 bp, Rattus norvegicus
caaaagagaatattcaggctttatt

SEQ ID NO: 216161 - DNA, 25 bp, Rattus norvegicus
caaaagatctgtcccctgtgtttca

SEQ ID NO: 216162 - DNA, 25 bp, Rattus norvegicus
caaaagatctgtgccctgtgtttca

SEQ ID NO: 216163 - DNA, 25 bp, Rattus norvegicus
caaaagcactttaaccacatggaga

SEQ ID NO: 216164 - DNA, 25 bp, Rattus norvegicus
caaaagcacttttaccacatggaga

SEQ ID NO: 216165 - DNA, 25 bp, Rattus norvegicus
caaaagcaggccctgcaactgcctg

SEQ ID NO: 216166 - DNA, 25 bp, Rattus norvegicus
caaaagcaggccgtgcaactgcctg

SEQ ID NO: 216167 - DNA, 25 bp, Rattus norvegicus
caaaagcaggtactgtgccgtccct

SEQ ID NO: 216168 - DNA, 25 bp, Rattus norvegicus
caaaagcaggtagtgtgccgtccct

SEQ ID NO: 216169 - DNA, 25 bp, Rattus norvegicus
caaaagcatcttctggcatttccca

SEQ ID NO: 216170 - DNA, 25 bp, Rattus norvegicus
caaaagcatcttgtggcatttccca

SEQ ID NO: 216171 - DNA, 25 bp, Rattus norvegicus
caaaagcatgttcttggaaactaaa

SEQ ID NO: 216172 - DNA, 25 bp, Rattus norvegicus
caaaagcatgttgttggaaactaaa

SEQ ID NO: 216173 - DNA, 25 bp, Rattus norvegicus
caaaagccttatagggttggtggtg

SEQ ID NO: 216174 - DNA, 25 bp, Rattus norvegicus
caaaagccttattgggttggtggtg

SEQ ID NO: 216175 - DNA, 25 bp, Rattus norvegicus
caaaagctaactatggtggcctgag

SEQ ID NO: 216176 - DNA, 25 bp, Rattus norvegicus
caaaagctaactttggtggcctgag

SEQ ID NO: 216177 - DNA, 25 bp, Rattus norvegicus
caaaagctaggaatccccagggttg

SEQ ID NO: 216178 - DNA, 25 bp, Rattus norvegicus
caaaagctaggattccccagggttg

SEQ ID NO: 216179 - DNA, 25 bp, Rattus norvegicus
caaaagctctgtaaccgggcaaaat

SEQ ID NO: 216180 - DNA, 25 bp, Rattus norvegicus
caaaagctctgttaccgggcaaaat

SEQ ID NO: 216181 - DNA, 25 bp, Rattus norvegicus
caaaagctgtctccgtcatcatcat

SEQ ID NO: 216182 - DNA, 25 bp, Rattus norvegicus
caaaagctgtctgcgtcatcatcat

SEQ ID NO: 216183 - DNA, 25 bp, Rattus norvegicus
caaaaggaaggcactggagctgcca

SEQ ID NO: 216184 - DNA, 25 bp, Rattus norvegicus
caaaaggaaggctctggagctgcca

SEQ ID NO: 216185 - DNA, 25 bp, Rattus norvegicus
caaaaggacaccataaccccagatt

SEQ ID NO: 216186 - DNA, 25 bp, Rattus norvegicus
caaaaggacaccttaaccccagatt

SEQ ID NO: 216187 - DNA, 25 bp, Rattus norvegicus
caaaaggagcttccctcctattctt

SEQ ID NO: 216188 - DNA, 25 bp, Rattus norvegicus
caaaaggagcttgcctcctattctt

SEQ ID NO: 216189 - DNA, 25 bp, Rattus norvegicus
caaaaggcacctatattgaccttgg

SEQ ID NO: 216190 - DNA, 25 bp, Rattus norvegicus
caaaaggcacctttattgaccttgg

SEQ ID NO: 216191 - DNA, 25 bp, Rattus norvegicus
caaaaggccattatatatactgggt

SEQ ID NO: 216192 - DNA, 25 bp, Rattus norvegicus
caaaaggccattttatatactgggt

SEQ ID NO: 216193 - DNA, 25 bp, Rattus norvegicus
caaaaggcctttatcatagctcaac

SEQ ID NO: 216194 - DNA, 25 bp, Rattus norvegicus
caaaaggcctttttcatagctcaac

SEQ ID NO: 216195 - DNA, 25 bp, Rattus norvegicus
caaaaggcggacatgccgtgctcat

SEQ ID NO: 216196 - DNA, 25 bp, Rattus norvegicus
caaaaggcggacttgccgtgctcat

SEQ ID NO: 216197 - DNA, 25 bp, Rattus norvegicus
caaaaggctccaacactgtgtgaca

SEQ ID NO: 216198 - DNA, 25 bp, Rattus norvegicus
caaaaggctccatcactgtgtgaca

SEQ ID NO: 216199 - DNA, 25 bp, Rattus norvegicus
caaaaggctgtgagccccagtttga

SEQ ID NO: 216200 - DNA, 25 bp, Rattus norvegicus
caaaaggctgtgtgccccagtttga

SEQ ID NO: 216201 - DNA, 25 bp, Rattus norvegicus
caaaaggctttcactccagggttgg

SEQ ID NO: 216202 - DNA, 25 bp, Rattus norvegicus
caaaaggctttctctccagggttgg

SEQ ID NO: 216203 - DNA, 25 bp, Rattus norvegicus
caaaaggtggtacagctcagctcca

SEQ ID NO: 216204 - DNA, 25 bp, Rattus norvegicus
caaaaggtggtagagctcagctcca

SEQ ID NO: 216205 - DNA, 25 bp, Rattus norvegicus
caaaaggttcccacagagaaggcaa

SEQ ID NO: 216206 - DNA, 25 bp, Rattus norvegicus
caaaaggttccctcagagaaggcaa

SEQ ID NO: 216207 - DNA, 25 bp, Rattus norvegicus
caaaaggttgctctcccgtgattaa

SEQ ID NO: 216208 - DNA, 25 bp, Rattus norvegicus
caaaaggttgctgtcccgtgattaa

SEQ ID NO: 216209 - DNA, 25 bp, Rattus norvegicus
caaaagtcaattcgaccaggccctt

SEQ ID NO: 216210 - DNA, 25 bp, Rattus norvegicus
caaaagtcaattggaccaggccctt

SEQ ID NO: 216211 - DNA, 25 bp, Rattus norvegicus
caaaagtcaggtaggagcagcgccg

SEQ ID NO: 216212 - DNA, 25 bp, Rattus norvegicus
caaaagtcaggttggagcagcgccg

SEQ ID NO: 216213 - DNA, 25 bp, Rattus norvegicus
caaaagtcatttccctctggatgta

SEQ ID NO: 216214 - DNA, 25 bp, Rattus norvegicus
caaaagtcatttgcctctggatgta

SEQ ID NO: 216215 - DNA, 25 bp, Rattus norvegicus
caaaagtgtcagacatttctcctct

SEQ ID NO: 216216 - DNA, 25 bp, Rattus norvegicus
caaaagtgtcagtcatttctcctct

SEQ ID NO: 216217 - DNA, 25 bp, Rattus norvegicus
caaaagtgtgtgactgccttcaagt

SEQ ID NO: 216218 - DNA, 25 bp, Rattus norvegicus
caaaagtgtgtgtctgccttcaagt

SEQ ID NO: 216219 - DNA, 25 bp, Rattus norvegicus
caaaagttgccaatccagggctggg

SEQ ID NO: 216220 - DNA, 25 bp, Rattus norvegicus
caaaagttgccattccagggctggg

SEQ ID NO: 216221 - DNA, 25 bp, Rattus norvegicus
caaaagtttggtcggctggatttcg

SEQ ID NO: 216222 - DNA, 25 bp, Rattus norvegicus
caaaagtttggtgggctggatttcg

SEQ ID NO: 216223 - DNA, 25 bp, Rattus norvegicus
caaaatacctggaggaatagatatt

SEQ ID NO: 216224 - DNA, 25 bp, Rattus norvegicus
caaaatacctggtggaatagatatt

SEQ ID NO: 216225 - DNA, 25 bp, Rattus norvegicus
caaaatacgtcaacataatctgtgg

SEQ ID NO: 216226 - DNA, 25 bp, Rattus norvegicus
caaaatacgtcatcataatctgtgg

SEQ ID NO: 216227 - DNA, 25 bp, Rattus norvegicus
caaaatactactactgccagcagat

SEQ ID NO: 216228 - DNA, 25 bp, Rattus norvegicus
caaaatactacttctgccagcagat

SEQ ID NO: 216229 - DNA, 25 bp, Rattus norvegicus
caaaatactcagaagccataggcaa

SEQ ID NO: 216230 - DNA, 25 bp, Rattus norvegicus
caaaatactcagtagccataggcaa

SEQ ID NO: 216231 - DNA, 25 bp, Rattus norvegicus
caaaataggcgaagtctcttctccc

SEQ ID NO: 216232 - DNA, 25 bp, Rattus norvegicus
caaaataggcgatgtctcttctccc

SEQ ID NO: 216233 - DNA, 25 bp, Rattus norvegicus
caaaataggtaccaggccctgtgca

SEQ ID NO: 216234 - DNA, 25 bp, Rattus norvegicus
caaaataggtacgaggccctgtgca

SEQ ID NO: 216235 - DNA, 25 bp, Rattus norvegicus
caaaataggttgaaatgtttccaag

SEQ ID NO: 216236 - DNA, 25 bp, Rattus norvegicus
caaaataggttgtaatgtttccaag

SEQ ID NO: 216237 - DNA, 25 bp, Rattus norvegicus
caaaatatagctctgcactgcaact

SEQ ID NO: 216238 - DNA, 25 bp, Rattus norvegicus
caaaatatagctgtgcactgcaact

SEQ ID NO: 216239 - DNA, 25 bp, Rattus norvegicus
caaaatatgttgaggctggtgccaa

SEQ ID NO: 216240 - DNA, 25 bp, Rattus norvegicus
caaaatatgttgtggctggtgccaa

SEQ ID NO: 216241 - DNA, 25 bp, Rattus norvegicus
caaaatcaagtgaccataatggctt

SEQ ID NO: 216242 - DNA, 25 bp, Rattus norvegicus
caaaatcaagtgtccataatggctt

SEQ ID NO: 216243 - DNA, 25 bp, Rattus norvegicus
caaaatcaggtcagtggagaggaac

SEQ ID NO: 216244 - DNA, 25 bp, Rattus norvegicus
caaaatcaggtctgtggagaggaac

SEQ ID NO: 216245 - DNA, 25 bp, Rattus norvegicus
caaaatcatcatcggctgcttcgtg

SEQ ID NO: 216246 - DNA, 25 bp, Rattus norvegicus
caaaatcatcatgggctgcttcgtg

SEQ ID NO: 216247 - DNA, 25 bp, Rattus norvegicus
caaaatcatgccatggctagagcat

SEQ ID NO: 216248 - DNA, 25 bp, Rattus norvegicus
caaaatcatgccttggctagagcat

SEQ ID NO: 216249 - DNA, 25 bp, Rattus norvegicus
caaaatccactcagtcctcttggag

SEQ ID NO: 216250 - DNA, 25 bp, Rattus norvegicus
caaaatccactctgtcctcttggag

SEQ ID NO: 216251 - DNA, 25 bp, Rattus norvegicus
caaaatcccactagtttcaccagaa

SEQ ID NO: 216252 - DNA, 25 bp, Rattus norvegicus
caaaatcccacttgtttcaccagaa

SEQ ID NO: 216253 - DNA, 25 bp, Rattus norvegicus
caaaatccctgcagtgaacgtgcca

SEQ ID NO: 216254 - DNA, 25 bp, Rattus norvegicus
caaaatccctgctgtgaacgtgcca

SEQ ID NO: 216255 - DNA, 25 bp, Rattus norvegicus
caaaatcctggaaatggcacaggct

SEQ ID NO: 216256 - DNA, 25 bp, Rattus norvegicus
caaaatcctggatatggcacaggct

SEQ ID NO: 216257 - DNA, 25 bp, Rattus norvegicus
caaaatcgatttaattgcagccaaa

SEQ ID NO: 216258 - DNA, 25 bp, Rattus norvegicus
caaaatcgattttattgcagccaaa

SEQ ID NO: 216259 - DNA, 25 bp, Rattus norvegicus
caaaatctgcatccgagtggcccac

SEQ ID NO: 216260 - DNA, 25 bp, Rattus norvegicus
caaaatctgcatgcgagtggcccac

SEQ ID NO: 216261 - DNA, 25 bp, Rattus norvegicus
caaaatctgcttcttcacctgtaag

SEQ ID NO: 216262 - DNA, 25 bp, Rattus norvegicus
caaaatctgcttgttcacctgtaag

SEQ ID NO: 216263 - DNA, 25 bp, Rattus norvegicus
caaaatctggttctgtggtaggcta

SEQ ID NO: 216264 - DNA, 25 bp, Rattus norvegicus
caaaatctggttgtgtggtaggcta

SEQ ID NO: 216265 - DNA, 25 bp, Rattus norvegicus
caaaatctttgtaccccggcgtgag

SEQ ID NO: 216266 - DNA, 25 bp, Rattus norvegicus
caaaatctttgttccccggcgtgag

SEQ ID NO: 216267 - DNA, 25 bp, Rattus norvegicus
caaaatcttttaatcactgccagtg

SEQ ID NO: 216268 - DNA, 25 bp, Rattus norvegicus
caaaatcttttattcactgccagtg

SEQ ID NO: 216269 - DNA, 25 bp, Rattus norvegicus
caaaatgagagaatccctatgtgga

SEQ ID NO: 216270 - DNA, 25 bp, Rattus norvegicus
caaaatgagagattccctatgtgga

SEQ ID NO: 216271 - DNA, 25 bp, Rattus norvegicus
caaaatgattcgctgggaggactat

SEQ ID NO: 216272 - DNA, 25 bp, Rattus norvegicus
caaaatgattcggtgggaggactat

SEQ ID NO: 216273 - DNA, 25 bp, Rattus norvegicus
caaaatgcgattacagtctatgtgc

SEQ ID NO: 216274 - DNA, 25 bp, Rattus norvegicus
caaaatgcgatttcagtctatgtgc

SEQ ID NO: 216275 - DNA, 25 bp, Rattus norvegicus
caaaatgctcttccatgatttttta

SEQ ID NO: 216276 - DNA, 25 bp, Rattus norvegicus
caaaatgctcttgcatgatttttta

SEQ ID NO: 216277 - DNA, 25 bp, Rattus norvegicus
caaaatgcttgtaggctctgcctaa

SEQ ID NO: 216278 - DNA, 25 bp, Rattus norvegicus
caaaatgcttgttggctctgcctaa

SEQ ID NO: 216279 - DNA, 25 bp, Rattus norvegicus
caaaatggattgactcccgtgtctc

SEQ ID NO: 216280 - DNA, 25 bp, Rattus norvegicus
caaaatggattgtctcccgtgtctc

SEQ ID NO: 216281 - DNA, 25 bp, Rattus norvegicus
caaaatggcacacaaaaccagatcc

SEQ ID NO: 216282 - DNA, 25 bp, Rattus norvegicus
caaaatggcacagaaaaccagatcc

SEQ ID NO: 216283 - DNA, 25 bp, Rattus norvegicus
caaaatggcccaagggatgacaggg

SEQ ID NO: 216284 - DNA, 25 bp, Rattus norvegicus
caaaatggcccatgggatgacaggg

SEQ ID NO: 216285 - DNA, 25 bp, Rattus norvegicus
caaaatggctatcggcggcccctac

SEQ ID NO: 216286 - DNA, 25 bp, Rattus norvegicus
caaaatggctatgggcggcccctac

SEQ ID NO: 216287 - DNA, 25 bp, Rattus norvegicus
caaaatgggagaagctgaagcaggc

SEQ ID NO: 216288 - DNA, 25 bp, Rattus norvegicus
caaaatgggagatgctgaagcaggc

SEQ ID NO: 216289 - DNA, 25 bp, Rattus norvegicus
caaaatgggtccattgcctggaact

SEQ ID NO: 216290 - DNA, 25 bp, Rattus norvegicus
caaaatgggtcctttgcctggaact

SEQ ID NO: 216291 - DNA, 25 bp, Rattus norvegicus
caaaatggtatcagtgctgtgcttc

SEQ ID NO: 216292 - DNA, 25 bp, Rattus norvegicus
caaaatggtatctgtgctgtgcttc

SEQ ID NO: 216293 - DNA, 25 bp, Rattus norvegicus
caaaatggtgtcagtcttctgctgc

SEQ ID NO: 216294 - DNA, 25 bp, Rattus norvegicus
caaaatggtgtctgtcttctgctgc

SEQ ID NO: 216295 - DNA, 25 bp, Rattus norvegicus
caaaatgtatcaaagcctgcagagt

SEQ ID NO: 216296 - DNA, 25 bp, Rattus norvegicus
caaaatgtatcatagcctgcagagt

SEQ ID NO: 216297 - DNA, 25 bp, Rattus norvegicus
caaaatgtcacaactgggtcagcca

SEQ ID NO: 216298 - DNA, 25 bp, Rattus norvegicus
caaaatgtcacatctgggtcagcca

SEQ ID NO: 216299 - DNA, 25 bp, Rattus norvegicus
caaaatgtctttatcccctccatgt

SEQ ID NO: 216300 - DNA, 25 bp, Rattus norvegicus
caaaatgtctttttcccctccatgt

SEQ ID NO: 216301 - DNA, 25 bp, Rattus norvegicus
caaaatgtgatcagctaagtacttt

SEQ ID NO: 216302 - DNA, 25 bp, Rattus norvegicus
caaaatgtgatctgctaagtacttt

SEQ ID NO: 216303 - DNA, 25 bp, Rattus norvegicus
caaaatgtggccacggctttttagg

SEQ ID NO: 216304 - DNA, 25 bp, Rattus norvegicus
caaaatgtggcctcggctttttagg

SEQ ID NO: 216305 - DNA, 25 bp, Rattus norvegicus
caaaatgtggtcacaggaactgcag

SEQ ID NO: 216306 - DNA, 25 bp, Rattus norvegicus
caaaatgtggtctcaggaactgcag

SEQ ID NO: 216307 - DNA, 25 bp, Rattus norvegicus
caaaatgtgtccagttctcctcagt

SEQ ID NO: 216308 - DNA, 25 bp, Rattus norvegicus
caaaatgtgtcctgttctcctcagt

SEQ ID NO: 216309 - DNA, 25 bp, Rattus norvegicus
caaaatgttctaaaacaggatcctt

SEQ ID NO: 216310 - DNA, 25 bp, Rattus norvegicus
caaaatgttctataacaggatcctt

SEQ ID NO: 216311 - DNA, 25 bp, Rattus norvegicus
caaaatgtttccatgtcatttgcca

SEQ ID NO: 216312 - DNA, 25 bp, Rattus norvegicus
caaaatgtttccttgtcatttgcca

SEQ ID NO: 216313 - DNA, 25 bp, Rattus norvegicus
caaaattacatgctgcttctcacag

SEQ ID NO: 216314 - DNA, 25 bp, Rattus norvegicus
caaaattacatggtgcttctcacag

SEQ ID NO: 216315 - DNA, 25 bp, Rattus norvegicus
caaaattacctgcttggatggccag

SEQ ID NO: 216316 - DNA, 25 bp, Rattus norvegicus
caaaattacctggttggatggccag

SEQ ID NO: 216317 - DNA, 25 bp, Rattus norvegicus
caaaattcaccacatggagctaggt

SEQ ID NO: 216318 - DNA, 25 bp, Rattus norvegicus
caaaattcaccagatggagctaggt

SEQ ID NO: 216319 - DNA, 25 bp, Rattus norvegicus
caaaattcccgcaaaaatctcagcc

SEQ ID NO: 216320 - DNA, 25 bp, Rattus norvegicus
caaaattcccgctaaaatctcagcc

SEQ ID NO: 216321 - DNA, 25 bp, Rattus norvegicus
caaaattgcattcagcactctctcc

SEQ ID NO: 216322 - DNA, 25 bp, Rattus norvegicus
caaaattgcattgagcactctctcc

SEQ ID NO: 216323 - DNA, 25 bp, Rattus norvegicus
caaaatttgttacgtatctactgta

SEQ ID NO: 216324 - DNA, 25 bp, Rattus norvegicus
caaaatttgttaggtatctactgta

SEQ ID NO: 216325 - DNA, 25 bp, Rattus norvegicus
caaaattttcctcttgttcaagtgt

SEQ ID NO: 216326 - DNA, 25 bp, Rattus norvegicus
caaaattttcctgttgttcaagtgt

SEQ ID NO: 216327 - DNA, 25 bp, Rattus norvegicus
caaacaaaacacaccgggccagaca

SEQ ID NO: 216328 - DNA, 25 bp, Rattus norvegicus
caaacaaaacactccgggccagaca

SEQ ID NO: 216329 - DNA, 25 bp, Rattus norvegicus
caaacaaaagctactttccactgcc

SEQ ID NO: 216330 - DNA, 25 bp, Rattus norvegicus
caaacaaaagcttctttccactgcc

SEQ ID NO: 216331 - DNA, 25 bp, Rattus norvegicus
caaacaaatcagaagccttcctcca

SEQ ID NO: 216332 - DNA, 25 bp, Rattus norvegicus
caaacaaatcagtagccttcctcca

SEQ ID NO: 216333 - DNA, 25 bp, Rattus norvegicus
caaacaacctgtattcgagctgcag

SEQ ID NO: 216334 - DNA, 25 bp, Rattus norvegicus
caaacaacctgttttcgagctgcag

SEQ ID NO: 216335 - DNA, 25 bp, Rattus norvegicus
caaacaacgaatcctactgcagcac

SEQ ID NO: 216336 - DNA, 25 bp, Rattus norvegicus
caaacaacgaatgctactgcagcac

SEQ ID NO: 216337 - DNA, 25 bp, Rattus norvegicus
caaacaactgggagttgtggctctc

SEQ ID NO: 216338 - DNA, 25 bp, Rattus norvegicus
caaacaactgggtgttgtggctctc

SEQ ID NO: 216339 - DNA, 25 bp, Rattus norvegicus
caaacaacttctcattgggaccttc

SEQ ID NO: 216340 - DNA, 25 bp, Rattus norvegicus
caaacaacttctgattgggaccttc

SEQ ID NO: 216341 - DNA, 25 bp, Rattus norvegicus
caaacaaggcttctagtccaatccc

SEQ ID NO: 216342 - DNA, 25 bp, Rattus norvegicus
caaacaaggcttgtagtccaatccc

SEQ ID NO: 216343 - DNA, 25 bp, Rattus norvegicus
caaacaagttttctccctcgcctgg

SEQ ID NO: 216344 - DNA, 25 bp, Rattus norvegicus
caaacaagttttgtccctcgcctgg

SEQ ID NO: 216345 - DNA, 25 bp, Rattus norvegicus
caaacacaaactcggcatgcatgct

SEQ ID NO: 216346 - DNA, 25 bp, Rattus norvegicus
caaacacaaactgggcatgcatgct

SEQ ID NO: 216347 - DNA, 25 bp, Rattus norvegicus
caaacacacaggaaaatacttacag

SEQ ID NO: 216348 - DNA, 25 bp, Rattus norvegicus
caaacacacaggtaaatacttacag

SEQ ID NO: 216349 - DNA, 25 bp, Rattus norvegicus
caaacaccagttacctcattttctg

SEQ ID NO: 216350 - DNA, 25 bp, Rattus norvegicus
caaacaccagtttcctcattttctg

SEQ ID NO: 216351 - DNA, 25 bp, Rattus norvegicus
caaacaccctgtaccctaagatcca

SEQ ID NO: 216352 - DNA, 25 bp, Rattus norvegicus
caaacaccctgttccctaagatcca

SEQ ID NO: 216353 - DNA, 25 bp, Rattus norvegicus
caaacacctgacagatgcttacttc

SEQ ID NO: 216354 - DNA, 25 bp, Rattus norvegicus
caaacacctgactgatgcttacttc

SEQ ID NO: 216355 - DNA, 25 bp, Rattus norvegicus
caaacaccttctactagacacagag

SEQ ID NO: 216356 - DNA, 25 bp, Rattus norvegicus
caaacaccttcttctagacacagag

SEQ ID NO: 216357 - DNA, 25 bp, Rattus norvegicus
caaacactgactcatccttaacgga

SEQ ID NO: 216358 - DNA, 25 bp, Rattus norvegicus
caaacactgactgatccttaacgga

SEQ ID NO: 216359 - DNA, 25 bp, Rattus norvegicus
caaacactgcccactttgcaaatgt

SEQ ID NO: 216360 - DNA, 25 bp, Rattus norvegicus
caaacactgccctctttgcaaatgt

SEQ ID NO: 216361 - DNA, 25 bp, Rattus norvegicus
caaacactggctacttggtccatct

SEQ ID NO: 216362 - DNA, 25 bp, Rattus norvegicus
caaacactggcttcttggtccatct

SEQ ID NO: 216363 - DNA, 25 bp, Rattus norvegicus
caaacacttcttatacctggcaaaa

SEQ ID NO: 216364 - DNA, 25 bp, Rattus norvegicus
caaacacttcttttacctggcaaaa

SEQ ID NO: 216365 - DNA, 25 bp, Rattus norvegicus
caaacacttgaaccgctctgcctat

SEQ ID NO: 216366 - DNA, 25 bp, Rattus norvegicus
caaacacttgaagcgctctgcctat

SEQ ID NO: 216367 - DNA, 25 bp, Rattus norvegicus
caaacacttttcataggcactgtat

SEQ ID NO: 216368 - DNA, 25 bp, Rattus norvegicus
caaacacttttcttaggcactgtat

SEQ ID NO: 216369 - DNA, 25 bp, Rattus norvegicus
caaacagccaaaccctgagagccag

SEQ ID NO: 216370 - DNA, 25 bp, Rattus norvegicus
caaacagccaaagcctgagagccag

SEQ ID NO: 216371 - DNA, 25 bp, Rattus norvegicus
caaacagccactcttgggtctttta

SEQ ID NO: 216372 - DNA, 25 bp, Rattus norvegicus
caaacagccactgttgggtctttta

SEQ ID NO: 216373 - DNA, 25 bp, Rattus norvegicus
caaacagcccaacgagacacccaag

SEQ ID NO: 216374 - DNA, 25 bp, Rattus norvegicus
caaacagcccaaggagacacccaag

SEQ ID NO: 216375 - DNA, 25 bp, Rattus norvegicus
caaacagcctttccgatctacatgc

SEQ ID NO: 216376 - DNA, 25 bp, Rattus norvegicus
caaacagcctttgcgatctacatgc

SEQ ID NO: 216377 - DNA, 25 bp, Rattus norvegicus
caaacagcgctaagtgatcaccgtt

SEQ ID NO: 216378 - DNA, 25 bp, Rattus norvegicus
caaacagcgctatgtgatcaccgtt

SEQ ID NO: 216379 - DNA, 25 bp, Rattus norvegicus
caaacagcggctaaactcataatct

SEQ ID NO: 216380 - DNA, 25 bp, Rattus norvegicus
caaacagcggcttaactcataatct

SEQ ID NO: 216381 - DNA, 25 bp, Rattus norvegicus
caaacagctcttctatctatcggta

SEQ ID NO: 216382 - DNA, 25 bp, Rattus norvegicus
caaacagctcttgtatctatcggta

SEQ ID NO: 216383 - DNA, 25 bp, Rattus norvegicus
caaacagctgtccactttaagtcat

SEQ ID NO: 216384 - DNA, 25 bp, Rattus norvegicus
caaacagctgtcgactttaagtcat

SEQ ID NO: 216385 - DNA, 25 bp, Rattus norvegicus
caaacagctgtgatagagtcacaaa

SEQ ID NO: 216386 - DNA, 25 bp, Rattus norvegicus
caaacagctgtgttagagtcacaaa

SEQ ID NO: 216387 - DNA, 25 bp, Rattus norvegicus
caaacagctttgactgacagttcaa

SEQ ID NO: 216388 - DNA, 25 bp, Rattus norvegicus
caaacagctttgtctgacagttcaa

SEQ ID NO: 216389 - DNA, 25 bp, Rattus norvegicus
caaacaggattaagttgtcatggtt

SEQ ID NO: 216390 - DNA, 25 bp, Rattus norvegicus
caaacaggattatgttgtcatggtt

SEQ ID NO: 216391 - DNA, 25 bp, Rattus norvegicus
caaacaggctggcagatacacttct

SEQ ID NO: 216392 - DNA, 25 bp, Rattus norvegicus
caaacaggctgggagatacacttct

SEQ ID NO: 216393 - DNA, 25 bp, Rattus norvegicus
caaacaggtgacacgggattatgat

SEQ ID NO: 216394 - DNA, 25 bp, Rattus norvegicus
caaacaggtgactcgggattatgat

SEQ ID NO: 216395 - DNA, 25 bp, Rattus norvegicus
caaacaggtgccagctttcagaagg

SEQ ID NO: 216396 - DNA, 25 bp, Rattus norvegicus
caaacaggtgcctgctttcagaagg

SEQ ID NO: 216397 - DNA, 25 bp, Rattus norvegicus
caaacagtagcacagacgtgacctc

SEQ ID NO: 216398 - DNA, 25 bp, Rattus norvegicus
caaacagtagcagagacgtgacctc

SEQ ID NO: 216399 - DNA, 25 bp, Rattus norvegicus
caaacagtcctcacatctggtccag

SEQ ID NO: 216400 - DNA, 25 bp, Rattus norvegicus
caaacagtcctctcatctggtccag

SEQ ID NO: 216401 - DNA, 25 bp, Rattus norvegicus
caaacagtctcaatggtacagggtg

SEQ ID NO: 216402 - DNA, 25 bp, Rattus norvegicus
caaacagtctcattggtacagggtg

SEQ ID NO: 216403 - DNA, 25 bp, Rattus norvegicus
caaacagtctgacggcgcgctgtgc

SEQ ID NO: 216404 - DNA, 25 bp, Rattus norvegicus
caaacagtctgagggcgcgctgtgc

SEQ ID NO: 216405 - DNA, 25 bp, Rattus norvegicus
caaacagtgcttattgctaacccca

SEQ ID NO: 216406 - DNA, 25 bp, Rattus norvegicus
caaacagtgctttttgctaacccca

SEQ ID NO: 216407 - DNA, 25 bp, Rattus norvegicus
caaacagtgtatcggtttctgagtt

SEQ ID NO: 216408 - DNA, 25 bp, Rattus norvegicus
caaacagtgtatgggtttctgagtt

SEQ ID NO: 216409 - DNA, 25 bp, Rattus norvegicus
caaacagttgagaggtaagagttag

SEQ ID NO: 216410 - DNA, 25 bp, Rattus norvegicus
caaacagttgagtggtaagagttag

SEQ ID NO: 216411 - DNA, 25 bp, Rattus norvegicus
caaacagttgggaggtaagagtcat

SEQ ID NO: 216412 - DNA, 25 bp, Rattus norvegicus
caaacagttgggtggtaagagtcat

SEQ ID NO: 216413 - DNA, 25 bp, Rattus norvegicus
caaacatagatgaacccctctacct

SEQ ID NO: 216414 - DNA, 25 bp, Rattus norvegicus
caaacatagatgtacccctctacct

SEQ ID NO: 216415 - DNA, 25 bp, Rattus norvegicus
caaacatcatgtagctcttaagagt

SEQ ID NO: 216416 - DNA, 25 bp, Rattus norvegicus
caaacatcatgttgctcttaagagt

SEQ ID NO: 216417 - DNA, 25 bp, Rattus norvegicus
caaacatggcagcagtccgggcccg

SEQ ID NO: 216418 - DNA, 25 bp, Rattus norvegicus
caaacatggcaggagtccgggcccg

SEQ ID NO: 216419 - DNA, 25 bp, Rattus norvegicus
caaacatgggccattctgttcgaat

SEQ ID NO: 216420 - DNA, 25 bp, Rattus norvegicus
caaacatgggcctttctgttcgaat

SEQ ID NO: 216421 - DNA, 25 bp, Rattus norvegicus
caaacatgtgctaatgctcaggtat

SEQ ID NO: 216422 - DNA, 25 bp, Rattus norvegicus
caaacatgtgcttatgctcaggtat

SEQ ID NO: 216423 - DNA, 25 bp, Rattus norvegicus
caaacatgtggcacagataagatct

SEQ ID NO: 216424 - DNA, 25 bp, Rattus norvegicus
caaacatgtggctcagataagatct

SEQ ID NO: 216425 - DNA, 25 bp, Rattus norvegicus
caaacattcatcatccatgggtaaa

SEQ ID NO: 216426 - DNA, 25 bp, Rattus norvegicus
caaacattcatcttccatgggtaaa

SEQ ID NO: 216427 - DNA, 25 bp, Rattus norvegicus
caaacatttcgtatggctaaccaaa

SEQ ID NO: 216428 - DNA, 25 bp, Rattus norvegicus
caaacatttcgtttggctaaccaaa

SEQ ID NO: 216429 - DNA, 25 bp, Rattus norvegicus
caaacatttgagaccacttgtaagt

SEQ ID NO: 216430 - DNA, 25 bp, Rattus norvegicus
caaacatttgagtccacttgtaagt

SEQ ID NO: 216431 - DNA, 25 bp, Rattus norvegicus
caaacatttggtcgtctgctagaga

SEQ ID NO: 216432 - DNA, 25 bp, Rattus norvegicus
caaacatttggtggtctgctagaga

SEQ ID NO: 216433 - DNA, 25 bp, Rattus norvegicus
caaaccaacgatccagaaagacaac

SEQ ID NO: 216434 - DNA, 25 bp, Rattus norvegicus
caaaccaacgatgcagaaagacaac

SEQ ID NO: 216435 - DNA, 25 bp, Rattus norvegicus
caaaccaatgtgaatgccttctaca

SEQ ID NO: 216436 - DNA, 25 bp, Rattus norvegicus
caaaccaatgtgtatgccttctaca

SEQ ID NO: 216437 - DNA, 25 bp, Rattus norvegicus
caaaccacaatccatacactcattt

SEQ ID NO: 216438 - DNA, 25 bp, Rattus norvegicus
caaaccacaatcgatacactcattt

SEQ ID NO: 216439 - DNA, 25 bp, Rattus norvegicus
caaaccacatggatgagcaatgatc

SEQ ID NO: 216440 - DNA, 25 bp, Rattus norvegicus
caaaccacatggttgagcaatgatc

SEQ ID NO: 216441 - DNA, 25 bp, Rattus norvegicus
caaaccaccgacataccagatgtta

SEQ ID NO: 216442 - DNA, 25 bp, Rattus norvegicus
caaaccaccgacttaccagatgtta

SEQ ID NO: 216443 - DNA, 25 bp, Rattus norvegicus
caaaccacgtctctgttcttctggg

SEQ ID NO: 216444 - DNA, 25 bp, Rattus norvegicus
caaaccacgtctgtgttcttctggg

SEQ ID NO: 216445 - DNA, 25 bp, Rattus norvegicus
caaaccagaaatagccatcctcatc

SEQ ID NO: 216446 - DNA, 25 bp, Rattus norvegicus
caaaccagaaattgccatcctcatc

SEQ ID NO: 216447 - DNA, 25 bp, Rattus norvegicus
caaaccagacaaccccttagggagc

SEQ ID NO: 216448 - DNA, 25 bp, Rattus norvegicus
caaaccagacaagcccttagggagc

SEQ ID NO: 216449 - DNA, 25 bp, Rattus norvegicus
caaaccagccagagattatgtgaga

SEQ ID NO: 216450 - DNA, 25 bp, Rattus norvegicus
caaaccagccagtgattatgtgaga

SEQ ID NO: 216451 - DNA, 25 bp, Rattus norvegicus
caaaccagcttaaatcctccaggat

SEQ ID NO: 216452 - DNA, 25 bp, Rattus norvegicus
caaaccagcttatatcctccaggat

SEQ ID NO: 216453 - DNA, 25 bp, Rattus norvegicus
caaaccaggacaattttgaacaaca

SEQ ID NO: 216454 - DNA, 25 bp, Rattus norvegicus
caaaccaggacatttttgaacaaca

SEQ ID NO: 216455 - DNA, 25 bp, Rattus norvegicus
caaaccaggtggcttgcacccaggt

SEQ ID NO: 216456 - DNA, 25 bp, Rattus norvegicus
caaaccaggtgggttgcacccaggt

SEQ ID NO: 216457 - DNA, 25 bp, Rattus norvegicus
caaaccataaaaacctctgtgggct

SEQ ID NO: 216458 - DNA, 25 bp, Rattus norvegicus
caaaccataaaatcctctgtgggct

SEQ ID NO: 216459 - DNA, 25 bp, Rattus norvegicus
caaaccatcctcatcaaattaacca

SEQ ID NO: 216460 - DNA, 25 bp, Rattus norvegicus
caaaccatcctcttcaaattaacca

SEQ ID NO: 216461 - DNA, 25 bp, Rattus norvegicus
caaaccatctgcagggtcacagaaa

SEQ ID NO: 216462 - DNA, 25 bp, Rattus norvegicus
caaaccatctgctgggtcacagaaa

SEQ ID NO: 216463 - DNA, 25 bp, Rattus norvegicus
caaaccatggacatactgatatctt

SEQ ID NO: 216464 - DNA, 25 bp, Rattus norvegicus
caaaccatggacttactgatatctt

SEQ ID NO: 216465 - DNA, 25 bp, Rattus norvegicus
caaaccatggatatcaccgtcagtg

SEQ ID NO: 216466 - DNA, 25 bp, Rattus norvegicus
caaaccatggatttcaccgtcagtg

SEQ ID NO: 216467 - DNA, 25 bp, Rattus norvegicus
caaaccatgtacctttatgcttcgt

SEQ ID NO: 216468 - DNA, 25 bp, Rattus norvegicus
caaaccatgtacgtttatgcttcgt

SEQ ID NO: 216469 - DNA, 25 bp, Rattus norvegicus
caaaccatttctactgtgcttgcag

SEQ ID NO: 216470 - DNA, 25 bp, Rattus norvegicus
caaaccatttcttctgtgcttgcag

SEQ ID NO: 216471 - DNA, 25 bp, Rattus norvegicus
caaacccagaccctttacaagagca

SEQ ID NO: 216472 - DNA, 25 bp, Rattus norvegicus
caaacccagaccgtttacaagagca

SEQ ID NO: 216473 - DNA, 25 bp, Rattus norvegicus
caaacccagcttagagatcctcaga

SEQ ID NO: 216474 - DNA, 25 bp, Rattus norvegicus
caaacccagctttgagatcctcaga

SEQ ID NO: 216475 - DNA, 25 bp, Rattus norvegicus
caaacccaggctctctttggagata

SEQ ID NO: 216476 - DNA, 25 bp, Rattus norvegicus
caaacccaggctgtctttggagata

SEQ ID NO: 216477 - DNA, 25 bp, Rattus norvegicus
caaacccagtgtatggacgagccat

SEQ ID NO: 216478 - DNA, 25 bp, Rattus norvegicus
caaacccagtgtttggacgagccat

SEQ ID NO: 216479 - DNA, 25 bp, Rattus norvegicus
caaacccataccatttgttttactg

SEQ ID NO: 216480 - DNA, 25 bp, Rattus norvegicus
caaacccataccttttgttttactg

SEQ ID NO: 216481 - DNA, 25 bp, Rattus norvegicus
caaacccatctcatcactgtatgaa

SEQ ID NO: 216482 - DNA, 25 bp, Rattus norvegicus
caaacccatctcttcactgtatgaa

SEQ ID NO: 216483 - DNA, 25 bp, Rattus norvegicus
caaacccatgtgagtaatccccaaa

SEQ ID NO: 216484 - DNA, 25 bp, Rattus norvegicus
caaacccatgtgtgtaatccccaaa

SEQ ID NO: 216485 - DNA, 25 bp, Rattus norvegicus
caaaccccatggatagggcagtggg

SEQ ID NO: 216486 - DNA, 25 bp, Rattus norvegicus
caaaccccatggttagggcagtggg

SEQ ID NO: 216487 - DNA, 25 bp, Rattus norvegicus
caaaccccttctcaataaacaacat

SEQ ID NO: 216488 - DNA, 25 bp, Rattus norvegicus
caaaccccttctgaataaacaacat

SEQ ID NO: 216489 - DNA, 25 bp, Rattus norvegicus
caaacccctttcagttatcatcata

SEQ ID NO: 216490 - DNA, 25 bp, Rattus norvegicus
caaacccctttctgttatcatcata

SEQ ID NO: 216491 - DNA, 25 bp, Rattus norvegicus
caaacccgtggaaagctgtcctgaa

SEQ ID NO: 216492 - DNA, 25 bp, Rattus norvegicus
caaacccgtggatagctgtcctgaa

SEQ ID NO: 216493 - DNA, 25 bp, Rattus norvegicus
caaaccctaatcattccaggcatga

SEQ ID NO: 216494 - DNA, 25 bp, Rattus norvegicus
caaaccctaatctttccaggcatga

SEQ ID NO: 216495 - DNA, 25 bp, Rattus norvegicus
caaaccctccacaggcgcagggtgt

SEQ ID NO: 216496 - DNA, 25 bp, Rattus norvegicus
caaaccctccactggcgcagggtgt

SEQ ID NO: 216497 - DNA, 25 bp, Rattus norvegicus
caaaccctgtaactagttcctcatt

SEQ ID NO: 216498 - DNA, 25 bp, Rattus norvegicus
caaaccctgtaagtagttcctcatt

SEQ ID NO: 216499 - DNA, 25 bp, Rattus norvegicus
caaaccctgtttacaggcacacgga

SEQ ID NO: 216500 - DNA, 25 bp, Rattus norvegicus
caaaccctgtttactgcattcagaa

SEQ ID NO: 216501 - DNA, 25 bp, Rattus norvegicus
caaaccctgttttcaggcacacgga

SEQ ID NO: 216502 - DNA, 25 bp, Rattus norvegicus
caaaccctgttttctgcattcagaa

SEQ ID NO: 216503 - DNA, 25 bp, Rattus norvegicus
caaacccttggactcattcccagat

SEQ ID NO: 216504 - DNA, 25 bp, Rattus norvegicus
caaacccttggagtcattcccagat

SEQ ID NO: 216505 - DNA, 25 bp, Rattus norvegicus
caaaccctttcccaacatgcaaaag

SEQ ID NO: 216506 - DNA, 25 bp, Rattus norvegicus
caaaccctttccgaacatgcaaaag

SEQ ID NO: 216507 - DNA, 25 bp, Rattus norvegicus
caaaccgctgctagacgcgtattaa

SEQ ID NO: 216508 - DNA, 25 bp, Rattus norvegicus
caaaccgctgcttgacgcgtattaa

SEQ ID NO: 216509 - DNA, 25 bp, Rattus norvegicus
caaacctaggtgaatgtgtctgtca

SEQ ID NO: 216510 - DNA, 25 bp, Rattus norvegicus
caaacctaggtgtatgtgtctgtca

SEQ ID NO: 216511 - DNA, 25 bp, Rattus norvegicus
caaacctcagttaagtcatccataa

SEQ ID NO: 216512 - DNA, 25 bp, Rattus norvegicus
caaacctcagtttagtcatccataa

SEQ ID NO: 216513 - DNA, 25 bp, Rattus norvegicus
caaacctcctcactgttagggttgg

SEQ ID NO: 216514 - DNA, 25 bp, Rattus norvegicus
caaacctcctcagtgttagggttgg

SEQ ID NO: 216515 - DNA, 25 bp, Rattus norvegicus
caaacctgaaagcatcgagtaaata

SEQ ID NO: 216516 - DNA, 25 bp, Rattus norvegicus
caaacctgaaaggatcgagtaaata

SEQ ID NO: 216517 - DNA, 25 bp, Rattus norvegicus
caaacctgagtccttgcaccgtagc

SEQ ID NO: 216518 - DNA, 25 bp, Rattus norvegicus
caaacctgagtcgttgcaccgtagc

SEQ ID NO: 216519 - DNA, 25 bp, Rattus norvegicus
caaacctgatatcatgtgacatgag

SEQ ID NO: 216520 - DNA, 25 bp, Rattus norvegicus
caaacctgatatgatgtgacatgag

SEQ ID NO: 216521 - DNA, 25 bp, Rattus norvegicus
caaacctgccagacctaagaagaac

SEQ ID NO: 216522 - DNA, 25 bp, Rattus norvegicus
caaacctgccagtcctaagaagaac

SEQ ID NO: 216523 - DNA, 25 bp, Rattus norvegicus
caaacctgcctgatgtagctttaag

SEQ ID NO: 216524 - DNA, 25 bp, Rattus norvegicus
caaacctgcctgttgtagctttaag

SEQ ID NO: 216525 - DNA, 25 bp, Rattus norvegicus
caaacctggctgactgcagttggat

SEQ ID NO: 216526 - DNA, 25 bp, Rattus norvegicus
caaacctggctgtctgcagttggat

SEQ ID NO: 216527 - DNA, 25 bp, Rattus norvegicus
caaacctggtttcccggtgacacat

SEQ ID NO: 216528 - DNA, 25 bp, Rattus norvegicus
caaacctggtttgccggtgacacat

SEQ ID NO: 216529 - DNA, 25 bp, Rattus norvegicus
caaacctgtcaacccctggaaatgg

SEQ ID NO: 216530 - DNA, 25 bp, Rattus norvegicus
caaacctgtcaagccctggaaatgg

SEQ ID NO: 216531 - DNA, 25 bp, Rattus norvegicus
caaacctgttagcatagtacctgta

SEQ ID NO: 216532 - DNA, 25 bp, Rattus norvegicus
caaacctgttaggatagtacctgta

SEQ ID NO: 216533 - DNA, 25 bp, Rattus norvegicus
caaaccttctcaacttcatgtactg

SEQ ID NO: 216534 - DNA, 25 bp, Rattus norvegicus
caaaccttctcatcttcatgtactg

SEQ ID NO: 216535 - DNA, 25 bp, Rattus norvegicus
caaaccttgatccactctgtcacta

SEQ ID NO: 216536 - DNA, 25 bp, Rattus norvegicus
caaaccttgatcgactctgtcacta

SEQ ID NO: 216537 - DNA, 25 bp, Rattus norvegicus
caaaccttgcttaatgtctctaatt

SEQ ID NO: 216538 - DNA, 25 bp, Rattus norvegicus
caaaccttgctttatgtctctaatt

SEQ ID NO: 216539 - DNA, 25 bp, Rattus norvegicus
caaaccttggctatttagctggagc

SEQ ID NO: 216540 - DNA, 25 bp, Rattus norvegicus
caaaccttggctttttagctggagc

SEQ ID NO: 216541 - DNA, 25 bp, Rattus norvegicus
caaaccttgtccaacgtgtgagaaa

SEQ ID NO: 216542 - DNA, 25 bp, Rattus norvegicus
caaaccttgtcctacgtgtgagaaa

SEQ ID NO: 216543 - DNA, 25 bp, Rattus norvegicus
caaaccttgtgtcgcctgaaatctg

SEQ ID NO: 216544 - DNA, 25 bp, Rattus norvegicus
caaaccttgtgtggcctgaaatctg

SEQ ID NO: 216545 - DNA, 25 bp, Rattus norvegicus
caaacctttgaccagaggcgctaaa

SEQ ID NO: 216546 - DNA, 25 bp, Rattus norvegicus
caaacctttgacgagaggcgctaaa

SEQ ID NO: 216547 - DNA, 25 bp, Rattus norvegicus
caaaccttttgaaccataattagaa

SEQ ID NO: 216548 - DNA, 25 bp, Rattus norvegicus
caaaccttttgatccataattagaa

SEQ ID NO: 216549 - DNA, 25 bp, Rattus norvegicus
caaacctttttgagtcttgacatca

SEQ ID NO: 216550 - DNA, 25 bp, Rattus norvegicus
caaacctttttgtgtcttgacatca

SEQ ID NO: 216551 - DNA, 25 bp, Rattus norvegicus
caaacgaaacccaacagcaacactt

SEQ ID NO: 216552 - DNA, 25 bp, Rattus norvegicus
caaacgaaaccctacagcaacactt

SEQ ID NO: 216553 - DNA, 25 bp, Rattus norvegicus
caaacgagttgcatggtgttcccgg

SEQ ID NO: 216554 - DNA, 25 bp, Rattus norvegicus
caaacgagttgcttggtgttcccgg

SEQ ID NO: 216555 - DNA, 25 bp, Rattus norvegicus
caaacgcctggccaatgtagttcgc

SEQ ID NO: 216556 - DNA, 25 bp, Rattus norvegicus
caaacgcctggcgaatgtagttcgc

SEQ ID NO: 216557 - DNA, 25 bp, Rattus norvegicus
caaacgccttttactgccttcaggg

SEQ ID NO: 216558 - DNA, 25 bp, Rattus norvegicus
caaacgccttttcgttgcctcttcg

SEQ ID NO: 216559 - DNA, 25 bp, Rattus norvegicus
caaacgccttttggttgcctcttcg

SEQ ID NO: 216560 - DNA, 25 bp, Rattus norvegicus
caaacgcctttttctgccttcaggg

SEQ ID NO: 216561 - DNA, 25 bp, Rattus norvegicus
caaacgctgaggctgtaggagacat

SEQ ID NO: 216562 - DNA, 25 bp, Rattus norvegicus
caaacgctgagggtgtaggagacat

SEQ ID NO: 216563 - DNA, 25 bp, Rattus norvegicus
caaacgctgatgatgcgggcagaaa

SEQ ID NO: 216564 - DNA, 25 bp, Rattus norvegicus
caaacgctgatgttgcgggcagaaa

SEQ ID NO: 216565 - DNA, 25 bp, Rattus norvegicus
caaacgctgcgtattattttggcat

SEQ ID NO: 216566 - DNA, 25 bp, Rattus norvegicus
caaacgctgcgttttattttggcat

SEQ ID NO: 216567 - DNA, 25 bp, Rattus norvegicus
caaacgctgttgagctacagcagat

SEQ ID NO: 216568 - DNA, 25 bp, Rattus norvegicus
caaacgctgttgtgctacagcagat

SEQ ID NO: 216569 - DNA, 25 bp, Rattus norvegicus
caaacgctttcgaggtccgggcatt

SEQ ID NO: 216570 - DNA, 25 bp, Rattus norvegicus
caaacgctttcgtggtccgggcatt

SEQ ID NO: 216571 - DNA, 25 bp, Rattus norvegicus
caaacggcgacgacctgatgtggac

SEQ ID NO: 216572 - DNA, 25 bp, Rattus norvegicus
caaacggcgacgtcctgatgtggac

SEQ ID NO: 216573 - DNA, 25 bp, Rattus norvegicus
caaacggctttcatctctgccttgt

SEQ ID NO: 216574 - DNA, 25 bp, Rattus norvegicus
caaacggctttcttctctgccttgt

SEQ ID NO: 216575 - DNA, 25 bp, Rattus norvegicus
caaacgggttatagagcagctcggt

SEQ ID NO: 216576 - DNA, 25 bp, Rattus norvegicus
caaacgggttattgagcagctcggt

SEQ ID NO: 216577 - DNA, 25 bp, Rattus norvegicus
caaacggtgcagctgctgagcccga

SEQ ID NO: 216578 - DNA, 25 bp, Rattus norvegicus
caaacggtgcaggtgctgagcccga

SEQ ID NO: 216579 - DNA, 25 bp, Rattus norvegicus
caaacggtgtccatagcgtctttag

SEQ ID NO: 216580 - DNA, 25 bp, Rattus norvegicus
caaacggtgtccttagcgtctttag

SEQ ID NO: 216581 - DNA, 25 bp, Rattus norvegicus
caaacgtacttcaggtgagcttgct

SEQ ID NO: 216582 - DNA, 25 bp, Rattus norvegicus
caaacgtacttctggtgagcttgct

SEQ ID NO: 216583 - DNA, 25 bp, Rattus norvegicus
caaacgtccgtgcatttcccattag

SEQ ID NO: 216584 - DNA, 25 bp, Rattus norvegicus
caaacgtccgtggatttcccattag

SEQ ID NO: 216585 - DNA, 25 bp, Rattus norvegicus
caaacgtgcggccagctacaacaaa

SEQ ID NO: 216586 - DNA, 25 bp, Rattus norvegicus
caaacgtgcggcgagctacaacaaa

SEQ ID NO: 216587 - DNA, 25 bp, Rattus norvegicus
caaacgtgtttgctagatgacttga

SEQ ID NO: 216588 - DNA, 25 bp, Rattus norvegicus
caaacgtgtttggtagatgacttga

SEQ ID NO: 216589 - DNA, 25 bp, Rattus norvegicus
caaacgtttacaagttctctctctc

SEQ ID NO: 216590 - DNA, 25 bp, Rattus norvegicus
caaacgtttacatgttctctctctc

SEQ ID NO: 216591 - DNA, 25 bp, Rattus norvegicus
caaacgtttcagatagtgcacaccc

SEQ ID NO: 216592 - DNA, 25 bp, Rattus norvegicus
caaacgtttcagttagtgcacaccc

SEQ ID NO: 216593 - DNA, 25 bp, Rattus norvegicus
caaactacagtgagtcatcttgtga

SEQ ID NO: 216594 - DNA, 25 bp, Rattus norvegicus
caaactacagtgtgtcatcttgtga

SEQ ID NO: 216595 - DNA, 25 bp, Rattus norvegicus
caaactacctatattccttgtgtaa

SEQ ID NO: 216596 - DNA, 25 bp, Rattus norvegicus
caaactacctattttccttgtgtaa

SEQ ID NO: 216597 - DNA, 25 bp, Rattus norvegicus
caaactaggatcacttggctatgta

SEQ ID NO: 216598 - DNA, 25 bp, Rattus norvegicus
caaactaggatctcttggctatgta

SEQ ID NO: 216599 - DNA, 25 bp, Rattus norvegicus
caaactaggcacatggtccagggat

SEQ ID NO: 216600 - DNA, 25 bp, Rattus norvegicus
caaactaggcacttggtccagggat

SEQ ID NO: 216601 - DNA, 25 bp, Rattus norvegicus
caaactaggtctcagtgtttccctt

SEQ ID NO: 216602 - DNA, 25 bp, Rattus norvegicus
caaactaggtctgagtgtttccctt

SEQ ID NO: 216603 - DNA, 25 bp, Rattus norvegicus
caaactagtgtgagatctcagggtt

SEQ ID NO: 216604 - DNA, 25 bp, Rattus norvegicus
caaactagtgtgtgatctcagggtt

SEQ ID NO: 216605 - DNA, 25 bp, Rattus norvegicus
caaactatagctagaggtctccaat

SEQ ID NO: 216606 - DNA, 25 bp, Rattus norvegicus
caaactatagcttgaggtctccaat

SEQ ID NO: 216607 - DNA, 25 bp, Rattus norvegicus
caaactataggtccgttgcttacta

SEQ ID NO: 216608 - DNA, 25 bp, Rattus norvegicus
caaactataggtgcgttgcttacta

SEQ ID NO: 216609 - DNA, 25 bp, Rattus norvegicus
caaactatatatcccagctgaccta

SEQ ID NO: 216610 - DNA, 25 bp, Rattus norvegicus
caaactatatatgccagctgaccta

SEQ ID NO: 216611 - DNA, 25 bp, Rattus norvegicus
caaactatttccatgtgatcctcca

SEQ ID NO: 216612 - DNA, 25 bp, Rattus norvegicus
caaactatttccttgtgatcctcca

SEQ ID NO: 216613 - DNA, 25 bp, Rattus norvegicus
caaactcagtatagatcctgtcagg

SEQ ID NO: 216614 - DNA, 25 bp, Rattus norvegicus
caaactcagtattgatcctgtcagg

SEQ ID NO: 216615 - DNA, 25 bp, Rattus norvegicus
caaactccagtcagtcctctggaaa

SEQ ID NO: 216616 - DNA, 25 bp, Rattus norvegicus
caaactccagtctgtcctctggaaa

SEQ ID NO: 216617 - DNA, 25 bp, Rattus norvegicus
caaactcccggcacacaagtgttgg

SEQ ID NO: 216618 - DNA, 25 bp, Rattus norvegicus
caaactcccggctcacaagtgttgg

SEQ ID NO: 216619 - DNA, 25 bp, Rattus norvegicus
caaactcctcctacatgtcaagaga

SEQ ID NO: 216620 - DNA, 25 bp, Rattus norvegicus
caaactcctccttcatgtcaagaga

SEQ ID NO: 216621 - DNA, 25 bp, Rattus norvegicus
caaactcgctgcaggcatggaacca

SEQ ID NO: 216622 - DNA, 25 bp, Rattus norvegicus
caaactcgctgctggcatggaacca

SEQ ID NO: 216623 - DNA, 25 bp, Rattus norvegicus
caaactcgggtcagtggcccactaa

SEQ ID NO: 216624 - DNA, 25 bp, Rattus norvegicus
caaactcgggtctgtggcccactaa

SEQ ID NO: 216625 - DNA, 25 bp, Rattus norvegicus
caaactctacgaaggcttccagtac

SEQ ID NO: 216626 - DNA, 25 bp, Rattus norvegicus
caaactctacgatggcttccagtac

SEQ ID NO: 216627 - DNA, 25 bp, Rattus norvegicus
caaactctatggaagtggaggccct

SEQ ID NO: 216628 - DNA, 25 bp, Rattus norvegicus
caaactctatggtagtggaggccct

SEQ ID NO: 216629 - DNA, 25 bp, Rattus norvegicus
caaactctccgccaaacgggaagag

SEQ ID NO: 216630 - DNA, 25 bp, Rattus norvegicus
caaactctccgcgaaacgggaagag

SEQ ID NO: 216631 - DNA, 25 bp, Rattus norvegicus
caaactctccggctaggttctagaa

SEQ ID NO: 216632 - DNA, 25 bp, Rattus norvegicus
caaactctccgggtaggttctagaa

SEQ ID NO: 216633 - DNA, 25 bp, Rattus norvegicus
caaactctctccatggtgggaaatt

SEQ ID NO: 216634 - DNA, 25 bp, Rattus norvegicus
caaactctctccttggtgggaaatt

SEQ ID NO: 216635 - DNA, 25 bp, Rattus norvegicus
caaactctgactatgctgcaggaga

SEQ ID NO: 216636 - DNA, 25 bp, Rattus norvegicus
caaactctgactttgctgcaggaga

SEQ ID NO: 216637 - DNA, 25 bp, Rattus norvegicus
caaactctgtggattacctcttcac

SEQ ID NO: 216638 - DNA, 25 bp, Rattus norvegicus
caaactctgtggtttacctcttcac

SEQ ID NO: 216639 - DNA, 25 bp, Rattus norvegicus
caaactctgtgtcccgtggccacag

SEQ ID NO: 216640 - DNA, 25 bp, Rattus norvegicus
caaactctgtgtgccgtggccacag

SEQ ID NO: 216641 - DNA, 25 bp, Rattus norvegicus
caaactcttggtagggaagccctgt

SEQ ID NO: 216642 - DNA, 25 bp, Rattus norvegicus
caaactcttggttgggaagccctgt

SEQ ID NO: 216643 - DNA, 25 bp, Rattus norvegicus
caaactcttgtacttgggacaggtc

SEQ ID NO: 216644 - DNA, 25 bp, Rattus norvegicus
caaactcttgtagttgggacaggtc

SEQ ID NO: 216645 - DNA, 25 bp, Rattus norvegicus
caaactcttgttctgagctggatca

SEQ ID NO: 216646 - DNA, 25 bp, Rattus norvegicus
caaactcttgttgtgagctggatca

SEQ ID NO: 216647 - DNA, 25 bp, Rattus norvegicus
caaactgaacgcagggcctctggaa

SEQ ID NO: 216648 - DNA, 25 bp, Rattus norvegicus
caaactgaacgctgggcctctggaa

SEQ ID NO: 216649 - DNA, 25 bp, Rattus norvegicus
caaactgaagaacgcctggctcacc

SEQ ID NO: 216650 - DNA, 25 bp, Rattus norvegicus
caaactgaagaaggcctggctcacc

SEQ ID NO: 216651 - DNA, 25 bp, Rattus norvegicus
caaactgaagttctgctcctagcac

SEQ ID NO: 216652 - DNA, 25 bp, Rattus norvegicus
caaactgaagttgtgctcctagcac

SEQ ID NO: 216653 - DNA, 25 bp, Rattus norvegicus
caaactgaggctacgggagacgcaa

SEQ ID NO: 216654 - DNA, 25 bp, Rattus norvegicus
caaactgaggcttcgggagacgcaa

SEQ ID NO: 216655 - DNA, 25 bp, Rattus norvegicus
caaactgagggcattacacatgcta

SEQ ID NO: 216656 - DNA, 25 bp, Rattus norvegicus
caaactgagggctttacacatgcta

SEQ ID NO: 216657 - DNA, 25 bp, Rattus norvegicus
caaactgatactccctgatacctga

SEQ ID NO: 216658 - DNA, 25 bp, Rattus norvegicus
caaactgatactgcctgatacctga

SEQ ID NO: 216659 - DNA, 25 bp, Rattus norvegicus
caaactgatcgtcgcggctgagcaa

SEQ ID NO: 216660 - DNA, 25 bp, Rattus norvegicus
caaactgatcgtggcggctgagcaa

SEQ ID NO: 216661 - DNA, 25 bp, Rattus norvegicus
caaactgcaccgagttcacagtggt

SEQ ID NO: 216662 - DNA, 25 bp, Rattus norvegicus
caaactgcaccgtgttcacagtggt

SEQ ID NO: 216663 - DNA, 25 bp, Rattus norvegicus
caaactgcagttagtgctctgtaaa

SEQ ID NO: 216664 - DNA, 25 bp, Rattus norvegicus
caaactgcagtttgtgctctgtaaa

SEQ ID NO: 216665 - DNA, 25 bp, Rattus norvegicus
caaactgcatggctaggagagaatt

SEQ ID NO: 216666 - DNA, 25 bp, Rattus norvegicus
caaactgcatgggtaggagagaatt

SEQ ID NO: 216667 - DNA, 25 bp, Rattus norvegicus
caaactgcctcactgtcaatggtta

SEQ ID NO: 216668 - DNA, 25 bp, Rattus norvegicus
caaactgcctcagtgtcaatggtta

SEQ ID NO: 216669 - DNA, 25 bp, Rattus norvegicus
caaactgcctccctagaaggtgctg

SEQ ID NO: 216670 - DNA, 25 bp, Rattus norvegicus
caaactgcctccgtagaaggtgctg

SEQ ID NO: 216671 - DNA, 25 bp, Rattus norvegicus
caaactgctccaccagacatttttt

SEQ ID NO: 216672 - DNA, 25 bp, Rattus norvegicus
caaactgctccagcagacatttttt

SEQ ID NO: 216673 - DNA, 25 bp, Rattus norvegicus
caaactgctgaccacgccgaatccg

SEQ ID NO: 216674 - DNA, 25 bp, Rattus norvegicus
caaactgctgacgacgccgaatccg

SEQ ID NO: 216675 - DNA, 25 bp, Rattus norvegicus
caaactgctgttaccatttctactg

SEQ ID NO: 216676 - DNA, 25 bp, Rattus norvegicus
caaactgctgtttccatttctactg

SEQ ID NO: 216677 - DNA, 25 bp, Rattus norvegicus
caaactggcctccatcttagagatc

SEQ ID NO: 216678 - DNA, 25 bp, Rattus norvegicus
caaactggcctcgatcttagagatc

SEQ ID NO: 216679 - DNA, 25 bp, Rattus norvegicus
caaactgggcccaggagtcaccatt

SEQ ID NO: 216680 - DNA, 25 bp, Rattus norvegicus
caaactgggccctggagtcaccatt

SEQ ID NO: 216681 - DNA, 25 bp, Rattus norvegicus
caaactggtacaacaagttgtctaa

SEQ ID NO: 216682 - DNA, 25 bp, Rattus norvegicus
caaactggtacatcaagttgtctaa

SEQ ID NO: 216683 - DNA, 25 bp, Rattus norvegicus
caaactgtactcattttgcctttgt

SEQ ID NO: 216684 - DNA, 25 bp, Rattus norvegicus
caaactgtactctttttgcctttgt

SEQ ID NO: 216685 - DNA, 25 bp, Rattus norvegicus
caaactgtactgaccttgaaagggt

SEQ ID NO: 216686 - DNA, 25 bp, Rattus norvegicus
caaactgtactgtccttgaaagggt

SEQ ID NO: 216687 - DNA, 25 bp, Rattus norvegicus
caaactgtagctacagtcccaggat

SEQ ID NO: 216688 - DNA, 25 bp, Rattus norvegicus
caaactgtagcttcagtcccaggat

SEQ ID NO: 216689 - DNA, 25 bp, Rattus norvegicus
caaactgtgagtctgattcgtgaga

SEQ ID NO: 216690 - DNA, 25 bp, Rattus norvegicus
caaactgtgagtgtgattcgtgaga

SEQ ID NO: 216691 - DNA, 25 bp, Rattus norvegicus
caaactgtgccgagagtctgttcat

SEQ ID NO: 216692 - DNA, 25 bp, Rattus norvegicus
caaactgtgccgtgagtctgttcat

SEQ ID NO: 216693 - DNA, 25 bp, Rattus norvegicus
caaactgtggctatgttttagtaca

SEQ ID NO: 216694 - DNA, 25 bp, Rattus norvegicus
caaactgtggctttgttttagtaca

SEQ ID NO: 216695 - DNA, 25 bp, Rattus norvegicus
caaactgttattattaccatgatat

SEQ ID NO: 216696 - DNA, 25 bp, Rattus norvegicus
caaactgttatttttaccatgatat

SEQ ID NO: 216697 - DNA, 25 bp, Rattus norvegicus
caaactgttggcaccacaggaaaag

SEQ ID NO: 216698 - DNA, 25 bp, Rattus norvegicus
caaactgttggctccacaggaaaag

SEQ ID NO: 216699 - DNA, 25 bp, Rattus norvegicus
caaacttaaggtctcaggcatggta

SEQ ID NO: 216700 - DNA, 25 bp, Rattus norvegicus
caaacttaaggtgtcaggcatggta

SEQ ID NO: 216701 - DNA, 25 bp, Rattus norvegicus
caaacttcatttctaactgctgggt

SEQ ID NO: 216702 - DNA, 25 bp, Rattus norvegicus
caaacttcatttgtaactgctgggt

SEQ ID NO: 216703 - DNA, 25 bp, Rattus norvegicus
caaacttctactatcgtcagtcctt

SEQ ID NO: 216704 - DNA, 25 bp, Rattus norvegicus
caaacttctactttcgtcagtcctt

SEQ ID NO: 216705 - DNA, 25 bp, Rattus norvegicus
caaacttgccccaggccttgaaggg

SEQ ID NO: 216706 - DNA, 25 bp, Rattus norvegicus
caaacttgcccctggccttgaaggg

SEQ ID NO: 216707 - DNA, 25 bp, Rattus norvegicus
caaacttggattcttcccaaccagg

SEQ ID NO: 216708 - DNA, 25 bp, Rattus norvegicus
caaacttggattgttcccaaccagg

SEQ ID NO: 216709 - DNA, 25 bp, Rattus norvegicus
caaacttggctacaccaggtggcat

SEQ ID NO: 216710 - DNA, 25 bp, Rattus norvegicus
caaacttggctagaccaggtggcat

SEQ ID NO: 216711 - DNA, 25 bp, Rattus norvegicus
caaacttgtcaaaggccgccttgaa

SEQ ID NO: 216712 - DNA, 25 bp, Rattus norvegicus
caaacttgtcaatggccgccttgaa

SEQ ID NO: 216713 - DNA, 25 bp, Rattus norvegicus
caaacttgtggtagactgctcagaa

SEQ ID NO: 216714 - DNA, 25 bp, Rattus norvegicus
caaacttgtggttgactgctcagaa

SEQ ID NO: 216715 - DNA, 25 bp, Rattus norvegicus
caaactttcaggctgcagtgacagt

SEQ ID NO: 216716 - DNA, 25 bp, Rattus norvegicus
caaactttcagggtgcagtgacagt

SEQ ID NO: 216717 - DNA, 25 bp, Rattus norvegicus
caaactttctcaataatctgctgtg

SEQ ID NO: 216718 - DNA, 25 bp, Rattus norvegicus
caaactttctcattaatctgctgtg

SEQ ID NO: 216719 - DNA, 25 bp, Rattus norvegicus
caaactttttataccgtcaaacatg

SEQ ID NO: 216720 - DNA, 25 bp, Rattus norvegicus
caaactttttattccgtcaaacatg

SEQ ID NO: 216721 - DNA, 25 bp, Rattus norvegicus
caaagaaacgccagctgtgcccaag

SEQ ID NO: 216722 - DNA, 25 bp, Rattus norvegicus
caaagaaacgcctgctgtgcccaag

SEQ ID NO: 216723 - DNA, 25 bp, Rattus norvegicus
caaagaactggcagcactggaggca

SEQ ID NO: 216724 - DNA, 25 bp, Rattus norvegicus
caaagaactggctgcactggaggca

SEQ ID NO: 216725 - DNA, 25 bp, Rattus norvegicus
caaagaagacttcggcttcctacac

SEQ ID NO: 216726 - DNA, 25 bp, Rattus norvegicus
caaagaagacttgggcttcctacac

SEQ ID NO: 216727 - DNA, 25 bp, Rattus norvegicus
caaagaagagatctatgcccatttt

SEQ ID NO: 216728 - DNA, 25 bp, Rattus norvegicus
caaagaagagatgtatgcccatttt

SEQ ID NO: 216729 - DNA, 25 bp, Rattus norvegicus
caaagaagaggcatttatgcagctc

SEQ ID NO: 216730 - DNA, 25 bp, Rattus norvegicus
caaagaagaggcttttatgcagctc

SEQ ID NO: 216731 - DNA, 25 bp, Rattus norvegicus
caaagaagggtgatgcacactggtg

SEQ ID NO: 216732 - DNA, 25 bp, Rattus norvegicus
caaagaagggtgttgcacactggtg

SEQ ID NO: 216733 - DNA, 25 bp, Rattus norvegicus
caaagaatagcaactccttcctgct

SEQ ID NO: 216734 - DNA, 25 bp, Rattus norvegicus
caaagaatagcatctccttcctgct

SEQ ID NO: 216735 - DNA, 25 bp, Rattus norvegicus
caaagaatctgtaggcatctattaa

SEQ ID NO: 216736 - DNA, 25 bp, Rattus norvegicus
caaagaatctgttggcatctattaa

SEQ ID NO: 216737 - DNA, 25 bp, Rattus norvegicus
caaagaatgtttcacgggttcctga

SEQ ID NO: 216738 - DNA, 25 bp, Rattus norvegicus
caaagaatgtttgacgggttcctga

SEQ ID NO: 216739 - DNA, 25 bp, Rattus norvegicus
caaagaattttcagtgctccctgga

SEQ ID NO: 216740 - DNA, 25 bp, Rattus norvegicus
caaagaattttctgtgctccctgga

SEQ ID NO: 216741 - DNA, 25 bp, Rattus norvegicus
caaagacaccggctaattaaaatgt

SEQ ID NO: 216742 - DNA, 25 bp, Rattus norvegicus
caaagacaccgggtaattaaaatgt

SEQ ID NO: 216743 - DNA, 25 bp, Rattus norvegicus
caaagacatgagctacagggagcct

SEQ ID NO: 216744 - DNA, 25 bp, Rattus norvegicus
caaagacatgaggtacagggagcct

SEQ ID NO: 216745 - DNA, 25 bp, Rattus norvegicus
caaagacattttcccagaccttgct

SEQ ID NO: 216746 - DNA, 25 bp, Rattus norvegicus
caaagacattttgccagaccttgct

SEQ ID NO: 216747 - DNA, 25 bp, Rattus norvegicus
caaagaccagaaccccagtgtgtaa

SEQ ID NO: 216748 - DNA, 25 bp, Rattus norvegicus
caaagaccagaagcccagtgtgtaa

SEQ ID NO: 216749 - DNA, 25 bp, Rattus norvegicus
caaagacccagcagacaacctacag

SEQ ID NO: 216750 - DNA, 25 bp, Rattus norvegicus
caaagacccagctgacaacctacag

SEQ ID NO: 216751 - DNA, 25 bp, Rattus norvegicus
caaagaccccttctagcctgcagag

SEQ ID NO: 216752 - DNA, 25 bp, Rattus norvegicus
caaagaccccttgtagcctgcagag

SEQ ID NO: 216753 - DNA, 25 bp, Rattus norvegicus
caaagaccgaagacagccactctgt

SEQ ID NO: 216754 - DNA, 25 bp, Rattus norvegicus
caaagaccgaagtcagccactctgt

SEQ ID NO: 216755 - DNA, 25 bp, Rattus norvegicus
caaagaccgcgaaagcccatggagg

SEQ ID NO: 216756 - DNA, 25 bp, Rattus norvegicus
caaagaccgcgatagcccatggagg

SEQ ID NO: 216757 - DNA, 25 bp, Rattus norvegicus
caaagacctgagataaaccccaact

SEQ ID NO: 216758 - DNA, 25 bp, Rattus norvegicus
caaagacctgagttaaaccccaact

SEQ ID NO: 216759 - DNA, 25 bp, Rattus norvegicus
caaagacctgttccgggaccacaag

SEQ ID NO: 216760 - DNA, 25 bp, Rattus norvegicus
caaagacctgttgcgggaccacaag

SEQ ID NO: 216761 - DNA, 25 bp, Rattus norvegicus
caaagaccttggagaatatttcagt

SEQ ID NO: 216762 - DNA, 25 bp, Rattus norvegicus
caaagaccttggtgaatatttcagt

SEQ ID NO: 216763 - DNA, 25 bp, Rattus norvegicus
caaagacgcgtactaccggcgagtt

SEQ ID NO: 216764 - DNA, 25 bp, Rattus norvegicus
caaagacgcgtagtaccggcgagtt

SEQ ID NO: 216765 - DNA, 25 bp, Rattus norvegicus
caaagacggccactgttcctgttaa

SEQ ID NO: 216766 - DNA, 25 bp, Rattus norvegicus
caaagacggccagtgttcctgttaa

SEQ ID NO: 216767 - DNA, 25 bp, Rattus norvegicus
caaagactagttacccagcattccg

SEQ ID NO: 216768 - DNA, 25 bp, Rattus norvegicus
caaagactagtttcccagcattccg

SEQ ID NO: 216769 - DNA, 25 bp, Rattus norvegicus
caaagactgagaactagttttccgg

SEQ ID NO: 216770 - DNA, 25 bp, Rattus norvegicus
caaagactgagatctagttttccgg

SEQ ID NO: 216771 - DNA, 25 bp, Rattus norvegicus
caaagactgagtctccctggtggac

SEQ ID NO: 216772 - DNA, 25 bp, Rattus norvegicus
caaagactgagtgtccctggtggac

SEQ ID NO: 216773 - DNA, 25 bp, Rattus norvegicus
caaagagaagatccctgttacccca

SEQ ID NO: 216774 - DNA, 25 bp, Rattus norvegicus
caaagagaagatgcctgttacccca

SEQ ID NO: 216775 - DNA, 25 bp, Rattus norvegicus
caaagagacatcaggaccctggagt

SEQ ID NO: 216776 - DNA, 25 bp, Rattus norvegicus
caaagagacatctggaccctggagt

SEQ ID NO: 216777 - DNA, 25 bp, Rattus norvegicus
caaagagaccataaggctgactcgt

SEQ ID NO: 216778 - DNA, 25 bp, Rattus norvegicus
caaagagaccattaggctgactcgt

SEQ ID NO: 216779 - DNA, 25 bp, Rattus norvegicus
caaagagactggctttcacagaggc

SEQ ID NO: 216780 - DNA, 25 bp, Rattus norvegicus
caaagagactgggtttcacagaggc

SEQ ID NO: 216781 - DNA, 25 bp, Rattus norvegicus
caaagagatagtccattatgtcaga

SEQ ID NO: 216782 - DNA, 25 bp, Rattus norvegicus
caaagagatagtgcattatgtcaga

SEQ ID NO: 216783 - DNA, 25 bp, Rattus norvegicus
caaagagatgcgagcccatcaggct

SEQ ID NO: 216784 - DNA, 25 bp, Rattus norvegicus
caaagagatgcgtgcccatcaggct

SEQ ID NO: 216785 - DNA, 25 bp, Rattus norvegicus
caaagagcaactcgaaggctccagg

SEQ ID NO: 216786 - DNA, 25 bp, Rattus norvegicus
caaagagcaactggaaggctccagg

SEQ ID NO: 216787 - DNA, 25 bp, Rattus norvegicus
caaagagcagatattgtctgggcta

SEQ ID NO: 216788 - DNA, 25 bp, Rattus norvegicus
caaagagcagattttgtctgggcta

SEQ ID NO: 216789 - DNA, 25 bp, Rattus norvegicus
caaagagcctatatgtaccccagac

SEQ ID NO: 216790 - DNA, 25 bp, Rattus norvegicus
caaagagcctatttgtaccccagac

SEQ ID NO: 216791 - DNA, 25 bp, Rattus norvegicus
caaagagctgtcatggtcatgcccc

SEQ ID NO: 216792 - DNA, 25 bp, Rattus norvegicus
caaagagctgtcttggtcatgcccc

SEQ ID NO: 216793 - DNA, 25 bp, Rattus norvegicus
caaagagcttctcaggtcactgtgc

SEQ ID NO: 216794 - DNA, 25 bp, Rattus norvegicus
caaagagcttctgaggtcactgtgc

SEQ ID NO: 216795 - DNA, 25 bp, Rattus norvegicus
caaagaggagcaactctgtacacaa

SEQ ID NO: 216796 - DNA, 25 bp, Rattus norvegicus
caaagaggagcatctctgtacacaa

SEQ ID NO: 216797 - DNA, 25 bp, Rattus norvegicus
caaagaggagctcgccgtcgcatgc

SEQ ID NO: 216798 - DNA, 25 bp, Rattus norvegicus
caaagaggagctggccgtcgcatgc

SEQ ID NO: 216799 - DNA, 25 bp, Rattus norvegicus
caaagaggagtcactttcccacact

SEQ ID NO: 216800 - DNA, 25 bp, Rattus norvegicus
caaagaggagtctctttcccacact

SEQ ID NO: 216801 - DNA, 25 bp, Rattus norvegicus
caaagaggcgcacctccctgtggct

SEQ ID NO: 216802 - DNA, 25 bp, Rattus norvegicus
caaagaggcgcagctccctgtggct

SEQ ID NO: 216803 - DNA, 25 bp, Rattus norvegicus
caaagaggtggaccgctttctggct

SEQ ID NO: 216804 - DNA, 25 bp, Rattus norvegicus
caaagaggtggagcgctttctggct

SEQ ID NO: 216805 - DNA, 25 bp, Rattus norvegicus
caaagagtccgccttgtgcagtaag

SEQ ID NO: 216806 - DNA, 25 bp, Rattus norvegicus
caaagagtccgcgttgtgcagtaag

SEQ ID NO: 216807 - DNA, 25 bp, Rattus norvegicus
caaagagtcctcaaagtcagaaaaa

SEQ ID NO: 216808 - DNA, 25 bp, Rattus norvegicus
caaagagtcctctaagtcagaaaaa

SEQ ID NO: 216809 - DNA, 25 bp, Rattus norvegicus
caaagagtcggaactgtgcccagct

SEQ ID NO: 216810 - DNA, 25 bp, Rattus norvegicus
caaagagtcggatctgtgcccagct

SEQ ID NO: 216811 - DNA, 25 bp, Rattus norvegicus
caaagagtgggtcttctttctcctg

SEQ ID NO: 216812 - DNA, 25 bp, Rattus norvegicus
caaagagtgggtgttctttctcctg

SEQ ID NO: 216813 - DNA, 25 bp, Rattus norvegicus
caaagagttcgaccgtgcctacatt

SEQ ID NO: 216814 - DNA, 25 bp, Rattus norvegicus
caaagagttcgagcgtgcctacatt

SEQ ID NO: 216815 - DNA, 25 bp, Rattus norvegicus
caaagagttgggattctcccctgct

SEQ ID NO: 216816 - DNA, 25 bp, Rattus norvegicus
caaagagttgggtttctcccctgct

SEQ ID NO: 216817 - DNA, 25 bp, Rattus norvegicus
caaagagttgtgcagcggtagccat

SEQ ID NO: 216818 - DNA, 25 bp, Rattus norvegicus
caaagagttgtggagcggtagccat

SEQ ID NO: 216819 - DNA, 25 bp, Rattus norvegicus
caaagagttgttcattctaagttta

SEQ ID NO: 216820 - DNA, 25 bp, Rattus norvegicus
caaagagttgttgattctaagttta

SEQ ID NO: 216821 - DNA, 25 bp, Rattus norvegicus
caaagataattcacccctggacctg

SEQ ID NO: 216822 - DNA, 25 bp, Rattus norvegicus
caaagataattctcccctggacctg

SEQ ID NO: 216823 - DNA, 25 bp, Rattus norvegicus
caaagatatatgcaagggtgactca

SEQ ID NO: 216824 - DNA, 25 bp, Rattus norvegicus
caaagatatatggaagggtgactca

SEQ ID NO: 216825 - DNA, 25 bp, Rattus norvegicus
caaagatcgcaacaaccactgtgga

SEQ ID NO: 216826 - DNA, 25 bp, Rattus norvegicus
caaagatcgcaagaaccactgtgga

SEQ ID NO: 216827 - DNA, 25 bp, Rattus norvegicus
caaagatctacactccaggacggaa

SEQ ID NO: 216828 - DNA, 25 bp, Rattus norvegicus
caaagatctacagtccaggacggaa

SEQ ID NO: 216829 - DNA, 25 bp, Rattus norvegicus
caaagatggttactagtccacccct

SEQ ID NO: 216830 - DNA, 25 bp, Rattus norvegicus
caaagatggttagtagtccacccct

SEQ ID NO: 216831 - DNA, 25 bp, Rattus norvegicus
caaagatgtggcagaagcccggcgc

SEQ ID NO: 216832 - DNA, 25 bp, Rattus norvegicus
caaagatgtggctgaagcccggcgc

SEQ ID NO: 216833 - DNA, 25 bp, Rattus norvegicus
caaagattactgattatcaccaata

SEQ ID NO: 216834 - DNA, 25 bp, Rattus norvegicus
caaagattactgtttatcaccaata

SEQ ID NO: 216835 - DNA, 25 bp, Rattus norvegicus
caaagattcaatcccctgggatcca

SEQ ID NO: 216836 - DNA, 25 bp, Rattus norvegicus
caaagattcaatgccctgggatcca

SEQ ID NO: 216837 - DNA, 25 bp, Rattus norvegicus
caaagattctctcgtcagggttccc

SEQ ID NO: 216838 - DNA, 25 bp, Rattus norvegicus
caaagattctctggtcagggttccc

SEQ ID NO: 216839 - DNA, 25 bp, Rattus norvegicus
caaagattgtccacgatgatcacat

SEQ ID NO: 216840 - DNA, 25 bp, Rattus norvegicus
caaagattgtcctcgatgatcacat

SEQ ID NO: 216841 - DNA, 25 bp, Rattus norvegicus
caaagcaacatcatttatctcagca

SEQ ID NO: 216842 - DNA, 25 bp, Rattus norvegicus
caaagcaacatcttttatctcagca

SEQ ID NO: 216843 - DNA, 25 bp, Rattus norvegicus
caaagcaagaaacgacctccacatc

SEQ ID NO: 216844 - DNA, 25 bp, Rattus norvegicus
caaagcaagaaaggacctccacatc

SEQ ID NO: 216845 - DNA, 25 bp, Rattus norvegicus
caaagcaaggcccaggacatccagg

SEQ ID NO: 216846 - DNA, 25 bp, Rattus norvegicus
caaagcaaggccgaggacatccagg

SEQ ID NO: 216847 - DNA, 25 bp, Rattus norvegicus
caaagcaagtccctagtgacacact

SEQ ID NO: 216848 - DNA, 25 bp, Rattus norvegicus
caaagcaagtccgtagtgacacact

SEQ ID NO: 216849 - DNA, 25 bp, Rattus norvegicus
caaagcaagttcaagcacagtcggg

SEQ ID NO: 216850 - DNA, 25 bp, Rattus norvegicus
caaagcaagttctagcacagtcggg

SEQ ID NO: 216851 - DNA, 25 bp, Rattus norvegicus
caaagcaattacaacctgggtccct

SEQ ID NO: 216852 - DNA, 25 bp, Rattus norvegicus
caaagcaattactacctgggtccct

SEQ ID NO: 216853 - DNA, 25 bp, Rattus norvegicus
caaagcaatttgagtgttctgagta

SEQ ID NO: 216854 - DNA, 25 bp, Rattus norvegicus
caaagcaatttgtgtgttctgagta

SEQ ID NO: 216855 - DNA, 25 bp, Rattus norvegicus
caaagcacagacagcattcactggg

SEQ ID NO: 216856 - DNA, 25 bp, Rattus norvegicus
caaagcacagactgcattcactggg

SEQ ID NO: 216857 - DNA, 25 bp, Rattus norvegicus
caaagcacagcacgtcttcttcagg

SEQ ID NO: 216858 - DNA, 25 bp, Rattus norvegicus
caaagcacagcaggtcttcttcagg

SEQ ID NO: 216859 - DNA, 25 bp, Rattus norvegicus
caaagcacatttaggcacactctgc

SEQ ID NO: 216860 - DNA, 25 bp, Rattus norvegicus
caaagcacattttggcacactctgc

SEQ ID NO: 216861 - DNA, 25 bp, Rattus norvegicus
caaagcactcttaatacccagcggg

SEQ ID NO: 216862 - DNA, 25 bp, Rattus norvegicus
caaagcactctttatacccagcggg

SEQ ID NO: 216863 - DNA, 25 bp, Rattus norvegicus
caaagcagaacaaacctacagggat

SEQ ID NO: 216864 - DNA, 25 bp, Rattus norvegicus
caaagcagaacatacctacagggat

SEQ ID NO: 216865 - DNA, 25 bp, Rattus norvegicus
caaagcagacatcctcctatggagg

SEQ ID NO: 216866 - DNA, 25 bp, Rattus norvegicus
caaagcagacatgctcctatggagg

SEQ ID NO: 216867 - DNA, 25 bp, Rattus norvegicus
caaagcagagacataaccggcccgg

SEQ ID NO: 216868 - DNA, 25 bp, Rattus norvegicus
caaagcagagacttaaccggcccgg

SEQ ID NO: 216869 - DNA, 25 bp, Rattus norvegicus
caaagcagcgagatgcctgtctgag

SEQ ID NO: 216870 - DNA, 25 bp, Rattus norvegicus
caaagcagcgagttgcctgtctgag

SEQ ID NO: 216871 - DNA, 25 bp, Rattus norvegicus
caaagcagctgacgccaggcgactg

SEQ ID NO: 216872 - DNA, 25 bp, Rattus norvegicus
caaagcagctgaggccaggcgactg

SEQ ID NO: 216873 - DNA, 25 bp, Rattus norvegicus
caaagcagctgtcactacctgggtg

SEQ ID NO: 216874 - DNA, 25 bp, Rattus norvegicus
caaagcagctgtgactacctgggtg

SEQ ID NO: 216875 - DNA, 25 bp, Rattus norvegicus
caaagcaggcttcaccagctctggt

SEQ ID NO: 216876 - DNA, 25 bp, Rattus norvegicus
caaagcaggcttgaccagctctggt

SEQ ID NO: 216877 - DNA, 25 bp, Rattus norvegicus
caaagcagggtcatatttgttatct

SEQ ID NO: 216878 - DNA, 25 bp, Rattus norvegicus
caaagcagggtcttatttgttatct

SEQ ID NO: 216879 - DNA, 25 bp, Rattus norvegicus
caaagcagtagtctgcgctggacag

SEQ ID NO: 216880 - DNA, 25 bp, Rattus norvegicus
caaagcagtagtgtgcgctggacag

SEQ ID NO: 216881 - DNA, 25 bp, Rattus norvegicus
caaagcagtttcattcccgagaaga

SEQ ID NO: 216882 - DNA, 25 bp, Rattus norvegicus
caaagcagtttccaatgacatgtta

SEQ ID NO: 216883 - DNA, 25 bp, Rattus norvegicus
caaagcagtttcgaatgacatgtta

SEQ ID NO: 216884 - DNA, 25 bp, Rattus norvegicus
caaagcagtttctttcccgagaaga

SEQ ID NO: 216885 - DNA, 25 bp, Rattus norvegicus
caaagcatgagtcggaaggtctgaa

SEQ ID NO: 216886 - DNA, 25 bp, Rattus norvegicus
caaagcatgagtgggaaggtctgaa

SEQ ID NO: 216887 - DNA, 25 bp, Rattus norvegicus
caaagcatttagatgctcccttacc

SEQ ID NO: 216888 - DNA, 25 bp, Rattus norvegicus
caaagcatttagttgctcccttacc

SEQ ID NO: 216889 - DNA, 25 bp, Rattus norvegicus
caaagcatttcacatttaacactat

SEQ ID NO: 216890 - DNA, 25 bp, Rattus norvegicus
caaagcatttcagatttaacactat

SEQ ID NO: 216891 - DNA, 25 bp, Rattus norvegicus
caaagccaagacccgttcttcacgg

SEQ ID NO: 216892 - DNA, 25 bp, Rattus norvegicus
caaagccaagacgcgttcttcacgg

SEQ ID NO: 216893 - DNA, 25 bp, Rattus norvegicus
caaagccaagctcttttcccttagc

SEQ ID NO: 216894 - DNA, 25 bp, Rattus norvegicus
caaagccaagctgttttcccttagc

SEQ ID NO: 216895 - DNA, 25 bp, Rattus norvegicus
caaagccagatgcagtgcagccaga

SEQ ID NO: 216896 - DNA, 25 bp, Rattus norvegicus
caaagccagatggagtgcagccaga

SEQ ID NO: 216897 - DNA, 25 bp, Rattus norvegicus
caaagccagcttcaggttgataact

SEQ ID NO: 216898 - DNA, 25 bp, Rattus norvegicus
caaagccagcttgaggttgataact

SEQ ID NO: 216899 - DNA, 25 bp, Rattus norvegicus
caaagccaggtgacccgactcacag

SEQ ID NO: 216900 - DNA, 25 bp, Rattus norvegicus
caaagccaggtgtcccgactcacag

SEQ ID NO: 216901 - DNA, 25 bp, Rattus norvegicus
caaagccatatccagccagagcaga

SEQ ID NO: 216902 - DNA, 25 bp, Rattus norvegicus
caaagccatatcgagccagagcaga

SEQ ID NO: 216903 - DNA, 25 bp, Rattus norvegicus
caaagcccaaagcatgagtattcgg

SEQ ID NO: 216904 - DNA, 25 bp, Rattus norvegicus
caaagcccaaaggatgagtattcgg

SEQ ID NO: 216905 - DNA, 25 bp, Rattus norvegicus
caaagcccaggccatcttgacggat

SEQ ID NO: 216906 - DNA, 25 bp, Rattus norvegicus
caaagcccaggcgatcttgacggat

SEQ ID NO: 216907 - DNA, 25 bp, Rattus norvegicus
caaagcccagggaccaagttgtggt

SEQ ID NO: 216908 - DNA, 25 bp, Rattus norvegicus
caaagcccagggtccaagttgtggt

SEQ ID NO: 216909 - DNA, 25 bp, Rattus norvegicus
caaagccctctcatggagcagaatt

SEQ ID NO: 216910 - DNA, 25 bp, Rattus norvegicus
caaagccctctcctgtggaaaaatc

SEQ ID NO: 216911 - DNA, 25 bp, Rattus norvegicus
caaagccctctcgtgtggaaaaatc

SEQ ID NO: 216912 - DNA, 25 bp, Rattus norvegicus
caaagccctctcttggagcagaatt

SEQ ID NO: 216913 - DNA, 25 bp, Rattus norvegicus
caaagccctttgctagacaagaaga

SEQ ID NO: 216914 - DNA, 25 bp, Rattus norvegicus
caaagccctttggtagacaagaaga

SEQ ID NO: 216915 - DNA, 25 bp, Rattus norvegicus
caaagccgtggtctaaacgctggga

SEQ ID NO: 216916 - DNA, 25 bp, Rattus norvegicus
caaagccgtggtgtaaacgctggga

SEQ ID NO: 216917 - DNA, 25 bp, Rattus norvegicus
caaagccgtttcagtgcacactgtt

SEQ ID NO: 216918 - DNA, 25 bp, Rattus norvegicus
caaagccgtttctgtgcacactgtt

SEQ ID NO: 216919 - DNA, 25 bp, Rattus norvegicus
caaagcctatggcattcgaatcgat

SEQ ID NO: 216920 - DNA, 25 bp, Rattus norvegicus
caaagcctatgggattcgaatcgat

SEQ ID NO: 216921 - DNA, 25 bp, Rattus norvegicus
caaagcctgtctagtcgttaaacgg

SEQ ID NO: 216922 - DNA, 25 bp, Rattus norvegicus
caaagcctgtcttgtcgttaaacgg

SEQ ID NO: 216923 - DNA, 25 bp, Rattus norvegicus
caaagcctgtggcagcactgaagat

SEQ ID NO: 216924 - DNA, 25 bp, Rattus norvegicus
caaagcctgtgggagcactgaagat

SEQ ID NO: 216925 - DNA, 25 bp, Rattus norvegicus
caaagccttctgatgttgaggagtc

SEQ ID NO: 216926 - DNA, 25 bp, Rattus norvegicus
caaagccttctgttgttgaggagtc

SEQ ID NO: 216927 - DNA, 25 bp, Rattus norvegicus
caaagccttggtcttggcaaaccac

SEQ ID NO: 216928 - DNA, 25 bp, Rattus norvegicus
caaagccttggtgttggcaaaccac

SEQ ID NO: 216929 - DNA, 25 bp, Rattus norvegicus
caaagccttgttacccagtctgagg

SEQ ID NO: 216930 - DNA, 25 bp, Rattus norvegicus
caaagccttgtttcccagtctgagg

SEQ ID NO: 216931 - DNA, 25 bp, Rattus norvegicus
caaagcgaaagccgcaggatcgacg

SEQ ID NO: 216932 - DNA, 25 bp, Rattus norvegicus
caaagcgaaagcggcaggatcgacg

SEQ ID NO: 216933 - DNA, 25 bp, Rattus norvegicus
caaagcgaggacagcagtaccagca

SEQ ID NO: 216934 - DNA, 25 bp, Rattus norvegicus
caaagcgaggactgcagtaccagca

SEQ ID NO: 216935 - DNA, 25 bp, Rattus norvegicus
caaagcgctcatcaactgtgaccat

SEQ ID NO: 216936 - DNA, 25 bp, Rattus norvegicus
caaagcgctcatgaactgtgaccat

SEQ ID NO: 216937 - DNA, 25 bp, Rattus norvegicus
caaagcgggcgtcctcttggtctgc

SEQ ID NO: 216938 - DNA, 25 bp, Rattus norvegicus
caaagcgggcgtgctcttggtctgc

SEQ ID NO: 216939 - DNA, 25 bp, Rattus norvegicus
caaagcgtagcgaggtccgaggacc

SEQ ID NO: 216940 - DNA, 25 bp, Rattus norvegicus
caaagcgtagcgtggtccgaggacc

SEQ ID NO: 216941 - DNA, 25 bp, Rattus norvegicus
caaagctaacccatgccttgtggaa

SEQ ID NO: 216942 - DNA, 25 bp, Rattus norvegicus
caaagctaacccttgccttgtggaa

SEQ ID NO: 216943 - DNA, 25 bp, Rattus norvegicus
caaagctaaggacttccggtctgaa

SEQ ID NO: 216944 - DNA, 25 bp, Rattus norvegicus
caaagctaaggagttccggtctgaa

SEQ ID NO: 216945 - DNA, 25 bp, Rattus norvegicus
caaagctagcccagagtctcaggag

SEQ ID NO: 216946 - DNA, 25 bp, Rattus norvegicus
caaagctagccctgagtctcaggag

SEQ ID NO: 216947 - DNA, 25 bp, Rattus norvegicus
caaagctagggtcagtctgtgtgca

SEQ ID NO: 216948 - DNA, 25 bp, Rattus norvegicus
caaagctagggtgagtctgtgtgca

SEQ ID NO: 216949 - DNA, 25 bp, Rattus norvegicus
caaagctagtctacctaagggcaga

SEQ ID NO: 216950 - DNA, 25 bp, Rattus norvegicus
caaagctagtcttcctaagggcaga

SEQ ID NO: 216951 - DNA, 25 bp, Rattus norvegicus
caaagctatcaacggcgccaagggt

SEQ ID NO: 216952 - DNA, 25 bp, Rattus norvegicus
caaagctatcaagggcgccaagggt

SEQ ID NO: 216953 - DNA, 25 bp, Rattus norvegicus
caaagctcagtgatccaaggcaaaa

SEQ ID NO: 216954 - DNA, 25 bp, Rattus norvegicus
caaagctcagtgttccaaggcaaaa

SEQ ID NO: 216955 - DNA, 25 bp, Rattus norvegicus
caaagctctgccaacatagaagact

SEQ ID NO: 216956 - DNA, 25 bp, Rattus norvegicus
caaagctctgcctacatagaagact

SEQ ID NO: 216957 - DNA, 25 bp, Rattus norvegicus
caaagctctggccttaaagaatgtt

SEQ ID NO: 216958 - DNA, 25 bp, Rattus norvegicus
caaagctctggcgttaaagaatgtt

SEQ ID NO: 216959 - DNA, 25 bp, Rattus norvegicus
caaagctctgttagtatccgaggaa

SEQ ID NO: 216960 - DNA, 25 bp, Rattus norvegicus
caaagctctgtttgtatccgaggaa

SEQ ID NO: 216961 - DNA, 25 bp, Rattus norvegicus
caaagctgattgacgcggtagtcaa

SEQ ID NO: 216962 - DNA, 25 bp, Rattus norvegicus
caaagctgattgtcgcggtagtcaa

SEQ ID NO: 216963 - DNA, 25 bp, Rattus norvegicus
caaagctgcccacgtagccaaggag

SEQ ID NO: 216964 - DNA, 25 bp, Rattus norvegicus
caaagctgcccaggtagccaaggag

SEQ ID NO: 216965 - DNA, 25 bp, Rattus norvegicus
caaagctgcctcatgtggtggtttt

SEQ ID NO: 216966 - DNA, 25 bp, Rattus norvegicus
caaagctgcctcttgtggtggtttt

SEQ ID NO: 216967 - DNA, 25 bp, Rattus norvegicus
caaagctggccaagaactcctgatc

SEQ ID NO: 216968 - DNA, 25 bp, Rattus norvegicus
caaagctggccatgaactcctgatc

SEQ ID NO: 216969 - DNA, 25 bp, Rattus norvegicus
caaagctggcgtcactgttgactca

SEQ ID NO: 216970 - DNA, 25 bp, Rattus norvegicus
caaagctggcgtgactgttgactca

SEQ ID NO: 216971 - DNA, 25 bp, Rattus norvegicus
caaagctgggacactccccgaaggt

SEQ ID NO: 216972 - DNA, 25 bp, Rattus norvegicus
caaagctgggaccactaccgagagt

SEQ ID NO: 216973 - DNA, 25 bp, Rattus norvegicus
caaagctgggacgactaccgagagt

SEQ ID NO: 216974 - DNA, 25 bp, Rattus norvegicus
caaagctgggactctccccgaaggt

SEQ ID NO: 216975 - DNA, 25 bp, Rattus norvegicus
caaagctgggccacatggagagcaa

SEQ ID NO: 216976 - DNA, 25 bp, Rattus norvegicus
caaagctgggcctcatggagagcaa

SEQ ID NO: 216977 - DNA, 25 bp, Rattus norvegicus
caaagctggtggatgtggcaaaaac

SEQ ID NO: 216978 - DNA, 25 bp, Rattus norvegicus
caaagctggtggttgtggcaaaaac

SEQ ID NO: 216979 - DNA, 25 bp, Rattus norvegicus
caaagctggtttagcttcctggttg

SEQ ID NO: 216980 - DNA, 25 bp, Rattus norvegicus
caaagctggttttgcttcctggttg

SEQ ID NO: 216981 - DNA, 25 bp, Rattus norvegicus
caaagctgtcacaaagccggagcag

SEQ ID NO: 216982 - DNA, 25 bp, Rattus norvegicus
caaagctgtcactaagccggagcag

SEQ ID NO: 216983 - DNA, 25 bp, Rattus norvegicus
caaagctgtgaacaccctgagagca

SEQ ID NO: 216984 - DNA, 25 bp, Rattus norvegicus
caaagctgtgaagaccctgagagca

SEQ ID NO: 216985 - DNA, 25 bp, Rattus norvegicus
caaagctgtggtactctgcaatgaa

SEQ ID NO: 216986 - DNA, 25 bp, Rattus norvegicus
caaagctgtggttctctgcaatgaa

SEQ ID NO: 216987 - DNA, 25 bp, Rattus norvegicus
caaagcttggccctcataatggatg

SEQ ID NO: 216988 - DNA, 25 bp, Rattus norvegicus
caaagcttggccgtcataatggatg

SEQ ID NO: 216989 - DNA, 25 bp, Rattus norvegicus
caaagctttcgactactgtagggtt

SEQ ID NO: 216990 - DNA, 25 bp, Rattus norvegicus
caaagctttcgagtactgtagggtt

SEQ ID NO: 216991 - DNA, 25 bp, Rattus norvegicus
caaagctttgacattccagggtgtt

SEQ ID NO: 216992 - DNA, 25 bp, Rattus norvegicus
caaagctttgactttccagggtgtt

SEQ ID NO: 216993 - DNA, 25 bp, Rattus norvegicus
caaaggaagactcagcatcgccaat

SEQ ID NO: 216994 - DNA, 25 bp, Rattus norvegicus
caaaggaagactgagcatcgccaat

SEQ ID NO: 216995 - DNA, 25 bp, Rattus norvegicus
caaaggaaggatagcggctccctct

SEQ ID NO: 216996 - DNA, 25 bp, Rattus norvegicus
caaaggaaggattgcggctccctct

SEQ ID NO: 216997 - DNA, 25 bp, Rattus norvegicus
caaaggaagtgtcccctcccaggtg

SEQ ID NO: 216998 - DNA, 25 bp, Rattus norvegicus
caaaggaagtgtgccctcccaggtg

SEQ ID NO: 216999 - DNA, 25 bp, Rattus norvegicus
caaaggacaaatacgggccacatct

SEQ ID NO: 217000 - DNA, 25 bp, Rattus norvegicus
caaaggacaaattcgggccacatct

SEQ ID NO: 217001 - DNA, 25 bp, Rattus norvegicus
caaaggacatcacggcacgcaacga

SEQ ID NO: 217002 - DNA, 25 bp, Rattus norvegicus
caaaggacatcagggcacgcaacga

SEQ ID NO: 217003 - DNA, 25 bp, Rattus norvegicus
caaaggaccccaattcatcagcagg

SEQ ID NO: 217004 - DNA, 25 bp, Rattus norvegicus
caaaggaccccatttcatcagcagg

SEQ ID NO: 217005 - DNA, 25 bp, Rattus norvegicus
caaaggacccgccttggacaacaat

SEQ ID NO: 217006 - DNA, 25 bp, Rattus norvegicus
caaaggacccgcgttggacaacaat

SEQ ID NO: 217007 - DNA, 25 bp, Rattus norvegicus
caaaggactggcacagttctgcatc

SEQ ID NO: 217008 - DNA, 25 bp, Rattus norvegicus
caaaggactggctcagttctgcatc

SEQ ID NO: 217009 - DNA, 25 bp, Rattus norvegicus
caaaggagcttgactgcctgtgcag

SEQ ID NO: 217010 - DNA, 25 bp, Rattus norvegicus
caaaggagcttgtctgcctgtgcag

SEQ ID NO: 217011 - DNA, 25 bp, Rattus norvegicus
caaaggagggctctctacttgctgc

SEQ ID NO: 217012 - DNA, 25 bp, Rattus norvegicus
caaaggagggctgtctacttgctgc

SEQ ID NO: 217013 - DNA, 25 bp, Rattus norvegicus
caaaggagtcttatcttgtctgaag

SEQ ID NO: 217014 - DNA, 25 bp, Rattus norvegicus
caaaggagtcttttcttgtctgaag

SEQ ID NO: 217015 - DNA, 25 bp, Rattus norvegicus
caaaggattgttacaccgtggtggg

SEQ ID NO: 217016 - DNA, 25 bp, Rattus norvegicus
caaaggattgtttcaccgtggtggg

SEQ ID NO: 217017 - DNA, 25 bp, Rattus norvegicus
caaaggcaaggaagggaccagccca

SEQ ID NO: 217018 - DNA, 25 bp, Rattus norvegicus
caaaggcaaggatgggaccagccca

SEQ ID NO: 217019 - DNA, 25 bp, Rattus norvegicus
caaaggcacggccactctgacggag

SEQ ID NO: 217020 - DNA, 25 bp, Rattus norvegicus
caaaggcacggcgactctgacggag

SEQ ID NO: 217021 - DNA, 25 bp, Rattus norvegicus
caaaggcaggatcctcaccgtggag

SEQ ID NO: 217022 - DNA, 25 bp, Rattus norvegicus
caaaggcaggatgctcaccgtggag

SEQ ID NO: 217023 - DNA, 25 bp, Rattus norvegicus
caaaggcatcacatggtccatggta

SEQ ID NO: 217024 - DNA, 25 bp, Rattus norvegicus
caaaggcatcacttggtccatggta

SEQ ID NO: 217025 - DNA, 25 bp, Rattus norvegicus
caaaggcattccacctaacattttc

SEQ ID NO: 217026 - DNA, 25 bp, Rattus norvegicus
caaaggcattcctcctaacattttc

SEQ ID NO: 217027 - DNA, 25 bp, Rattus norvegicus
caaaggccacggattgtgacaggaa

SEQ ID NO: 217028 - DNA, 25 bp, Rattus norvegicus
caaaggccacggtttgtgacaggaa

SEQ ID NO: 217029 - DNA, 25 bp, Rattus norvegicus
caaaggccagacagagtgacatagt

SEQ ID NO: 217030 - DNA, 25 bp, Rattus norvegicus
caaaggccagactgagtgacatagt

SEQ ID NO: 217031 - DNA, 25 bp, Rattus norvegicus
caaaggccaggtcttgaggtagcat

SEQ ID NO: 217032 - DNA, 25 bp, Rattus norvegicus
caaaggccaggtgttgaggtagcat

SEQ ID NO: 217033 - DNA, 25 bp, Rattus norvegicus
caaaggccagttaagagcatgtctc

SEQ ID NO: 217034 - DNA, 25 bp, Rattus norvegicus
caaaggccagtttagagcatgtctc

SEQ ID NO: 217035 - DNA, 25 bp, Rattus norvegicus
caaaggccctgacaacttccttttg

SEQ ID NO: 217036 - DNA, 25 bp, Rattus norvegicus
caaaggccctgagaacttccttttg

SEQ ID NO: 217037 - DNA, 25 bp, Rattus norvegicus
caaaggccctgtaatgtggcactaa

SEQ ID NO: 217038 - DNA, 25 bp, Rattus norvegicus
caaaggccctgttatgtggcactaa

SEQ ID NO: 217039 - DNA, 25 bp, Rattus norvegicus
caaaggccgagtccagtttttcatg

SEQ ID NO: 217040 - DNA, 25 bp, Rattus norvegicus
caaaggccgagtgcagtttttcatg

SEQ ID NO: 217041 - DNA, 25 bp, Rattus norvegicus
caaaggccggacaggctggccacag

SEQ ID NO: 217042 - DNA, 25 bp, Rattus norvegicus
caaaggccggactggctggccacag

SEQ ID NO: 217043 - DNA, 25 bp, Rattus norvegicus
caaaggccgtctatatgggccacct

SEQ ID NO: 217044 - DNA, 25 bp, Rattus norvegicus
caaaggccgtctttatgggccacct

SEQ ID NO: 217045 - DNA, 25 bp, Rattus norvegicus
caaaggcctgttctccatagatgaa

SEQ ID NO: 217046 - DNA, 25 bp, Rattus norvegicus
caaaggcctgttgtccatagatgaa

SEQ ID NO: 217047 - DNA, 25 bp, Rattus norvegicus
caaaggcgacacactggatcacaga

SEQ ID NO: 217048 - DNA, 25 bp, Rattus norvegicus
caaaggcgacactctggatcacaga

SEQ ID NO: 217049 - DNA, 25 bp, Rattus norvegicus
caaaggcgaggtatttcctcttctg

SEQ ID NO: 217050 - DNA, 25 bp, Rattus norvegicus
caaaggcgaggtttttcctcttctg

SEQ ID NO: 217051 - DNA, 25 bp, Rattus norvegicus
caaaggcggcgtccgcgcaggacgg

SEQ ID NO: 217052 - DNA, 25 bp, Rattus norvegicus
caaaggcggcgtgcgcgcaggacgg

SEQ ID NO: 217053 - DNA, 25 bp, Rattus norvegicus
caaaggcgggaaccagagcacactt

SEQ ID NO: 217054 - DNA, 25 bp, Rattus norvegicus
caaaggcgggaagcagagcacactt

SEQ ID NO: 217055 - DNA, 25 bp, Rattus norvegicus
caaaggcggtatcgctcggcaccaa

SEQ ID NO: 217056 - DNA, 25 bp, Rattus norvegicus
caaaggcggtatggctcggcaccaa

SEQ ID NO: 217057 - DNA, 25 bp, Rattus norvegicus
caaaggcgtgagaccgggctacttc

SEQ ID NO: 217058 - DNA, 25 bp, Rattus norvegicus
caaaggcgtgagtccgggctacttc

SEQ ID NO: 217059 - DNA, 25 bp, Rattus norvegicus
caaaggctccttacccaagtgggtg

SEQ ID NO: 217060 - DNA, 25 bp, Rattus norvegicus
caaaggctcctttcccaagtgggtg

SEQ ID NO: 217061 - DNA, 25 bp, Rattus norvegicus
caaaggctgaggaaatgtgtcttca

SEQ ID NO: 217062 - DNA, 25 bp, Rattus norvegicus
caaaggctgaggtaatgtgtcttca

SEQ ID NO: 217063 - DNA, 25 bp, Rattus norvegicus
caaaggctgcctcgcctcagagagg

SEQ ID NO: 217064 - DNA, 25 bp, Rattus norvegicus
caaaggctgcctggcctcagagagg

SEQ ID NO: 217065 - DNA, 25 bp, Rattus norvegicus
caaaggcttctccaggaacagcgac

SEQ ID NO: 217066 - DNA, 25 bp, Rattus norvegicus
caaaggcttctcgaggaacagcgac

SEQ ID NO: 217067 - DNA, 25 bp, Rattus norvegicus
caaaggcttgttagtcggacatcat

SEQ ID NO: 217068 - DNA, 25 bp, Rattus norvegicus
caaaggcttgtttgtcggacatcat

SEQ ID NO: 217069 - DNA, 25 bp, Rattus norvegicus
caaaggctttgtacttctctaggga

SEQ ID NO: 217070 - DNA, 25 bp, Rattus norvegicus
caaaggctttgttcttctctaggga

SEQ ID NO: 217071 - DNA, 25 bp, Rattus norvegicus
caaagggaacctattgcttggcaat

SEQ ID NO: 217072 - DNA, 25 bp, Rattus norvegicus
caaagggaaccttttgcttggcaat

SEQ ID NO: 217073 - DNA, 25 bp, Rattus norvegicus
caaagggacagaccagggctgccaa

SEQ ID NO: 217074 - DNA, 25 bp, Rattus norvegicus
caaagggacagagcagggctgccaa

SEQ ID NO: 217075 - DNA, 25 bp, Rattus norvegicus
caaagggacccaacttgaaaacaat

SEQ ID NO: 217076 - DNA, 25 bp, Rattus norvegicus
caaagggacccatcttgaaaacaat

SEQ ID NO: 217077 - DNA, 25 bp, Rattus norvegicus
caaagggagagtctcatccaccggg

SEQ ID NO: 217078 - DNA, 25 bp, Rattus norvegicus
caaagggagagtgtcatccaccggg

SEQ ID NO: 217079 - DNA, 25 bp, Rattus norvegicus
caaagggagcttcatctatttacaa

SEQ ID NO: 217080 - DNA, 25 bp, Rattus norvegicus
caaagggagcttgatctatttacaa

SEQ ID NO: 217081 - DNA, 25 bp, Rattus norvegicus
caaagggattaactccggctctggg

SEQ ID NO: 217082 - DNA, 25 bp, Rattus norvegicus
caaagggattaagtccggctctggg

SEQ ID NO: 217083 - DNA, 25 bp, Rattus norvegicus
caaagggccaggcttcagttcccag

SEQ ID NO: 217084 - DNA, 25 bp, Rattus norvegicus
caaagggccagggttcagttcccag

SEQ ID NO: 217085 - DNA, 25 bp, Rattus norvegicus
caaagggcccttacagtttagatgc

SEQ ID NO: 217086 - DNA, 25 bp, Rattus norvegicus
caaagggccctttcagtttagatgc

SEQ ID NO: 217087 - DNA, 25 bp, Rattus norvegicus
caaagggccgtgctcagaagattta

SEQ ID NO: 217088 - DNA, 25 bp, Rattus norvegicus
caaagggccgtggtcagaagattta

SEQ ID NO: 217089 - DNA, 25 bp, Rattus norvegicus
caaagggcctgtagtggtggtacat

SEQ ID NO: 217090 - DNA, 25 bp, Rattus norvegicus
caaagggcctgttgtggtggtacat

SEQ ID NO: 217091 - DNA, 25 bp, Rattus norvegicus
caaagggcctttccagagtattcca

SEQ ID NO: 217092 - DNA, 25 bp, Rattus norvegicus
caaagggcctttgcagagtattcca

SEQ ID NO: 217093 - DNA, 25 bp, Rattus norvegicus
caaagggtatgtcttcagattccaa

SEQ ID NO: 217094 - DNA, 25 bp, Rattus norvegicus
caaagggtatgtgttcagattccaa

SEQ ID NO: 217095 - DNA, 25 bp, Rattus norvegicus
caaagggttctgacatcttgaggat

SEQ ID NO: 217096 - DNA, 25 bp, Rattus norvegicus
caaagggttctgtcatcttgaggat

SEQ ID NO: 217097 - DNA, 25 bp, Rattus norvegicus
caaagggttttcaagatcttcttgt

SEQ ID NO: 217098 - DNA, 25 bp, Rattus norvegicus
caaagggttttctagatcttcttgt

SEQ ID NO: 217099 - DNA, 25 bp, Rattus norvegicus
caaaggtaacttcgccagggctctc

SEQ ID NO: 217100 - DNA, 25 bp, Rattus norvegicus
caaaggtaacttggccagggctctc

SEQ ID NO: 217101 - DNA, 25 bp, Rattus norvegicus
caaaggtcagctaaaaatggatcaa

SEQ ID NO: 217102 - DNA, 25 bp, Rattus norvegicus
caaaggtcagcttaaaatggatcaa

SEQ ID NO: 217103 - DNA, 25 bp, Rattus norvegicus
caaaggtcccaaaactgtctaaagg

SEQ ID NO: 217104 - DNA, 25 bp, Rattus norvegicus
caaaggtcccaatactgtctaaagg

SEQ ID NO: 217105 - DNA, 25 bp, Rattus norvegicus
caaaggtcctgtagtttgacatctt

SEQ ID NO: 217106 - DNA, 25 bp, Rattus norvegicus
caaaggtcctgttgtttgacatctt

SEQ ID NO: 217107 - DNA, 25 bp, Rattus norvegicus
caaaggtctgaacccatttcaccca

SEQ ID NO: 217108 - DNA, 25 bp, Rattus norvegicus
caaaggtctgaagccatttcaccca

SEQ ID NO: 217109 - DNA, 25 bp, Rattus norvegicus
caaaggtgacctcggagagcctcca

SEQ ID NO: 217110 - DNA, 25 bp, Rattus norvegicus
caaaggtgacctgggagagcctcca

SEQ ID NO: 217111 - DNA, 25 bp, Rattus norvegicus
caaaggtgcgcaaggtgctgcagct

SEQ ID NO: 217112 - DNA, 25 bp, Rattus norvegicus
caaaggtgcgcatggtgctgcagct

SEQ ID NO: 217113 - DNA, 25 bp, Rattus norvegicus
caaaggtgctgtccccagagtatgt

SEQ ID NO: 217114 - DNA, 25 bp, Rattus norvegicus
caaaggtgctgtgcccagagtatgt

SEQ ID NO: 217115 - DNA, 25 bp, Rattus norvegicus
caaaggtggctcaggtggccaggtc

SEQ ID NO: 217116 - DNA, 25 bp, Rattus norvegicus
caaaggtggctctggtggccaggtc

SEQ ID NO: 217117 - DNA, 25 bp, Rattus norvegicus
caaaggtggtggaccttagctcggc

SEQ ID NO: 217118 - DNA, 25 bp, Rattus norvegicus
caaaggtggtggtccttagctcggc

SEQ ID NO: 217119 - DNA, 25 bp, Rattus norvegicus
caaaggtgttctcttgggtcaaaga

SEQ ID NO: 217120 - DNA, 25 bp, Rattus norvegicus
caaaggtgttctgttgggtcaaaga

SEQ ID NO: 217121 - DNA, 25 bp, Rattus norvegicus
caaaggttatgtctcccgtagagaa

SEQ ID NO: 217122 - DNA, 25 bp, Rattus norvegicus
caaaggttatgtgtcccgtagagaa

SEQ ID NO: 217123 - DNA, 25 bp, Rattus norvegicus
caaaggttccttacgagtgtagtct

SEQ ID NO: 217124 - DNA, 25 bp, Rattus norvegicus
caaaggttcctttcgagtgtagtct

SEQ ID NO: 217125 - DNA, 25 bp, Rattus norvegicus
caaaggttgccacgtggtagcgcat

SEQ ID NO: 217126 - DNA, 25 bp, Rattus norvegicus
caaaggttgccaggtggtagcgcat

SEQ ID NO: 217127 - DNA, 25 bp, Rattus norvegicus
caaaggttgcttaggctcttctgcc

SEQ ID NO: 217128 - DNA, 25 bp, Rattus norvegicus
caaaggttgctttggctcttctgcc

SEQ ID NO: 217129 - DNA, 25 bp, Rattus norvegicus
caaaggtttgctacactggactctg

SEQ ID NO: 217130 - DNA, 25 bp, Rattus norvegicus
caaaggtttgcttcactggactctg

SEQ ID NO: 217131 - DNA, 25 bp, Rattus norvegicus
caaagtaagcttctccgcctggaac

SEQ ID NO: 217132 - DNA, 25 bp, Rattus norvegicus
caaagtaagcttgtccgcctggaac

SEQ ID NO: 217133 - DNA, 25 bp, Rattus norvegicus
caaagtaatagcctttctcctcttc

SEQ ID NO: 217134 - DNA, 25 bp, Rattus norvegicus
caaagtaatagcgtttctcctcttc

SEQ ID NO: 217135 - DNA, 25 bp, Rattus norvegicus
caaagtacgtttccagactgccaac

SEQ ID NO: 217136 - DNA, 25 bp, Rattus norvegicus
caaagtacgtttgcagactgccaac

SEQ ID NO: 217137 - DNA, 25 bp, Rattus norvegicus
caaagtacttagacagtattgctaa

SEQ ID NO: 217138 - DNA, 25 bp, Rattus norvegicus
caaagtacttagtcagtattgctaa

SEQ ID NO: 217139 - DNA, 25 bp, Rattus norvegicus
caaagtaggactcgatgaactggat

SEQ ID NO: 217140 - DNA, 25 bp, Rattus norvegicus
caaagtaggactggatgaactggat

SEQ ID NO: 217141 - DNA, 25 bp, Rattus norvegicus
caaagtagtgtcacacagaactgcc

SEQ ID NO: 217142 - DNA, 25 bp, Rattus norvegicus
caaagtagtgtctcacagaactgcc

SEQ ID NO: 217143 - DNA, 25 bp, Rattus norvegicus
caaagtagttctctgtgaccctgcc

SEQ ID NO: 217144 - DNA, 25 bp, Rattus norvegicus
caaagtagttctgtgtgaccctgcc

SEQ ID NO: 217145 - DNA, 25 bp, Rattus norvegicus
caaagtatctatattgaactagtct

SEQ ID NO: 217146 - DNA, 25 bp, Rattus norvegicus
caaagtatctattttgaactagtct

SEQ ID NO: 217147 - DNA, 25 bp, Rattus norvegicus
caaagtatcttgctgattcgggtaa

SEQ ID NO: 217148 - DNA, 25 bp, Rattus norvegicus
caaagtatcttggtgattcgggtaa

SEQ ID NO: 217149 - DNA, 25 bp, Rattus norvegicus
caaagtatctttaggcatcacccct

SEQ ID NO: 217150 - DNA, 25 bp, Rattus norvegicus
caaagtatcttttggcatcacccct

SEQ ID NO: 217151 - DNA, 25 bp, Rattus norvegicus
caaagtatgtagacgcgaccgcgga

SEQ ID NO: 217152 - DNA, 25 bp, Rattus norvegicus
caaagtatgtagtcgcgaccgcgga

SEQ ID NO: 217153 - DNA, 25 bp, Rattus norvegicus
caaagtattttcagacatccaatgt

SEQ ID NO: 217154 - DNA, 25 bp, Rattus norvegicus
caaagtattttctgacatccaatgt

SEQ ID NO: 217155 - DNA, 25 bp, Rattus norvegicus
caaagtcaaagccagaagcaggtct

SEQ ID NO: 217156 - DNA, 25 bp, Rattus norvegicus
caaagtcaaagcgagaagcaggtct

SEQ ID NO: 217157 - DNA, 25 bp, Rattus norvegicus
caaagtcaatatactggagggtcga

SEQ ID NO: 217158 - DNA, 25 bp, Rattus norvegicus
caaagtcaatattctggagggtcga

SEQ ID NO: 217159 - DNA, 25 bp, Rattus norvegicus
caaagtcacaaaattcacgttcttc

SEQ ID NO: 217160 - DNA, 25 bp, Rattus norvegicus
caaagtcacaaatttcacgttcttc

SEQ ID NO: 217161 - DNA, 25 bp, Rattus norvegicus
caaagtcagtggcttttcctataat

SEQ ID NO: 217162 - DNA, 25 bp, Rattus norvegicus
caaagtcagtgggttttcctataat

SEQ ID NO: 217163 - DNA, 25 bp, Rattus norvegicus
caaagtcattcccttctaatcttgt

SEQ ID NO: 217164 - DNA, 25 bp, Rattus norvegicus
caaagtcattccgttctaatcttgt

SEQ ID NO: 217165 - DNA, 25 bp, Rattus norvegicus
caaagtccatgtaggctagtctagc

SEQ ID NO: 217166 - DNA, 25 bp, Rattus norvegicus
caaagtccatgttggctagtctagc

SEQ ID NO: 217167 - DNA, 25 bp, Rattus norvegicus
caaagtccctccacaaggttccaga

SEQ ID NO: 217168 - DNA, 25 bp, Rattus norvegicus
caaagtccctcctcaaggttccaga

SEQ ID NO: 217169 - DNA, 25 bp, Rattus norvegicus
caaagtcctagaatgtcttccttcc

SEQ ID NO: 217170 - DNA, 25 bp, Rattus norvegicus
caaagtcctagattgtcttccttcc

SEQ ID NO: 217171 - DNA, 25 bp, Rattus norvegicus
caaagtcggcgtcggtattccagac

SEQ ID NO: 217172 - DNA, 25 bp, Rattus norvegicus
caaagtcggcgtgggtattccagac

SEQ ID NO: 217173 - DNA, 25 bp, Rattus norvegicus
caaagtcgttggatcacacctttcg

SEQ ID NO: 217174 - DNA, 25 bp, Rattus norvegicus
caaagtcgttggttcacacctttcg

SEQ ID NO: 217175 - DNA, 25 bp, Rattus norvegicus
caaagtctaagaatccttactaagg

SEQ ID NO: 217176 - DNA, 25 bp, Rattus norvegicus
caaagtctaagattccttactaagg

SEQ ID NO: 217177 - DNA, 25 bp, Rattus norvegicus
caaagtctactgagttttatcaaaa

SEQ ID NO: 217178 - DNA, 25 bp, Rattus norvegicus
caaagtctactgtgttttatcaaaa

SEQ ID NO: 217179 - DNA, 25 bp, Rattus norvegicus
caaagtctcactatgctggtatcaa

SEQ ID NO: 217180 - DNA, 25 bp, Rattus norvegicus
caaagtctcactattccggttgatc

SEQ ID NO: 217181 - DNA, 25 bp, Rattus norvegicus
caaagtctcactttgctggtatcaa

SEQ ID NO: 217182 - DNA, 25 bp, Rattus norvegicus
caaagtctcacttttccggttgatc

SEQ ID NO: 217183 - DNA, 25 bp, Rattus norvegicus
caaagtctccaaacagtgctgtcag

SEQ ID NO: 217184 - DNA, 25 bp, Rattus norvegicus
caaagtctccaatcagtgctgtcag

SEQ ID NO: 217185 - DNA, 25 bp, Rattus norvegicus
caaagtctcccacaactgcacaggg

SEQ ID NO: 217186 - DNA, 25 bp, Rattus norvegicus
caaagtctcccagaactgcacaggg

SEQ ID NO: 217187 - DNA, 25 bp, Rattus norvegicus
caaagtctctgtacttgggaaggct

SEQ ID NO: 217188 - DNA, 25 bp, Rattus norvegicus
caaagtctctgttcttgggaaggct

SEQ ID NO: 217189 - DNA, 25 bp, Rattus norvegicus
caaagtctgcttcgctaggtgtttc

SEQ ID NO: 217190 - DNA, 25 bp, Rattus norvegicus
caaagtctgcttggctaggtgtttc

SEQ ID NO: 217191 - DNA, 25 bp, Rattus norvegicus
caaagtctggacacttgagcatcaa

SEQ ID NO: 217192 - DNA, 25 bp, Rattus norvegicus
caaagtctggactcttgagcatcaa

SEQ ID NO: 217193 - DNA, 25 bp, Rattus norvegicus
caaagtcttagcatacaaccgggca

SEQ ID NO: 217194 - DNA, 25 bp, Rattus norvegicus
caaagtcttagcttacaaccgggca

SEQ ID NO: 217195 - DNA, 25 bp, Rattus norvegicus
caaagtcttcatcttgccttgtaac

SEQ ID NO: 217196 - DNA, 25 bp, Rattus norvegicus
caaagtcttcatgttgccttgtaac

SEQ ID NO: 217197 - DNA, 25 bp, Rattus norvegicus
caaagtgaacgcaaggacgagccaa

SEQ ID NO: 217198 - DNA, 25 bp, Rattus norvegicus
caaagtgaacgctaggacgagccaa

SEQ ID NO: 217199 - DNA, 25 bp, Rattus norvegicus
caaagtgaatatcaacccttcccca

SEQ ID NO: 217200 - DNA, 25 bp, Rattus norvegicus
caaagtgaatatgaacccttcccca

SEQ ID NO: 217201 - DNA, 25 bp, Rattus norvegicus
caaagtgacaatcgagtttagccct

SEQ ID NO: 217202 - DNA, 25 bp, Rattus norvegicus
caaagtgacaatggagtttagccct

SEQ ID NO: 217203 - DNA, 25 bp, Rattus norvegicus
caaagtgacatccaatgcctcctgc

SEQ ID NO: 217204 - DNA, 25 bp, Rattus norvegicus
caaagtgacatcgaatgcctcctgc

SEQ ID NO: 217205 - DNA, 25 bp, Rattus norvegicus
caaagtgaccttagacgaggcggaa

SEQ ID NO: 217206 - DNA, 25 bp, Rattus norvegicus
caaagtgacctttgacgaggcggaa

SEQ ID NO: 217207 - DNA, 25 bp, Rattus norvegicus
caaagtgactagctgactctgggct

SEQ ID NO: 217208 - DNA, 25 bp, Rattus norvegicus
caaagtgactaggtgactctgggct

SEQ ID NO: 217209 - DNA, 25 bp, Rattus norvegicus
caaagtgagtagcttgggttccgct

SEQ ID NO: 217210 - DNA, 25 bp, Rattus norvegicus
caaagtgagtaggttgggttccgct

SEQ ID NO: 217211 - DNA, 25 bp, Rattus norvegicus
caaagtgcactgactcttgttgaga

SEQ ID NO: 217212 - DNA, 25 bp, Rattus norvegicus
caaagtgcactgtctcttgttgaga

SEQ ID NO: 217213 - DNA, 25 bp, Rattus norvegicus
caaagtgcagggacgggacctccta

SEQ ID NO: 217214 - DNA, 25 bp, Rattus norvegicus
caaagtgcagggtcgggacctccta

SEQ ID NO: 217215 - DNA, 25 bp, Rattus norvegicus
caaagtgcctgcatagaggaaagtg

SEQ ID NO: 217216 - DNA, 25 bp, Rattus norvegicus
caaagtgcctgcttagaggaaagtg

SEQ ID NO: 217217 - DNA, 25 bp, Rattus norvegicus
caaagtgctgtgacggttttgtcca

SEQ ID NO: 217218 - DNA, 25 bp, Rattus norvegicus
caaagtgctgtgtcggttttgtcca

SEQ ID NO: 217219 - DNA, 25 bp, Rattus norvegicus
caaagtgcttaccacaacgtgtgct

SEQ ID NO: 217220 - DNA, 25 bp, Rattus norvegicus
caaagtgcttacgacaacgtgtgct

SEQ ID NO: 217221 - DNA, 25 bp, Rattus norvegicus
caaagtggacaaccgcgccgtcaga

SEQ ID NO: 217222 - DNA, 25 bp, Rattus norvegicus
caaagtggacaagcgcgccgtcaga

SEQ ID NO: 217223 - DNA, 25 bp, Rattus norvegicus
caaagtggattaaacatctgtccct

SEQ ID NO: 217224 - DNA, 25 bp, Rattus norvegicus
caaagtggattatacatctgtccct

SEQ ID NO: 217225 - DNA, 25 bp, Rattus norvegicus
caaagtggcacaagtcttcaatccc

SEQ ID NO: 217226 - DNA, 25 bp, Rattus norvegicus
caaagtggcacatgtcttcaatccc

SEQ ID NO: 217227 - DNA, 25 bp, Rattus norvegicus
caaagtggctataaagatggtcagg

SEQ ID NO: 217228 - DNA, 25 bp, Rattus norvegicus
caaagtggctattaagatggtcagg

SEQ ID NO: 217229 - DNA, 25 bp, Rattus norvegicus
caaagtggctgtatgttgactctgc

SEQ ID NO: 217230 - DNA, 25 bp, Rattus norvegicus
caaagtggctgtttgttgactctgc

SEQ ID NO: 217231 - DNA, 25 bp, Rattus norvegicus
caaagtgggcagaggatcctactgg

SEQ ID NO: 217232 - DNA, 25 bp, Rattus norvegicus
caaagtgggcagtggatcctactgg

SEQ ID NO: 217233 - DNA, 25 bp, Rattus norvegicus
caaagtgggtctacggcagtgctgc

SEQ ID NO: 217234 - DNA, 25 bp, Rattus norvegicus
caaagtgggtcttcggcagtgctgc

SEQ ID NO: 217235 - DNA, 25 bp, Rattus norvegicus
caaagtgggtgccagtgcatctgat

SEQ ID NO: 217236 - DNA, 25 bp, Rattus norvegicus
caaagtgggtgcgagtgcatctgat

SEQ ID NO: 217237 - DNA, 25 bp, Rattus norvegicus
caaagtggtggtccttgtggtcccc

SEQ ID NO: 217238 - DNA, 25 bp, Rattus norvegicus
caaagtggtggtgcttgtggtcccc

SEQ ID NO: 217239 - DNA, 25 bp, Rattus norvegicus
caaagtggttccaccaagttctgaa

SEQ ID NO: 217240 - DNA, 25 bp, Rattus norvegicus
caaagtggttcctccaagttctgaa

SEQ ID NO: 217241 - DNA, 25 bp, Rattus norvegicus
caaagtgtaaccacggtggctgaga

SEQ ID NO: 217242 - DNA, 25 bp, Rattus norvegicus
caaagtgtaacctcggtggctgaga

SEQ ID NO: 217243 - DNA, 25 bp, Rattus norvegicus
caaagtgtactgattctactgagct

SEQ ID NO: 217244 - DNA, 25 bp, Rattus norvegicus
caaagtgtactgtttctactgagct

SEQ ID NO: 217245 - DNA, 25 bp, Rattus norvegicus
caaagtgtataacccgcagaatgca

SEQ ID NO: 217246 - DNA, 25 bp, Rattus norvegicus
caaagtgtataagccgcagaatgca

SEQ ID NO: 217247 - DNA, 25 bp, Rattus norvegicus
caaagtgtcaagaacttgccgagac

SEQ ID NO: 217248 - DNA, 25 bp, Rattus norvegicus
caaagtgtcaagtacttgccgagac

SEQ ID NO: 217249 - DNA, 25 bp, Rattus norvegicus
caaagtgtccttaggctcggataag

SEQ ID NO: 217250 - DNA, 25 bp, Rattus norvegicus
caaagtgtcctttggctcggataag

SEQ ID NO: 217251 - DNA, 25 bp, Rattus norvegicus
caaagtgtctttatcaatttatcaa

SEQ ID NO: 217252 - DNA, 25 bp, Rattus norvegicus
caaagtgtctttttcaatttatcaa

SEQ ID NO: 217253 - DNA, 25 bp, Rattus norvegicus
caaagtgtggacatggtgttccccg

SEQ ID NO: 217254 - DNA, 25 bp, Rattus norvegicus
caaagtgtggacttggtgttccccg

SEQ ID NO: 217255 - DNA, 25 bp, Rattus norvegicus
caaagtgtgtgcatttccttctcaa

SEQ ID NO: 217256 - DNA, 25 bp, Rattus norvegicus
caaagtgtgtgccttcttttttcaa

SEQ ID NO: 217257 - DNA, 25 bp, Rattus norvegicus
caaagtgtgtgcgttcttttttcaa

SEQ ID NO: 217258 - DNA, 25 bp, Rattus norvegicus
caaagtgtgtgcttttccttctcaa

SEQ ID NO: 217259 - DNA, 25 bp, Rattus norvegicus
caaagtgttcaaagcagttacctaa

SEQ ID NO: 217260 - DNA, 25 bp, Rattus norvegicus
caaagtgttcaatgcagttacctaa

SEQ ID NO: 217261 - DNA, 25 bp, Rattus norvegicus
caaagtgttcggagccccaggcttg

SEQ ID NO: 217262 - DNA, 25 bp, Rattus norvegicus
caaagtgttcggtgccccaggcttg

SEQ ID NO: 217263 - DNA, 25 bp, Rattus norvegicus
caaagtgttgctcggtccccgggct

SEQ ID NO: 217264 - DNA, 25 bp, Rattus norvegicus
caaagtgttgctgggtccccgggct

SEQ ID NO: 217265 - DNA, 25 bp, Rattus norvegicus
caaagtgtttacaaactcggcgtct

SEQ ID NO: 217266 - DNA, 25 bp, Rattus norvegicus
caaagtgtttactaactcggcgtct

SEQ ID NO: 217267 - DNA, 25 bp, Rattus norvegicus
caaagttaacatatagaccaggcaa

SEQ ID NO: 217268 - DNA, 25 bp, Rattus norvegicus
caaagttaacatttagaccaggcaa

SEQ ID NO: 217269 - DNA, 25 bp, Rattus norvegicus
caaagttaccaaatctacaagtgaa

SEQ ID NO: 217270 - DNA, 25 bp, Rattus norvegicus
caaagttaccaattctacaagtgaa

SEQ ID NO: 217271 - DNA, 25 bp, Rattus norvegicus
caaagttactgcagtctgaggacga

SEQ ID NO: 217272 - DNA, 25 bp, Rattus norvegicus
caaagttactgctgtctgaggacga

SEQ ID NO: 217273 - DNA, 25 bp, Rattus norvegicus
caaagttagatcctacaagtaagtt

SEQ ID NO: 217274 - DNA, 25 bp, Rattus norvegicus
caaagttagatcgtacaagtaagtt

SEQ ID NO: 217275 - DNA, 25 bp, Rattus norvegicus
caaagttagtccctgtctgaggagt

SEQ ID NO: 217276 - DNA, 25 bp, Rattus norvegicus
caaagttagtccgtgtctgaggagt

SEQ ID NO: 217277 - DNA, 25 bp, Rattus norvegicus
caaagttcactcaacatcatctcag

SEQ ID NO: 217278 - DNA, 25 bp, Rattus norvegicus
caaagttcactctacatcatctcag

SEQ ID NO: 217279 - DNA, 25 bp, Rattus norvegicus
caaagttccctaatgatttccctct

SEQ ID NO: 217280 - DNA, 25 bp, Rattus norvegicus
caaagttccctattgatttccctct

SEQ ID NO: 217281 - DNA, 25 bp, Rattus norvegicus
caaagttctcatatagttcctccaa

SEQ ID NO: 217282 - DNA, 25 bp, Rattus norvegicus
caaagttctcatttagttcctccaa

SEQ ID NO: 217283 - DNA, 25 bp, Rattus norvegicus
caaagttgccttaagccccaaatgt

SEQ ID NO: 217284 - DNA, 25 bp, Rattus norvegicus
caaagttgcctttagccccaaatgt

SEQ ID NO: 217285 - DNA, 25 bp, Rattus norvegicus
caaagttggcctatcaccagggtgt

SEQ ID NO: 217286 - DNA, 25 bp, Rattus norvegicus
caaagttggcctttcaccagggtgt

SEQ ID NO: 217287 - DNA, 25 bp, Rattus norvegicus
caaagttgtcttacctgtcagttta

SEQ ID NO: 217288 - DNA, 25 bp, Rattus norvegicus
caaagttgtctttcctgtcagttta

SEQ ID NO: 217289 - DNA, 25 bp, Rattus norvegicus
caaagttgtgttcgcaggcgtccct

SEQ ID NO: 217290 - DNA, 25 bp, Rattus norvegicus
caaagttgtgttggcaggcgtccct

SEQ ID NO: 217291 - DNA, 25 bp, Rattus norvegicus
caaagttgttgcagcctgatgtgat

SEQ ID NO: 217292 - DNA, 25 bp, Rattus norvegicus
caaagttgttgctgcctgatgtgat

SEQ ID NO: 217293 - DNA, 25 bp, Rattus norvegicus
caaagttgtttcactgttattattt

SEQ ID NO: 217294 - DNA, 25 bp, Rattus norvegicus
caaagttgtttctctgttattattt

SEQ ID NO: 217295 - DNA, 25 bp, Rattus norvegicus
caaagtttaagcatccggtgcttct

SEQ ID NO: 217296 - DNA, 25 bp, Rattus norvegicus
caaagtttaagcttccggtgcttct

SEQ ID NO: 217297 - DNA, 25 bp, Rattus norvegicus
caaagtttcatcactggcatccatt

SEQ ID NO: 217298 - DNA, 25 bp, Rattus norvegicus
caaagtttcatctctggcatccatt

SEQ ID NO: 217299 - DNA, 25 bp, Rattus norvegicus
caaagtttcggcctagtggcgcgct

SEQ ID NO: 217300 - DNA, 25 bp, Rattus norvegicus
caaagtttcggcgtagtggcgcgct

SEQ ID NO: 217301 - DNA, 25 bp, Rattus norvegicus
caaagtttctttcccggcggatcac

SEQ ID NO: 217302 - DNA, 25 bp, Rattus norvegicus
caaagtttctttgccggcggatcac

SEQ ID NO: 217303 - DNA, 25 bp, Rattus norvegicus
caaagtttgtttcttctgggccagg

SEQ ID NO: 217304 - DNA, 25 bp, Rattus norvegicus
caaagtttgtttgttctgggccagg

SEQ ID NO: 217305 - DNA, 25 bp, Rattus norvegicus
caaagttttccaaaagaccgtcctg

SEQ ID NO: 217306 - DNA, 25 bp, Rattus norvegicus
caaagttttccataagaccgtcctg

SEQ ID NO: 217307 - DNA, 25 bp, Rattus norvegicus
caaataaagtcccttttctcagagt

SEQ ID NO: 217308 - DNA, 25 bp, Rattus norvegicus
caaataaagtccgttttctcagagt

SEQ ID NO: 217309 - DNA, 25 bp, Rattus norvegicus
caaataaagtttacccagctgtcct

SEQ ID NO: 217310 - DNA, 25 bp, Rattus norvegicus
caaataaagttttcccagctgtcct

SEQ ID NO: 217311 - DNA, 25 bp, Rattus norvegicus
caaataacctgtaagctcctcaaaa

SEQ ID NO: 217312 - DNA, 25 bp, Rattus norvegicus
caaataacctgttagctcctcaaaa

SEQ ID NO: 217313 - DNA, 25 bp, Rattus norvegicus
caaataagattcatgcaggctcccc

SEQ ID NO: 217314 - DNA, 25 bp, Rattus norvegicus
caaataagattcttgcaggctcccc

SEQ ID NO: 217315 - DNA, 25 bp, Rattus norvegicus
caaataagttatcccttgactccca

SEQ ID NO: 217316 - DNA, 25 bp, Rattus norvegicus
caaataagttatgccttgactccca

SEQ ID NO: 217317 - DNA, 25 bp, Rattus norvegicus
caaatacagcaccttctctggattt

SEQ ID NO: 217318 - DNA, 25 bp, Rattus norvegicus
caaatacagcacgttctctggattt

SEQ ID NO: 217319 - DNA, 25 bp, Rattus norvegicus
caaataccagttcagcgaggcccag

SEQ ID NO: 217320 - DNA, 25 bp, Rattus norvegicus
caaataccagttgagcgaggcccag

SEQ ID NO: 217321 - DNA, 25 bp, Rattus norvegicus
caaatacccgtgactgaagtcttca

SEQ ID NO: 217322 - DNA, 25 bp, Rattus norvegicus
caaatacccgtgtctgaagtcttca

SEQ ID NO: 217323 - DNA, 25 bp, Rattus norvegicus
caaatacctgggacctgggtgcaaa

SEQ ID NO: 217324 - DNA, 25 bp, Rattus norvegicus
caaatacctgggtcctgggtgcaaa

SEQ ID NO: 217325 - DNA, 25 bp, Rattus norvegicus
caaatactgcccccaaacgtcgcgc

SEQ ID NO: 217326 - DNA, 25 bp, Rattus norvegicus
caaatactgcccgcaaacgtcgcgc

SEQ ID NO: 217327 - DNA, 25 bp, Rattus norvegicus
caaatacttgaacctgtcccattgt

SEQ ID NO: 217328 - DNA, 25 bp, Rattus norvegicus
caaatacttgaagctgtcccattgt

SEQ ID NO: 217329 - DNA, 25 bp, Rattus norvegicus
caaatacttgtgagtagctgactgt

SEQ ID NO: 217330 - DNA, 25 bp, Rattus norvegicus
caaatacttgtgtgtagctgactgt

SEQ ID NO: 217331 - DNA, 25 bp, Rattus norvegicus
caaatagaattcaggcctcctcttg

SEQ ID NO: 217332 - DNA, 25 bp, Rattus norvegicus
caaatagaattctggcctcctcttg

SEQ ID NO: 217333 - DNA, 25 bp, Rattus norvegicus
caaatagctgttatctcttcctttt

SEQ ID NO: 217334 - DNA, 25 bp, Rattus norvegicus
caaatagctgttttctcttcctttt

SEQ ID NO: 217335 - DNA, 25 bp, Rattus norvegicus
caaataggccttcggctggctggtc

SEQ ID NO: 217336 - DNA, 25 bp, Rattus norvegicus
caaataggccttgggctggctggtc

SEQ ID NO: 217337 - DNA, 25 bp, Rattus norvegicus
caaataggctgtagatggaccccaa

SEQ ID NO: 217338 - DNA, 25 bp, Rattus norvegicus
caaataggctgttgatggaccccaa

SEQ ID NO: 217339 - DNA, 25 bp, Rattus norvegicus
caaatagttgctcttgccttctggg

SEQ ID NO: 217340 - DNA, 25 bp, Rattus norvegicus
caaatagttgctgttgccttctggg

SEQ ID NO: 217341 - DNA, 25 bp, Rattus norvegicus
caaatataagccctttcttcctcaa

SEQ ID NO: 217342 - DNA, 25 bp, Rattus norvegicus
caaatataagccgtttcttcctcaa

SEQ ID NO: 217343 - DNA, 25 bp, Rattus norvegicus
caaatatcacttacaggctgcagaa

SEQ ID NO: 217344 - DNA, 25 bp, Rattus norvegicus
caaatatcactttcaggctgcagaa

SEQ ID NO: 217345 - DNA, 25 bp, Rattus norvegicus
caaatatcagaaagccacttcagtt

SEQ ID NO: 217346 - DNA, 25 bp, Rattus norvegicus
caaatatcagaatgccacttcagtt

SEQ ID NO: 217347 - DNA, 25 bp, Rattus norvegicus
caaatatcccagctgtacttttaca

SEQ ID NO: 217348 - DNA, 25 bp, Rattus norvegicus
caaatatcccaggtgtacttttaca

SEQ ID NO: 217349 - DNA, 25 bp, Rattus norvegicus
caaatatctgtgctaccgtggaata

SEQ ID NO: 217350 - DNA, 25 bp, Rattus norvegicus
caaatatctgtggtaccgtggaata

SEQ ID NO: 217351 - DNA, 25 bp, Rattus norvegicus
caaatatgaacgacagggttaatct

SEQ ID NO: 217352 - DNA, 25 bp, Rattus norvegicus
caaatatgaacgtcagggttaatct

SEQ ID NO: 217353 - DNA, 25 bp, Rattus norvegicus
caaatatgttttctgcttctgtaag

SEQ ID NO: 217354 - DNA, 25 bp, Rattus norvegicus
caaatatgttttgtgcttctgtaag

SEQ ID NO: 217355 - DNA, 25 bp, Rattus norvegicus
caaatattctccctttctggctcag

SEQ ID NO: 217356 - DNA, 25 bp, Rattus norvegicus
caaatattctccgtttctggctcag

SEQ ID NO: 217357 - DNA, 25 bp, Rattus norvegicus
caaatattctttccggaggctcgac

SEQ ID NO: 217358 - DNA, 25 bp, Rattus norvegicus
caaatattctttgcggaggctcgac

SEQ ID NO: 217359 - DNA, 25 bp, Rattus norvegicus
caaatatttttaatgtcacaaactg

SEQ ID NO: 217360 - DNA, 25 bp, Rattus norvegicus
caaatatttttattgtcacaaactg

SEQ ID NO: 217361 - DNA, 25 bp, Rattus norvegicus
caaatatttttgctggtcacctaaa

SEQ ID NO: 217362 - DNA, 25 bp, Rattus norvegicus
caaatatttttggtggtcacctaaa

SEQ ID NO: 217363 - DNA, 25 bp, Rattus norvegicus
caaatcaaggtcaggttttggccta

SEQ ID NO: 217364 - DNA, 25 bp, Rattus norvegicus
caaatcaaggtctggttttggccta

SEQ ID NO: 217365 - DNA, 25 bp, Rattus norvegicus
caaatcacactgaacatttagctgt

SEQ ID NO: 217366 - DNA, 25 bp, Rattus norvegicus
caaatcacactgtacatttagctgt

SEQ ID NO: 217367 - DNA, 25 bp, Rattus norvegicus
caaatcacagtaatggctctccctc

SEQ ID NO: 217368 - DNA, 25 bp, Rattus norvegicus
caaatcacagtattggctctccctc

SEQ ID NO: 217369 - DNA, 25 bp, Rattus norvegicus
caaatcaggcttatggttctggaaa

SEQ ID NO: 217370 - DNA, 25 bp, Rattus norvegicus
caaatcaggcttttggttctggaaa

SEQ ID NO: 217371 - DNA, 25 bp, Rattus norvegicus
caaatcagtatcaatcccacctcta

SEQ ID NO: 217372 - DNA, 25 bp, Rattus norvegicus
caaatcagtatctatcccacctcta

SEQ ID NO: 217373 - DNA, 25 bp, Rattus norvegicus
caaatcagtgggatagcattctagt

SEQ ID NO: 217374 - DNA, 25 bp, Rattus norvegicus
caaatcagtgggttagcattctagt

SEQ ID NO: 217375 - DNA, 25 bp, Rattus norvegicus
caaatcatatttctaccccatcaag

SEQ ID NO: 217376 - DNA, 25 bp, Rattus norvegicus
caaatcatatttctagctcagctac

SEQ ID NO: 217377 - DNA, 25 bp, Rattus norvegicus
caaatcatatttgtaccccatcaag

SEQ ID NO: 217378 - DNA, 25 bp, Rattus norvegicus
caaatcatatttgtagctcagctac

SEQ ID NO: 217379 - DNA, 25 bp, Rattus norvegicus
caaatcattctgacgctgagctata

SEQ ID NO: 217380 - DNA, 25 bp, Rattus norvegicus
caaatcattctgtcgctgagctata

SEQ ID NO: 217381 - DNA, 25 bp, Rattus norvegicus
caaatcattgagagcccttacgtcc

SEQ ID NO: 217382 - DNA, 25 bp, Rattus norvegicus
caaatcattgagtgcccttacgtcc

SEQ ID NO: 217383 - DNA, 25 bp, Rattus norvegicus
caaatccaaaacaacataccttcct

SEQ ID NO: 217384 - DNA, 25 bp, Rattus norvegicus
caaatccaaaactacataccttcct

SEQ ID NO: 217385 - DNA, 25 bp, Rattus norvegicus
caaatccaaaccagtagagcctcca

SEQ ID NO: 217386 - DNA, 25 bp, Rattus norvegicus
caaatccaaacctgtagagcctcca

SEQ ID NO: 217387 - DNA, 25 bp, Rattus norvegicus
caaatccaggcccaaaggcagttag

SEQ ID NO: 217388 - DNA, 25 bp, Rattus norvegicus
caaatccaggccgaaaggcagttag

SEQ ID NO: 217389 - DNA, 25 bp, Rattus norvegicus
caaatccaggtaagagtcggaccgt

SEQ ID NO: 217390 - DNA, 25 bp, Rattus norvegicus
caaatccaggtatgagtcggaccgt

SEQ ID NO: 217391 - DNA, 25 bp, Rattus norvegicus
caaatccattgacccctatctgaag

SEQ ID NO: 217392 - DNA, 25 bp, Rattus norvegicus
caaatccattgaccggccatgaaaa

SEQ ID NO: 217393 - DNA, 25 bp, Rattus norvegicus
caaatccattgagccctatctgaag

SEQ ID NO: 217394 - DNA, 25 bp, Rattus norvegicus
caaatccattgagcggccatgaaaa

SEQ ID NO: 217395 - DNA, 25 bp, Rattus norvegicus
caaatcccaataatccaggtacata

SEQ ID NO: 217396 - DNA, 25 bp, Rattus norvegicus
caaatcccaatattccaggtacata

SEQ ID NO: 217397 - DNA, 25 bp, Rattus norvegicus
caaatcccatgcaaggccactcaga

SEQ ID NO: 217398 - DNA, 25 bp, Rattus norvegicus
caaatcccatgctaggccactcaga

SEQ ID NO: 217399 - DNA, 25 bp, Rattus norvegicus
caaatcccattcagacattgtcaac

SEQ ID NO: 217400 - DNA, 25 bp, Rattus norvegicus
caaatcccattctgacattgtcaac

SEQ ID NO: 217401 - DNA, 25 bp, Rattus norvegicus
caaatccctattctaactctgatgg

SEQ ID NO: 217402 - DNA, 25 bp, Rattus norvegicus
caaatccctattgtaactctgatgg

SEQ ID NO: 217403 - DNA, 25 bp, Rattus norvegicus
caaatccgtcaacggcgtcgggcaa

SEQ ID NO: 217404 - DNA, 25 bp, Rattus norvegicus
caaatccgtcaagggcgtcgggcaa

SEQ ID NO: 217405 - DNA, 25 bp, Rattus norvegicus
caaatcctaccgcaaaaggcttttg

SEQ ID NO: 217406 - DNA, 25 bp, Rattus norvegicus
caaatcctaccggaaaaggcttttg

SEQ ID NO: 217407 - DNA, 25 bp, Rattus norvegicus
caaatcctctttcgtgatgggtcat

SEQ ID NO: 217408 - DNA, 25 bp, Rattus norvegicus
caaatcctctttggtgatgggtcat

SEQ ID NO: 217409 - DNA, 25 bp, Rattus norvegicus
caaatcctgcttcgctggctggaag

SEQ ID NO: 217410 - DNA, 25 bp, Rattus norvegicus
caaatcctgcttggctggctggaag

SEQ ID NO: 217411 - DNA, 25 bp, Rattus norvegicus
caaatccttcccaggctttagcaga

SEQ ID NO: 217412 - DNA, 25 bp, Rattus norvegicus
caaatccttccctggctttagcaga

SEQ ID NO: 217413 - DNA, 25 bp, Rattus norvegicus
caaatcgaatgacgcctagaacaga

SEQ ID NO: 217414 - DNA, 25 bp, Rattus norvegicus
caaatcgaatgaggcctagaacaga

SEQ ID NO: 217415 - DNA, 25 bp, Rattus norvegicus
caaatcggacagatgcaggagctaa

SEQ ID NO: 217416 - DNA, 25 bp, Rattus norvegicus
caaatcggacagttgcaggagctaa

SEQ ID NO: 217417 - DNA, 25 bp, Rattus norvegicus
caaatctagactatccgtggagcac

SEQ ID NO: 217418 - DNA, 25 bp, Rattus norvegicus
caaatctagactttccgtggagcac

SEQ ID NO: 217419 - DNA, 25 bp, Rattus norvegicus
caaatctatttaatcccaagcctgg

SEQ ID NO: 217420 - DNA, 25 bp, Rattus norvegicus
caaatctatttattcccaagcctgg

SEQ ID NO: 217421 - DNA, 25 bp, Rattus norvegicus
caaatctcgagcacttgcctttatt

SEQ ID NO: 217422 - DNA, 25 bp, Rattus norvegicus
caaatctcgagctcttgcctttatt

SEQ ID NO: 217423 - DNA, 25 bp, Rattus norvegicus
caaatctctctaatgtttccgggtc

SEQ ID NO: 217424 - DNA, 25 bp, Rattus norvegicus
caaatctctctattgtttccgggtc

SEQ ID NO: 217425 - DNA, 25 bp, Rattus norvegicus
caaatcttagaacacattgcagagt

SEQ ID NO: 217426 - DNA, 25 bp, Rattus norvegicus
caaatcttagaagacattgcagagt

SEQ ID NO: 217427 - DNA, 25 bp, Rattus norvegicus
caaatcttagtgctggtgaccgggt

SEQ ID NO: 217428 - DNA, 25 bp, Rattus norvegicus
caaatcttagtggtggtgaccgggt

SEQ ID NO: 217429 - DNA, 25 bp, Rattus norvegicus
caaatcttcattagtgttccaaaca

SEQ ID NO: 217430 - DNA, 25 bp, Rattus norvegicus
caaatcttcatttgtgttccaaaca

SEQ ID NO: 217431 - DNA, 25 bp, Rattus norvegicus
caaatcttgcccataaatagcccag

SEQ ID NO: 217432 - DNA, 25 bp, Rattus norvegicus
caaatcttgcccttaaatagcccag

SEQ ID NO: 217433 - DNA, 25 bp, Rattus norvegicus
caaatcttgtccaccttccttgaaa

SEQ ID NO: 217434 - DNA, 25 bp, Rattus norvegicus
caaatcttgtcctccttccttgaaa

SEQ ID NO: 217435 - DNA, 25 bp, Rattus norvegicus
caaatgaaagttatgcccctcctac

SEQ ID NO: 217436 - DNA, 25 bp, Rattus norvegicus
caaatgaaagttttgcccctcctac

SEQ ID NO: 217437 - DNA, 25 bp, Rattus norvegicus
caaatgaactctcttccgtcgtttc

SEQ ID NO: 217438 - DNA, 25 bp, Rattus norvegicus
caaatgaactctgttccgtcgtttc

SEQ ID NO: 217439 - DNA, 25 bp, Rattus norvegicus
caaatgaaggctacctgcctctgag

SEQ ID NO: 217440 - DNA, 25 bp, Rattus norvegicus
caaatgaaggcttcctgcctctgag

SEQ ID NO: 217441 - DNA, 25 bp, Rattus norvegicus
caaatgactgtcagtcctgtaacct

SEQ ID NO: 217442 - DNA, 25 bp, Rattus norvegicus
caaatgactgtctgtcctgtaacct

SEQ ID NO: 217443 - DNA, 25 bp, Rattus norvegicus
caaatgacttgcaggttactggttt

SEQ ID NO: 217444 - DNA, 25 bp, Rattus norvegicus
caaatgacttgctggttactggttt

SEQ ID NO: 217445 - DNA, 25 bp, Rattus norvegicus
caaatgagtgaacgctactagctgt

SEQ ID NO: 217446 - DNA, 25 bp, Rattus norvegicus
caaatgagtgaaggctactagctgt

SEQ ID NO: 217447 - DNA, 25 bp, Rattus norvegicus
caaatgatagttcgcgggctctgca

SEQ ID NO: 217448 - DNA, 25 bp, Rattus norvegicus
caaatgatagttggcgggctctgca

SEQ ID NO: 217449 - DNA, 25 bp, Rattus norvegicus
caaatgcaacagagcggcttcccct

SEQ ID NO: 217450 - DNA, 25 bp, Rattus norvegicus
caaatgcaacagtgcggcttcccct

SEQ ID NO: 217451 - DNA, 25 bp, Rattus norvegicus
caaatgcaacttcttggccaagcca

SEQ ID NO: 217452 - DNA, 25 bp, Rattus norvegicus
caaatgcaacttgttggccaagcca

SEQ ID NO: 217453 - DNA, 25 bp, Rattus norvegicus
caaatgcactcacctctgtagttga

SEQ ID NO: 217454 - DNA, 25 bp, Rattus norvegicus
caaatgcactcagctctgtagttga

SEQ ID NO: 217455 - DNA, 25 bp, Rattus norvegicus
caaatgcatttgaacactcggtgta

SEQ ID NO: 217456 - DNA, 25 bp, Rattus norvegicus
caaatgcatttgtacactcggtgta

SEQ ID NO: 217457 - DNA, 25 bp, Rattus norvegicus
caaatgccaagtcgacgaggctgaa

SEQ ID NO: 217458 - DNA, 25 bp, Rattus norvegicus
caaatgccaagtggacgaggctgaa

SEQ ID NO: 217459 - DNA, 25 bp, Rattus norvegicus
caaatgccagaaattcaaccaggcg

SEQ ID NO: 217460 - DNA, 25 bp, Rattus norvegicus
caaatgccagaatttcaaccaggcg

SEQ ID NO: 217461 - DNA, 25 bp, Rattus norvegicus
caaatgccccgaagggccgtgaaaa

SEQ ID NO: 217462 - DNA, 25 bp, Rattus norvegicus
caaatgccccgatgggccgtgaaaa

SEQ ID NO: 217463 - DNA, 25 bp, Rattus norvegicus
caaatgccgtaacgcctgagcagtt

SEQ ID NO: 217464 - DNA, 25 bp, Rattus norvegicus
caaatgccgtaaggcctgagcagtt

SEQ ID NO: 217465 - DNA, 25 bp, Rattus norvegicus
caaatgcctgcccactttgtttttt

SEQ ID NO: 217466 - DNA, 25 bp, Rattus norvegicus
caaatgcctgccgactttgtttttt

SEQ ID NO: 217467 - DNA, 25 bp, Rattus norvegicus
caaatgcctggtctgtgtgcctgaa

SEQ ID NO: 217468 - DNA, 25 bp, Rattus norvegicus
caaatgcctggtgtgtgtgcctgaa

SEQ ID NO: 217469 - DNA, 25 bp, Rattus norvegicus
caaatgcggttacctgctgtggact

SEQ ID NO: 217470 - DNA, 25 bp, Rattus norvegicus
caaatgcggttagctgctgtggact

SEQ ID NO: 217471 - DNA, 25 bp, Rattus norvegicus
caaatgcgttggattgtctccttta

SEQ ID NO: 217472 - DNA, 25 bp, Rattus norvegicus
caaatgcgttggtttgtctccttta

SEQ ID NO: 217473 - DNA, 25 bp, Rattus norvegicus
caaatgctcgagatacttatgtttc

SEQ ID NO: 217474 - DNA, 25 bp, Rattus norvegicus
caaatgctcgagttacttatgtttc

SEQ ID NO: 217475 - DNA, 25 bp, Rattus norvegicus
caaatgctctgaacgttgtacatac

SEQ ID NO: 217476 - DNA, 25 bp, Rattus norvegicus
caaatgctctgatcgttgtacatac

SEQ ID NO: 217477 - DNA, 25 bp, Rattus norvegicus
caaatgctcttaacttgtcacctct

SEQ ID NO: 217478 - DNA, 25 bp, Rattus norvegicus
caaatgctcttatcttgtcacctct

SEQ ID NO: 217479 - DNA, 25 bp, Rattus norvegicus
caaatgctgaatactttagggtgta

SEQ ID NO: 217480 - DNA, 25 bp, Rattus norvegicus
caaatgctgaattctttagggtgta

SEQ ID NO: 217481 - DNA, 25 bp, Rattus norvegicus
caaatgctgagaagcagcgtctgga

SEQ ID NO: 217482 - DNA, 25 bp, Rattus norvegicus
caaatgctgagatgcagcgtctgga

SEQ ID NO: 217483 - DNA, 25 bp, Rattus norvegicus
caaatgcttctacccgtatctgtat

SEQ ID NO: 217484 - DNA, 25 bp, Rattus norvegicus
caaatgcttctagccgtatctgtat

SEQ ID NO: 217485 - DNA, 25 bp, Rattus norvegicus
caaatgcttgtcaaggtgcagaaga

SEQ ID NO: 217486 - DNA, 25 bp, Rattus norvegicus
caaatgcttgtctaggtgcagaaga

SEQ ID NO: 217487 - DNA, 25 bp, Rattus norvegicus
caaatgctttcaaattttggtccaa

SEQ ID NO: 217488 - DNA, 25 bp, Rattus norvegicus
caaatgctttcatattttggtccaa

SEQ ID NO: 217489 - DNA, 25 bp, Rattus norvegicus
caaatggacattacatcgggatacc

SEQ ID NO: 217490 - DNA, 25 bp, Rattus norvegicus
caaatggacatttcatcgggatacc

SEQ ID NO: 217491 - DNA, 25 bp, Rattus norvegicus
caaatggacccgaagcctgtgtaaa

SEQ ID NO: 217492 - DNA, 25 bp, Rattus norvegicus
caaatggacccgtagcctgtgtaaa

SEQ ID NO: 217493 - DNA, 25 bp, Rattus norvegicus
caaatggcaccaatgtgtgacggag

SEQ ID NO: 217494 - DNA, 25 bp, Rattus norvegicus
caaatggcaccattgtgtgacggag

SEQ ID NO: 217495 - DNA, 25 bp, Rattus norvegicus
caaatggcatagatccggtccctgg

SEQ ID NO: 217496 - DNA, 25 bp, Rattus norvegicus
caaatggcatagttccggtccctgg

SEQ ID NO: 217497 - DNA, 25 bp, Rattus norvegicus
caaatggcccatcactgtttagagt

SEQ ID NO: 217498 - DNA, 25 bp, Rattus norvegicus
caaatggcccatgactgtttagagt

SEQ ID NO: 217499 - DNA, 25 bp, Rattus norvegicus
caaatgggacttcggctcggattac

SEQ ID NO: 217500 - DNA, 25 bp, Rattus norvegicus
caaatgggacttgggctcggattac

SEQ ID NO: 217501 - DNA, 25 bp, Rattus norvegicus
caaatgggccgcatgactctcaggc

SEQ ID NO: 217502 - DNA, 25 bp, Rattus norvegicus
caaatgggccgcttgactctcaggc

SEQ ID NO: 217503 - DNA, 25 bp, Rattus norvegicus
caaatggtccctccttcggtgaagg

SEQ ID NO: 217504 - DNA, 25 bp, Rattus norvegicus
caaatggtccctgcttcggtgaagg

SEQ ID NO: 217505 - DNA, 25 bp, Rattus norvegicus
caaatggtcctcatcgtaagtgaat

SEQ ID NO: 217506 - DNA, 25 bp, Rattus norvegicus
caaatggtcctcttcgtaagtgaat

SEQ ID NO: 217507 - DNA, 25 bp, Rattus norvegicus
caaatggtctttactgttaccttgt

SEQ ID NO: 217508 - DNA, 25 bp, Rattus norvegicus
caaatggtcttttctgttaccttgt

SEQ ID NO: 217509 - DNA, 25 bp, Rattus norvegicus
caaatggtggctcctcagttctcag

SEQ ID NO: 217510 - DNA, 25 bp, Rattus norvegicus
caaatggtggctgctcagttctcag

SEQ ID NO: 217511 - DNA, 25 bp, Rattus norvegicus
caaatggttagtcttcaggcagctt

SEQ ID NO: 217512 - DNA, 25 bp, Rattus norvegicus
caaatggttagtgttcaggcagctt

SEQ ID NO: 217513 - DNA, 25 bp, Rattus norvegicus
caaatgtcaactccaagccccaaag

SEQ ID NO: 217514 - DNA, 25 bp, Rattus norvegicus
caaatgtcaactgcaagccccaaag

SEQ ID NO: 217515 - DNA, 25 bp, Rattus norvegicus
caaatgtcatagaaccttacacccc

SEQ ID NO: 217516 - DNA, 25 bp, Rattus norvegicus
caaatgtcatagtaccttacacccc

SEQ ID NO: 217517 - DNA, 25 bp, Rattus norvegicus
caaatgtctgctcggttggacctca

SEQ ID NO: 217518 - DNA, 25 bp, Rattus norvegicus
caaatgtctgctgggttggacctca

SEQ ID NO: 217519 - DNA, 25 bp, Rattus norvegicus
caaatgtgcacaaagccgctagtaa

SEQ ID NO: 217520 - DNA, 25 bp, Rattus norvegicus
caaatgtgcacatagccgctagtaa

SEQ ID NO: 217521 - DNA, 25 bp, Rattus norvegicus
caaatgtgcagtccagagatgccat

SEQ ID NO: 217522 - DNA, 25 bp, Rattus norvegicus
caaatgtgcagtgcagagatgccat

SEQ ID NO: 217523 - DNA, 25 bp, Rattus norvegicus
caaatgtgctgaacaaagacttgag

SEQ ID NO: 217524 - DNA, 25 bp, Rattus norvegicus
caaatgtgctgatcaaagacttgag

SEQ ID NO: 217525 - DNA, 25 bp, Rattus norvegicus
caaatgtgtattatccagagtgaag

SEQ ID NO: 217526 - DNA, 25 bp, Rattus norvegicus
caaatgtgtattttccagagtgaag

SEQ ID NO: 217527 - DNA, 25 bp, Rattus norvegicus
caaatgtgtttcattagttttccat

SEQ ID NO: 217528 - DNA, 25 bp, Rattus norvegicus
caaatgtgtttctttagttttccat

SEQ ID NO: 217529 - DNA, 25 bp, Rattus norvegicus
caaatgttaaaactgggacccatag

SEQ ID NO: 217530 - DNA, 25 bp, Rattus norvegicus
caaatgttaaaagtgggacccatag

SEQ ID NO: 217531 - DNA, 25 bp, Rattus norvegicus
caaatgttaggaattccacccaaag

SEQ ID NO: 217532 - DNA, 25 bp, Rattus norvegicus
caaatgttaggatttccacccaaag

SEQ ID NO: 217533 - DNA, 25 bp, Rattus norvegicus
caaatgttatttctgcctttccctc

SEQ ID NO: 217534 - DNA, 25 bp, Rattus norvegicus
caaatgttatttgtgcctttccctc

SEQ ID NO: 217535 - DNA, 25 bp, Rattus norvegicus
caaatgttcagtcttctaacgctac

SEQ ID NO: 217536 - DNA, 25 bp, Rattus norvegicus
caaatgttcagtgttctaacgctac

SEQ ID NO: 217537 - DNA, 25 bp, Rattus norvegicus
caaatgttggtaaggtagtcctata

SEQ ID NO: 217538 - DNA, 25 bp, Rattus norvegicus
caaatgttggtatggtagtcctata

SEQ ID NO: 217539 - DNA, 25 bp, Rattus norvegicus
caaatgttggttcctgtctgcgtga

SEQ ID NO: 217540 - DNA, 25 bp, Rattus norvegicus
caaatgttggttgctgtctgcgtga

SEQ ID NO: 217541 - DNA, 25 bp, Rattus norvegicus
caaatgttgtgtcgtctgtcgtgca

SEQ ID NO: 217542 - DNA, 25 bp, Rattus norvegicus
caaatgttgtgtggtctgtcgtgca

SEQ ID NO: 217543 - DNA, 25 bp, Rattus norvegicus
caaatgttgttactatgcatgtaca

SEQ ID NO: 217544 - DNA, 25 bp, Rattus norvegicus
caaatgttgttagtatgcatgtaca

SEQ ID NO: 217545 - DNA, 25 bp, Rattus norvegicus
caaatgtttatgcaagaagcacttc

SEQ ID NO: 217546 - DNA, 25 bp, Rattus norvegicus
caaatgtttatggaagaagcacttc

SEQ ID NO: 217547 - DNA, 25 bp, Rattus norvegicus
caaattacaggacagttgggactac

SEQ ID NO: 217548 - DNA, 25 bp, Rattus norvegicus
caaattacaggagagttgggactac

SEQ ID NO: 217549 - DNA, 25 bp, Rattus norvegicus
caaattagccaacaccaggagcatt

SEQ ID NO: 217550 - DNA, 25 bp, Rattus norvegicus
caaattagccaagaccaggagcatt

SEQ ID NO: 217551 - DNA, 25 bp, Rattus norvegicus
caaattagtcttctttcgaatccct

SEQ ID NO: 217552 - DNA, 25 bp, Rattus norvegicus
caaattagtcttgtttcgaatccct

SEQ ID NO: 217553 - DNA, 25 bp, Rattus norvegicus
caaattagtggcaccctccgagtga

SEQ ID NO: 217554 - DNA, 25 bp, Rattus norvegicus
caaattagtggctccctccgagtga

SEQ ID NO: 217555 - DNA, 25 bp, Rattus norvegicus
caaattatcatgaatcccgtgtgtg

SEQ ID NO: 217556 - DNA, 25 bp, Rattus norvegicus
caaattatcatgtatcccgtgtgtg

SEQ ID NO: 217557 - DNA, 25 bp, Rattus norvegicus
caaattcaagtgaactctcgccatc

SEQ ID NO: 217558 - DNA, 25 bp, Rattus norvegicus
caaattcaagtgtactctcgccatc

SEQ ID NO: 217559 - DNA, 25 bp, Rattus norvegicus
caaattcacaagagttcctcctgcc

SEQ ID NO: 217560 - DNA, 25 bp, Rattus norvegicus
caaattcacaagtgttcctcctgcc

SEQ ID NO: 217561 - DNA, 25 bp, Rattus norvegicus
caaattcagcctcgcatgcgtagct

SEQ ID NO: 217562 - DNA, 25 bp, Rattus norvegicus
caaattcagcctggcatgcgtagct

SEQ ID NO: 217563 - DNA, 25 bp, Rattus norvegicus
caaattcagtggagtcatatggttt

SEQ ID NO: 217564 - DNA, 25 bp, Rattus norvegicus
caaattcagtggtgtcatatggttt

SEQ ID NO: 217565 - DNA, 25 bp, Rattus norvegicus
caaattccaaatcccttcccatgat

SEQ ID NO: 217566 - DNA, 25 bp, Rattus norvegicus
caaattccaaatgccttcccatgat

SEQ ID NO: 217567 - DNA, 25 bp, Rattus norvegicus
caaattccaagaatgccagagttat

SEQ ID NO: 217568 - DNA, 25 bp, Rattus norvegicus
caaattccaagattgccagagttat

SEQ ID NO: 217569 - DNA, 25 bp, Rattus norvegicus
caaattccactgattgctgggcaca

SEQ ID NO: 217570 - DNA, 25 bp, Rattus norvegicus
caaattccactgtttgctgggcaca

SEQ ID NO: 217571 - DNA, 25 bp, Rattus norvegicus
caaattcccaaaccatacttgctaa

SEQ ID NO: 217572 - DNA, 25 bp, Rattus norvegicus
caaattcccaaagcatacttgctaa

SEQ ID NO: 217573 - DNA, 25 bp, Rattus norvegicus
caaattcccctgaactgaccaaggt

SEQ ID NO: 217574 - DNA, 25 bp, Rattus norvegicus
caaattcccctgtactgaccaaggt

SEQ ID NO: 217575 - DNA, 25 bp, Rattus norvegicus
caaattccgctcacacgagggtgag

SEQ ID NO: 217576 - DNA, 25 bp, Rattus norvegicus
caaattccgctctcacgagggtgag

SEQ ID NO: 217577 - DNA, 25 bp, Rattus norvegicus
caaattccgggacaagattgagaaa

SEQ ID NO: 217578 - DNA, 25 bp, Rattus norvegicus
caaattccgggagaagattgagaaa

SEQ ID NO: 217579 - DNA, 25 bp, Rattus norvegicus
caaattcgaagtccatcctgagtgt

SEQ ID NO: 217580 - DNA, 25 bp, Rattus norvegicus
caaattcgaagtgcatcctgagtgt

SEQ ID NO: 217581 - DNA, 25 bp, Rattus norvegicus
caaattcgttaaacggttcctagcg

SEQ ID NO: 217582 - DNA, 25 bp, Rattus norvegicus
caaattcgttaatcggttcctagcg

SEQ ID NO: 217583 - DNA, 25 bp, Rattus norvegicus
caaattctattaacctacatgactg

SEQ ID NO: 217584 - DNA, 25 bp, Rattus norvegicus
caaattctattatcctacatgactg

SEQ ID NO: 217585 - DNA, 25 bp, Rattus norvegicus
caaattctccacaagacctggtcta

SEQ ID NO: 217586 - DNA, 25 bp, Rattus norvegicus
caaattctccactagacctggtcta

SEQ ID NO: 217587 - DNA, 25 bp, Rattus norvegicus
caaattctctcaaaggatccagccc

SEQ ID NO: 217588 - DNA, 25 bp, Rattus norvegicus
caaattctctcataggatccagccc

SEQ ID NO: 217589 - DNA, 25 bp, Rattus norvegicus
caaattctcttcagctgtctgtctg

SEQ ID NO: 217590 - DNA, 25 bp, Rattus norvegicus
caaattctcttctgctgtctgtctg

SEQ ID NO: 217591 - DNA, 25 bp, Rattus norvegicus
caaattctgctgctgcaagtaggca

SEQ ID NO: 217592 - DNA, 25 bp, Rattus norvegicus
caaattctgctggtgcaagtaggca

SEQ ID NO: 217593 - DNA, 25 bp, Rattus norvegicus
caaattctgtctaactgtgtgaata

SEQ ID NO: 217594 - DNA, 25 bp, Rattus norvegicus
caaattctgtcttactgtgtgaata

SEQ ID NO: 217595 - DNA, 25 bp, Rattus norvegicus
caaattcttattaatagctgagcag

SEQ ID NO: 217596 - DNA, 25 bp, Rattus norvegicus
caaattcttatttatagctgagcag

SEQ ID NO: 217597 - DNA, 25 bp, Rattus norvegicus
caaattcttcctattcaagttcgat

SEQ ID NO: 217598 - DNA, 25 bp, Rattus norvegicus
caaattcttccttttcaagttcgat

SEQ ID NO: 217599 - DNA, 25 bp, Rattus norvegicus
caaattcttctcacacattctggtg

SEQ ID NO: 217600 - DNA, 25 bp, Rattus norvegicus
caaattcttctctcacattctggtg

SEQ ID NO: 217601 - DNA, 25 bp, Rattus norvegicus
caaattcttgacaatccggtgattc

SEQ ID NO: 217602 - DNA, 25 bp, Rattus norvegicus
caaattcttgactatccggtgattc

SEQ ID NO: 217603 - DNA, 25 bp, Rattus norvegicus
caaattctttcacgagttcactcaa

SEQ ID NO: 217604 - DNA, 25 bp, Rattus norvegicus
caaattctttcaggagttcactcaa

SEQ ID NO: 217605 - DNA, 25 bp, Rattus norvegicus
caaattctttctcgttgtctgtttt

SEQ ID NO: 217606 - DNA, 25 bp, Rattus norvegicus
caaattctttctggttgtctgtttt

SEQ ID NO: 217607 - DNA, 25 bp, Rattus norvegicus
caaattcttttacctacatccggta

SEQ ID NO: 217608 - DNA, 25 bp, Rattus norvegicus
caaattcttttagctacatccggta

SEQ ID NO: 217609 - DNA, 25 bp, Rattus norvegicus
caaattgaaataccttgtgcttttt

SEQ ID NO: 217610 - DNA, 25 bp, Rattus norvegicus
caaattgaaatagcttgtgcttttt

SEQ ID NO: 217611 - DNA, 25 bp, Rattus norvegicus
caaattgacaatcgcttcttttctc

SEQ ID NO: 217612 - DNA, 25 bp, Rattus norvegicus
caaattgacaatggcttcttttctc

SEQ ID NO: 217613 - DNA, 25 bp, Rattus norvegicus
caaattgacttaatggctgccctgg

SEQ ID NO: 217614 - DNA, 25 bp, Rattus norvegicus
caaattgacttattggctgccctgg

SEQ ID NO: 217615 - DNA, 25 bp, Rattus norvegicus
caaattgccaagctaagtttaccct

SEQ ID NO: 217616 - DNA, 25 bp, Rattus norvegicus
caaattgccaaggtaagtttaccct

SEQ ID NO: 217617 - DNA, 25 bp, Rattus norvegicus
caaattgctgctagggttttgaatt

SEQ ID NO: 217618 - DNA, 25 bp, Rattus norvegicus
caaattgctgctcctttgtttacaa

SEQ ID NO: 217619 - DNA, 25 bp, Rattus norvegicus
caaattgctgctgctttgtttacaa

SEQ ID NO: 217620 - DNA, 25 bp, Rattus norvegicus
caaattgctgcttgggttttgaatt

SEQ ID NO: 217621 - DNA, 25 bp, Rattus norvegicus
caaattggagtaatcttcctgagga

SEQ ID NO: 217622 - DNA, 25 bp, Rattus norvegicus
caaattggagtattcttcctgagga

SEQ ID NO: 217623 - DNA, 25 bp, Rattus norvegicus
caaattggtatcagtgtctgatgca

SEQ ID NO: 217624 - DNA, 25 bp, Rattus norvegicus
caaattggtatctgtgtctgatgca

SEQ ID NO: 217625 - DNA, 25 bp, Rattus norvegicus
caaattggtattatgtagtgggcag

SEQ ID NO: 217626 - DNA, 25 bp, Rattus norvegicus
caaattggtattttgtagtgggcag

SEQ ID NO: 217627 - DNA, 25 bp, Rattus norvegicus
caaattgtcgttctgtttcacgggt

SEQ ID NO: 217628 - DNA, 25 bp, Rattus norvegicus
caaattgtcgttgtgtttcacgggt

SEQ ID NO: 217629 - DNA, 25 bp, Rattus norvegicus
caaattgtctaactttatctttggg

SEQ ID NO: 217630 - DNA, 25 bp, Rattus norvegicus
caaattgtctaagtttatctttggg

SEQ ID NO: 217631 - DNA, 25 bp, Rattus norvegicus
caaattgtctccactttcaaacgtg

SEQ ID NO: 217632 - DNA, 25 bp, Rattus norvegicus
caaattgtctcctctttcaaacgtg

SEQ ID NO: 217633 - DNA, 25 bp, Rattus norvegicus
caaattgtctgtcctgtggagcagg

SEQ ID NO: 217634 - DNA, 25 bp, Rattus norvegicus
caaattgtctgtgctgtggagcagg

SEQ ID NO: 217635 - DNA, 25 bp, Rattus norvegicus
caaatttacctcacttccagtagga

SEQ ID NO: 217636 - DNA, 25 bp, Rattus norvegicus
caaatttacctctcttccagtagga

SEQ ID NO: 217637 - DNA, 25 bp, Rattus norvegicus
caaatttactagactttgtcttcct

SEQ ID NO: 217638 - DNA, 25 bp, Rattus norvegicus
caaatttactagtctttgtcttcct

SEQ ID NO: 217639 - DNA, 25 bp, Rattus norvegicus
caaatttataaaacctcctcctggg

SEQ ID NO: 217640 - DNA, 25 bp, Rattus norvegicus
caaatttataaatcctcctcctggg

SEQ ID NO: 217641 - DNA, 25 bp, Rattus norvegicus
caaatttcaggcaatcttcaggatt

SEQ ID NO: 217642 - DNA, 25 bp, Rattus norvegicus
caaatttcaggcatgggatccaagt

SEQ ID NO: 217643 - DNA, 25 bp, Rattus norvegicus
caaatttcaggctatcttcaggatt

SEQ ID NO: 217644 - DNA, 25 bp, Rattus norvegicus
caaatttcaggcttgggatccaagt

SEQ ID NO: 217645 - DNA, 25 bp, Rattus norvegicus
caaatttcatataccgccattcgtt

SEQ ID NO: 217646 - DNA, 25 bp, Rattus norvegicus
caaatttcatattccgccattcgtt

SEQ ID NO: 217647 - DNA, 25 bp, Rattus norvegicus
caaatttccttgactgtggttgttt

SEQ ID NO: 217648 - DNA, 25 bp, Rattus norvegicus
caaatttccttgtctgtggttgttt

SEQ ID NO: 217649 - DNA, 25 bp, Rattus norvegicus
caaatttctttgagcatcctgactc

SEQ ID NO: 217650 - DNA, 25 bp, Rattus norvegicus
caaatttctttgtgcatcctgactc

SEQ ID NO: 217651 - DNA, 25 bp, Rattus norvegicus
caaatttgacacaagcatgtttaca

SEQ ID NO: 217652 - DNA, 25 bp, Rattus norvegicus
caaatttgacactagcatgtttaca

SEQ ID NO: 217653 - DNA, 25 bp, Rattus norvegicus
caaatttgactaactgtcctttcca

SEQ ID NO: 217654 - DNA, 25 bp, Rattus norvegicus
caaatttgactatctgtcctttcca

SEQ ID NO: 217655 - DNA, 25 bp, Rattus norvegicus
caaatttgacttatctagttcgtgt

SEQ ID NO: 217656 - DNA, 25 bp, Rattus norvegicus
caaatttgacttttctagttcgtgt

SEQ ID NO: 217657 - DNA, 25 bp, Rattus norvegicus
caaatttgagtcctgcagtgtgcct

SEQ ID NO: 217658 - DNA, 25 bp, Rattus norvegicus
caaatttgagtcgtgcagtgtgcct

SEQ ID NO: 217659 - DNA, 25 bp, Rattus norvegicus
caaatttgatgaatgctctgcacta

SEQ ID NO: 217660 - DNA, 25 bp, Rattus norvegicus
caaatttgatgattgctctgcacta

SEQ ID NO: 217661 - DNA, 25 bp, Rattus norvegicus
caaatttgatttcgccctcctaaca

SEQ ID NO: 217662 - DNA, 25 bp, Rattus norvegicus
caaatttgatttggccctcctaaca

SEQ ID NO: 217663 - DNA, 25 bp, Rattus norvegicus
caaatttggctaccactttacccag

SEQ ID NO: 217664 - DNA, 25 bp, Rattus norvegicus
caaatttggctagcactttacccag

SEQ ID NO: 217665 - DNA, 25 bp, Rattus norvegicus
caaatttgtcatatgctgcgctggg

SEQ ID NO: 217666 - DNA, 25 bp, Rattus norvegicus
caaatttgtcatttgctgcgctggg

SEQ ID NO: 217667 - DNA, 25 bp, Rattus norvegicus
caaattttccttacaatccaaacag

SEQ ID NO: 217668 - DNA, 25 bp, Rattus norvegicus
caaattttcctttcaatccaaacag

SEQ ID NO: 217669 - DNA, 25 bp, Rattus norvegicus
caaattttgaaaccctgatatctgt

SEQ ID NO: 217670 - DNA, 25 bp, Rattus norvegicus
caaattttgaaagcctgatatctgt

SEQ ID NO: 217671 - DNA, 25 bp, Rattus norvegicus
caaattttgcagcttttaagaatca

SEQ ID NO: 217672 - DNA, 25 bp, Rattus norvegicus
caaattttgcaggttttaagaatca

SEQ ID NO: 217673 - DNA, 25 bp, Rattus norvegicus
caaattttggccaatgtgggtttct

SEQ ID NO: 217674 - DNA, 25 bp, Rattus norvegicus
caaattttggcctatgtgggtttct

SEQ ID NO: 217675 - DNA, 25 bp, Rattus norvegicus
caaatttttacaagtgagctctggg

SEQ ID NO: 217676 - DNA, 25 bp, Rattus norvegicus
caaatttttacatgtgagctctggg

SEQ ID NO: 217677 - DNA, 25 bp, Rattus norvegicus
caaatttttgctacttggaacacga

SEQ ID NO: 217678 - DNA, 25 bp, Rattus norvegicus
caaatttttgcttcttggaacacga

SEQ ID NO: 217679 - DNA, 25 bp, Rattus norvegicus
caacaaaacgtcattcctacttcat

SEQ ID NO: 217680 - DNA, 25 bp, Rattus norvegicus
caacaaaacgtctttcctacttcat

SEQ ID NO: 217681 - DNA, 25 bp, Rattus norvegicus
caacaaaaggttctaggctcaggca

SEQ ID NO: 217682 - DNA, 25 bp, Rattus norvegicus
caacaaaaggttgtaggctcaggca

SEQ ID NO: 217683 - DNA, 25 bp, Rattus norvegicus
caacaaaccacgcagtttctgtgtt

SEQ ID NO: 217684 - DNA, 25 bp, Rattus norvegicus
caacaaaccacggagtttctgtgtt

SEQ ID NO: 217685 - DNA, 25 bp, Rattus norvegicus
caacaaacctgtccttaatacgtca

SEQ ID NO: 217686 - DNA, 25 bp, Rattus norvegicus
caacaaacctgtgcttaatacgtca

SEQ ID NO: 217687 - DNA, 25 bp, Rattus norvegicus
caacaaacttggaggcttccccgtg

SEQ ID NO: 217688 - DNA, 25 bp, Rattus norvegicus
caacaaacttggtggcttccccgtg

SEQ ID NO: 217689 - DNA, 25 bp, Rattus norvegicus
caacaaagaccaacccatgggatgt

SEQ ID NO: 217690 - DNA, 25 bp, Rattus norvegicus
caacaaagaccatcccatgggatgt

SEQ ID NO: 217691 - DNA, 25 bp, Rattus norvegicus
caacaacattgtcactagctctggg

SEQ ID NO: 217692 - DNA, 25 bp, Rattus norvegicus
caacaacattgtgactagctctggg

SEQ ID NO: 217693 - DNA, 25 bp, Rattus norvegicus
caacaaccctacagctactgtttaa

SEQ ID NO: 217694 - DNA, 25 bp, Rattus norvegicus
caacaaccctactgctactgtttaa

SEQ ID NO: 217695 - DNA, 25 bp, Rattus norvegicus
caacaacccttcatttatggctctt

SEQ ID NO: 217696 - DNA, 25 bp, Rattus norvegicus
caacaacccttcttttatggctctt

SEQ ID NO: 217697 - DNA, 25 bp, Rattus norvegicus
caacaacctggcatcatttctgtga

SEQ ID NO: 217698 - DNA, 25 bp, Rattus norvegicus
caacaacctggcttcatttctgtga

SEQ ID NO: 217699 - DNA, 25 bp, Rattus norvegicus
caacaaccttgcacagtattcgtcc

SEQ ID NO: 217700 - DNA, 25 bp, Rattus norvegicus
caacaaccttgctcagtattcgtcc

SEQ ID NO: 217701 - DNA, 25 bp, Rattus norvegicus
caacaactgtctaccgtgcagtgaa

SEQ ID NO: 217702 - DNA, 25 bp, Rattus norvegicus
caacaactgtctcctagctctgaaa

SEQ ID NO: 217703 - DNA, 25 bp, Rattus norvegicus
caacaactgtctgctagctctgaaa

SEQ ID NO: 217704 - DNA, 25 bp, Rattus norvegicus
caacaactgtcttccgtgcagtgaa

SEQ ID NO: 217705 - DNA, 25 bp, Rattus norvegicus
caacaactgtttacaaatggacggg

SEQ ID NO: 217706 - DNA, 25 bp, Rattus norvegicus
caacaactgttttcaaatggacggg

SEQ ID NO: 217707 - DNA, 25 bp, Rattus norvegicus
caacaacttcttcggcgccgggcag

SEQ ID NO: 217708 - DNA, 25 bp, Rattus norvegicus
caacaacttcttgggcgccgggcag

SEQ ID NO: 217709 - DNA, 25 bp, Rattus norvegicus
caacaacttgtcactccctgagaag

SEQ ID NO: 217710 - DNA, 25 bp, Rattus norvegicus
caacaacttgtctctccctgagaag

SEQ ID NO: 217711 - DNA, 25 bp, Rattus norvegicus
caacaagaaacactttcccacgtgc

SEQ ID NO: 217712 - DNA, 25 bp, Rattus norvegicus
caacaagaaacagtttcccacgtgc

SEQ ID NO: 217713 - DNA, 25 bp, Rattus norvegicus
caacaagagagtcgacgagcatgga

SEQ ID NO: 217714 - DNA, 25 bp, Rattus norvegicus
caacaagagagtggacgagcatgga

SEQ ID NO: 217715 - DNA, 25 bp, Rattus norvegicus
caacaagccattaatcaacttccca

SEQ ID NO: 217716 - DNA, 25 bp, Rattus norvegicus
caacaagccatttatcaacttccca

SEQ ID NO: 217717 - DNA, 25 bp, Rattus norvegicus
caacaagctggtacctctggtaaag

SEQ ID NO: 217718 - DNA, 25 bp, Rattus norvegicus
caacaagctggttcctctggtaaag

SEQ ID NO: 217719 - DNA, 25 bp, Rattus norvegicus
caacaaggaaccagcgggcgggaca

SEQ ID NO: 217720 - DNA, 25 bp, Rattus norvegicus
caacaaggaacctgcgggcgggaca

SEQ ID NO: 217721 - DNA, 25 bp, Rattus norvegicus
caacaagggcgactagggcatatcc

SEQ ID NO: 217722 - DNA, 25 bp, Rattus norvegicus
caacaagggcgagtagggcatatcc

SEQ ID NO: 217723 - DNA, 25 bp, Rattus norvegicus
caacaaggtcccaaccaaggtgtgt

SEQ ID NO: 217724 - DNA, 25 bp, Rattus norvegicus
caacaaggtccctaccaaggtgtgt

SEQ ID NO: 217725 - DNA, 25 bp, Rattus norvegicus
caacaaggtcctcctgctgtagcag

SEQ ID NO: 217726 - DNA, 25 bp, Rattus norvegicus
caacaaggtcctgctgctgtagcag

SEQ ID NO: 217727 - DNA, 25 bp, Rattus norvegicus
caacaaggtgctccctagagagagc

SEQ ID NO: 217728 - DNA, 25 bp, Rattus norvegicus
caacaaggtgctgcctagagagagc

SEQ ID NO: 217729 - DNA, 25 bp, Rattus norvegicus
caacaagtctagctccatggtacag

SEQ ID NO: 217730 - DNA, 25 bp, Rattus norvegicus
caacaagtctaggtccatggtacag

SEQ ID NO: 217731 - DNA, 25 bp, Rattus norvegicus
caacaagttcagacatgacacatat

SEQ ID NO: 217732 - DNA, 25 bp, Rattus norvegicus
caacaagttcagtcatgacacatat

SEQ ID NO: 217733 - DNA, 25 bp, Rattus norvegicus
caacaataaaccactcccacgtggg

SEQ ID NO: 217734 - DNA, 25 bp, Rattus norvegicus
caacaataaacctctcccacgtggg

SEQ ID NO: 217735 - DNA, 25 bp, Rattus norvegicus
caacaatagacaaatgggacttcat

SEQ ID NO: 217736 - DNA, 25 bp, Rattus norvegicus
caacaatagacatatgggacttcat

SEQ ID NO: 217737 - DNA, 25 bp, Rattus norvegicus
caacaatagctgactgtgtgccctg

SEQ ID NO: 217738 - DNA, 25 bp, Rattus norvegicus
caacaatagctgtctgtgtgccctg

SEQ ID NO: 217739 - DNA, 25 bp, Rattus norvegicus
caacaatggtggagctcagtcttat

SEQ ID NO: 217740 - DNA, 25 bp, Rattus norvegicus
caacaatggtggtgctcagtcttat

SEQ ID NO: 217741 - DNA, 25 bp, Rattus norvegicus
caacaatgtggtccaggtgatcgaa

SEQ ID NO: 217742 - DNA, 25 bp, Rattus norvegicus
caacaatgtggtgcaggtgatcgaa

SEQ ID NO: 217743 - DNA, 25 bp, Rattus norvegicus
caacaattacaacactcagaagggt

SEQ ID NO: 217744 - DNA, 25 bp, Rattus norvegicus
caacaattacaagactcagaagggt

SEQ ID NO: 217745 - DNA, 25 bp, Rattus norvegicus
caacacacacacatgccaaatcaga

SEQ ID NO: 217746 - DNA, 25 bp, Rattus norvegicus
caacacacacacttgccaaatcaga

SEQ ID NO: 217747 - DNA, 25 bp, Rattus norvegicus
caacacacacagatagcccagaacg

SEQ ID NO: 217748 - DNA, 25 bp, Rattus norvegicus
caacacacacagttagcccagaacg

SEQ ID NO: 217749 - DNA, 25 bp, Rattus norvegicus
caacacacttccaggaggacagcta

SEQ ID NO: 217750 - DNA, 25 bp, Rattus norvegicus
caacacacttcctggaggacagcta

SEQ ID NO: 217751 - DNA, 25 bp, Rattus norvegicus
caacacagacagacaaggcccacag

SEQ ID NO: 217752 - DNA, 25 bp, Rattus norvegicus
caacacagacagtcaaggcccacag

SEQ ID NO: 217753 - DNA, 25 bp, Rattus norvegicus
caacacagaccacaaccagaagctt

SEQ ID NO: 217754 - DNA, 25 bp, Rattus norvegicus
caacacagaccagaaccagaagctt

SEQ ID NO: 217755 - DNA, 25 bp, Rattus norvegicus
caacacagggttattctgtgtatcc

SEQ ID NO: 217756 - DNA, 25 bp, Rattus norvegicus
caacacagggtttttctgtgtatcc

SEQ ID NO: 217757 - DNA, 25 bp, Rattus norvegicus
caacacagtggaattcattggaaga

SEQ ID NO: 217758 - DNA, 25 bp, Rattus norvegicus
caacacagtggatttcattggaaga

SEQ ID NO: 217759 - DNA, 25 bp, Rattus norvegicus
caacacatgactccttgactcttgg

SEQ ID NO: 217760 - DNA, 25 bp, Rattus norvegicus
caacacatgactgcttgactcttgg

SEQ ID NO: 217761 - DNA, 25 bp, Rattus norvegicus
caacaccaggagctcgtatccgttt

SEQ ID NO: 217762 - DNA, 25 bp, Rattus norvegicus
caacaccaggaggtcgtatccgttt

SEQ ID NO: 217763 - DNA, 25 bp, Rattus norvegicus
caacacccacgacgtttctggaagt

SEQ ID NO: 217764 - DNA, 25 bp, Rattus norvegicus
caacacccacgaggtttctggaagt

SEQ ID NO: 217765 - DNA, 25 bp, Rattus norvegicus
caacacccctatacctgagtttaag

SEQ ID NO: 217766 - DNA, 25 bp, Rattus norvegicus
caacacccctattcctgagtttaag

SEQ ID NO: 217767 - DNA, 25 bp, Rattus norvegicus
caacaccctctcatcagaaacatta

SEQ ID NO: 217768 - DNA, 25 bp, Rattus norvegicus
caacaccctctcttcagaaacatta

SEQ ID NO: 217769 - DNA, 25 bp, Rattus norvegicus
caacacctactgcttcagggttctg

SEQ ID NO: 217770 - DNA, 25 bp, Rattus norvegicus
caacacctactggttcagggttctg

SEQ ID NO: 217771 - DNA, 25 bp, Rattus norvegicus
caacacctatgcatcttttaactgg

SEQ ID NO: 217772 - DNA, 25 bp, Rattus norvegicus
caacacctatgcttcttttaactgg

SEQ ID NO: 217773 - DNA, 25 bp, Rattus norvegicus
caacacctgttgaattttctcaaga

SEQ ID NO: 217774 - DNA, 25 bp, Rattus norvegicus
caacacctgttgtattttctcaaga

SEQ ID NO: 217775 - DNA, 25 bp, Rattus norvegicus
caacaccttgtgctcctttagtagt

SEQ ID NO: 217776 - DNA, 25 bp, Rattus norvegicus
caacaccttgtggtcctttagtagt

SEQ ID NO: 217777 - DNA, 25 bp, Rattus norvegicus
caacacgaatcaaaagtctcttttt

SEQ ID NO: 217778 - DNA, 25 bp, Rattus norvegicus
caacacgaatcataagtctcttttt

SEQ ID NO: 217779 - DNA, 25 bp, Rattus norvegicus
caacacgaatctccgcgttttttat

SEQ ID NO: 217780 - DNA, 25 bp, Rattus norvegicus
caacacgaatctgcgcgttttttat

SEQ ID NO: 217781 - DNA, 25 bp, Rattus norvegicus
caacacgtatttagcgctcatgggc

SEQ ID NO: 217782 - DNA, 25 bp, Rattus norvegicus
caacacgtattttgcgctcatgggc

SEQ ID NO: 217783 - DNA, 25 bp, Rattus norvegicus
caacactcagttctttaggccccaa

SEQ ID NO: 217784 - DNA, 25 bp, Rattus norvegicus
caacactcagttgtttaggccccaa

SEQ ID NO: 217785 - DNA, 25 bp, Rattus norvegicus
caacactcgggcacttacagaatga

SEQ ID NO: 217786 - DNA, 25 bp, Rattus norvegicus
caacactcgggctcttacagaatga

SEQ ID NO: 217787 - DNA, 25 bp, Rattus norvegicus
caacactgaaggctactgcgtcaac

SEQ ID NO: 217788 - DNA, 25 bp, Rattus norvegicus
caacactgaagggtactgcgtcaac

SEQ ID NO: 217789 - DNA, 25 bp, Rattus norvegicus
caacactggaccactacatacatgt

SEQ ID NO: 217790 - DNA, 25 bp, Rattus norvegicus
caacactggacctctacatacatgt

SEQ ID NO: 217791 - DNA, 25 bp, Rattus norvegicus
caacactggtgccaggctgacgtgt

SEQ ID NO: 217792 - DNA, 25 bp, Rattus norvegicus
caacactggtgcgaggctgacgtgt

SEQ ID NO: 217793 - DNA, 25 bp, Rattus norvegicus
caacactgtgtaaggcctaggcttt

SEQ ID NO: 217794 - DNA, 25 bp, Rattus norvegicus
caacactgtgtatggcctaggcttt

SEQ ID NO: 217795 - DNA, 25 bp, Rattus norvegicus
caacacttggaaccccaggagcgct

SEQ ID NO: 217796 - DNA, 25 bp, Rattus norvegicus
caacacttggaagcccaggagcgct

SEQ ID NO: 217797 - DNA, 25 bp, Rattus norvegicus
caacactttacaagcccaaaccatt

SEQ ID NO: 217798 - DNA, 25 bp, Rattus norvegicus
caacactttacatgcccaaaccatt

SEQ ID NO: 217799 - DNA, 25 bp, Rattus norvegicus
caacagaatcctccttttaatttgc

SEQ ID NO: 217800 - DNA, 25 bp, Rattus norvegicus
caacagaatcctgcttttaatttgc

SEQ ID NO: 217801 - DNA, 25 bp, Rattus norvegicus
caacagaatcgtcgcactagagcca

SEQ ID NO: 217802 - DNA, 25 bp, Rattus norvegicus
caacagaatcgtggcactagagcca

SEQ ID NO: 217803 - DNA, 25 bp, Rattus norvegicus
caacagagatgacctcctgggttct

SEQ ID NO: 217804 - DNA, 25 bp, Rattus norvegicus
caacagagatgagctcctgggttct

SEQ ID NO: 217805 - DNA, 25 bp, Rattus norvegicus
caacagagccgaccacgaccggatg

SEQ ID NO: 217806 - DNA, 25 bp, Rattus norvegicus
caacagagccgagcacgaccggatg

SEQ ID NO: 217807 - DNA, 25 bp, Rattus norvegicus
caacagaggtgtcagcaagcagcat

SEQ ID NO: 217808 - DNA, 25 bp, Rattus norvegicus
caacagaggtgtgagcaagcagcat

SEQ ID NO: 217809 - DNA, 25 bp, Rattus norvegicus
caacagatcataatcagtgtcttga

SEQ ID NO: 217810 - DNA, 25 bp, Rattus norvegicus
caacagatcatattcagtgtcttga

SEQ ID NO: 217811 - DNA, 25 bp, Rattus norvegicus
caacagatggcgcaccaaaggtgat

SEQ ID NO: 217812 - DNA, 25 bp, Rattus norvegicus
caacagatggcggaccaaaggtgat

SEQ ID NO: 217813 - DNA, 25 bp, Rattus norvegicus
caacagcaggccagttttaatcatt

SEQ ID NO: 217814 - DNA, 25 bp, Rattus norvegicus
caacagcaggcctgttttaatcatt

SEQ ID NO: 217815 - DNA, 25 bp, Rattus norvegicus
caacagcagtgactcctacggagcc

SEQ ID NO: 217816 - DNA, 25 bp, Rattus norvegicus
caacagcagtgagtcctacggagcc

SEQ ID NO: 217817 - DNA, 25 bp, Rattus norvegicus
caacagcatcctcttctttggaaga

SEQ ID NO: 217818 - DNA, 25 bp, Rattus norvegicus
caacagcatcctgttctttggaaga

SEQ ID NO: 217819 - DNA, 25 bp, Rattus norvegicus
caacagcatgctctgaactactttt

SEQ ID NO: 217820 - DNA, 25 bp, Rattus norvegicus
caacagcatgctgtgaactactttt

SEQ ID NO: 217821 - DNA, 25 bp, Rattus norvegicus
caacagccaccaagaatgttctcca

SEQ ID NO: 217822 - DNA, 25 bp, Rattus norvegicus
caacagccaccatgaatgttctcca

SEQ ID NO: 217823 - DNA, 25 bp, Rattus norvegicus
caacagcccctaaaattcaaaatag

SEQ ID NO: 217824 - DNA, 25 bp, Rattus norvegicus
caacagcccctataattcaaaatag

SEQ ID NO: 217825 - DNA, 25 bp, Rattus norvegicus
caacagcctctgagggcaggtgagt

SEQ ID NO: 217826 - DNA, 25 bp, Rattus norvegicus
caacagcctctgtgggcaggtgagt

SEQ ID NO: 217827 - DNA, 25 bp, Rattus norvegicus
caacagcctgagaccagggatcaca

SEQ ID NO: 217828 - DNA, 25 bp, Rattus norvegicus
caacagcctgagtccagggatcaca

SEQ ID NO: 217829 - DNA, 25 bp, Rattus norvegicus
caacagccttttctctttgtgaaaa

SEQ ID NO: 217830 - DNA, 25 bp, Rattus norvegicus
caacagccttttgtctttgtgaaaa

SEQ ID NO: 217831 - DNA, 25 bp, Rattus norvegicus
caacagcgacaaccctcttctacat

SEQ ID NO: 217832 - DNA, 25 bp, Rattus norvegicus
caacagcgacaagcctcttctacat

SEQ ID NO: 217833 - DNA, 25 bp, Rattus norvegicus
caacagcgcttcattcatggaggaa

SEQ ID NO: 217834 - DNA, 25 bp, Rattus norvegicus
caacagcgcttctttcatggaggaa

SEQ ID NO: 217835 - DNA, 25 bp, Rattus norvegicus
caacagctagaaagcaagtcctcaa

SEQ ID NO: 217836 - DNA, 25 bp, Rattus norvegicus
caacagctagaatgcaagtcctcaa

SEQ ID NO: 217837 - DNA, 25 bp, Rattus norvegicus
caacagctcaggacatggaaacttc

SEQ ID NO: 217838 - DNA, 25 bp, Rattus norvegicus
caacagctcaggtcatggaaacttc

SEQ ID NO: 217839 - DNA, 25 bp, Rattus norvegicus
caacagctcattcattccttgatca

SEQ ID NO: 217840 - DNA, 25 bp, Rattus norvegicus
caacagctcattgattccttgatca

SEQ ID NO: 217841 - DNA, 25 bp, Rattus norvegicus
caacagctccagatttgccaaacta

SEQ ID NO: 217842 - DNA, 25 bp, Rattus norvegicus
caacagctccagttttgccaaacta

SEQ ID NO: 217843 - DNA, 25 bp, Rattus norvegicus
caacagctgataactgaagtcttca

SEQ ID NO: 217844 - DNA, 25 bp, Rattus norvegicus
caacagctgatatctgaagtcttca

SEQ ID NO: 217845 - DNA, 25 bp, Rattus norvegicus
caacagctgccccaacagatatgct

SEQ ID NO: 217846 - DNA, 25 bp, Rattus norvegicus
caacagctgcccgaacagatatgct

SEQ ID NO: 217847 - DNA, 25 bp, Rattus norvegicus
caacagctggttcgccaaagggctc

SEQ ID NO: 217848 - DNA, 25 bp, Rattus norvegicus
caacagctggttggccaaagggctc

SEQ ID NO: 217849 - DNA, 25 bp, Rattus norvegicus
caacagcttgttccagtttttcata

SEQ ID NO: 217850 - DNA, 25 bp, Rattus norvegicus
caacagcttgttgcagtttttcata

SEQ ID NO: 217851 - DNA, 25 bp, Rattus norvegicus
caacaggaatctcctggagcccagc

SEQ ID NO: 217852 - DNA, 25 bp, Rattus norvegicus
caacaggaatctgctggagcccagc

SEQ ID NO: 217853 - DNA, 25 bp, Rattus norvegicus
caacaggagacgcactgaagccaca

SEQ ID NO: 217854 - DNA, 25 bp, Rattus norvegicus
caacaggagacggactgaagccaca

SEQ ID NO: 217855 - DNA, 25 bp, Rattus norvegicus
caacaggagaggattctgcaacatt

SEQ ID NO: 217856 - DNA, 25 bp, Rattus norvegicus
caacaggagaggtttctgcaacatt

SEQ ID NO: 217857 - DNA, 25 bp, Rattus norvegicus
caacaggattggctggaacatttta

SEQ ID NO: 217858 - DNA, 25 bp, Rattus norvegicus
caacaggattgggtggaacatttta

SEQ ID NO: 217859 - DNA, 25 bp, Rattus norvegicus
caacaggccaggaggtgagttctca

SEQ ID NO: 217860 - DNA, 25 bp, Rattus norvegicus
caacaggccaggtggtgagttctca

SEQ ID NO: 217861 - DNA, 25 bp, Rattus norvegicus
caacaggcctgaactctctgaggag

SEQ ID NO: 217862 - DNA, 25 bp, Rattus norvegicus
caacaggcctgatctctctgaggag

SEQ ID NO: 217863 - DNA, 25 bp, Rattus norvegicus
caacaggctgccataatatattttt

SEQ ID NO: 217864 - DNA, 25 bp, Rattus norvegicus
caacaggctgccttaatatattttt

SEQ ID NO: 217865 - DNA, 25 bp, Rattus norvegicus
caacagggagatatggccaggccat

SEQ ID NO: 217866 - DNA, 25 bp, Rattus norvegicus
caacagggagatttggccaggccat

SEQ ID NO: 217867 - DNA, 25 bp, Rattus norvegicus
caacagggcactactgccctctgag

SEQ ID NO: 217868 - DNA, 25 bp, Rattus norvegicus
caacagggcacttctgccctctgag

SEQ ID NO: 217869 - DNA, 25 bp, Rattus norvegicus
caacagggcagtattcttagaaaca

SEQ ID NO: 217870 - DNA, 25 bp, Rattus norvegicus
caacagggcagttttcttagaaaca

SEQ ID NO: 217871 - DNA, 25 bp, Rattus norvegicus
caacaggtccggatttggaattgga

SEQ ID NO: 217872 - DNA, 25 bp, Rattus norvegicus
caacaggtccggttttggaattgga

SEQ ID NO: 217873 - DNA, 25 bp, Rattus norvegicus
caacaggtctgtcctatttgggtag

SEQ ID NO: 217874 - DNA, 25 bp, Rattus norvegicus
caacaggtctgtgctatttgggtag

SEQ ID NO: 217875 - DNA, 25 bp, Rattus norvegicus
caacagtaactgagtggcctccttt

SEQ ID NO: 217876 - DNA, 25 bp, Rattus norvegicus
caacagtaactgtgtggcctccttt

SEQ ID NO: 217877 - DNA, 25 bp, Rattus norvegicus
caacagtcaagtatcctgtggtcat

SEQ ID NO: 217878 - DNA, 25 bp, Rattus norvegicus
caacagtcaagtttcctgtggtcat

SEQ ID NO: 217879 - DNA, 25 bp, Rattus norvegicus
caacagtctcgccagttttgtaaga

SEQ ID NO: 217880 - DNA, 25 bp, Rattus norvegicus
caacagtctcgcgagttttgtaaga

SEQ ID NO: 217881 - DNA, 25 bp, Rattus norvegicus
caacagtgcctgacagcttaggagt

SEQ ID NO: 217882 - DNA, 25 bp, Rattus norvegicus
caacagtgcctgtcagcttaggagt

SEQ ID NO: 217883 - DNA, 25 bp, Rattus norvegicus
caacagtgctgtcaagggcttctca

SEQ ID NO: 217884 - DNA, 25 bp, Rattus norvegicus
caacagtgctgtgaagggcttctca

SEQ ID NO: 217885 - DNA, 25 bp, Rattus norvegicus
caacagtgtggtaatgacctttatt

SEQ ID NO: 217886 - DNA, 25 bp, Rattus norvegicus
caacagtgtggttatgacctttatt

SEQ ID NO: 217887 - DNA, 25 bp, Rattus norvegicus
caacagttacgcagaatgctatcca

SEQ ID NO: 217888 - DNA, 25 bp, Rattus norvegicus
caacagttacgctgaatgctatcca

SEQ ID NO: 217889 - DNA, 25 bp, Rattus norvegicus
caacagttagagattcctgctcctc

SEQ ID NO: 217890 - DNA, 25 bp, Rattus norvegicus
caacagttagagtttcctgctcctc

SEQ ID NO: 217891 - DNA, 25 bp, Rattus norvegicus
caacagttcccaactgtgctaggaa

SEQ ID NO: 217892 - DNA, 25 bp, Rattus norvegicus
caacagttcccatctgtgctaggaa

SEQ ID NO: 217893 - DNA, 25 bp, Rattus norvegicus
caacagttctccatatgctcatagt

SEQ ID NO: 217894 - DNA, 25 bp, Rattus norvegicus
caacagttctccttatgctcatagt

SEQ ID NO: 217895 - DNA, 25 bp, Rattus norvegicus
caacagttgtatagtaggttatgca

SEQ ID NO: 217896 - DNA, 25 bp, Rattus norvegicus
caacagttgtattgtaggttatgca

SEQ ID NO: 217897 - DNA, 25 bp, Rattus norvegicus
caacatacccctacagaaagcactg

SEQ ID NO: 217898 - DNA, 25 bp, Rattus norvegicus
caacataccccttcagaaagcactg

SEQ ID NO: 217899 - DNA, 25 bp, Rattus norvegicus
caacatagattgacttctcttgcag

SEQ ID NO: 217900 - DNA, 25 bp, Rattus norvegicus
caacatagattgtcttctcttgcag

SEQ ID NO: 217901 - DNA, 25 bp, Rattus norvegicus
caacataggattccctggtccagcc

SEQ ID NO: 217902 - DNA, 25 bp, Rattus norvegicus
caacataggattgcctggtccagcc

SEQ ID NO: 217903 - DNA, 25 bp, Rattus norvegicus
caacatatagggactttgtccctcc

SEQ ID NO: 217904 - DNA, 25 bp, Rattus norvegicus
caacatatagggtctttgtccctcc

SEQ ID NO: 217905 - DNA, 25 bp, Rattus norvegicus
caacatatttggacgctactgagtc

SEQ ID NO: 217906 - DNA, 25 bp, Rattus norvegicus
caacatatttggtcgctactgagtc

SEQ ID NO: 217907 - DNA, 25 bp, Rattus norvegicus
caacatcaagttactggtctgcgca

SEQ ID NO: 217908 - DNA, 25 bp, Rattus norvegicus
caacatcaagtttctggtctgcgca

SEQ ID NO: 217909 - DNA, 25 bp, Rattus norvegicus
caacatcacagtagggtccctggtc

SEQ ID NO: 217910 - DNA, 25 bp, Rattus norvegicus
caacatcacagttgggtccctggtc

SEQ ID NO: 217911 - DNA, 25 bp, Rattus norvegicus
caacatcacgctctctgggaagaag

SEQ ID NO: 217912 - DNA, 25 bp, Rattus norvegicus
caacatcacgctgtctgggaagaag

SEQ ID NO: 217913 - DNA, 25 bp, Rattus norvegicus
caacatcagaggacgtgaaggcact

SEQ ID NO: 217914 - DNA, 25 bp, Rattus norvegicus
caacatcagaggtcgtgaaggcact

SEQ ID NO: 217915 - DNA, 25 bp, Rattus norvegicus
caacatcatcatcatcttactggga

SEQ ID NO: 217916 - DNA, 25 bp, Rattus norvegicus
caacatcatcatgatcttactggga

SEQ ID NO: 217917 - DNA, 25 bp, Rattus norvegicus
caacatcatttcagctcttgtagag

SEQ ID NO: 217918 - DNA, 25 bp, Rattus norvegicus
caacatcatttctgctcttgtagag

SEQ ID NO: 217919 - DNA, 25 bp, Rattus norvegicus
caacatcattttacttcctggcaaa

SEQ ID NO: 217920 - DNA, 25 bp, Rattus norvegicus
caacatcatttttcttcctggcaaa

SEQ ID NO: 217921 - DNA, 25 bp, Rattus norvegicus
caacatccaaaacgcattccctgaa

SEQ ID NO: 217922 - DNA, 25 bp, Rattus norvegicus
caacatccaaaaggcattccctgaa

SEQ ID NO: 217923 - DNA, 25 bp, Rattus norvegicus
caacatccggttaagccgccacgaa

SEQ ID NO: 217924 - DNA, 25 bp, Rattus norvegicus
caacatccggtttagccgccacgaa

SEQ ID NO: 217925 - DNA, 25 bp, Rattus norvegicus
caacatctccgacggcgaagggttt

SEQ ID NO: 217926 - DNA, 25 bp, Rattus norvegicus
caacatctccgagggcgaagggttt

SEQ ID NO: 217927 - DNA, 25 bp, Rattus norvegicus
caacatctcttacccatcgtgtaga

SEQ ID NO: 217928 - DNA, 25 bp, Rattus norvegicus
caacatctcttagccatcgtgtaga

SEQ ID NO: 217929 - DNA, 25 bp, Rattus norvegicus
caacatgaaaccatgggacaccctt

SEQ ID NO: 217930 - DNA, 25 bp, Rattus norvegicus
caacatgaaaccttgggacaccctt

SEQ ID NO: 217931 - DNA, 25 bp, Rattus norvegicus
caacatgaaagacaccaggcctgaa

SEQ ID NO: 217932 - DNA, 25 bp, Rattus norvegicus
caacatgaaagagaccaggcctgaa

SEQ ID NO: 217933 - DNA, 25 bp, Rattus norvegicus
caacatgaagacactgctgcagcag

SEQ ID NO: 217934 - DNA, 25 bp, Rattus norvegicus
caacatgaagactctgctgcagcag

SEQ ID NO: 217935 - DNA, 25 bp, Rattus norvegicus
caacatgacagtccaccagtggtac

SEQ ID NO: 217936 - DNA, 25 bp, Rattus norvegicus
caacatgacagtgcaccagtggtac

SEQ ID NO: 217937 - DNA, 25 bp, Rattus norvegicus
caacatgaggaacacttaagaggga

SEQ ID NO: 217938 - DNA, 25 bp, Rattus norvegicus
caacatgaggaagacttaagaggga

SEQ ID NO: 217939 - DNA, 25 bp, Rattus norvegicus
caacatgaggctcgctcgaggacca

SEQ ID NO: 217940 - DNA, 25 bp, Rattus norvegicus
caacatgaggctggctcgaggacca

SEQ ID NO: 217941 - DNA, 25 bp, Rattus norvegicus
caacatgcacatatattcacagatg

SEQ ID NO: 217942 - DNA, 25 bp, Rattus norvegicus
caacatgcacatttattcacagatg

SEQ ID NO: 217943 - DNA, 25 bp, Rattus norvegicus
caacatgcttgaagtttggcctgat

SEQ ID NO: 217944 - DNA, 25 bp, Rattus norvegicus
caacatgcttgatgtttggcctgat

SEQ ID NO: 217945 - DNA, 25 bp, Rattus norvegicus
caacatgctttgcttttatcattac

SEQ ID NO: 217946 - DNA, 25 bp, Rattus norvegicus
caacatgctttggttttatcattac

SEQ ID NO: 217947 - DNA, 25 bp, Rattus norvegicus
caacatgtacacagagggcccaggt

SEQ ID NO: 217948 - DNA, 25 bp, Rattus norvegicus
caacatgtacactgagggcccaggt

SEQ ID NO: 217949 - DNA, 25 bp, Rattus norvegicus
caacatgtggtgaagtgtgagccga

SEQ ID NO: 217950 - DNA, 25 bp, Rattus norvegicus
caacatgtggtgtagtgtgagccga

SEQ ID NO: 217951 - DNA, 25 bp, Rattus norvegicus
caacatgttgctcgtgggcgtgcat

SEQ ID NO: 217952 - DNA, 25 bp, Rattus norvegicus
caacatgttgctggtgggcgtgcat

SEQ ID NO: 217953 - DNA, 25 bp, Rattus norvegicus
caacattattcaatcctttattagg

SEQ ID NO: 217954 - DNA, 25 bp, Rattus norvegicus
caacattattcattcctttattagg

SEQ ID NO: 217955 - DNA, 25 bp, Rattus norvegicus
caacattatttgcttttgtgtataa

SEQ ID NO: 217956 - DNA, 25 bp, Rattus norvegicus
caacattatttggttttgtgtataa

SEQ ID NO: 217957 - DNA, 25 bp, Rattus norvegicus
caacattcgggcacatcctggatga

SEQ ID NO: 217958 - DNA, 25 bp, Rattus norvegicus
caacattcgggctcatcctggatga

SEQ ID NO: 217959 - DNA, 25 bp, Rattus norvegicus
caacattctgcaaggtctacacact

SEQ ID NO: 217960 - DNA, 25 bp, Rattus norvegicus
caacattctgcatggtctacacact

SEQ ID NO: 217961 - DNA, 25 bp, Rattus norvegicus
caacattcttcccaacttgctaaga

SEQ ID NO: 217962 - DNA, 25 bp, Rattus norvegicus
caacattcttccgaacttgctaaga

SEQ ID NO: 217963 - DNA, 25 bp, Rattus norvegicus
caacattggaggatatttcagttac

SEQ ID NO: 217964 - DNA, 25 bp, Rattus norvegicus
caacattggaggttatttcagttac

SEQ ID NO: 217965 - DNA, 25 bp, Rattus norvegicus
caacattgggtgacatctgcctaca

SEQ ID NO: 217966 - DNA, 25 bp, Rattus norvegicus
caacattgggtgtcatctgcctaca

SEQ ID NO: 217967 - DNA, 25 bp, Rattus norvegicus
caacattgtgtaagtgtgtttcttt

SEQ ID NO: 217968 - DNA, 25 bp, Rattus norvegicus
caacattgtgtatgtgtgtttcttt

SEQ ID NO: 217969 - DNA, 25 bp, Rattus norvegicus
caacatttcattaagcttccacata

SEQ ID NO: 217970 - DNA, 25 bp, Rattus norvegicus
caacatttcatttagcttccacata

SEQ ID NO: 217971 - DNA, 25 bp, Rattus norvegicus
caacatttccgacctccttaaagta

SEQ ID NO: 217972 - DNA, 25 bp, Rattus norvegicus
caacatttccgagctccttaaagta

SEQ ID NO: 217973 - DNA, 25 bp, Rattus norvegicus
caacatttctatattctccttttct

SEQ ID NO: 217974 - DNA, 25 bp, Rattus norvegicus
caacatttctattttctccttttct

SEQ ID NO: 217975 - DNA, 25 bp, Rattus norvegicus
caaccaaaggttacatgcctccatc

SEQ ID NO: 217976 - DNA, 25 bp, Rattus norvegicus
caaccaaaggtttcatgcctccatc

SEQ ID NO: 217977 - DNA, 25 bp, Rattus norvegicus
caaccaaccaatcacttcttgacat

SEQ ID NO: 217978 - DNA, 25 bp, Rattus norvegicus
caaccaaccaatgacttcttgacat

SEQ ID NO: 217979 - DNA, 25 bp, Rattus norvegicus
caaccaactgctactggcttgaaaa

SEQ ID NO: 217980 - DNA, 25 bp, Rattus norvegicus
caaccaactgcttctggcttgaaaa

SEQ ID NO: 217981 - DNA, 25 bp, Rattus norvegicus
caaccaagagctacgggccaagttt

SEQ ID NO: 217982 - DNA, 25 bp, Rattus norvegicus
caaccaagagcttcgggccaagttt

SEQ ID NO: 217983 - DNA, 25 bp, Rattus norvegicus
caaccaatccttacttatagcctta

SEQ ID NO: 217984 - DNA, 25 bp, Rattus norvegicus
caaccaatcctttcttatagcctta

SEQ ID NO: 217985 - DNA, 25 bp, Rattus norvegicus
caaccaatgtctctgctcgaggaat

SEQ ID NO: 217986 - DNA, 25 bp, Rattus norvegicus
caaccaatgtctgtgctcgaggaat

SEQ ID NO: 217987 - DNA, 25 bp, Rattus norvegicus
caaccacatgagcatcacaaacttt

SEQ ID NO: 217988 - DNA, 25 bp, Rattus norvegicus
caaccacatgaggatcacaaacttt

SEQ ID NO: 217989 - DNA, 25 bp, Rattus norvegicus
caaccaccaacccatatatcttttg

SEQ ID NO: 217990 - DNA, 25 bp, Rattus norvegicus
caaccaccaaccgatatatcttttg

SEQ ID NO: 217991 - DNA, 25 bp, Rattus norvegicus
caaccaccacctcaactttggaggg

SEQ ID NO: 217992 - DNA, 25 bp, Rattus norvegicus
caaccaccacctgaactttggaggg

SEQ ID NO: 217993 - DNA, 25 bp, Rattus norvegicus
caaccaccactgaagttccaggata

SEQ ID NO: 217994 - DNA, 25 bp, Rattus norvegicus
caaccaccactgtagttccaggata

SEQ ID NO: 217995 - DNA, 25 bp, Rattus norvegicus
caaccacctgtaatttggtgcacat

SEQ ID NO: 217996 - DNA, 25 bp, Rattus norvegicus
caaccacctgtattttggtgcacat

SEQ ID NO: 217997 - DNA, 25 bp, Rattus norvegicus
caaccacgatcaataacccctttag

SEQ ID NO: 217998 - DNA, 25 bp, Rattus norvegicus
caaccacgatcattaacccctttag

SEQ ID NO: 217999 - DNA, 25 bp, Rattus norvegicus
caaccactggaaagcaggcccggag

SEQ ID NO: 218000 - DNA, 25 bp, Rattus norvegicus
caaccactggaatgcaggcccggag

SEQ ID NO: 218001 - DNA, 25 bp, Rattus norvegicus
caaccacttctaagggtgagtcagt

SEQ ID NO: 218002 - DNA, 25 bp, Rattus norvegicus
caaccacttctatgggtgagtcagt

SEQ ID NO: 218003 - DNA, 25 bp, Rattus norvegicus
caaccagaagctaccgtggtgtcta

SEQ ID NO: 218004 - DNA, 25 bp, Rattus norvegicus
caaccagaagcttccgtggtgtcta

SEQ ID NO: 218005 - DNA, 25 bp, Rattus norvegicus
caaccagagaggacgctgcgaggaa

SEQ ID NO: 218006 - DNA, 25 bp, Rattus norvegicus
caaccagagaggtcgctgcgaggaa

SEQ ID NO: 218007 - DNA, 25 bp, Rattus norvegicus
caaccagagctgcagacctgaggcc

SEQ ID NO: 218008 - DNA, 25 bp, Rattus norvegicus
caaccagagctggagacctgaggcc

SEQ ID NO: 218009 - DNA, 25 bp, Rattus norvegicus
caaccagaggctcctggcggagtca

SEQ ID NO: 218010 - DNA, 25 bp, Rattus norvegicus
caaccagaggctgctggcggagtca

SEQ ID NO: 218011 - DNA, 25 bp, Rattus norvegicus
caaccagatcttctttgtctttcaa

SEQ ID NO: 218012 - DNA, 25 bp, Rattus norvegicus
caaccagatcttgtttgtctttcaa

SEQ ID NO: 218013 - DNA, 25 bp, Rattus norvegicus
caaccagatggtcttcaagactgaa

SEQ ID NO: 218014 - DNA, 25 bp, Rattus norvegicus
caaccagatggtgttcaagactgaa

SEQ ID NO: 218015 - DNA, 25 bp, Rattus norvegicus
caaccagcatgtactcttttaactc

SEQ ID NO: 218016 - DNA, 25 bp, Rattus norvegicus
caaccagcatgttctcttttaactc

SEQ ID NO: 218017 - DNA, 25 bp, Rattus norvegicus
caaccagccatgacgaggaccagtt

SEQ ID NO: 218018 - DNA, 25 bp, Rattus norvegicus
caaccagccatgtcgaggaccagtt

SEQ ID NO: 218019 - DNA, 25 bp, Rattus norvegicus
caaccaggaacgaggcagaggctct

SEQ ID NO: 218020 - DNA, 25 bp, Rattus norvegicus
caaccaggaacgtggcagaggctct

SEQ ID NO: 218021 - DNA, 25 bp, Rattus norvegicus
caaccaggagttagcgcagtccaaa

SEQ ID NO: 218022 - DNA, 25 bp, Rattus norvegicus
caaccaggagtttgcgcagtccaaa

SEQ ID NO: 218023 - DNA, 25 bp, Rattus norvegicus
caaccaggcggtcatccaggacagt

SEQ ID NO: 218024 - DNA, 25 bp, Rattus norvegicus
caaccaggcggtgatccaggacagt

SEQ ID NO: 218025 - DNA, 25 bp, Rattus norvegicus
caaccaggtgcgatctggcttggat

SEQ ID NO: 218026 - DNA, 25 bp, Rattus norvegicus
caaccaggtgcgttctggcttggat

SEQ ID NO: 218027 - DNA, 25 bp, Rattus norvegicus
caaccaggttgtacagctcgagagg

SEQ ID NO: 218028 - DNA, 25 bp, Rattus norvegicus
caaccaggttgttcagctcgagagg

SEQ ID NO: 218029 - DNA, 25 bp, Rattus norvegicus
caaccagtcagacccctcagggttt

SEQ ID NO: 218030 - DNA, 25 bp, Rattus norvegicus
caaccagtcagagccctcagggttt

SEQ ID NO: 218031 - DNA, 25 bp, Rattus norvegicus
caaccagtgagtcatgtcctcatca

SEQ ID NO: 218032 - DNA, 25 bp, Rattus norvegicus
caaccagtgagtgatgtcctcatca

SEQ ID NO: 218033 - DNA, 25 bp, Rattus norvegicus
caaccagtgcgtcccagaccgagag

SEQ ID NO: 218034 - DNA, 25 bp, Rattus norvegicus
caaccagtgcgtgccagaccgagag

SEQ ID NO: 218035 - DNA, 25 bp, Rattus norvegicus
caaccagtgggaagggtcagcccat

SEQ ID NO: 218036 - DNA, 25 bp, Rattus norvegicus
caaccagtgggatgggtcagcccat

SEQ ID NO: 218037 - DNA, 25 bp, Rattus norvegicus
caaccagtgtgaagaaacccaggat

SEQ ID NO: 218038 - DNA, 25 bp, Rattus norvegicus
caaccagtgtgatgaaacccaggat

SEQ ID NO: 218039 - DNA, 25 bp, Rattus norvegicus
caaccagttcggcaggcaggagcca

SEQ ID NO: 218040 - DNA, 25 bp, Rattus norvegicus
caaccagttcgggaggcaggagcca

SEQ ID NO: 218041 - DNA, 25 bp, Rattus norvegicus
caaccatcttctcccggattttgga

SEQ ID NO: 218042 - DNA, 25 bp, Rattus norvegicus
caaccatcttctgccggattttgga

SEQ ID NO: 218043 - DNA, 25 bp, Rattus norvegicus
caaccatgcagacatcttgcttata

SEQ ID NO: 218044 - DNA, 25 bp, Rattus norvegicus
caaccatgcagagatcttgcttata

SEQ ID NO: 218045 - DNA, 25 bp, Rattus norvegicus
caaccatgcggaccagtgggaccga

SEQ ID NO: 218046 - DNA, 25 bp, Rattus norvegicus
caaccatgcggagcagtgggaccga

SEQ ID NO: 218047 - DNA, 25 bp, Rattus norvegicus
caaccatgcgttcgcgatgaacagc

SEQ ID NO: 218048 - DNA, 25 bp, Rattus norvegicus
caaccatgcgttggcgatgaacagc

SEQ ID NO: 218049 - DNA, 25 bp, Rattus norvegicus
caaccattgcccctgtattcattca

SEQ ID NO: 218050 - DNA, 25 bp, Rattus norvegicus
caaccattgcccgtgtattcattca

SEQ ID NO: 218051 - DNA, 25 bp, Rattus norvegicus
caaccattttggctactgtttcctc

SEQ ID NO: 218052 - DNA, 25 bp, Rattus norvegicus
caaccattttgggtactgtttcctc

SEQ ID NO: 218053 - DNA, 25 bp, Rattus norvegicus
caaccattttgtacgcgcccttggg

SEQ ID NO: 218054 - DNA, 25 bp, Rattus norvegicus
caaccattttgttcgcgcccttggg

SEQ ID NO: 218055 - DNA, 25 bp, Rattus norvegicus
caacccaaataaagcactgtctctc

SEQ ID NO: 218056 - DNA, 25 bp, Rattus norvegicus
caacccaaataatgcactgtctctc

SEQ ID NO: 218057 - DNA, 25 bp, Rattus norvegicus
caacccaaatctaaaccttgcagac

SEQ ID NO: 218058 - DNA, 25 bp, Rattus norvegicus
caacccaaatcttaaccttgcagac

SEQ ID NO: 218059 - DNA, 25 bp, Rattus norvegicus
caacccaacctcaaaggcaagctat

SEQ ID NO: 218060 - DNA, 25 bp, Rattus norvegicus
caacccaacctctaaggcaagctat

SEQ ID NO: 218061 - DNA, 25 bp, Rattus norvegicus
caacccaatccaccttccagggcta

SEQ ID NO: 218062 - DNA, 25 bp, Rattus norvegicus
caacccaatccagcttccagggcta

SEQ ID NO: 218063 - DNA, 25 bp, Rattus norvegicus
caacccaatggcaggtgactttatt

SEQ ID NO: 218064 - DNA, 25 bp, Rattus norvegicus
caacccaatggctggtgactttatt

SEQ ID NO: 218065 - DNA, 25 bp, Rattus norvegicus
caacccaccattccgtgttaatatt

SEQ ID NO: 218066 - DNA, 25 bp, Rattus norvegicus
caacccaccattgcgtgttaatatt

SEQ ID NO: 218067 - DNA, 25 bp, Rattus norvegicus
caacccactgccaggagctatgcgg

SEQ ID NO: 218068 - DNA, 25 bp, Rattus norvegicus
caacccactgcctggagctatgcgg

SEQ ID NO: 218069 - DNA, 25 bp, Rattus norvegicus
caacccacttccctgaatcagaaat

SEQ ID NO: 218070 - DNA, 25 bp, Rattus norvegicus
caacccacttccgtgaatcagaaat

SEQ ID NO: 218071 - DNA, 25 bp, Rattus norvegicus
caacccagaggaccgtgcggagacc

SEQ ID NO: 218072 - DNA, 25 bp, Rattus norvegicus
caacccagaggagcgtgcggagacc

SEQ ID NO: 218073 - DNA, 25 bp, Rattus norvegicus
caacccagatgtccctcaactgaag

SEQ ID NO: 218074 - DNA, 25 bp, Rattus norvegicus
caacccagatgtgcctcaactgaag

SEQ ID NO: 218075 - DNA, 25 bp, Rattus norvegicus
caacccagctatccaggacgaagtt

SEQ ID NO: 218076 - DNA, 25 bp, Rattus norvegicus
caacccagctatgcaggacgaagtt

SEQ ID NO: 218077 - DNA, 25 bp, Rattus norvegicus
caacccaggtaacttgcgctgtgta

SEQ ID NO: 218078 - DNA, 25 bp, Rattus norvegicus
caacccaggtaagttgcgctgtgta

SEQ ID NO: 218079 - DNA, 25 bp, Rattus norvegicus
caacccagtgttcgctgtgcagatt

SEQ ID NO: 218080 - DNA, 25 bp, Rattus norvegicus
caacccagtgttggctgtgcagatt

SEQ ID NO: 218081 - DNA, 25 bp, Rattus norvegicus
caacccagttgcatacctatggcct

SEQ ID NO: 218082 - DNA, 25 bp, Rattus norvegicus
caacccagttgcttacctatggcct

SEQ ID NO: 218083 - DNA, 25 bp, Rattus norvegicus
caacccatgaacagccaagttacct

SEQ ID NO: 218084 - DNA, 25 bp, Rattus norvegicus
caacccatgaactgccaagttacct

SEQ ID NO: 218085 - DNA, 25 bp, Rattus norvegicus
caacccattatgaacctgcttatct

SEQ ID NO: 218086 - DNA, 25 bp, Rattus norvegicus
caacccattatgtacctgcttatct

SEQ ID NO: 218087 - DNA, 25 bp, Rattus norvegicus
caaccccaattgagacgagctagcg

SEQ ID NO: 218088 - DNA, 25 bp, Rattus norvegicus
caaccccaattgtgacgagctagcg

SEQ ID NO: 218089 - DNA, 25 bp, Rattus norvegicus
caaccccacagcatctaactaatgt

SEQ ID NO: 218090 - DNA, 25 bp, Rattus norvegicus
caaccccacagcttctaactaatgt

SEQ ID NO: 218091 - DNA, 25 bp, Rattus norvegicus
caaccccacgttagaacctgacagt

SEQ ID NO: 218092 - DNA, 25 bp, Rattus norvegicus
caaccccacgtttgaacctgacagt

SEQ ID NO: 218093 - DNA, 25 bp, Rattus norvegicus
caaccccagcgacatcttgagatct

SEQ ID NO: 218094 - DNA, 25 bp, Rattus norvegicus
caaccccagcgagatcttgagatct

SEQ ID NO: 218095 - DNA, 25 bp, Rattus norvegicus
caaccccagctaaactgagtcttgg

SEQ ID NO: 218096 - DNA, 25 bp, Rattus norvegicus
caaccccagctatactgagtcttgg

SEQ ID NO: 218097 - DNA, 25 bp, Rattus norvegicus
caaccccaggccacagagaaagaag

SEQ ID NO: 218098 - DNA, 25 bp, Rattus norvegicus
caaccccaggcctcagagaaagaag

SEQ ID NO: 218099 - DNA, 25 bp, Rattus norvegicus
caaccccatgcactgtcagtaacaa

SEQ ID NO: 218100 - DNA, 25 bp, Rattus norvegicus
caaccccatgcagtgtcagtaacaa

SEQ ID NO: 218101 - DNA, 25 bp, Rattus norvegicus
caaccccatggcatttacttgtgaa

SEQ ID NO: 218102 - DNA, 25 bp, Rattus norvegicus
caaccccatggcttttacttgtgaa

SEQ ID NO: 218103 - DNA, 25 bp, Rattus norvegicus
caaccccgatttaccaaactagcag

SEQ ID NO: 218104 - DNA, 25 bp, Rattus norvegicus
caaccccgattttccaaactagcag

SEQ ID NO: 218105 - DNA, 25 bp, Rattus norvegicus
caaccccgtagcattaacagagtga

SEQ ID NO: 218106 - DNA, 25 bp, Rattus norvegicus
caaccccgtagctttaacagagtga

SEQ ID NO: 218107 - DNA, 25 bp, Rattus norvegicus
caacccctaactatttcacttctat

SEQ ID NO: 218108 - DNA, 25 bp, Rattus norvegicus
caacccctaactttttcacttctat

SEQ ID NO: 218109 - DNA, 25 bp, Rattus norvegicus
caacccctagagcagacactcttaa

SEQ ID NO: 218110 - DNA, 25 bp, Rattus norvegicus
caacccctagaggagacactcttaa

SEQ ID NO: 218111 - DNA, 25 bp, Rattus norvegicus
caacccctgatgcatctcttgagtt

SEQ ID NO: 218112 - DNA, 25 bp, Rattus norvegicus
caacccctgatggatctcttgagtt

SEQ ID NO: 218113 - DNA, 25 bp, Rattus norvegicus
caacccctgattatagttaccaatg

SEQ ID NO: 218114 - DNA, 25 bp, Rattus norvegicus
caacccctgattttagttaccaatg

SEQ ID NO: 218115 - DNA, 25 bp, Rattus norvegicus
caacccctgctaaggaactccagtt

SEQ ID NO: 218116 - DNA, 25 bp, Rattus norvegicus
caacccctgctatggaactccagtt

SEQ ID NO: 218117 - DNA, 25 bp, Rattus norvegicus
caaccccttcctactgaggaggtgg

SEQ ID NO: 218118 - DNA, 25 bp, Rattus norvegicus
caaccccttccttctgaggaggtgg

SEQ ID NO: 218119 - DNA, 25 bp, Rattus norvegicus
caaccccttctcaatttctgggtgt

SEQ ID NO: 218120 - DNA, 25 bp, Rattus norvegicus
caaccccttctctatttctgggtgt

SEQ ID NO: 218121 - DNA, 25 bp, Rattus norvegicus
caacccgaaatgagtaccgcatcat

SEQ ID NO: 218122 - DNA, 25 bp, Rattus norvegicus
caacccgaaatgtgtaccgcatcat

SEQ ID NO: 218123 - DNA, 25 bp, Rattus norvegicus
caacccgaagctctgttagcgctgc

SEQ ID NO: 218124 - DNA, 25 bp, Rattus norvegicus
caacccgaagctgtgttagcgctgc

SEQ ID NO: 218125 - DNA, 25 bp, Rattus norvegicus
caacccgggacactattcaaagaat

SEQ ID NO: 218126 - DNA, 25 bp, Rattus norvegicus
caacccgggacagtattcaaagaat

SEQ ID NO: 218127 - DNA, 25 bp, Rattus norvegicus
caacccgggatgacaaaatggcctt

SEQ ID NO: 218128 - DNA, 25 bp, Rattus norvegicus
caacccgggatgtcaaaatggcctt

SEQ ID NO: 218129 - DNA, 25 bp, Rattus norvegicus
caacccggtcagattcaggataagt

SEQ ID NO: 218130 - DNA, 25 bp, Rattus norvegicus
caacccggtcagtttcaggataagt

SEQ ID NO: 218131 - DNA, 25 bp, Rattus norvegicus
caacccgtttgcacagtagctgtaa

SEQ ID NO: 218132 - DNA, 25 bp, Rattus norvegicus
caacccgtttgctcagtagctgtaa

SEQ ID NO: 218133 - DNA, 25 bp, Rattus norvegicus
caaccctaacctccattctagagaa

SEQ ID NO: 218134 - DNA, 25 bp, Rattus norvegicus
caaccctaacctgcattctagagaa

SEQ ID NO: 218135 - DNA, 25 bp, Rattus norvegicus
caaccctaaggccattccgattttg

SEQ ID NO: 218136 - DNA, 25 bp, Rattus norvegicus
caaccctaaggcgattccgattttg

SEQ ID NO: 218137 - DNA, 25 bp, Rattus norvegicus
caaccctcaggccatatggtggata

SEQ ID NO: 218138 - DNA, 25 bp, Rattus norvegicus
caaccctcaggcgatatggtggata

SEQ ID NO: 218139 - DNA, 25 bp, Rattus norvegicus
caaccctcattcagatacttggact

SEQ ID NO: 218140 - DNA, 25 bp, Rattus norvegicus
caaccctcattctgatacttggact

SEQ ID NO: 218141 - DNA, 25 bp, Rattus norvegicus
caaccctcgaggatacctatttcta

SEQ ID NO: 218142 - DNA, 25 bp, Rattus norvegicus
caaccctcgaggttacctatttcta

SEQ ID NO: 218143 - DNA, 25 bp, Rattus norvegicus
caaccctctcagaggtcattggaat

SEQ ID NO: 218144 - DNA, 25 bp, Rattus norvegicus
caaccctctcagtggtcattggaat

SEQ ID NO: 218145 - DNA, 25 bp, Rattus norvegicus
caaccctctgcgaagatggaatgaa

SEQ ID NO: 218146 - DNA, 25 bp, Rattus norvegicus
caaccctctgcgtagatggaatgaa

SEQ ID NO: 218147 - DNA, 25 bp, Rattus norvegicus
caaccctgcctgacttaagatctaa

SEQ ID NO: 218148 - DNA, 25 bp, Rattus norvegicus
caaccctgcctgtcttaagatctaa

SEQ ID NO: 218149 - DNA, 25 bp, Rattus norvegicus
caaccctgctgtcgagaaggcctgg

SEQ ID NO: 218150 - DNA, 25 bp, Rattus norvegicus
caaccctgctgtggagaaggcctgg

SEQ ID NO: 218151 - DNA, 25 bp, Rattus norvegicus
caaccctgggacatttgcctggatg

SEQ ID NO: 218152 - DNA, 25 bp, Rattus norvegicus
caaccctgggacttttgcctggatg

SEQ ID NO: 218153 - DNA, 25 bp, Rattus norvegicus
caaccctgggagaaggcaaactact

SEQ ID NO: 218154 - DNA, 25 bp, Rattus norvegicus
caaccctgggagtaggcaaactact

SEQ ID NO: 218155 - DNA, 25 bp, Rattus norvegicus
caaccctggtgtatgaggtggaact

SEQ ID NO: 218156 - DNA, 25 bp, Rattus norvegicus
caaccctggtgtttgaggtggaact

SEQ ID NO: 218157 - DNA, 25 bp, Rattus norvegicus
caaccctgtgttcatcactgcggta

SEQ ID NO: 218158 - DNA, 25 bp, Rattus norvegicus
caaccctgtgttgatcactgcggta

SEQ ID NO: 218159 - DNA, 25 bp, Rattus norvegicus
caacccttaaagctaaatgcgttgt

SEQ ID NO: 218160 - DNA, 25 bp, Rattus norvegicus
caacccttaaaggtaaatgcgttgt

SEQ ID NO: 218161 - DNA, 25 bp, Rattus norvegicus
caacccttccgaatagtctatcagt

SEQ ID NO: 218162 - DNA, 25 bp, Rattus norvegicus
caacccttccgattagtctatcagt

SEQ ID NO: 218163 - DNA, 25 bp, Rattus norvegicus
caacccttctttaatggctctttct

SEQ ID NO: 218164 - DNA, 25 bp, Rattus norvegicus
caacccttcttttatggctctttct

SEQ ID NO: 218165 - DNA, 25 bp, Rattus norvegicus
caaccgaaacagacttgcaccattt

SEQ ID NO: 218166 - DNA, 25 bp, Rattus norvegicus
caaccgaaacagtcttgcaccattt

SEQ ID NO: 218167 - DNA, 25 bp, Rattus norvegicus
caaccgaaacccaggagcagcagtg

SEQ ID NO: 218168 - DNA, 25 bp, Rattus norvegicus
caaccgaaaccctggagcagcagtg

SEQ ID NO: 218169 - DNA, 25 bp, Rattus norvegicus
caaccgaagaccatccatgaggcga

SEQ ID NO: 218170 - DNA, 25 bp, Rattus norvegicus
caaccgaagaccttccatgaggcga

SEQ ID NO: 218171 - DNA, 25 bp, Rattus norvegicus
caaccgacctatacacaaacacttt

SEQ ID NO: 218172 - DNA, 25 bp, Rattus norvegicus
caaccgacctattcacaaacacttt

SEQ ID NO: 218173 - DNA, 25 bp, Rattus norvegicus
caaccgagaacacctctgatatttg

SEQ ID NO: 218174 - DNA, 25 bp, Rattus norvegicus
caaccgagaacagctctgatatttg

SEQ ID NO: 218175 - DNA, 25 bp, Rattus norvegicus
caaccgaggcagattccatgagagc

SEQ ID NO: 218176 - DNA, 25 bp, Rattus norvegicus
caaccgaggcagtttccatgagagc

SEQ ID NO: 218177 - DNA, 25 bp, Rattus norvegicus
caaccgatacttctctccaaatttt

SEQ ID NO: 218178 - DNA, 25 bp, Rattus norvegicus
caaccgatacttgtctccaaatttt

SEQ ID NO: 218179 - DNA, 25 bp, Rattus norvegicus
caaccgatctacaaagggactacga

SEQ ID NO: 218180 - DNA, 25 bp, Rattus norvegicus
caaccgatctactaagggactacga

SEQ ID NO: 218181 - DNA, 25 bp, Rattus norvegicus
caaccgccaggaacgggcaccatgg

SEQ ID NO: 218182 - DNA, 25 bp, Rattus norvegicus
caaccgccaggatcgggcaccatgg

SEQ ID NO: 218183 - DNA, 25 bp, Rattus norvegicus
caaccgctgcggcttacagcaaaaa

SEQ ID NO: 218184 - DNA, 25 bp, Rattus norvegicus
caaccgctgcgggttacagcaaaaa

SEQ ID NO: 218185 - DNA, 25 bp, Rattus norvegicus
caaccgctgctgactttattttaaa

SEQ ID NO: 218186 - DNA, 25 bp, Rattus norvegicus
caaccgctgctgtctttattttaaa

SEQ ID NO: 218187 - DNA, 25 bp, Rattus norvegicus
caaccggattcgcagtggcatgttc

SEQ ID NO: 218188 - DNA, 25 bp, Rattus norvegicus
caaccggattcggagtggcatgttc

SEQ ID NO: 218189 - DNA, 25 bp, Rattus norvegicus
caaccgggactgcttcttccgcggg

SEQ ID NO: 218190 - DNA, 25 bp, Rattus norvegicus
caaccgggactggttcttccgcggg

SEQ ID NO: 218191 - DNA, 25 bp, Rattus norvegicus
caaccgggagatcctgcatcgcggc

SEQ ID NO: 218192 - DNA, 25 bp, Rattus norvegicus
caaccgggagatgctgcatcgcggc

SEQ ID NO: 218193 - DNA, 25 bp, Rattus norvegicus
caaccgggatttagccattgggaag

SEQ ID NO: 218194 - DNA, 25 bp, Rattus norvegicus
caaccgggattttgccattgggaag

SEQ ID NO: 218195 - DNA, 25 bp, Rattus norvegicus
caaccggtccataagcccagaagct

SEQ ID NO: 218196 - DNA, 25 bp, Rattus norvegicus
caaccggtccattagcccagaagct

SEQ ID NO: 218197 - DNA, 25 bp, Rattus norvegicus
caaccggtttttcatggccagtgag

SEQ ID NO: 218198 - DNA, 25 bp, Rattus norvegicus
caaccggtttttgatggccagtgag

SEQ ID NO: 218199 - DNA, 25 bp, Rattus norvegicus
caaccgtaacacaggcattgcaaat

SEQ ID NO: 218200 - DNA, 25 bp, Rattus norvegicus
caaccgtaacactggcattgcaaat

SEQ ID NO: 218201 - DNA, 25 bp, Rattus norvegicus
caaccgtccagactctacagtgaga

SEQ ID NO: 218202 - DNA, 25 bp, Rattus norvegicus
caaccgtccagagtctacagtgaga

SEQ ID NO: 218203 - DNA, 25 bp, Rattus norvegicus
caaccgtctaagactcatttcgtat

SEQ ID NO: 218204 - DNA, 25 bp, Rattus norvegicus
caaccgtctaagtctcatttcgtat

SEQ ID NO: 218205 - DNA, 25 bp, Rattus norvegicus
caaccgtgcatcagtgtgcttgatt

SEQ ID NO: 218206 - DNA, 25 bp, Rattus norvegicus
caaccgtgcatctgtgtgcttgatt

SEQ ID NO: 218207 - DNA, 25 bp, Rattus norvegicus
caaccgtgtagaagagtctcttgat

SEQ ID NO: 218208 - DNA, 25 bp, Rattus norvegicus
caaccgtgtagatgagtctcttgat

SEQ ID NO: 218209 - DNA, 25 bp, Rattus norvegicus
caaccgtgtctgagtctggtgacaa

SEQ ID NO: 218210 - DNA, 25 bp, Rattus norvegicus
caaccgtgtctgtgtctggtgacaa

SEQ ID NO: 218211 - DNA, 25 bp, Rattus norvegicus
caaccgttaattcgctcaggacctt

SEQ ID NO: 218212 - DNA, 25 bp, Rattus norvegicus
caaccgttaattggctcaggacctt

SEQ ID NO: 218213 - DNA, 25 bp, Rattus norvegicus
caaccgttacctcgacgtggtcaat

SEQ ID NO: 218214 - DNA, 25 bp, Rattus norvegicus
caaccgttacctggacgtggtcaat

SEQ ID NO: 218215 - DNA, 25 bp, Rattus norvegicus
caacctaaaggcctctgtggtgttt

SEQ ID NO: 218216 - DNA, 25 bp, Rattus norvegicus
caacctaaaggcgtctgtggtgttt

SEQ ID NO: 218217 - DNA, 25 bp, Rattus norvegicus
caacctaattttcccagttccattt

SEQ ID NO: 218218 - DNA, 25 bp, Rattus norvegicus
caacctaattttgccagttccattt

SEQ ID NO: 218219 - DNA, 25 bp, Rattus norvegicus
caacctacctgacctctatctggat

SEQ ID NO: 218220 - DNA, 25 bp, Rattus norvegicus
caacctacctgagctctatctggat

SEQ ID NO: 218221 - DNA, 25 bp, Rattus norvegicus
caacctactgacctacctaagtgag

SEQ ID NO: 218222 - DNA, 25 bp, Rattus norvegicus
caacctactgacgtacctaagtgag

SEQ ID NO: 218223 - DNA, 25 bp, Rattus norvegicus
caacctagagatccacctgggcaca

SEQ ID NO: 218224 - DNA, 25 bp, Rattus norvegicus
caacctagagatgcacctgggcaca

SEQ ID NO: 218225 - DNA, 25 bp, Rattus norvegicus
caacctatgcttatgctggattttg

SEQ ID NO: 218226 - DNA, 25 bp, Rattus norvegicus
caacctatgcttttgctggattttg

SEQ ID NO: 218227 - DNA, 25 bp, Rattus norvegicus
caacctcaccatcctgattggtaaa

SEQ ID NO: 218228 - DNA, 25 bp, Rattus norvegicus
caacctcaccatgctgattggtaaa

SEQ ID NO: 218229 - DNA, 25 bp, Rattus norvegicus
caacctcagaacctgactgtcttgg

SEQ ID NO: 218230 - DNA, 25 bp, Rattus norvegicus
caacctcagaacgtgactgtcttgg

SEQ ID NO: 218231 - DNA, 25 bp, Rattus norvegicus
caacctcattccagagctgtgttaa

SEQ ID NO: 218232 - DNA, 25 bp, Rattus norvegicus
caacctcattcctgagctgtgttaa

SEQ ID NO: 218233 - DNA, 25 bp, Rattus norvegicus
caacctcccagtccttgtgagggaa

SEQ ID NO: 218234 - DNA, 25 bp, Rattus norvegicus
caacctcccagtgcttgtgagggaa

SEQ ID NO: 218235 - DNA, 25 bp, Rattus norvegicus
caacctctagttcccactagactgt

SEQ ID NO: 218236 - DNA, 25 bp, Rattus norvegicus
caacctctagttgccactagactgt

SEQ ID NO: 218237 - DNA, 25 bp, Rattus norvegicus
caacctctattaagggcagaaccca

SEQ ID NO: 218238 - DNA, 25 bp, Rattus norvegicus
caacctctattatgggcagaaccca

SEQ ID NO: 218239 - DNA, 25 bp, Rattus norvegicus
caacctctcataacctactgtaaga

SEQ ID NO: 218240 - DNA, 25 bp, Rattus norvegicus
caacctctcatatcctactgtaaga

SEQ ID NO: 218241 - DNA, 25 bp, Rattus norvegicus
caacctctcatgagcacttggaata

SEQ ID NO: 218242 - DNA, 25 bp, Rattus norvegicus
caacctctcatgtgcacttggaata

SEQ ID NO: 218243 - DNA, 25 bp, Rattus norvegicus
caacctctcgaacctatgggtcagg

SEQ ID NO: 218244 - DNA, 25 bp, Rattus norvegicus
caacctctcgaagctatgggtcagg

SEQ ID NO: 218245 - DNA, 25 bp, Rattus norvegicus
caacctctgcagcaaatgactactg

SEQ ID NO: 218246 - DNA, 25 bp, Rattus norvegicus
caacctctgcaggaaatgactactg

SEQ ID NO: 218247 - DNA, 25 bp, Rattus norvegicus
caacctctgcgaattttcttatgaa

SEQ ID NO: 218248 - DNA, 25 bp, Rattus norvegicus
caacctctgcgatttttcttatgaa

SEQ ID NO: 218249 - DNA, 25 bp, Rattus norvegicus
caacctctgcggatcatgactgaga

SEQ ID NO: 218250 - DNA, 25 bp, Rattus norvegicus
caacctctgcggttcatgactgaga

SEQ ID NO: 218251 - DNA, 25 bp, Rattus norvegicus
caacctctgggccagagttggtcct

SEQ ID NO: 218252 - DNA, 25 bp, Rattus norvegicus
caacctctgggcgagagttggtcct

SEQ ID NO: 218253 - DNA, 25 bp, Rattus norvegicus
caacctcttacgagcgcctttctgc

SEQ ID NO: 218254 - DNA, 25 bp, Rattus norvegicus
caacctcttacgtgcgcctttctgc

SEQ ID NO: 218255 - DNA, 25 bp, Rattus norvegicus
caacctcttcctatatcctgggatt

SEQ ID NO: 218256 - DNA, 25 bp, Rattus norvegicus
caacctcttcctttatcctgggatt

SEQ ID NO: 218257 - DNA, 25 bp, Rattus norvegicus
caacctcttgctatttatgactttt

SEQ ID NO: 218258 - DNA, 25 bp, Rattus norvegicus
caacctcttgctttttatgactttt

SEQ ID NO: 218259 - DNA, 25 bp, Rattus norvegicus
caacctgaacttatgaaacgtgcaa

SEQ ID NO: 218260 - DNA, 25 bp, Rattus norvegicus
caacctgaacttttgaaacgtgcaa

SEQ ID NO: 218261 - DNA, 25 bp, Rattus norvegicus
caacctgaagctatgtgcttaacat

SEQ ID NO: 218262 - DNA, 25 bp, Rattus norvegicus
caacctgaagctttgtgcttaacat

SEQ ID NO: 218263 - DNA, 25 bp, Rattus norvegicus
caacctgagtgccttctttagacca

SEQ ID NO: 218264 - DNA, 25 bp, Rattus norvegicus
caacctgagtgcgttctttagacca

SEQ ID NO: 218265 - DNA, 25 bp, Rattus norvegicus
caacctgcagtgaaccatgctggaa

SEQ ID NO: 218266 - DNA, 25 bp, Rattus norvegicus
caacctgcagtgtaccatgctggaa

SEQ ID NO: 218267 - DNA, 25 bp, Rattus norvegicus
caacctgcggtaatgcttggagtac

SEQ ID NO: 218268 - DNA, 25 bp, Rattus norvegicus
caacctgcggtattgcttggagtac

SEQ ID NO: 218269 - DNA, 25 bp, Rattus norvegicus
caacctgctactaatcacggagaag

SEQ ID NO: 218270 - DNA, 25 bp, Rattus norvegicus
caacctgctacttatcacggagaag

SEQ ID NO: 218271 - DNA, 25 bp, Rattus norvegicus
caacctggacgacaactgcgggctc

SEQ ID NO: 218272 - DNA, 25 bp, Rattus norvegicus
caacctggacgagaactgcgggctc

SEQ ID NO: 218273 - DNA, 25 bp, Rattus norvegicus
caacctggactaatctctggacaat

SEQ ID NO: 218274 - DNA, 25 bp, Rattus norvegicus
caacctggactattctctggacaat

SEQ ID NO: 218275 - DNA, 25 bp, Rattus norvegicus
caacctggaggtatcatttggacct

SEQ ID NO: 218276 - DNA, 25 bp, Rattus norvegicus
caacctggaggtttcatttggacct

SEQ ID NO: 218277 - DNA, 25 bp, Rattus norvegicus
caacctggatgacgatcggctccgg

SEQ ID NO: 218278 - DNA, 25 bp, Rattus norvegicus
caacctggatgaggatcggctccgg

SEQ ID NO: 218279 - DNA, 25 bp, Rattus norvegicus
caacctggcagaagtctggcgggtt

SEQ ID NO: 218280 - DNA, 25 bp, Rattus norvegicus
caacctggcagatgtctggcgggtt

SEQ ID NO: 218281 - DNA, 25 bp, Rattus norvegicus
caacctggctcaccgaggcggagat

SEQ ID NO: 218282 - DNA, 25 bp, Rattus norvegicus
caacctggctcagcgaggcggagat

SEQ ID NO: 218283 - DNA, 25 bp, Rattus norvegicus
caacctggctttactcatgattggt

SEQ ID NO: 218284 - DNA, 25 bp, Rattus norvegicus
caacctggcttttctcatgattggt

SEQ ID NO: 218285 - DNA, 25 bp, Rattus norvegicus
caacctgggagacagatcgtgactc

SEQ ID NO: 218286 - DNA, 25 bp, Rattus norvegicus
caacctgggagagagatcgtgactc

SEQ ID NO: 218287 - DNA, 25 bp, Rattus norvegicus
caacctggttagaagacgcccgtca

SEQ ID NO: 218288 - DNA, 25 bp, Rattus norvegicus
caacctggttagtagacgcccgtca

SEQ ID NO: 218289 - DNA, 25 bp, Rattus norvegicus
caacctggttttaagactgctgtat

SEQ ID NO: 218290 - DNA, 25 bp, Rattus norvegicus
caacctggtttttagactgctgtat

SEQ ID NO: 218291 - DNA, 25 bp, Rattus norvegicus
caacctgtacggctcgctgaaggag

SEQ ID NO: 218292 - DNA, 25 bp, Rattus norvegicus
caacctgtacgggtcgctgaaggag

SEQ ID NO: 218293 - DNA, 25 bp, Rattus norvegicus
caacctgtgcatatttgtgtgttta

SEQ ID NO: 218294 - DNA, 25 bp, Rattus norvegicus
caacctgtgcatcaccacagcaatg

SEQ ID NO: 218295 - DNA, 25 bp, Rattus norvegicus
caacctgtgcatgaccacagcaatg

SEQ ID NO: 218296 - DNA, 25 bp, Rattus norvegicus
caacctgtgcatttttgtgtgttta

SEQ ID NO: 218297 - DNA, 25 bp, Rattus norvegicus
caacctgtgttaagtgatcgttcat

SEQ ID NO: 218298 - DNA, 25 bp, Rattus norvegicus
caacctgtgttatgtgatcgttcat

SEQ ID NO: 218299 - DNA, 25 bp, Rattus norvegicus
caacctgttctgaggagtctgcgtg

SEQ ID NO: 218300 - DNA, 25 bp, Rattus norvegicus
caacctgttctgtggagtctgcgtg

SEQ ID NO: 218301 - DNA, 25 bp, Rattus norvegicus
caacctgttcttcctaccaaatata

SEQ ID NO: 218302 - DNA, 25 bp, Rattus norvegicus
caacctgttcttgctaccaaatata

SEQ ID NO: 218303 - DNA, 25 bp, Rattus norvegicus
caacctgttgagctgtctgcaagtt

SEQ ID NO: 218304 - DNA, 25 bp, Rattus norvegicus
caacctgttgaggtgtctgcaagtt

SEQ ID NO: 218305 - DNA, 25 bp, Rattus norvegicus
caaccttaaaatcttgaccctcctg

SEQ ID NO: 218306 - DNA, 25 bp, Rattus norvegicus
caaccttaaaatgttgaccctcctg

SEQ ID NO: 218307 - DNA, 25 bp, Rattus norvegicus
caaccttaccctcagtgactgaact

SEQ ID NO: 218308 - DNA, 25 bp, Rattus norvegicus
caaccttaccctgagtgactgaact

SEQ ID NO: 218309 - DNA, 25 bp, Rattus norvegicus
caaccttaggtgacattctcaggaa

SEQ ID NO: 218310 - DNA, 25 bp, Rattus norvegicus
caaccttaggtgtcattctcaggaa

SEQ ID NO: 218311 - DNA, 25 bp, Rattus norvegicus
caaccttatcccaaaccatattggt

SEQ ID NO: 218312 - DNA, 25 bp, Rattus norvegicus
caaccttatccctaaccatattggt

SEQ ID NO: 218313 - DNA, 25 bp, Rattus norvegicus
caaccttatgtgagcccagtttcag

SEQ ID NO: 218314 - DNA, 25 bp, Rattus norvegicus
caaccttatgtgtgcccagtttcag

SEQ ID NO: 218315 - DNA, 25 bp, Rattus norvegicus
caaccttattggaggcttagctata

SEQ ID NO: 218316 - DNA, 25 bp, Rattus norvegicus
caaccttattggtggcttagctata

SEQ ID NO: 218317 - DNA, 25 bp, Rattus norvegicus
caaccttcacataccctttgtggaa

SEQ ID NO: 218318 - DNA, 25 bp, Rattus norvegicus
caaccttcacattccctttgtggaa

SEQ ID NO: 218319 - DNA, 25 bp, Rattus norvegicus
caaccttccgtgactaagtagtgta

SEQ ID NO: 218320 - DNA, 25 bp, Rattus norvegicus
caaccttccgtgtctaagtagtgta

SEQ ID NO: 218321 - DNA, 25 bp, Rattus norvegicus
caaccttgagatcgtcactctgtcc

SEQ ID NO: 218322 - DNA, 25 bp, Rattus norvegicus
caaccttgagatggtcactctgtcc

SEQ ID NO: 218323 - DNA, 25 bp, Rattus norvegicus
caaccttgctggctctggtgaagct

SEQ ID NO: 218324 - DNA, 25 bp, Rattus norvegicus
caaccttgctgggtctggtgaagct

SEQ ID NO: 218325 - DNA, 25 bp, Rattus norvegicus
caaccttggccaacagaagtcttga

SEQ ID NO: 218326 - DNA, 25 bp, Rattus norvegicus
caaccttggccatcagaagtcttga

SEQ ID NO: 218327 - DNA, 25 bp, Rattus norvegicus
caaccttggcgtaaactggatacac

SEQ ID NO: 218328 - DNA, 25 bp, Rattus norvegicus
caaccttggcgttaactggatacac

SEQ ID NO: 218329 - DNA, 25 bp, Rattus norvegicus
caaccttggtctcggtgggcagcaa

SEQ ID NO: 218330 - DNA, 25 bp, Rattus norvegicus
caaccttggtctgggtgggcagcaa

SEQ ID NO: 218331 - DNA, 25 bp, Rattus norvegicus
caaccttgttgcagactgagatctc

SEQ ID NO: 218332 - DNA, 25 bp, Rattus norvegicus
caaccttgttgctgactgagatctc

SEQ ID NO: 218333 - DNA, 25 bp, Rattus norvegicus
caaccttgtttgcactgagaccctt

SEQ ID NO: 218334 - DNA, 25 bp, Rattus norvegicus
caaccttgtttggactgagaccctt

SEQ ID NO: 218335 - DNA, 25 bp, Rattus norvegicus
caacctttaaagaattcactgataa

SEQ ID NO: 218336 - DNA, 25 bp, Rattus norvegicus
caacctttaaagtattcactgataa

SEQ ID NO: 218337 - DNA, 25 bp, Rattus norvegicus
caacctttccctagagtctctgtta

SEQ ID NO: 218338 - DNA, 25 bp, Rattus norvegicus
caacctttcccttgagtctctgtta

SEQ ID NO: 218339 - DNA, 25 bp, Rattus norvegicus
caacctttgatgagatatagtctga

SEQ ID NO: 218340 - DNA, 25 bp, Rattus norvegicus
caacctttgatgtgatatagtctga

SEQ ID NO: 218341 - DNA, 25 bp, Rattus norvegicus
caaccttttgttccgtgtttctgtt

SEQ ID NO: 218342 - DNA, 25 bp, Rattus norvegicus
caaccttttgttgcgtgtttctgtt

SEQ ID NO: 218343 - DNA, 25 bp, Rattus norvegicus
caacgaagtgtacatgctgccctaa

SEQ ID NO: 218344 - DNA, 25 bp, Rattus norvegicus
caacgaagtgtagatgctgccctaa

SEQ ID NO: 218345 - DNA, 25 bp, Rattus norvegicus
caacgaagttctctgggccgtggta

SEQ ID NO: 218346 - DNA, 25 bp, Rattus norvegicus
caacgaagttctgtgggccgtggta

SEQ ID NO: 218347 - DNA, 25 bp, Rattus norvegicus
caacgaccgtctcgcggtgtatatt

SEQ ID NO: 218348 - DNA, 25 bp, Rattus norvegicus
caacgaccgtctggcggtgtatatt

SEQ ID NO: 218349 - DNA, 25 bp, Rattus norvegicus
caacgacttgaactctatggcgggt

SEQ ID NO: 218350 - DNA, 25 bp, Rattus norvegicus
caacgacttgaagtctatggcgggt

SEQ ID NO: 218351 - DNA, 25 bp, Rattus norvegicus
caacgacttgccattcaaaactact

SEQ ID NO: 218352 - DNA, 25 bp, Rattus norvegicus
caacgacttgcctttcaaaactact

SEQ ID NO: 218353 - DNA, 25 bp, Rattus norvegicus
caacgagactggacttctctgagcc

SEQ ID NO: 218354 - DNA, 25 bp, Rattus norvegicus
caacgagactggtcttctctgagcc

SEQ ID NO: 218355 - DNA, 25 bp, Rattus norvegicus
caacgagattacaaatttcccactt

SEQ ID NO: 218356 - DNA, 25 bp, Rattus norvegicus
caacgagattactaatttcccactt

SEQ ID NO: 218357 - DNA, 25 bp, Rattus norvegicus
caacgagcctgtagccaagacaacg

SEQ ID NO: 218358 - DNA, 25 bp, Rattus norvegicus
caacgagcctgttgccaagacaacg

SEQ ID NO: 218359 - DNA, 25 bp, Rattus norvegicus
caacgagctggcagagaggtgcaat

SEQ ID NO: 218360 - DNA, 25 bp, Rattus norvegicus
caacgagctggctgagaggtgcaat

SEQ ID NO: 218361 - DNA, 25 bp, Rattus norvegicus
caacgagtcctgctgttctctggat

SEQ ID NO: 218362 - DNA, 25 bp, Rattus norvegicus
caacgagtcctggtgttctctggat

SEQ ID NO: 218363 - DNA, 25 bp, Rattus norvegicus
caacgagtctgacggcagtagctcc

SEQ ID NO: 218364 - DNA, 25 bp, Rattus norvegicus
caacgagtctgagggcagtagctcc

SEQ ID NO: 218365 - DNA, 25 bp, Rattus norvegicus
caacgagtctggacaagggagccaa

SEQ ID NO: 218366 - DNA, 25 bp, Rattus norvegicus
caacgagtctggtcaagggagccaa

SEQ ID NO: 218367 - DNA, 25 bp, Rattus norvegicus
caacgagtgcctaggtgtcaggaca

SEQ ID NO: 218368 - DNA, 25 bp, Rattus norvegicus
caacgagtgccttggtgtcaggaca

SEQ ID NO: 218369 - DNA, 25 bp, Rattus norvegicus
caacgatatttgaagacctctctga

SEQ ID NO: 218370 - DNA, 25 bp, Rattus norvegicus
caacgatatttgtagacctctctga

SEQ ID NO: 218371 - DNA, 25 bp, Rattus norvegicus
caacgatcccgacgcgagagcgagc

SEQ ID NO: 218372 - DNA, 25 bp, Rattus norvegicus
caacgatcccgaggcgagagcgagc

SEQ ID NO: 218373 - DNA, 25 bp, Rattus norvegicus
caacgatcccgtatttgaagaccta

SEQ ID NO: 218374 - DNA, 25 bp, Rattus norvegicus
caacgatcccgtttttgaagaccta

SEQ ID NO: 218375 - DNA, 25 bp, Rattus norvegicus
caacgatgaccacactgtggcagct

SEQ ID NO: 218376 - DNA, 25 bp, Rattus norvegicus
caacgatgaccagactgtggcagct

SEQ ID NO: 218377 - DNA, 25 bp, Rattus norvegicus
caacgccactgcattgattactgga

SEQ ID NO: 218378 - DNA, 25 bp, Rattus norvegicus
caacgccactgctttgattactgga

SEQ ID NO: 218379 - DNA, 25 bp, Rattus norvegicus
caacgccatttccttgtcaagttca

SEQ ID NO: 218380 - DNA, 25 bp, Rattus norvegicus
caacgccatttcgttgtcaagttca

SEQ ID NO: 218381 - DNA, 25 bp, Rattus norvegicus
caacgccctcatagcttcattgtgt

SEQ ID NO: 218382 - DNA, 25 bp, Rattus norvegicus
caacgccctcattgcttcattgtgt

SEQ ID NO: 218383 - DNA, 25 bp, Rattus norvegicus
caacgcggcgggaaggacaagcagc

SEQ ID NO: 218384 - DNA, 25 bp, Rattus norvegicus
caacgcggcgggtaggacaagcagc

SEQ ID NO: 218385 - DNA, 25 bp, Rattus norvegicus
caacgctaagtacttctgaacccca

SEQ ID NO: 218386 - DNA, 25 bp, Rattus norvegicus
caacgctaagtagttctgaacccca

SEQ ID NO: 218387 - DNA, 25 bp, Rattus norvegicus
caacgctctcatccgagggtttgga

SEQ ID NO: 218388 - DNA, 25 bp, Rattus norvegicus
caacgctctcatgcgagggtttgga

SEQ ID NO: 218389 - DNA, 25 bp, Rattus norvegicus
caacgctgaatcagtatgtataatg

SEQ ID NO: 218390 - DNA, 25 bp, Rattus norvegicus
caacgctgaatctgtatgtataatg

SEQ ID NO: 218391 - DNA, 25 bp, Rattus norvegicus
caacgctgcagcacaagtttttgga

SEQ ID NO: 218392 - DNA, 25 bp, Rattus norvegicus
caacgctgcagctcaagtttttgga

SEQ ID NO: 218393 - DNA, 25 bp, Rattus norvegicus
caacgctgggtcagttggaacccaa

SEQ ID NO: 218394 - DNA, 25 bp, Rattus norvegicus
caacgctgggtctgttggaacccaa

SEQ ID NO: 218395 - DNA, 25 bp, Rattus norvegicus
caacggaaactaagccttctccagg

SEQ ID NO: 218396 - DNA, 25 bp, Rattus norvegicus
caacggaaactatgccttctccagg

SEQ ID NO: 218397 - DNA, 25 bp, Rattus norvegicus
caacggaacagacgctgcccagaca

SEQ ID NO: 218398 - DNA, 25 bp, Rattus norvegicus
caacggaacagaggctgcccagaca

SEQ ID NO: 218399 - DNA, 25 bp, Rattus norvegicus
caacggaagtcgattgacgtccttt

SEQ ID NO: 218400 - DNA, 25 bp, Rattus norvegicus
caacggaagtcgtttgacgtccttt

SEQ ID NO: 218401 - DNA, 25 bp, Rattus norvegicus
caacggaatccaagtaagctgttac

SEQ ID NO: 218402 - DNA, 25 bp, Rattus norvegicus
caacggaatccatgtaagctgttac

SEQ ID NO: 218403 - DNA, 25 bp, Rattus norvegicus
caacggacacttatgaaggcctctt

SEQ ID NO: 218404 - DNA, 25 bp, Rattus norvegicus
caacggacacttttgaaggcctctt

SEQ ID NO: 218405 - DNA, 25 bp, Rattus norvegicus
caacggagacagatcatcctgctct

SEQ ID NO: 218406 - DNA, 25 bp, Rattus norvegicus
caacggagacagttcatcctgctct

SEQ ID NO: 218407 - DNA, 25 bp, Rattus norvegicus
caacggattcctcatctagagattt

SEQ ID NO: 218408 - DNA, 25 bp, Rattus norvegicus
caacggattcctgatctagagattt

SEQ ID NO: 218409 - DNA, 25 bp, Rattus norvegicus
caacggcagtctcagtcttgtactc

SEQ ID NO: 218410 - DNA, 25 bp, Rattus norvegicus
caacggcagtctgagtcttgtactc

SEQ ID NO: 218411 - DNA, 25 bp, Rattus norvegicus
caacggcccaggatatgtgcttaat

SEQ ID NO: 218412 - DNA, 25 bp, Rattus norvegicus
caacggcccaggttatgtgcttaat

SEQ ID NO: 218413 - DNA, 25 bp, Rattus norvegicus
caacggcgaggaatgagctctttct

SEQ ID NO: 218414 - DNA, 25 bp, Rattus norvegicus
caacggcgaggattgagctctttct

SEQ ID NO: 218415 - DNA, 25 bp, Rattus norvegicus
caacggcgggacatggttcaggcca

SEQ ID NO: 218416 - DNA, 25 bp, Rattus norvegicus
caacggcgggacttggttcaggcca

SEQ ID NO: 218417 - DNA, 25 bp, Rattus norvegicus
caacggcgggctccacttctcggag

SEQ ID NO: 218418 - DNA, 25 bp, Rattus norvegicus
caacggcgggctgcacttctcggag

SEQ ID NO: 218419 - DNA, 25 bp, Rattus norvegicus
caacggctgccacttgctgctaggg

SEQ ID NO: 218420 - DNA, 25 bp, Rattus norvegicus
caacggctgccagttgctgctaggg

SEQ ID NO: 218421 - DNA, 25 bp, Rattus norvegicus
caacggctgggcaaacggcgcctac

SEQ ID NO: 218422 - DNA, 25 bp, Rattus norvegicus
caacggctgggctaacggcgcctac

SEQ ID NO: 218423 - DNA, 25 bp, Rattus norvegicus
caacggcttttacatcttttctgag

SEQ ID NO: 218424 - DNA, 25 bp, Rattus norvegicus
caacggcttttagatcttttctgag

SEQ ID NO: 218425 - DNA, 25 bp, Rattus norvegicus
caacgggcagctctgcgccaagcag

SEQ ID NO: 218426 - DNA, 25 bp, Rattus norvegicus
caacgggcagctgtgcgccaagcag

SEQ ID NO: 218427 - DNA, 25 bp, Rattus norvegicus
caacggtctatacctccatttcaga

SEQ ID NO: 218428 - DNA, 25 bp, Rattus norvegicus
caacggtctatagctccatttcaga

SEQ ID NO: 218429 - DNA, 25 bp, Rattus norvegicus
caacggtgaccaaacttttctgcag

SEQ ID NO: 218430 - DNA, 25 bp, Rattus norvegicus
caacggtgaccatacttttctgcag

SEQ ID NO: 218431 - DNA, 25 bp, Rattus norvegicus
caacgtatgtgcaggaactagtctg

SEQ ID NO: 218432 - DNA, 25 bp, Rattus norvegicus
caacgtatgtgctggaactagtctg

SEQ ID NO: 218433 - DNA, 25 bp, Rattus norvegicus
caacgtccaggacgctgagagctca

SEQ ID NO: 218434 - DNA, 25 bp, Rattus norvegicus
caacgtccaggaggctgagagctca

SEQ ID NO: 218435 - DNA, 25 bp, Rattus norvegicus
caacgtccaggcactgttcgagggt

SEQ ID NO: 218436 - DNA, 25 bp, Rattus norvegicus
caacgtccaggctctgttcgagggt

SEQ ID NO: 218437 - DNA, 25 bp, Rattus norvegicus
caacgtcgccttccgtagtgtctgt

SEQ ID NO: 218438 - DNA, 25 bp, Rattus norvegicus
caacgtcgccttgcgtagtgtctgt

SEQ ID NO: 218439 - DNA, 25 bp, Rattus norvegicus
caacgtcgtttgcatgtgttctgag

SEQ ID NO: 218440 - DNA, 25 bp, Rattus norvegicus
caacgtcgtttggatgtgttctgag

SEQ ID NO: 218441 - DNA, 25 bp, Rattus norvegicus
caacgtctgtctatactggagagga

SEQ ID NO: 218442 - DNA, 25 bp, Rattus norvegicus
caacgtctgtctttactggagagga

SEQ ID NO: 218443 - DNA, 25 bp, Rattus norvegicus
caacgtcttgataaacttgcttaag

SEQ ID NO: 218444 - DNA, 25 bp, Rattus norvegicus
caacgtcttgattaacttgcttaag

SEQ ID NO: 218445 - DNA, 25 bp, Rattus norvegicus
caacgtgaaggtcaggaagccctct

SEQ ID NO: 218446 - DNA, 25 bp, Rattus norvegicus
caacgtgaaggtgaggaagccctct

SEQ ID NO: 218447 - DNA, 25 bp, Rattus norvegicus
caacgtgaatttacgggctgtcgtc

SEQ ID NO: 218448 - DNA, 25 bp, Rattus norvegicus
caacgtgaattttcgggctgtcgtc

SEQ ID NO: 218449 - DNA, 25 bp, Rattus norvegicus
caacgtgatgtaccagtttgtaatc

SEQ ID NO: 218450 - DNA, 25 bp, Rattus norvegicus
caacgtgatgtagcagtttgtaatc

SEQ ID NO: 218451 - DNA, 25 bp, Rattus norvegicus
caacgtggaaaccattgttgtttct

SEQ ID NO: 218452 - DNA, 25 bp, Rattus norvegicus
caacgtggaaacgattgttgtttct

SEQ ID NO: 218453 - DNA, 25 bp, Rattus norvegicus
caacgtggcagcacaaagccatcat

SEQ ID NO: 218454 - DNA, 25 bp, Rattus norvegicus
caacgtggcagctcaaagccatcat

SEQ ID NO: 218455 - DNA, 25 bp, Rattus norvegicus
caacgtggcatcaaaccctatgtgt

SEQ ID NO: 218456 - DNA, 25 bp, Rattus norvegicus
caacgtggcatctaaccctatgtgt

SEQ ID NO: 218457 - DNA, 25 bp, Rattus norvegicus
caacgtggctatctgcaatggatat

SEQ ID NO: 218458 - DNA, 25 bp, Rattus norvegicus
caacgtggctatgtgcaatggatat

SEQ ID NO: 218459 - DNA, 25 bp, Rattus norvegicus
caacgtggtaacacgggtgctatct

SEQ ID NO: 218460 - DNA, 25 bp, Rattus norvegicus
caacgtggtaactcgggtgctatct

SEQ ID NO: 218461 - DNA, 25 bp, Rattus norvegicus
caacgtgtccctaatctacaactgg

SEQ ID NO: 218462 - DNA, 25 bp, Rattus norvegicus
caacgtgtcccttatctacaactgg

SEQ ID NO: 218463 - DNA, 25 bp, Rattus norvegicus
caacgtgtctcccagaactattttg

SEQ ID NO: 218464 - DNA, 25 bp, Rattus norvegicus
caacgtgtctccgagaactattttg

SEQ ID NO: 218465 - DNA, 25 bp, Rattus norvegicus
caacgtgtttgcatgagctcagata

SEQ ID NO: 218466 - DNA, 25 bp, Rattus norvegicus
caacgtgtttgcttgagctcagata

SEQ ID NO: 218467 - DNA, 25 bp, Rattus norvegicus
caacgttaggttccgaggctgcatc

SEQ ID NO: 218468 - DNA, 25 bp, Rattus norvegicus
caacgttaggttgcgaggctgcatc

SEQ ID NO: 218469 - DNA, 25 bp, Rattus norvegicus
caacgttcggaaaggcagcatctca

SEQ ID NO: 218470 - DNA, 25 bp, Rattus norvegicus
caacgttcggaatggcagcatctca

SEQ ID NO: 218471 - DNA, 25 bp, Rattus norvegicus
caacgttctgcgacttctggaacag

SEQ ID NO: 218472 - DNA, 25 bp, Rattus norvegicus
caacgttctgcgtcttctggaacag

SEQ ID NO: 218473 - DNA, 25 bp, Rattus norvegicus
caacgttcttgacggacgcggaagc

SEQ ID NO: 218474 - DNA, 25 bp, Rattus norvegicus
caacgttcttgagggacgcggaagc

SEQ ID NO: 218475 - DNA, 25 bp, Rattus norvegicus
caacgttgctgacaacgagtcggcg

SEQ ID NO: 218476 - DNA, 25 bp, Rattus norvegicus
caacgttgctgacctcatttgaggg

SEQ ID NO: 218477 - DNA, 25 bp, Rattus norvegicus
caacgttgctgagaacgagtcggcg

SEQ ID NO: 218478 - DNA, 25 bp, Rattus norvegicus
caacgttgctgagctcatttgaggg

SEQ ID NO: 218479 - DNA, 25 bp, Rattus norvegicus
caacgttgtagacaagggtcccgct

SEQ ID NO: 218480 - DNA, 25 bp, Rattus norvegicus
caacgttgtagagaagggtcccgct

SEQ ID NO: 218481 - DNA, 25 bp, Rattus norvegicus
caacgtttcccgaccttcagtattg

SEQ ID NO: 218482 - DNA, 25 bp, Rattus norvegicus
caacgtttcccgtccttcagtattg

SEQ ID NO: 218483 - DNA, 25 bp, Rattus norvegicus
caacgttttgccatgaccctctgta

SEQ ID NO: 218484 - DNA, 25 bp, Rattus norvegicus
caacgttttgccttgaccctctgta

SEQ ID NO: 218485 - DNA, 25 bp, Rattus norvegicus
caacgttttgtcactgtggctgtga

SEQ ID NO: 218486 - DNA, 25 bp, Rattus norvegicus
caacgttttgtctctgtggctgtga

SEQ ID NO: 218487 - DNA, 25 bp, Rattus norvegicus
caacgtttttctcttgcatgtcaag

SEQ ID NO: 218488 - DNA, 25 bp, Rattus norvegicus
caacgtttttctgttgcatgtcaag

SEQ ID NO: 218489 - DNA, 25 bp, Rattus norvegicus
caactaaaccagactgtcaaaaaag

SEQ ID NO: 218490 - DNA, 25 bp, Rattus norvegicus
caactaaaccagtctgtcaaaaaag

SEQ ID NO: 218491 - DNA, 25 bp, Rattus norvegicus
caactaaattacaccttcccttctg

SEQ ID NO: 218492 - DNA, 25 bp, Rattus norvegicus
caactaaattactccttcccttctg

SEQ ID NO: 218493 - DNA, 25 bp, Rattus norvegicus
caactacagtttatgcagccgtgag

SEQ ID NO: 218494 - DNA, 25 bp, Rattus norvegicus
caactacagtttttgcagccgtgag

SEQ ID NO: 218495 - DNA, 25 bp, Rattus norvegicus
caactacatggtctacatgttccag

SEQ ID NO: 218496 - DNA, 25 bp, Rattus norvegicus
caactacatggtgtacatgttccag

SEQ ID NO: 218497 - DNA, 25 bp, Rattus norvegicus
caactaccacgtcgctcgtgaagtt

SEQ ID NO: 218498 - DNA, 25 bp, Rattus norvegicus
caactaccacgtggctcgtgaagtt

SEQ ID NO: 218499 - DNA, 25 bp, Rattus norvegicus
caactactaccaccttgcagatttc

SEQ ID NO: 218500 - DNA, 25 bp, Rattus norvegicus
caactactaccagcttgcagatttc

SEQ ID NO: 218501 - DNA, 25 bp, Rattus norvegicus
caactactgtctcagctacattgca

SEQ ID NO: 218502 - DNA, 25 bp, Rattus norvegicus
caactactgtctgagctacattgca

SEQ ID NO: 218503 - DNA, 25 bp, Rattus norvegicus
caactacttcgccattgctgagaat

SEQ ID NO: 218504 - DNA, 25 bp, Rattus norvegicus
caactacttcgcgattgctgagaat

SEQ ID NO: 218505 - DNA, 25 bp, Rattus norvegicus
caactagacctacccggagctggcg

SEQ ID NO: 218506 - DNA, 25 bp, Rattus norvegicus
caactagacctagccggagctggcg

SEQ ID NO: 218507 - DNA, 25 bp, Rattus norvegicus
caactagcatcaactgtgtcttgta

SEQ ID NO: 218508 - DNA, 25 bp, Rattus norvegicus
caactagcatcatctgtgtcttgta

SEQ ID NO: 218509 - DNA, 25 bp, Rattus norvegicus
caactagtctggaaacatatgtgct

SEQ ID NO: 218510 - DNA, 25 bp, Rattus norvegicus
caactagtctggtaacatatgtgct

SEQ ID NO: 218511 - DNA, 25 bp, Rattus norvegicus
caactataccaacctgagccagggt

SEQ ID NO: 218512 - DNA, 25 bp, Rattus norvegicus
caactataccaagctgagccagggt

SEQ ID NO: 218513 - DNA, 25 bp, Rattus norvegicus
caactataggtcatcccttaccaat

SEQ ID NO: 218514 - DNA, 25 bp, Rattus norvegicus
caactataggtcttcccttaccaat

SEQ ID NO: 218515 - DNA, 25 bp, Rattus norvegicus
caactatgagtcctggtgttcttaa

SEQ ID NO: 218516 - DNA, 25 bp, Rattus norvegicus
caactatgagtcgtggtgttcttaa

SEQ ID NO: 218517 - DNA, 25 bp, Rattus norvegicus
caactatggcctactcagtagcaga

SEQ ID NO: 218518 - DNA, 25 bp, Rattus norvegicus
caactatggccttctcagtagcaga

SEQ ID NO: 218519 - DNA, 25 bp, Rattus norvegicus
caactatgtggacctgcggcagtag

SEQ ID NO: 218520 - DNA, 25 bp, Rattus norvegicus
caactatgtggagctgcggcagtag

SEQ ID NO: 218521 - DNA, 25 bp, Rattus norvegicus
caactattgtctactgtgtcaggca

SEQ ID NO: 218522 - DNA, 25 bp, Rattus norvegicus
caactattgtcttctgtgtcaggca

SEQ ID NO: 218523 - DNA, 25 bp, Rattus norvegicus
caactcaaactccactttccaaaag

SEQ ID NO: 218524 - DNA, 25 bp, Rattus norvegicus
caactcaaactcgactttccaaaag

SEQ ID NO: 218525 - DNA, 25 bp, Rattus norvegicus
caactcacaggcattgattttgttc

SEQ ID NO: 218526 - DNA, 25 bp, Rattus norvegicus
caactcacaggctttgattttgttc

SEQ ID NO: 218527 - DNA, 25 bp, Rattus norvegicus
caactcagcctgctatagacaaagt

SEQ ID NO: 218528 - DNA, 25 bp, Rattus norvegicus
caactcagcctggtatagacaaagt

SEQ ID NO: 218529 - DNA, 25 bp, Rattus norvegicus
caactcagcttcactgcttttataa

SEQ ID NO: 218530 - DNA, 25 bp, Rattus norvegicus
caactcagcttctctgcttttataa

SEQ ID NO: 218531 - DNA, 25 bp, Rattus norvegicus
caactcatacatacctcttgtctat

SEQ ID NO: 218532 - DNA, 25 bp, Rattus norvegicus
caactcatacattcctcttgtctat

SEQ ID NO: 218533 - DNA, 25 bp, Rattus norvegicus
caactcatggagatgccctgtcttc

SEQ ID NO: 218534 - DNA, 25 bp, Rattus norvegicus
caactcatggagttgccctgtcttc

SEQ ID NO: 218535 - DNA, 25 bp, Rattus norvegicus
caactcatttccaccatggttttta

SEQ ID NO: 218536 - DNA, 25 bp, Rattus norvegicus
caactcatttcctccatggttttta

SEQ ID NO: 218537 - DNA, 25 bp, Rattus norvegicus
caactcatttgtagggacacgctcc

SEQ ID NO: 218538 - DNA, 25 bp, Rattus norvegicus
caactcatttgttgggacacgctcc

SEQ ID NO: 218539 - DNA, 25 bp, Rattus norvegicus
caactccaagttcacctgggaacag

SEQ ID NO: 218540 - DNA, 25 bp, Rattus norvegicus
caactccaagttgacctgggaacag

SEQ ID NO: 218541 - DNA, 25 bp, Rattus norvegicus
caactccagggcattattgtatcct

SEQ ID NO: 218542 - DNA, 25 bp, Rattus norvegicus
caactccagggctttattgtatcct

SEQ ID NO: 218543 - DNA, 25 bp, Rattus norvegicus
caactccatataatgctgtctccaa

SEQ ID NO: 218544 - DNA, 25 bp, Rattus norvegicus
caactccatatattgctgtctccaa

SEQ ID NO: 218545 - DNA, 25 bp, Rattus norvegicus
caactccattctccttggtactggg

SEQ ID NO: 218546 - DNA, 25 bp, Rattus norvegicus
caactccattctgcttggtactggg

SEQ ID NO: 218547 - DNA, 25 bp, Rattus norvegicus
caactcccagggatcattgctgaag

SEQ ID NO: 218548 - DNA, 25 bp, Rattus norvegicus
caactcccagggttcattgctgaag

SEQ ID NO: 218549 - DNA, 25 bp, Rattus norvegicus
caactccgagtgacctcacagagga

SEQ ID NO: 218550 - DNA, 25 bp, Rattus norvegicus
caactccgagtgtcctcacagagga

SEQ ID NO: 218551 - DNA, 25 bp, Rattus norvegicus
caactccgctacagtacttgaaaca

SEQ ID NO: 218552 - DNA, 25 bp, Rattus norvegicus
caactccgctactgtacttgaaaca

SEQ ID NO: 218553 - DNA, 25 bp, Rattus norvegicus
caactccgtgcgcagaaaacctagg

SEQ ID NO: 218554 - DNA, 25 bp, Rattus norvegicus
caactccgtgcggagaaaacctagg

SEQ ID NO: 218555 - DNA, 25 bp, Rattus norvegicus
caactcctaatgctgcgatcctgta

SEQ ID NO: 218556 - DNA, 25 bp, Rattus norvegicus
caactcctaatggtgcgatcctgta

SEQ ID NO: 218557 - DNA, 25 bp, Rattus norvegicus
caactcctactaccactgaaataac

SEQ ID NO: 218558 - DNA, 25 bp, Rattus norvegicus
caactcctactagcactgaaataac

SEQ ID NO: 218559 - DNA, 25 bp, Rattus norvegicus
caactcctcagtcgtcactatttca

SEQ ID NO: 218560 - DNA, 25 bp, Rattus norvegicus
caactcctcagtctgctgttttgga

SEQ ID NO: 218561 - DNA, 25 bp, Rattus norvegicus
caactcctcagtggtcactatttca

SEQ ID NO: 218562 - DNA, 25 bp, Rattus norvegicus
caactcctcagtgtgctgttttgga

SEQ ID NO: 218563 - DNA, 25 bp, Rattus norvegicus
caactcctcttcagacactgtggaa

SEQ ID NO: 218564 - DNA, 25 bp, Rattus norvegicus
caactcctcttctgacactgtggaa

SEQ ID NO: 218565 - DNA, 25 bp, Rattus norvegicus
caactcctgagtccttatttttgcc

SEQ ID NO: 218566 - DNA, 25 bp, Rattus norvegicus
caactcctgagtgcttatttttgcc

SEQ ID NO: 218567 - DNA, 25 bp, Rattus norvegicus
caactcctgcaaaactccataaaca

SEQ ID NO: 218568 - DNA, 25 bp, Rattus norvegicus
caactcctgcaatactccataaaca

SEQ ID NO: 218569 - DNA, 25 bp, Rattus norvegicus
caactcctgcagacacattctttgt

SEQ ID NO: 218570 - DNA, 25 bp, Rattus norvegicus
caactcctgcagtcacattctttgt

SEQ ID NO: 218571 - DNA, 25 bp, Rattus norvegicus
caactcctgcggcttctgcaggcag

SEQ ID NO: 218572 - DNA, 25 bp, Rattus norvegicus
caactcctgcgggttctgcaggcag

SEQ ID NO: 218573 - DNA, 25 bp, Rattus norvegicus
caactcctgtgaattatgccaataa

SEQ ID NO: 218574 - DNA, 25 bp, Rattus norvegicus
caactcctgtgatttatgccaataa

SEQ ID NO: 218575 - DNA, 25 bp, Rattus norvegicus
caactcctttaaaggcctttttgag

SEQ ID NO: 218576 - DNA, 25 bp, Rattus norvegicus
caactcctttaatggcctttttgag

SEQ ID NO: 218577 - DNA, 25 bp, Rattus norvegicus
caactcgcacagctgctctgaggaa

SEQ ID NO: 218578 - DNA, 25 bp, Rattus norvegicus
caactcgcacaggtgctctgaggaa

SEQ ID NO: 218579 - DNA, 25 bp, Rattus norvegicus
caactcggtgttctctgtagagacc

SEQ ID NO: 218580 - DNA, 25 bp, Rattus norvegicus
caactcggtgttgtctgtagagacc

SEQ ID NO: 218581 - DNA, 25 bp, Rattus norvegicus
caactcgtaacccatgacagtcggt

SEQ ID NO: 218582 - DNA, 25 bp, Rattus norvegicus
caactcgtaaccgatgacagtcggt

SEQ ID NO: 218583 - DNA, 25 bp, Rattus norvegicus
caactctaagtgatcttacccacat

SEQ ID NO: 218584 - DNA, 25 bp, Rattus norvegicus
caactctaagtgttcttacccacat

SEQ ID NO: 218585 - DNA, 25 bp, Rattus norvegicus
caactctcataaacaccccaaataa

SEQ ID NO: 218586 - DNA, 25 bp, Rattus norvegicus
caactctcataatcaccccaaataa

SEQ ID NO: 218587 - DNA, 25 bp, Rattus norvegicus
caactctccgtcatatccttatatt

SEQ ID NO: 218588 - DNA, 25 bp, Rattus norvegicus
caactctccgtcttatccttatatt

SEQ ID NO: 218589 - DNA, 25 bp, Rattus norvegicus
caactctctctgactaaggttccag

SEQ ID NO: 218590 - DNA, 25 bp, Rattus norvegicus
caactctctctgtctaaggttccag

SEQ ID NO: 218591 - DNA, 25 bp, Rattus norvegicus
caactctctgtacttcttgaaccat

SEQ ID NO: 218592 - DNA, 25 bp, Rattus norvegicus
caactctctgtagttcttgaaccat

SEQ ID NO: 218593 - DNA, 25 bp, Rattus norvegicus
caactctcttggagctattgggcat

SEQ ID NO: 218594 - DNA, 25 bp, Rattus norvegicus
caactctcttggtgctattgggcat

SEQ ID NO: 218595 - DNA, 25 bp, Rattus norvegicus
caactctgatttcttttgttttcca

SEQ ID NO: 218596 - DNA, 25 bp, Rattus norvegicus
caactctgatttgttttgttttcca

SEQ ID NO: 218597 - DNA, 25 bp, Rattus norvegicus
caactctggactctgggaacctgca

SEQ ID NO: 218598 - DNA, 25 bp, Rattus norvegicus
caactctggactgtgggaacctgca

SEQ ID NO: 218599 - DNA, 25 bp, Rattus norvegicus
caactctggcgaccattggtgcagc

SEQ ID NO: 218600 - DNA, 25 bp, Rattus norvegicus
caactctggcgagcattggtgcagc

SEQ ID NO: 218601 - DNA, 25 bp, Rattus norvegicus
caactctgggaaatttatgcctgca

SEQ ID NO: 218602 - DNA, 25 bp, Rattus norvegicus
caactctgggaattttatgcctgca

SEQ ID NO: 218603 - DNA, 25 bp, Rattus norvegicus
caactctggtgcacgaattccaaaa

SEQ ID NO: 218604 - DNA, 25 bp, Rattus norvegicus
caactctggtgctcgaattccaaaa

SEQ ID NO: 218605 - DNA, 25 bp, Rattus norvegicus
caactctgtcgcagtgtttttaata

SEQ ID NO: 218606 - DNA, 25 bp, Rattus norvegicus
caactctgtcgctgtgtttttaata

SEQ ID NO: 218607 - DNA, 25 bp, Rattus norvegicus
caactctgtcttcctcttgaaaggt

SEQ ID NO: 218608 - DNA, 25 bp, Rattus norvegicus
caactctgtcttgctcttgaaaggt

SEQ ID NO: 218609 - DNA, 25 bp, Rattus norvegicus
caactcttagttctgccttgaacat

SEQ ID NO: 218610 - DNA, 25 bp, Rattus norvegicus
caactcttagttgtgccttgaacat

SEQ ID NO: 218611 - DNA, 25 bp, Rattus norvegicus
caactcttccctattagattctggc

SEQ ID NO: 218612 - DNA, 25 bp, Rattus norvegicus
caactcttcccttttagattctggc

SEQ ID NO: 218613 - DNA, 25 bp, Rattus norvegicus
caactcttgtctcgaccacctggag

SEQ ID NO: 218614 - DNA, 25 bp, Rattus norvegicus
caactcttgtctggaccacctggag

SEQ ID NO: 218615 - DNA, 25 bp, Rattus norvegicus
caactctttcaccacgttgcaaaag

SEQ ID NO: 218616 - DNA, 25 bp, Rattus norvegicus
caactctttcacgacgttgcaaaag

SEQ ID NO: 218617 - DNA, 25 bp, Rattus norvegicus
caactctttgaactagtgctgtatt

SEQ ID NO: 218618 - DNA, 25 bp, Rattus norvegicus
caactctttgaagtagtgctgtatt

SEQ ID NO: 218619 - DNA, 25 bp, Rattus norvegicus
caactgaaaggacatgtttgtttcc

SEQ ID NO: 218620 - DNA, 25 bp, Rattus norvegicus
caactgaaaggagatgtttgtttcc

SEQ ID NO: 218621 - DNA, 25 bp, Rattus norvegicus
caactgaatgaaagcttctcccact

SEQ ID NO: 218622 - DNA, 25 bp, Rattus norvegicus
caactgaatgaatgcttctcccact

SEQ ID NO: 218623 - DNA, 25 bp, Rattus norvegicus
caactgaatgttcccactcgtggct

SEQ ID NO: 218624 - DNA, 25 bp, Rattus norvegicus
caactgaatgttgccactcgtggct

SEQ ID NO: 218625 - DNA, 25 bp, Rattus norvegicus
caactgaatttgcatggtcttaaga

SEQ ID NO: 218626 - DNA, 25 bp, Rattus norvegicus
caactgaatttggatggtcttaaga

SEQ ID NO: 218627 - DNA, 25 bp, Rattus norvegicus
caactgacacaccactctgttaatg

SEQ ID NO: 218628 - DNA, 25 bp, Rattus norvegicus
caactgacacacgactctgttaatg

SEQ ID NO: 218629 - DNA, 25 bp, Rattus norvegicus
caactgacatttactgtgcatgcca

SEQ ID NO: 218630 - DNA, 25 bp, Rattus norvegicus
caactgacattttctgtgcatgcca

SEQ ID NO: 218631 - DNA, 25 bp, Rattus norvegicus
caactgacgctgactctgtgacctg

SEQ ID NO: 218632 - DNA, 25 bp, Rattus norvegicus
caactgacgctgtctctgtgacctg

SEQ ID NO: 218633 - DNA, 25 bp, Rattus norvegicus
caactgactctgatcctggccagaa

SEQ ID NO: 218634 - DNA, 25 bp, Rattus norvegicus
caactgactctgttcctggccagaa

SEQ ID NO: 218635 - DNA, 25 bp, Rattus norvegicus
caactgagactcataatctccccaa

SEQ ID NO: 218636 - DNA, 25 bp, Rattus norvegicus
caactgagactcttaatctccccaa

SEQ ID NO: 218637 - DNA, 25 bp, Rattus norvegicus
caactgagtgtgatcttgtgaccaa

SEQ ID NO: 218638 - DNA, 25 bp, Rattus norvegicus
caactgagtgtgttcttgtgaccaa

SEQ ID NO: 218639 - DNA, 25 bp, Rattus norvegicus
caactgagttctcttacctttcgta

SEQ ID NO: 218640 - DNA, 25 bp, Rattus norvegicus
caactgagttctgttacctttcgta

SEQ ID NO: 218641 - DNA, 25 bp, Rattus norvegicus
caactgatcttcctcttgggatttt

SEQ ID NO: 218642 - DNA, 25 bp, Rattus norvegicus
caactgatcttcgtcttgggatttt

SEQ ID NO: 218643 - DNA, 25 bp, Rattus norvegicus
caactgatgggtatggaacttattt

SEQ ID NO: 218644 - DNA, 25 bp, Rattus norvegicus
caactgatgggtttggaacttattt

SEQ ID NO: 218645 - DNA, 25 bp, Rattus norvegicus
caactgattgtgctggcatatgcta

SEQ ID NO: 218646 - DNA, 25 bp, Rattus norvegicus
caactgattgtggtggcatatgcta

SEQ ID NO: 218647 - DNA, 25 bp, Rattus norvegicus
caactgatttggagggtctgctaat

SEQ ID NO: 218648 - DNA, 25 bp, Rattus norvegicus
caactgatttggtgggtctgctaat

SEQ ID NO: 218649 - DNA, 25 bp, Rattus norvegicus
caactgcaaaacctaccaggagagg

SEQ ID NO: 218650 - DNA, 25 bp, Rattus norvegicus
caactgcaaaacgtaccaggagagg

SEQ ID NO: 218651 - DNA, 25 bp, Rattus norvegicus
caactgcaatgcagttctgttcctt

SEQ ID NO: 218652 - DNA, 25 bp, Rattus norvegicus
caactgcaatgctgttctgttcctt

SEQ ID NO: 218653 - DNA, 25 bp, Rattus norvegicus
caactgcagtgcatttctgtgtttt

SEQ ID NO: 218654 - DNA, 25 bp, Rattus norvegicus
caactgcagtgcttttctgtgtttt

SEQ ID NO: 218655 - DNA, 25 bp, Rattus norvegicus
caactgcatcccagacacaagaaat

SEQ ID NO: 218656 - DNA, 25 bp, Rattus norvegicus
caactgcatccctgacacaagaaat

SEQ ID NO: 218657 - DNA, 25 bp, Rattus norvegicus
caactgcattgtatctaaagcctta

SEQ ID NO: 218658 - DNA, 25 bp, Rattus norvegicus
caactgcattgtttctaaagcctta

SEQ ID NO: 218659 - DNA, 25 bp, Rattus norvegicus
caactgcatttcacatgcggtggtt

SEQ ID NO: 218660 - DNA, 25 bp, Rattus norvegicus
caactgcatttctcatgcggtggtt

SEQ ID NO: 218661 - DNA, 25 bp, Rattus norvegicus
caactgccaccgaaccttctggaag

SEQ ID NO: 218662 - DNA, 25 bp, Rattus norvegicus
caactgccaccgtaccttctggaag

SEQ ID NO: 218663 - DNA, 25 bp, Rattus norvegicus
caactgccactgacttaaccagaag

SEQ ID NO: 218664 - DNA, 25 bp, Rattus norvegicus
caactgccactgtcttaaccagaag

SEQ ID NO: 218665 - DNA, 25 bp, Rattus norvegicus
caactgccctttccagatgtccatg

SEQ ID NO: 218666 - DNA, 25 bp, Rattus norvegicus
caactgccctttgcagatgtccatg

SEQ ID NO: 218667 - DNA, 25 bp, Rattus norvegicus
caactgcctatgataattctttata

SEQ ID NO: 218668 - DNA, 25 bp, Rattus norvegicus
caactgcctatgttaattctttata

SEQ ID NO: 218669 - DNA, 25 bp, Rattus norvegicus
caactgcctggcagaggtgactgga

SEQ ID NO: 218670 - DNA, 25 bp, Rattus norvegicus
caactgcctggctgaggtgactgga

SEQ ID NO: 218671 - DNA, 25 bp, Rattus norvegicus
caactgcctggtccggctggagaat

SEQ ID NO: 218672 - DNA, 25 bp, Rattus norvegicus
caactgcctggtgcggctggagaat

SEQ ID NO: 218673 - DNA, 25 bp, Rattus norvegicus
caactgcctgtgactaaaacttagg

SEQ ID NO: 218674 - DNA, 25 bp, Rattus norvegicus
caactgcctgtgtctaaaacttagg

SEQ ID NO: 218675 - DNA, 25 bp, Rattus norvegicus
caactgccttgtctgactgtcatcg

SEQ ID NO: 218676 - DNA, 25 bp, Rattus norvegicus
caactgccttgtgtgactgtcatcg

SEQ ID NO: 218677 - DNA, 25 bp, Rattus norvegicus
caactgcggcgcatttcagagtgga

SEQ ID NO: 218678 - DNA, 25 bp, Rattus norvegicus
caactgcggcgcttttcagagtgga

SEQ ID NO: 218679 - DNA, 25 bp, Rattus norvegicus
caactgcgggttactttaggttcag

SEQ ID NO: 218680 - DNA, 25 bp, Rattus norvegicus
caactgcgggtttctttaggttcag

SEQ ID NO: 218681 - DNA, 25 bp, Rattus norvegicus
caactgcggttgacactttttattt

SEQ ID NO: 218682 - DNA, 25 bp, Rattus norvegicus
caactgcggttgtcactttttattt

SEQ ID NO: 218683 - DNA, 25 bp, Rattus norvegicus
caactgctaaagaaggtggaggccc

SEQ ID NO: 218684 - DNA, 25 bp, Rattus norvegicus
caactgctaaagtaggtggaggccc

SEQ ID NO: 218685 - DNA, 25 bp, Rattus norvegicus
caactgctctacatctggatttaca

SEQ ID NO: 218686 - DNA, 25 bp, Rattus norvegicus
caactgctctacttctggatttaca

SEQ ID NO: 218687 - DNA, 25 bp, Rattus norvegicus
caactgcttacaatggccatgtttt

SEQ ID NO: 218688 - DNA, 25 bp, Rattus norvegicus
caactgcttacattggccatgtttt

SEQ ID NO: 218689 - DNA, 25 bp, Rattus norvegicus
caactgcttcacctgagatccaaaa

SEQ ID NO: 218690 - DNA, 25 bp, Rattus norvegicus
caactgcttcacgtgagatccaaaa

SEQ ID NO: 218691 - DNA, 25 bp, Rattus norvegicus
caactgcttggacacctgagaccta

SEQ ID NO: 218692 - DNA, 25 bp, Rattus norvegicus
caactgcttggagacctgagaccta

SEQ ID NO: 218693 - DNA, 25 bp, Rattus norvegicus
caactgctttccacatatgtcttag

SEQ ID NO: 218694 - DNA, 25 bp, Rattus norvegicus
caactgctttcctcatatgtcttag

SEQ ID NO: 218695 - DNA, 25 bp, Rattus norvegicus
caactggagaggaatgctgaaaact

SEQ ID NO: 218696 - DNA, 25 bp, Rattus norvegicus
caactggagaggtatgctgaaaact

SEQ ID NO: 218697 - DNA, 25 bp, Rattus norvegicus
caactggatgagaagcttgggatca

SEQ ID NO: 218698 - DNA, 25 bp, Rattus norvegicus
caactggatgagtagcttgggatca

SEQ ID NO: 218699 - DNA, 25 bp, Rattus norvegicus
caactgggaactctccgtgggctta

SEQ ID NO: 218700 - DNA, 25 bp, Rattus norvegicus
caactgggaactgtccgtgggctta

SEQ ID NO: 218701 - DNA, 25 bp, Rattus norvegicus
caactgggacctctcaatgcaatga

SEQ ID NO: 218702 - DNA, 25 bp, Rattus norvegicus
caactgggacctgtcaatgcaatga

SEQ ID NO: 218703 - DNA, 25 bp, Rattus norvegicus
caactgggacgaaatggagaagatt

SEQ ID NO: 218704 - DNA, 25 bp, Rattus norvegicus
caactgggacgatatggagaagatt

SEQ ID NO: 218705 - DNA, 25 bp, Rattus norvegicus
caactgggcatgaggaccgaggacc

SEQ ID NO: 218706 - DNA, 25 bp, Rattus norvegicus
caactgggcatgtggaccgaggacc

SEQ ID NO: 218707 - DNA, 25 bp, Rattus norvegicus
caactgggtgataccatgtcaggat

SEQ ID NO: 218708 - DNA, 25 bp, Rattus norvegicus
caactgggtgattccatgtcaggat

SEQ ID NO: 218709 - DNA, 25 bp, Rattus norvegicus
caactggtatgtacttttgcatgta

SEQ ID NO: 218710 - DNA, 25 bp, Rattus norvegicus
caactggtatgtcatggctatgggc

SEQ ID NO: 218711 - DNA, 25 bp, Rattus norvegicus
caactggtatgtgatggctatgggc

SEQ ID NO: 218712 - DNA, 25 bp, Rattus norvegicus
caactggtatgttcttttgcatgta

SEQ ID NO: 218713 - DNA, 25 bp, Rattus norvegicus
caactggtggtgctcgattttcctc

SEQ ID NO: 218714 - DNA, 25 bp, Rattus norvegicus
caactggtggtggtcgattttcctc

SEQ ID NO: 218715 - DNA, 25 bp, Rattus norvegicus
caactgtaacagaaggtcctaaacg

SEQ ID NO: 218716 - DNA, 25 bp, Rattus norvegicus
caactgtaacagtaggtcctaaacg

SEQ ID NO: 218717 - DNA, 25 bp, Rattus norvegicus
caactgtagccacctttgctgactc

SEQ ID NO: 218718 - DNA, 25 bp, Rattus norvegicus
caactgtagccagctttgctgactc

SEQ ID NO: 218719 - DNA, 25 bp, Rattus norvegicus
caactgtatggtcgccgttggctac

SEQ ID NO: 218720 - DNA, 25 bp, Rattus norvegicus
caactgtatggtggccgttggctac

SEQ ID NO: 218721 - DNA, 25 bp, Rattus norvegicus
caactgtcccaccaggctgggtttt

SEQ ID NO: 218722 - DNA, 25 bp, Rattus norvegicus
caactgtcccacgaggctgggtttt

SEQ ID NO: 218723 - DNA, 25 bp, Rattus norvegicus
caactgtgaagtacctttgtacata

SEQ ID NO: 218724 - DNA, 25 bp, Rattus norvegicus
caactgtgaagttcctttgtacata

SEQ ID NO: 218725 - DNA, 25 bp, Rattus norvegicus
caactgtgacttctggatttggagt

SEQ ID NO: 218726 - DNA, 25 bp, Rattus norvegicus
caactgtgacttgtggatttggagt

SEQ ID NO: 218727 - DNA, 25 bp, Rattus norvegicus
caactgtgccctctaccatcgtggg

SEQ ID NO: 218728 - DNA, 25 bp, Rattus norvegicus
caactgtgccctgtaccatcgtggg

SEQ ID NO: 218729 - DNA, 25 bp, Rattus norvegicus
caactgtgccgtccgttaccatgga

SEQ ID NO: 218730 - DNA, 25 bp, Rattus norvegicus
caactgtgccgtgcgttaccatgga

SEQ ID NO: 218731 - DNA, 25 bp, Rattus norvegicus
caactgtggcaacccctttagttat

SEQ ID NO: 218732 - DNA, 25 bp, Rattus norvegicus
caactgtggcaagccctttagttat

SEQ ID NO: 218733 - DNA, 25 bp, Rattus norvegicus
caactgtggcggattgctctggaat

SEQ ID NO: 218734 - DNA, 25 bp, Rattus norvegicus
caactgtggcggtttgctctggaat

SEQ ID NO: 218735 - DNA, 25 bp, Rattus norvegicus
caactgttgcacctggatttcccaa

SEQ ID NO: 218736 - DNA, 25 bp, Rattus norvegicus
caactgttgcacgtggatttcccaa

SEQ ID NO: 218737 - DNA, 25 bp, Rattus norvegicus
caactgttgttcatgcacgctggat

SEQ ID NO: 218738 - DNA, 25 bp, Rattus norvegicus
caactgttgttcttgcacgctggat

SEQ ID NO: 218739 - DNA, 25 bp, Rattus norvegicus
caactgttgttgcttctgtcttgaa

SEQ ID NO: 218740 - DNA, 25 bp, Rattus norvegicus
caactgttgttggttctgtcttgaa

SEQ ID NO: 218741 - DNA, 25 bp, Rattus norvegicus
caactgtttgttctagtctacctgg

SEQ ID NO: 218742 - DNA, 25 bp, Rattus norvegicus
caactgtttgttgtagtctacctgg

SEQ ID NO: 218743 - DNA, 25 bp, Rattus norvegicus
caactgtttttgcatatttctgaat

SEQ ID NO: 218744 - DNA, 25 bp, Rattus norvegicus
caactgtttttggatatttctgaat

SEQ ID NO: 218745 - DNA, 25 bp, Rattus norvegicus
caacttacaccaattgcaatggcta

SEQ ID NO: 218746 - DNA, 25 bp, Rattus norvegicus
caacttacaccatttgcaatggcta

SEQ ID NO: 218747 - DNA, 25 bp, Rattus norvegicus
caacttacagatccaatgtgcctta

SEQ ID NO: 218748 - DNA, 25 bp, Rattus norvegicus
caacttacagatgcaatgtgcctta

SEQ ID NO: 218749 - DNA, 25 bp, Rattus norvegicus
caacttaccggaacgggatgcactt

SEQ ID NO: 218750 - DNA, 25 bp, Rattus norvegicus
caacttaccggatcgggatgcactt

SEQ ID NO: 218751 - DNA, 25 bp, Rattus norvegicus
caacttacgctgaggctgataacat

SEQ ID NO: 218752 - DNA, 25 bp, Rattus norvegicus
caacttacgctgtggctgataacat

SEQ ID NO: 218753 - DNA, 25 bp, Rattus norvegicus
caacttactctaagtggcactgtca

SEQ ID NO: 218754 - DNA, 25 bp, Rattus norvegicus
caacttactctatgtggcactgtca

SEQ ID NO: 218755 - DNA, 25 bp, Rattus norvegicus
caacttactgttatctcggatctgg

SEQ ID NO: 218756 - DNA, 25 bp, Rattus norvegicus
caacttactgttttctcggatctgg

SEQ ID NO: 218757 - DNA, 25 bp, Rattus norvegicus
caacttaggcctccgagacacgtga

SEQ ID NO: 218758 - DNA, 25 bp, Rattus norvegicus
caacttaggcctgcgagacacgtga

SEQ ID NO: 218759 - DNA, 25 bp, Rattus norvegicus
caacttagggctcctgttcgggctg

SEQ ID NO: 218760 - DNA, 25 bp, Rattus norvegicus
caacttagggctgctgttcgggctg

SEQ ID NO: 218761 - DNA, 25 bp, Rattus norvegicus
caacttagttgcctttggtttcata

SEQ ID NO: 218762 - DNA, 25 bp, Rattus norvegicus
caacttagttgcgtttggtttcata

SEQ ID NO: 218763 - DNA, 25 bp, Rattus norvegicus
caacttcacaaacttgttctctggt

SEQ ID NO: 218764 - DNA, 25 bp, Rattus norvegicus
caacttcacaaagttgttctctggt

SEQ ID NO: 218765 - DNA, 25 bp, Rattus norvegicus
caacttcagaagattcccagcacac

SEQ ID NO: 218766 - DNA, 25 bp, Rattus norvegicus
caacttcagaagtttcccagcacac

SEQ ID NO: 218767 - DNA, 25 bp, Rattus norvegicus
caacttcatctcctgtaaccatgat

SEQ ID NO: 218768 - DNA, 25 bp, Rattus norvegicus
caacttcatctcgtgtaaccatgat

SEQ ID NO: 218769 - DNA, 25 bp, Rattus norvegicus
caacttccaccaaccagaaggaggg

SEQ ID NO: 218770 - DNA, 25 bp, Rattus norvegicus
caacttccaccatccagaaggaggg

SEQ ID NO: 218771 - DNA, 25 bp, Rattus norvegicus
caacttccttccctaataggcaact

SEQ ID NO: 218772 - DNA, 25 bp, Rattus norvegicus
caacttccttccgtaataggcaact

SEQ ID NO: 218773 - DNA, 25 bp, Rattus norvegicus
caacttctctctaaccttggaaaag

SEQ ID NO: 218774 - DNA, 25 bp, Rattus norvegicus
caacttctctcttaccttggaaaag

SEQ ID NO: 218775 - DNA, 25 bp, Rattus norvegicus
caacttctgagcagggtctagggag

SEQ ID NO: 218776 - DNA, 25 bp, Rattus norvegicus
caacttctgagctgggtctagggag

SEQ ID NO: 218777 - DNA, 25 bp, Rattus norvegicus
caacttctgatcattttgtctctac

SEQ ID NO: 218778 - DNA, 25 bp, Rattus norvegicus
caacttctgatctttttgtctctac

SEQ ID NO: 218779 - DNA, 25 bp, Rattus norvegicus
caacttctgatgagtttggccaaca

SEQ ID NO: 218780 - DNA, 25 bp, Rattus norvegicus
caacttctgatgtgtttggccaaca

SEQ ID NO: 218781 - DNA, 25 bp, Rattus norvegicus
caacttctggctctgtggtgtggct

SEQ ID NO: 218782 - DNA, 25 bp, Rattus norvegicus
caacttctggctgtgtggtgtggct

SEQ ID NO: 218783 - DNA, 25 bp, Rattus norvegicus
caacttctgggcattgagtaactgt

SEQ ID NO: 218784 - DNA, 25 bp, Rattus norvegicus
caacttctgggctttgagtaactgt

SEQ ID NO: 218785 - DNA, 25 bp, Rattus norvegicus
caacttctgggtaggcattggagca

SEQ ID NO: 218786 - DNA, 25 bp, Rattus norvegicus
caacttctgggttggcattggagca

SEQ ID NO: 218787 - DNA, 25 bp, Rattus norvegicus
caacttcttcaccttgtaaaactga

SEQ ID NO: 218788 - DNA, 25 bp, Rattus norvegicus
caacttcttcacgttgtaaaactga

SEQ ID NO: 218789 - DNA, 25 bp, Rattus norvegicus
caacttcttcatcctgggtttttgt

SEQ ID NO: 218790 - DNA, 25 bp, Rattus norvegicus
caacttcttcatgctgggtttttgt

SEQ ID NO: 218791 - DNA, 25 bp, Rattus norvegicus
caacttctttttagcgtcagaccta

SEQ ID NO: 218792 - DNA, 25 bp, Rattus norvegicus
caacttcttttttgcgtcagaccta

SEQ ID NO: 218793 - DNA, 25 bp, Rattus norvegicus
caacttgaacataccgttatagtag

SEQ ID NO: 218794 - DNA, 25 bp, Rattus norvegicus
caacttgaacattccgttatagtag

SEQ ID NO: 218795 - DNA, 25 bp, Rattus norvegicus
caacttgaacgtcagctggaaaatt

SEQ ID NO: 218796 - DNA, 25 bp, Rattus norvegicus
caacttgaacgtgagctggaaaatt

SEQ ID NO: 218797 - DNA, 25 bp, Rattus norvegicus
caacttgaactcactcactgattac

SEQ ID NO: 218798 - DNA, 25 bp, Rattus norvegicus
caacttgaactctctcactgattac

SEQ ID NO: 218799 - DNA, 25 bp, Rattus norvegicus
caacttgacaatatgctcctttcac

SEQ ID NO: 218800 - DNA, 25 bp, Rattus norvegicus
caacttgacaatttgctcctttcac

SEQ ID NO: 218801 - DNA, 25 bp, Rattus norvegicus
caacttgagtcaaagagaacctgta

SEQ ID NO: 218802 - DNA, 25 bp, Rattus norvegicus
caacttgagtcatagagaacctgta

SEQ ID NO: 218803 - DNA, 25 bp, Rattus norvegicus
caacttgcatccattgttttccaat

SEQ ID NO: 218804 - DNA, 25 bp, Rattus norvegicus
caacttgcatcctttgttttccaat

SEQ ID NO: 218805 - DNA, 25 bp, Rattus norvegicus
caacttgccagtatcatcggacatt

SEQ ID NO: 218806 - DNA, 25 bp, Rattus norvegicus
caacttgccagtttcatcggacatt

SEQ ID NO: 218807 - DNA, 25 bp, Rattus norvegicus
caacttgctgtaacttccttttgga

SEQ ID NO: 218808 - DNA, 25 bp, Rattus norvegicus
caacttgctgtatcttccttttgga

SEQ ID NO: 218809 - DNA, 25 bp, Rattus norvegicus
caacttgctttgaatgtggaaccaa

SEQ ID NO: 218810 - DNA, 25 bp, Rattus norvegicus
caacttgctttgtatgtggaaccaa

SEQ ID NO: 218811 - DNA, 25 bp, Rattus norvegicus
caacttggaccgatttcgctttgag

SEQ ID NO: 218812 - DNA, 25 bp, Rattus norvegicus
caacttggaccgttttcgctttgag

SEQ ID NO: 218813 - DNA, 25 bp, Rattus norvegicus
caacttggagtgacggacctgcttc

SEQ ID NO: 218814 - DNA, 25 bp, Rattus norvegicus
caacttggagtgtcggacctgcttc

SEQ ID NO: 218815 - DNA, 25 bp, Rattus norvegicus
caacttggatctattggaccccggg

SEQ ID NO: 218816 - DNA, 25 bp, Rattus norvegicus
caacttggatcttttggaccccggg

SEQ ID NO: 218817 - DNA, 25 bp, Rattus norvegicus
caacttggcagactggttccagcga

SEQ ID NO: 218818 - DNA, 25 bp, Rattus norvegicus
caacttggcagagtggttccagcga

SEQ ID NO: 218819 - DNA, 25 bp, Rattus norvegicus
caacttggcctgaacaagctagaga

SEQ ID NO: 218820 - DNA, 25 bp, Rattus norvegicus
caacttggcctgtacaagctagaga

SEQ ID NO: 218821 - DNA, 25 bp, Rattus norvegicus
caacttggctttatgattcttgctt

SEQ ID NO: 218822 - DNA, 25 bp, Rattus norvegicus
caacttggctttttgattcttgctt

SEQ ID NO: 218823 - DNA, 25 bp, Rattus norvegicus
caacttgggcccagctctagaccct

SEQ ID NO: 218824 - DNA, 25 bp, Rattus norvegicus
caacttgggccctgctctagaccct

SEQ ID NO: 218825 - DNA, 25 bp, Rattus norvegicus
caacttgggctgaaatctggtctcc

SEQ ID NO: 218826 - DNA, 25 bp, Rattus norvegicus
caacttgggctgtaatctggtctcc

SEQ ID NO: 218827 - DNA, 25 bp, Rattus norvegicus
caacttgtagctagcattgtctagt

SEQ ID NO: 218828 - DNA, 25 bp, Rattus norvegicus
caacttgtagcttgcattgtctagt

SEQ ID NO: 218829 - DNA, 25 bp, Rattus norvegicus
caacttgtccggattttatgccttg

SEQ ID NO: 218830 - DNA, 25 bp, Rattus norvegicus
caacttgtccggtttttatgccttg

SEQ ID NO: 218831 - DNA, 25 bp, Rattus norvegicus
caacttgttccaagatacctatcca

SEQ ID NO: 218832 - DNA, 25 bp, Rattus norvegicus
caacttgttccatgatacctatcca

SEQ ID NO: 218833 - DNA, 25 bp, Rattus norvegicus
caacttgttctgctcaagctggaga

SEQ ID NO: 218834 - DNA, 25 bp, Rattus norvegicus
caacttgttctggtcaagctggaga

SEQ ID NO: 218835 - DNA, 25 bp, Rattus norvegicus
caacttgtttgcctgaattctccta

SEQ ID NO: 218836 - DNA, 25 bp, Rattus norvegicus
caacttgtttgcgtgaattctccta

SEQ ID NO: 218837 - DNA, 25 bp, Rattus norvegicus
caactttccccaatccagaacaaat

SEQ ID NO: 218838 - DNA, 25 bp, Rattus norvegicus
caactttccccattccagaacaaat

SEQ ID NO: 218839 - DNA, 25 bp, Rattus norvegicus
caactttcccgacccattagaaatg

SEQ ID NO: 218840 - DNA, 25 bp, Rattus norvegicus
caactttcccgagccattagaaatg

SEQ ID NO: 218841 - DNA, 25 bp, Rattus norvegicus
caactttccctgaacgagtgccgtc

SEQ ID NO: 218842 - DNA, 25 bp, Rattus norvegicus
caactttccctgtacgagtgccgtc

SEQ ID NO: 218843 - DNA, 25 bp, Rattus norvegicus
caactttcgtttactctcccaagag

SEQ ID NO: 218844 - DNA, 25 bp, Rattus norvegicus
caactttcgttttctctcccaagag

SEQ ID NO: 218845 - DNA, 25 bp, Rattus norvegicus
caactttctaaaactccagctgcag

SEQ ID NO: 218846 - DNA, 25 bp, Rattus norvegicus
caactttctaaatctccagctgcag

SEQ ID NO: 218847 - DNA, 25 bp, Rattus norvegicus
caactttgaaaaacttttcctggat

SEQ ID NO: 218848 - DNA, 25 bp, Rattus norvegicus
caactttgaaaatcttttcctggat

SEQ ID NO: 218849 - DNA, 25 bp, Rattus norvegicus
caactttgacctcgtgtgggacaca

SEQ ID NO: 218850 - DNA, 25 bp, Rattus norvegicus
caactttgacctggtgtgggacaca

SEQ ID NO: 218851 - DNA, 25 bp, Rattus norvegicus
caactttgcttgactttaagatcac

SEQ ID NO: 218852 - DNA, 25 bp, Rattus norvegicus
caactttgcttgtctttaagatcac

SEQ ID NO: 218853 - DNA, 25 bp, Rattus norvegicus
caactttggaacctctagcccctag

SEQ ID NO: 218854 - DNA, 25 bp, Rattus norvegicus
caactttggaacgtctagcccctag

SEQ ID NO: 218855 - DNA, 25 bp, Rattus norvegicus
caactttggaatagatgagcgtaac

SEQ ID NO: 218856 - DNA, 25 bp, Rattus norvegicus
caactttggaattgatgagcgtaac

SEQ ID NO: 218857 - DNA, 25 bp, Rattus norvegicus
caactttggaccatcatactgtgaa

SEQ ID NO: 218858 - DNA, 25 bp, Rattus norvegicus
caactttggaccctgtgattctaaa

SEQ ID NO: 218859 - DNA, 25 bp, Rattus norvegicus
caactttggaccgtgtgattctaaa

SEQ ID NO: 218860 - DNA, 25 bp, Rattus norvegicus
caactttggaccttcatactgtgaa

SEQ ID NO: 218861 - DNA, 25 bp, Rattus norvegicus
caactttggactcgttccttttgct

SEQ ID NO: 218862 - DNA, 25 bp, Rattus norvegicus
caactttggactggttccttttgct

SEQ ID NO: 218863 - DNA, 25 bp, Rattus norvegicus
caactttggtggacagctcggcctg

SEQ ID NO: 218864 - DNA, 25 bp, Rattus norvegicus
caactttggtggtcagctcggcctg

SEQ ID NO: 218865 - DNA, 25 bp, Rattus norvegicus
caactttgtgaacccagtcctgtta

SEQ ID NO: 218866 - DNA, 25 bp, Rattus norvegicus
caactttgtgaagccagtcctgtta

SEQ ID NO: 218867 - DNA, 25 bp, Rattus norvegicus
caactttgtgagcttcgtccagggt

SEQ ID NO: 218868 - DNA, 25 bp, Rattus norvegicus
caactttgtgaggttcgtccagggt

SEQ ID NO: 218869 - DNA, 25 bp, Rattus norvegicus
caactttgttctccttttttaggtg

SEQ ID NO: 218870 - DNA, 25 bp, Rattus norvegicus
caactttgttctgcttttttaggtg

SEQ ID NO: 218871 - DNA, 25 bp, Rattus norvegicus
caacttttcaagctggtactggcct

SEQ ID NO: 218872 - DNA, 25 bp, Rattus norvegicus
caacttttcaaggtggtactggcct

SEQ ID NO: 218873 - DNA, 25 bp, Rattus norvegicus
caacttttccggctgatgtttgcag

SEQ ID NO: 218874 - DNA, 25 bp, Rattus norvegicus
caacttttccgggtgatgtttgcag

SEQ ID NO: 218875 - DNA, 25 bp, Rattus norvegicus
caacttttcctcagggctcgataat

SEQ ID NO: 218876 - DNA, 25 bp, Rattus norvegicus
caacttttcctctgggctcgataat

SEQ ID NO: 218877 - DNA, 25 bp, Rattus norvegicus
caacttttctccactacaaactgat

SEQ ID NO: 218878 - DNA, 25 bp, Rattus norvegicus
caacttttctcctctacaaactgat

SEQ ID NO: 218879 - DNA, 25 bp, Rattus norvegicus
caacttttgctactgctgtgatcat

SEQ ID NO: 218880 - DNA, 25 bp, Rattus norvegicus
caacttttgctagtgctgtgatcat

SEQ ID NO: 218881 - DNA, 25 bp, Rattus norvegicus
caacttttgttgatctaaccaggat

SEQ ID NO: 218882 - DNA, 25 bp, Rattus norvegicus
caacttttgttgttctaaccaggat

SEQ ID NO: 218883 - DNA, 25 bp, Rattus norvegicus
caacttttttgaacatacgcctcca

SEQ ID NO: 218884 - DNA, 25 bp, Rattus norvegicus
caacttttttgatcatacgcctcca

SEQ ID NO: 218885 - DNA, 25 bp, Rattus norvegicus
caagaaaacctaagaccgggcaatt

SEQ ID NO: 218886 - DNA, 25 bp, Rattus norvegicus
caagaaaacctatgaccgggcaatt

SEQ ID NO: 218887 - DNA, 25 bp, Rattus norvegicus
caagaaaatctcactgccatggtag

SEQ ID NO: 218888 - DNA, 25 bp, Rattus norvegicus
caagaaaatctctctgccatggtag

SEQ ID NO: 218889 - DNA, 25 bp, Rattus norvegicus
caagaaacatcaaggccgagccgga

SEQ ID NO: 218890 - DNA, 25 bp, Rattus norvegicus
caagaaacatcatggccgagccgga

SEQ ID NO: 218891 - DNA, 25 bp, Rattus norvegicus
caagaaactgcccttacctcaactg

SEQ ID NO: 218892 - DNA, 25 bp, Rattus norvegicus
caagaaactgccgttacctcaactg

SEQ ID NO: 218893 - DNA, 25 bp, Rattus norvegicus
caagaaatagccaccatgtgctgcc

SEQ ID NO: 218894 - DNA, 25 bp, Rattus norvegicus
caagaaatagcctccatgtgctgcc

SEQ ID NO: 218895 - DNA, 25 bp, Rattus norvegicus
caagaaatctggactgtcctggaga

SEQ ID NO: 218896 - DNA, 25 bp, Rattus norvegicus
caagaaatctggtctgtcctggaga

SEQ ID NO: 218897 - DNA, 25 bp, Rattus norvegicus
caagaacaaactcgtagggactcca

SEQ ID NO: 218898 - DNA, 25 bp, Rattus norvegicus
caagaacaaactggtagggactcca

SEQ ID NO: 218899 - DNA, 25 bp, Rattus norvegicus
caagaacaagctactgacctcagag

SEQ ID NO: 218900 - DNA, 25 bp, Rattus norvegicus
caagaacaagcttctgacctcagag

SEQ ID NO: 218901 - DNA, 25 bp, Rattus norvegicus
caagaacacatccatgcttttccta

SEQ ID NO: 218902 - DNA, 25 bp, Rattus norvegicus
caagaacacatcgatgcttttccta

SEQ ID NO: 218903 - DNA, 25 bp, Rattus norvegicus
caagaacatgctcccctggactatg

SEQ ID NO: 218904 - DNA, 25 bp, Rattus norvegicus
caagaacatgctgccctggactatg

SEQ ID NO: 218905 - DNA, 25 bp, Rattus norvegicus
caagaaccctccacattttatgtac

SEQ ID NO: 218906 - DNA, 25 bp, Rattus norvegicus
caagaaccctcctcattttatgtac

SEQ ID NO: 218907 - DNA, 25 bp, Rattus norvegicus
caagaaccgccactcattcagtatt

SEQ ID NO: 218908 - DNA, 25 bp, Rattus norvegicus
caagaaccgccagtcattcagtatt

SEQ ID NO: 218909 - DNA, 25 bp, Rattus norvegicus
caagaacgatgacgctcccaaggaa

SEQ ID NO: 218910 - DNA, 25 bp, Rattus norvegicus
caagaacgatgaggctcccaaggaa

SEQ ID NO: 218911 - DNA, 25 bp, Rattus norvegicus
caagaactcataataccccagtggg

SEQ ID NO: 218912 - DNA, 25 bp, Rattus norvegicus
caagaactcatattaccccagtggg

SEQ ID NO: 218913 - DNA, 25 bp, Rattus norvegicus
caagaactgttccaagttgccctgc

SEQ ID NO: 218914 - DNA, 25 bp, Rattus norvegicus
caagaactgttcgaagttgccctgc

SEQ ID NO: 218915 - DNA, 25 bp, Rattus norvegicus
caagaacttcacaacacctttcgaa

SEQ ID NO: 218916 - DNA, 25 bp, Rattus norvegicus
caagaacttcactacacctttcgaa

SEQ ID NO: 218917 - DNA, 25 bp, Rattus norvegicus
caagaagaacttcgtgcggctgcag

SEQ ID NO: 218918 - DNA, 25 bp, Rattus norvegicus
caagaagaacttggtgcggctgcag

SEQ ID NO: 218919 - DNA, 25 bp, Rattus norvegicus
caagaagactggctgtaacaaaatc

SEQ ID NO: 218920 - DNA, 25 bp, Rattus norvegicus
caagaagactgggtgtaacaaaatc

SEQ ID NO: 218921 - DNA, 25 bp, Rattus norvegicus
caagaagaggctcctcgacgctcag

SEQ ID NO: 218922 - DNA, 25 bp, Rattus norvegicus
caagaagaggctgctcgacgctcag

SEQ ID NO: 218923 - DNA, 25 bp, Rattus norvegicus
caagaagatctaccgcattggccgg

SEQ ID NO: 218924 - DNA, 25 bp, Rattus norvegicus
caagaagatctagcgcattggccgg

SEQ ID NO: 218925 - DNA, 25 bp, Rattus norvegicus
caagaagcctagaccattcagtggt

SEQ ID NO: 218926 - DNA, 25 bp, Rattus norvegicus
caagaagcctagtccattcagtggt

SEQ ID NO: 218927 - DNA, 25 bp, Rattus norvegicus
caagaagccttaacactgtgactaa

SEQ ID NO: 218928 - DNA, 25 bp, Rattus norvegicus
caagaagccttatcactgtgactaa

SEQ ID NO: 218929 - DNA, 25 bp, Rattus norvegicus
caagaagcgttcacatggctcacct

SEQ ID NO: 218930 - DNA, 25 bp, Rattus norvegicus
caagaagcgttctcatggctcacct

SEQ ID NO: 218931 - DNA, 25 bp, Rattus norvegicus
caagaagctactatgctgtgtgacc

SEQ ID NO: 218932 - DNA, 25 bp, Rattus norvegicus
caagaagctactttgctgtgtgacc

SEQ ID NO: 218933 - DNA, 25 bp, Rattus norvegicus
caagaagctagactccaaactggac

SEQ ID NO: 218934 - DNA, 25 bp, Rattus norvegicus
caagaagctagagtccaaactggac

SEQ ID NO: 218935 - DNA, 25 bp, Rattus norvegicus
caagaagctcccaacagtactgatt

SEQ ID NO: 218936 - DNA, 25 bp, Rattus norvegicus
caagaagctccctacagtactgatt

SEQ ID NO: 218937 - DNA, 25 bp, Rattus norvegicus
caagaagctcttatggtccctgtaa

SEQ ID NO: 218938 - DNA, 25 bp, Rattus norvegicus
caagaagctcttttggtccctgtaa

SEQ ID NO: 218939 - DNA, 25 bp, Rattus norvegicus
caagaagctggtcggcccttcggaa

SEQ ID NO: 218940 - DNA, 25 bp, Rattus norvegicus
caagaagctggtgggcccttcggaa

SEQ ID NO: 218941 - DNA, 25 bp, Rattus norvegicus
caagaagcttttactcccaggaagg

SEQ ID NO: 218942 - DNA, 25 bp, Rattus norvegicus
caagaagcttttcggctaccagcat

SEQ ID NO: 218943 - DNA, 25 bp, Rattus norvegicus
caagaagcttttgggctaccagcat

SEQ ID NO: 218944 - DNA, 25 bp, Rattus norvegicus
caagaagctttttctcccaggaagg

SEQ ID NO: 218945 - DNA, 25 bp, Rattus norvegicus
caagaaggaccaaggcaggaggcca

SEQ ID NO: 218946 - DNA, 25 bp, Rattus norvegicus
caagaaggaccatggcaggaggcca

SEQ ID NO: 218947 - DNA, 25 bp, Rattus norvegicus
caagaaggagcgaagggcccctcct

SEQ ID NO: 218948 - DNA, 25 bp, Rattus norvegicus
caagaaggagcgtagggcccctcct

SEQ ID NO: 218949 - DNA, 25 bp, Rattus norvegicus
caagaaggctgtcccgaggccctgc

SEQ ID NO: 218950 - DNA, 25 bp, Rattus norvegicus
caagaaggctgtgccgaggccctgc

SEQ ID NO: 218951 - DNA, 25 bp, Rattus norvegicus
caagaagggaacacttgacctcgga

SEQ ID NO: 218952 - DNA, 25 bp, Rattus norvegicus
caagaagggaactcttgacctcgga

SEQ ID NO: 218953 - DNA, 25 bp, Rattus norvegicus
caagaagggcaaaacctcccacaca

SEQ ID NO: 218954 - DNA, 25 bp, Rattus norvegicus
caagaagggcaatacctcccacaca

SEQ ID NO: 218955 - DNA, 25 bp, Rattus norvegicus
caagaagtatgtaggcctctccttt

SEQ ID NO: 218956 - DNA, 25 bp, Rattus norvegicus
caagaagtatgttggcctctccttt

SEQ ID NO: 218957 - DNA, 25 bp, Rattus norvegicus
caagaagtgcttaatgggttccttt

SEQ ID NO: 218958 - DNA, 25 bp, Rattus norvegicus
caagaagtgctttatgggttccttt

SEQ ID NO: 218959 - DNA, 25 bp, Rattus norvegicus
caagaagtgtcacttaccaagtcag

SEQ ID NO: 218960 - DNA, 25 bp, Rattus norvegicus
caagaagtgtcagttaccaagtcag

SEQ ID NO: 218961 - DNA, 25 bp, Rattus norvegicus
caagaatacattcggctttggtctt

SEQ ID NO: 218962 - DNA, 25 bp, Rattus norvegicus
caagaatacattgggctttggtctt

SEQ ID NO: 218963 - DNA, 25 bp, Rattus norvegicus
caagaatacgacaccctgtccctaa

SEQ ID NO: 218964 - DNA, 25 bp, Rattus norvegicus
caagaatacgactccctgtccctaa

SEQ ID NO: 218965 - DNA, 25 bp, Rattus norvegicus
caagaatagcacaaaccatgaggtt

SEQ ID NO: 218966 - DNA, 25 bp, Rattus norvegicus
caagaatagcactaaccatgaggtt

SEQ ID NO: 218967 - DNA, 25 bp, Rattus norvegicus
caagaatatatactactgaccaaag

SEQ ID NO: 218968 - DNA, 25 bp, Rattus norvegicus
caagaatatatagtactgaccaaag

SEQ ID NO: 218969 - DNA, 25 bp, Rattus norvegicus
caagaatcacccctacacaatctat

SEQ ID NO: 218970 - DNA, 25 bp, Rattus norvegicus
caagaatcacccgtacacaatctat

SEQ ID NO: 218971 - DNA, 25 bp, Rattus norvegicus
caagaatcaccgatcctgacaatgg

SEQ ID NO: 218972 - DNA, 25 bp, Rattus norvegicus
caagaatcaccgttcctgacaatgg

SEQ ID NO: 218973 - DNA, 25 bp, Rattus norvegicus
caagaatccgcaattgtatttcaag

SEQ ID NO: 218974 - DNA, 25 bp, Rattus norvegicus
caagaatccgcatttgtatttcaag

SEQ ID NO: 218975 - DNA, 25 bp, Rattus norvegicus
caagaatctatgctgtggtgcctaa

SEQ ID NO: 218976 - DNA, 25 bp, Rattus norvegicus
caagaatctatggtgtggtgcctaa

SEQ ID NO: 218977 - DNA, 25 bp, Rattus norvegicus
caagaatgccatccgggccacagtg

SEQ ID NO: 218978 - DNA, 25 bp, Rattus norvegicus
caagaatgccatgcgggccacagtg

SEQ ID NO: 218979 - DNA, 25 bp, Rattus norvegicus
caagaatggcctatgctcgaggtct

SEQ ID NO: 218980 - DNA, 25 bp, Rattus norvegicus
caagaatggcctttgctcgaggtct

SEQ ID NO: 218981 - DNA, 25 bp, Rattus norvegicus
caagaatgggccagcaggatggctc

SEQ ID NO: 218982 - DNA, 25 bp, Rattus norvegicus
caagaatgggcctgcaggatggctc

SEQ ID NO: 218983 - DNA, 25 bp, Rattus norvegicus
caagaatgttggacctctgggcggc

SEQ ID NO: 218984 - DNA, 25 bp, Rattus norvegicus
caagaatgttggtcctctgggcggc

SEQ ID NO: 218985 - DNA, 25 bp, Rattus norvegicus
caagaattagtgctttccttcccag

SEQ ID NO: 218986 - DNA, 25 bp, Rattus norvegicus
caagaattagtggtttccttcccag

SEQ ID NO: 218987 - DNA, 25 bp, Rattus norvegicus
caagaattctggcttggtcctccta

SEQ ID NO: 218988 - DNA, 25 bp, Rattus norvegicus
caagaattctgggttggtcctccta

SEQ ID NO: 218989 - DNA, 25 bp, Rattus norvegicus
caagaattgtatactaggccctggc

SEQ ID NO: 218990 - DNA, 25 bp, Rattus norvegicus
caagaattgtattctaggccctggc

SEQ ID NO: 218991 - DNA, 25 bp, Rattus norvegicus
caagaatttagcaggtttttgccct

SEQ ID NO: 218992 - DNA, 25 bp, Rattus norvegicus
caagaatttagctggtttttgccct

SEQ ID NO: 218993 - DNA, 25 bp, Rattus norvegicus
caagacaaagggaccagcagtaaat

SEQ ID NO: 218994 - DNA, 25 bp, Rattus norvegicus
caagacaaagggtccagcagtaaat

SEQ ID NO: 218995 - DNA, 25 bp, Rattus norvegicus
caagacactactcacactggacggg

SEQ ID NO: 218996 - DNA, 25 bp, Rattus norvegicus
caagacactactgacactggacggg

SEQ ID NO: 218997 - DNA, 25 bp, Rattus norvegicus
caagacagacagatggcgacccacc

SEQ ID NO: 218998 - DNA, 25 bp, Rattus norvegicus
caagacagacagttggcgacccacc

SEQ ID NO: 218999 - DNA, 25 bp, Rattus norvegicus
caagacagctttctactctttctac

SEQ ID NO: 219000 - DNA, 25 bp, Rattus norvegicus
caagacagctttgtactctttctac

SEQ ID NO: 219001 - DNA, 25 bp, Rattus norvegicus
caagacaggacacgccagacctaag

SEQ ID NO: 219002 - DNA, 25 bp, Rattus norvegicus
caagacaggacaggccagacctaag

SEQ ID NO: 219003 - DNA, 25 bp, Rattus norvegicus
caagacagtcagctcagaaatcccc

SEQ ID NO: 219004 - DNA, 25 bp, Rattus norvegicus
caagacagtcaggtcagaaatcccc

SEQ ID NO: 219005 - DNA, 25 bp, Rattus norvegicus
caagacatcaacagggagcaaatcc

SEQ ID NO: 219006 - DNA, 25 bp, Rattus norvegicus
caagacatcaactgggagcaaatcc

SEQ ID NO: 219007 - DNA, 25 bp, Rattus norvegicus
caagaccaagcaccgcaccagggaa

SEQ ID NO: 219008 - DNA, 25 bp, Rattus norvegicus
caagaccaagcagcgcaccagggaa

SEQ ID NO: 219009 - DNA, 25 bp, Rattus norvegicus
caagaccaccttcgcggtgttggga

SEQ ID NO: 219010 - DNA, 25 bp, Rattus norvegicus
caagaccaccttggcggtgttggga

SEQ ID NO: 219011 - DNA, 25 bp, Rattus norvegicus
caagaccagcacaatgacatcacca

SEQ ID NO: 219012 - DNA, 25 bp, Rattus norvegicus
caagaccagcactatgacatcacca

SEQ ID NO: 219013 - DNA, 25 bp, Rattus norvegicus
caagaccatcctaggttagggtagt

SEQ ID NO: 219014 - DNA, 25 bp, Rattus norvegicus
caagaccatccttggttagggtagt

SEQ ID NO: 219015 - DNA, 25 bp, Rattus norvegicus
caagacccaggacctgttccgaagg

SEQ ID NO: 219016 - DNA, 25 bp, Rattus norvegicus
caagacccaggagctgttccgaagg

SEQ ID NO: 219017 - DNA, 25 bp, Rattus norvegicus
caagaccccgctacaataatgttca

SEQ ID NO: 219018 - DNA, 25 bp, Rattus norvegicus
caagaccccgcttcaataatgttca

SEQ ID NO: 219019 - DNA, 25 bp, Rattus norvegicus
caagaccctcatcacttacatttta

SEQ ID NO: 219020 - DNA, 25 bp, Rattus norvegicus
caagaccctcatgacttacatttta

SEQ ID NO: 219021 - DNA, 25 bp, Rattus norvegicus
caagaccggcggaggtacctcaggt

SEQ ID NO: 219022 - DNA, 25 bp, Rattus norvegicus
caagaccggcggtggtacctcaggt

SEQ ID NO: 219023 - DNA, 25 bp, Rattus norvegicus
caagaccgtttcagaactttccact

SEQ ID NO: 219024 - DNA, 25 bp, Rattus norvegicus
caagaccgtttctgaactttccact

SEQ ID NO: 219025 - DNA, 25 bp, Rattus norvegicus
caagacctcaacaagtttcacacct

SEQ ID NO: 219026 - DNA, 25 bp, Rattus norvegicus
caagacctcaactagtttcacacct

SEQ ID NO: 219027 - DNA, 25 bp, Rattus norvegicus
caagacctccgcatccaagttaaac

SEQ ID NO: 219028 - DNA, 25 bp, Rattus norvegicus
caagacctccgcttccaagttaaac

SEQ ID NO: 219029 - DNA, 25 bp, Rattus norvegicus
caagacctctctacgtaaagtgcag

SEQ ID NO: 219030 - DNA, 25 bp, Rattus norvegicus
caagacctctcttcgtaaagtgcag

SEQ ID NO: 219031 - DNA, 25 bp, Rattus norvegicus
caagacctgagaaggctttgcctgt

SEQ ID NO: 219032 - DNA, 25 bp, Rattus norvegicus
caagacctgagatggctttgcctgt

SEQ ID NO: 219033 - DNA, 25 bp, Rattus norvegicus
caagacctgcagaccgtgtgtccgt

SEQ ID NO: 219034 - DNA, 25 bp, Rattus norvegicus
caagacctgcagtccgtgtgtccgt

SEQ ID NO: 219035 - DNA, 25 bp, Rattus norvegicus
caagacctggccaaccggaagtgtt

SEQ ID NO: 219036 - DNA, 25 bp, Rattus norvegicus
caagacctggcctaccggaagtgtt

SEQ ID NO: 219037 - DNA, 25 bp, Rattus norvegicus
caagacctgtttctatttgtgacta

SEQ ID NO: 219038 - DNA, 25 bp, Rattus norvegicus
caagacctgtttgtatttgtgacta

SEQ ID NO: 219039 - DNA, 25 bp, Rattus norvegicus
caagaccttgaaatgtgctcgtttc

SEQ ID NO: 219040 - DNA, 25 bp, Rattus norvegicus
caagaccttgaattgtgctcgtttc

SEQ ID NO: 219041 - DNA, 25 bp, Rattus norvegicus
caagacgaagcccttcgggccaaga

SEQ ID NO: 219042 - DNA, 25 bp, Rattus norvegicus
caagacgaagccgttcgggccaaga

SEQ ID NO: 219043 - DNA, 25 bp, Rattus norvegicus
caagacgaaggacatttccggttgt

SEQ ID NO: 219044 - DNA, 25 bp, Rattus norvegicus
caagacgaaggagatttccggttgt

SEQ ID NO: 219045 - DNA, 25 bp, Rattus norvegicus
caagacgagcaccaggaacctaagc

SEQ ID NO: 219046 - DNA, 25 bp, Rattus norvegicus
caagacgagcacgaggaacctaagc

SEQ ID NO: 219047 - DNA, 25 bp, Rattus norvegicus
caagacgcacggctggcaagtatta

SEQ ID NO: 219048 - DNA, 25 bp, Rattus norvegicus
caagacgcacgggtggcaagtatta

SEQ ID NO: 219049 - DNA, 25 bp, Rattus norvegicus
caagacgctagtcctgctgatgggc

SEQ ID NO: 219050 - DNA, 25 bp, Rattus norvegicus
caagacgctagtgctgctgatgggc

SEQ ID NO: 219051 - DNA, 25 bp, Rattus norvegicus
caagacgttaagagactaatactat

SEQ ID NO: 219052 - DNA, 25 bp, Rattus norvegicus
caagacgttaagtgactaatactat

SEQ ID NO: 219053 - DNA, 25 bp, Rattus norvegicus
caagactaacatcgcggattgccca

SEQ ID NO: 219054 - DNA, 25 bp, Rattus norvegicus
caagactaacatggcggattgccca

SEQ ID NO: 219055 - DNA, 25 bp, Rattus norvegicus
caagactaatgtagttccttacaca

SEQ ID NO: 219056 - DNA, 25 bp, Rattus norvegicus
caagactaatgttgttccttacaca

SEQ ID NO: 219057 - DNA, 25 bp, Rattus norvegicus
caagactaccttacagcagtgtgca

SEQ ID NO: 219058 - DNA, 25 bp, Rattus norvegicus
caagactacctttcagcagtgtgca

SEQ ID NO: 219059 - DNA, 25 bp, Rattus norvegicus
caagactagtaacgtggctgcgcag

SEQ ID NO: 219060 - DNA, 25 bp, Rattus norvegicus
caagactagtaaggtggctgcgcag

SEQ ID NO: 219061 - DNA, 25 bp, Rattus norvegicus
caagactcagttagatgtgtatgct

SEQ ID NO: 219062 - DNA, 25 bp, Rattus norvegicus
caagactcagtttgatgtgtatgct

SEQ ID NO: 219063 - DNA, 25 bp, Rattus norvegicus
caagactccatgatgtctacagtgg

SEQ ID NO: 219064 - DNA, 25 bp, Rattus norvegicus
caagactccatgttgtctacagtgg

SEQ ID NO: 219065 - DNA, 25 bp, Rattus norvegicus
caagactcccatatagtggccagga

SEQ ID NO: 219066 - DNA, 25 bp, Rattus norvegicus
caagactcccatttagtggccagga

SEQ ID NO: 219067 - DNA, 25 bp, Rattus norvegicus
caagactccggcattctggacatgc

SEQ ID NO: 219068 - DNA, 25 bp, Rattus norvegicus
caagactccggctttctggacatgc

SEQ ID NO: 219069 - DNA, 25 bp, Rattus norvegicus
caagactccttaattatattcacag

SEQ ID NO: 219070 - DNA, 25 bp, Rattus norvegicus
caagactccttatttatattcacag

SEQ ID NO: 219071 - DNA, 25 bp, Rattus norvegicus
caagactctcctccttttcttttat

SEQ ID NO: 219072 - DNA, 25 bp, Rattus norvegicus
caagactctcctgcttttcttttat

SEQ ID NO: 219073 - DNA, 25 bp, Rattus norvegicus
caagactcttgcagattggacaggt

SEQ ID NO: 219074 - DNA, 25 bp, Rattus norvegicus
caagactcttgctgattggacaggt

SEQ ID NO: 219075 - DNA, 25 bp, Rattus norvegicus
caagactcttttagtactaccacac

SEQ ID NO: 219076 - DNA, 25 bp, Rattus norvegicus
caagactctttttgtactaccacac

SEQ ID NO: 219077 - DNA, 25 bp, Rattus norvegicus
caagactgccttccttcgtttgcta

SEQ ID NO: 219078 - DNA, 25 bp, Rattus norvegicus
caagactgccttgcttcgtttgcta

SEQ ID NO: 219079 - DNA, 25 bp, Rattus norvegicus
caagactgcttactaagaccctatc

SEQ ID NO: 219080 - DNA, 25 bp, Rattus norvegicus
caagactgcttagtaagaccctatc

SEQ ID NO: 219081 - DNA, 25 bp, Rattus norvegicus
caagactgggccacatggttttatt

SEQ ID NO: 219082 - DNA, 25 bp, Rattus norvegicus
caagactgggcctcatggttttatt

SEQ ID NO: 219083 - DNA, 25 bp, Rattus norvegicus
caagactgtcacaagcaccatgcta

SEQ ID NO: 219084 - DNA, 25 bp, Rattus norvegicus
caagactgtcactagcaccatgcta

SEQ ID NO: 219085 - DNA, 25 bp, Rattus norvegicus
caagactgtctcacgccttacatgg

SEQ ID NO: 219086 - DNA, 25 bp, Rattus norvegicus
caagactgtctctcgccttacatgg

SEQ ID NO: 219087 - DNA, 25 bp, Rattus norvegicus
caagactttcttctctagaactgaa

SEQ ID NO: 219088 - DNA, 25 bp, Rattus norvegicus
caagactttcttgtctagaactgaa

SEQ ID NO: 219089 - DNA, 25 bp, Rattus norvegicus
caagactttgctctggatgagccac

SEQ ID NO: 219090 - DNA, 25 bp, Rattus norvegicus
caagactttgctgtggatgagccac

SEQ ID NO: 219091 - DNA, 25 bp, Rattus norvegicus
caagagaaccagaccaagattaaaa

SEQ ID NO: 219092 - DNA, 25 bp, Rattus norvegicus
caagagaaccagtccaagattaaaa

SEQ ID NO: 219093 - DNA, 25 bp, Rattus norvegicus
caagagaactgcaactttactcccc

SEQ ID NO: 219094 - DNA, 25 bp, Rattus norvegicus
caagagaactgctactttactcccc

SEQ ID NO: 219095 - DNA, 25 bp, Rattus norvegicus
caagagaactttccaaacaccctca

SEQ ID NO: 219096 - DNA, 25 bp, Rattus norvegicus
caagagaactttgcaaacaccctca

SEQ ID NO: 219097 - DNA, 25 bp, Rattus norvegicus
caagagaagcggctcatttcagggt

SEQ ID NO: 219098 - DNA, 25 bp, Rattus norvegicus
caagagaagcgggtcatttcagggt

SEQ ID NO: 219099 - DNA, 25 bp, Rattus norvegicus
caagagaagcttcggctcaaggtct

SEQ ID NO: 219100 - DNA, 25 bp, Rattus norvegicus
caagagaagcttgggctcaaggtct

SEQ ID NO: 219101 - DNA, 25 bp, Rattus norvegicus
caagagaattctccacagacatatc

SEQ ID NO: 219102 - DNA, 25 bp, Rattus norvegicus
caagagaattctgcacagacatatc

SEQ ID NO: 219103 - DNA, 25 bp, Rattus norvegicus
caagagacagagcatcctgttttcc

SEQ ID NO: 219104 - DNA, 25 bp, Rattus norvegicus
caagagacagaggatcctgttttcc

SEQ ID NO: 219105 - DNA, 25 bp, Rattus norvegicus
caagagaccatgagttcctgaaaac

SEQ ID NO: 219106 - DNA, 25 bp, Rattus norvegicus
caagagaccatgtgttcctgaaaac

SEQ ID NO: 219107 - DNA, 25 bp, Rattus norvegicus
caagagaccggcctctttggacttt

SEQ ID NO: 219108 - DNA, 25 bp, Rattus norvegicus
caagagaccggcgtctttggacttt

SEQ ID NO: 219109 - DNA, 25 bp, Rattus norvegicus
caagagacctatcagccagtatgct

SEQ ID NO: 219110 - DNA, 25 bp, Rattus norvegicus
caagagacctatgagccagtatgct

SEQ ID NO: 219111 - DNA, 25 bp, Rattus norvegicus
caagagactctcagatttgacaaga

SEQ ID NO: 219112 - DNA, 25 bp, Rattus norvegicus
caagagactctctgatttgacaaga

SEQ ID NO: 219113 - DNA, 25 bp, Rattus norvegicus
caagagagagtgagcgcagacacgt

SEQ ID NO: 219114 - DNA, 25 bp, Rattus norvegicus
caagagagagtgtgcgcagacacgt

SEQ ID NO: 219115 - DNA, 25 bp, Rattus norvegicus
caagagagctggaattggacacaca

SEQ ID NO: 219116 - DNA, 25 bp, Rattus norvegicus
caagagagctggtattggacacaca

SEQ ID NO: 219117 - DNA, 25 bp, Rattus norvegicus
caagagaggcgtactcatcggaaat

SEQ ID NO: 219118 - DNA, 25 bp, Rattus norvegicus
caagagaggcgttctcatcggaaat

SEQ ID NO: 219119 - DNA, 25 bp, Rattus norvegicus
caagagatttttattccaaggactg

SEQ ID NO: 219120 - DNA, 25 bp, Rattus norvegicus
caagagattttttttccaaggactg

SEQ ID NO: 219121 - DNA, 25 bp, Rattus norvegicus
caagagcaagttctgtggctggcct

SEQ ID NO: 219122 - DNA, 25 bp, Rattus norvegicus
caagagcaagttgtgtggctggcct

SEQ ID NO: 219123 - DNA, 25 bp, Rattus norvegicus
caagagcataatagtctcagtccaa

SEQ ID NO: 219124 - DNA, 25 bp, Rattus norvegicus
caagagcataattgtctcagtccaa

SEQ ID NO: 219125 - DNA, 25 bp, Rattus norvegicus
caagagcatgccagtttgctgggct

SEQ ID NO: 219126 - DNA, 25 bp, Rattus norvegicus
caagagcatgcctgtttgctgggct

SEQ ID NO: 219127 - DNA, 25 bp, Rattus norvegicus
caagagcatgctcggtctcccgtga

SEQ ID NO: 219128 - DNA, 25 bp, Rattus norvegicus
caagagcatgctgggtctcccgtga

SEQ ID NO: 219129 - DNA, 25 bp, Rattus norvegicus
caagagccatagcacctcaggtcat

SEQ ID NO: 219130 - DNA, 25 bp, Rattus norvegicus
caagagccataggacctcaggtcat

SEQ ID NO: 219131 - DNA, 25 bp, Rattus norvegicus
caagagccatgtctgtttagcagca

SEQ ID NO: 219132 - DNA, 25 bp, Rattus norvegicus
caagagccatgtgtgtttagcagca

SEQ ID NO: 219133 - DNA, 25 bp, Rattus norvegicus
caagagcccgtgactgggcagtgaa

SEQ ID NO: 219134 - DNA, 25 bp, Rattus norvegicus
caagagcccgtgtctgggcagtgaa

SEQ ID NO: 219135 - DNA, 25 bp, Rattus norvegicus
caagagccctctcgcgcagatggag

SEQ ID NO: 219136 - DNA, 25 bp, Rattus norvegicus
caagagccctctggcgcagatggag

SEQ ID NO: 219137 - DNA, 25 bp, Rattus norvegicus
caagagcctctgagtattccagggc

SEQ ID NO: 219138 - DNA, 25 bp, Rattus norvegicus
caagagcctctgtgtattccagggc

SEQ ID NO: 219139 - DNA, 25 bp, Rattus norvegicus
caagagcctgaacccactgctggag

SEQ ID NO: 219140 - DNA, 25 bp, Rattus norvegicus
caagagcctgaagccactgctggag

SEQ ID NO: 219141 - DNA, 25 bp, Rattus norvegicus
caagagcctggtatcctttttgctt

SEQ ID NO: 219142 - DNA, 25 bp, Rattus norvegicus
caagagcctggtttcctttttgctt

SEQ ID NO: 219143 - DNA, 25 bp, Rattus norvegicus
caagagccttctcactctgctgggg

SEQ ID NO: 219144 - DNA, 25 bp, Rattus norvegicus
caagagccttctgactctgctgggg

SEQ ID NO: 219145 - DNA, 25 bp, Rattus norvegicus
caagagctaaataagtaccagtaat

SEQ ID NO: 219146 - DNA, 25 bp, Rattus norvegicus
caagagctaaattagtaccagtaat

SEQ ID NO: 219147 - DNA, 25 bp, Rattus norvegicus
caagagctgggtatccagccgagct

SEQ ID NO: 219148 - DNA, 25 bp, Rattus norvegicus
caagagctgggtttccagccgagct

SEQ ID NO: 219149 - DNA, 25 bp, Rattus norvegicus
caagagctttgcatttgagctaggc

SEQ ID NO: 219150 - DNA, 25 bp, Rattus norvegicus
caagagctttgcttttgagctaggc

SEQ ID NO: 219151 - DNA, 25 bp, Rattus norvegicus
caagaggaaccgaggactcccgtgg

SEQ ID NO: 219152 - DNA, 25 bp, Rattus norvegicus
caagaggaaccgtggactcccgtgg

SEQ ID NO: 219153 - DNA, 25 bp, Rattus norvegicus
caagaggaacttccttcgtgaccca

SEQ ID NO: 219154 - DNA, 25 bp, Rattus norvegicus
caagaggaacttgcttcgtgaccca

SEQ ID NO: 219155 - DNA, 25 bp, Rattus norvegicus
caagaggacacgctttctacgacgt

SEQ ID NO: 219156 - DNA, 25 bp, Rattus norvegicus
caagaggacacggtttctacgacgt

SEQ ID NO: 219157 - DNA, 25 bp, Rattus norvegicus
caagaggagtggacttagccgccgc

SEQ ID NO: 219158 - DNA, 25 bp, Rattus norvegicus
caagaggagtggtcttagccgccgc

SEQ ID NO: 219159 - DNA, 25 bp, Rattus norvegicus
caagaggcaacacgtgaagctcccc

SEQ ID NO: 219160 - DNA, 25 bp, Rattus norvegicus
caagaggcaacaggtgaagctcccc

SEQ ID NO: 219161 - DNA, 25 bp, Rattus norvegicus
caagaggcccaacccctgtcttgga

SEQ ID NO: 219162 - DNA, 25 bp, Rattus norvegicus
caagaggcccaagccctgtcttgga

SEQ ID NO: 219163 - DNA, 25 bp, Rattus norvegicus
caagaggccctgagaagcctggagt

SEQ ID NO: 219164 - DNA, 25 bp, Rattus norvegicus
caagaggccctgtgaagcctggagt

SEQ ID NO: 219165 - DNA, 25 bp, Rattus norvegicus
caagaggcggtacttccgcttagac

SEQ ID NO: 219166 - DNA, 25 bp, Rattus norvegicus
caagaggcggtagttccgcttagac

SEQ ID NO: 219167 - DNA, 25 bp, Rattus norvegicus
caagaggctctgcagtatttcacaa

SEQ ID NO: 219168 - DNA, 25 bp, Rattus norvegicus
caagaggctctggagtatttcacaa

SEQ ID NO: 219169 - DNA, 25 bp, Rattus norvegicus
caagagggtcttccctgtttccaca

SEQ ID NO: 219170 - DNA, 25 bp, Rattus norvegicus
caagagggtcttgcctgtttccaca

SEQ ID NO: 219171 - DNA, 25 bp, Rattus norvegicus
caagaggtctttatacctgctaccc

SEQ ID NO: 219172 - DNA, 25 bp, Rattus norvegicus
caagaggtctttttacctgctaccc

SEQ ID NO: 219173 - DNA, 25 bp, Rattus norvegicus
caagaggtgtcacgagcccaaagcc

SEQ ID NO: 219174 - DNA, 25 bp, Rattus norvegicus
caagaggtgtcaggagcccaaagcc

SEQ ID NO: 219175 - DNA, 25 bp, Rattus norvegicus
caagaggttcctaattgcttctaac

SEQ ID NO: 219176 - DNA, 25 bp, Rattus norvegicus
caagaggttccttattgcttctaac

SEQ ID NO: 219177 - DNA, 25 bp, Rattus norvegicus
caagaggtttctctttctgtttcct

SEQ ID NO: 219178 - DNA, 25 bp, Rattus norvegicus
caagaggtttctgtttctgtttcct

SEQ ID NO: 219179 - DNA, 25 bp, Rattus norvegicus
caagagtaacaacggcacataattt

SEQ ID NO: 219180 - DNA, 25 bp, Rattus norvegicus
caagagtaacaagggcacataattt

SEQ ID NO: 219181 - DNA, 25 bp, Rattus norvegicus
caagagtagcacacactaccactac

SEQ ID NO: 219182 - DNA, 25 bp, Rattus norvegicus
caagagtagcactcactaccactac

SEQ ID NO: 219183 - DNA, 25 bp, Rattus norvegicus
caagagtccctcagtagaagtgcta

SEQ ID NO: 219184 - DNA, 25 bp, Rattus norvegicus
caagagtccctctgtagaagtgcta

SEQ ID NO: 219185 - DNA, 25 bp, Rattus norvegicus
caagagtggatgaatacaaggcccc

SEQ ID NO: 219186 - DNA, 25 bp, Rattus norvegicus
caagagtggatgtatacaaggcccc

SEQ ID NO: 219187 - DNA, 25 bp, Rattus norvegicus
caagagtgggtcagggagtcctcca

SEQ ID NO: 219188 - DNA, 25 bp, Rattus norvegicus
caagagtgggtctgggagtcctcca

SEQ ID NO: 219189 - DNA, 25 bp, Rattus norvegicus
caagagtgtgaaccaatcaaccaac

SEQ ID NO: 219190 - DNA, 25 bp, Rattus norvegicus
caagagtgtgaacttcctgaaggca

SEQ ID NO: 219191 - DNA, 25 bp, Rattus norvegicus
caagagtgtgaagcaatcaaccaac

SEQ ID NO: 219192 - DNA, 25 bp, Rattus norvegicus
caagagtgtgaagttcctgaaggca

SEQ ID NO: 219193 - DNA, 25 bp, Rattus norvegicus
caagagtgtggtcagtcctggcttc

SEQ ID NO: 219194 - DNA, 25 bp, Rattus norvegicus
caagagtgtggtgagtcctggcttc

SEQ ID NO: 219195 - DNA, 25 bp, Rattus norvegicus
caagagttcgcacctaaaggcgcat

SEQ ID NO: 219196 - DNA, 25 bp, Rattus norvegicus
caagagttcgcagctaaaggcgcat

SEQ ID NO: 219197 - DNA, 25 bp, Rattus norvegicus
caagagttcttcctgcaggtggttc

SEQ ID NO: 219198 - DNA, 25 bp, Rattus norvegicus
caagagttcttcgtgcaggtggttc

SEQ ID NO: 219199 - DNA, 25 bp, Rattus norvegicus
caagagttgatgctagcgttgctaa

SEQ ID NO: 219200 - DNA, 25 bp, Rattus norvegicus
caagagttgatggtagcgttgctaa

SEQ ID NO: 219201 - DNA, 25 bp, Rattus norvegicus
caagagttggttatctcctatcaga

SEQ ID NO: 219202 - DNA, 25 bp, Rattus norvegicus
caagagttggttttctcctatcaga

SEQ ID NO: 219203 - DNA, 25 bp, Rattus norvegicus
caagagtttcatccgcaagcagaac

SEQ ID NO: 219204 - DNA, 25 bp, Rattus norvegicus
caagagtttcatgcgcaagcagaac

SEQ ID NO: 219205 - DNA, 25 bp, Rattus norvegicus
caagataccgagcaggacctggtga

SEQ ID NO: 219206 - DNA, 25 bp, Rattus norvegicus
caagataccgaggaggacctggtga

SEQ ID NO: 219207 - DNA, 25 bp, Rattus norvegicus
caagataccttcatgctactacaaa

SEQ ID NO: 219208 - DNA, 25 bp, Rattus norvegicus
caagataccttcttgctactacaaa

SEQ ID NO: 219209 - DNA, 25 bp, Rattus norvegicus
caagatagtggcatctgcgggacga

SEQ ID NO: 219210 - DNA, 25 bp, Rattus norvegicus
caagatagtggcttctgcgggacga

SEQ ID NO: 219211 - DNA, 25 bp, Rattus norvegicus
caagatatctttacgtggatcaagc

SEQ ID NO: 219212 - DNA, 25 bp, Rattus norvegicus
caagatatcttttcgtggatcaagc

SEQ ID NO: 219213 - DNA, 25 bp, Rattus norvegicus
caagatatggagacagctgtaagca

SEQ ID NO: 219214 - DNA, 25 bp, Rattus norvegicus
caagatatggagtcagctgtaagca

SEQ ID NO: 219215 - DNA, 25 bp, Rattus norvegicus
caagatatgtgcagaaggccggcca

SEQ ID NO: 219216 - DNA, 25 bp, Rattus norvegicus
caagatatgtgctgaaggccggcca

SEQ ID NO: 219217 - DNA, 25 bp, Rattus norvegicus
caagatattcttaggtccctcagga

SEQ ID NO: 219218 - DNA, 25 bp, Rattus norvegicus
caagatattctttggtccctcagga

SEQ ID NO: 219219 - DNA, 25 bp, Rattus norvegicus
caagatatttggctcatactactca

SEQ ID NO: 219220 - DNA, 25 bp, Rattus norvegicus
caagatatttgggtcatactactca

SEQ ID NO: 219221 - DNA, 25 bp, Rattus norvegicus
caagatcaataaccgtaccctgcac

SEQ ID NO: 219222 - DNA, 25 bp, Rattus norvegicus
caagatcaataagcgtaccctgcac

SEQ ID NO: 219223 - DNA, 25 bp, Rattus norvegicus
caagatcacggacgccaagctggct

SEQ ID NO: 219224 - DNA, 25 bp, Rattus norvegicus
caagatcacggaggccaagctggct

SEQ ID NO: 219225 - DNA, 25 bp, Rattus norvegicus
caagatcattctcgcttacagtttg

SEQ ID NO: 219226 - DNA, 25 bp, Rattus norvegicus
caagatcattctggcttacagtttg

SEQ ID NO: 219227 - DNA, 25 bp, Rattus norvegicus
caagatcccaccacaaaaacagaag

SEQ ID NO: 219228 - DNA, 25 bp, Rattus norvegicus
caagatcccacctcaaaaacagaag

SEQ ID NO: 219229 - DNA, 25 bp, Rattus norvegicus
caagatccgagcagttttggtcact

SEQ ID NO: 219230 - DNA, 25 bp, Rattus norvegicus
caagatccgagctgttttggtcact

SEQ ID NO: 219231 - DNA, 25 bp, Rattus norvegicus
caagatcgccgacgtgggcgcgggc

SEQ ID NO: 219232 - DNA, 25 bp, Rattus norvegicus
caagatcgccgaggtgggcgcgggc

SEQ ID NO: 219233 - DNA, 25 bp, Rattus norvegicus
caagatcgtgccacatggccagaat

SEQ ID NO: 219234 - DNA, 25 bp, Rattus norvegicus
caagatcgtgcctcatggccagaat

SEQ ID NO: 219235 - DNA, 25 bp, Rattus norvegicus
caagatctaccccagtgcgtatata

SEQ ID NO: 219236 - DNA, 25 bp, Rattus norvegicus
caagatctacccgagtgcgtatata

SEQ ID NO: 219237 - DNA, 25 bp, Rattus norvegicus
caagatctatttagaccaccttcaa

SEQ ID NO: 219238 - DNA, 25 bp, Rattus norvegicus
caagatctattttgaccaccttcaa

SEQ ID NO: 219239 - DNA, 25 bp, Rattus norvegicus
caagatctcactctagcctatgctg

SEQ ID NO: 219240 - DNA, 25 bp, Rattus norvegicus
caagatctcactgtagcctatgctg

SEQ ID NO: 219241 - DNA, 25 bp, Rattus norvegicus
caagatctccgaagtgcaggtgttc

SEQ ID NO: 219242 - DNA, 25 bp, Rattus norvegicus
caagatctccgatgtgcaggtgttc

SEQ ID NO: 219243 - DNA, 25 bp, Rattus norvegicus
caagatctctaacagctcagccaag

SEQ ID NO: 219244 - DNA, 25 bp, Rattus norvegicus
caagatctctaagagctcagccaag

SEQ ID NO: 219245 - DNA, 25 bp, Rattus norvegicus
caagatcttagcatctgaggacccc

SEQ ID NO: 219246 - DNA, 25 bp, Rattus norvegicus
caagatcttagcttctgaggacccc

SEQ ID NO: 219247 - DNA, 25 bp, Rattus norvegicus
caagatctttctagatgctctcggg

SEQ ID NO: 219248 - DNA, 25 bp, Rattus norvegicus
caagatctttcttgatgctctcggg

SEQ ID NO: 219249 - DNA, 25 bp, Rattus norvegicus
caagatctttggattcgtggccaag

SEQ ID NO: 219250 - DNA, 25 bp, Rattus norvegicus
caagatctttggtttcgtggccaag

SEQ ID NO: 219251 - DNA, 25 bp, Rattus norvegicus
caagatgagttgcactatcaccggg

SEQ ID NO: 219252 - DNA, 25 bp, Rattus norvegicus
caagatgagttggactatcaccggg

SEQ ID NO: 219253 - DNA, 25 bp, Rattus norvegicus
caagatgcagcacaagtcacagaag

SEQ ID NO: 219254 - DNA, 25 bp, Rattus norvegicus
caagatgcagcagaagtcacagaag

SEQ ID NO: 219255 - DNA, 25 bp, Rattus norvegicus
caagatgccaggagtgatcccaaca

SEQ ID NO: 219256 - DNA, 25 bp, Rattus norvegicus
caagatgccaggtgtgatcccaaca

SEQ ID NO: 219257 - DNA, 25 bp, Rattus norvegicus
caagatgcccatccctgccaagagg

SEQ ID NO: 219258 - DNA, 25 bp, Rattus norvegicus
caagatgcccatgcctgccaagagg

SEQ ID NO: 219259 - DNA, 16 bp, Rattus norvegicus
caagatgctaccgttc

SEQ ID NO: 219260 - DNA, 25 bp, Rattus norvegicus
caagatgctcttcctatttgaaggt

SEQ ID NO: 219261 - DNA, 25 bp, Rattus norvegicus
caagatgctcttgctatttgaaggt

SEQ ID NO: 219262 - DNA, 25 bp, Rattus norvegicus
caagatgctttccagttctgccaaa

SEQ ID NO: 219263 - DNA, 25 bp, Rattus norvegicus
caagatgctttcgagttctgccaaa

SEQ ID NO: 219264 - DNA, 25 bp, Rattus norvegicus
caagatggccttaatttgaacccct

SEQ ID NO: 219265 - DNA, 25 bp, Rattus norvegicus
caagatggccttcagggtcacttgg

SEQ ID NO: 219266 - DNA, 25 bp, Rattus norvegicus
caagatggccttgagggtcacttgg

SEQ ID NO: 219267 - DNA, 25 bp, Rattus norvegicus
caagatggcctttatttgaacccct

SEQ ID NO: 219268 - DNA, 25 bp, Rattus norvegicus
caagatggctgtatcctgctgactg

SEQ ID NO: 219269 - DNA, 25 bp, Rattus norvegicus
caagatggctgtttcctgctgactg

SEQ ID NO: 219270 - DNA, 25 bp, Rattus norvegicus
caagatggcttcagagtagactaac

SEQ ID NO: 219271 - DNA, 25 bp, Rattus norvegicus
caagatggcttctgagtagactaac

SEQ ID NO: 219272 - DNA, 25 bp, Rattus norvegicus
caagatgggcctcggtctcagaact

SEQ ID NO: 219273 - DNA, 25 bp, Rattus norvegicus
caagatgggcctgggtctcagaact

SEQ ID NO: 219274 - DNA, 25 bp, Rattus norvegicus
caagatgggcgtccatcctggaagc

SEQ ID NO: 219275 - DNA, 25 bp, Rattus norvegicus
caagatgggcgtgcatcctggaagc

SEQ ID NO: 219276 - DNA, 25 bp, Rattus norvegicus
caagatgggtgcaaccgggccaatg

SEQ ID NO: 219277 - DNA, 25 bp, Rattus norvegicus
caagatgggtgctaccgggccaatg

SEQ ID NO: 219278 - DNA, 25 bp, Rattus norvegicus
caagatggtcttcgctgattgctgg

SEQ ID NO: 219279 - DNA, 25 bp, Rattus norvegicus
caagatggtcttctatttcttacac

SEQ ID NO: 219280 - DNA, 25 bp, Rattus norvegicus
caagatggtcttggctgattgctgg

SEQ ID NO: 219281 - DNA, 25 bp, Rattus norvegicus
caagatggtcttgtatttcttacac

SEQ ID NO: 219282 - DNA, 25 bp, Rattus norvegicus
caagatggtgtgctatttcctacta

SEQ ID NO: 219283 - DNA, 25 bp, Rattus norvegicus
caagatggtgtggtatttcctacta

SEQ ID NO: 219284 - DNA, 25 bp, Rattus norvegicus
caagatgtacggaagtggcctcagg

SEQ ID NO: 219285 - DNA, 25 bp, Rattus norvegicus
caagatgtacggtagtggcctcagg

SEQ ID NO: 219286 - DNA, 25 bp, Rattus norvegicus
caagatgtatcccaagtctgcactt

SEQ ID NO: 219287 - DNA, 25 bp, Rattus norvegicus
caagatgtatccgaagtctgcactt

SEQ ID NO: 219288 - DNA, 25 bp, Rattus norvegicus
caagatgtgctgagccagtgtgtct

SEQ ID NO: 219289 - DNA, 25 bp, Rattus norvegicus
caagatgtgctgtgccagtgtgtct

SEQ ID NO: 219290 - DNA, 25 bp, Rattus norvegicus
caagatgttggtcaatgtggttagc

SEQ ID NO: 219291 - DNA, 25 bp, Rattus norvegicus
caagatgttggtgaatgtggttagc

SEQ ID NO: 219292 - DNA, 25 bp, Rattus norvegicus
caagattcatctctaaaccccggat

SEQ ID NO: 219293 - DNA, 25 bp, Rattus norvegicus
caagattcatctgtaaaccccggat

SEQ ID NO: 219294 - DNA, 25 bp, Rattus norvegicus
caagattcctacattgttgcctgta

SEQ ID NO: 219295 - DNA, 25 bp, Rattus norvegicus
caagattcctactttgttgcctgta

SEQ ID NO: 219296 - DNA, 25 bp, Rattus norvegicus
caagattctaggaggttccgtcctc

SEQ ID NO: 219297 - DNA, 25 bp, Rattus norvegicus
caagattctaggtggttccgtcctc

SEQ ID NO: 219298 - DNA, 25 bp, Rattus norvegicus
caagattcttggaatcccgtctggg

SEQ ID NO: 219299 - DNA, 25 bp, Rattus norvegicus
caagattcttggtatcccgtctggg

SEQ ID NO: 219300 - DNA, 25 bp, Rattus norvegicus
caagattgcggcaactactcgaggg

SEQ ID NO: 219301 - DNA, 25 bp, Rattus norvegicus
caagattgcggctactactcgaggg

SEQ ID NO: 219302 - DNA, 25 bp, Rattus norvegicus
caagattgggcgaaacctggagttt

SEQ ID NO: 219303 - DNA, 25 bp, Rattus norvegicus
caagattgggcgtaacctggagttt

SEQ ID NO: 219304 - DNA, 25 bp, Rattus norvegicus
caagattggtggagagtgagaattc

SEQ ID NO: 219305 - DNA, 25 bp, Rattus norvegicus
caagattggtggtgagtgagaattc

SEQ ID NO: 219306 - DNA, 25 bp, Rattus norvegicus
caagattggtgtactccgggtggac

SEQ ID NO: 219307 - DNA, 25 bp, Rattus norvegicus
caagattggtgttctccgggtggac

SEQ ID NO: 219308 - DNA, 25 bp, Rattus norvegicus
caagattgtatgaaccgcatggtgc

SEQ ID NO: 219309 - DNA, 25 bp, Rattus norvegicus
caagattgtatgtaccgcatggtgc

SEQ ID NO: 219310 - DNA, 25 bp, Rattus norvegicus
caagatttacccacagacacagcaa

SEQ ID NO: 219311 - DNA, 25 bp, Rattus norvegicus
caagatttaccctcagacacagcaa

SEQ ID NO: 219312 - DNA, 25 bp, Rattus norvegicus
caagatttgcttagtagcccgctga

SEQ ID NO: 219313 - DNA, 25 bp, Rattus norvegicus
caagatttgctttgtagcccgctga

SEQ ID NO: 219314 - DNA, 25 bp, Rattus norvegicus
caagcaaaggatcccatagaagccc

SEQ ID NO: 219315 - DNA, 25 bp, Rattus norvegicus
caagcaaaggatgccatagaagccc

SEQ ID NO: 219316 - DNA, 25 bp, Rattus norvegicus
caagcaaagtcaagtaaggccacaa

SEQ ID NO: 219317 - DNA, 25 bp, Rattus norvegicus
caagcaaagtcatgtaaggccacaa

SEQ ID NO: 219318 - DNA, 25 bp, Rattus norvegicus
caagcaacttacactggtttgacag

SEQ ID NO: 219319 - DNA, 25 bp, Rattus norvegicus
caagcaacttactctggtttgacag

SEQ ID NO: 219320 - DNA, 25 bp, Rattus norvegicus
caagcaagaagcagttgtcaagatt

SEQ ID NO: 219321 - DNA, 25 bp, Rattus norvegicus
caagcaagaagctgttgtcaagatt

SEQ ID NO: 219322 - DNA, 25 bp, Rattus norvegicus
caagcaagagctacctgggtgttct

SEQ ID NO: 219323 - DNA, 25 bp, Rattus norvegicus
caagcaagagcttcctgggtgttct

SEQ ID NO: 219324 - DNA, 25 bp, Rattus norvegicus
caagcaagagtcagtttccacctac

SEQ ID NO: 219325 - DNA, 25 bp, Rattus norvegicus
caagcaagagtctgtttccacctac

SEQ ID NO: 219326 - DNA, 25 bp, Rattus norvegicus
caagcaagatcaactccgagttcct

SEQ ID NO: 219327 - DNA, 25 bp, Rattus norvegicus
caagcaagatcatctccgagttcct

SEQ ID NO: 219328 - DNA, 25 bp, Rattus norvegicus
caagcaagcacacccaggcatggat

SEQ ID NO: 219329 - DNA, 25 bp, Rattus norvegicus
caagcaagcacagccaggcatggat

SEQ ID NO: 219330 - DNA, 25 bp, Rattus norvegicus
caagcaaggcttctcccagatgggt

SEQ ID NO: 219331 - DNA, 25 bp, Rattus norvegicus
caagcaaggcttgtcccagatgggt

SEQ ID NO: 219332 - DNA, 25 bp, Rattus norvegicus
caagcaagttcacgccacaagagtg

SEQ ID NO: 219333 - DNA, 25 bp, Rattus norvegicus
caagcaagttcaggccacaagagtg

SEQ ID NO: 219334 - DNA, 25 bp, Rattus norvegicus
caagcaatccacagttcaatgaagt

SEQ ID NO: 219335 - DNA, 25 bp, Rattus norvegicus
caagcaatccactgttcaatgaagt

SEQ ID NO: 219336 - DNA, 25 bp, Rattus norvegicus
caagcaatggagctagcgcagcaaa

SEQ ID NO: 219337 - DNA, 25 bp, Rattus norvegicus
caagcaatggaggtagcgcagcaaa

SEQ ID NO: 219338 - DNA, 25 bp, Rattus norvegicus
caagcaatgggtcctgccccgggaa

SEQ ID NO: 219339 - DNA, 25 bp, Rattus norvegicus
caagcaatgggtgctgccccgggaa

SEQ ID NO: 219340 - DNA, 25 bp, Rattus norvegicus
caagcaatgttgactcctagttttt

SEQ ID NO: 219341 - DNA, 25 bp, Rattus norvegicus
caagcaatgttgtctcctagttttt

SEQ ID NO: 219342 - DNA, 25 bp, Rattus norvegicus
caagcaattcaacacttttcctttt

SEQ ID NO: 219343 - DNA, 25 bp, Rattus norvegicus
caagcaattcaagacttttcctttt

SEQ ID NO: 219344 - DNA, 25 bp, Rattus norvegicus
caagcacaagcaaagaagtttcccc

SEQ ID NO: 219345 - DNA, 25 bp, Rattus norvegicus
caagcacaagcatagaagtttcccc

SEQ ID NO: 219346 - DNA, 25 bp, Rattus norvegicus
caagcacaagtaacttaagctccag

SEQ ID NO: 219347 - DNA, 25 bp, Rattus norvegicus
caagcacaagtatcttaagctccag

SEQ ID NO: 219348 - DNA, 25 bp, Rattus norvegicus
caagcacagaggactccatgtcttc

SEQ ID NO: 219349 - DNA, 25 bp, Rattus norvegicus
caagcacagaggtctccatgtcttc

SEQ ID NO: 219350 - DNA, 25 bp, Rattus norvegicus
caagcacccaggagagtgaaaaagt

SEQ ID NO: 219351 - DNA, 25 bp, Rattus norvegicus
caagcacccaggtgagtgaaaaagt

SEQ ID NO: 219352 - DNA, 25 bp, Rattus norvegicus
caagcaccgaatatagaccccacta

SEQ ID NO: 219353 - DNA, 25 bp, Rattus norvegicus
caagcaccgaatttagaccccacta

SEQ ID NO: 219354 - DNA, 25 bp, Rattus norvegicus
caagcaccgttcattggcagcggta

SEQ ID NO: 219355 - DNA, 25 bp, Rattus norvegicus
caagcaccgttctttggcagcggta

SEQ ID NO: 219356 - DNA, 25 bp, Rattus norvegicus
caagcaccttcgagaaacttctaca

SEQ ID NO: 219357 - DNA, 25 bp, Rattus norvegicus
caagcaccttcgtgaaacttctaca

SEQ ID NO: 219358 - DNA, 25 bp, Rattus norvegicus
caagcacgttggaccttgagcagag

SEQ ID NO: 219359 - DNA, 25 bp, Rattus norvegicus
caagcacgttggtccttgagcagag

SEQ ID NO: 219360 - DNA, 25 bp, Rattus norvegicus
caagcactaagtctgaagccctcat

SEQ ID NO: 219361 - DNA, 25 bp, Rattus norvegicus
caagcactaagtgtgaagccctcat

SEQ ID NO: 219362 - DNA, 25 bp, Rattus norvegicus
caagcactgctcagagggttctgaa

SEQ ID NO: 219363 - DNA, 25 bp, Rattus norvegicus
caagcactgctctgagggttctgaa

SEQ ID NO: 219364 - DNA, 25 bp, Rattus norvegicus
caagcacttaaaaataccctctatg

SEQ ID NO: 219365 - DNA, 25 bp, Rattus norvegicus
caagcacttaaatataccctctatg

SEQ ID NO: 219366 - DNA, 25 bp, Rattus norvegicus
caagcacttaatacgtccagcagga

SEQ ID NO: 219367 - DNA, 25 bp, Rattus norvegicus
caagcacttaattcgtccagcagga

SEQ ID NO: 219368 - DNA, 25 bp, Rattus norvegicus
caagcactttggacacaggcagaaa

SEQ ID NO: 219369 - DNA, 25 bp, Rattus norvegicus
caagcactttggtcacaggcagaaa

SEQ ID NO: 219370 - DNA, 25 bp, Rattus norvegicus
caagcagaaagacctcagtggattt

SEQ ID NO: 219371 - DNA, 25 bp, Rattus norvegicus
caagcagaaagagctcagtggattt

SEQ ID NO: 219372 - DNA, 25 bp, Rattus norvegicus
caagcagaaagtagccagcagctgc

SEQ ID NO: 219373 - DNA, 25 bp, Rattus norvegicus
caagcagaaagttgccagcagctgc

SEQ ID NO: 219374 - DNA, 25 bp, Rattus norvegicus
caagcagaatctcgaggctctcaaa

SEQ ID NO: 219375 - DNA, 25 bp, Rattus norvegicus
caagcagaatctggaggctctcaaa

SEQ ID NO: 219376 - DNA, 25 bp, Rattus norvegicus
caagcagacaacatctgtgcgtgtt

SEQ ID NO: 219377 - DNA, 25 bp, Rattus norvegicus
caagcagacaacttctgtgcgtgtt

SEQ ID NO: 219378 - DNA, 25 bp, Rattus norvegicus
caagcagaggccaatacaatttact

SEQ ID NO: 219379 - DNA, 25 bp, Rattus norvegicus
caagcagaggcccattaagtgttct

SEQ ID NO: 219380 - DNA, 25 bp, Rattus norvegicus
caagcagaggccgattaagtgttct

SEQ ID NO: 219381 - DNA, 25 bp, Rattus norvegicus
caagcagaggcctatacaatttact

SEQ ID NO: 219382 - DNA, 25 bp, Rattus norvegicus
caagcagatcttcccgacagcagaa

SEQ ID NO: 219383 - DNA, 25 bp, Rattus norvegicus
caagcagatcttgccgacagcagaa

SEQ ID NO: 219384 - DNA, 25 bp, Rattus norvegicus
caagcagattgtatcctcagccaag

SEQ ID NO: 219385 - DNA, 25 bp, Rattus norvegicus
caagcagattgtttcctcagccaag

SEQ ID NO: 219386 - DNA, 25 bp, Rattus norvegicus
caagcagcacacagagttccattta

SEQ ID NO: 219387 - DNA, 25 bp, Rattus norvegicus
caagcagcacactgagttccattta

SEQ ID NO: 219388 - DNA, 25 bp, Rattus norvegicus
caagcagcatgtattctgtctcctg

SEQ ID NO: 219389 - DNA, 25 bp, Rattus norvegicus
caagcagcatgttttctgtctcctg

SEQ ID NO: 219390 - DNA, 25 bp, Rattus norvegicus
caagcagccatcaactaagttccat

SEQ ID NO: 219391 - DNA, 25 bp, Rattus norvegicus
caagcagccatctactaagttccat

SEQ ID NO: 219392 - DNA, 25 bp, Rattus norvegicus
caagcagccccacctgggtttacaa

SEQ ID NO: 219393 - DNA, 25 bp, Rattus norvegicus
caagcagccccagctgggtttacaa

SEQ ID NO: 219394 - DNA, 25 bp, Rattus norvegicus
caagcagcctctctgcacttggaga

SEQ ID NO: 219395 - DNA, 25 bp, Rattus norvegicus
caagcagcctctgtgcacttggaga

SEQ ID NO: 219396 - DNA, 25 bp, Rattus norvegicus
caagcagcctgacttcaactttggg

SEQ ID NO: 219397 - DNA, 25 bp, Rattus norvegicus
caagcagcctgagttcaactttggg

SEQ ID NO: 219398 - DNA, 25 bp, Rattus norvegicus
caagcagctctgcaactcatctttg

SEQ ID NO: 219399 - DNA, 25 bp, Rattus norvegicus
caagcagctctggaactcatctttg

SEQ ID NO: 219400 - DNA, 25 bp, Rattus norvegicus
caagcagcttggatcagtgtggtat

SEQ ID NO: 219401 - DNA, 25 bp, Rattus norvegicus
caagcagcttggttcagtgtggtat

SEQ ID NO: 219402 - DNA, 25 bp, Rattus norvegicus
caagcaggctgactctcgtgggaca

SEQ ID NO: 219403 - DNA, 25 bp, Rattus norvegicus
caagcaggctgagtctcgtgggaca

SEQ ID NO: 219404 - DNA, 25 bp, Rattus norvegicus
caagcagggaacattcccaggcaaa

SEQ ID NO: 219405 - DNA, 25 bp, Rattus norvegicus
caagcagggaactttcccaggcaaa

SEQ ID NO: 219406 - DNA, 25 bp, Rattus norvegicus
caagcagggacacctctgagagctc

SEQ ID NO: 219407 - DNA, 25 bp, Rattus norvegicus
caagcagggacagctctgagagctc

SEQ ID NO: 219408 - DNA, 25 bp, Rattus norvegicus
caagcagggagcaccgcaggccagt

SEQ ID NO: 219409 - DNA, 25 bp, Rattus norvegicus
caagcagggagctccgcaggccagt

SEQ ID NO: 219410 - DNA, 25 bp, Rattus norvegicus
caagcagtcctgcaggcttctgtta

SEQ ID NO: 219411 - DNA, 25 bp, Rattus norvegicus
caagcagtcctggaggcttctgtta

SEQ ID NO: 219412 - DNA, 25 bp, Rattus norvegicus
caagcagtctccatactcatatttt

SEQ ID NO: 219413 - DNA, 25 bp, Rattus norvegicus
caagcagtctccttactcatatttt

SEQ ID NO: 219414 - DNA, 25 bp, Rattus norvegicus
caagcagtgtgcaggctgagacttt

SEQ ID NO: 219415 - DNA, 25 bp, Rattus norvegicus
caagcagtgtgctggctgagacttt

SEQ ID NO: 219416 - DNA, 25 bp, Rattus norvegicus
caagcagtgttgattccctagtgtt

SEQ ID NO: 219417 - DNA, 25 bp, Rattus norvegicus
caagcagtgttgtttccctagtgtt

SEQ ID NO: 219418 - DNA, 25 bp, Rattus norvegicus
caagcagtgtttcgtgttgcctctc

SEQ ID NO: 219419 - DNA, 25 bp, Rattus norvegicus
caagcagtgtttggtgttgcctctc

SEQ ID NO: 219420 - DNA, 25 bp, Rattus norvegicus
caagcagttcacaaccagctgtaac

SEQ ID NO: 219421 - DNA, 25 bp, Rattus norvegicus
caagcagttcactaccagctgtaac

SEQ ID NO: 219422 - DNA, 25 bp, Rattus norvegicus
caagcagttctgattcaagccctaa

SEQ ID NO: 219423 - DNA, 25 bp, Rattus norvegicus
caagcagttctgtttcaagccctaa

SEQ ID NO: 219424 - DNA, 25 bp, Rattus norvegicus
caagcagtttgtcggatttgtgact

SEQ ID NO: 219425 - DNA, 25 bp, Rattus norvegicus
caagcagtttgtgggatttgtgact

SEQ ID NO: 219426 - DNA, 25 bp, Rattus norvegicus
caagcataccaaaatctcctctgag

SEQ ID NO: 219427 - DNA, 25 bp, Rattus norvegicus
caagcataccaatatctcctctgag

SEQ ID NO: 219428 - DNA, 25 bp, Rattus norvegicus
caagcatccacacagggctcaggga

SEQ ID NO: 219429 - DNA, 25 bp, Rattus norvegicus
caagcatccacagagggctcaggga

SEQ ID NO: 219430 - DNA, 25 bp, Rattus norvegicus
caagcatcccaacttcgataggaag

SEQ ID NO: 219431 - DNA, 25 bp, Rattus norvegicus
caagcatcccaagttcgataggaag

SEQ ID NO: 219432 - DNA, 25 bp, Rattus norvegicus
caagcatccggcagagcacagaaga

SEQ ID NO: 219433 - DNA, 25 bp, Rattus norvegicus
caagcatccggctgagcacagaaga

SEQ ID NO: 219434 - DNA, 25 bp, Rattus norvegicus
caagcatctgatccctcttatttga

SEQ ID NO: 219435 - DNA, 25 bp, Rattus norvegicus
caagcatctgatgcctcttatttga

SEQ ID NO: 219436 - DNA, 25 bp, Rattus norvegicus
caagcatctggacgcctctcagtgc

SEQ ID NO: 219437 - DNA, 25 bp, Rattus norvegicus
caagcatctggaggcctctcagtgc

SEQ ID NO: 219438 - DNA, 25 bp, Rattus norvegicus
caagcatgatggcaggagcccttga

SEQ ID NO: 219439 - DNA, 25 bp, Rattus norvegicus
caagcatgatgggaggagcccttga

SEQ ID NO: 219440 - DNA, 25 bp, Rattus norvegicus
caagcatggagtccttgctccagga

SEQ ID NO: 219441 - DNA, 25 bp, Rattus norvegicus
caagcatggagtgcttgctccagga

SEQ ID NO: 219442 - DNA, 25 bp, Rattus norvegicus
caagcatggttacccaactgcggaa

SEQ ID NO: 219443 - DNA, 25 bp, Rattus norvegicus
caagcatggttagccaactgcggaa

SEQ ID NO: 219444 - DNA, 25 bp, Rattus norvegicus
caagcattatacacacatggcctca

SEQ ID NO: 219445 - DNA, 25 bp, Rattus norvegicus
caagcattatactcacatggcctca

SEQ ID NO: 219446 - DNA, 25 bp, Rattus norvegicus
caagcattatgccagccaaggttac

SEQ ID NO: 219447 - DNA, 25 bp, Rattus norvegicus
caagcattatgcgagccaaggttac

SEQ ID NO: 219448 - DNA, 25 bp, Rattus norvegicus
caagcattcagtctgagtcccattt

SEQ ID NO: 219449 - DNA, 25 bp, Rattus norvegicus
caagcattcagtgtgagtcccattt

SEQ ID NO: 219450 - DNA, 25 bp, Rattus norvegicus
caagcattccacaaactgagccata

SEQ ID NO: 219451 - DNA, 25 bp, Rattus norvegicus
caagcattccactaactgagccata

SEQ ID NO: 219452 - DNA, 25 bp, Rattus norvegicus
caagcattccttcttctcttatgga

SEQ ID NO: 219453 - DNA, 25 bp, Rattus norvegicus
caagcattccttgttctcttatgga

SEQ ID NO: 219454 - DNA, 25 bp, Rattus norvegicus
caagcattctgactacatgacaccc

SEQ ID NO: 219455 - DNA, 25 bp, Rattus norvegicus
caagcattctgagtacatgacaccc

SEQ ID NO: 219456 - DNA, 25 bp, Rattus norvegicus
caagcattgtccactaatagtgttc

SEQ ID NO: 219457 - DNA, 25 bp, Rattus norvegicus
caagcattgtcctctaatagtgttc

SEQ ID NO: 219458 - DNA, 25 bp, Rattus norvegicus
caagccaaaatgatctgctttgtct

SEQ ID NO: 219459 - DNA, 25 bp, Rattus norvegicus
caagccaaaatgttctgctttgtct

SEQ ID NO: 219460 - DNA, 25 bp, Rattus norvegicus
caagccaacaagctattgtccttta

SEQ ID NO: 219461 - DNA, 25 bp, Rattus norvegicus
caagccaacaaggtattgtccttta

SEQ ID NO: 219462 - DNA, 25 bp, Rattus norvegicus
caagccaacaccatctagtgggaaa

SEQ ID NO: 219463 - DNA, 25 bp, Rattus norvegicus
caagccaacaccttctagtgggaaa

SEQ ID NO: 219464 - DNA, 25 bp, Rattus norvegicus
caagccacacccctaaagaaaactg

SEQ ID NO: 219465 - DNA, 25 bp, Rattus norvegicus
caagccacacccgtaaagaaaactg

SEQ ID NO: 219466 - DNA, 25 bp, Rattus norvegicus
caagccacaggtaactcccagtttt

SEQ ID NO: 219467 - DNA, 25 bp, Rattus norvegicus
caagccacaggttactcccagtttt

SEQ ID NO: 219468 - DNA, 25 bp, Rattus norvegicus
caagccactgtgaagcaaaagagaa

SEQ ID NO: 219469 - DNA, 25 bp, Rattus norvegicus
caagccactgtgtagcaaaagagaa

SEQ ID NO: 219470 - DNA, 25 bp, Rattus norvegicus
caagccagctctcatgtttacaggg

SEQ ID NO: 219471 - DNA, 25 bp, Rattus norvegicus
caagccagctctgatgtttacaggg

SEQ ID NO: 219472 - DNA, 25 bp, Rattus norvegicus
caagccagctgcagtttctctgtaa

SEQ ID NO: 219473 - DNA, 25 bp, Rattus norvegicus
caagccagctgctgtttctctgtaa

SEQ ID NO: 219474 - DNA, 25 bp, Rattus norvegicus
caagccagtctgatctacagagtga

SEQ ID NO: 219475 - DNA, 25 bp, Rattus norvegicus
caagccagtctgctagcgagggcca

SEQ ID NO: 219476 - DNA, 25 bp, Rattus norvegicus
caagccagtctggtagcgagggcca

SEQ ID NO: 219477 - DNA, 25 bp, Rattus norvegicus
caagccagtctgttctacagagtga

SEQ ID NO: 219478 - DNA, 25 bp, Rattus norvegicus
caagccagtcttccctgtggtgaat

SEQ ID NO: 219479 - DNA, 25 bp, Rattus norvegicus
caagccagtcttgcctgtggtgaat

SEQ ID NO: 219480 - DNA, 25 bp, Rattus norvegicus
caagcccaacgtacaggttcaaaag

SEQ ID NO: 219481 - DNA, 25 bp, Rattus norvegicus
caagcccaacgttcaggttcaaaag

SEQ ID NO: 219482 - DNA, 25 bp, Rattus norvegicus
caagcccaacttcatcatcagcgta

SEQ ID NO: 219483 - DNA, 25 bp, Rattus norvegicus
caagcccaacttgatcatcagcgta

SEQ ID NO: 219484 - DNA, 25 bp, Rattus norvegicus
caagcccaaggcctaaagctgagga

SEQ ID NO: 219485 - DNA, 25 bp, Rattus norvegicus
caagcccaaggcgtaaagctgagga

SEQ ID NO: 219486 - DNA, 25 bp, Rattus norvegicus
caagcccaatgtatatgactccaaa

SEQ ID NO: 219487 - DNA, 25 bp, Rattus norvegicus
caagcccaatgtttatgactccaaa

SEQ ID NO: 219488 - DNA, 25 bp, Rattus norvegicus
caagcccacctaccagtgttttggg

SEQ ID NO: 219489 - DNA, 25 bp, Rattus norvegicus
caagcccacctagcagtgttttggg

SEQ ID NO: 219490 - DNA, 25 bp, Rattus norvegicus
caagcccagcacaggttttactttt

SEQ ID NO: 219491 - DNA, 25 bp, Rattus norvegicus
caagcccagcactggttttactttt

SEQ ID NO: 219492 - DNA, 25 bp, Rattus norvegicus
caagcccagcccaagagaaggccat

SEQ ID NO: 219493 - DNA, 25 bp, Rattus norvegicus
caagcccagccctagagaaggccat

SEQ ID NO: 219494 - DNA, 25 bp, Rattus norvegicus
caagcccagcttcacagtatcaata

SEQ ID NO: 219495 - DNA, 25 bp, Rattus norvegicus
caagcccagcttccctatttaggtg

SEQ ID NO: 219496 - DNA, 25 bp, Rattus norvegicus
caagcccagcttgacagtatcaata

SEQ ID NO: 219497 - DNA, 25 bp, Rattus norvegicus
caagcccagcttgcctatttaggtg

SEQ ID NO: 219498 - DNA, 25 bp, Rattus norvegicus
caagcccattggcttcactatgtac

SEQ ID NO: 219499 - DNA, 25 bp, Rattus norvegicus
caagcccattgggttcactatgtac

SEQ ID NO: 219500 - DNA, 25 bp, Rattus norvegicus
caagccccacttatgcgatatgtga

SEQ ID NO: 219501 - DNA, 25 bp, Rattus norvegicus
caagccccacttttgcgatatgtga

SEQ ID NO: 219502 - DNA, 25 bp, Rattus norvegicus
caagccccagagcatgcgtgaagtt

SEQ ID NO: 219503 - DNA, 25 bp, Rattus norvegicus
caagccccagaggatgcgtgaagtt

SEQ ID NO: 219504 - DNA, 25 bp, Rattus norvegicus
caagcccctggaatcaactgtatgg

SEQ ID NO: 219505 - DNA, 25 bp, Rattus norvegicus
caagcccctggattcaactgtatgg

SEQ ID NO: 219506 - DNA, 25 bp, Rattus norvegicus
caagcccgcggcaacttgtgaaggg

SEQ ID NO: 219507 - DNA, 25 bp, Rattus norvegicus
caagcccgcggctacttgtgaaggg

SEQ ID NO: 219508 - DNA, 25 bp, Rattus norvegicus
caagccctactgcatgtgtgatgca

SEQ ID NO: 219509 - DNA, 25 bp, Rattus norvegicus
caagccctactggatgtgtgatgca

SEQ ID NO: 219510 - DNA, 25 bp, Rattus norvegicus
caagccctagaacgtacttagaatt

SEQ ID NO: 219511 - DNA, 25 bp, Rattus norvegicus
caagccctagaaggtacttagaatt

SEQ ID NO: 219512 - DNA, 25 bp, Rattus norvegicus
caagccctgactatggtacagctat

SEQ ID NO: 219513 - DNA, 25 bp, Rattus norvegicus
caagccctgactttggtacagctat

SEQ ID NO: 219514 - DNA, 25 bp, Rattus norvegicus
caagccctggagatcacctagtgat

SEQ ID NO: 219515 - DNA, 25 bp, Rattus norvegicus
caagccctggagcagctggtagcct

SEQ ID NO: 219516 - DNA, 25 bp, Rattus norvegicus
caagccctggaggagctggtagcct

SEQ ID NO: 219517 - DNA, 25 bp, Rattus norvegicus
caagccctggagttcacctagtgat

SEQ ID NO: 219518 - DNA, 25 bp, Rattus norvegicus
caagcccttgttcgtgttgtttaat

SEQ ID NO: 219519 - DNA, 25 bp, Rattus norvegicus
caagcccttgttggtgttgtttaat

SEQ ID NO: 219520 - DNA, 25 bp, Rattus norvegicus
caagccctttatcatactccaatag

SEQ ID NO: 219521 - DNA, 25 bp, Rattus norvegicus
caagccctttatgatactccaatag

SEQ ID NO: 219522 - DNA, 25 bp, Rattus norvegicus
caagccgacattctaggactcacat

SEQ ID NO: 219523 - DNA, 25 bp, Rattus norvegicus
caagccgacattgtaggactcacat

SEQ ID NO: 219524 - DNA, 25 bp, Rattus norvegicus
caagccgaccaccagacagagatac

SEQ ID NO: 219525 - DNA, 25 bp, Rattus norvegicus
caagccgaccacgagacagagatac

SEQ ID NO: 219526 - DNA, 25 bp, Rattus norvegicus
caagccgagctgatatggaatcacg

SEQ ID NO: 219527 - DNA, 25 bp, Rattus norvegicus
caagccgagctgttatggaatcacg

SEQ ID NO: 219528 - DNA, 25 bp, Rattus norvegicus
caagccgaggacagggtgctgccca

SEQ ID NO: 219529 - DNA, 25 bp, Rattus norvegicus
caagccgaggactgggtgctgccca

SEQ ID NO: 219530 - DNA, 25 bp, Rattus norvegicus
caagccgcaaagccagcaggctacc

SEQ ID NO: 219531 - DNA, 25 bp, Rattus norvegicus
caagccgcaaaggcagcaggctacc

SEQ ID NO: 219532 - DNA, 25 bp, Rattus norvegicus
caagccgcaacaatgactctcaaag

SEQ ID NO: 219533 - DNA, 25 bp, Rattus norvegicus
caagccgcaacattgactctcaaag

SEQ ID NO: 219534 - DNA, 25 bp, Rattus norvegicus
caagccgccaacagctcaaggagac

SEQ ID NO: 219535 - DNA, 25 bp, Rattus norvegicus
caagccgccaactgctcaaggagac

SEQ ID NO: 219536 - DNA, 25 bp, Rattus norvegicus
caagccgggacacgtttctccttca

SEQ ID NO: 219537 - DNA, 25 bp, Rattus norvegicus
caagccgggacaggtttctccttca

SEQ ID NO: 219538 - DNA, 25 bp, Rattus norvegicus
caagccgtatgacttccctggtaga

SEQ ID NO: 219539 - DNA, 25 bp, Rattus norvegicus
caagccgtatgagttccctggtaga

SEQ ID NO: 219540 - DNA, 25 bp, Rattus norvegicus
caagccgtggatataatctattcaa

SEQ ID NO: 219541 - DNA, 25 bp, Rattus norvegicus
caagccgtggatttaatctattcaa

SEQ ID NO: 219542 - DNA, 25 bp, Rattus norvegicus
caagcctatccccatatcaaagaga

SEQ ID NO: 219543 - DNA, 25 bp, Rattus norvegicus
caagcctatcccgatatcaaagaga

SEQ ID NO: 219544 - DNA, 25 bp, Rattus norvegicus
caagcctcagcacttctttggatta

SEQ ID NO: 219545 - DNA, 25 bp, Rattus norvegicus
caagcctcagcagttctttggatta

SEQ ID NO: 219546 - DNA, 25 bp, Rattus norvegicus
caagcctcgggactggctcctggct

SEQ ID NO: 219547 - DNA, 25 bp, Rattus norvegicus
caagcctcgggagtggctcctggct

SEQ ID NO: 219548 - DNA, 25 bp, Rattus norvegicus
caagcctctaaccatgaattcgtct

SEQ ID NO: 219549 - DNA, 25 bp, Rattus norvegicus
caagcctctaacgatgaattcgtct

SEQ ID NO: 219550 - DNA, 25 bp, Rattus norvegicus
caagcctctggtactaatttctcat

SEQ ID NO: 219551 - DNA, 25 bp, Rattus norvegicus
caagcctctggttctaatttctcat

SEQ ID NO: 219552 - DNA, 25 bp, Rattus norvegicus
caagcctgagaacatgagctcttta

SEQ ID NO: 219553 - DNA, 25 bp, Rattus norvegicus
caagcctgagaagatgagctcttta

SEQ ID NO: 219554 - DNA, 25 bp, Rattus norvegicus
caagcctgagcaagtgggtctgaaa

SEQ ID NO: 219555 - DNA, 25 bp, Rattus norvegicus
caagcctgagcatgtgggtctgaaa

SEQ ID NO: 219556 - DNA, 25 bp, Rattus norvegicus
caagcctgagccagaaagggtgcat

SEQ ID NO: 219557 - DNA, 25 bp, Rattus norvegicus
caagcctgagcctgaaagggtgcat

SEQ ID NO: 219558 - DNA, 25 bp, Rattus norvegicus
caagcctgaggacccgttagtgctg

SEQ ID NO: 219559 - DNA, 25 bp, Rattus norvegicus
caagcctgaggagccgttagtgctg

SEQ ID NO: 219560 - DNA, 25 bp, Rattus norvegicus
caagcctgcctcattttataccatt

SEQ ID NO: 219561 - DNA, 25 bp, Rattus norvegicus
caagcctgcctctttttataccatt

SEQ ID NO: 219562 - DNA, 25 bp, Rattus norvegicus
caagcctgcggcacaggtggtccag

SEQ ID NO: 219563 - DNA, 25 bp, Rattus norvegicus
caagcctgcggctcaggtggtccag

SEQ ID NO: 219564 - DNA, 25 bp, Rattus norvegicus
caagcctggaaaaaacggataccgt

SEQ ID NO: 219565 - DNA, 25 bp, Rattus norvegicus
caagcctggaaataacggataccgt

SEQ ID NO: 219566 - DNA, 25 bp, Rattus norvegicus
caagcctggcatcgagttctgcata

SEQ ID NO: 219567 - DNA, 25 bp, Rattus norvegicus
caagcctggcatggagttctgcata

SEQ ID NO: 219568 - DNA, 25 bp, Rattus norvegicus
caagcctgttccacattttgtacat

SEQ ID NO: 219569 - DNA, 25 bp, Rattus norvegicus
caagcctgttcctcattttgtacat

SEQ ID NO: 219570 - DNA, 25 bp, Rattus norvegicus
caagccttatccactggactgcatc

SEQ ID NO: 219571 - DNA, 25 bp, Rattus norvegicus
caagccttatcctctggactgcatc

SEQ ID NO: 219572 - DNA, 20 bp, Rattus norvegicus
caagccttccatagaaatca

SEQ ID NO: 219573 - DNA, 20 bp, Rattus norvegicus
caagccttccctagaaatca

SEQ ID NO: 219574 - DNA, 20 bp, Rattus norvegicus
caagccttccgtagaaatca

SEQ ID NO: 219575 - DNA, 20 bp, Rattus norvegicus
caagccttccttagaaatca

SEQ ID NO: 219576 - DNA, 25 bp, Rattus norvegicus
caagccttccttcggccagcattaa

SEQ ID NO: 219577 - DNA, 25 bp, Rattus norvegicus
caagccttccttgggccagcattaa

SEQ ID NO: 219578 - DNA, 25 bp, Rattus norvegicus
caagccttctacatggtgggaccca

SEQ ID NO: 219579 - DNA, 25 bp, Rattus norvegicus
caagccttctacttggtgggaccca

SEQ ID NO: 219580 - DNA, 25 bp, Rattus norvegicus
caagccttgcagcttttctttcctc

SEQ ID NO: 219581 - DNA, 25 bp, Rattus norvegicus
caagccttgcaggttttctttcctc

SEQ ID NO: 219582 - DNA, 25 bp, Rattus norvegicus
caagccttgcgtattctgtctgtga

SEQ ID NO: 219583 - DNA, 25 bp, Rattus norvegicus
caagccttgcgttttctgtctgtga

SEQ ID NO: 219584 - DNA, 25 bp, Rattus norvegicus
caagccttgtgcaacccagtgtggg

SEQ ID NO: 219585 - DNA, 25 bp, Rattus norvegicus
caagccttgtgctacccagtgtggg

SEQ ID NO: 219586 - DNA, 25 bp, Rattus norvegicus
caagcctttctgacaacttttcctc

SEQ ID NO: 219587 - DNA, 25 bp, Rattus norvegicus
caagcctttctgtcaacttttcctc

SEQ ID NO: 219588 - DNA, 25 bp, Rattus norvegicus
caagcctttcttcagcatagtagcc

SEQ ID NO: 219589 - DNA, 25 bp, Rattus norvegicus
caagcctttcttgagcatagtagcc

SEQ ID NO: 219590 - DNA, 25 bp, Rattus norvegicus
caagcctttggcattttctgcaatt

SEQ ID NO: 219591 - DNA, 25 bp, Rattus norvegicus
caagcctttggctttttctgcaatt

SEQ ID NO: 219592 - DNA, 25 bp, Rattus norvegicus
caagccttttttctagcctacaagt

SEQ ID NO: 219593 - DNA, 25 bp, Rattus norvegicus
caagccttttttgtagcctacaagt

SEQ ID NO: 219594 - DNA, 25 bp, Rattus norvegicus
caagcgaccattcaggatctgcctg

SEQ ID NO: 219595 - DNA, 25 bp, Rattus norvegicus
caagcgaccattgaggatctgcctg

SEQ ID NO: 219596 - DNA, 25 bp, Rattus norvegicus
caagcgactcttcactcttaattaa

SEQ ID NO: 219597 - DNA, 25 bp, Rattus norvegicus
caagcgactcttgactcttaattaa

SEQ ID NO: 219598 - DNA, 25 bp, Rattus norvegicus
caagcgactggaagctctgtagttg

SEQ ID NO: 219599 - DNA, 25 bp, Rattus norvegicus
caagcgactggatgctctgtagttg

SEQ ID NO: 219600 - DNA, 25 bp, Rattus norvegicus
caagcgagcgagaccgagaggttct

SEQ ID NO: 219601 - DNA, 25 bp, Rattus norvegicus
caagcgagcgagtccgagaggttct

SEQ ID NO: 219602 - DNA, 25 bp, Rattus norvegicus
caagcgagggctactacagctgtgt

SEQ ID NO: 219603 - DNA, 25 bp, Rattus norvegicus
caagcgagggcttctacagctgtgt

SEQ ID NO: 219604 - DNA, 25 bp, Rattus norvegicus
caagcgcaccatagctcaggattat

SEQ ID NO: 219605 - DNA, 25 bp, Rattus norvegicus
caagcgcaccattgctcaggattat

SEQ ID NO: 219606 - DNA, 25 bp, Rattus norvegicus
caagcgcatgcaaaccaggaagtgg

SEQ ID NO: 219607 - DNA, 25 bp, Rattus norvegicus
caagcgcatgcataccaggaagtgg

SEQ ID NO: 219608 - DNA, 25 bp, Rattus norvegicus
caagcgccgtgaaggaggagtatcc

SEQ ID NO: 219609 - DNA, 25 bp, Rattus norvegicus
caagcgccgtgatggaggagtatcc

SEQ ID NO: 219610 - DNA, 25 bp, Rattus norvegicus
caagcgctatgcaaggaatccttaa

SEQ ID NO: 219611 - DNA, 25 bp, Rattus norvegicus
caagcgctatgctaggaatccttaa

SEQ ID NO: 219612 - DNA, 25 bp, Rattus norvegicus
caagcgctggatctttagctgctca

SEQ ID NO: 219613 - DNA, 25 bp, Rattus norvegicus
caagcgctggatgtttagctgctca

SEQ ID NO: 219614 - DNA, 25 bp, Rattus norvegicus
caagcggaactgcgcttaaaacagc

SEQ ID NO: 219615 - DNA, 25 bp, Rattus norvegicus
caagcggaactgggcttaaaacagc

SEQ ID NO: 219616 - DNA, 25 bp, Rattus norvegicus
caagcggaagccacgcctgatggaa

SEQ ID NO: 219617 - DNA, 25 bp, Rattus norvegicus
caagcggaagcctcgcctgatggaa

SEQ ID NO: 219618 - DNA, 25 bp, Rattus norvegicus
caagcggacaagctgttcctcatat

SEQ ID NO: 219619 - DNA, 25 bp, Rattus norvegicus
caagcggacaaggtgttcctcatat

SEQ ID NO: 219620 - DNA, 25 bp, Rattus norvegicus
caagcggcggcgagatgacatcagt

SEQ ID NO: 219621 - DNA, 25 bp, Rattus norvegicus
caagcggcggcgtgatgacatcagt

SEQ ID NO: 219622 - DNA, 25 bp, Rattus norvegicus
caagcgggcaagctgtagatctgac

SEQ ID NO: 219623 - DNA, 25 bp, Rattus norvegicus
caagcgggcaaggtgtagatctgac

SEQ ID NO: 219624 - DNA, 25 bp, Rattus norvegicus
caagcggtttttcgaagcctacaat

SEQ ID NO: 219625 - DNA, 25 bp, Rattus norvegicus
caagcggtttttggaagcctacaat

SEQ ID NO: 219626 - DNA, 25 bp, Rattus norvegicus
caagcgtctgtgaggccagaacaca

SEQ ID NO: 219627 - DNA, 25 bp, Rattus norvegicus
caagcgtctgtgtggccagaacaca

SEQ ID NO: 219628 - DNA, 25 bp, Rattus norvegicus
caagcgtgaagaaagatggcagtaa

SEQ ID NO: 219629 - DNA, 25 bp, Rattus norvegicus
caagcgtgaagatagatggcagtaa

SEQ ID NO: 219630 - DNA, 25 bp, Rattus norvegicus
caagcgtggcacctgtttgcataat

SEQ ID NO: 219631 - DNA, 25 bp, Rattus norvegicus
caagcgtggcacgtgtttgcataat

SEQ ID NO: 219632 - DNA, 25 bp, Rattus norvegicus
caagcgttgaagactgcatgccaca

SEQ ID NO: 219633 - DNA, 25 bp, Rattus norvegicus
caagcgttgaagtctgcatgccaca

SEQ ID NO: 219634 - DNA, 25 bp, Rattus norvegicus
caagctaaacttacatttgtacttt

SEQ ID NO: 219635 - DNA, 25 bp, Rattus norvegicus
caagctaaactttcatttgtacttt

SEQ ID NO: 219636 - DNA, 25 bp, Rattus norvegicus
caagctacgagcagcaagctcgcct

SEQ ID NO: 219637 - DNA, 25 bp, Rattus norvegicus
caagctacgagctgcaagctcgcct

SEQ ID NO: 219638 - DNA, 25 bp, Rattus norvegicus
caagctactggaagcactgtcagat

SEQ ID NO: 219639 - DNA, 25 bp, Rattus norvegicus
caagctactggatgcactgtcagat

SEQ ID NO: 219640 - DNA, 25 bp, Rattus norvegicus
caagctagcaggaacatccccagat

SEQ ID NO: 219641 - DNA, 25 bp, Rattus norvegicus
caagctagcaggtacatccccagat

SEQ ID NO: 219642 - DNA, 25 bp, Rattus norvegicus
caagctagcttgacatagttccaga

SEQ ID NO: 219643 - DNA, 25 bp, Rattus norvegicus
caagctagcttgcaagtccttatat

SEQ ID NO: 219644 - DNA, 25 bp, Rattus norvegicus
caagctagcttggaagtccttatat

SEQ ID NO: 219645 - DNA, 25 bp, Rattus norvegicus
caagctagcttgtcatagttccaga

SEQ ID NO: 219646 - DNA, 25 bp, Rattus norvegicus
caagctaggagcactagggcctgta

SEQ ID NO: 219647 - DNA, 25 bp, Rattus norvegicus
caagctaggagctctagggcctgta

SEQ ID NO: 219648 - DNA, 25 bp, Rattus norvegicus
caagctaggcttcgaggatctgatc

SEQ ID NO: 219649 - DNA, 25 bp, Rattus norvegicus
caagctaggcttggaggatctgatc

SEQ ID NO: 219650 - DNA, 25 bp, Rattus norvegicus
caagctagtggtctttgtccagaca

SEQ ID NO: 219651 - DNA, 25 bp, Rattus norvegicus
caagctagtggtgtttgtccagaca

SEQ ID NO: 219652 - DNA, 25 bp, Rattus norvegicus
caagctatgactagacactcccaag

SEQ ID NO: 219653 - DNA, 25 bp, Rattus norvegicus
caagctatgacttgacactcccaag

SEQ ID NO: 219654 - DNA, 25 bp, Rattus norvegicus
caagctattcagactttatccatat

SEQ ID NO: 219655 - DNA, 25 bp, Rattus norvegicus
caagctattcagtctttatccatat

SEQ ID NO: 219656 - DNA, 25 bp, Rattus norvegicus
caagctcacacacagcggcgagaag

SEQ ID NO: 219657 - DNA, 25 bp, Rattus norvegicus
caagctcacacagagcggcgagaag

SEQ ID NO: 219658 - DNA, 25 bp, Rattus norvegicus
caagctcaccagaggcagagccggt

SEQ ID NO: 219659 - DNA, 25 bp, Rattus norvegicus
caagctcaccagtggcagagccggt

SEQ ID NO: 219660 - DNA, 25 bp, Rattus norvegicus
caagctcaggaacggagcctgcctt

SEQ ID NO: 219661 - DNA, 25 bp, Rattus norvegicus
caagctcaggaagggagcctgcctt

SEQ ID NO: 219662 - DNA, 25 bp, Rattus norvegicus
caagctcatattcctgtaccgatca

SEQ ID NO: 219663 - DNA, 25 bp, Rattus norvegicus
caagctcatattgctgtaccgatca

SEQ ID NO: 219664 - DNA, 25 bp, Rattus norvegicus
caagctcatcttacaaagccttctt

SEQ ID NO: 219665 - DNA, 25 bp, Rattus norvegicus
caagctcatctttcaaagccttctt

SEQ ID NO: 219666 - DNA, 25 bp, Rattus norvegicus
caagctccaccccttttctatattt

SEQ ID NO: 219667 - DNA, 25 bp, Rattus norvegicus
caagctccacccgttttctatattt

SEQ ID NO: 219668 - DNA, 25 bp, Rattus norvegicus
caagctcccttgatatttgttctgt

SEQ ID NO: 219669 - DNA, 25 bp, Rattus norvegicus
caagctcccttgttatttgttctgt

SEQ ID NO: 219670 - DNA, 25 bp, Rattus norvegicus
caagctccgaagatgcgacatggat

SEQ ID NO: 219671 - DNA, 25 bp, Rattus norvegicus
caagctccgaagttgcgacatggat

SEQ ID NO: 219672 - DNA, 25 bp, Rattus norvegicus
caagctccgttcctgttggaacaag

SEQ ID NO: 219673 - DNA, 25 bp, Rattus norvegicus
caagctccgttcgtgttggaacaag

SEQ ID NO: 219674 - DNA, 25 bp, Rattus norvegicus
caagctcctagcatctggcagtggg

SEQ ID NO: 219675 - DNA, 25 bp, Rattus norvegicus
caagctcctagcttctggcagtggg

SEQ ID NO: 219676 - DNA, 25 bp, Rattus norvegicus
caagctcctgccctgtttgttaacc

SEQ ID NO: 219677 - DNA, 25 bp, Rattus norvegicus
caagctcctgccgtgtttgttaacc

SEQ ID NO: 219678 - DNA, 25 bp, Rattus norvegicus
caagctccttccacggtaggcagga

SEQ ID NO: 219679 - DNA, 25 bp, Rattus norvegicus
caagctccttcctcggtaggcagga

SEQ ID NO: 219680 - DNA, 25 bp, Rattus norvegicus
caagctccttgtctaaaatgatgaa

SEQ ID NO: 219681 - DNA, 25 bp, Rattus norvegicus
caagctccttgtgtaaaatgatgaa

SEQ ID NO: 219682 - DNA, 25 bp, Rattus norvegicus
caagctcctttgacacctcatcgaa

SEQ ID NO: 219683 - DNA, 25 bp, Rattus norvegicus
caagctcctttgtcacctcatcgaa

SEQ ID NO: 219684 - DNA, 25 bp, Rattus norvegicus
caagctctacttctcctagaacaca

SEQ ID NO: 219685 - DNA, 25 bp, Rattus norvegicus
caagctctacttgtcctagaacaca

SEQ ID NO: 219686 - DNA, 25 bp, Rattus norvegicus
caagctctccaacatacgagtcgta

SEQ ID NO: 219687 - DNA, 25 bp, Rattus norvegicus
caagctctccaagatacgagtcgta

SEQ ID NO: 219688 - DNA, 25 bp, Rattus norvegicus
caagctctccttctatgtttgtggt

SEQ ID NO: 219689 - DNA, 25 bp, Rattus norvegicus
caagctctccttgtatgtttgtggt

SEQ ID NO: 219690 - DNA, 25 bp, Rattus norvegicus
caagctctcgggagatgcggccatg

SEQ ID NO: 219691 - DNA, 25 bp, Rattus norvegicus
caagctctcgggtgatgcggccatg

SEQ ID NO: 219692 - DNA, 25 bp, Rattus norvegicus
caagctctgataactgacttcctat

SEQ ID NO: 219693 - DNA, 25 bp, Rattus norvegicus
caagctctgatatctgacttcctat

SEQ ID NO: 219694 - DNA, 25 bp, Rattus norvegicus
caagctctgcacaggcctacagcgg

SEQ ID NO: 219695 - DNA, 25 bp, Rattus norvegicus
caagctctgcactggcctacagcgg

SEQ ID NO: 219696 - DNA, 25 bp, Rattus norvegicus
caagctctgccacgtgaggctcata

SEQ ID NO: 219697 - DNA, 25 bp, Rattus norvegicus
caagctctgccaggtgaggctcata

SEQ ID NO: 219698 - DNA, 25 bp, Rattus norvegicus
caagctctgctcctgttactgaaaa

SEQ ID NO: 219699 - DNA, 25 bp, Rattus norvegicus
caagctctgctcgtgttactgaaaa

SEQ ID NO: 219700 - DNA, 25 bp, Rattus norvegicus
caagctctgggcactcaggtgaggc

SEQ ID NO: 219701 - DNA, 25 bp, Rattus norvegicus
caagctctgggctctcaggtgaggc

SEQ ID NO: 219702 - DNA, 25 bp, Rattus norvegicus
caagctctgtgtcccggcaggataa

SEQ ID NO: 219703 - DNA, 25 bp, Rattus norvegicus
caagctctgtgtgccggcaggataa

SEQ ID NO: 219704 - DNA, 25 bp, Rattus norvegicus
caagctcttggccatggtgaccagt

SEQ ID NO: 219705 - DNA, 25 bp, Rattus norvegicus
caagctcttggcgatggtgaccagt

SEQ ID NO: 219706 - DNA, 25 bp, Rattus norvegicus
caagctgaagatctccactgtgcat

SEQ ID NO: 219707 - DNA, 25 bp, Rattus norvegicus
caagctgaagatgtccactgtgcat

SEQ ID NO: 219708 - DNA, 25 bp, Rattus norvegicus
caagctgaagccaagtacctacgaa

SEQ ID NO: 219709 - DNA, 25 bp, Rattus norvegicus
caagctgaagcctagtacctacgaa

SEQ ID NO: 219710 - DNA, 25 bp, Rattus norvegicus
caagctgaagtcaggcgggagttgg

SEQ ID NO: 219711 - DNA, 25 bp, Rattus norvegicus
caagctgaagtctggcgggagttgg

SEQ ID NO: 219712 - DNA, 25 bp, Rattus norvegicus
caagctgacaacaacgactgaccat

SEQ ID NO: 219713 - DNA, 25 bp, Rattus norvegicus
caagctgacaactacgactgaccat

SEQ ID NO: 219714 - DNA, 25 bp, Rattus norvegicus
caagctgacagacgacactcggcag

SEQ ID NO: 219715 - DNA, 25 bp, Rattus norvegicus
caagctgacagaggacactcggcag

SEQ ID NO: 219716 - DNA, 25 bp, Rattus norvegicus
caagctgactctccgatcaaggcta

SEQ ID NO: 219717 - DNA, 25 bp, Rattus norvegicus
caagctgactctgcgatcaaggcta

SEQ ID NO: 219718 - DNA, 25 bp, Rattus norvegicus
caagctgagtcccttcgcggccgag

SEQ ID NO: 219719 - DNA, 25 bp, Rattus norvegicus
caagctgagtccgttcgcggccgag

SEQ ID NO: 219720 - DNA, 25 bp, Rattus norvegicus
caagctgagtctcgcccttggcagt

SEQ ID NO: 219721 - DNA, 25 bp, Rattus norvegicus
caagctgagtctggcccttggcagt

SEQ ID NO: 219722 - DNA, 25 bp, Rattus norvegicus
caagctgattttcgtcacggtgtct

SEQ ID NO: 219723 - DNA, 25 bp, Rattus norvegicus
caagctgattttggtcacggtgtct

SEQ ID NO: 219724 - DNA, 25 bp, Rattus norvegicus
caagctgcacctctgttacaaatgt

SEQ ID NO: 219725 - DNA, 25 bp, Rattus norvegicus
caagctgcacctgtgttacaaatgt

SEQ ID NO: 219726 - DNA, 25 bp, Rattus norvegicus
caagctgcagccactgttcctagaa

SEQ ID NO: 219727 - DNA, 25 bp, Rattus norvegicus
caagctgcagcctctgttcctagaa

SEQ ID NO: 219728 - DNA, 25 bp, Rattus norvegicus
caagctgcatctacagaggctgaga

SEQ ID NO: 219729 - DNA, 25 bp, Rattus norvegicus
caagctgcatcttcagaggctgaga

SEQ ID NO: 219730 - DNA, 25 bp, Rattus norvegicus
caagctgccaccagggcctggcttt

SEQ ID NO: 219731 - DNA, 25 bp, Rattus norvegicus
caagctgccacctgggcctggcttt

SEQ ID NO: 219732 - DNA, 25 bp, Rattus norvegicus
caagctgccagtcttgatcaacaga

SEQ ID NO: 219733 - DNA, 25 bp, Rattus norvegicus
caagctgccagtgttgatcaacaga

SEQ ID NO: 219734 - DNA, 25 bp, Rattus norvegicus
caagctgcctctcagcagtgaggga

SEQ ID NO: 219735 - DNA, 25 bp, Rattus norvegicus
caagctgcctctgagcagtgaggga

SEQ ID NO: 219736 - DNA, 25 bp, Rattus norvegicus
caagctgctcctcccgaagggcagt

SEQ ID NO: 219737 - DNA, 25 bp, Rattus norvegicus
caagctgctcctgccgaagggcagt

SEQ ID NO: 219738 - DNA, 25 bp, Rattus norvegicus
caagctgctctacgcctttgccgag

SEQ ID NO: 219739 - DNA, 25 bp, Rattus norvegicus
caagctgctctaggcctttgccgag

SEQ ID NO: 219740 - DNA, 25 bp, Rattus norvegicus
caagctgctggacgtgctctccgga

SEQ ID NO: 219741 - DNA, 25 bp, Rattus norvegicus
caagctgctggaggtgctctccgga

SEQ ID NO: 219742 - DNA, 25 bp, Rattus norvegicus
caagctgcttggatgagtccggtta

SEQ ID NO: 219743 - DNA, 25 bp, Rattus norvegicus
caagctgcttggttgagtccggtta

SEQ ID NO: 219744 - DNA, 25 bp, Rattus norvegicus
caagctgcttgtagacctgttaata

SEQ ID NO: 219745 - DNA, 25 bp, Rattus norvegicus
caagctgcttgttgacctgttaata

SEQ ID NO: 219746 - DNA, 25 bp, Rattus norvegicus
caagctggagttctgcagaggcaaa

SEQ ID NO: 219747 - DNA, 25 bp, Rattus norvegicus
caagctggagttgtgcagaggcaaa

SEQ ID NO: 219748 - DNA, 25 bp, Rattus norvegicus
caagctggcccgagccctccgggaa

SEQ ID NO: 219749 - DNA, 25 bp, Rattus norvegicus
caagctggcccgtgccctccgggaa

SEQ ID NO: 219750 - DNA, 25 bp, Rattus norvegicus
caagctggctgtcacctcctacaat

SEQ ID NO: 219751 - DNA, 25 bp, Rattus norvegicus
caagctggctgtgacctcctacaat

SEQ ID NO: 219752 - DNA, 25 bp, Rattus norvegicus
caagctgggaacactggttggcaag

SEQ ID NO: 219753 - DNA, 25 bp, Rattus norvegicus
caagctgggaactctggttggcaag

SEQ ID NO: 219754 - DNA, 25 bp, Rattus norvegicus
caagctgggagcacatcttgttcac

SEQ ID NO: 219755 - DNA, 25 bp, Rattus norvegicus
caagctgggagctcatcttgttcac

SEQ ID NO: 219756 - DNA, 25 bp, Rattus norvegicus
caagctgggtgtatgttgcagcaaa

SEQ ID NO: 219757 - DNA, 25 bp, Rattus norvegicus
caagctgggtgtttgttgcagcaaa

SEQ ID NO: 219758 - DNA, 25 bp, Rattus norvegicus
caagctggtcaacgtctcagatctc

SEQ ID NO: 219759 - DNA, 25 bp, Rattus norvegicus
caagctggtcaaggtctcagatctc

SEQ ID NO: 219760 - DNA, 25 bp, Rattus norvegicus
caagctggtcttagaaattcccttt

SEQ ID NO: 219761 - DNA, 25 bp, Rattus norvegicus
caagctggtcttcacctcgctgggc

SEQ ID NO: 219762 - DNA, 25 bp, Rattus norvegicus
caagctggtcttctttgtgttttta

SEQ ID NO: 219763 - DNA, 25 bp, Rattus norvegicus
caagctggtcttgacctcgctgggc

SEQ ID NO: 219764 - DNA, 25 bp, Rattus norvegicus
caagctggtcttgtttgtgttttta

SEQ ID NO: 219765 - DNA, 25 bp, Rattus norvegicus
caagctggtctttgaaattcccttt

SEQ ID NO: 219766 - DNA, 25 bp, Rattus norvegicus
caagctgtaccccattgatgaggag

SEQ ID NO: 219767 - DNA, 25 bp, Rattus norvegicus
caagctgtacccgattgatgaggag

SEQ ID NO: 219768 - DNA, 25 bp, Rattus norvegicus
caagctgtagaaataggtccatttt

SEQ ID NO: 219769 - DNA, 25 bp, Rattus norvegicus
caagctgtagaattaggtccatttt

SEQ ID NO: 219770 - DNA, 25 bp, Rattus norvegicus
caagctgtcagtccctcacagtttt

SEQ ID NO: 219771 - DNA, 25 bp, Rattus norvegicus
caagctgtcagtgcctcacagtttt

SEQ ID NO: 219772 - DNA, 25 bp, Rattus norvegicus
caagctgtccatagtctgctgcaat

SEQ ID NO: 219773 - DNA, 25 bp, Rattus norvegicus
caagctgtccattgtctgctgcaat

SEQ ID NO: 219774 - DNA, 25 bp, Rattus norvegicus
caagctgtcccaacccagaggcaag

SEQ ID NO: 219775 - DNA, 25 bp, Rattus norvegicus
caagctgtcccatcccagaggcaag

SEQ ID NO: 219776 - DNA, 25 bp, Rattus norvegicus
caagctgtccttctatgtcagttta

SEQ ID NO: 219777 - DNA, 25 bp, Rattus norvegicus
caagctgtccttgtatgtcagttta

SEQ ID NO: 219778 - DNA, 25 bp, Rattus norvegicus
caagctgtgacaagattcgtgacca

SEQ ID NO: 219779 - DNA, 25 bp, Rattus norvegicus
caagctgtgacatgattcgtgacca

SEQ ID NO: 219780 - DNA, 25 bp, Rattus norvegicus
caagctgtgcttcagacctgactta

SEQ ID NO: 219781 - DNA, 25 bp, Rattus norvegicus
caagctgtgcttgagacctgactta

SEQ ID NO: 219782 - DNA, 25 bp, Rattus norvegicus
caagctgtgttcattcatggcctgt

SEQ ID NO: 219783 - DNA, 25 bp, Rattus norvegicus
caagctgtgttctttcatggcctgt

SEQ ID NO: 219784 - DNA, 25 bp, Rattus norvegicus
caagctgtttccctacagataggat

SEQ ID NO: 219785 - DNA, 25 bp, Rattus norvegicus
caagctgtttccgtacagataggat

SEQ ID NO: 219786 - DNA, 25 bp, Rattus norvegicus
caagctgttttacagaaccctgttt

SEQ ID NO: 219787 - DNA, 25 bp, Rattus norvegicus
caagctgttttagagaaccctgttt

SEQ ID NO: 219788 - DNA, 25 bp, Rattus norvegicus
caagcttcaaggctgcagggcaagt

SEQ ID NO: 219789 - DNA, 25 bp, Rattus norvegicus
caagcttcaagggtgcagggcaagt

SEQ ID NO: 219790 - DNA, 25 bp, Rattus norvegicus
caagcttcagtacctactccagaaa

SEQ ID NO: 219791 - DNA, 25 bp, Rattus norvegicus
caagcttcagtagctactccagaaa

SEQ ID NO: 219792 - DNA, 25 bp, Rattus norvegicus
caagcttcatggcttctaatctgtc

SEQ ID NO: 219793 - DNA, 25 bp, Rattus norvegicus
caagcttcatgggttctaatctgtc

SEQ ID NO: 219794 - DNA, 25 bp, Rattus norvegicus
caagcttccaataggatggcaccat

SEQ ID NO: 219795 - DNA, 25 bp, Rattus norvegicus
caagcttccaattggatggcaccat

SEQ ID NO: 219796 - DNA, 25 bp, Rattus norvegicus
caagcttccctgatgtgggtagtca

SEQ ID NO: 219797 - DNA, 25 bp, Rattus norvegicus
caagcttccctgttgtgggtagtca

SEQ ID NO: 219798 - DNA, 25 bp, Rattus norvegicus
caagcttcctgtcgctgtggtcaat

SEQ ID NO: 219799 - DNA, 25 bp, Rattus norvegicus
caagcttcctgtggctgtggtcaat

SEQ ID NO: 219800 - DNA, 25 bp, Rattus norvegicus
caagcttcgtggctttttatgaaga

SEQ ID NO: 219801 - DNA, 25 bp, Rattus norvegicus
caagcttcgtgggtttttatgaaga

SEQ ID NO: 219802 - DNA, 25 bp, Rattus norvegicus
caagcttctcctagagggccaaggg

SEQ ID NO: 219803 - DNA, 25 bp, Rattus norvegicus
caagcttctccttgagggccaaggg

SEQ ID NO: 219804 - DNA, 25 bp, Rattus norvegicus
caagcttctctgcactacagtctgt

SEQ ID NO: 219805 - DNA, 25 bp, Rattus norvegicus
caagcttctctggactacagtctgt

SEQ ID NO: 219806 - DNA, 25 bp, Rattus norvegicus
caagcttctgatatctattcctaca

SEQ ID NO: 219807 - DNA, 25 bp, Rattus norvegicus
caagcttctgatttctattcctaca

SEQ ID NO: 219808 - DNA, 25 bp, Rattus norvegicus
caagcttctgtaacccacttgggaa

SEQ ID NO: 219809 - DNA, 25 bp, Rattus norvegicus
caagcttctgtatcccacttgggaa

SEQ ID NO: 219810 - DNA, 25 bp, Rattus norvegicus
caagcttctgtgagaggatcctgtt

SEQ ID NO: 219811 - DNA, 25 bp, Rattus norvegicus
caagcttctgtgtgaggatcctgtt

SEQ ID NO: 219812 - DNA, 25 bp, Rattus norvegicus
caagcttgaccacagtagcaacagt

SEQ ID NO: 219813 - DNA, 25 bp, Rattus norvegicus
caagcttgaccactatgctatcatc

SEQ ID NO: 219814 - DNA, 25 bp, Rattus norvegicus
caagcttgaccagagtagcaacagt

SEQ ID NO: 219815 - DNA, 25 bp, Rattus norvegicus
caagcttgaccagtatgctatcatc

SEQ ID NO: 219816 - DNA, 25 bp, Rattus norvegicus
caagcttgaggcatgtgtggtttca

SEQ ID NO: 219817 - DNA, 25 bp, Rattus norvegicus
caagcttgaggcttgtgtggtttca

SEQ ID NO: 219818 - DNA, 25 bp, Rattus norvegicus
caagcttgctctaaggtgagtgcct

SEQ ID NO: 219819 - DNA, 25 bp, Rattus norvegicus
caagcttgctcttaggtgagtgcct

SEQ ID NO: 219820 - DNA, 25 bp, Rattus norvegicus
caagcttggcctcaacttttttgtt

SEQ ID NO: 219821 - DNA, 25 bp, Rattus norvegicus
caagcttggcctgaacttttttgtt

SEQ ID NO: 219822 - DNA, 25 bp, Rattus norvegicus
caagcttgggctaccagatataaat

SEQ ID NO: 219823 - DNA, 25 bp, Rattus norvegicus
caagcttgggcttccagatataaat

SEQ ID NO: 219824 - DNA, 25 bp, Rattus norvegicus
caagcttgggtcatcagatgagcaa

SEQ ID NO: 219825 - DNA, 25 bp, Rattus norvegicus
caagcttgggtcttcagatgagcaa

SEQ ID NO: 219826 - DNA, 25 bp, Rattus norvegicus
caagcttgtgagagtgtttgcacgt

SEQ ID NO: 219827 - DNA, 25 bp, Rattus norvegicus
caagcttgtgagtgtgtttgcacgt

SEQ ID NO: 219828 - DNA, 25 bp, Rattus norvegicus
caagctttaggccttactcagcggg

SEQ ID NO: 219829 - DNA, 25 bp, Rattus norvegicus
caagctttaggcgttactcagcggg

SEQ ID NO: 219830 - DNA, 25 bp, Rattus norvegicus
caagctttcttgaggatgctatcac

SEQ ID NO: 219831 - DNA, 25 bp, Rattus norvegicus
caagctttcttgaggttatcctcta

SEQ ID NO: 219832 - DNA, 25 bp, Rattus norvegicus
caagctttcttgtggatgctatcac

SEQ ID NO: 219833 - DNA, 25 bp, Rattus norvegicus
caagctttcttgtggttatcctcta

SEQ ID NO: 219834 - DNA, 25 bp, Rattus norvegicus
caagcttttctgaaaacggccaggt

SEQ ID NO: 219835 - DNA, 25 bp, Rattus norvegicus
caagcttttctgtaaacggccaggt

SEQ ID NO: 219836 - DNA, 25 bp, Rattus norvegicus
caagcttttgctctacgttaatatg

SEQ ID NO: 219837 - DNA, 25 bp, Rattus norvegicus
caagcttttgctgtacgttaatatg

SEQ ID NO: 219838 - DNA, 25 bp, Rattus norvegicus
caaggaaaatccagagtgccctgtt

SEQ ID NO: 219839 - DNA, 25 bp, Rattus norvegicus
caaggaaaatcctgagtgccctgtt

SEQ ID NO: 219840 - DNA, 25 bp, Rattus norvegicus
caaggaaacctcagatctataaatt

SEQ ID NO: 219841 - DNA, 25 bp, Rattus norvegicus
caaggaaacctctgatctataaatt

SEQ ID NO: 219842 - DNA, 25 bp, Rattus norvegicus
caaggaaagggtccttctcgggatc

SEQ ID NO: 219843 - DNA, 25 bp, Rattus norvegicus
caaggaaagggtgcttctcgggatc

SEQ ID NO: 219844 - DNA, 25 bp, Rattus norvegicus
caaggaacacctagggtcaccaaca

SEQ ID NO: 219845 - DNA, 25 bp, Rattus norvegicus
caaggaacaccttgggtcaccaaca

SEQ ID NO: 219846 - DNA, 25 bp, Rattus norvegicus
caaggaacccataactgtcagcagt

SEQ ID NO: 219847 - DNA, 25 bp, Rattus norvegicus
caaggaacccattactgtcagcagt

SEQ ID NO: 219848 - DNA, 25 bp, Rattus norvegicus
caaggaactcaaacacgaacggcga

SEQ ID NO: 219849 - DNA, 25 bp, Rattus norvegicus
caaggaactcaatcacgaacggcga

SEQ ID NO: 219850 - DNA, 25 bp, Rattus norvegicus
caaggaagaaggattatccactgtt

SEQ ID NO: 219851 - DNA, 25 bp, Rattus norvegicus
caaggaagaaggtttatccactgtt

SEQ ID NO: 219852 - DNA, 25 bp, Rattus norvegicus
caaggaagcagacggcctagtacct

SEQ ID NO: 219853 - DNA, 25 bp, Rattus norvegicus
caaggaagcagagggcctagtacct

SEQ ID NO: 219854 - DNA, 25 bp, Rattus norvegicus
caaggaagctgtacgtgatgttaga

SEQ ID NO: 219855 - DNA, 25 bp, Rattus norvegicus
caaggaagctgttcgtgatgttaga

SEQ ID NO: 219856 - DNA, 25 bp, Rattus norvegicus
caaggaaggagtcctctctactttc

SEQ ID NO: 219857 - DNA, 25 bp, Rattus norvegicus
caaggaaggagtgctctctactttc

SEQ ID NO: 219858 - DNA, 25 bp, Rattus norvegicus
caaggaaggcaaccctgcagagatc

SEQ ID NO: 219859 - DNA, 25 bp, Rattus norvegicus
caaggaaggcaagcctgcagagatc

SEQ ID NO: 219860 - DNA, 25 bp, Rattus norvegicus
caaggaaggctcagttctctctggt

SEQ ID NO: 219861 - DNA, 25 bp, Rattus norvegicus
caaggaaggctctgttctctctggt

SEQ ID NO: 219862 - DNA, 25 bp, Rattus norvegicus
caaggaagtcaaagttgatcaggct

SEQ ID NO: 219863 - DNA, 25 bp, Rattus norvegicus
caaggaagtcaatgttgatcaggct

SEQ ID NO: 219864 - DNA, 25 bp, Rattus norvegicus
caaggaatctctcggatcgctcgac

SEQ ID NO: 219865 - DNA, 25 bp, Rattus norvegicus
caaggaatctctgggatcgctcgac

SEQ ID NO: 219866 - DNA, 25 bp, Rattus norvegicus
caaggaattcaaagcaggtgccatt

SEQ ID NO: 219867 - DNA, 25 bp, Rattus norvegicus
caaggaattcaatgcaggtgccatt

SEQ ID NO: 219868 - DNA, 25 bp, Rattus norvegicus
caaggaatttgcagactctctgggt

SEQ ID NO: 219869 - DNA, 25 bp, Rattus norvegicus
caaggaatttgctgactctctgggt

SEQ ID NO: 219870 - DNA, 25 bp, Rattus norvegicus
caaggacacagaccccagctggagg

SEQ ID NO: 219871 - DNA, 25 bp, Rattus norvegicus
caaggacacagagcccagctggagg

SEQ ID NO: 219872 - DNA, 25 bp, Rattus norvegicus
caaggacacctcacagaagcacagt

SEQ ID NO: 219873 - DNA, 25 bp, Rattus norvegicus
caaggacacctctcagaagcacagt

SEQ ID NO: 219874 - DNA, 25 bp, Rattus norvegicus
caaggacagcacatctgacagcagt

SEQ ID NO: 219875 - DNA, 25 bp, Rattus norvegicus
caaggacagcacttctgacagcagt

SEQ ID NO: 219876 - DNA, 25 bp, Rattus norvegicus
caaggacagcctccgccatgtgata

SEQ ID NO: 219877 - DNA, 25 bp, Rattus norvegicus
caaggacagcctgcgccatgtgata

SEQ ID NO: 219878 - DNA, 25 bp, Rattus norvegicus
caaggacagtctcactaaggcccag

SEQ ID NO: 219879 - DNA, 25 bp, Rattus norvegicus
caaggacagtctcggaactggtttt

SEQ ID NO: 219880 - DNA, 25 bp, Rattus norvegicus
caaggacagtctgactaaggcccag

SEQ ID NO: 219881 - DNA, 25 bp, Rattus norvegicus
caaggacagtctgggaactggtttt

SEQ ID NO: 219882 - DNA, 25 bp, Rattus norvegicus
caaggacataatatcatactggctg

SEQ ID NO: 219883 - DNA, 25 bp, Rattus norvegicus
caaggacataatttcatactggctg

SEQ ID NO: 219884 - DNA, 25 bp, Rattus norvegicus
caaggacatccaaacccaagtgaat

SEQ ID NO: 219885 - DNA, 25 bp, Rattus norvegicus
caaggacatccatacccaagtgaat

SEQ ID NO: 219886 - DNA, 25 bp, Rattus norvegicus
caaggacattagatttagtgggtta

SEQ ID NO: 219887 - DNA, 25 bp, Rattus norvegicus
caaggacattagttttagtgggtta

SEQ ID NO: 219888 - DNA, 25 bp, Rattus norvegicus
caaggacattggaagtgggctttat

SEQ ID NO: 219889 - DNA, 25 bp, Rattus norvegicus
caaggacattggtagtgggctttat

SEQ ID NO: 219890 - DNA, 25 bp, Rattus norvegicus
caaggaccaactcctgttctggagt

SEQ ID NO: 219891 - DNA, 25 bp, Rattus norvegicus
caaggaccaactgctgttctggagt

SEQ ID NO: 219892 - DNA, 25 bp, Rattus norvegicus
caaggaccacttacgtattaatact

SEQ ID NO: 219893 - DNA, 25 bp, Rattus norvegicus
caaggaccactttcgtattaatact

SEQ ID NO: 219894 - DNA, 25 bp, Rattus norvegicus
caaggaccctataactgcggtgtgg

SEQ ID NO: 219895 - DNA, 25 bp, Rattus norvegicus
caaggaccctattactgcggtgtgg

SEQ ID NO: 219896 - DNA, 25 bp, Rattus norvegicus
caaggacccttcagggcccacagag

SEQ ID NO: 219897 - DNA, 25 bp, Rattus norvegicus
caaggacccttctgggcccacagag

SEQ ID NO: 219898 - DNA, 25 bp, Rattus norvegicus
caaggaccgagccagattcttcaat

SEQ ID NO: 219899 - DNA, 25 bp, Rattus norvegicus
caaggaccgagcgagattcttcaat

SEQ ID NO: 219900 - DNA, 25 bp, Rattus norvegicus
caaggacctaaacagttgcagatat

SEQ ID NO: 219901 - DNA, 25 bp, Rattus norvegicus
caaggacctaaagagttgcagatat

SEQ ID NO: 219902 - DNA, 25 bp, Rattus norvegicus
caaggacctgcaagcagtcctgtgc

SEQ ID NO: 219903 - DNA, 25 bp, Rattus norvegicus
caaggacctgcatgcagtcctgtgc

SEQ ID NO: 219904 - DNA, 25 bp, Rattus norvegicus
caaggacgagtaccttctctgggtc

SEQ ID NO: 219905 - DNA, 25 bp, Rattus norvegicus
caaggacgagtagcttctctgggtc

SEQ ID NO: 219906 - DNA, 25 bp, Rattus norvegicus
caaggacgtcttcggctaagcactg

SEQ ID NO: 219907 - DNA, 25 bp, Rattus norvegicus
caaggacgtcttgggctaagcactg

SEQ ID NO: 219908 - DNA, 25 bp, Rattus norvegicus
caaggacgttctacagtgaaactgt

SEQ ID NO: 219909 - DNA, 25 bp, Rattus norvegicus
caaggacgttcttcagtgaaactgt

SEQ ID NO: 219910 - DNA, 25 bp, Rattus norvegicus
caaggactacatctgcttgtgagca

SEQ ID NO: 219911 - DNA, 25 bp, Rattus norvegicus
caaggactacatgtgcttgtgagca

SEQ ID NO: 219912 - DNA, 25 bp, Rattus norvegicus
caaggactgtctcaacgtgctgaac

SEQ ID NO: 219913 - DNA, 25 bp, Rattus norvegicus
caaggactgtctgaacgtgctgaac

SEQ ID NO: 219914 - DNA, 25 bp, Rattus norvegicus
caaggacttaatctgggctgccgtg

SEQ ID NO: 219915 - DNA, 25 bp, Rattus norvegicus
caaggacttaatgtgggctgccgtg

SEQ ID NO: 219916 - DNA, 25 bp, Rattus norvegicus
caaggacttagaagtcttcatgaga

SEQ ID NO: 219917 - DNA, 25 bp, Rattus norvegicus
caaggacttagatgtcttcatgaga

SEQ ID NO: 219918 - DNA, 25 bp, Rattus norvegicus
caaggacttcttctttagcggaggt

SEQ ID NO: 219919 - DNA, 25 bp, Rattus norvegicus
caaggacttcttgtttagcggaggt

SEQ ID NO: 219920 - DNA, 25 bp, Rattus norvegicus
caaggacttgacaaagctgaagagt

SEQ ID NO: 219921 - DNA, 25 bp, Rattus norvegicus
caaggacttgacatcttcaggtgta

SEQ ID NO: 219922 - DNA, 25 bp, Rattus norvegicus
caaggacttgactaagctgaagagt

SEQ ID NO: 219923 - DNA, 25 bp, Rattus norvegicus
caaggacttgacttcttcaggtgta

SEQ ID NO: 219924 - DNA, 25 bp, Rattus norvegicus
caaggacttggcatcatgtagttac

SEQ ID NO: 219925 - DNA, 25 bp, Rattus norvegicus
caaggacttggcttcatgtagttac

SEQ ID NO: 219926 - DNA, 25 bp, Rattus norvegicus
caaggactttctatgctttcttact

SEQ ID NO: 219927 - DNA, 25 bp, Rattus norvegicus
caaggactttctttgctttcttact

SEQ ID NO: 219928 - DNA, 25 bp, Rattus norvegicus
caaggactttgcaactcggtgctgc

SEQ ID NO: 219929 - DNA, 25 bp, Rattus norvegicus
caaggactttgctactcggtgctgc

SEQ ID NO: 219930 - DNA, 25 bp, Rattus norvegicus
caaggagaaccccaagtacacattt

SEQ ID NO: 219931 - DNA, 25 bp, Rattus norvegicus
caaggagaacccgaagtacacattt

SEQ ID NO: 219932 - DNA, 25 bp, Rattus norvegicus
caaggagacaggacagtttagcccc

SEQ ID NO: 219933 - DNA, 25 bp, Rattus norvegicus
caaggagacaggcaccaatatggtt

SEQ ID NO: 219934 - DNA, 25 bp, Rattus norvegicus
caaggagacagggaccaatatggtt

SEQ ID NO: 219935 - DNA, 25 bp, Rattus norvegicus
caaggagacaggtcagtttagcccc

SEQ ID NO: 219936 - DNA, 25 bp, Rattus norvegicus
caaggagacataatgcatttctgtt

SEQ ID NO: 219937 - DNA, 25 bp, Rattus norvegicus
caaggagacatattgcatttctgtt

SEQ ID NO: 219938 - DNA, 25 bp, Rattus norvegicus
caaggagagaatctacctggcatta

SEQ ID NO: 219939 - DNA, 25 bp, Rattus norvegicus
caaggagagaatgtacctggcatta

SEQ ID NO: 219940 - DNA, 25 bp, Rattus norvegicus
caaggagagccacgcgagctgccgg

SEQ ID NO: 219941 - DNA, 25 bp, Rattus norvegicus
caaggagagccaggcgagctgccgg

SEQ ID NO: 219942 - DNA, 25 bp, Rattus norvegicus
caaggagagtcacccaatgggcaaa

SEQ ID NO: 219943 - DNA, 25 bp, Rattus norvegicus
caaggagagtcagccaatgggcaaa

SEQ ID NO: 219944 - DNA, 25 bp, Rattus norvegicus
caaggagcaactatgtgcggcccaa

SEQ ID NO: 219945 - DNA, 25 bp, Rattus norvegicus
caaggagcaactttgtgcggcccaa

SEQ ID NO: 219946 - DNA, 25 bp, Rattus norvegicus
caaggagcacatctttaccgttatt

SEQ ID NO: 219947 - DNA, 25 bp, Rattus norvegicus
caaggagcacatgtttaccgttatt

SEQ ID NO: 219948 - DNA, 25 bp, Rattus norvegicus
caaggagccttcagagttctgagag

SEQ ID NO: 219949 - DNA, 25 bp, Rattus norvegicus
caaggagccttcagtttgcaggaaa

SEQ ID NO: 219950 - DNA, 25 bp, Rattus norvegicus
caaggagccttctgagttctgagag

SEQ ID NO: 219951 - DNA, 25 bp, Rattus norvegicus
caaggagccttctgtttgcaggaaa

SEQ ID NO: 219952 - DNA, 25 bp, Rattus norvegicus
caaggagcctttatattcagtcttt

SEQ ID NO: 219953 - DNA, 25 bp, Rattus norvegicus
caaggagcctttttattcagtcttt

SEQ ID NO: 219954 - DNA, 25 bp, Rattus norvegicus
caaggagcgaatctgcatggtcttc

SEQ ID NO: 219955 - DNA, 25 bp, Rattus norvegicus
caaggagcgaatgtgcatggtcttc

SEQ ID NO: 219956 - DNA, 25 bp, Rattus norvegicus
caaggaggaaggagcttgattccag

SEQ ID NO: 219957 - DNA, 25 bp, Rattus norvegicus
caaggaggaaggtgcttgattccag

SEQ ID NO: 219958 - DNA, 25 bp, Rattus norvegicus
caaggaggaccgagaggcttctcag

SEQ ID NO: 219959 - DNA, 25 bp, Rattus norvegicus
caaggaggaccgtgaggcttctcag

SEQ ID NO: 219960 - DNA, 25 bp, Rattus norvegicus
caaggaggagatcctcttcttcttc

SEQ ID NO: 219961 - DNA, 25 bp, Rattus norvegicus
caaggaggagatgctcttcttcttc

SEQ ID NO: 219962 - DNA, 25 bp, Rattus norvegicus
caaggaggcaccaggtacagattat

SEQ ID NO: 219963 - DNA, 25 bp, Rattus norvegicus
caaggaggcacctggtacagattat

SEQ ID NO: 219964 - DNA, 25 bp, Rattus norvegicus
caaggaggcactattccaggtggac

SEQ ID NO: 219965 - DNA, 25 bp, Rattus norvegicus
caaggaggcacttttccaggtggac

SEQ ID NO: 219966 - DNA, 25 bp, Rattus norvegicus
caaggaggccccatttgtgtgtagg

SEQ ID NO: 219967 - DNA, 25 bp, Rattus norvegicus
caaggaggccccttttgtgtgtagg

SEQ ID NO: 219968 - DNA, 25 bp, Rattus norvegicus
caaggaggccctactggagctaaag

SEQ ID NO: 219969 - DNA, 25 bp, Rattus norvegicus
caaggaggcccttctggagctaaag

SEQ ID NO: 219970 - DNA, 25 bp, Rattus norvegicus
caaggaggcctcagtcattttaaag

SEQ ID NO: 219971 - DNA, 25 bp, Rattus norvegicus
caaggaggcctctgtcattttaaag

SEQ ID NO: 219972 - DNA, 25 bp, Rattus norvegicus
caaggaggcctgacattagcgctgg

SEQ ID NO: 219973 - DNA, 25 bp, Rattus norvegicus
caaggaggcctgtcattagcgctgg

SEQ ID NO: 219974 - DNA, 25 bp, Rattus norvegicus
caaggagggatgactcatacccagg

SEQ ID NO: 219975 - DNA, 25 bp, Rattus norvegicus
caaggagggatgtctcatacccagg

SEQ ID NO: 219976 - DNA, 25 bp, Rattus norvegicus
caaggaggtacaattcagttgggaa

SEQ ID NO: 219977 - DNA, 25 bp, Rattus norvegicus
caaggaggtacatttcagttgggaa

SEQ ID NO: 219978 - DNA, 25 bp, Rattus norvegicus
caaggaggtcacaaggcctggctgt

SEQ ID NO: 219979 - DNA, 25 bp, Rattus norvegicus
caaggaggtcactaggcctggctgt

SEQ ID NO: 219980 - DNA, 25 bp, Rattus norvegicus
caaggaggtggtcctttacgtcaaa

SEQ ID NO: 219981 - DNA, 25 bp, Rattus norvegicus
caaggaggtggtgctttacgtcaaa

SEQ ID NO: 219982 - DNA, 25 bp, Rattus norvegicus
caaggaggtgtaattcgctgagcga

SEQ ID NO: 219983 - DNA, 25 bp, Rattus norvegicus
caaggaggtgtatttcgctgagcga

SEQ ID NO: 219984 - DNA, 25 bp, Rattus norvegicus
caaggagtaaccacagtcttcccag

SEQ ID NO: 219985 - DNA, 25 bp, Rattus norvegicus
caaggagtaacctcagtcttcccag

SEQ ID NO: 219986 - DNA, 25 bp, Rattus norvegicus
caaggagtcaggctttcgtccgtga

SEQ ID NO: 219987 - DNA, 25 bp, Rattus norvegicus
caaggagtcagggtttcgtccgtga

SEQ ID NO: 219988 - DNA, 25 bp, Rattus norvegicus
caaggagtccataagcaaagctgca

SEQ ID NO: 219989 - DNA, 25 bp, Rattus norvegicus
caaggagtccattagcaaagctgca

SEQ ID NO: 219990 - DNA, 25 bp, Rattus norvegicus
caaggagtcttcaaaatcgcttttt

SEQ ID NO: 219991 - DNA, 25 bp, Rattus norvegicus
caaggagtcttctaaatcgcttttt

SEQ ID NO: 219992 - DNA, 25 bp, Rattus norvegicus
caaggagtgaggagtctctcgtcct

SEQ ID NO: 219993 - DNA, 25 bp, Rattus norvegicus
caaggagtgaggtgtctctcgtcct

SEQ ID NO: 219994 - DNA, 25 bp, Rattus norvegicus
caaggagtggttctgccgagtcttc

SEQ ID NO: 219995 - DNA, 25 bp, Rattus norvegicus
caaggagtggttgtgccgagtcttc

SEQ ID NO: 219996 - DNA, 25 bp, Rattus norvegicus
caaggagtgtctctgcaggcctgca

SEQ ID NO: 219997 - DNA, 25 bp, Rattus norvegicus
caaggagtgtctgtgcaggcctgca

SEQ ID NO: 219998 - DNA, 25 bp, Rattus norvegicus
caaggagttcccagagtctttctta

SEQ ID NO: 219999 - DNA, 25 bp, Rattus norvegicus
caaggagttccctgagtctttctta

SEQ ID NO: 220000 - DNA, 25 bp, Rattus norvegicus
caaggagttcctacgtctccggaga

SEQ ID NO: 220001 - DNA, 25 bp, Rattus norvegicus
caaggagttccttcgtctccggaga

SEQ ID NO: 220002 - DNA, 25 bp, Rattus norvegicus
caaggagttctgcagcacgtgctgt

SEQ ID NO: 220003 - DNA, 25 bp, Rattus norvegicus
caaggagttctggagcacgtgctgt

SEQ ID NO: 220004 - DNA, 25 bp, Rattus norvegicus
caaggagtttagctacagacaggga

SEQ ID NO: 220005 - DNA, 25 bp, Rattus norvegicus
caaggagtttaggtacagacaggga

SEQ ID NO: 220006 - DNA, 25 bp, Rattus norvegicus
caaggataactgcttcgccactgag

SEQ ID NO: 220007 - DNA, 25 bp, Rattus norvegicus
caaggataactggttcgccactgag

SEQ ID NO: 220008 - DNA, 25 bp, Rattus norvegicus
caaggataaggacgagcgggcccac

SEQ ID NO: 220009 - DNA, 25 bp, Rattus norvegicus
caaggataaggaggagcgggcccac

SEQ ID NO: 220010 - DNA, 25 bp, Rattus norvegicus
caaggataatctatacaccgggtat

SEQ ID NO: 220011 - DNA, 25 bp, Rattus norvegicus
caaggataatctttacaccgggtat

SEQ ID NO: 220012 - DNA, 25 bp, Rattus norvegicus
caaggataccttaggctcttactaa

SEQ ID NO: 220013 - DNA, 25 bp, Rattus norvegicus
caaggatacctttggctcttactaa

SEQ ID NO: 220014 - DNA, 25 bp, Rattus norvegicus
caaggatggcatatctcacagaact

SEQ ID NO: 220015 - DNA, 25 bp, Rattus norvegicus
caaggatggcatttctcacagaact

SEQ ID NO: 220016 - DNA, 25 bp, Rattus norvegicus
caaggatggcctcctagatgacgag

SEQ ID NO: 220017 - DNA, 25 bp, Rattus norvegicus
caaggatggcctgctagatgacgag

SEQ ID NO: 220018 - DNA, 25 bp, Rattus norvegicus
caaggattatctacctgctgggctt

SEQ ID NO: 220019 - DNA, 25 bp, Rattus norvegicus
caaggattatcttcctgctgggctt

SEQ ID NO: 220020 - DNA, 25 bp, Rattus norvegicus
caaggattatttcgtgcctcagctc

SEQ ID NO: 220021 - DNA, 25 bp, Rattus norvegicus
caaggattatttggtgcctcagctc

SEQ ID NO: 220022 - DNA, 25 bp, Rattus norvegicus
caaggattctttctatgcccaggga

SEQ ID NO: 220023 - DNA, 25 bp, Rattus norvegicus
caaggattctttgtatgcccaggga

SEQ ID NO: 220024 - DNA, 25 bp, Rattus norvegicus
caaggattggcaaagaaacccggat

SEQ ID NO: 220025 - DNA, 25 bp, Rattus norvegicus
caaggattggcatagaaacccggat

SEQ ID NO: 220026 - DNA, 25 bp, Rattus norvegicus
caaggattggtgagacgacccctac

SEQ ID NO: 220027 - DNA, 25 bp, Rattus norvegicus
caaggattggtgtgacgacccctac

SEQ ID NO: 220028 - DNA, 25 bp, Rattus norvegicus
caaggatttttgagctttcttatca

SEQ ID NO: 220029 - DNA, 25 bp, Rattus norvegicus
caaggatttttgtgctttcttatca

SEQ ID NO: 220030 - DNA, 25 bp, Rattus norvegicus
caaggcaaactaccggagctccatg

SEQ ID NO: 220031 - DNA, 25 bp, Rattus norvegicus
caaggcaaactagcggagctccatg

SEQ ID NO: 220032 - DNA, 25 bp, Rattus norvegicus
caaggcaacgagagcagaactgtaa

SEQ ID NO: 220033 - DNA, 25 bp, Rattus norvegicus
caaggcaacgagtgcagaactgtaa

SEQ ID NO: 220034 - DNA, 25 bp, Rattus norvegicus
caaggcaactctctactgaagctcc

SEQ ID NO: 220035 - DNA, 25 bp, Rattus norvegicus
caaggcaactctgtactgaagctcc

SEQ ID NO: 220036 - DNA, 25 bp, Rattus norvegicus
caaggcaactttaataatttcccat

SEQ ID NO: 220037 - DNA, 25 bp, Rattus norvegicus
caaggcaacttttataatttcccat

SEQ ID NO: 220038 - DNA, 25 bp, Rattus norvegicus
caaggcaattgtagacgctgcaagt

SEQ ID NO: 220039 - DNA, 25 bp, Rattus norvegicus
caaggcaattgttgacgctgcaagt

SEQ ID NO: 220040 - DNA, 25 bp, Rattus norvegicus
caaggcacagagcattccaggatag

SEQ ID NO: 220041 - DNA, 25 bp, Rattus norvegicus
caaggcacagaggattccaggatag

SEQ ID NO: 220042 - DNA, 25 bp, Rattus norvegicus
caaggcacagtgatacctgagcaga

SEQ ID NO: 220043 - DNA, 25 bp, Rattus norvegicus
caaggcacagtgttacctgagcaga

SEQ ID NO: 220044 - DNA, 25 bp, Rattus norvegicus
caaggcacatgactaggctaacagt

SEQ ID NO: 220045 - DNA, 25 bp, Rattus norvegicus
caaggcacatgagtaggctaacagt

SEQ ID NO: 220046 - DNA, 25 bp, Rattus norvegicus
caaggcaccactaagtcctttgggt

SEQ ID NO: 220047 - DNA, 25 bp, Rattus norvegicus
caaggcaccacttagtcctttgggt

SEQ ID NO: 220048 - DNA, 25 bp, Rattus norvegicus
caaggcactggcagataaaatcggg

SEQ ID NO: 220049 - DNA, 25 bp, Rattus norvegicus
caaggcactggctgataaaatcggg

SEQ ID NO: 220050 - DNA, 25 bp, Rattus norvegicus
caaggcactttcatgtatttttcgt

SEQ ID NO: 220051 - DNA, 25 bp, Rattus norvegicus
caaggcactttcttgtatttttcgt

SEQ ID NO: 220052 - DNA, 25 bp, Rattus norvegicus
caaggcagagtccacaggtgcttaa

SEQ ID NO: 220053 - DNA, 25 bp, Rattus norvegicus
caaggcagagtcgacaggtgcttaa

SEQ ID NO: 220054 - DNA, 25 bp, Rattus norvegicus
caaggcagcctcataaggcagccac

SEQ ID NO: 220055 - DNA, 25 bp, Rattus norvegicus
caaggcagcctcttaaggcagccac

SEQ ID NO: 220056 - DNA, 25 bp, Rattus norvegicus
caaggcagctttccacacggtgaac

SEQ ID NO: 220057 - DNA, 25 bp, Rattus norvegicus
caaggcagctttgcacacggtgaac

SEQ ID NO: 220058 - DNA, 25 bp, Rattus norvegicus
caaggcaggtctcctgggagctgca

SEQ ID NO: 220059 - DNA, 25 bp, Rattus norvegicus
caaggcaggtctgctgggagctgca

SEQ ID NO: 220060 - DNA, 25 bp, Rattus norvegicus
caaggcagtctcctttaattgatga

SEQ ID NO: 220061 - DNA, 25 bp, Rattus norvegicus
caaggcagtctcgtttaattgatga

SEQ ID NO: 220062 - DNA, 25 bp, Rattus norvegicus
caaggcatagcaacagtaagtgtct

SEQ ID NO: 220063 - DNA, 25 bp, Rattus norvegicus
caaggcatagcatcagtaagtgtct

SEQ ID NO: 220064 - DNA, 25 bp, Rattus norvegicus
caaggcatctgactgggacacaaca

SEQ ID NO: 220065 - DNA, 25 bp, Rattus norvegicus
caaggcatctgagtgggacacaaca

SEQ ID NO: 220066 - DNA, 25 bp, Rattus norvegicus
caaggcatggtcagcacagggtctc

SEQ ID NO: 220067 - DNA, 25 bp, Rattus norvegicus
caaggcatggtctgcacagggtctc

SEQ ID NO: 220068 - DNA, 25 bp, Rattus norvegicus
caaggcatgttcagtcatttccact

SEQ ID NO: 220069 - DNA, 25 bp, Rattus norvegicus
caaggcatgttctgtcatttccact

SEQ ID NO: 220070 - DNA, 25 bp, Rattus norvegicus
caaggcattatgagttagaccgtct

SEQ ID NO: 220071 - DNA, 25 bp, Rattus norvegicus
caaggcattatgtgttagaccgtct

SEQ ID NO: 220072 - DNA, 25 bp, Rattus norvegicus
caaggcattggacccatggctgatt

SEQ ID NO: 220073 - DNA, 25 bp, Rattus norvegicus
caaggcattggagccatggctgatt

SEQ ID NO: 220074 - DNA, 25 bp, Rattus norvegicus
caaggcatttcaagggtctgcccat

SEQ ID NO: 220075 - DNA, 25 bp, Rattus norvegicus
caaggcatttcatgggtctgcccat

SEQ ID NO: 220076 - DNA, 25 bp, Rattus norvegicus
caaggccaacagaggagtgtcccat

SEQ ID NO: 220077 - DNA, 25 bp, Rattus norvegicus
caaggccaacagtggagtgtcccat

SEQ ID NO: 220078 - DNA, 25 bp, Rattus norvegicus
caaggccaaggcaggtcagggtacc

SEQ ID NO: 220079 - DNA, 25 bp, Rattus norvegicus
caaggccaaggctggtcagggtacc

SEQ ID NO: 220080 - DNA, 25 bp, Rattus norvegicus
caaggccaaggtctgttgctgtttt

SEQ ID NO: 220081 - DNA, 25 bp, Rattus norvegicus
caaggccaaggtgtgttgctgtttt

SEQ ID NO: 220082 - DNA, 25 bp, Rattus norvegicus
caaggccaatgcagttctgtgatgt

SEQ ID NO: 220083 - DNA, 25 bp, Rattus norvegicus
caaggccaatgctgttctgtgatgt

SEQ ID NO: 220084 - DNA, 25 bp, Rattus norvegicus
caaggccagctactctgggctatac

SEQ ID NO: 220085 - DNA, 25 bp, Rattus norvegicus
caaggccagctagtctgggctatac

SEQ ID NO: 220086 - DNA, 25 bp, Rattus norvegicus
caaggccagtttaatccgtaagcaa

SEQ ID NO: 220087 - DNA, 25 bp, Rattus norvegicus
caaggccagttttatccgtaagcaa

SEQ ID NO: 220088 - DNA, 25 bp, Rattus norvegicus
caaggccatggaaattcagagttct

SEQ ID NO: 220089 - DNA, 25 bp, Rattus norvegicus
caaggccatggatattcagagttct

SEQ ID NO: 220090 - DNA, 25 bp, Rattus norvegicus
caaggccatggcagacgaggtgaat

SEQ ID NO: 220091 - DNA, 25 bp, Rattus norvegicus
caaggccatggctgacgaggtgaat

SEQ ID NO: 220092 - DNA, 25 bp, Rattus norvegicus
caaggcccagatccgcaaatttgat

SEQ ID NO: 220093 - DNA, 25 bp, Rattus norvegicus
caaggcccagatgcgcaaatttgat

SEQ ID NO: 220094 - DNA, 25 bp, Rattus norvegicus
caaggcccagtgcaaaagtgaaaat

SEQ ID NO: 220095 - DNA, 25 bp, Rattus norvegicus
caaggcccagtggaaaagtgaaaat

SEQ ID NO: 220096 - DNA, 25 bp, Rattus norvegicus
caaggcccctcaatgtcaacaaaag

SEQ ID NO: 220097 - DNA, 25 bp, Rattus norvegicus
caaggcccctcattgtcaacaaaag

SEQ ID NO: 220098 - DNA, 25 bp, Rattus norvegicus
caaggcccctctctacatgaaataa

SEQ ID NO: 220099 - DNA, 25 bp, Rattus norvegicus
caaggcccctctgtacatgaaataa

SEQ ID NO: 220100 - DNA, 25 bp, Rattus norvegicus
caaggcccctttattattgcgcatt

SEQ ID NO: 220101 - DNA, 25 bp, Rattus norvegicus
caaggccccttttttattgcgcatt

SEQ ID NO: 220102 - DNA, 25 bp, Rattus norvegicus
caaggcccggccatgaaagaggatt

SEQ ID NO: 220103 - DNA, 25 bp, Rattus norvegicus
caaggcccggccttgaaagaggatt

SEQ ID NO: 220104 - DNA, 25 bp, Rattus norvegicus
caaggccgagaaatgcagctgctgc

SEQ ID NO: 220105 - DNA, 25 bp, Rattus norvegicus
caaggccgagaattgcagctgctgc

SEQ ID NO: 220106 - DNA, 25 bp, Rattus norvegicus
caaggccgagctcgtggtgttcaaa

SEQ ID NO: 220107 - DNA, 25 bp, Rattus norvegicus
caaggccgagctggtggtgttcaaa

SEQ ID NO: 220108 - DNA, 25 bp, Rattus norvegicus
caaggccgagtaagcacagtatgta

SEQ ID NO: 220109 - DNA, 25 bp, Rattus norvegicus
caaggccgagtatgcacagtatgta

SEQ ID NO: 220110 - DNA, 25 bp, Rattus norvegicus
caaggccggcgacgcgagcgcggag

SEQ ID NO: 220111 - DNA, 25 bp, Rattus norvegicus
caaggccggcgaggcgagcgcggag

SEQ ID NO: 220112 - DNA, 25 bp, Rattus norvegicus
caaggccgtttgaggtctattgtca

SEQ ID NO: 220113 - DNA, 25 bp, Rattus norvegicus
caaggccgtttgtggtctattgtca

SEQ ID NO: 220114 - DNA, 25 bp, Rattus norvegicus
caaggcctcacaaccacaaaagaag

SEQ ID NO: 220115 - DNA, 25 bp, Rattus norvegicus
caaggcctcacatccacaaaagaag

SEQ ID NO: 220116 - DNA, 25 bp, Rattus norvegicus
caaggcctgaatcctaactctggac

SEQ ID NO: 220117 - DNA, 25 bp, Rattus norvegicus
caaggcctgaatgctaactctggac

SEQ ID NO: 220118 - DNA, 25 bp, Rattus norvegicus
caaggcctgagacggctgcttgcat

SEQ ID NO: 220119 - DNA, 25 bp, Rattus norvegicus
caaggcctgagagggctgcttgcat

SEQ ID NO: 220120 - DNA, 25 bp, Rattus norvegicus
caaggcctgagtcacctgaatctga

SEQ ID NO: 220121 - DNA, 25 bp, Rattus norvegicus
caaggcctgagtgacctgaatctga

SEQ ID NO: 220122 - DNA, 25 bp, Rattus norvegicus
caaggcctgcgaagagtcagtgctc

SEQ ID NO: 220123 - DNA, 25 bp, Rattus norvegicus
caaggcctgcgatgagtcagtgctc

SEQ ID NO: 220124 - DNA, 25 bp, Rattus norvegicus
caaggcctgctgacggagagaaccc

SEQ ID NO: 220125 - DNA, 25 bp, Rattus norvegicus
caaggcctgctgtcggagagaaccc

SEQ ID NO: 220126 - DNA, 25 bp, Rattus norvegicus
caaggcctgtctcagcactaagtgc

SEQ ID NO: 220127 - DNA, 25 bp, Rattus norvegicus
caaggcctgtctgagcactaagtgc

SEQ ID NO: 220128 - DNA, 25 bp, Rattus norvegicus
caaggcctgttgagtgtgtcgctgc

SEQ ID NO: 220129 - DNA, 25 bp, Rattus norvegicus
caaggcctgttgtgtgtgtcgctgc

SEQ ID NO: 220130 - DNA, 25 bp, Rattus norvegicus
caaggccttccaattatttctattt

SEQ ID NO: 220131 - DNA, 25 bp, Rattus norvegicus
caaggccttccatttatttctattt

SEQ ID NO: 220132 - DNA, 25 bp, Rattus norvegicus
caaggccttgagatctatccctaaa

SEQ ID NO: 220133 - DNA, 25 bp, Rattus norvegicus
caaggccttgagttctatccctaaa

SEQ ID NO: 220134 - DNA, 25 bp, Rattus norvegicus
caaggccttggacatcttcatctta

SEQ ID NO: 220135 - DNA, 25 bp, Rattus norvegicus
caaggccttggagatcttcatctta

SEQ ID NO: 220136 - DNA, 25 bp, Rattus norvegicus
caaggccttggtacctctggtgaag

SEQ ID NO: 220137 - DNA, 25 bp, Rattus norvegicus
caaggccttggttcctctggtgaag

SEQ ID NO: 220138 - DNA, 25 bp, Rattus norvegicus
caaggcctttatacactgggtgtca

SEQ ID NO: 220139 - DNA, 25 bp, Rattus norvegicus
caaggcctttattcactgggtgtca

SEQ ID NO: 220140 - DNA, 25 bp, Rattus norvegicus
caaggcctttgtcggtcagtagtgt

SEQ ID NO: 220141 - DNA, 25 bp, Rattus norvegicus
caaggcctttgtgggtcagtagtgt

SEQ ID NO: 220142 - DNA, 25 bp, Rattus norvegicus
caaggcgagcgcaaattcatcttcg

SEQ ID NO: 220143 - DNA, 25 bp, Rattus norvegicus
caaggcgagcgctaattcatcttcg

SEQ ID NO: 220144 - DNA, 25 bp, Rattus norvegicus
caaggcgccaagcacttaccctgtt

SEQ ID NO: 220145 - DNA, 25 bp, Rattus norvegicus
caaggcgccaaggacttaccctgtt

SEQ ID NO: 220146 - DNA, 25 bp, Rattus norvegicus
caaggcgctgcgctacaagcaaaag

SEQ ID NO: 220147 - DNA, 25 bp, Rattus norvegicus
caaggcgctgcggtacaagcaaaag

SEQ ID NO: 220148 - DNA, 25 bp, Rattus norvegicus
caaggcggaaaacccagtgcccttt

SEQ ID NO: 220149 - DNA, 25 bp, Rattus norvegicus
caaggcggaaaagccagtgcccttt

SEQ ID NO: 220150 - DNA, 25 bp, Rattus norvegicus
caaggcggaggaccacaacatcgtg

SEQ ID NO: 220151 - DNA, 25 bp, Rattus norvegicus
caaggcggaggagcacaacatcgtg

SEQ ID NO: 220152 - DNA, 25 bp, Rattus norvegicus
caaggcggctctaacgtcccttagt

SEQ ID NO: 220153 - DNA, 25 bp, Rattus norvegicus
caaggcggctcttacgtcccttagt

SEQ ID NO: 220154 - DNA, 25 bp, Rattus norvegicus
caaggcggtagtcctgccaccctgg

SEQ ID NO: 220155 - DNA, 25 bp, Rattus norvegicus
caaggcggtagtgctgccaccctgg

SEQ ID NO: 220156 - DNA, 25 bp, Rattus norvegicus
caaggcgttagcatagtctccaaca

SEQ ID NO: 220157 - DNA, 25 bp, Rattus norvegicus
caaggcgttagcttagtctccaaca

SEQ ID NO: 220158 - DNA, 25 bp, Rattus norvegicus
caaggctaaccacaaatgctctcag

SEQ ID NO: 220159 - DNA, 25 bp, Rattus norvegicus
caaggctaaccagaaatgctctcag

SEQ ID NO: 220160 - DNA, 25 bp, Rattus norvegicus
caaggctacagtcgctgctttcaca

SEQ ID NO: 220161 - DNA, 25 bp, Rattus norvegicus
caaggctacagtggctgctttcaca

SEQ ID NO: 220162 - DNA, 25 bp, Rattus norvegicus
caaggctaccagctagggctctaga

SEQ ID NO: 220163 - DNA, 25 bp, Rattus norvegicus
caaggctaccaggtagggctctaga

SEQ ID NO: 220164 - DNA, 25 bp, Rattus norvegicus
caaggctaccgtacacgggtggaga

SEQ ID NO: 220165 - DNA, 25 bp, Rattus norvegicus
caaggctaccgttcacgggtggaga

SEQ ID NO: 220166 - DNA, 25 bp, Rattus norvegicus
caaggctacggccagggtttccgct

SEQ ID NO: 220167 - DNA, 25 bp, Rattus norvegicus
caaggctacggcgagggtttccgct

SEQ ID NO: 220168 - DNA, 25 bp, Rattus norvegicus
caaggctactctacagtgggaaccc

SEQ ID NO: 220169 - DNA, 25 bp, Rattus norvegicus
caaggctactcttcagtgggaaccc

SEQ ID NO: 220170 - DNA, 25 bp, Rattus norvegicus
caaggctagaacacccagtggaagg

SEQ ID NO: 220171 - DNA, 25 bp, Rattus norvegicus
caaggctagaactcccagtggaagg

SEQ ID NO: 220172 - DNA, 25 bp, Rattus norvegicus
caaggctagcaactgtaacagctct

SEQ ID NO: 220173 - DNA, 25 bp, Rattus norvegicus
caaggctagcaagtgtaacagctct

SEQ ID NO: 220174 - DNA, 25 bp, Rattus norvegicus
caaggctagtaaagaccagaggtgc

SEQ ID NO: 220175 - DNA, 25 bp, Rattus norvegicus
caaggctagtaatgaccagaggtgc

SEQ ID NO: 220176 - DNA, 25 bp, Rattus norvegicus
caaggctatgatctcctgcggtttc

SEQ ID NO: 220177 - DNA, 25 bp, Rattus norvegicus
caaggctatgatgtcctgcggtttc

SEQ ID NO: 220178 - DNA, 25 bp, Rattus norvegicus
caaggctattggacatcagcaccaa

SEQ ID NO: 220179 - DNA, 25 bp, Rattus norvegicus
caaggctattggtcatcagcaccaa

SEQ ID NO: 220180 - DNA, 25 bp, Rattus norvegicus
caaggctcagctccagtgccaggcg

SEQ ID NO: 220181 - DNA, 25 bp, Rattus norvegicus
caaggctcagctgcagtgccaggcg

SEQ ID NO: 220182 - DNA, 25 bp, Rattus norvegicus
caaggctcatcaagggagacggtga

SEQ ID NO: 220183 - DNA, 25 bp, Rattus norvegicus
caaggctcatcatgggagacggtga

SEQ ID NO: 220184 - DNA, 25 bp, Rattus norvegicus
caaggctccagtctggttcttttaa

SEQ ID NO: 220185 - DNA, 25 bp, Rattus norvegicus
caaggctccagtgtggttcttttaa

SEQ ID NO: 220186 - DNA, 25 bp, Rattus norvegicus
caaggctccggtagagtcagggaat

SEQ ID NO: 220187 - DNA, 25 bp, Rattus norvegicus
caaggctccggttgagtcagggaat

SEQ ID NO: 220188 - DNA, 25 bp, Rattus norvegicus
caaggctcctaacagtttgatttgt

SEQ ID NO: 220189 - DNA, 25 bp, Rattus norvegicus
caaggctcctaagagtttgatttgt

SEQ ID NO: 220190 - DNA, 25 bp, Rattus norvegicus
caaggctcgatcactactgggaaag

SEQ ID NO: 220191 - DNA, 25 bp, Rattus norvegicus
caaggctcgatctctactgggaaag

SEQ ID NO: 220192 - DNA, 25 bp, Rattus norvegicus
caaggctcggagcttatccctggcg

SEQ ID NO: 220193 - DNA, 25 bp, Rattus norvegicus
caaggctcggaggttatccctggcg

SEQ ID NO: 220194 - DNA, 25 bp, Rattus norvegicus
caaggctctggcactggtcgaagtg

SEQ ID NO: 220195 - DNA, 25 bp, Rattus norvegicus
caaggctctggctctggtcgaagtg

SEQ ID NO: 220196 - DNA, 25 bp, Rattus norvegicus
caaggctctgtgacgtctgcaggag

SEQ ID NO: 220197 - DNA, 25 bp, Rattus norvegicus
caaggctctgtgtcgtctgcaggag

SEQ ID NO: 220198 - DNA, 25 bp, Rattus norvegicus
caaggctcttggcagtgaccactgt

SEQ ID NO: 220199 - DNA, 25 bp, Rattus norvegicus
caaggctcttgggagtgaccactgt

SEQ ID NO: 220200 - DNA, 25 bp, Rattus norvegicus
caaggctgcagcacagggcaatggc

SEQ ID NO: 220201 - DNA, 25 bp, Rattus norvegicus
caaggctgcagctcagggcaatggc

SEQ ID NO: 220202 - DNA, 25 bp, Rattus norvegicus
caaggctgcataacgaatggcttct

SEQ ID NO: 220203 - DNA, 25 bp, Rattus norvegicus
caaggctgcatatcgaatggcttct

SEQ ID NO: 220204 - DNA, 25 bp, Rattus norvegicus
caaggctgccgtatccttaatggaa

SEQ ID NO: 220205 - DNA, 25 bp, Rattus norvegicus
caaggctgccgtttccttaatggaa

SEQ ID NO: 220206 - DNA, 25 bp, Rattus norvegicus
caaggctggtgactccacatggaga

SEQ ID NO: 220207 - DNA, 25 bp, Rattus norvegicus
caaggctggtgagtccacatggaga

SEQ ID NO: 220208 - DNA, 25 bp, Rattus norvegicus
caaggctgtggacgtgcactctgct

SEQ ID NO: 220209 - DNA, 25 bp, Rattus norvegicus
caaggctgtggaggtgcactctgct

SEQ ID NO: 220210 - DNA, 25 bp, Rattus norvegicus
caaggctgtgttcctacgctctggg

SEQ ID NO: 220211 - DNA, 25 bp, Rattus norvegicus
caaggctgtgttgctacgctctggg

SEQ ID NO: 220212 - DNA, 25 bp, Rattus norvegicus
caaggcttattcagtagcccaggtt

SEQ ID NO: 220213 - DNA, 25 bp, Rattus norvegicus
caaggcttattctgtagcccaggtt

SEQ ID NO: 220214 - DNA, 25 bp, Rattus norvegicus
caaggcttccagactatgcagggcg

SEQ ID NO: 220215 - DNA, 25 bp, Rattus norvegicus
caaggcttccagtctatgcagggcg

SEQ ID NO: 220216 - DNA, 25 bp, Rattus norvegicus
caaggcttccctataaactactgtg

SEQ ID NO: 220217 - DNA, 25 bp, Rattus norvegicus
caaggcttccctttaaactactgtg

SEQ ID NO: 220218 - DNA, 25 bp, Rattus norvegicus
caaggcttctggagatggcgagtac

SEQ ID NO: 220219 - DNA, 25 bp, Rattus norvegicus
caaggcttctggtgatggcgagtac

SEQ ID NO: 220220 - DNA, 25 bp, Rattus norvegicus
caaggcttgactcaatgtatctctc

SEQ ID NO: 220221 - DNA, 25 bp, Rattus norvegicus
caaggcttgactgaatgtatctctc

SEQ ID NO: 220222 - DNA, 25 bp, Rattus norvegicus
caaggcttgcagcagaccaacccaa

SEQ ID NO: 220223 - DNA, 25 bp, Rattus norvegicus
caaggcttgcaggagaccaacccaa

SEQ ID NO: 220224 - DNA, 25 bp, Rattus norvegicus
caaggcttggtgagtgagctgcttt

SEQ ID NO: 220225 - DNA, 25 bp, Rattus norvegicus
caaggcttggtgattcatctctgtt

SEQ ID NO: 220226 - DNA, 25 bp, Rattus norvegicus
caaggcttggtgtgtgagctgcttt

SEQ ID NO: 220227 - DNA, 25 bp, Rattus norvegicus
caaggcttggtgtttcatctctgtt

SEQ ID NO: 220228 - DNA, 25 bp, Rattus norvegicus
caaggcttgtccatgctgctgtgag

SEQ ID NO: 220229 - DNA, 25 bp, Rattus norvegicus
caaggcttgtccttgctgctgtgag

SEQ ID NO: 220230 - DNA, 25 bp, Rattus norvegicus
caaggctttatactactatttgtaa

SEQ ID NO: 220231 - DNA, 25 bp, Rattus norvegicus
caaggctttatagtactatttgtaa

SEQ ID NO: 220232 - DNA, 25 bp, Rattus norvegicus
caaggctttcgcctttacagacgcg

SEQ ID NO: 220233 - DNA, 25 bp, Rattus norvegicus
caaggctttcgcgtttacagacgcg

SEQ ID NO: 220234 - DNA, 25 bp, Rattus norvegicus
caaggctttcgtcactcgcagtggt

SEQ ID NO: 220235 - DNA, 25 bp, Rattus norvegicus
caaggctttcgtgactcgcagtggt

SEQ ID NO: 220236 - DNA, 25 bp, Rattus norvegicus
caaggctttgagacggacacactgt

SEQ ID NO: 220237 - DNA, 25 bp, Rattus norvegicus
caaggctttgagtcggacacactgt

SEQ ID NO: 220238 - DNA, 25 bp, Rattus norvegicus
caaggctttgttcgcgtttcagggc

SEQ ID NO: 220239 - DNA, 25 bp, Rattus norvegicus
caaggctttgttggcgtttcagggc

SEQ ID NO: 220240 - DNA, 25 bp, Rattus norvegicus
caagggaatccacttcttcttatgt

SEQ ID NO: 220241 - DNA, 25 bp, Rattus norvegicus
caagggaatccagttcttcttatgt

SEQ ID NO: 220242 - DNA, 25 bp, Rattus norvegicus
caagggaccgtcactaaggagggca

SEQ ID NO: 220243 - DNA, 25 bp, Rattus norvegicus
caagggaccgtctctaaggagggca

SEQ ID NO: 220244 - DNA, 25 bp, Rattus norvegicus
caagggacgtttagttgataatcca

SEQ ID NO: 220245 - DNA, 25 bp, Rattus norvegicus
caagggacgttttgttgataatcca

SEQ ID NO: 220246 - DNA, 25 bp, Rattus norvegicus
caagggactcttcttcttttataag

SEQ ID NO: 220247 - DNA, 25 bp, Rattus norvegicus
caagggactcttgttcttttataag

SEQ ID NO: 220248 - DNA, 25 bp, Rattus norvegicus
caagggagacagcaggtttgcccaa

SEQ ID NO: 220249 - DNA, 25 bp, Rattus norvegicus
caagggagacaggaggtttgcccaa

SEQ ID NO: 220250 - DNA, 25 bp, Rattus norvegicus
caagggagagctccctcaggacaag

SEQ ID NO: 220251 - DNA, 25 bp, Rattus norvegicus
caagggagagctgcctcaggacaag

SEQ ID NO: 220252 - DNA, 25 bp, Rattus norvegicus
caagggaggcttagcatgtctctaa

SEQ ID NO: 220253 - DNA, 25 bp, Rattus norvegicus
caagggaggctttgcatgtctctaa

SEQ ID NO: 220254 - DNA, 25 bp, Rattus norvegicus
caagggatcccacatactcttctag

SEQ ID NO: 220255 - DNA, 25 bp, Rattus norvegicus
caagggatcccagatactcttctag

SEQ ID NO: 220256 - DNA, 25 bp, Rattus norvegicus
caagggattagcatttttgtgtctt

SEQ ID NO: 220257 - DNA, 25 bp, Rattus norvegicus
caagggattagcttttttgtgtctt

SEQ ID NO: 220258 - DNA, 25 bp, Rattus norvegicus
caagggcaacaaaccgtggatttct

SEQ ID NO: 220259 - DNA, 25 bp, Rattus norvegicus
caagggcaacaatccgtggatttct

SEQ ID NO: 220260 - DNA, 25 bp, Rattus norvegicus
caagggcatgagatggtggaaccat

SEQ ID NO: 220261 - DNA, 25 bp, Rattus norvegicus
caagggcatgagttggtggaaccat

SEQ ID NO: 220262 - DNA, 25 bp, Rattus norvegicus
caagggcatgatccgcaaacagtag

SEQ ID NO: 220263 - DNA, 25 bp, Rattus norvegicus
caagggcatgatgcgcaaacagtag

SEQ ID NO: 220264 - DNA, 25 bp, Rattus norvegicus
caagggcattgtcgaacctccggaa

SEQ ID NO: 220265 - DNA, 25 bp, Rattus norvegicus
caagggcattgtggaacctccggaa

SEQ ID NO: 220266 - DNA, 25 bp, Rattus norvegicus
caagggccaactcggaactgtccgt

SEQ ID NO: 220267 - DNA, 25 bp, Rattus norvegicus
caagggccaactgggaactgtccgt

SEQ ID NO: 220268 - DNA, 25 bp, Rattus norvegicus
caagggcccacaattcttcacttta

SEQ ID NO: 220269 - DNA, 25 bp, Rattus norvegicus
caagggcccacatttcttcacttta

SEQ ID NO: 220270 - DNA, 25 bp, Rattus norvegicus
caagggccctgacattggcactcta

SEQ ID NO: 220271 - DNA, 25 bp, Rattus norvegicus
caagggccctgagattggcactcta

SEQ ID NO: 220272 - DNA, 25 bp, Rattus norvegicus
caagggccggacattttacgttatg

SEQ ID NO: 220273 - DNA, 25 bp, Rattus norvegicus
caagggccggactttttacgttatg

SEQ ID NO: 220274 - DNA, 25 bp, Rattus norvegicus
caagggcctcagctgtggcagaaca

SEQ ID NO: 220275 - DNA, 25 bp, Rattus norvegicus
caagggcctcaggtgtggcagaaca

SEQ ID NO: 220276 - DNA, 25 bp, Rattus norvegicus
caagggcctgaaagaagagtagatc

SEQ ID NO: 220277 - DNA, 25 bp, Rattus norvegicus
caagggcctgaatgaagagtagatc

SEQ ID NO: 220278 - DNA, 25 bp, Rattus norvegicus
caagggccttgcagtgctgtttagc

SEQ ID NO: 220279 - DNA, 25 bp, Rattus norvegicus
caagggccttgctgtgctgtttagc

SEQ ID NO: 220280 - DNA, 25 bp, Rattus norvegicus
caagggctccggctatcgctgtatc

SEQ ID NO: 220281 - DNA, 25 bp, Rattus norvegicus
caagggctccgggtatcgctgtatc

SEQ ID NO: 220282 - DNA, 25 bp, Rattus norvegicus
caagggctgagaatcttcgtgtata

SEQ ID NO: 220283 - DNA, 25 bp, Rattus norvegicus
caagggctgagattcttcgtgtata

SEQ ID NO: 220284 - DNA, 25 bp, Rattus norvegicus
caagggctgcggacttcttctgaga

SEQ ID NO: 220285 - DNA, 25 bp, Rattus norvegicus
caagggctgcggtcttcttctgaga

SEQ ID NO: 220286 - DNA, 25 bp, Rattus norvegicus
caagggctgctgattcgaagatgat

SEQ ID NO: 220287 - DNA, 25 bp, Rattus norvegicus
caagggctgctgtttcgaagatgat

SEQ ID NO: 220288 - DNA, 25 bp, Rattus norvegicus
caaggggctcatctgtgtaaaaatc

SEQ ID NO: 220289 - DNA, 25 bp, Rattus norvegicus
caaggggctcatgtgtgtaaaaatc

SEQ ID NO: 220290 - DNA, 25 bp, Rattus norvegicus
caagggtacagcagctatctgcacc

SEQ ID NO: 220291 - DNA, 25 bp, Rattus norvegicus
caagggtacagctgctatctgcacc

SEQ ID NO: 220292 - DNA, 25 bp, Rattus norvegicus
caagggtagaatcaccttcccagcc

SEQ ID NO: 220293 - DNA, 25 bp, Rattus norvegicus
caagggtagaatgaccttcccagcc

SEQ ID NO: 220294 - DNA, 25 bp, Rattus norvegicus
caagggtagagaacccagccccggt

SEQ ID NO: 220295 - DNA, 25 bp, Rattus norvegicus
caagggtagagatcccagccccggt

SEQ ID NO: 220296 - DNA, 25 bp, Rattus norvegicus
caagggtagcgtcgcacaccgagca

SEQ ID NO: 220297 - DNA, 25 bp, Rattus norvegicus
caagggtagcgtggcacaccgagca

SEQ ID NO: 220298 - DNA, 25 bp, Rattus norvegicus
caagggtagtttactgtctgttttg

SEQ ID NO: 220299 - DNA, 25 bp, Rattus norvegicus
caagggtagttttctgtctgttttg

SEQ ID NO: 220300 - DNA, 25 bp, Rattus norvegicus
caagggtatgccaagtgctttgcaa

SEQ ID NO: 220301 - DNA, 25 bp, Rattus norvegicus
caagggtatgcctagtgctttgcaa

SEQ ID NO: 220302 - DNA, 25 bp, Rattus norvegicus
caagggtccagcagtgtatccgtga

SEQ ID NO: 220303 - DNA, 25 bp, Rattus norvegicus
caagggtccagctgtgtatccgtga

SEQ ID NO: 220304 - DNA, 25 bp, Rattus norvegicus
caagggtcccctagttctcagacaa

SEQ ID NO: 220305 - DNA, 25 bp, Rattus norvegicus
caagggtccccttgttctcagacaa

SEQ ID NO: 220306 - DNA, 25 bp, Rattus norvegicus
caagggtccggaaccttcagtggat

SEQ ID NO: 220307 - DNA, 25 bp, Rattus norvegicus
caagggtccggatccttcagtggat

SEQ ID NO: 220308 - DNA, 25 bp, Rattus norvegicus
caagggtcgggaagccagatactgc

SEQ ID NO: 220309 - DNA, 25 bp, Rattus norvegicus
caagggtcgggatgccagatactgc

SEQ ID NO: 220310 - DNA, 25 bp, Rattus norvegicus
caagggtcgggcagctaagtccatt

SEQ ID NO: 220311 - DNA, 25 bp, Rattus norvegicus
caagggtcgggctgctaagtccatt

SEQ ID NO: 220312 - DNA, 25 bp, Rattus norvegicus
caagggtctcggagcctcaagtaaa

SEQ ID NO: 220313 - DNA, 25 bp, Rattus norvegicus
caagggtctcggtgcctcaagtaaa

SEQ ID NO: 220314 - DNA, 25 bp, Rattus norvegicus
caagggtgccacatttttcaacata

SEQ ID NO: 220315 - DNA, 25 bp, Rattus norvegicus
caagggtgccacttttttcaacata

SEQ ID NO: 220316 - DNA, 25 bp, Rattus norvegicus
caagggtgcctacagccgttctgga

SEQ ID NO: 220317 - DNA, 25 bp, Rattus norvegicus
caagggtgcctagagccgttctgga

SEQ ID NO: 220318 - DNA, 25 bp, Rattus norvegicus
caagggtgctttctaaggtctgaat

SEQ ID NO: 220319 - DNA, 25 bp, Rattus norvegicus
caagggtgctttgtaaggtctgaat

SEQ ID NO: 220320 - DNA, 25 bp, Rattus norvegicus
caagggtgggcccaaggtgttctcg

SEQ ID NO: 220321 - DNA, 25 bp, Rattus norvegicus
caagggtgggccgaaggtgttctcg

SEQ ID NO: 220322 - DNA, 25 bp, Rattus norvegicus
caagggtgggttagcttatgttgac

SEQ ID NO: 220323 - DNA, 25 bp, Rattus norvegicus
caagggtgggtttgcttatgttgac

SEQ ID NO: 220324 - DNA, 25 bp, Rattus norvegicus
caagggtgtgtaagttggtacaagt

SEQ ID NO: 220325 - DNA, 25 bp, Rattus norvegicus
caagggtgtgtatgttggtacaagt

SEQ ID NO: 220326 - DNA, 25 bp, Rattus norvegicus
caagggttgtctataggattcgctc

SEQ ID NO: 220327 - DNA, 25 bp, Rattus norvegicus
caagggttgtctttaggattcgctc

SEQ ID NO: 220328 - DNA, 25 bp, Rattus norvegicus
caaggtaaaatgagtattcctttct

SEQ ID NO: 220329 - DNA, 25 bp, Rattus norvegicus
caaggtaaaatgtgtattcctttct

SEQ ID NO: 220330 - DNA, 25 bp, Rattus norvegicus
caaggtaactgtatgctgcctgttg

SEQ ID NO: 220331 - DNA, 25 bp, Rattus norvegicus
caaggtaactgtttgctgcctgttg

SEQ ID NO: 220332 - DNA, 25 bp, Rattus norvegicus
caaggtacaaccagatcttttatgt

SEQ ID NO: 220333 - DNA, 25 bp, Rattus norvegicus
caaggtacaacctgatcttttatgt

SEQ ID NO: 220334 - DNA, 25 bp, Rattus norvegicus
caaggtaccacaagcacagactgcc

SEQ ID NO: 220335 - DNA, 25 bp, Rattus norvegicus
caaggtaccacatgcacagactgcc

SEQ ID NO: 220336 - DNA, 25 bp, Rattus norvegicus
caaggtacctgtaggttgatgtcaa

SEQ ID NO: 220337 - DNA, 25 bp, Rattus norvegicus
caaggtacctgttggttgatgtcaa

SEQ ID NO: 220338 - DNA, 25 bp, Rattus norvegicus
caaggtactaagactcagtgaggtg

SEQ ID NO: 220339 - DNA, 25 bp, Rattus norvegicus
caaggtactaagtctcagtgaggtg

SEQ ID NO: 220340 - DNA, 25 bp, Rattus norvegicus
caaggtagcattcttcgcagctgta

SEQ ID NO: 220341 - DNA, 25 bp, Rattus norvegicus
caaggtagcattgttcgcagctgta

SEQ ID NO: 220342 - DNA, 25 bp, Rattus norvegicus
caaggtaggttgacggcgttgctta

SEQ ID NO: 220343 - DNA, 25 bp, Rattus norvegicus
caaggtaggttgtcggcgttgctta

SEQ ID NO: 220344 - DNA, 25 bp, Rattus norvegicus
caaggtatccctctgctgtgtgtgc

SEQ ID NO: 220345 - DNA, 25 bp, Rattus norvegicus
caaggtatccctgtgctgtgtgtgc

SEQ ID NO: 220346 - DNA, 25 bp, Rattus norvegicus
caaggtatccttctagatcttacta

SEQ ID NO: 220347 - DNA, 25 bp, Rattus norvegicus
caaggtatccttgtagatcttacta

SEQ ID NO: 220348 - DNA, 25 bp, Rattus norvegicus
caaggtattaggcttcctcttcttt

SEQ ID NO: 220349 - DNA, 25 bp, Rattus norvegicus
caaggtattagggttcctcttcttt

SEQ ID NO: 220350 - DNA, 25 bp, Rattus norvegicus
caaggtcaccgaagctttcatagca

SEQ ID NO: 220351 - DNA, 25 bp, Rattus norvegicus
caaggtcaccgatgctttcatagca

SEQ ID NO: 220352 - DNA, 25 bp, Rattus norvegicus
caaggtcaccgtccttgctcgtcgg

SEQ ID NO: 220353 - DNA, 25 bp, Rattus norvegicus
caaggtcaccgtgcttgctcgtcgg

SEQ ID NO: 220354 - DNA, 25 bp, Rattus norvegicus
caaggtcactctataatacggcccg

SEQ ID NO: 220355 - DNA, 25 bp, Rattus norvegicus
caaggtcactctttaatacggcccg

SEQ ID NO: 220356 - DNA, 25 bp, Rattus norvegicus
caaggtcagaatcccctggccagga

SEQ ID NO: 220357 - DNA, 25 bp, Rattus norvegicus
caaggtcagaatgccctggccagga

SEQ ID NO: 220358 - DNA, 25 bp, Rattus norvegicus
caaggtcagcaaaatttcccacatc

SEQ ID NO: 220359 - DNA, 25 bp, Rattus norvegicus
caaggtcagcaatatttcccacatc

SEQ ID NO: 220360 - DNA, 25 bp, Rattus norvegicus
caaggtcagcctcagttactataat

SEQ ID NO: 220361 - DNA, 25 bp, Rattus norvegicus
caaggtcagcctcatctatagagtg

SEQ ID NO: 220362 - DNA, 25 bp, Rattus norvegicus
caaggtcagcctgagttactataat

SEQ ID NO: 220363 - DNA, 25 bp, Rattus norvegicus
caaggtcagcctgatctatagagtg

SEQ ID NO: 220364 - DNA, 25 bp, Rattus norvegicus
caaggtcagggtcgagtcttacctc

SEQ ID NO: 220365 - DNA, 25 bp, Rattus norvegicus
caaggtcagggtggagtcttacctc

SEQ ID NO: 220366 - DNA, 25 bp, Rattus norvegicus
caaggtcagtttattccagccagga

SEQ ID NO: 220367 - DNA, 25 bp, Rattus norvegicus
caaggtcagttttttccagccagga

SEQ ID NO: 220368 - DNA, 25 bp, Rattus norvegicus
caaggtcatcctcaactatatatat

SEQ ID NO: 220369 - DNA, 25 bp, Rattus norvegicus
caaggtcatcctgaactatatatat

SEQ ID NO: 220370 - DNA, 25 bp, Rattus norvegicus
caaggtcatcgtctacacctgtata

SEQ ID NO: 220371 - DNA, 25 bp, Rattus norvegicus
caaggtcatcgtgtacacctgtata

SEQ ID NO: 220372 - DNA, 25 bp, Rattus norvegicus
caaggtcatctgactaactgtgctg

SEQ ID NO: 220373 - DNA, 25 bp, Rattus norvegicus
caaggtcatctgtctaactgtgctg

SEQ ID NO: 220374 - DNA, 25 bp, Rattus norvegicus
caaggtcatgtccaatgccttcatg

SEQ ID NO: 220375 - DNA, 25 bp, Rattus norvegicus
caaggtcatgtcgaatgccttcatg

SEQ ID NO: 220376 - DNA, 25 bp, Rattus norvegicus
caaggtcattcaacacgttatatat

SEQ ID NO: 220377 - DNA, 25 bp, Rattus norvegicus
caaggtcattcatcacgttatatat

SEQ ID NO: 220378 - DNA, 25 bp, Rattus norvegicus
caaggtcattttaggattttcacat

SEQ ID NO: 220379 - DNA, 25 bp, Rattus norvegicus
caaggtcatttttggattttcacat

SEQ ID NO: 220380 - DNA, 25 bp, Rattus norvegicus
caaggtccaatgagtgtcgcagtaa

SEQ ID NO: 220381 - DNA, 25 bp, Rattus norvegicus
caaggtccaatgtgtgtcgcagtaa

SEQ ID NO: 220382 - DNA, 25 bp, Rattus norvegicus
caaggtccatcacgttatctccagg

SEQ ID NO: 220383 - DNA, 25 bp, Rattus norvegicus
caaggtccatcaggttatctccagg

SEQ ID NO: 220384 - DNA, 25 bp, Rattus norvegicus
caaggtcccactccatatatatcaa

SEQ ID NO: 220385 - DNA, 25 bp, Rattus norvegicus
caaggtcccactgcatatatatcaa

SEQ ID NO: 220386 - DNA, 25 bp, Rattus norvegicus
caaggtcccagtccagtcagagaag

SEQ ID NO: 220387 - DNA, 25 bp, Rattus norvegicus
caaggtcccagtgcagtcagagaag

SEQ ID NO: 220388 - DNA, 25 bp, Rattus norvegicus
caaggtccctatatccaggttggag

SEQ ID NO: 220389 - DNA, 25 bp, Rattus norvegicus
caaggtccctatttccaggttggag

SEQ ID NO: 220390 - DNA, 25 bp, Rattus norvegicus
caaggtcctcagcttggcaggtcaa

SEQ ID NO: 220391 - DNA, 25 bp, Rattus norvegicus
caaggtcctcaggttggcaggtcaa

SEQ ID NO: 220392 - DNA, 25 bp, Rattus norvegicus
caaggtcctgccacagtgatggact

SEQ ID NO: 220393 - DNA, 25 bp, Rattus norvegicus
caaggtcctgcctcagtgatggact

SEQ ID NO: 220394 - DNA, 25 bp, Rattus norvegicus
caaggtccttaaccagtgccgataa

SEQ ID NO: 220395 - DNA, 25 bp, Rattus norvegicus
caaggtccttaagcagtgccgataa

SEQ ID NO: 220396 - DNA, 25 bp, Rattus norvegicus
caaggtcggccgagtcagtgtgtat

SEQ ID NO: 220397 - DNA, 25 bp, Rattus norvegicus
caaggtcggccgtgtcagtgtgtat

SEQ ID NO: 220398 - DNA, 25 bp, Rattus norvegicus
caaggtctcactcggctcaaattta

SEQ ID NO: 220399 - DNA, 25 bp, Rattus norvegicus
caaggtctcactgggctcaaattta

SEQ ID NO: 220400 - DNA, 25 bp, Rattus norvegicus
caaggtctcctcacttggaatgaga

SEQ ID NO: 220401 - DNA, 25 bp, Rattus norvegicus
caaggtctcctctcttggaatgaga

SEQ ID NO: 220402 - DNA, 25 bp, Rattus norvegicus
caaggtctctctcgcgatcctggaa

SEQ ID NO: 220403 - DNA, 25 bp, Rattus norvegicus
caaggtctctctggcgatcctggaa

SEQ ID NO: 220404 - DNA, 25 bp, Rattus norvegicus
caaggtctcttacagtccaggctaa

SEQ ID NO: 220405 - DNA, 25 bp, Rattus norvegicus
caaggtctcttagagtccaggctaa

SEQ ID NO: 220406 - DNA, 25 bp, Rattus norvegicus
caaggtctgaggctttctccctgaa

SEQ ID NO: 220407 - DNA, 25 bp, Rattus norvegicus
caaggtctgagggtttctccctgaa

SEQ ID NO: 220408 - DNA, 25 bp, Rattus norvegicus
caaggtctgtgtcgtgctaatgcaa

SEQ ID NO: 220409 - DNA, 25 bp, Rattus norvegicus
caaggtctgtgtggtgctaatgcaa

SEQ ID NO: 220410 - DNA, 25 bp, Rattus norvegicus
caaggtcttataaactgttggtcaa

SEQ ID NO: 220411 - DNA, 25 bp, Rattus norvegicus
caaggtcttatatactgttggtcaa

SEQ ID NO: 220412 - DNA, 25 bp, Rattus norvegicus
caaggtcttcctctccattaaaggt

SEQ ID NO: 220413 - DNA, 25 bp, Rattus norvegicus
caaggtcttcctgtccattaaaggt

SEQ ID NO: 220414 - DNA, 25 bp, Rattus norvegicus
caaggtcttgaaatgccgcgatatt

SEQ ID NO: 220415 - DNA, 25 bp, Rattus norvegicus
caaggtcttgaattgccgcgatatt

SEQ ID NO: 220416 - DNA, 25 bp, Rattus norvegicus
caaggtctttacagggcgtatttga

SEQ ID NO: 220417 - DNA, 25 bp, Rattus norvegicus
caaggtctttactgggcgtatttga

SEQ ID NO: 220418 - DNA, 25 bp, Rattus norvegicus
caaggtgaaaccatcccgtgttctg

SEQ ID NO: 220419 - DNA, 25 bp, Rattus norvegicus
caaggtgaaaccttcccgtgttctg

SEQ ID NO: 220420 - DNA, 25 bp, Rattus norvegicus
caaggtgaacctatttgcagagctc

SEQ ID NO: 220421 - DNA, 25 bp, Rattus norvegicus
caaggtgaacctcacctcgggtggt

SEQ ID NO: 220422 - DNA, 25 bp, Rattus norvegicus
caaggtgaacctgacctcgggtggt

SEQ ID NO: 220423 - DNA, 25 bp, Rattus norvegicus
caaggtgaacctttttgcagagctc

SEQ ID NO: 220424 - DNA, 25 bp, Rattus norvegicus
caaggtgaacgtcgtgctgcagaac

SEQ ID NO: 220425 - DNA, 25 bp, Rattus norvegicus
caaggtgaacgtggtgctgcagaac

SEQ ID NO: 220426 - DNA, 25 bp, Rattus norvegicus
caaggtgaacttaactcgcgttgta

SEQ ID NO: 220427 - DNA, 25 bp, Rattus norvegicus
caaggtgaactttactcgcgttgta

SEQ ID NO: 220428 - DNA, 25 bp, Rattus norvegicus
caaggtgacgctccctgatggacac

SEQ ID NO: 220429 - DNA, 25 bp, Rattus norvegicus
caaggtgacgctgcctgatggacac

SEQ ID NO: 220430 - DNA, 25 bp, Rattus norvegicus
caaggtgactagagggctgtaaaca

SEQ ID NO: 220431 - DNA, 25 bp, Rattus norvegicus
caaggtgactagtgggctgtaaaca

SEQ ID NO: 220432 - DNA, 25 bp, Rattus norvegicus
caaggtgactccagtgcagacacat

SEQ ID NO: 220433 - DNA, 25 bp, Rattus norvegicus
caaggtgactcctgtgcagacacat

SEQ ID NO: 220434 - DNA, 25 bp, Rattus norvegicus
caaggtgactgaagctttccatgca

SEQ ID NO: 220435 - DNA, 25 bp, Rattus norvegicus
caaggtgactgatgctttccatgca

SEQ ID NO: 220436 - DNA, 25 bp, Rattus norvegicus
caaggtgagcatacttcctctatca

SEQ ID NO: 220437 - DNA, 25 bp, Rattus norvegicus
caaggtgagcattcttcctctatca

SEQ ID NO: 220438 - DNA, 25 bp, Rattus norvegicus
caaggtgagggtcccctgcacagac

SEQ ID NO: 220439 - DNA, 25 bp, Rattus norvegicus
caaggtgagggtgccctgcacagac

SEQ ID NO: 220440 - DNA, 25 bp, Rattus norvegicus
caaggtgatctacattgcccgaaat

SEQ ID NO: 220441 - DNA, 25 bp, Rattus norvegicus
caaggtgatctagattgcccgaaat

SEQ ID NO: 220442 - DNA, 25 bp, Rattus norvegicus
caaggtgatgcgacttggaccaggt

SEQ ID NO: 220443 - DNA, 25 bp, Rattus norvegicus
caaggtgatgcgtcttggaccaggt

SEQ ID NO: 220444 - DNA, 25 bp, Rattus norvegicus
caaggtgatggtactgcagccggca

SEQ ID NO: 220445 - DNA, 25 bp, Rattus norvegicus
caaggtgatggttctgcagccggca

SEQ ID NO: 220446 - DNA, 25 bp, Rattus norvegicus
caaggtgatttcagagttcttcctc

SEQ ID NO: 220447 - DNA, 25 bp, Rattus norvegicus
caaggtgatttctgagttcttcctc

SEQ ID NO: 220448 - DNA, 25 bp, Rattus norvegicus
caaggtgcacccaaatccagacgtt

SEQ ID NO: 220449 - DNA, 25 bp, Rattus norvegicus
caaggtgcaccctaatccagacgtt

SEQ ID NO: 220450 - DNA, 25 bp, Rattus norvegicus
caaggtgcactcatctgtgttggga

SEQ ID NO: 220451 - DNA, 25 bp, Rattus norvegicus
caaggtgcactcttctgtgttggga

SEQ ID NO: 220452 - DNA, 25 bp, Rattus norvegicus
caaggtgcaggcctggtctacataa

SEQ ID NO: 220453 - DNA, 25 bp, Rattus norvegicus
caaggtgcaggcgtggtctacataa

SEQ ID NO: 220454 - DNA, 25 bp, Rattus norvegicus
caaggtgcaggtcagtcgaatacta

SEQ ID NO: 220455 - DNA, 25 bp, Rattus norvegicus
caaggtgcaggtgagtcgaatacta

SEQ ID NO: 220456 - DNA, 25 bp, Rattus norvegicus
caaggtgcccaacggccgcaagtga

SEQ ID NO: 220457 - DNA, 25 bp, Rattus norvegicus
caaggtgcccaagggccgcaagtga

SEQ ID NO: 220458 - DNA, 25 bp, Rattus norvegicus
caaggtgcctggagtgactgactgt

SEQ ID NO: 220459 - DNA, 25 bp, Rattus norvegicus
caaggtgcctggtgtgactgactgt

SEQ ID NO: 220460 - DNA, 25 bp, Rattus norvegicus
caaggtgcgcgcagagcgcaaccgt

SEQ ID NO: 220461 - DNA, 25 bp, Rattus norvegicus
caaggtgcgcgctgagcgcaaccgt

SEQ ID NO: 220462 - DNA, 25 bp, Rattus norvegicus
caaggtgcggtcctggatccacagc

SEQ ID NO: 220463 - DNA, 25 bp, Rattus norvegicus
caaggtgcggtcgtggatccacagc

SEQ ID NO: 220464 - DNA, 25 bp, Rattus norvegicus
caaggtgctcggaccttccgaggaa

SEQ ID NO: 220465 - DNA, 25 bp, Rattus norvegicus
caaggtgctcggtccttccgaggaa

SEQ ID NO: 220466 - DNA, 25 bp, Rattus norvegicus
caaggtggtaacaccgtgtgttcaa

SEQ ID NO: 220467 - DNA, 25 bp, Rattus norvegicus
caaggtggtaactccgtgtgttcaa

SEQ ID NO: 220468 - DNA, 25 bp, Rattus norvegicus
caaggtggtctgaggtagggagtca

SEQ ID NO: 220469 - DNA, 25 bp, Rattus norvegicus
caaggtggtctgtggtagggagtca

SEQ ID NO: 220470 - DNA, 25 bp, Rattus norvegicus
caaggtggtgtaatctttttgacaa

SEQ ID NO: 220471 - DNA, 25 bp, Rattus norvegicus
caaggtggtgtattctttttgacaa

SEQ ID NO: 220472 - DNA, 25 bp, Rattus norvegicus
caaggtgtaaatccctttccggcca

SEQ ID NO: 220473 - DNA, 25 bp, Rattus norvegicus
caaggtgtaaatgcctttccggcca

SEQ ID NO: 220474 - DNA, 25 bp, Rattus norvegicus
caaggtgtacacaactgatgctgtt

SEQ ID NO: 220475 - DNA, 25 bp, Rattus norvegicus
caaggtgtacactactgatgctgtt

SEQ ID NO: 220476 - DNA, 25 bp, Rattus norvegicus
caaggtgtcctacgtgaaagctatt

SEQ ID NO: 220477 - DNA, 25 bp, Rattus norvegicus
caaggtgtcctaggtgaaagctatt

SEQ ID NO: 220478 - DNA, 25 bp, Rattus norvegicus
caaggtgtgactcctgactgttttc

SEQ ID NO: 220479 - DNA, 25 bp, Rattus norvegicus
caaggtgtgactgctgactgttttc

SEQ ID NO: 220480 - DNA, 25 bp, Rattus norvegicus
caaggtgtggtcagagctcgagaaa

SEQ ID NO: 220481 - DNA, 25 bp, Rattus norvegicus
caaggtgtggtctgagctcgagaaa

SEQ ID NO: 220482 - DNA, 25 bp, Rattus norvegicus
caaggtgttgccatgacgaagttct

SEQ ID NO: 220483 - DNA, 25 bp, Rattus norvegicus
caaggtgttgccttgacgaagttct

SEQ ID NO: 220484 - DNA, 25 bp, Rattus norvegicus
caaggtgttggacctcgaccctgcc

SEQ ID NO: 220485 - DNA, 25 bp, Rattus norvegicus
caaggtgttggagctcgaccctgcc

SEQ ID NO: 220486 - DNA, 25 bp, Rattus norvegicus
caaggtgtttctaagcatgtgcaaa

SEQ ID NO: 220487 - DNA, 25 bp, Rattus norvegicus
caaggtgtttcttagcatgtgcaaa

SEQ ID NO: 220488 - DNA, 25 bp, Rattus norvegicus
caaggttatacaccatgcgtctaga

SEQ ID NO: 220489 - DNA, 25 bp, Rattus norvegicus
caaggttatacagcatgcgtctaga

SEQ ID NO: 220490 - DNA, 25 bp, Rattus norvegicus
caaggttatcctccaaatatactta

SEQ ID NO: 220491 - DNA, 25 bp, Rattus norvegicus
caaggttatcctgcaaatatactta

SEQ ID NO: 220492 - DNA, 25 bp, Rattus norvegicus
caaggttatgtcaccggagcgtcgg

SEQ ID NO: 220493 - DNA, 25 bp, Rattus norvegicus
caaggttatgtctccggagcgtcgg

SEQ ID NO: 220494 - DNA, 25 bp, Rattus norvegicus
caaggttcaggtcagtcttccgtta

SEQ ID NO: 220495 - DNA, 25 bp, Rattus norvegicus
caaggttcaggtgagtcttccgtta

SEQ ID NO: 220496 - DNA, 25 bp, Rattus norvegicus
caaggttcataaaggtggtgtgagc

SEQ ID NO: 220497 - DNA, 25 bp, Rattus norvegicus
caaggttcataatggtggtgtgagc

SEQ ID NO: 220498 - DNA, 25 bp, Rattus norvegicus
caaggttccgagcagtggctacagt

SEQ ID NO: 220499 - DNA, 25 bp, Rattus norvegicus
caaggttccgaggagtggctacagt

SEQ ID NO: 220500 - DNA, 25 bp, Rattus norvegicus
caaggttccttacatgtgctgtaaa

SEQ ID NO: 220501 - DNA, 25 bp, Rattus norvegicus
caaggttccttagatgtgctgtaaa

SEQ ID NO: 220502 - DNA, 25 bp, Rattus norvegicus
caaggttctcagacatggatctaca

SEQ ID NO: 220503 - DNA, 25 bp, Rattus norvegicus
caaggttctcagtcatggatctaca

SEQ ID NO: 220504 - DNA, 25 bp, Rattus norvegicus
caaggttctgggagatgtgtctgct

SEQ ID NO: 220505 - DNA, 25 bp, Rattus norvegicus
caaggttctgggtgatgtgtctgct

SEQ ID NO: 220506 - DNA, 25 bp, Rattus norvegicus
caaggttcttagcaccagattcaca

SEQ ID NO: 220507 - DNA, 25 bp, Rattus norvegicus
caaggttcttaggaccagattcaca

SEQ ID NO: 220508 - DNA, 25 bp, Rattus norvegicus
caaggttcttatagcactcgggctg

SEQ ID NO: 220509 - DNA, 25 bp, Rattus norvegicus
caaggttcttattgcactcgggctg

SEQ ID NO: 220510 - DNA, 25 bp, Rattus norvegicus
caaggttgacctcggctgttaacac

SEQ ID NO: 220511 - DNA, 25 bp, Rattus norvegicus
caaggttgacctgggctgttaacac

SEQ ID NO: 220512 - DNA, 25 bp, Rattus norvegicus
caaggttgacttaccccaagaccag

SEQ ID NO: 220513 - DNA, 25 bp, Rattus norvegicus
caaggttgactttccccaagaccag

SEQ ID NO: 220514 - DNA, 25 bp, Rattus norvegicus
caaggttgcaccactatatgttggg

SEQ ID NO: 220515 - DNA, 25 bp, Rattus norvegicus
caaggttgcacctctatatgttggg

SEQ ID NO: 220516 - DNA, 25 bp, Rattus norvegicus
caaggttgctcaagacgtggcgctg

SEQ ID NO: 220517 - DNA, 25 bp, Rattus norvegicus
caaggttgctcatgacgtggcgctg

SEQ ID NO: 220518 - DNA, 25 bp, Rattus norvegicus
caaggttggcaccatcagagggtca

SEQ ID NO: 220519 - DNA, 25 bp, Rattus norvegicus
caaggttggcacgatcagagggtca

SEQ ID NO: 220520 - DNA, 25 bp, Rattus norvegicus
caaggttggcccatctgggtacagt

SEQ ID NO: 220521 - DNA, 25 bp, Rattus norvegicus
caaggttggcccttctgggtacagt

SEQ ID NO: 220522 - DNA, 25 bp, Rattus norvegicus
caaggttggtcccacccatctagaa

SEQ ID NO: 220523 - DNA, 25 bp, Rattus norvegicus
caaggttggtccgacccatctagaa

SEQ ID NO: 220524 - DNA, 25 bp, Rattus norvegicus
caaggttggtctctatttggattca

SEQ ID NO: 220525 - DNA, 25 bp, Rattus norvegicus
caaggttggtctgtatttggattca

SEQ ID NO: 220526 - DNA, 25 bp, Rattus norvegicus
caaggttgtcagcaatcgatctcgt

SEQ ID NO: 220527 - DNA, 25 bp, Rattus norvegicus
caaggttgtcaggaatcgatctcgt

SEQ ID NO: 220528 - DNA, 25 bp, Rattus norvegicus
caaggttgtcttaggctttgagttt

SEQ ID NO: 220529 - DNA, 25 bp, Rattus norvegicus
caaggttgtctttggctttgagttt

SEQ ID NO: 220530 - DNA, 25 bp, Rattus norvegicus
caaggttgttctcgccatcacagac

SEQ ID NO: 220531 - DNA, 25 bp, Rattus norvegicus
caaggttgttctggccatcacagac

SEQ ID NO: 220532 - DNA, 25 bp, Rattus norvegicus
caaggtttattgacaactgtgtact

SEQ ID NO: 220533 - DNA, 25 bp, Rattus norvegicus
caaggtttattgtcaactgtgtact

SEQ ID NO: 220534 - DNA, 25 bp, Rattus norvegicus
caaggtttcagcattggtagcgttt

SEQ ID NO: 220535 - DNA, 25 bp, Rattus norvegicus
caaggtttcagctttggtagcgttt

SEQ ID NO: 220536 - DNA, 25 bp, Rattus norvegicus
caaggtttccacctagacccagagg

SEQ ID NO: 220537 - DNA, 25 bp, Rattus norvegicus
caaggtttccacgtagacccagagg

SEQ ID NO: 220538 - DNA, 25 bp, Rattus norvegicus
caaggtttcctcatcggtatctttg

SEQ ID NO: 220539 - DNA, 25 bp, Rattus norvegicus
caaggtttcctcttcggtatctttg

SEQ ID NO: 220540 - DNA, 25 bp, Rattus norvegicus
caaggtttcctgcaggccaagttca

SEQ ID NO: 220541 - DNA, 25 bp, Rattus norvegicus
caaggtttcctggaggccaagttca

SEQ ID NO: 220542 - DNA, 25 bp, Rattus norvegicus
caaggtttctctctgtagaccatga

SEQ ID NO: 220543 - DNA, 25 bp, Rattus norvegicus
caaggtttctctgtgtagaccatga

SEQ ID NO: 220544 - DNA, 25 bp, Rattus norvegicus
caaggtttctgtattgtgtggaaga

SEQ ID NO: 220545 - DNA, 25 bp, Rattus norvegicus
caaggtttctgttttgtgtggaaga

SEQ ID NO: 220546 - DNA, 25 bp, Rattus norvegicus
caaggtttgaaacccagccaccggt

SEQ ID NO: 220547 - DNA, 25 bp, Rattus norvegicus
caaggtttgaaagccagccaccggt

SEQ ID NO: 220548 - DNA, 25 bp, Rattus norvegicus
caaggtttggtgaagtcaccatcag

SEQ ID NO: 220549 - DNA, 25 bp, Rattus norvegicus
caaggtttggtgtagtcaccatcag

SEQ ID NO: 220550 - DNA, 25 bp, Rattus norvegicus
caagtaaaaactagactgggatcaa

SEQ ID NO: 220551 - DNA, 25 bp, Rattus norvegicus
caagtaaaaacttgactgggatcaa

SEQ ID NO: 220552 - DNA, 25 bp, Rattus norvegicus
caagtaactgcaatccggctggaac

SEQ ID NO: 220553 - DNA, 25 bp, Rattus norvegicus
caagtaactgcattccggctggaac

SEQ ID NO: 220554 - DNA, 25 bp, Rattus norvegicus
caagtaacttcaccattgtggctaa

SEQ ID NO: 220555 - DNA, 25 bp, Rattus norvegicus
caagtaacttcagcattgtggctaa

SEQ ID NO: 220556 - DNA, 25 bp, Rattus norvegicus
caagtaagcttgcttgcctttttta

SEQ ID NO: 220557 - DNA, 25 bp, Rattus norvegicus
caagtaagcttggttgcctttttta

SEQ ID NO: 220558 - DNA, 25 bp, Rattus norvegicus
caagtaaggcgcacaggctcccaag

SEQ ID NO: 220559 - DNA, 25 bp, Rattus norvegicus
caagtaaggcgctcaggctcccaag

SEQ ID NO: 220560 - DNA, 25 bp, Rattus norvegicus
caagtaatattgctcctttaaaggg

SEQ ID NO: 220561 - DNA, 25 bp, Rattus norvegicus
caagtaatattggtcctttaaaggg

SEQ ID NO: 220562 - DNA, 25 bp, Rattus norvegicus
caagtaatgattacagccctgccaa

SEQ ID NO: 220563 - DNA, 25 bp, Rattus norvegicus
caagtaatgatttcagccctgccaa

SEQ ID NO: 220564 - DNA, 25 bp, Rattus norvegicus
caagtacaagctacccaccttggaa

SEQ ID NO: 220565 - DNA, 25 bp, Rattus norvegicus
caagtacaagcttcccaccttggaa

SEQ ID NO: 220566 - DNA, 25 bp, Rattus norvegicus
caagtacaccatcgcccgagagcgt

SEQ ID NO: 220567 - DNA, 25 bp, Rattus norvegicus
caagtacaccatggcccgagagcgt

SEQ ID NO: 220568 - DNA, 25 bp, Rattus norvegicus
caagtaccaactcgccttcaagagg

SEQ ID NO: 220569 - DNA, 25 bp, Rattus norvegicus
caagtaccaactggccttcaagagg

SEQ ID NO: 220570 - DNA, 25 bp, Rattus norvegicus
caagtaccaggacattcccttctac

SEQ ID NO: 220571 - DNA, 25 bp, Rattus norvegicus
caagtaccaggagattcccttctac

SEQ ID NO: 220572 - DNA, 25 bp, Rattus norvegicus
caagtacctggcctcagctgggaag

SEQ ID NO: 220573 - DNA, 25 bp, Rattus norvegicus
caagtacctggcgtcagctgggaag

SEQ ID NO: 220574 - DNA, 25 bp, Rattus norvegicus
caagtactacgaagccattgcctgc

SEQ ID NO: 220575 - DNA, 25 bp, Rattus norvegicus
caagtactacgatgccattgcctgc

SEQ ID NO: 220576 - DNA, 25 bp, Rattus norvegicus
caagtactactaacagggacctgag

SEQ ID NO: 220577 - DNA, 25 bp, Rattus norvegicus
caagtactactatcagggacctgag

SEQ ID NO: 220578 - DNA, 25 bp, Rattus norvegicus
caagtactctctccgggagctacac

SEQ ID NO: 220579 - DNA, 25 bp, Rattus norvegicus
caagtactctctgcgggagctacac

SEQ ID NO: 220580 - DNA, 25 bp, Rattus norvegicus
caagtactggagacccatgggatcg

SEQ ID NO: 220581 - DNA, 25 bp, Rattus norvegicus
caagtactggagtcccatgggatcg

SEQ ID NO: 220582 - DNA, 25 bp, Rattus norvegicus
caagtagacaaacctgctttcagta

SEQ ID NO: 220583 - DNA, 25 bp, Rattus norvegicus
caagtagacaaagctgctttcagta

SEQ ID NO: 220584 - DNA, 25 bp, Rattus norvegicus
caagtagatgggatgatcctcctcc

SEQ ID NO: 220585 - DNA, 25 bp, Rattus norvegicus
caagtagatgggttgatcctcctcc

SEQ ID NO: 220586 - DNA, 25 bp, Rattus norvegicus
caagtagatgtcctgttagcctgca

SEQ ID NO: 220587 - DNA, 25 bp, Rattus norvegicus
caagtagatgtcgtgttagcctgca

SEQ ID NO: 220588 - DNA, 25 bp, Rattus norvegicus
caagtagccaagatgccagcctgaa

SEQ ID NO: 220589 - DNA, 25 bp, Rattus norvegicus
caagtagccaagttgccagcctgaa

SEQ ID NO: 220590 - DNA, 25 bp, Rattus norvegicus
caagtagcctatcctccagaattat

SEQ ID NO: 220591 - DNA, 25 bp, Rattus norvegicus
caagtagcctatgctccagaattat

SEQ ID NO: 220592 - DNA, 25 bp, Rattus norvegicus
caagtagcggtgatttccatatgta

SEQ ID NO: 220593 - DNA, 25 bp, Rattus norvegicus
caagtagcggtgttttccatatgta

SEQ ID NO: 220594 - DNA, 25 bp, Rattus norvegicus
caagtagctagtacatgtgcgtcta

SEQ ID NO: 220595 - DNA, 25 bp, Rattus norvegicus
caagtagctagttcatgtgcgtcta

SEQ ID NO: 220596 - DNA, 25 bp, Rattus norvegicus
caagtagctgataaccctggatggt

SEQ ID NO: 220597 - DNA, 25 bp, Rattus norvegicus
caagtagctgattaccctggatggt

SEQ ID NO: 220598 - DNA, 25 bp, Rattus norvegicus
caagtagctgctcgtgctcaggcat

SEQ ID NO: 220599 - DNA, 25 bp, Rattus norvegicus
caagtagctgctggtgctcaggcat

SEQ ID NO: 220600 - DNA, 25 bp, Rattus norvegicus
caagtaggactgagagtagggccca

SEQ ID NO: 220601 - DNA, 25 bp, Rattus norvegicus
caagtaggactgtgagtagggccca

SEQ ID NO: 220602 - DNA, 25 bp, Rattus norvegicus
caagtagtccttcgcgtgagccttg

SEQ ID NO: 220603 - DNA, 25 bp, Rattus norvegicus
caagtagtccttggcgtgagccttg

SEQ ID NO: 220604 - DNA, 25 bp, Rattus norvegicus
caagtatcccaaatgtgactacaca

SEQ ID NO: 220605 - DNA, 25 bp, Rattus norvegicus
caagtatcccaattgtgactacaca

SEQ ID NO: 220606 - DNA, 25 bp, Rattus norvegicus
caagtatcttataggtgctgcacct

SEQ ID NO: 220607 - DNA, 25 bp, Rattus norvegicus
caagtatcttattggtgctgcacct

SEQ ID NO: 220608 - DNA, 25 bp, Rattus norvegicus
caagtatgtcatcctcttgtttctc

SEQ ID NO: 220609 - DNA, 25 bp, Rattus norvegicus
caagtatgtcatgctcttgtttctc

SEQ ID NO: 220610 - DNA, 25 bp, Rattus norvegicus
caagtatgtgaacctgaacgtgggc

SEQ ID NO: 220611 - DNA, 25 bp, Rattus norvegicus
caagtatgtgaagctgaacgtgggc

SEQ ID NO: 220612 - DNA, 25 bp, Rattus norvegicus
caagtattaattcccagatgcccac

SEQ ID NO: 220613 - DNA, 25 bp, Rattus norvegicus
caagtattaattgccagatgcccac

SEQ ID NO: 220614 - DNA, 25 bp, Rattus norvegicus
caagtattacagcagggcccagata

SEQ ID NO: 220615 - DNA, 25 bp, Rattus norvegicus
caagtattacaggagggcccagata

SEQ ID NO: 220616 - DNA, 25 bp, Rattus norvegicus
caagtatttgtcctgtgcccaacac

SEQ ID NO: 220617 - DNA, 25 bp, Rattus norvegicus
caagtatttgtcgtgtgcccaacac

SEQ ID NO: 220618 - DNA, 25 bp, Rattus norvegicus
caagtattttctatatcctccatga

SEQ ID NO: 220619 - DNA, 25 bp, Rattus norvegicus
caagtattttctttatcctccatga

SEQ ID NO: 220620 - DNA, 25 bp, Rattus norvegicus
caagtattttgaaagtgtgccacct

SEQ ID NO: 220621 - DNA, 25 bp, Rattus norvegicus
caagtattttgatagtgtgccacct

SEQ ID NO: 220622 - DNA, 25 bp, Rattus norvegicus
caagtattttgtaccagtgcattaa

SEQ ID NO: 220623 - DNA, 25 bp, Rattus norvegicus
caagtattttgttccagtgcattaa

SEQ ID NO: 220624 - DNA, 25 bp, Rattus norvegicus
caagtcaaagccacagtgcctgtca

SEQ ID NO: 220625 - DNA, 25 bp, Rattus norvegicus
caagtcaaagcctcagtgcctgtca

SEQ ID NO: 220626 - DNA, 25 bp, Rattus norvegicus
caagtcacgtggaccttctgaaggc

SEQ ID NO: 220627 - DNA, 25 bp, Rattus norvegicus
caagtcacgtggtccttctgaaggc

SEQ ID NO: 220628 - DNA, 25 bp, Rattus norvegicus
caagtcactgctcaacatgttctgt

SEQ ID NO: 220629 - DNA, 25 bp, Rattus norvegicus
caagtcactgctgaacatgttctgt

SEQ ID NO: 220630 - DNA, 25 bp, Rattus norvegicus
caagtcaggtgaaccagagtttcat

SEQ ID NO: 220631 - DNA, 25 bp, Rattus norvegicus
caagtcaggtgatccagagtttcat

SEQ ID NO: 220632 - DNA, 25 bp, Rattus norvegicus
caagtcataaggatctggtggtcaa

SEQ ID NO: 220633 - DNA, 25 bp, Rattus norvegicus
caagtcataaggttctggtggtcaa

SEQ ID NO: 220634 - DNA, 25 bp, Rattus norvegicus
caagtcattgttcgtgcctaatcac

SEQ ID NO: 220635 - DNA, 25 bp, Rattus norvegicus
caagtcattgttggtgcctaatcac

SEQ ID NO: 220636 - DNA, 25 bp, Rattus norvegicus
caagtcatttatcgagtctggtggt

SEQ ID NO: 220637 - DNA, 25 bp, Rattus norvegicus
caagtcatttatggagtctggtggt

SEQ ID NO: 220638 - DNA, 25 bp, Rattus norvegicus
caagtccaccctcaactacataagg

SEQ ID NO: 220639 - DNA, 25 bp, Rattus norvegicus
caagtccaccctgaactacataagg

SEQ ID NO: 220640 - DNA, 25 bp, Rattus norvegicus
caagtccagagtctccaggctgaga

SEQ ID NO: 220641 - DNA, 25 bp, Rattus norvegicus
caagtccagagtgtccaggctgaga

SEQ ID NO: 220642 - DNA, 25 bp, Rattus norvegicus
caagtccatggtattattaaattag

SEQ ID NO: 220643 - DNA, 25 bp, Rattus norvegicus
caagtccatggttttattaaattag

SEQ ID NO: 220644 - DNA, 25 bp, Rattus norvegicus
caagtcccaggaacaagttttcgat

SEQ ID NO: 220645 - DNA, 25 bp, Rattus norvegicus
caagtcccaggatcaagttttcgat

SEQ ID NO: 220646 - DNA, 25 bp, Rattus norvegicus
caagtcccttttactacgttgcagt

SEQ ID NO: 220647 - DNA, 25 bp, Rattus norvegicus
caagtccctttttctacgttgcagt

SEQ ID NO: 220648 - DNA, 25 bp, Rattus norvegicus
caagtccgtcaacccaatctacaag

SEQ ID NO: 220649 - DNA, 25 bp, Rattus norvegicus
caagtccgtcaagccaatctacaag

SEQ ID NO: 220650 - DNA, 25 bp, Rattus norvegicus
caagtcctactgctgttgtcaggcc

SEQ ID NO: 220651 - DNA, 25 bp, Rattus norvegicus
caagtcctactggtgttgtcaggcc

SEQ ID NO: 220652 - DNA, 25 bp, Rattus norvegicus
caagtcctagtgcatgtctctgaat

SEQ ID NO: 220653 - DNA, 25 bp, Rattus norvegicus
caagtcctagtggatgtctctgaat

SEQ ID NO: 220654 - DNA, 25 bp, Rattus norvegicus
caagtcctccttaaagtggtccgag

SEQ ID NO: 220655 - DNA, 25 bp, Rattus norvegicus
caagtcctcctttaagtggtccgag

SEQ ID NO: 220656 - DNA, 25 bp, Rattus norvegicus
caagtcctgctcagctgggattaga

SEQ ID NO: 220657 - DNA, 25 bp, Rattus norvegicus
caagtcctgctctgctgggattaga

SEQ ID NO: 220658 - DNA, 25 bp, Rattus norvegicus
caagtcctggaaacaattgctcaca

SEQ ID NO: 220659 - DNA, 25 bp, Rattus norvegicus
caagtcctggaatcaattgctcaca

SEQ ID NO: 220660 - DNA, 25 bp, Rattus norvegicus
caagtcctggctaacatgacagagt

SEQ ID NO: 220661 - DNA, 25 bp, Rattus norvegicus
caagtcctggctcgccaagttactg

SEQ ID NO: 220662 - DNA, 25 bp, Rattus norvegicus
caagtcctggctggccaagttactg

SEQ ID NO: 220663 - DNA, 25 bp, Rattus norvegicus
caagtcctggcttacatgacagagt

SEQ ID NO: 220664 - DNA, 25 bp, Rattus norvegicus
caagtcctgggacatacatgcacac

SEQ ID NO: 220665 - DNA, 25 bp, Rattus norvegicus
caagtcctgggagatacatgcacac

SEQ ID NO: 220666 - DNA, 25 bp, Rattus norvegicus
caagtcctgggcaatcatctggaat

SEQ ID NO: 220667 - DNA, 25 bp, Rattus norvegicus
caagtcctgggctatcatctggaat

SEQ ID NO: 220668 - DNA, 25 bp, Rattus norvegicus
caagtcctgggtaggtcctgggcca

SEQ ID NO: 220669 - DNA, 25 bp, Rattus norvegicus
caagtcctgggttggtcctgggcca

SEQ ID NO: 220670 - DNA, 25 bp, Rattus norvegicus
caagtccttcataagttgctgtgct

SEQ ID NO: 220671 - DNA, 25 bp, Rattus norvegicus
caagtccttcattagttgctgtgct

SEQ ID NO: 220672 - DNA, 25 bp, Rattus norvegicus
caagtcgcggtcaggactaagtcct

SEQ ID NO: 220673 - DNA, 25 bp, Rattus norvegicus
caagtcgcggtctggactaagtcct

SEQ ID NO: 220674 - DNA, 25 bp, Rattus norvegicus
caagtcggatgacaagtgatggttt

SEQ ID NO: 220675 - DNA, 25 bp, Rattus norvegicus
caagtcggatgagaagtgatggttt

SEQ ID NO: 220676 - DNA, 25 bp, Rattus norvegicus
caagtcggtgccaccagaaacaaga

SEQ ID NO: 220677 - DNA, 25 bp, Rattus norvegicus
caagtcggtgcctccagaaacaaga

SEQ ID NO: 220678 - DNA, 25 bp, Rattus norvegicus
caagtcggtggtcgctcgattcgat

SEQ ID NO: 220679 - DNA, 25 bp, Rattus norvegicus
caagtcggtggtggctcgattcgat

SEQ ID NO: 220680 - DNA, 25 bp, Rattus norvegicus
caagtcgtcagtctccaaggagctc

SEQ ID NO: 220681 - DNA, 25 bp, Rattus norvegicus
caagtcgtcagtgtccaaggagctc

SEQ ID NO: 220682 - DNA, 25 bp, Rattus norvegicus
caagtcgtcgctcgacaaatattgt

SEQ ID NO: 220683 - DNA, 25 bp, Rattus norvegicus
caagtcgtcgctggacaaatattgt

SEQ ID NO: 220684 - DNA, 25 bp, Rattus norvegicus
caagtctaccctactactctaaaga

SEQ ID NO: 220685 - DNA, 25 bp, Rattus norvegicus
caagtctacccttctactctaaaga

SEQ ID NO: 220686 - DNA, 25 bp, Rattus norvegicus
caagtctactttatatgtctgcgct

SEQ ID NO: 220687 - DNA, 25 bp, Rattus norvegicus
caagtctactttttatgtctgcgct

SEQ ID NO: 220688 - DNA, 25 bp, Rattus norvegicus
caagtctagaaaccggcgggaagtt

SEQ ID NO: 220689 - DNA, 25 bp, Rattus norvegicus
caagtctagaaagcggcgggaagtt

SEQ ID NO: 220690 - DNA, 25 bp, Rattus norvegicus
caagtctatgttaacgtttttgaga

SEQ ID NO: 220691 - DNA, 25 bp, Rattus norvegicus
caagtctatgtttacgtttttgaga

SEQ ID NO: 220692 - DNA, 25 bp, Rattus norvegicus
caagtctccccacaaagtcttacgg

SEQ ID NO: 220693 - DNA, 25 bp, Rattus norvegicus
caagtctccccagaaagtcttacgg

SEQ ID NO: 220694 - DNA, 25 bp, Rattus norvegicus
caagtctctggaacctctgatggag

SEQ ID NO: 220695 - DNA, 25 bp, Rattus norvegicus
caagtctctggatcctctgatggag

SEQ ID NO: 220696 - DNA, 25 bp, Rattus norvegicus
caagtctgactcctacttttggaaa

SEQ ID NO: 220697 - DNA, 25 bp, Rattus norvegicus
caagtctgactcgtacttttggaaa

SEQ ID NO: 220698 - DNA, 25 bp, Rattus norvegicus
caagtctgagatagaggtcatgtct

SEQ ID NO: 220699 - DNA, 25 bp, Rattus norvegicus
caagtctgagattgaggtcatgtct

SEQ ID NO: 220700 - DNA, 25 bp, Rattus norvegicus
caagtctgagccactgtctgtgtca

SEQ ID NO: 220701 - DNA, 25 bp, Rattus norvegicus
caagtctgagcctctgtctgtgtca

SEQ ID NO: 220702 - DNA, 25 bp, Rattus norvegicus
caagtctgatctattgtagatgcaa

SEQ ID NO: 220703 - DNA, 25 bp, Rattus norvegicus
caagtctgatcttttgtagatgcaa

SEQ ID NO: 220704 - DNA, 25 bp, Rattus norvegicus
caagtctgcaagctggccatttttc

SEQ ID NO: 220705 - DNA, 25 bp, Rattus norvegicus
caagtctgcaaggtggccatttttc

SEQ ID NO: 220706 - DNA, 25 bp, Rattus norvegicus
caagtctgccacacgactcagagga

SEQ ID NO: 220707 - DNA, 25 bp, Rattus norvegicus
caagtctgccactcgactcagagga

SEQ ID NO: 220708 - DNA, 25 bp, Rattus norvegicus
caagtctggcgcactgaactattta

SEQ ID NO: 220709 - DNA, 25 bp, Rattus norvegicus
caagtctggcgctctgaactattta

SEQ ID NO: 220710 - DNA, 25 bp, Rattus norvegicus
caagtctgtgacctgaactgtctta

SEQ ID NO: 220711 - DNA, 25 bp, Rattus norvegicus
caagtctgtgacgtgaactgtctta

SEQ ID NO: 220712 - DNA, 25 bp, Rattus norvegicus
caagtctgtgttccctgccattgta

SEQ ID NO: 220713 - DNA, 25 bp, Rattus norvegicus
caagtctgtgttgcctgccattgta

SEQ ID NO: 220714 - DNA, 25 bp, Rattus norvegicus
caagtctgttgtcagcggctgtgcc

SEQ ID NO: 220715 - DNA, 25 bp, Rattus norvegicus
caagtctgttgtgagcggctgtgcc

SEQ ID NO: 220716 - DNA, 25 bp, Rattus norvegicus
caagtcttccctctttcacaaggat

SEQ ID NO: 220717 - DNA, 25 bp, Rattus norvegicus
caagtcttccctgtttcacaaggat

SEQ ID NO: 220718 - DNA, 25 bp, Rattus norvegicus
caagtcttcctaaactgggctgcat

SEQ ID NO: 220719 - DNA, 25 bp, Rattus norvegicus
caagtcttcctatactgggctgcat

SEQ ID NO: 220720 - DNA, 25 bp, Rattus norvegicus
caagtctttaaacgctctggtcctc

SEQ ID NO: 220721 - DNA, 25 bp, Rattus norvegicus
caagtctttaaaggctctggtcctc

SEQ ID NO: 220722 - DNA, 25 bp, Rattus norvegicus
caagtctttacaactcatctggtca

SEQ ID NO: 220723 - DNA, 25 bp, Rattus norvegicus
caagtctttacatctcatctggtca

SEQ ID NO: 220724 - DNA, 25 bp, Rattus norvegicus
caagtctttccaccttttgagcagt

SEQ ID NO: 220725 - DNA, 25 bp, Rattus norvegicus
caagtctttccagcttttgagcagt

SEQ ID NO: 220726 - DNA, 25 bp, Rattus norvegicus
caagtctttgaccaccctgggaaag

SEQ ID NO: 220727 - DNA, 25 bp, Rattus norvegicus
caagtctttgacgaccctgggaaag

SEQ ID NO: 220728 - DNA, 25 bp, Rattus norvegicus
caagtctttttgagtttccctgctg

SEQ ID NO: 220729 - DNA, 25 bp, Rattus norvegicus
caagtctttttgtgtttccctgctg

SEQ ID NO: 220730 - DNA, 25 bp, Rattus norvegicus
caagtgaccagaacactgtgatcca

SEQ ID NO: 220731 - DNA, 25 bp, Rattus norvegicus
caagtgaccagatcactgtgatcca

SEQ ID NO: 220732 - DNA, 25 bp, Rattus norvegicus
caagtgacctgcctagtgaactcag

SEQ ID NO: 220733 - DNA, 25 bp, Rattus norvegicus
caagtgacctgcgtagtgaactcag

SEQ ID NO: 220734 - DNA, 25 bp, Rattus norvegicus
caagtgacgttcacattctttcaaa

SEQ ID NO: 220735 - DNA, 25 bp, Rattus norvegicus
caagtgacgttctcattctttcaaa

SEQ ID NO: 220736 - DNA, 25 bp, Rattus norvegicus
caagtgacttagaaatttacaaggc

SEQ ID NO: 220737 - DNA, 25 bp, Rattus norvegicus
caagtgacttagtaatttacaaggc

SEQ ID NO: 220738 - DNA, 25 bp, Rattus norvegicus
caagtgagaagtagattggccttta

SEQ ID NO: 220739 - DNA, 25 bp, Rattus norvegicus
caagtgagaagttgattggccttta

SEQ ID NO: 220740 - DNA, 25 bp, Rattus norvegicus
caagtgatcaggagcaaggtgtcta

SEQ ID NO: 220741 - DNA, 25 bp, Rattus norvegicus
caagtgatcaggtgcaaggtgtcta

SEQ ID NO: 220742 - DNA, 25 bp, Rattus norvegicus
caagtgatggttagtcatgagtcgt

SEQ ID NO: 220743 - DNA, 25 bp, Rattus norvegicus
caagtgatggtttgtcatgagtcgt

SEQ ID NO: 220744 - DNA, 25 bp, Rattus norvegicus
caagtgcaatcacactgtggcagct

SEQ ID NO: 220745 - DNA, 25 bp, Rattus norvegicus
caagtgcaatcagactgtggcagct

SEQ ID NO: 220746 - DNA, 25 bp, Rattus norvegicus
caagtgcacgtgctgtgcctgaagt

SEQ ID NO: 220747 - DNA, 25 bp, Rattus norvegicus
caagtgcacgtggtgtgcctgaagt

SEQ ID NO: 220748 - DNA, 25 bp, Rattus norvegicus
caagtgccctccaggttgaagaaca

SEQ ID NO: 220749 - DNA, 25 bp, Rattus norvegicus
caagtgccctcctggttgaagaaca

SEQ ID NO: 220750 - DNA, 25 bp, Rattus norvegicus
caagtgccttaaaagtagggtaagt

SEQ ID NO: 220751 - DNA, 25 bp, Rattus norvegicus
caagtgccttaatagtagggtaagt

SEQ ID NO: 220752 - DNA, 25 bp, Rattus norvegicus
caagtgccttttcgattgtctgaaa

SEQ ID NO: 220753 - DNA, 25 bp, Rattus norvegicus
caagtgccttttggattgtctgaaa

SEQ ID NO: 220754 - DNA, 25 bp, Rattus norvegicus
caagtgcgagccatcagacgtggat

SEQ ID NO: 220755 - DNA, 25 bp, Rattus norvegicus
caagtgcgagccttcagacgtggat

SEQ ID NO: 220756 - DNA, 25 bp, Rattus norvegicus
caagtgcgcgctcaacgaggcctgc

SEQ ID NO: 220757 - DNA, 25 bp, Rattus norvegicus
caagtgcgcgctgaacgaggcctgc

SEQ ID NO: 220758 - DNA, 25 bp, Rattus norvegicus
caagtgcggaacaggacgctctgga

SEQ ID NO: 220759 - DNA, 25 bp, Rattus norvegicus
caagtgcggaactggacgctctgga

SEQ ID NO: 220760 - DNA, 25 bp, Rattus norvegicus
caagtgctagttaaaatgcctgtca

SEQ ID NO: 220761 - DNA, 25 bp, Rattus norvegicus
caagtgctagtttaaatgcctgtca

SEQ ID NO: 220762 - DNA, 25 bp, Rattus norvegicus
caagtgctcactcggcatcgatgct

SEQ ID NO: 220763 - DNA, 25 bp, Rattus norvegicus
caagtgctcactgggcatcgatgct

SEQ ID NO: 220764 - DNA, 25 bp, Rattus norvegicus
caagtgctctttaggcagtttgtct

SEQ ID NO: 220765 - DNA, 25 bp, Rattus norvegicus
caagtgctcttttggcagtttgtct

SEQ ID NO: 220766 - DNA, 25 bp, Rattus norvegicus
caagtgctgaatctgttgaatgtca

SEQ ID NO: 220767 - DNA, 25 bp, Rattus norvegicus
caagtgctgaatgtgttgaatgtca

SEQ ID NO: 220768 - DNA, 25 bp, Rattus norvegicus
caagtgctgatgctgtgtgctctaa

SEQ ID NO: 220769 - DNA, 25 bp, Rattus norvegicus
caagtgctgatggtgtgtgctctaa

SEQ ID NO: 220770 - DNA, 25 bp, Rattus norvegicus
caagtgctgattcatgcccgtgact

SEQ ID NO: 220771 - DNA, 25 bp, Rattus norvegicus
caagtgctgattgatgcccgtgact

SEQ ID NO: 220772 - DNA, 25 bp, Rattus norvegicus
caagtgctggtcagttcttttcaac

SEQ ID NO: 220773 - DNA, 25 bp, Rattus norvegicus
caagtgctggtctgttcttttcaac

SEQ ID NO: 220774 - DNA, 25 bp, Rattus norvegicus
caagtgctgtctctcgttggagaca

SEQ ID NO: 220775 - DNA, 25 bp, Rattus norvegicus
caagtgctgtctgtcgttggagaca

SEQ ID NO: 220776 - DNA, 25 bp, Rattus norvegicus
caagtgctgtgacgcacattccctc

SEQ ID NO: 220777 - DNA, 25 bp, Rattus norvegicus
caagtgctgtgaggcacattccctc

SEQ ID NO: 220778 - DNA, 25 bp, Rattus norvegicus
caagtgcttaagaaggtcggaaccg

SEQ ID NO: 220779 - DNA, 25 bp, Rattus norvegicus
caagtgcttaagtaggtcggaaccg

SEQ ID NO: 220780 - DNA, 25 bp, Rattus norvegicus
caagtggacctgatgttcaacaagt

SEQ ID NO: 220781 - DNA, 25 bp, Rattus norvegicus
caagtggacctgttgttcaacaagt

SEQ ID NO: 220782 - DNA, 25 bp, Rattus norvegicus
caagtggagcacagcacctccagga

SEQ ID NO: 220783 - DNA, 25 bp, Rattus norvegicus
caagtggagcactgcacctccagga

SEQ ID NO: 220784 - DNA, 25 bp, Rattus norvegicus
caagtggaggttacatgtctggtca

SEQ ID NO: 220785 - DNA, 25 bp, Rattus norvegicus
caagtggaggtttcatgtctggtca

SEQ ID NO: 220786 - DNA, 25 bp, Rattus norvegicus
caagtggcaggactctcaccagctg

SEQ ID NO: 220787 - DNA, 25 bp, Rattus norvegicus
caagtggcaggagtctcaccagctg

SEQ ID NO: 220788 - DNA, 25 bp, Rattus norvegicus
caagtggccttgctttcattttgaa

SEQ ID NO: 220789 - DNA, 25 bp, Rattus norvegicus
caagtggccttggtttcattttgaa

SEQ ID NO: 220790 - DNA, 25 bp, Rattus norvegicus
caagtggctattactacgctcagtg

SEQ ID NO: 220791 - DNA, 25 bp, Rattus norvegicus
caagtggctatttctacgctcagtg

SEQ ID NO: 220792 - DNA, 25 bp, Rattus norvegicus
caagtggctccacccctagagggta

SEQ ID NO: 220793 - DNA, 25 bp, Rattus norvegicus
caagtggctccagccctagagggta

SEQ ID NO: 220794 - DNA, 25 bp, Rattus norvegicus
caagtggctgatagattgcctagca

SEQ ID NO: 220795 - DNA, 25 bp, Rattus norvegicus
caagtggctgattgattgcctagca

SEQ ID NO: 220796 - DNA, 25 bp, Rattus norvegicus
caagtgggcggtaagcatagcatat

SEQ ID NO: 220797 - DNA, 25 bp, Rattus norvegicus
caagtgggcggttagcatagcatat

SEQ ID NO: 220798 - DNA, 25 bp, Rattus norvegicus
caagtgggcttacctttctctcaga

SEQ ID NO: 220799 - DNA, 25 bp, Rattus norvegicus
caagtgggcttagctttctctcaga

SEQ ID NO: 220800 - DNA, 25 bp, Rattus norvegicus
caagtgggtagacctgctgccgacc

SEQ ID NO: 220801 - DNA, 25 bp, Rattus norvegicus
caagtgggtagagctgctgccgacc

SEQ ID NO: 220802 - DNA, 25 bp, Rattus norvegicus
caagtgggtgtcactgtgtagcctg

SEQ ID NO: 220803 - DNA, 25 bp, Rattus norvegicus
caagtgggtgtctctgtgtagcctg

SEQ ID NO: 220804 - DNA, 25 bp, Rattus norvegicus
caagtggtagccataatggtcacac

SEQ ID NO: 220805 - DNA, 25 bp, Rattus norvegicus
caagtggtagccttaatggtcacac

SEQ ID NO: 220806 - DNA, 25 bp, Rattus norvegicus
caagtggtagcgagtagggttctct

SEQ ID NO: 220807 - DNA, 25 bp, Rattus norvegicus
caagtggtagcgtgtagggttctct

SEQ ID NO: 220808 - DNA, 25 bp, Rattus norvegicus
caagtggtatggctgatttctctgt

SEQ ID NO: 220809 - DNA, 25 bp, Rattus norvegicus
caagtggtatgggtgatttctctgt

SEQ ID NO: 220810 - DNA, 25 bp, Rattus norvegicus
caagtggtccttcgaagccaggcaa

SEQ ID NO: 220811 - DNA, 25 bp, Rattus norvegicus
caagtggtccttggaagccaggcaa

SEQ ID NO: 220812 - DNA, 25 bp, Rattus norvegicus
caagtggttctaataactgtcaccc

SEQ ID NO: 220813 - DNA, 25 bp, Rattus norvegicus
caagtggttctattaactgtcaccc

SEQ ID NO: 220814 - DNA, 25 bp, Rattus norvegicus
caagtggttctgagtcgaggattac

SEQ ID NO: 220815 - DNA, 25 bp, Rattus norvegicus
caagtggttctgtgtcgaggattac

SEQ ID NO: 220816 - DNA, 25 bp, Rattus norvegicus
caagtgtaccataaccccgaggatc

SEQ ID NO: 220817 - DNA, 25 bp, Rattus norvegicus
caagtgtaccattaccccgaggatc

SEQ ID NO: 220818 - DNA, 25 bp, Rattus norvegicus
caagtgtaggaactctcagaaggct

SEQ ID NO: 220819 - DNA, 25 bp, Rattus norvegicus
caagtgtaggaagtctcagaaggct

SEQ ID NO: 220820 - DNA, 25 bp, Rattus norvegicus
caagtgtagtccagcttttgcttct

SEQ ID NO: 220821 - DNA, 25 bp, Rattus norvegicus
caagtgtagtcctgcttttgcttct

SEQ ID NO: 220822 - DNA, 25 bp, Rattus norvegicus
caagtgtatactctgggcctaggag

SEQ ID NO: 220823 - DNA, 25 bp, Rattus norvegicus
caagtgtatactgtgggcctaggag

SEQ ID NO: 220824 - DNA, 25 bp, Rattus norvegicus
caagtgtcacatcctttggttgagt

SEQ ID NO: 220825 - DNA, 25 bp, Rattus norvegicus
caagtgtcacatgctttggttgagt

SEQ ID NO: 220826 - DNA, 25 bp, Rattus norvegicus
caagtgtcacttctacagctccgtc

SEQ ID NO: 220827 - DNA, 25 bp, Rattus norvegicus
caagtgtcacttgtacagctccgtc

SEQ ID NO: 220828 - DNA, 25 bp, Rattus norvegicus
caagtgtcattgacaggcatctgtc

SEQ ID NO: 220829 - DNA, 25 bp, Rattus norvegicus
caagtgtcattgtcaggcatctgtc

SEQ ID NO: 220830 - DNA, 25 bp, Rattus norvegicus
caagtgtccctgaagtctcatcaag

SEQ ID NO: 220831 - DNA, 25 bp, Rattus norvegicus
caagtgtccctgtagtctcatcaag

SEQ ID NO: 220832 - DNA, 25 bp, Rattus norvegicus
caagtgtcgggtactgagttctcat

SEQ ID NO: 220833 - DNA, 25 bp, Rattus norvegicus
caagtgtcgggttctgagttctcat

SEQ ID NO: 220834 - DNA, 25 bp, Rattus norvegicus
caagtgtctataagccatttgcggc

SEQ ID NO: 220835 - DNA, 25 bp, Rattus norvegicus
caagtgtctatatgccatttgcggc

SEQ ID NO: 220836 - DNA, 25 bp, Rattus norvegicus
caagtgtctgagacctgtactgtct

SEQ ID NO: 220837 - DNA, 25 bp, Rattus norvegicus
caagtgtctgagtcctgtactgtct

SEQ ID NO: 220838 - DNA, 25 bp, Rattus norvegicus
caagtgtctgctaacattcagggat

SEQ ID NO: 220839 - DNA, 25 bp, Rattus norvegicus
caagtgtctgcttacattcagggat

SEQ ID NO: 220840 - DNA, 25 bp, Rattus norvegicus
caagtgtctggacgagttttacgca

SEQ ID NO: 220841 - DNA, 25 bp, Rattus norvegicus
caagtgtctggaggagttttacgca

SEQ ID NO: 220842 - DNA, 25 bp, Rattus norvegicus
caagtgtctgggaccacttcagtct

SEQ ID NO: 220843 - DNA, 25 bp, Rattus norvegicus
caagtgtctgggtccacttcagtct

SEQ ID NO: 220844 - DNA, 25 bp, Rattus norvegicus
caagtgtctgttaagggccacggat

SEQ ID NO: 220845 - DNA, 25 bp, Rattus norvegicus
caagtgtctgtttagggccacggat

SEQ ID NO: 220846 - DNA, 25 bp, Rattus norvegicus
caagtgtgaaggagccagcctgcaa

SEQ ID NO: 220847 - DNA, 25 bp, Rattus norvegicus
caagtgtgaaggtgccagcctgcaa

SEQ ID NO: 220848 - DNA, 25 bp, Rattus norvegicus
caagtgtgacttaagctggtagctc

SEQ ID NO: 220849 - DNA, 25 bp, Rattus norvegicus
caagtgtgactttagctggtagctc

SEQ ID NO: 220850 - DNA, 25 bp, Rattus norvegicus
caagtgtgcactcagaaatttatct

SEQ ID NO: 220851 - DNA, 25 bp, Rattus norvegicus
caagtgtgcactgagaaatttatct

SEQ ID NO: 220852 - DNA, 25 bp, Rattus norvegicus
caagtgtgccagatacttttcttgt

SEQ ID NO: 220853 - DNA, 25 bp, Rattus norvegicus
caagtgtgccagttacttttcttgt

SEQ ID NO: 220854 - DNA, 25 bp, Rattus norvegicus
caagtgtggcagcaactgtatgcgt

SEQ ID NO: 220855 - DNA, 25 bp, Rattus norvegicus
caagtgtggcaggaactgtatgcgt

SEQ ID NO: 220856 - DNA, 25 bp, Rattus norvegicus
caagtgtggcctagcgtgtctgcaa

SEQ ID NO: 220857 - DNA, 25 bp, Rattus norvegicus
caagtgtggccttgcgtgtctgcaa

SEQ ID NO: 220858 - DNA, 25 bp, Rattus norvegicus
caagtgtgggcgactgcagagaaat

SEQ ID NO: 220859 - DNA, 25 bp, Rattus norvegicus
caagtgtgggcgtctgcagagaaat

SEQ ID NO: 220860 - DNA, 25 bp, Rattus norvegicus
caagtgtgggctcctcctactagag

SEQ ID NO: 220861 - DNA, 25 bp, Rattus norvegicus
caagtgtgggctgctcctactagag

SEQ ID NO: 220862 - DNA, 25 bp, Rattus norvegicus
caagtgtgtatacccttccacggat

SEQ ID NO: 220863 - DNA, 25 bp, Rattus norvegicus
caagtgtgtatagccttccacggat

SEQ ID NO: 220864 - DNA, 25 bp, Rattus norvegicus
caagtgtgtctgaatacgtgttcta

SEQ ID NO: 220865 - DNA, 25 bp, Rattus norvegicus
caagtgtgtctgtatacgtgttcta

SEQ ID NO: 220866 - DNA, 25 bp, Rattus norvegicus
caagtgtgtgttaacgggacgcctc

SEQ ID NO: 220867 - DNA, 25 bp, Rattus norvegicus
caagtgtgtgtttacgggacgcctc

SEQ ID NO: 220868 - DNA, 25 bp, Rattus norvegicus
caagtgtgttggattctgtggtaga

SEQ ID NO: 220869 - DNA, 25 bp, Rattus norvegicus
caagtgtgttggtttctgtggtaga

SEQ ID NO: 220870 - DNA, 25 bp, Rattus norvegicus
caagtgttagacctgtgtgtgcgtt

SEQ ID NO: 220871 - DNA, 25 bp, Rattus norvegicus
caagtgttagacgtgtgtgtgcgtt

SEQ ID NO: 220872 - DNA, 25 bp, Rattus norvegicus
caagtgttcactcgccacatggaga

SEQ ID NO: 220873 - DNA, 25 bp, Rattus norvegicus
caagtgttcactggccacatggaga

SEQ ID NO: 220874 - DNA, 25 bp, Rattus norvegicus
caagtgttcagtatttctcttcccc

SEQ ID NO: 220875 - DNA, 25 bp, Rattus norvegicus
caagtgttcagtttttctcttcccc

SEQ ID NO: 220876 - DNA, 25 bp, Rattus norvegicus
caagtgttcatcatccacgaattgg

SEQ ID NO: 220877 - DNA, 25 bp, Rattus norvegicus
caagtgttcatcttccacgaattgg

SEQ ID NO: 220878 - DNA, 25 bp, Rattus norvegicus
caagtgttccctctggctgtgagga

SEQ ID NO: 220879 - DNA, 25 bp, Rattus norvegicus
caagtgttccctgtggctgtgagga

SEQ ID NO: 220880 - DNA, 25 bp, Rattus norvegicus
caagtgttgatgcagcagcagcaaa

SEQ ID NO: 220881 - DNA, 25 bp, Rattus norvegicus
caagtgttgatggagcagcagcaaa

SEQ ID NO: 220882 - DNA, 25 bp, Rattus norvegicus
caagtgttgcaacggttctgcctct

SEQ ID NO: 220883 - DNA, 25 bp, Rattus norvegicus
caagtgttgcaagggttctgcctct

SEQ ID NO: 220884 - DNA, 25 bp, Rattus norvegicus
caagtgtttctgagaatggttgagc

SEQ ID NO: 220885 - DNA, 25 bp, Rattus norvegicus
caagtgtttctgtgaatggttgagc

SEQ ID NO: 220886 - DNA, 25 bp, Rattus norvegicus
caagtgtttgagatcactgaaccga

SEQ ID NO: 220887 - DNA, 25 bp, Rattus norvegicus
caagtgtttgagttcactgaaccga

SEQ ID NO: 220888 - DNA, 25 bp, Rattus norvegicus
caagtgtttgttaccagtatgaagt

SEQ ID NO: 220889 - DNA, 25 bp, Rattus norvegicus
caagtgtttgtttccagtatgaagt

SEQ ID NO: 220890 - DNA, 25 bp, Rattus norvegicus
caagttaactccaccaagttgtcct

SEQ ID NO: 220891 - DNA, 25 bp, Rattus norvegicus
caagttaactcctccaagttgtcct

SEQ ID NO: 220892 - DNA, 25 bp, Rattus norvegicus
caagttaactctaacatgacccatg

SEQ ID NO: 220893 - DNA, 25 bp, Rattus norvegicus
caagttaactcttacatgacccatg

SEQ ID NO: 220894 - DNA, 25 bp, Rattus norvegicus
caagttaactgcaccccttggtata

SEQ ID NO: 220895 - DNA, 25 bp, Rattus norvegicus
caagttaactgctccccttggtata

SEQ ID NO: 220896 - DNA, 25 bp, Rattus norvegicus
caagttaccctccatgacaacaatg

SEQ ID NO: 220897 - DNA, 25 bp, Rattus norvegicus
caagttaccctcgatgacaacaatg

SEQ ID NO: 220898 - DNA, 25 bp, Rattus norvegicus
caagttacggttcagcattgcagta

SEQ ID NO: 220899 - DNA, 25 bp, Rattus norvegicus
caagttacggttgagcattgcagta

SEQ ID NO: 220900 - DNA, 25 bp, Rattus norvegicus
caagttactcccctgagatccagga

SEQ ID NO: 220901 - DNA, 25 bp, Rattus norvegicus
caagttactcccgtgagatccagga

SEQ ID NO: 220902 - DNA, 25 bp, Rattus norvegicus
caagttagacttaccattgggcagt

SEQ ID NO: 220903 - DNA, 25 bp, Rattus norvegicus
caagttagactttccattgggcagt

SEQ ID NO: 220904 - DNA, 25 bp, Rattus norvegicus
caagttaggatgatctgcgtcagat

SEQ ID NO: 220905 - DNA, 25 bp, Rattus norvegicus
caagttaggatgttctgcgtcagat

SEQ ID NO: 220906 - DNA, 25 bp, Rattus norvegicus
caagttagggccacaccagttttag

SEQ ID NO: 220907 - DNA, 25 bp, Rattus norvegicus
caagttagggcctcaccagttttag

SEQ ID NO: 220908 - DNA, 25 bp, Rattus norvegicus
caagttataccacaaatgcagcctg

SEQ ID NO: 220909 - DNA, 25 bp, Rattus norvegicus
caagttataccagaaatgcagcctg

SEQ ID NO: 220910 - DNA, 25 bp, Rattus norvegicus
caagttcaaaataagcctgggcttc

SEQ ID NO: 220911 - DNA, 25 bp, Rattus norvegicus
caagttcaaaattagcctgggcttc

SEQ ID NO: 220912 - DNA, 25 bp, Rattus norvegicus
caagttcaacggcacagtcaaggct

SEQ ID NO: 220913 - DNA, 25 bp, Rattus norvegicus
caagttcaacgggacagtcaaggct

SEQ ID NO: 220914 - DNA, 25 bp, Rattus norvegicus
caagttcaactcacaggactcgtgt

SEQ ID NO: 220915 - DNA, 25 bp, Rattus norvegicus
caagttcaactctcaggactcgtgt

SEQ ID NO: 220916 - DNA, 25 bp, Rattus norvegicus
caagttcaagctcgtgtccctcggt

SEQ ID NO: 220917 - DNA, 25 bp, Rattus norvegicus
caagttcaagctggtgtccctcggt

SEQ ID NO: 220918 - DNA, 25 bp, Rattus norvegicus
caagttcactctccgtgtacatacg

SEQ ID NO: 220919 - DNA, 25 bp, Rattus norvegicus
caagttcactctgcgtgtacatacg

SEQ ID NO: 220920 - DNA, 25 bp, Rattus norvegicus
caagttcaggacagctacaagtaca

SEQ ID NO: 220921 - DNA, 25 bp, Rattus norvegicus
caagttcaggactgctacaagtaca

SEQ ID NO: 220922 - DNA, 25 bp, Rattus norvegicus
caagttcaggcaagcttaccttctg

SEQ ID NO: 220923 - DNA, 25 bp, Rattus norvegicus
caagttcaggcatgcttaccttctg

SEQ ID NO: 220924 - DNA, 25 bp, Rattus norvegicus
caagttccagagcaaatgggagcca

SEQ ID NO: 220925 - DNA, 25 bp, Rattus norvegicus
caagttccagaggaaatgggagcca

SEQ ID NO: 220926 - DNA, 25 bp, Rattus norvegicus
caagttccagccactaactgcagaa

SEQ ID NO: 220927 - DNA, 25 bp, Rattus norvegicus
caagttccagcctctaactgcagaa

SEQ ID NO: 220928 - DNA, 25 bp, Rattus norvegicus
caagttcctattcgctttggtgctt

SEQ ID NO: 220929 - DNA, 25 bp, Rattus norvegicus
caagttcctattggctttggtgctt

SEQ ID NO: 220930 - DNA, 25 bp, Rattus norvegicus
caagttcctggaagctcttgtgtca

SEQ ID NO: 220931 - DNA, 25 bp, Rattus norvegicus
caagttcctggatgctcttgtgtca

SEQ ID NO: 220932 - DNA, 25 bp, Rattus norvegicus
caagttcctttgattcagaggaaag

SEQ ID NO: 220933 - DNA, 25 bp, Rattus norvegicus
caagttcctttgtttcagaggaaag

SEQ ID NO: 220934 - DNA, 25 bp, Rattus norvegicus
caagttcgaccccaacgagatcaaa

SEQ ID NO: 220935 - DNA, 25 bp, Rattus norvegicus
caagttcgacccgaacgagatcaaa

SEQ ID NO: 220936 - DNA, 25 bp, Rattus norvegicus
caagttcgtggcagaggacctttcc

SEQ ID NO: 220937 - DNA, 25 bp, Rattus norvegicus
caagttcgtggctgaggacctttcc

SEQ ID NO: 220938 - DNA, 25 bp, Rattus norvegicus
caagttcgtgggacagtctgttcct

SEQ ID NO: 220939 - DNA, 25 bp, Rattus norvegicus
caagttcgtgggtcagtctgttcct

SEQ ID NO: 220940 - DNA, 25 bp, Rattus norvegicus
caagttctatctcggtgttctggta

SEQ ID NO: 220941 - DNA, 25 bp, Rattus norvegicus
caagttctatctgggtgttctggta

SEQ ID NO: 220942 - DNA, 25 bp, Rattus norvegicus
caagttctgatgactgctaaaggat

SEQ ID NO: 220943 - DNA, 25 bp, Rattus norvegicus
caagttctgatgtctgctaaaggat

SEQ ID NO: 220944 - DNA, 25 bp, Rattus norvegicus
caagttctgtttccagtcccataac

SEQ ID NO: 220945 - DNA, 25 bp, Rattus norvegicus
caagttctgtttgcagtcccataac

SEQ ID NO: 220946 - DNA, 25 bp, Rattus norvegicus
caagttcttagtcgctgtgtgtctg

SEQ ID NO: 220947 - DNA, 25 bp, Rattus norvegicus
caagttcttagtggctgtgtgtctg

SEQ ID NO: 220948 - DNA, 25 bp, Rattus norvegicus
caagttctttctaaaggactggtga

SEQ ID NO: 220949 - DNA, 25 bp, Rattus norvegicus
caagttctttcttaaggactggtga

SEQ ID NO: 220950 - DNA, 25 bp, Rattus norvegicus
caagttgaagctcccgtcttcatct

SEQ ID NO: 220951 - DNA, 25 bp, Rattus norvegicus
caagttgaagctgccgtcttcatct

SEQ ID NO: 220952 - DNA, 25 bp, Rattus norvegicus
caagttgaagtcatgcttcctgttc

SEQ ID NO: 220953 - DNA, 25 bp, Rattus norvegicus
caagttgaagtcttgcttcctgttc

SEQ ID NO: 220954 - DNA, 25 bp, Rattus norvegicus
caagttgcaactatctagagacaga

SEQ ID NO: 220955 - DNA, 25 bp, Rattus norvegicus
caagttgcaactttctagagacaga

SEQ ID NO: 220956 - DNA, 25 bp, Rattus norvegicus
caagttgcaggaccgttctgacctt

SEQ ID NO: 220957 - DNA, 25 bp, Rattus norvegicus
caagttgcaggagcgttctgacctt

SEQ ID NO: 220958 - DNA, 25 bp, Rattus norvegicus
caagttgcccaacatctcacgagaa

SEQ ID NO: 220959 - DNA, 25 bp, Rattus norvegicus
caagttgcccaactcaggtcatggc

SEQ ID NO: 220960 - DNA, 25 bp, Rattus norvegicus
caagttgcccaagatctcacgagaa

SEQ ID NO: 220961 - DNA, 25 bp, Rattus norvegicus
caagttgcccaagtcaggtcatggc

SEQ ID NO: 220962 - DNA, 25 bp, Rattus norvegicus
caagttgcccgcagagtgcgtgctg

SEQ ID NO: 220963 - DNA, 25 bp, Rattus norvegicus
caagttgcccgctgagtgcgtgctg

SEQ ID NO: 220964 - DNA, 25 bp, Rattus norvegicus
caagttgcccgtaccagaagtctaa

SEQ ID NO: 220965 - DNA, 25 bp, Rattus norvegicus
caagttgcccgttccagaagtctaa

SEQ ID NO: 220966 - DNA, 25 bp, Rattus norvegicus
caagttgcgcgcagtggaggctcaa

SEQ ID NO: 220967 - DNA, 25 bp, Rattus norvegicus
caagttgcgcgctgtggaggctcaa

SEQ ID NO: 220968 - DNA, 25 bp, Rattus norvegicus
caagttgctctgacttttggtttta

SEQ ID NO: 220969 - DNA, 25 bp, Rattus norvegicus
caagttgctctgtcttttggtttta

SEQ ID NO: 220970 - DNA, 25 bp, Rattus norvegicus
caagttgctttcctaacccctcagt

SEQ ID NO: 220971 - DNA, 25 bp, Rattus norvegicus
caagttgctttcgtaacccctcagt

SEQ ID NO: 220972 - DNA, 25 bp, Rattus norvegicus
caagttggcttacagtagagctgct

SEQ ID NO: 220973 - DNA, 25 bp, Rattus norvegicus
caagttggcttagagtagagctgct

SEQ ID NO: 220974 - DNA, 25 bp, Rattus norvegicus
caagttggtgtcaggattcattcat

SEQ ID NO: 220975 - DNA, 25 bp, Rattus norvegicus
caagttggtgtctggattcattcat

SEQ ID NO: 220976 - DNA, 25 bp, Rattus norvegicus
caagttgtacaaaatctccctctgc

SEQ ID NO: 220977 - DNA, 25 bp, Rattus norvegicus
caagttgtacaatatctccctctgc

SEQ ID NO: 220978 - DNA, 25 bp, Rattus norvegicus
caagttgtagctaattttcctgtcc

SEQ ID NO: 220979 - DNA, 25 bp, Rattus norvegicus
caagttgtagcttattttcctgtcc

SEQ ID NO: 220980 - DNA, 25 bp, Rattus norvegicus
caagttgtccctagcaaaaccgctg

SEQ ID NO: 220981 - DNA, 25 bp, Rattus norvegicus
caagttgtcccttgcaaaaccgctg

SEQ ID NO: 220982 - DNA, 25 bp, Rattus norvegicus
caagttgtccggcagctttatgtat

SEQ ID NO: 220983 - DNA, 25 bp, Rattus norvegicus
caagttgtccgggagctttatgtat

SEQ ID NO: 220984 - DNA, 25 bp, Rattus norvegicus
caagttgtgagtcaccacgaatgct

SEQ ID NO: 220985 - DNA, 25 bp, Rattus norvegicus
caagttgtgagtgaccacgaatgct

SEQ ID NO: 220986 - DNA, 25 bp, Rattus norvegicus
caagttgtgtgtcgtttcatgctgc

SEQ ID NO: 220987 - DNA, 25 bp, Rattus norvegicus
caagttgtgtgtggtttcatgctgc

SEQ ID NO: 220988 - DNA, 25 bp, Rattus norvegicus
caagttgtgttccaggtgacatcca

SEQ ID NO: 220989 - DNA, 25 bp, Rattus norvegicus
caagttgtgttcctggtgcaccaaa

SEQ ID NO: 220990 - DNA, 25 bp, Rattus norvegicus
caagttgtgttcgaggtgacatcca

SEQ ID NO: 220991 - DNA, 25 bp, Rattus norvegicus
caagttgtgttcgtggtgcaccaaa

SEQ ID NO: 220992 - DNA, 25 bp, Rattus norvegicus
caagttgtgtttactgtacagcggg

SEQ ID NO: 220993 - DNA, 25 bp, Rattus norvegicus
caagttgtgttttctgtacagcggg

SEQ ID NO: 220994 - DNA, 25 bp, Rattus norvegicus
caagttgttcaccttcttgtttaag

SEQ ID NO: 220995 - DNA, 25 bp, Rattus norvegicus
caagttgttcacgttcttgtttaag

SEQ ID NO: 220996 - DNA, 25 bp, Rattus norvegicus
caagttgttgttcaagctgcctctg

SEQ ID NO: 220997 - DNA, 25 bp, Rattus norvegicus
caagttgttgttgaagctgcctctg

SEQ ID NO: 220998 - DNA, 25 bp, Rattus norvegicus
caagtttaagatccccttgggctca

SEQ ID NO: 220999 - DNA, 25 bp, Rattus norvegicus
caagtttaagatgcccttgggctca

SEQ ID NO: 221000 - DNA, 25 bp, Rattus norvegicus
caagtttactccatctgttctgagt

SEQ ID NO: 221001 - DNA, 25 bp, Rattus norvegicus
caagtttactccttctgttctgagt

SEQ ID NO: 221002 - DNA, 25 bp, Rattus norvegicus
caagtttatcctactgccgaagcag

SEQ ID NO: 221003 - DNA, 25 bp, Rattus norvegicus
caagtttatccttctgccgaagcag

SEQ ID NO: 221004 - DNA, 25 bp, Rattus norvegicus
caagtttatgccatcaagtttggtt

SEQ ID NO: 221005 - DNA, 25 bp, Rattus norvegicus
caagtttatgccttcaagtttggtt

SEQ ID NO: 221006 - DNA, 25 bp, Rattus norvegicus
caagtttcaaacagctcaagtggga

SEQ ID NO: 221007 - DNA, 25 bp, Rattus norvegicus
caagtttcaaactgctcaagtggga

SEQ ID NO: 221008 - DNA, 25 bp, Rattus norvegicus
caagtttcactgctcctgagtgggt

SEQ ID NO: 221009 - DNA, 25 bp, Rattus norvegicus
caagtttcactggtcctgagtgggt

SEQ ID NO: 221010 - DNA, 25 bp, Rattus norvegicus
caagtttcctggctagatccggtaa

SEQ ID NO: 221011 - DNA, 25 bp, Rattus norvegicus
caagtttcctgggtagatccggtaa

SEQ ID NO: 221012 - DNA, 25 bp, Rattus norvegicus
caagtttcgatgcaaggttgtggac

SEQ ID NO: 221013 - DNA, 25 bp, Rattus norvegicus
caagtttcgatggaaggttgtggac

SEQ ID NO: 221014 - DNA, 25 bp, Rattus norvegicus
caagtttctctcaaatcggctgcat

SEQ ID NO: 221015 - DNA, 25 bp, Rattus norvegicus
caagtttctctctaatcggctgcat

SEQ ID NO: 221016 - DNA, 25 bp, Rattus norvegicus
caagtttctcttatttatgctggta

SEQ ID NO: 221017 - DNA, 25 bp, Rattus norvegicus
caagtttctcttctatacagtcaca

SEQ ID NO: 221018 - DNA, 25 bp, Rattus norvegicus
caagtttctcttgtatacagtcaca

SEQ ID NO: 221019 - DNA, 25 bp, Rattus norvegicus
caagtttctcttttttatgctggta

SEQ ID NO: 221020 - DNA, 25 bp, Rattus norvegicus
caagtttctgtcatgttctctccat

SEQ ID NO: 221021 - DNA, 25 bp, Rattus norvegicus
caagtttctgtcttgttctctccat

SEQ ID NO: 221022 - DNA, 25 bp, Rattus norvegicus
caagtttctgttactatttctagct

SEQ ID NO: 221023 - DNA, 25 bp, Rattus norvegicus
caagtttctgttcgtgggacttcca

SEQ ID NO: 221024 - DNA, 25 bp, Rattus norvegicus
caagtttctgttggtgggacttcca

SEQ ID NO: 221025 - DNA, 25 bp, Rattus norvegicus
caagtttctgtttctatttctagct

SEQ ID NO: 221026 - DNA, 25 bp, Rattus norvegicus
caagtttgaggtattgtccctggct

SEQ ID NO: 221027 - DNA, 25 bp, Rattus norvegicus
caagtttgaggttttgtccctggct

SEQ ID NO: 221028 - DNA, 25 bp, Rattus norvegicus
caagtttgggttacgcttcgacatc

SEQ ID NO: 221029 - DNA, 25 bp, Rattus norvegicus
caagtttgggtttcgcttcgacatc

SEQ ID NO: 221030 - DNA, 25 bp, Rattus norvegicus
caagtttgtggactcttcggtgttg

SEQ ID NO: 221031 - DNA, 25 bp, Rattus norvegicus
caagtttgtggagtcttcggtgttg

SEQ ID NO: 221032 - DNA, 25 bp, Rattus norvegicus
caagtttgtgtacaccctgaagtgt

SEQ ID NO: 221033 - DNA, 25 bp, Rattus norvegicus
caagtttgtgtagaccctgaagtgt

SEQ ID NO: 221034 - DNA, 25 bp, Rattus norvegicus
caagttttaacaactggagttcaat

SEQ ID NO: 221035 - DNA, 25 bp, Rattus norvegicus
caagttttaacatctggagttcaat

SEQ ID NO: 221036 - DNA, 25 bp, Rattus norvegicus
caagttttatacacgcattattgac

SEQ ID NO: 221037 - DNA, 25 bp, Rattus norvegicus
caagttttatactcgcattattgac

SEQ ID NO: 221038 - DNA, 25 bp, Rattus norvegicus
caagttttccaacctgactcagtgt

SEQ ID NO: 221039 - DNA, 25 bp, Rattus norvegicus
caagttttccaagctgactcagtgt

SEQ ID NO: 221040 - DNA, 25 bp, Rattus norvegicus
caagttttggatattgcttcttcaa

SEQ ID NO: 221041 - DNA, 25 bp, Rattus norvegicus
caagttttggattttgcttcttcaa

SEQ ID NO: 221042 - DNA, 25 bp, Rattus norvegicus
caagtttttgctctctggatgtttt

SEQ ID NO: 221043 - DNA, 25 bp, Rattus norvegicus
caagtttttgctgtctggatgtttt

SEQ ID NO: 221044 - DNA, 25 bp, Rattus norvegicus
caataaatacgtcttcctctcctgc

SEQ ID NO: 221045 - DNA, 25 bp, Rattus norvegicus
caataaatacgtgttcctctcctgc

SEQ ID NO: 221046 - DNA, 25 bp, Rattus norvegicus
caataaatcactacgctgtcagctt

SEQ ID NO: 221047 - DNA, 25 bp, Rattus norvegicus
caataaatcacttcgctgtcagctt

SEQ ID NO: 221048 - DNA, 25 bp, Rattus norvegicus
caataaatctatctcttcggaggaa

SEQ ID NO: 221049 - DNA, 25 bp, Rattus norvegicus
caataaatctatgtcttcggaggaa

SEQ ID NO: 221050 - DNA, 25 bp, Rattus norvegicus
caataacatgaactcctgggagcaa

SEQ ID NO: 221051 - DNA, 25 bp, Rattus norvegicus
caataacatgaagtcctgggagcaa

SEQ ID NO: 221052 - DNA, 25 bp, Rattus norvegicus
caataactactaaagcacactggta

SEQ ID NO: 221053 - DNA, 25 bp, Rattus norvegicus
caataactactatagcacactggta

SEQ ID NO: 221054 - DNA, 25 bp, Rattus norvegicus
caataactcataattggcttacaat

SEQ ID NO: 221055 - DNA, 25 bp, Rattus norvegicus
caataactcatatttggcttacaat

SEQ ID NO: 221056 - DNA, 25 bp, Rattus norvegicus
caataactccttcttaactgtacgg

SEQ ID NO: 221057 - DNA, 25 bp, Rattus norvegicus
caataactccttgttaactgtacgg

SEQ ID NO: 221058 - DNA, 25 bp, Rattus norvegicus
caataacttagtagaacctgcttag

SEQ ID NO: 221059 - DNA, 25 bp, Rattus norvegicus
caataacttagttgaacctgcttag

SEQ ID NO: 221060 - DNA, 25 bp, Rattus norvegicus
caataagatcggagtcccagctagt

SEQ ID NO: 221061 - DNA, 25 bp, Rattus norvegicus
caataagatcggtgtcccagctagt

SEQ ID NO: 221062 - DNA, 25 bp, Rattus norvegicus
caataaggatgtcgtggccccaggt

SEQ ID NO: 221063 - DNA, 25 bp, Rattus norvegicus
caataaggatgtggtggccccaggt

SEQ ID NO: 221064 - DNA, 25 bp, Rattus norvegicus
caataaggtggcactcaaggtgggc

SEQ ID NO: 221065 - DNA, 25 bp, Rattus norvegicus
caataaggtggctctcaaggtgggc

SEQ ID NO: 221066 - DNA, 25 bp, Rattus norvegicus
caataagtctgcatggcgccattac

SEQ ID NO: 221067 - DNA, 25 bp, Rattus norvegicus
caataagtctgcttggcgccattac

SEQ ID NO: 221068 - DNA, 25 bp, Rattus norvegicus
caataagtgccacaactgttcctgc

SEQ ID NO: 221069 - DNA, 25 bp, Rattus norvegicus
caataagtgccagaactgttcctgc

SEQ ID NO: 221070 - DNA, 25 bp, Rattus norvegicus
caataataactgactctgaggatgt

SEQ ID NO: 221071 - DNA, 25 bp, Rattus norvegicus
caataataactgtctctgaggatgt

SEQ ID NO: 221072 - DNA, 25 bp, Rattus norvegicus
caataatcaatcaacctcacagcgg

SEQ ID NO: 221073 - DNA, 25 bp, Rattus norvegicus
caataatcaatctacctcacagcgg

SEQ ID NO: 221074 - DNA, 25 bp, Rattus norvegicus
caataatgcgtacacatccaccagt

SEQ ID NO: 221075 - DNA, 25 bp, Rattus norvegicus
caataatgcgtagacatccaccagt

SEQ ID NO: 221076 - DNA, 25 bp, Rattus norvegicus
caataatgtcctccaaactgtcttc

SEQ ID NO: 221077 - DNA, 25 bp, Rattus norvegicus
caataatgtcctgcaaactgtcttc

SEQ ID NO: 221078 - DNA, 25 bp, Rattus norvegicus
caatacaaaactcctgggaaacttc

SEQ ID NO: 221079 - DNA, 25 bp, Rattus norvegicus
caatacaaaactgctgggaaacttc

SEQ ID NO: 221080 - DNA, 25 bp, Rattus norvegicus
caatacacattgcttctcctcaaac

SEQ ID NO: 221081 - DNA, 25 bp, Rattus norvegicus
caatacacattggttctcctcaaac

SEQ ID NO: 221082 - DNA, 25 bp, Rattus norvegicus
caatacatttttcccttacctgagc

SEQ ID NO: 221083 - DNA, 25 bp, Rattus norvegicus
caatacatttttgccttacctgagc

SEQ ID NO: 221084 - DNA, 25 bp, Rattus norvegicus
caataccatcgccatcggtttattt

SEQ ID NO: 221085 - DNA, 25 bp, Rattus norvegicus
caataccatcgcgatcggtttattt

SEQ ID NO: 221086 - DNA, 25 bp, Rattus norvegicus
caataccccagaaatgtcctggctt

SEQ ID NO: 221087 - DNA, 25 bp, Rattus norvegicus
caataccccagatatgtcctggctt

SEQ ID NO: 221088 - DNA, 25 bp, Rattus norvegicus
caataccctcagcagccaaactagg

SEQ ID NO: 221089 - DNA, 25 bp, Rattus norvegicus
caataccctcaggagccaaactagg

SEQ ID NO: 221090 - DNA, 25 bp, Rattus norvegicus
caatacctgcttagcctaggcctgt

SEQ ID NO: 221091 - DNA, 25 bp, Rattus norvegicus
caatacctgctttgcctaggcctgt

SEQ ID NO: 221092 - DNA, 25 bp, Rattus norvegicus
caatacgaacaacgcgtgtctgaaa

SEQ ID NO: 221093 - DNA, 25 bp, Rattus norvegicus
caatacgaacaaggcgtgtctgaaa

SEQ ID NO: 221094 - DNA, 25 bp, Rattus norvegicus
caatacggccctccgggacaatgag

SEQ ID NO: 221095 - DNA, 25 bp, Rattus norvegicus
caatacggccctgcgggacaatgag

SEQ ID NO: 221096 - DNA, 25 bp, Rattus norvegicus
caatacggttaaaactcaagtcaag

SEQ ID NO: 221097 - DNA, 25 bp, Rattus norvegicus
caatacggttaatactcaagtcaag

SEQ ID NO: 221098 - DNA, 25 bp, Rattus norvegicus
caatacgtggatactcagtggagcc

SEQ ID NO: 221099 - DNA, 25 bp, Rattus norvegicus
caatacgtggattctcagtggagcc

SEQ ID NO: 221100 - DNA, 25 bp, Rattus norvegicus
caatactaagatagatggaccgtta

SEQ ID NO: 221101 - DNA, 25 bp, Rattus norvegicus
caatactaagattgatggaccgtta

SEQ ID NO: 221102 - DNA, 25 bp, Rattus norvegicus
caatactaggccacagacttctgaa

SEQ ID NO: 221103 - DNA, 25 bp, Rattus norvegicus
caatactaggcctcagacttctgaa

SEQ ID NO: 221104 - DNA, 25 bp, Rattus norvegicus
caatactccaggaccatttcaaact

SEQ ID NO: 221105 - DNA, 25 bp, Rattus norvegicus
caatactccaggtccatttcaaact

SEQ ID NO: 221106 - DNA, 25 bp, Rattus norvegicus
caatactctctaaatgggttcccct

SEQ ID NO: 221107 - DNA, 25 bp, Rattus norvegicus
caatactctctatatgggttcccct

SEQ ID NO: 221108 - DNA, 25 bp, Rattus norvegicus
caatactctgctcaactcatgttca

SEQ ID NO: 221109 - DNA, 25 bp, Rattus norvegicus
caatactctgctgaactcatgttca

SEQ ID NO: 221110 - DNA, 25 bp, Rattus norvegicus
caatacttcctcaggactcatagtc

SEQ ID NO: 221111 - DNA, 25 bp, Rattus norvegicus
caatacttcctctggactcatagtc

SEQ ID NO: 221112 - DNA, 25 bp, Rattus norvegicus
caatacttgatgaggctgacgcaga

SEQ ID NO: 221113 - DNA, 25 bp, Rattus norvegicus
caatacttgatgtggctgacgcaga

SEQ ID NO: 221114 - DNA, 25 bp, Rattus norvegicus
caatactttcacaatcgctacgggt

SEQ ID NO: 221115 - DNA, 25 bp, Rattus norvegicus
caatactttcactatcgctacgggt

SEQ ID NO: 221116 - DNA, 25 bp, Rattus norvegicus
caatagagactcctgacatctgtcc

SEQ ID NO: 221117 - DNA, 25 bp, Rattus norvegicus
caatagagactcgtgacatctgtcc

SEQ ID NO: 221118 - DNA, 25 bp, Rattus norvegicus
caatagatgcttccttacctgcttg

SEQ ID NO: 221119 - DNA, 25 bp, Rattus norvegicus
caatagatgcttgcttacctgcttg

SEQ ID NO: 221120 - DNA, 25 bp, Rattus norvegicus
caatagatgttccaacgttacccct

SEQ ID NO: 221121 - DNA, 25 bp, Rattus norvegicus
caatagatgttcgaacgttacccct

SEQ ID NO: 221122 - DNA, 25 bp, Rattus norvegicus
caatagccttggctgcctgtgtgca

SEQ ID NO: 221123 - DNA, 25 bp, Rattus norvegicus
caatagccttgggtgcctgtgtgca

SEQ ID NO: 221124 - DNA, 25 bp, Rattus norvegicus
caatagcttggtcaggccgtgtcaa

SEQ ID NO: 221125 - DNA, 25 bp, Rattus norvegicus
caatagcttggtgaggccgtgtcaa

SEQ ID NO: 221126 - DNA, 25 bp, Rattus norvegicus
caataggatgaacccacggcggccc

SEQ ID NO: 221127 - DNA, 25 bp, Rattus norvegicus
caataggatgaagccacggcggccc

SEQ ID NO: 221128 - DNA, 25 bp, Rattus norvegicus
caataggcccctagagggcgtgaga

SEQ ID NO: 221129 - DNA, 25 bp, Rattus norvegicus
caataggccccttgagggcgtgaga

SEQ ID NO: 221130 - DNA, 25 bp, Rattus norvegicus
caatagggccagaccgtggcatgat

SEQ ID NO: 221131 - DNA, 25 bp, Rattus norvegicus
caatagggccagtccgtggcatgat

SEQ ID NO: 221132 - DNA, 25 bp, Rattus norvegicus
caatagggtgtgagccagcctgtac

SEQ ID NO: 221133 - DNA, 25 bp, Rattus norvegicus
caatagggtgtgtgccagcctgtac

SEQ ID NO: 221134 - DNA, 25 bp, Rattus norvegicus
caataggtgcatattctgctcagta

SEQ ID NO: 221135 - DNA, 25 bp, Rattus norvegicus
caataggtgcattttctgctcagta

SEQ ID NO: 221136 - DNA, 25 bp, Rattus norvegicus
caatagtactatctgggttcagatt

SEQ ID NO: 221137 - DNA, 25 bp, Rattus norvegicus
caatagtactatgtgggttcagatt

SEQ ID NO: 221138 - DNA, 25 bp, Rattus norvegicus
caatagttagtaaggcagccttcaa

SEQ ID NO: 221139 - DNA, 25 bp, Rattus norvegicus
caatagttagtatggcagccttcaa

SEQ ID NO: 221140 - DNA, 25 bp, Rattus norvegicus
caatataacaaacacaaccttcccg

SEQ ID NO: 221141 - DNA, 25 bp, Rattus norvegicus
caatataacaaagacaaccttcccg

SEQ ID NO: 221142 - DNA, 25 bp, Rattus norvegicus
caatataacacgcagtcgtcaatca

SEQ ID NO: 221143 - DNA, 25 bp, Rattus norvegicus
caatataacacggagtcgtcaatca

SEQ ID NO: 221144 - DNA, 25 bp, Rattus norvegicus
caatataactgtatcctggtctgta

SEQ ID NO: 221145 - DNA, 25 bp, Rattus norvegicus
caatataactgtttcctggtctgta

SEQ ID NO: 221146 - DNA, 25 bp, Rattus norvegicus
caatatataaccaaggctggccttg

SEQ ID NO: 221147 - DNA, 25 bp, Rattus norvegicus
caatatataacctaggctggccttg

SEQ ID NO: 221148 - DNA, 25 bp, Rattus norvegicus
caatatatacctattcctttgaaag

SEQ ID NO: 221149 - DNA, 25 bp, Rattus norvegicus
caatatataccttttcctttgaaag

SEQ ID NO: 221150 - DNA, 25 bp, Rattus norvegicus
caatatcaatacagatgaccaggaa

SEQ ID NO: 221151 - DNA, 25 bp, Rattus norvegicus
caatatcaatactgatgaccaggaa

SEQ ID NO: 221152 - DNA, 25 bp, Rattus norvegicus
caatatcatgttaaagctctctaag

SEQ ID NO: 221153 - DNA, 25 bp, Rattus norvegicus
caatatcatgtttaagctctctaag

SEQ ID NO: 221154 - DNA, 25 bp, Rattus norvegicus
caatatcccgggaggtgtcaaacaa

SEQ ID NO: 221155 - DNA, 25 bp, Rattus norvegicus
caatatcccgggtggtgtcaaacaa

SEQ ID NO: 221156 - DNA, 25 bp, Rattus norvegicus
caatatccgtagatggcaagttcat

SEQ ID NO: 221157 - DNA, 25 bp, Rattus norvegicus
caatatccgtagttggcaagttcat

SEQ ID NO: 221158 - DNA, 25 bp, Rattus norvegicus
caatatcctgtcctattttccagaa

SEQ ID NO: 221159 - DNA, 25 bp, Rattus norvegicus
caatatcctgtcgtattttccagaa

SEQ ID NO: 221160 - DNA, 25 bp, Rattus norvegicus
caatatctcatcattccctgtaaaa

SEQ ID NO: 221161 - DNA, 25 bp, Rattus norvegicus
caatatctcatctttccctgtaaaa

SEQ ID NO: 221162 - DNA, 25 bp, Rattus norvegicus
caatatctccctctaagtgccaaag

SEQ ID NO: 221163 - DNA, 25 bp, Rattus norvegicus
caatatctccctgtaagtgccaaag

SEQ ID NO: 221164 - DNA, 25 bp, Rattus norvegicus
caatatctgcagagtgggccacctt

SEQ ID NO: 221165 - DNA, 25 bp, Rattus norvegicus
caatatctgcagtgtgggccacctt

SEQ ID NO: 221166 - DNA, 25 bp, Rattus norvegicus
caatatctgtgtcctttcatgagtg

SEQ ID NO: 221167 - DNA, 25 bp, Rattus norvegicus
caatatctgtgtgctttcatgagtg

SEQ ID NO: 221168 - DNA, 25 bp, Rattus norvegicus
caatatcttcccaatctggtggatt

SEQ ID NO: 221169 - DNA, 25 bp, Rattus norvegicus
caatatcttccctatctggtggatt

SEQ ID NO: 221170 - DNA, 25 bp, Rattus norvegicus
caatatcttgatatccttgccaaaa

SEQ ID NO: 221171 - DNA, 25 bp, Rattus norvegicus
caatatcttgatttccttgccaaaa

SEQ ID NO: 221172 - DNA, 25 bp, Rattus norvegicus
caatatctttccaggccttctctgt

SEQ ID NO: 221173 - DNA, 25 bp, Rattus norvegicus
caatatctttcctggccttctctgt

SEQ ID NO: 221174 - DNA, 25 bp, Rattus norvegicus
caatatctttggctacctgcacaag

SEQ ID NO: 221175 - DNA, 25 bp, Rattus norvegicus
caatatctttgggtacctgcacaag

SEQ ID NO: 221176 - DNA, 25 bp, Rattus norvegicus
caatatgaaaatctctgtctcctta

SEQ ID NO: 221177 - DNA, 25 bp, Rattus norvegicus
caatatgaaaatgtctgtctcctta

SEQ ID NO: 221178 - DNA, 25 bp, Rattus norvegicus
caatatgaagagaaggacaaagcct

SEQ ID NO: 221179 - DNA, 25 bp, Rattus norvegicus
caatatgaagagtaggacaaagcct

SEQ ID NO: 221180 - DNA, 25 bp, Rattus norvegicus
caatatgccgtacccaccggtgtat

SEQ ID NO: 221181 - DNA, 25 bp, Rattus norvegicus
caatatgccgtagccaccggtgtat

SEQ ID NO: 221182 - DNA, 25 bp, Rattus norvegicus
caatatggtggaacgtttgtctatc

SEQ ID NO: 221183 - DNA, 25 bp, Rattus norvegicus
caatatggtggatcgtttgtctatc

SEQ ID NO: 221184 - DNA, 25 bp, Rattus norvegicus
caatatggttttactgtgccttaca

SEQ ID NO: 221185 - DNA, 25 bp, Rattus norvegicus
caatatggtttttctgtgccttaca

SEQ ID NO: 221186 - DNA, 25 bp, Rattus norvegicus
caatatgtctacactggcagcccaa

SEQ ID NO: 221187 - DNA, 25 bp, Rattus norvegicus
caatatgtctactctggcagcccaa

SEQ ID NO: 221188 - DNA, 25 bp, Rattus norvegicus
caatatgtctctctccgatgggaaa

SEQ ID NO: 221189 - DNA, 25 bp, Rattus norvegicus
caatatgtctctgtccgatgggaaa

SEQ ID NO: 221190 - DNA, 25 bp, Rattus norvegicus
caatatgtctttagtgaggtaaata

SEQ ID NO: 221191 - DNA, 25 bp, Rattus norvegicus
caatatgtcttttgtgaggtaaata

SEQ ID NO: 221192 - DNA, 25 bp, Rattus norvegicus
caatatgtgactatatttccagata

SEQ ID NO: 221193 - DNA, 25 bp, Rattus norvegicus
caatatgtgactttatttccagata

SEQ ID NO: 221194 - DNA, 25 bp, Rattus norvegicus
caatatgtgagaactgagaccaggg

SEQ ID NO: 221195 - DNA, 25 bp, Rattus norvegicus
caatatgtgagatctgagaccaggg

SEQ ID NO: 221196 - DNA, 25 bp, Rattus norvegicus
caatatgtgggtacccggcttcgga

SEQ ID NO: 221197 - DNA, 25 bp, Rattus norvegicus
caatatgtgggttcccggcttcgga

SEQ ID NO: 221198 - DNA, 25 bp, Rattus norvegicus
caatatgtgtatcggacttgctgga

SEQ ID NO: 221199 - DNA, 25 bp, Rattus norvegicus
caatatgtgtatgggacttgctgga

SEQ ID NO: 221200 - DNA, 25 bp, Rattus norvegicus
caatatgtttttctatgcaggtagt

SEQ ID NO: 221201 - DNA, 25 bp, Rattus norvegicus
caatatgtttttgtatgcaggtagt

SEQ ID NO: 221202 - DNA, 25 bp, Rattus norvegicus
caatattacatacccacagttttcc

SEQ ID NO: 221203 - DNA, 25 bp, Rattus norvegicus
caatattacatagccacagttttcc

SEQ ID NO: 221204 - DNA, 25 bp, Rattus norvegicus
caatattcaggtcgcttctgctcta

SEQ ID NO: 221205 - DNA, 25 bp, Rattus norvegicus
caatattcaggtggcttctgctcta

SEQ ID NO: 221206 - DNA, 25 bp, Rattus norvegicus
caatattctttacatagcctctctt

SEQ ID NO: 221207 - DNA, 25 bp, Rattus norvegicus
caatattctttagatagcctctctt

SEQ ID NO: 221208 - DNA, 25 bp, Rattus norvegicus
caatattgccttccagcgtgatcaa

SEQ ID NO: 221209 - DNA, 25 bp, Rattus norvegicus
caatattgccttgcagcgtgatcaa

SEQ ID NO: 221210 - DNA, 25 bp, Rattus norvegicus
caatatttaaccctttggcctagtg

SEQ ID NO: 221211 - DNA, 25 bp, Rattus norvegicus
caatatttaaccgtttggcctagtg

SEQ ID NO: 221212 - DNA, 25 bp, Rattus norvegicus
caatatttccaaagctctagcatgt

SEQ ID NO: 221213 - DNA, 25 bp, Rattus norvegicus
caatatttccaatgctctagcatgt

SEQ ID NO: 221214 - DNA, 25 bp, Rattus norvegicus
caatatttccttacacctggttggg

SEQ ID NO: 221215 - DNA, 25 bp, Rattus norvegicus
caatatttcctttcacctggttggg

SEQ ID NO: 221216 - DNA, 25 bp, Rattus norvegicus
caatatttgtcgacagctctgttaa

SEQ ID NO: 221217 - DNA, 25 bp, Rattus norvegicus
caatatttgtcgtcagctctgttaa

SEQ ID NO: 221218 - DNA, 25 bp, Rattus norvegicus
caatattttcccctgaaaggcagaa

SEQ ID NO: 221219 - DNA, 25 bp, Rattus norvegicus
caatattttcccgtgaaaggcagaa

SEQ ID NO: 221220 - DNA, 25 bp, Rattus norvegicus
caatcaaagattctctgtgccaggg

SEQ ID NO: 221221 - DNA, 25 bp, Rattus norvegicus
caatcaaagattgtctgtgccaggg

SEQ ID NO: 221222 - DNA, 25 bp, Rattus norvegicus
caatcaacatgcaggtgaaggtgaa

SEQ ID NO: 221223 - DNA, 25 bp, Rattus norvegicus
caatcaacatgctggtgaaggtgaa

SEQ ID NO: 221224 - DNA, 25 bp, Rattus norvegicus
caatcaactgtcattcttggtgtat

SEQ ID NO: 221225 - DNA, 25 bp, Rattus norvegicus
caatcaactgtctttcttggtgtat

SEQ ID NO: 221226 - DNA, 25 bp, Rattus norvegicus
caatcaagcctacaccaactggagt

SEQ ID NO: 221227 - DNA, 25 bp, Rattus norvegicus
caatcaagcctagaccaactggagt

SEQ ID NO: 221228 - DNA, 25 bp, Rattus norvegicus
caatcaatatcccaaaccctgtttt

SEQ ID NO: 221229 - DNA, 25 bp, Rattus norvegicus
caatcaatatccgaaaccctgtttt

SEQ ID NO: 221230 - DNA, 25 bp, Rattus norvegicus
caatcaccaagtcttctgcccggat

SEQ ID NO: 221231 - DNA, 25 bp, Rattus norvegicus
caatcaccaagtgttctgcccggat

SEQ ID NO: 221232 - DNA, 25 bp, Rattus norvegicus
caatcactcaagacaagaagatcgg

SEQ ID NO: 221233 - DNA, 25 bp, Rattus norvegicus
caatcactcaagtcaagaagatcgg

SEQ ID NO: 221234 - DNA, 25 bp, Rattus norvegicus
caatcactctaaacagtctgacagt

SEQ ID NO: 221235 - DNA, 25 bp, Rattus norvegicus
caatcactctaatcagtctgacagt

SEQ ID NO: 221236 - DNA, 25 bp, Rattus norvegicus
caatcactgcttaaacctagtaagt

SEQ ID NO: 221237 - DNA, 25 bp, Rattus norvegicus
caatcactgctttaacctagtaagt

SEQ ID NO: 221238 - DNA, 25 bp, Rattus norvegicus
caatcactgtgcacatgctgtccat

SEQ ID NO: 221239 - DNA, 25 bp, Rattus norvegicus
caatcactgtgctcatgctgtccat

SEQ ID NO: 221240 - DNA, 25 bp, Rattus norvegicus
caatcacttagtaaattctgtaact

SEQ ID NO: 221241 - DNA, 25 bp, Rattus norvegicus
caatcacttagttaattctgtaact

SEQ ID NO: 221242 - DNA, 25 bp, Rattus norvegicus
caatcagaagctcagtgcccagtgg

SEQ ID NO: 221243 - DNA, 25 bp, Rattus norvegicus
caatcagaagctgagtgcccagtgg

SEQ ID NO: 221244 - DNA, 25 bp, Rattus norvegicus
caatcagacacacgctcgagcgggc

SEQ ID NO: 221245 - DNA, 25 bp, Rattus norvegicus
caatcagacacaggctcgagcgggc

SEQ ID NO: 221246 - DNA, 25 bp, Rattus norvegicus
caatcagactataccaaggcttggg

SEQ ID NO: 221247 - DNA, 25 bp, Rattus norvegicus
caatcagactattccaaggcttggg

SEQ ID NO: 221248 - DNA, 25 bp, Rattus norvegicus
caatcagaggctatctcctccactg

SEQ ID NO: 221249 - DNA, 25 bp, Rattus norvegicus
caatcagaggctttctcctccactg

SEQ ID NO: 221250 - DNA, 25 bp, Rattus norvegicus
caatcagcctgtcggtttgcttttt

SEQ ID NO: 221251 - DNA, 25 bp, Rattus norvegicus
caatcagcctgtgggtttgcttttt

SEQ ID NO: 221252 - DNA, 25 bp, Rattus norvegicus
caatcagcctttcccggaaggagca

SEQ ID NO: 221253 - DNA, 25 bp, Rattus norvegicus
caatcagcctttgccggaaggagca

SEQ ID NO: 221254 - DNA, 25 bp, Rattus norvegicus
caatcaggccacctgggacaccttt

SEQ ID NO: 221255 - DNA, 25 bp, Rattus norvegicus
caatcaggccacgtgggacaccttt

SEQ ID NO: 221256 - DNA, 25 bp, Rattus norvegicus
caatcaggcctacgtagtgagactc

SEQ ID NO: 221257 - DNA, 25 bp, Rattus norvegicus
caatcaggcctaggtagtgagactc

SEQ ID NO: 221258 - DNA, 25 bp, Rattus norvegicus
caatcagggatgctgctccaggaat

SEQ ID NO: 221259 - DNA, 25 bp, Rattus norvegicus
caatcagggatggtgctccaggaat

SEQ ID NO: 221260 - DNA, 25 bp, Rattus norvegicus
caatcagggctcaagaccacagtgc

SEQ ID NO: 221261 - DNA, 25 bp, Rattus norvegicus
caatcagggctctagaccacagtgc

SEQ ID NO: 221262 - DNA, 25 bp, Rattus norvegicus
caatcagtatgtacagggctgtata

SEQ ID NO: 221263 - DNA, 25 bp, Rattus norvegicus
caatcagtatgttcagggctgtata

SEQ ID NO: 221264 - DNA, 25 bp, Rattus norvegicus
caatcagtcgagattcttcccatgg

SEQ ID NO: 221265 - DNA, 25 bp, Rattus norvegicus
caatcagtcgagtttcttcccatgg

SEQ ID NO: 221266 - DNA, 25 bp, Rattus norvegicus
caatcagttcatacctctgcaggtt

SEQ ID NO: 221267 - DNA, 25 bp, Rattus norvegicus
caatcagttcattcctctgcaggtt

SEQ ID NO: 221268 - DNA, 25 bp, Rattus norvegicus
caatcatacctacgcactgtctttg

SEQ ID NO: 221269 - DNA, 25 bp, Rattus norvegicus
caatcatacctaggcactgtctttg

SEQ ID NO: 221270 - DNA, 25 bp, Rattus norvegicus
caatcatccatcactttccaaagag

SEQ ID NO: 221271 - DNA, 25 bp, Rattus norvegicus
caatcatccatctctttccaaagag

SEQ ID NO: 221272 - DNA, 25 bp, Rattus norvegicus
caatcatccctgcattcatcatgga

SEQ ID NO: 221273 - DNA, 25 bp, Rattus norvegicus
caatcatccctggattcatcatgga

SEQ ID NO: 221274 - DNA, 25 bp, Rattus norvegicus
caatcatctgttaatttctccttcc

SEQ ID NO: 221275 - DNA, 25 bp, Rattus norvegicus
caatcatctgtttatttctccttcc

SEQ ID NO: 221276 - DNA, 25 bp, Rattus norvegicus
caatcatgtgtaaccacgcgaatac

SEQ ID NO: 221277 - DNA, 25 bp, Rattus norvegicus
caatcatgtgtatccacgcgaatac

SEQ ID NO: 221278 - DNA, 25 bp, Rattus norvegicus
caatccaaacagactatttcttttt

SEQ ID NO: 221279 - DNA, 25 bp, Rattus norvegicus
caatccaaacagtctatttcttttt

SEQ ID NO: 221280 - DNA, 25 bp, Rattus norvegicus
caatccaacctacttctttttctga

SEQ ID NO: 221281 - DNA, 25 bp, Rattus norvegicus
caatccaacctagttctttttctga

SEQ ID NO: 221282 - DNA, 25 bp, Rattus norvegicus
caatccaactttagttctgagccca

SEQ ID NO: 221283 - DNA, 25 bp, Rattus norvegicus
caatccaacttttgttctgagccca

SEQ ID NO: 221284 - DNA, 25 bp, Rattus norvegicus
caatccagtgtgattgcttgtctct

SEQ ID NO: 221285 - DNA, 25 bp, Rattus norvegicus
caatccagtgtgtttgcttgtctct

SEQ ID NO: 221286 - DNA, 25 bp, Rattus norvegicus
caatccataattatgcttcagggca

SEQ ID NO: 221287 - DNA, 25 bp, Rattus norvegicus
caatccataattttgcttcagggca

SEQ ID NO: 221288 - DNA, 25 bp, Rattus norvegicus
caatccatagcaccccgttggcggg

SEQ ID NO: 221289 - DNA, 25 bp, Rattus norvegicus
caatccatagcagcccgttggcggg

SEQ ID NO: 221290 - DNA, 25 bp, Rattus norvegicus
caatccatccctatgagcgatcatc

SEQ ID NO: 221291 - DNA, 25 bp, Rattus norvegicus
caatccatccctttgagcgatcatc

SEQ ID NO: 221292 - DNA, 25 bp, Rattus norvegicus
caatccatgtcccttgaactgtggc

SEQ ID NO: 221293 - DNA, 25 bp, Rattus norvegicus
caatccatgtccgttgaactgtggc

SEQ ID NO: 221294 - DNA, 25 bp, Rattus norvegicus
caatccatttaaactacagtgaagc

SEQ ID NO: 221295 - DNA, 25 bp, Rattus norvegicus
caatccatttaatctacagtgaagc

SEQ ID NO: 221296 - DNA, 25 bp, Rattus norvegicus
caatcccagggtatggcatcttgga

SEQ ID NO: 221297 - DNA, 25 bp, Rattus norvegicus
caatcccagggtttggcatcttgga

SEQ ID NO: 221298 - DNA, 25 bp, Rattus norvegicus
caatcccatattcacttatctagaa

SEQ ID NO: 221299 - DNA, 25 bp, Rattus norvegicus
caatcccatattgacttatctagaa

SEQ ID NO: 221300 - DNA, 25 bp, Rattus norvegicus
caatccccagcaatggagaaaggct

SEQ ID NO: 221301 - DNA, 25 bp, Rattus norvegicus
caatccccagcattggagaaaggct

SEQ ID NO: 221302 - DNA, 25 bp, Rattus norvegicus
caatccccatacatgagtgtctgag

SEQ ID NO: 221303 - DNA, 25 bp, Rattus norvegicus
caatccccatacttgagtgtctgag

SEQ ID NO: 221304 - DNA, 25 bp, Rattus norvegicus
caatcccctcttaaaaacactctag

SEQ ID NO: 221305 - DNA, 25 bp, Rattus norvegicus
caatcccctctttaaaacactctag

SEQ ID NO: 221306 - DNA, 25 bp, Rattus norvegicus
caatcccgagctcaagccgtttaaa

SEQ ID NO: 221307 - DNA, 25 bp, Rattus norvegicus
caatcccgagctgaagccgtttaaa

SEQ ID NO: 221308 - DNA, 25 bp, Rattus norvegicus
caatcccggaggagagccttacgaa

SEQ ID NO: 221309 - DNA, 25 bp, Rattus norvegicus
caatcccggaggtgagccttacgaa

SEQ ID NO: 221310 - DNA, 25 bp, Rattus norvegicus
caatccctaactctaaacctaagct

SEQ ID NO: 221311 - DNA, 25 bp, Rattus norvegicus
caatccctaactgtaaacctaagct

SEQ ID NO: 221312 - DNA, 25 bp, Rattus norvegicus
caatccctacttcattgttttctct

SEQ ID NO: 221313 - DNA, 25 bp, Rattus norvegicus
caatccctacttgattgttttctct

SEQ ID NO: 221314 - DNA, 25 bp, Rattus norvegicus
caatccctagggagacagctgaatt

SEQ ID NO: 221315 - DNA, 25 bp, Rattus norvegicus
caatccctagggtgacagctgaatt

SEQ ID NO: 221316 - DNA, 25 bp, Rattus norvegicus
caatccctctacagtcattatgtca

SEQ ID NO: 221317 - DNA, 25 bp, Rattus norvegicus
caatccctctactgtcattatgtca

SEQ ID NO: 221318 - DNA, 25 bp, Rattus norvegicus
caatccctgcttagtagttctttca

SEQ ID NO: 221319 - DNA, 25 bp, Rattus norvegicus
caatccctgctttgtagttctttca

SEQ ID NO: 221320 - DNA, 25 bp, Rattus norvegicus
caatccctgggtaacacatgctaca

SEQ ID NO: 221321 - DNA, 25 bp, Rattus norvegicus
caatccctgggtcctgcaattacag

SEQ ID NO: 221322 - DNA, 25 bp, Rattus norvegicus
caatccctgggtgctgcaattacag

SEQ ID NO: 221323 - DNA, 25 bp, Rattus norvegicus
caatccctgggttacacatgctaca

SEQ ID NO: 221324 - DNA, 25 bp, Rattus norvegicus
caatcccttataagctctaaatgtt

SEQ ID NO: 221325 - DNA, 25 bp, Rattus norvegicus
caatcccttatatgctctaaatgtt

SEQ ID NO: 221326 - DNA, 25 bp, Rattus norvegicus
caatcccttcttctgtatcaggtta

SEQ ID NO: 221327 - DNA, 25 bp, Rattus norvegicus
caatcccttcttgtgtatcaggtta

SEQ ID NO: 221328 - DNA, 25 bp, Rattus norvegicus
caatccctttaactcaatgcctgct

SEQ ID NO: 221329 - DNA, 25 bp, Rattus norvegicus
caatccctttaagtcaatgcctgct

SEQ ID NO: 221330 - DNA, 25 bp, Rattus norvegicus
caatccgacattcgtcttgcagtat

SEQ ID NO: 221331 - DNA, 25 bp, Rattus norvegicus
caatccgacattggtcttgcagtat

SEQ ID NO: 221332 - DNA, 25 bp, Rattus norvegicus
caatccggaccacgcttggtttcaa

SEQ ID NO: 221333 - DNA, 25 bp, Rattus norvegicus
caatccggaccaggcttggtttcaa

SEQ ID NO: 221334 - DNA, 25 bp, Rattus norvegicus
caatccgggtgcaagctgaccaaaa

SEQ ID NO: 221335 - DNA, 25 bp, Rattus norvegicus
caatccgggtgctagctgaccaaaa

SEQ ID NO: 221336 - DNA, 25 bp, Rattus norvegicus
caatcctcagagcactctctttcag

SEQ ID NO: 221337 - DNA, 25 bp, Rattus norvegicus
caatcctcagaggactctctttcag

SEQ ID NO: 221338 - DNA, 25 bp, Rattus norvegicus
caatcctcagtgatctctgtatgta

SEQ ID NO: 221339 - DNA, 25 bp, Rattus norvegicus
caatcctcagtgttctctgtatgta

SEQ ID NO: 221340 - DNA, 25 bp, Rattus norvegicus
caatcctccataactctgtctaggg

SEQ ID NO: 221341 - DNA, 25 bp, Rattus norvegicus
caatcctccatatctctgtctaggg

SEQ ID NO: 221342 - DNA, 25 bp, Rattus norvegicus
caatcctcctttagccaagtaaaat

SEQ ID NO: 221343 - DNA, 25 bp, Rattus norvegicus
caatcctccttttgccaagtaaaat

SEQ ID NO: 221344 - DNA, 25 bp, Rattus norvegicus
caatcctctctgaacatggcctcag

SEQ ID NO: 221345 - DNA, 25 bp, Rattus norvegicus
caatcctctctgtacatggcctcag

SEQ ID NO: 221346 - DNA, 25 bp, Rattus norvegicus
caatcctgacctattgaagacgcca

SEQ ID NO: 221347 - DNA, 25 bp, Rattus norvegicus
caatcctgaccttttgaagacgcca

SEQ ID NO: 221348 - DNA, 25 bp, Rattus norvegicus
caatcctgccgtatgtaacactgtt

SEQ ID NO: 221349 - DNA, 25 bp, Rattus norvegicus
caatcctgccgtttgtaacactgtt

SEQ ID NO: 221350 - DNA, 25 bp, Rattus norvegicus
caatccttataacctctgggcctac

SEQ ID NO: 221351 - DNA, 25 bp, Rattus norvegicus
caatccttataagctctgggcctac

SEQ ID NO: 221352 - DNA, 25 bp, Rattus norvegicus
caatccttcaggagggaatctttcc

SEQ ID NO: 221353 - DNA, 25 bp, Rattus norvegicus
caatccttcaggtgggaatctttcc

SEQ ID NO: 221354 - DNA, 25 bp, Rattus norvegicus
caatcgaaggccaaggttcaaacca

SEQ ID NO: 221355 - DNA, 25 bp, Rattus norvegicus
caatcgaaggcctaggttcaaacca

SEQ ID NO: 221356 - DNA, 25 bp, Rattus norvegicus
caatcgatactgagacctaggcgtc

SEQ ID NO: 221357 - DNA, 25 bp, Rattus norvegicus
caatcgatactgtgacctaggcgtc

SEQ ID NO: 221358 - DNA, 25 bp, Rattus norvegicus
caatcgcaccctaccttattttttg

SEQ ID NO: 221359 - DNA, 25 bp, Rattus norvegicus
caatcgcacccttccttattttttg

SEQ ID NO: 221360 - DNA, 25 bp, Rattus norvegicus
caatcgccatataatggagcttgtt

SEQ ID NO: 221361 - DNA, 25 bp, Rattus norvegicus
caatcgccatattatggagcttgtt

SEQ ID NO: 221362 - DNA, 25 bp, Rattus norvegicus
caatcgcctgggatcagcgagatct

SEQ ID NO: 221363 - DNA, 25 bp, Rattus norvegicus
caatcgcctgggttcagcgagatct

SEQ ID NO: 221364 - DNA, 25 bp, Rattus norvegicus
caatcgctctgtctcttctaaaagc

SEQ ID NO: 221365 - DNA, 25 bp, Rattus norvegicus
caatcgctctgtgtcttctaaaagc

SEQ ID NO: 221366 - DNA, 25 bp, Rattus norvegicus
caatcggaagtcatcagggtgcagg

SEQ ID NO: 221367 - DNA, 25 bp, Rattus norvegicus
caatcggaagtcttcagggtgcagg

SEQ ID NO: 221368 - DNA, 25 bp, Rattus norvegicus
caatcggctcctagagaaacagctg

SEQ ID NO: 221369 - DNA, 25 bp, Rattus norvegicus
caatcggctccttgagaaacagctg

SEQ ID NO: 221370 - DNA, 25 bp, Rattus norvegicus
caatcgggacacacacttaacggaa

SEQ ID NO: 221371 - DNA, 25 bp, Rattus norvegicus
caatcgggacactcacttaacggaa

SEQ ID NO: 221372 - DNA, 25 bp, Rattus norvegicus
caatcgtttttaagtgctctcacct

SEQ ID NO: 221373 - DNA, 25 bp, Rattus norvegicus
caatcgtttttatgtgctctcacct

SEQ ID NO: 221374 - DNA, 25 bp, Rattus norvegicus
caatctaactacatctcgttccaga

SEQ ID NO: 221375 - DNA, 25 bp, Rattus norvegicus
caatctaactacttctcgttccaga

SEQ ID NO: 221376 - DNA, 25 bp, Rattus norvegicus
caatctaatccacggaagcttcagt

SEQ ID NO: 221377 - DNA, 25 bp, Rattus norvegicus
caatctaatccagggaagcttcagt

SEQ ID NO: 221378 - DNA, 25 bp, Rattus norvegicus
caatctagagagagtttgcgtggga

SEQ ID NO: 221379 - DNA, 25 bp, Rattus norvegicus
caatctagagagtgtttgcgtggga

SEQ ID NO: 221380 - DNA, 25 bp, Rattus norvegicus
caatctaggctgcagagcagtgaat

SEQ ID NO: 221381 - DNA, 25 bp, Rattus norvegicus
caatctaggctggagagcagtgaat

SEQ ID NO: 221382 - DNA, 25 bp, Rattus norvegicus
caatctagtagcataccccaagtgc

SEQ ID NO: 221383 - DNA, 25 bp, Rattus norvegicus
caatctagtagcttaccccaagtgc

SEQ ID NO: 221384 - DNA, 25 bp, Rattus norvegicus
caatctatgaagacctcaggccagg

SEQ ID NO: 221385 - DNA, 25 bp, Rattus norvegicus
caatctatgaagtcctcaggccagg

SEQ ID NO: 221386 - DNA, 25 bp, Rattus norvegicus
caatctcactgaccggcaggtcaaa

SEQ ID NO: 221387 - DNA, 25 bp, Rattus norvegicus
caatctcactgagcggcaggtcaaa

SEQ ID NO: 221388 - DNA, 25 bp, Rattus norvegicus
caatctcatcttaatgtctccaaca

SEQ ID NO: 221389 - DNA, 25 bp, Rattus norvegicus
caatctcatctttatgtctccaaca

SEQ ID NO: 221390 - DNA, 25 bp, Rattus norvegicus
caatctccacttcgttttgttttgt

SEQ ID NO: 221391 - DNA, 25 bp, Rattus norvegicus
caatctccacttggttttgttttgt

SEQ ID NO: 221392 - DNA, 25 bp, Rattus norvegicus
caatctccaggcaccttcagaagaa

SEQ ID NO: 221393 - DNA, 25 bp, Rattus norvegicus
caatctccaggctccttcagaagaa

SEQ ID NO: 221394 - DNA, 25 bp, Rattus norvegicus
caatctcccctactgaagttcaatt

SEQ ID NO: 221395 - DNA, 25 bp, Rattus norvegicus
caatctcccctagtgaagttcaatt

SEQ ID NO: 221396 - DNA, 25 bp, Rattus norvegicus
caatctcgatctaggacttccttgt

SEQ ID NO: 221397 - DNA, 25 bp, Rattus norvegicus
caatctcgatcttggacttccttgt

SEQ ID NO: 221398 - DNA, 25 bp, Rattus norvegicus
caatctcgcagtccagtggtgcggt

SEQ ID NO: 221399 - DNA, 25 bp, Rattus norvegicus
caatctcgcagtgcagtggtgcggt

SEQ ID NO: 221400 - DNA, 25 bp, Rattus norvegicus
caatctctaaacaggaatactctaa

SEQ ID NO: 221401 - DNA, 25 bp, Rattus norvegicus
caatctctaaactggaatactctaa

SEQ ID NO: 221402 - DNA, 25 bp, Rattus norvegicus
caatctctatccacatttttactgg

SEQ ID NO: 221403 - DNA, 25 bp, Rattus norvegicus
caatctctatcctcatttttactgg

SEQ ID NO: 221404 - DNA, 25 bp, Rattus norvegicus
caatctctctggacatctgaaggaa

SEQ ID NO: 221405 - DNA, 25 bp, Rattus norvegicus
caatctctctggtcatctgaaggaa

SEQ ID NO: 221406 - DNA, 25 bp, Rattus norvegicus
caatctctgagtccccatgggaacg

SEQ ID NO: 221407 - DNA, 25 bp, Rattus norvegicus
caatctctgagtgcccatgggaacg

SEQ ID NO: 221408 - DNA, 25 bp, Rattus norvegicus
caatctgagaagaaggagacagctt

SEQ ID NO: 221409 - DNA, 25 bp, Rattus norvegicus
caatctgagaagtaggagacagctt

SEQ ID NO: 221410 - DNA, 25 bp, Rattus norvegicus
caatctgagtttcagtccggcctgg

SEQ ID NO: 221411 - DNA, 25 bp, Rattus norvegicus
caatctgagtttgagtccggcctgg

SEQ ID NO: 221412 - DNA, 25 bp, Rattus norvegicus
caatctgatgtaatgattcaacaca

SEQ ID NO: 221413 - DNA, 25 bp, Rattus norvegicus
caatctgatgtattgattcaacaca

SEQ ID NO: 221414 - DNA, 25 bp, Rattus norvegicus
caatctgatgtgacttactgctgaa

SEQ ID NO: 221415 - DNA, 25 bp, Rattus norvegicus
caatctgatgtgtcttactgctgaa

SEQ ID NO: 221416 - DNA, 25 bp, Rattus norvegicus
caatctgcaacaaagtagctgagct

SEQ ID NO: 221417 - DNA, 25 bp, Rattus norvegicus
caatctgcaacatagtagctgagct

SEQ ID NO: 221418 - DNA, 25 bp, Rattus norvegicus
caatctgcacagaggctggcttgat

SEQ ID NO: 221419 - DNA, 25 bp, Rattus norvegicus
caatctgcacagtggctggcttgat

SEQ ID NO: 221420 - DNA, 25 bp, Rattus norvegicus
caatctgcagaacttccaagaccct

SEQ ID NO: 221421 - DNA, 25 bp, Rattus norvegicus
caatctgcagaagttccaagaccct

SEQ ID NO: 221422 - DNA, 25 bp, Rattus norvegicus
caatctgcttgaatgcagtggtact

SEQ ID NO: 221423 - DNA, 25 bp, Rattus norvegicus
caatctgcttgattgcagtggtact

SEQ ID NO: 221424 - DNA, 25 bp, Rattus norvegicus
caatctggacccattgccaaaggat

SEQ ID NO: 221425 - DNA, 25 bp, Rattus norvegicus
caatctggaccctttgccaaaggat

SEQ ID NO: 221426 - DNA, 25 bp, Rattus norvegicus
caatctggagtcctgtcgttgtctc

SEQ ID NO: 221427 - DNA, 25 bp, Rattus norvegicus
caatctggagtcgtgtcgttgtctc

SEQ ID NO: 221428 - DNA, 25 bp, Rattus norvegicus
caatctggttctcgctggctcgaga

SEQ ID NO: 221429 - DNA, 25 bp, Rattus norvegicus
caatctggttctggctggctcgaga

SEQ ID NO: 221430 - DNA, 25 bp, Rattus norvegicus
caatctgtaagaaaagcccctgagg

SEQ ID NO: 221431 - DNA, 25 bp, Rattus norvegicus
caatctgtaagataagcccctgagg

SEQ ID NO: 221432 - DNA, 25 bp, Rattus norvegicus
caatctgtacagcacgtggacggca

SEQ ID NO: 221433 - DNA, 25 bp, Rattus norvegicus
caatctgtacaggacgtggacggca

SEQ ID NO: 221434 - DNA, 25 bp, Rattus norvegicus
caatctgtcaggacagtcggttcaa

SEQ ID NO: 221435 - DNA, 25 bp, Rattus norvegicus
caatctgtcaggtcagtcggttcaa

SEQ ID NO: 221436 - DNA, 25 bp, Rattus norvegicus
caatctgtccagagcattcatatgc

SEQ ID NO: 221437 - DNA, 25 bp, Rattus norvegicus
caatctgtccagtgcattcatatgc

SEQ ID NO: 221438 - DNA, 25 bp, Rattus norvegicus
caatctgtgaccagttgggagctaa

SEQ ID NO: 221439 - DNA, 25 bp, Rattus norvegicus
caatctgtgacctgttgggagctaa

SEQ ID NO: 221440 - DNA, 25 bp, Rattus norvegicus
caatctgtgcatcggtgtagactga

SEQ ID NO: 221441 - DNA, 25 bp, Rattus norvegicus
caatctgtgcatgggtgtagactga

SEQ ID NO: 221442 - DNA, 25 bp, Rattus norvegicus
caatctgtggaacgtgctgttttct

SEQ ID NO: 221443 - DNA, 25 bp, Rattus norvegicus
caatctgtggaaggtgctgttttct

SEQ ID NO: 221444 - DNA, 25 bp, Rattus norvegicus
caatctgtgtgcacacttgggagga

SEQ ID NO: 221445 - DNA, 25 bp, Rattus norvegicus
caatctgtgtgctcacttgggagga

SEQ ID NO: 221446 - DNA, 25 bp, Rattus norvegicus
caatctgtgtttccttgacttagaa

SEQ ID NO: 221447 - DNA, 25 bp, Rattus norvegicus
caatctgtgtttgcttgacttagaa

SEQ ID NO: 221448 - DNA, 25 bp, Rattus norvegicus
caatcttcccttaattgtctttcct

SEQ ID NO: 221449 - DNA, 25 bp, Rattus norvegicus
caatcttccctttattgtctttcct

SEQ ID NO: 221450 - DNA, 25 bp, Rattus norvegicus
caatcttctgaacacaactccttag

SEQ ID NO: 221451 - DNA, 25 bp, Rattus norvegicus
caatcttctgaagacaactccttag

SEQ ID NO: 221452 - DNA, 25 bp, Rattus norvegicus
caatcttctggacatggcatcgagt

SEQ ID NO: 221453 - DNA, 25 bp, Rattus norvegicus
caatcttctggagatggcatcgagt

SEQ ID NO: 221454 - DNA, 25 bp, Rattus norvegicus
caatcttgcaccattttggttgtga

SEQ ID NO: 221455 - DNA, 25 bp, Rattus norvegicus
caatcttgcacctttttggttgtga

SEQ ID NO: 221456 - DNA, 25 bp, Rattus norvegicus
caatcttggtgtagacttattctca

SEQ ID NO: 221457 - DNA, 25 bp, Rattus norvegicus
caatcttggtgttgacttattctca

SEQ ID NO: 221458 - DNA, 25 bp, Rattus norvegicus
caatcttgtcatattaatgctggtt

SEQ ID NO: 221459 - DNA, 25 bp, Rattus norvegicus
caatcttgtcattttaatgctggtt

SEQ ID NO: 221460 - DNA, 25 bp, Rattus norvegicus
caatctttctgaaacccaggtgaag

SEQ ID NO: 221461 - DNA, 25 bp, Rattus norvegicus
caatctttctgatacccaggtgaag

SEQ ID NO: 221462 - DNA, 25 bp, Rattus norvegicus
caatctttgaataggaggccactca

SEQ ID NO: 221463 - DNA, 25 bp, Rattus norvegicus
caatctttgaattggaggccactca

SEQ ID NO: 221464 - DNA, 25 bp, Rattus norvegicus
caatctttgttgaaggtagttccca

SEQ ID NO: 221465 - DNA, 25 bp, Rattus norvegicus
caatctttgttgtaggtagttccca

SEQ ID NO: 221466 - DNA, 25 bp, Rattus norvegicus
caatcttttcaacagcttctaccag

SEQ ID NO: 221467 - DNA, 25 bp, Rattus norvegicus
caatcttttcaagagcttctaccag

SEQ ID NO: 221468 - DNA, 25 bp, Rattus norvegicus
caatgaaaattcaccgctcagctgg

SEQ ID NO: 221469 - DNA, 25 bp, Rattus norvegicus
caatgaaaattctccgctcagctgg

SEQ ID NO: 221470 - DNA, 25 bp, Rattus norvegicus
caatgaaacttcctgcccagcagac

SEQ ID NO: 221471 - DNA, 25 bp, Rattus norvegicus
caatgaaacttcgtgcccagcagac

SEQ ID NO: 221472 - DNA, 25 bp, Rattus norvegicus
caatgaacgctaattcctggtcctc

SEQ ID NO: 221473 - DNA, 25 bp, Rattus norvegicus
caatgaacgctatttcctggtcctc

SEQ ID NO: 221474 - DNA, 25 bp, Rattus norvegicus
caatgaactgctacccgcaaacaat

SEQ ID NO: 221475 - DNA, 25 bp, Rattus norvegicus
caatgaactgcttcccgcaaacaat

SEQ ID NO: 221476 - DNA, 25 bp, Rattus norvegicus
caatgaactttcatagtaatctggg

SEQ ID NO: 221477 - DNA, 25 bp, Rattus norvegicus
caatgaactttcttagtaatctggg

SEQ ID NO: 221478 - DNA, 25 bp, Rattus norvegicus
caatgaagaccaagttctcctgggc

SEQ ID NO: 221479 - DNA, 25 bp, Rattus norvegicus
caatgaagaccatgttctcctgggc

SEQ ID NO: 221480 - DNA, 25 bp, Rattus norvegicus
caatgaagccgacttctaaaccctt

SEQ ID NO: 221481 - DNA, 25 bp, Rattus norvegicus
caatgaagccgagttctaaaccctt

SEQ ID NO: 221482 - DNA, 25 bp, Rattus norvegicus
caatgaatgatacacctggccgatg

SEQ ID NO: 221483 - DNA, 25 bp, Rattus norvegicus
caatgaatgatagacctggccgatg

SEQ ID NO: 221484 - DNA, 25 bp, Rattus norvegicus
caatgacacatcagtccactggttc

SEQ ID NO: 221485 - DNA, 25 bp, Rattus norvegicus
caatgacacatctgtccactggttc

SEQ ID NO: 221486 - DNA, 25 bp, Rattus norvegicus
caatgacaggtcaacaggtgcagtt

SEQ ID NO: 221487 - DNA, 25 bp, Rattus norvegicus
caatgacaggtctacaggtgcagtt

SEQ ID NO: 221488 - DNA, 25 bp, Rattus norvegicus
caatgacatgttcaggcttgccctg

SEQ ID NO: 221489 - DNA, 25 bp, Rattus norvegicus
caatgacatgttgaggcttgccctg

SEQ ID NO: 221490 - DNA, 25 bp, Rattus norvegicus
caatgacattgacctgttcggcagt

SEQ ID NO: 221491 - DNA, 25 bp, Rattus norvegicus
caatgacattgagctgttcggcagt

SEQ ID NO: 221492 - DNA, 25 bp, Rattus norvegicus
caatgacctaccaaacgaaagcagt

SEQ ID NO: 221493 - DNA, 25 bp, Rattus norvegicus
caatgacctacctaacgaaagcagt

SEQ ID NO: 221494 - DNA, 25 bp, Rattus norvegicus
caatgactgttgcttacacttttca

SEQ ID NO: 221495 - DNA, 25 bp, Rattus norvegicus
caatgactgttggttacacttttca

SEQ ID NO: 221496 - DNA, 25 bp, Rattus norvegicus
caatgacttcttccctgttcaagtt

SEQ ID NO: 221497 - DNA, 25 bp, Rattus norvegicus
caatgacttcttgcctgttcaagtt

SEQ ID NO: 221498 - DNA, 25 bp, Rattus norvegicus
caatgagaaggtagtggtccgaaac

SEQ ID NO: 221499 - DNA, 25 bp, Rattus norvegicus
caatgagaaggttgtggtccgaaac

SEQ ID NO: 221500 - DNA, 25 bp, Rattus norvegicus
caatgagccgcaaatgtctgttccc

SEQ ID NO: 221501 - DNA, 25 bp, Rattus norvegicus
caatgagccgcatatgtctgttccc

SEQ ID NO: 221502 - DNA, 25 bp, Rattus norvegicus
caatgagctcttcggtggcagtaca

SEQ ID NO: 221503 - DNA, 25 bp, Rattus norvegicus
caatgagctcttgggtggcagtaca

SEQ ID NO: 221504 - DNA, 25 bp, Rattus norvegicus
caatgaggagatccttgagtttcaa

SEQ ID NO: 221505 - DNA, 25 bp, Rattus norvegicus
caatgaggagatgcttgagtttcaa

SEQ ID NO: 221506 - DNA, 25 bp, Rattus norvegicus
caatgaggatgcaactctgcgctgt

SEQ ID NO: 221507 - DNA, 25 bp, Rattus norvegicus
caatgaggatgctactctgcgctgt

SEQ ID NO: 221508 - DNA, 25 bp, Rattus norvegicus
caatgaggccagcttgtgctatcaa

SEQ ID NO: 221509 - DNA, 25 bp, Rattus norvegicus
caatgaggccaggttgtgctatcaa

SEQ ID NO: 221510 - DNA, 25 bp, Rattus norvegicus
caatgaggcctccacccacgatggg

SEQ ID NO: 221511 - DNA, 25 bp, Rattus norvegicus
caatgaggcctcgacccacgatggg

SEQ ID NO: 221512 - DNA, 25 bp, Rattus norvegicus
caatgaggtcatcggcgtgtgccaa

SEQ ID NO: 221513 - DNA, 25 bp, Rattus norvegicus
caatgaggtcatgggcgtgtgccaa

SEQ ID NO: 221514 - DNA, 25 bp, Rattus norvegicus
caatgaggtgtgcacgctgcttgaa

SEQ ID NO: 221515 - DNA, 25 bp, Rattus norvegicus
caatgaggtgtggacgctgcttgaa

SEQ ID NO: 221516 - DNA, 25 bp, Rattus norvegicus
caatgagttagtcctttctggcttt

SEQ ID NO: 221517 - DNA, 25 bp, Rattus norvegicus
caatgagttagtgctttctggcttt

SEQ ID NO: 221518 - DNA, 25 bp, Rattus norvegicus
caatgagttctcctgttaagtaatg

SEQ ID NO: 221519 - DNA, 25 bp, Rattus norvegicus
caatgagttctcgtgttaagtaatg

SEQ ID NO: 221520 - DNA, 25 bp, Rattus norvegicus
caatgagtttccacagttttttcct

SEQ ID NO: 221521 - DNA, 25 bp, Rattus norvegicus
caatgagtttcctcagttttttcct

SEQ ID NO: 221522 - DNA, 25 bp, Rattus norvegicus
caatgataaattctcgaggacggac

SEQ ID NO: 221523 - DNA, 25 bp, Rattus norvegicus
caatgataaattgtcgaggacggac

SEQ ID NO: 221524 - DNA, 25 bp, Rattus norvegicus
caatgatcatgaactggcccaggcc

SEQ ID NO: 221525 - DNA, 25 bp, Rattus norvegicus
caatgatcatgatctggcccaggcc

SEQ ID NO: 221526 - DNA, 25 bp, Rattus norvegicus
caatgatctgctcttcaaccactgt

SEQ ID NO: 221527 - DNA, 25 bp, Rattus norvegicus
caatgatctgctgttcaaccactgt

SEQ ID NO: 221528 - DNA, 25 bp, Rattus norvegicus
caatgatgacctccttctcactgaa

SEQ ID NO: 221529 - DNA, 25 bp, Rattus norvegicus
caatgatgacctgcttctcactgaa

SEQ ID NO: 221530 - DNA, 25 bp, Rattus norvegicus
caatgatgcagaccccaccagtgat

SEQ ID NO: 221531 - DNA, 25 bp, Rattus norvegicus
caatgatgcagagcccaccagtgat

SEQ ID NO: 221532 - DNA, 25 bp, Rattus norvegicus
caatgatggcaaactgtccctggaa

SEQ ID NO: 221533 - DNA, 25 bp, Rattus norvegicus
caatgatggcaatctgtccctggaa

SEQ ID NO: 221534 - DNA, 25 bp, Rattus norvegicus
caatgattcaagaatgagtcaaatc

SEQ ID NO: 221535 - DNA, 25 bp, Rattus norvegicus
caatgattcaagtatgagtcaaatc

SEQ ID NO: 221536 - DNA, 25 bp, Rattus norvegicus
caatgatttgtgcttctggctgctt

SEQ ID NO: 221537 - DNA, 25 bp, Rattus norvegicus
caatgatttgtggttctggctgctt

SEQ ID NO: 221538 - DNA, 25 bp, Rattus norvegicus
caatgatttttaaggagtgtctgac

SEQ ID NO: 221539 - DNA, 25 bp, Rattus norvegicus
caatgatttttatggagtgtctgac

SEQ ID NO: 221540 - DNA, 25 bp, Rattus norvegicus
caatgcaaatttctgtatggtcttt

SEQ ID NO: 221541 - DNA, 25 bp, Rattus norvegicus
caatgcaaatttgtgtatggtcttt

SEQ ID NO: 221542 - DNA, 25 bp, Rattus norvegicus
caatgcaatactagtaacgtgtgta

SEQ ID NO: 221543 - DNA, 25 bp, Rattus norvegicus
caatgcaatacttgtaacgtgtgta

SEQ ID NO: 221544 - DNA, 25 bp, Rattus norvegicus
caatgcacataacgagctggtaggc

SEQ ID NO: 221545 - DNA, 25 bp, Rattus norvegicus
caatgcacataaggagctggtaggc

SEQ ID NO: 221546 - DNA, 25 bp, Rattus norvegicus
caatgcactgcccaagattctgagc

SEQ ID NO: 221547 - DNA, 25 bp, Rattus norvegicus
caatgcactgccgaagattctgagc

SEQ ID NO: 221548 - DNA, 25 bp, Rattus norvegicus
caatgcactgctacttttcggcata

SEQ ID NO: 221549 - DNA, 25 bp, Rattus norvegicus
caatgcactgcttcttttcggcata

SEQ ID NO: 221550 - DNA, 25 bp, Rattus norvegicus
caatgcactggtcacaaagctcctg

SEQ ID NO: 221551 - DNA, 25 bp, Rattus norvegicus
caatgcactggtgacaaagctcctg

SEQ ID NO: 221552 - DNA, 25 bp, Rattus norvegicus
caatgcagcagcctctggaacagct

SEQ ID NO: 221553 - DNA, 25 bp, Rattus norvegicus
caatgcagcagcgtctggaacagct

SEQ ID NO: 221554 - DNA, 25 bp, Rattus norvegicus
caatgcaggcacattctcaactttc

SEQ ID NO: 221555 - DNA, 25 bp, Rattus norvegicus
caatgcaggcactttctcaactttc

SEQ ID NO: 221556 - DNA, 25 bp, Rattus norvegicus
caatgcaggtcactctccaattatg

SEQ ID NO: 221557 - DNA, 25 bp, Rattus norvegicus
caatgcaggtcagtctccaattatg

SEQ ID NO: 221558 - DNA, 25 bp, Rattus norvegicus
caatgcagtcgtctgtttcctgaaa

SEQ ID NO: 221559 - DNA, 25 bp, Rattus norvegicus
caatgcagtcgtgtgtttcctgaaa

SEQ ID NO: 221560 - DNA, 25 bp, Rattus norvegicus
caatgcatgcaactcagggatgtgg

SEQ ID NO: 221561 - DNA, 25 bp, Rattus norvegicus
caatgcatgcaagtcagggatgtgg

SEQ ID NO: 221562 - DNA, 25 bp, Rattus norvegicus
caatgcatgtatctggtccagcttt

SEQ ID NO: 221563 - DNA, 25 bp, Rattus norvegicus
caatgcatgtatgtggtccagcttt

SEQ ID NO: 221564 - DNA, 25 bp, Rattus norvegicus
caatgcattgctactggttccagct

SEQ ID NO: 221565 - DNA, 25 bp, Rattus norvegicus
caatgcattgcttctggttccagct

SEQ ID NO: 221566 - DNA, 25 bp, Rattus norvegicus
caatgccaaatgctcccttgagaga

SEQ ID NO: 221567 - DNA, 25 bp, Rattus norvegicus
caatgccaaatggtcccttgagaga

SEQ ID NO: 221568 - DNA, 25 bp, Rattus norvegicus
caatgccaaggccaactctggagat

SEQ ID NO: 221569 - DNA, 25 bp, Rattus norvegicus
caatgccaaggcgaactctggagat

SEQ ID NO: 221570 - DNA, 25 bp, Rattus norvegicus
caatgccacatgactgctgggcagt

SEQ ID NO: 221571 - DNA, 25 bp, Rattus norvegicus
caatgccacatgtctgctgggcagt

SEQ ID NO: 221572 - DNA, 25 bp, Rattus norvegicus
caatgccagccaatcagggactgct

SEQ ID NO: 221573 - DNA, 25 bp, Rattus norvegicus
caatgccagccattcagggactgct

SEQ ID NO: 221574 - DNA, 25 bp, Rattus norvegicus
caatgccagcctagtccttttcaga

SEQ ID NO: 221575 - DNA, 25 bp, Rattus norvegicus
caatgccagccttgtccttttcaga

SEQ ID NO: 221576 - DNA, 25 bp, Rattus norvegicus
caatgccagtgcatagccagttagc

SEQ ID NO: 221577 - DNA, 25 bp, Rattus norvegicus
caatgccagtgcttagccagttagc

SEQ ID NO: 221578 - DNA, 25 bp, Rattus norvegicus
caatgcccaatcaccaatacttagg

SEQ ID NO: 221579 - DNA, 25 bp, Rattus norvegicus
caatgcccaatctccaatacttagg

SEQ ID NO: 221580 - DNA, 25 bp, Rattus norvegicus
caatgcccagacaggtatgaccgct

SEQ ID NO: 221581 - DNA, 25 bp, Rattus norvegicus
caatgcccagactggtatgaccgct

SEQ ID NO: 221582 - DNA, 25 bp, Rattus norvegicus
caatgcccatacctgtgatttttta

SEQ ID NO: 221583 - DNA, 25 bp, Rattus norvegicus
caatgcccatacgtgtgatttttta

SEQ ID NO: 221584 - DNA, 25 bp, Rattus norvegicus
caatgccctgagacagccgtatatt

SEQ ID NO: 221585 - DNA, 25 bp, Rattus norvegicus
caatgccctgagatagttatgtcaa

SEQ ID NO: 221586 - DNA, 25 bp, Rattus norvegicus
caatgccctgagtcagccgtatatt

SEQ ID NO: 221587 - DNA, 25 bp, Rattus norvegicus
caatgccctgagttagttatgtcaa

SEQ ID NO: 221588 - DNA, 25 bp, Rattus norvegicus
caatgccctgtacgaaggcttcctt

SEQ ID NO: 221589 - DNA, 25 bp, Rattus norvegicus
caatgccctgtaggaaggcttcctt

SEQ ID NO: 221590 - DNA, 25 bp, Rattus norvegicus
caatgcccttttatggcttccatag

SEQ ID NO: 221591 - DNA, 25 bp, Rattus norvegicus
caatgcccttttttggcttccatag

SEQ ID NO: 221592 - DNA, 25 bp, Rattus norvegicus
caatgccgaggtacactggttactt

SEQ ID NO: 221593 - DNA, 25 bp, Rattus norvegicus
caatgccgaggttcactggttactt

SEQ ID NO: 221594 - DNA, 25 bp, Rattus norvegicus
caatgccggcagaaaggttttaatt

SEQ ID NO: 221595 - DNA, 25 bp, Rattus norvegicus
caatgccggcagtaaggttttaatt

SEQ ID NO: 221596 - DNA, 25 bp, Rattus norvegicus
caatgcctaagaaagccggtgcaac

SEQ ID NO: 221597 - DNA, 25 bp, Rattus norvegicus
caatgcctaagatagccggtgcaac

SEQ ID NO: 221598 - DNA, 25 bp, Rattus norvegicus
caatgcctattgaatcctggactgt

SEQ ID NO: 221599 - DNA, 25 bp, Rattus norvegicus
caatgcctattgtatcctggactgt

SEQ ID NO: 221600 - DNA, 25 bp, Rattus norvegicus
caatgcctgcttacagagagcgatt

SEQ ID NO: 221601 - DNA, 25 bp, Rattus norvegicus
caatgcctgctttcagagagcgatt

SEQ ID NO: 221602 - DNA, 25 bp, Rattus norvegicus
caatgcctggagcacaccctatggg

SEQ ID NO: 221603 - DNA, 25 bp, Rattus norvegicus
caatgcctggaggacaccctatggg

SEQ ID NO: 221604 - DNA, 25 bp, Rattus norvegicus
caatgcctgggaaggtggcactgct

SEQ ID NO: 221605 - DNA, 25 bp, Rattus norvegicus
caatgcctgggatggtggcactgct

SEQ ID NO: 221606 - DNA, 25 bp, Rattus norvegicus
caatgccttcatacactgctttaat

SEQ ID NO: 221607 - DNA, 25 bp, Rattus norvegicus
caatgccttcattcactgctttaat

SEQ ID NO: 221608 - DNA, 25 bp, Rattus norvegicus
caatgccttctgatttgcaggcata

SEQ ID NO: 221609 - DNA, 25 bp, Rattus norvegicus
caatgccttctgttttgcaggcata

SEQ ID NO: 221610 - DNA, 25 bp, Rattus norvegicus
caatgccttggaaattgctcccaga

SEQ ID NO: 221611 - DNA, 25 bp, Rattus norvegicus
caatgccttggatattgctcccaga

SEQ ID NO: 221612 - DNA, 25 bp, Rattus norvegicus
caatgccttgtcaaggttgtcagaa

SEQ ID NO: 221613 - DNA, 25 bp, Rattus norvegicus
caatgccttgtctaggttgtcagaa

SEQ ID NO: 221614 - DNA, 25 bp, Rattus norvegicus
caatgcgctggtcgtcggactgcac

SEQ ID NO: 221615 - DNA, 25 bp, Rattus norvegicus
caatgcgctggtggtcggactgcac

SEQ ID NO: 221616 - DNA, 25 bp, Rattus norvegicus
caatgcgggcacacgctcttacagt

SEQ ID NO: 221617 - DNA, 25 bp, Rattus norvegicus
caatgcgggcactcgctcttacagt

SEQ ID NO: 221618 - DNA, 25 bp, Rattus norvegicus
caatgcggtggcagacatgttgcgt

SEQ ID NO: 221619 - DNA, 25 bp, Rattus norvegicus
caatgcggtggctgacatgttgcgt

SEQ ID NO: 221620 - DNA, 25 bp, Rattus norvegicus
caatgcgtttgtcccgatggtttcc

SEQ ID NO: 221621 - DNA, 25 bp, Rattus norvegicus
caatgcgtttgtgccgatggtttcc

SEQ ID NO: 221622 - DNA, 25 bp, Rattus norvegicus
caatgctattcaactacctctatct

SEQ ID NO: 221623 - DNA, 25 bp, Rattus norvegicus
caatgctattcatctacctctatct

SEQ ID NO: 221624 - DNA, 25 bp, Rattus norvegicus
caatgctcaccaagtacctggaggt

SEQ ID NO: 221625 - DNA, 25 bp, Rattus norvegicus
caatgctcaccatgtacctggaggt

SEQ ID NO: 221626 - DNA, 25 bp, Rattus norvegicus
caatgctcagcacgcgttcgtcgtt

SEQ ID NO: 221627 - DNA, 25 bp, Rattus norvegicus
caatgctcagcaggcgttcgtcgtt

SEQ ID NO: 221628 - DNA, 25 bp, Rattus norvegicus
caatgctccaaaccgttgagccatc

SEQ ID NO: 221629 - DNA, 25 bp, Rattus norvegicus
caatgctccaaagcgttgagccatc

SEQ ID NO: 221630 - DNA, 25 bp, Rattus norvegicus
caatgctctcatctggtttcaaggc

SEQ ID NO: 221631 - DNA, 25 bp, Rattus norvegicus
caatgctctcatgtggtttcaaggc

SEQ ID NO: 221632 - DNA, 25 bp, Rattus norvegicus
caatgctcttggctgtctgggtgct

SEQ ID NO: 221633 - DNA, 25 bp, Rattus norvegicus
caatgctcttgggtgtctgggtgct

SEQ ID NO: 221634 - DNA, 25 bp, Rattus norvegicus
caatgctgacagaccagggtgtgct

SEQ ID NO: 221635 - DNA, 25 bp, Rattus norvegicus
caatgctgacagtccagggtgtgct

SEQ ID NO: 221636 - DNA, 25 bp, Rattus norvegicus
caatgctgacatcgtaactctgcta

SEQ ID NO: 221637 - DNA, 25 bp, Rattus norvegicus
caatgctgacatggtaactctgcta

SEQ ID NO: 221638 - DNA, 25 bp, Rattus norvegicus
caatgctgccatccggaataccaaa

SEQ ID NO: 221639 - DNA, 25 bp, Rattus norvegicus
caatgctgccatgcggaataccaaa

SEQ ID NO: 221640 - DNA, 25 bp, Rattus norvegicus
caatgctggcagatgtttgaaacct

SEQ ID NO: 221641 - DNA, 25 bp, Rattus norvegicus
caatgctggcagttgtttgaaacct

SEQ ID NO: 221642 - DNA, 25 bp, Rattus norvegicus
caatgctggttgactggttttgttg

SEQ ID NO: 221643 - DNA, 25 bp, Rattus norvegicus
caatgctggttgtctggttttgttg

SEQ ID NO: 221644 - DNA, 25 bp, Rattus norvegicus
caatgctgtaatcctgtgagatgtt

SEQ ID NO: 221645 - DNA, 25 bp, Rattus norvegicus
caatgctgtaatgctgtgagatgtt

SEQ ID NO: 221646 - DNA, 25 bp, Rattus norvegicus
caatgcttatgcaagggcccaggaa

SEQ ID NO: 221647 - DNA, 25 bp, Rattus norvegicus
caatgcttatgctagggcccaggaa

SEQ ID NO: 221648 - DNA, 25 bp, Rattus norvegicus
caatgcttcattcttggtgaccaga

SEQ ID NO: 221649 - DNA, 25 bp, Rattus norvegicus
caatgcttcattgttggtgaccaga

SEQ ID NO: 221650 - DNA, 25 bp, Rattus norvegicus
caatgcttgaagacccttgggctgg

SEQ ID NO: 221651 - DNA, 25 bp, Rattus norvegicus
caatgcttgaagtcccttgggctgg

SEQ ID NO: 221652 - DNA, 25 bp, Rattus norvegicus
caatgcttgcagagcccctcaacta

SEQ ID NO: 221653 - DNA, 25 bp, Rattus norvegicus
caatgcttgcagtgcccctcaacta

SEQ ID NO: 221654 - DNA, 25 bp, Rattus norvegicus
caatgcttgctacatggaggaactg

SEQ ID NO: 221655 - DNA, 25 bp, Rattus norvegicus
caatgcttgctagatggaggaactg

SEQ ID NO: 221656 - DNA, 25 bp, Rattus norvegicus
caatgcttgtcactaagagcctaca

SEQ ID NO: 221657 - DNA, 25 bp, Rattus norvegicus
caatgcttgtcagtaagagcctaca

SEQ ID NO: 221658 - DNA, 25 bp, Rattus norvegicus
caatgctttaggatccccaggaaaa

SEQ ID NO: 221659 - DNA, 25 bp, Rattus norvegicus
caatgctttaggttccccaggaaaa

SEQ ID NO: 221660 - DNA, 25 bp, Rattus norvegicus
caatgctttctacctgaaatgtgta

SEQ ID NO: 221661 - DNA, 25 bp, Rattus norvegicus
caatgctttctagctgaaatgtgta

SEQ ID NO: 221662 - DNA, 25 bp, Rattus norvegicus
caatgctttgcaagcgtgtcatagc

SEQ ID NO: 221663 - DNA, 25 bp, Rattus norvegicus
caatgctttgcatgcgtgtcatagc

SEQ ID NO: 221664 - DNA, 25 bp, Rattus norvegicus
caatggaacaccaagggacaccctt

SEQ ID NO: 221665 - DNA, 25 bp, Rattus norvegicus
caatggaacacctagggacaccctt

SEQ ID NO: 221666 - DNA, 25 bp, Rattus norvegicus
caatggaagggtagtctcctggctg

SEQ ID NO: 221667 - DNA, 25 bp, Rattus norvegicus
caatggaagggttgtctcctggctg

SEQ ID NO: 221668 - DNA, 25 bp, Rattus norvegicus
caatggaatagactgctgtgcactt

SEQ ID NO: 221669 - DNA, 25 bp, Rattus norvegicus
caatggaatagagtgctgtgcactt

SEQ ID NO: 221670 - DNA, 25 bp, Rattus norvegicus
caatggacccagaaactcagtgtta

SEQ ID NO: 221671 - DNA, 25 bp, Rattus norvegicus
caatggacccagtaactcagtgtta

SEQ ID NO: 221672 - DNA, 25 bp, Rattus norvegicus
caatggacccgacagacagagaatt

SEQ ID NO: 221673 - DNA, 25 bp, Rattus norvegicus
caatggacccgagagacagagaatt

SEQ ID NO: 221674 - DNA, 25 bp, Rattus norvegicus
caatggagaccacaggaggctgtca

SEQ ID NO: 221675 - DNA, 25 bp, Rattus norvegicus
caatggagaccagaggaggctgtca

SEQ ID NO: 221676 - DNA, 25 bp, Rattus norvegicus
caatggagagctcggtgtgtacctt

SEQ ID NO: 221677 - DNA, 25 bp, Rattus norvegicus
caatggagagctgggtgtgtacctt

SEQ ID NO: 221678 - DNA, 25 bp, Rattus norvegicus
caatggagattaagccctgtggaag

SEQ ID NO: 221679 - DNA, 25 bp, Rattus norvegicus
caatggagattatgccctgtggaag

SEQ ID NO: 221680 - DNA, 25 bp, Rattus norvegicus
caatggataaagagacatctaattt

SEQ ID NO: 221681 - DNA, 25 bp, Rattus norvegicus
caatggataaagtgacatctaattt

SEQ ID NO: 221682 - DNA, 25 bp, Rattus norvegicus
caatggatggtccttcggaactgct

SEQ ID NO: 221683 - DNA, 25 bp, Rattus norvegicus
caatggatggtcgttcggaactgct

SEQ ID NO: 221684 - DNA, 25 bp, Rattus norvegicus
caatggcagttcatcctagtggagc

SEQ ID NO: 221685 - DNA, 25 bp, Rattus norvegicus
caatggcagttcttcctagtggagc

SEQ ID NO: 221686 - DNA, 25 bp, Rattus norvegicus
caatggcatgctcttgccctttgag

SEQ ID NO: 221687 - DNA, 25 bp, Rattus norvegicus
caatggcatgctgttgccctttgag

SEQ ID NO: 221688 - DNA, 25 bp, Rattus norvegicus
caatggccatagcaagtctgaacgg

SEQ ID NO: 221689 - DNA, 25 bp, Rattus norvegicus
caatggccataggaagtctgaacgg

SEQ ID NO: 221690 - DNA, 25 bp, Rattus norvegicus
caatggccccatccggataaccagt

SEQ ID NO: 221691 - DNA, 25 bp, Rattus norvegicus
caatggccccatgcggataaccagt

SEQ ID NO: 221692 - DNA, 25 bp, Rattus norvegicus
caatggcgagcgaggtcaggaaaca

SEQ ID NO: 221693 - DNA, 25 bp, Rattus norvegicus
caatggcgagcgtggtcaggaaaca

SEQ ID NO: 221694 - DNA, 25 bp, Rattus norvegicus
caatggcgtgatcccatctgaggat

SEQ ID NO: 221695 - DNA, 25 bp, Rattus norvegicus
caatggcgtgatgccatctgaggat

SEQ ID NO: 221696 - DNA, 25 bp, Rattus norvegicus
caatggctagagcaatccacggaaa

SEQ ID NO: 221697 - DNA, 25 bp, Rattus norvegicus
caatggctagagcaccttgggtgtt

SEQ ID NO: 221698 - DNA, 25 bp, Rattus norvegicus
caatggctagaggaatccacggaaa

SEQ ID NO: 221699 - DNA, 25 bp, Rattus norvegicus
caatggctagaggaccttgggtgtt

SEQ ID NO: 221700 - DNA, 25 bp, Rattus norvegicus
caatggctccggactggtgaaggct

SEQ ID NO: 221701 - DNA, 25 bp, Rattus norvegicus
caatggctccggtctggtgaaggct

SEQ ID NO: 221702 - DNA, 25 bp, Rattus norvegicus
caatggctctgaaaggatctgctgc

SEQ ID NO: 221703 - DNA, 25 bp, Rattus norvegicus
caatggctctgataggatctgctgc

SEQ ID NO: 221704 - DNA, 25 bp, Rattus norvegicus
caatggctgattctagttagttcat

SEQ ID NO: 221705 - DNA, 25 bp, Rattus norvegicus
caatggctgattgtagttagttcat

SEQ ID NO: 221706 - DNA, 25 bp, Rattus norvegicus
caatggctgctcatgactgttactc

SEQ ID NO: 221707 - DNA, 25 bp, Rattus norvegicus
caatggctgctcttgactgttactc

SEQ ID NO: 221708 - DNA, 25 bp, Rattus norvegicus
caatggcttctacctccgagctgac

SEQ ID NO: 221709 - DNA, 25 bp, Rattus norvegicus
caatggcttctagctccgagctgac

SEQ ID NO: 221710 - DNA, 25 bp, Rattus norvegicus
caatggcttgggaatacctttgtca

SEQ ID NO: 221711 - DNA, 25 bp, Rattus norvegicus
caatggcttgggtatacctttgtca

SEQ ID NO: 221712 - DNA, 25 bp, Rattus norvegicus
caatggcttgttaaattccggtgct

SEQ ID NO: 221713 - DNA, 25 bp, Rattus norvegicus
caatggcttgtttaattccggtgct

SEQ ID NO: 221714 - DNA, 25 bp, Rattus norvegicus
caatggctttcccaacgagtactgg

SEQ ID NO: 221715 - DNA, 25 bp, Rattus norvegicus
caatggctttccgaacgagtactgg

SEQ ID NO: 221716 - DNA, 25 bp, Rattus norvegicus
caatgggaaccactgtttcaagatg

SEQ ID NO: 221717 - DNA, 25 bp, Rattus norvegicus
caatgggaaccagtgtttcaagatg

SEQ ID NO: 221718 - DNA, 25 bp, Rattus norvegicus
caatgggaagtcctgtctgccgtga

SEQ ID NO: 221719 - DNA, 25 bp, Rattus norvegicus
caatgggaagtcgtgtctgccgtga

SEQ ID NO: 221720 - DNA, 25 bp, Rattus norvegicus
caatgggacaagcaaagttgactaa

SEQ ID NO: 221721 - DNA, 25 bp, Rattus norvegicus
caatgggacaaggaaagttgactaa

SEQ ID NO: 221722 - DNA, 25 bp, Rattus norvegicus
caatgggacgccagagcttcagaac

SEQ ID NO: 221723 - DNA, 25 bp, Rattus norvegicus
caatgggacgcctgagcttcagaac

SEQ ID NO: 221724 - DNA, 25 bp, Rattus norvegicus
caatgggactcacggcaatagcaca

SEQ ID NO: 221725 - DNA, 25 bp, Rattus norvegicus
caatgggactcagggcaatagcaca

SEQ ID NO: 221726 - DNA, 25 bp, Rattus norvegicus
caatgggagcccagttgagagcctc

SEQ ID NO: 221727 - DNA, 25 bp, Rattus norvegicus
caatgggagccctgttgagagcctc

SEQ ID NO: 221728 - DNA, 25 bp, Rattus norvegicus
caatgggcccaaagtttgaaaagtc

SEQ ID NO: 221729 - DNA, 25 bp, Rattus norvegicus
caatgggcccaatgtttgaaaagtc

SEQ ID NO: 221730 - DNA, 25 bp, Rattus norvegicus
caatgggcctgtcactcttctaagc

SEQ ID NO: 221731 - DNA, 25 bp, Rattus norvegicus
caatgggcctgtgactcttctaagc

SEQ ID NO: 221732 - DNA, 25 bp, Rattus norvegicus
caatgggctactcctacttgtgtgt

SEQ ID NO: 221733 - DNA, 25 bp, Rattus norvegicus
caatgggctactgctacttgtgtgt

SEQ ID NO: 221734 - DNA, 25 bp, Rattus norvegicus
caatgggcttccataaacaggcgac

SEQ ID NO: 221735 - DNA, 25 bp, Rattus norvegicus
caatgggcttccttaaacaggcgac

SEQ ID NO: 221736 - DNA, 25 bp, Rattus norvegicus
caatgggtatttatggtctgtgact

SEQ ID NO: 221737 - DNA, 25 bp, Rattus norvegicus
caatgggtatttttggtctgtgact

SEQ ID NO: 221738 - DNA, 25 bp, Rattus norvegicus
caatgggtccgtcaacatgctcaac

SEQ ID NO: 221739 - DNA, 25 bp, Rattus norvegicus
caatgggtccgtgaacatgctcaac

SEQ ID NO: 221740 - DNA, 25 bp, Rattus norvegicus
caatgggtttacagtgtttctcctt

SEQ ID NO: 221741 - DNA, 25 bp, Rattus norvegicus
caatgggtttactgtgtttctcctt

SEQ ID NO: 221742 - DNA, 25 bp, Rattus norvegicus
caatggtcccaacttgttctttatc

SEQ ID NO: 221743 - DNA, 25 bp, Rattus norvegicus
caatggtcccaagttgttctttatc

SEQ ID NO: 221744 - DNA, 25 bp, Rattus norvegicus
caatggtcgtgcacgccagagagag

SEQ ID NO: 221745 - DNA, 25 bp, Rattus norvegicus
caatggtcgtgctcgccagagagag

SEQ ID NO: 221746 - DNA, 25 bp, Rattus norvegicus
caatggtgcaagagtctctagccag

SEQ ID NO: 221747 - DNA, 25 bp, Rattus norvegicus
caatggtgcaagtgtctctagccag

SEQ ID NO: 221748 - DNA, 25 bp, Rattus norvegicus
caatggtgccgtaaatagatgtgtt

SEQ ID NO: 221749 - DNA, 25 bp, Rattus norvegicus
caatggtgccgttaatagatgtgtt

SEQ ID NO: 221750 - DNA, 25 bp, Rattus norvegicus
caatggtggttcagcgaggtccgct

SEQ ID NO: 221751 - DNA, 25 bp, Rattus norvegicus
caatggtggttctgcgaggtccgct

SEQ ID NO: 221752 - DNA, 25 bp, Rattus norvegicus
caatggtgtcagatggacttttgct

SEQ ID NO: 221753 - DNA, 25 bp, Rattus norvegicus
caatggtgtcagttggacttttgct

SEQ ID NO: 221754 - DNA, 25 bp, Rattus norvegicus
caatggtgtcctcagtgttcttcag

SEQ ID NO: 221755 - DNA, 25 bp, Rattus norvegicus
caatggtgtcctgagtgttcttcag

SEQ ID NO: 221756 - DNA, 25 bp, Rattus norvegicus
caatggtgtgcacggacctacagtc

SEQ ID NO: 221757 - DNA, 25 bp, Rattus norvegicus
caatggtgtgcagggacctacagtc

SEQ ID NO: 221758 - DNA, 25 bp, Rattus norvegicus
caatggttccatatgtatcatctgt

SEQ ID NO: 221759 - DNA, 25 bp, Rattus norvegicus
caatggttccatttgtatcatctgt

SEQ ID NO: 221760 - DNA, 25 bp, Rattus norvegicus
caatggtttaggatttctactgaca

SEQ ID NO: 221761 - DNA, 25 bp, Rattus norvegicus
caatggtttaggttttctactgaca

SEQ ID NO: 221762 - DNA, 25 bp, Rattus norvegicus
caatggttttctcggcatggcgacc

SEQ ID NO: 221763 - DNA, 25 bp, Rattus norvegicus
caatggttttctgggcatggcgacc

SEQ ID NO: 221764 - DNA, 25 bp, Rattus norvegicus
caatgtaagagcctctcctgtggct

SEQ ID NO: 221765 - DNA, 25 bp, Rattus norvegicus
caatgtaagagcgtctcctgtggct

SEQ ID NO: 221766 - DNA, 25 bp, Rattus norvegicus
caatgtaagctcacacagggccgga

SEQ ID NO: 221767 - DNA, 25 bp, Rattus norvegicus
caatgtaagctctcacagggccgga

SEQ ID NO: 221768 - DNA, 25 bp, Rattus norvegicus
caatgtacaatgcttttcatttcag

SEQ ID NO: 221769 - DNA, 25 bp, Rattus norvegicus
caatgtacaatggttttcatttcag

SEQ ID NO: 221770 - DNA, 25 bp, Rattus norvegicus
caatgtacatctccttgatctcaaa

SEQ ID NO: 221771 - DNA, 25 bp, Rattus norvegicus
caatgtacatctgcttgatctcaaa

SEQ ID NO: 221772 - DNA, 25 bp, Rattus norvegicus
caatgtagcactcccaactgactgg

SEQ ID NO: 221773 - DNA, 25 bp, Rattus norvegicus
caatgtagcactgccaactgactgg

SEQ ID NO: 221774 - DNA, 25 bp, Rattus norvegicus
caatgtagccctctccacagcaggg

SEQ ID NO: 221775 - DNA, 25 bp, Rattus norvegicus
caatgtagccctgtccacagcaggg

SEQ ID NO: 221776 - DNA, 25 bp, Rattus norvegicus
caatgtaggaaaacgggctggagta

SEQ ID NO: 221777 - DNA, 25 bp, Rattus norvegicus
caatgtaggaaatcgggctggagta

SEQ ID NO: 221778 - DNA, 25 bp, Rattus norvegicus
caatgtatcatcacatcctgaacgc

SEQ ID NO: 221779 - DNA, 25 bp, Rattus norvegicus
caatgtatcatctcatcctgaacgc

SEQ ID NO: 221780 - DNA, 25 bp, Rattus norvegicus
caatgtattggtcatcttcagtata

SEQ ID NO: 221781 - DNA, 25 bp, Rattus norvegicus
caatgtattggtgatcttcagtata

SEQ ID NO: 221782 - DNA, 25 bp, Rattus norvegicus
caatgtcaccccagtgctttatctc

SEQ ID NO: 221783 - DNA, 25 bp, Rattus norvegicus
caatgtcacccctgtgctttatctc

SEQ ID NO: 221784 - DNA, 25 bp, Rattus norvegicus
caatgtcacttaacctgcagcagac

SEQ ID NO: 221785 - DNA, 25 bp, Rattus norvegicus
caatgtcacttatcctgcagcagac

SEQ ID NO: 221786 - DNA, 25 bp, Rattus norvegicus
caatgtcaggtcctcctgataagat

SEQ ID NO: 221787 - DNA, 25 bp, Rattus norvegicus
caatgtcaggtcgtcctgataagat

SEQ ID NO: 221788 - DNA, 25 bp, Rattus norvegicus
caatgtcagttacaagcccgtgcgg

SEQ ID NO: 221789 - DNA, 25 bp, Rattus norvegicus
caatgtcagttagaagcccgtgcgg

SEQ ID NO: 221790 - DNA, 25 bp, Rattus norvegicus
caatgtcatcttctgcatgtggtga

SEQ ID NO: 221791 - DNA, 25 bp, Rattus norvegicus
caatgtcatcttgtgcatgtggtga

SEQ ID NO: 221792 - DNA, 25 bp, Rattus norvegicus
caatgtcatgtacaagtgggtgcaa

SEQ ID NO: 221793 - DNA, 25 bp, Rattus norvegicus
caatgtcatgtagaagtgggtgcaa

SEQ ID NO: 221794 - DNA, 25 bp, Rattus norvegicus
caatgtcatttgactgttagtccca

SEQ ID NO: 221795 - DNA, 25 bp, Rattus norvegicus
caatgtcatttgtctgttagtccca

SEQ ID NO: 221796 - DNA, 25 bp, Rattus norvegicus
caatgtcattttagccttggtggat

SEQ ID NO: 221797 - DNA, 25 bp, Rattus norvegicus
caatgtcatttttgccttggtggat

SEQ ID NO: 221798 - DNA, 25 bp, Rattus norvegicus
caatgtccacccatcttgggaatta

SEQ ID NO: 221799 - DNA, 25 bp, Rattus norvegicus
caatgtccacccttcttgggaatta

SEQ ID NO: 221800 - DNA, 25 bp, Rattus norvegicus
caatgtccgtgccatgttgagtata

SEQ ID NO: 221801 - DNA, 25 bp, Rattus norvegicus
caatgtccgtgcgatgttgagtata

SEQ ID NO: 221802 - DNA, 25 bp, Rattus norvegicus
caatgtccttgacggcgatgagcaa

SEQ ID NO: 221803 - DNA, 25 bp, Rattus norvegicus
caatgtccttgagggcgatgagcaa

SEQ ID NO: 221804 - DNA, 25 bp, Rattus norvegicus
caatgtctcattcctctcactgtgc

SEQ ID NO: 221805 - DNA, 25 bp, Rattus norvegicus
caatgtctcattgctctcactgtgc

SEQ ID NO: 221806 - DNA, 25 bp, Rattus norvegicus
caatgtctctggcactccaataaac

SEQ ID NO: 221807 - DNA, 25 bp, Rattus norvegicus
caatgtctctgggactccaataaac

SEQ ID NO: 221808 - DNA, 25 bp, Rattus norvegicus
caatgtctgattaaaatttctgtgt

SEQ ID NO: 221809 - DNA, 25 bp, Rattus norvegicus
caatgtctgatttaaatttctgtgt

SEQ ID NO: 221810 - DNA, 25 bp, Rattus norvegicus
caatgtctggataggcctccatgat

SEQ ID NO: 221811 - DNA, 25 bp, Rattus norvegicus
caatgtctggattggcctccatgat

SEQ ID NO: 221812 - DNA, 25 bp, Rattus norvegicus
caatgtctggtacttctgtgtggtg

SEQ ID NO: 221813 - DNA, 25 bp, Rattus norvegicus
caatgtctggtagttctgtgtggtg

SEQ ID NO: 221814 - DNA, 25 bp, Rattus norvegicus
caatgtctgtaaccaggtgtgcctg

SEQ ID NO: 221815 - DNA, 25 bp, Rattus norvegicus
caatgtctgtaagcaggtgtgcctg

SEQ ID NO: 221816 - DNA, 25 bp, Rattus norvegicus
caatgtctgtctcccgaggttggaa

SEQ ID NO: 221817 - DNA, 25 bp, Rattus norvegicus
caatgtctgtctgccgaggttggaa

SEQ ID NO: 221818 - DNA, 25 bp, Rattus norvegicus
caatgtctgttcagcccttaaataa

SEQ ID NO: 221819 - DNA, 25 bp, Rattus norvegicus
caatgtctgttctgcccttaaataa

SEQ ID NO: 221820 - DNA, 25 bp, Rattus norvegicus
caatgtctgtttatattcaggactt

SEQ ID NO: 221821 - DNA, 25 bp, Rattus norvegicus
caatgtctgtttttattcaggactt

SEQ ID NO: 221822 - DNA, 25 bp, Rattus norvegicus
caatgtcttctaccttgtcagccaa

SEQ ID NO: 221823 - DNA, 25 bp, Rattus norvegicus
caatgtcttctagcttgtcagccaa

SEQ ID NO: 221824 - DNA, 25 bp, Rattus norvegicus
caatgtcttggtacttgctgctatt

SEQ ID NO: 221825 - DNA, 25 bp, Rattus norvegicus
caatgtcttggttcttgctgctatt

SEQ ID NO: 221826 - DNA, 25 bp, Rattus norvegicus
caatgtgaagctcgtttcgctcctc

SEQ ID NO: 221827 - DNA, 25 bp, Rattus norvegicus
caatgtgaagctggtttcgctcctc

SEQ ID NO: 221828 - DNA, 25 bp, Rattus norvegicus
caatgtgacatcagaaacttaggga

SEQ ID NO: 221829 - DNA, 25 bp, Rattus norvegicus
caatgtgacatctgaaacttaggga

SEQ ID NO: 221830 - DNA, 25 bp, Rattus norvegicus
caatgtgaggccatacccagttgat

SEQ ID NO: 221831 - DNA, 25 bp, Rattus norvegicus
caatgtgaggccttacccagttgat

SEQ ID NO: 221832 - DNA, 25 bp, Rattus norvegicus
caatgtgatggaccggctccactgc

SEQ ID NO: 221833 - DNA, 25 bp, Rattus norvegicus
caatgtgatggagcggctccactgc

SEQ ID NO: 221834 - DNA, 25 bp, Rattus norvegicus
caatgtgccatgaccgaagcggttg

SEQ ID NO: 221835 - DNA, 25 bp, Rattus norvegicus
caatgtgccatgtccgaagcggttg

SEQ ID NO: 221836 - DNA, 25 bp, Rattus norvegicus
caatgtgctttgattaggccgtgaa

SEQ ID NO: 221837 - DNA, 25 bp, Rattus norvegicus
caatgtgctttgtttaggccgtgaa

SEQ ID NO: 221838 - DNA, 25 bp, Rattus norvegicus
caatgtggaaggctccagcccactg

SEQ ID NO: 221839 - DNA, 25 bp, Rattus norvegicus
caatgtggaagggtccagcccactg

SEQ ID NO: 221840 - DNA, 25 bp, Rattus norvegicus
caatgtggagcgagtcttccaggac

SEQ ID NO: 221841 - DNA, 25 bp, Rattus norvegicus
caatgtggagcgtgtcttccaggac

SEQ ID NO: 221842 - DNA, 25 bp, Rattus norvegicus
caatgtggagttccgcaaagccttc

SEQ ID NO: 221843 - DNA, 25 bp, Rattus norvegicus
caatgtggagttgcgcaaagccttc

SEQ ID NO: 221844 - DNA, 25 bp, Rattus norvegicus
caatgtggcactccagctgctggta

SEQ ID NO: 221845 - DNA, 25 bp, Rattus norvegicus
caatgtggcactgcagctgctggta

SEQ ID NO: 221846 - DNA, 25 bp, Rattus norvegicus
caatgtggccttcgagtgctgagca

SEQ ID NO: 221847 - DNA, 25 bp, Rattus norvegicus
caatgtggccttggagtgctgagca

SEQ ID NO: 221848 - DNA, 25 bp, Rattus norvegicus
caatgtgggtgcaatgtcctggtgt

SEQ ID NO: 221849 - DNA, 25 bp, Rattus norvegicus
caatgtgggtgcactgggtcctgct

SEQ ID NO: 221850 - DNA, 25 bp, Rattus norvegicus
caatgtgggtgctatgtcctggtgt

SEQ ID NO: 221851 - DNA, 25 bp, Rattus norvegicus
caatgtgggtgctctgggtcctgct

SEQ ID NO: 221852 - DNA, 25 bp, Rattus norvegicus
caatgtggttccaattcatgtccca

SEQ ID NO: 221853 - DNA, 25 bp, Rattus norvegicus
caatgtggttcctattcatgtccca

SEQ ID NO: 221854 - DNA, 25 bp, Rattus norvegicus
caatgtgtaaaactcccagggtaag

SEQ ID NO: 221855 - DNA, 25 bp, Rattus norvegicus
caatgtgtaaaagtcccagggtaag

SEQ ID NO: 221856 - DNA, 25 bp, Rattus norvegicus
caatgtgtaaatatcaacaggtttt

SEQ ID NO: 221857 - DNA, 25 bp, Rattus norvegicus
caatgtgtaaatttcaacaggtttt

SEQ ID NO: 221858 - DNA, 25 bp, Rattus norvegicus
caatgtgtactgagtggcgcttcaa

SEQ ID NO: 221859 - DNA, 25 bp, Rattus norvegicus
caatgtgtactgtgtggcgcttcaa

SEQ ID NO: 221860 - DNA, 25 bp, Rattus norvegicus
caatgtgtagtcactgaagtgggca

SEQ ID NO: 221861 - DNA, 25 bp, Rattus norvegicus
caatgtgtagtctctgaagtgggca

SEQ ID NO: 221862 - DNA, 25 bp, Rattus norvegicus
caatgtgtcaccatcacgactgctg

SEQ ID NO: 221863 - DNA, 25 bp, Rattus norvegicus
caatgtgtcaccttcacgactgctg

SEQ ID NO: 221864 - DNA, 25 bp, Rattus norvegicus
caatgtgtccgtatcattatggagc

SEQ ID NO: 221865 - DNA, 25 bp, Rattus norvegicus
caatgtgtccgtttcattatggagc

SEQ ID NO: 221866 - DNA, 25 bp, Rattus norvegicus
caatgtgtcgtcctctgtttaaaag

SEQ ID NO: 221867 - DNA, 25 bp, Rattus norvegicus
caatgtgtcgtcgtctgtttaaaag

SEQ ID NO: 221868 - DNA, 25 bp, Rattus norvegicus
caatgtgtgcgtccctagagccaga

SEQ ID NO: 221869 - DNA, 25 bp, Rattus norvegicus
caatgtgtgcgtgcctagagccaga

SEQ ID NO: 221870 - DNA, 25 bp, Rattus norvegicus
caatgtgtggatattgcctcttaca

SEQ ID NO: 221871 - DNA, 25 bp, Rattus norvegicus
caatgtgtggattttgcctcttaca

SEQ ID NO: 221872 - DNA, 25 bp, Rattus norvegicus
caatgtgtgttcagaggtgactgta

SEQ ID NO: 221873 - DNA, 25 bp, Rattus norvegicus
caatgtgtgttctgaggtgactgta

SEQ ID NO: 221874 - DNA, 25 bp, Rattus norvegicus
caatgtgttaagagccttgttgtaa

SEQ ID NO: 221875 - DNA, 25 bp, Rattus norvegicus
caatgtgttaagtgccttgttgtaa

SEQ ID NO: 221876 - DNA, 25 bp, Rattus norvegicus
caatgtgttcatcttcctttcatag

SEQ ID NO: 221877 - DNA, 25 bp, Rattus norvegicus
caatgtgttcatgttcctttcatag

SEQ ID NO: 221878 - DNA, 25 bp, Rattus norvegicus
caatgttacatccactggcctggaa

SEQ ID NO: 221879 - DNA, 25 bp, Rattus norvegicus
caatgttacatcgactggcctggaa

SEQ ID NO: 221880 - DNA, 25 bp, Rattus norvegicus
caatgttactggctgtttcttttct

SEQ ID NO: 221881 - DNA, 25 bp, Rattus norvegicus
caatgttactgggtgtttcttttct

SEQ ID NO: 221882 - DNA, 25 bp, Rattus norvegicus
caatgttagatgatcaccctctctc

SEQ ID NO: 221883 - DNA, 25 bp, Rattus norvegicus
caatgttagatgttcaccctctctc

SEQ ID NO: 221884 - DNA, 25 bp, Rattus norvegicus
caatgttagcacattctgtttctcc

SEQ ID NO: 221885 - DNA, 25 bp, Rattus norvegicus
caatgttagcactttctgtttctcc

SEQ ID NO: 221886 - DNA, 25 bp, Rattus norvegicus
caatgttcactcattaggttcttta

SEQ ID NO: 221887 - DNA, 25 bp, Rattus norvegicus
caatgttcactctttaggttcttta

SEQ ID NO: 221888 - DNA, 25 bp, Rattus norvegicus
caatgttccagcaacgtgtgtatgt

SEQ ID NO: 221889 - DNA, 25 bp, Rattus norvegicus
caatgttccagctacgtgtgtatgt

SEQ ID NO: 221890 - DNA, 25 bp, Rattus norvegicus
caatgttctaaaccctttcctacag

SEQ ID NO: 221891 - DNA, 25 bp, Rattus norvegicus
caatgttctaaagcctttcctacag

SEQ ID NO: 221892 - DNA, 25 bp, Rattus norvegicus
caatgttctcaaagttttcatagtt

SEQ ID NO: 221893 - DNA, 25 bp, Rattus norvegicus
caatgttctcaatgttttcatagtt

SEQ ID NO: 221894 - DNA, 25 bp, Rattus norvegicus
caatgttctcagaatcaaggaccaa

SEQ ID NO: 221895 - DNA, 25 bp, Rattus norvegicus
caatgttctcagtatcaaggaccaa

SEQ ID NO: 221896 - DNA, 25 bp, Rattus norvegicus
caatgttctccgattgcagtcgaga

SEQ ID NO: 221897 - DNA, 25 bp, Rattus norvegicus
caatgttctccgtttgcagtcgaga

SEQ ID NO: 221898 - DNA, 25 bp, Rattus norvegicus
caatgttctgttactgtttttccaa

SEQ ID NO: 221899 - DNA, 25 bp, Rattus norvegicus
caatgttctgtttctgtttttccaa

SEQ ID NO: 221900 - DNA, 25 bp, Rattus norvegicus
caatgttgaactacacctcttctac

SEQ ID NO: 221901 - DNA, 25 bp, Rattus norvegicus
caatgttgaacttcacctcttctac

SEQ ID NO: 221902 - DNA, 25 bp, Rattus norvegicus
caatgttgacacatggatacaccaa

SEQ ID NO: 221903 - DNA, 25 bp, Rattus norvegicus
caatgttgacacttggatacaccaa

SEQ ID NO: 221904 - DNA, 25 bp, Rattus norvegicus
caatgttgactgatctccttagaag

SEQ ID NO: 221905 - DNA, 25 bp, Rattus norvegicus
caatgttgactgttctccttagaag

SEQ ID NO: 221906 - DNA, 25 bp, Rattus norvegicus
caatgttgagaaatatgacacctaa

SEQ ID NO: 221907 - DNA, 25 bp, Rattus norvegicus
caatgttgagaattatgacacctaa

SEQ ID NO: 221908 - DNA, 25 bp, Rattus norvegicus
caatgttgcaacattgtgtggtttt

SEQ ID NO: 221909 - DNA, 25 bp, Rattus norvegicus
caatgttgcaactttgtgtggtttt

SEQ ID NO: 221910 - DNA, 25 bp, Rattus norvegicus
caatgttgcattcctcaaacacagg

SEQ ID NO: 221911 - DNA, 25 bp, Rattus norvegicus
caatgttgcattgctcaaacacagg

SEQ ID NO: 221912 - DNA, 25 bp, Rattus norvegicus
caatgttgggctaggttttctaccg

SEQ ID NO: 221913 - DNA, 25 bp, Rattus norvegicus
caatgttgggcttggttttctaccg

SEQ ID NO: 221914 - DNA, 25 bp, Rattus norvegicus
caatgttggttcatcctcctgtatc

SEQ ID NO: 221915 - DNA, 25 bp, Rattus norvegicus
caatgttggttcttcctcctgtatc

SEQ ID NO: 221916 - DNA, 25 bp, Rattus norvegicus
caatgttgtgctatgactttcctcc

SEQ ID NO: 221917 - DNA, 25 bp, Rattus norvegicus
caatgttgtgctttgactttcctcc

SEQ ID NO: 221918 - DNA, 25 bp, Rattus norvegicus
caatgttgtggacgtcttgtgcccc

SEQ ID NO: 221919 - DNA, 25 bp, Rattus norvegicus
caatgttgtggaggtcttgtgcccc

SEQ ID NO: 221920 - DNA, 25 bp, Rattus norvegicus
caatgtttacttcggcctccagcaa

SEQ ID NO: 221921 - DNA, 25 bp, Rattus norvegicus
caatgtttacttgggcctccagcaa

SEQ ID NO: 221922 - DNA, 25 bp, Rattus norvegicus
caatgtttagtaatttcctgccttt

SEQ ID NO: 221923 - DNA, 25 bp, Rattus norvegicus
caatgtttagtattttcctgccttt

SEQ ID NO: 221924 - DNA, 25 bp, Rattus norvegicus
caatgtttatagcagccctgtgctg

SEQ ID NO: 221925 - DNA, 25 bp, Rattus norvegicus
caatgtttataggagccctgtgctg

SEQ ID NO: 221926 - DNA, 25 bp, Rattus norvegicus
caatgtttccccaaagtcatgtatt

SEQ ID NO: 221927 - DNA, 25 bp, Rattus norvegicus
caatgtttcccctaagtcatgtatt

SEQ ID NO: 221928 - DNA, 25 bp, Rattus norvegicus
caatgtttctacaatttctccaggt

SEQ ID NO: 221929 - DNA, 25 bp, Rattus norvegicus
caatgtttctactatttctccaggt

SEQ ID NO: 221930 - DNA, 25 bp, Rattus norvegicus
caatgtttcttactcctacttccaa

SEQ ID NO: 221931 - DNA, 25 bp, Rattus norvegicus
caatgtttcttagtcctacttccaa

SEQ ID NO: 221932 - DNA, 25 bp, Rattus norvegicus
caatgtttgagcctggtgtgtccaa

SEQ ID NO: 221933 - DNA, 25 bp, Rattus norvegicus
caatgtttgagcgtggtgtgtccaa

SEQ ID NO: 221934 - DNA, 25 bp, Rattus norvegicus
caatgtttgttccaaggccttctgc

SEQ ID NO: 221935 - DNA, 25 bp, Rattus norvegicus
caatgtttgttcgaaggccttctgc

SEQ ID NO: 221936 - DNA, 25 bp, Rattus norvegicus
caatgtttgttgatgtctccccctg

SEQ ID NO: 221937 - DNA, 25 bp, Rattus norvegicus
caatgtttgttgttgtctccccctg

SEQ ID NO: 221938 - DNA, 25 bp, Rattus norvegicus
caatgtttgtttagtggaaatgcct

SEQ ID NO: 221939 - DNA, 25 bp, Rattus norvegicus
caatgtttgttttgtggaaatgcct

SEQ ID NO: 221940 - DNA, 25 bp, Rattus norvegicus
caatgttttccaacagtactctagg

SEQ ID NO: 221941 - DNA, 25 bp, Rattus norvegicus
caatgttttccatcagtactctagg

SEQ ID NO: 221942 - DNA, 25 bp, Rattus norvegicus
caatgttttctgaccttggaatgaa

SEQ ID NO: 221943 - DNA, 25 bp, Rattus norvegicus
caatgttttctgtccttggaatgaa

SEQ ID NO: 221944 - DNA, 25 bp, Rattus norvegicus
caattaagacatactctgttgcttt

SEQ ID NO: 221945 - DNA, 25 bp, Rattus norvegicus
caattaagacattctctgttgcttt

SEQ ID NO: 221946 - DNA, 25 bp, Rattus norvegicus
caattaatctataccctttaccctg

SEQ ID NO: 221947 - DNA, 25 bp, Rattus norvegicus
caattaatctattccctttaccctg

SEQ ID NO: 221948 - DNA, 25 bp, Rattus norvegicus
caattacaagcgaatttctcacccc

SEQ ID NO: 221949 - DNA, 25 bp, Rattus norvegicus
caattacaagcgtatttctcacccc

SEQ ID NO: 221950 - DNA, 25 bp, Rattus norvegicus
caattaccaaagactccatctgagg

SEQ ID NO: 221951 - DNA, 25 bp, Rattus norvegicus
caattaccaaagtctccatctgagg

SEQ ID NO: 221952 - DNA, 25 bp, Rattus norvegicus
caattaccaggccacaaagtcagta

SEQ ID NO: 221953 - DNA, 25 bp, Rattus norvegicus
caattaccaggcgacaaagtcagta

SEQ ID NO: 221954 - DNA, 25 bp, Rattus norvegicus
caattacggaatctcatctgggaca

SEQ ID NO: 221955 - DNA, 25 bp, Rattus norvegicus
caattacggaatgtcatctgggaca

SEQ ID NO: 221956 - DNA, 25 bp, Rattus norvegicus
caattactgaaaactgtgcttctga

SEQ ID NO: 221957 - DNA, 25 bp, Rattus norvegicus
caattactgaaatctgtgcttctga

SEQ ID NO: 221958 - DNA, 25 bp, Rattus norvegicus
caattacttcccaaagaacacccag

SEQ ID NO: 221959 - DNA, 25 bp, Rattus norvegicus
caattacttccctaagaacacccag

SEQ ID NO: 221960 - DNA, 25 bp, Rattus norvegicus
caattagttgcccattcttggtatt

SEQ ID NO: 221961 - DNA, 25 bp, Rattus norvegicus
caattagttgccgattcttggtatt

SEQ ID NO: 221962 - DNA, 25 bp, Rattus norvegicus
caattatcactaactgcagcacagg

SEQ ID NO: 221963 - DNA, 25 bp, Rattus norvegicus
caattatcactatctgcagcacagg

SEQ ID NO: 221964 - DNA, 25 bp, Rattus norvegicus
caattatctgaaccgggactctgtc

SEQ ID NO: 221965 - DNA, 25 bp, Rattus norvegicus
caattatctgaagcgggactctgtc

SEQ ID NO: 221966 - DNA, 25 bp, Rattus norvegicus
caattatgcataagcccagggctga

SEQ ID NO: 221967 - DNA, 25 bp, Rattus norvegicus
caattatgcatatgcccagggctga

SEQ ID NO: 221968 - DNA, 25 bp, Rattus norvegicus
caattcaaccgcattgtatcttgca

SEQ ID NO: 221969 - DNA, 25 bp, Rattus norvegicus
caattcaaccgctttgtatcttgca

SEQ ID NO: 221970 - DNA, 25 bp, Rattus norvegicus
caattcacaccccacagttatttgt

SEQ ID NO: 221971 - DNA, 25 bp, Rattus norvegicus
caattcacacccgacagttatttgt

SEQ ID NO: 221972 - DNA, 25 bp, Rattus norvegicus
caattcagatgtagtcccagaccct

SEQ ID NO: 221973 - DNA, 25 bp, Rattus norvegicus
caattcagatgttgtcccagaccct

SEQ ID NO: 221974 - DNA, 25 bp, Rattus norvegicus
caattcattttcctacagactaccc

SEQ ID NO: 221975 - DNA, 25 bp, Rattus norvegicus
caattcattttcgtacagactaccc

SEQ ID NO: 221976 - DNA, 25 bp, Rattus norvegicus
caattccaattccagcactacagag

SEQ ID NO: 221977 - DNA, 25 bp, Rattus norvegicus
caattccaattcgagcactacagag

SEQ ID NO: 221978 - DNA, 25 bp, Rattus norvegicus
caattcccaattacctatgttcaaa

SEQ ID NO: 221979 - DNA, 25 bp, Rattus norvegicus
caattcccaatttcctatgttcaaa

SEQ ID NO: 221980 - DNA, 25 bp, Rattus norvegicus
caattcccagcacttatgtcagaca

SEQ ID NO: 221981 - DNA, 25 bp, Rattus norvegicus
caattcccagcagttatgtcagaca

SEQ ID NO: 221982 - DNA, 25 bp, Rattus norvegicus
caattcccaggacaggtttctacac

SEQ ID NO: 221983 - DNA, 25 bp, Rattus norvegicus
caattcccaggagaggtttctacac

SEQ ID NO: 221984 - DNA, 25 bp, Rattus norvegicus
caattcccatcacgtagttgtccac

SEQ ID NO: 221985 - DNA, 25 bp, Rattus norvegicus
caattcccatcaggtagttgtccac

SEQ ID NO: 221986 - DNA, 25 bp, Rattus norvegicus
caattccctggaacactggtgtcat

SEQ ID NO: 221987 - DNA, 25 bp, Rattus norvegicus
caattccctggatcactggtgtcat

SEQ ID NO: 221988 - DNA, 25 bp, Rattus norvegicus
caattcctaggacccatatgctgct

SEQ ID NO: 221989 - DNA, 25 bp, Rattus norvegicus
caattcctaggagccatatgctgct

SEQ ID NO: 221990 - DNA, 25 bp, Rattus norvegicus
caattcctccagaacctgtagatga

SEQ ID NO: 221991 - DNA, 25 bp, Rattus norvegicus
caattcctccagtacctgtagatga

SEQ ID NO: 221992 - DNA, 25 bp, Rattus norvegicus
caattcctcccaaacaaccatttgt

SEQ ID NO: 221993 - DNA, 25 bp, Rattus norvegicus
caattcctcccatacaaccatttgt

SEQ ID NO: 221994 - DNA, 25 bp, Rattus norvegicus
caattcctgaggatgtagtgaccat

SEQ ID NO: 221995 - DNA, 25 bp, Rattus norvegicus
caattcctgaggttgtagtgaccat

SEQ ID NO: 221996 - DNA, 25 bp, Rattus norvegicus
caattcggtagcatatgtttttcag

SEQ ID NO: 221997 - DNA, 25 bp, Rattus norvegicus
caattcggtagcttatgtttttcag

SEQ ID NO: 221998 - DNA, 25 bp, Rattus norvegicus
caattcggtcaaatgtcactgtcat

SEQ ID NO: 221999 - DNA, 25 bp, Rattus norvegicus
caattcggtcaattgtcactgtcat

SEQ ID NO: 222000 - DNA, 25 bp, Rattus norvegicus
caattcggtgataacttgcttttcc

SEQ ID NO: 222001 - DNA, 25 bp, Rattus norvegicus
caattcggtgattacttgcttttcc

SEQ ID NO: 222002 - DNA, 25 bp, Rattus norvegicus
caattcgtagggagcccaggaggct

SEQ ID NO: 222003 - DNA, 25 bp, Rattus norvegicus
caattcgtagggtgcccaggaggct

SEQ ID NO: 222004 - DNA, 25 bp, Rattus norvegicus
caattctaactgaccgagtctgaga

SEQ ID NO: 222005 - DNA, 25 bp, Rattus norvegicus
caattctaactgtccgagtctgaga

SEQ ID NO: 222006 - DNA, 25 bp, Rattus norvegicus
caattctaagatcgtttttgttatc

SEQ ID NO: 222007 - DNA, 25 bp, Rattus norvegicus
caattctaagatggtttttgttatc

SEQ ID NO: 222008 - DNA, 25 bp, Rattus norvegicus
caattctaatttcgcttgctaaggg

SEQ ID NO: 222009 - DNA, 25 bp, Rattus norvegicus
caattctaatttggcttgctaaggg

SEQ ID NO: 222010 - DNA, 25 bp, Rattus norvegicus
caattctcaagtcattctcacagtc

SEQ ID NO: 222011 - DNA, 25 bp, Rattus norvegicus
caattctcaagtgattctcacagtc

SEQ ID NO: 222012 - DNA, 25 bp, Rattus norvegicus
caattctcttcaacatcttgggaca

SEQ ID NO: 222013 - DNA, 25 bp, Rattus norvegicus
caattctcttcatcatcttgggaca

SEQ ID NO: 222014 - DNA, 25 bp, Rattus norvegicus
caattctcttttcagttttccataa

SEQ ID NO: 222015 - DNA, 25 bp, Rattus norvegicus
caattctcttttgagttttccataa

SEQ ID NO: 222016 - DNA, 25 bp, Rattus norvegicus
caattctgctttagtccaatctggg

SEQ ID NO: 222017 - DNA, 25 bp, Rattus norvegicus
caattctgcttttgtccaatctggg

SEQ ID NO: 222018 - DNA, 25 bp, Rattus norvegicus
caattctgtgctcgccttgggaata

SEQ ID NO: 222019 - DNA, 25 bp, Rattus norvegicus
caattctgtgctggccttgggaata

SEQ ID NO: 222020 - DNA, 25 bp, Rattus norvegicus
caattcttagaacactgctggatgt

SEQ ID NO: 222021 - DNA, 25 bp, Rattus norvegicus
caattcttagaagactgctggatgt

SEQ ID NO: 222022 - DNA, 25 bp, Rattus norvegicus
caattcttcatcaaggtattcacat

SEQ ID NO: 222023 - DNA, 25 bp, Rattus norvegicus
caattcttcatctaggtattcacat

SEQ ID NO: 222024 - DNA, 25 bp, Rattus norvegicus
caattcttgtctaatccatatgccc

SEQ ID NO: 222025 - DNA, 25 bp, Rattus norvegicus
caattcttgtcttatccatatgccc

SEQ ID NO: 222026 - DNA, 25 bp, Rattus norvegicus
caattgacactgacctgccttttaa

SEQ ID NO: 222027 - DNA, 25 bp, Rattus norvegicus
caattgacactgtcctgccttttaa

SEQ ID NO: 222028 - DNA, 25 bp, Rattus norvegicus
caattgacctttacactgtaaaaat

SEQ ID NO: 222029 - DNA, 25 bp, Rattus norvegicus
caattgaccttttcactgtaaaaat

SEQ ID NO: 222030 - DNA, 25 bp, Rattus norvegicus
caattgactgacagtatctttccac

SEQ ID NO: 222031 - DNA, 25 bp, Rattus norvegicus
caattgactgactgtatctttccac

SEQ ID NO: 222032 - DNA, 25 bp, Rattus norvegicus
caattgactgttcttgttacgagca

SEQ ID NO: 222033 - DNA, 25 bp, Rattus norvegicus
caattgactgttgttgttacgagca

SEQ ID NO: 222034 - DNA, 25 bp, Rattus norvegicus
caattgatccagctgtttgtttcta

SEQ ID NO: 222035 - DNA, 25 bp, Rattus norvegicus
caattgatccaggtgtttgtttcta

SEQ ID NO: 222036 - DNA, 25 bp, Rattus norvegicus
caattgatcctaataacccggccag

SEQ ID NO: 222037 - DNA, 25 bp, Rattus norvegicus
caattgatcctattaacccggccag

SEQ ID NO: 222038 - DNA, 25 bp, Rattus norvegicus
caattgcatattactttcttgggaa

SEQ ID NO: 222039 - DNA, 25 bp, Rattus norvegicus
caattgcatatttctttcttgggaa

SEQ ID NO: 222040 - DNA, 25 bp, Rattus norvegicus
caattgccagcaaccaatcacttgg

SEQ ID NO: 222041 - DNA, 25 bp, Rattus norvegicus
caattgccagcatccaatcacttgg

SEQ ID NO: 222042 - DNA, 25 bp, Rattus norvegicus
caattgccggatctgtgtatgtgtg

SEQ ID NO: 222043 - DNA, 25 bp, Rattus norvegicus
caattgccggatgtgtgtatgtgtg

SEQ ID NO: 222044 - DNA, 25 bp, Rattus norvegicus
caattgcctctgactggtgctaata

SEQ ID NO: 222045 - DNA, 25 bp, Rattus norvegicus
caattgcctctgtctggtgctaata

SEQ ID NO: 222046 - DNA, 25 bp, Rattus norvegicus
caattgcgatggctttctcacagtc

SEQ ID NO: 222047 - DNA, 25 bp, Rattus norvegicus
caattgcgatgggtttctcacagtc

SEQ ID NO: 222048 - DNA, 25 bp, Rattus norvegicus
caattgcttatacagcagcgcagga

SEQ ID NO: 222049 - DNA, 25 bp, Rattus norvegicus
caattgcttatagagcagcgcagga

SEQ ID NO: 222050 - DNA, 25 bp, Rattus norvegicus
caattggaataaaggtgtaccctgt

SEQ ID NO: 222051 - DNA, 25 bp, Rattus norvegicus
caattggaataatggtgtaccctgt

SEQ ID NO: 222052 - DNA, 25 bp, Rattus norvegicus
caattggaggctagcgtcttctgaa

SEQ ID NO: 222053 - DNA, 25 bp, Rattus norvegicus
caattggaggcttgcgtcttctgaa

SEQ ID NO: 222054 - DNA, 25 bp, Rattus norvegicus
caattggcccctcatgttactgttg

SEQ ID NO: 222055 - DNA, 25 bp, Rattus norvegicus
caattggcccctgatgttactgttg

SEQ ID NO: 222056 - DNA, 25 bp, Rattus norvegicus
caattggcgaacctaagagtcctta

SEQ ID NO: 222057 - DNA, 25 bp, Rattus norvegicus
caattggcgaacgtaagagtcctta

SEQ ID NO: 222058 - DNA, 25 bp, Rattus norvegicus
caattggcttcgagaggctgaggac

SEQ ID NO: 222059 - DNA, 25 bp, Rattus norvegicus
caattggcttcgtgaggctgaggac

SEQ ID NO: 222060 - DNA, 25 bp, Rattus norvegicus
caattggctttgacacgcagtgttg

SEQ ID NO: 222061 - DNA, 25 bp, Rattus norvegicus
caattggctttgtcacgcagtgttg

SEQ ID NO: 222062 - DNA, 25 bp, Rattus norvegicus
caattgggacttccgtgcaggcacc

SEQ ID NO: 222063 - DNA, 25 bp, Rattus norvegicus
caattgggacttgcgtgcaggcacc

SEQ ID NO: 222064 - DNA, 25 bp, Rattus norvegicus
caattgggctggcatcactggatca

SEQ ID NO: 222065 - DNA, 25 bp, Rattus norvegicus
caattgggctgggatcactggatca

SEQ ID NO: 222066 - DNA, 25 bp, Rattus norvegicus
caattggtacatacaggccacctgt

SEQ ID NO: 222067 - DNA, 25 bp, Rattus norvegicus
caattggtacattcaggccacctgt

SEQ ID NO: 222068 - DNA, 25 bp, Rattus norvegicus
caattggtgcccaatgttcagagat

SEQ ID NO: 222069 - DNA, 25 bp, Rattus norvegicus
caattggtgccctatgttcagagat

SEQ ID NO: 222070 - DNA, 25 bp, Rattus norvegicus
caattggttgacaagaggctcttcc

SEQ ID NO: 222071 - DNA, 25 bp, Rattus norvegicus
caattggttgactagaggctcttcc

SEQ ID NO: 222072 - DNA, 25 bp, Rattus norvegicus
caattgtcattgagcacagtgtaaa

SEQ ID NO: 222073 - DNA, 25 bp, Rattus norvegicus
caattgtcattgtgcacagtgtaaa

SEQ ID NO: 222074 - DNA, 25 bp, Rattus norvegicus
caattgtcttcgaaatgtgtgtgct

SEQ ID NO: 222075 - DNA, 25 bp, Rattus norvegicus
caattgtcttcgtaatgtgtgtgct

SEQ ID NO: 222076 - DNA, 25 bp, Rattus norvegicus
caattgtgctttcttggatgggatt

SEQ ID NO: 222077 - DNA, 25 bp, Rattus norvegicus
caattgtgctttgttggatgggatt

SEQ ID NO: 222078 - DNA, 25 bp, Rattus norvegicus
caattgttgtccagaagttttacct

SEQ ID NO: 222079 - DNA, 25 bp, Rattus norvegicus
caattgttgtcctgaagttttacct

SEQ ID NO: 222080 - DNA, 25 bp, Rattus norvegicus
caattgttgttcattcatctgctga

SEQ ID NO: 222081 - DNA, 25 bp, Rattus norvegicus
caattgttgttctttcatctgctga

SEQ ID NO: 222082 - DNA, 25 bp, Rattus norvegicus
caattgttttgcactttcagataga

SEQ ID NO: 222083 - DNA, 25 bp, Rattus norvegicus
caattgttttgctctttcagataga

SEQ ID NO: 222084 - DNA, 25 bp, Rattus norvegicus
caattgttttgtcatgctttctcat

SEQ ID NO: 222085 - DNA, 25 bp, Rattus norvegicus
caattgttttgtgatgctttctcat

SEQ ID NO: 222086 - DNA, 25 bp, Rattus norvegicus
caattgttttttctaaccatcttag

SEQ ID NO: 222087 - DNA, 25 bp, Rattus norvegicus
caattgttttttgtaaccatcttag

SEQ ID NO: 222088 - DNA, 25 bp, Rattus norvegicus
caatttaattttctgcagctgtggt

SEQ ID NO: 222089 - DNA, 25 bp, Rattus norvegicus
caatttaattttgtgcagctgtggt

SEQ ID NO: 222090 - DNA, 25 bp, Rattus norvegicus
caatttacaccgagttgggagcaat

SEQ ID NO: 222091 - DNA, 25 bp, Rattus norvegicus
caatttacaccgtgttgggagcaat

SEQ ID NO: 222092 - DNA, 25 bp, Rattus norvegicus
caatttacagtacgcctgggcaccg

SEQ ID NO: 222093 - DNA, 25 bp, Rattus norvegicus
caatttacagtaggcctgggcaccg

SEQ ID NO: 222094 - DNA, 25 bp, Rattus norvegicus
caatttaccctcagtgtgttcttgc

SEQ ID NO: 222095 - DNA, 25 bp, Rattus norvegicus
caatttaccctctgtgtgttcttgc

SEQ ID NO: 222096 - DNA, 25 bp, Rattus norvegicus
caatttataactcgctatgtggaca

SEQ ID NO: 222097 - DNA, 25 bp, Rattus norvegicus
caatttataactggctatgtggaca

SEQ ID NO: 222098 - DNA, 25 bp, Rattus norvegicus
caatttatgaagctctgggctgtgc

SEQ ID NO: 222099 - DNA, 25 bp, Rattus norvegicus
caatttatgaaggtctgggctgtgc

SEQ ID NO: 222100 - DNA, 25 bp, Rattus norvegicus
caatttatgcgtcccaagactggag

SEQ ID NO: 222101 - DNA, 25 bp, Rattus norvegicus
caatttatgcgtgccaagactggag

SEQ ID NO: 222102 - DNA, 25 bp, Rattus norvegicus
caatttcatcctacgtttttatctg

SEQ ID NO: 222103 - DNA, 25 bp, Rattus norvegicus
caatttcatccttcgtttttatctg

SEQ ID NO: 222104 - DNA, 25 bp, Rattus norvegicus
caatttcatggtccccactggacct

SEQ ID NO: 222105 - DNA, 25 bp, Rattus norvegicus
caatttcatggtgcccactggacct

SEQ ID NO: 222106 - DNA, 25 bp, Rattus norvegicus
caatttcattccactgtttgcagtc

SEQ ID NO: 222107 - DNA, 25 bp, Rattus norvegicus
caatttcattcctctgtttgcagtc

SEQ ID NO: 222108 - DNA, 25 bp, Rattus norvegicus
caatttcatttgacctgctctgggc

SEQ ID NO: 222109 - DNA, 25 bp, Rattus norvegicus
caatttcatttgtcctgctctgggc

SEQ ID NO: 222110 - DNA, 25 bp, Rattus norvegicus
caatttccactgcaggctttacaaa

SEQ ID NO: 222111 - DNA, 25 bp, Rattus norvegicus
caatttccactggaggctttacaaa

SEQ ID NO: 222112 - DNA, 25 bp, Rattus norvegicus
caatttcccctcaatgcctttattt

SEQ ID NO: 222113 - DNA, 25 bp, Rattus norvegicus
caatttcccctctatgcctttattt

SEQ ID NO: 222114 - DNA, 25 bp, Rattus norvegicus
caatttccctcacagtggacacgag

SEQ ID NO: 222115 - DNA, 25 bp, Rattus norvegicus
caatttccctcagagtggacacgag

SEQ ID NO: 222116 - DNA, 25 bp, Rattus norvegicus
caatttcctgtcacttagagctgag

SEQ ID NO: 222117 - DNA, 25 bp, Rattus norvegicus
caatttcctgtctcttagagctgag

SEQ ID NO: 222118 - DNA, 25 bp, Rattus norvegicus
caatttcctttcacggtgtgggaca

SEQ ID NO: 222119 - DNA, 25 bp, Rattus norvegicus
caatttcctttctcggtgtgggaca

SEQ ID NO: 222120 - DNA, 25 bp, Rattus norvegicus
caatttccttttaatctctgtcctc

SEQ ID NO: 222121 - DNA, 25 bp, Rattus norvegicus
caatttcctttttatctctgtcctc

SEQ ID NO: 222122 - DNA, 25 bp, Rattus norvegicus
caatttcgccttcgagggcattgga

SEQ ID NO: 222123 - DNA, 25 bp, Rattus norvegicus
caatttcgccttggagggcattgga

SEQ ID NO: 222124 - DNA, 25 bp, Rattus norvegicus
caatttctgaatctgcaactgcaat

SEQ ID NO: 222125 - DNA, 25 bp, Rattus norvegicus
caatttctgaatgtgcaactgcaat

SEQ ID NO: 222126 - DNA, 25 bp, Rattus norvegicus
caatttctgggtagtacctgtcttc

SEQ ID NO: 222127 - DNA, 25 bp, Rattus norvegicus
caatttctgggttgtacctgtcttc

SEQ ID NO: 222128 - DNA, 25 bp, Rattus norvegicus
caatttctgtcaaccctaatcgtgg

SEQ ID NO: 222129 - DNA, 25 bp, Rattus norvegicus
caatttctgtcatccctaatcgtgg

SEQ ID NO: 222130 - DNA, 25 bp, Rattus norvegicus
caatttcttccacttcgtgctggcg

SEQ ID NO: 222131 - DNA, 25 bp, Rattus norvegicus
caatttcttccagttcgtgctggcg

SEQ ID NO: 222132 - DNA, 25 bp, Rattus norvegicus
caatttcttcccaacacagtgttaa

SEQ ID NO: 222133 - DNA, 25 bp, Rattus norvegicus
caatttcttccctacacagtgttaa

SEQ ID NO: 222134 - DNA, 25 bp, Rattus norvegicus
caatttcttcttcgagcattgggaa

SEQ ID NO: 222135 - DNA, 25 bp, Rattus norvegicus
caatttcttcttggagcattgggaa

SEQ ID NO: 222136 - DNA, 25 bp, Rattus norvegicus
caatttctttggagtcttcctttgt

SEQ ID NO: 222137 - DNA, 25 bp, Rattus norvegicus
caatttctttggatggttctcaagt

SEQ ID NO: 222138 - DNA, 25 bp, Rattus norvegicus
caatttctttggtgtcttcctttgt

SEQ ID NO: 222139 - DNA, 25 bp, Rattus norvegicus
caatttctttggttggttctcaagt

SEQ ID NO: 222140 - DNA, 25 bp, Rattus norvegicus
caatttgaaagtctgttacccatag

SEQ ID NO: 222141 - DNA, 25 bp, Rattus norvegicus
caatttgaaagtgtgttacccatag

SEQ ID NO: 222142 - DNA, 25 bp, Rattus norvegicus
caatttgacctaattcctcctgtta

SEQ ID NO: 222143 - DNA, 25 bp, Rattus norvegicus
caatttgacctatttcctcctgtta

SEQ ID NO: 222144 - DNA, 25 bp, Rattus norvegicus
caatttgagcacagtctctgtcctc

SEQ ID NO: 222145 - DNA, 25 bp, Rattus norvegicus
caatttgagcactgtctctgtcctc

SEQ ID NO: 222146 - DNA, 25 bp, Rattus norvegicus
caatttgaggtacagcttcagcagt

SEQ ID NO: 222147 - DNA, 25 bp, Rattus norvegicus
caatttgaggtagagcttcagcagt

SEQ ID NO: 222148 - DNA, 25 bp, Rattus norvegicus
caatttgatgcactcggtgtcacct

SEQ ID NO: 222149 - DNA, 25 bp, Rattus norvegicus
caatttgatgcagtcggtgtcacct

SEQ ID NO: 222150 - DNA, 25 bp, Rattus norvegicus
caatttgattggacgcttgcagctc

SEQ ID NO: 222151 - DNA, 25 bp, Rattus norvegicus
caatttgattggtcgcttgcagctc

SEQ ID NO: 222152 - DNA, 25 bp, Rattus norvegicus
caatttgccgagctgatgcttctga

SEQ ID NO: 222153 - DNA, 25 bp, Rattus norvegicus
caatttgccgaggtgatgcttctga

SEQ ID NO: 222154 - DNA, 25 bp, Rattus norvegicus
caatttgctgacagaaatctctggc

SEQ ID NO: 222155 - DNA, 25 bp, Rattus norvegicus
caatttgctgactgaaatctctggc

SEQ ID NO: 222156 - DNA, 25 bp, Rattus norvegicus
caatttgctgcactatttagccacg

SEQ ID NO: 222157 - DNA, 25 bp, Rattus norvegicus
caatttgctgcagtatttagccacg

SEQ ID NO: 222158 - DNA, 25 bp, Rattus norvegicus
caatttggatgcatgtgacctgtga

SEQ ID NO: 222159 - DNA, 25 bp, Rattus norvegicus
caatttggatgcttgtgacctgtga

SEQ ID NO: 222160 - DNA, 25 bp, Rattus norvegicus
caatttggcaatcgcttttcccact

SEQ ID NO: 222161 - DNA, 25 bp, Rattus norvegicus
caatttggcaatggcttttcccact

SEQ ID NO: 222162 - DNA, 25 bp, Rattus norvegicus
caatttgtggtgatgcctgcaggct

SEQ ID NO: 222163 - DNA, 25 bp, Rattus norvegicus
caatttgtggtgttgcctgcaggct

SEQ ID NO: 222164 - DNA, 25 bp, Rattus norvegicus
caatttgtgtacaatgtccttgaat

SEQ ID NO: 222165 - DNA, 25 bp, Rattus norvegicus
caatttgtgtactatgtccttgaat

SEQ ID NO: 222166 - DNA, 25 bp, Rattus norvegicus
caatttgtgttcaccttttttcata

SEQ ID NO: 222167 - DNA, 25 bp, Rattus norvegicus
caatttgtgttctccttttttcata

SEQ ID NO: 222168 - DNA, 25 bp, Rattus norvegicus
caatttgtttcgacttgtgcttctg

SEQ ID NO: 222169 - DNA, 25 bp, Rattus norvegicus
caatttgtttcgtcttgtgcttctg

SEQ ID NO: 222170 - DNA, 25 bp, Rattus norvegicus
caattttcaacgactaagccctgta

SEQ ID NO: 222171 - DNA, 25 bp, Rattus norvegicus
caattttcaacgtctaagccctgta

SEQ ID NO: 222172 - DNA, 25 bp, Rattus norvegicus
caattttctgcccagcactcttaaa

SEQ ID NO: 222173 - DNA, 25 bp, Rattus norvegicus
caattttctgccgagcactcttaaa

SEQ ID NO: 222174 - DNA, 25 bp, Rattus norvegicus
caattttgcactactgactacaggt

SEQ ID NO: 222175 - DNA, 25 bp, Rattus norvegicus
caattttgcacttctgactacaggt

SEQ ID NO: 222176 - DNA, 25 bp, Rattus norvegicus
caattttggagaatgggctgggttt

SEQ ID NO: 222177 - DNA, 25 bp, Rattus norvegicus
caattttggagattgggctgggttt

SEQ ID NO: 222178 - DNA, 25 bp, Rattus norvegicus
caattttgtgtgagtgcgtccagtt

SEQ ID NO: 222179 - DNA, 25 bp, Rattus norvegicus
caattttgtgtgtgtgcgtccagtt

SEQ ID NO: 222180 - DNA, 25 bp, Rattus norvegicus
caatttttatggactttggattatg

SEQ ID NO: 222181 - DNA, 25 bp, Rattus norvegicus
caatttttatggtctttggattatg

SEQ ID NO: 222182 - DNA, 25 bp, Rattus norvegicus
caatttttccaaaccctaacaactg

SEQ ID NO: 222183 - DNA, 25 bp, Rattus norvegicus
caatttttccaatccctaacaactg

SEQ ID NO: 222184 - DNA, 25 bp, Rattus norvegicus
caatttttgggcaacaggccttctt

SEQ ID NO: 222185 - DNA, 25 bp, Rattus norvegicus
caatttttgggctacaggccttctt

SEQ ID NO: 222186 - DNA, 25 bp, Rattus norvegicus
caattttttcaccaccctccgagtg

SEQ ID NO: 222187 - DNA, 25 bp, Rattus norvegicus
caattttttcacgaccctccgagtg

SEQ ID NO: 222188 - DNA, 25 bp, Rattus norvegicus
caattttttcagagtgccccaaggg

SEQ ID NO: 222189 - DNA, 25 bp, Rattus norvegicus
caattttttcagtgtgccccaaggg

SEQ ID NO: 222190 - DNA, 25 bp, Rattus norvegicus
caattttttgggaaatctgtgccat

SEQ ID NO: 222191 - DNA, 25 bp, Rattus norvegicus
caattttttgggtaatctgtgccat

SEQ ID NO: 222192 - DNA, 25 bp, Rattus norvegicus
cacaaaaaacagagctttagggccg

SEQ ID NO: 222193 - DNA, 25 bp, Rattus norvegicus
cacaaaaaacagtgctttagggccg

SEQ ID NO: 222194 - DNA, 25 bp, Rattus norvegicus
cacaaaatctgactattccccggaa

SEQ ID NO: 222195 - DNA, 25 bp, Rattus norvegicus
cacaaaatctgagtattccccggaa

SEQ ID NO: 222196 - DNA, 25 bp, Rattus norvegicus
cacaaaattcttaagctcagccctg

SEQ ID NO: 222197 - DNA, 25 bp, Rattus norvegicus
cacaaaattctttagctcagccctg

SEQ ID NO: 222198 - DNA, 25 bp, Rattus norvegicus
cacaaaccatctcgcctcgataagg

SEQ ID NO: 222199 - DNA, 25 bp, Rattus norvegicus
cacaaaccatctggcctcgataagg

SEQ ID NO: 222200 - DNA, 25 bp, Rattus norvegicus
cacaaaccgtggaacctggtgggct

SEQ ID NO: 222201 - DNA, 25 bp, Rattus norvegicus
cacaaaccgtggtacctggtgggct

SEQ ID NO: 222202 - DNA, 25 bp, Rattus norvegicus
cacaaactatgtcccattttccttg

SEQ ID NO: 222203 - DNA, 25 bp, Rattus norvegicus
cacaaactatgtgccattttccttg

SEQ ID NO: 222204 - DNA, 25 bp, Rattus norvegicus
cacaaactgtctaccaactgggaag

SEQ ID NO: 222205 - DNA, 25 bp, Rattus norvegicus
cacaaactgtcttccaactgggaag

SEQ ID NO: 222206 - DNA, 25 bp, Rattus norvegicus
cacaaacttcaacagcagcgagatt

SEQ ID NO: 222207 - DNA, 25 bp, Rattus norvegicus
cacaaacttcaagagcagcgagatt

SEQ ID NO: 222208 - DNA, 25 bp, Rattus norvegicus
cacaaagcaactcgtggtcccttaa

SEQ ID NO: 222209 - DNA, 25 bp, Rattus norvegicus
cacaaagcaactggtggtcccttaa

SEQ ID NO: 222210 - DNA, 25 bp, Rattus norvegicus
cacaaagccatgctattccttgaat

SEQ ID NO: 222211 - DNA, 25 bp, Rattus norvegicus
cacaaagccatggtattccttgaat

SEQ ID NO: 222212 - DNA, 25 bp, Rattus norvegicus
cacaaagctcatattccattgcatg

SEQ ID NO: 222213 - DNA, 25 bp, Rattus norvegicus
cacaaagctcattttccattgcatg

SEQ ID NO: 222214 - DNA, 25 bp, Rattus norvegicus
cacaaagcttatatctatactcgag

SEQ ID NO: 222215 - DNA, 25 bp, Rattus norvegicus
cacaaagcttatttctatactcgag

SEQ ID NO: 222216 - DNA, 25 bp, Rattus norvegicus
cacaaaggacgtctctcgatgggag

SEQ ID NO: 222217 - DNA, 25 bp, Rattus norvegicus
cacaaaggacgtgtctcgatgggag

SEQ ID NO: 222218 - DNA, 25 bp, Rattus norvegicus
cacaaaggagtcatcacgcctgtag

SEQ ID NO: 222219 - DNA, 25 bp, Rattus norvegicus
cacaaaggagtcttcacgcctgtag

SEQ ID NO: 222220 - DNA, 25 bp, Rattus norvegicus
cacaaaggcgtcatgatggagctga

SEQ ID NO: 222221 - DNA, 25 bp, Rattus norvegicus
cacaaaggcgtcttgatggagctga

SEQ ID NO: 222222 - DNA, 25 bp, Rattus norvegicus
cacaaagtaaagctggctgccccta

SEQ ID NO: 222223 - DNA, 25 bp, Rattus norvegicus
cacaaagtaaaggtggctgccccta

SEQ ID NO: 222224 - DNA, 25 bp, Rattus norvegicus
cacaaagtagctcggcagcaggctc

SEQ ID NO: 222225 - DNA, 25 bp, Rattus norvegicus
cacaaagtagctgggcagcaggctc

SEQ ID NO: 222226 - DNA, 25 bp, Rattus norvegicus
cacaaagtccgtcaacgactgttcc

SEQ ID NO: 222227 - DNA, 25 bp, Rattus norvegicus
cacaaagtccgtgaacgactgttcc

SEQ ID NO: 222228 - DNA, 25 bp, Rattus norvegicus
cacaaagtgtttacaggaggcccgt

SEQ ID NO: 222229 - DNA, 25 bp, Rattus norvegicus
cacaaagtgttttcaggaggcccgt

SEQ ID NO: 222230 - DNA, 25 bp, Rattus norvegicus
cacaaatactgtaagccgtcctgct

SEQ ID NO: 222231 - DNA, 25 bp, Rattus norvegicus
cacaaatactgttagccgtcctgct

SEQ ID NO: 222232 - DNA, 25 bp, Rattus norvegicus
cacaaatcaataatgcctgttagct

SEQ ID NO: 222233 - DNA, 25 bp, Rattus norvegicus
cacaaatcaatattgcctgttagct

SEQ ID NO: 222234 - DNA, 25 bp, Rattus norvegicus
cacaaatccttgaatgggcgtgttt

SEQ ID NO: 222235 - DNA, 25 bp, Rattus norvegicus
cacaaatccttgtatgggcgtgttt

SEQ ID NO: 222236 - DNA, 25 bp, Rattus norvegicus
cacaaatgggtgcagcgctgatctt

SEQ ID NO: 222237 - DNA, 25 bp, Rattus norvegicus
cacaaatgggtggagcgctgatctt

SEQ ID NO: 222238 - DNA, 25 bp, Rattus norvegicus
cacaaattccgtcctaaacttttca

SEQ ID NO: 222239 - DNA, 25 bp, Rattus norvegicus
cacaaattccgtgctaaacttttca

SEQ ID NO: 222240 - DNA, 25 bp, Rattus norvegicus
cacaaatttggtcaactcttgccat

SEQ ID NO: 222241 - DNA, 25 bp, Rattus norvegicus
cacaaatttggtgaactcttgccat

SEQ ID NO: 222242 - DNA, 25 bp, Rattus norvegicus
cacaacaacttgctgggatacattt

SEQ ID NO: 222243 - DNA, 25 bp, Rattus norvegicus
cacaacaacttggtgggatacattt

SEQ ID NO: 222244 - DNA, 25 bp, Rattus norvegicus
cacaacacccacattctgtattttt

SEQ ID NO: 222245 - DNA, 25 bp, Rattus norvegicus
cacaacacccactttctgtattttt

SEQ ID NO: 222246 - DNA, 25 bp, Rattus norvegicus
cacaacatgcacatagatcctacac

SEQ ID NO: 222247 - DNA, 25 bp, Rattus norvegicus
cacaacatgcacttagatcctacac

SEQ ID NO: 222248 - DNA, 25 bp, Rattus norvegicus
cacaaccagcatagtttcaacggat

SEQ ID NO: 222249 - DNA, 25 bp, Rattus norvegicus
cacaaccagcattgtttcaacggat

SEQ ID NO: 222250 - DNA, 25 bp, Rattus norvegicus
cacaaccagggtacttcttagagag

SEQ ID NO: 222251 - DNA, 25 bp, Rattus norvegicus
cacaaccagggttcttcttagagag

SEQ ID NO: 222252 - DNA, 25 bp, Rattus norvegicus
cacaaccctttgacctatgctaggg

SEQ ID NO: 222253 - DNA, 25 bp, Rattus norvegicus
cacaaccctttgtcctatgctaggg

SEQ ID NO: 222254 - DNA, 25 bp, Rattus norvegicus
cacaaccgggaacgctatgaagcga

SEQ ID NO: 222255 - DNA, 25 bp, Rattus norvegicus
cacaaccgggaaggctatgaagcga

SEQ ID NO: 222256 - DNA, 25 bp, Rattus norvegicus
cacaaccgtgaaacagctgctgtca

SEQ ID NO: 222257 - DNA, 25 bp, Rattus norvegicus
cacaaccgtgaatcagctgctgtca

SEQ ID NO: 222258 - DNA, 25 bp, Rattus norvegicus
cacaacctcactcgacttgagagat

SEQ ID NO: 222259 - DNA, 25 bp, Rattus norvegicus
cacaacctcactggacttgagagat

SEQ ID NO: 222260 - DNA, 25 bp, Rattus norvegicus
cacaacctgcttcatgttactcaaa

SEQ ID NO: 222261 - DNA, 25 bp, Rattus norvegicus
cacaacctgcttgatgttactcaaa

SEQ ID NO: 222262 - DNA, 25 bp, Rattus norvegicus
cacaacctggttcctgaggttcctg

SEQ ID NO: 222263 - DNA, 25 bp, Rattus norvegicus
cacaacctggttgctgaggttcctg

SEQ ID NO: 222264 - DNA, 25 bp, Rattus norvegicus
cacaaccttggtcaagactcctgaa

SEQ ID NO: 222265 - DNA, 25 bp, Rattus norvegicus
cacaaccttggtgaagactcctgaa

SEQ ID NO: 222266 - DNA, 25 bp, Rattus norvegicus
cacaacgagaatcctcagccttgta

SEQ ID NO: 222267 - DNA, 25 bp, Rattus norvegicus
cacaacgagaatgctcagccttgta

SEQ ID NO: 222268 - DNA, 25 bp, Rattus norvegicus
cacaacggaacccagagtctacttt

SEQ ID NO: 222269 - DNA, 25 bp, Rattus norvegicus
cacaacggaaccgagagtctacttt

SEQ ID NO: 222270 - DNA, 25 bp, Rattus norvegicus
cacaacggcacgaaatacttccttc

SEQ ID NO: 222271 - DNA, 25 bp, Rattus norvegicus
cacaacggcacgtaatacttccttc

SEQ ID NO: 222272 - DNA, 25 bp, Rattus norvegicus
cacaacggtaacatcgggccaggtg

SEQ ID NO: 222273 - DNA, 25 bp, Rattus norvegicus
cacaacggtaacttcgggccaggtg

SEQ ID NO: 222274 - DNA, 25 bp, Rattus norvegicus
cacaacgtttgtccttctggttggg

SEQ ID NO: 222275 - DNA, 25 bp, Rattus norvegicus
cacaacgtttgtgcttctggttggg

SEQ ID NO: 222276 - DNA, 25 bp, Rattus norvegicus
cacaactagagtattgggtggcttg

SEQ ID NO: 222277 - DNA, 25 bp, Rattus norvegicus
cacaactagagttttgggtggcttg

SEQ ID NO: 222278 - DNA, 25 bp, Rattus norvegicus
cacaactggcgcctgagggttttga

SEQ ID NO: 222279 - DNA, 25 bp, Rattus norvegicus
cacaactggcgcgtgagggttttga

SEQ ID NO: 222280 - DNA, 25 bp, Rattus norvegicus
cacaactgtagtattgctgctgtta

SEQ ID NO: 222281 - DNA, 25 bp, Rattus norvegicus
cacaactgtagttttgctgctgtta

SEQ ID NO: 222282 - DNA, 25 bp, Rattus norvegicus
cacaacttgaccatcggtgactttt

SEQ ID NO: 222283 - DNA, 25 bp, Rattus norvegicus
cacaacttgaccttcggtgactttt

SEQ ID NO: 222284 - DNA, 25 bp, Rattus norvegicus
cacaacttgtatctgtcctcgtggt

SEQ ID NO: 222285 - DNA, 25 bp, Rattus norvegicus
cacaacttgtatgtgtcctcgtggt

SEQ ID NO: 222286 - DNA, 25 bp, Rattus norvegicus
cacaactttagccttgcctttttag

SEQ ID NO: 222287 - DNA, 25 bp, Rattus norvegicus
cacaactttagcgttgcctttttag

SEQ ID NO: 222288 - DNA, 25 bp, Rattus norvegicus
cacaagaactgaattcggatgctca

SEQ ID NO: 222289 - DNA, 25 bp, Rattus norvegicus
cacaagaactgatttcggatgctca

SEQ ID NO: 222290 - DNA, 25 bp, Rattus norvegicus
cacaagaagacaacggacaccctgg

SEQ ID NO: 222291 - DNA, 25 bp, Rattus norvegicus
cacaagaagacatcggacaccctgg

SEQ ID NO: 222292 - DNA, 25 bp, Rattus norvegicus
cacaagactgtacctctcggtagtt

SEQ ID NO: 222293 - DNA, 25 bp, Rattus norvegicus
cacaagactgtagctctcggtagtt

SEQ ID NO: 222294 - DNA, 25 bp, Rattus norvegicus
cacaagagaacaagagcgcgggcag

SEQ ID NO: 222295 - DNA, 25 bp, Rattus norvegicus
cacaagagaacatgagcgcgggcag

SEQ ID NO: 222296 - DNA, 25 bp, Rattus norvegicus
cacaagatccagactccacaggaga

SEQ ID NO: 222297 - DNA, 25 bp, Rattus norvegicus
cacaagatccagtctccacaggaga

SEQ ID NO: 222298 - DNA, 25 bp, Rattus norvegicus
cacaagatgagacgctaacccctgg

SEQ ID NO: 222299 - DNA, 25 bp, Rattus norvegicus
cacaagatgagaggctaacccctgg

SEQ ID NO: 222300 - DNA, 25 bp, Rattus norvegicus
cacaagatgtacatattccttcccc

SEQ ID NO: 222301 - DNA, 25 bp, Rattus norvegicus
cacaagatgtacttattccttcccc

SEQ ID NO: 222302 - DNA, 25 bp, Rattus norvegicus
cacaagattgtcagtctgctcgttt

SEQ ID NO: 222303 - DNA, 25 bp, Rattus norvegicus
cacaagattgtctgtctgctcgttt

SEQ ID NO: 222304 - DNA, 25 bp, Rattus norvegicus
cacaagcaagtcatgatccgtccat

SEQ ID NO: 222305 - DNA, 25 bp, Rattus norvegicus
cacaagcaagtcttgatccgtccat

SEQ ID NO: 222306 - DNA, 25 bp, Rattus norvegicus
cacaagcattggatttcaggacagc

SEQ ID NO: 222307 - DNA, 25 bp, Rattus norvegicus
cacaagcattggttttcaggacagc

SEQ ID NO: 222308 - DNA, 25 bp, Rattus norvegicus
cacaagcattgtactatgtcttcaa

SEQ ID NO: 222309 - DNA, 25 bp, Rattus norvegicus
cacaagcattgttctatgtcttcaa

SEQ ID NO: 222310 - DNA, 25 bp, Rattus norvegicus
cacaagccacccaagaattcaagag

SEQ ID NO: 222311 - DNA, 25 bp, Rattus norvegicus
cacaagccaccctagaattcaagag

SEQ ID NO: 222312 - DNA, 25 bp, Rattus norvegicus
cacaagcccctgattcagtgtgcaa

SEQ ID NO: 222313 - DNA, 25 bp, Rattus norvegicus
cacaagcccctgtttcagtgtgcaa

SEQ ID NO: 222314 - DNA, 25 bp, Rattus norvegicus
cacaagcctagtatggtgggtgttt

SEQ ID NO: 222315 - DNA, 25 bp, Rattus norvegicus
cacaagcctagtttggtgggtgttt

SEQ ID NO: 222316 - DNA, 25 bp, Rattus norvegicus
cacaagcctcacagtggctcagggc

SEQ ID NO: 222317 - DNA, 25 bp, Rattus norvegicus
cacaagcctcactgtggctcagggc

SEQ ID NO: 222318 - DNA, 25 bp, Rattus norvegicus
cacaagcctgctaagagtctggaca

SEQ ID NO: 222319 - DNA, 25 bp, Rattus norvegicus
cacaagcctgcttagagtctggaca

SEQ ID NO: 222320 - DNA, 25 bp, Rattus norvegicus
cacaagctgctgacattgaaaagga

SEQ ID NO: 222321 - DNA, 25 bp, Rattus norvegicus
cacaagctgctgtcattgaaaagga

SEQ ID NO: 222322 - DNA, 25 bp, Rattus norvegicus
cacaagctggctcggagatgtttca

SEQ ID NO: 222323 - DNA, 25 bp, Rattus norvegicus
cacaagctggctgggagatgtttca

SEQ ID NO: 222324 - DNA, 25 bp, Rattus norvegicus
cacaagctttctacagtcctgattg

SEQ ID NO: 222325 - DNA, 25 bp, Rattus norvegicus
cacaagctttcttcagtcctgattg

SEQ ID NO: 222326 - DNA, 25 bp, Rattus norvegicus
cacaaggaaggactcacccgtgtta

SEQ ID NO: 222327 - DNA, 25 bp, Rattus norvegicus
cacaaggaaggagtcacccgtgtta

SEQ ID NO: 222328 - DNA, 25 bp, Rattus norvegicus
cacaaggagattcggcagctgctga

SEQ ID NO: 222329 - DNA, 25 bp, Rattus norvegicus
cacaaggagattgggcagctgctga

SEQ ID NO: 222330 - DNA, 25 bp, Rattus norvegicus
cacaaggaggtacaacctggcacaa

SEQ ID NO: 222331 - DNA, 25 bp, Rattus norvegicus
cacaaggaggtagaacctggcacaa

SEQ ID NO: 222332 - DNA, 25 bp, Rattus norvegicus
cacaaggaggtcctgtgggattccc

SEQ ID NO: 222333 - DNA, 25 bp, Rattus norvegicus
cacaaggaggtcgtgtgggattccc

SEQ ID NO: 222334 - DNA, 25 bp, Rattus norvegicus
cacaaggatcttacggtttcacgaa

SEQ ID NO: 222335 - DNA, 25 bp, Rattus norvegicus
cacaaggatctttcggtttcacgaa

SEQ ID NO: 222336 - DNA, 25 bp, Rattus norvegicus
cacaaggcctcgctgttacatatca

SEQ ID NO: 222337 - DNA, 25 bp, Rattus norvegicus
cacaaggcctcggtgttacatatca

SEQ ID NO: 222338 - DNA, 25 bp, Rattus norvegicus
cacaaggcgcgtagcgtgtacggcc

SEQ ID NO: 222339 - DNA, 25 bp, Rattus norvegicus
cacaaggcgcgttgcgtgtacggcc

SEQ ID NO: 222340 - DNA, 25 bp, Rattus norvegicus
cacaaggctgctcacaattatctat

SEQ ID NO: 222341 - DNA, 25 bp, Rattus norvegicus
cacaaggctgctgacaattatctat

SEQ ID NO: 222342 - DNA, 25 bp, Rattus norvegicus
cacaagggaagcagaggcgcctaca

SEQ ID NO: 222343 - DNA, 25 bp, Rattus norvegicus
cacaagggaagctgaggcgcctaca

SEQ ID NO: 222344 - DNA, 25 bp, Rattus norvegicus
cacaagggacctatcactgcagtgt

SEQ ID NO: 222345 - DNA, 25 bp, Rattus norvegicus
cacaagggacctttcactgcagtgt

SEQ ID NO: 222346 - DNA, 25 bp, Rattus norvegicus
cacaagggtagacgtgcgtcccgac

SEQ ID NO: 222347 - DNA, 25 bp, Rattus norvegicus
cacaagggtagaggtgcgtcccgac

SEQ ID NO: 222348 - DNA, 25 bp, Rattus norvegicus
cacaagggtcagatggtgtttttct

SEQ ID NO: 222349 - DNA, 25 bp, Rattus norvegicus
cacaagggtcagttggtgtttttct

SEQ ID NO: 222350 - DNA, 25 bp, Rattus norvegicus
cacaaggtagaaatcgccatagtta

SEQ ID NO: 222351 - DNA, 25 bp, Rattus norvegicus
cacaaggtagaattcgccatagtta

SEQ ID NO: 222352 - DNA, 25 bp, Rattus norvegicus
cacaaggtcttaaatatctcaggct

SEQ ID NO: 222353 - DNA, 25 bp, Rattus norvegicus
cacaaggtcttatatatctcaggct

SEQ ID NO: 222354 - DNA, 25 bp, Rattus norvegicus
cacaaggttcttctccactttggtt

SEQ ID NO: 222355 - DNA, 25 bp, Rattus norvegicus
cacaaggttcttgtccactttggtt

SEQ ID NO: 222356 - DNA, 25 bp, Rattus norvegicus
cacaaggtttgaactcacgagctga

SEQ ID NO: 222357 - DNA, 25 bp, Rattus norvegicus
cacaaggtttgatctcacgagctga

SEQ ID NO: 222358 - DNA, 25 bp, Rattus norvegicus
cacaaggttttccaaggtcctgcac

SEQ ID NO: 222359 - DNA, 25 bp, Rattus norvegicus
cacaaggttttcgaaggtcctgcac

SEQ ID NO: 222360 - DNA, 25 bp, Rattus norvegicus
cacaagtaaaatagggcagcccgtt

SEQ ID NO: 222361 - DNA, 25 bp, Rattus norvegicus
cacaagtaaaattgggcagcccgtt

SEQ ID NO: 222362 - DNA, 25 bp, Rattus norvegicus
cacaagtaatggattccgatgttta

SEQ ID NO: 222363 - DNA, 25 bp, Rattus norvegicus
cacaagtaatggtttccgatgttta

SEQ ID NO: 222364 - DNA, 25 bp, Rattus norvegicus
cacaagtagaatcagccccagggct

SEQ ID NO: 222365 - DNA, 25 bp, Rattus norvegicus
cacaagtagaatgagccccagggct

SEQ ID NO: 222366 - DNA, 25 bp, Rattus norvegicus
cacaagtcttgccaatagacctggg

SEQ ID NO: 222367 - DNA, 25 bp, Rattus norvegicus
cacaagtcttgcgaatagacctggg

SEQ ID NO: 222368 - DNA, 25 bp, Rattus norvegicus
cacaagtgcatgcttcaggctcaaa

SEQ ID NO: 222369 - DNA, 25 bp, Rattus norvegicus
cacaagtgcatggttcaggctcaaa

SEQ ID NO: 222370 - DNA, 25 bp, Rattus norvegicus
cacaagtggcctatgttgacatgat

SEQ ID NO: 222371 - DNA, 25 bp, Rattus norvegicus
cacaagtggcctttgttgacatgat

SEQ ID NO: 222372 - DNA, 25 bp, Rattus norvegicus
cacaagtggctcacaactgaggact

SEQ ID NO: 222373 - DNA, 25 bp, Rattus norvegicus
cacaagtggctctcaactgaggact

SEQ ID NO: 222374 - DNA, 25 bp, Rattus norvegicus
cacaagtggtccacaccccgagtgt

SEQ ID NO: 222375 - DNA, 25 bp, Rattus norvegicus
cacaagtggtcctcaccccgagtgt

SEQ ID NO: 222376 - DNA, 25 bp, Rattus norvegicus
cacaagtgtctgatgagtgctgtct

SEQ ID NO: 222377 - DNA, 25 bp, Rattus norvegicus
cacaagtgtctgttgagtgctgtct

SEQ ID NO: 222378 - DNA, 25 bp, Rattus norvegicus
cacaagttgctgagatacttcattt

SEQ ID NO: 222379 - DNA, 25 bp, Rattus norvegicus
cacaagttgctgtgatacttcattt

SEQ ID NO: 222380 - DNA, 25 bp, Rattus norvegicus
cacaagtttctgaacctggactgat

SEQ ID NO: 222381 - DNA, 25 bp, Rattus norvegicus
cacaagtttctgtacctggactgat

SEQ ID NO: 222382 - DNA, 25 bp, Rattus norvegicus
cacaagtttgataggcagccttctg

SEQ ID NO: 222383 - DNA, 25 bp, Rattus norvegicus
cacaagtttgattggcagccttctg

SEQ ID NO: 222384 - DNA, 25 bp, Rattus norvegicus
cacaagtttttgaccttcacagtag

SEQ ID NO: 222385 - DNA, 25 bp, Rattus norvegicus
cacaagtttttgtccttcacagtag

SEQ ID NO: 222386 - DNA, 25 bp, Rattus norvegicus
cacaataaacgacagggctccaaag

SEQ ID NO: 222387 - DNA, 25 bp, Rattus norvegicus
cacaataaacgagagggctccaaag

SEQ ID NO: 222388 - DNA, 25 bp, Rattus norvegicus
cacaataatttcagtttcttcttta

SEQ ID NO: 222389 - DNA, 25 bp, Rattus norvegicus
cacaataatttctgtttcttcttta

SEQ ID NO: 222390 - DNA, 25 bp, Rattus norvegicus
cacaatacattgatcttaagacaga

SEQ ID NO: 222391 - DNA, 25 bp, Rattus norvegicus
cacaatacattgttcttaagacaga

SEQ ID NO: 222392 - DNA, 25 bp, Rattus norvegicus
cacaatctgggtatttattcatgga

SEQ ID NO: 222393 - DNA, 25 bp, Rattus norvegicus
cacaatctgggtttttattcatgga

SEQ ID NO: 222394 - DNA, 25 bp, Rattus norvegicus
cacaatctgtcacctaactttctaa

SEQ ID NO: 222395 - DNA, 25 bp, Rattus norvegicus
cacaatctgtcagctaactttctaa

SEQ ID NO: 222396 - DNA, 25 bp, Rattus norvegicus
cacaatctttccagatgagactcaa

SEQ ID NO: 222397 - DNA, 25 bp, Rattus norvegicus
cacaatctttcctgatgagactcaa

SEQ ID NO: 222398 - DNA, 25 bp, Rattus norvegicus
cacaatgactgtcgacatgaattca

SEQ ID NO: 222399 - DNA, 25 bp, Rattus norvegicus
cacaatgactgtggacatgaattca

SEQ ID NO: 222400 - DNA, 25 bp, Rattus norvegicus
cacaatgcccgacttctttattaaa

SEQ ID NO: 222401 - DNA, 25 bp, Rattus norvegicus
cacaatgcccgagttctttattaaa

SEQ ID NO: 222402 - DNA, 25 bp, Rattus norvegicus
cacaatgcctgcctggtaagtgtaa

SEQ ID NO: 222403 - DNA, 25 bp, Rattus norvegicus
cacaatgcctgcgtggtaagtgtaa

SEQ ID NO: 222404 - DNA, 25 bp, Rattus norvegicus
cacaatggcatgaagtagtattcaa

SEQ ID NO: 222405 - DNA, 25 bp, Rattus norvegicus
cacaatggcatgtagtagtattcaa

SEQ ID NO: 222406 - DNA, 25 bp, Rattus norvegicus
cacaatgtgattactctgaggtttt

SEQ ID NO: 222407 - DNA, 25 bp, Rattus norvegicus
cacaatgtgatttctctgaggtttt

SEQ ID NO: 222408 - DNA, 25 bp, Rattus norvegicus
cacaatgttacacgtctccagatta

SEQ ID NO: 222409 - DNA, 25 bp, Rattus norvegicus
cacaatgttacaggtctccagatta

SEQ ID NO: 222410 - DNA, 25 bp, Rattus norvegicus
cacaatgttcttatgatttctagca

SEQ ID NO: 222411 - DNA, 25 bp, Rattus norvegicus
cacaatgttcttttgatttctagca

SEQ ID NO: 222412 - DNA, 25 bp, Rattus norvegicus
cacaatgtttgcagaagctcactct

SEQ ID NO: 222413 - DNA, 25 bp, Rattus norvegicus
cacaatgtttgctgaagctcactct

SEQ ID NO: 222414 - DNA, 25 bp, Rattus norvegicus
cacaattaaactccacgtgagctct

SEQ ID NO: 222415 - DNA, 25 bp, Rattus norvegicus
cacaattaaactgcacgtgagctct

SEQ ID NO: 222416 - DNA, 25 bp, Rattus norvegicus
cacaattccttacaggccttgaaag

SEQ ID NO: 222417 - DNA, 25 bp, Rattus norvegicus
cacaattccttagaggccttgaaag

SEQ ID NO: 222418 - DNA, 25 bp, Rattus norvegicus
cacaattctcttcaattactcatcc

SEQ ID NO: 222419 - DNA, 25 bp, Rattus norvegicus
cacaattctcttgaattactcatcc

SEQ ID NO: 222420 - DNA, 25 bp, Rattus norvegicus
cacaatttagtcctcgtgttattta

SEQ ID NO: 222421 - DNA, 25 bp, Rattus norvegicus
cacaatttagtcgtcgtgttattta

SEQ ID NO: 222422 - DNA, 25 bp, Rattus norvegicus
cacaatttcaccatgagctgtctca

SEQ ID NO: 222423 - DNA, 25 bp, Rattus norvegicus
cacaatttcaccttgagctgtctca

SEQ ID NO: 222424 - DNA, 25 bp, Rattus norvegicus
cacacaaatacaaaaggccccaggg

SEQ ID NO: 222425 - DNA, 25 bp, Rattus norvegicus
cacacaaatacataaggccccaggg

SEQ ID NO: 222426 - DNA, 25 bp, Rattus norvegicus
cacacaagactcaagcctctgaata

SEQ ID NO: 222427 - DNA, 25 bp, Rattus norvegicus
cacacaagactctagcctctgaata

SEQ ID NO: 222428 - DNA, 25 bp, Rattus norvegicus
cacacaagagggacagtcacatgct

SEQ ID NO: 222429 - DNA, 25 bp, Rattus norvegicus
cacacaagagggtcagtcacatgct

SEQ ID NO: 222430 - DNA, 25 bp, Rattus norvegicus
cacacaaggatgctcgtgcccagat

SEQ ID NO: 222431 - DNA, 25 bp, Rattus norvegicus
cacacaaggatggtcgtgcccagat

SEQ ID NO: 222432 - DNA, 25 bp, Rattus norvegicus
cacacaagtgagattcctaggtttt

SEQ ID NO: 222433 - DNA, 25 bp, Rattus norvegicus
cacacaagtgagtttcctaggtttt

SEQ ID NO: 222434 - DNA, 25 bp, Rattus norvegicus
cacacacacatccatacatgatgat

SEQ ID NO: 222435 - DNA, 25 bp, Rattus norvegicus
cacacacacatcgatacatgatgat

SEQ ID NO: 222436 - DNA, 25 bp, Rattus norvegicus
cacacacacttgattagcttttctg

SEQ ID NO: 222437 - DNA, 25 bp, Rattus norvegicus
cacacacacttgtttagcttttctg

SEQ ID NO: 222438 - DNA, 25 bp, Rattus norvegicus
cacacacactttaacgcaggataat

SEQ ID NO: 222439 - DNA, 25 bp, Rattus norvegicus
cacacacacttttacgcaggataat

SEQ ID NO: 222440 - DNA, 25 bp, Rattus norvegicus
cacacacagaacacaaggcaccttt

SEQ ID NO: 222441 - DNA, 25 bp, Rattus norvegicus
cacacacagaactcaaggcaccttt

SEQ ID NO: 222442 - DNA, 25 bp, Rattus norvegicus
cacacacaggatatgagccaatacg

SEQ ID NO: 222443 - DNA, 25 bp, Rattus norvegicus
cacacacaggatttgagccaatacg

SEQ ID NO: 222444 - DNA, 25 bp, Rattus norvegicus
cacacacagtagcacgagggatctt

SEQ ID NO: 222445 - DNA, 25 bp, Rattus norvegicus
cacacacagtaggacgagggatctt

SEQ ID NO: 222446 - DNA, 25 bp, Rattus norvegicus
cacacacagttaccccagaacggtg

SEQ ID NO: 222447 - DNA, 25 bp, Rattus norvegicus
cacacacagttagcccagaacggtg

SEQ ID NO: 222448 - DNA, 25 bp, Rattus norvegicus
cacacacagttcaacattgccaaag

SEQ ID NO: 222449 - DNA, 25 bp, Rattus norvegicus
cacacacagttctacattgccaaag

SEQ ID NO: 222450 - DNA, 25 bp, Rattus norvegicus
cacacacatgcacagacttagagag

SEQ ID NO: 222451 - DNA, 25 bp, Rattus norvegicus
cacacacatgcagagacttagagag

SEQ ID NO: 222452 - DNA, 25 bp, Rattus norvegicus
cacacacattgaccctgttgctcta

SEQ ID NO: 222453 - DNA, 25 bp, Rattus norvegicus
cacacacattgagcctgttgctcta

SEQ ID NO: 222454 - DNA, 25 bp, Rattus norvegicus
cacacaccatttaaacttcgaactc

SEQ ID NO: 222455 - DNA, 25 bp, Rattus norvegicus
cacacaccattttaacttcgaactc

SEQ ID NO: 222456 - DNA, 25 bp, Rattus norvegicus
cacacaccccaaaattaagctctaa

SEQ ID NO: 222457 - DNA, 25 bp, Rattus norvegicus
cacacaccccaatattaagctctaa

SEQ ID NO: 222458 - DNA, 25 bp, Rattus norvegicus
cacacaccctgtaatactctagata

SEQ ID NO: 222459 - DNA, 25 bp, Rattus norvegicus
cacacaccctgttatactctagata

SEQ ID NO: 222460 - DNA, 25 bp, Rattus norvegicus
cacacacctacaaccatcagatttt

SEQ ID NO: 222461 - DNA, 25 bp, Rattus norvegicus
cacacacctacatccatcagatttt

SEQ ID NO: 222462 - DNA, 25 bp, Rattus norvegicus
cacacacctgctcttgggttttcag

SEQ ID NO: 222463 - DNA, 25 bp, Rattus norvegicus
cacacacctgctgttgggttttcag

SEQ ID NO: 222464 - DNA, 25 bp, Rattus norvegicus
cacacacctgtgaatctgacttgat

SEQ ID NO: 222465 - DNA, 25 bp, Rattus norvegicus
cacacacctgtgtatctgacttgat

SEQ ID NO: 222466 - DNA, 25 bp, Rattus norvegicus
cacacacgagcacggttgggaaata

SEQ ID NO: 222467 - DNA, 25 bp, Rattus norvegicus
cacacacgagcagggttgggaaata

SEQ ID NO: 222468 - DNA, 25 bp, Rattus norvegicus
cacacacgcaaacatgcaaataaaa

SEQ ID NO: 222469 - DNA, 25 bp, Rattus norvegicus
cacacacgcaaagatgcaaataaaa

SEQ ID NO: 222470 - DNA, 25 bp, Rattus norvegicus
cacacacggtgaaggttgtttcaaa

SEQ ID NO: 222471 - DNA, 25 bp, Rattus norvegicus
cacacacggtgatggttgtttcaaa

SEQ ID NO: 222472 - DNA, 25 bp, Rattus norvegicus
cacacacgtgttaccttctatttat

SEQ ID NO: 222473 - DNA, 25 bp, Rattus norvegicus
cacacacgtgtttccttctatttat

SEQ ID NO: 222474 - DNA, 25 bp, Rattus norvegicus
cacacactcctgcaaagcttttgtt

SEQ ID NO: 222475 - DNA, 25 bp, Rattus norvegicus
cacacactcctggaaagcttttgtt

SEQ ID NO: 222476 - DNA, 25 bp, Rattus norvegicus
cacacactcgggactacaagagttc

SEQ ID NO: 222477 - DNA, 25 bp, Rattus norvegicus
cacacactcgggtctacaagagttc

SEQ ID NO: 222478 - DNA, 25 bp, Rattus norvegicus
cacacactctggaccgtttgaggga

SEQ ID NO: 222479 - DNA, 25 bp, Rattus norvegicus
cacacactctggtccgtttgaggga

SEQ ID NO: 222480 - DNA, 25 bp, Rattus norvegicus
cacacactcttacgccccaggtggg

SEQ ID NO: 222481 - DNA, 25 bp, Rattus norvegicus
cacacactcttaggccccaggtggg

SEQ ID NO: 222482 - DNA, 25 bp, Rattus norvegicus
cacacactgctgaagaggtcacctt

SEQ ID NO: 222483 - DNA, 25 bp, Rattus norvegicus
cacacactgctgtagaggtcacctt

SEQ ID NO: 222484 - DNA, 25 bp, Rattus norvegicus
cacacactgtgtacctttaaaccgt

SEQ ID NO: 222485 - DNA, 25 bp, Rattus norvegicus
cacacactgtgttcctttaaaccgt

SEQ ID NO: 222486 - DNA, 25 bp, Rattus norvegicus
cacacactgtttcacgcagggctat

SEQ ID NO: 222487 - DNA, 25 bp, Rattus norvegicus
cacacactgtttgacgcagggctat

SEQ ID NO: 222488 - DNA, 25 bp, Rattus norvegicus
cacacacttcttctggatgtcgtaa

SEQ ID NO: 222489 - DNA, 25 bp, Rattus norvegicus
cacacacttcttgtggatgtcgtaa

SEQ ID NO: 222490 - DNA, 25 bp, Rattus norvegicus
cacacacttgtgaaccaactcttag

SEQ ID NO: 222491 - DNA, 25 bp, Rattus norvegicus
cacacacttgtgtaccaactcttag

SEQ ID NO: 222492 - DNA, 25 bp, Rattus norvegicus
cacacacttgttcggccttttctgt

SEQ ID NO: 222493 - DNA, 25 bp, Rattus norvegicus
cacacacttgttgggccttttctgt

SEQ ID NO: 222494 - DNA, 25 bp, Rattus norvegicus
cacacacttttacaagttatcaaat

SEQ ID NO: 222495 - DNA, 25 bp, Rattus norvegicus
cacacacttttagaagttatcaaat

SEQ ID NO: 222496 - DNA, 25 bp, Rattus norvegicus
cacacagaaactaaggtttgttggt

SEQ ID NO: 222497 - DNA, 25 bp, Rattus norvegicus
cacacagaaacttaggtttgttggt

SEQ ID NO: 222498 - DNA, 25 bp, Rattus norvegicus
cacacagacctcatggatgtccatt

SEQ ID NO: 222499 - DNA, 25 bp, Rattus norvegicus
cacacagacctcttggatgtccatt

SEQ ID NO: 222500 - DNA, 25 bp, Rattus norvegicus
cacacagaccttcagttgcagtttt

SEQ ID NO: 222501 - DNA, 25 bp, Rattus norvegicus
cacacagaccttgagttgcagtttt

SEQ ID NO: 222502 - DNA, 25 bp, Rattus norvegicus
cacacagagcagcaacttggagaca

SEQ ID NO: 222503 - DNA, 25 bp, Rattus norvegicus
cacacagagcaggaacttggagaca

SEQ ID NO: 222504 - DNA, 25 bp, Rattus norvegicus
cacacagagcctatttccatggtgg

SEQ ID NO: 222505 - DNA, 25 bp, Rattus norvegicus
cacacagagcctttttccatggtgg

SEQ ID NO: 222506 - DNA, 25 bp, Rattus norvegicus
cacacagatactattatggtcgctt

SEQ ID NO: 222507 - DNA, 25 bp, Rattus norvegicus
cacacagatacttttatggtcgctt

SEQ ID NO: 222508 - DNA, 25 bp, Rattus norvegicus
cacacagcgctgacattttgttgta

SEQ ID NO: 222509 - DNA, 25 bp, Rattus norvegicus
cacacagcgctgtcattttgttgta

SEQ ID NO: 222510 - DNA, 25 bp, Rattus norvegicus
cacacagcgcttaccacttgataaa

SEQ ID NO: 222511 - DNA, 25 bp, Rattus norvegicus
cacacagcgctttccacttgataaa

SEQ ID NO: 222512 - DNA, 25 bp, Rattus norvegicus
cacacagcggcacaacagataagaa

SEQ ID NO: 222513 - DNA, 25 bp, Rattus norvegicus
cacacagcggcagaacagataagaa

SEQ ID NO: 222514 - DNA, 25 bp, Rattus norvegicus
cacacagcgggtctttaatgcacac

SEQ ID NO: 222515 - DNA, 25 bp, Rattus norvegicus
cacacagcgggtgtttaatgcacac

SEQ ID NO: 222516 - DNA, 25 bp, Rattus norvegicus
cacacagctggcacaaggtcttgga

SEQ ID NO: 222517 - DNA, 25 bp, Rattus norvegicus
cacacagctggctcaaggtcttgga

SEQ ID NO: 222518 - DNA, 25 bp, Rattus norvegicus
cacacagcttctcggtgacaccatg

SEQ ID NO: 222519 - DNA, 25 bp, Rattus norvegicus
cacacagcttctgggtgacaccatg

SEQ ID NO: 222520 - DNA, 25 bp, Rattus norvegicus
cacacaggaggcagcaaggtctaca

SEQ ID NO: 222521 - DNA, 25 bp, Rattus norvegicus
cacacaggaggctgcaaggtctaca

SEQ ID NO: 222522 - DNA, 25 bp, Rattus norvegicus
cacacaggagttctttatcacccat

SEQ ID NO: 222523 - DNA, 25 bp, Rattus norvegicus
cacacaggagttgtttatcacccat

SEQ ID NO: 222524 - DNA, 25 bp, Rattus norvegicus
cacacaggcagtatagggagaacaa

SEQ ID NO: 222525 - DNA, 25 bp, Rattus norvegicus
cacacaggcagtttagggagaacaa

SEQ ID NO: 222526 - DNA, 25 bp, Rattus norvegicus
cacacagggaatcttttttaccagg

SEQ ID NO: 222527 - DNA, 25 bp, Rattus norvegicus
cacacagggaatgttttttaccagg

SEQ ID NO: 222528 - DNA, 25 bp, Rattus norvegicus
cacacagggaccctgaaagcccggg

SEQ ID NO: 222529 - DNA, 25 bp, Rattus norvegicus
cacacagggaccgtgaaagcccggg

SEQ ID NO: 222530 - DNA, 25 bp, Rattus norvegicus
cacacaggtgacagtcccaggtaaa

SEQ ID NO: 222531 - DNA, 25 bp, Rattus norvegicus
cacacaggtgactgtcccaggtaaa

SEQ ID NO: 222532 - DNA, 25 bp, Rattus norvegicus
cacacagtacagataattgtctgct

SEQ ID NO: 222533 - DNA, 25 bp, Rattus norvegicus
cacacagtacagttaattgtctgct

SEQ ID NO: 222534 - DNA, 25 bp, Rattus norvegicus
cacacagtaggcactctcaaatgga

SEQ ID NO: 222535 - DNA, 25 bp, Rattus norvegicus
cacacagtaggctctctcaaatgga

SEQ ID NO: 222536 - DNA, 25 bp, Rattus norvegicus
cacacagtcagacggtttttagcta

SEQ ID NO: 222537 - DNA, 25 bp, Rattus norvegicus
cacacagtcagagggtttttagcta

SEQ ID NO: 222538 - DNA, 25 bp, Rattus norvegicus
cacacagtgaagaggaccagggcta

SEQ ID NO: 222539 - DNA, 25 bp, Rattus norvegicus
cacacagtgaagtggaccagggcta

SEQ ID NO: 222540 - DNA, 25 bp, Rattus norvegicus
cacacagtgctgcttgagcctttaa

SEQ ID NO: 222541 - DNA, 25 bp, Rattus norvegicus
cacacagtgctggttgagcctttaa

SEQ ID NO: 222542 - DNA, 25 bp, Rattus norvegicus
cacacagtgtgaaccaaagacgcct

SEQ ID NO: 222543 - DNA, 25 bp, Rattus norvegicus
cacacagtgtgatccaaagacgcct

SEQ ID NO: 222544 - DNA, 25 bp, Rattus norvegicus
cacacagtgtgcattggagttcatt

SEQ ID NO: 222545 - DNA, 25 bp, Rattus norvegicus
cacacagtgtgctttggagttcatt

SEQ ID NO: 222546 - DNA, 25 bp, Rattus norvegicus
cacacagtgtgtcttcccctaggga

SEQ ID NO: 222547 - DNA, 25 bp, Rattus norvegicus
cacacagtgtgtgttcccctaggga

SEQ ID NO: 222548 - DNA, 25 bp, Rattus norvegicus
cacacataagtgattagggccaaaa

SEQ ID NO: 222549 - DNA, 25 bp, Rattus norvegicus
cacacataagtgtttagggccaaaa

SEQ ID NO: 222550 - DNA, 25 bp, Rattus norvegicus
cacacataccttataaaggtgcaaa

SEQ ID NO: 222551 - DNA, 25 bp, Rattus norvegicus
cacacataccttttaaaggtgcaaa

SEQ ID NO: 222552 - DNA, 25 bp, Rattus norvegicus
cacacatactgtataaagcattcca

SEQ ID NO: 222553 - DNA, 25 bp, Rattus norvegicus
cacacatactgtttaaagcattcca

SEQ ID NO: 222554 - DNA, 25 bp, Rattus norvegicus
cacacatccggcaggaaaggcggcc

SEQ ID NO: 222555 - DNA, 25 bp, Rattus norvegicus
cacacatccggctggaaaggcggcc

SEQ ID NO: 222556 - DNA, 25 bp, Rattus norvegicus
cacacatcctaacatctgattcaca

SEQ ID NO: 222557 - DNA, 25 bp, Rattus norvegicus
cacacatcctaagatctgattcaca

SEQ ID NO: 222558 - DNA, 25 bp, Rattus norvegicus
cacacatcgctcactgcagaaaggg

SEQ ID NO: 222559 - DNA, 25 bp, Rattus norvegicus
cacacatcgctctctgcagaaaggg

SEQ ID NO: 222560 - DNA, 25 bp, Rattus norvegicus
cacacatctatcaatacatgctggc

SEQ ID NO: 222561 - DNA, 25 bp, Rattus norvegicus
cacacatctatctatacatgctggc

SEQ ID NO: 222562 - DNA, 25 bp, Rattus norvegicus
cacacatctgtcacctagcatttag

SEQ ID NO: 222563 - DNA, 25 bp, Rattus norvegicus
cacacatctgtctcctagcatttag

SEQ ID NO: 222564 - DNA, 25 bp, Rattus norvegicus
cacacatcttcccaggcttggataa

SEQ ID NO: 222565 - DNA, 25 bp, Rattus norvegicus
cacacatcttccgaggcttggataa

SEQ ID NO: 222566 - DNA, 25 bp, Rattus norvegicus
cacacatggcacacgtggtgggtat

SEQ ID NO: 222567 - DNA, 25 bp, Rattus norvegicus
cacacatggcactcgtggtgggtat

SEQ ID NO: 222568 - DNA, 25 bp, Rattus norvegicus
cacacatggcctcattgttctttct

SEQ ID NO: 222569 - DNA, 25 bp, Rattus norvegicus
cacacatggcctgattgttctttct

SEQ ID NO: 222570 - DNA, 25 bp, Rattus norvegicus
cacacatggtccacatgctgacaaa

SEQ ID NO: 222571 - DNA, 25 bp, Rattus norvegicus
cacacatggtcctcatgctgacaaa

SEQ ID NO: 222572 - DNA, 25 bp, Rattus norvegicus
cacacatgtgtgactgtttgtttat

SEQ ID NO: 222573 - DNA, 25 bp, Rattus norvegicus
cacacatgtgtgtctgtttgtttat

SEQ ID NO: 222574 - DNA, 25 bp, Rattus norvegicus
cacacatgttctatcttcaaggcac

SEQ ID NO: 222575 - DNA, 25 bp, Rattus norvegicus
cacacatgttctttcttcaaggcac

SEQ ID NO: 222576 - DNA, 25 bp, Rattus norvegicus
cacacattcacgcatatacacacag

SEQ ID NO: 222577 - DNA, 25 bp, Rattus norvegicus
cacacattcacggatatacacacag

SEQ ID NO: 222578 - DNA, 25 bp, Rattus norvegicus
cacacatttcccctttgacttatta

SEQ ID NO: 222579 - DNA, 25 bp, Rattus norvegicus
cacacatttcccgtttgacttatta

SEQ ID NO: 222580 - DNA, 25 bp, Rattus norvegicus
cacaccaacatgaacccaggacaaa

SEQ ID NO: 222581 - DNA, 25 bp, Rattus norvegicus
cacaccaacatgtacccaggacaaa

SEQ ID NO: 222582 - DNA, 25 bp, Rattus norvegicus
cacaccacatggatgtctttatgta

SEQ ID NO: 222583 - DNA, 25 bp, Rattus norvegicus
cacaccacatggttgtctttatgta

SEQ ID NO: 222584 - DNA, 25 bp, Rattus norvegicus
cacaccacctcaaaattgcacaaaa

SEQ ID NO: 222585 - DNA, 25 bp, Rattus norvegicus
cacaccacctcataattgcacaaaa

SEQ ID NO: 222586 - DNA, 25 bp, Rattus norvegicus
cacaccactcatactcacttgtggg

SEQ ID NO: 222587 - DNA, 25 bp, Rattus norvegicus
cacaccactcattctcacttgtggg

SEQ ID NO: 222588 - DNA, 25 bp, Rattus norvegicus
cacaccacttatattgttggaattg

SEQ ID NO: 222589 - DNA, 25 bp, Rattus norvegicus
cacaccacttattttgttggaattg

SEQ ID NO: 222590 - DNA, 25 bp, Rattus norvegicus
cacaccagaagacactattgaaaga

SEQ ID NO: 222591 - DNA, 25 bp, Rattus norvegicus
cacaccagaagagactattgaaaga

SEQ ID NO: 222592 - DNA, 25 bp, Rattus norvegicus
cacaccagcctgatctgtatttaaa

SEQ ID NO: 222593 - DNA, 25 bp, Rattus norvegicus
cacaccagcctgttctgtatttaaa

SEQ ID NO: 222594 - DNA, 25 bp, Rattus norvegicus
cacaccagcttgagcttcttccagt

SEQ ID NO: 222595 - DNA, 25 bp, Rattus norvegicus
cacaccagcttgtgcttcttccagt

SEQ ID NO: 222596 - DNA, 25 bp, Rattus norvegicus
cacaccagtgtacttggcggccgtg

SEQ ID NO: 222597 - DNA, 25 bp, Rattus norvegicus
cacaccagtgtagttggcggccgtg

SEQ ID NO: 222598 - DNA, 25 bp, Rattus norvegicus
cacaccagtgtgcagttaggccatt

SEQ ID NO: 222599 - DNA, 25 bp, Rattus norvegicus
cacaccagtgtggagttaggccatt

SEQ ID NO: 222600 - DNA, 25 bp, Rattus norvegicus
cacaccatctaaccaaattctggag

SEQ ID NO: 222601 - DNA, 25 bp, Rattus norvegicus
cacaccatctaagcaaattctggag

SEQ ID NO: 222602 - DNA, 25 bp, Rattus norvegicus
cacaccatcttcctgtttgaatggc

SEQ ID NO: 222603 - DNA, 25 bp, Rattus norvegicus
cacaccatcttcgtgtttgaatggc

SEQ ID NO: 222604 - DNA, 25 bp, Rattus norvegicus
cacaccatgccaacagtgggctaga

SEQ ID NO: 222605 - DNA, 25 bp, Rattus norvegicus
cacaccatgccatcagtgggctaga

SEQ ID NO: 222606 - DNA, 25 bp, Rattus norvegicus
cacaccattgcgaggcatgtatttt

SEQ ID NO: 222607 - DNA, 25 bp, Rattus norvegicus
cacaccattgcgtggcatgtatttt

SEQ ID NO: 222608 - DNA, 25 bp, Rattus norvegicus
cacacccagcttagttcttttaagt

SEQ ID NO: 222609 - DNA, 25 bp, Rattus norvegicus
cacacccagctttgttcttttaagt

SEQ ID NO: 222610 - DNA, 25 bp, Rattus norvegicus
cacacccaggtgatttgttgcaatt

SEQ ID NO: 222611 - DNA, 25 bp, Rattus norvegicus
cacacccaggtgttttgttgcaatt

SEQ ID NO: 222612 - DNA, 25 bp, Rattus norvegicus
cacaccccagagatgaatctatcca

SEQ ID NO: 222613 - DNA, 25 bp, Rattus norvegicus
cacaccccagagttgaatctatcca

SEQ ID NO: 222614 - DNA, 25 bp, Rattus norvegicus
cacaccccgaggaaccagtggtgga

SEQ ID NO: 222615 - DNA, 25 bp, Rattus norvegicus
cacaccccgaggtaccagtggtgga

SEQ ID NO: 222616 - DNA, 25 bp, Rattus norvegicus
cacacccgtttcctcattgggttgg

SEQ ID NO: 222617 - DNA, 25 bp, Rattus norvegicus
cacacccgtttcgtcattgggttgg

SEQ ID NO: 222618 - DNA, 25 bp, Rattus norvegicus
cacaccctataccattcatctgtat

SEQ ID NO: 222619 - DNA, 25 bp, Rattus norvegicus
cacaccctatacgattcatctgtat

SEQ ID NO: 222620 - DNA, 25 bp, Rattus norvegicus
cacaccctcctgctttatggatggg

SEQ ID NO: 222621 - DNA, 25 bp, Rattus norvegicus
cacaccctcctggtttatggatggg

SEQ ID NO: 222622 - DNA, 25 bp, Rattus norvegicus
cacaccctgactattcattctttta

SEQ ID NO: 222623 - DNA, 25 bp, Rattus norvegicus
cacaccctgacttttcattctttta

SEQ ID NO: 222624 - DNA, 25 bp, Rattus norvegicus
cacaccctgcagattcgatcccggg

SEQ ID NO: 222625 - DNA, 25 bp, Rattus norvegicus
cacaccctgcagtttcgatcccggg

SEQ ID NO: 222626 - DNA, 25 bp, Rattus norvegicus
cacacccttgacacaagtgttgatt

SEQ ID NO: 222627 - DNA, 25 bp, Rattus norvegicus
cacacccttgactcaagtgttgatt

SEQ ID NO: 222628 - DNA, 25 bp, Rattus norvegicus
cacaccctttcacttgaactttgta

SEQ ID NO: 222629 - DNA, 25 bp, Rattus norvegicus
cacaccctttcagttgaactttgta

SEQ ID NO: 222630 - DNA, 25 bp, Rattus norvegicus
cacaccgaagtcctcaagcagaaaa

SEQ ID NO: 222631 - DNA, 25 bp, Rattus norvegicus
cacaccgaagtcgtcaagcagaaaa

SEQ ID NO: 222632 - DNA, 25 bp, Rattus norvegicus
cacaccgaggacagggtcttgcgtt

SEQ ID NO: 222633 - DNA, 25 bp, Rattus norvegicus
cacaccgaggactgggtcttgcgtt

SEQ ID NO: 222634 - DNA, 25 bp, Rattus norvegicus
cacaccgtccagataatttctcaca

SEQ ID NO: 222635 - DNA, 25 bp, Rattus norvegicus
cacaccgtccagttaatttctcaca

SEQ ID NO: 222636 - DNA, 25 bp, Rattus norvegicus
cacaccgtggtcactgctcagtttc

SEQ ID NO: 222637 - DNA, 25 bp, Rattus norvegicus
cacaccgtggtctctgctcagtttc

SEQ ID NO: 222638 - DNA, 25 bp, Rattus norvegicus
cacaccgtttccagtgtcatggagt

SEQ ID NO: 222639 - DNA, 25 bp, Rattus norvegicus
cacaccgtttcctgtgtcatggagt

SEQ ID NO: 222640 - DNA, 25 bp, Rattus norvegicus
cacacctaggacctttcccaagttg

SEQ ID NO: 222641 - DNA, 25 bp, Rattus norvegicus
cacacctaggacgtttcccaagttg

SEQ ID NO: 222642 - DNA, 25 bp, Rattus norvegicus
cacacctcgagacaaggagagcctt

SEQ ID NO: 222643 - DNA, 25 bp, Rattus norvegicus
cacacctcgagagaaggagagcctt

SEQ ID NO: 222644 - DNA, 25 bp, Rattus norvegicus
cacacctcttgcctagagtttgaat

SEQ ID NO: 222645 - DNA, 25 bp, Rattus norvegicus
cacacctcttgcgtagagtttgaat

SEQ ID NO: 222646 - DNA, 25 bp, Rattus norvegicus
cacacctgacggattggaattaagt

SEQ ID NO: 222647 - DNA, 25 bp, Rattus norvegicus
cacacctgacggtttggaattaagt

SEQ ID NO: 222648 - DNA, 25 bp, Rattus norvegicus
cacacctgattcacctagactatta

SEQ ID NO: 222649 - DNA, 25 bp, Rattus norvegicus
cacacctgattctcctagactatta

SEQ ID NO: 222650 - DNA, 25 bp, Rattus norvegicus
cacacctgcagcatgtttactgact

SEQ ID NO: 222651 - DNA, 25 bp, Rattus norvegicus
cacacctgcagcttgtttactgact

SEQ ID NO: 222652 - DNA, 25 bp, Rattus norvegicus
cacacctgcctcattagtagtatat

SEQ ID NO: 222653 - DNA, 25 bp, Rattus norvegicus
cacacctgcctctttagtagtatat

SEQ ID NO: 222654 - DNA, 25 bp, Rattus norvegicus
cacacctgctgtcggctgggaagaa

SEQ ID NO: 222655 - DNA, 25 bp, Rattus norvegicus
cacacctgctgtgggctgggaagaa

SEQ ID NO: 222656 - DNA, 25 bp, Rattus norvegicus
cacacctggatcctgagtctattgg

SEQ ID NO: 222657 - DNA, 25 bp, Rattus norvegicus
cacacctggatcgtgagtctattgg

SEQ ID NO: 222658 - DNA, 25 bp, Rattus norvegicus
cacacctgggcactggtcaatttgc

SEQ ID NO: 222659 - DNA, 25 bp, Rattus norvegicus
cacacctgggcagtggtcaatttgc

SEQ ID NO: 222660 - DNA, 25 bp, Rattus norvegicus
cacacctggttcattacatataata

SEQ ID NO: 222661 - DNA, 25 bp, Rattus norvegicus
cacacctggttctttacatataata

SEQ ID NO: 222662 - DNA, 25 bp, Rattus norvegicus
cacacctgtggcatacggttgtaaa

SEQ ID NO: 222663 - DNA, 25 bp, Rattus norvegicus
cacacctgtggcttacggttgtaaa

SEQ ID NO: 222664 - DNA, 25 bp, Rattus norvegicus
cacaccttgctcctaatcagaagtt

SEQ ID NO: 222665 - DNA, 25 bp, Rattus norvegicus
cacaccttgctcgtaatcagaagtt

SEQ ID NO: 222666 - DNA, 25 bp, Rattus norvegicus
cacaccttgggtagttgagatctcc

SEQ ID NO: 222667 - DNA, 25 bp, Rattus norvegicus
cacaccttgggttgttgagatctcc

SEQ ID NO: 222668 - DNA, 25 bp, Rattus norvegicus
cacacctttatgactggcttcagta

SEQ ID NO: 222669 - DNA, 25 bp, Rattus norvegicus
cacacctttatgtctggcttcagta

SEQ ID NO: 222670 - DNA, 25 bp, Rattus norvegicus
cacacctttctaaacgtggtactgt

SEQ ID NO: 222671 - DNA, 25 bp, Rattus norvegicus
cacacctttctatacgtggtactgt

SEQ ID NO: 222672 - DNA, 25 bp, Rattus norvegicus
cacaccttttaccacttcatcgtgg

SEQ ID NO: 222673 - DNA, 25 bp, Rattus norvegicus
cacaccttttacgacttcatcgtgg

SEQ ID NO: 222674 - DNA, 25 bp, Rattus norvegicus
cacacgaaagggaagtggtactcta

SEQ ID NO: 222675 - DNA, 25 bp, Rattus norvegicus
cacacgaaagggtagtggtactcta

SEQ ID NO: 222676 - DNA, 25 bp, Rattus norvegicus
cacacgaacaccatgacacctgtgg

SEQ ID NO: 222677 - DNA, 25 bp, Rattus norvegicus
cacacgaacaccttgacacctgtgg

SEQ ID NO: 222678 - DNA, 25 bp, Rattus norvegicus
cacacgcacctgcttttgttctttt

SEQ ID NO: 222679 - DNA, 25 bp, Rattus norvegicus
cacacgcacctggttttgttctttt

SEQ ID NO: 222680 - DNA, 25 bp, Rattus norvegicus
cacacgcatgtgaaggtcagcagac

SEQ ID NO: 222681 - DNA, 25 bp, Rattus norvegicus
cacacgcatgtgtaggtcagcagac

SEQ ID NO: 222682 - DNA, 25 bp, Rattus norvegicus
cacacgccaggcattatgagttcta

SEQ ID NO: 222683 - DNA, 25 bp, Rattus norvegicus
cacacgccaggctttatgagttcta

SEQ ID NO: 222684 - DNA, 25 bp, Rattus norvegicus
cacacgccccttcctagagagaagg

SEQ ID NO: 222685 - DNA, 25 bp, Rattus norvegicus
cacacgccccttgctagagagaagg

SEQ ID NO: 222686 - DNA, 25 bp, Rattus norvegicus
cacacggaagccactgaaagtctct

SEQ ID NO: 222687 - DNA, 25 bp, Rattus norvegicus
cacacggaagcctctgaaagtctct

SEQ ID NO: 222688 - DNA, 25 bp, Rattus norvegicus
cacacggcactcatttctaatattt

SEQ ID NO: 222689 - DNA, 25 bp, Rattus norvegicus
cacacggcactcttttctaatattt

SEQ ID NO: 222690 - DNA, 25 bp, Rattus norvegicus
cacacggcatttctcgttcaatgga

SEQ ID NO: 222691 - DNA, 25 bp, Rattus norvegicus
cacacggcatttgtcgttcaatgga

SEQ ID NO: 222692 - DNA, 25 bp, Rattus norvegicus
cacacgggagtgcagttgctgcaca

SEQ ID NO: 222693 - DNA, 25 bp, Rattus norvegicus
cacacgggagtggagttgctgcaca

SEQ ID NO: 222694 - DNA, 25 bp, Rattus norvegicus
cacacgggcaggcactgacagacat

SEQ ID NO: 222695 - DNA, 25 bp, Rattus norvegicus
cacacgggcagggactgacagacat

SEQ ID NO: 222696 - DNA, 25 bp, Rattus norvegicus
cacacggtaggtatgctgtcttgat

SEQ ID NO: 222697 - DNA, 25 bp, Rattus norvegicus
cacacggtaggtttgctgtcttgat

SEQ ID NO: 222698 - DNA, 25 bp, Rattus norvegicus
cacacggtccaacggagcctgagca

SEQ ID NO: 222699 - DNA, 25 bp, Rattus norvegicus
cacacggtccaagggagcctgagca

SEQ ID NO: 222700 - DNA, 25 bp, Rattus norvegicus
cacacggtctgtcggtcagtgacat

SEQ ID NO: 222701 - DNA, 25 bp, Rattus norvegicus
cacacggtctgtgggtcagtgacat

SEQ ID NO: 222702 - DNA, 25 bp, Rattus norvegicus
cacacggtgctaaacacattttatt

SEQ ID NO: 222703 - DNA, 25 bp, Rattus norvegicus
cacacggtgctatacacattttatt

SEQ ID NO: 222704 - DNA, 25 bp, Rattus norvegicus
cacacggtgtaaccatggctgggct

SEQ ID NO: 222705 - DNA, 25 bp, Rattus norvegicus
cacacggtgtaagcatggctgggct

SEQ ID NO: 222706 - DNA, 25 bp, Rattus norvegicus
cacacggtgttaatcattgggcctg

SEQ ID NO: 222707 - DNA, 25 bp, Rattus norvegicus
cacacggtgttattcattgggcctg

SEQ ID NO: 222708 - DNA, 25 bp, Rattus norvegicus
cacacggttgatcgattgtgtccta

SEQ ID NO: 222709 - DNA, 25 bp, Rattus norvegicus
cacacggttgatggattgtgtccta

SEQ ID NO: 222710 - DNA, 25 bp, Rattus norvegicus
cacacggtttacagcttttcaatat

SEQ ID NO: 222711 - DNA, 25 bp, Rattus norvegicus
cacacggtttactgcttttcaatat

SEQ ID NO: 222712 - DNA, 25 bp, Rattus norvegicus
cacacgtattggcagtgcatgaata

SEQ ID NO: 222713 - DNA, 25 bp, Rattus norvegicus
cacacgtattgggagtgcatgaata

SEQ ID NO: 222714 - DNA, 25 bp, Rattus norvegicus
cacacgtcacctaagtgtcacttat

SEQ ID NO: 222715 - DNA, 25 bp, Rattus norvegicus
cacacgtcaccttagtgtcacttat

SEQ ID NO: 222716 - DNA, 25 bp, Rattus norvegicus
cacacgtccgatcctgttgatttga

SEQ ID NO: 222717 - DNA, 25 bp, Rattus norvegicus
cacacgtccgatgctgttgatttga

SEQ ID NO: 222718 - DNA, 25 bp, Rattus norvegicus
cacacgtcgtggcttctgaaggtct

SEQ ID NO: 222719 - DNA, 25 bp, Rattus norvegicus
cacacgtcgtgggttctgaaggtct

SEQ ID NO: 222720 - DNA, 25 bp, Rattus norvegicus
cacacgtgagcccattcagttattt

SEQ ID NO: 222721 - DNA, 25 bp, Rattus norvegicus
cacacgtgagccgattcagttattt

SEQ ID NO: 222722 - DNA, 25 bp, Rattus norvegicus
cacacgtgcagacgcatgcatgaga

SEQ ID NO: 222723 - DNA, 25 bp, Rattus norvegicus
cacacgtgcagaggcatgcatgaga

SEQ ID NO: 222724 - DNA, 25 bp, Rattus norvegicus
cacacgtggtaaatgctgaggcatt

SEQ ID NO: 222725 - DNA, 25 bp, Rattus norvegicus
cacacgtggtaattgctgaggcatt

SEQ ID NO: 222726 - DNA, 25 bp, Rattus norvegicus
cacacgtggtgtcccgacatacagg

SEQ ID NO: 222727 - DNA, 25 bp, Rattus norvegicus
cacacgtggtgtgccgacatacagg

SEQ ID NO: 222728 - DNA, 25 bp, Rattus norvegicus
cacacgtgtggaaccttattggcat

SEQ ID NO: 222729 - DNA, 25 bp, Rattus norvegicus
cacacgtgtggatccttattggcat

SEQ ID NO: 222730 - DNA, 25 bp, Rattus norvegicus
cacacgtgtgtcagcaataccaaat

SEQ ID NO: 222731 - DNA, 25 bp, Rattus norvegicus
cacacgtgtgtctgcaataccaaat

SEQ ID NO: 222732 - DNA, 25 bp, Rattus norvegicus
cacacgttgtgacagtgaccatcaa

SEQ ID NO: 222733 - DNA, 25 bp, Rattus norvegicus
cacacgttgtgagagtgaccatcaa

SEQ ID NO: 222734 - DNA, 25 bp, Rattus norvegicus
cacactaattccagtttgtggtgac

SEQ ID NO: 222735 - DNA, 25 bp, Rattus norvegicus
cacactaattcctgtttgtggtgac

SEQ ID NO: 222736 - DNA, 25 bp, Rattus norvegicus
cacactacaggcccggagctttggg

SEQ ID NO: 222737 - DNA, 25 bp, Rattus norvegicus
cacactacaggcgcggagctttggg

SEQ ID NO: 222738 - DNA, 25 bp, Rattus norvegicus
cacactaccacaactggcagtttat

SEQ ID NO: 222739 - DNA, 25 bp, Rattus norvegicus
cacactaccacatctggcagtttat

SEQ ID NO: 222740 - DNA, 25 bp, Rattus norvegicus
cacactagcagtcccagcattcaga

SEQ ID NO: 222741 - DNA, 25 bp, Rattus norvegicus
cacactagcagtgccagcattcaga

SEQ ID NO: 222742 - DNA, 25 bp, Rattus norvegicus
cacactaggtgcctggagcctctgg

SEQ ID NO: 222743 - DNA, 25 bp, Rattus norvegicus
cacactaggtgcgtggagcctctgg

SEQ ID NO: 222744 - DNA, 25 bp, Rattus norvegicus
cacactagtcatcgagctggctcaa

SEQ ID NO: 222745 - DNA, 25 bp, Rattus norvegicus
cacactagtcatggagctggctcaa

SEQ ID NO: 222746 - DNA, 25 bp, Rattus norvegicus
cacactagttttcgagagatttgct

SEQ ID NO: 222747 - DNA, 25 bp, Rattus norvegicus
cacactagttttggagagatttgct

SEQ ID NO: 222748 - DNA, 25 bp, Rattus norvegicus
cacactatcctgagcatggtgacag

SEQ ID NO: 222749 - DNA, 25 bp, Rattus norvegicus
cacactatcctgtgcatggtgacag

SEQ ID NO: 222750 - DNA, 25 bp, Rattus norvegicus
cacactatctttcgttggcccagta

SEQ ID NO: 222751 - DNA, 25 bp, Rattus norvegicus
cacactatctttggttggcccagta

SEQ ID NO: 222752 - DNA, 25 bp, Rattus norvegicus
cacactcataaactgcttgcgcaat

SEQ ID NO: 222753 - DNA, 25 bp, Rattus norvegicus
cacactcataaagtgcttgcgcaat

SEQ ID NO: 222754 - DNA, 25 bp, Rattus norvegicus
cacactcattccaaaccaacgtttg

SEQ ID NO: 222755 - DNA, 25 bp, Rattus norvegicus
cacactcattcctaaccaacgtttg

SEQ ID NO: 222756 - DNA, 25 bp, Rattus norvegicus
cacactccatgtctccaaggcagaa

SEQ ID NO: 222757 - DNA, 25 bp, Rattus norvegicus
cacactccatgtgtccaaggcagaa

SEQ ID NO: 222758 - DNA, 25 bp, Rattus norvegicus
cacactccgataaccatgaatggca

SEQ ID NO: 222759 - DNA, 25 bp, Rattus norvegicus
cacactccgatatccatgaatggca

SEQ ID NO: 222760 - DNA, 25 bp, Rattus norvegicus
cacactccgattatcttatgacaat

SEQ ID NO: 222761 - DNA, 25 bp, Rattus norvegicus
cacactccgattttcttatgacaat

SEQ ID NO: 222762 - DNA, 25 bp, Rattus norvegicus
cacactcctattagtttgcttgctt

SEQ ID NO: 222763 - DNA, 25 bp, Rattus norvegicus
cacactcctatttgtttgcttgctt

SEQ ID NO: 222764 - DNA, 25 bp, Rattus norvegicus
cacactcctttgctaggtcttttta

SEQ ID NO: 222765 - DNA, 25 bp, Rattus norvegicus
cacactcctttggtaggtcttttta

SEQ ID NO: 222766 - DNA, 25 bp, Rattus norvegicus
cacactcgggaacggccagcggttt

SEQ ID NO: 222767 - DNA, 25 bp, Rattus norvegicus
cacactcgggaagggccagcggttt

SEQ ID NO: 222768 - DNA, 25 bp, Rattus norvegicus
cacactcgtgagcaaagaaccttag

SEQ ID NO: 222769 - DNA, 25 bp, Rattus norvegicus
cacactcgtgaggaaagaaccttag

SEQ ID NO: 222770 - DNA, 25 bp, Rattus norvegicus
cacactctactgaaacccttaactt

SEQ ID NO: 222771 - DNA, 25 bp, Rattus norvegicus
cacactctactgtaacccttaactt

SEQ ID NO: 222772 - DNA, 25 bp, Rattus norvegicus
cacactctgaatatgccctaggtag

SEQ ID NO: 222773 - DNA, 25 bp, Rattus norvegicus
cacactctgaatttgccctaggtag

SEQ ID NO: 222774 - DNA, 25 bp, Rattus norvegicus
cacactctgatcatgcagtctttga

SEQ ID NO: 222775 - DNA, 25 bp, Rattus norvegicus
cacactctgatcttgcagtctttga

SEQ ID NO: 222776 - DNA, 25 bp, Rattus norvegicus
cacactctgctactcttgttatcag

SEQ ID NO: 222777 - DNA, 25 bp, Rattus norvegicus
cacactctgctagtcttgttatcag

SEQ ID NO: 222778 - DNA, 25 bp, Rattus norvegicus
cacactcttcatatccacattatat

SEQ ID NO: 222779 - DNA, 25 bp, Rattus norvegicus
cacactcttcatttccacattatat

SEQ ID NO: 222780 - DNA, 25 bp, Rattus norvegicus
cacactgaacatctgatggactgca

SEQ ID NO: 222781 - DNA, 25 bp, Rattus norvegicus
cacactgaacatgtgatggactgca

SEQ ID NO: 222782 - DNA, 25 bp, Rattus norvegicus
cacactgaactcaggcttttaactt

SEQ ID NO: 222783 - DNA, 25 bp, Rattus norvegicus
cacactgaactctggcttttaactt

SEQ ID NO: 222784 - DNA, 25 bp, Rattus norvegicus
cacactgaagttaaccacccattta

SEQ ID NO: 222785 - DNA, 25 bp, Rattus norvegicus
cacactgaagtttaccacccattta

SEQ ID NO: 222786 - DNA, 25 bp, Rattus norvegicus
cacactgaccctcttgagaagccaa

SEQ ID NO: 222787 - DNA, 25 bp, Rattus norvegicus
cacactgaccctgttgagaagccaa

SEQ ID NO: 222788 - DNA, 25 bp, Rattus norvegicus
cacactgatggacattttgagggtt

SEQ ID NO: 222789 - DNA, 25 bp, Rattus norvegicus
cacactgatggagattttgagggtt

SEQ ID NO: 222790 - DNA, 25 bp, Rattus norvegicus
cacactgatgtgctttcttcttcca

SEQ ID NO: 222791 - DNA, 25 bp, Rattus norvegicus
cacactgatgtggtttcttcttcca

SEQ ID NO: 222792 - DNA, 25 bp, Rattus norvegicus
cacactgcacgcacttttgtattat

SEQ ID NO: 222793 - DNA, 25 bp, Rattus norvegicus
cacactgcacgctcttttgtattat

SEQ ID NO: 222794 - DNA, 25 bp, Rattus norvegicus
cacactgcattgatcggtgacatta

SEQ ID NO: 222795 - DNA, 25 bp, Rattus norvegicus
cacactgcattgttcggtgacatta

SEQ ID NO: 222796 - DNA, 25 bp, Rattus norvegicus
cacactgcctatagtcccagaattt

SEQ ID NO: 222797 - DNA, 25 bp, Rattus norvegicus
cacactgcctattgtcccagaattt

SEQ ID NO: 222798 - DNA, 25 bp, Rattus norvegicus
cacactgcggctactaatggaggtt

SEQ ID NO: 222799 - DNA, 25 bp, Rattus norvegicus
cacactgcggcttctaatggaggtt

SEQ ID NO: 222800 - DNA, 25 bp, Rattus norvegicus
cacactgcgggacgttgagctgaca

SEQ ID NO: 222801 - DNA, 25 bp, Rattus norvegicus
cacactgcgggaggttgagctgaca

SEQ ID NO: 222802 - DNA, 25 bp, Rattus norvegicus
cacactgctgaacatgttgaacatc

SEQ ID NO: 222803 - DNA, 25 bp, Rattus norvegicus
cacactgctgaagatgttgaacatc

SEQ ID NO: 222804 - DNA, 25 bp, Rattus norvegicus
cacactgctgttaacggacttaggt

SEQ ID NO: 222805 - DNA, 25 bp, Rattus norvegicus
cacactgctgtttacggacttaggt

SEQ ID NO: 222806 - DNA, 25 bp, Rattus norvegicus
cacactgcttgacattttctctgat

SEQ ID NO: 222807 - DNA, 25 bp, Rattus norvegicus
cacactgcttgagattttctctgat

SEQ ID NO: 222808 - DNA, 25 bp, Rattus norvegicus
cacactgcttggatttttcactggt

SEQ ID NO: 222809 - DNA, 25 bp, Rattus norvegicus
cacactgcttggttttttcactggt

SEQ ID NO: 222810 - DNA, 25 bp, Rattus norvegicus
cacactggacagattgtgtactgcg

SEQ ID NO: 222811 - DNA, 25 bp, Rattus norvegicus
cacactggacagtttgtgtactgcg

SEQ ID NO: 222812 - DNA, 25 bp, Rattus norvegicus
cacactggcagcaggatcttattca

SEQ ID NO: 222813 - DNA, 25 bp, Rattus norvegicus
cacactggcagctggatcttattca

SEQ ID NO: 222814 - DNA, 25 bp, Rattus norvegicus
cacactggcgaaaaaccctatgggt

SEQ ID NO: 222815 - DNA, 25 bp, Rattus norvegicus
cacactggcgaataaccctatgggt

SEQ ID NO: 222816 - DNA, 25 bp, Rattus norvegicus
cacactggctgtactcttagaagaa

SEQ ID NO: 222817 - DNA, 25 bp, Rattus norvegicus
cacactggctgttctcttagaagaa

SEQ ID NO: 222818 - DNA, 25 bp, Rattus norvegicus
cacactggcttactctctattcaga

SEQ ID NO: 222819 - DNA, 25 bp, Rattus norvegicus
cacactggcttagtctctattcaga

SEQ ID NO: 222820 - DNA, 25 bp, Rattus norvegicus
cacactgggttgcaacagaggctcc

SEQ ID NO: 222821 - DNA, 25 bp, Rattus norvegicus
cacactgggttggaacagaggctcc

SEQ ID NO: 222822 - DNA, 25 bp, Rattus norvegicus
cacactggtgagacaactggccgca

SEQ ID NO: 222823 - DNA, 25 bp, Rattus norvegicus
cacactggtgagtcaactggccgca

SEQ ID NO: 222824 - DNA, 25 bp, Rattus norvegicus
cacactggtgtgactgatttctgat

SEQ ID NO: 222825 - DNA, 25 bp, Rattus norvegicus
cacactggtgtgtctgatttctgat

SEQ ID NO: 222826 - DNA, 25 bp, Rattus norvegicus
cacactggttttaagctttgggcgt

SEQ ID NO: 222827 - DNA, 25 bp, Rattus norvegicus
cacactggtttttagctttgggcgt

SEQ ID NO: 222828 - DNA, 25 bp, Rattus norvegicus
cacactgtaagaccccttggatgca

SEQ ID NO: 222829 - DNA, 25 bp, Rattus norvegicus
cacactgtaagagcccttggatgca

SEQ ID NO: 222830 - DNA, 25 bp, Rattus norvegicus
cacactgtagacctggtgacagact

SEQ ID NO: 222831 - DNA, 25 bp, Rattus norvegicus
cacactgtagacgtggtgacagact

SEQ ID NO: 222832 - DNA, 25 bp, Rattus norvegicus
cacactgtaggtctctgcctcctgg

SEQ ID NO: 222833 - DNA, 25 bp, Rattus norvegicus
cacactgtaggtgtctgcctcctgg

SEQ ID NO: 222834 - DNA, 25 bp, Rattus norvegicus
cacactgtagtcacagtactcagta

SEQ ID NO: 222835 - DNA, 25 bp, Rattus norvegicus
cacactgtagtctcagtactcagta

SEQ ID NO: 222836 - DNA, 25 bp, Rattus norvegicus
cacactgtcggtcacgtgtgttttc

SEQ ID NO: 222837 - DNA, 25 bp, Rattus norvegicus
cacactgtcggtgacgtgtgttttc

SEQ ID NO: 222838 - DNA, 25 bp, Rattus norvegicus
cacactgtctctcggaatcaatagc

SEQ ID NO: 222839 - DNA, 25 bp, Rattus norvegicus
cacactgtctctgggaatcaatagc

SEQ ID NO: 222840 - DNA, 25 bp, Rattus norvegicus
cacactgtcttgattccgctgggaa

SEQ ID NO: 222841 - DNA, 25 bp, Rattus norvegicus
cacactgtcttgtttccgctgggaa

SEQ ID NO: 222842 - DNA, 25 bp, Rattus norvegicus
cacactgtgatgcagctgcgatggc

SEQ ID NO: 222843 - DNA, 25 bp, Rattus norvegicus
cacactgtgatggagctgcgatggc

SEQ ID NO: 222844 - DNA, 25 bp, Rattus norvegicus
cacactgtgcagacagctcctgttt

SEQ ID NO: 222845 - DNA, 25 bp, Rattus norvegicus
cacactgtgcagtcagctcctgttt

SEQ ID NO: 222846 - DNA, 25 bp, Rattus norvegicus
cacactgtgctgaacaaggaaccac

SEQ ID NO: 222847 - DNA, 25 bp, Rattus norvegicus
cacactgtgctgtacaaggaaccac

SEQ ID NO: 222848 - DNA, 25 bp, Rattus norvegicus
cacactgtgtacagggactgctgat

SEQ ID NO: 222849 - DNA, 25 bp, Rattus norvegicus
cacactgtgtactgggactgctgat

SEQ ID NO: 222850 - DNA, 25 bp, Rattus norvegicus
cacactgtgttcactgcttctaaag

SEQ ID NO: 222851 - DNA, 25 bp, Rattus norvegicus
cacactgtgttctctgcttctaaag

SEQ ID NO: 222852 - DNA, 25 bp, Rattus norvegicus
cacactgtgttgataaccttcttta

SEQ ID NO: 222853 - DNA, 25 bp, Rattus norvegicus
cacactgtgttgttaaccttcttta

SEQ ID NO: 222854 - DNA, 25 bp, Rattus norvegicus
cacactgttccaatcctcaagatgg

SEQ ID NO: 222855 - DNA, 25 bp, Rattus norvegicus
cacactgttccattcctcaagatgg

SEQ ID NO: 222856 - DNA, 25 bp, Rattus norvegicus
cacactgttctacgctgattcttca

SEQ ID NO: 222857 - DNA, 25 bp, Rattus norvegicus
cacactgttctaggctgattcttca

SEQ ID NO: 222858 - DNA, 25 bp, Rattus norvegicus
cacactgttggtacaagctggcttg

SEQ ID NO: 222859 - DNA, 25 bp, Rattus norvegicus
cacactgttggttcaagctggcttg

SEQ ID NO: 222860 - DNA, 25 bp, Rattus norvegicus
cacacttagattcagattgaccaca

SEQ ID NO: 222861 - DNA, 25 bp, Rattus norvegicus
cacacttagattgagattgaccaca

SEQ ID NO: 222862 - DNA, 25 bp, Rattus norvegicus
cacacttcacgtccctttagaggat

SEQ ID NO: 222863 - DNA, 25 bp, Rattus norvegicus
cacacttcacgtgcctttagaggat

SEQ ID NO: 222864 - DNA, 25 bp, Rattus norvegicus
cacacttcagtaacttttgcagcca

SEQ ID NO: 222865 - DNA, 25 bp, Rattus norvegicus
cacacttcagtatcttttgcagcca

SEQ ID NO: 222866 - DNA, 25 bp, Rattus norvegicus
cacacttccacactgatctttagga

SEQ ID NO: 222867 - DNA, 25 bp, Rattus norvegicus
cacacttccacagtgatctttagga

SEQ ID NO: 222868 - DNA, 25 bp, Rattus norvegicus
cacacttcttacctcacttgtgtaa

SEQ ID NO: 222869 - DNA, 25 bp, Rattus norvegicus
cacacttcttacgtcacttgtgtaa

SEQ ID NO: 222870 - DNA, 25 bp, Rattus norvegicus
cacacttgccaaatcagatctggtt

SEQ ID NO: 222871 - DNA, 25 bp, Rattus norvegicus
cacacttgccaattcagatctggtt

SEQ ID NO: 222872 - DNA, 25 bp, Rattus norvegicus
cacacttgcccactctagtgaaggt

SEQ ID NO: 222873 - DNA, 25 bp, Rattus norvegicus
cacacttgcccagtctagtgaaggt

SEQ ID NO: 222874 - DNA, 25 bp, Rattus norvegicus
cacacttgcttcaaggttgagacta

SEQ ID NO: 222875 - DNA, 25 bp, Rattus norvegicus
cacacttgcttctaggttgagacta

SEQ ID NO: 222876 - DNA, 25 bp, Rattus norvegicus
cacacttggagaaggccactagcca

SEQ ID NO: 222877 - DNA, 25 bp, Rattus norvegicus
cacacttggagatggccactagcca

SEQ ID NO: 222878 - DNA, 25 bp, Rattus norvegicus
cacacttggccaccatatgggacaa

SEQ ID NO: 222879 - DNA, 25 bp, Rattus norvegicus
cacacttggccagcatatgggacaa

SEQ ID NO: 222880 - DNA, 25 bp, Rattus norvegicus
cacactttacttacttagctttcca

SEQ ID NO: 222881 - DNA, 25 bp, Rattus norvegicus
cacactttactttcttagctttcca

SEQ ID NO: 222882 - DNA, 25 bp, Rattus norvegicus
cacactttcagcactaactcatcag

SEQ ID NO: 222883 - DNA, 25 bp, Rattus norvegicus
cacactttcagctctaactcatcag

SEQ ID NO: 222884 - DNA, 25 bp, Rattus norvegicus
cacactttccaaagttgttctcagg

SEQ ID NO: 222885 - DNA, 25 bp, Rattus norvegicus
cacactttccaatgttgttctcagg

SEQ ID NO: 222886 - DNA, 25 bp, Rattus norvegicus
cacactttctgcactaagctcaaga

SEQ ID NO: 222887 - DNA, 25 bp, Rattus norvegicus
cacactttctgctctaagctcaaga

SEQ ID NO: 222888 - DNA, 25 bp, Rattus norvegicus
cacactttgagaaacatggatctaa

SEQ ID NO: 222889 - DNA, 25 bp, Rattus norvegicus
cacactttgagatacatggatctaa

SEQ ID NO: 222890 - DNA, 25 bp, Rattus norvegicus
cacacttttagtcccttactcctaa

SEQ ID NO: 222891 - DNA, 25 bp, Rattus norvegicus
cacacttttagtgccttactcctaa

SEQ ID NO: 222892 - DNA, 25 bp, Rattus norvegicus
cacacttttggaaaccgtggttctt

SEQ ID NO: 222893 - DNA, 25 bp, Rattus norvegicus
cacacttttggataccgtggttctt

SEQ ID NO: 222894 - DNA, 25 bp, Rattus norvegicus
cacagaaatctgagtccctctgact

SEQ ID NO: 222895 - DNA, 25 bp, Rattus norvegicus
cacagaaatctgtgtccctctgact

SEQ ID NO: 222896 - DNA, 25 bp, Rattus norvegicus
cacagaaattagagacccatgagtt

SEQ ID NO: 222897 - DNA, 25 bp, Rattus norvegicus
cacagaaattagtgacccatgagtt

SEQ ID NO: 222898 - DNA, 25 bp, Rattus norvegicus
cacagaaatttcctatgtgtactcc

SEQ ID NO: 222899 - DNA, 25 bp, Rattus norvegicus
cacagaaatttcgtatgtgtactcc

SEQ ID NO: 222900 - DNA, 25 bp, Rattus norvegicus
cacagaacccagattggtccgtttc

SEQ ID NO: 222901 - DNA, 25 bp, Rattus norvegicus
cacagaacccagtttggtccgtttc

SEQ ID NO: 222902 - DNA, 25 bp, Rattus norvegicus
cacagaactctgatgctatgagcat

SEQ ID NO: 222903 - DNA, 25 bp, Rattus norvegicus
cacagaactctgttgctatgagcat

SEQ ID NO: 222904 - DNA, 25 bp, Rattus norvegicus
cacagaactgctatgcgtctacaaa

SEQ ID NO: 222905 - DNA, 25 bp, Rattus norvegicus
cacagaactgctttgcgtctacaaa

SEQ ID NO: 222906 - DNA, 25 bp, Rattus norvegicus
cacagaagacaccttggtgcttggg

SEQ ID NO: 222907 - DNA, 25 bp, Rattus norvegicus
cacagaagacacgttggtgcttggg

SEQ ID NO: 222908 - DNA, 25 bp, Rattus norvegicus
cacagaagagcaccgctacctgact

SEQ ID NO: 222909 - DNA, 25 bp, Rattus norvegicus
cacagaagagcagcgctacctgact

SEQ ID NO: 222910 - DNA, 25 bp, Rattus norvegicus
cacagaagcttgcttagtctgcttt

SEQ ID NO: 222911 - DNA, 25 bp, Rattus norvegicus
cacagaagcttggttagtctgcttt

SEQ ID NO: 222912 - DNA, 25 bp, Rattus norvegicus
cacagaaggttgctgcctggactgc

SEQ ID NO: 222913 - DNA, 25 bp, Rattus norvegicus
cacagaaggttggtgcctggactgc

SEQ ID NO: 222914 - DNA, 25 bp, Rattus norvegicus
cacagaagtcctatttgttttttct

SEQ ID NO: 222915 - DNA, 25 bp, Rattus norvegicus
cacagaagtcctttttgttttttct

SEQ ID NO: 222916 - DNA, 25 bp, Rattus norvegicus
cacagaagtggtacttgcagctgaa

SEQ ID NO: 222917 - DNA, 25 bp, Rattus norvegicus
cacagaagtggttcttgcagctgaa

SEQ ID NO: 222918 - DNA, 25 bp, Rattus norvegicus
cacagaatcttcaaatccccaggga

SEQ ID NO: 222919 - DNA, 25 bp, Rattus norvegicus
cacagaatcttctaatccccaggga

SEQ ID NO: 222920 - DNA, 25 bp, Rattus norvegicus
cacagaattctacgttatccccggg

SEQ ID NO: 222921 - DNA, 25 bp, Rattus norvegicus
cacagaattctaggttatccccggg

SEQ ID NO: 222922 - DNA, 25 bp, Rattus norvegicus
cacagacatctgctggttctacaga

SEQ ID NO: 222923 - DNA, 25 bp, Rattus norvegicus
cacagacatctggtggttctacaga

SEQ ID NO: 222924 - DNA, 25 bp, Rattus norvegicus
cacagaccctatatcaagaatgttt

SEQ ID NO: 222925 - DNA, 25 bp, Rattus norvegicus
cacagaccctatttcaagaatgttt

SEQ ID NO: 222926 - DNA, 25 bp, Rattus norvegicus
cacagacgaaaacccctgaccggaa

SEQ ID NO: 222927 - DNA, 25 bp, Rattus norvegicus
cacagacgaaaagccctgaccggaa

SEQ ID NO: 222928 - DNA, 25 bp, Rattus norvegicus
cacagacggtcacggcgaggctcca

SEQ ID NO: 222929 - DNA, 25 bp, Rattus norvegicus
cacagacggtcagggcgaggctcca

SEQ ID NO: 222930 - DNA, 25 bp, Rattus norvegicus
cacagacgtgtgaggaatgtggcaa

SEQ ID NO: 222931 - DNA, 25 bp, Rattus norvegicus
cacagacgtgtgtggaatgtggcaa

SEQ ID NO: 222932 - DNA, 25 bp, Rattus norvegicus
cacagactaggcaagtgctcactta

SEQ ID NO: 222933 - DNA, 25 bp, Rattus norvegicus
cacagactaggctagtgctcactta

SEQ ID NO: 222934 - DNA, 25 bp, Rattus norvegicus
cacagacttttaaaaccccttgacg

SEQ ID NO: 222935 - DNA, 25 bp, Rattus norvegicus
cacagacttttataaccccttgacg

SEQ ID NO: 222936 - DNA, 25 bp, Rattus norvegicus
cacagagaaccccaaggataataac

SEQ ID NO: 222937 - DNA, 25 bp, Rattus norvegicus
cacagagaacccgaaggataataac

SEQ ID NO: 222938 - DNA, 25 bp, Rattus norvegicus
cacagagacctgatgttttctacat

SEQ ID NO: 222939 - DNA, 25 bp, Rattus norvegicus
cacagagacctgttgttttctacat

SEQ ID NO: 222940 - DNA, 25 bp, Rattus norvegicus
cacagagacggtcccacaggactta

SEQ ID NO: 222941 - DNA, 25 bp, Rattus norvegicus
cacagagacggtgccacaggactta

SEQ ID NO: 222942 - DNA, 25 bp, Rattus norvegicus
cacagagaggtgattgtcccaatgt

SEQ ID NO: 222943 - DNA, 25 bp, Rattus norvegicus
cacagagaggtgtttgtcccaatgt

SEQ ID NO: 222944 - DNA, 25 bp, Rattus norvegicus
cacagagatataatgtgagctgcct

SEQ ID NO: 222945 - DNA, 25 bp, Rattus norvegicus
cacagagatatattgtgagctgcct

SEQ ID NO: 222946 - DNA, 25 bp, Rattus norvegicus
cacagagcaggtccctgatgcacca

SEQ ID NO: 222947 - DNA, 25 bp, Rattus norvegicus
cacagagcaggtgcctgatgcacca

SEQ ID NO: 222948 - DNA, 25 bp, Rattus norvegicus
cacagagcattcctctttcttggag

SEQ ID NO: 222949 - DNA, 25 bp, Rattus norvegicus
cacagagcattcgtctttcttggag

SEQ ID NO: 222950 - DNA, 25 bp, Rattus norvegicus
cacagagccagaacccaggtctgaa

SEQ ID NO: 222951 - DNA, 25 bp, Rattus norvegicus
cacagagccagatcccaggtctgaa

SEQ ID NO: 222952 - DNA, 25 bp, Rattus norvegicus
cacagagccagtccgaggcatggtt

SEQ ID NO: 222953 - DNA, 25 bp, Rattus norvegicus
cacagagccagtgcgaggcatggtt

SEQ ID NO: 222954 - DNA, 25 bp, Rattus norvegicus
cacagagcgcatcccatctggagga

SEQ ID NO: 222955 - DNA, 25 bp, Rattus norvegicus
cacagagcgcatgccatctggagga

SEQ ID NO: 222956 - DNA, 25 bp, Rattus norvegicus
cacagagctgcccaggccgaaaaga

SEQ ID NO: 222957 - DNA, 25 bp, Rattus norvegicus
cacagagctgccgaggccgaaaaga

SEQ ID NO: 222958 - DNA, 25 bp, Rattus norvegicus
cacagaggaacacagaagcttgctt

SEQ ID NO: 222959 - DNA, 25 bp, Rattus norvegicus
cacagaggaacagagaagcttgctt

SEQ ID NO: 222960 - DNA, 25 bp, Rattus norvegicus
cacagaggccagaaacgggtcgtaa

SEQ ID NO: 222961 - DNA, 25 bp, Rattus norvegicus
cacagaggccagtaacgggtcgtaa

SEQ ID NO: 222962 - DNA, 25 bp, Rattus norvegicus
cacagaggcggcagtacaggctcag

SEQ ID NO: 222963 - DNA, 25 bp, Rattus norvegicus
cacagaggcggctgtacaggctcag

SEQ ID NO: 222964 - DNA, 25 bp, Rattus norvegicus
cacagaggcttacagggcctggcca

SEQ ID NO: 222965 - DNA, 25 bp, Rattus norvegicus
cacagaggcttagagggcctggcca

SEQ ID NO: 222966 - DNA, 25 bp, Rattus norvegicus
cacagaggcttgcttttgagggttt

SEQ ID NO: 222967 - DNA, 25 bp, Rattus norvegicus
cacagaggcttggttttgagggttt

SEQ ID NO: 222968 - DNA, 25 bp, Rattus norvegicus
cacagagggagcagtggcttgttct

SEQ ID NO: 222969 - DNA, 25 bp, Rattus norvegicus
cacagagggagctgtggcttgttct

SEQ ID NO: 222970 - DNA, 25 bp, Rattus norvegicus
cacagaggtattagccattggccac

SEQ ID NO: 222971 - DNA, 25 bp, Rattus norvegicus
cacagaggtatttgccattggccac

SEQ ID NO: 222972 - DNA, 25 bp, Rattus norvegicus
cacagagtaccaagagcccgtgtat

SEQ ID NO: 222973 - DNA, 25 bp, Rattus norvegicus
cacagagtaccatgagcccgtgtat

SEQ ID NO: 222974 - DNA, 25 bp, Rattus norvegicus
cacagagtactgatactctccaggg

SEQ ID NO: 222975 - DNA, 25 bp, Rattus norvegicus
cacagagtactgcacttgccttgat

SEQ ID NO: 222976 - DNA, 25 bp, Rattus norvegicus
cacagagtactggacttgccttgat

SEQ ID NO: 222977 - DNA, 25 bp, Rattus norvegicus
cacagagtactgttactctccaggg

SEQ ID NO: 222978 - DNA, 25 bp, Rattus norvegicus
cacagagtgcatagtccatgagctt

SEQ ID NO: 222979 - DNA, 25 bp, Rattus norvegicus
cacagagtgcatatgagtaaaccca

SEQ ID NO: 222980 - DNA, 25 bp, Rattus norvegicus
cacagagtgcattgtccatgagctt

SEQ ID NO: 222981 - DNA, 25 bp, Rattus norvegicus
cacagagtgcatttgagtaaaccca

SEQ ID NO: 222982 - DNA, 25 bp, Rattus norvegicus
cacagagttcaaagtctgacacatt

SEQ ID NO: 222983 - DNA, 25 bp, Rattus norvegicus
cacagagttcaatgtctgacacatt

SEQ ID NO: 222984 - DNA, 25 bp, Rattus norvegicus
cacagagttctgacaagtgggaaat

SEQ ID NO: 222985 - DNA, 25 bp, Rattus norvegicus
cacagagttctgtcaagtgggaaat

SEQ ID NO: 222986 - DNA, 25 bp, Rattus norvegicus
cacagatatgccagttaggcccttt

SEQ ID NO: 222987 - DNA, 25 bp, Rattus norvegicus
cacagatatgcctgttaggcccttt

SEQ ID NO: 222988 - DNA, 25 bp, Rattus norvegicus
cacagatcactcaaaacaagtggga

SEQ ID NO: 222989 - DNA, 25 bp, Rattus norvegicus
cacagatcactctaaacaagtggga

SEQ ID NO: 222990 - DNA, 25 bp, Rattus norvegicus
cacagatccatgacacctcagaaat

SEQ ID NO: 222991 - DNA, 25 bp, Rattus norvegicus
cacagatccatgtcacctcagaaat

SEQ ID NO: 222992 - DNA, 25 bp, Rattus norvegicus
cacagatcccataggcctgcctttg

SEQ ID NO: 222993 - DNA, 25 bp, Rattus norvegicus
cacagatcccattggcctgcctttg

SEQ ID NO: 222994 - DNA, 25 bp, Rattus norvegicus
cacagatcccctagggttgacagga

SEQ ID NO: 222995 - DNA, 25 bp, Rattus norvegicus
cacagatccccttgggttgacagga

SEQ ID NO: 222996 - DNA, 25 bp, Rattus norvegicus
cacagatccctgatatttgtcagtt

SEQ ID NO: 222997 - DNA, 25 bp, Rattus norvegicus
cacagatccctgttatttgtcagtt

SEQ ID NO: 222998 - DNA, 25 bp, Rattus norvegicus
cacagatctgccctacatggttctt

SEQ ID NO: 222999 - DNA, 25 bp, Rattus norvegicus
cacagatctgccgtacatggttctt

SEQ ID NO: 223000 - DNA, 25 bp, Rattus norvegicus
cacagatgagggacacttgcaaagt

SEQ ID NO: 223001 - DNA, 25 bp, Rattus norvegicus
cacagatgagggtcacttgcaaagt

SEQ ID NO: 223002 - DNA, 25 bp, Rattus norvegicus
cacagatgatgtcctagattctaag

SEQ ID NO: 223003 - DNA, 25 bp, Rattus norvegicus
cacagatgatgtgctagattctaag

SEQ ID NO: 223004 - DNA, 25 bp, Rattus norvegicus
cacagatggatcagccctcaggatc

SEQ ID NO: 223005 - DNA, 25 bp, Rattus norvegicus
cacagatggatctgccctcaggatc

SEQ ID NO: 223006 - DNA, 25 bp, Rattus norvegicus
cacagatggcaaatgtagtattact

SEQ ID NO: 223007 - DNA, 25 bp, Rattus norvegicus
cacagatggcaattgtagtattact

SEQ ID NO: 223008 - DNA, 25 bp, Rattus norvegicus
cacagatggcttaaggtgacctagc

SEQ ID NO: 223009 - DNA, 25 bp, Rattus norvegicus
cacagatggctttaggtgacctagc

SEQ ID NO: 223010 - DNA, 25 bp, Rattus norvegicus
cacagatgtgcacgctcaggcagtt

SEQ ID NO: 223011 - DNA, 25 bp, Rattus norvegicus
cacagatgtgcaggctcaggcagtt

SEQ ID NO: 223012 - DNA, 25 bp, Rattus norvegicus
cacagatgtgtgaccttggcattga

SEQ ID NO: 223013 - DNA, 25 bp, Rattus norvegicus
cacagatgtgtgtccttggcattga

SEQ ID NO: 223014 - DNA, 25 bp, Rattus norvegicus
cacagattaaagacttccccggtca

SEQ ID NO: 223015 - DNA, 25 bp, Rattus norvegicus
cacagattaaagtcttccccggtca

SEQ ID NO: 223016 - DNA, 25 bp, Rattus norvegicus
cacagattctgcacttattgcccaa

SEQ ID NO: 223017 - DNA, 25 bp, Rattus norvegicus
cacagattctgctcttattgcccaa

SEQ ID NO: 223018 - DNA, 25 bp, Rattus norvegicus
cacagattgtgtaacctccaggtcc

SEQ ID NO: 223019 - DNA, 25 bp, Rattus norvegicus
cacagattgtgttacctccaggtcc

SEQ ID NO: 223020 - DNA, 25 bp, Rattus norvegicus
cacagcaaatgcactgcaggtgaga

SEQ ID NO: 223021 - DNA, 25 bp, Rattus norvegicus
cacagcaaatgctctgcaggtgaga

SEQ ID NO: 223022 - DNA, 25 bp, Rattus norvegicus
cacagcaacttgaatcctacccggg

SEQ ID NO: 223023 - DNA, 25 bp, Rattus norvegicus
cacagcaacttgtatcctacccggg

SEQ ID NO: 223024 - DNA, 25 bp, Rattus norvegicus
cacagcaagatgcaggcaatcagtt

SEQ ID NO: 223025 - DNA, 25 bp, Rattus norvegicus
cacagcaagatggaggcaatcagtt

SEQ ID NO: 223026 - DNA, 25 bp, Rattus norvegicus
cacagcaatgcgatttaagtcctag

SEQ ID NO: 223027 - DNA, 25 bp, Rattus norvegicus
cacagcaatgcgttttaagtcctag

SEQ ID NO: 223028 - DNA, 25 bp, Rattus norvegicus
cacagcaatgttaatgtttggttgt

SEQ ID NO: 223029 - DNA, 25 bp, Rattus norvegicus
cacagcaatgtttatgtttggttgt

SEQ ID NO: 223030 - DNA, 25 bp, Rattus norvegicus
cacagcacactcacttttatatttg

SEQ ID NO: 223031 - DNA, 25 bp, Rattus norvegicus
cacagcacactctcttttatatttg

SEQ ID NO: 223032 - DNA, 25 bp, Rattus norvegicus
cacagcacggttcatggactcgact

SEQ ID NO: 223033 - DNA, 25 bp, Rattus norvegicus
cacagcacggttgatggactcgact

SEQ ID NO: 223034 - DNA, 25 bp, Rattus norvegicus
cacagcacttgcatggatagtaaaa

SEQ ID NO: 223035 - DNA, 25 bp, Rattus norvegicus
cacagcacttgcttggatagtaaaa

SEQ ID NO: 223036 - DNA, 25 bp, Rattus norvegicus
cacagcacttgtatcgaacttccat

SEQ ID NO: 223037 - DNA, 25 bp, Rattus norvegicus
cacagcacttgtttcgaacttccat

SEQ ID NO: 223038 - DNA, 25 bp, Rattus norvegicus
cacagcagcagtcgacaagggctct

SEQ ID NO: 223039 - DNA, 25 bp, Rattus norvegicus
cacagcagcagtggacaagggctct

SEQ ID NO: 223040 - DNA, 25 bp, Rattus norvegicus
cacagcagcccgaggaggccatgga

SEQ ID NO: 223041 - DNA, 25 bp, Rattus norvegicus
cacagcagcccgtggaggccatgga

SEQ ID NO: 223042 - DNA, 25 bp, Rattus norvegicus
cacagcagctcacacgtgtgtataa

SEQ ID NO: 223043 - DNA, 25 bp, Rattus norvegicus
cacagcagctcagacgtgtgtataa

SEQ ID NO: 223044 - DNA, 25 bp, Rattus norvegicus
cacagcagggtcatacagtgtatcc

SEQ ID NO: 223045 - DNA, 25 bp, Rattus norvegicus
cacagcagggtcttacagtgtatcc

SEQ ID NO: 223046 - DNA, 25 bp, Rattus norvegicus
cacagcaggtgcaggttagggctaa

SEQ ID NO: 223047 - DNA, 25 bp, Rattus norvegicus
cacagcaggtgctggttagggctaa

SEQ ID NO: 223048 - DNA, 25 bp, Rattus norvegicus
cacagcatcagtaaccgtccaagaa

SEQ ID NO: 223049 - DNA, 25 bp, Rattus norvegicus
cacagcatcagttaccgtccaagaa

SEQ ID NO: 223050 - DNA, 25 bp, Rattus norvegicus
cacagcatccctaatggtttcagga

SEQ ID NO: 223051 - DNA, 25 bp, Rattus norvegicus
cacagcatcccttatggtttcagga

SEQ ID NO: 223052 - DNA, 25 bp, Rattus norvegicus
cacagcatcctgaattccaaacact

SEQ ID NO: 223053 - DNA, 25 bp, Rattus norvegicus
cacagcatcctgtattccaaacact

SEQ ID NO: 223054 - DNA, 25 bp, Rattus norvegicus
cacagcatgtgcagcctgggtgaca

SEQ ID NO: 223055 - DNA, 25 bp, Rattus norvegicus
cacagcatgtgctgcctgggtgaca

SEQ ID NO: 223056 - DNA, 25 bp, Rattus norvegicus
cacagcatgtggagtacaggtttgt

SEQ ID NO: 223057 - DNA, 25 bp, Rattus norvegicus
cacagcatgtggtgtacaggtttgt

SEQ ID NO: 223058 - DNA, 25 bp, Rattus norvegicus
cacagcatttgcatatttcttgaca

SEQ ID NO: 223059 - DNA, 25 bp, Rattus norvegicus
cacagcatttgcttatttcttgaca

SEQ ID NO: 223060 - DNA, 25 bp, Rattus norvegicus
cacagccaaactaggacactccgtt

SEQ ID NO: 223061 - DNA, 25 bp, Rattus norvegicus
cacagccaaacttggacactccgtt

SEQ ID NO: 223062 - DNA, 25 bp, Rattus norvegicus
cacagccaataccttgtgttctcag

SEQ ID NO: 223063 - DNA, 25 bp, Rattus norvegicus
cacagccaatacgttgtgttctcag

SEQ ID NO: 223064 - DNA, 25 bp, Rattus norvegicus
cacagccacattccgatgtcttagg

SEQ ID NO: 223065 - DNA, 25 bp, Rattus norvegicus
cacagccacattgcgatgtcttagg

SEQ ID NO: 223066 - DNA, 25 bp, Rattus norvegicus
cacagccaggagaggtagtgtactt

SEQ ID NO: 223067 - DNA, 25 bp, Rattus norvegicus
cacagccaggagtggtagtgtactt

SEQ ID NO: 223068 - DNA, 25 bp, Rattus norvegicus
cacagccagtacctgtctgcagagg

SEQ ID NO: 223069 - DNA, 25 bp, Rattus norvegicus
cacagccagtacgtgtctgcagagg

SEQ ID NO: 223070 - DNA, 25 bp, Rattus norvegicus
cacagccatccaagtattctctctg

SEQ ID NO: 223071 - DNA, 25 bp, Rattus norvegicus
cacagccatccatgtattctctctg

SEQ ID NO: 223072 - DNA, 25 bp, Rattus norvegicus
cacagcccactgactacaatattgt

SEQ ID NO: 223073 - DNA, 25 bp, Rattus norvegicus
cacagcccactgtctacaatattgt

SEQ ID NO: 223074 - DNA, 25 bp, Rattus norvegicus
cacagcccatgccaagtaactggta

SEQ ID NO: 223075 - DNA, 25 bp, Rattus norvegicus
cacagcccatgcgaagtaactggta

SEQ ID NO: 223076 - DNA, 25 bp, Rattus norvegicus
cacagccccagtctttgaagcgtat

SEQ ID NO: 223077 - DNA, 25 bp, Rattus norvegicus
cacagccccagtgtttgaagcgtat

SEQ ID NO: 223078 - DNA, 25 bp, Rattus norvegicus
cacagcccctgaagagaatgtacca

SEQ ID NO: 223079 - DNA, 25 bp, Rattus norvegicus
cacagcccctgatgagaatgtacca

SEQ ID NO: 223080 - DNA, 25 bp, Rattus norvegicus
cacagcccggcaacttaagatgaca

SEQ ID NO: 223081 - DNA, 25 bp, Rattus norvegicus
cacagcccggcatcttaagatgaca

SEQ ID NO: 223082 - DNA, 25 bp, Rattus norvegicus
cacagccctccacgataggcagatg

SEQ ID NO: 223083 - DNA, 25 bp, Rattus norvegicus
cacagccctccaggataggcagatg

SEQ ID NO: 223084 - DNA, 25 bp, Rattus norvegicus
cacagccgcagcagccaaagagagg

SEQ ID NO: 223085 - DNA, 25 bp, Rattus norvegicus
cacagccgcagctgccaaagagagg

SEQ ID NO: 223086 - DNA, 25 bp, Rattus norvegicus
cacagccgctacagaagttacctat

SEQ ID NO: 223087 - DNA, 25 bp, Rattus norvegicus
cacagccgctactgaagttacctat

SEQ ID NO: 223088 - DNA, 25 bp, Rattus norvegicus
cacagccgctctcgaggaagacgct

SEQ ID NO: 223089 - DNA, 25 bp, Rattus norvegicus
cacagccgctctggaggaagacgct

SEQ ID NO: 223090 - DNA, 25 bp, Rattus norvegicus
cacagccgtgttatacagtctgaca

SEQ ID NO: 223091 - DNA, 25 bp, Rattus norvegicus
cacagccgtgttttacagtctgaca

SEQ ID NO: 223092 - DNA, 25 bp, Rattus norvegicus
cacagcctcaaacccttagggaaag

SEQ ID NO: 223093 - DNA, 25 bp, Rattus norvegicus
cacagcctcaaagccttagggaaag

SEQ ID NO: 223094 - DNA, 25 bp, Rattus norvegicus
cacagcctccttcgagtcaaggcag

SEQ ID NO: 223095 - DNA, 25 bp, Rattus norvegicus
cacagcctccttggagtcaaggcag

SEQ ID NO: 223096 - DNA, 25 bp, Rattus norvegicus
cacagcctgggcattaatttcccaa

SEQ ID NO: 223097 - DNA, 25 bp, Rattus norvegicus
cacagcctgggctttaatttcccaa

SEQ ID NO: 223098 - DNA, 25 bp, Rattus norvegicus
cacagcctgtacaagtaactatttg

SEQ ID NO: 223099 - DNA, 25 bp, Rattus norvegicus
cacagcctgtactagtaactatttg

SEQ ID NO: 223100 - DNA, 25 bp, Rattus norvegicus
cacagcctgtgtcttgactacttgt

SEQ ID NO: 223101 - DNA, 25 bp, Rattus norvegicus
cacagcctgtgtgttgactacttgt

SEQ ID NO: 223102 - DNA, 25 bp, Rattus norvegicus
cacagcctttctcggcagctttggg

SEQ ID NO: 223103 - DNA, 25 bp, Rattus norvegicus
cacagcctttctgggcagctttggg

SEQ ID NO: 223104 - DNA, 25 bp, Rattus norvegicus
cacagcgcaggaatatggaggcatc

SEQ ID NO: 223105 - DNA, 25 bp, Rattus norvegicus
cacagcgcaggattatggaggcatc

SEQ ID NO: 223106 - DNA, 25 bp, Rattus norvegicus
cacagcggctctattgacaaactag

SEQ ID NO: 223107 - DNA, 25 bp, Rattus norvegicus
cacagcggctcttttgacaaactag

SEQ ID NO: 223108 - DNA, 25 bp, Rattus norvegicus
cacagcggtgctaaaacatacagat

SEQ ID NO: 223109 - DNA, 25 bp, Rattus norvegicus
cacagcggtgcttaaacatacagat

SEQ ID NO: 223110 - DNA, 25 bp, Rattus norvegicus
cacagcggttcaaggactccagatt

SEQ ID NO: 223111 - DNA, 25 bp, Rattus norvegicus
cacagcggttcatggactccagatt

SEQ ID NO: 223112 - DNA, 25 bp, Rattus norvegicus
cacagcgtccgtagcatgagttggg

SEQ ID NO: 223113 - DNA, 25 bp, Rattus norvegicus
cacagcgtccgttgcatgagttggg

SEQ ID NO: 223114 - DNA, 25 bp, Rattus norvegicus
cacagcgttaagagtctttccttta

SEQ ID NO: 223115 - DNA, 25 bp, Rattus norvegicus
cacagcgttaagtgtctttccttta

SEQ ID NO: 223116 - DNA, 25 bp, Rattus norvegicus
cacagcgttagcagttgaatctttt

SEQ ID NO: 223117 - DNA, 25 bp, Rattus norvegicus
cacagcgttagctgttgaatctttt

SEQ ID NO: 223118 - DNA, 25 bp, Rattus norvegicus
cacagcgtttttcgaaagcatagct

SEQ ID NO: 223119 - DNA, 25 bp, Rattus norvegicus
cacagcgtttttggaaagcatagct

SEQ ID NO: 223120 - DNA, 25 bp, Rattus norvegicus
cacagctcacatactgcataggtaa

SEQ ID NO: 223121 - DNA, 25 bp, Rattus norvegicus
cacagctcacattctgcataggtaa

SEQ ID NO: 223122 - DNA, 25 bp, Rattus norvegicus
cacagctcagacaaagatcctgggt

SEQ ID NO: 223123 - DNA, 25 bp, Rattus norvegicus
cacagctcagactaagatcctgggt

SEQ ID NO: 223124 - DNA, 25 bp, Rattus norvegicus
cacagctcagcgacattctggagat

SEQ ID NO: 223125 - DNA, 25 bp, Rattus norvegicus
cacagctcagcgtcattctggagat

SEQ ID NO: 223126 - DNA, 25 bp, Rattus norvegicus
cacagctccaggcttagcttggaga

SEQ ID NO: 223127 - DNA, 25 bp, Rattus norvegicus
cacagctccagggttagcttggaga

SEQ ID NO: 223128 - DNA, 25 bp, Rattus norvegicus
cacagctctgcacggtgaccttgag

SEQ ID NO: 223129 - DNA, 25 bp, Rattus norvegicus
cacagctctgcacggttatggcggc

SEQ ID NO: 223130 - DNA, 25 bp, Rattus norvegicus
cacagctctgcagggtgaccttgag

SEQ ID NO: 223131 - DNA, 25 bp, Rattus norvegicus
cacagctctgcagggttatggcggc

SEQ ID NO: 223132 - DNA, 25 bp, Rattus norvegicus
cacagctctgcccattcatgaaatg

SEQ ID NO: 223133 - DNA, 25 bp, Rattus norvegicus
cacagctctgccgattcatgaaatg

SEQ ID NO: 223134 - DNA, 25 bp, Rattus norvegicus
cacagctctgtgattatgtacaatt

SEQ ID NO: 223135 - DNA, 25 bp, Rattus norvegicus
cacagctctgtgtttatgtacaatt

SEQ ID NO: 223136 - DNA, 25 bp, Rattus norvegicus
cacagctgcactattgggacatata

SEQ ID NO: 223137 - DNA, 25 bp, Rattus norvegicus
cacagctgcacttttgggacatata

SEQ ID NO: 223138 - DNA, 25 bp, Rattus norvegicus
cacagctgcatcacgagtctctaag

SEQ ID NO: 223139 - DNA, 25 bp, Rattus norvegicus
cacagctgcatctcgagtctctaag

SEQ ID NO: 223140 - DNA, 25 bp, Rattus norvegicus
cacagctggtgtcccgagttggaac

SEQ ID NO: 223141 - DNA, 25 bp, Rattus norvegicus
cacagctggtgtgccgagttggaac

SEQ ID NO: 223142 - DNA, 25 bp, Rattus norvegicus
cacagctgtgagaatccatcttgca

SEQ ID NO: 223143 - DNA, 25 bp, Rattus norvegicus
cacagctgtgagtatccatcttgca

SEQ ID NO: 223144 - DNA, 25 bp, Rattus norvegicus
cacagcttcatacccattgtactag

SEQ ID NO: 223145 - DNA, 25 bp, Rattus norvegicus
cacagcttcatagccattgtactag

SEQ ID NO: 223146 - DNA, 25 bp, Rattus norvegicus
cacagcttcctgctctgggtgagca

SEQ ID NO: 223147 - DNA, 25 bp, Rattus norvegicus
cacagcttcctggtctgggtgagca

SEQ ID NO: 223148 - DNA, 25 bp, Rattus norvegicus
cacagcttccttctcaaaatctatt

SEQ ID NO: 223149 - DNA, 25 bp, Rattus norvegicus
cacagcttccttgtcaaaatctatt

SEQ ID NO: 223150 - DNA, 25 bp, Rattus norvegicus
cacagcttcttgactctgtatacta

SEQ ID NO: 223151 - DNA, 25 bp, Rattus norvegicus
cacagcttcttgtctctgtatacta

SEQ ID NO: 223152 - DNA, 25 bp, Rattus norvegicus
cacagcttgtgtctgcctcttgaga

SEQ ID NO: 223153 - DNA, 25 bp, Rattus norvegicus
cacagcttgtgtgtgcctcttgaga

SEQ ID NO: 223154 - DNA, 25 bp, Rattus norvegicus
cacagctttcccatcttaaagtaag

SEQ ID NO: 223155 - DNA, 25 bp, Rattus norvegicus
cacagctttcccttcttaaagtaag

SEQ ID NO: 223156 - DNA, 25 bp, Rattus norvegicus
cacagctttgctactttggttacaa

SEQ ID NO: 223157 - DNA, 25 bp, Rattus norvegicus
cacagctttgctaggtgaaggacac

SEQ ID NO: 223158 - DNA, 25 bp, Rattus norvegicus
cacagctttgcttctttggttacaa

SEQ ID NO: 223159 - DNA, 25 bp, Rattus norvegicus
cacagctttgcttggtgaaggacac

SEQ ID NO: 223160 - DNA, 25 bp, Rattus norvegicus
cacaggaaactcctcttcattatct

SEQ ID NO: 223161 - DNA, 25 bp, Rattus norvegicus
cacaggaaactcgtcttcattatct

SEQ ID NO: 223162 - DNA, 25 bp, Rattus norvegicus
cacaggaacacacagtcgggtgaat

SEQ ID NO: 223163 - DNA, 25 bp, Rattus norvegicus
cacaggaacacagagtcgggtgaat

SEQ ID NO: 223164 - DNA, 25 bp, Rattus norvegicus
cacaggaactttctttctccgtgta

SEQ ID NO: 223165 - DNA, 25 bp, Rattus norvegicus
cacaggaactttgtttctccgtgta

SEQ ID NO: 223166 - DNA, 25 bp, Rattus norvegicus
cacaggaatccacaggccggatggt

SEQ ID NO: 223167 - DNA, 25 bp, Rattus norvegicus
cacaggaatccagaggccggatggt

SEQ ID NO: 223168 - DNA, 25 bp, Rattus norvegicus
cacaggacagaccagcagtgtttgc

SEQ ID NO: 223169 - DNA, 25 bp, Rattus norvegicus
cacaggacagacgagcagtgtttgc

SEQ ID NO: 223170 - DNA, 25 bp, Rattus norvegicus
cacaggacagagatggattcagttc

SEQ ID NO: 223171 - DNA, 25 bp, Rattus norvegicus
cacaggacagagttggattcagttc

SEQ ID NO: 223172 - DNA, 25 bp, Rattus norvegicus
cacaggacggtgcttgggtacaatt

SEQ ID NO: 223173 - DNA, 25 bp, Rattus norvegicus
cacaggacggtggttgggtacaatt

SEQ ID NO: 223174 - DNA, 25 bp, Rattus norvegicus
cacaggactgataggctttggctct

SEQ ID NO: 223175 - DNA, 25 bp, Rattus norvegicus
cacaggactgattggctttggctct

SEQ ID NO: 223176 - DNA, 25 bp, Rattus norvegicus
cacaggactgtgctaagccatagtt

SEQ ID NO: 223177 - DNA, 25 bp, Rattus norvegicus
cacaggactgtggtaagccatagtt

SEQ ID NO: 223178 - DNA, 25 bp, Rattus norvegicus
cacaggacttcaatgctgcaattca

SEQ ID NO: 223179 - DNA, 25 bp, Rattus norvegicus
cacaggacttcattgctgcaattca

SEQ ID NO: 223180 - DNA, 25 bp, Rattus norvegicus
cacaggagacctcaccgtgttgggt

SEQ ID NO: 223181 - DNA, 25 bp, Rattus norvegicus
cacaggagacctgaccgtgttgggt

SEQ ID NO: 223182 - DNA, 25 bp, Rattus norvegicus
cacaggaggagcagccacagaggaa

SEQ ID NO: 223183 - DNA, 25 bp, Rattus norvegicus
cacaggaggagctgccacagaggaa

SEQ ID NO: 223184 - DNA, 25 bp, Rattus norvegicus
cacaggaggagtcgaacacaccaga

SEQ ID NO: 223185 - DNA, 25 bp, Rattus norvegicus
cacaggaggagtggaacacaccaga

SEQ ID NO: 223186 - DNA, 25 bp, Rattus norvegicus
cacaggaggcgtcgacactgcagca

SEQ ID NO: 223187 - DNA, 25 bp, Rattus norvegicus
cacaggaggcgtggacactgcagca

SEQ ID NO: 223188 - DNA, 25 bp, Rattus norvegicus
cacaggatatgacccaatacgttgc

SEQ ID NO: 223189 - DNA, 25 bp, Rattus norvegicus
cacaggatatgagccaatacgttgc

SEQ ID NO: 223190 - DNA, 25 bp, Rattus norvegicus
cacaggatggagcaataggacagca

SEQ ID NO: 223191 - DNA, 25 bp, Rattus norvegicus
cacaggatggaggaataggacagca

SEQ ID NO: 223192 - DNA, 25 bp, Rattus norvegicus
cacaggattcacaggttttcaattt

SEQ ID NO: 223193 - DNA, 25 bp, Rattus norvegicus
cacaggattcactggttttcaattt

SEQ ID NO: 223194 - DNA, 25 bp, Rattus norvegicus
cacaggcagctcaagacccgtgttg

SEQ ID NO: 223195 - DNA, 25 bp, Rattus norvegicus
cacaggcagctctagacccgtgttg

SEQ ID NO: 223196 - DNA, 25 bp, Rattus norvegicus
cacaggccatctacgcgcagagggt

SEQ ID NO: 223197 - DNA, 25 bp, Rattus norvegicus
cacaggccatcttcgcgcagagggt

SEQ ID NO: 223198 - DNA, 25 bp, Rattus norvegicus
cacaggcccataaccacattattaa

SEQ ID NO: 223199 - DNA, 25 bp, Rattus norvegicus
cacaggcccatatccacattattaa

SEQ ID NO: 223200 - DNA, 25 bp, Rattus norvegicus
cacaggccgtccaaagtgagatgct

SEQ ID NO: 223201 - DNA, 25 bp, Rattus norvegicus
cacaggccgtcctaagtgagatgct

SEQ ID NO: 223202 - DNA, 25 bp, Rattus norvegicus
cacaggccttcgatgagatgctcag

SEQ ID NO: 223203 - DNA, 25 bp, Rattus norvegicus
cacaggccttcgttgagatgctcag

SEQ ID NO: 223204 - DNA, 25 bp, Rattus norvegicus
cacaggcgtttacacatgcgtttat

SEQ ID NO: 223205 - DNA, 25 bp, Rattus norvegicus
cacaggcgtttagacatgcgtttat

SEQ ID NO: 223206 - DNA, 25 bp, Rattus norvegicus
cacaggctacctcagatgtttgaat

SEQ ID NO: 223207 - DNA, 25 bp, Rattus norvegicus
cacaggctacctgagatgtttgaat

SEQ ID NO: 223208 - DNA, 25 bp, Rattus norvegicus
cacaggctatgcattgagggtctca

SEQ ID NO: 223209 - DNA, 25 bp, Rattus norvegicus
cacaggctatgctttgagggtctca

SEQ ID NO: 223210 - DNA, 25 bp, Rattus norvegicus
cacaggctccaaacagacacagttg

SEQ ID NO: 223211 - DNA, 25 bp, Rattus norvegicus
cacaggctccaatcagacacagttg

SEQ ID NO: 223212 - DNA, 25 bp, Rattus norvegicus
cacaggctgcggaggagcccctgct

SEQ ID NO: 223213 - DNA, 25 bp, Rattus norvegicus
cacaggctgcggtggagcccctgct

SEQ ID NO: 223214 - DNA, 25 bp, Rattus norvegicus
cacaggctgctcaattgccagaaga

SEQ ID NO: 223215 - DNA, 25 bp, Rattus norvegicus
cacaggctgctctattgccagaaga

SEQ ID NO: 223216 - DNA, 25 bp, Rattus norvegicus
cacaggctggacaggtggaacagca

SEQ ID NO: 223217 - DNA, 25 bp, Rattus norvegicus
cacaggctggactggtggaacagca

SEQ ID NO: 223218 - DNA, 25 bp, Rattus norvegicus
cacaggctggatctcgttggcattg

SEQ ID NO: 223219 - DNA, 25 bp, Rattus norvegicus
cacaggctggatgtcgttggcattg

SEQ ID NO: 223220 - DNA, 25 bp, Rattus norvegicus
cacaggctggttcttcttggtaaat

SEQ ID NO: 223221 - DNA, 25 bp, Rattus norvegicus
cacaggctggttgttcttggtaaat

SEQ ID NO: 223222 - DNA, 25 bp, Rattus norvegicus
cacagggaatctcgttgaccgcact

SEQ ID NO: 223223 - DNA, 25 bp, Rattus norvegicus
cacagggaatctggttgaccgcact

SEQ ID NO: 223224 - DNA, 25 bp, Rattus norvegicus
cacagggagagtaggttcgaaacct

SEQ ID NO: 223225 - DNA, 25 bp, Rattus norvegicus
cacagggagagttggttcgaaacct

SEQ ID NO: 223226 - DNA, 25 bp, Rattus norvegicus
cacagggagcaaccagggtttgaat

SEQ ID NO: 223227 - DNA, 25 bp, Rattus norvegicus
cacagggagcaagcagggtttgaat

SEQ ID NO: 223228 - DNA, 25 bp, Rattus norvegicus
cacagggatgggaacttagaacaat

SEQ ID NO: 223229 - DNA, 25 bp, Rattus norvegicus
cacagggatgggtacttagaacaat

SEQ ID NO: 223230 - DNA, 25 bp, Rattus norvegicus
cacagggcaattatcttgaacacag

SEQ ID NO: 223231 - DNA, 25 bp, Rattus norvegicus
cacagggcaattttcttgaacacag

SEQ ID NO: 223232 - DNA, 25 bp, Rattus norvegicus
cacagggcactgcatgacattagcg

SEQ ID NO: 223233 - DNA, 25 bp, Rattus norvegicus
cacagggcactggatgacattagcg

SEQ ID NO: 223234 - DNA, 25 bp, Rattus norvegicus
cacagggcattgacacagcacttgt

SEQ ID NO: 223235 - DNA, 25 bp, Rattus norvegicus
cacagggcattgacataaactttga

SEQ ID NO: 223236 - DNA, 25 bp, Rattus norvegicus
cacagggcattgtcacagcacttgt

SEQ ID NO: 223237 - DNA, 25 bp, Rattus norvegicus
cacagggcattgtcataaactttga

SEQ ID NO: 223238 - DNA, 25 bp, Rattus norvegicus
cacagggcccgaacttgccttaaat

SEQ ID NO: 223239 - DNA, 25 bp, Rattus norvegicus
cacagggcccgatcttgccttaaat

SEQ ID NO: 223240 - DNA, 25 bp, Rattus norvegicus
cacagggccctgactacaaaggagt

SEQ ID NO: 223241 - DNA, 25 bp, Rattus norvegicus
cacagggccctgtctacaaaggagt

SEQ ID NO: 223242 - DNA, 25 bp, Rattus norvegicus
cacagggccgaaattacggccacct

SEQ ID NO: 223243 - DNA, 25 bp, Rattus norvegicus
cacagggccgaatttacggccacct

SEQ ID NO: 223244 - DNA, 25 bp, Rattus norvegicus
cacagggctcagctgattaattacc

SEQ ID NO: 223245 - DNA, 25 bp, Rattus norvegicus
cacagggctcaggtgattaattacc

SEQ ID NO: 223246 - DNA, 25 bp, Rattus norvegicus
cacagggctcccagggacaggaagt

SEQ ID NO: 223247 - DNA, 25 bp, Rattus norvegicus
cacagggctccctgggacaggaagt

SEQ ID NO: 223248 - DNA, 25 bp, Rattus norvegicus
cacagggctgtgacgtgcacattaa

SEQ ID NO: 223249 - DNA, 25 bp, Rattus norvegicus
cacagggctgtgagttagaacccaa

SEQ ID NO: 223250 - DNA, 25 bp, Rattus norvegicus
cacagggctgtgtcgtgcacattaa

SEQ ID NO: 223251 - DNA, 25 bp, Rattus norvegicus
cacagggctgtgtgttagaacccaa

SEQ ID NO: 223252 - DNA, 25 bp, Rattus norvegicus
cacagggcttcacggcactgtgttt

SEQ ID NO: 223253 - DNA, 25 bp, Rattus norvegicus
cacagggcttcagggcactgtgttt

SEQ ID NO: 223254 - DNA, 25 bp, Rattus norvegicus
cacagggcttttcttgacttcattc

SEQ ID NO: 223255 - DNA, 25 bp, Rattus norvegicus
cacagggcttttgttgacttcattc

SEQ ID NO: 223256 - DNA, 25 bp, Rattus norvegicus
cacagggtcagtcggagcctcttat

SEQ ID NO: 223257 - DNA, 25 bp, Rattus norvegicus
cacagggtcagtgggagcctcttat

SEQ ID NO: 223258 - DNA, 25 bp, Rattus norvegicus
cacagggtcctcacgaactgcagag

SEQ ID NO: 223259 - DNA, 25 bp, Rattus norvegicus
cacagggtcctctcgaactgcagag

SEQ ID NO: 223260 - DNA, 25 bp, Rattus norvegicus
cacagggtctctcgatcaaagctag

SEQ ID NO: 223261 - DNA, 25 bp, Rattus norvegicus
cacagggtctctggatcaaagctag

SEQ ID NO: 223262 - DNA, 25 bp, Rattus norvegicus
cacagggttactatcagagtcttat

SEQ ID NO: 223263 - DNA, 25 bp, Rattus norvegicus
cacagggttactttcagagtcttat

SEQ ID NO: 223264 - DNA, 25 bp, Rattus norvegicus
cacagggtttcaactttgagggcat

SEQ ID NO: 223265 - DNA, 25 bp, Rattus norvegicus
cacagggtttcatctttgagggcat

SEQ ID NO: 223266 - DNA, 25 bp, Rattus norvegicus
cacaggtaatacaacacgccggact

SEQ ID NO: 223267 - DNA, 25 bp, Rattus norvegicus
cacaggtaatactacacgccggact

SEQ ID NO: 223268 - DNA, 25 bp, Rattus norvegicus
cacaggtacaggatgaatgcgtcaa

SEQ ID NO: 223269 - DNA, 25 bp, Rattus norvegicus
cacaggtacaggttgaatgcgtcaa

SEQ ID NO: 223270 - DNA, 25 bp, Rattus norvegicus
cacaggtcaggtcgtcaatggaaca

SEQ ID NO: 223271 - DNA, 25 bp, Rattus norvegicus
cacaggtcaggtggtcaatggaaca

SEQ ID NO: 223272 - DNA, 25 bp, Rattus norvegicus
cacaggtctgtactttggcttttta

SEQ ID NO: 223273 - DNA, 25 bp, Rattus norvegicus
cacaggtctgtagtttggcttttta

SEQ ID NO: 223274 - DNA, 25 bp, Rattus norvegicus
cacaggtgacatcgccatcacgttt

SEQ ID NO: 223275 - DNA, 25 bp, Rattus norvegicus
cacaggtgacatggccatcacgttt

SEQ ID NO: 223276 - DNA, 25 bp, Rattus norvegicus
cacaggtgacttatctattgataga

SEQ ID NO: 223277 - DNA, 25 bp, Rattus norvegicus
cacaggtgacttttctattgataga

SEQ ID NO: 223278 - DNA, 25 bp, Rattus norvegicus
cacaggtgcatgagagttccttcgt

SEQ ID NO: 223279 - DNA, 25 bp, Rattus norvegicus
cacaggtgcatgtgagttccttcgt

SEQ ID NO: 223280 - DNA, 25 bp, Rattus norvegicus
cacaggtgttggataatgttgcctt

SEQ ID NO: 223281 - DNA, 25 bp, Rattus norvegicus
cacaggtgttggttaatgttgcctt

SEQ ID NO: 223282 - DNA, 25 bp, Rattus norvegicus
cacaggttacaaaatggtcagtagg

SEQ ID NO: 223283 - DNA, 25 bp, Rattus norvegicus
cacaggttacaatatggtcagtagg

SEQ ID NO: 223284 - DNA, 25 bp, Rattus norvegicus
cacaggtttaacactttgactctaa

SEQ ID NO: 223285 - DNA, 25 bp, Rattus norvegicus
cacaggtttaactctttgactctaa

SEQ ID NO: 223286 - DNA, 25 bp, Rattus norvegicus
cacaggtttgggatttctacactag

SEQ ID NO: 223287 - DNA, 25 bp, Rattus norvegicus
cacaggtttgggttttctacactag

SEQ ID NO: 223288 - DNA, 25 bp, Rattus norvegicus
cacagtaaagggagtcctggccacc

SEQ ID NO: 223289 - DNA, 25 bp, Rattus norvegicus
cacagtaaagggtgtcctggccacc

SEQ ID NO: 223290 - DNA, 25 bp, Rattus norvegicus
cacagtaacacacataccccaaaat

SEQ ID NO: 223291 - DNA, 25 bp, Rattus norvegicus
cacagtaacacagataccccaaaat

SEQ ID NO: 223292 - DNA, 25 bp, Rattus norvegicus
cacagtaactgcacttcttgctata

SEQ ID NO: 223293 - DNA, 25 bp, Rattus norvegicus
cacagtaactgctcttcttgctata

SEQ ID NO: 223294 - DNA, 25 bp, Rattus norvegicus
cacagtaatatcatgtcctctggat

SEQ ID NO: 223295 - DNA, 25 bp, Rattus norvegicus
cacagtaatatcttgtcctctggat

SEQ ID NO: 223296 - DNA, 25 bp, Rattus norvegicus
cacagtacgtggagttattaacttc

SEQ ID NO: 223297 - DNA, 25 bp, Rattus norvegicus
cacagtacgtggtgttattaacttc

SEQ ID NO: 223298 - DNA, 25 bp, Rattus norvegicus
cacagtagcaccaccagttttgtcc

SEQ ID NO: 223299 - DNA, 25 bp, Rattus norvegicus
cacagtagcacctccagttttgtcc

SEQ ID NO: 223300 - DNA, 25 bp, Rattus norvegicus
cacagtagtcttaggtcttcctgac

SEQ ID NO: 223301 - DNA, 25 bp, Rattus norvegicus
cacagtagtctttggtcttcctgac

SEQ ID NO: 223302 - DNA, 25 bp, Rattus norvegicus
cacagtatatgcagtccccgagtgt

SEQ ID NO: 223303 - DNA, 25 bp, Rattus norvegicus
cacagtatatgctgtccccgagtgt

SEQ ID NO: 223304 - DNA, 25 bp, Rattus norvegicus
cacagtatccatcccatccttaaga

SEQ ID NO: 223305 - DNA, 25 bp, Rattus norvegicus
cacagtatccatgccatccttaaga

SEQ ID NO: 223306 - DNA, 25 bp, Rattus norvegicus
cacagtatgggaacctcattgcaaa

SEQ ID NO: 223307 - DNA, 25 bp, Rattus norvegicus
cacagtatgggatcctcattgcaaa

SEQ ID NO: 223308 - DNA, 25 bp, Rattus norvegicus
cacagtatgtgcatccaggaggcca

SEQ ID NO: 223309 - DNA, 25 bp, Rattus norvegicus
cacagtatgtgcttccaggaggcca

SEQ ID NO: 223310 - DNA, 25 bp, Rattus norvegicus
cacagtatttgtcgcctgcgttgga

SEQ ID NO: 223311 - DNA, 25 bp, Rattus norvegicus
cacagtatttgtggcctgcgttgga

SEQ ID NO: 223312 - DNA, 25 bp, Rattus norvegicus
cacagtcaaggcagagaatgggaag

SEQ ID NO: 223313 - DNA, 25 bp, Rattus norvegicus
cacagtcaaggctgagaatgggaag

SEQ ID NO: 223314 - DNA, 25 bp, Rattus norvegicus
cacagtcaatatactttgttgtcta

SEQ ID NO: 223315 - DNA, 25 bp, Rattus norvegicus
cacagtcaatattctttgttgtcta

SEQ ID NO: 223316 - DNA, 25 bp, Rattus norvegicus
cacagtcacatgcacccagagaggg

SEQ ID NO: 223317 - DNA, 25 bp, Rattus norvegicus
cacagtcacatggacccagagaggg

SEQ ID NO: 223318 - DNA, 25 bp, Rattus norvegicus
cacagtcacttgacaggttggcact

SEQ ID NO: 223319 - DNA, 25 bp, Rattus norvegicus
cacagtcacttgtcaggttggcact

SEQ ID NO: 223320 - DNA, 25 bp, Rattus norvegicus
cacagtcagaataaactcctcaggg

SEQ ID NO: 223321 - DNA, 25 bp, Rattus norvegicus
cacagtcagaattaactcctcaggg

SEQ ID NO: 223322 - DNA, 25 bp, Rattus norvegicus
cacagtcagacgctttttagctatt

SEQ ID NO: 223323 - DNA, 25 bp, Rattus norvegicus
cacagtcagacggtttttagctatt

SEQ ID NO: 223324 - DNA, 25 bp, Rattus norvegicus
cacagtcattggagccgtgtattgt

SEQ ID NO: 223325 - DNA, 25 bp, Rattus norvegicus
cacagtcattggtgccgtgtattgt

SEQ ID NO: 223326 - DNA, 25 bp, Rattus norvegicus
cacagtccaactccatttcaggtaa

SEQ ID NO: 223327 - DNA, 25 bp, Rattus norvegicus
cacagtccaactgcatttcaggtaa

SEQ ID NO: 223328 - DNA, 25 bp, Rattus norvegicus
cacagtccacgtctctaataataga

SEQ ID NO: 223329 - DNA, 25 bp, Rattus norvegicus
cacagtccacgtgtctaataataga

SEQ ID NO: 223330 - DNA, 25 bp, Rattus norvegicus
cacagtccagagaccttgatgcaat

SEQ ID NO: 223331 - DNA, 25 bp, Rattus norvegicus
cacagtccagagtccttgatgcaat

SEQ ID NO: 223332 - DNA, 25 bp, Rattus norvegicus
cacagtccagcaactagaggtttgc

SEQ ID NO: 223333 - DNA, 25 bp, Rattus norvegicus
cacagtccagcacaattccttctag

SEQ ID NO: 223334 - DNA, 25 bp, Rattus norvegicus
cacagtccagcagaattccttctag

SEQ ID NO: 223335 - DNA, 25 bp, Rattus norvegicus
cacagtccagcatctagaggtttgc

SEQ ID NO: 223336 - DNA, 25 bp, Rattus norvegicus
cacagtcctccaagcaggcaaaata

SEQ ID NO: 223337 - DNA, 25 bp, Rattus norvegicus
cacagtcctccatgcaggcaaaata

SEQ ID NO: 223338 - DNA, 25 bp, Rattus norvegicus
cacagtcctcttatccatacaaaaa

SEQ ID NO: 223339 - DNA, 25 bp, Rattus norvegicus
cacagtcctcttttccatacaaaaa

SEQ ID NO: 223340 - DNA, 25 bp, Rattus norvegicus
cacagtcctgttacacagtgtggat

SEQ ID NO: 223341 - DNA, 25 bp, Rattus norvegicus
cacagtcctgtttcacagtgtggat

SEQ ID NO: 223342 - DNA, 25 bp, Rattus norvegicus
cacagtccttttatacttgtctttg

SEQ ID NO: 223343 - DNA, 25 bp, Rattus norvegicus
cacagtccttttctgtgatttgagg

SEQ ID NO: 223344 - DNA, 25 bp, Rattus norvegicus
cacagtccttttgtgtgatttgagg

SEQ ID NO: 223345 - DNA, 25 bp, Rattus norvegicus
cacagtccttttttacttgtctttg

SEQ ID NO: 223346 - DNA, 25 bp, Rattus norvegicus
cacagtcgggtgaattggagaacca

SEQ ID NO: 223347 - DNA, 25 bp, Rattus norvegicus
cacagtcgggtgtattggagaacca

SEQ ID NO: 223348 - DNA, 25 bp, Rattus norvegicus
cacagtcgtgggaataattttcagg

SEQ ID NO: 223349 - DNA, 25 bp, Rattus norvegicus
cacagtcgtgggtataattttcagg

SEQ ID NO: 223350 - DNA, 25 bp, Rattus norvegicus
cacagtcgttggcaacttcagcatt

SEQ ID NO: 223351 - DNA, 25 bp, Rattus norvegicus
cacagtcgttgggaacttcagcatt

SEQ ID NO: 223352 - DNA, 25 bp, Rattus norvegicus
cacagtctacggattaagccatgcc

SEQ ID NO: 223353 - DNA, 25 bp, Rattus norvegicus
cacagtctacggtttaagccatgcc

SEQ ID NO: 223354 - DNA, 25 bp, Rattus norvegicus
cacagtctatggctgggtgatgtct

SEQ ID NO: 223355 - DNA, 25 bp, Rattus norvegicus
cacagtctatgggtgggtgatgtct

SEQ ID NO: 223356 - DNA, 25 bp, Rattus norvegicus
cacagtctcccactgggtgatgctt

SEQ ID NO: 223357 - DNA, 25 bp, Rattus norvegicus
cacagtctcccagtgggtgatgctt

SEQ ID NO: 223358 - DNA, 25 bp, Rattus norvegicus
cacagtctgtttcaattctccagca

SEQ ID NO: 223359 - DNA, 25 bp, Rattus norvegicus
cacagtctgtttgaattctccagca

SEQ ID NO: 223360 - DNA, 25 bp, Rattus norvegicus
cacagtcttagcatcctgagtggga

SEQ ID NO: 223361 - DNA, 25 bp, Rattus norvegicus
cacagtcttagcttcctgagtggga

SEQ ID NO: 223362 - DNA, 25 bp, Rattus norvegicus
cacagtctttctcgtaaggccgttt

SEQ ID NO: 223363 - DNA, 25 bp, Rattus norvegicus
cacagtctttctggtaaggccgttt

SEQ ID NO: 223364 - DNA, 25 bp, Rattus norvegicus
cacagtgacagtccctgtgctgcag

SEQ ID NO: 223365 - DNA, 25 bp, Rattus norvegicus
cacagtgacagtgcctgtgctgcag

SEQ ID NO: 223366 - DNA, 25 bp, Rattus norvegicus
cacagtgacgtgcagctgagcccgt

SEQ ID NO: 223367 - DNA, 25 bp, Rattus norvegicus
cacagtgacgtggagctgagcccgt

SEQ ID NO: 223368 - DNA, 25 bp, Rattus norvegicus
cacagtgatgatctcgagatcggaa

SEQ ID NO: 223369 - DNA, 25 bp, Rattus norvegicus
cacagtgatgatgtcgagatcggaa

SEQ ID NO: 223370 - DNA, 25 bp, Rattus norvegicus
cacagtgcactgatgcagaggacat

SEQ ID NO: 223371 - DNA, 25 bp, Rattus norvegicus
cacagtgcactgttgcagaggacat

SEQ ID NO: 223372 - DNA, 25 bp, Rattus norvegicus
cacagtgcagcacgactggagtcct

SEQ ID NO: 223373 - DNA, 25 bp, Rattus norvegicus
cacagtgcagcaggactggagtcct

SEQ ID NO: 223374 - DNA, 25 bp, Rattus norvegicus
cacagtgcagggagcagatgtctct

SEQ ID NO: 223375 - DNA, 25 bp, Rattus norvegicus
cacagtgcagggtgcagatgtctct

SEQ ID NO: 223376 - DNA, 25 bp, Rattus norvegicus
cacagtgcgcgccagaagtatgtac

SEQ ID NO: 223377 - DNA, 25 bp, Rattus norvegicus
cacagtgcgcgcgagaagtatgtac

SEQ ID NO: 223378 - DNA, 25 bp, Rattus norvegicus
cacagtgcgcgtctgttaacacaga

SEQ ID NO: 223379 - DNA, 25 bp, Rattus norvegicus
cacagtgcgcgtgtgttaacacaga

SEQ ID NO: 223380 - DNA, 25 bp, Rattus norvegicus
cacagtgctgccataagtgaatgca

SEQ ID NO: 223381 - DNA, 25 bp, Rattus norvegicus
cacagtgctgccttaagtgaatgca

SEQ ID NO: 223382 - DNA, 25 bp, Rattus norvegicus
cacagtgctggacgcatgtttccca

SEQ ID NO: 223383 - DNA, 25 bp, Rattus norvegicus
cacagtgctggaggcatgtttccca

SEQ ID NO: 223384 - DNA, 25 bp, Rattus norvegicus
cacagtgctgggaaccggcatgaac

SEQ ID NO: 223385 - DNA, 25 bp, Rattus norvegicus
cacagtgctgggtaccggcatgaac

SEQ ID NO: 223386 - DNA, 25 bp, Rattus norvegicus
cacagtgctgtaattctcggtgcag

SEQ ID NO: 223387 - DNA, 25 bp, Rattus norvegicus
cacagtgctgtatttctcggtgcag

SEQ ID NO: 223388 - DNA, 25 bp, Rattus norvegicus
cacagtgctgtcaggtggcaccacc

SEQ ID NO: 223389 - DNA, 25 bp, Rattus norvegicus
cacagtgctgtctggtggcaccacc

SEQ ID NO: 223390 - DNA, 25 bp, Rattus norvegicus
cacagtggacttcctgttttgtgtc

SEQ ID NO: 223391 - DNA, 25 bp, Rattus norvegicus
cacagtggacttgctgttttgtgtc

SEQ ID NO: 223392 - DNA, 25 bp, Rattus norvegicus
cacagtggaggtcacatgccttctc

SEQ ID NO: 223393 - DNA, 25 bp, Rattus norvegicus
cacagtggaggtgacatgccttctc

SEQ ID NO: 223394 - DNA, 25 bp, Rattus norvegicus
cacagtggatctcgcgtcacgttat

SEQ ID NO: 223395 - DNA, 25 bp, Rattus norvegicus
cacagtggatctggcgtcacgttat

SEQ ID NO: 223396 - DNA, 25 bp, Rattus norvegicus
cacagtggcacactctgcaggtaga

SEQ ID NO: 223397 - DNA, 25 bp, Rattus norvegicus
cacagtggcacagtctgcaggtaga

SEQ ID NO: 223398 - DNA, 25 bp, Rattus norvegicus
cacagtggcatcatcagctatacca

SEQ ID NO: 223399 - DNA, 25 bp, Rattus norvegicus
cacagtggcatcttcagctatacca

SEQ ID NO: 223400 - DNA, 25 bp, Rattus norvegicus
cacagtgggtggaagacagtgtcaa

SEQ ID NO: 223401 - DNA, 25 bp, Rattus norvegicus
cacagtgggtggatggtctcttagc

SEQ ID NO: 223402 - DNA, 25 bp, Rattus norvegicus
cacagtgggtggtagacagtgtcaa

SEQ ID NO: 223403 - DNA, 25 bp, Rattus norvegicus
cacagtgggtggttggtctcttagc

SEQ ID NO: 223404 - DNA, 25 bp, Rattus norvegicus
cacagtgggttgagtcttcccaaat

SEQ ID NO: 223405 - DNA, 25 bp, Rattus norvegicus
cacagtgggttgtgtcttcccaaat

SEQ ID NO: 223406 - DNA, 25 bp, Rattus norvegicus
cacagtggtattaggcctcagcaga

SEQ ID NO: 223407 - DNA, 25 bp, Rattus norvegicus
cacagtggtatttggcctcagcaga

SEQ ID NO: 223408 - DNA, 25 bp, Rattus norvegicus
cacagtggtgagacatatggtatta

SEQ ID NO: 223409 - DNA, 25 bp, Rattus norvegicus
cacagtggtgagtcatatggtatta

SEQ ID NO: 223410 - DNA, 25 bp, Rattus norvegicus
cacagtgtaactcccctgcaaagtg

SEQ ID NO: 223411 - DNA, 25 bp, Rattus norvegicus
cacagtgtaactgccctgcaaagtg

SEQ ID NO: 223412 - DNA, 25 bp, Rattus norvegicus
cacagtgtagatctctttttcttta

SEQ ID NO: 223413 - DNA, 25 bp, Rattus norvegicus
cacagtgtagatgtctttttcttta

SEQ ID NO: 223414 - DNA, 25 bp, Rattus norvegicus
cacagtgtagtcagtgctccatcac

SEQ ID NO: 223415 - DNA, 25 bp, Rattus norvegicus
cacagtgtagtctgtgctccatcac

SEQ ID NO: 223416 - DNA, 25 bp, Rattus norvegicus
cacagtgtccagaaacccagtagtt

SEQ ID NO: 223417 - DNA, 25 bp, Rattus norvegicus
cacagtgtccagtaacccagtagtt

SEQ ID NO: 223418 - DNA, 25 bp, Rattus norvegicus
cacagtgtcgtaacatggcaaccat

SEQ ID NO: 223419 - DNA, 25 bp, Rattus norvegicus
cacagtgtcgtatcatggcaaccat

SEQ ID NO: 223420 - DNA, 25 bp, Rattus norvegicus
cacagtgtgaccacaggaagctgtg

SEQ ID NO: 223421 - DNA, 25 bp, Rattus norvegicus
cacagtgtgacctcaggaagctgtg

SEQ ID NO: 223422 - DNA, 25 bp, Rattus norvegicus
cacagtgtgcctaagggagttccta

SEQ ID NO: 223423 - DNA, 25 bp, Rattus norvegicus
cacagtgtgccttagggagttccta

SEQ ID NO: 223424 - DNA, 25 bp, Rattus norvegicus
cacagtgtggtgcacagctaccata

SEQ ID NO: 223425 - DNA, 25 bp, Rattus norvegicus
cacagtgtggtggacagctaccata

SEQ ID NO: 223426 - DNA, 25 bp, Rattus norvegicus
cacagtgtgtatctgttcactatat

SEQ ID NO: 223427 - DNA, 25 bp, Rattus norvegicus
cacagtgtgtatgtgttcactatat

SEQ ID NO: 223428 - DNA, 25 bp, Rattus norvegicus
cacagtgtgtgacgacaagccgttt

SEQ ID NO: 223429 - DNA, 25 bp, Rattus norvegicus
cacagtgtgtgaggacaagccgttt

SEQ ID NO: 223430 - DNA, 25 bp, Rattus norvegicus
cacagtgtgtgcattataagctagc

SEQ ID NO: 223431 - DNA, 25 bp, Rattus norvegicus
cacagtgtgtgctttataagctagc

SEQ ID NO: 223432 - DNA, 25 bp, Rattus norvegicus
cacagtgttctgagggccacactgc

SEQ ID NO: 223433 - DNA, 25 bp, Rattus norvegicus
cacagtgttctgtgggccacactgc

SEQ ID NO: 223434 - DNA, 25 bp, Rattus norvegicus
cacagtgttgaccaggaacctgcac

SEQ ID NO: 223435 - DNA, 25 bp, Rattus norvegicus
cacagtgttgacgaggaacctgcac

SEQ ID NO: 223436 - DNA, 25 bp, Rattus norvegicus
cacagtgtttgcctgttgctgagat

SEQ ID NO: 223437 - DNA, 25 bp, Rattus norvegicus
cacagtgtttgcgtgttgctgagat

SEQ ID NO: 223438 - DNA, 25 bp, Rattus norvegicus
cacagttaattaaggcttgcctaat

SEQ ID NO: 223439 - DNA, 25 bp, Rattus norvegicus
cacagttaattatggcttgcctaat

SEQ ID NO: 223440 - DNA, 25 bp, Rattus norvegicus
cacagttattgtaggcgtagtacgc

SEQ ID NO: 223441 - DNA, 25 bp, Rattus norvegicus
cacagttattgttggcgtagtacgc

SEQ ID NO: 223442 - DNA, 25 bp, Rattus norvegicus
cacagttcaaccactcagactttta

SEQ ID NO: 223443 - DNA, 25 bp, Rattus norvegicus
cacagttcaacctctcagactttta

SEQ ID NO: 223444 - DNA, 25 bp, Rattus norvegicus
cacagttcaagtcagcagtgctttc

SEQ ID NO: 223445 - DNA, 25 bp, Rattus norvegicus
cacagttcaagtgagcagtgctttc

SEQ ID NO: 223446 - DNA, 25 bp, Rattus norvegicus
cacagttcctatcctttctgtagag

SEQ ID NO: 223447 - DNA, 25 bp, Rattus norvegicus
cacagttcctatgctttctgtagag

SEQ ID NO: 223448 - DNA, 25 bp, Rattus norvegicus
cacagttctcctattggctaacgta

SEQ ID NO: 223449 - DNA, 25 bp, Rattus norvegicus
cacagttctccttttggctaacgta

SEQ ID NO: 223450 - DNA, 25 bp, Rattus norvegicus
cacagttcttcaattgtgatgaccc

SEQ ID NO: 223451 - DNA, 25 bp, Rattus norvegicus
cacagttcttcatttgtgatgaccc

SEQ ID NO: 223452 - DNA, 25 bp, Rattus norvegicus
cacagttgatgtagggagcggctaa

SEQ ID NO: 223453 - DNA, 25 bp, Rattus norvegicus
cacagttgatgttgggagcggctaa

SEQ ID NO: 223454 - DNA, 25 bp, Rattus norvegicus
cacagttggaacagtgctgctggaa

SEQ ID NO: 223455 - DNA, 25 bp, Rattus norvegicus
cacagttggaactgtgctgctggaa

SEQ ID NO: 223456 - DNA, 25 bp, Rattus norvegicus
cacagttgggtgcaatctttgcttt

SEQ ID NO: 223457 - DNA, 25 bp, Rattus norvegicus
cacagttgggtggaatctttgcttt

SEQ ID NO: 223458 - DNA, 25 bp, Rattus norvegicus
cacagttgtccgaccatattaggaa

SEQ ID NO: 223459 - DNA, 25 bp, Rattus norvegicus
cacagttgtccgtccatattaggaa

SEQ ID NO: 223460 - DNA, 25 bp, Rattus norvegicus
cacagttgtctacggctgcaggaga

SEQ ID NO: 223461 - DNA, 25 bp, Rattus norvegicus
cacagttgtctagggctgcaggaga

SEQ ID NO: 223462 - DNA, 25 bp, Rattus norvegicus
cacagttgtgttccttgcattctaa

SEQ ID NO: 223463 - DNA, 25 bp, Rattus norvegicus
cacagttgtgttgcttgcattctaa

SEQ ID NO: 223464 - DNA, 25 bp, Rattus norvegicus
cacagtttaggcattctcttggttc

SEQ ID NO: 223465 - DNA, 25 bp, Rattus norvegicus
cacagtttaggctttctcttggttc

SEQ ID NO: 223466 - DNA, 25 bp, Rattus norvegicus
cacagtttagtgaaaaagcccacaa

SEQ ID NO: 223467 - DNA, 25 bp, Rattus norvegicus
cacagtttagtgtaaaagcccacaa

SEQ ID NO: 223468 - DNA, 25 bp, Rattus norvegicus
cacagtttccgccagtaccttaaag

SEQ ID NO: 223469 - DNA, 25 bp, Rattus norvegicus
cacagtttccgcgagtaccttaaag

SEQ ID NO: 223470 - DNA, 25 bp, Rattus norvegicus
cacagtttctgtcgtactggcctta

SEQ ID NO: 223471 - DNA, 25 bp, Rattus norvegicus
cacagtttctgtggtactggcctta

SEQ ID NO: 223472 - DNA, 25 bp, Rattus norvegicus
cacagtttgttcagttacgttttca

SEQ ID NO: 223473 - DNA, 25 bp, Rattus norvegicus
cacagtttgttctgttacgttttca

SEQ ID NO: 223474 - DNA, 25 bp, Rattus norvegicus
cacagttttcaaaaagaagcaccag

SEQ ID NO: 223475 - DNA, 25 bp, Rattus norvegicus
cacagttttcaataagaagcaccag

SEQ ID NO: 223476 - DNA, 25 bp, Rattus norvegicus
cacagttttgctacacatatttctc

SEQ ID NO: 223477 - DNA, 25 bp, Rattus norvegicus
cacagttttgcttcacatatttctc

SEQ ID NO: 223478 - DNA, 25 bp, Rattus norvegicus
cacataaatctacctaaaggccatt

SEQ ID NO: 223479 - DNA, 25 bp, Rattus norvegicus
cacataaatctagctaaaggccatt

SEQ ID NO: 223480 - DNA, 25 bp, Rattus norvegicus
cacataagccatccagtctcagaga

SEQ ID NO: 223481 - DNA, 25 bp, Rattus norvegicus
cacataagccatgcagtctcagaga

SEQ ID NO: 223482 - DNA, 25 bp, Rattus norvegicus
cacataagccttactgtcctctggg

SEQ ID NO: 223483 - DNA, 25 bp, Rattus norvegicus
cacataagcctttctgtcctctggg

SEQ ID NO: 223484 - DNA, 25 bp, Rattus norvegicus
cacatacaccttatacccaagttct

SEQ ID NO: 223485 - DNA, 25 bp, Rattus norvegicus
cacatacaccttttacccaagttct

SEQ ID NO: 223486 - DNA, 25 bp, Rattus norvegicus
cacatacacgtgcaagctgaatatt

SEQ ID NO: 223487 - DNA, 25 bp, Rattus norvegicus
cacatacacgtggaagctgaatatt

SEQ ID NO: 223488 - DNA, 25 bp, Rattus norvegicus
cacatacactacacgggcagcttgg

SEQ ID NO: 223489 - DNA, 25 bp, Rattus norvegicus
cacatacactactcgggcagcttgg

SEQ ID NO: 223490 - DNA, 25 bp, Rattus norvegicus
cacatacagcacatgctcacacaga

SEQ ID NO: 223491 - DNA, 25 bp, Rattus norvegicus
cacatacagcacttgctcacacaga

SEQ ID NO: 223492 - DNA, 25 bp, Rattus norvegicus
cacatacataaactgttgccctctc

SEQ ID NO: 223493 - DNA, 25 bp, Rattus norvegicus
cacatacataaagtgttgccctctc

SEQ ID NO: 223494 - DNA, 25 bp, Rattus norvegicus
cacatacatacaaacccttttcagg

SEQ ID NO: 223495 - DNA, 25 bp, Rattus norvegicus
cacatacatacatacccttttcagg

SEQ ID NO: 223496 - DNA, 25 bp, Rattus norvegicus
cacatacatagtctttgggccctga

SEQ ID NO: 223497 - DNA, 25 bp, Rattus norvegicus
cacatacatagtgtttgggccctga

SEQ ID NO: 223498 - DNA, 25 bp, Rattus norvegicus
cacatacctatgaagtcatctggaa

SEQ ID NO: 223499 - DNA, 25 bp, Rattus norvegicus
cacatacctatgtagtcatctggaa

SEQ ID NO: 223500 - DNA, 25 bp, Rattus norvegicus
cacatacttcagattcatagcctgg

SEQ ID NO: 223501 - DNA, 25 bp, Rattus norvegicus
cacatacttcagtttcatagcctgg

SEQ ID NO: 223502 - DNA, 25 bp, Rattus norvegicus
cacatagaagttcccagctttcctc

SEQ ID NO: 223503 - DNA, 25 bp, Rattus norvegicus
cacatagaagttgccagctttcctc

SEQ ID NO: 223504 - DNA, 25 bp, Rattus norvegicus
cacataggaagacctctaggccgga

SEQ ID NO: 223505 - DNA, 25 bp, Rattus norvegicus
cacataggaagagctctaggccgga

SEQ ID NO: 223506 - DNA, 25 bp, Rattus norvegicus
cacataggtctaattggctttgaag

SEQ ID NO: 223507 - DNA, 25 bp, Rattus norvegicus
cacataggtctatttggctttgaag

SEQ ID NO: 223508 - DNA, 25 bp, Rattus norvegicus
cacataggtcttcaagtcaggtact

SEQ ID NO: 223509 - DNA, 25 bp, Rattus norvegicus
cacataggtcttgaagtcaggtact

SEQ ID NO: 223510 - DNA, 25 bp, Rattus norvegicus
cacatagtgactatgatacttgttt

SEQ ID NO: 223511 - DNA, 25 bp, Rattus norvegicus
cacatagtgactttgatacttgttt

SEQ ID NO: 223512 - DNA, 25 bp, Rattus norvegicus
cacatatcttacacctgttacctaa

SEQ ID NO: 223513 - DNA, 25 bp, Rattus norvegicus
cacatatcttactcctgttacctaa

SEQ ID NO: 223514 - DNA, 25 bp, Rattus norvegicus
cacatatggctgattcctgttgcat

SEQ ID NO: 223515 - DNA, 25 bp, Rattus norvegicus
cacatatggctgtttcctgttgcat

SEQ ID NO: 223516 - DNA, 25 bp, Rattus norvegicus
cacatattgttcatttatccttgga

SEQ ID NO: 223517 - DNA, 25 bp, Rattus norvegicus
cacatattgttcttttatccttgga

SEQ ID NO: 223518 - DNA, 25 bp, Rattus norvegicus
cacatcaatcaacagctgctggtca

SEQ ID NO: 223519 - DNA, 25 bp, Rattus norvegicus
cacatcaatcaagagctgctggtca

SEQ ID NO: 223520 - DNA, 25 bp, Rattus norvegicus
cacatcacagtaatgtccctcgatc

SEQ ID NO: 223521 - DNA, 25 bp, Rattus norvegicus
cacatcacagtattgtccctcgatc

SEQ ID NO: 223522 - DNA, 25 bp, Rattus norvegicus
cacatcactaagacccttgggactg

SEQ ID NO: 223523 - DNA, 25 bp, Rattus norvegicus
cacatcactaagtcccttgggactg

SEQ ID NO: 223524 - DNA, 25 bp, Rattus norvegicus
cacatcacttgtcggttcgaagcaa

SEQ ID NO: 223525 - DNA, 25 bp, Rattus norvegicus
cacatcacttgtgggttcgaagcaa

SEQ ID NO: 223526 - DNA, 25 bp, Rattus norvegicus
cacatcagacgaaggcatcagatct

SEQ ID NO: 223527 - DNA, 25 bp, Rattus norvegicus
cacatcagacgatggcatcagatct

SEQ ID NO: 223528 - DNA, 25 bp, Rattus norvegicus
cacatcagtcagatggcactttttt

SEQ ID NO: 223529 - DNA, 25 bp, Rattus norvegicus
cacatcagtcagttggcactttttt

SEQ ID NO: 223530 - DNA, 25 bp, Rattus norvegicus
cacatcatcctcaggccaataagaa

SEQ ID NO: 223531 - DNA, 25 bp, Rattus norvegicus
cacatcatcctctggccaataagaa

SEQ ID NO: 223532 - DNA, 25 bp, Rattus norvegicus
cacatcatctgtcgcttcatgacaa

SEQ ID NO: 223533 - DNA, 25 bp, Rattus norvegicus
cacatcatctgtggcttcatgacaa

SEQ ID NO: 223534 - DNA, 25 bp, Rattus norvegicus
cacatcattgttcgccagatcctgg

SEQ ID NO: 223535 - DNA, 25 bp, Rattus norvegicus
cacatcattgttggccagatcctgg

SEQ ID NO: 223536 - DNA, 25 bp, Rattus norvegicus
cacatccagttgattccacatcatg

SEQ ID NO: 223537 - DNA, 25 bp, Rattus norvegicus
cacatccagttgtttccacatcatg

SEQ ID NO: 223538 - DNA, 25 bp, Rattus norvegicus
cacatccatggccagtttgggagaa

SEQ ID NO: 223539 - DNA, 25 bp, Rattus norvegicus
cacatccatggcgagtttgggagaa

SEQ ID NO: 223540 - DNA, 25 bp, Rattus norvegicus
cacatccatttcatccatctaaaaa

SEQ ID NO: 223541 - DNA, 25 bp, Rattus norvegicus
cacatccatttcttccatctaaaaa

SEQ ID NO: 223542 - DNA, 25 bp, Rattus norvegicus
cacatcccagagcacacattgttgt

SEQ ID NO: 223543 - DNA, 25 bp, Rattus norvegicus
cacatcccagaggacacattgttgt

SEQ ID NO: 223544 - DNA, 25 bp, Rattus norvegicus
cacatccccatcattcatttgtata

SEQ ID NO: 223545 - DNA, 25 bp, Rattus norvegicus
cacatccccatctttcatttgtata

SEQ ID NO: 223546 - DNA, 25 bp, Rattus norvegicus
cacatccccattacttttactgagg

SEQ ID NO: 223547 - DNA, 25 bp, Rattus norvegicus
cacatccccatttcttttactgagg

SEQ ID NO: 223548 - DNA, 25 bp, Rattus norvegicus
cacatcctaaatcctggcactcagg

SEQ ID NO: 223549 - DNA, 25 bp, Rattus norvegicus
cacatcctaaatgctggcactcagg

SEQ ID NO: 223550 - DNA, 25 bp, Rattus norvegicus
cacatcctagctatgtctctaccat

SEQ ID NO: 223551 - DNA, 25 bp, Rattus norvegicus
cacatcctagctttgtctctaccat

SEQ ID NO: 223552 - DNA, 25 bp, Rattus norvegicus
cacatcctctcacttccataattat

SEQ ID NO: 223553 - DNA, 25 bp, Rattus norvegicus
cacatcctctcagttccataattat

SEQ ID NO: 223554 - DNA, 25 bp, Rattus norvegicus
cacatcctcttgatcttacattact

SEQ ID NO: 223555 - DNA, 25 bp, Rattus norvegicus
cacatcctcttgttcttacattact

SEQ ID NO: 223556 - DNA, 25 bp, Rattus norvegicus
cacatcctgtgacaagttacctagc

SEQ ID NO: 223557 - DNA, 25 bp, Rattus norvegicus
cacatcctgtgagaagttacctagc

SEQ ID NO: 223558 - DNA, 25 bp, Rattus norvegicus
cacatccttaaaacctctgagcttg

SEQ ID NO: 223559 - DNA, 25 bp, Rattus norvegicus
cacatccttaaatcctctgagcttg

SEQ ID NO: 223560 - DNA, 25 bp, Rattus norvegicus
cacatcctttgtaatttctgggtta

SEQ ID NO: 223561 - DNA, 25 bp, Rattus norvegicus
cacatcctttgttatttctgggtta

SEQ ID NO: 223562 - DNA, 25 bp, Rattus norvegicus
cacatcggccaacttcttgatctgg

SEQ ID NO: 223563 - DNA, 25 bp, Rattus norvegicus
cacatcggccaagttcttgatctgg

SEQ ID NO: 223564 - DNA, 25 bp, Rattus norvegicus
cacatctagcttcttctctttgtaa

SEQ ID NO: 223565 - DNA, 25 bp, Rattus norvegicus
cacatctagcttgttctctttgtaa

SEQ ID NO: 223566 - DNA, 25 bp, Rattus norvegicus
cacatctatgtacaacccctgaata

SEQ ID NO: 223567 - DNA, 25 bp, Rattus norvegicus
cacatctatgtagaacccctgaata

SEQ ID NO: 223568 - DNA, 25 bp, Rattus norvegicus
cacatctcaagtccttttctgtttt

SEQ ID NO: 223569 - DNA, 25 bp, Rattus norvegicus
cacatctcaagtgcttttctgtttt

SEQ ID NO: 223570 - DNA, 25 bp, Rattus norvegicus
cacatctcatttcgttctcgggtac

SEQ ID NO: 223571 - DNA, 25 bp, Rattus norvegicus
cacatctcatttggttctcgggtac

SEQ ID NO: 223572 - DNA, 25 bp, Rattus norvegicus
cacatctcccagatgcttttgtaat

SEQ ID NO: 223573 - DNA, 25 bp, Rattus norvegicus
cacatctcccagttgcttttgtaat

SEQ ID NO: 223574 - DNA, 25 bp, Rattus norvegicus
cacatctctctaccatgccataaaa

SEQ ID NO: 223575 - DNA, 25 bp, Rattus norvegicus
cacatctctctagcatgccataaaa

SEQ ID NO: 223576 - DNA, 25 bp, Rattus norvegicus
cacatctcttccctcaaaattcaga

SEQ ID NO: 223577 - DNA, 25 bp, Rattus norvegicus
cacatctcttccgtcaaaattcaga

SEQ ID NO: 223578 - DNA, 25 bp, Rattus norvegicus
cacatctgctcaattaaccttctaa

SEQ ID NO: 223579 - DNA, 25 bp, Rattus norvegicus
cacatctgctcatttaaccttctaa

SEQ ID NO: 223580 - DNA, 25 bp, Rattus norvegicus
cacatctggcctcggttctttaaga

SEQ ID NO: 223581 - DNA, 25 bp, Rattus norvegicus
cacatctggcctgggttctttaaga

SEQ ID NO: 223582 - DNA, 25 bp, Rattus norvegicus
cacatctgtcagctgtagtgaaatg

SEQ ID NO: 223583 - DNA, 25 bp, Rattus norvegicus
cacatctgtcaggtgtagtgaaatg

SEQ ID NO: 223584 - DNA, 25 bp, Rattus norvegicus
cacatctgttttcactggaataaaa

SEQ ID NO: 223585 - DNA, 25 bp, Rattus norvegicus
cacatctgttttgactggaataaaa

SEQ ID NO: 223586 - DNA, 25 bp, Rattus norvegicus
cacatcttccagatttaggtacaca

SEQ ID NO: 223587 - DNA, 25 bp, Rattus norvegicus
cacatcttccagttttaggtacaca

SEQ ID NO: 223588 - DNA, 25 bp, Rattus norvegicus
cacatcttctccacgagactgagat

SEQ ID NO: 223589 - DNA, 25 bp, Rattus norvegicus
cacatcttctcctcgagactgagat

SEQ ID NO: 223590 - DNA, 25 bp, Rattus norvegicus
cacatcttctctcggtggacttggg

SEQ ID NO: 223591 - DNA, 25 bp, Rattus norvegicus
cacatcttctctgggtggacttggg

SEQ ID NO: 223592 - DNA, 25 bp, Rattus norvegicus
cacatctttcctcaagtatcttcta

SEQ ID NO: 223593 - DNA, 25 bp, Rattus norvegicus
cacatctttcctgaagtatcttcta

SEQ ID NO: 223594 - DNA, 25 bp, Rattus norvegicus
cacatctttctacggtccaactaca

SEQ ID NO: 223595 - DNA, 25 bp, Rattus norvegicus
cacatctttctagggtccaactaca

SEQ ID NO: 223596 - DNA, 25 bp, Rattus norvegicus
cacatctttgtgagggtgctacctt

SEQ ID NO: 223597 - DNA, 25 bp, Rattus norvegicus
cacatctttgtgtgggtgctacctt

SEQ ID NO: 223598 - DNA, 25 bp, Rattus norvegicus
cacatgaacagaacctggtgctcaa

SEQ ID NO: 223599 - DNA, 25 bp, Rattus norvegicus
cacatgaacagatcctggtgctcaa

SEQ ID NO: 223600 - DNA, 25 bp, Rattus norvegicus
cacatgaacatgaggaccgctatgt

SEQ ID NO: 223601 - DNA, 25 bp, Rattus norvegicus
cacatgaacatgtggaccgctatgt

SEQ ID NO: 223602 - DNA, 25 bp, Rattus norvegicus
cacatgacagtcaccacgaggagag

SEQ ID NO: 223603 - DNA, 25 bp, Rattus norvegicus
cacatgacagtctccacgaggagag

SEQ ID NO: 223604 - DNA, 25 bp, Rattus norvegicus
cacatgaccctgctagaaccaatgg

SEQ ID NO: 223605 - DNA, 25 bp, Rattus norvegicus
cacatgaccctggtagaaccaatgg

SEQ ID NO: 223606 - DNA, 25 bp, Rattus norvegicus
cacatgagcggaccgagagcacctt

SEQ ID NO: 223607 - DNA, 25 bp, Rattus norvegicus
cacatgagcggagcgagagcacctt

SEQ ID NO: 223608 - DNA, 25 bp, Rattus norvegicus
cacatgatcggcagggtgccacaaa

SEQ ID NO: 223609 - DNA, 25 bp, Rattus norvegicus
cacatgatcggctgggtgccacaaa

SEQ ID NO: 223610 - DNA, 25 bp, Rattus norvegicus
cacatgatgttgatactcacgtgat

SEQ ID NO: 223611 - DNA, 25 bp, Rattus norvegicus
cacatgatgttgttactcacgtgat

SEQ ID NO: 223612 - DNA, 25 bp, Rattus norvegicus
cacatgattcatccaaatacagaca

SEQ ID NO: 223613 - DNA, 25 bp, Rattus norvegicus
cacatgattcatgcaaatacagaca

SEQ ID NO: 223614 - DNA, 25 bp, Rattus norvegicus
cacatgcatgtgagagtgtctacat

SEQ ID NO: 223615 - DNA, 25 bp, Rattus norvegicus
cacatgcatgtgtgagtgtctacat

SEQ ID NO: 223616 - DNA, 25 bp, Rattus norvegicus
cacatgccagtacccgtgttaagat

SEQ ID NO: 223617 - DNA, 25 bp, Rattus norvegicus
cacatgccagtagccgtgttaagat

SEQ ID NO: 223618 - DNA, 25 bp, Rattus norvegicus
cacatgccctctctgggtggatatg

SEQ ID NO: 223619 - DNA, 25 bp, Rattus norvegicus
cacatgccctctgtgggtggatatg

SEQ ID NO: 223620 - DNA, 25 bp, Rattus norvegicus
cacatgctagccctggacggagaga

SEQ ID NO: 223621 - DNA, 25 bp, Rattus norvegicus
cacatgctagccgtggacggagaga

SEQ ID NO: 223622 - DNA, 25 bp, Rattus norvegicus
cacatgctatttcctttacctggga

SEQ ID NO: 223623 - DNA, 25 bp, Rattus norvegicus
cacatgctatttgctttacctggga

SEQ ID NO: 223624 - DNA, 25 bp, Rattus norvegicus
cacatgctcagcatacaaacttgga

SEQ ID NO: 223625 - DNA, 25 bp, Rattus norvegicus
cacatgctcagcttacaaacttgga

SEQ ID NO: 223626 - DNA, 25 bp, Rattus norvegicus
cacatgctcttcctgaataccgaag

SEQ ID NO: 223627 - DNA, 25 bp, Rattus norvegicus
cacatgctcttcgtgaataccgaag

SEQ ID NO: 223628 - DNA, 25 bp, Rattus norvegicus
cacatgctgtctaggatctttgaaa

SEQ ID NO: 223629 - DNA, 25 bp, Rattus norvegicus
cacatgctgtcttggatctttgaaa

SEQ ID NO: 223630 - DNA, 25 bp, Rattus norvegicus
cacatgctttgcagttagacaggct

SEQ ID NO: 223631 - DNA, 25 bp, Rattus norvegicus
cacatgctttgctgttagacaggct

SEQ ID NO: 223632 - DNA, 25 bp, Rattus norvegicus
cacatggaaatgctgcccaatcttc

SEQ ID NO: 223633 - DNA, 25 bp, Rattus norvegicus
cacatggaaatggtgcccaatcttc

SEQ ID NO: 223634 - DNA, 25 bp, Rattus norvegicus
cacatggactcactgctcaaagcgt

SEQ ID NO: 223635 - DNA, 25 bp, Rattus norvegicus
cacatggactcagtgctcaaagcgt

SEQ ID NO: 223636 - DNA, 25 bp, Rattus norvegicus
cacatggactggagatgctacttga

SEQ ID NO: 223637 - DNA, 25 bp, Rattus norvegicus
cacatggactggtgatgctacttga

SEQ ID NO: 223638 - DNA, 25 bp, Rattus norvegicus
cacatggcaggacaggcagtcttct

SEQ ID NO: 223639 - DNA, 25 bp, Rattus norvegicus
cacatggcaggagaggcagtcttct

SEQ ID NO: 223640 - DNA, 25 bp, Rattus norvegicus
cacatggccattattgactttttca

SEQ ID NO: 223641 - DNA, 25 bp, Rattus norvegicus
cacatggccatttttgactttttca

SEQ ID NO: 223642 - DNA, 25 bp, Rattus norvegicus
cacatggcctctcagttgtttgtta

SEQ ID NO: 223643 - DNA, 25 bp, Rattus norvegicus
cacatggcctctgagttgtttgtta

SEQ ID NO: 223644 - DNA, 25 bp, Rattus norvegicus
cacatggctatgctggtacagacat

SEQ ID NO: 223645 - DNA, 25 bp, Rattus norvegicus
cacatggctatggtggtacagacat

SEQ ID NO: 223646 - DNA, 25 bp, Rattus norvegicus
cacatggctggcacaagggccctgg

SEQ ID NO: 223647 - DNA, 25 bp, Rattus norvegicus
cacatggctggctcaagggccctgg

SEQ ID NO: 223648 - DNA, 25 bp, Rattus norvegicus
cacatggcttgcattggtttggttt

SEQ ID NO: 223649 - DNA, 25 bp, Rattus norvegicus
cacatggcttgctttggtttggttt

SEQ ID NO: 223650 - DNA, 25 bp, Rattus norvegicus
cacatgggaagtcggctttttctgt

SEQ ID NO: 223651 - DNA, 25 bp, Rattus norvegicus
cacatgggaagtgggctttttctgt

SEQ ID NO: 223652 - DNA, 25 bp, Rattus norvegicus
cacatgggatctcttgacgtttctg

SEQ ID NO: 223653 - DNA, 25 bp, Rattus norvegicus
cacatgggatctgttgacgtttctg

SEQ ID NO: 223654 - DNA, 25 bp, Rattus norvegicus
cacatgggtaccatgtgcctgtgga

SEQ ID NO: 223655 - DNA, 25 bp, Rattus norvegicus
cacatgggtaccttgtgcctgtgga

SEQ ID NO: 223656 - DNA, 25 bp, Rattus norvegicus
cacatgggtcagaaagaagtaggat

SEQ ID NO: 223657 - DNA, 25 bp, Rattus norvegicus
cacatgggtcagtaagaagtaggat

SEQ ID NO: 223658 - DNA, 25 bp, Rattus norvegicus
cacatggtacccagatatgcacgca

SEQ ID NO: 223659 - DNA, 25 bp, Rattus norvegicus
cacatggtaccctgatatgcacgca

SEQ ID NO: 223660 - DNA, 25 bp, Rattus norvegicus
cacatggtggtcagtaatgggatcc

SEQ ID NO: 223661 - DNA, 25 bp, Rattus norvegicus
cacatggtggtctgtaatgggatcc

SEQ ID NO: 223662 - DNA, 25 bp, Rattus norvegicus
cacatggttaccatcccttcagaaa

SEQ ID NO: 223663 - DNA, 25 bp, Rattus norvegicus
cacatggttaccttcccttcagaaa

SEQ ID NO: 223664 - DNA, 25 bp, Rattus norvegicus
cacatggtttccagtgcttggcaat

SEQ ID NO: 223665 - DNA, 25 bp, Rattus norvegicus
cacatggtttcctgtgcttggcaat

SEQ ID NO: 223666 - DNA, 25 bp, Rattus norvegicus
cacatgtaaagtattgccagaaatt

SEQ ID NO: 223667 - DNA, 25 bp, Rattus norvegicus
cacatgtaaagttttgccagaaatt

SEQ ID NO: 223668 - DNA, 25 bp, Rattus norvegicus
cacatgtaataacgctgcggactat

SEQ ID NO: 223669 - DNA, 25 bp, Rattus norvegicus
cacatgtaataaggctgcggactat

SEQ ID NO: 223670 - DNA, 25 bp, Rattus norvegicus
cacatgtagataatgatgaggtttc

SEQ ID NO: 223671 - DNA, 25 bp, Rattus norvegicus
cacatgtagatattgatgaggtttc

SEQ ID NO: 223672 - DNA, 25 bp, Rattus norvegicus
cacatgtcatgacttcactgaagct

SEQ ID NO: 223673 - DNA, 25 bp, Rattus norvegicus
cacatgtcatgagttcactgaagct

SEQ ID NO: 223674 - DNA, 25 bp, Rattus norvegicus
cacatgtccatgacatcggcgagga

SEQ ID NO: 223675 - DNA, 25 bp, Rattus norvegicus
cacatgtccatgtcatcggcgagga

SEQ ID NO: 223676 - DNA, 25 bp, Rattus norvegicus
cacatgtctgttatcatacctggaa

SEQ ID NO: 223677 - DNA, 25 bp, Rattus norvegicus
cacatgtctgttttcatacctggaa

SEQ ID NO: 223678 - DNA, 25 bp, Rattus norvegicus
cacatgttaggacgccccttcttac

SEQ ID NO: 223679 - DNA, 25 bp, Rattus norvegicus
cacatgttaggaggccccttcttac

SEQ ID NO: 223680 - DNA, 25 bp, Rattus norvegicus
cacatgttccttaatgctgacttta

SEQ ID NO: 223681 - DNA, 25 bp, Rattus norvegicus
cacatgttcctttatgctgacttta

SEQ ID NO: 223682 - DNA, 25 bp, Rattus norvegicus
cacattaaatatccagattggatga

SEQ ID NO: 223683 - DNA, 25 bp, Rattus norvegicus
cacattaaatatgcagattggatga

SEQ ID NO: 223684 - DNA, 25 bp, Rattus norvegicus
cacattaagagacgcctagacctga

SEQ ID NO: 223685 - DNA, 25 bp, Rattus norvegicus
cacattaagagaggcctagacctga

SEQ ID NO: 223686 - DNA, 25 bp, Rattus norvegicus
cacattagagagaccctgctgcaaa

SEQ ID NO: 223687 - DNA, 25 bp, Rattus norvegicus
cacattagagagtccctgctgcaaa

SEQ ID NO: 223688 - DNA, 25 bp, Rattus norvegicus
cacattatgtccctttgtgcgataa

SEQ ID NO: 223689 - DNA, 25 bp, Rattus norvegicus
cacattatgtccgtttgtgcgataa

SEQ ID NO: 223690 - DNA, 25 bp, Rattus norvegicus
cacattcacatcaaagtgggcctaa

SEQ ID NO: 223691 - DNA, 25 bp, Rattus norvegicus
cacattcacatctaagtgggcctaa

SEQ ID NO: 223692 - DNA, 25 bp, Rattus norvegicus
cacattcagcttagggcatactaaa

SEQ ID NO: 223693 - DNA, 25 bp, Rattus norvegicus
cacattcagctttgggcatactaaa

SEQ ID NO: 223694 - DNA, 25 bp, Rattus norvegicus
cacattcagtttacagctcgtaata

SEQ ID NO: 223695 - DNA, 25 bp, Rattus norvegicus
cacattcagttttcagctcgtaata

SEQ ID NO: 223696 - DNA, 25 bp, Rattus norvegicus
cacattcatatgacaggcactgcct

SEQ ID NO: 223697 - DNA, 25 bp, Rattus norvegicus
cacattcatatgtcaggcactgcct

SEQ ID NO: 223698 - DNA, 25 bp, Rattus norvegicus
cacattcatcagctggtgagtttta

SEQ ID NO: 223699 - DNA, 25 bp, Rattus norvegicus
cacattcatcaggtggtgagtttta

SEQ ID NO: 223700 - DNA, 25 bp, Rattus norvegicus
cacattccagttacagttcctgact

SEQ ID NO: 223701 - DNA, 25 bp, Rattus norvegicus
cacattccagtttcagttcctgact

SEQ ID NO: 223702 - DNA, 25 bp, Rattus norvegicus
cacattcccaatactggcagacttg

SEQ ID NO: 223703 - DNA, 25 bp, Rattus norvegicus
cacattcccaattctggcagacttg

SEQ ID NO: 223704 - DNA, 25 bp, Rattus norvegicus
cacattccctctacagaagcttgaa

SEQ ID NO: 223705 - DNA, 25 bp, Rattus norvegicus
cacattccctcttcagaagcttgaa

SEQ ID NO: 223706 - DNA, 25 bp, Rattus norvegicus
cacattctcatgcaagtcatcacca

SEQ ID NO: 223707 - DNA, 25 bp, Rattus norvegicus
cacattctcatgcactatcagggtc

SEQ ID NO: 223708 - DNA, 25 bp, Rattus norvegicus
cacattctcatggaagtcatcacca

SEQ ID NO: 223709 - DNA, 25 bp, Rattus norvegicus
cacattctcatggactatcagggtc

SEQ ID NO: 223710 - DNA, 25 bp, Rattus norvegicus
cacattctgcgtcatgcttgttata

SEQ ID NO: 223711 - DNA, 25 bp, Rattus norvegicus
cacattctgcgtgatgcttgttata

SEQ ID NO: 223712 - DNA, 25 bp, Rattus norvegicus
cacattctgggtctttttgctgcat

SEQ ID NO: 223713 - DNA, 25 bp, Rattus norvegicus
cacattctgggtgtttttgctgcat

SEQ ID NO: 223714 - DNA, 25 bp, Rattus norvegicus
cacattcttgtgacctttctgggaa

SEQ ID NO: 223715 - DNA, 25 bp, Rattus norvegicus
cacattcttgtgtcctttctgggaa

SEQ ID NO: 223716 - DNA, 25 bp, Rattus norvegicus
cacattgatggacttggaagacgga

SEQ ID NO: 223717 - DNA, 25 bp, Rattus norvegicus
cacattgatggagttggaagacgga

SEQ ID NO: 223718 - DNA, 25 bp, Rattus norvegicus
cacattgcatgtcaaaaagattcaa

SEQ ID NO: 223719 - DNA, 25 bp, Rattus norvegicus
cacattgcatgtgaaaaagattcaa

SEQ ID NO: 223720 - DNA, 25 bp, Rattus norvegicus
cacattgcccttctaagctctgggt

SEQ ID NO: 223721 - DNA, 25 bp, Rattus norvegicus
cacattgcccttgtaagctctgggt

SEQ ID NO: 223722 - DNA, 25 bp, Rattus norvegicus
cacattggacatacctcatttcgat

SEQ ID NO: 223723 - DNA, 25 bp, Rattus norvegicus
cacattggacattcctcatttcgat

SEQ ID NO: 223724 - DNA, 25 bp, Rattus norvegicus
cacattggatggatattcttcacta

SEQ ID NO: 223725 - DNA, 25 bp, Rattus norvegicus
cacattggatggttattcttcacta

SEQ ID NO: 223726 - DNA, 25 bp, Rattus norvegicus
cacattggtataatggtccacacag

SEQ ID NO: 223727 - DNA, 25 bp, Rattus norvegicus
cacattggtatattggtccacacag

SEQ ID NO: 223728 - DNA, 25 bp, Rattus norvegicus
cacattggtgatcagatctgaggaa

SEQ ID NO: 223729 - DNA, 25 bp, Rattus norvegicus
cacattggtgatgagatctgaggaa

SEQ ID NO: 223730 - DNA, 25 bp, Rattus norvegicus
cacattggtgtcctgccgagtgtca

SEQ ID NO: 223731 - DNA, 25 bp, Rattus norvegicus
cacattggtgtcgtgccgagtgtca

SEQ ID NO: 223732 - DNA, 25 bp, Rattus norvegicus
cacattgtaaaaagcatgcattctc

SEQ ID NO: 223733 - DNA, 25 bp, Rattus norvegicus
cacattgtaaaatgcatgcattctc

SEQ ID NO: 223734 - DNA, 25 bp, Rattus norvegicus
cacattgtacctcacattttttgtt

SEQ ID NO: 223735 - DNA, 25 bp, Rattus norvegicus
cacattgtacctgacattttttgtt

SEQ ID NO: 223736 - DNA, 25 bp, Rattus norvegicus
cacattgtcagaactagttgtacta

SEQ ID NO: 223737 - DNA, 25 bp, Rattus norvegicus
cacattgtcagatctagttgtacta

SEQ ID NO: 223738 - DNA, 25 bp, Rattus norvegicus
cacattgtcttgactattccagcaa

SEQ ID NO: 223739 - DNA, 25 bp, Rattus norvegicus
cacattgtcttgtctattccagcaa

SEQ ID NO: 223740 - DNA, 25 bp, Rattus norvegicus
cacattgtctttcgtgactggagca

SEQ ID NO: 223741 - DNA, 25 bp, Rattus norvegicus
cacattgtctttggtgactggagca

SEQ ID NO: 223742 - DNA, 25 bp, Rattus norvegicus
cacattgtgcttactggaggttcta

SEQ ID NO: 223743 - DNA, 25 bp, Rattus norvegicus
cacattgtgctttctggaggttcta

SEQ ID NO: 223744 - DNA, 25 bp, Rattus norvegicus
cacattgtgtttatctttcggtttg

SEQ ID NO: 223745 - DNA, 25 bp, Rattus norvegicus
cacattgtgtttttctttcggtttg

SEQ ID NO: 223746 - DNA, 25 bp, Rattus norvegicus
cacattgtttgtcaactggagtgtc

SEQ ID NO: 223747 - DNA, 25 bp, Rattus norvegicus
cacattgtttgtgaactggagtgtc

SEQ ID NO: 223748 - DNA, 25 bp, Rattus norvegicus
cacatttacccaccaggtgtacctg

SEQ ID NO: 223749 - DNA, 25 bp, Rattus norvegicus
cacatttacccagcaggtgtacctg

SEQ ID NO: 223750 - DNA, 25 bp, Rattus norvegicus
cacatttacctaactgacggcttag

SEQ ID NO: 223751 - DNA, 25 bp, Rattus norvegicus
cacatttacctatctgacggcttag

SEQ ID NO: 223752 - DNA, 25 bp, Rattus norvegicus
cacatttacgaccagttaggcggta

SEQ ID NO: 223753 - DNA, 25 bp, Rattus norvegicus
cacatttacgacgagttaggcggta

SEQ ID NO: 223754 - DNA, 25 bp, Rattus norvegicus
cacatttagttaagggactggaaac

SEQ ID NO: 223755 - DNA, 25 bp, Rattus norvegicus
cacatttagttatgggactggaaac

SEQ ID NO: 223756 - DNA, 25 bp, Rattus norvegicus
cacatttatgccaattacctggatt

SEQ ID NO: 223757 - DNA, 25 bp, Rattus norvegicus
cacatttatgcctattacctggatt

SEQ ID NO: 223758 - DNA, 25 bp, Rattus norvegicus
cacatttatttgcttctgagttctt

SEQ ID NO: 223759 - DNA, 25 bp, Rattus norvegicus
cacatttatttggttctgagttctt

SEQ ID NO: 223760 - DNA, 25 bp, Rattus norvegicus
cacatttccaatagctcttatccag

SEQ ID NO: 223761 - DNA, 25 bp, Rattus norvegicus
cacatttccaattgctcttatccag

SEQ ID NO: 223762 - DNA, 25 bp, Rattus norvegicus
cacatttcctacatgcaagtcctga

SEQ ID NO: 223763 - DNA, 25 bp, Rattus norvegicus
cacatttcctacttgcaagtcctga

SEQ ID NO: 223764 - DNA, 25 bp, Rattus norvegicus
cacatttcctgaatacagagaatac

SEQ ID NO: 223765 - DNA, 25 bp, Rattus norvegicus
cacatttcctgattacagagaatac

SEQ ID NO: 223766 - DNA, 25 bp, Rattus norvegicus
cacatttcgagccagaggagccggt

SEQ ID NO: 223767 - DNA, 25 bp, Rattus norvegicus
cacatttcgagcgagaggagccggt

SEQ ID NO: 223768 - DNA, 25 bp, Rattus norvegicus
cacatttgcgccatcagtgactgaa

SEQ ID NO: 223769 - DNA, 25 bp, Rattus norvegicus
cacatttgcgccttcagtgactgaa

SEQ ID NO: 223770 - DNA, 25 bp, Rattus norvegicus
cacatttggatcatacaggcttgga

SEQ ID NO: 223771 - DNA, 25 bp, Rattus norvegicus
cacatttggatcttacaggcttgga

SEQ ID NO: 223772 - DNA, 25 bp, Rattus norvegicus
cacatttggcttcgtttccaaccga

SEQ ID NO: 223773 - DNA, 25 bp, Rattus norvegicus
cacatttggcttggtttccaaccga

SEQ ID NO: 223774 - DNA, 25 bp, Rattus norvegicus
cacatttggtctcttgttctttcaa

SEQ ID NO: 223775 - DNA, 25 bp, Rattus norvegicus
cacatttggtctgttgttctttcaa

SEQ ID NO: 223776 - DNA, 25 bp, Rattus norvegicus
cacatttgtacaaagcatctttcaa

SEQ ID NO: 223777 - DNA, 25 bp, Rattus norvegicus
cacatttgtacatagcatctttcaa

SEQ ID NO: 223778 - DNA, 25 bp, Rattus norvegicus
cacatttgttcccttttcagttgca

SEQ ID NO: 223779 - DNA, 25 bp, Rattus norvegicus
cacatttgttccgttttcagttgca

SEQ ID NO: 223780 - DNA, 25 bp, Rattus norvegicus
cacattttcagactgcagccagagt

SEQ ID NO: 223781 - DNA, 25 bp, Rattus norvegicus
cacattttcagagtgcagccagagt

SEQ ID NO: 223782 - DNA, 25 bp, Rattus norvegicus
cacattttcaggcttggtttccaca

SEQ ID NO: 223783 - DNA, 25 bp, Rattus norvegicus
cacattttcagggttggtttccaca

SEQ ID NO: 223784 - DNA, 25 bp, Rattus norvegicus
cacattttcattagggtcttggact

SEQ ID NO: 223785 - DNA, 25 bp, Rattus norvegicus
cacattttcatttgggtcttggact

SEQ ID NO: 223786 - DNA, 25 bp, Rattus norvegicus
cacattttgctgctcgaaggataat

SEQ ID NO: 223787 - DNA, 25 bp, Rattus norvegicus
cacattttgctggtcgaaggataat

SEQ ID NO: 223788 - DNA, 25 bp, Rattus norvegicus
cacattttggcactatgctagggtt

SEQ ID NO: 223789 - DNA, 25 bp, Rattus norvegicus
cacattttggcagtatgctagggtt

SEQ ID NO: 223790 - DNA, 25 bp, Rattus norvegicus
cacattttgtgtacagaccgctggt

SEQ ID NO: 223791 - DNA, 25 bp, Rattus norvegicus
cacattttgtgttcagaccgctggt

SEQ ID NO: 223792 - DNA, 25 bp, Rattus norvegicus
caccaaactgttcggcttgtttcct

SEQ ID NO: 223793 - DNA, 25 bp, Rattus norvegicus
caccaaactgttgggcttgtttcct

SEQ ID NO: 223794 - DNA, 25 bp, Rattus norvegicus
caccaaaggcttagttgtgccgaat

SEQ ID NO: 223795 - DNA, 25 bp, Rattus norvegicus
caccaaaggctttgttgtgccgaat

SEQ ID NO: 223796 - DNA, 25 bp, Rattus norvegicus
caccaaagttctactgggccagaga

SEQ ID NO: 223797 - DNA, 25 bp, Rattus norvegicus
caccaaagttcttctgggccagaga

SEQ ID NO: 223798 - DNA, 25 bp, Rattus norvegicus
caccaaattgttctcttaagctatt

SEQ ID NO: 223799 - DNA, 25 bp, Rattus norvegicus
caccaaattgttgtcttaagctatt

SEQ ID NO: 223800 - DNA, 25 bp, Rattus norvegicus
caccaacctggtcacattcttgatt

SEQ ID NO: 223801 - DNA, 25 bp, Rattus norvegicus
caccaacctggtgacattcttgatt

SEQ ID NO: 223802 - DNA, 25 bp, Rattus norvegicus
caccaactgggaagcgctctgaatg

SEQ ID NO: 223803 - DNA, 25 bp, Rattus norvegicus
caccaactgggatgcgctctgaatg

SEQ ID NO: 223804 - DNA, 25 bp, Rattus norvegicus
caccaacttgcacggtgaggcacag

SEQ ID NO: 223805 - DNA, 25 bp, Rattus norvegicus
caccaacttgcagggtgaggcacag

SEQ ID NO: 223806 - DNA, 25 bp, Rattus norvegicus
caccaagagggccacgtctggcaag

SEQ ID NO: 223807 - DNA, 25 bp, Rattus norvegicus
caccaagagggcgacgtctggcaag

SEQ ID NO: 223808 - DNA, 25 bp, Rattus norvegicus
caccaagagggtcctcggcgagtct

SEQ ID NO: 223809 - DNA, 25 bp, Rattus norvegicus
caccaagagggtgctcggcgagtct

SEQ ID NO: 223810 - DNA, 25 bp, Rattus norvegicus
caccaagcacacagccaatgaaatt

SEQ ID NO: 223811 - DNA, 25 bp, Rattus norvegicus
caccaagcacactgccaatgaaatt

SEQ ID NO: 223812 - DNA, 25 bp, Rattus norvegicus
caccaagcttgtactaacttctcat

SEQ ID NO: 223813 - DNA, 25 bp, Rattus norvegicus
caccaagcttgttctaacttctcat

SEQ ID NO: 223814 - DNA, 25 bp, Rattus norvegicus
caccaaggacccatctatgcatagg

SEQ ID NO: 223815 - DNA, 25 bp, Rattus norvegicus
caccaaggacccttctatgcatagg

SEQ ID NO: 223816 - DNA, 25 bp, Rattus norvegicus
caccaaggatgtccgctgtgctggc

SEQ ID NO: 223817 - DNA, 25 bp, Rattus norvegicus
caccaaggatgtgcgctgtgctggc

SEQ ID NO: 223818 - DNA, 25 bp, Rattus norvegicus
caccaaggcaagacagacctctcag

SEQ ID NO: 223819 - DNA, 25 bp, Rattus norvegicus
caccaaggcaagtcagacctctcag

SEQ ID NO: 223820 - DNA, 25 bp, Rattus norvegicus
caccaaggcgtacgaccagagctgt

SEQ ID NO: 223821 - DNA, 25 bp, Rattus norvegicus
caccaaggcgtaggaccagagctgt

SEQ ID NO: 223822 - DNA, 25 bp, Rattus norvegicus
caccaagggctccagtatgtgggaa

SEQ ID NO: 223823 - DNA, 25 bp, Rattus norvegicus
caccaagggctcgagtatgtgggaa

SEQ ID NO: 223824 - DNA, 25 bp, Rattus norvegicus
caccaagtggtgctcttccttttgg

SEQ ID NO: 223825 - DNA, 25 bp, Rattus norvegicus
caccaagtggtggtcttccttttgg

SEQ ID NO: 223826 - DNA, 25 bp, Rattus norvegicus
caccaagttctcacagcgtggataa

SEQ ID NO: 223827 - DNA, 25 bp, Rattus norvegicus
caccaagttctctcagcgtggataa

SEQ ID NO: 223828 - DNA, 25 bp, Rattus norvegicus
caccaatactggatcacagcaggaa

SEQ ID NO: 223829 - DNA, 25 bp, Rattus norvegicus
caccaatactggttcacagcaggaa

SEQ ID NO: 223830 - DNA, 25 bp, Rattus norvegicus
caccaatagttgctgtagtcatcca

SEQ ID NO: 223831 - DNA, 25 bp, Rattus norvegicus
caccaatagttggtgtagtcatcca

SEQ ID NO: 223832 - DNA, 25 bp, Rattus norvegicus
caccaatcacttcaagatccacagg

SEQ ID NO: 223833 - DNA, 25 bp, Rattus norvegicus
caccaatcacttgaagatccacagg

SEQ ID NO: 223834 - DNA, 25 bp, Rattus norvegicus
caccaatcagctctctgtaagtgga

SEQ ID NO: 223835 - DNA, 25 bp, Rattus norvegicus
caccaatcagctgtctgtaagtgga

SEQ ID NO: 223836 - DNA, 25 bp, Rattus norvegicus
caccaatccactcttattctcagag

SEQ ID NO: 223837 - DNA, 25 bp, Rattus norvegicus
caccaatccactgttattctcagag

SEQ ID NO: 223838 - DNA, 25 bp, Rattus norvegicus
caccaatctcctatcaggaggcaga

SEQ ID NO: 223839 - DNA, 25 bp, Rattus norvegicus
caccaatctcctttcaggaggcaga

SEQ ID NO: 223840 - DNA, 25 bp, Rattus norvegicus
caccaatgaattcccaactgtttta

SEQ ID NO: 223841 - DNA, 25 bp, Rattus norvegicus
caccaatgaattgccaactgtttta

SEQ ID NO: 223842 - DNA, 25 bp, Rattus norvegicus
caccaattctgactggccaacatta

SEQ ID NO: 223843 - DNA, 25 bp, Rattus norvegicus
caccaattctgagtggccaacatta

SEQ ID NO: 223844 - DNA, 25 bp, Rattus norvegicus
caccaattgcaaaggctaagatcaa

SEQ ID NO: 223845 - DNA, 25 bp, Rattus norvegicus
caccaattgcaatggctaagatcaa

SEQ ID NO: 223846 - DNA, 25 bp, Rattus norvegicus
caccaatttttcatagctcttcttc

SEQ ID NO: 223847 - DNA, 25 bp, Rattus norvegicus
caccaatttttcttagctcttcttc

SEQ ID NO: 223848 - DNA, 25 bp, Rattus norvegicus
caccacaaacctacacagtacttta

SEQ ID NO: 223849 - DNA, 25 bp, Rattus norvegicus
caccacaaaccttcacagtacttta

SEQ ID NO: 223850 - DNA, 25 bp, Rattus norvegicus
caccacactgtgatgtagctaggag

SEQ ID NO: 223851 - DNA, 25 bp, Rattus norvegicus
caccacactgtgttgtagctaggag

SEQ ID NO: 223852 - DNA, 25 bp, Rattus norvegicus
caccacagcctgaaacctatcatgg

SEQ ID NO: 223853 - DNA, 25 bp, Rattus norvegicus
caccacagcctgtaacctatcatgg

SEQ ID NO: 223854 - DNA, 25 bp, Rattus norvegicus
caccacaggacaatgccatatgacg

SEQ ID NO: 223855 - DNA, 25 bp, Rattus norvegicus
caccacaggacattgccatatgacg

SEQ ID NO: 223856 - DNA, 25 bp, Rattus norvegicus
caccacaggacgagaattggagttt

SEQ ID NO: 223857 - DNA, 25 bp, Rattus norvegicus
caccacaggacgtgaattggagttt

SEQ ID NO: 223858 - DNA, 25 bp, Rattus norvegicus
caccacagtggtctccagatgaaga

SEQ ID NO: 223859 - DNA, 25 bp, Rattus norvegicus
caccacagtggtgtccagatgaaga

SEQ ID NO: 223860 - DNA, 25 bp, Rattus norvegicus
caccacatccagcttgaacttgtag

SEQ ID NO: 223861 - DNA, 25 bp, Rattus norvegicus
caccacatccaggttgaacttgtag

SEQ ID NO: 223862 - DNA, 25 bp, Rattus norvegicus
caccacatcgacagctcagagagaa

SEQ ID NO: 223863 - DNA, 25 bp, Rattus norvegicus
caccacatcgactgctcagagagaa

SEQ ID NO: 223864 - DNA, 25 bp, Rattus norvegicus
caccacatgaaaaacagtctcctct

SEQ ID NO: 223865 - DNA, 25 bp, Rattus norvegicus
caccacatgaaatacagtctcctct

SEQ ID NO: 223866 - DNA, 25 bp, Rattus norvegicus
caccaccaagacatctgttctgcta

SEQ ID NO: 223867 - DNA, 25 bp, Rattus norvegicus
caccaccaagacttctgttctgcta

SEQ ID NO: 223868 - DNA, 25 bp, Rattus norvegicus
caccaccacagcagagagggaaatc

SEQ ID NO: 223869 - DNA, 25 bp, Rattus norvegicus
caccaccacagctgagagggaaatc

SEQ ID NO: 223870 - DNA, 25 bp, Rattus norvegicus
caccaccagggcctagagggtgacc

SEQ ID NO: 223871 - DNA, 25 bp, Rattus norvegicus
caccaccagggcgtagagggtgacc

SEQ ID NO: 223872 - DNA, 25 bp, Rattus norvegicus
caccaccatgggaagctgtagtttt

SEQ ID NO: 223873 - DNA, 25 bp, Rattus norvegicus
caccaccatgggtagctgtagtttt

SEQ ID NO: 223874 - DNA, 25 bp, Rattus norvegicus
caccacctcaggcatcatttgcaat

SEQ ID NO: 223875 - DNA, 25 bp, Rattus norvegicus
caccacctcagggatcatttgcaat

SEQ ID NO: 223876 - DNA, 25 bp, Rattus norvegicus
caccacctcattactggattcagaa

SEQ ID NO: 223877 - DNA, 25 bp, Rattus norvegicus
caccacctcatttctggattcagaa

SEQ ID NO: 223878 - DNA, 25 bp, Rattus norvegicus
caccacctggctaagaatttccttt

SEQ ID NO: 223879 - DNA, 25 bp, Rattus norvegicus
caccacctggcttagaatttccttt

SEQ ID NO: 223880 - DNA, 25 bp, Rattus norvegicus
caccacctgtttaatttcgaagtct

SEQ ID NO: 223881 - DNA, 25 bp, Rattus norvegicus
caccacctgttttatttcgaagtct

SEQ ID NO: 223882 - DNA, 25 bp, Rattus norvegicus
caccaccttccactagctttttaag

SEQ ID NO: 223883 - DNA, 25 bp, Rattus norvegicus
caccaccttccagtagctttttaag

SEQ ID NO: 223884 - DNA, 25 bp, Rattus norvegicus
caccacctttctctagttgtatcat

SEQ ID NO: 223885 - DNA, 25 bp, Rattus norvegicus
caccacctttctgtagttgtatcat

SEQ ID NO: 223886 - DNA, 25 bp, Rattus norvegicus
caccacgacaacaggccttgaattt

SEQ ID NO: 223887 - DNA, 25 bp, Rattus norvegicus
caccacgacaactggccttgaattt

SEQ ID NO: 223888 - DNA, 25 bp, Rattus norvegicus
caccacggagatcaaatgccttgat

SEQ ID NO: 223889 - DNA, 25 bp, Rattus norvegicus
caccacggagatgaaatgccttgat

SEQ ID NO: 223890 - DNA, 25 bp, Rattus norvegicus
caccacggcggcaatgagctgatgg

SEQ ID NO: 223891 - DNA, 25 bp, Rattus norvegicus
caccacggcggctatgagctgatgg

SEQ ID NO: 223892 - DNA, 25 bp, Rattus norvegicus
caccacgggcccaggatatgctggg

SEQ ID NO: 223893 - DNA, 25 bp, Rattus norvegicus
caccacgggccctggatatgctggg

SEQ ID NO: 223894 - DNA, 25 bp, Rattus norvegicus
caccacggtgttcgccttgttggaa

SEQ ID NO: 223895 - DNA, 25 bp, Rattus norvegicus
caccacggtgttggccttgttggaa

SEQ ID NO: 223896 - DNA, 25 bp, Rattus norvegicus
caccacgtcagtccccttgggatgg

SEQ ID NO: 223897 - DNA, 25 bp, Rattus norvegicus
caccacgtcagtgcccttgggatgg

SEQ ID NO: 223898 - DNA, 25 bp, Rattus norvegicus
caccactacaacactcactatgaaa

SEQ ID NO: 223899 - DNA, 25 bp, Rattus norvegicus
caccactacaactctcactatgaaa

SEQ ID NO: 223900 - DNA, 25 bp, Rattus norvegicus
caccactagaggctagccacggagt

SEQ ID NO: 223901 - DNA, 25 bp, Rattus norvegicus
caccactagagggtagccacggagt

SEQ ID NO: 223902 - DNA, 25 bp, Rattus norvegicus
caccactatgggatcctttgcagaa

SEQ ID NO: 223903 - DNA, 25 bp, Rattus norvegicus
caccactatgggttcctttgcagaa

SEQ ID NO: 223904 - DNA, 25 bp, Rattus norvegicus
caccactattccagcactattaata

SEQ ID NO: 223905 - DNA, 25 bp, Rattus norvegicus
caccactattcctgcactattaata

SEQ ID NO: 223906 - DNA, 25 bp, Rattus norvegicus
caccactccagtctttgggcacaat

SEQ ID NO: 223907 - DNA, 25 bp, Rattus norvegicus
caccactccagtgtttgggcacaat

SEQ ID NO: 223908 - DNA, 25 bp, Rattus norvegicus
caccactctgtgaaaggacttaggc

SEQ ID NO: 223909 - DNA, 25 bp, Rattus norvegicus
caccactctgtgtaaggacttaggc

SEQ ID NO: 223910 - DNA, 25 bp, Rattus norvegicus
caccactctttgaatagacacctac

SEQ ID NO: 223911 - DNA, 25 bp, Rattus norvegicus
caccactctttgatcctagagctaa

SEQ ID NO: 223912 - DNA, 25 bp, Rattus norvegicus
caccactctttgtatagacacctac

SEQ ID NO: 223913 - DNA, 25 bp, Rattus norvegicus
caccactctttgttcctagagctaa

SEQ ID NO: 223914 - DNA, 25 bp, Rattus norvegicus
caccactgaggaagtagcgcttgct

SEQ ID NO: 223915 - DNA, 25 bp, Rattus norvegicus
caccactgaggatgtagcgcttgct

SEQ ID NO: 223916 - DNA, 25 bp, Rattus norvegicus
caccactgagtgctcctgagctgct

SEQ ID NO: 223917 - DNA, 25 bp, Rattus norvegicus
caccactgagtggtcctgagctgct

SEQ ID NO: 223918 - DNA, 25 bp, Rattus norvegicus
caccactgctcactgaacagacaga

SEQ ID NO: 223919 - DNA, 25 bp, Rattus norvegicus
caccactgctcagtgaacagacaga

SEQ ID NO: 223920 - DNA, 25 bp, Rattus norvegicus
caccactgcttacctcttttgtttt

SEQ ID NO: 223921 - DNA, 25 bp, Rattus norvegicus
caccactgcttagctcttttgtttt

SEQ ID NO: 223922 - DNA, 25 bp, Rattus norvegicus
caccactgtatacactcctaggatg

SEQ ID NO: 223923 - DNA, 25 bp, Rattus norvegicus
caccactgtatagactcctaggatg

SEQ ID NO: 223924 - DNA, 25 bp, Rattus norvegicus
caccacttcatgcacctgaacatga

SEQ ID NO: 223925 - DNA, 25 bp, Rattus norvegicus
caccacttcatggacctgaacatga

SEQ ID NO: 223926 - DNA, 25 bp, Rattus norvegicus
caccacttgttaaggctctagccag

SEQ ID NO: 223927 - DNA, 25 bp, Rattus norvegicus
caccacttgttatggctctagccag

SEQ ID NO: 223928 - DNA, 25 bp, Rattus norvegicus
caccactttcagatcctgttttggg

SEQ ID NO: 223929 - DNA, 25 bp, Rattus norvegicus
caccactttcagttcctgttttggg

SEQ ID NO: 223930 - DNA, 25 bp, Rattus norvegicus
caccagaaccgcagtctttataggt

SEQ ID NO: 223931 - DNA, 25 bp, Rattus norvegicus
caccagaaccgctgtctttataggt

SEQ ID NO: 223932 - DNA, 25 bp, Rattus norvegicus
caccagaaccttccacatgaaatga

SEQ ID NO: 223933 - DNA, 25 bp, Rattus norvegicus
caccagaaccttgcacatgaaatga

SEQ ID NO: 223934 - DNA, 25 bp, Rattus norvegicus
caccagaagcctcctcgagaaggga

SEQ ID NO: 223935 - DNA, 25 bp, Rattus norvegicus
caccagaagcctgctcgagaaggga

SEQ ID NO: 223936 - DNA, 25 bp, Rattus norvegicus
caccagaagtgcagctcggaggcat

SEQ ID NO: 223937 - DNA, 25 bp, Rattus norvegicus
caccagaagtgctgctcggaggcat

SEQ ID NO: 223938 - DNA, 25 bp, Rattus norvegicus
caccagaatgtcctgtgacctgtaa

SEQ ID NO: 223939 - DNA, 25 bp, Rattus norvegicus
caccagaatgtcgtgtgacctgtaa

SEQ ID NO: 223940 - DNA, 25 bp, Rattus norvegicus
caccagaggtggattcccttgggtg

SEQ ID NO: 223941 - DNA, 25 bp, Rattus norvegicus
caccagaggtggtttcccttgggtg

SEQ ID NO: 223942 - DNA, 25 bp, Rattus norvegicus
caccagatctggcactggagttaac

SEQ ID NO: 223943 - DNA, 25 bp, Rattus norvegicus
caccagatctgggactggagttaac

SEQ ID NO: 223944 - DNA, 25 bp, Rattus norvegicus
caccagatggtgagcttggctgcaa

SEQ ID NO: 223945 - DNA, 25 bp, Rattus norvegicus
caccagatggtgtgcttggctgcaa

SEQ ID NO: 223946 - DNA, 25 bp, Rattus norvegicus
caccagcaagtgatcagagagactc

SEQ ID NO: 223947 - DNA, 25 bp, Rattus norvegicus
caccagcaagtgttcagagagactc

SEQ ID NO: 223948 - DNA, 25 bp, Rattus norvegicus
caccagcacaagaagaggccccagg

SEQ ID NO: 223949 - DNA, 25 bp, Rattus norvegicus
caccagcacaagtagaggccccagg

SEQ ID NO: 223950 - DNA, 25 bp, Rattus norvegicus
caccagcacatcagcactgcagatg

SEQ ID NO: 223951 - DNA, 25 bp, Rattus norvegicus
caccagcacatctgcactgcagatg

SEQ ID NO: 223952 - DNA, 25 bp, Rattus norvegicus
caccagcactggcttttgtctgttt

SEQ ID NO: 223953 - DNA, 25 bp, Rattus norvegicus
caccagcactgggttttgtctgttt

SEQ ID NO: 223954 - DNA, 25 bp, Rattus norvegicus
caccagcagctgcagtagctcaatg

SEQ ID NO: 223955 - DNA, 25 bp, Rattus norvegicus
caccagcagctggagtagctcaatg

SEQ ID NO: 223956 - DNA, 25 bp, Rattus norvegicus
caccagcagggaagcggcttgtgaa

SEQ ID NO: 223957 - DNA, 25 bp, Rattus norvegicus
caccagcagggatgcggcttgtgaa

SEQ ID NO: 223958 - DNA, 25 bp, Rattus norvegicus
caccagcaggtgattcttgcaaact

SEQ ID NO: 223959 - DNA, 25 bp, Rattus norvegicus
caccagcaggtgtttcttgcaaact

SEQ ID NO: 223960 - DNA, 25 bp, Rattus norvegicus
caccagcagtgccttagtcaattgt

SEQ ID NO: 223961 - DNA, 25 bp, Rattus norvegicus
caccagcagtgcgttagtcaattgt

SEQ ID NO: 223962 - DNA, 25 bp, Rattus norvegicus
caccagcatcctatgaagaaacctg

SEQ ID NO: 223963 - DNA, 25 bp, Rattus norvegicus
caccagcatcctttgaagaaacctg

SEQ ID NO: 223964 - DNA, 25 bp, Rattus norvegicus
caccagccccataaatgtctattta

SEQ ID NO: 223965 - DNA, 25 bp, Rattus norvegicus
caccagccccattaatgtctattta

SEQ ID NO: 223966 - DNA, 25 bp, Rattus norvegicus
caccagccgtgtactagctgttagg

SEQ ID NO: 223967 - DNA, 25 bp, Rattus norvegicus
caccagccgtgtcggaaggaagtca

SEQ ID NO: 223968 - DNA, 25 bp, Rattus norvegicus
caccagccgtgtgggaaggaagtca

SEQ ID NO: 223969 - DNA, 25 bp, Rattus norvegicus
caccagccgtgttctagctgttagg

SEQ ID NO: 223970 - DNA, 25 bp, Rattus norvegicus
caccagcctgcacctgcgttcactt

SEQ ID NO: 223971 - DNA, 25 bp, Rattus norvegicus
caccagcctgcagctgcgttcactt

SEQ ID NO: 223972 - DNA, 25 bp, Rattus norvegicus
caccagctccctctgaaggaggtga

SEQ ID NO: 223973 - DNA, 25 bp, Rattus norvegicus
caccagctccctgtgaaggaggtga

SEQ ID NO: 223974 - DNA, 25 bp, Rattus norvegicus
caccagctcttactgtcatcaggaa

SEQ ID NO: 223975 - DNA, 25 bp, Rattus norvegicus
caccagctcttagtgtcatcaggaa

SEQ ID NO: 223976 - DNA, 25 bp, Rattus norvegicus
caccagctgtccagtacggtaacag

SEQ ID NO: 223977 - DNA, 25 bp, Rattus norvegicus
caccagctgtcctgtacggtaacag

SEQ ID NO: 223978 - DNA, 25 bp, Rattus norvegicus
caccagctgtctagatgcatttgtt

SEQ ID NO: 223979 - DNA, 25 bp, Rattus norvegicus
caccagctgtctattgactctttag

SEQ ID NO: 223980 - DNA, 25 bp, Rattus norvegicus
caccagctgtcttgatgcatttgtt

SEQ ID NO: 223981 - DNA, 25 bp, Rattus norvegicus
caccagctgtcttttgactctttag

SEQ ID NO: 223982 - DNA, 25 bp, Rattus norvegicus
caccaggaccatcatgattctcatg

SEQ ID NO: 223983 - DNA, 25 bp, Rattus norvegicus
caccaggaccatgatgattctcatg

SEQ ID NO: 223984 - DNA, 25 bp, Rattus norvegicus
caccaggagctgcaagtcacagtac

SEQ ID NO: 223985 - DNA, 25 bp, Rattus norvegicus
caccaggagctggaagtcacagtac

SEQ ID NO: 223986 - DNA, 25 bp, Rattus norvegicus
caccaggatcctacagttagagcat

SEQ ID NO: 223987 - DNA, 25 bp, Rattus norvegicus
caccaggatccttcagttagagcat

SEQ ID NO: 223988 - DNA, 25 bp, Rattus norvegicus
caccaggcaggtctgcagtgcactt

SEQ ID NO: 223989 - DNA, 25 bp, Rattus norvegicus
caccaggcaggtgtgcagtgcactt

SEQ ID NO: 223990 - DNA, 25 bp, Rattus norvegicus
caccaggccactctttaattgtttt

SEQ ID NO: 223991 - DNA, 25 bp, Rattus norvegicus
caccaggccactgtttaattgtttt

SEQ ID NO: 223992 - DNA, 25 bp, Rattus norvegicus
caccaggctgtgatgagactgtcat

SEQ ID NO: 223993 - DNA, 25 bp, Rattus norvegicus
caccaggctgtgttgagactgtcat

SEQ ID NO: 223994 - DNA, 25 bp, Rattus norvegicus
caccagggaggcaagtttacatcaa

SEQ ID NO: 223995 - DNA, 25 bp, Rattus norvegicus
caccagggaggctagtttacatcaa

SEQ ID NO: 223996 - DNA, 25 bp, Rattus norvegicus
caccagggatcaccatttgtcaagt

SEQ ID NO: 223997 - DNA, 25 bp, Rattus norvegicus
caccagggatcagcatttgtcaagt

SEQ ID NO: 223998 - DNA, 25 bp, Rattus norvegicus
caccagggcctgaatttcaatgaca

SEQ ID NO: 223999 - DNA, 25 bp, Rattus norvegicus
caccagggcctgtatttcaatgaca

SEQ ID NO: 224000 - DNA, 25 bp, Rattus norvegicus
caccagggcttcagcaggagccctg

SEQ ID NO: 224001 - DNA, 25 bp, Rattus norvegicus
caccagggcttctgcaggagccctg

SEQ ID NO: 224002 - DNA, 25 bp, Rattus norvegicus
caccagggtgtgctcatcgtgactt

SEQ ID NO: 224003 - DNA, 25 bp, Rattus norvegicus
caccagggtgtggtcatcgtgactt

SEQ ID NO: 224004 - DNA, 25 bp, Rattus norvegicus
caccaggtggcaaccaagtcttgat

SEQ ID NO: 224005 - DNA, 25 bp, Rattus norvegicus
caccaggtggcatccaagtcttgat

SEQ ID NO: 224006 - DNA, 25 bp, Rattus norvegicus
caccaggtggctagctacagttgta

SEQ ID NO: 224007 - DNA, 25 bp, Rattus norvegicus
caccaggtggcttgctacagttgta

SEQ ID NO: 224008 - DNA, 25 bp, Rattus norvegicus
caccaggtgtgcaaaggagtatctc

SEQ ID NO: 224009 - DNA, 25 bp, Rattus norvegicus
caccaggtgtgctaaggagtatctc

SEQ ID NO: 224010 - DNA, 25 bp, Rattus norvegicus
caccaggttcctactcaatttatgt

SEQ ID NO: 224011 - DNA, 25 bp, Rattus norvegicus
caccaggttccttctcaatttatgt

SEQ ID NO: 224012 - DNA, 25 bp, Rattus norvegicus
caccagtaggtcattatcccgattt

SEQ ID NO: 224013 - DNA, 25 bp, Rattus norvegicus
caccagtaggtctttatcccgattt

SEQ ID NO: 224014 - DNA, 25 bp, Rattus norvegicus
caccagtggataccgccaggaagga

SEQ ID NO: 224015 - DNA, 25 bp, Rattus norvegicus
caccagtggatagcgccaggaagga

SEQ ID NO: 224016 - DNA, 25 bp, Rattus norvegicus
caccagtgtgcaaatgggcaaggga

SEQ ID NO: 224017 - DNA, 25 bp, Rattus norvegicus
caccagtgtgcatatgggcaaggga

SEQ ID NO: 224018 - DNA, 25 bp, Rattus norvegicus
caccagttacttagtggcataccca

SEQ ID NO: 224019 - DNA, 25 bp, Rattus norvegicus
caccagttactttgtggcataccca

SEQ ID NO: 224020 - DNA, 25 bp, Rattus norvegicus
caccatacaagtcctattatttcta

SEQ ID NO: 224021 - DNA, 25 bp, Rattus norvegicus
caccatacaagtgctattatttcta

SEQ ID NO: 224022 - DNA, 25 bp, Rattus norvegicus
caccataccctgattatgtagtgtt

SEQ ID NO: 224023 - DNA, 25 bp, Rattus norvegicus
caccataccctgtttatgtagtgtt

SEQ ID NO: 224024 - DNA, 25 bp, Rattus norvegicus
caccatagctgtcagttttgcctaa

SEQ ID NO: 224025 - DNA, 25 bp, Rattus norvegicus
caccatagctgtgagttttgcctaa

SEQ ID NO: 224026 - DNA, 25 bp, Rattus norvegicus
caccatatcaccagctaaaatgttc

SEQ ID NO: 224027 - DNA, 25 bp, Rattus norvegicus
caccatatcacctgctaaaatgttc

SEQ ID NO: 224028 - DNA, 25 bp, Rattus norvegicus
caccatatgaatcccttatgttccc

SEQ ID NO: 224029 - DNA, 25 bp, Rattus norvegicus
caccatatgaatgccttatgttccc

SEQ ID NO: 224030 - DNA, 25 bp, Rattus norvegicus
caccatcatgagcaccaagttctgt

SEQ ID NO: 224031 - DNA, 25 bp, Rattus norvegicus
caccatcatgaggaccaagttctgt

SEQ ID NO: 224032 - DNA, 25 bp, Rattus norvegicus
caccatcccctcactttttgtttgg

SEQ ID NO: 224033 - DNA, 25 bp, Rattus norvegicus
caccatcccctctctttttgtttgg

SEQ ID NO: 224034 - DNA, 25 bp, Rattus norvegicus
caccatcccggcctggaacatttga

SEQ ID NO: 224035 - DNA, 25 bp, Rattus norvegicus
caccatcccggcgtggaacatttga

SEQ ID NO: 224036 - DNA, 25 bp, Rattus norvegicus
caccatccgttaaatctgttctcat

SEQ ID NO: 224037 - DNA, 25 bp, Rattus norvegicus
caccatccgttatatctgttctcat

SEQ ID NO: 224038 - DNA, 25 bp, Rattus norvegicus
caccatcctagcactcaaggagggt

SEQ ID NO: 224039 - DNA, 25 bp, Rattus norvegicus
caccatcctagctctcaaggagggt

SEQ ID NO: 224040 - DNA, 25 bp, Rattus norvegicus
caccatcctggtcggctatgagtga

SEQ ID NO: 224041 - DNA, 25 bp, Rattus norvegicus
caccatcctggtgggctatgagtga

SEQ ID NO: 224042 - DNA, 25 bp, Rattus norvegicus
caccatcgaggacttctaccgcaag

SEQ ID NO: 224043 - DNA, 25 bp, Rattus norvegicus
caccatcgaggagttctaccgcaag

SEQ ID NO: 224044 - DNA, 25 bp, Rattus norvegicus
caccatctcagacagtttgggagta

SEQ ID NO: 224045 - DNA, 25 bp, Rattus norvegicus
caccatctcagagagtttgggagta

SEQ ID NO: 224046 - DNA, 25 bp, Rattus norvegicus
caccatctcaggcttacacatgcgg

SEQ ID NO: 224047 - DNA, 25 bp, Rattus norvegicus
caccatctcagggttacacatgcgg

SEQ ID NO: 224048 - DNA, 25 bp, Rattus norvegicus
caccatctctacacgacttggaaaa

SEQ ID NO: 224049 - DNA, 25 bp, Rattus norvegicus
caccatctctactcgacttggaaaa

SEQ ID NO: 224050 - DNA, 25 bp, Rattus norvegicus
caccatcttcatccctttttcaaga

SEQ ID NO: 224051 - DNA, 25 bp, Rattus norvegicus
caccatcttcatgcctttttcaaga

SEQ ID NO: 224052 - DNA, 25 bp, Rattus norvegicus
caccatcttccacgagcgagatccc

SEQ ID NO: 224053 - DNA, 25 bp, Rattus norvegicus
caccatcttccaggagcgagatccc

SEQ ID NO: 224054 - DNA, 25 bp, Rattus norvegicus
caccatgacgtccatacatgatgat

SEQ ID NO: 224055 - DNA, 25 bp, Rattus norvegicus
caccatgacgtcgatacatgatgat

SEQ ID NO: 224056 - DNA, 25 bp, Rattus norvegicus
caccatgatgttctggatgctgctt

SEQ ID NO: 224057 - DNA, 25 bp, Rattus norvegicus
caccatgatgttgtggatgctgctt

SEQ ID NO: 224058 - DNA, 25 bp, Rattus norvegicus
caccatgcactgatactgccaatat

SEQ ID NO: 224059 - DNA, 25 bp, Rattus norvegicus
caccatgcactgttactgccaatat

SEQ ID NO: 224060 - DNA, 25 bp, Rattus norvegicus
caccatgcccatctgtaaggcagat

SEQ ID NO: 224061 - DNA, 25 bp, Rattus norvegicus
caccatgcccatgtgtaaggcagat

SEQ ID NO: 224062 - DNA, 25 bp, Rattus norvegicus
caccatgcccgacatctgtaaagat

SEQ ID NO: 224063 - DNA, 25 bp, Rattus norvegicus
caccatgcccgagatctgtaaagat

SEQ ID NO: 224064 - DNA, 25 bp, Rattus norvegicus
caccatgccctgatctaattaatgt

SEQ ID NO: 224065 - DNA, 25 bp, Rattus norvegicus
caccatgccctgttctaattaatgt

SEQ ID NO: 224066 - DNA, 25 bp, Rattus norvegicus
caccatgccgtgatatctaaagcct

SEQ ID NO: 224067 - DNA, 25 bp, Rattus norvegicus
caccatgccgtgttatctaaagcct

SEQ ID NO: 224068 - DNA, 25 bp, Rattus norvegicus
caccatgcctatcttcatcgtgaac

SEQ ID NO: 224069 - DNA, 25 bp, Rattus norvegicus
caccatgcctatgttcatcgtgaac

SEQ ID NO: 224070 - DNA, 25 bp, Rattus norvegicus
caccatgctgcaataagagatttat

SEQ ID NO: 224071 - DNA, 25 bp, Rattus norvegicus
caccatgctgcattaagagatttat

SEQ ID NO: 224072 - DNA, 25 bp, Rattus norvegicus
caccatgctgctagaactccaaata

SEQ ID NO: 224073 - DNA, 25 bp, Rattus norvegicus
caccatgctgcttgaactccaaata

SEQ ID NO: 224074 - DNA, 25 bp, Rattus norvegicus
caccatgctggccttagtagtaaaa

SEQ ID NO: 224075 - DNA, 25 bp, Rattus norvegicus
caccatgctggcgttagtagtaaaa

SEQ ID NO: 224076 - DNA, 25 bp, Rattus norvegicus
caccatgcttgacattttcctttgt

SEQ ID NO: 224077 - DNA, 25 bp, Rattus norvegicus
caccatgcttgagattttcctttgt

SEQ ID NO: 224078 - DNA, 25 bp, Rattus norvegicus
caccatgcttggactcagacggagt

SEQ ID NO: 224079 - DNA, 25 bp, Rattus norvegicus
caccatgcttggtctcagacggagt

SEQ ID NO: 224080 - DNA, 25 bp, Rattus norvegicus
caccatggacatcctctgttaactt

SEQ ID NO: 224081 - DNA, 25 bp, Rattus norvegicus
caccatggacatgctctgttaactt

SEQ ID NO: 224082 - DNA, 25 bp, Rattus norvegicus
caccatggagacagtgggtcaccaa

SEQ ID NO: 224083 - DNA, 25 bp, Rattus norvegicus
caccatggagactgtgggtcaccaa

SEQ ID NO: 224084 - DNA, 25 bp, Rattus norvegicus
caccatggagctcccttcagtaaat

SEQ ID NO: 224085 - DNA, 25 bp, Rattus norvegicus
caccatggagctgccttcagtaaat

SEQ ID NO: 224086 - DNA, 25 bp, Rattus norvegicus
caccatggcgagacccttggaggag

SEQ ID NO: 224087 - DNA, 25 bp, Rattus norvegicus
caccatggcgagtcccttggaggag

SEQ ID NO: 224088 - DNA, 25 bp, Rattus norvegicus
caccatggtcatattctagtttttt

SEQ ID NO: 224089 - DNA, 25 bp, Rattus norvegicus
caccatggtcattttctagtttttt

SEQ ID NO: 224090 - DNA, 25 bp, Rattus norvegicus
caccatggtgggatactgggaccta

SEQ ID NO: 224091 - DNA, 25 bp, Rattus norvegicus
caccatggtgggttactgggaccta

SEQ ID NO: 224092 - DNA, 25 bp, Rattus norvegicus
caccatgtaagtaccagtcccataa

SEQ ID NO: 224093 - DNA, 25 bp, Rattus norvegicus
caccatgtaagttccagtcccataa

SEQ ID NO: 224094 - DNA, 25 bp, Rattus norvegicus
caccatgtacacagggtttactaaa

SEQ ID NO: 224095 - DNA, 25 bp, Rattus norvegicus
caccatgtacactgggtttactaaa

SEQ ID NO: 224096 - DNA, 25 bp, Rattus norvegicus
caccatgtagtcaggttgtgttcct

SEQ ID NO: 224097 - DNA, 25 bp, Rattus norvegicus
caccatgtagtctggttgtgttcct

SEQ ID NO: 224098 - DNA, 25 bp, Rattus norvegicus
caccatgtccacctattagaacctt

SEQ ID NO: 224099 - DNA, 25 bp, Rattus norvegicus
caccatgtccacgtattagaacctt

SEQ ID NO: 224100 - DNA, 25 bp, Rattus norvegicus
caccatgtcctcaaagtgttcacaa

SEQ ID NO: 224101 - DNA, 25 bp, Rattus norvegicus
caccatgtcctctaagtgttcacaa

SEQ ID NO: 224102 - DNA, 25 bp, Rattus norvegicus
caccatgtcttcctatgagttgcgg

SEQ ID NO: 224103 - DNA, 25 bp, Rattus norvegicus
caccatgtcttcgtatgagttgcgg

SEQ ID NO: 224104 - DNA, 25 bp, Rattus norvegicus
caccatgtgtgtagtgcccctggag

SEQ ID NO: 224105 - DNA, 25 bp, Rattus norvegicus
caccatgtgtgtccagtgccagagg

SEQ ID NO: 224106 - DNA, 25 bp, Rattus norvegicus
caccatgtgtgtgcagtgccagagg

SEQ ID NO: 224107 - DNA, 25 bp, Rattus norvegicus
caccatgtgtgttgtgcccctggag

SEQ ID NO: 224108 - DNA, 25 bp, Rattus norvegicus
caccatgtgtttctcagttttcctt

SEQ ID NO: 224109 - DNA, 25 bp, Rattus norvegicus
caccatgtgtttgtcagttttcctt

SEQ ID NO: 224110 - DNA, 25 bp, Rattus norvegicus
caccattccatgaggctgactagat

SEQ ID NO: 224111 - DNA, 25 bp, Rattus norvegicus
caccattccatgtggctgactagat

SEQ ID NO: 224112 - DNA, 25 bp, Rattus norvegicus
caccattctgctctggatggacaga

SEQ ID NO: 224113 - DNA, 25 bp, Rattus norvegicus
caccattctgctgtggatggacaga

SEQ ID NO: 224114 - DNA, 25 bp, Rattus norvegicus
caccattgagccctgtgttcaggtt

SEQ ID NO: 224115 - DNA, 25 bp, Rattus norvegicus
caccattgagccgtgtgttcaggtt

SEQ ID NO: 224116 - DNA, 25 bp, Rattus norvegicus
caccattgccccaggagttgttatg

SEQ ID NO: 224117 - DNA, 25 bp, Rattus norvegicus
caccattgcccctggagttgttatg

SEQ ID NO: 224118 - DNA, 25 bp, Rattus norvegicus
caccattggctcaatcctcagggag

SEQ ID NO: 224119 - DNA, 25 bp, Rattus norvegicus
caccattggctctatcctcagggag

SEQ ID NO: 224120 - DNA, 25 bp, Rattus norvegicus
caccattgggtgctagagccttaac

SEQ ID NO: 224121 - DNA, 25 bp, Rattus norvegicus
caccattgggtggtagagccttaac

SEQ ID NO: 224122 - DNA, 25 bp, Rattus norvegicus
caccattgtccactcttaacaggaa

SEQ ID NO: 224123 - DNA, 25 bp, Rattus norvegicus
caccattgtccagtcttaacaggaa

SEQ ID NO: 224124 - DNA, 25 bp, Rattus norvegicus
caccattgtctgacgtgtacgtgta

SEQ ID NO: 224125 - DNA, 25 bp, Rattus norvegicus
caccattgtctgtcgtgtacgtgta

SEQ ID NO: 224126 - DNA, 25 bp, Rattus norvegicus
caccatttgtctccctttcatgaaa

SEQ ID NO: 224127 - DNA, 25 bp, Rattus norvegicus
caccatttgtctgcctttcatgaaa

SEQ ID NO: 224128 - DNA, 25 bp, Rattus norvegicus
caccattttatgagctgtgcttcat

SEQ ID NO: 224129 - DNA, 25 bp, Rattus norvegicus
caccattttatgtgctgtgcttcat

SEQ ID NO: 224130 - DNA, 25 bp, Rattus norvegicus
cacccaaatagactccttttccaag

SEQ ID NO: 224131 - DNA, 25 bp, Rattus norvegicus
cacccaaatagagtccttttccaag

SEQ ID NO: 224132 - DNA, 25 bp, Rattus norvegicus
cacccaagggcaccagagttaggca

SEQ ID NO: 224133 - DNA, 25 bp, Rattus norvegicus
cacccaagggcagcagagttaggca

SEQ ID NO: 224134 - DNA, 25 bp, Rattus norvegicus
cacccacagcttctttaacatctgt

SEQ ID NO: 224135 - DNA, 25 bp, Rattus norvegicus
cacccacagcttgtttaacatctgt

SEQ ID NO: 224136 - DNA, 25 bp, Rattus norvegicus
cacccaccagtgactcatttaaagg

SEQ ID NO: 224137 - DNA, 25 bp, Rattus norvegicus
cacccaccagtgctaggactaaagg

SEQ ID NO: 224138 - DNA, 25 bp, Rattus norvegicus
cacccaccagtggtaggactaaagg

SEQ ID NO: 224139 - DNA, 25 bp, Rattus norvegicus
cacccaccagtgtctcatttaaagg

SEQ ID NO: 224140 - DNA, 25 bp, Rattus norvegicus
cacccacccagtagtgtccgaaaat

SEQ ID NO: 224141 - DNA, 25 bp, Rattus norvegicus
cacccacccagttgtgtccgaaaat

SEQ ID NO: 224142 - DNA, 25 bp, Rattus norvegicus
cacccacctaaacttcatgtgccag

SEQ ID NO: 224143 - DNA, 25 bp, Rattus norvegicus
cacccacctaaagttcatgtgccag

SEQ ID NO: 224144 - DNA, 25 bp, Rattus norvegicus
cacccacctccaataattgcaatta

SEQ ID NO: 224145 - DNA, 25 bp, Rattus norvegicus
cacccacctccattaattgcaatta

SEQ ID NO: 224146 - DNA, 25 bp, Rattus norvegicus
cacccacgggaaaggcttagggaag

SEQ ID NO: 224147 - DNA, 25 bp, Rattus norvegicus
cacccacgggaatggcttagggaag

SEQ ID NO: 224148 - DNA, 25 bp, Rattus norvegicus
cacccactcatgactcttaagtttg

SEQ ID NO: 224149 - DNA, 25 bp, Rattus norvegicus
cacccactcatgtctcttaagtttg

SEQ ID NO: 224150 - DNA, 25 bp, Rattus norvegicus
cacccacttttcaaacgcttcagga

SEQ ID NO: 224151 - DNA, 25 bp, Rattus norvegicus
cacccacttttctaacgcttcagga

SEQ ID NO: 224152 - DNA, 25 bp, Rattus norvegicus
cacccagaatcacatgcacgagttt

SEQ ID NO: 224153 - DNA, 25 bp, Rattus norvegicus
cacccagaatcagatgcacgagttt

SEQ ID NO: 224154 - DNA, 25 bp, Rattus norvegicus
cacccagacagtagcattgccagaa

SEQ ID NO: 224155 - DNA, 25 bp, Rattus norvegicus
cacccagacagttgcattgccagaa

SEQ ID NO: 224156 - DNA, 25 bp, Rattus norvegicus
cacccagaggatcgccaggaagacg

SEQ ID NO: 224157 - DNA, 25 bp, Rattus norvegicus
cacccagaggatggccaggaagacg

SEQ ID NO: 224158 - DNA, 25 bp, Rattus norvegicus
cacccagatttgatgaggccccaaa

SEQ ID NO: 224159 - DNA, 25 bp, Rattus norvegicus
cacccagatttgttgaggccccaaa

SEQ ID NO: 224160 - DNA, 25 bp, Rattus norvegicus
cacccagcatataccaaggttctct

SEQ ID NO: 224161 - DNA, 25 bp, Rattus norvegicus
cacccagcatattccaaggttctct

SEQ ID NO: 224162 - DNA, 25 bp, Rattus norvegicus
cacccagcatgtcgacctcaaaaga

SEQ ID NO: 224163 - DNA, 25 bp, Rattus norvegicus
cacccagcatgtggacctcaaaaga

SEQ ID NO: 224164 - DNA, 25 bp, Rattus norvegicus
cacccagcattcacacgatgctttg

SEQ ID NO: 224165 - DNA, 25 bp, Rattus norvegicus
cacccagcattctcacgatgctttg

SEQ ID NO: 224166 - DNA, 25 bp, Rattus norvegicus
cacccagctgtacatgactccttag

SEQ ID NO: 224167 - DNA, 25 bp, Rattus norvegicus
cacccagctgtagatgactccttag

SEQ ID NO: 224168 - DNA, 25 bp, Rattus norvegicus
cacccagcttaaataattcttccta

SEQ ID NO: 224169 - DNA, 25 bp, Rattus norvegicus
cacccagcttaattaattcttccta

SEQ ID NO: 224170 - DNA, 25 bp, Rattus norvegicus
cacccaggagacatgattgaagtgt

SEQ ID NO: 224171 - DNA, 25 bp, Rattus norvegicus
cacccaggagacttgattgaagtgt

SEQ ID NO: 224172 - DNA, 25 bp, Rattus norvegicus
cacccaggaggccttgtagtgttac

SEQ ID NO: 224173 - DNA, 25 bp, Rattus norvegicus
cacccaggaggcgttgtagtgttac

SEQ ID NO: 224174 - DNA, 25 bp, Rattus norvegicus
cacccaggattcaattttttgccat

SEQ ID NO: 224175 - DNA, 25 bp, Rattus norvegicus
cacccaggattctattttttgccat

SEQ ID NO: 224176 - DNA, 25 bp, Rattus norvegicus
cacccaggcatgctagcagccagat

SEQ ID NO: 224177 - DNA, 25 bp, Rattus norvegicus
cacccaggcatggtagcagccagat

SEQ ID NO: 224178 - DNA, 25 bp, Rattus norvegicus
cacccaggcgcacatgtcagaagac

SEQ ID NO: 224179 - DNA, 25 bp, Rattus norvegicus
cacccaggcgcagatgtcagaagac

SEQ ID NO: 224180 - DNA, 25 bp, Rattus norvegicus
cacccaggctctagactgtgttaag

SEQ ID NO: 224181 - DNA, 25 bp, Rattus norvegicus
cacccaggctcttgactgtgttaag

SEQ ID NO: 224182 - DNA, 25 bp, Rattus norvegicus
cacccagggctgaaggaaggagact

SEQ ID NO: 224183 - DNA, 25 bp, Rattus norvegicus
cacccagggctgtaggaaggagact

SEQ ID NO: 224184 - DNA, 25 bp, Rattus norvegicus
cacccagggtccatgtgagtcacat

SEQ ID NO: 224185 - DNA, 25 bp, Rattus norvegicus
cacccagggtccttgtgagtcacat

SEQ ID NO: 224186 - DNA, 25 bp, Rattus norvegicus
cacccaggttatctctgttgtaaaa

SEQ ID NO: 224187 - DNA, 25 bp, Rattus norvegicus
cacccaggttatgtctgttgtaaaa

SEQ ID NO: 224188 - DNA, 25 bp, Rattus norvegicus
cacccagtcaggaggctgacagtca

SEQ ID NO: 224189 - DNA, 25 bp, Rattus norvegicus
cacccagtcaggtggctgacagtca

SEQ ID NO: 224190 - DNA, 25 bp, Rattus norvegicus
cacccagtcattatcctagggatgg

SEQ ID NO: 224191 - DNA, 25 bp, Rattus norvegicus
cacccagtcattttcctagggatgg

SEQ ID NO: 224192 - DNA, 25 bp, Rattus norvegicus
cacccagtctcaacagagggacagt

SEQ ID NO: 224193 - DNA, 25 bp, Rattus norvegicus
cacccagtctcatcagagggacagt

SEQ ID NO: 224194 - DNA, 25 bp, Rattus norvegicus
cacccatacacaaactacgataaag

SEQ ID NO: 224195 - DNA, 25 bp, Rattus norvegicus
cacccatacacatactacgataaag

SEQ ID NO: 224196 - DNA, 25 bp, Rattus norvegicus
cacccatacactataatccatcatg

SEQ ID NO: 224197 - DNA, 25 bp, Rattus norvegicus
cacccatacactttaatccatcatg

SEQ ID NO: 224198 - DNA, 25 bp, Rattus norvegicus
cacccatcctccaattgtgtttatt

SEQ ID NO: 224199 - DNA, 25 bp, Rattus norvegicus
cacccatcctcctattgtgtttatt

SEQ ID NO: 224200 - DNA, 25 bp, Rattus norvegicus
cacccatctcacagaatcttgaata

SEQ ID NO: 224201 - DNA, 25 bp, Rattus norvegicus
cacccatctcactgaatcttgaata

SEQ ID NO: 224202 - DNA, 25 bp, Rattus norvegicus
cacccatctggtcgcttgaagtttg

SEQ ID NO: 224203 - DNA, 25 bp, Rattus norvegicus
cacccatctggtctaaatgctatat

SEQ ID NO: 224204 - DNA, 25 bp, Rattus norvegicus
cacccatctggtggcttgaagtttg

SEQ ID NO: 224205 - DNA, 25 bp, Rattus norvegicus
cacccatctggtgtaaatgctatat

SEQ ID NO: 224206 - DNA, 25 bp, Rattus norvegicus
cacccatgagtaaagttgtaacagt

SEQ ID NO: 224207 - DNA, 25 bp, Rattus norvegicus
cacccatgagtatagttgtaacagt

SEQ ID NO: 224208 - DNA, 25 bp, Rattus norvegicus
cacccatgccgacaagttgacactt

SEQ ID NO: 224209 - DNA, 25 bp, Rattus norvegicus
cacccatgccgagaagttgacactt

SEQ ID NO: 224210 - DNA, 25 bp, Rattus norvegicus
cacccatgctcgcagactaaagaat

SEQ ID NO: 224211 - DNA, 25 bp, Rattus norvegicus
cacccatgctcggagactaaagaat

SEQ ID NO: 224212 - DNA, 25 bp, Rattus norvegicus
cacccatgctggcattttggaatgc

SEQ ID NO: 224213 - DNA, 25 bp, Rattus norvegicus
cacccatgctgggattttggaatgc

SEQ ID NO: 224214 - DNA, 25 bp, Rattus norvegicus
cacccatgtcacagaatcgtgaatt

SEQ ID NO: 224215 - DNA, 25 bp, Rattus norvegicus
cacccatgtcactgaatcgtgaatt

SEQ ID NO: 224216 - DNA, 25 bp, Rattus norvegicus
cacccatgtcttcatgcctttattt

SEQ ID NO: 224217 - DNA, 25 bp, Rattus norvegicus
cacccatgtcttgatgcctttattt

SEQ ID NO: 224218 - DNA, 25 bp, Rattus norvegicus
cacccatgtgggagtaggaccttgt

SEQ ID NO: 224219 - DNA, 25 bp, Rattus norvegicus
cacccatgtgggtgtaggaccttgt

SEQ ID NO: 224220 - DNA, 25 bp, Rattus norvegicus
cacccattccaaaatctaaccatgg

SEQ ID NO: 224221 - DNA, 25 bp, Rattus norvegicus
cacccattccaatatctaaccatgg

SEQ ID NO: 224222 - DNA, 25 bp, Rattus norvegicus
cacccattgcacagtctgtttgaaa

SEQ ID NO: 224223 - DNA, 25 bp, Rattus norvegicus
cacccattgcactgtctgtttgaaa

SEQ ID NO: 224224 - DNA, 25 bp, Rattus norvegicus
cacccattgggtcatgcagcttttt

SEQ ID NO: 224225 - DNA, 25 bp, Rattus norvegicus
cacccattgggtgatgcagcttttt

SEQ ID NO: 224226 - DNA, 25 bp, Rattus norvegicus
caccccaaaaaacctgaggacgaca

SEQ ID NO: 224227 - DNA, 25 bp, Rattus norvegicus
caccccaaaaaagctgaggacgaca

SEQ ID NO: 224228 - DNA, 25 bp, Rattus norvegicus
caccccaaatgtcttttctctttga

SEQ ID NO: 224229 - DNA, 25 bp, Rattus norvegicus
caccccaaatgtgttttctctttga

SEQ ID NO: 224230 - DNA, 25 bp, Rattus norvegicus
caccccacaagcactgaagaagtta

SEQ ID NO: 224231 - DNA, 25 bp, Rattus norvegicus
caccccacaagctctgaagaagtta

SEQ ID NO: 224232 - DNA, 25 bp, Rattus norvegicus
caccccacacatcagtgacatgttt

SEQ ID NO: 224233 - DNA, 25 bp, Rattus norvegicus
caccccacacatgagtgacatgttt

SEQ ID NO: 224234 - DNA, 25 bp, Rattus norvegicus
caccccaccaggaactgcttatagg

SEQ ID NO: 224235 - DNA, 25 bp, Rattus norvegicus
caccccaccaggtactgcttatagg

SEQ ID NO: 224236 - DNA, 25 bp, Rattus norvegicus
caccccacgggtaggacggagcact

SEQ ID NO: 224237 - DNA, 25 bp, Rattus norvegicus
caccccacgggttggacggagcact

SEQ ID NO: 224238 - DNA, 25 bp, Rattus norvegicus
caccccactgcaatacatttgtgtt

SEQ ID NO: 224239 - DNA, 25 bp, Rattus norvegicus
caccccactgcattacatttgtgtt

SEQ ID NO: 224240 - DNA, 25 bp, Rattus norvegicus
caccccagctctctggaggttggag

SEQ ID NO: 224241 - DNA, 25 bp, Rattus norvegicus
caccccagctctgtggaggttggag

SEQ ID NO: 224242 - DNA, 25 bp, Rattus norvegicus
caccccaggaccatgtggctaagag

SEQ ID NO: 224243 - DNA, 25 bp, Rattus norvegicus
caccccaggaccttgtggctaagag

SEQ ID NO: 224244 - DNA, 25 bp, Rattus norvegicus
caccccaggcacatgggctacaggg

SEQ ID NO: 224245 - DNA, 25 bp, Rattus norvegicus
caccccaggcacttgggctacaggg

SEQ ID NO: 224246 - DNA, 25 bp, Rattus norvegicus
caccccaggttaaacttcttcgaag

SEQ ID NO: 224247 - DNA, 25 bp, Rattus norvegicus
caccccaggttatacttcttcgaag

SEQ ID NO: 224248 - DNA, 25 bp, Rattus norvegicus
caccccagtcttatctctttgaaat

SEQ ID NO: 224249 - DNA, 25 bp, Rattus norvegicus
caccccagtcttttctctttgaaat

SEQ ID NO: 224250 - DNA, 25 bp, Rattus norvegicus
caccccatagcgactgacttttaag

SEQ ID NO: 224251 - DNA, 25 bp, Rattus norvegicus
caccccatagcgtctgacttttaag

SEQ ID NO: 224252 - DNA, 25 bp, Rattus norvegicus
caccccatcaagacagaagctgtgg

SEQ ID NO: 224253 - DNA, 25 bp, Rattus norvegicus
caccccatcaagtcagaagctgtgg

SEQ ID NO: 224254 - DNA, 25 bp, Rattus norvegicus
caccccatccagatctagggctgta

SEQ ID NO: 224255 - DNA, 25 bp, Rattus norvegicus
caccccatccagttctagggctgta

SEQ ID NO: 224256 - DNA, 25 bp, Rattus norvegicus
caccccatgtgcattttacaataaa

SEQ ID NO: 224257 - DNA, 25 bp, Rattus norvegicus
caccccatgtgctttttacaataaa

SEQ ID NO: 224258 - DNA, 25 bp, Rattus norvegicus
caccccattgtcaacttaactgagt

SEQ ID NO: 224259 - DNA, 25 bp, Rattus norvegicus
caccccattgtctacttaactgagt

SEQ ID NO: 224260 - DNA, 25 bp, Rattus norvegicus
caccccggttttcctacagaatcag

SEQ ID NO: 224261 - DNA, 25 bp, Rattus norvegicus
caccccggttttgctacagaatcag

SEQ ID NO: 224262 - DNA, 25 bp, Rattus norvegicus
caccccgtgcacataacataagcta

SEQ ID NO: 224263 - DNA, 25 bp, Rattus norvegicus
caccccgtgcacttaacataagcta

SEQ ID NO: 224264 - DNA, 25 bp, Rattus norvegicus
cacccctaactgaagagcttctggg

SEQ ID NO: 224265 - DNA, 25 bp, Rattus norvegicus
cacccctaactgtagagcttctggg

SEQ ID NO: 224266 - DNA, 25 bp, Rattus norvegicus
cacccctatgtccttggaatttcaa

SEQ ID NO: 224267 - DNA, 25 bp, Rattus norvegicus
cacccctatgtcgttggaatttcaa

SEQ ID NO: 224268 - DNA, 25 bp, Rattus norvegicus
cacccctcacacacgataagttagt

SEQ ID NO: 224269 - DNA, 25 bp, Rattus norvegicus
cacccctcacactcgataagttagt

SEQ ID NO: 224270 - DNA, 25 bp, Rattus norvegicus
cacccctcacggacgatgatgaaag

SEQ ID NO: 224271 - DNA, 25 bp, Rattus norvegicus
cacccctcacggtcgatgatgaaag

SEQ ID NO: 224272 - DNA, 25 bp, Rattus norvegicus
cacccctcctgacatggaatggact

SEQ ID NO: 224273 - DNA, 25 bp, Rattus norvegicus
cacccctcctgagatggaatggact

SEQ ID NO: 224274 - DNA, 25 bp, Rattus norvegicus
cacccctcctggaagcgatgagaaa

SEQ ID NO: 224275 - DNA, 25 bp, Rattus norvegicus
cacccctcctggtagcgatgagaaa

SEQ ID NO: 224276 - DNA, 25 bp, Rattus norvegicus
cacccctgaggaacactgtacaaat

SEQ ID NO: 224277 - DNA, 25 bp, Rattus norvegicus
cacccctgaggatcactgtacaaat

SEQ ID NO: 224278 - DNA, 25 bp, Rattus norvegicus
cacccctgctttcctggaatagaag

SEQ ID NO: 224279 - DNA, 25 bp, Rattus norvegicus
cacccctgctttcttaagtcttaag

SEQ ID NO: 224280 - DNA, 25 bp, Rattus norvegicus
cacccctgctttgctggaatagaag

SEQ ID NO: 224281 - DNA, 25 bp, Rattus norvegicus
cacccctgctttgttaagtcttaag

SEQ ID NO: 224282 - DNA, 25 bp, Rattus norvegicus
cacccctgggagctctttgtaaagt

SEQ ID NO: 224283 - DNA, 25 bp, Rattus norvegicus
cacccctgggaggtctttgtaaagt

SEQ ID NO: 224284 - DNA, 25 bp, Rattus norvegicus
cacccctgggtcattatgcatgaag

SEQ ID NO: 224285 - DNA, 25 bp, Rattus norvegicus
cacccctgggtctttatgcatgaag

SEQ ID NO: 224286 - DNA, 25 bp, Rattus norvegicus
cacccctggtgaatccttggtgatg

SEQ ID NO: 224287 - DNA, 25 bp, Rattus norvegicus
cacccctggtgattccttggtgatg

SEQ ID NO: 224288 - DNA, 25 bp, Rattus norvegicus
cacccctgtcttaacactgttggta

SEQ ID NO: 224289 - DNA, 25 bp, Rattus norvegicus
cacccctgtctttacactgttggta

SEQ ID NO: 224290 - DNA, 25 bp, Rattus norvegicus
cacccctgtgcaagccagaatggag

SEQ ID NO: 224291 - DNA, 25 bp, Rattus norvegicus
cacccctgtgcatgccagaatggag

SEQ ID NO: 224292 - DNA, 25 bp, Rattus norvegicus
caccccttcacaagttatgcagcag

SEQ ID NO: 224293 - DNA, 25 bp, Rattus norvegicus
caccccttcacatgttatgcagcag

SEQ ID NO: 224294 - DNA, 25 bp, Rattus norvegicus
caccccttcatcaaggagtaccagg

SEQ ID NO: 224295 - DNA, 25 bp, Rattus norvegicus
caccccttcatctaggagtaccagg

SEQ ID NO: 224296 - DNA, 25 bp, Rattus norvegicus
caccccttgctaaggtctgtgcttt

SEQ ID NO: 224297 - DNA, 25 bp, Rattus norvegicus
caccccttgctatggtctgtgcttt

SEQ ID NO: 224298 - DNA, 25 bp, Rattus norvegicus
caccccttggttacacaaatggtag

SEQ ID NO: 224299 - DNA, 25 bp, Rattus norvegicus
caccccttggtttcacaaatggtag

SEQ ID NO: 224300 - DNA, 25 bp, Rattus norvegicus
cacccctttccaaaatacgcaatag

SEQ ID NO: 224301 - DNA, 25 bp, Rattus norvegicus
cacccctttccataatacgcaatag

SEQ ID NO: 224302 - DNA, 25 bp, Rattus norvegicus
cacccgactctgacaggaagcaata

SEQ ID NO: 224303 - DNA, 25 bp, Rattus norvegicus
cacccgactctgtcaggaagcaata

SEQ ID NO: 224304 - DNA, 25 bp, Rattus norvegicus
cacccgactggtatgctgtatcaat

SEQ ID NO: 224305 - DNA, 25 bp, Rattus norvegicus
cacccgactggtttgctgtatcaat

SEQ ID NO: 224306 - DNA, 25 bp, Rattus norvegicus
cacccgcaactcactgaaattgaaa

SEQ ID NO: 224307 - DNA, 25 bp, Rattus norvegicus
cacccgcaactctctgaaattgaaa

SEQ ID NO: 224308 - DNA, 25 bp, Rattus norvegicus
cacccgctggaaaaagatcgttctt

SEQ ID NO: 224309 - DNA, 25 bp, Rattus norvegicus
cacccgctggaataagatcgttctt

SEQ ID NO: 224310 - DNA, 25 bp, Rattus norvegicus
cacccggcggccagcagtgagaaga

SEQ ID NO: 224311 - DNA, 25 bp, Rattus norvegicus
cacccggcggcctgcagtgagaaga

SEQ ID NO: 224312 - DNA, 25 bp, Rattus norvegicus
cacccggctcctataaaatacactg

SEQ ID NO: 224313 - DNA, 25 bp, Rattus norvegicus
cacccggctcctttaaaatacactg

SEQ ID NO: 224314 - DNA, 25 bp, Rattus norvegicus
cacccgggaaacaatttggctgcct

SEQ ID NO: 224315 - DNA, 25 bp, Rattus norvegicus
cacccgggaaactatttggctgcct

SEQ ID NO: 224316 - DNA, 25 bp, Rattus norvegicus
cacccggtggtgcattaggacatgt

SEQ ID NO: 224317 - DNA, 25 bp, Rattus norvegicus
cacccggtggtggattaggacatgt

SEQ ID NO: 224318 - DNA, 25 bp, Rattus norvegicus
cacccgtgctggaaggaaggagaca

SEQ ID NO: 224319 - DNA, 25 bp, Rattus norvegicus
cacccgtgctggtaggaaggagaca

SEQ ID NO: 224320 - DNA, 25 bp, Rattus norvegicus
cacccgtgggggactcaactggatc

SEQ ID NO: 224321 - DNA, 25 bp, Rattus norvegicus
cacccgtgggggtctcaactggatc

SEQ ID NO: 224322 - DNA, 25 bp, Rattus norvegicus
cacccgtgtctgagtgagttgtggt

SEQ ID NO: 224323 - DNA, 25 bp, Rattus norvegicus
cacccgtgtctgtgtgagttgtggt

SEQ ID NO: 224324 - DNA, 25 bp, Rattus norvegicus
cacccgttgctcatccgagtaaaga

SEQ ID NO: 224325 - DNA, 25 bp, Rattus norvegicus
cacccgttgctcttccgagtaaaga

SEQ ID NO: 224326 - DNA, 25 bp, Rattus norvegicus
caccctaactatcacttctgaggtt

SEQ ID NO: 224327 - DNA, 25 bp, Rattus norvegicus
caccctaactatgacttctgaggtt

SEQ ID NO: 224328 - DNA, 25 bp, Rattus norvegicus
caccctaactgccagtctgggaagt

SEQ ID NO: 224329 - DNA, 25 bp, Rattus norvegicus
caccctaactgcgagtctgggaagt

SEQ ID NO: 224330 - DNA, 25 bp, Rattus norvegicus
caccctacatcaaagctgctgtgca

SEQ ID NO: 224331 - DNA, 25 bp, Rattus norvegicus
caccctacatcatagctgctgtgca

SEQ ID NO: 224332 - DNA, 25 bp, Rattus norvegicus
caccctacatctccactgagtgtgg

SEQ ID NO: 224333 - DNA, 25 bp, Rattus norvegicus
caccctacatctgcactgagtgtgg

SEQ ID NO: 224334 - DNA, 25 bp, Rattus norvegicus
caccctagcctaccaggttgtgagt

SEQ ID NO: 224335 - DNA, 25 bp, Rattus norvegicus
caccctagcctagcaggttgtgagt

SEQ ID NO: 224336 - DNA, 25 bp, Rattus norvegicus
caccctagggtcatgagttcgacat

SEQ ID NO: 224337 - DNA, 25 bp, Rattus norvegicus
caccctagggtcttgagttcgacat

SEQ ID NO: 224338 - DNA, 25 bp, Rattus norvegicus
caccctcacggacctagcatatgat

SEQ ID NO: 224339 - DNA, 25 bp, Rattus norvegicus
caccctcacggagctagcatatgat

SEQ ID NO: 224340 - DNA, 25 bp, Rattus norvegicus
caccctcagcttagaaaccagcttt

SEQ ID NO: 224341 - DNA, 25 bp, Rattus norvegicus
caccctcagctttgaaaccagcttt

SEQ ID NO: 224342 - DNA, 25 bp, Rattus norvegicus
caccctcagggtctgcatgattgag

SEQ ID NO: 224343 - DNA, 25 bp, Rattus norvegicus
caccctcagggtgtgcatgattgag

SEQ ID NO: 224344 - DNA, 25 bp, Rattus norvegicus
caccctcatagccactaacagtgaa

SEQ ID NO: 224345 - DNA, 25 bp, Rattus norvegicus
caccctcatagcgactaacagtgaa

SEQ ID NO: 224346 - DNA, 25 bp, Rattus norvegicus
caccctcattgaaaacttagccctg

SEQ ID NO: 224347 - DNA, 25 bp, Rattus norvegicus
caccctcattgataacttagccctg

SEQ ID NO: 224348 - DNA, 25 bp, Rattus norvegicus
caccctccaaagctgtttagatgac

SEQ ID NO: 224349 - DNA, 25 bp, Rattus norvegicus
caccctccaaaggtgtttagatgac

SEQ ID NO: 224350 - DNA, 25 bp, Rattus norvegicus
caccctccctcaaagtttcattgaa

SEQ ID NO: 224351 - DNA, 25 bp, Rattus norvegicus
caccctccctcatagtttcattgaa

SEQ ID NO: 224352 - DNA, 25 bp, Rattus norvegicus
caccctccgtttagtacagatgagc

SEQ ID NO: 224353 - DNA, 25 bp, Rattus norvegicus
caccctccgttttgtacagatgagc

SEQ ID NO: 224354 - DNA, 25 bp, Rattus norvegicus
caccctcctagaagatgcctgaaag

SEQ ID NO: 224355 - DNA, 25 bp, Rattus norvegicus
caccctcctagatgatgcctgaaag

SEQ ID NO: 224356 - DNA, 25 bp, Rattus norvegicus
caccctcctcatatctcaataaaaa

SEQ ID NO: 224357 - DNA, 25 bp, Rattus norvegicus
caccctcctcatttctcaataaaaa

SEQ ID NO: 224358 - DNA, 25 bp, Rattus norvegicus
caccctcctttaaccatgtttataa

SEQ ID NO: 224359 - DNA, 25 bp, Rattus norvegicus
caccctcctttatccatgtttataa

SEQ ID NO: 224360 - DNA, 25 bp, Rattus norvegicus
caccctcgattcaatccacattgta

SEQ ID NO: 224361 - DNA, 25 bp, Rattus norvegicus
caccctcgattctatccacattgta

SEQ ID NO: 224362 - DNA, 25 bp, Rattus norvegicus
caccctctatgaaggacttacttct

SEQ ID NO: 224363 - DNA, 25 bp, Rattus norvegicus
caccctctatgatggacttacttct

SEQ ID NO: 224364 - DNA, 25 bp, Rattus norvegicus
caccctctggtgcaggtgctaacta

SEQ ID NO: 224365 - DNA, 25 bp, Rattus norvegicus
caccctctggtggaggtgctaacta

SEQ ID NO: 224366 - DNA, 25 bp, Rattus norvegicus
caccctgaccaaccaaaagctgaat

SEQ ID NO: 224367 - DNA, 25 bp, Rattus norvegicus
caccctgaccaagcaaaagctgaat

SEQ ID NO: 224368 - DNA, 25 bp, Rattus norvegicus
caccctgactgcatatggagccata

SEQ ID NO: 224369 - DNA, 25 bp, Rattus norvegicus
caccctgactgcttatggagccata

SEQ ID NO: 224370 - DNA, 25 bp, Rattus norvegicus
caccctgcctataatcctgataaac

SEQ ID NO: 224371 - DNA, 25 bp, Rattus norvegicus
caccctgcctattatcctgataaac

SEQ ID NO: 224372 - DNA, 25 bp, Rattus norvegicus
caccctgcgtttacaatcagtgttt

SEQ ID NO: 224373 - DNA, 25 bp, Rattus norvegicus
caccctgcgttttcaatcagtgttt

SEQ ID NO: 224374 - DNA, 25 bp, Rattus norvegicus
caccctgctccacagtgagtgaaga

SEQ ID NO: 224375 - DNA, 25 bp, Rattus norvegicus
caccctgctccagagtgagtgaaga

SEQ ID NO: 224376 - DNA, 25 bp, Rattus norvegicus
caccctgctttaattttggcctgtt

SEQ ID NO: 224377 - DNA, 25 bp, Rattus norvegicus
caccctgctttatttttggcctgtt

SEQ ID NO: 224378 - DNA, 25 bp, Rattus norvegicus
caccctggctggagtgctggctgat

SEQ ID NO: 224379 - DNA, 25 bp, Rattus norvegicus
caccctggctggtgtgctggctgat

SEQ ID NO: 224380 - DNA, 25 bp, Rattus norvegicus
caccctggcttgaacaactcagata

SEQ ID NO: 224381 - DNA, 25 bp, Rattus norvegicus
caccctggcttgtacaactcagata

SEQ ID NO: 224382 - DNA, 25 bp, Rattus norvegicus
caccctgggatgctttttgtcaata

SEQ ID NO: 224383 - DNA, 25 bp, Rattus norvegicus
caccctgggatggtttttgtcaata

SEQ ID NO: 224384 - DNA, 25 bp, Rattus norvegicus
caccctgggccacgaagtctggaaa

SEQ ID NO: 224385 - DNA, 25 bp, Rattus norvegicus
caccctgggccaggaagtctggaaa

SEQ ID NO: 224386 - DNA, 25 bp, Rattus norvegicus
caccctgtcttgctgtgaaggaggt

SEQ ID NO: 224387 - DNA, 25 bp, Rattus norvegicus
caccctgtcttggtgtgaaggaggt

SEQ ID NO: 224388 - DNA, 25 bp, Rattus norvegicus
caccctgtgagtcgacatactgtac

SEQ ID NO: 224389 - DNA, 25 bp, Rattus norvegicus
caccctgtgagtggacatactgtac

SEQ ID NO: 224390 - DNA, 25 bp, Rattus norvegicus
caccctgtgtgccatgtttgtgaca

SEQ ID NO: 224391 - DNA, 25 bp, Rattus norvegicus
caccctgtgtgcgatgtttgtgaca

SEQ ID NO: 224392 - DNA, 25 bp, Rattus norvegicus
caccctgtgttaaaactgtagttct

SEQ ID NO: 224393 - DNA, 25 bp, Rattus norvegicus
caccctgtgttataactgtagttct

SEQ ID NO: 224394 - DNA, 25 bp, Rattus norvegicus
caccctgttacacggcgccttaagt

SEQ ID NO: 224395 - DNA, 25 bp, Rattus norvegicus
caccctgttacagggcgccttaagt

SEQ ID NO: 224396 - DNA, 25 bp, Rattus norvegicus
caccctgttactcttaatgtccttc

SEQ ID NO: 224397 - DNA, 25 bp, Rattus norvegicus
caccctgttactgttaatgtccttc

SEQ ID NO: 224398 - DNA, 25 bp, Rattus norvegicus
caccctgttcgtatcaaataggtct

SEQ ID NO: 224399 - DNA, 25 bp, Rattus norvegicus
caccctgttcgtttcaaataggtct

SEQ ID NO: 224400 - DNA, 25 bp, Rattus norvegicus
caccctgttggtcattggattccta

SEQ ID NO: 224401 - DNA, 25 bp, Rattus norvegicus
caccctgttggtgattggattccta

SEQ ID NO: 224402 - DNA, 25 bp, Rattus norvegicus
cacccttaaatgcagctgtagctag

SEQ ID NO: 224403 - DNA, 25 bp, Rattus norvegicus
cacccttaaatggagctgtagctag

SEQ ID NO: 224404 - DNA, 25 bp, Rattus norvegicus
cacccttagggcacggtacagattt

SEQ ID NO: 224405 - DNA, 25 bp, Rattus norvegicus
cacccttagggctcggtacagattt

SEQ ID NO: 224406 - DNA, 25 bp, Rattus norvegicus
cacccttcaggcatgaggaaaccaa

SEQ ID NO: 224407 - DNA, 25 bp, Rattus norvegicus
cacccttcaggcttgaggaaaccaa

SEQ ID NO: 224408 - DNA, 25 bp, Rattus norvegicus
cacccttcctttactcaatgacatt

SEQ ID NO: 224409 - DNA, 25 bp, Rattus norvegicus
cacccttccttttctcaatgacatt

SEQ ID NO: 224410 - DNA, 25 bp, Rattus norvegicus
cacccttgacagctggtcctgagtg

SEQ ID NO: 224411 - DNA, 25 bp, Rattus norvegicus
cacccttgacaggtggtcctgagtg

SEQ ID NO: 224412 - DNA, 25 bp, Rattus norvegicus
cacccttgctgtcgcattttgtgga

SEQ ID NO: 224413 - DNA, 25 bp, Rattus norvegicus
cacccttgctgtggcattttgtgga

SEQ ID NO: 224414 - DNA, 25 bp, Rattus norvegicus
cacccttgtcagcattgatggtcaa

SEQ ID NO: 224415 - DNA, 25 bp, Rattus norvegicus
cacccttgtcaggattgatggtcaa

SEQ ID NO: 224416 - DNA, 25 bp, Rattus norvegicus
cacccttgttctccattaagctttt

SEQ ID NO: 224417 - DNA, 25 bp, Rattus norvegicus
cacccttgttctgcattaagctttt

SEQ ID NO: 224418 - DNA, 25 bp, Rattus norvegicus
caccctttacttctttccctgagag

SEQ ID NO: 224419 - DNA, 25 bp, Rattus norvegicus
caccctttacttgtttccctgagag

SEQ ID NO: 224420 - DNA, 25 bp, Rattus norvegicus
caccctttagatcttgatttcttgg

SEQ ID NO: 224421 - DNA, 25 bp, Rattus norvegicus
caccctttagatgttgatttcttgg

SEQ ID NO: 224422 - DNA, 25 bp, Rattus norvegicus
caccctttctcacggactttctgag

SEQ ID NO: 224423 - DNA, 25 bp, Rattus norvegicus
caccctttctcagggactttctgag

SEQ ID NO: 224424 - DNA, 25 bp, Rattus norvegicus
caccctttctccaggaagttgacaa

SEQ ID NO: 224425 - DNA, 25 bp, Rattus norvegicus
caccctttctcctggaagttgacaa

SEQ ID NO: 224426 - DNA, 25 bp, Rattus norvegicus
caccctttctttactcagtagtgct

SEQ ID NO: 224427 - DNA, 25 bp, Rattus norvegicus
caccctttcttttctcagtagtgct

SEQ ID NO: 224428 - DNA, 25 bp, Rattus norvegicus
caccctttgccacttgaaacttact

SEQ ID NO: 224429 - DNA, 25 bp, Rattus norvegicus
caccctttgccagttgaaacttact

SEQ ID NO: 224430 - DNA, 25 bp, Rattus norvegicus
caccctttgcgtaactgcgtgggaa

SEQ ID NO: 224431 - DNA, 25 bp, Rattus norvegicus
caccctttgcgttactgcgtgggaa

SEQ ID NO: 224432 - DNA, 25 bp, Rattus norvegicus
caccctttgtgcacataattctctg

SEQ ID NO: 224433 - DNA, 25 bp, Rattus norvegicus
caccctttgtgctcataattctctg

SEQ ID NO: 224434 - DNA, 25 bp, Rattus norvegicus
caccctttttctactgatcagtttt

SEQ ID NO: 224435 - DNA, 25 bp, Rattus norvegicus
caccctttttcttctgatcagtttt

SEQ ID NO: 224436 - DNA, 25 bp, Rattus norvegicus
caccgaaagagaccgcctatctcat

SEQ ID NO: 224437 - DNA, 25 bp, Rattus norvegicus
caccgaaagagagcgcctatctcat

SEQ ID NO: 224438 - DNA, 25 bp, Rattus norvegicus
caccgaaaggatcagcgttggagct

SEQ ID NO: 224439 - DNA, 25 bp, Rattus norvegicus
caccgaaaggatgagcgttggagct

SEQ ID NO: 224440 - DNA, 25 bp, Rattus norvegicus
caccgaccatccatccaaggaaata

SEQ ID NO: 224441 - DNA, 25 bp, Rattus norvegicus
caccgaccatccttccaaggaaata

SEQ ID NO: 224442 - DNA, 25 bp, Rattus norvegicus
caccgacgggctaattgacgtcata

SEQ ID NO: 224443 - DNA, 25 bp, Rattus norvegicus
caccgacgggcttattgacgtcata

SEQ ID NO: 224444 - DNA, 25 bp, Rattus norvegicus
caccgactactgaatgatgccaaag

SEQ ID NO: 224445 - DNA, 25 bp, Rattus norvegicus
caccgactactgtatgatgccaaag

SEQ ID NO: 224446 - DNA, 25 bp, Rattus norvegicus
caccgactccaacatggaaacctat

SEQ ID NO: 224447 - DNA, 25 bp, Rattus norvegicus
caccgactccaagatggaaacctat

SEQ ID NO: 224448 - DNA, 25 bp, Rattus norvegicus
caccgactgagcattgccctgggaa

SEQ ID NO: 224449 - DNA, 25 bp, Rattus norvegicus
caccgactgagctttgccctgggaa

SEQ ID NO: 224450 - DNA, 25 bp, Rattus norvegicus
caccgactgttgactgctctaagaa

SEQ ID NO: 224451 - DNA, 25 bp, Rattus norvegicus
caccgactgttgtctgctctaagaa

SEQ ID NO: 224452 - DNA, 25 bp, Rattus norvegicus
caccgacttgaaattgtttacccag

SEQ ID NO: 224453 - DNA, 25 bp, Rattus norvegicus
caccgacttgaatttgtttacccag

SEQ ID NO: 224454 - DNA, 25 bp, Rattus norvegicus
caccgagaacgaagcaagcctgttt

SEQ ID NO: 224455 - DNA, 25 bp, Rattus norvegicus
caccgagaacgatgcaagcctgttt

SEQ ID NO: 224456 - DNA, 25 bp, Rattus norvegicus
caccgagacacaatgctggcagctg

SEQ ID NO: 224457 - DNA, 25 bp, Rattus norvegicus
caccgagacacattgctggcagctg

SEQ ID NO: 224458 - DNA, 25 bp, Rattus norvegicus
caccgagagtgaagaccagccagtc

SEQ ID NO: 224459 - DNA, 25 bp, Rattus norvegicus
caccgagagtgatgaccagccagtc

SEQ ID NO: 224460 - DNA, 25 bp, Rattus norvegicus
caccgagataaaagttttcctgcct

SEQ ID NO: 224461 - DNA, 25 bp, Rattus norvegicus
caccgagataaatgttttcctgcct

SEQ ID NO: 224462 - DNA, 25 bp, Rattus norvegicus
caccgaggaataatccactgggttc

SEQ ID NO: 224463 - DNA, 25 bp, Rattus norvegicus
caccgaggaatattccactgggttc

SEQ ID NO: 224464 - DNA, 25 bp, Rattus norvegicus
caccgaggagtcatttttagctttg

SEQ ID NO: 224465 - DNA, 25 bp, Rattus norvegicus
caccgaggagtcttttttagctttg

SEQ ID NO: 224466 - DNA, 25 bp, Rattus norvegicus
caccgaggcaggaccagataccgaa

SEQ ID NO: 224467 - DNA, 25 bp, Rattus norvegicus
caccgaggcaggtccagataccgaa

SEQ ID NO: 224468 - DNA, 25 bp, Rattus norvegicus
caccgaggcctcatttaagctactg

SEQ ID NO: 224469 - DNA, 25 bp, Rattus norvegicus
caccgaggcctcttttaagctactg

SEQ ID NO: 224470 - DNA, 25 bp, Rattus norvegicus
caccgagggagacactagttggcaa

SEQ ID NO: 224471 - DNA, 25 bp, Rattus norvegicus
caccgagggagagactagttggcaa

SEQ ID NO: 224472 - DNA, 25 bp, Rattus norvegicus
caccgagggaggcatgtctccagaa

SEQ ID NO: 224473 - DNA, 25 bp, Rattus norvegicus
caccgagggagggatgtctccagaa

SEQ ID NO: 224474 - DNA, 25 bp, Rattus norvegicus
caccgaggtgatcatgccagccaac

SEQ ID NO: 224475 - DNA, 25 bp, Rattus norvegicus
caccgaggtgatgatgccagccaac

SEQ ID NO: 224476 - DNA, 25 bp, Rattus norvegicus
caccgagtgggcacacgtgtccttc

SEQ ID NO: 224477 - DNA, 25 bp, Rattus norvegicus
caccgagtgggctcacgtgtccttc

SEQ ID NO: 224478 - DNA, 25 bp, Rattus norvegicus
caccgatcagatagtctggagggaa

SEQ ID NO: 224479 - DNA, 25 bp, Rattus norvegicus
caccgatcagattgtctggagggaa

SEQ ID NO: 224480 - DNA, 25 bp, Rattus norvegicus
caccgatgctccagttgcaaccagg

SEQ ID NO: 224481 - DNA, 25 bp, Rattus norvegicus
caccgatgctcctgttgcaaccagg

SEQ ID NO: 224482 - DNA, 25 bp, Rattus norvegicus
caccgattcttcatttctttgataa

SEQ ID NO: 224483 - DNA, 25 bp, Rattus norvegicus
caccgattcttcttttctttgataa

SEQ ID NO: 224484 - DNA, 25 bp, Rattus norvegicus
caccgcaacggtctgtgtgctcttg

SEQ ID NO: 224485 - DNA, 25 bp, Rattus norvegicus
caccgcaacggtgtgtgtgctcttg

SEQ ID NO: 224486 - DNA, 25 bp, Rattus norvegicus
caccgcactggtaagaacggagtct

SEQ ID NO: 224487 - DNA, 25 bp, Rattus norvegicus
caccgcactggttagaacggagtct

SEQ ID NO: 224488 - DNA, 25 bp, Rattus norvegicus
caccgcagaacccatacgggaggga

SEQ ID NO: 224489 - DNA, 25 bp, Rattus norvegicus
caccgcagaaccgatacgggaggga

SEQ ID NO: 224490 - DNA, 25 bp, Rattus norvegicus
caccgcagaggtacttgagttggca

SEQ ID NO: 224491 - DNA, 25 bp, Rattus norvegicus
caccgcagaggttcttgagttggca

SEQ ID NO: 224492 - DNA, 25 bp, Rattus norvegicus
caccgcaggtgtagagaaggcactt

SEQ ID NO: 224493 - DNA, 25 bp, Rattus norvegicus
caccgcaggtgttgagaaggcactt

SEQ ID NO: 224494 - DNA, 25 bp, Rattus norvegicus
caccgccaacccatatgttattgag

SEQ ID NO: 224495 - DNA, 25 bp, Rattus norvegicus
caccgccaacccttatgttattgag

SEQ ID NO: 224496 - DNA, 25 bp, Rattus norvegicus
caccgccaagagctcactcaggaag

SEQ ID NO: 224497 - DNA, 25 bp, Rattus norvegicus
caccgccaagaggtcactcaggaag

SEQ ID NO: 224498 - DNA, 25 bp, Rattus norvegicus
caccgccatggacgtggtctacgca

SEQ ID NO: 224499 - DNA, 25 bp, Rattus norvegicus
caccgccatggaggtggtctacgca

SEQ ID NO: 224500 - DNA, 25 bp, Rattus norvegicus
caccgccctggtatggagagagatt

SEQ ID NO: 224501 - DNA, 25 bp, Rattus norvegicus
caccgccctggtttggagagagatt

SEQ ID NO: 224502 - DNA, 25 bp, Rattus norvegicus
caccgcctgaagaacttgccggata

SEQ ID NO: 224503 - DNA, 25 bp, Rattus norvegicus
caccgcctgaagtacttgccggata

SEQ ID NO: 224504 - DNA, 25 bp, Rattus norvegicus
caccgcctgcttcgaaaggaaacta

SEQ ID NO: 224505 - DNA, 25 bp, Rattus norvegicus
caccgcctgcttggaaaggaaacta

SEQ ID NO: 224506 - DNA, 25 bp, Rattus norvegicus
caccgcggacttatttcttctcaga

SEQ ID NO: 224507 - DNA, 25 bp, Rattus norvegicus
caccgcggacttttttcttctcaga

SEQ ID NO: 224508 - DNA, 25 bp, Rattus norvegicus
caccgcgtgggtactggcagtcaaa

SEQ ID NO: 224509 - DNA, 25 bp, Rattus norvegicus
caccgcgtgggttctggcagtcaaa

SEQ ID NO: 224510 - DNA, 25 bp, Rattus norvegicus
caccgctgctttcactctaatttat

SEQ ID NO: 224511 - DNA, 25 bp, Rattus norvegicus
caccgctgctttgactctaatttat

SEQ ID NO: 224512 - DNA, 25 bp, Rattus norvegicus
caccgctgtaacctggacatgggca

SEQ ID NO: 224513 - DNA, 25 bp, Rattus norvegicus
caccgctgtaacgtggacatgggca

SEQ ID NO: 224514 - DNA, 25 bp, Rattus norvegicus
caccgctgtgtgcaaatgtactgaa

SEQ ID NO: 224515 - DNA, 25 bp, Rattus norvegicus
caccgctgtgtggaaatgtactgaa

SEQ ID NO: 224516 - DNA, 25 bp, Rattus norvegicus
caccgcttagtcaaatggaggcagt

SEQ ID NO: 224517 - DNA, 25 bp, Rattus norvegicus
caccgcttagtctaatggaggcagt

SEQ ID NO: 224518 - DNA, 25 bp, Rattus norvegicus
caccggaaggcgacagggatcccaa

SEQ ID NO: 224519 - DNA, 25 bp, Rattus norvegicus
caccggaaggcgtcagggatcccaa

SEQ ID NO: 224520 - DNA, 25 bp, Rattus norvegicus
caccggacagcgcaccagtgaagaa

SEQ ID NO: 224521 - DNA, 25 bp, Rattus norvegicus
caccggacagcggaccagtgaagaa

SEQ ID NO: 224522 - DNA, 25 bp, Rattus norvegicus
caccggacctttccaatgttgagac

SEQ ID NO: 224523 - DNA, 25 bp, Rattus norvegicus
caccggacctttgcaatgttgagac

SEQ ID NO: 224524 - DNA, 25 bp, Rattus norvegicus
caccggagtcccacgggaaggcaag

SEQ ID NO: 224525 - DNA, 25 bp, Rattus norvegicus
caccggagtccctcgggaaggcaag

SEQ ID NO: 224526 - DNA, 25 bp, Rattus norvegicus
caccggcagcatcgttttgtaacag

SEQ ID NO: 224527 - DNA, 25 bp, Rattus norvegicus
caccggcagcatggttttgtaacag

SEQ ID NO: 224528 - DNA, 25 bp, Rattus norvegicus
caccggcagggcagagtgtgctcca

SEQ ID NO: 224529 - DNA, 25 bp, Rattus norvegicus
caccggcagggctgagtgtgctcca

SEQ ID NO: 224530 - DNA, 25 bp, Rattus norvegicus
caccggcgtcttacagactgtggag

SEQ ID NO: 224531 - DNA, 25 bp, Rattus norvegicus
caccggcgtctttcagactgtggag

SEQ ID NO: 224532 - DNA, 25 bp, Rattus norvegicus
caccggcttattcggattctttaat

SEQ ID NO: 224533 - DNA, 25 bp, Rattus norvegicus
caccggcttattgggattctttaat

SEQ ID NO: 224534 - DNA, 25 bp, Rattus norvegicus
caccgggaacacagctgcacaatat

SEQ ID NO: 224535 - DNA, 25 bp, Rattus norvegicus
caccgggaacactgctgcacaatat

SEQ ID NO: 224536 - DNA, 25 bp, Rattus norvegicus
caccgggatgcgagtgtagccacta

SEQ ID NO: 224537 - DNA, 25 bp, Rattus norvegicus
caccgggatgcgtgtgtagccacta

SEQ ID NO: 224538 - DNA, 25 bp, Rattus norvegicus
caccgggcactcactgtatttgttt

SEQ ID NO: 224539 - DNA, 25 bp, Rattus norvegicus
caccgggcactctctgtatttgttt

SEQ ID NO: 224540 - DNA, 25 bp, Rattus norvegicus
caccgggcggaacactgttaccaag

SEQ ID NO: 224541 - DNA, 25 bp, Rattus norvegicus
caccgggcggaagactgttaccaag

SEQ ID NO: 224542 - DNA, 25 bp, Rattus norvegicus
caccgggtcctactacaatttccat

SEQ ID NO: 224543 - DNA, 25 bp, Rattus norvegicus
caccgggtcctagtacaatttccat

SEQ ID NO: 224544 - DNA, 25 bp, Rattus norvegicus
caccggtattacaatccacactttt

SEQ ID NO: 224545 - DNA, 25 bp, Rattus norvegicus
caccggtattactatccacactttt

SEQ ID NO: 224546 - DNA, 25 bp, Rattus norvegicus
caccggtgtgacagctgcagtgtgt

SEQ ID NO: 224547 - DNA, 25 bp, Rattus norvegicus
caccggtgtgactgctgcagtgtgt

SEQ ID NO: 224548 - DNA, 25 bp, Rattus norvegicus
caccggttctttcgtcttgataatg

SEQ ID NO: 224549 - DNA, 25 bp, Rattus norvegicus
caccggttctttggtcttgataatg

SEQ ID NO: 224550 - DNA, 25 bp, Rattus norvegicus
caccgtagaactaccatctggacag

SEQ ID NO: 224551 - DNA, 25 bp, Rattus norvegicus
caccgtagaacttccatctggacag

SEQ ID NO: 224552 - DNA, 25 bp, Rattus norvegicus
caccgtaggtgtaagaattgaattc

SEQ ID NO: 224553 - DNA, 25 bp, Rattus norvegicus
caccgtaggtgttagaattgaattc

SEQ ID NO: 224554 - DNA, 25 bp, Rattus norvegicus
caccgtatttatatgggcctgacta

SEQ ID NO: 224555 - DNA, 25 bp, Rattus norvegicus
caccgtatttatttgggcctgacta

SEQ ID NO: 224556 - DNA, 25 bp, Rattus norvegicus
caccgtcacttccttgggagagaaa

SEQ ID NO: 224557 - DNA, 25 bp, Rattus norvegicus
caccgtcacttcgttgggagagaaa

SEQ ID NO: 224558 - DNA, 25 bp, Rattus norvegicus
caccgtctataacgccatggctatt

SEQ ID NO: 224559 - DNA, 25 bp, Rattus norvegicus
caccgtctataaggccatggctatt

SEQ ID NO: 224560 - DNA, 25 bp, Rattus norvegicus
caccgtctcatcctatactttcaaa

SEQ ID NO: 224561 - DNA, 25 bp, Rattus norvegicus
caccgtctcatcgtatactttcaaa

SEQ ID NO: 224562 - DNA, 25 bp, Rattus norvegicus
caccgtctgcttaacaagggcaact

SEQ ID NO: 224563 - DNA, 25 bp, Rattus norvegicus
caccgtctgctttacaagggcaact

SEQ ID NO: 224564 - DNA, 25 bp, Rattus norvegicus
caccgtctggttcaaggacacctaa

SEQ ID NO: 224565 - DNA, 25 bp, Rattus norvegicus
caccgtctggttgaaggacacctaa

SEQ ID NO: 224566 - DNA, 25 bp, Rattus norvegicus
caccgtctgtctctatagcatggat

SEQ ID NO: 224567 - DNA, 25 bp, Rattus norvegicus
caccgtctgtctgtatagcatggat

SEQ ID NO: 224568 - DNA, 25 bp, Rattus norvegicus
caccgtgaaggtatggacatgctaa

SEQ ID NO: 224569 - DNA, 25 bp, Rattus norvegicus
caccgtgaaggtttggacatgctaa

SEQ ID NO: 224570 - DNA, 25 bp, Rattus norvegicus
caccgtgagcaaacccagtatttac

SEQ ID NO: 224571 - DNA, 25 bp, Rattus norvegicus
caccgtgagcaatcccagtatttac

SEQ ID NO: 224572 - DNA, 25 bp, Rattus norvegicus
caccgtgcaaggactcagtggttca

SEQ ID NO: 224573 - DNA, 25 bp, Rattus norvegicus
caccgtgcaaggtctcagtggttca

SEQ ID NO: 224574 - DNA, 25 bp, Rattus norvegicus
caccgtgcgcagagtggtcttgaga

SEQ ID NO: 224575 - DNA, 25 bp, Rattus norvegicus
caccgtgcgcagtgtggtcttgaga

SEQ ID NO: 224576 - DNA, 25 bp, Rattus norvegicus
caccgtgcggataccagggactgaa

SEQ ID NO: 224577 - DNA, 25 bp, Rattus norvegicus
caccgtgcggattccagggactgaa

SEQ ID NO: 224578 - DNA, 25 bp, Rattus norvegicus
caccgtgctgccataattgaataca

SEQ ID NO: 224579 - DNA, 25 bp, Rattus norvegicus
caccgtgctgccttaattgaataca

SEQ ID NO: 224580 - DNA, 25 bp, Rattus norvegicus
caccgtgctgtgaatgtctgcttca

SEQ ID NO: 224581 - DNA, 25 bp, Rattus norvegicus
caccgtgctgtgtatgtctgcttca

SEQ ID NO: 224582 - DNA, 25 bp, Rattus norvegicus
caccgtggaaatcagagtgggcacc

SEQ ID NO: 224583 - DNA, 25 bp, Rattus norvegicus
caccgtggaaatgagagtgggcacc

SEQ ID NO: 224584 - DNA, 25 bp, Rattus norvegicus
caccgtggagaactgccgtgcacag

SEQ ID NO: 224585 - DNA, 25 bp, Rattus norvegicus
caccgtggagaagtgccgtgcacag

SEQ ID NO: 224586 - DNA, 25 bp, Rattus norvegicus
caccgtggcatcagcctttgaaaaa

SEQ ID NO: 224587 - DNA, 25 bp, Rattus norvegicus
caccgtggcatctgcctttgaaaaa

SEQ ID NO: 224588 - DNA, 25 bp, Rattus norvegicus
caccgtgggatgacagcagccataa

SEQ ID NO: 224589 - DNA, 25 bp, Rattus norvegicus
caccgtgggatgtcagcagccataa

SEQ ID NO: 224590 - DNA, 25 bp, Rattus norvegicus
caccgtggtggtcacaaggcccaca

SEQ ID NO: 224591 - DNA, 25 bp, Rattus norvegicus
caccgtggtggtgacaaggcccaca

SEQ ID NO: 224592 - DNA, 25 bp, Rattus norvegicus
caccgtggtgtgattctgagcaggc

SEQ ID NO: 224593 - DNA, 25 bp, Rattus norvegicus
caccgtggtgtgcatatgacagtaa

SEQ ID NO: 224594 - DNA, 25 bp, Rattus norvegicus
caccgtggtgtggatatgacagtaa

SEQ ID NO: 224595 - DNA, 25 bp, Rattus norvegicus
caccgtggtgtgtttctgagcaggc

SEQ ID NO: 224596 - DNA, 25 bp, Rattus norvegicus
caccgtgtacttcagctccatagta

SEQ ID NO: 224597 - DNA, 25 bp, Rattus norvegicus
caccgtgtacttgagctccatagta

SEQ ID NO: 224598 - DNA, 25 bp, Rattus norvegicus
caccgtgtccagaattttacccaga

SEQ ID NO: 224599 - DNA, 25 bp, Rattus norvegicus
caccgtgtccagtattttacccaga

SEQ ID NO: 224600 - DNA, 25 bp, Rattus norvegicus
caccgtgtgcatacctagtgcacaa

SEQ ID NO: 224601 - DNA, 25 bp, Rattus norvegicus
caccgtgtgcattcctagtgcacaa

SEQ ID NO: 224602 - DNA, 25 bp, Rattus norvegicus
caccgtgtggacagcgaaggcccaa

SEQ ID NO: 224603 - DNA, 25 bp, Rattus norvegicus
caccgtgtggactgcgaaggcccaa

SEQ ID NO: 224604 - DNA, 25 bp, Rattus norvegicus
caccgttcaaacaacttgctgctaa

SEQ ID NO: 224605 - DNA, 25 bp, Rattus norvegicus
caccgttcaaactacttgctgctaa

SEQ ID NO: 224606 - DNA, 25 bp, Rattus norvegicus
caccgttcacgtcgacattagaaga

SEQ ID NO: 224607 - DNA, 25 bp, Rattus norvegicus
caccgttcacgtcgagatgtgaatg

SEQ ID NO: 224608 - DNA, 25 bp, Rattus norvegicus
caccgttcacgtggacattagaaga

SEQ ID NO: 224609 - DNA, 25 bp, Rattus norvegicus
caccgttcacgtggagatgtgaatg

SEQ ID NO: 224610 - DNA, 25 bp, Rattus norvegicus
caccgttcattgagggctctgacat

SEQ ID NO: 224611 - DNA, 25 bp, Rattus norvegicus
caccgttcattgtgggctctgacat

SEQ ID NO: 224612 - DNA, 25 bp, Rattus norvegicus
caccgttcatttattcttcactagt

SEQ ID NO: 224613 - DNA, 25 bp, Rattus norvegicus
caccgttcattttttcttcactagt

SEQ ID NO: 224614 - DNA, 25 bp, Rattus norvegicus
caccgttcctttataaggcagcttg

SEQ ID NO: 224615 - DNA, 25 bp, Rattus norvegicus
caccgttcctttttaaggcagcttg

SEQ ID NO: 224616 - DNA, 25 bp, Rattus norvegicus
caccgttctcttaggtattcatgtc

SEQ ID NO: 224617 - DNA, 25 bp, Rattus norvegicus
caccgttctctttggtattcatgtc

SEQ ID NO: 224618 - DNA, 25 bp, Rattus norvegicus
caccgttctgggaagctgcgggaaa

SEQ ID NO: 224619 - DNA, 25 bp, Rattus norvegicus
caccgttctgggtagctgcgggaaa

SEQ ID NO: 224620 - DNA, 25 bp, Rattus norvegicus
caccgttggtggaacactgtgagct

SEQ ID NO: 224621 - DNA, 25 bp, Rattus norvegicus
caccgttggtggtacactgtgagct

SEQ ID NO: 224622 - DNA, 25 bp, Rattus norvegicus
caccgtttcttgatgctctgtagga

SEQ ID NO: 224623 - DNA, 25 bp, Rattus norvegicus
caccgtttcttgttgctctgtagga

SEQ ID NO: 224624 - DNA, 25 bp, Rattus norvegicus
caccgtttctttagtatcttctcat

SEQ ID NO: 224625 - DNA, 25 bp, Rattus norvegicus
caccgtttcttttgtatcttctcat

SEQ ID NO: 224626 - DNA, 25 bp, Rattus norvegicus
caccgttttgtcagcctagagtttt

SEQ ID NO: 224627 - DNA, 25 bp, Rattus norvegicus
caccgttttgtctgcctagagtttt

SEQ ID NO: 224628 - DNA, 25 bp, Rattus norvegicus
cacctaacatttctctatcttgcta

SEQ ID NO: 224629 - DNA, 25 bp, Rattus norvegicus
cacctaacatttgtctatcttgcta

SEQ ID NO: 224630 - DNA, 25 bp, Rattus norvegicus
cacctaacctctcctttgcaaggaa

SEQ ID NO: 224631 - DNA, 25 bp, Rattus norvegicus
cacctaacctctgctttgcaaggaa

SEQ ID NO: 224632 - DNA, 25 bp, Rattus norvegicus
cacctaacttccactgaacagtcta

SEQ ID NO: 224633 - DNA, 25 bp, Rattus norvegicus
cacctaacttcctctgaacagtcta

SEQ ID NO: 224634 - DNA, 25 bp, Rattus norvegicus
cacctaatgggtcccttatgcatag

SEQ ID NO: 224635 - DNA, 25 bp, Rattus norvegicus
cacctaatgggtgccttatgcatag

SEQ ID NO: 224636 - DNA, 25 bp, Rattus norvegicus
cacctaatgtgccttttgcagcatt

SEQ ID NO: 224637 - DNA, 25 bp, Rattus norvegicus
cacctaatgtgcgttttgcagcatt

SEQ ID NO: 224638 - DNA, 25 bp, Rattus norvegicus
cacctaattagtatcaaagatgatc

SEQ ID NO: 224639 - DNA, 25 bp, Rattus norvegicus
cacctaattagtttcaaagatgatc

SEQ ID NO: 224640 - DNA, 25 bp, Rattus norvegicus
cacctacagtggagtattccggact

SEQ ID NO: 224641 - DNA, 25 bp, Rattus norvegicus
cacctacagtggtgtattccggact

SEQ ID NO: 224642 - DNA, 25 bp, Rattus norvegicus
cacctacattggattcttttaatat

SEQ ID NO: 224643 - DNA, 25 bp, Rattus norvegicus
cacctacattggtttcttttaatat

SEQ ID NO: 224644 - DNA, 25 bp, Rattus norvegicus
cacctaccaggtctcggaatctgac

SEQ ID NO: 224645 - DNA, 25 bp, Rattus norvegicus
cacctaccaggtgtcggaatctgac

SEQ ID NO: 224646 - DNA, 25 bp, Rattus norvegicus
cacctacctgctatgagtggtctta

SEQ ID NO: 224647 - DNA, 25 bp, Rattus norvegicus
cacctacctgctttgagtggtctta

SEQ ID NO: 224648 - DNA, 25 bp, Rattus norvegicus
cacctactgactacctggcaaagat

SEQ ID NO: 224649 - DNA, 25 bp, Rattus norvegicus
cacctactgacttcctggcaaagat

SEQ ID NO: 224650 - DNA, 25 bp, Rattus norvegicus
cacctactgtcaagtggaggcacat

SEQ ID NO: 224651 - DNA, 25 bp, Rattus norvegicus
cacctactgtcatgtggaggcacat

SEQ ID NO: 224652 - DNA, 25 bp, Rattus norvegicus
cacctactgtgtctatctggaacat

SEQ ID NO: 224653 - DNA, 25 bp, Rattus norvegicus
cacctactgtgtgtatctggaacat

SEQ ID NO: 224654 - DNA, 25 bp, Rattus norvegicus
cacctagactggacaaattgcccta

SEQ ID NO: 224655 - DNA, 25 bp, Rattus norvegicus
cacctagactggtcaaattgcccta

SEQ ID NO: 224656 - DNA, 25 bp, Rattus norvegicus
cacctagctcaacatgaagtcccag

SEQ ID NO: 224657 - DNA, 25 bp, Rattus norvegicus
cacctagctcaagatgaagtcccag

SEQ ID NO: 224658 - DNA, 25 bp, Rattus norvegicus
cacctagctctcacatttactaatg

SEQ ID NO: 224659 - DNA, 25 bp, Rattus norvegicus
cacctagctctctcatttactaatg

SEQ ID NO: 224660 - DNA, 25 bp, Rattus norvegicus
cacctagcttctatgagtcagtcag

SEQ ID NO: 224661 - DNA, 25 bp, Rattus norvegicus
cacctagcttctttgagtcagtcag

SEQ ID NO: 224662 - DNA, 25 bp, Rattus norvegicus
cacctagtgtcactgctgttctaca

SEQ ID NO: 224663 - DNA, 25 bp, Rattus norvegicus
cacctagtgtcagtgctgttctaca

SEQ ID NO: 224664 - DNA, 25 bp, Rattus norvegicus
cacctagtgtttcccttctggaaaa

SEQ ID NO: 224665 - DNA, 25 bp, Rattus norvegicus
cacctagtgtttgccttctggaaaa

SEQ ID NO: 224666 - DNA, 25 bp, Rattus norvegicus
cacctataatgacatccaatgcctt

SEQ ID NO: 224667 - DNA, 25 bp, Rattus norvegicus
cacctataatgagatccaatgcctt

SEQ ID NO: 224668 - DNA, 25 bp, Rattus norvegicus
cacctatggccgcatcactaaggat

SEQ ID NO: 224669 - DNA, 25 bp, Rattus norvegicus
cacctatggccggatcactaaggat

SEQ ID NO: 224670 - DNA, 25 bp, Rattus norvegicus
cacctattcatgatccgcgatgtaa

SEQ ID NO: 224671 - DNA, 25 bp, Rattus norvegicus
cacctattcatgttccgcgatgtaa

SEQ ID NO: 224672 - DNA, 25 bp, Rattus norvegicus
cacctattcctgagagatacgttag

SEQ ID NO: 224673 - DNA, 25 bp, Rattus norvegicus
cacctattcctgtgagatacgttag

SEQ ID NO: 224674 - DNA, 25 bp, Rattus norvegicus
cacctattgtgtcgagttttctgaa

SEQ ID NO: 224675 - DNA, 25 bp, Rattus norvegicus
cacctattgtgtggagttttctgaa

SEQ ID NO: 224676 - DNA, 25 bp, Rattus norvegicus
cacctcaaagccctccaggagtggg

SEQ ID NO: 224677 - DNA, 25 bp, Rattus norvegicus
cacctcaaagccgtccaggagtggg

SEQ ID NO: 224678 - DNA, 25 bp, Rattus norvegicus
cacctcaaagcgctttagccacatt

SEQ ID NO: 224679 - DNA, 25 bp, Rattus norvegicus
cacctcaaagcggtttagccacatt

SEQ ID NO: 224680 - DNA, 25 bp, Rattus norvegicus
cacctcaacattcccggaaggctat

SEQ ID NO: 224681 - DNA, 25 bp, Rattus norvegicus
cacctcaacattgccggaaggctat

SEQ ID NO: 224682 - DNA, 25 bp, Rattus norvegicus
cacctcaacccgatttcatttggat

SEQ ID NO: 224683 - DNA, 25 bp, Rattus norvegicus
cacctcaacccgttttcatttggat

SEQ ID NO: 224684 - DNA, 25 bp, Rattus norvegicus
cacctcaacttacccaatctaggaa

SEQ ID NO: 224685 - DNA, 25 bp, Rattus norvegicus
cacctcaacttagccaatctaggaa

SEQ ID NO: 224686 - DNA, 25 bp, Rattus norvegicus
cacctcaactttcagtattcattga

SEQ ID NO: 224687 - DNA, 25 bp, Rattus norvegicus
cacctcaactttgagtattcattga

SEQ ID NO: 224688 - DNA, 25 bp, Rattus norvegicus
cacctcaagctaatgtttcctcatt

SEQ ID NO: 224689 - DNA, 25 bp, Rattus norvegicus
cacctcaagctattgtttcctcatt

SEQ ID NO: 224690 - DNA, 25 bp, Rattus norvegicus
cacctcacatatccctaactaagga

SEQ ID NO: 224691 - DNA, 25 bp, Rattus norvegicus
cacctcacatatgcctaactaagga

SEQ ID NO: 224692 - DNA, 25 bp, Rattus norvegicus
cacctcactggtatttactctcaaa

SEQ ID NO: 224693 - DNA, 25 bp, Rattus norvegicus
cacctcactggtttttactctcaaa

SEQ ID NO: 224694 - DNA, 25 bp, Rattus norvegicus
cacctcagacacacagttcactaag

SEQ ID NO: 224695 - DNA, 25 bp, Rattus norvegicus
cacctcagacactcagttcactaag

SEQ ID NO: 224696 - DNA, 25 bp, Rattus norvegicus
cacctcagatggaattcggcaaaca

SEQ ID NO: 224697 - DNA, 25 bp, Rattus norvegicus
cacctcagatggtattcggcaaaca

SEQ ID NO: 224698 - DNA, 25 bp, Rattus norvegicus
cacctcagggtcctcctggtcaggt

SEQ ID NO: 224699 - DNA, 25 bp, Rattus norvegicus
cacctcagggtcgtcctggtcaggt

SEQ ID NO: 224700 - DNA, 25 bp, Rattus norvegicus
cacctcagttccctactatagaact

SEQ ID NO: 224701 - DNA, 25 bp, Rattus norvegicus
cacctcagttccgtactatagaact

SEQ ID NO: 224702 - DNA, 25 bp, Rattus norvegicus
cacctcatgtggcagctgggctgaa

SEQ ID NO: 224703 - DNA, 25 bp, Rattus norvegicus
cacctcatgtgggagctgggctgaa

SEQ ID NO: 224704 - DNA, 25 bp, Rattus norvegicus
cacctccaagttcaagtgggtacgt

SEQ ID NO: 224705 - DNA, 25 bp, Rattus norvegicus
cacctccaagttccctaagcataga

SEQ ID NO: 224706 - DNA, 25 bp, Rattus norvegicus
cacctccaagttgaagtgggtacgt

SEQ ID NO: 224707 - DNA, 25 bp, Rattus norvegicus
cacctccaagttgcctaagcataga

SEQ ID NO: 224708 - DNA, 25 bp, Rattus norvegicus
cacctccagctgcacatttttagaa

SEQ ID NO: 224709 - DNA, 25 bp, Rattus norvegicus
cacctccagctggacatttttagaa

SEQ ID NO: 224710 - DNA, 25 bp, Rattus norvegicus
cacctccaggagcagttagacttaa

SEQ ID NO: 224711 - DNA, 25 bp, Rattus norvegicus
cacctccaggaggagttagacttaa

SEQ ID NO: 224712 - DNA, 25 bp, Rattus norvegicus
cacctccagtccagggtgtggaaga

SEQ ID NO: 224713 - DNA, 25 bp, Rattus norvegicus
cacctccagtcctgggtgtggaaga

SEQ ID NO: 224714 - DNA, 25 bp, Rattus norvegicus
cacctccagtttaattttgctacct

SEQ ID NO: 224715 - DNA, 25 bp, Rattus norvegicus
cacctccagttttattttgctacct

SEQ ID NO: 224716 - DNA, 25 bp, Rattus norvegicus
cacctcccagttagagtggcctaaa

SEQ ID NO: 224717 - DNA, 25 bp, Rattus norvegicus
cacctcccagtttgagtggcctaaa

SEQ ID NO: 224718 - DNA, 25 bp, Rattus norvegicus
cacctcctagctagcaaaatctatt

SEQ ID NO: 224719 - DNA, 25 bp, Rattus norvegicus
cacctcctagcttgcaaaatctatt

SEQ ID NO: 224720 - DNA, 25 bp, Rattus norvegicus
cacctcctccaaagggatcgtaaac

SEQ ID NO: 224721 - DNA, 25 bp, Rattus norvegicus
cacctcctccaatgggatcgtaaac

SEQ ID NO: 224722 - DNA, 25 bp, Rattus norvegicus
cacctcctcctacaactttgaattt

SEQ ID NO: 224723 - DNA, 25 bp, Rattus norvegicus
cacctcctcctagaactttgaattt

SEQ ID NO: 224724 - DNA, 25 bp, Rattus norvegicus
cacctcctgcctaccgaggaaggag

SEQ ID NO: 224725 - DNA, 25 bp, Rattus norvegicus
cacctcctgccttccgaggaaggag

SEQ ID NO: 224726 - DNA, 25 bp, Rattus norvegicus
cacctcctggctaagccatttttta

SEQ ID NO: 224727 - DNA, 25 bp, Rattus norvegicus
cacctcctggcttagccatttttta

SEQ ID NO: 224728 - DNA, 25 bp, Rattus norvegicus
cacctccttccgctatttgtacata

SEQ ID NO: 224729 - DNA, 25 bp, Rattus norvegicus
cacctccttccggtatttgtacata

SEQ ID NO: 224730 - DNA, 25 bp, Rattus norvegicus
cacctccttggtagactgaagctat

SEQ ID NO: 224731 - DNA, 25 bp, Rattus norvegicus
cacctccttggttgactgaagctat

SEQ ID NO: 224732 - DNA, 25 bp, Rattus norvegicus
cacctcgattatccaactctgtaaa

SEQ ID NO: 224733 - DNA, 25 bp, Rattus norvegicus
cacctcgattatgcaactctgtaaa

SEQ ID NO: 224734 - DNA, 25 bp, Rattus norvegicus
cacctcgccttacaacagcatgttg

SEQ ID NO: 224735 - DNA, 25 bp, Rattus norvegicus
cacctcgccttagaacagcatgttg

SEQ ID NO: 224736 - DNA, 25 bp, Rattus norvegicus
cacctcgtactcactggagattcag

SEQ ID NO: 224737 - DNA, 25 bp, Rattus norvegicus
cacctcgtactctctggagattcag

SEQ ID NO: 224738 - DNA, 25 bp, Rattus norvegicus
cacctcgtgggcaatgtctatgtta

SEQ ID NO: 224739 - DNA, 25 bp, Rattus norvegicus
cacctcgtgggctatgtctatgtta

SEQ ID NO: 224740 - DNA, 25 bp, Rattus norvegicus
cacctctaagatcccaaaaccattg

SEQ ID NO: 224741 - DNA, 25 bp, Rattus norvegicus
cacctctaagatgccaaaaccattg

SEQ ID NO: 224742 - DNA, 25 bp, Rattus norvegicus
cacctctacattatctggacataca

SEQ ID NO: 224743 - DNA, 25 bp, Rattus norvegicus
cacctctacattttctggacataca

SEQ ID NO: 224744 - DNA, 25 bp, Rattus norvegicus
cacctctatccactggtgtgggatt

SEQ ID NO: 224745 - DNA, 25 bp, Rattus norvegicus
cacctctatccagtggtgtgggatt

SEQ ID NO: 224746 - DNA, 25 bp, Rattus norvegicus
cacctctcagcgaacaggtacgggt

SEQ ID NO: 224747 - DNA, 25 bp, Rattus norvegicus
cacctctcagcgtacaggtacgggt

SEQ ID NO: 224748 - DNA, 25 bp, Rattus norvegicus
cacctctcatggattgtgacaacag

SEQ ID NO: 224749 - DNA, 25 bp, Rattus norvegicus
cacctctcatggtttgtgacaacag

SEQ ID NO: 224750 - DNA, 25 bp, Rattus norvegicus
cacctctcggtgaattcagagctgt

SEQ ID NO: 224751 - DNA, 25 bp, Rattus norvegicus
cacctctcggtgtattcagagctgt

SEQ ID NO: 224752 - DNA, 25 bp, Rattus norvegicus
cacctctcttccactacatgagaaa

SEQ ID NO: 224753 - DNA, 25 bp, Rattus norvegicus
cacctctcttcctctacatgagaaa

SEQ ID NO: 224754 - DNA, 25 bp, Rattus norvegicus
cacctctgacttctatgccagggaa

SEQ ID NO: 224755 - DNA, 25 bp, Rattus norvegicus
cacctctgacttgtatgccagggaa

SEQ ID NO: 224756 - DNA, 25 bp, Rattus norvegicus
cacctctgctgtcgctacttttaga

SEQ ID NO: 224757 - DNA, 25 bp, Rattus norvegicus
cacctctgctgtggctacttttaga

SEQ ID NO: 224758 - DNA, 25 bp, Rattus norvegicus
cacctctggccaacttaaacatttg

SEQ ID NO: 224759 - DNA, 25 bp, Rattus norvegicus
cacctctggccatcttaaacatttg

SEQ ID NO: 224760 - DNA, 25 bp, Rattus norvegicus
cacctctggctgagcgagagtttga

SEQ ID NO: 224761 - DNA, 25 bp, Rattus norvegicus
cacctctggctgtgcgagagtttga

SEQ ID NO: 224762 - DNA, 25 bp, Rattus norvegicus
cacctctggttgaatcttgcactta

SEQ ID NO: 224763 - DNA, 25 bp, Rattus norvegicus
cacctctggttgtatcttgcactta

SEQ ID NO: 224764 - DNA, 25 bp, Rattus norvegicus
cacctctgttctactgattattttg

SEQ ID NO: 224765 - DNA, 25 bp, Rattus norvegicus
cacctctgttcttctgattattttg

SEQ ID NO: 224766 - DNA, 25 bp, Rattus norvegicus
cacctcttcctactctttctaggga

SEQ ID NO: 224767 - DNA, 25 bp, Rattus norvegicus
cacctcttcctagtctttctaggga

SEQ ID NO: 224768 - DNA, 25 bp, Rattus norvegicus
cacctcttcgtaagtgtacactcta

SEQ ID NO: 224769 - DNA, 25 bp, Rattus norvegicus
cacctcttcgtatgtgtacactcta

SEQ ID NO: 224770 - DNA, 25 bp, Rattus norvegicus
cacctctttacgaatatgatgtggc

SEQ ID NO: 224771 - DNA, 25 bp, Rattus norvegicus
cacctctttacgtatatgatgtggc

SEQ ID NO: 224772 - DNA, 25 bp, Rattus norvegicus
cacctctttgatcttgccaagccaa

SEQ ID NO: 224773 - DNA, 25 bp, Rattus norvegicus
cacctctttgatgttgccaagccaa

SEQ ID NO: 224774 - DNA, 25 bp, Rattus norvegicus
cacctgaattttcagtctgtctgtt

SEQ ID NO: 224775 - DNA, 25 bp, Rattus norvegicus
cacctgaattttgagtctgtctgtt

SEQ ID NO: 224776 - DNA, 25 bp, Rattus norvegicus
cacctgacaccaaccacagatatag

SEQ ID NO: 224777 - DNA, 25 bp, Rattus norvegicus
cacctgacaccatccacagatatag

SEQ ID NO: 224778 - DNA, 25 bp, Rattus norvegicus
cacctgacaggcctgcatctggaat

SEQ ID NO: 224779 - DNA, 25 bp, Rattus norvegicus
cacctgacaggcgtgcatctggaat

SEQ ID NO: 224780 - DNA, 25 bp, Rattus norvegicus
cacctgactttcatccaaattctgt

SEQ ID NO: 224781 - DNA, 25 bp, Rattus norvegicus
cacctgactttcttccaaattctgt

SEQ ID NO: 224782 - DNA, 25 bp, Rattus norvegicus
cacctgagcagtccaagccttgttg

SEQ ID NO: 224783 - DNA, 25 bp, Rattus norvegicus
cacctgagcagtgcaagccttgttg

SEQ ID NO: 224784 - DNA, 25 bp, Rattus norvegicus
cacctgagcttcaaggcgagcatag

SEQ ID NO: 224785 - DNA, 25 bp, Rattus norvegicus
cacctgagcttctaggcgagcatag

SEQ ID NO: 224786 - DNA, 25 bp, Rattus norvegicus
cacctgagctttatggactttgacc

SEQ ID NO: 224787 - DNA, 25 bp, Rattus norvegicus
cacctgagctttttggactttgacc

SEQ ID NO: 224788 - DNA, 25 bp, Rattus norvegicus
cacctgatggccattgggtcttgag

SEQ ID NO: 224789 - DNA, 25 bp, Rattus norvegicus
cacctgatggcctttgggtcttgag

SEQ ID NO: 224790 - DNA, 25 bp, Rattus norvegicus
cacctgcaaggccttactttagcat

SEQ ID NO: 224791 - DNA, 25 bp, Rattus norvegicus
cacctgcaaggcgttactttagcat

SEQ ID NO: 224792 - DNA, 25 bp, Rattus norvegicus
cacctgcaccaacgattctcattga

SEQ ID NO: 224793 - DNA, 25 bp, Rattus norvegicus
cacctgcaccaaggattctcattga

SEQ ID NO: 224794 - DNA, 25 bp, Rattus norvegicus
cacctgcagctcaacataaattcaa

SEQ ID NO: 224795 - DNA, 25 bp, Rattus norvegicus
cacctgcagctctacataaattcaa

SEQ ID NO: 224796 - DNA, 25 bp, Rattus norvegicus
cacctgcagcttcccttcaggaaga

SEQ ID NO: 224797 - DNA, 25 bp, Rattus norvegicus
cacctgcagcttgccttcaggaaga

SEQ ID NO: 224798 - DNA, 25 bp, Rattus norvegicus
cacctgcatcatcatttactcctga

SEQ ID NO: 224799 - DNA, 25 bp, Rattus norvegicus
cacctgcatcatgatttactcctga

SEQ ID NO: 224800 - DNA, 25 bp, Rattus norvegicus
cacctgccagatcttttgttgtatg

SEQ ID NO: 224801 - DNA, 25 bp, Rattus norvegicus
cacctgccagatgttttgttgtatg

SEQ ID NO: 224802 - DNA, 25 bp, Rattus norvegicus
cacctgccagtgacttctttttatc

SEQ ID NO: 224803 - DNA, 25 bp, Rattus norvegicus
cacctgccagtgaggctctgagaag

SEQ ID NO: 224804 - DNA, 25 bp, Rattus norvegicus
cacctgccagtgtcttctttttatc

SEQ ID NO: 224805 - DNA, 25 bp, Rattus norvegicus
cacctgccagtgtggctctgagaag

SEQ ID NO: 224806 - DNA, 25 bp, Rattus norvegicus
cacctgccagttaaaggcaaccctt

SEQ ID NO: 224807 - DNA, 25 bp, Rattus norvegicus
cacctgccagtttaaggcaaccctt

SEQ ID NO: 224808 - DNA, 25 bp, Rattus norvegicus
cacctgccctacagaggttcaagag

SEQ ID NO: 224809 - DNA, 25 bp, Rattus norvegicus
cacctgccctactgaggttcaagag

SEQ ID NO: 224810 - DNA, 25 bp, Rattus norvegicus
cacctgcctcgccaagagaacagga

SEQ ID NO: 224811 - DNA, 25 bp, Rattus norvegicus
cacctgcctcgcgaagagaacagga

SEQ ID NO: 224812 - DNA, 25 bp, Rattus norvegicus
cacctgctcaaccatcttggtattt

SEQ ID NO: 224813 - DNA, 25 bp, Rattus norvegicus
cacctgctcaacgatcttggtattt

SEQ ID NO: 224814 - DNA, 25 bp, Rattus norvegicus
cacctgctcagcagtagatgactat

SEQ ID NO: 224815 - DNA, 25 bp, Rattus norvegicus
cacctgctcagctgtagatgactat

SEQ ID NO: 224816 - DNA, 25 bp, Rattus norvegicus
cacctgctgctcatctgaaaacaag

SEQ ID NO: 224817 - DNA, 25 bp, Rattus norvegicus
cacctgctgctcttctgaaaacaag

SEQ ID NO: 224818 - DNA, 25 bp, Rattus norvegicus
cacctgctggagaaggagtgaccca

SEQ ID NO: 224819 - DNA, 25 bp, Rattus norvegicus
cacctgctggagtaggagtgaccca

SEQ ID NO: 224820 - DNA, 25 bp, Rattus norvegicus
cacctgctggtgctcagtgattagg

SEQ ID NO: 224821 - DNA, 25 bp, Rattus norvegicus
cacctgctggtggtcagtgattagg

SEQ ID NO: 224822 - DNA, 25 bp, Rattus norvegicus
cacctgctttgtatgatctttaatt

SEQ ID NO: 224823 - DNA, 25 bp, Rattus norvegicus
cacctgctttgtttgatctttaatt

SEQ ID NO: 224824 - DNA, 25 bp, Rattus norvegicus
cacctggaaatacatgggctgcgtt

SEQ ID NO: 224825 - DNA, 25 bp, Rattus norvegicus
cacctggaaatagatgggctgcgtt

SEQ ID NO: 224826 - DNA, 25 bp, Rattus norvegicus
cacctggaagatcctcatgtaacta

SEQ ID NO: 224827 - DNA, 25 bp, Rattus norvegicus
cacctggaagatgctcatgtaacta

SEQ ID NO: 224828 - DNA, 25 bp, Rattus norvegicus
cacctggaaggtcttcaaagtttgt

SEQ ID NO: 224829 - DNA, 25 bp, Rattus norvegicus
cacctggaaggtgttcaaagtttgt

SEQ ID NO: 224830 - DNA, 25 bp, Rattus norvegicus
cacctggatctgcagcgcatgcaag

SEQ ID NO: 224831 - DNA, 25 bp, Rattus norvegicus
cacctggatctggagcgcatgcaag

SEQ ID NO: 224832 - DNA, 25 bp, Rattus norvegicus
cacctggatgatcagaccctggcaa

SEQ ID NO: 224833 - DNA, 25 bp, Rattus norvegicus
cacctggatgatgagaccctggcaa

SEQ ID NO: 224834 - DNA, 25 bp, Rattus norvegicus
cacctggccatcatgaggtaggctt

SEQ ID NO: 224835 - DNA, 25 bp, Rattus norvegicus
cacctggccatcttgaggtaggctt

SEQ ID NO: 224836 - DNA, 25 bp, Rattus norvegicus
cacctgggacagcttcttggagaac

SEQ ID NO: 224837 - DNA, 25 bp, Rattus norvegicus
cacctgggacaggttcttggagaac

SEQ ID NO: 224838 - DNA, 25 bp, Rattus norvegicus
cacctgggaggtacatctgggcaat

SEQ ID NO: 224839 - DNA, 25 bp, Rattus norvegicus
cacctgggaggttcatctgggcaat

SEQ ID NO: 224840 - DNA, 25 bp, Rattus norvegicus
cacctgggcgtgatggcaacactta

SEQ ID NO: 224841 - DNA, 25 bp, Rattus norvegicus
cacctgggcgtgttggcaacactta

SEQ ID NO: 224842 - DNA, 25 bp, Rattus norvegicus
cacctggtgaatcctggagtcctca

SEQ ID NO: 224843 - DNA, 25 bp, Rattus norvegicus
cacctggtgaatgctggagtcctca

SEQ ID NO: 224844 - DNA, 25 bp, Rattus norvegicus
cacctggtggagatctacgacttta

SEQ ID NO: 224845 - DNA, 25 bp, Rattus norvegicus
cacctggtggagttctacgacttta

SEQ ID NO: 224846 - DNA, 25 bp, Rattus norvegicus
cacctggttgaacttgttgcgagca

SEQ ID NO: 224847 - DNA, 25 bp, Rattus norvegicus
cacctggttgaagttgttgcgagca

SEQ ID NO: 224848 - DNA, 25 bp, Rattus norvegicus
cacctggttgctagaagtttgccta

SEQ ID NO: 224849 - DNA, 25 bp, Rattus norvegicus
cacctggttgcttgaagtttgccta

SEQ ID NO: 224850 - DNA, 25 bp, Rattus norvegicus
cacctgtaaattcatttgtcattca

SEQ ID NO: 224851 - DNA, 25 bp, Rattus norvegicus
cacctgtaaattgatttgtcattca

SEQ ID NO: 224852 - DNA, 25 bp, Rattus norvegicus
cacctgtacacaagaaagagtctaa

SEQ ID NO: 224853 - DNA, 25 bp, Rattus norvegicus
cacctgtacacatgaaagagtctaa

SEQ ID NO: 224854 - DNA, 25 bp, Rattus norvegicus
cacctgtacatactgtttcctcaga

SEQ ID NO: 224855 - DNA, 25 bp, Rattus norvegicus
cacctgtacatagtgtttcctcaga

SEQ ID NO: 224856 - DNA, 25 bp, Rattus norvegicus
cacctgtactgcacctgagtagtta

SEQ ID NO: 224857 - DNA, 25 bp, Rattus norvegicus
cacctgtactgctcctgagtagtta

SEQ ID NO: 224858 - DNA, 25 bp, Rattus norvegicus
cacctgtagctgaagtgtttccgag

SEQ ID NO: 224859 - DNA, 25 bp, Rattus norvegicus
cacctgtagctgtagtgtttccgag

SEQ ID NO: 224860 - DNA, 25 bp, Rattus norvegicus
cacctgtcacccatgcgttaaataa

SEQ ID NO: 224861 - DNA, 25 bp, Rattus norvegicus
cacctgtcacccttgcgttaaataa

SEQ ID NO: 224862 - DNA, 25 bp, Rattus norvegicus
cacctgtcatcccagaacgtgagga

SEQ ID NO: 224863 - DNA, 25 bp, Rattus norvegicus
cacctgtcatccgagaacgtgagga

SEQ ID NO: 224864 - DNA, 25 bp, Rattus norvegicus
cacctgtcttttatacttgtctcat

SEQ ID NO: 224865 - DNA, 25 bp, Rattus norvegicus
cacctgtcttttttacttgtctcat

SEQ ID NO: 224866 - DNA, 25 bp, Rattus norvegicus
cacctgtgattgatccatggacttg

SEQ ID NO: 224867 - DNA, 25 bp, Rattus norvegicus
cacctgtgattgttccatggacttg

SEQ ID NO: 224868 - DNA, 25 bp, Rattus norvegicus
cacctgtgccagcaaggctctacaa

SEQ ID NO: 224869 - DNA, 25 bp, Rattus norvegicus
cacctgtgccaggaaggctctacaa

SEQ ID NO: 224870 - DNA, 25 bp, Rattus norvegicus
cacctgtggcttatacagtgtgagc

SEQ ID NO: 224871 - DNA, 25 bp, Rattus norvegicus
cacctgtggcttttacagtgtgagc

SEQ ID NO: 224872 - DNA, 25 bp, Rattus norvegicus
cacctgtgggttaagcttttgtatt

SEQ ID NO: 224873 - DNA, 25 bp, Rattus norvegicus
cacctgtgggtttagcttttgtatt

SEQ ID NO: 224874 - DNA, 25 bp, Rattus norvegicus
cacctgtggttacctgtaccagaga

SEQ ID NO: 224875 - DNA, 25 bp, Rattus norvegicus
cacctgtggttagctgtaccagaga

SEQ ID NO: 224876 - DNA, 25 bp, Rattus norvegicus
cacctgtgtcagcaagtcaatgtct

SEQ ID NO: 224877 - DNA, 25 bp, Rattus norvegicus
cacctgtgtcaggaagtcaatgtct

SEQ ID NO: 224878 - DNA, 25 bp, Rattus norvegicus
cacctgttccggcagatggaggtca

SEQ ID NO: 224879 - DNA, 25 bp, Rattus norvegicus
cacctgttccgggagatggaggtca

SEQ ID NO: 224880 - DNA, 25 bp, Rattus norvegicus
cacctgttgttcatgtcatttgtac

SEQ ID NO: 224881 - DNA, 25 bp, Rattus norvegicus
cacctgttgttcttgtcatttgtac

SEQ ID NO: 224882 - DNA, 25 bp, Rattus norvegicus
caccttaacctaagtttgctcagtc

SEQ ID NO: 224883 - DNA, 25 bp, Rattus norvegicus
caccttaacctatgtttgctcagtc

SEQ ID NO: 224884 - DNA, 25 bp, Rattus norvegicus
caccttacactgaccttaatccaag

SEQ ID NO: 224885 - DNA, 25 bp, Rattus norvegicus
caccttacactgtccttaatccaag

SEQ ID NO: 224886 - DNA, 25 bp, Rattus norvegicus
caccttagctgtctgcaacacagga

SEQ ID NO: 224887 - DNA, 25 bp, Rattus norvegicus
caccttagctgtgtgcaacacagga

SEQ ID NO: 224888 - DNA, 25 bp, Rattus norvegicus
caccttagctttagtttatccgaga

SEQ ID NO: 224889 - DNA, 25 bp, Rattus norvegicus
caccttagcttttgtttatccgaga

SEQ ID NO: 224890 - DNA, 25 bp, Rattus norvegicus
caccttatggtacccttgtctttaa

SEQ ID NO: 224891 - DNA, 25 bp, Rattus norvegicus
caccttatggtagccttgtctttaa

SEQ ID NO: 224892 - DNA, 25 bp, Rattus norvegicus
caccttcaaaatctcccttctagtt

SEQ ID NO: 224893 - DNA, 25 bp, Rattus norvegicus
caccttcaaaatgtcccttctagtt

SEQ ID NO: 224894 - DNA, 25 bp, Rattus norvegicus
caccttcacaaccacatcttaaaaa

SEQ ID NO: 224895 - DNA, 25 bp, Rattus norvegicus
caccttcacaacgacatcttaaaaa

SEQ ID NO: 224896 - DNA, 25 bp, Rattus norvegicus
caccttcactccatcattattaaat

SEQ ID NO: 224897 - DNA, 25 bp, Rattus norvegicus
caccttcactccttcattattaaat

SEQ ID NO: 224898 - DNA, 25 bp, Rattus norvegicus
caccttcagcagaactctgggacgg

SEQ ID NO: 224899 - DNA, 25 bp, Rattus norvegicus
caccttcagcagtactctgggacgg

SEQ ID NO: 224900 - DNA, 25 bp, Rattus norvegicus
caccttcagggcctacagagtgagg

SEQ ID NO: 224901 - DNA, 25 bp, Rattus norvegicus
caccttcagggcgtacagagtgagg

SEQ ID NO: 224902 - DNA, 25 bp, Rattus norvegicus
caccttcagtctcagatcttaggag

SEQ ID NO: 224903 - DNA, 25 bp, Rattus norvegicus
caccttcagtctgagatcttaggag

SEQ ID NO: 224904 - DNA, 25 bp, Rattus norvegicus
caccttcattgcatccgacattagg

SEQ ID NO: 224905 - DNA, 25 bp, Rattus norvegicus
caccttcattgcttccgacattagg

SEQ ID NO: 224906 - DNA, 25 bp, Rattus norvegicus
caccttccagcacatgtggatcagc

SEQ ID NO: 224907 - DNA, 25 bp, Rattus norvegicus
caccttccagcagatgtggatcagc

SEQ ID NO: 224908 - DNA, 25 bp, Rattus norvegicus
caccttcccggaaagagctgtttga

SEQ ID NO: 224909 - DNA, 25 bp, Rattus norvegicus
caccttcccggatagagctgtttga

SEQ ID NO: 224910 - DNA, 25 bp, Rattus norvegicus
caccttccctgactggttgaaatca

SEQ ID NO: 224911 - DNA, 25 bp, Rattus norvegicus
caccttccctgagtggttgaaatca

SEQ ID NO: 224912 - DNA, 25 bp, Rattus norvegicus
caccttcctcaacattttccggaga

SEQ ID NO: 224913 - DNA, 25 bp, Rattus norvegicus
caccttcctcaagattttccggaga

SEQ ID NO: 224914 - DNA, 25 bp, Rattus norvegicus
caccttcctcgtcttatgtttaaag

SEQ ID NO: 224915 - DNA, 25 bp, Rattus norvegicus
caccttcctcgtgttatgtttaaag

SEQ ID NO: 224916 - DNA, 25 bp, Rattus norvegicus
caccttccttgtattccactcttgt

SEQ ID NO: 224917 - DNA, 25 bp, Rattus norvegicus
caccttccttgttttccactcttgt

SEQ ID NO: 224918 - DNA, 25 bp, Rattus norvegicus
caccttctgttgcttttgatttctg

SEQ ID NO: 224919 - DNA, 25 bp, Rattus norvegicus
caccttctgttggttttgatttctg

SEQ ID NO: 224920 - DNA, 25 bp, Rattus norvegicus
caccttcttaacacttcctgattat

SEQ ID NO: 224921 - DNA, 25 bp, Rattus norvegicus
caccttcttaactcttcctgattat

SEQ ID NO: 224922 - DNA, 25 bp, Rattus norvegicus
caccttcttaccctgaagacacaag

SEQ ID NO: 224923 - DNA, 25 bp, Rattus norvegicus
caccttcttaccgtgaagacacaag

SEQ ID NO: 224924 - DNA, 25 bp, Rattus norvegicus
caccttcttcatagcttctaacatt

SEQ ID NO: 224925 - DNA, 25 bp, Rattus norvegicus
caccttcttcattgcttctaacatt

SEQ ID NO: 224926 - DNA, 25 bp, Rattus norvegicus
caccttcttggtcaattcccattca

SEQ ID NO: 224927 - DNA, 25 bp, Rattus norvegicus
caccttcttggtgaattcccattca

SEQ ID NO: 224928 - DNA, 25 bp, Rattus norvegicus
caccttgaacctagggcagggcagg

SEQ ID NO: 224929 - DNA, 25 bp, Rattus norvegicus
caccttgaaccttgggcagggcagg

SEQ ID NO: 224930 - DNA, 25 bp, Rattus norvegicus
caccttgaagaactgtgtgggcact

SEQ ID NO: 224931 - DNA, 25 bp, Rattus norvegicus
caccttgaagaagtgtgtgggcact

SEQ ID NO: 224932 - DNA, 25 bp, Rattus norvegicus
caccttgaaggtcacttttctggga

SEQ ID NO: 224933 - DNA, 25 bp, Rattus norvegicus
caccttgaaggtgacttttctggga

SEQ ID NO: 224934 - DNA, 25 bp, Rattus norvegicus
caccttgacgctccaggctagaaag

SEQ ID NO: 224935 - DNA, 25 bp, Rattus norvegicus
caccttgacgctgcaggctagaaag

SEQ ID NO: 224936 - DNA, 25 bp, Rattus norvegicus
caccttgccaccactgattaaagtg

SEQ ID NO: 224937 - DNA, 25 bp, Rattus norvegicus
caccttgccacctctgattaaagtg

SEQ ID NO: 224938 - DNA, 25 bp, Rattus norvegicus
caccttgctgggatacttgtcaaca

SEQ ID NO: 224939 - DNA, 25 bp, Rattus norvegicus
caccttgctgggttacttgtcaaca

SEQ ID NO: 224940 - DNA, 25 bp, Rattus norvegicus
caccttgctttgcttgaacttcaga

SEQ ID NO: 224941 - DNA, 25 bp, Rattus norvegicus
caccttgctttggttgaacttcaga

SEQ ID NO: 224942 - DNA, 25 bp, Rattus norvegicus
caccttggacctcatctgagcacag

SEQ ID NO: 224943 - DNA, 25 bp, Rattus norvegicus
caccttggacctgatctgagcacag

SEQ ID NO: 224944 - DNA, 25 bp, Rattus norvegicus
caccttggaggtcccatgggtttag

SEQ ID NO: 224945 - DNA, 25 bp, Rattus norvegicus
caccttggaggtgccatgggtttag

SEQ ID NO: 224946 - DNA, 25 bp, Rattus norvegicus
caccttggcccaatttcttaatttg

SEQ ID NO: 224947 - DNA, 25 bp, Rattus norvegicus
caccttggcccattttcttaatttg

SEQ ID NO: 224948 - DNA, 25 bp, Rattus norvegicus
caccttggcttaactgcttgttgaa

SEQ ID NO: 224949 - DNA, 25 bp, Rattus norvegicus
caccttggcttatctgcttgttgaa

SEQ ID NO: 224950 - DNA, 25 bp, Rattus norvegicus
caccttggttttctgttcttgtgtg

SEQ ID NO: 224951 - DNA, 25 bp, Rattus norvegicus
caccttggttttgtgttcttgtgtg

SEQ ID NO: 224952 - DNA, 25 bp, Rattus norvegicus
caccttgtatctcttgtattgttaa

SEQ ID NO: 224953 - DNA, 25 bp, Rattus norvegicus
caccttgtatctgttgtattgttaa

SEQ ID NO: 224954 - DNA, 25 bp, Rattus norvegicus
caccttgtatggacttctgtctaag

SEQ ID NO: 224955 - DNA, 25 bp, Rattus norvegicus
caccttgtatggtcttctgtctaag

SEQ ID NO: 224956 - DNA, 25 bp, Rattus norvegicus
caccttgtctacctagagctgtctt

SEQ ID NO: 224957 - DNA, 25 bp, Rattus norvegicus
caccttgtctacgtagagctgtctt

SEQ ID NO: 224958 - DNA, 25 bp, Rattus norvegicus
caccttgtgactctcctagctaagg

SEQ ID NO: 224959 - DNA, 25 bp, Rattus norvegicus
caccttgtgactgtcctagctaagg

SEQ ID NO: 224960 - DNA, 25 bp, Rattus norvegicus
caccttgtggctattctctgagtta

SEQ ID NO: 224961 - DNA, 25 bp, Rattus norvegicus
caccttgtggcttttctctgagtta

SEQ ID NO: 224962 - DNA, 25 bp, Rattus norvegicus
caccttgtggttatcttacaactgg

SEQ ID NO: 224963 - DNA, 25 bp, Rattus norvegicus
caccttgtggttttcttacaactgg

SEQ ID NO: 224964 - DNA, 25 bp, Rattus norvegicus
caccttgtgtgtagtagctcatttg

SEQ ID NO: 224965 - DNA, 25 bp, Rattus norvegicus
caccttgtgtgtagttttctgttac

SEQ ID NO: 224966 - DNA, 25 bp, Rattus norvegicus
caccttgtgtgttgtagctcatttg

SEQ ID NO: 224967 - DNA, 25 bp, Rattus norvegicus
caccttgtgtgttgttttctgttac

SEQ ID NO: 224968 - DNA, 25 bp, Rattus norvegicus
caccttgttcaccttggttttcaga

SEQ ID NO: 224969 - DNA, 25 bp, Rattus norvegicus
caccttgttcacgttggttttcaga

SEQ ID NO: 224970 - DNA, 25 bp, Rattus norvegicus
caccttgtttatcccctttccagag

SEQ ID NO: 224971 - DNA, 25 bp, Rattus norvegicus
caccttgtttatgccctttccagag

SEQ ID NO: 224972 - DNA, 25 bp, Rattus norvegicus
caccttgttttccttcttgaggcgc

SEQ ID NO: 224973 - DNA, 25 bp, Rattus norvegicus
caccttgttttcgttcttgaggcgc

SEQ ID NO: 224974 - DNA, 25 bp, Rattus norvegicus
cacctttaacccagacattcggaag

SEQ ID NO: 224975 - DNA, 25 bp, Rattus norvegicus
cacctttaaccctgacattcggaag

SEQ ID NO: 224976 - DNA, 25 bp, Rattus norvegicus
cacctttaacctctggaggcagaag

SEQ ID NO: 224977 - DNA, 25 bp, Rattus norvegicus
cacctttaacctgtggaggcagaag

SEQ ID NO: 224978 - DNA, 25 bp, Rattus norvegicus
cacctttaatccctctggctggaat

SEQ ID NO: 224979 - DNA, 25 bp, Rattus norvegicus
cacctttaatccgtctggctggaat

SEQ ID NO: 224980 - DNA, 25 bp, Rattus norvegicus
cacctttagctgaggctgcctttac

SEQ ID NO: 224981 - DNA, 25 bp, Rattus norvegicus
cacctttagctgtggctgcctttac

SEQ ID NO: 224982 - DNA, 25 bp, Rattus norvegicus
cacctttattgaccttggagggcaa

SEQ ID NO: 224983 - DNA, 25 bp, Rattus norvegicus
cacctttattgagcttggagggcaa

SEQ ID NO: 224984 - DNA, 25 bp, Rattus norvegicus
cacctttcactgacgctggtatgag

SEQ ID NO: 224985 - DNA, 25 bp, Rattus norvegicus
cacctttcactgtcgctggtatgag

SEQ ID NO: 224986 - DNA, 25 bp, Rattus norvegicus
cacctttcccaaatttagtttcatg

SEQ ID NO: 224987 - DNA, 25 bp, Rattus norvegicus
cacctttcccaattttagtttcatg

SEQ ID NO: 224988 - DNA, 25 bp, Rattus norvegicus
cacctttccctgagactttatcaaa

SEQ ID NO: 224989 - DNA, 25 bp, Rattus norvegicus
cacctttccctgtgactttatcaaa

SEQ ID NO: 224990 - DNA, 25 bp, Rattus norvegicus
cacctttctaaaccgctgtgggaag

SEQ ID NO: 224991 - DNA, 25 bp, Rattus norvegicus
cacctttctaaagcgctgtgggaag

SEQ ID NO: 224992 - DNA, 25 bp, Rattus norvegicus
cacctttctcttcataaccgggtca

SEQ ID NO: 224993 - DNA, 25 bp, Rattus norvegicus
cacctttctcttgataaccgggtca

SEQ ID NO: 224994 - DNA, 25 bp, Rattus norvegicus
cacctttgaaagctttggatgaatg

SEQ ID NO: 224995 - DNA, 25 bp, Rattus norvegicus
cacctttgaaaggtttggatgaatg

SEQ ID NO: 224996 - DNA, 25 bp, Rattus norvegicus
cacctttgagctcctggtgcgcttc

SEQ ID NO: 224997 - DNA, 25 bp, Rattus norvegicus
cacctttgagctgctggtgcgcttc

SEQ ID NO: 224998 - DNA, 25 bp, Rattus norvegicus
cacctttgaggtattgccatgggaa

SEQ ID NO: 224999 - DNA, 25 bp, Rattus norvegicus
cacctttgaggttttgccatgggaa

SEQ ID NO: 225000 - DNA, 25 bp, Rattus norvegicus
caccttttaaaacatgttctctaat

SEQ ID NO: 225001 - DNA, 25 bp, Rattus norvegicus
caccttttaaaagatgttctctaat

SEQ ID NO: 225002 - DNA, 25 bp, Rattus norvegicus
caccttttaatgatgtcttcagatt

SEQ ID NO: 225003 - DNA, 25 bp, Rattus norvegicus
caccttttaatgttgtcttcagatt

SEQ ID NO: 225004 - DNA, 25 bp, Rattus norvegicus
caccttttacacatggcattcactt

SEQ ID NO: 225005 - DNA, 25 bp, Rattus norvegicus
caccttttacacttggcattcactt

SEQ ID NO: 225006 - DNA, 25 bp, Rattus norvegicus
caccttttatagctgctgagccgag

SEQ ID NO: 225007 - DNA, 25 bp, Rattus norvegicus
caccttttataggtgctgagccgag

SEQ ID NO: 225008 - DNA, 25 bp, Rattus norvegicus
caccttttcaacacctgagctggaa

SEQ ID NO: 225009 - DNA, 25 bp, Rattus norvegicus
caccttttcaactcctgagctggaa

SEQ ID NO: 225010 - DNA, 25 bp, Rattus norvegicus
caccttttcccaacacaagtgatca

SEQ ID NO: 225011 - DNA, 25 bp, Rattus norvegicus
caccttttcccatcacaagtgatca

SEQ ID NO: 225012 - DNA, 25 bp, Rattus norvegicus
caccttttcccgataatgaccaatg

SEQ ID NO: 225013 - DNA, 25 bp, Rattus norvegicus
caccttttcccgttaatgaccaatg

SEQ ID NO: 225014 - DNA, 25 bp, Rattus norvegicus
caccttttctctcttcaacttagtt

SEQ ID NO: 225015 - DNA, 25 bp, Rattus norvegicus
caccttttctctgttcaacttagtt

SEQ ID NO: 225016 - DNA, 25 bp, Rattus norvegicus
caccttttctgactgtggtactgaa

SEQ ID NO: 225017 - DNA, 25 bp, Rattus norvegicus
caccttttctgagtgtggtactgaa

SEQ ID NO: 225018 - DNA, 25 bp, Rattus norvegicus
caccttttcttcaagcattttcttg

SEQ ID NO: 225019 - DNA, 25 bp, Rattus norvegicus
caccttttcttctagcattttcttg

SEQ ID NO: 225020 - DNA, 25 bp, Rattus norvegicus
caccttttgaagacttgcacccaat

SEQ ID NO: 225021 - DNA, 25 bp, Rattus norvegicus
caccttttgaagtcttgcacccaat

SEQ ID NO: 225022 - DNA, 25 bp, Rattus norvegicus
caccttttggtgatgattgctaatc

SEQ ID NO: 225023 - DNA, 25 bp, Rattus norvegicus
caccttttggtgttgattgctaatc

SEQ ID NO: 225024 - DNA, 25 bp, Rattus norvegicus
cacctttttgttcctcattggtcaa

SEQ ID NO: 225025 - DNA, 25 bp, Rattus norvegicus
cacctttttgttgctcattggtcaa

SEQ ID NO: 225026 - DNA, 25 bp, Rattus norvegicus
caccttttttctatgctggtttgca

SEQ ID NO: 225027 - DNA, 25 bp, Rattus norvegicus
caccttttttctttgctggtttgca

SEQ ID NO: 225028 - DNA, 25 bp, Rattus norvegicus
caccttttttgcatgagatagacca

SEQ ID NO: 225029 - DNA, 25 bp, Rattus norvegicus
caccttttttgcttgagatagacca

SEQ ID NO: 225030 - DNA, 25 bp, Rattus norvegicus
cacgaaagtggtctgccttcataca

SEQ ID NO: 225031 - DNA, 25 bp, Rattus norvegicus
cacgaaagtggtgtgccttcataca

SEQ ID NO: 225032 - DNA, 25 bp, Rattus norvegicus
cacgaacagtttagtatctccctct

SEQ ID NO: 225033 - DNA, 25 bp, Rattus norvegicus
cacgaacagttttgtatctccctct

SEQ ID NO: 225034 - DNA, 25 bp, Rattus norvegicus
cacgaactctagcttctccaaagaa

SEQ ID NO: 225035 - DNA, 25 bp, Rattus norvegicus
cacgaactctaggttctccaaagaa

SEQ ID NO: 225036 - DNA, 25 bp, Rattus norvegicus
cacgaagactcacaagacgatatgt

SEQ ID NO: 225037 - DNA, 25 bp, Rattus norvegicus
cacgaagactcagaagacgatatgt

SEQ ID NO: 225038 - DNA, 25 bp, Rattus norvegicus
cacgaagatgaaaggctctgtgtaa

SEQ ID NO: 225039 - DNA, 25 bp, Rattus norvegicus
cacgaagatgaatggctctgtgtaa

SEQ ID NO: 225040 - DNA, 25 bp, Rattus norvegicus
cacgaaggcgaaaccacggcttaca

SEQ ID NO: 225041 - DNA, 25 bp, Rattus norvegicus
cacgaaggcgaatccacggcttaca

SEQ ID NO: 225042 - DNA, 25 bp, Rattus norvegicus
cacgaatattgtctaaatgtttctt

SEQ ID NO: 225043 - DNA, 25 bp, Rattus norvegicus
cacgaatattgtgtaaatgtttctt

SEQ ID NO: 225044 - DNA, 25 bp, Rattus norvegicus
cacgacaaggctcctggcaattggc

SEQ ID NO: 225045 - DNA, 25 bp, Rattus norvegicus
cacgacaaggctgctggcaattggc

SEQ ID NO: 225046 - DNA, 25 bp, Rattus norvegicus
cacgacacacaacgcctcatgaagt

SEQ ID NO: 225047 - DNA, 25 bp, Rattus norvegicus
cacgacacacaaggcctcatgaagt

SEQ ID NO: 225048 - DNA, 25 bp, Rattus norvegicus
cacgacacccggcacaagtttcatt

SEQ ID NO: 225049 - DNA, 25 bp, Rattus norvegicus
cacgacacccgggacaagtttcatt

SEQ ID NO: 225050 - DNA, 25 bp, Rattus norvegicus
cacgacagtcccaggctataattaa

SEQ ID NO: 225051 - DNA, 25 bp, Rattus norvegicus
cacgacagtccctggctataattaa

SEQ ID NO: 225052 - DNA, 25 bp, Rattus norvegicus
cacgacccgttactccagaggagtt

SEQ ID NO: 225053 - DNA, 25 bp, Rattus norvegicus
cacgacccgttagtccagaggagtt

SEQ ID NO: 225054 - DNA, 25 bp, Rattus norvegicus
cacgacgctgtcatctagggataga

SEQ ID NO: 225055 - DNA, 25 bp, Rattus norvegicus
cacgacgctgtcttctagggataga

SEQ ID NO: 225056 - DNA, 25 bp, Rattus norvegicus
cacgacgggatgaacctggagcttt

SEQ ID NO: 225057 - DNA, 25 bp, Rattus norvegicus
cacgacgggatgtacctggagcttt

SEQ ID NO: 225058 - DNA, 25 bp, Rattus norvegicus
cacgacgttcgtaatggtggtcatg

SEQ ID NO: 225059 - DNA, 25 bp, Rattus norvegicus
cacgacgttcgttatggtggtcatg

SEQ ID NO: 225060 - DNA, 25 bp, Rattus norvegicus
cacgactcgcctacgtagtatcaaa

SEQ ID NO: 225061 - DNA, 25 bp, Rattus norvegicus
cacgactcgccttcgtagtatcaaa

SEQ ID NO: 225062 - DNA, 25 bp, Rattus norvegicus
cacgactctttgctgtcttacacaa

SEQ ID NO: 225063 - DNA, 25 bp, Rattus norvegicus
cacgactctttggtgtcttacacaa

SEQ ID NO: 225064 - DNA, 25 bp, Rattus norvegicus
cacgagactcacatcgatggaggct

SEQ ID NO: 225065 - DNA, 25 bp, Rattus norvegicus
cacgagactcacttcgatggaggct

SEQ ID NO: 225066 - DNA, 25 bp, Rattus norvegicus
cacgagactgtgctttgatcatgtt

SEQ ID NO: 225067 - DNA, 25 bp, Rattus norvegicus
cacgagactgtggtttgatcatgtt

SEQ ID NO: 225068 - DNA, 25 bp, Rattus norvegicus
cacgagagaggactgtactgcaaga

SEQ ID NO: 225069 - DNA, 25 bp, Rattus norvegicus
cacgagagaggagtgtactgcaaga

SEQ ID NO: 225070 - DNA, 25 bp, Rattus norvegicus
cacgagagcaggaggtgccgtctac

SEQ ID NO: 225071 - DNA, 25 bp, Rattus norvegicus
cacgagagcaggtggtgccgtctac

SEQ ID NO: 225072 - DNA, 25 bp, Rattus norvegicus
cacgagatccaaatgctgcttgcat

SEQ ID NO: 225073 - DNA, 25 bp, Rattus norvegicus
cacgagatccaattgctgcttgcat

SEQ ID NO: 225074 - DNA, 25 bp, Rattus norvegicus
cacgagcaagtgctctgatttcaga

SEQ ID NO: 225075 - DNA, 25 bp, Rattus norvegicus
cacgagcaagtggtctgatttcaga

SEQ ID NO: 225076 - DNA, 25 bp, Rattus norvegicus
cacgagcacgctatgatggaacctt

SEQ ID NO: 225077 - DNA, 25 bp, Rattus norvegicus
cacgagcacgctttgatggaacctt

SEQ ID NO: 225078 - DNA, 25 bp, Rattus norvegicus
cacgagcactttcttatgtcctaaa

SEQ ID NO: 225079 - DNA, 25 bp, Rattus norvegicus
cacgagcactttgttatgtcctaaa

SEQ ID NO: 225080 - DNA, 25 bp, Rattus norvegicus
cacgagccaggtctgagtggttcac

SEQ ID NO: 225081 - DNA, 25 bp, Rattus norvegicus
cacgagccaggtgtgagtggttcac

SEQ ID NO: 225082 - DNA, 25 bp, Rattus norvegicus
cacgagcgccgcagacaagcgatgg

SEQ ID NO: 225083 - DNA, 25 bp, Rattus norvegicus
cacgagcgccgctgacaagcgatgg

SEQ ID NO: 225084 - DNA, 25 bp, Rattus norvegicus
cacgagcttgccattaagctgcaga

SEQ ID NO: 225085 - DNA, 25 bp, Rattus norvegicus
cacgagcttgcctttaagctgcaga

SEQ ID NO: 225086 - DNA, 25 bp, Rattus norvegicus
cacgaggaaaaactcagtgttctaa

SEQ ID NO: 225087 - DNA, 25 bp, Rattus norvegicus
cacgaggaaaaagtcagtgttctaa

SEQ ID NO: 225088 - DNA, 25 bp, Rattus norvegicus
cacgaggaagtgattgctgcttctt

SEQ ID NO: 225089 - DNA, 25 bp, Rattus norvegicus
cacgaggaagtgtttgctgcttctt

SEQ ID NO: 225090 - DNA, 25 bp, Rattus norvegicus
cacgaggcaaacactatggcatcaa

SEQ ID NO: 225091 - DNA, 25 bp, Rattus norvegicus
cacgaggcaaactctatggcatcaa

SEQ ID NO: 225092 - DNA, 25 bp, Rattus norvegicus
cacgaggcacggacagaaagcatga

SEQ ID NO: 225093 - DNA, 25 bp, Rattus norvegicus
cacgaggcacggtcagaaagcatga

SEQ ID NO: 225094 - DNA, 25 bp, Rattus norvegicus
cacgaggcatctcgttgtgcacgaa

SEQ ID NO: 225095 - DNA, 25 bp, Rattus norvegicus
cacgaggcatctggttgtgcacgaa

SEQ ID NO: 225096 - DNA, 25 bp, Rattus norvegicus
cacgaggctgctctaagttgggaca

SEQ ID NO: 225097 - DNA, 25 bp, Rattus norvegicus
cacgaggctgctgtaagttgggaca

SEQ ID NO: 225098 - DNA, 25 bp, Rattus norvegicus
cacgaggctggaaatactgcgcccc

SEQ ID NO: 225099 - DNA, 25 bp, Rattus norvegicus
cacgaggctggatatactgcgcccc

SEQ ID NO: 225100 - DNA, 25 bp, Rattus norvegicus
cacgaggcttggcactttgcaagga

SEQ ID NO: 225101 - DNA, 25 bp, Rattus norvegicus
cacgaggcttgggactttgcaagga

SEQ ID NO: 225102 - DNA, 25 bp, Rattus norvegicus
cacgaggttgcactccagggctgaa

SEQ ID NO: 225103 - DNA, 25 bp, Rattus norvegicus
cacgaggttgcagtccagggctgaa

SEQ ID NO: 225104 - DNA, 25 bp, Rattus norvegicus
cacgagtcctttcgccagtgggcga

SEQ ID NO: 225105 - DNA, 25 bp, Rattus norvegicus
cacgagtcctttggccagtgggcga

SEQ ID NO: 225106 - DNA, 25 bp, Rattus norvegicus
cacgagtgacacatctgttgaaatt

SEQ ID NO: 225107 - DNA, 25 bp, Rattus norvegicus
cacgagtgacacttctgttgaaatt

SEQ ID NO: 225108 - DNA, 25 bp, Rattus norvegicus
cacgagtgcctcacacagagctgtg

SEQ ID NO: 225109 - DNA, 25 bp, Rattus norvegicus
cacgagtgcctctcacagagctgtg

SEQ ID NO: 225110 - DNA, 25 bp, Rattus norvegicus
cacgagtgccttcttgcagtgaact

SEQ ID NO: 225111 - DNA, 25 bp, Rattus norvegicus
cacgagtgccttgttgcagtgaact

SEQ ID NO: 225112 - DNA, 25 bp, Rattus norvegicus
cacgagtgcgacacctgtggagtga

SEQ ID NO: 225113 - DNA, 25 bp, Rattus norvegicus
cacgagtgcgactcctgtggagtga

SEQ ID NO: 225114 - DNA, 25 bp, Rattus norvegicus
cacgagtggcgcacaggaagcttta

SEQ ID NO: 225115 - DNA, 25 bp, Rattus norvegicus
cacgagtggcgctcaggaagcttta

SEQ ID NO: 225116 - DNA, 25 bp, Rattus norvegicus
cacgagtgtgaccaatgtgggcccc

SEQ ID NO: 225117 - DNA, 25 bp, Rattus norvegicus
cacgagtgtgacgaatgtgggcccc

SEQ ID NO: 225118 - DNA, 25 bp, Rattus norvegicus
cacgagttcagcaacaggaggacga

SEQ ID NO: 225119 - DNA, 25 bp, Rattus norvegicus
cacgagttcagctacaggaggacga

SEQ ID NO: 225120 - DNA, 25 bp, Rattus norvegicus
cacgagttcgccagtagcctctgaa

SEQ ID NO: 225121 - DNA, 25 bp, Rattus norvegicus
cacgagttcgcctgtagcctctgaa

SEQ ID NO: 225122 - DNA, 25 bp, Rattus norvegicus
cacgatacactcagtggttctgtgt

SEQ ID NO: 225123 - DNA, 25 bp, Rattus norvegicus
cacgatacactctgtggttctgtgt

SEQ ID NO: 225124 - DNA, 25 bp, Rattus norvegicus
cacgatactgttagttctaggagag

SEQ ID NO: 225125 - DNA, 25 bp, Rattus norvegicus
cacgatactgtttgttctaggagag

SEQ ID NO: 225126 - DNA, 25 bp, Rattus norvegicus
cacgataggttccatgtcccttggg

SEQ ID NO: 225127 - DNA, 25 bp, Rattus norvegicus
cacgataggttcgatgtcccttggg

SEQ ID NO: 225128 - DNA, 25 bp, Rattus norvegicus
cacgatattccaacaattcattaga

SEQ ID NO: 225129 - DNA, 25 bp, Rattus norvegicus
cacgatattccatcaattcattaga

SEQ ID NO: 225130 - DNA, 25 bp, Rattus norvegicus
cacgatgctaccattgtatctcaat

SEQ ID NO: 225131 - DNA, 25 bp, Rattus norvegicus
cacgatgctacctttgtatctcaat

SEQ ID NO: 225132 - DNA, 25 bp, Rattus norvegicus
cacgatggcatcagtcacctttaga

SEQ ID NO: 225133 - DNA, 25 bp, Rattus norvegicus
cacgatggcatctgtcacctttaga

SEQ ID NO: 225134 - DNA, 25 bp, Rattus norvegicus
cacgatggccatcaaattgcgcttg

SEQ ID NO: 225135 - DNA, 25 bp, Rattus norvegicus
cacgatggccatgaaattgcgcttg

SEQ ID NO: 225136 - DNA, 25 bp, Rattus norvegicus
cacgatgtgtgtatggtccttggaa

SEQ ID NO: 225137 - DNA, 25 bp, Rattus norvegicus
cacgatgtgtgtttggtccttggaa

SEQ ID NO: 225138 - DNA, 25 bp, Rattus norvegicus
cacgatgttcagaaatgtcctctat

SEQ ID NO: 225139 - DNA, 25 bp, Rattus norvegicus
cacgatgttcagtaatgtcctctat

SEQ ID NO: 225140 - DNA, 25 bp, Rattus norvegicus
cacgattctgaacctgtgccaataa

SEQ ID NO: 225141 - DNA, 25 bp, Rattus norvegicus
cacgattctgaagctgtgccaataa

SEQ ID NO: 225142 - DNA, 25 bp, Rattus norvegicus
cacgattcttctagagcatgaggca

SEQ ID NO: 225143 - DNA, 25 bp, Rattus norvegicus
cacgattcttcttgagcatgaggca

SEQ ID NO: 225144 - DNA, 25 bp, Rattus norvegicus
cacgcaaacaacagagttgcccggg

SEQ ID NO: 225145 - DNA, 25 bp, Rattus norvegicus
cacgcaaacaactgagttgcccggg

SEQ ID NO: 225146 - DNA, 25 bp, Rattus norvegicus
cacgcaaatgtgagccttcttgtca

SEQ ID NO: 225147 - DNA, 25 bp, Rattus norvegicus
cacgcaaatgtgtgccttcttgtca

SEQ ID NO: 225148 - DNA, 25 bp, Rattus norvegicus
cacgcacaccttacgctgagaaaat

SEQ ID NO: 225149 - DNA, 25 bp, Rattus norvegicus
cacgcacacctttcgctgagaaaat

SEQ ID NO: 225150 - DNA, 25 bp, Rattus norvegicus
cacgcacagtgcagacacatatctc

SEQ ID NO: 225151 - DNA, 25 bp, Rattus norvegicus
cacgcacagtgctgacacatatctc

SEQ ID NO: 225152 - DNA, 25 bp, Rattus norvegicus
cacgcacatgtgcacacgttagttg

SEQ ID NO: 225153 - DNA, 25 bp, Rattus norvegicus
cacgcacatgtggacacgttagttg

SEQ ID NO: 225154 - DNA, 25 bp, Rattus norvegicus
cacgcaccacctatttatgaaccag

SEQ ID NO: 225155 - DNA, 25 bp, Rattus norvegicus
cacgcaccacctttttatgaaccag

SEQ ID NO: 225156 - DNA, 25 bp, Rattus norvegicus
cacgcacttatcaggaacgcctcga

SEQ ID NO: 225157 - DNA, 25 bp, Rattus norvegicus
cacgcacttatctggaacgcctcga

SEQ ID NO: 225158 - DNA, 25 bp, Rattus norvegicus
cacgcagagctgacacgggaggtac

SEQ ID NO: 225159 - DNA, 25 bp, Rattus norvegicus
cacgcagagctgtcacgggaggtac

SEQ ID NO: 225160 - DNA, 25 bp, Rattus norvegicus
cacgcagatgaaagaactatggtac

SEQ ID NO: 225161 - DNA, 25 bp, Rattus norvegicus
cacgcagatgaatgaactatggtac

SEQ ID NO: 225162 - DNA, 25 bp, Rattus norvegicus
cacgcagggtggctaaattcaagta

SEQ ID NO: 225163 - DNA, 25 bp, Rattus norvegicus
cacgcagggtgggtaaattcaagta

SEQ ID NO: 225164 - DNA, 25 bp, Rattus norvegicus
cacgcagtggctaggtggagtcact

SEQ ID NO: 225165 - DNA, 25 bp, Rattus norvegicus
cacgcagtggcttggtggagtcact

SEQ ID NO: 225166 - DNA, 25 bp, Rattus norvegicus
cacgcagtttggatttgcagtgact

SEQ ID NO: 225167 - DNA, 25 bp, Rattus norvegicus
cacgcagtttggttttgcagtgact

SEQ ID NO: 225168 - DNA, 25 bp, Rattus norvegicus
cacgcagtttgtctctggcagcaag

SEQ ID NO: 225169 - DNA, 25 bp, Rattus norvegicus
cacgcagtttgtgtctggcagcaag

SEQ ID NO: 225170 - DNA, 25 bp, Rattus norvegicus
cacgcatactctaggaggtcctttg

SEQ ID NO: 225171 - DNA, 25 bp, Rattus norvegicus
cacgcatactcttggaggtcctttg

SEQ ID NO: 225172 - DNA, 25 bp, Rattus norvegicus
cacgcatcccatacaagtctgtgga

SEQ ID NO: 225173 - DNA, 25 bp, Rattus norvegicus
cacgcatcccattcaagtctgtgga

SEQ ID NO: 225174 - DNA, 25 bp, Rattus norvegicus
cacgcatgtgcactgtacagatttc

SEQ ID NO: 225175 - DNA, 25 bp, Rattus norvegicus
cacgcatgtgcagtgtacagatttc

SEQ ID NO: 225176 - DNA, 25 bp, Rattus norvegicus
cacgccaatcagaggttggaccaca

SEQ ID NO: 225177 - DNA, 25 bp, Rattus norvegicus
cacgccaatcagtggttggaccaca

SEQ ID NO: 225178 - DNA, 25 bp, Rattus norvegicus
cacgccacggctattatacatgcaa

SEQ ID NO: 225179 - DNA, 25 bp, Rattus norvegicus
cacgccacggcttttatacatgcaa

SEQ ID NO: 225180 - DNA, 25 bp, Rattus norvegicus
cacgccatcttcacaattacaatcg

SEQ ID NO: 225181 - DNA, 25 bp, Rattus norvegicus
cacgccatcttctcaattacaatcg

SEQ ID NO: 225182 - DNA, 25 bp, Rattus norvegicus
cacgccatggcaacttggtgtgaaa

SEQ ID NO: 225183 - DNA, 25 bp, Rattus norvegicus
cacgccatggcatcttggtgtgaaa

SEQ ID NO: 225184 - DNA, 25 bp, Rattus norvegicus
cacgcccaatggcagcttgattttg

SEQ ID NO: 225185 - DNA, 25 bp, Rattus norvegicus
cacgcccaatgggagcttgattttg

SEQ ID NO: 225186 - DNA, 25 bp, Rattus norvegicus
cacgcccgtcgtatctgtaatgtga

SEQ ID NO: 225187 - DNA, 25 bp, Rattus norvegicus
cacgcccgtcgtttctgtaatgtga

SEQ ID NO: 225188 - DNA, 25 bp, Rattus norvegicus
cacgccctcctgattttcataattt

SEQ ID NO: 225189 - DNA, 25 bp, Rattus norvegicus
cacgccctcctgtttttcataattt

SEQ ID NO: 225190 - DNA, 25 bp, Rattus norvegicus
cacgccctgggcagtcattatatat

SEQ ID NO: 225191 - DNA, 25 bp, Rattus norvegicus
cacgccctgggctgtcattatatat

SEQ ID NO: 225192 - DNA, 25 bp, Rattus norvegicus
cacgccgcaggaatattagtaactt

SEQ ID NO: 225193 - DNA, 25 bp, Rattus norvegicus
cacgccgcaggattattagtaactt

SEQ ID NO: 225194 - DNA, 25 bp, Rattus norvegicus
cacgccgcagtcagagctagagaat

SEQ ID NO: 225195 - DNA, 25 bp, Rattus norvegicus
cacgccgcagtctgagctagagaat

SEQ ID NO: 225196 - DNA, 25 bp, Rattus norvegicus
cacgccggatgtcctggagtcctct

SEQ ID NO: 225197 - DNA, 25 bp, Rattus norvegicus
cacgccggatgtgctggagtcctct

SEQ ID NO: 225198 - DNA, 25 bp, Rattus norvegicus
cacgccgtagtcagcgaagcagagc

SEQ ID NO: 225199 - DNA, 25 bp, Rattus norvegicus
cacgccgtagtctgcgaagcagagc

SEQ ID NO: 225200 - DNA, 25 bp, Rattus norvegicus
cacgccgtctatcctgtgctaggag

SEQ ID NO: 225201 - DNA, 25 bp, Rattus norvegicus
cacgccgtctatgctgtgctaggag

SEQ ID NO: 225202 - DNA, 25 bp, Rattus norvegicus
cacgccgtgtgaattttgggagcat

SEQ ID NO: 225203 - DNA, 25 bp, Rattus norvegicus
cacgccgtgtgatttttgggagcat

SEQ ID NO: 225204 - DNA, 25 bp, Rattus norvegicus
cacgcctcggacagcgggcaaaagg

SEQ ID NO: 225205 - DNA, 25 bp, Rattus norvegicus
cacgcctcggactgcgggcaaaagg

SEQ ID NO: 225206 - DNA, 25 bp, Rattus norvegicus
cacgcctgagccctgttaaagtatg

SEQ ID NO: 225207 - DNA, 25 bp, Rattus norvegicus
cacgcctgagccgtgttaaagtatg

SEQ ID NO: 225208 - DNA, 25 bp, Rattus norvegicus
cacgcctgtctgaaatatcctaatg

SEQ ID NO: 225209 - DNA, 25 bp, Rattus norvegicus
cacgcctgtctgtaatatcctaatg

SEQ ID NO: 225210 - DNA, 25 bp, Rattus norvegicus
cacgcctgtggaatgttttgaactt

SEQ ID NO: 225211 - DNA, 25 bp, Rattus norvegicus
cacgcctgtggattgttttgaactt

SEQ ID NO: 225212 - DNA, 25 bp, Rattus norvegicus
cacgccttgctgaggattgtctcag

SEQ ID NO: 225213 - DNA, 25 bp, Rattus norvegicus
cacgccttgctgtggattgtctcag

SEQ ID NO: 225214 - DNA, 25 bp, Rattus norvegicus
cacgcctttcgtagacatggttgat

SEQ ID NO: 225215 - DNA, 25 bp, Rattus norvegicus
cacgcctttcgttgacatggttgat

SEQ ID NO: 225216 - DNA, 25 bp, Rattus norvegicus
cacgcgactttgctaaacatggaga

SEQ ID NO: 225217 - DNA, 25 bp, Rattus norvegicus
cacgcgactttggtaaacatggaga

SEQ ID NO: 225218 - DNA, 25 bp, Rattus norvegicus
cacgcgcatcctagggtatttttta

SEQ ID NO: 225219 - DNA, 25 bp, Rattus norvegicus
cacgcgcatccttgggtatttttta

SEQ ID NO: 225220 - DNA, 25 bp, Rattus norvegicus
cacgcgcgcacacggtcgggattaa

SEQ ID NO: 225221 - DNA, 25 bp, Rattus norvegicus
cacgcgcgcacagggtcgggattaa

SEQ ID NO: 225222 - DNA, 25 bp, Rattus norvegicus
cacgcggagctcctgggtgagcgcg

SEQ ID NO: 225223 - DNA, 25 bp, Rattus norvegicus
cacgcggagctcgtgggtgagcgcg

SEQ ID NO: 225224 - DNA, 25 bp, Rattus norvegicus
cacgcgtgggacctggtatatccag

SEQ ID NO: 225225 - DNA, 25 bp, Rattus norvegicus
cacgcgtgggacgtggtatatccag

SEQ ID NO: 225226 - DNA, 25 bp, Rattus norvegicus
cacgcgtgtggtcggcacgtagacc

SEQ ID NO: 225227 - DNA, 25 bp, Rattus norvegicus
cacgcgtgtggtgggcacgtagacc

SEQ ID NO: 225228 - DNA, 25 bp, Rattus norvegicus
cacgcgttcaacaatcctcaatgaa

SEQ ID NO: 225229 - DNA, 25 bp, Rattus norvegicus
cacgcgttcaactatcctcaatgaa

SEQ ID NO: 225230 - DNA, 25 bp, Rattus norvegicus
cacgctaatagcatgaatctcttca

SEQ ID NO: 225231 - DNA, 25 bp, Rattus norvegicus
cacgctaatagcttgaatctcttca

SEQ ID NO: 225232 - DNA, 25 bp, Rattus norvegicus
cacgctaatgaaaccctctacagag

SEQ ID NO: 225233 - DNA, 25 bp, Rattus norvegicus
cacgctaatgaatccctctacagag

SEQ ID NO: 225234 - DNA, 25 bp, Rattus norvegicus
cacgctagtggcaggtgtttaggat

SEQ ID NO: 225235 - DNA, 25 bp, Rattus norvegicus
cacgctagtggcctaccaccaaggg

SEQ ID NO: 225236 - DNA, 25 bp, Rattus norvegicus
cacgctagtggcgtaccaccaaggg

SEQ ID NO: 225237 - DNA, 25 bp, Rattus norvegicus
cacgctagtggctggtgtttaggat

SEQ ID NO: 225238 - DNA, 25 bp, Rattus norvegicus
cacgctagtttgcacggttttgaca

SEQ ID NO: 225239 - DNA, 25 bp, Rattus norvegicus
cacgctagtttggacggttttgaca

SEQ ID NO: 225240 - DNA, 25 bp, Rattus norvegicus
cacgctatactgcagggatatcatt

SEQ ID NO: 225241 - DNA, 25 bp, Rattus norvegicus
cacgctatactggagggatatcatt

SEQ ID NO: 225242 - DNA, 25 bp, Rattus norvegicus
cacgctcacctgaggtggagctgag

SEQ ID NO: 225243 - DNA, 25 bp, Rattus norvegicus
cacgctcacctgtggtggagctgag

SEQ ID NO: 225244 - DNA, 25 bp, Rattus norvegicus
cacgctccggttccaagatgacatt

SEQ ID NO: 225245 - DNA, 25 bp, Rattus norvegicus
cacgctccggttgcaagatgacatt

SEQ ID NO: 225246 - DNA, 25 bp, Rattus norvegicus
cacgctcgggagctgttatgtcata

SEQ ID NO: 225247 - DNA, 25 bp, Rattus norvegicus
cacgctcgggaggtgttatgtcata

SEQ ID NO: 225248 - DNA, 25 bp, Rattus norvegicus
cacgctctggtgagcttacttgaag

SEQ ID NO: 225249 - DNA, 25 bp, Rattus norvegicus
cacgctctggtgtgcttacttgaag

SEQ ID NO: 225250 - DNA, 25 bp, Rattus norvegicus
cacgctctttacacagaaccaataa

SEQ ID NO: 225251 - DNA, 25 bp, Rattus norvegicus
cacgctctttactcagaaccaataa

SEQ ID NO: 225252 - DNA, 25 bp, Rattus norvegicus
cacgctgctggtcactgtgtcagga

SEQ ID NO: 225253 - DNA, 25 bp, Rattus norvegicus
cacgctgctggtgactgtgtcagga

SEQ ID NO: 225254 - DNA, 25 bp, Rattus norvegicus
cacgctgggaatacgtggacgtttt

SEQ ID NO: 225255 - DNA, 25 bp, Rattus norvegicus
cacgctgggaattcgtggacgtttt

SEQ ID NO: 225256 - DNA, 25 bp, Rattus norvegicus
cacgctgtagtcacccaagatgatg

SEQ ID NO: 225257 - DNA, 25 bp, Rattus norvegicus
cacgctgtagtctcccaagatgatg

SEQ ID NO: 225258 - DNA, 25 bp, Rattus norvegicus
cacgctgtccgtagaagtaagttta

SEQ ID NO: 225259 - DNA, 25 bp, Rattus norvegicus
cacgctgtccgttgaagtaagttta

SEQ ID NO: 225260 - DNA, 25 bp, Rattus norvegicus
cacgctgtggttagatgatgcgctc

SEQ ID NO: 225261 - DNA, 25 bp, Rattus norvegicus
cacgctgtggtttgatgatgcgctc

SEQ ID NO: 225262 - DNA, 25 bp, Rattus norvegicus
cacgctgttgtaaatttggattgca

SEQ ID NO: 225263 - DNA, 25 bp, Rattus norvegicus
cacgctgttgtatatttggattgca

SEQ ID NO: 225264 - DNA, 25 bp, Rattus norvegicus
cacgctgttttgaaaccactttcta

SEQ ID NO: 225265 - DNA, 25 bp, Rattus norvegicus
cacgctgttttgtaaccactttcta

SEQ ID NO: 225266 - DNA, 25 bp, Rattus norvegicus
cacgcttaacataggccaggcatca

SEQ ID NO: 225267 - DNA, 25 bp, Rattus norvegicus
cacgcttaacattggccaggcatca

SEQ ID NO: 225268 - DNA, 25 bp, Rattus norvegicus
cacgcttaacgcaccgagtggaact

SEQ ID NO: 225269 - DNA, 25 bp, Rattus norvegicus
cacgcttaacgctccgagtggaact

SEQ ID NO: 225270 - DNA, 25 bp, Rattus norvegicus
cacgcttaccgtcatgttcttaatg

SEQ ID NO: 225271 - DNA, 25 bp, Rattus norvegicus
cacgcttaccgtgatgttcttaatg

SEQ ID NO: 225272 - DNA, 25 bp, Rattus norvegicus
cacgcttaggagacgcatggagctc

SEQ ID NO: 225273 - DNA, 25 bp, Rattus norvegicus
cacgcttaggagtcgcatggagctc

SEQ ID NO: 225274 - DNA, 25 bp, Rattus norvegicus
cacgcttagtttctatgtgcaaata

SEQ ID NO: 225275 - DNA, 25 bp, Rattus norvegicus
cacgcttagtttgtatgtgcaaata

SEQ ID NO: 225276 - DNA, 25 bp, Rattus norvegicus
cacgcttcagagcacatgctttaca

SEQ ID NO: 225277 - DNA, 25 bp, Rattus norvegicus
cacgcttcagaggacatgctttaca

SEQ ID NO: 225278 - DNA, 25 bp, Rattus norvegicus
cacgcttcccagaatgcagcagaac

SEQ ID NO: 225279 - DNA, 25 bp, Rattus norvegicus
cacgcttcccagtatgcagcagaac

SEQ ID NO: 225280 - DNA, 25 bp, Rattus norvegicus
cacgctttcgtgcatgagaggacag

SEQ ID NO: 225281 - DNA, 25 bp, Rattus norvegicus
cacgctttcgtggatgagaggacag

SEQ ID NO: 225282 - DNA, 25 bp, Rattus norvegicus
cacgcttttgacagctccatgggtc

SEQ ID NO: 225283 - DNA, 25 bp, Rattus norvegicus
cacgcttttgactgctccatgggtc

SEQ ID NO: 225284 - DNA, 25 bp, Rattus norvegicus
cacggaaactggaacctccttctgg

SEQ ID NO: 225285 - DNA, 25 bp, Rattus norvegicus
cacggaaactggtacctccttctgg

SEQ ID NO: 225286 - DNA, 25 bp, Rattus norvegicus
cacggaagcaccagggtctttggat

SEQ ID NO: 225287 - DNA, 25 bp, Rattus norvegicus
cacggaagcacctgggtctttggat

SEQ ID NO: 225288 - DNA, 25 bp, Rattus norvegicus
cacggaatggtgctaatggtaagta

SEQ ID NO: 225289 - DNA, 25 bp, Rattus norvegicus
cacggaatggtggtaatggtaagta

SEQ ID NO: 225290 - DNA, 25 bp, Rattus norvegicus
cacggaattcagatgaggacaggga

SEQ ID NO: 225291 - DNA, 25 bp, Rattus norvegicus
cacggaattcagttgaggacaggga

SEQ ID NO: 225292 - DNA, 25 bp, Rattus norvegicus
cacggacaactgatttctgtggaga

SEQ ID NO: 225293 - DNA, 25 bp, Rattus norvegicus
cacggacaactgttttctgtggaga

SEQ ID NO: 225294 - DNA, 25 bp, Rattus norvegicus
cacggacatactatgctgatctcag

SEQ ID NO: 225295 - DNA, 25 bp, Rattus norvegicus
cacggacatactttgctgatctcag

SEQ ID NO: 225296 - DNA, 25 bp, Rattus norvegicus
cacggaccctggatatacagaacat

SEQ ID NO: 225297 - DNA, 25 bp, Rattus norvegicus
cacggaccctggttatacagaacat

SEQ ID NO: 225298 - DNA, 25 bp, Rattus norvegicus
cacggacgagctcgtggagctacac

SEQ ID NO: 225299 - DNA, 25 bp, Rattus norvegicus
cacggacgagctggtggagctacac

SEQ ID NO: 225300 - DNA, 25 bp, Rattus norvegicus
cacggactttgcctctggtatctgg

SEQ ID NO: 225301 - DNA, 25 bp, Rattus norvegicus
cacggactttgcgtctggtatctgg

SEQ ID NO: 225302 - DNA, 25 bp, Rattus norvegicus
cacggagacttgctgtcatggctaa

SEQ ID NO: 225303 - DNA, 25 bp, Rattus norvegicus
cacggagacttggtgtcatggctaa

SEQ ID NO: 225304 - DNA, 25 bp, Rattus norvegicus
cacggagactttaacctagcactta

SEQ ID NO: 225305 - DNA, 25 bp, Rattus norvegicus
cacggagacttttacctagcactta

SEQ ID NO: 225306 - DNA, 25 bp, Rattus norvegicus
cacggagaggctcagaactgtttca

SEQ ID NO: 225307 - DNA, 25 bp, Rattus norvegicus
cacggagaggctgagaactgtttca

SEQ ID NO: 225308 - DNA, 25 bp, Rattus norvegicus
cacggagatcacctgcaaatggcca

SEQ ID NO: 225309 - DNA, 25 bp, Rattus norvegicus
cacggagatcacgtgcaaatggcca

SEQ ID NO: 225310 - DNA, 25 bp, Rattus norvegicus
cacggagcacacatgcaggcggaat

SEQ ID NO: 225311 - DNA, 25 bp, Rattus norvegicus
cacggagcacacttgcaggcggaat

SEQ ID NO: 225312 - DNA, 25 bp, Rattus norvegicus
cacggagcccagcaagatactttgt

SEQ ID NO: 225313 - DNA, 25 bp, Rattus norvegicus
cacggagcccaggaagatactttgt

SEQ ID NO: 225314 - DNA, 25 bp, Rattus norvegicus
cacggaggccacagttgtataacaa

SEQ ID NO: 225315 - DNA, 25 bp, Rattus norvegicus
cacggaggccactgttgtataacaa

SEQ ID NO: 225316 - DNA, 25 bp, Rattus norvegicus
cacggaggctggaagcagacgaaac

SEQ ID NO: 225317 - DNA, 25 bp, Rattus norvegicus
cacggaggctggtagcagacgaaac

SEQ ID NO: 225318 - DNA, 25 bp, Rattus norvegicus
cacggagggcagcactcggtctact

SEQ ID NO: 225319 - DNA, 25 bp, Rattus norvegicus
cacggagggcaggactcggtctact

SEQ ID NO: 225320 - DNA, 25 bp, Rattus norvegicus
cacggagtctctcaaacctcttaaa

SEQ ID NO: 225321 - DNA, 25 bp, Rattus norvegicus
cacggagtctctgaaacctcttaaa

SEQ ID NO: 225322 - DNA, 25 bp, Rattus norvegicus
cacggagtgcgtaggtgagcattct

SEQ ID NO: 225323 - DNA, 25 bp, Rattus norvegicus
cacggagtgcgttggtgagcattct

SEQ ID NO: 225324 - DNA, 25 bp, Rattus norvegicus
cacggatcggctactgtcagaacta

SEQ ID NO: 225325 - DNA, 25 bp, Rattus norvegicus
cacggatcggcttctgtcagaacta

SEQ ID NO: 225326 - DNA, 25 bp, Rattus norvegicus
cacggatgaatcctgagccatggtt

SEQ ID NO: 225327 - DNA, 25 bp, Rattus norvegicus
cacggatgaatcgtgagccatggtt

SEQ ID NO: 225328 - DNA, 25 bp, Rattus norvegicus
cacggatgccagagttggtctattc

SEQ ID NO: 225329 - DNA, 25 bp, Rattus norvegicus
cacggatgccagtgttggtctattc

SEQ ID NO: 225330 - DNA, 25 bp, Rattus norvegicus
cacggatttatgagctcgccaaaaa

SEQ ID NO: 225331 - DNA, 25 bp, Rattus norvegicus
cacggatttatgtgctcgccaaaaa

SEQ ID NO: 225332 - DNA, 25 bp, Rattus norvegicus
cacggcaacagaaagagaagagctt

SEQ ID NO: 225333 - DNA, 25 bp, Rattus norvegicus
cacggcaacagatagagaagagctt

SEQ ID NO: 225334 - DNA, 25 bp, Rattus norvegicus
cacggcaatgcactcaaccttgatt

SEQ ID NO: 225335 - DNA, 25 bp, Rattus norvegicus
cacggcaatgcagtcaaccttgatt

SEQ ID NO: 225336 - DNA, 25 bp, Rattus norvegicus
cacggcactccgcgagctgtatcgg

SEQ ID NO: 225337 - DNA, 25 bp, Rattus norvegicus
cacggcactccgggagctgtatcgg

SEQ ID NO: 225338 - DNA, 25 bp, Rattus norvegicus
cacggcagagggaagcaccagagtt

SEQ ID NO: 225339 - DNA, 25 bp, Rattus norvegicus
cacggcagagggtagcaccagagtt

SEQ ID NO: 225340 - DNA, 25 bp, Rattus norvegicus
cacggcagctcacaagcacatgtaa

SEQ ID NO: 225341 - DNA, 25 bp, Rattus norvegicus
cacggcagctcagaagcacatgtaa

SEQ ID NO: 225342 - DNA, 25 bp, Rattus norvegicus
cacggcagtctgctgggagttattt

SEQ ID NO: 225343 - DNA, 25 bp, Rattus norvegicus
cacggcagtctggtgggagttattt

SEQ ID NO: 225344 - DNA, 25 bp, Rattus norvegicus
cacggcatacggctgtgacatgtgt

SEQ ID NO: 225345 - DNA, 25 bp, Rattus norvegicus
cacggcatacgggtgtgacatgtgt

SEQ ID NO: 225346 - DNA, 25 bp, Rattus norvegicus
cacggcatcaccatagctgtagttg

SEQ ID NO: 225347 - DNA, 25 bp, Rattus norvegicus
cacggcatcaccttagctgtagttg

SEQ ID NO: 225348 - DNA, 25 bp, Rattus norvegicus
cacggcatccgaccctggtagggaa

SEQ ID NO: 225349 - DNA, 25 bp, Rattus norvegicus
cacggcatccgagcctggtagggaa

SEQ ID NO: 225350 - DNA, 25 bp, Rattus norvegicus
cacggcatcctgcatgtaaacactt

SEQ ID NO: 225351 - DNA, 25 bp, Rattus norvegicus
cacggcatcctggatgtaaacactt

SEQ ID NO: 225352 - DNA, 25 bp, Rattus norvegicus
cacggcatgggtatgttgacacttt

SEQ ID NO: 225353 - DNA, 25 bp, Rattus norvegicus
cacggcatgggtttgttgacacttt

SEQ ID NO: 225354 - DNA, 25 bp, Rattus norvegicus
cacggccacactcacagcaggatat

SEQ ID NO: 225355 - DNA, 25 bp, Rattus norvegicus
cacggccacactgacagcaggatat

SEQ ID NO: 225356 - DNA, 25 bp, Rattus norvegicus
cacggcccagcgacctgtggttgcg

SEQ ID NO: 225357 - DNA, 25 bp, Rattus norvegicus
cacggcccagcgtcctgtggttgcg

SEQ ID NO: 225358 - DNA, 25 bp, Rattus norvegicus
cacggcccaggcaccttaagggagg

SEQ ID NO: 225359 - DNA, 25 bp, Rattus norvegicus
cacggcccaggctccttaagggagg

SEQ ID NO: 225360 - DNA, 25 bp, Rattus norvegicus
cacggcctacaactgtggtctagaa

SEQ ID NO: 225361 - DNA, 25 bp, Rattus norvegicus
cacggcctacaagtgtggtctagaa

SEQ ID NO: 225362 - DNA, 25 bp, Rattus norvegicus
cacggcggacaacctgatcaagcag

SEQ ID NO: 225363 - DNA, 25 bp, Rattus norvegicus
cacggcggacaagctgatcaagcag

SEQ ID NO: 225364 - DNA, 25 bp, Rattus norvegicus
cacggcggccatcataagttgtttt

SEQ ID NO: 225365 - DNA, 25 bp, Rattus norvegicus
cacggcggccatgataagttgtttt

SEQ ID NO: 225366 - DNA, 25 bp, Rattus norvegicus
cacggcgtttagctggagcgctcac

SEQ ID NO: 225367 - DNA, 25 bp, Rattus norvegicus
cacggcgtttaggtggagcgctcac

SEQ ID NO: 225368 - DNA, 25 bp, Rattus norvegicus
cacggctcggagattgtacttaaat

SEQ ID NO: 225369 - DNA, 25 bp, Rattus norvegicus
cacggctcggagtttgtacttaaat

SEQ ID NO: 225370 - DNA, 25 bp, Rattus norvegicus
cacggctcttgtctttggaaggttt

SEQ ID NO: 225371 - DNA, 25 bp, Rattus norvegicus
cacggctcttgtgtttggaaggttt

SEQ ID NO: 225372 - DNA, 25 bp, Rattus norvegicus
cacggcttcttccaaggagagctga

SEQ ID NO: 225373 - DNA, 25 bp, Rattus norvegicus
cacggcttcttcgaaggagagctga

SEQ ID NO: 225374 - DNA, 25 bp, Rattus norvegicus
cacggctttcatcccagcattaagg

SEQ ID NO: 225375 - DNA, 25 bp, Rattus norvegicus
cacggctttcatgccagcattaagg

SEQ ID NO: 225376 - DNA, 25 bp, Rattus norvegicus
cacgggaagaagacgctaacactgc

SEQ ID NO: 225377 - DNA, 25 bp, Rattus norvegicus
cacgggaagaagtcgctaacactgc

SEQ ID NO: 225378 - DNA, 25 bp, Rattus norvegicus
cacgggacactgcaaaccctgttca

SEQ ID NO: 225379 - DNA, 25 bp, Rattus norvegicus
cacgggacactggaaaccctgttca

SEQ ID NO: 225380 - DNA, 25 bp, Rattus norvegicus
cacgggatgggcagcttcagctaac

SEQ ID NO: 225381 - DNA, 25 bp, Rattus norvegicus
cacgggatgggctgcttcagctaac

SEQ ID NO: 225382 - DNA, 25 bp, Rattus norvegicus
cacgggcacaacagggcacatggca

SEQ ID NO: 225383 - DNA, 25 bp, Rattus norvegicus
cacgggcacaactgggcacatggca

SEQ ID NO: 225384 - DNA, 25 bp, Rattus norvegicus
cacgggcaccagcacttagattcaa

SEQ ID NO: 225385 - DNA, 25 bp, Rattus norvegicus
cacgggcaccaggacttagattcaa

SEQ ID NO: 225386 - DNA, 25 bp, Rattus norvegicus
cacgggcacctgaactcatatgcat

SEQ ID NO: 225387 - DNA, 25 bp, Rattus norvegicus
cacgggcacctgtactcatatgcat

SEQ ID NO: 225388 - DNA, 25 bp, Rattus norvegicus
cacgggcaggagcaccttttgcatt

SEQ ID NO: 225389 - DNA, 25 bp, Rattus norvegicus
cacgggcaggaggaccttttgcatt

SEQ ID NO: 225390 - DNA, 25 bp, Rattus norvegicus
cacgggcatcataactgttcagaac

SEQ ID NO: 225391 - DNA, 25 bp, Rattus norvegicus
cacgggcatcattactgttcagaac

SEQ ID NO: 225392 - DNA, 25 bp, Rattus norvegicus
cacgggcatggcagatcgcatcttg

SEQ ID NO: 225393 - DNA, 25 bp, Rattus norvegicus
cacgggcatggctgatcgcatcttg

SEQ ID NO: 225394 - DNA, 25 bp, Rattus norvegicus
cacgggcccttaacatgatgctagc

SEQ ID NO: 225395 - DNA, 25 bp, Rattus norvegicus
cacgggcccttatcatgatgctagc

SEQ ID NO: 225396 - DNA, 25 bp, Rattus norvegicus
cacgggctatttagggttgaacact

SEQ ID NO: 225397 - DNA, 25 bp, Rattus norvegicus
cacgggctattttgggttgaacact

SEQ ID NO: 225398 - DNA, 25 bp, Rattus norvegicus
cacgggctgcggacgaagaagaact

SEQ ID NO: 225399 - DNA, 25 bp, Rattus norvegicus
cacgggctgcggtcgaagaagaact

SEQ ID NO: 225400 - DNA, 25 bp, Rattus norvegicus
cacgggctggctcttctgaagaaga

SEQ ID NO: 225401 - DNA, 25 bp, Rattus norvegicus
cacgggctggctgttctgaagaaga

SEQ ID NO: 225402 - DNA, 25 bp, Rattus norvegicus
cacgggtatccaaaggcagttcttt

SEQ ID NO: 225403 - DNA, 25 bp, Rattus norvegicus
cacgggtatccataggcagttcttt

SEQ ID NO: 225404 - DNA, 25 bp, Rattus norvegicus
cacgggtcttctaacttgccttgtt

SEQ ID NO: 225405 - DNA, 25 bp, Rattus norvegicus
cacgggtcttcttacttgccttgtt

SEQ ID NO: 225406 - DNA, 25 bp, Rattus norvegicus
cacgggttcaggaccacgggtatag

SEQ ID NO: 225407 - DNA, 25 bp, Rattus norvegicus
cacgggttcaggtccacgggtatag

SEQ ID NO: 225408 - DNA, 25 bp, Rattus norvegicus
cacgggttccccattggcagcggcg

SEQ ID NO: 225409 - DNA, 25 bp, Rattus norvegicus
cacgggttcccctttggcagcggcg

SEQ ID NO: 225410 - DNA, 25 bp, Rattus norvegicus
cacgggttcgacatgacagactgca

SEQ ID NO: 225411 - DNA, 25 bp, Rattus norvegicus
cacgggttcgacttgacagactgca

SEQ ID NO: 225412 - DNA, 25 bp, Rattus norvegicus
cacgggtttcctacagacttctaag

SEQ ID NO: 225413 - DNA, 25 bp, Rattus norvegicus
cacgggtttccttcagacttctaag

SEQ ID NO: 225414 - DNA, 25 bp, Rattus norvegicus
cacggtcactcacttctatattttt

SEQ ID NO: 225415 - DNA, 25 bp, Rattus norvegicus
cacggtcactcagttctatattttt

SEQ ID NO: 225416 - DNA, 25 bp, Rattus norvegicus
cacggtcatgtccttcttactaaaa

SEQ ID NO: 225417 - DNA, 25 bp, Rattus norvegicus
cacggtcatgtcgttcttactaaaa

SEQ ID NO: 225418 - DNA, 25 bp, Rattus norvegicus
cacggtcatgttcacggttgtggcc

SEQ ID NO: 225419 - DNA, 25 bp, Rattus norvegicus
cacggtcatgttgacggttgtggcc

SEQ ID NO: 225420 - DNA, 25 bp, Rattus norvegicus
cacggtccacacagcttaaaggtaa

SEQ ID NO: 225421 - DNA, 25 bp, Rattus norvegicus
cacggtccacactgcttaaaggtaa

SEQ ID NO: 225422 - DNA, 25 bp, Rattus norvegicus
cacggtccaggaccagaaggttttg

SEQ ID NO: 225423 - DNA, 25 bp, Rattus norvegicus
cacggtccaggagcagaaggttttg

SEQ ID NO: 225424 - DNA, 25 bp, Rattus norvegicus
cacggtcctgctctggtcaataaag

SEQ ID NO: 225425 - DNA, 25 bp, Rattus norvegicus
cacggtcctgctgtggtcaataaag

SEQ ID NO: 225426 - DNA, 25 bp, Rattus norvegicus
cacggtcgtggccaacatcagatag

SEQ ID NO: 225427 - DNA, 25 bp, Rattus norvegicus
cacggtcgtggcgaacatcagatag

SEQ ID NO: 225428 - DNA, 25 bp, Rattus norvegicus
cacggtcttccacctttatggagaa

SEQ ID NO: 225429 - DNA, 25 bp, Rattus norvegicus
cacggtcttccagctttatggagaa

SEQ ID NO: 225430 - DNA, 25 bp, Rattus norvegicus
cacggtgacactcttgtctcaaaga

SEQ ID NO: 225431 - DNA, 25 bp, Rattus norvegicus
cacggtgacactgttgtctcaaaga

SEQ ID NO: 225432 - DNA, 25 bp, Rattus norvegicus
cacggtgagagaccagtggctacca

SEQ ID NO: 225433 - DNA, 25 bp, Rattus norvegicus
cacggtgagagagcagtggctacca

SEQ ID NO: 225434 - DNA, 25 bp, Rattus norvegicus
cacggtgagcggagttcagatccca

SEQ ID NO: 225435 - DNA, 25 bp, Rattus norvegicus
cacggtgagcggtgttcagatccca

SEQ ID NO: 225436 - DNA, 25 bp, Rattus norvegicus
cacggtgccttcaagagctgggtac

SEQ ID NO: 225437 - DNA, 25 bp, Rattus norvegicus
cacggtgccttctagagctgggtac

SEQ ID NO: 225438 - DNA, 25 bp, Rattus norvegicus
cacggtgcgcttactgcgcagggaa

SEQ ID NO: 225439 - DNA, 25 bp, Rattus norvegicus
cacggtgcgctttctgcgcagggaa

SEQ ID NO: 225440 - DNA, 25 bp, Rattus norvegicus
cacggtgcggctcgagttcatctga

SEQ ID NO: 225441 - DNA, 25 bp, Rattus norvegicus
cacggtgcggctggagttcatctga

SEQ ID NO: 225442 - DNA, 25 bp, Rattus norvegicus
cacggtggcgccaatgctacgtggg

SEQ ID NO: 225443 - DNA, 25 bp, Rattus norvegicus
cacggtggcgcctatgctacgtggg

SEQ ID NO: 225444 - DNA, 25 bp, Rattus norvegicus
cacggtggctgtatcagtcttgaac

SEQ ID NO: 225445 - DNA, 25 bp, Rattus norvegicus
cacggtggctgtttcagtcttgaac

SEQ ID NO: 225446 - DNA, 25 bp, Rattus norvegicus
cacggtgggccacatcgcgggatgg

SEQ ID NO: 225447 - DNA, 25 bp, Rattus norvegicus
cacggtgggccagatcgcgggatgg

SEQ ID NO: 225448 - DNA, 25 bp, Rattus norvegicus
cacggtgtgttgcatgcccttgctg

SEQ ID NO: 225449 - DNA, 25 bp, Rattus norvegicus
cacggtgtgttggatgcccttgctg

SEQ ID NO: 225450 - DNA, 25 bp, Rattus norvegicus
cacggtgttgtcatctgggatctga

SEQ ID NO: 225451 - DNA, 25 bp, Rattus norvegicus
cacggtgttgtcttctgggatctga

SEQ ID NO: 225452 - DNA, 25 bp, Rattus norvegicus
cacggttctgacatccatgttagga

SEQ ID NO: 225453 - DNA, 25 bp, Rattus norvegicus
cacggttctgacttccatgttagga

SEQ ID NO: 225454 - DNA, 25 bp, Rattus norvegicus
cacggtttagttaatgctgcagcgc

SEQ ID NO: 225455 - DNA, 25 bp, Rattus norvegicus
cacggtttagtttatgctgcagcgc

SEQ ID NO: 225456 - DNA, 25 bp, Rattus norvegicus
cacggtttctatcatttccactgtc

SEQ ID NO: 225457 - DNA, 25 bp, Rattus norvegicus
cacggtttctatgatttccactgtc

SEQ ID NO: 225458 - DNA, 25 bp, Rattus norvegicus
cacgtacagagtagacttcatgccc

SEQ ID NO: 225459 - DNA, 25 bp, Rattus norvegicus
cacgtacagagttgacttcatgccc

SEQ ID NO: 225460 - DNA, 25 bp, Rattus norvegicus
cacgtacctgtacctgaaagccaga

SEQ ID NO: 225461 - DNA, 25 bp, Rattus norvegicus
cacgtacctgtagctgaaagccaga

SEQ ID NO: 225462 - DNA, 25 bp, Rattus norvegicus
cacgtacgtgtcacctgtggaataa

SEQ ID NO: 225463 - DNA, 25 bp, Rattus norvegicus
cacgtacgtgtctcctgtggaataa

SEQ ID NO: 225464 - DNA, 25 bp, Rattus norvegicus
cacgtactgtctctccttagttaaa

SEQ ID NO: 225465 - DNA, 25 bp, Rattus norvegicus
cacgtactgtctgtccttagttaaa

SEQ ID NO: 225466 - DNA, 25 bp, Rattus norvegicus
cacgtagaccggagagctggctgcc

SEQ ID NO: 225467 - DNA, 25 bp, Rattus norvegicus
cacgtagaccggtgagctggctgcc

SEQ ID NO: 225468 - DNA, 25 bp, Rattus norvegicus
cacgtagccccaattttcactaagg

SEQ ID NO: 225469 - DNA, 25 bp, Rattus norvegicus
cacgtagccccatttttcactaagg

SEQ ID NO: 225470 - DNA, 25 bp, Rattus norvegicus
cacgtagccggacgacacatggcca

SEQ ID NO: 225471 - DNA, 25 bp, Rattus norvegicus
cacgtagccggaggacacatggcca

SEQ ID NO: 225472 - DNA, 25 bp, Rattus norvegicus
cacgtaggagccagagtcctgcaga

SEQ ID NO: 225473 - DNA, 25 bp, Rattus norvegicus
cacgtaggagcctgagtcctgcaga

SEQ ID NO: 225474 - DNA, 25 bp, Rattus norvegicus
cacgtaggcgctaagtctcattaat

SEQ ID NO: 225475 - DNA, 25 bp, Rattus norvegicus
cacgtaggcgcttagtctcattaat

SEQ ID NO: 225476 - DNA, 25 bp, Rattus norvegicus
cacgtattctacacacaacacaaca

SEQ ID NO: 225477 - DNA, 25 bp, Rattus norvegicus
cacgtattctactcacaacacaaca

SEQ ID NO: 225478 - DNA, 25 bp, Rattus norvegicus
cacgtatttcttctgtggcacggaa

SEQ ID NO: 225479 - DNA, 25 bp, Rattus norvegicus
cacgtatttcttgtgtggcacggaa

SEQ ID NO: 225480 - DNA, 25 bp, Rattus norvegicus
cacgtcaacgtgagttcatttccaa

SEQ ID NO: 225481 - DNA, 25 bp, Rattus norvegicus
cacgtcaacgtgtgttcatttccaa

SEQ ID NO: 225482 - DNA, 25 bp, Rattus norvegicus
cacgtcaaggctctggaggtagcac

SEQ ID NO: 225483 - DNA, 25 bp, Rattus norvegicus
cacgtcaaggctgtggaggtagcac

SEQ ID NO: 225484 - DNA, 25 bp, Rattus norvegicus
cacgtcactctcactgcaaagtgta

SEQ ID NO: 225485 - DNA, 25 bp, Rattus norvegicus
cacgtcactctctctgcaaagtgta

SEQ ID NO: 225486 - DNA, 25 bp, Rattus norvegicus
cacgtcagcatgactgttggttcag

SEQ ID NO: 225487 - DNA, 25 bp, Rattus norvegicus
cacgtcagcatgtctgttggttcag

SEQ ID NO: 225488 - DNA, 25 bp, Rattus norvegicus
cacgtcccacacctgagattaaaac

SEQ ID NO: 225489 - DNA, 25 bp, Rattus norvegicus
cacgtcccacacgtgagattaaaac

SEQ ID NO: 225490 - DNA, 25 bp, Rattus norvegicus
cacgtccctgggaatgtttatgagg

SEQ ID NO: 225491 - DNA, 25 bp, Rattus norvegicus
cacgtccctgggtatgtttatgagg

SEQ ID NO: 225492 - DNA, 25 bp, Rattus norvegicus
cacgtccctgtactctatgatcaag

SEQ ID NO: 225493 - DNA, 25 bp, Rattus norvegicus
cacgtccctgtagtctatgatcaag

SEQ ID NO: 225494 - DNA, 25 bp, Rattus norvegicus
cacgtccgttttactcattcagaat

SEQ ID NO: 225495 - DNA, 25 bp, Rattus norvegicus
cacgtccgtttttctcattcagaat

SEQ ID NO: 225496 - DNA, 25 bp, Rattus norvegicus
cacgtcctacggaataacaaggcgt

SEQ ID NO: 225497 - DNA, 25 bp, Rattus norvegicus
cacgtcctacggtataacaaggcgt

SEQ ID NO: 225498 - DNA, 25 bp, Rattus norvegicus
cacgtcctgattattctgtgtctgt

SEQ ID NO: 225499 - DNA, 25 bp, Rattus norvegicus
cacgtcctgatttttctgtgtctgt

SEQ ID NO: 225500 - DNA, 25 bp, Rattus norvegicus
cacgtccttcatccgagattcgggt

SEQ ID NO: 225501 - DNA, 25 bp, Rattus norvegicus
cacgtccttcatgcgagattcgggt

SEQ ID NO: 225502 - DNA, 25 bp, Rattus norvegicus
cacgtccttttcaaaatgcttctgt

SEQ ID NO: 225503 - DNA, 25 bp, Rattus norvegicus
cacgtccttttctaaatgcttctgt

SEQ ID NO: 225504 - DNA, 25 bp, Rattus norvegicus
cacgtcggttccatattgctgaaga

SEQ ID NO: 225505 - DNA, 25 bp, Rattus norvegicus
cacgtcggttccttattgctgaaga

SEQ ID NO: 225506 - DNA, 25 bp, Rattus norvegicus
cacgtctaccgtaatcacagaagga

SEQ ID NO: 225507 - DNA, 25 bp, Rattus norvegicus
cacgtctaccgttatcacagaagga

SEQ ID NO: 225508 - DNA, 25 bp, Rattus norvegicus
cacgtctcatgtctctgtgttggga

SEQ ID NO: 225509 - DNA, 25 bp, Rattus norvegicus
cacgtctcatgtgtctgtgttggga

SEQ ID NO: 225510 - DNA, 25 bp, Rattus norvegicus
cacgtcttaaatcttggttctcata

SEQ ID NO: 225511 - DNA, 25 bp, Rattus norvegicus
cacgtcttaaatgttggttctcata

SEQ ID NO: 225512 - DNA, 25 bp, Rattus norvegicus
cacgtgaaaccaagtgtgattttta

SEQ ID NO: 225513 - DNA, 25 bp, Rattus norvegicus
cacgtgaaaccatgtgtgattttta

SEQ ID NO: 225514 - DNA, 25 bp, Rattus norvegicus
cacgtgaacggaaccctgggctcgg

SEQ ID NO: 225515 - DNA, 25 bp, Rattus norvegicus
cacgtgaacggatccctgggctcgg

SEQ ID NO: 225516 - DNA, 25 bp, Rattus norvegicus
cacgtgaactctattctactgggat

SEQ ID NO: 225517 - DNA, 25 bp, Rattus norvegicus
cacgtgaactcttttctactgggat

SEQ ID NO: 225518 - DNA, 25 bp, Rattus norvegicus
cacgtgaccgtgcagtcagcacaaa

SEQ ID NO: 225519 - DNA, 25 bp, Rattus norvegicus
cacgtgaccgtggagtcagcacaaa

SEQ ID NO: 225520 - DNA, 25 bp, Rattus norvegicus
cacgtgactccacgatccgtggatt

SEQ ID NO: 225521 - DNA, 25 bp, Rattus norvegicus
cacgtgactccaggatccgtggatt

SEQ ID NO: 225522 - DNA, 25 bp, Rattus norvegicus
cacgtgagtcctataggtgtttctc

SEQ ID NO: 225523 - DNA, 25 bp, Rattus norvegicus
cacgtgagtcctttaggtgtttctc

SEQ ID NO: 225524 - DNA, 25 bp, Rattus norvegicus
cacgtgatagagctcctgtgtataa

SEQ ID NO: 225525 - DNA, 25 bp, Rattus norvegicus
cacgtgatagaggtcctgtgtataa

SEQ ID NO: 225526 - DNA, 25 bp, Rattus norvegicus
cacgtgatcactaggttcctttgaa

SEQ ID NO: 225527 - DNA, 25 bp, Rattus norvegicus
cacgtgatcacttggttcctttgaa

SEQ ID NO: 225528 - DNA, 25 bp, Rattus norvegicus
cacgtgattgacacaaaattgggct

SEQ ID NO: 225529 - DNA, 25 bp, Rattus norvegicus
cacgtgattgactcaaaattgggct

SEQ ID NO: 225530 - DNA, 25 bp, Rattus norvegicus
cacgtgcgctagatgaggtttttaa

SEQ ID NO: 225531 - DNA, 25 bp, Rattus norvegicus
cacgtgcgctagttgaggtttttaa

SEQ ID NO: 225532 - DNA, 25 bp, Rattus norvegicus
cacgtgctagcactgcgttaggata

SEQ ID NO: 225533 - DNA, 25 bp, Rattus norvegicus
cacgtgctagcagtgcgttaggata

SEQ ID NO: 225534 - DNA, 25 bp, Rattus norvegicus
cacgtggaagacctgcttggtgccc

SEQ ID NO: 225535 - DNA, 25 bp, Rattus norvegicus
cacgtggaagacgtgcttggtgccc

SEQ ID NO: 225536 - DNA, 25 bp, Rattus norvegicus
cacgtggactccatgtatgtatata

SEQ ID NO: 225537 - DNA, 25 bp, Rattus norvegicus
cacgtggactccttgtatgtatata

SEQ ID NO: 225538 - DNA, 25 bp, Rattus norvegicus
cacgtggcctggagaaacttcgagt

SEQ ID NO: 225539 - DNA, 25 bp, Rattus norvegicus
cacgtggcctggtgaaacttcgagt

SEQ ID NO: 225540 - DNA, 25 bp, Rattus norvegicus
cacgtggcggaaatgttgcggacca

SEQ ID NO: 225541 - DNA, 25 bp, Rattus norvegicus
cacgtggcggaattgttgcggacca

SEQ ID NO: 225542 - DNA, 25 bp, Rattus norvegicus
cacgtggcgtgtagtctctagtcag

SEQ ID NO: 225543 - DNA, 25 bp, Rattus norvegicus
cacgtggcgtgttgtctctagtcag

SEQ ID NO: 225544 - DNA, 25 bp, Rattus norvegicus
cacgtgggcagtatttgtaggtcat

SEQ ID NO: 225545 - DNA, 25 bp, Rattus norvegicus
cacgtgggcagtttttgtaggtcat

SEQ ID NO: 225546 - DNA, 25 bp, Rattus norvegicus
cacgtggtggctcactatactgaga

SEQ ID NO: 225547 - DNA, 25 bp, Rattus norvegicus
cacgtggtggctgactatactgaga

SEQ ID NO: 225548 - DNA, 25 bp, Rattus norvegicus
cacgtggtgtctaggatggatcttc

SEQ ID NO: 225549 - DNA, 25 bp, Rattus norvegicus
cacgtggtgtcttggatggatcttc

SEQ ID NO: 225550 - DNA, 25 bp, Rattus norvegicus
cacgtggttccaattcaagatgacc

SEQ ID NO: 225551 - DNA, 25 bp, Rattus norvegicus
cacgtggttccatttcaagatgacc

SEQ ID NO: 225552 - DNA, 25 bp, Rattus norvegicus
cacgtgtaagcactttgttccaaga

SEQ ID NO: 225553 - DNA, 25 bp, Rattus norvegicus
cacgtgtaagcagtttgttccaaga

SEQ ID NO: 225554 - DNA, 25 bp, Rattus norvegicus
cacgtgtcacccaggagggagtcta

SEQ ID NO: 225555 - DNA, 25 bp, Rattus norvegicus
cacgtgtcaccctggagggagtcta

SEQ ID NO: 225556 - DNA, 25 bp, Rattus norvegicus
cacgtgtccattagaaccacctaaa

SEQ ID NO: 225557 - DNA, 25 bp, Rattus norvegicus
cacgtgtccatttgaaccacctaaa

SEQ ID NO: 225558 - DNA, 25 bp, Rattus norvegicus
cacgtgtcgcataaaggttgtcttg

SEQ ID NO: 225559 - DNA, 25 bp, Rattus norvegicus
cacgtgtcgcattaaggttgtcttg

SEQ ID NO: 225560 - DNA, 25 bp, Rattus norvegicus
cacgtgtctgtgaaggcacttacca

SEQ ID NO: 225561 - DNA, 25 bp, Rattus norvegicus
cacgtgtctgtgtaggcacttacca

SEQ ID NO: 225562 - DNA, 25 bp, Rattus norvegicus
cacgtgtgcgcgctcgtgagtacac

SEQ ID NO: 225563 - DNA, 25 bp, Rattus norvegicus
cacgtgtgcgcggtcgtgagtacac

SEQ ID NO: 225564 - DNA, 25 bp, Rattus norvegicus
cacgtgtggcataaacttggtttac

SEQ ID NO: 225565 - DNA, 25 bp, Rattus norvegicus
cacgtgtggcattaacttggtttac

SEQ ID NO: 225566 - DNA, 25 bp, Rattus norvegicus
cacgtgtggtggcagcattcatgtt

SEQ ID NO: 225567 - DNA, 25 bp, Rattus norvegicus
cacgtgtggtgggagcattcatgtt

SEQ ID NO: 225568 - DNA, 25 bp, Rattus norvegicus
cacgtgtgtcatcggtcgtaaggac

SEQ ID NO: 225569 - DNA, 25 bp, Rattus norvegicus
cacgtgtgtcatctacttttgttca

SEQ ID NO: 225570 - DNA, 25 bp, Rattus norvegicus
cacgtgtgtcatgggtcgtaaggac

SEQ ID NO: 225571 - DNA, 25 bp, Rattus norvegicus
cacgtgtgtcatgtacttttgttca

SEQ ID NO: 225572 - DNA, 25 bp, Rattus norvegicus
cacgtgtgtccaatttgaaaagcaa

SEQ ID NO: 225573 - DNA, 25 bp, Rattus norvegicus
cacgtgtgtccattttgaaaagcaa

SEQ ID NO: 225574 - DNA, 25 bp, Rattus norvegicus
cacgtgttccacatgctgtaacagt

SEQ ID NO: 225575 - DNA, 25 bp, Rattus norvegicus
cacgtgttccacttgctgtaacagt

SEQ ID NO: 225576 - DNA, 25 bp, Rattus norvegicus
cacgtgtttcccaccacaatgataa

SEQ ID NO: 225577 - DNA, 25 bp, Rattus norvegicus
cacgtgtttccctccacaatgataa

SEQ ID NO: 225578 - DNA, 25 bp, Rattus norvegicus
cacgtgttttagctgaggcatcgaa

SEQ ID NO: 225579 - DNA, 25 bp, Rattus norvegicus
cacgtgttttaggtgaggcatcgaa

SEQ ID NO: 225580 - DNA, 25 bp, Rattus norvegicus
cacgttagcccgcaagagctgagga

SEQ ID NO: 225581 - DNA, 25 bp, Rattus norvegicus
cacgttagcccggaagagctgagga

SEQ ID NO: 225582 - DNA, 25 bp, Rattus norvegicus
cacgttccagtgactcagtgagggc

SEQ ID NO: 225583 - DNA, 25 bp, Rattus norvegicus
cacgttccagtgtctcagtgagggc

SEQ ID NO: 225584 - DNA, 25 bp, Rattus norvegicus
cacgttccctatacccgagtctggg

SEQ ID NO: 225585 - DNA, 25 bp, Rattus norvegicus
cacgttccctattcccgagtctggg

SEQ ID NO: 225586 - DNA, 25 bp, Rattus norvegicus
cacgttccgcaactatgacctagat

SEQ ID NO: 225587 - DNA, 25 bp, Rattus norvegicus
cacgttccgcaagtatgacctagat

SEQ ID NO: 225588 - DNA, 25 bp, Rattus norvegicus
cacgttctacttcagctttggatgt

SEQ ID NO: 225589 - DNA, 25 bp, Rattus norvegicus
cacgttctacttgagctttggatgt

SEQ ID NO: 225590 - DNA, 25 bp, Rattus norvegicus
cacgttctctggactcacagtttag

SEQ ID NO: 225591 - DNA, 25 bp, Rattus norvegicus
cacgttctctggtctcacagtttag

SEQ ID NO: 225592 - DNA, 25 bp, Rattus norvegicus
cacgttctggtcatacccatggaaa

SEQ ID NO: 225593 - DNA, 25 bp, Rattus norvegicus
cacgttctggtcttacccatggaaa

SEQ ID NO: 225594 - DNA, 25 bp, Rattus norvegicus
cacgttgcaggcaacacgctggaaa

SEQ ID NO: 225595 - DNA, 25 bp, Rattus norvegicus
cacgttgcaggctacacgctggaaa

SEQ ID NO: 225596 - DNA, 25 bp, Rattus norvegicus
cacgttgcatgtctacacttggtcg

SEQ ID NO: 225597 - DNA, 25 bp, Rattus norvegicus
cacgttgcatgtgtacacttggtcg

SEQ ID NO: 225598 - DNA, 25 bp, Rattus norvegicus
cacgttgcgctgattgtgtttgacc

SEQ ID NO: 225599 - DNA, 25 bp, Rattus norvegicus
cacgttgcgctgtttgtgtttgacc

SEQ ID NO: 225600 - DNA, 25 bp, Rattus norvegicus
cacgttggatgaactaactgcctca

SEQ ID NO: 225601 - DNA, 25 bp, Rattus norvegicus
cacgttggatgatctaactgcctca

SEQ ID NO: 225602 - DNA, 25 bp, Rattus norvegicus
cacgttgggccgaatgcactattac

SEQ ID NO: 225603 - DNA, 25 bp, Rattus norvegicus
cacgttgggccgtatgcactattac

SEQ ID NO: 225604 - DNA, 25 bp, Rattus norvegicus
cacgttggtgtgattgcaccaggct

SEQ ID NO: 225605 - DNA, 25 bp, Rattus norvegicus
cacgttggtgtgtttgcaccaggct

SEQ ID NO: 225606 - DNA, 25 bp, Rattus norvegicus
cacgttgtgaggaggctgttttcct

SEQ ID NO: 225607 - DNA, 25 bp, Rattus norvegicus
cacgttgtgaggtggctgttttcct

SEQ ID NO: 225608 - DNA, 25 bp, Rattus norvegicus
cacgttgtgtaaatatcttcttgga

SEQ ID NO: 225609 - DNA, 25 bp, Rattus norvegicus
cacgttgtgtaattatcttcttgga

SEQ ID NO: 225610 - DNA, 25 bp, Rattus norvegicus
cacgtttaatgtagaagcttttgcg

SEQ ID NO: 225611 - DNA, 25 bp, Rattus norvegicus
cacgtttaatgttgaagcttttgcg

SEQ ID NO: 225612 - DNA, 25 bp, Rattus norvegicus
cacgttttaggaactcgcctggaaa

SEQ ID NO: 225613 - DNA, 25 bp, Rattus norvegicus
cacgttttaggatctcgcctggaaa

SEQ ID NO: 225614 - DNA, 25 bp, Rattus norvegicus
cacgttttccaaattctgggcacca

SEQ ID NO: 225615 - DNA, 25 bp, Rattus norvegicus
cacgttttccaatttctgggcacca

SEQ ID NO: 225616 - DNA, 25 bp, Rattus norvegicus
cacgttttgcgtcttcgggactctc

SEQ ID NO: 225617 - DNA, 25 bp, Rattus norvegicus
cacgttttgcgtgttcgggactctc

SEQ ID NO: 225618 - DNA, 25 bp, Rattus norvegicus
cacgtttttcacacagggtttcact

SEQ ID NO: 225619 - DNA, 25 bp, Rattus norvegicus
cacgtttttcactcagggtttcact

SEQ ID NO: 225620 - DNA, 25 bp, Rattus norvegicus
cactaaaaaagacaccggcttgctt

SEQ ID NO: 225621 - DNA, 25 bp, Rattus norvegicus
cactaaaaaagagaccggcttgctt

SEQ ID NO: 225622 - DNA, 25 bp, Rattus norvegicus
cactaaaaacagactagctgggctc

SEQ ID NO: 225623 - DNA, 25 bp, Rattus norvegicus
cactaaaaacagtctagctgggctc

SEQ ID NO: 225624 - DNA, 25 bp, Rattus norvegicus
cactaaaatctacgtgtccctggaa

SEQ ID NO: 225625 - DNA, 25 bp, Rattus norvegicus
cactaaaatctaggtgtccctggaa

SEQ ID NO: 225626 - DNA, 25 bp, Rattus norvegicus
cactaaagactgatgggttgttcct

SEQ ID NO: 225627 - DNA, 25 bp, Rattus norvegicus
cactaaagactgttgggttgttcct

SEQ ID NO: 225628 - DNA, 25 bp, Rattus norvegicus
cactaaatggttatctgttcagagg

SEQ ID NO: 225629 - DNA, 25 bp, Rattus norvegicus
cactaaatggttttctgttcagagg

SEQ ID NO: 225630 - DNA, 25 bp, Rattus norvegicus
cactaacagtgcagaggacagaact

SEQ ID NO: 225631 - DNA, 25 bp, Rattus norvegicus
cactaacagtgctgaggacagaact

SEQ ID NO: 225632 - DNA, 25 bp, Rattus norvegicus
cactaacctggccttgtatcttctt

SEQ ID NO: 225633 - DNA, 25 bp, Rattus norvegicus
cactaacctggcgttgtatcttctt

SEQ ID NO: 225634 - DNA, 25 bp, Rattus norvegicus
cactaactccagaactgtgacagtt

SEQ ID NO: 225635 - DNA, 25 bp, Rattus norvegicus
cactaactccagtactgtgacagtt

SEQ ID NO: 225636 - DNA, 25 bp, Rattus norvegicus
cactaactgcctcccagaatggaag

SEQ ID NO: 225637 - DNA, 25 bp, Rattus norvegicus
cactaactgcctgccagaatggaag

SEQ ID NO: 225638 - DNA, 25 bp, Rattus norvegicus
cactaagaatgcaggaacacacggt

SEQ ID NO: 225639 - DNA, 25 bp, Rattus norvegicus
cactaagaatgctggaacacacggt

SEQ ID NO: 225640 - DNA, 25 bp, Rattus norvegicus
cactaagatataacctgcaagcata

SEQ ID NO: 225641 - DNA, 25 bp, Rattus norvegicus
cactaagatatatcctgcaagcata

SEQ ID NO: 225642 - DNA, 25 bp, Rattus norvegicus
cactaagcattgcttctgttttctc

SEQ ID NO: 225643 - DNA, 25 bp, Rattus norvegicus
cactaagcattggttctgttttctc

SEQ ID NO: 225644 - DNA, 25 bp, Rattus norvegicus
cactaagcttgtatgtcaccatgag

SEQ ID NO: 225645 - DNA, 25 bp, Rattus norvegicus
cactaagcttgtttgtcaccatgag

SEQ ID NO: 225646 - DNA, 25 bp, Rattus norvegicus
cactaagtaagcagggtctctaccc

SEQ ID NO: 225647 - DNA, 25 bp, Rattus norvegicus
cactaagtaagctgggtctctaccc

SEQ ID NO: 225648 - DNA, 25 bp, Rattus norvegicus
cactaagtcgggaagctggccagtc

SEQ ID NO: 225649 - DNA, 25 bp, Rattus norvegicus
cactaagtcgggtagctggccagtc

SEQ ID NO: 225650 - DNA, 25 bp, Rattus norvegicus
cactaagttttacactccctgggag

SEQ ID NO: 225651 - DNA, 25 bp, Rattus norvegicus
cactaagttttagactccctgggag

SEQ ID NO: 225652 - DNA, 25 bp, Rattus norvegicus
cactaatccgttaggcgcaggcgaa

SEQ ID NO: 225653 - DNA, 25 bp, Rattus norvegicus
cactaatccgtttggcgcaggcgaa

SEQ ID NO: 225654 - DNA, 25 bp, Rattus norvegicus
cactaatggatgatccagtgtttaa

SEQ ID NO: 225655 - DNA, 25 bp, Rattus norvegicus
cactaatggatgttccagtgtttaa

SEQ ID NO: 225656 - DNA, 25 bp, Rattus norvegicus
cactaatgtttaactgagagcccag

SEQ ID NO: 225657 - DNA, 25 bp, Rattus norvegicus
cactaatgtttatctgagagcccag

SEQ ID NO: 225658 - DNA, 25 bp, Rattus norvegicus
cactacaaccccagcttggttataa

SEQ ID NO: 225659 - DNA, 25 bp, Rattus norvegicus
cactacaacccctgcttggttataa

SEQ ID NO: 225660 - DNA, 25 bp, Rattus norvegicus
cactacaagttcagatgggcccaga

SEQ ID NO: 225661 - DNA, 25 bp, Rattus norvegicus
cactacaagttctgatgggcccaga

SEQ ID NO: 225662 - DNA, 25 bp, Rattus norvegicus
cactacacagcccatgaagctcaat

SEQ ID NO: 225663 - DNA, 25 bp, Rattus norvegicus
cactacacagccgatgaagctcaat

SEQ ID NO: 225664 - DNA, 25 bp, Rattus norvegicus
cactacacaggtatggcatcttata

SEQ ID NO: 225665 - DNA, 25 bp, Rattus norvegicus
cactacacaggtttggcatcttata

SEQ ID NO: 225666 - DNA, 25 bp, Rattus norvegicus
cactacagatgtacgtgtccttaca

SEQ ID NO: 225667 - DNA, 25 bp, Rattus norvegicus
cactacagatgttcgtgtccttaca

SEQ ID NO: 225668 - DNA, 25 bp, Rattus norvegicus
cactaccactttagttacaaaggct

SEQ ID NO: 225669 - DNA, 25 bp, Rattus norvegicus
cactaccacttttgttacaaaggct

SEQ ID NO: 225670 - DNA, 25 bp, Rattus norvegicus
cactaccctatgaccagatttcaga

SEQ ID NO: 225671 - DNA, 25 bp, Rattus norvegicus
cactaccctatgtccagatttcaga

SEQ ID NO: 225672 - DNA, 25 bp, Rattus norvegicus
cactacctacgtactgtctgttaaa

SEQ ID NO: 225673 - DNA, 25 bp, Rattus norvegicus
cactacctacgttctgtctgttaaa

SEQ ID NO: 225674 - DNA, 25 bp, Rattus norvegicus
cactacctaggaccatggctggttt

SEQ ID NO: 225675 - DNA, 25 bp, Rattus norvegicus
cactacctaggagcatggctggttt

SEQ ID NO: 225676 - DNA, 25 bp, Rattus norvegicus
cactaccttcttccaaaaccaatga

SEQ ID NO: 225677 - DNA, 25 bp, Rattus norvegicus
cactaccttcttgcaaaaccaatga

SEQ ID NO: 225678 - DNA, 25 bp, Rattus norvegicus
cactacgcacgtatatatgtgttaa

SEQ ID NO: 225679 - DNA, 25 bp, Rattus norvegicus
cactacgcacgtttatatgtgttaa

SEQ ID NO: 225680 - DNA, 25 bp, Rattus norvegicus
cactacgtggctcgtccttgctgat

SEQ ID NO: 225681 - DNA, 25 bp, Rattus norvegicus
cactacgtggctggtccttgctgat

SEQ ID NO: 225682 - DNA, 25 bp, Rattus norvegicus
cactactagtgaacagcggctcaat

SEQ ID NO: 225683 - DNA, 25 bp, Rattus norvegicus
cactactagtgatcagcggctcaat

SEQ ID NO: 225684 - DNA, 25 bp, Rattus norvegicus
cactactcctataacattttctatg

SEQ ID NO: 225685 - DNA, 25 bp, Rattus norvegicus
cactactcctattacattttctatg

SEQ ID NO: 225686 - DNA, 25 bp, Rattus norvegicus
cactactctgagaccacggagattt

SEQ ID NO: 225687 - DNA, 25 bp, Rattus norvegicus
cactactctgagtccacggagattt

SEQ ID NO: 225688 - DNA, 25 bp, Rattus norvegicus
cactacttcaggcaaacatgagggt

SEQ ID NO: 225689 - DNA, 25 bp, Rattus norvegicus
cactacttcagggaaacatgagggt

SEQ ID NO: 225690 - DNA, 25 bp, Rattus norvegicus
cactacttcctgactattgatctgt

SEQ ID NO: 225691 - DNA, 25 bp, Rattus norvegicus
cactacttcctgtctattgatctgt

SEQ ID NO: 225692 - DNA, 25 bp, Rattus norvegicus
cactacttcgacactgcgattgtga

SEQ ID NO: 225693 - DNA, 25 bp, Rattus norvegicus
cactacttcgactctgcgattgtga

SEQ ID NO: 225694 - DNA, 25 bp, Rattus norvegicus
cactacttctttagtgcatgtgtaa

SEQ ID NO: 225695 - DNA, 25 bp, Rattus norvegicus
cactacttcttttgtgcatgtgtaa

SEQ ID NO: 225696 - DNA, 25 bp, Rattus norvegicus
cactactttaacacctggttccatg

SEQ ID NO: 225697 - DNA, 25 bp, Rattus norvegicus
cactactttaactcctggttccatg

SEQ ID NO: 225698 - DNA, 25 bp, Rattus norvegicus
cactactttaatctttgcatgccta

SEQ ID NO: 225699 - DNA, 25 bp, Rattus norvegicus
cactactttaatgtttgcatgccta

SEQ ID NO: 225700 - DNA, 25 bp, Rattus norvegicus
cactactttcaacgcttcttctgta

SEQ ID NO: 225701 - DNA, 25 bp, Rattus norvegicus
cactactttcaaggcttcttctgta

SEQ ID NO: 225702 - DNA, 25 bp, Rattus norvegicus
cactagaattctctggtctggtgaa

SEQ ID NO: 225703 - DNA, 25 bp, Rattus norvegicus
cactagaattctgtggtctggtgaa

SEQ ID NO: 225704 - DNA, 25 bp, Rattus norvegicus
cactagcagcttccctaagcagatg

SEQ ID NO: 225705 - DNA, 25 bp, Rattus norvegicus
cactagcagcttgcctaagcagatg

SEQ ID NO: 225706 - DNA, 25 bp, Rattus norvegicus
cactagctatttctttgtatccctt

SEQ ID NO: 225707 - DNA, 25 bp, Rattus norvegicus
cactagctatttgtttgtatccctt

SEQ ID NO: 225708 - DNA, 25 bp, Rattus norvegicus
cactagctctaaacactgtcacgtt

SEQ ID NO: 225709 - DNA, 25 bp, Rattus norvegicus
cactagctctaatcactgtcacgtt

SEQ ID NO: 225710 - DNA, 25 bp, Rattus norvegicus
cactagctgcctactgggttatgag

SEQ ID NO: 225711 - DNA, 25 bp, Rattus norvegicus
cactagctgccttctgggttatgag

SEQ ID NO: 225712 - DNA, 25 bp, Rattus norvegicus
cactagctggctacgggccaaggaa

SEQ ID NO: 225713 - DNA, 25 bp, Rattus norvegicus
cactagctggcttcgggccaaggaa

SEQ ID NO: 225714 - DNA, 25 bp, Rattus norvegicus
cactagctgtgtagctcctaacaga

SEQ ID NO: 225715 - DNA, 25 bp, Rattus norvegicus
cactagctgtgttgctcctaacaga

SEQ ID NO: 225716 - DNA, 25 bp, Rattus norvegicus
cactaggcgcagatgtgtagcagtt

SEQ ID NO: 225717 - DNA, 25 bp, Rattus norvegicus
cactaggcgcagttgtgtagcagtt

SEQ ID NO: 225718 - DNA, 25 bp, Rattus norvegicus
cactaggctcatccccggaggtatt

SEQ ID NO: 225719 - DNA, 25 bp, Rattus norvegicus
cactaggctcatgcccggaggtatt

SEQ ID NO: 225720 - DNA, 25 bp, Rattus norvegicus
cactaggctcggctaggttctaaca

SEQ ID NO: 225721 - DNA, 25 bp, Rattus norvegicus
cactaggctcgggtaggttctaaca

SEQ ID NO: 225722 - DNA, 25 bp, Rattus norvegicus
cactaggtaaaacgccttcagctta

SEQ ID NO: 225723 - DNA, 25 bp, Rattus norvegicus
cactaggtaaaaggccttcagctta

SEQ ID NO: 225724 - DNA, 25 bp, Rattus norvegicus
cactaggtcgctctcgtttttataa

SEQ ID NO: 225725 - DNA, 25 bp, Rattus norvegicus
cactaggtcgctgtcgtttttataa

SEQ ID NO: 225726 - DNA, 25 bp, Rattus norvegicus
cactaggtgtttcaaatgcgcaggg

SEQ ID NO: 225727 - DNA, 25 bp, Rattus norvegicus
cactaggtgtttgaaatgcgcaggg

SEQ ID NO: 225728 - DNA, 25 bp, Rattus norvegicus
cactagtggtcgacagtcactgtct

SEQ ID NO: 225729 - DNA, 25 bp, Rattus norvegicus
cactagtggtcgtcagtcactgtct

SEQ ID NO: 225730 - DNA, 25 bp, Rattus norvegicus
cactagttctgtagaggatgcttaa

SEQ ID NO: 225731 - DNA, 25 bp, Rattus norvegicus
cactagttctgttgaggatgcttaa

SEQ ID NO: 225732 - DNA, 25 bp, Rattus norvegicus
cactagtttaaacacccaccagagt

SEQ ID NO: 225733 - DNA, 25 bp, Rattus norvegicus
cactagtttaaagacccaccagagt

SEQ ID NO: 225734 - DNA, 25 bp, Rattus norvegicus
cactataataccagcatttctgatt

SEQ ID NO: 225735 - DNA, 25 bp, Rattus norvegicus
cactataatacctgcatttctgatt

SEQ ID NO: 225736 - DNA, 25 bp, Rattus norvegicus
cactataccactattacactcattc

SEQ ID NO: 225737 - DNA, 25 bp, Rattus norvegicus
cactataccacttttacactcattc

SEQ ID NO: 225738 - DNA, 25 bp, Rattus norvegicus
cactatataaatacctgccttcagc

SEQ ID NO: 225739 - DNA, 25 bp, Rattus norvegicus
cactatataaattcctgccttcagc

SEQ ID NO: 225740 - DNA, 25 bp, Rattus norvegicus
cactatattcctaaacttggttata

SEQ ID NO: 225741 - DNA, 25 bp, Rattus norvegicus
cactatattccttaacttggttata

SEQ ID NO: 225742 - DNA, 25 bp, Rattus norvegicus
cactatcaccacctggcaagttatt

SEQ ID NO: 225743 - DNA, 25 bp, Rattus norvegicus
cactatcaccacgtggcaagttatt

SEQ ID NO: 225744 - DNA, 25 bp, Rattus norvegicus
cactatcagcccatgctggattggg

SEQ ID NO: 225745 - DNA, 25 bp, Rattus norvegicus
cactatcagcccttgctggattggg

SEQ ID NO: 225746 - DNA, 25 bp, Rattus norvegicus
cactatcatttgactcctgtgcatg

SEQ ID NO: 225747 - DNA, 25 bp, Rattus norvegicus
cactatcatttgtctcctgtgcatg

SEQ ID NO: 225748 - DNA, 25 bp, Rattus norvegicus
cactatcggcaaagagcggttccga

SEQ ID NO: 225749 - DNA, 25 bp, Rattus norvegicus
cactatcggcaatgagcggttccga

SEQ ID NO: 225750 - DNA, 25 bp, Rattus norvegicus
cactatctgtacagttgtgcaagat

SEQ ID NO: 225751 - DNA, 25 bp, Rattus norvegicus
cactatctgtactgttgtgcaagat

SEQ ID NO: 225752 - DNA, 25 bp, Rattus norvegicus
cactatgactttcgtggtttgaata

SEQ ID NO: 225753 - DNA, 25 bp, Rattus norvegicus
cactatgactttggtggtttgaata

SEQ ID NO: 225754 - DNA, 25 bp, Rattus norvegicus
cactatgagtcccacgccgagaagc

SEQ ID NO: 225755 - DNA, 25 bp, Rattus norvegicus
cactatgagtccgacgccgagaagc

SEQ ID NO: 225756 - DNA, 25 bp, Rattus norvegicus
cactatgagtttcttgtcccgttga

SEQ ID NO: 225757 - DNA, 25 bp, Rattus norvegicus
cactatgagtttgttgtcccgttga

SEQ ID NO: 225758 - DNA, 25 bp, Rattus norvegicus
cactatgatgcgctgggttcaatcc

SEQ ID NO: 225759 - DNA, 25 bp, Rattus norvegicus
cactatgatgcggtgggttcaatcc

SEQ ID NO: 225760 - DNA, 25 bp, Rattus norvegicus
cactatgcacacactatgctggttt

SEQ ID NO: 225761 - DNA, 25 bp, Rattus norvegicus
cactatgcacactctatgctggttt

SEQ ID NO: 225762 - DNA, 25 bp, Rattus norvegicus
cactatgcacggatgtttggaattc

SEQ ID NO: 225763 - DNA, 25 bp, Rattus norvegicus
cactatgcacggttgtttggaattc

SEQ ID NO: 225764 - DNA, 25 bp, Rattus norvegicus
cactatgcagcaacctttgaggtct

SEQ ID NO: 225765 - DNA, 25 bp, Rattus norvegicus
cactatgcagcatcctttgaggtct

SEQ ID NO: 225766 - DNA, 25 bp, Rattus norvegicus
cactatgctcatcctaagaccgaca

SEQ ID NO: 225767 - DNA, 25 bp, Rattus norvegicus
cactatgctcatgctaagaccgaca

SEQ ID NO: 225768 - DNA, 25 bp, Rattus norvegicus
cactatgtagctctcctcgaactca

SEQ ID NO: 225769 - DNA, 25 bp, Rattus norvegicus
cactatgtagctgtcctcgaactca

SEQ ID NO: 225770 - DNA, 25 bp, Rattus norvegicus
cactatgtcctacacctgttgatgg

SEQ ID NO: 225771 - DNA, 25 bp, Rattus norvegicus
cactatgtcctagacctgttgatgg

SEQ ID NO: 225772 - DNA, 25 bp, Rattus norvegicus
cactatgtcgtgcaggatgatctta

SEQ ID NO: 225773 - DNA, 25 bp, Rattus norvegicus
cactatgtcgtggaggatgatctta

SEQ ID NO: 225774 - DNA, 25 bp, Rattus norvegicus
cactattccatcactgtcagacata

SEQ ID NO: 225775 - DNA, 25 bp, Rattus norvegicus
cactattccatctctgtcagacata

SEQ ID NO: 225776 - DNA, 25 bp, Rattus norvegicus
cactattgcatgcaccgtgtggata

SEQ ID NO: 225777 - DNA, 25 bp, Rattus norvegicus
cactattgcatggaccgtgtggata

SEQ ID NO: 225778 - DNA, 25 bp, Rattus norvegicus
cactatttctgtctggctttcaaac

SEQ ID NO: 225779 - DNA, 25 bp, Rattus norvegicus
cactatttctgtgtggctttcaaac

SEQ ID NO: 225780 - DNA, 25 bp, Rattus norvegicus
cactatttctttatccagaggctta

SEQ ID NO: 225781 - DNA, 25 bp, Rattus norvegicus
cactatttctttttccagaggctta

SEQ ID NO: 225782 - DNA, 25 bp, Rattus norvegicus
cactatttgggcagtgcaatgcggt

SEQ ID NO: 225783 - DNA, 25 bp, Rattus norvegicus
cactatttgggctgtgcaatgcggt

SEQ ID NO: 225784 - DNA, 25 bp, Rattus norvegicus
cactattttatcagtcacctcaaag

SEQ ID NO: 225785 - DNA, 25 bp, Rattus norvegicus
cactattttatctgtcacctcaaag

SEQ ID NO: 225786 - DNA, 25 bp, Rattus norvegicus
cactcaacctacattctgaggtggg

SEQ ID NO: 225787 - DNA, 25 bp, Rattus norvegicus
cactcaacctactttctgaggtggg

SEQ ID NO: 225788 - DNA, 25 bp, Rattus norvegicus
cactcaactgttcttcctcagatca

SEQ ID NO: 225789 - DNA, 25 bp, Rattus norvegicus
cactcaactgttgttcctcagatca

SEQ ID NO: 225790 - DNA, 25 bp, Rattus norvegicus
cactcaaggtggctttcgaactctt

SEQ ID NO: 225791 - DNA, 25 bp, Rattus norvegicus
cactcaaggtgggtttcgaactctt

SEQ ID NO: 225792 - DNA, 25 bp, Rattus norvegicus
cactcaatagcaacgtctggactct

SEQ ID NO: 225793 - DNA, 25 bp, Rattus norvegicus
cactcaatagcatcgtctggactct

SEQ ID NO: 225794 - DNA, 25 bp, Rattus norvegicus
cactcaatgcctcactattctttag

SEQ ID NO: 225795 - DNA, 25 bp, Rattus norvegicus
cactcaatgcctgactattctttag

SEQ ID NO: 225796 - DNA, 25 bp, Rattus norvegicus
cactcaatggagaggttccaccgat

SEQ ID NO: 225797 - DNA, 25 bp, Rattus norvegicus
cactcaatggagtggttccaccgat

SEQ ID NO: 225798 - DNA, 25 bp, Rattus norvegicus
cactcaattttgctcctgtgtgaat

SEQ ID NO: 225799 - DNA, 25 bp, Rattus norvegicus
cactcaattttgctcttctgaatga

SEQ ID NO: 225800 - DNA, 25 bp, Rattus norvegicus
cactcaattttggtcctgtgtgaat

SEQ ID NO: 225801 - DNA, 25 bp, Rattus norvegicus
cactcaattttggtcttctgaatga

SEQ ID NO: 225802 - DNA, 25 bp, Rattus norvegicus
cactcacaatgcaactcctggtggg

SEQ ID NO: 225803 - DNA, 25 bp, Rattus norvegicus
cactcacaatgctactcctggtggg

SEQ ID NO: 225804 - DNA, 25 bp, Rattus norvegicus
cactcaccactgcttacgtatggaa

SEQ ID NO: 225805 - DNA, 25 bp, Rattus norvegicus
cactcaccactggttacgtatggaa

SEQ ID NO: 225806 - DNA, 25 bp, Rattus norvegicus
cactcaccgtatagggacttatttt

SEQ ID NO: 225807 - DNA, 25 bp, Rattus norvegicus
cactcaccgtattgggacttatttt

SEQ ID NO: 225808 - DNA, 25 bp, Rattus norvegicus
cactcacctcacaccaataattaga

SEQ ID NO: 225809 - DNA, 25 bp, Rattus norvegicus
cactcacctcactccaataattaga

SEQ ID NO: 225810 - DNA, 25 bp, Rattus norvegicus
cactcacctgtgaacaaagactctc

SEQ ID NO: 225811 - DNA, 25 bp, Rattus norvegicus
cactcacctgtgtacaaagactctc

SEQ ID NO: 225812 - DNA, 25 bp, Rattus norvegicus
cactcacgacgtactggttagggta

SEQ ID NO: 225813 - DNA, 25 bp, Rattus norvegicus
cactcacgacgttctggttagggta

SEQ ID NO: 225814 - DNA, 25 bp, Rattus norvegicus
cactcacgcgggattcggtggagta

SEQ ID NO: 225815 - DNA, 25 bp, Rattus norvegicus
cactcacgcgggtttcggtggagta

SEQ ID NO: 225816 - DNA, 25 bp, Rattus norvegicus
cactcacggagcaggttttgacaat

SEQ ID NO: 225817 - DNA, 25 bp, Rattus norvegicus
cactcacggagctggttttgacaat

SEQ ID NO: 225818 - DNA, 25 bp, Rattus norvegicus
cactcacggtcacaacttcggaaga

SEQ ID NO: 225819 - DNA, 25 bp, Rattus norvegicus
cactcacggtcagaacttcggaaga

SEQ ID NO: 225820 - DNA, 25 bp, Rattus norvegicus
cactcactctcacgtctcaaaataa

SEQ ID NO: 225821 - DNA, 25 bp, Rattus norvegicus
cactcactctcaggtctcaaaataa

SEQ ID NO: 225822 - DNA, 25 bp, Rattus norvegicus
cactcacttactaatctggttagga

SEQ ID NO: 225823 - DNA, 25 bp, Rattus norvegicus
cactcacttacttatctggttagga

SEQ ID NO: 225824 - DNA, 25 bp, Rattus norvegicus
cactcacttaggagggcacatggaa

SEQ ID NO: 225825 - DNA, 25 bp, Rattus norvegicus
cactcacttaggtgggcacatggaa

SEQ ID NO: 225826 - DNA, 25 bp, Rattus norvegicus
cactcacttttgcacctcaagtcta

SEQ ID NO: 225827 - DNA, 25 bp, Rattus norvegicus
cactcacttttggacctcaagtcta

SEQ ID NO: 225828 - DNA, 25 bp, Rattus norvegicus
cactcagacctgcttaggcttcgag

SEQ ID NO: 225829 - DNA, 25 bp, Rattus norvegicus
cactcagacctggttaggcttcgag

SEQ ID NO: 225830 - DNA, 25 bp, Rattus norvegicus
cactcagcagagactaggtaaccta

SEQ ID NO: 225831 - DNA, 25 bp, Rattus norvegicus
cactcagcagagtctaggtaaccta

SEQ ID NO: 225832 - DNA, 25 bp, Rattus norvegicus
cactcagcagctcgcgatactggga

SEQ ID NO: 225833 - DNA, 25 bp, Rattus norvegicus
cactcagcagctggcgatactggga

SEQ ID NO: 225834 - DNA, 25 bp, Rattus norvegicus
cactcagcagttcaaggcacttgtt

SEQ ID NO: 225835 - DNA, 25 bp, Rattus norvegicus
cactcagcagttgaaggcacttgtt

SEQ ID NO: 225836 - DNA, 25 bp, Rattus norvegicus
cactcagccctaattcatactttgg

SEQ ID NO: 225837 - DNA, 25 bp, Rattus norvegicus
cactcagccctatttcatactttgg

SEQ ID NO: 225838 - DNA, 25 bp, Rattus norvegicus
cactcagcgggtcttaacgtagttt

SEQ ID NO: 225839 - DNA, 25 bp, Rattus norvegicus
cactcagcgggtgttaacgtagttt

SEQ ID NO: 225840 - DNA, 25 bp, Rattus norvegicus
cactcagctatgctagggcttggct

SEQ ID NO: 225841 - DNA, 25 bp, Rattus norvegicus
cactcagctatggtagggcttggct

SEQ ID NO: 225842 - DNA, 25 bp, Rattus norvegicus
cactcagcttccagcatgttaggaa

SEQ ID NO: 225843 - DNA, 25 bp, Rattus norvegicus
cactcagcttcctgcatgttaggaa

SEQ ID NO: 225844 - DNA, 25 bp, Rattus norvegicus
cactcagctttgcagggtcattggg

SEQ ID NO: 225845 - DNA, 25 bp, Rattus norvegicus
cactcagctttggagggtcattggg

SEQ ID NO: 225846 - DNA, 25 bp, Rattus norvegicus
cactcaggaaatacagacaggcaaa

SEQ ID NO: 225847 - DNA, 25 bp, Rattus norvegicus
cactcaggaaattcagacaggcaaa

SEQ ID NO: 225848 - DNA, 25 bp, Rattus norvegicus
cactcaggcccaacaatacaaaaca

SEQ ID NO: 225849 - DNA, 25 bp, Rattus norvegicus
cactcaggcccatcaatacaaaaca

SEQ ID NO: 225850 - DNA, 25 bp, Rattus norvegicus
cactcaggtgtcagctgtttatctt

SEQ ID NO: 225851 - DNA, 25 bp, Rattus norvegicus
cactcaggtgtctgctgtttatctt

SEQ ID NO: 225852 - DNA, 25 bp, Rattus norvegicus
cactcagtacatacttctatcctaa

SEQ ID NO: 225853 - DNA, 25 bp, Rattus norvegicus
cactcagtacattcttctatcctaa

SEQ ID NO: 225854 - DNA, 25 bp, Rattus norvegicus
cactcagtgacaaggttgggttgtt

SEQ ID NO: 225855 - DNA, 25 bp, Rattus norvegicus
cactcagtgacatggttgggttgtt

SEQ ID NO: 225856 - DNA, 25 bp, Rattus norvegicus
cactcagtgagtattttcctgttgt

SEQ ID NO: 225857 - DNA, 25 bp, Rattus norvegicus
cactcagtgagttttttcctgttgt

SEQ ID NO: 225858 - DNA, 25 bp, Rattus norvegicus
cactcagtgtatattttgcccattt

SEQ ID NO: 225859 - DNA, 25 bp, Rattus norvegicus
cactcagtgtattttttgcccattt

SEQ ID NO: 225860 - DNA, 25 bp, Rattus norvegicus
cactcagtgtccacttttctgggag

SEQ ID NO: 225861 - DNA, 25 bp, Rattus norvegicus
cactcagtgtcctcttttctgggag

SEQ ID NO: 225862 - DNA, 25 bp, Rattus norvegicus
cactcatagaggatcactgtcacaa

SEQ ID NO: 225863 - DNA, 25 bp, Rattus norvegicus
cactcatagaggttcactgtcacaa

SEQ ID NO: 225864 - DNA, 25 bp, Rattus norvegicus
cactcatccctaagcggcaataaac

SEQ ID NO: 225865 - DNA, 25 bp, Rattus norvegicus
cactcatccctatgcggcaataaac

SEQ ID NO: 225866 - DNA, 25 bp, Rattus norvegicus
cactcatctaatcacctgcaagaac

SEQ ID NO: 225867 - DNA, 25 bp, Rattus norvegicus
cactcatctaatgacctgcaagaac

SEQ ID NO: 225868 - DNA, 25 bp, Rattus norvegicus
cactcatctccaccgagttagtatt

SEQ ID NO: 225869 - DNA, 25 bp, Rattus norvegicus
cactcatctccagcgagttagtatt

SEQ ID NO: 225870 - DNA, 25 bp, Rattus norvegicus
cactcatgagacagacaagatggca

SEQ ID NO: 225871 - DNA, 25 bp, Rattus norvegicus
cactcatgagactgacaagatggca

SEQ ID NO: 225872 - DNA, 25 bp, Rattus norvegicus
cactcatggttactgcccgctcctc

SEQ ID NO: 225873 - DNA, 25 bp, Rattus norvegicus
cactcatggttagtgcccgctcctc

SEQ ID NO: 225874 - DNA, 25 bp, Rattus norvegicus
cactcattccaaaccaacgtttggt

SEQ ID NO: 225875 - DNA, 25 bp, Rattus norvegicus
cactcattccaatccaacgtttggt

SEQ ID NO: 225876 - DNA, 25 bp, Rattus norvegicus
cactcattcttcactgtggtttgag

SEQ ID NO: 225877 - DNA, 25 bp, Rattus norvegicus
cactcattcttctctgtggtttgag

SEQ ID NO: 225878 - DNA, 25 bp, Rattus norvegicus
cactccaagcttcctgaggtacaag

SEQ ID NO: 225879 - DNA, 25 bp, Rattus norvegicus
cactccaagcttgctgaggtacaag

SEQ ID NO: 225880 - DNA, 25 bp, Rattus norvegicus
cactccaagtgtccgtttgctgctg

SEQ ID NO: 225881 - DNA, 25 bp, Rattus norvegicus
cactccaagtgtgcgtttgctgctg

SEQ ID NO: 225882 - DNA, 25 bp, Rattus norvegicus
cactccaccagtagcattagcttgg

SEQ ID NO: 225883 - DNA, 25 bp, Rattus norvegicus
cactccaccagttgcattagcttgg

SEQ ID NO: 225884 - DNA, 25 bp, Rattus norvegicus
cactccagagtgagtgctgtataca

SEQ ID NO: 225885 - DNA, 25 bp, Rattus norvegicus
cactccagagtgtgtgctgtataca

SEQ ID NO: 225886 - DNA, 25 bp, Rattus norvegicus
cactccaggctccagatatttggat

SEQ ID NO: 225887 - DNA, 25 bp, Rattus norvegicus
cactccaggctcgagatatttggat

SEQ ID NO: 225888 - DNA, 25 bp, Rattus norvegicus
cactccatcagtaacttgcttttgc

SEQ ID NO: 225889 - DNA, 25 bp, Rattus norvegicus
cactccatcagttacttgcttttgc

SEQ ID NO: 225890 - DNA, 25 bp, Rattus norvegicus
cactcccaaagccactttttgttat

SEQ ID NO: 225891 - DNA, 25 bp, Rattus norvegicus
cactcccaaagcgactttttgttat

SEQ ID NO: 225892 - DNA, 25 bp, Rattus norvegicus
cactcccaagtgagattacagactt

SEQ ID NO: 225893 - DNA, 25 bp, Rattus norvegicus
cactcccaagtgtgattacagactt

SEQ ID NO: 225894 - DNA, 25 bp, Rattus norvegicus
cactcccagctgagtggccagttca

SEQ ID NO: 225895 - DNA, 25 bp, Rattus norvegicus
cactcccagctgcagggttcattga

SEQ ID NO: 225896 - DNA, 25 bp, Rattus norvegicus
cactcccagctggagggttcattga

SEQ ID NO: 225897 - DNA, 25 bp, Rattus norvegicus
cactcccagctgtgtggccagttca

SEQ ID NO: 225898 - DNA, 25 bp, Rattus norvegicus
cactcccagtaaacttccttctaag

SEQ ID NO: 225899 - DNA, 25 bp, Rattus norvegicus
cactcccagtaatcttccttctaag

SEQ ID NO: 225900 - DNA, 25 bp, Rattus norvegicus
cactcccagtgtatttgccttaaaa

SEQ ID NO: 225901 - DNA, 25 bp, Rattus norvegicus
cactcccagtgtttttgccttaaaa

SEQ ID NO: 225902 - DNA, 25 bp, Rattus norvegicus
cactccccagatctttggcctgatt

SEQ ID NO: 225903 - DNA, 25 bp, Rattus norvegicus
cactccccagatgtttggcctgatt

SEQ ID NO: 225904 - DNA, 25 bp, Rattus norvegicus
cactccccaggaagaagcaatacag

SEQ ID NO: 225905 - DNA, 25 bp, Rattus norvegicus
cactccccaggatgaagcaatacag

SEQ ID NO: 225906 - DNA, 25 bp, Rattus norvegicus
cactccccgagtatctattttttgt

SEQ ID NO: 225907 - DNA, 25 bp, Rattus norvegicus
cactccccgagtttctattttttgt

SEQ ID NO: 225908 - DNA, 25 bp, Rattus norvegicus
cactcccgtgtacagcgtcttttta

SEQ ID NO: 225909 - DNA, 25 bp, Rattus norvegicus
cactcccgtgtagagcgtcttttta

SEQ ID NO: 225910 - DNA, 25 bp, Rattus norvegicus
cactccctccaacttgtttcaaatt

SEQ ID NO: 225911 - DNA, 25 bp, Rattus norvegicus
cactccctccaagttgtttcaaatt

SEQ ID NO: 225912 - DNA, 25 bp, Rattus norvegicus
cactccctcctactgagagttgaaa

SEQ ID NO: 225913 - DNA, 25 bp, Rattus norvegicus
cactccctcctagtgagagttgaaa

SEQ ID NO: 225914 - DNA, 25 bp, Rattus norvegicus
cactccctgggaaatgccggcatgt

SEQ ID NO: 225915 - DNA, 25 bp, Rattus norvegicus
cactccctgggatatgccggcatgt

SEQ ID NO: 225916 - DNA, 25 bp, Rattus norvegicus
cactccctgggcaaagtatatacgc

SEQ ID NO: 225917 - DNA, 25 bp, Rattus norvegicus
cactccctgggctaagtatatacgc

SEQ ID NO: 225918 - DNA, 25 bp, Rattus norvegicus
cactcccttattaccatgtttctat

SEQ ID NO: 225919 - DNA, 25 bp, Rattus norvegicus
cactcccttatttccatgtttctat

SEQ ID NO: 225920 - DNA, 25 bp, Rattus norvegicus
cactcccttggtaagatcatctgat

SEQ ID NO: 225921 - DNA, 25 bp, Rattus norvegicus
cactcccttggtaccttaggaaatg

SEQ ID NO: 225922 - DNA, 25 bp, Rattus norvegicus
cactcccttggttagatcatctgat

SEQ ID NO: 225923 - DNA, 25 bp, Rattus norvegicus
cactcccttggttccttaggaaatg

SEQ ID NO: 225924 - DNA, 25 bp, Rattus norvegicus
cactccctttatcctctgtattaga

SEQ ID NO: 225925 - DNA, 25 bp, Rattus norvegicus
cactccctttatgctctgtattaga

SEQ ID NO: 225926 - DNA, 25 bp, Rattus norvegicus
cactccgagctgctttactgtacaa

SEQ ID NO: 225927 - DNA, 25 bp, Rattus norvegicus
cactccgagctggtttactgtacaa

SEQ ID NO: 225928 - DNA, 25 bp, Rattus norvegicus
cactccgcagcacgcaatgaggtga

SEQ ID NO: 225929 - DNA, 25 bp, Rattus norvegicus
cactccgcagcaggcaatgaggtga

SEQ ID NO: 225930 - DNA, 25 bp, Rattus norvegicus
cactccgtgctgaaggcccaaggaa

SEQ ID NO: 225931 - DNA, 25 bp, Rattus norvegicus
cactccgtgctgtaggcccaaggaa

SEQ ID NO: 225932 - DNA, 25 bp, Rattus norvegicus
cactcctaaaccaagtcctgattta

SEQ ID NO: 225933 - DNA, 25 bp, Rattus norvegicus
cactcctaaacctagtcctgattta

SEQ ID NO: 225934 - DNA, 25 bp, Rattus norvegicus
cactcctcaccaaggctagttaaaa

SEQ ID NO: 225935 - DNA, 25 bp, Rattus norvegicus
cactcctcaccatggctagttaaaa

SEQ ID NO: 225936 - DNA, 25 bp, Rattus norvegicus
cactcctccaaaccatctaaaaata

SEQ ID NO: 225937 - DNA, 25 bp, Rattus norvegicus
cactcctccaaagcatctaaaaata

SEQ ID NO: 225938 - DNA, 25 bp, Rattus norvegicus
cactcctccactccaaggtgattat

SEQ ID NO: 225939 - DNA, 25 bp, Rattus norvegicus
cactcctccactgcaaggtgattat

SEQ ID NO: 225940 - DNA, 25 bp, Rattus norvegicus
cactcctccagcctggaatgtgaag

SEQ ID NO: 225941 - DNA, 25 bp, Rattus norvegicus
cactcctccagcgtggaatgtgaag

SEQ ID NO: 225942 - DNA, 25 bp, Rattus norvegicus
cactcctcttcaaccatttatacaa

SEQ ID NO: 225943 - DNA, 25 bp, Rattus norvegicus
cactcctcttcatccatttatacaa

SEQ ID NO: 225944 - DNA, 25 bp, Rattus norvegicus
cactcctcttcgattcagttttttg

SEQ ID NO: 225945 - DNA, 25 bp, Rattus norvegicus
cactcctcttcgtttcagttttttg

SEQ ID NO: 225946 - DNA, 25 bp, Rattus norvegicus
cactcctcttgcaccaagcaagaag

SEQ ID NO: 225947 - DNA, 25 bp, Rattus norvegicus
cactcctcttgctccaagcaagaag

SEQ ID NO: 225948 - DNA, 25 bp, Rattus norvegicus
cactcctgataaatctcctctaaga

SEQ ID NO: 225949 - DNA, 25 bp, Rattus norvegicus
cactcctgataattctcctctaaga

SEQ ID NO: 225950 - DNA, 25 bp, Rattus norvegicus
cactcctgatacataatagtttttt

SEQ ID NO: 225951 - DNA, 25 bp, Rattus norvegicus
cactcctgatacttaatagtttttt

SEQ ID NO: 225952 - DNA, 25 bp, Rattus norvegicus
cactcctgctttatgtccatgtagt

SEQ ID NO: 225953 - DNA, 25 bp, Rattus norvegicus
cactcctgctttttgtccatgtagt

SEQ ID NO: 225954 - DNA, 25 bp, Rattus norvegicus
cactcctggctgctcaagatatggt

SEQ ID NO: 225955 - DNA, 25 bp, Rattus norvegicus
cactcctggctggtcaagatatggt

SEQ ID NO: 225956 - DNA, 25 bp, Rattus norvegicus
cactcctgggcgaatactcgggaaa

SEQ ID NO: 225957 - DNA, 25 bp, Rattus norvegicus
cactcctgggcgtatactcgggaaa

SEQ ID NO: 225958 - DNA, 25 bp, Rattus norvegicus
cactcctggtttagaagtcgcttta

SEQ ID NO: 225959 - DNA, 25 bp, Rattus norvegicus
cactcctggttttgaagtcgcttta

SEQ ID NO: 225960 - DNA, 25 bp, Rattus norvegicus
cactcctgtccgacagtgaggaaaa

SEQ ID NO: 225961 - DNA, 25 bp, Rattus norvegicus
cactcctgtccgtcagtgaggaaaa

SEQ ID NO: 225962 - DNA, 25 bp, Rattus norvegicus
cactcctgtctgatggtcagttagt

SEQ ID NO: 225963 - DNA, 25 bp, Rattus norvegicus
cactcctgtctgttggtcagttagt

SEQ ID NO: 225964 - DNA, 25 bp, Rattus norvegicus
cactcctgttctagaggctctaata

SEQ ID NO: 225965 - DNA, 25 bp, Rattus norvegicus
cactcctgttcttgaggctctaata

SEQ ID NO: 225966 - DNA, 25 bp, Rattus norvegicus
cactccttctggagatcctttcaca

SEQ ID NO: 225967 - DNA, 25 bp, Rattus norvegicus
cactccttctggtgatcctttcaca

SEQ ID NO: 225968 - DNA, 25 bp, Rattus norvegicus
cactccttcttccttgtcaatgttg

SEQ ID NO: 225969 - DNA, 25 bp, Rattus norvegicus
cactccttcttcgttgtcaatgttg

SEQ ID NO: 225970 - DNA, 25 bp, Rattus norvegicus
cactccttttcaatctccatagtat

SEQ ID NO: 225971 - DNA, 25 bp, Rattus norvegicus
cactccttttcattctccatagtat

SEQ ID NO: 225972 - DNA, 25 bp, Rattus norvegicus
cactcgccttaccagttagcagcag

SEQ ID NO: 225973 - DNA, 25 bp, Rattus norvegicus
cactcgccttacgagttagcagcag

SEQ ID NO: 225974 - DNA, 25 bp, Rattus norvegicus
cactcgcgagccagaagtctgggac

SEQ ID NO: 225975 - DNA, 25 bp, Rattus norvegicus
cactcgcgagcctgaagtctgggac

SEQ ID NO: 225976 - DNA, 25 bp, Rattus norvegicus
cactcgctcctccagaatagaaaat

SEQ ID NO: 225977 - DNA, 25 bp, Rattus norvegicus
cactcgctcctcgagaatagaaaat

SEQ ID NO: 225978 - DNA, 25 bp, Rattus norvegicus
cactcggacagcaagtgttgtttgc

SEQ ID NO: 225979 - DNA, 25 bp, Rattus norvegicus
cactcggacagctagtgttgtttgc

SEQ ID NO: 225980 - DNA, 25 bp, Rattus norvegicus
cactcggctgtgcattggcaggcca

SEQ ID NO: 225981 - DNA, 25 bp, Rattus norvegicus
cactcggctgtggattggcaggcca

SEQ ID NO: 225982 - DNA, 25 bp, Rattus norvegicus
cactcgggaaaacgacggatggcta

SEQ ID NO: 225983 - DNA, 25 bp, Rattus norvegicus
cactcgggaaaaggacggatggcta

SEQ ID NO: 225984 - DNA, 25 bp, Rattus norvegicus
cactcgggccacactcaaaggagga

SEQ ID NO: 225985 - DNA, 25 bp, Rattus norvegicus
cactcgggccactctcaaaggagga

SEQ ID NO: 225986 - DNA, 25 bp, Rattus norvegicus
cactcggtaaggcacagccatgcct

SEQ ID NO: 225987 - DNA, 25 bp, Rattus norvegicus
cactcggtaagggacagccatgcct

SEQ ID NO: 225988 - DNA, 25 bp, Rattus norvegicus
cactcggtagggagactgtggcctc

SEQ ID NO: 225989 - DNA, 25 bp, Rattus norvegicus
cactcggtagggtgactgtggcctc

SEQ ID NO: 225990 - DNA, 25 bp, Rattus norvegicus
cactcggtctctattacagtctaga

SEQ ID NO: 225991 - DNA, 25 bp, Rattus norvegicus
cactcggtctcttttacagtctaga

SEQ ID NO: 225992 - DNA, 25 bp, Rattus norvegicus
cactcggttccgaatgattccaaag

SEQ ID NO: 225993 - DNA, 25 bp, Rattus norvegicus
cactcggttccgtatgattccaaag

SEQ ID NO: 225994 - DNA, 25 bp, Rattus norvegicus
cactcgtgcctgattaaatgtattg

SEQ ID NO: 225995 - DNA, 25 bp, Rattus norvegicus
cactcgtgcctgtttaaatgtattg

SEQ ID NO: 225996 - DNA, 25 bp, Rattus norvegicus
cactcgttgcttcagtgtccggtgt

SEQ ID NO: 225997 - DNA, 25 bp, Rattus norvegicus
cactcgttgcttgagtgtccggtgt

SEQ ID NO: 225998 - DNA, 25 bp, Rattus norvegicus
cactctaagctccactccaggaggg

SEQ ID NO: 225999 - DNA, 25 bp, Rattus norvegicus
cactctaagctcgactccaggaggg

SEQ ID NO: 226000 - DNA, 25 bp, Rattus norvegicus
cactctaaggttatagccccagtag

SEQ ID NO: 226001 - DNA, 25 bp, Rattus norvegicus
cactctaaggttttagccccagtag

SEQ ID NO: 226002 - DNA, 25 bp, Rattus norvegicus
cactctatctataaagggaccccgc

SEQ ID NO: 226003 - DNA, 25 bp, Rattus norvegicus
cactctatctattaagggaccccgc

SEQ ID NO: 226004 - DNA, 25 bp, Rattus norvegicus
cactctatgagaagctgccgctgga

SEQ ID NO: 226005 - DNA, 25 bp, Rattus norvegicus
cactctatgagatgctgccgctgga

SEQ ID NO: 226006 - DNA, 25 bp, Rattus norvegicus
cactctatgggtaatgtgcctgata

SEQ ID NO: 226007 - DNA, 25 bp, Rattus norvegicus
cactctatgggttatgtgcctgata

SEQ ID NO: 226008 - DNA, 25 bp, Rattus norvegicus
cactctcacagtcaaagctctcgag

SEQ ID NO: 226009 - DNA, 25 bp, Rattus norvegicus
cactctcacagtgaaagctctcgag

SEQ ID NO: 226010 - DNA, 25 bp, Rattus norvegicus
cactctcaggtaaggatggcttctc

SEQ ID NO: 226011 - DNA, 25 bp, Rattus norvegicus
cactctcaggtacacagcttcttgg

SEQ ID NO: 226012 - DNA, 25 bp, Rattus norvegicus
cactctcaggtagacagcttcttgg

SEQ ID NO: 226013 - DNA, 25 bp, Rattus norvegicus
cactctcaggtatggatggcttctc

SEQ ID NO: 226014 - DNA, 25 bp, Rattus norvegicus
cactctcaggtgaaaagcgccaact

SEQ ID NO: 226015 - DNA, 25 bp, Rattus norvegicus
cactctcaggtgtaaagcgccaact

SEQ ID NO: 226016 - DNA, 25 bp, Rattus norvegicus
cactctcatgtcacctttgtatgat

SEQ ID NO: 226017 - DNA, 25 bp, Rattus norvegicus
cactctcatgtctcctttgtatgat

SEQ ID NO: 226018 - DNA, 25 bp, Rattus norvegicus
cactctccagtaccacttttgaaca

SEQ ID NO: 226019 - DNA, 25 bp, Rattus norvegicus
cactctccagtagcacttttgaaca

SEQ ID NO: 226020 - DNA, 25 bp, Rattus norvegicus
cactctcccatgaatgctgtgcata

SEQ ID NO: 226021 - DNA, 25 bp, Rattus norvegicus
cactctcccatgtatgctgtgcata

SEQ ID NO: 226022 - DNA, 25 bp, Rattus norvegicus
cactctccctcaatgttatcatgta

SEQ ID NO: 226023 - DNA, 25 bp, Rattus norvegicus
cactctccctcattgttatcatgta

SEQ ID NO: 226024 - DNA, 25 bp, Rattus norvegicus
cactctcctagcagggttttagttt

SEQ ID NO: 226025 - DNA, 25 bp, Rattus norvegicus
cactctcctagctgggttttagttt

SEQ ID NO: 226026 - DNA, 25 bp, Rattus norvegicus
cactctcctctcagtagggttggaa

SEQ ID NO: 226027 - DNA, 25 bp, Rattus norvegicus
cactctcctctctgtagggttggaa

SEQ ID NO: 226028 - DNA, 25 bp, Rattus norvegicus
cactctcctgctcacttacaaataa

SEQ ID NO: 226029 - DNA, 25 bp, Rattus norvegicus
cactctcctgctgacttacaaataa

SEQ ID NO: 226030 - DNA, 25 bp, Rattus norvegicus
cactctcctgtcatctggaataagg

SEQ ID NO: 226031 - DNA, 25 bp, Rattus norvegicus
cactctcctgtcttctggaataagg

SEQ ID NO: 226032 - DNA, 25 bp, Rattus norvegicus
cactctccttaacctggcagatggc

SEQ ID NO: 226033 - DNA, 25 bp, Rattus norvegicus
cactctccttaagctggcagatggc

SEQ ID NO: 226034 - DNA, 25 bp, Rattus norvegicus
cactctccttggctgacttagaaga

SEQ ID NO: 226035 - DNA, 25 bp, Rattus norvegicus
cactctccttgggtgacttagaaga

SEQ ID NO: 226036 - DNA, 25 bp, Rattus norvegicus
cactctcctttcattgtacagcaat

SEQ ID NO: 226037 - DNA, 25 bp, Rattus norvegicus
cactctcctttctttgtacagcaat

SEQ ID NO: 226038 - DNA, 25 bp, Rattus norvegicus
cactctcgattgactataacctgga

SEQ ID NO: 226039 - DNA, 25 bp, Rattus norvegicus
cactctcgattgtctataacctgga

SEQ ID NO: 226040 - DNA, 25 bp, Rattus norvegicus
cactctcgcaggacatttaactact

SEQ ID NO: 226041 - DNA, 25 bp, Rattus norvegicus
cactctcgcaggtcatttaactact

SEQ ID NO: 226042 - DNA, 25 bp, Rattus norvegicus
cactctcgggttacattctgtattt

SEQ ID NO: 226043 - DNA, 25 bp, Rattus norvegicus
cactctcgggtttcattctgtattt

SEQ ID NO: 226044 - DNA, 25 bp, Rattus norvegicus
cactctctacccaatgtgcatttaa

SEQ ID NO: 226045 - DNA, 25 bp, Rattus norvegicus
cactctctaccctatgtgcatttaa

SEQ ID NO: 226046 - DNA, 25 bp, Rattus norvegicus
cactctctcaccagcaaatacaaga

SEQ ID NO: 226047 - DNA, 25 bp, Rattus norvegicus
cactctctcacctgcaaatacaaga

SEQ ID NO: 226048 - DNA, 25 bp, Rattus norvegicus
cactctctcagcatctaagggctaa

SEQ ID NO: 226049 - DNA, 25 bp, Rattus norvegicus
cactctctcagcttctaagggctaa

SEQ ID NO: 226050 - DNA, 25 bp, Rattus norvegicus
cactctctcatgatcaactggacag

SEQ ID NO: 226051 - DNA, 25 bp, Rattus norvegicus
cactctctcatgttcaactggacag

SEQ ID NO: 226052 - DNA, 25 bp, Rattus norvegicus
cactctctcccaagctttgaaaggt

SEQ ID NO: 226053 - DNA, 25 bp, Rattus norvegicus
cactctctcccatgctttgaaaggt

SEQ ID NO: 226054 - DNA, 25 bp, Rattus norvegicus
cactctctgccaccaatgggattgt

SEQ ID NO: 226055 - DNA, 25 bp, Rattus norvegicus
cactctctgccagcaatgggattgt

SEQ ID NO: 226056 - DNA, 25 bp, Rattus norvegicus
cactctctggaaatcagaccttgca

SEQ ID NO: 226057 - DNA, 25 bp, Rattus norvegicus
cactctctggaattcagaccttgca

SEQ ID NO: 226058 - DNA, 25 bp, Rattus norvegicus
cactctctggatcggcatgccttga

SEQ ID NO: 226059 - DNA, 25 bp, Rattus norvegicus
cactctctggatgggcatgccttga

SEQ ID NO: 226060 - DNA, 25 bp, Rattus norvegicus
cactctcttatgcttggacagctaa

SEQ ID NO: 226061 - DNA, 25 bp, Rattus norvegicus
cactctcttatggttggacagctaa

SEQ ID NO: 226062 - DNA, 25 bp, Rattus norvegicus
cactctcttcttcttcatggagcta

SEQ ID NO: 226063 - DNA, 25 bp, Rattus norvegicus
cactctcttcttgttcatggagcta

SEQ ID NO: 226064 - DNA, 25 bp, Rattus norvegicus
cactctcttgagatcgggtgcggag

SEQ ID NO: 226065 - DNA, 25 bp, Rattus norvegicus
cactctcttgagttcgggtgcggag

SEQ ID NO: 226066 - DNA, 25 bp, Rattus norvegicus
cactctgagctaatgttaacttgtc

SEQ ID NO: 226067 - DNA, 25 bp, Rattus norvegicus
cactctgagctacgaatacagttca

SEQ ID NO: 226068 - DNA, 25 bp, Rattus norvegicus
cactctgagctaggaatacagttca

SEQ ID NO: 226069 - DNA, 25 bp, Rattus norvegicus
cactctgagctattgttaacttgtc

SEQ ID NO: 226070 - DNA, 25 bp, Rattus norvegicus
cactctgagggtactcaccttgtta

SEQ ID NO: 226071 - DNA, 25 bp, Rattus norvegicus
cactctgagggttctcaccttgtta

SEQ ID NO: 226072 - DNA, 25 bp, Rattus norvegicus
cactctgagtgaagactgctttgtt

SEQ ID NO: 226073 - DNA, 25 bp, Rattus norvegicus
cactctgagtgatgactgctttgtt

SEQ ID NO: 226074 - DNA, 25 bp, Rattus norvegicus
cactctgatgtgaatgactccctaa

SEQ ID NO: 226075 - DNA, 25 bp, Rattus norvegicus
cactctgatgtgtatgactccctaa

SEQ ID NO: 226076 - DNA, 25 bp, Rattus norvegicus
cactctgcacctagctttgaagtag

SEQ ID NO: 226077 - DNA, 25 bp, Rattus norvegicus
cactctgcaccttgctttgaagtag

SEQ ID NO: 226078 - DNA, 25 bp, Rattus norvegicus
cactctgcagacaccacttttgaag

SEQ ID NO: 226079 - DNA, 25 bp, Rattus norvegicus
cactctgcagactccacttttgaag

SEQ ID NO: 226080 - DNA, 25 bp, Rattus norvegicus
cactctgcagtcagatgtaccctga

SEQ ID NO: 226081 - DNA, 25 bp, Rattus norvegicus
cactctgcagtctgatgtaccctga

SEQ ID NO: 226082 - DNA, 25 bp, Rattus norvegicus
cactctgcattcagtaactctttac

SEQ ID NO: 226083 - DNA, 25 bp, Rattus norvegicus
cactctgcattctgtaactctttac

SEQ ID NO: 226084 - DNA, 25 bp, Rattus norvegicus
cactctgccagtaaattcgccaaat

SEQ ID NO: 226085 - DNA, 25 bp, Rattus norvegicus
cactctgccagttaattcgccaaat

SEQ ID NO: 226086 - DNA, 25 bp, Rattus norvegicus
cactctgcccgacgctggacaagaa

SEQ ID NO: 226087 - DNA, 25 bp, Rattus norvegicus
cactctgcccgaggctggacaagaa

SEQ ID NO: 226088 - DNA, 25 bp, Rattus norvegicus
cactctgcctggcttggagtttata

SEQ ID NO: 226089 - DNA, 25 bp, Rattus norvegicus
cactctgcctgggttggagtttata

SEQ ID NO: 226090 - DNA, 25 bp, Rattus norvegicus
cactctgcctgtaggtagcttgctt

SEQ ID NO: 226091 - DNA, 25 bp, Rattus norvegicus
cactctgcctgttggtagcttgctt

SEQ ID NO: 226092 - DNA, 25 bp, Rattus norvegicus
cactctgctctgacgggaaggctgg

SEQ ID NO: 226093 - DNA, 25 bp, Rattus norvegicus
cactctgctctgtcgggaaggctgg

SEQ ID NO: 226094 - DNA, 25 bp, Rattus norvegicus
cactctgctgacacataccatagga

SEQ ID NO: 226095 - DNA, 25 bp, Rattus norvegicus
cactctgctgactcataccatagga

SEQ ID NO: 226096 - DNA, 25 bp, Rattus norvegicus
cactctgctgagatgttttgtttat

SEQ ID NO: 226097 - DNA, 25 bp, Rattus norvegicus
cactctgctgagttgttttgtttat

SEQ ID NO: 226098 - DNA, 25 bp, Rattus norvegicus
cactctgctgtgctgttgtcatgat

SEQ ID NO: 226099 - DNA, 25 bp, Rattus norvegicus
cactctgctgtggtgttgtcatgat

SEQ ID NO: 226100 - DNA, 25 bp, Rattus norvegicus
cactctgcttccatggacaaatcag

SEQ ID NO: 226101 - DNA, 25 bp, Rattus norvegicus
cactctgcttccttggacaaatcag

SEQ ID NO: 226102 - DNA, 25 bp, Rattus norvegicus
cactctgcttgtaaggaccacacta

SEQ ID NO: 226103 - DNA, 25 bp, Rattus norvegicus
cactctgcttgttaggaccacacta

SEQ ID NO: 226104 - DNA, 25 bp, Rattus norvegicus
cactctgctttacacttctggattg

SEQ ID NO: 226105 - DNA, 25 bp, Rattus norvegicus
cactctgctttagacttctggattg

SEQ ID NO: 226106 - DNA, 25 bp, Rattus norvegicus
cactctggacacacgaagctgatag

SEQ ID NO: 226107 - DNA, 25 bp, Rattus norvegicus
cactctggacactcgaagctgatag

SEQ ID NO: 226108 - DNA, 25 bp, Rattus norvegicus
cactctggcgatacgggttagctgt

SEQ ID NO: 226109 - DNA, 25 bp, Rattus norvegicus
cactctggcgattcgggttagctgt

SEQ ID NO: 226110 - DNA, 25 bp, Rattus norvegicus
cactctgggcatcagacattccgaa

SEQ ID NO: 226111 - DNA, 25 bp, Rattus norvegicus
cactctgggcatgagacattccgaa

SEQ ID NO: 226112 - DNA, 25 bp, Rattus norvegicus
cactctgggcctccaggagaacatg

SEQ ID NO: 226113 - DNA, 25 bp, Rattus norvegicus
cactctgggcctgcaggagaacatg

SEQ ID NO: 226114 - DNA, 25 bp, Rattus norvegicus
cactctgggtccagagcaagctgta

SEQ ID NO: 226115 - DNA, 25 bp, Rattus norvegicus
cactctgggtcctgagcaagctgta

SEQ ID NO: 226116 - DNA, 25 bp, Rattus norvegicus
cactctggtcgtaagcttttgtaca

SEQ ID NO: 226117 - DNA, 25 bp, Rattus norvegicus
cactctggtcgttagcttttgtaca

SEQ ID NO: 226118 - DNA, 25 bp, Rattus norvegicus
cactctggtgtcacaggctctaaga

SEQ ID NO: 226119 - DNA, 25 bp, Rattus norvegicus
cactctggtgtctcaggctctaaga

SEQ ID NO: 226120 - DNA, 25 bp, Rattus norvegicus
cactctgtacagataattttctgaa

SEQ ID NO: 226121 - DNA, 25 bp, Rattus norvegicus
cactctgtacagttaattttctgaa

SEQ ID NO: 226122 - DNA, 25 bp, Rattus norvegicus
cactctgtaccccaaagcttaaatt

SEQ ID NO: 226123 - DNA, 25 bp, Rattus norvegicus
cactctgtacccgaaagcttaaatt

SEQ ID NO: 226124 - DNA, 25 bp, Rattus norvegicus
cactctgtacgtcttagacaaccag

SEQ ID NO: 226125 - DNA, 25 bp, Rattus norvegicus
cactctgtacgtgttagacaaccag

SEQ ID NO: 226126 - DNA, 25 bp, Rattus norvegicus
cactctgtacttactttccatttac

SEQ ID NO: 226127 - DNA, 25 bp, Rattus norvegicus
cactctgtactttctttccatttac

SEQ ID NO: 226128 - DNA, 25 bp, Rattus norvegicus
cactctgtagctcagatgggtcttg

SEQ ID NO: 226129 - DNA, 25 bp, Rattus norvegicus
cactctgtagctgagatgggtcttg

SEQ ID NO: 226130 - DNA, 25 bp, Rattus norvegicus
cactctgtaggtactttctggtcaa

SEQ ID NO: 226131 - DNA, 25 bp, Rattus norvegicus
cactctgtaggttctttctggtcaa

SEQ ID NO: 226132 - DNA, 25 bp, Rattus norvegicus
cactctgtccatcgcttatgctgga

SEQ ID NO: 226133 - DNA, 25 bp, Rattus norvegicus
cactctgtccatggcttatgctgga

SEQ ID NO: 226134 - DNA, 25 bp, Rattus norvegicus
cactctgtgcaacgctccatggtag

SEQ ID NO: 226135 - DNA, 25 bp, Rattus norvegicus
cactctgtgcaaggctccatggtag

SEQ ID NO: 226136 - DNA, 25 bp, Rattus norvegicus
cactctgtgcagctgaagggcctct

SEQ ID NO: 226137 - DNA, 25 bp, Rattus norvegicus
cactctgtgcaggtgaagggcctct

SEQ ID NO: 226138 - DNA, 25 bp, Rattus norvegicus
cactctgtgccccatagatatatat

SEQ ID NO: 226139 - DNA, 25 bp, Rattus norvegicus
cactctgtgcccgatagatatatat

SEQ ID NO: 226140 - DNA, 25 bp, Rattus norvegicus
cactctgtgtctatgtgactttgtg

SEQ ID NO: 226141 - DNA, 25 bp, Rattus norvegicus
cactctgtgtctttgtgactttgtg

SEQ ID NO: 226142 - DNA, 25 bp, Rattus norvegicus
cactctgttcagcaccactaaatgt

SEQ ID NO: 226143 - DNA, 25 bp, Rattus norvegicus
cactctgttcaggaccactaaatgt

SEQ ID NO: 226144 - DNA, 25 bp, Rattus norvegicus
cactctgttctaaagatgttctgtt

SEQ ID NO: 226145 - DNA, 25 bp, Rattus norvegicus
cactctgttctatagatgttctgtt

SEQ ID NO: 226146 - DNA, 25 bp, Rattus norvegicus
cactctgttttaacacctgtcaaga

SEQ ID NO: 226147 - DNA, 25 bp, Rattus norvegicus
cactctgttttatcacctgtcaaga

SEQ ID NO: 226148 - DNA, 25 bp, Rattus norvegicus
cactcttcaagcatccttcagaaag

SEQ ID NO: 226149 - DNA, 25 bp, Rattus norvegicus
cactcttcaagcttccttcagaaag

SEQ ID NO: 226150 - DNA, 25 bp, Rattus norvegicus
cactcttcatctatagaattttaga

SEQ ID NO: 226151 - DNA, 25 bp, Rattus norvegicus
cactcttcatctttagaattttaga

SEQ ID NO: 226152 - DNA, 25 bp, Rattus norvegicus
cactcttcccatagcacaggatgag

SEQ ID NO: 226153 - DNA, 25 bp, Rattus norvegicus
cactcttcccattgcacaggatgag

SEQ ID NO: 226154 - DNA, 25 bp, Rattus norvegicus
cactcttcccttaatactcttattt

SEQ ID NO: 226155 - DNA, 25 bp, Rattus norvegicus
cactcttccctttatactcttattt

SEQ ID NO: 226156 - DNA, 25 bp, Rattus norvegicus
cactcttctggtacttcaacatcta

SEQ ID NO: 226157 - DNA, 25 bp, Rattus norvegicus
cactcttctggttcttcaacatcta

SEQ ID NO: 226158 - DNA, 25 bp, Rattus norvegicus
cactcttctgtgcatgtatgtgagc

SEQ ID NO: 226159 - DNA, 25 bp, Rattus norvegicus
cactcttctgtggatgtatgtgagc

SEQ ID NO: 226160 - DNA, 25 bp, Rattus norvegicus
cactcttggctaactgtccttaata

SEQ ID NO: 226161 - DNA, 25 bp, Rattus norvegicus
cactcttggctatctgtccttaata

SEQ ID NO: 226162 - DNA, 25 bp, Rattus norvegicus
cactcttggtggaatcgcagccagg

SEQ ID NO: 226163 - DNA, 25 bp, Rattus norvegicus
cactcttggtggtatcgcagccagg

SEQ ID NO: 226164 - DNA, 25 bp, Rattus norvegicus
cactcttgtaatcatgtgcttccaa

SEQ ID NO: 226165 - DNA, 25 bp, Rattus norvegicus
cactcttgtaatgatgtgcttccaa

SEQ ID NO: 226166 - DNA, 25 bp, Rattus norvegicus
cactcttgtcctcgaaggctagcat

SEQ ID NO: 226167 - DNA, 25 bp, Rattus norvegicus
cactcttgtcctggaaggctagcat

SEQ ID NO: 226168 - DNA, 25 bp, Rattus norvegicus
cactcttgtgtaaactttgggtctt

SEQ ID NO: 226169 - DNA, 25 bp, Rattus norvegicus
cactcttgtgtatactttgggtctt

SEQ ID NO: 226170 - DNA, 25 bp, Rattus norvegicus
cactctttaatgatttgtctcgatg

SEQ ID NO: 226171 - DNA, 25 bp, Rattus norvegicus
cactctttaatgttttgtctcgatg

SEQ ID NO: 226172 - DNA, 25 bp, Rattus norvegicus
cactctttagtaactttctccctgg

SEQ ID NO: 226173 - DNA, 25 bp, Rattus norvegicus
cactctttagtatctttctccctgg

SEQ ID NO: 226174 - DNA, 25 bp, Rattus norvegicus
cactctttgtttcttgtgcactaga

SEQ ID NO: 226175 - DNA, 25 bp, Rattus norvegicus
cactctttgtttgttgtgcactaga

SEQ ID NO: 226176 - DNA, 25 bp, Rattus norvegicus
cactgaaaaggccacttggagctat

SEQ ID NO: 226177 - DNA, 25 bp, Rattus norvegicus
cactgaaaaggcgacttggagctat

SEQ ID NO: 226178 - DNA, 25 bp, Rattus norvegicus
cactgaaaggacattaggagggaca

SEQ ID NO: 226179 - DNA, 25 bp, Rattus norvegicus
cactgaaaggactttaggagggaca

SEQ ID NO: 226180 - DNA, 25 bp, Rattus norvegicus
cactgaacaaccagtgcatgaccac

SEQ ID NO: 226181 - DNA, 25 bp, Rattus norvegicus
cactgaacaacctgtgcatgaccac

SEQ ID NO: 226182 - DNA, 25 bp, Rattus norvegicus
cactgaacaccaatcatgtgctgaa

SEQ ID NO: 226183 - DNA, 25 bp, Rattus norvegicus
cactgaacaccattcatgtgctgaa

SEQ ID NO: 226184 - DNA, 25 bp, Rattus norvegicus
cactgaacccctctaacctatttat

SEQ ID NO: 226185 - DNA, 25 bp, Rattus norvegicus
cactgaacccctgtaacctatttat

SEQ ID NO: 226186 - DNA, 25 bp, Rattus norvegicus
cactgaacctagctgtgctgcaaga

SEQ ID NO: 226187 - DNA, 25 bp, Rattus norvegicus
cactgaacctaggtgtgctgcaaga

SEQ ID NO: 226188 - DNA, 25 bp, Rattus norvegicus
cactgaacctgaactcaccaattca

SEQ ID NO: 226189 - DNA, 25 bp, Rattus norvegicus
cactgaacctgatctcaccaattca

SEQ ID NO: 226190 - DNA, 25 bp, Rattus norvegicus
cactgaagcccaagtaactgacctt

SEQ ID NO: 226191 - DNA, 25 bp, Rattus norvegicus
cactgaagcccatgtaactgacctt

SEQ ID NO: 226192 - DNA, 25 bp, Rattus norvegicus
cactgaagccttatcggtgccgaag

SEQ ID NO: 226193 - DNA, 25 bp, Rattus norvegicus
cactgaagccttttcggtgccgaag

SEQ ID NO: 226194 - DNA, 25 bp, Rattus norvegicus
cactgaaggcttccatgcgagagct

SEQ ID NO: 226195 - DNA, 25 bp, Rattus norvegicus
cactgaaggcttgcatgcgagagct

SEQ ID NO: 226196 - DNA, 25 bp, Rattus norvegicus
cactgaagggcaagtgctccttttt

SEQ ID NO: 226197 - DNA, 25 bp, Rattus norvegicus
cactgaagggcatgtgctccttttt

SEQ ID NO: 226198 - DNA, 25 bp, Rattus norvegicus
cactgaagttgacccggcgtttgca

SEQ ID NO: 226199 - DNA, 25 bp, Rattus norvegicus
cactgaagttgagccggcgtttgca

SEQ ID NO: 226200 - DNA, 25 bp, Rattus norvegicus
cactgaatagcccaacaccagagct

SEQ ID NO: 226201 - DNA, 25 bp, Rattus norvegicus
cactgaatagccgaacaccagagct

SEQ ID NO: 226202 - DNA, 25 bp, Rattus norvegicus
cactgaatgtacagcccaggttggg

SEQ ID NO: 226203 - DNA, 25 bp, Rattus norvegicus
cactgaatgtactgcccaggttggg

SEQ ID NO: 226204 - DNA, 25 bp, Rattus norvegicus
cactgaattttgaagctaatgctgt

SEQ ID NO: 226205 - DNA, 25 bp, Rattus norvegicus
cactgaattttgtagctaatgctgt

SEQ ID NO: 226206 - DNA, 25 bp, Rattus norvegicus
cactgacagccgatatatccgagcg

SEQ ID NO: 226207 - DNA, 25 bp, Rattus norvegicus
cactgacagccgttatatccgagcg

SEQ ID NO: 226208 - DNA, 25 bp, Rattus norvegicus
cactgacagttaaggctgcagcagc

SEQ ID NO: 226209 - DNA, 25 bp, Rattus norvegicus
cactgacagttatggctgcagcagc

SEQ ID NO: 226210 - DNA, 25 bp, Rattus norvegicus
cactgaccgcttcctgggtgtgcag

SEQ ID NO: 226211 - DNA, 25 bp, Rattus norvegicus
cactgaccgcttgctgggtgtgcag

SEQ ID NO: 226212 - DNA, 25 bp, Rattus norvegicus
cactgacgagttctgtgctaactag

SEQ ID NO: 226213 - DNA, 25 bp, Rattus norvegicus
cactgacgagttgtgtgctaactag

SEQ ID NO: 226214 - DNA, 25 bp, Rattus norvegicus
cactgacgatccagttgttcaactg

SEQ ID NO: 226215 - DNA, 25 bp, Rattus norvegicus
cactgacgatcctgttgttcaactg

SEQ ID NO: 226216 - DNA, 25 bp, Rattus norvegicus
cactgactccgtcaggctgtattaa

SEQ ID NO: 226217 - DNA, 25 bp, Rattus norvegicus
cactgactccgtgaggctgtattaa

SEQ ID NO: 226218 - DNA, 25 bp, Rattus norvegicus
cactgactctgcatcacttttaaga

SEQ ID NO: 226219 - DNA, 25 bp, Rattus norvegicus
cactgactctgcttcacttttaaga

SEQ ID NO: 226220 - DNA, 25 bp, Rattus norvegicus
cactgactctgtattcttaatggga

SEQ ID NO: 226221 - DNA, 25 bp, Rattus norvegicus
cactgactctgttttcttaatggga

SEQ ID NO: 226222 - DNA, 25 bp, Rattus norvegicus
cactgactggaacgactggtaacga

SEQ ID NO: 226223 - DNA, 25 bp, Rattus norvegicus
cactgactggaaggactggtaacga

SEQ ID NO: 226224 - DNA, 25 bp, Rattus norvegicus
cactgactgggcagactgttttatg

SEQ ID NO: 226225 - DNA, 25 bp, Rattus norvegicus
cactgactgggctgactgttttatg

SEQ ID NO: 226226 - DNA, 25 bp, Rattus norvegicus
cactgactgttaaaatgccgcccat

SEQ ID NO: 226227 - DNA, 25 bp, Rattus norvegicus
cactgactgttataatgccgcccat

SEQ ID NO: 226228 - DNA, 25 bp, Rattus norvegicus
cactgacttctcatctttggattgg

SEQ ID NO: 226229 - DNA, 25 bp, Rattus norvegicus
cactgacttctcttctttggattgg

SEQ ID NO: 226230 - DNA, 25 bp, Rattus norvegicus
cactgacttgggattgggctacgaa

SEQ ID NO: 226231 - DNA, 25 bp, Rattus norvegicus
cactgacttgggtttgggctacgaa

SEQ ID NO: 226232 - DNA, 25 bp, Rattus norvegicus
cactgacttgttatccgtgtgtaag

SEQ ID NO: 226233 - DNA, 25 bp, Rattus norvegicus
cactgacttgttttccgtgtgtaag

SEQ ID NO: 226234 - DNA, 25 bp, Rattus norvegicus
cactgagacgccacgtgtgtgctga

SEQ ID NO: 226235 - DNA, 25 bp, Rattus norvegicus
cactgagacgcctcgtgtgtgctga

SEQ ID NO: 226236 - DNA, 25 bp, Rattus norvegicus
cactgagactggataaagagcacga

SEQ ID NO: 226237 - DNA, 25 bp, Rattus norvegicus
cactgagactggttaaagagcacga

SEQ ID NO: 226238 - DNA, 25 bp, Rattus norvegicus
cactgagcacagacccagagcaggg

SEQ ID NO: 226239 - DNA, 25 bp, Rattus norvegicus
cactgagcacagtcccagagcaggg

SEQ ID NO: 226240 - DNA, 25 bp, Rattus norvegicus
cactgagcacctcaagtcctggaga

SEQ ID NO: 226241 - DNA, 25 bp, Rattus norvegicus
cactgagcacctgaagtcctggaga

SEQ ID NO: 226242 - DNA, 25 bp, Rattus norvegicus
cactgagcctccatgtggatttgaa

SEQ ID NO: 226243 - DNA, 25 bp, Rattus norvegicus
cactgagcctccttgtggatttgaa

SEQ ID NO: 226244 - DNA, 25 bp, Rattus norvegicus
cactgagctacaaatctgggcccaa

SEQ ID NO: 226245 - DNA, 25 bp, Rattus norvegicus
cactgagctacatatctgggcccaa

SEQ ID NO: 226246 - DNA, 25 bp, Rattus norvegicus
cactgaggacctagctgatctgtat

SEQ ID NO: 226247 - DNA, 25 bp, Rattus norvegicus
cactgaggaccttgctgatctgtat

SEQ ID NO: 226248 - DNA, 25 bp, Rattus norvegicus
cactgaggacttctgtattgatttc

SEQ ID NO: 226249 - DNA, 25 bp, Rattus norvegicus
cactgaggacttgtgtattgatttc

SEQ ID NO: 226250 - DNA, 25 bp, Rattus norvegicus
cactgaggaggactacctgcacttt

SEQ ID NO: 226251 - DNA, 25 bp, Rattus norvegicus
cactgaggaggagtacctgcacttt

SEQ ID NO: 226252 - DNA, 25 bp, Rattus norvegicus
cactgaggaggcagtggaaatatca

SEQ ID NO: 226253 - DNA, 25 bp, Rattus norvegicus
cactgaggaggctgtggaaatatca

SEQ ID NO: 226254 - DNA, 25 bp, Rattus norvegicus
cactgaggcactcgctggactctgc

SEQ ID NO: 226255 - DNA, 25 bp, Rattus norvegicus
cactgaggcactggctggactctgc

SEQ ID NO: 226256 - DNA, 25 bp, Rattus norvegicus
cactgaggcgggaatcatttcgtta

SEQ ID NO: 226257 - DNA, 25 bp, Rattus norvegicus
cactgaggcgggtatcatttcgtta

SEQ ID NO: 226258 - DNA, 25 bp, Rattus norvegicus
cactgaggctgacgaattctttgtc

SEQ ID NO: 226259 - DNA, 25 bp, Rattus norvegicus
cactgaggctgaggaattctttgtc

SEQ ID NO: 226260 - DNA, 25 bp, Rattus norvegicus
cactgagggctcaagctggctgaag

SEQ ID NO: 226261 - DNA, 25 bp, Rattus norvegicus
cactgagggctctagctggctgaag

SEQ ID NO: 226262 - DNA, 25 bp, Rattus norvegicus
cactgagggctgatggagctcttta

SEQ ID NO: 226263 - DNA, 25 bp, Rattus norvegicus
cactgagggctgttggagctcttta

SEQ ID NO: 226264 - DNA, 25 bp, Rattus norvegicus
cactgaggtcccagagatggatacc

SEQ ID NO: 226265 - DNA, 25 bp, Rattus norvegicus
cactgaggtccctgagatggatacc

SEQ ID NO: 226266 - DNA, 25 bp, Rattus norvegicus
cactgaggttaaatcttgggaggct

SEQ ID NO: 226267 - DNA, 25 bp, Rattus norvegicus
cactgaggttaattcttgggaggct

SEQ ID NO: 226268 - DNA, 25 bp, Rattus norvegicus
cactgagtactgctggtcaggcact

SEQ ID NO: 226269 - DNA, 25 bp, Rattus norvegicus
cactgagtactggtggtcaggcact

SEQ ID NO: 226270 - DNA, 25 bp, Rattus norvegicus
cactgagtcagacgtcatccctgta

SEQ ID NO: 226271 - DNA, 25 bp, Rattus norvegicus
cactgagtcagaggtcatccctgta

SEQ ID NO: 226272 - DNA, 25 bp, Rattus norvegicus
cactgagtctcacatgggctggaaa

SEQ ID NO: 226273 - DNA, 25 bp, Rattus norvegicus
cactgagtctcagatgggctggaaa

SEQ ID NO: 226274 - DNA, 25 bp, Rattus norvegicus
cactgagttagtatgtttccttgaa

SEQ ID NO: 226275 - DNA, 25 bp, Rattus norvegicus
cactgagttagtttgtttccttgaa

SEQ ID NO: 226276 - DNA, 25 bp, Rattus norvegicus
cactgagttccaactgtatgccaac

SEQ ID NO: 226277 - DNA, 25 bp, Rattus norvegicus
cactgagttccatctgtatgccaac

SEQ ID NO: 226278 - DNA, 25 bp, Rattus norvegicus
cactgagttgatacatttctgcaca

SEQ ID NO: 226279 - DNA, 25 bp, Rattus norvegicus
cactgagttgattcatttctgcaca

SEQ ID NO: 226280 - DNA, 25 bp, Rattus norvegicus
cactgagtttggagactatgcttca

SEQ ID NO: 226281 - DNA, 25 bp, Rattus norvegicus
cactgagtttggtgactatgcttca

SEQ ID NO: 226282 - DNA, 25 bp, Rattus norvegicus
cactgatagggcagtgtccatatac

SEQ ID NO: 226283 - DNA, 25 bp, Rattus norvegicus
cactgatagggctgtgtccatatac

SEQ ID NO: 226284 - DNA, 25 bp, Rattus norvegicus
cactgatatttcacatcttgtcaga

SEQ ID NO: 226285 - DNA, 25 bp, Rattus norvegicus
cactgatatttctcatcttgtcaga

SEQ ID NO: 226286 - DNA, 25 bp, Rattus norvegicus
cactgatgtctcaggtgaacaaaac

SEQ ID NO: 226287 - DNA, 25 bp, Rattus norvegicus
cactgatgtctctggtgaacaaaac

SEQ ID NO: 226288 - DNA, 25 bp, Rattus norvegicus
cactgatgtgtgatggccggagact

SEQ ID NO: 226289 - DNA, 25 bp, Rattus norvegicus
cactgatgtgtgttggccggagact

SEQ ID NO: 226290 - DNA, 25 bp, Rattus norvegicus
cactgatgtttgacattactttgta

SEQ ID NO: 226291 - DNA, 25 bp, Rattus norvegicus
cactgatgtttgtcattactttgta

SEQ ID NO: 226292 - DNA, 25 bp, Rattus norvegicus
cactgattatatatttgctgaactg

SEQ ID NO: 226293 - DNA, 25 bp, Rattus norvegicus
cactgattatatttttgctgaactg

SEQ ID NO: 226294 - DNA, 25 bp, Rattus norvegicus
cactgatttcttatactgtttctgg

SEQ ID NO: 226295 - DNA, 25 bp, Rattus norvegicus
cactgatttcttctaaccagtaaat

SEQ ID NO: 226296 - DNA, 25 bp, Rattus norvegicus
cactgatttcttgtaaccagtaaat

SEQ ID NO: 226297 - DNA, 25 bp, Rattus norvegicus
cactgatttcttttactgtttctgg

SEQ ID NO: 226298 - DNA, 25 bp, Rattus norvegicus
cactgattttggcttctgtgcccag

SEQ ID NO: 226299 - DNA, 25 bp, Rattus norvegicus
cactgattttgggttctgtgcccag

SEQ ID NO: 226300 - DNA, 25 bp, Rattus norvegicus
cactgcaaacaaaatggctatcatt

SEQ ID NO: 226301 - DNA, 25 bp, Rattus norvegicus
cactgcaaacaatatggctatcatt

SEQ ID NO: 226302 - DNA, 25 bp, Rattus norvegicus
cactgcaagggcaccaagattttag

SEQ ID NO: 226303 - DNA, 25 bp, Rattus norvegicus
cactgcaagggctccaagattttag

SEQ ID NO: 226304 - DNA, 25 bp, Rattus norvegicus
cactgcacagggaaagggttcatct

SEQ ID NO: 226305 - DNA, 25 bp, Rattus norvegicus
cactgcacagggtaagggttcatct

SEQ ID NO: 226306 - DNA, 25 bp, Rattus norvegicus
cactgcacatgacctagagagcttg

SEQ ID NO: 226307 - DNA, 25 bp, Rattus norvegicus
cactgcacatgagctagagagcttg

SEQ ID NO: 226308 - DNA, 25 bp, Rattus norvegicus
cactgcaccgggacctaggagggct

SEQ ID NO: 226309 - DNA, 25 bp, Rattus norvegicus
cactgcaccgggtcctaggagggct

SEQ ID NO: 226310 - DNA, 25 bp, Rattus norvegicus
cactgcagagctcgtgggtctagaa

SEQ ID NO: 226311 - DNA, 25 bp, Rattus norvegicus
cactgcagagctggtgggtctagaa

SEQ ID NO: 226312 - DNA, 25 bp, Rattus norvegicus
cactgcagctgaacggtgtgtagta

SEQ ID NO: 226313 - DNA, 25 bp, Rattus norvegicus
cactgcagctgacttgtttggttat

SEQ ID NO: 226314 - DNA, 25 bp, Rattus norvegicus
cactgcagctgagttgtttggttat

SEQ ID NO: 226315 - DNA, 25 bp, Rattus norvegicus
cactgcagctgatcggtgtgtagta

SEQ ID NO: 226316 - DNA, 25 bp, Rattus norvegicus
cactgcagcttgactatacggtgct

SEQ ID NO: 226317 - DNA, 25 bp, Rattus norvegicus
cactgcagcttgtctatacggtgct

SEQ ID NO: 226318 - DNA, 25 bp, Rattus norvegicus
cactgcagtctgaaccttggatggg

SEQ ID NO: 226319 - DNA, 25 bp, Rattus norvegicus
cactgcagtctgtaccttggatggg

SEQ ID NO: 226320 - DNA, 25 bp, Rattus norvegicus
cactgcagtgaaagtttctaacggc

SEQ ID NO: 226321 - DNA, 25 bp, Rattus norvegicus
cactgcagtgaatgtttctaacggc

SEQ ID NO: 226322 - DNA, 25 bp, Rattus norvegicus
cactgcagtggcaggagagtgactt

SEQ ID NO: 226323 - DNA, 25 bp, Rattus norvegicus
cactgcagtggctggagagtgactt

SEQ ID NO: 226324 - DNA, 25 bp, Rattus norvegicus
cactgcatccctcgagacagagcat

SEQ ID NO: 226325 - DNA, 25 bp, Rattus norvegicus
cactgcatccctggagacagagcat

SEQ ID NO: 226326 - DNA, 25 bp, Rattus norvegicus
cactgccacaccattctttttatgt

SEQ ID NO: 226327 - DNA, 25 bp, Rattus norvegicus
cactgccacacctttctttttatgt

SEQ ID NO: 226328 - DNA, 25 bp, Rattus norvegicus
cactgccacagacaactggagggtt

SEQ ID NO: 226329 - DNA, 25 bp, Rattus norvegicus
cactgccacagagaactggagggtt

SEQ ID NO: 226330 - DNA, 25 bp, Rattus norvegicus
cactgccacagcctctgttataata

SEQ ID NO: 226331 - DNA, 25 bp, Rattus norvegicus
cactgccacagcgtctgttataata

SEQ ID NO: 226332 - DNA, 25 bp, Rattus norvegicus
cactgccacagtattatctgttgat

SEQ ID NO: 226333 - DNA, 25 bp, Rattus norvegicus
cactgccacagtattcatcgtgatt

SEQ ID NO: 226334 - DNA, 25 bp, Rattus norvegicus
cactgccacagttttatctgttgat

SEQ ID NO: 226335 - DNA, 25 bp, Rattus norvegicus
cactgccacagttttcatcgtgatt

SEQ ID NO: 226336 - DNA, 25 bp, Rattus norvegicus
cactgccacccaagaagagttacgt

SEQ ID NO: 226337 - DNA, 25 bp, Rattus norvegicus
cactgccacccatgaagagttacgt

SEQ ID NO: 226338 - DNA, 25 bp, Rattus norvegicus
cactgccacgggacagagactacat

SEQ ID NO: 226339 - DNA, 25 bp, Rattus norvegicus
cactgccacgggtcagagactacat

SEQ ID NO: 226340 - DNA, 25 bp, Rattus norvegicus
cactgccactggcagtcactggaga

SEQ ID NO: 226341 - DNA, 25 bp, Rattus norvegicus
cactgccactgggagtcactggaga

SEQ ID NO: 226342 - DNA, 25 bp, Rattus norvegicus
cactgccaggtcagatgctgctgag

SEQ ID NO: 226343 - DNA, 25 bp, Rattus norvegicus
cactgccaggtctgatgctgctgag

SEQ ID NO: 226344 - DNA, 25 bp, Rattus norvegicus
cactgccatgccagctgcaaagaaa

SEQ ID NO: 226345 - DNA, 25 bp, Rattus norvegicus
cactgccatgcctgctgcaaagaaa

SEQ ID NO: 226346 - DNA, 25 bp, Rattus norvegicus
cactgcccaggaactttacgattgt

SEQ ID NO: 226347 - DNA, 25 bp, Rattus norvegicus
cactgcccaggatctttacgattgt

SEQ ID NO: 226348 - DNA, 25 bp, Rattus norvegicus
cactgcccagttatgcggtttagaa

SEQ ID NO: 226349 - DNA, 25 bp, Rattus norvegicus
cactgcccagttttgcggtttagaa

SEQ ID NO: 226350 - DNA, 25 bp, Rattus norvegicus
cactgccctaagattctttctgtgg

SEQ ID NO: 226351 - DNA, 25 bp, Rattus norvegicus
cactgccctaagtttctttctgtgg

SEQ ID NO: 226352 - DNA, 25 bp, Rattus norvegicus
cactgccctctcatggacaaagaaa

SEQ ID NO: 226353 - DNA, 25 bp, Rattus norvegicus
cactgccctctcttggacaaagaaa

SEQ ID NO: 226354 - DNA, 25 bp, Rattus norvegicus
cactgccctgtgaccttgggagcct

SEQ ID NO: 226355 - DNA, 25 bp, Rattus norvegicus
cactgccctgtgtccttgggagcct

SEQ ID NO: 226356 - DNA, 25 bp, Rattus norvegicus
cactgcccttctcgatggtttttca

SEQ ID NO: 226357 - DNA, 25 bp, Rattus norvegicus
cactgcccttctggatggtttttca

SEQ ID NO: 226358 - DNA, 25 bp, Rattus norvegicus
cactgcccttgacaggtctgtcaaa

SEQ ID NO: 226359 - DNA, 25 bp, Rattus norvegicus
cactgcccttgagaggtctgtcaaa

SEQ ID NO: 226360 - DNA, 25 bp, Rattus norvegicus
cactgccctttgaggttgagttcaa

SEQ ID NO: 226361 - DNA, 25 bp, Rattus norvegicus
cactgccctttgtggttgagttcaa

SEQ ID NO: 226362 - DNA, 25 bp, Rattus norvegicus
cactgccgcctaccaaaatatacaa

SEQ ID NO: 226363 - DNA, 25 bp, Rattus norvegicus
cactgccgcctagcaaaatatacaa

SEQ ID NO: 226364 - DNA, 25 bp, Rattus norvegicus
cactgccgtgttcttttaacttgag

SEQ ID NO: 226365 - DNA, 25 bp, Rattus norvegicus
cactgccgtgttgttttaacttgag

SEQ ID NO: 226366 - DNA, 25 bp, Rattus norvegicus
cactgcctatgtcttttgtctttaa

SEQ ID NO: 226367 - DNA, 25 bp, Rattus norvegicus
cactgcctatgtgttttgtctttaa

SEQ ID NO: 226368 - DNA, 25 bp, Rattus norvegicus
cactgcctcagacaaggtggttgtt

SEQ ID NO: 226369 - DNA, 25 bp, Rattus norvegicus
cactgcctcagagaaggtggttgtt

SEQ ID NO: 226370 - DNA, 25 bp, Rattus norvegicus
cactgcctgaagatgaaattctgac

SEQ ID NO: 226371 - DNA, 25 bp, Rattus norvegicus
cactgcctgaagttgaaattctgac

SEQ ID NO: 226372 - DNA, 25 bp, Rattus norvegicus
cactgcctgcagcaagacctgctgt

SEQ ID NO: 226373 - DNA, 25 bp, Rattus norvegicus
cactgcctgcaggaagacctgctgt

SEQ ID NO: 226374 - DNA, 25 bp, Rattus norvegicus
cactgcctgcccatgtggaacattt

SEQ ID NO: 226375 - DNA, 25 bp, Rattus norvegicus
cactgcctgcccttgtggaacattt

SEQ ID NO: 226376 - DNA, 25 bp, Rattus norvegicus
cactgcctgcctctatagagcagaa

SEQ ID NO: 226377 - DNA, 25 bp, Rattus norvegicus
cactgcctgcctgtatagagcagaa

SEQ ID NO: 226378 - DNA, 25 bp, Rattus norvegicus
cactgcctggtgagagtctgagtaa

SEQ ID NO: 226379 - DNA, 25 bp, Rattus norvegicus
cactgcctggtgtgagtctgagtaa

SEQ ID NO: 226380 - DNA, 25 bp, Rattus norvegicus
cactgccttcctaaataagcacaaa

SEQ ID NO: 226381 - DNA, 25 bp, Rattus norvegicus
cactgccttccttaataagcacaaa

SEQ ID NO: 226382 - DNA, 25 bp, Rattus norvegicus
cactgccttgctcctttttaaagcg

SEQ ID NO: 226383 - DNA, 25 bp, Rattus norvegicus
cactgccttgctgctttttaaagcg

SEQ ID NO: 226384 - DNA, 25 bp, Rattus norvegicus
cactgcctttgtcaagcggtatata

SEQ ID NO: 226385 - DNA, 25 bp, Rattus norvegicus
cactgcctttgtgaagcggtatata

SEQ ID NO: 226386 - DNA, 25 bp, Rattus norvegicus
cactgcgctcttatcaggttacaga

SEQ ID NO: 226387 - DNA, 25 bp, Rattus norvegicus
cactgcgctcttttcaggttacaga

SEQ ID NO: 226388 - DNA, 25 bp, Rattus norvegicus
cactgcgctttcacgtgtgtgggtt

SEQ ID NO: 226389 - DNA, 25 bp, Rattus norvegicus
cactgcgctttctcgtgtgtgggtt

SEQ ID NO: 226390 - DNA, 25 bp, Rattus norvegicus
cactgcgtaagtcccctgggaggtt

SEQ ID NO: 226391 - DNA, 25 bp, Rattus norvegicus
cactgcgtaagtgccctgggaggtt

SEQ ID NO: 226392 - DNA, 25 bp, Rattus norvegicus
cactgcgtccaaatccaggtgggaa

SEQ ID NO: 226393 - DNA, 25 bp, Rattus norvegicus
cactgcgtccaattccaggtgggaa

SEQ ID NO: 226394 - DNA, 25 bp, Rattus norvegicus
cactgcgtccatatttcctaacatc

SEQ ID NO: 226395 - DNA, 25 bp, Rattus norvegicus
cactgcgtccatttttcctaacatc

SEQ ID NO: 226396 - DNA, 25 bp, Rattus norvegicus
cactgcgtcttgattttctactcaa

SEQ ID NO: 226397 - DNA, 25 bp, Rattus norvegicus
cactgcgtcttgtttttctactcaa

SEQ ID NO: 226398 - DNA, 25 bp, Rattus norvegicus
cactgcgtggctctgtgtacagtaa

SEQ ID NO: 226399 - DNA, 25 bp, Rattus norvegicus
cactgcgtggctgtgtgtacagtaa

SEQ ID NO: 226400 - DNA, 25 bp, Rattus norvegicus
cactgctaagttattgatctctcca

SEQ ID NO: 226401 - DNA, 25 bp, Rattus norvegicus
cactgctaagtttttgatctctcca

SEQ ID NO: 226402 - DNA, 25 bp, Rattus norvegicus
cactgctaatggctgagttgcttat

SEQ ID NO: 226403 - DNA, 25 bp, Rattus norvegicus
cactgctaatgggtgagttgcttat

SEQ ID NO: 226404 - DNA, 25 bp, Rattus norvegicus
cactgctaccaacctagtgggtaag

SEQ ID NO: 226405 - DNA, 25 bp, Rattus norvegicus
cactgctaccaagctagtgggtaag

SEQ ID NO: 226406 - DNA, 25 bp, Rattus norvegicus
cactgctagactcgctactggagac

SEQ ID NO: 226407 - DNA, 25 bp, Rattus norvegicus
cactgctagactggctactggagac

SEQ ID NO: 226408 - DNA, 25 bp, Rattus norvegicus
cactgctatggaagcctgtgtatat

SEQ ID NO: 226409 - DNA, 25 bp, Rattus norvegicus
cactgctatggatgcctgtgtatat

SEQ ID NO: 226410 - DNA, 25 bp, Rattus norvegicus
cactgctcactaacatttccatatt

SEQ ID NO: 226411 - DNA, 25 bp, Rattus norvegicus
cactgctcactatcatttccatatt

SEQ ID NO: 226412 - DNA, 25 bp, Rattus norvegicus
cactgctcagggacacctgttggga

SEQ ID NO: 226413 - DNA, 25 bp, Rattus norvegicus
cactgctcagggtcacctgttggga

SEQ ID NO: 226414 - DNA, 25 bp, Rattus norvegicus
cactgctccagtcaattttcttgtt

SEQ ID NO: 226415 - DNA, 25 bp, Rattus norvegicus
cactgctccagtgaattttcttgtt

SEQ ID NO: 226416 - DNA, 25 bp, Rattus norvegicus
cactgctcccacattgacattgtga

SEQ ID NO: 226417 - DNA, 25 bp, Rattus norvegicus
cactgctcccactttgacattgtga

SEQ ID NO: 226418 - DNA, 25 bp, Rattus norvegicus
cactgctctatgacgatgggctctc

SEQ ID NO: 226419 - DNA, 25 bp, Rattus norvegicus
cactgctctatgtcgatgggctctc

SEQ ID NO: 226420 - DNA, 25 bp, Rattus norvegicus
cactgctctcacactaggatgatga

SEQ ID NO: 226421 - DNA, 25 bp, Rattus norvegicus
cactgctctcactctaggatgatga

SEQ ID NO: 226422 - DNA, 25 bp, Rattus norvegicus
cactgctctgtgatctttgtaattt

SEQ ID NO: 226423 - DNA, 25 bp, Rattus norvegicus
cactgctctgtgttctttgtaattt

SEQ ID NO: 226424 - DNA, 25 bp, Rattus norvegicus
cactgctcttagacccaaatgtaga

SEQ ID NO: 226425 - DNA, 25 bp, Rattus norvegicus
cactgctcttagtcccaaatgtaga

SEQ ID NO: 226426 - DNA, 25 bp, Rattus norvegicus
cactgctgatatatggcctcttgca

SEQ ID NO: 226427 - DNA, 25 bp, Rattus norvegicus
cactgctgatatttggcctcttgca

SEQ ID NO: 226428 - DNA, 25 bp, Rattus norvegicus
cactgctgccacaactgtgttttaa

SEQ ID NO: 226429 - DNA, 25 bp, Rattus norvegicus
cactgctgccactactgtgttttaa

SEQ ID NO: 226430 - DNA, 25 bp, Rattus norvegicus
cactgctgccggctatggaaattac

SEQ ID NO: 226431 - DNA, 25 bp, Rattus norvegicus
cactgctgccgggtatggaaattac

SEQ ID NO: 226432 - DNA, 25 bp, Rattus norvegicus
cactgctgctctactggttatatgg

SEQ ID NO: 226433 - DNA, 25 bp, Rattus norvegicus
cactgctgctcttctggttatatgg

SEQ ID NO: 226434 - DNA, 25 bp, Rattus norvegicus
cactgctggcagaagtctacacgaa

SEQ ID NO: 226435 - DNA, 25 bp, Rattus norvegicus
cactgctggcagtagtctacacgaa

SEQ ID NO: 226436 - DNA, 25 bp, Rattus norvegicus
cactgctggttcacaagctgggttt

SEQ ID NO: 226437 - DNA, 25 bp, Rattus norvegicus
cactgctggttctcaagctgggttt

SEQ ID NO: 226438 - DNA, 25 bp, Rattus norvegicus
cactgctgtgctccagaacaagttt

SEQ ID NO: 226439 - DNA, 25 bp, Rattus norvegicus
cactgctgtgctgcagaacaagttt

SEQ ID NO: 226440 - DNA, 25 bp, Rattus norvegicus
cactgctgtgggagccagggatcat

SEQ ID NO: 226441 - DNA, 25 bp, Rattus norvegicus
cactgctgtgggtgccagggatcat

SEQ ID NO: 226442 - DNA, 25 bp, Rattus norvegicus
cactgctgtgtgcactctgggttaa

SEQ ID NO: 226443 - DNA, 25 bp, Rattus norvegicus
cactgctgtgtggactctgggttaa

SEQ ID NO: 226444 - DNA, 25 bp, Rattus norvegicus
cactgcttacagaataactccgtta

SEQ ID NO: 226445 - DNA, 25 bp, Rattus norvegicus
cactgcttacagtataactccgtta

SEQ ID NO: 226446 - DNA, 25 bp, Rattus norvegicus
cactgcttagataggtagctattga

SEQ ID NO: 226447 - DNA, 25 bp, Rattus norvegicus
cactgcttagattggtagctattga

SEQ ID NO: 226448 - DNA, 25 bp, Rattus norvegicus
cactgcttatggctactcatgtagt

SEQ ID NO: 226449 - DNA, 25 bp, Rattus norvegicus
cactgcttatgggtactcatgtagt

SEQ ID NO: 226450 - DNA, 25 bp, Rattus norvegicus
cactgcttcaacactgcgtgacaaa

SEQ ID NO: 226451 - DNA, 25 bp, Rattus norvegicus
cactgcttcaactctgcgtgacaaa

SEQ ID NO: 226452 - DNA, 25 bp, Rattus norvegicus
cactgcttcacaagctttagccaaa

SEQ ID NO: 226453 - DNA, 25 bp, Rattus norvegicus
cactgcttcacatgctttagccaaa

SEQ ID NO: 226454 - DNA, 25 bp, Rattus norvegicus
cactgcttccagctagtgtgcagaa

SEQ ID NO: 226455 - DNA, 25 bp, Rattus norvegicus
cactgcttccaggtagtgtgcagaa

SEQ ID NO: 226456 - DNA, 25 bp, Rattus norvegicus
cactgcttcttcacactgatagaca

SEQ ID NO: 226457 - DNA, 25 bp, Rattus norvegicus
cactgcttcttctcactgatagaca

SEQ ID NO: 226458 - DNA, 25 bp, Rattus norvegicus
cactgcttgaccaagtacaggtaca

SEQ ID NO: 226459 - DNA, 25 bp, Rattus norvegicus
cactgcttgacctagtacaggtaca

SEQ ID NO: 226460 - DNA, 25 bp, Rattus norvegicus
cactgcttgcatatgtactatacac

SEQ ID NO: 226461 - DNA, 25 bp, Rattus norvegicus
cactgcttgcatccccagggttgaa

SEQ ID NO: 226462 - DNA, 25 bp, Rattus norvegicus
cactgcttgcatcttgaggatccct

SEQ ID NO: 226463 - DNA, 25 bp, Rattus norvegicus
cactgcttgcatgcccagggttgaa

SEQ ID NO: 226464 - DNA, 25 bp, Rattus norvegicus
cactgcttgcatgttgaggatccct

SEQ ID NO: 226465 - DNA, 25 bp, Rattus norvegicus
cactgcttgcatttgtactatacac

SEQ ID NO: 226466 - DNA, 25 bp, Rattus norvegicus
cactgcttgccacgagagcggtttt

SEQ ID NO: 226467 - DNA, 25 bp, Rattus norvegicus
cactgcttgccaggagagcggtttt

SEQ ID NO: 226468 - DNA, 25 bp, Rattus norvegicus
cactgcttgcctcagagactctaga

SEQ ID NO: 226469 - DNA, 25 bp, Rattus norvegicus
cactgcttgcctgagagactctaga

SEQ ID NO: 226470 - DNA, 25 bp, Rattus norvegicus
cactgcttgcttactattgcaaagg

SEQ ID NO: 226471 - DNA, 25 bp, Rattus norvegicus
cactgcttgctttctattgcaaagg

SEQ ID NO: 226472 - DNA, 25 bp, Rattus norvegicus
cactgctttaccacctgggtctggg

SEQ ID NO: 226473 - DNA, 25 bp, Rattus norvegicus
cactgctttacctcctgggtctggg

SEQ ID NO: 226474 - DNA, 25 bp, Rattus norvegicus
cactgctttatgaattttatctgtt

SEQ ID NO: 226475 - DNA, 25 bp, Rattus norvegicus
cactgctttatgtattttatctgtt

SEQ ID NO: 226476 - DNA, 25 bp, Rattus norvegicus
cactgctttcccataagactgtata

SEQ ID NO: 226477 - DNA, 25 bp, Rattus norvegicus
cactgctttcccttaagactgtata

SEQ ID NO: 226478 - DNA, 25 bp, Rattus norvegicus
cactgctttggacgctttgaagaaa

SEQ ID NO: 226479 - DNA, 25 bp, Rattus norvegicus
cactgctttggaggctttgaagaaa

SEQ ID NO: 226480 - DNA, 25 bp, Rattus norvegicus
cactgctttgtaactgggtttttca

SEQ ID NO: 226481 - DNA, 25 bp, Rattus norvegicus
cactgctttgtatctgggtttttca

SEQ ID NO: 226482 - DNA, 25 bp, Rattus norvegicus
cactggaactggaaacgtttgtctc

SEQ ID NO: 226483 - DNA, 25 bp, Rattus norvegicus
cactggaactggtaacgtttgtctc

SEQ ID NO: 226484 - DNA, 25 bp, Rattus norvegicus
cactggaagcagattcacggagttt

SEQ ID NO: 226485 - DNA, 25 bp, Rattus norvegicus
cactggaagcagtttcacggagttt

SEQ ID NO: 226486 - DNA, 25 bp, Rattus norvegicus
cactggaaggatagtgcgatccggt

SEQ ID NO: 226487 - DNA, 25 bp, Rattus norvegicus
cactggaaggattgtgcgatccggt

SEQ ID NO: 226488 - DNA, 25 bp, Rattus norvegicus
cactggaatctgcttacattacata

SEQ ID NO: 226489 - DNA, 25 bp, Rattus norvegicus
cactggaatctggttacattacata

SEQ ID NO: 226490 - DNA, 25 bp, Rattus norvegicus
cactggacaacaccccattggtgtg

SEQ ID NO: 226491 - DNA, 25 bp, Rattus norvegicus
cactggacaacagcccattggtgtg

SEQ ID NO: 226492 - DNA, 25 bp, Rattus norvegicus
cactggacatacatacttgtgccct

SEQ ID NO: 226493 - DNA, 25 bp, Rattus norvegicus
cactggacatacttacttgtgccct

SEQ ID NO: 226494 - DNA, 25 bp, Rattus norvegicus
cactggacctctcggttgttttcaa

SEQ ID NO: 226495 - DNA, 25 bp, Rattus norvegicus
cactggacctctgggttgttttcaa

SEQ ID NO: 226496 - DNA, 25 bp, Rattus norvegicus
cactggacggccactggattacaga

SEQ ID NO: 226497 - DNA, 25 bp, Rattus norvegicus
cactggacggcctctggattacaga

SEQ ID NO: 226498 - DNA, 25 bp, Rattus norvegicus
cactggacgggaatacgagcgagaa

SEQ ID NO: 226499 - DNA, 25 bp, Rattus norvegicus
cactggacgggattacgagcgagaa

SEQ ID NO: 226500 - DNA, 25 bp, Rattus norvegicus
cactggactccacccaagttggatt

SEQ ID NO: 226501 - DNA, 25 bp, Rattus norvegicus
cactggactccagccaagttggatt

SEQ ID NO: 226502 - DNA, 25 bp, Rattus norvegicus
cactggacttaaccctggcaatttt

SEQ ID NO: 226503 - DNA, 25 bp, Rattus norvegicus
cactggacttaagcctggcaatttt

SEQ ID NO: 226504 - DNA, 25 bp, Rattus norvegicus
cactggagacatacttcccatttct

SEQ ID NO: 226505 - DNA, 25 bp, Rattus norvegicus
cactggagacattcttcccatttct

SEQ ID NO: 226506 - DNA, 25 bp, Rattus norvegicus
cactggagccagaggatgtgtaaat

SEQ ID NO: 226507 - DNA, 25 bp, Rattus norvegicus
cactggagccagtggatgtgtaaat

SEQ ID NO: 226508 - DNA, 25 bp, Rattus norvegicus
cactggagggcaactacgtctggga

SEQ ID NO: 226509 - DNA, 25 bp, Rattus norvegicus
cactggagggcatctacgtctggga

SEQ ID NO: 226510 - DNA, 25 bp, Rattus norvegicus
cactggatacaaaaaattatgggca

SEQ ID NO: 226511 - DNA, 25 bp, Rattus norvegicus
cactggatacaataaattatgggca

SEQ ID NO: 226512 - DNA, 25 bp, Rattus norvegicus
cactggatcagcacgagagtgacca

SEQ ID NO: 226513 - DNA, 25 bp, Rattus norvegicus
cactggatcagctcgagagtgacca

SEQ ID NO: 226514 - DNA, 25 bp, Rattus norvegicus
cactggatccaccaccagctggaag

SEQ ID NO: 226515 - DNA, 25 bp, Rattus norvegicus
cactggatccacgaccagctggaag

SEQ ID NO: 226516 - DNA, 25 bp, Rattus norvegicus
cactggatcttgcagttggttgcct

SEQ ID NO: 226517 - DNA, 25 bp, Rattus norvegicus
cactggatcttggagttggttgcct

SEQ ID NO: 226518 - DNA, 25 bp, Rattus norvegicus
cactggcaagcaaggtccaaacact

SEQ ID NO: 226519 - DNA, 25 bp, Rattus norvegicus
cactggcaagcatggtccaaacact

SEQ ID NO: 226520 - DNA, 25 bp, Rattus norvegicus
cactggcacaaacttcgtgaggcct

SEQ ID NO: 226521 - DNA, 25 bp, Rattus norvegicus
cactggcacaaagttcgtgaggcct

SEQ ID NO: 226522 - DNA, 25 bp, Rattus norvegicus
cactggcactgcatggcggaggtaa

SEQ ID NO: 226523 - DNA, 25 bp, Rattus norvegicus
cactggcactgcttggcggaggtaa

SEQ ID NO: 226524 - DNA, 25 bp, Rattus norvegicus
cactggcacttcagagtcctctggg

SEQ ID NO: 226525 - DNA, 25 bp, Rattus norvegicus
cactggcacttctgagtcctctggg

SEQ ID NO: 226526 - DNA, 25 bp, Rattus norvegicus
cactggcagtgacccatggtactgt

SEQ ID NO: 226527 - DNA, 25 bp, Rattus norvegicus
cactggcagtgagccatggtactgt

SEQ ID NO: 226528 - DNA, 25 bp, Rattus norvegicus
cactggcatgccacatagtagatgt

SEQ ID NO: 226529 - DNA, 25 bp, Rattus norvegicus
cactggcatgcctcatagtagatgt

SEQ ID NO: 226530 - DNA, 25 bp, Rattus norvegicus
cactggcattctcagcgtatgcaga

SEQ ID NO: 226531 - DNA, 25 bp, Rattus norvegicus
cactggcattctgagcgtatgcaga

SEQ ID NO: 226532 - DNA, 25 bp, Rattus norvegicus
cactggcattgtcatggactccgga

SEQ ID NO: 226533 - DNA, 25 bp, Rattus norvegicus
cactggcattgtgatggactccgga

SEQ ID NO: 226534 - DNA, 25 bp, Rattus norvegicus
cactggccaaagcactcgtggatgt

SEQ ID NO: 226535 - DNA, 25 bp, Rattus norvegicus
cactggccaaaggactcgtggatgt

SEQ ID NO: 226536 - DNA, 25 bp, Rattus norvegicus
cactggccacacatgctgctaaggg

SEQ ID NO: 226537 - DNA, 25 bp, Rattus norvegicus
cactggccacacttgctgctaaggg

SEQ ID NO: 226538 - DNA, 25 bp, Rattus norvegicus
cactggccacagctttctggttaca

SEQ ID NO: 226539 - DNA, 25 bp, Rattus norvegicus
cactggccacaggtttctggttaca

SEQ ID NO: 226540 - DNA, 25 bp, Rattus norvegicus
cactggccagtgatatggtgagctt

SEQ ID NO: 226541 - DNA, 25 bp, Rattus norvegicus
cactggccagtgttatggtgagctt

SEQ ID NO: 226542 - DNA, 25 bp, Rattus norvegicus
cactggccccagatatttcggaatt

SEQ ID NO: 226543 - DNA, 25 bp, Rattus norvegicus
cactggccccagttatttcggaatt

SEQ ID NO: 226544 - DNA, 25 bp, Rattus norvegicus
cactggcctgtcactggacaatagg

SEQ ID NO: 226545 - DNA, 25 bp, Rattus norvegicus
cactggcctgtctctggacaatagg

SEQ ID NO: 226546 - DNA, 25 bp, Rattus norvegicus
cactggcctgtgcagcattggacat

SEQ ID NO: 226547 - DNA, 25 bp, Rattus norvegicus
cactggcctgtggagcattggacat

SEQ ID NO: 226548 - DNA, 25 bp, Rattus norvegicus
cactggcgcctgcatgacatgcaat

SEQ ID NO: 226549 - DNA, 25 bp, Rattus norvegicus
cactggcgcctggatgacatgcaat

SEQ ID NO: 226550 - DNA, 25 bp, Rattus norvegicus
cactggctacccatcttgaggacct

SEQ ID NO: 226551 - DNA, 25 bp, Rattus norvegicus
cactggctacccttcttgaggacct

SEQ ID NO: 226552 - DNA, 25 bp, Rattus norvegicus
cactggctcattagaaggactgctt

SEQ ID NO: 226553 - DNA, 25 bp, Rattus norvegicus
cactggctcatttgaaggactgctt

SEQ ID NO: 226554 - DNA, 25 bp, Rattus norvegicus
cactggctctgcagttaagaacact

SEQ ID NO: 226555 - DNA, 25 bp, Rattus norvegicus
cactggctctgctgttaagaacact

SEQ ID NO: 226556 - DNA, 25 bp, Rattus norvegicus
cactggctgctcattgagaagatct

SEQ ID NO: 226557 - DNA, 25 bp, Rattus norvegicus
cactggctgctctttgagaagatct

SEQ ID NO: 226558 - DNA, 25 bp, Rattus norvegicus
cactggcttccaacctaagagtggg

SEQ ID NO: 226559 - DNA, 25 bp, Rattus norvegicus
cactggcttccatcctaagagtggg

SEQ ID NO: 226560 - DNA, 25 bp, Rattus norvegicus
cactggcttgacaggctgaatattg

SEQ ID NO: 226561 - DNA, 25 bp, Rattus norvegicus
cactggcttgaccttggcaatgaag

SEQ ID NO: 226562 - DNA, 25 bp, Rattus norvegicus
cactggcttgacgttggcaatgaag

SEQ ID NO: 226563 - DNA, 25 bp, Rattus norvegicus
cactggcttgactggctgaatattg

SEQ ID NO: 226564 - DNA, 25 bp, Rattus norvegicus
cactggcttttcaaaggatctgcaa

SEQ ID NO: 226565 - DNA, 25 bp, Rattus norvegicus
cactggcttttctaaggatctgcaa

SEQ ID NO: 226566 - DNA, 25 bp, Rattus norvegicus
cactgggaacagatggcatgctttt

SEQ ID NO: 226567 - DNA, 25 bp, Rattus norvegicus
cactgggaacagttggcatgctttt

SEQ ID NO: 226568 - DNA, 25 bp, Rattus norvegicus
cactgggactgcagaggtaaaaaac

SEQ ID NO: 226569 - DNA, 25 bp, Rattus norvegicus
cactgggactgctgaggtaaaaaac

SEQ ID NO: 226570 - DNA, 25 bp, Rattus norvegicus
cactgggagagacatttgcctaaaa

SEQ ID NO: 226571 - DNA, 25 bp, Rattus norvegicus
cactgggagagagatttgcctaaaa

SEQ ID NO: 226572 - DNA, 25 bp, Rattus norvegicus
cactgggaggaaacgtgtgcaccac

SEQ ID NO: 226573 - DNA, 25 bp, Rattus norvegicus
cactgggaggaatcgtgtgcaccac

SEQ ID NO: 226574 - DNA, 25 bp, Rattus norvegicus
cactgggaggagagaggtctctttc

SEQ ID NO: 226575 - DNA, 25 bp, Rattus norvegicus
cactgggaggagtgaggtctctttc

SEQ ID NO: 226576 - DNA, 25 bp, Rattus norvegicus
cactgggagttgaactagggcctca

SEQ ID NO: 226577 - DNA, 25 bp, Rattus norvegicus
cactgggagttgtactagggcctca

SEQ ID NO: 226578 - DNA, 25 bp, Rattus norvegicus
cactgggatgggagcctgacataat

SEQ ID NO: 226579 - DNA, 25 bp, Rattus norvegicus
cactgggatgggtgcctgacataat

SEQ ID NO: 226580 - DNA, 25 bp, Rattus norvegicus
cactgggatttgcttgtccattcac

SEQ ID NO: 226581 - DNA, 25 bp, Rattus norvegicus
cactgggatttggttgtccattcac

SEQ ID NO: 226582 - DNA, 25 bp, Rattus norvegicus
cactgggcaagacttaaagcggaaa

SEQ ID NO: 226583 - DNA, 25 bp, Rattus norvegicus
cactgggcaagagttaaagcggaaa

SEQ ID NO: 226584 - DNA, 25 bp, Rattus norvegicus
cactgggcaagcataatttggcctt

SEQ ID NO: 226585 - DNA, 25 bp, Rattus norvegicus
cactgggcaagcttaatttggcctt

SEQ ID NO: 226586 - DNA, 25 bp, Rattus norvegicus
cactgggcacttactattttgtcta

SEQ ID NO: 226587 - DNA, 25 bp, Rattus norvegicus
cactgggcactttctattttgtcta

SEQ ID NO: 226588 - DNA, 25 bp, Rattus norvegicus
cactgggcagctatgattgtaactc

SEQ ID NO: 226589 - DNA, 25 bp, Rattus norvegicus
cactgggcagctttgattgtaactc

SEQ ID NO: 226590 - DNA, 25 bp, Rattus norvegicus
cactgggcatgccatcgaggacata

SEQ ID NO: 226591 - DNA, 25 bp, Rattus norvegicus
cactgggcatgcgatcgaggacata

SEQ ID NO: 226592 - DNA, 25 bp, Rattus norvegicus
cactgggcccatcgctttagaggat

SEQ ID NO: 226593 - DNA, 25 bp, Rattus norvegicus
cactgggcccatggctttagaggat

SEQ ID NO: 226594 - DNA, 25 bp, Rattus norvegicus
cactgggccctgagctccgggaaag

SEQ ID NO: 226595 - DNA, 25 bp, Rattus norvegicus
cactgggccctgtgctccgggaaag

SEQ ID NO: 226596 - DNA, 25 bp, Rattus norvegicus
cactgggccgccaggtgaagtttgc

SEQ ID NO: 226597 - DNA, 25 bp, Rattus norvegicus
cactgggccgcctggtgaagtttgc

SEQ ID NO: 226598 - DNA, 25 bp, Rattus norvegicus
cactgggccgctcggattctggact

SEQ ID NO: 226599 - DNA, 25 bp, Rattus norvegicus
cactgggccgctgggattctggact

SEQ ID NO: 226600 - DNA, 25 bp, Rattus norvegicus
cactgggcctttagtgctagttttg

SEQ ID NO: 226601 - DNA, 25 bp, Rattus norvegicus
cactgggccttttgtgctagttttg

SEQ ID NO: 226602 - DNA, 25 bp, Rattus norvegicus
cactgggcgtgtactttggcttgat

SEQ ID NO: 226603 - DNA, 25 bp, Rattus norvegicus
cactgggcgtgttctttggcttgat

SEQ ID NO: 226604 - DNA, 25 bp, Rattus norvegicus
cactgggtacggctttgtacactaa

SEQ ID NO: 226605 - DNA, 25 bp, Rattus norvegicus
cactgggtacgggtttgtacactaa

SEQ ID NO: 226606 - DNA, 25 bp, Rattus norvegicus
cactgggtcacacggcactgagcta

SEQ ID NO: 226607 - DNA, 25 bp, Rattus norvegicus
cactgggtcacagggcactgagcta

SEQ ID NO: 226608 - DNA, 25 bp, Rattus norvegicus
cactgggtgccaaggagctgtgcaa

SEQ ID NO: 226609 - DNA, 25 bp, Rattus norvegicus
cactgggtgccatggagctgtgcaa

SEQ ID NO: 226610 - DNA, 25 bp, Rattus norvegicus
cactgggtgcccacaaatgaaggct

SEQ ID NO: 226611 - DNA, 25 bp, Rattus norvegicus
cactgggtgccctcaaatgaaggct

SEQ ID NO: 226612 - DNA, 25 bp, Rattus norvegicus
cactgggtggctatgtccattatgg

SEQ ID NO: 226613 - DNA, 25 bp, Rattus norvegicus
cactgggtggctttgtccattatgg

SEQ ID NO: 226614 - DNA, 25 bp, Rattus norvegicus
cactgggtgtgactctctaatctta

SEQ ID NO: 226615 - DNA, 25 bp, Rattus norvegicus
cactgggtgtgagtctctaatctta

SEQ ID NO: 226616 - DNA, 25 bp, Rattus norvegicus
cactgggtgtgcacgttcacaggta

SEQ ID NO: 226617 - DNA, 25 bp, Rattus norvegicus
cactgggtgtgctcgttcacaggta

SEQ ID NO: 226618 - DNA, 25 bp, Rattus norvegicus
cactgggttttaatcaaggtatgta

SEQ ID NO: 226619 - DNA, 25 bp, Rattus norvegicus
cactgggttttattcaaggtatgta

SEQ ID NO: 226620 - DNA, 25 bp, Rattus norvegicus
cactgggttttcctctcgtggttgc

SEQ ID NO: 226621 - DNA, 25 bp, Rattus norvegicus
cactgggttttcgtctcgtggttgc

SEQ ID NO: 226622 - DNA, 25 bp, Rattus norvegicus
cactggtaaggtcgctcgcctgtat

SEQ ID NO: 226623 - DNA, 25 bp, Rattus norvegicus
cactggtaaggtggctcgcctgtat

SEQ ID NO: 226624 - DNA, 25 bp, Rattus norvegicus
cactggtaagtaattgtatcacatt

SEQ ID NO: 226625 - DNA, 25 bp, Rattus norvegicus
cactggtaagtatttgtatcacatt

SEQ ID NO: 226626 - DNA, 25 bp, Rattus norvegicus
cactggtaggtactcacagcagcca

SEQ ID NO: 226627 - DNA, 25 bp, Rattus norvegicus
cactggtaggtagtcacagcagcca

SEQ ID NO: 226628 - DNA, 25 bp, Rattus norvegicus
cactggtaggtgactgctgcttctg

SEQ ID NO: 226629 - DNA, 25 bp, Rattus norvegicus
cactggtaggtgtctgctgcttctg

SEQ ID NO: 226630 - DNA, 25 bp, Rattus norvegicus
cactggtaggttattccttctgtct

SEQ ID NO: 226631 - DNA, 25 bp, Rattus norvegicus
cactggtaggtttttccttctgtct

SEQ ID NO: 226632 - DNA, 25 bp, Rattus norvegicus
cactggtcactacagcagcaggttt

SEQ ID NO: 226633 - DNA, 25 bp, Rattus norvegicus
cactggtcactagagcagcaggttt

SEQ ID NO: 226634 - DNA, 25 bp, Rattus norvegicus
cactggtctagaccacggctttgag

SEQ ID NO: 226635 - DNA, 25 bp, Rattus norvegicus
cactggtctagagcacggctttgag

SEQ ID NO: 226636 - DNA, 25 bp, Rattus norvegicus
cactggtctgccaggtgtgtgctga

SEQ ID NO: 226637 - DNA, 25 bp, Rattus norvegicus
cactggtctgcctggtgtgtgctga

SEQ ID NO: 226638 - DNA, 25 bp, Rattus norvegicus
cactggtgaatgctctgcggaatta

SEQ ID NO: 226639 - DNA, 25 bp, Rattus norvegicus
cactggtgaatggtctgcggaatta

SEQ ID NO: 226640 - DNA, 25 bp, Rattus norvegicus
cactggtgacatcgacttctctgta

SEQ ID NO: 226641 - DNA, 25 bp, Rattus norvegicus
cactggtgacatggacttctctgta

SEQ ID NO: 226642 - DNA, 25 bp, Rattus norvegicus
cactggtgacggacggaggtcttct

SEQ ID NO: 226643 - DNA, 25 bp, Rattus norvegicus
cactggtgacggtcggaggtcttct

SEQ ID NO: 226644 - DNA, 25 bp, Rattus norvegicus
cactggtgccacagacggtgaaatc

SEQ ID NO: 226645 - DNA, 25 bp, Rattus norvegicus
cactggtgccactgacggtgaaatc

SEQ ID NO: 226646 - DNA, 25 bp, Rattus norvegicus
cactggtggcaaccctggcatctaa

SEQ ID NO: 226647 - DNA, 25 bp, Rattus norvegicus
cactggtggcaagcctggcatctaa

SEQ ID NO: 226648 - DNA, 25 bp, Rattus norvegicus
cactggtgggaaacagcaggacgca

SEQ ID NO: 226649 - DNA, 25 bp, Rattus norvegicus
cactggtgggaatcagcaggacgca

SEQ ID NO: 226650 - DNA, 25 bp, Rattus norvegicus
cactggtgtttgcttaggcttggca

SEQ ID NO: 226651 - DNA, 25 bp, Rattus norvegicus
cactggtgtttggttaggcttggca

SEQ ID NO: 226652 - DNA, 25 bp, Rattus norvegicus
cactggttaacacgtttggcctata

SEQ ID NO: 226653 - DNA, 25 bp, Rattus norvegicus
cactggttaacaggtttggcctata

SEQ ID NO: 226654 - DNA, 25 bp, Rattus norvegicus
cactggttccagaatcttcttgaga

SEQ ID NO: 226655 - DNA, 25 bp, Rattus norvegicus
cactggttccagtatcttcttgaga

SEQ ID NO: 226656 - DNA, 25 bp, Rattus norvegicus
cactggttcctgaagatgcttcatg

SEQ ID NO: 226657 - DNA, 25 bp, Rattus norvegicus
cactggttcctgtagatgcttcatg

SEQ ID NO: 226658 - DNA, 25 bp, Rattus norvegicus
cactggttgcccatttctcattgga

SEQ ID NO: 226659 - DNA, 25 bp, Rattus norvegicus
cactggttgcccttttctcattgga

SEQ ID NO: 226660 - DNA, 25 bp, Rattus norvegicus
cactggttggtgcttgtacccatca

SEQ ID NO: 226661 - DNA, 25 bp, Rattus norvegicus
cactggttggtggttgtacccatca

SEQ ID NO: 226662 - DNA, 25 bp, Rattus norvegicus
cactggttgtctattttgttattgt

SEQ ID NO: 226663 - DNA, 25 bp, Rattus norvegicus
cactggttgtcttttttgttattgt

SEQ ID NO: 226664 - DNA, 25 bp, Rattus norvegicus
cactgtaacactagaagggttgtac

SEQ ID NO: 226665 - DNA, 25 bp, Rattus norvegicus
cactgtaacacttgaagggttgtac

SEQ ID NO: 226666 - DNA, 25 bp, Rattus norvegicus
cactgtaacattatttcataggcaa

SEQ ID NO: 226667 - DNA, 25 bp, Rattus norvegicus
cactgtaacattttttcataggcaa

SEQ ID NO: 226668 - DNA, 25 bp, Rattus norvegicus
cactgtaacccacactgtatggaga

SEQ ID NO: 226669 - DNA, 25 bp, Rattus norvegicus
cactgtaacccagactgtatggaga

SEQ ID NO: 226670 - DNA, 25 bp, Rattus norvegicus
cactgtaagatacgccaccccaaaa

SEQ ID NO: 226671 - DNA, 25 bp, Rattus norvegicus
cactgtaagataggccaccccaaaa

SEQ ID NO: 226672 - DNA, 25 bp, Rattus norvegicus
cactgtacagaactgtttgtccccg

SEQ ID NO: 226673 - DNA, 25 bp, Rattus norvegicus
cactgtacagaagtgtttgtccccg

SEQ ID NO: 226674 - DNA, 25 bp, Rattus norvegicus
cactgtacgatcattgcggactgca

SEQ ID NO: 226675 - DNA, 25 bp, Rattus norvegicus
cactgtacgatctttgcggactgca

SEQ ID NO: 226676 - DNA, 25 bp, Rattus norvegicus
cactgtagacagctgattcttccac

SEQ ID NO: 226677 - DNA, 25 bp, Rattus norvegicus
cactgtagacaggtgattcttccac

SEQ ID NO: 226678 - DNA, 25 bp, Rattus norvegicus
cactgtagatacattaggactgtct

SEQ ID NO: 226679 - DNA, 25 bp, Rattus norvegicus
cactgtagatactttaggactgtct

SEQ ID NO: 226680 - DNA, 25 bp, Rattus norvegicus
cactgtatcaggctcactaccaaag

SEQ ID NO: 226681 - DNA, 25 bp, Rattus norvegicus
cactgtatcagggtcactaccaaag

SEQ ID NO: 226682 - DNA, 25 bp, Rattus norvegicus
cactgtatggagcaggcaaagcact

SEQ ID NO: 226683 - DNA, 25 bp, Rattus norvegicus
cactgtatggaggaggcaaagcact

SEQ ID NO: 226684 - DNA, 25 bp, Rattus norvegicus
cactgtatgggaacgcctgggcctg

SEQ ID NO: 226685 - DNA, 25 bp, Rattus norvegicus
cactgtatgggatcgcctgggcctg

SEQ ID NO: 226686 - DNA, 25 bp, Rattus norvegicus
cactgtattagtactgcctggttat

SEQ ID NO: 226687 - DNA, 25 bp, Rattus norvegicus
cactgtattagttctgcctggttat

SEQ ID NO: 226688 - DNA, 25 bp, Rattus norvegicus
cactgtattgtgaatgtctgctcat

SEQ ID NO: 226689 - DNA, 25 bp, Rattus norvegicus
cactgtattgtgtatgtctgctcat

SEQ ID NO: 226690 - DNA, 25 bp, Rattus norvegicus
cactgtattgttatttctgctgagg

SEQ ID NO: 226691 - DNA, 25 bp, Rattus norvegicus
cactgtattgttttttctgctgagg

SEQ ID NO: 226692 - DNA, 25 bp, Rattus norvegicus
cactgtcaacagagcctacttaaag

SEQ ID NO: 226693 - DNA, 25 bp, Rattus norvegicus
cactgtcaacagtgcctacttaaag

SEQ ID NO: 226694 - DNA, 25 bp, Rattus norvegicus
cactgtcaactcactgcagatgaac

SEQ ID NO: 226695 - DNA, 25 bp, Rattus norvegicus
cactgtcaactctctgcagatgaac

SEQ ID NO: 226696 - DNA, 25 bp, Rattus norvegicus
cactgtcaatatatgttttctccgg

SEQ ID NO: 226697 - DNA, 25 bp, Rattus norvegicus
cactgtcaatatttgttttctccgg

SEQ ID NO: 226698 - DNA, 25 bp, Rattus norvegicus
cactgtcacctgatgttgagagctt

SEQ ID NO: 226699 - DNA, 25 bp, Rattus norvegicus
cactgtcacctgttgttgagagctt

SEQ ID NO: 226700 - DNA, 25 bp, Rattus norvegicus
cactgtcagctacactttctactaa

SEQ ID NO: 226701 - DNA, 25 bp, Rattus norvegicus
cactgtcagctagactttctactaa

SEQ ID NO: 226702 - DNA, 25 bp, Rattus norvegicus
cactgtcaggagaaagaggctacca

SEQ ID NO: 226703 - DNA, 25 bp, Rattus norvegicus
cactgtcaggagtaagaggctacca

SEQ ID NO: 226704 - DNA, 25 bp, Rattus norvegicus
cactgtcaggctctgagtcactgag

SEQ ID NO: 226705 - DNA, 25 bp, Rattus norvegicus
cactgtcaggctgtgagtcactgag

SEQ ID NO: 226706 - DNA, 25 bp, Rattus norvegicus
cactgtcagtccaaaaggcattttt

SEQ ID NO: 226707 - DNA, 25 bp, Rattus norvegicus
cactgtcagtcctaaaggcattttt

SEQ ID NO: 226708 - DNA, 25 bp, Rattus norvegicus
cactgtcatctgaagggtttggcat

SEQ ID NO: 226709 - DNA, 25 bp, Rattus norvegicus
cactgtcatctgtagggtttggcat

SEQ ID NO: 226710 - DNA, 25 bp, Rattus norvegicus
cactgtcatgctatactccaatgtg

SEQ ID NO: 226711 - DNA, 25 bp, Rattus norvegicus
cactgtcatgctttactccaatgtg

SEQ ID NO: 226712 - DNA, 25 bp, Rattus norvegicus
cactgtcatgtgattgatgccgccc

SEQ ID NO: 226713 - DNA, 25 bp, Rattus norvegicus
cactgtcatgtgtttgatgccgccc

SEQ ID NO: 226714 - DNA, 25 bp, Rattus norvegicus
cactgtccagaacttacaacccatt

SEQ ID NO: 226715 - DNA, 25 bp, Rattus norvegicus
cactgtccagaagttacaacccatt

SEQ ID NO: 226716 - DNA, 25 bp, Rattus norvegicus
cactgtcccataccgatgggtcaga

SEQ ID NO: 226717 - DNA, 25 bp, Rattus norvegicus
cactgtcccatagcgatgggtcaga

SEQ ID NO: 226718 - DNA, 25 bp, Rattus norvegicus
cactgtccccaacggagtggataat

SEQ ID NO: 226719 - DNA, 25 bp, Rattus norvegicus
cactgtccccaagggagtggataat

SEQ ID NO: 226720 - DNA, 25 bp, Rattus norvegicus
cactgtcccctgaaatattactaag

SEQ ID NO: 226721 - DNA, 25 bp, Rattus norvegicus
cactgtcccctgtaatattactaag

SEQ ID NO: 226722 - DNA, 25 bp, Rattus norvegicus
cactgtccctaacccacataatgtt

SEQ ID NO: 226723 - DNA, 25 bp, Rattus norvegicus
cactgtccctaagccacataatgtt

SEQ ID NO: 226724 - DNA, 25 bp, Rattus norvegicus
cactgtcccttacaagtctattcta

SEQ ID NO: 226725 - DNA, 25 bp, Rattus norvegicus
cactgtcccttagaagtctattcta

SEQ ID NO: 226726 - DNA, 25 bp, Rattus norvegicus
cactgtcctaaactcagggcgggct

SEQ ID NO: 226727 - DNA, 25 bp, Rattus norvegicus
cactgtcctaaagtcagggcgggct

SEQ ID NO: 226728 - DNA, 25 bp, Rattus norvegicus
cactgtcctgggaattgggtagcat

SEQ ID NO: 226729 - DNA, 25 bp, Rattus norvegicus
cactgtcctgggtattgggtagcat

SEQ ID NO: 226730 - DNA, 25 bp, Rattus norvegicus
cactgtccttgccttcttgattgga

SEQ ID NO: 226731 - DNA, 25 bp, Rattus norvegicus
cactgtccttgcgttcttgattgga

SEQ ID NO: 226732 - DNA, 25 bp, Rattus norvegicus
cactgtccttttctctttgtttact

SEQ ID NO: 226733 - DNA, 25 bp, Rattus norvegicus
cactgtccttttgtctttgtttact

SEQ ID NO: 226734 - DNA, 25 bp, Rattus norvegicus
cactgtcgcactaggctatttggaa

SEQ ID NO: 226735 - DNA, 25 bp, Rattus norvegicus
cactgtcgcacttggctatttggaa

SEQ ID NO: 226736 - DNA, 25 bp, Rattus norvegicus
cactgtcggctcaaggaagttcttt

SEQ ID NO: 226737 - DNA, 25 bp, Rattus norvegicus
cactgtcggctctaggaagttcttt

SEQ ID NO: 226738 - DNA, 25 bp, Rattus norvegicus
cactgtcgggagatgcatgctgcaa

SEQ ID NO: 226739 - DNA, 25 bp, Rattus norvegicus
cactgtcgggagttgcatgctgcaa

SEQ ID NO: 226740 - DNA, 25 bp, Rattus norvegicus
cactgtctatcactacgtcggcaat

SEQ ID NO: 226741 - DNA, 25 bp, Rattus norvegicus
cactgtctatcagtacgtcggcaat

SEQ ID NO: 226742 - DNA, 25 bp, Rattus norvegicus
cactgtctcagtatctatttggttt

SEQ ID NO: 226743 - DNA, 25 bp, Rattus norvegicus
cactgtctcagtttctatttggttt

SEQ ID NO: 226744 - DNA, 25 bp, Rattus norvegicus
cactgtctcctgacaatggcaagat

SEQ ID NO: 226745 - DNA, 25 bp, Rattus norvegicus
cactgtctcctgtcaatggcaagat

SEQ ID NO: 226746 - DNA, 25 bp, Rattus norvegicus
cactgtctgttgatgtgggcttaca

SEQ ID NO: 226747 - DNA, 25 bp, Rattus norvegicus
cactgtctgttgttgtgggcttaca

SEQ ID NO: 226748 - DNA, 25 bp, Rattus norvegicus
cactgtcttctgacatcaagtcaca

SEQ ID NO: 226749 - DNA, 25 bp, Rattus norvegicus
cactgtcttctgtcatcaagtcaca

SEQ ID NO: 226750 - DNA, 25 bp, Rattus norvegicus
cactgtctttgtcggtttacttcac

SEQ ID NO: 226751 - DNA, 25 bp, Rattus norvegicus
cactgtctttgtgggtttacttcac

SEQ ID NO: 226752 - DNA, 25 bp, Rattus norvegicus
cactgtcttttgagtcctggtgcag

SEQ ID NO: 226753 - DNA, 25 bp, Rattus norvegicus
cactgtcttttgtgtcctggtgcag

SEQ ID NO: 226754 - DNA, 25 bp, Rattus norvegicus
cactgtgaaatgattctgtcttgac

SEQ ID NO: 226755 - DNA, 25 bp, Rattus norvegicus
cactgtgaaatgtttctgtcttgac

SEQ ID NO: 226756 - DNA, 25 bp, Rattus norvegicus
cactgtgaagcccacacttgtgtaa

SEQ ID NO: 226757 - DNA, 25 bp, Rattus norvegicus
cactgtgaagccgacacttgtgtaa

SEQ ID NO: 226758 - DNA, 25 bp, Rattus norvegicus
cactgtgaatacagaacctgcctgc

SEQ ID NO: 226759 - DNA, 25 bp, Rattus norvegicus
cactgtgaatactgaacctgcctgc

SEQ ID NO: 226760 - DNA, 25 bp, Rattus norvegicus
cactgtgaattgaacattgatactt

SEQ ID NO: 226761 - DNA, 25 bp, Rattus norvegicus
cactgtgaattgtacattgatactt

SEQ ID NO: 226762 - DNA, 25 bp, Rattus norvegicus
cactgtgactgtaggagcttgtctg

SEQ ID NO: 226763 - DNA, 25 bp, Rattus norvegicus
cactgtgactgttggagcttgtctg

SEQ ID NO: 226764 - DNA, 25 bp, Rattus norvegicus
cactgtgagcacattactgttgaaa

SEQ ID NO: 226765 - DNA, 25 bp, Rattus norvegicus
cactgtgagcactttactgttgaaa

SEQ ID NO: 226766 - DNA, 25 bp, Rattus norvegicus
cactgtgagtggcaggaaatcttca

SEQ ID NO: 226767 - DNA, 25 bp, Rattus norvegicus
cactgtgagtgggaggaaatcttca

SEQ ID NO: 226768 - DNA, 25 bp, Rattus norvegicus
cactgtgatttactgcactgcaggc

SEQ ID NO: 226769 - DNA, 25 bp, Rattus norvegicus
cactgtgatttagtgcactgcaggc

SEQ ID NO: 226770 - DNA, 25 bp, Rattus norvegicus
cactgtgcacttcatgttaccatat

SEQ ID NO: 226771 - DNA, 25 bp, Rattus norvegicus
cactgtgcacttgatgttaccatat

SEQ ID NO: 226772 - DNA, 25 bp, Rattus norvegicus
cactgtgcaggaaagccaggctccc

SEQ ID NO: 226773 - DNA, 25 bp, Rattus norvegicus
cactgtgcaggatagccaggctccc

SEQ ID NO: 226774 - DNA, 25 bp, Rattus norvegicus
cactgtgcccagcagtagtttcgta

SEQ ID NO: 226775 - DNA, 25 bp, Rattus norvegicus
cactgtgcccaggagtagtttcgta

SEQ ID NO: 226776 - DNA, 25 bp, Rattus norvegicus
cactgtgcccctaggagaggcataa

SEQ ID NO: 226777 - DNA, 25 bp, Rattus norvegicus
cactgtgccccttggagaggcataa

SEQ ID NO: 226778 - DNA, 25 bp, Rattus norvegicus
cactgtgccttcagttccgggaaga

SEQ ID NO: 226779 - DNA, 25 bp, Rattus norvegicus
cactgtgccttctgttccgggaaga

SEQ ID NO: 226780 - DNA, 25 bp, Rattus norvegicus
cactgtgctcggaggacgatgtctt

SEQ ID NO: 226781 - DNA, 25 bp, Rattus norvegicus
cactgtgctcggtggacgatgtctt

SEQ ID NO: 226782 - DNA, 25 bp, Rattus norvegicus
cactgtgctctacaggtgtccagag

SEQ ID NO: 226783 - DNA, 25 bp, Rattus norvegicus
cactgtgctctagaggtgtccagag

SEQ ID NO: 226784 - DNA, 25 bp, Rattus norvegicus
cactgtgctctgaaaccctagttta

SEQ ID NO: 226785 - DNA, 25 bp, Rattus norvegicus
cactgtgctctgtaaccctagttta

SEQ ID NO: 226786 - DNA, 25 bp, Rattus norvegicus
cactgtgcttggattggtattgaca

SEQ ID NO: 226787 - DNA, 25 bp, Rattus norvegicus
cactgtgcttggtttggtattgaca

SEQ ID NO: 226788 - DNA, 25 bp, Rattus norvegicus
cactgtgctttgatcggcctgatgt

SEQ ID NO: 226789 - DNA, 25 bp, Rattus norvegicus
cactgtgctttgttcggcctgatgt

SEQ ID NO: 226790 - DNA, 25 bp, Rattus norvegicus
cactgtgcttttcatttctctgaaa

SEQ ID NO: 226791 - DNA, 25 bp, Rattus norvegicus
cactgtgcttttgatttctctgaaa

SEQ ID NO: 226792 - DNA, 25 bp, Rattus norvegicus
cactgtggcaataagcagtattctg

SEQ ID NO: 226793 - DNA, 25 bp, Rattus norvegicus
cactgtggcaattagcagtattctg

SEQ ID NO: 226794 - DNA, 25 bp, Rattus norvegicus
cactgtggcgttacatattttattg

SEQ ID NO: 226795 - DNA, 25 bp, Rattus norvegicus
cactgtggcgtttcatattttattg

SEQ ID NO: 226796 - DNA, 25 bp, Rattus norvegicus
cactgtgggatgataactgcgcttt

SEQ ID NO: 226797 - DNA, 25 bp, Rattus norvegicus
cactgtgggatgttaactgcgcttt

SEQ ID NO: 226798 - DNA, 25 bp, Rattus norvegicus
cactgtgggtgtcgaataccggcct

SEQ ID NO: 226799 - DNA, 25 bp, Rattus norvegicus
cactgtgggtgtggaataccggcct

SEQ ID NO: 226800 - DNA, 25 bp, Rattus norvegicus
cactgtggtgtcacgtgtgagccca

SEQ ID NO: 226801 - DNA, 25 bp, Rattus norvegicus
cactgtggtgtctcgtgtgagccca

SEQ ID NO: 226802 - DNA, 25 bp, Rattus norvegicus
cactgtggttttatgagacgtcccc

SEQ ID NO: 226803 - DNA, 25 bp, Rattus norvegicus
cactgtggttttttgagacgtcccc

SEQ ID NO: 226804 - DNA, 25 bp, Rattus norvegicus
cactgtgtaactacaaccccagaaa

SEQ ID NO: 226805 - DNA, 25 bp, Rattus norvegicus
cactgtgtaacttcaaccccagaaa

SEQ ID NO: 226806 - DNA, 25 bp, Rattus norvegicus
cactgtgtacgaagcactttggttt

SEQ ID NO: 226807 - DNA, 25 bp, Rattus norvegicus
cactgtgtacgatgcactttggttt

SEQ ID NO: 226808 - DNA, 25 bp, Rattus norvegicus
cactgtgtagccagctgcgtggccg

SEQ ID NO: 226809 - DNA, 25 bp, Rattus norvegicus
cactgtgtagcctgctgcgtggccg

SEQ ID NO: 226810 - DNA, 25 bp, Rattus norvegicus
cactgtgtcaagctcttagaggcta

SEQ ID NO: 226811 - DNA, 25 bp, Rattus norvegicus
cactgtgtcaaggtcttagaggcta

SEQ ID NO: 226812 - DNA, 25 bp, Rattus norvegicus
cactgtgtcataatcttggattcaa

SEQ ID NO: 226813 - DNA, 25 bp, Rattus norvegicus
cactgtgtcatattcttggattcaa

SEQ ID NO: 226814 - DNA, 25 bp, Rattus norvegicus
cactgtgtccaccagcagatatttt

SEQ ID NO: 226815 - DNA, 25 bp, Rattus norvegicus
cactgtgtccacgagcagatatttt

SEQ ID NO: 226816 - DNA, 25 bp, Rattus norvegicus
cactgtgtctctctggagacatcta

SEQ ID NO: 226817 - DNA, 25 bp, Rattus norvegicus
cactgtgtctctgtggagacatcta

SEQ ID NO: 226818 - DNA, 25 bp, Rattus norvegicus
cactgtgtgactaatgagcttccta

SEQ ID NO: 226819 - DNA, 25 bp, Rattus norvegicus
cactgtgtgacttatgagcttccta

SEQ ID NO: 226820 - DNA, 25 bp, Rattus norvegicus
cactgtgtgagcatgcgaggccatt

SEQ ID NO: 226821 - DNA, 25 bp, Rattus norvegicus
cactgtgtgagcttgcgaggccatt

SEQ ID NO: 226822 - DNA, 25 bp, Rattus norvegicus
cactgtgtgcccatctagatgtcag

SEQ ID NO: 226823 - DNA, 25 bp, Rattus norvegicus
cactgtgtgcccttctagatgtcag

SEQ ID NO: 226824 - DNA, 25 bp, Rattus norvegicus
cactgtgtgtggactctgagctgac

SEQ ID NO: 226825 - DNA, 25 bp, Rattus norvegicus
cactgtgtgtggtctctgagctgac

SEQ ID NO: 226826 - DNA, 25 bp, Rattus norvegicus
cactgtgtgtgtactgtttaaccca

SEQ ID NO: 226827 - DNA, 25 bp, Rattus norvegicus
cactgtgtgtgttctgtttaaccca

SEQ ID NO: 226828 - DNA, 25 bp, Rattus norvegicus
cactgtgttgacatactagggcttt

SEQ ID NO: 226829 - DNA, 25 bp, Rattus norvegicus
cactgtgttgacttactagggcttt

SEQ ID NO: 226830 - DNA, 25 bp, Rattus norvegicus
cactgttagtctcttgttcctcaaa

SEQ ID NO: 226831 - DNA, 25 bp, Rattus norvegicus
cactgttagtctgttgttcctcaaa

SEQ ID NO: 226832 - DNA, 25 bp, Rattus norvegicus
cactgttatacaacttttctcctag

SEQ ID NO: 226833 - DNA, 25 bp, Rattus norvegicus
cactgttatacatcttttctcctag

SEQ ID NO: 226834 - DNA, 25 bp, Rattus norvegicus
cactgttatgggagagcctttcaca

SEQ ID NO: 226835 - DNA, 25 bp, Rattus norvegicus
cactgttatgggtgagcctttcaca

SEQ ID NO: 226836 - DNA, 25 bp, Rattus norvegicus
cactgttccagtcccgccaaaggga

SEQ ID NO: 226837 - DNA, 25 bp, Rattus norvegicus
cactgttccagtgccgccaaaggga

SEQ ID NO: 226838 - DNA, 25 bp, Rattus norvegicus
cactgttcctaactgcttgtcaaca

SEQ ID NO: 226839 - DNA, 25 bp, Rattus norvegicus
cactgttcctaagtgcttgtcaaca

SEQ ID NO: 226840 - DNA, 25 bp, Rattus norvegicus
cactgttcgataattatgccttctg

SEQ ID NO: 226841 - DNA, 25 bp, Rattus norvegicus
cactgttcgatatttatgccttctg

SEQ ID NO: 226842 - DNA, 25 bp, Rattus norvegicus
cactgttcgcagacatgtttgctat

SEQ ID NO: 226843 - DNA, 25 bp, Rattus norvegicus
cactgttcgcagtcatgtttgctat

SEQ ID NO: 226844 - DNA, 25 bp, Rattus norvegicus
cactgttcggcaaggaggcggacaa

SEQ ID NO: 226845 - DNA, 25 bp, Rattus norvegicus
cactgttcggcatggaggcggacaa

SEQ ID NO: 226846 - DNA, 25 bp, Rattus norvegicus
cactgttctaacaccattctgggag

SEQ ID NO: 226847 - DNA, 25 bp, Rattus norvegicus
cactgttctaactccattctgggag

SEQ ID NO: 226848 - DNA, 25 bp, Rattus norvegicus
cactgttctcaacttacacacacat

SEQ ID NO: 226849 - DNA, 25 bp, Rattus norvegicus
cactgttctcaagttacacacacat

SEQ ID NO: 226850 - DNA, 25 bp, Rattus norvegicus
cactgttctcctaacctgataagtt

SEQ ID NO: 226851 - DNA, 25 bp, Rattus norvegicus
cactgttctccttacctgataagtt

SEQ ID NO: 226852 - DNA, 25 bp, Rattus norvegicus
cactgttctgtcctgtgtgtggcca

SEQ ID NO: 226853 - DNA, 25 bp, Rattus norvegicus
cactgttctgtcgtgtgtgtggcca

SEQ ID NO: 226854 - DNA, 25 bp, Rattus norvegicus
cactgttgacgaactatttgtattc

SEQ ID NO: 226855 - DNA, 25 bp, Rattus norvegicus
cactgttgacgatctatttgtattc

SEQ ID NO: 226856 - DNA, 25 bp, Rattus norvegicus
cactgttgattgactctgtgtgtgt

SEQ ID NO: 226857 - DNA, 25 bp, Rattus norvegicus
cactgttgattgtctctgtgtgtgt

SEQ ID NO: 226858 - DNA, 25 bp, Rattus norvegicus
cactgttgcagcaccaattatttat

SEQ ID NO: 226859 - DNA, 25 bp, Rattus norvegicus
cactgttgcagctccaattatttat

SEQ ID NO: 226860 - DNA, 25 bp, Rattus norvegicus
cactgttgcccacgtggatggtaaa

SEQ ID NO: 226861 - DNA, 25 bp, Rattus norvegicus
cactgttgcccaggtggatggtaaa

SEQ ID NO: 226862 - DNA, 25 bp, Rattus norvegicus
cactgttggacaatggttttgctat

SEQ ID NO: 226863 - DNA, 25 bp, Rattus norvegicus
cactgttggacattggttttgctat

SEQ ID NO: 226864 - DNA, 25 bp, Rattus norvegicus
cactgttggcgaacaaatggccttt

SEQ ID NO: 226865 - DNA, 25 bp, Rattus norvegicus
cactgttggcgatcaaatggccttt

SEQ ID NO: 226866 - DNA, 25 bp, Rattus norvegicus
cactgttgtcaacggaggaacgcaa

SEQ ID NO: 226867 - DNA, 25 bp, Rattus norvegicus
cactgttgtcaagggaggaacgcaa

SEQ ID NO: 226868 - DNA, 25 bp, Rattus norvegicus
cactgttgtctgatctcttgtcaaa

SEQ ID NO: 226869 - DNA, 25 bp, Rattus norvegicus
cactgttgtctgttctcttgtcaaa

SEQ ID NO: 226870 - DNA, 25 bp, Rattus norvegicus
cactgttgtgtgctttctattgtat

SEQ ID NO: 226871 - DNA, 25 bp, Rattus norvegicus
cactgttgtgtggtttctattgtat

SEQ ID NO: 226872 - DNA, 25 bp, Rattus norvegicus
cactgttgttagctatggtggcaca

SEQ ID NO: 226873 - DNA, 25 bp, Rattus norvegicus
cactgttgttaggtatggtggcaca

SEQ ID NO: 226874 - DNA, 25 bp, Rattus norvegicus
cactgtttaagacacgcccttggga

SEQ ID NO: 226875 - DNA, 25 bp, Rattus norvegicus
cactgtttaagagacgcccttggga

SEQ ID NO: 226876 - DNA, 25 bp, Rattus norvegicus
cactgtttatttaccttggtgctaa

SEQ ID NO: 226877 - DNA, 25 bp, Rattus norvegicus
cactgtttattttccttggtgctaa

SEQ ID NO: 226878 - DNA, 25 bp, Rattus norvegicus
cactgtttcatgctcaatatctttt

SEQ ID NO: 226879 - DNA, 25 bp, Rattus norvegicus
cactgtttcatggtcaatatctttt

SEQ ID NO: 226880 - DNA, 25 bp, Rattus norvegicus
cactgtttccccaaagtgtctacaa

SEQ ID NO: 226881 - DNA, 25 bp, Rattus norvegicus
cactgtttcccctaagtgtctacaa

SEQ ID NO: 226882 - DNA, 25 bp, Rattus norvegicus
cactgtttctatcccaataaatgag

SEQ ID NO: 226883 - DNA, 25 bp, Rattus norvegicus
cactgtttctatgccaataaatgag

SEQ ID NO: 226884 - DNA, 25 bp, Rattus norvegicus
cactgtttgctgcaaactccccggg

SEQ ID NO: 226885 - DNA, 25 bp, Rattus norvegicus
cactgtttgctggaaactccccggg

SEQ ID NO: 226886 - DNA, 25 bp, Rattus norvegicus
cactgttttgacattttgagaccta

SEQ ID NO: 226887 - DNA, 25 bp, Rattus norvegicus
cactgttttgactttttgagaccta

SEQ ID NO: 226888 - DNA, 25 bp, Rattus norvegicus
cactgttttgtgattgcttgtagaa

SEQ ID NO: 226889 - DNA, 25 bp, Rattus norvegicus
cactgttttgtgtttgcttgtagaa

SEQ ID NO: 226890 - DNA, 25 bp, Rattus norvegicus
cactgtttttggcaaccctgtaaag

SEQ ID NO: 226891 - DNA, 25 bp, Rattus norvegicus
cactgtttttgggaaccctgtaaag

SEQ ID NO: 226892 - DNA, 25 bp, Rattus norvegicus
cactgttttttaagtcaatggactt

SEQ ID NO: 226893 - DNA, 25 bp, Rattus norvegicus
cactgttttttatgtcaatggactt

SEQ ID NO: 226894 - DNA, 25 bp, Rattus norvegicus
cacttaaatgtgagcagctattttc

SEQ ID NO: 226895 - DNA, 25 bp, Rattus norvegicus
cacttaaatgtgtgcagctattttc

SEQ ID NO: 226896 - DNA, 25 bp, Rattus norvegicus
cacttaacatctacactatgcacac

SEQ ID NO: 226897 - DNA, 25 bp, Rattus norvegicus
cacttaacatcttcactatgcacac

SEQ ID NO: 226898 - DNA, 25 bp, Rattus norvegicus
cacttaacatggagtgtttccccac

SEQ ID NO: 226899 - DNA, 25 bp, Rattus norvegicus
cacttaacatggtgtgtttccccac

SEQ ID NO: 226900 - DNA, 25 bp, Rattus norvegicus
cacttaactgctaggtcactggatc

SEQ ID NO: 226901 - DNA, 25 bp, Rattus norvegicus
cacttaactgcttggtcactggatc

SEQ ID NO: 226902 - DNA, 25 bp, Rattus norvegicus
cacttaagcagtattttacatctac

SEQ ID NO: 226903 - DNA, 25 bp, Rattus norvegicus
cacttaagcagttttttacatctac

SEQ ID NO: 226904 - DNA, 25 bp, Rattus norvegicus
cacttaaggcagcactgtgtggctt

SEQ ID NO: 226905 - DNA, 25 bp, Rattus norvegicus
cacttaaggcaggactgtgtggctt

SEQ ID NO: 226906 - DNA, 25 bp, Rattus norvegicus
cacttaatggccaaagagcaagaaa

SEQ ID NO: 226907 - DNA, 25 bp, Rattus norvegicus
cacttaatggcctaagagcaagaaa

SEQ ID NO: 226908 - DNA, 25 bp, Rattus norvegicus
cacttacagcagatgcttcaggaag

SEQ ID NO: 226909 - DNA, 25 bp, Rattus norvegicus
cacttacagcagttgcttcaggaag

SEQ ID NO: 226910 - DNA, 25 bp, Rattus norvegicus
cacttacagcttcacttttggagaa

SEQ ID NO: 226911 - DNA, 25 bp, Rattus norvegicus
cacttacagcttgacttttggagaa

SEQ ID NO: 226912 - DNA, 25 bp, Rattus norvegicus
cacttacagtttagcttggcccaaa

SEQ ID NO: 226913 - DNA, 25 bp, Rattus norvegicus
cacttacagttttgcttggcccaaa

SEQ ID NO: 226914 - DNA, 25 bp, Rattus norvegicus
cacttacctcacagacgtctatttt

SEQ ID NO: 226915 - DNA, 25 bp, Rattus norvegicus
cacttacctcactgacgtctatttt

SEQ ID NO: 226916 - DNA, 25 bp, Rattus norvegicus
cacttacctcctcttgttggcaaca

SEQ ID NO: 226917 - DNA, 25 bp, Rattus norvegicus
cacttacctcctgttgttggcaaca

SEQ ID NO: 226918 - DNA, 25 bp, Rattus norvegicus
cacttaccttggcaacctcttagat

SEQ ID NO: 226919 - DNA, 25 bp, Rattus norvegicus
cacttaccttgggaacctcttagat

SEQ ID NO: 226920 - DNA, 25 bp, Rattus norvegicus
cacttacgttggaggtgaaccttca

SEQ ID NO: 226921 - DNA, 25 bp, Rattus norvegicus
cacttacgttggtggtgaaccttca

SEQ ID NO: 226922 - DNA, 25 bp, Rattus norvegicus
cacttactatatctccttagaggga

SEQ ID NO: 226923 - DNA, 25 bp, Rattus norvegicus
cacttactatatgtccttagaggga

SEQ ID NO: 226924 - DNA, 25 bp, Rattus norvegicus
cacttactcagaatggaccacagcc

SEQ ID NO: 226925 - DNA, 25 bp, Rattus norvegicus
cacttactcagattggaccacagcc

SEQ ID NO: 226926 - DNA, 25 bp, Rattus norvegicus
cacttactctagacacataacaatg

SEQ ID NO: 226927 - DNA, 25 bp, Rattus norvegicus
cacttactctagtcacataacaatg

SEQ ID NO: 226928 - DNA, 25 bp, Rattus norvegicus
cacttactgcctatgcaaagggcca

SEQ ID NO: 226929 - DNA, 25 bp, Rattus norvegicus
cacttactgcctttgcaaagggcca

SEQ ID NO: 226930 - DNA, 25 bp, Rattus norvegicus
cacttagacttcaggacccactaga

SEQ ID NO: 226931 - DNA, 25 bp, Rattus norvegicus
cacttagacttctggacccactaga

SEQ ID NO: 226932 - DNA, 25 bp, Rattus norvegicus
cacttagatttgctttctggtactt

SEQ ID NO: 226933 - DNA, 25 bp, Rattus norvegicus
cacttagatttggtttctggtactt

SEQ ID NO: 226934 - DNA, 25 bp, Rattus norvegicus
cacttagcagcacagagtcggttct

SEQ ID NO: 226935 - DNA, 25 bp, Rattus norvegicus
cacttagcagcagagagtcggttct

SEQ ID NO: 226936 - DNA, 25 bp, Rattus norvegicus
cacttaggtgagctggttctccaga

SEQ ID NO: 226937 - DNA, 25 bp, Rattus norvegicus
cacttaggtgaggtggttctccaga

SEQ ID NO: 226938 - DNA, 25 bp, Rattus norvegicus
cacttaggtgctaggaatcagaact

SEQ ID NO: 226939 - DNA, 25 bp, Rattus norvegicus
cacttaggtgcttggaatcagaact

SEQ ID NO: 226940 - DNA, 25 bp, Rattus norvegicus
cacttagtcttgaagtttggcccta

SEQ ID NO: 226941 - DNA, 25 bp, Rattus norvegicus
cacttagtcttgtagtttggcccta

SEQ ID NO: 226942 - DNA, 25 bp, Rattus norvegicus
cacttagtgagactccaggcctctt

SEQ ID NO: 226943 - DNA, 25 bp, Rattus norvegicus
cacttagtgagagtccaggcctctt

SEQ ID NO: 226944 - DNA, 25 bp, Rattus norvegicus
cacttagttgatactgttttgcggt

SEQ ID NO: 226945 - DNA, 25 bp, Rattus norvegicus
cacttagttgattctgttttgcggt

SEQ ID NO: 226946 - DNA, 25 bp, Rattus norvegicus
cacttagtttctcctctggatcaaa

SEQ ID NO: 226947 - DNA, 25 bp, Rattus norvegicus
cacttagtttctgctctggatcaaa

SEQ ID NO: 226948 - DNA, 25 bp, Rattus norvegicus
cacttagttttgaatgatatgctca

SEQ ID NO: 226949 - DNA, 25 bp, Rattus norvegicus
cacttagttttgtatgatatgctca

SEQ ID NO: 226950 - DNA, 25 bp, Rattus norvegicus
cacttagtttttccacatatagaat

SEQ ID NO: 226951 - DNA, 25 bp, Rattus norvegicus
cacttagtttttgcacatatagaat

SEQ ID NO: 226952 - DNA, 25 bp, Rattus norvegicus
cacttatctttcagtagcctggaag

SEQ ID NO: 226953 - DNA, 25 bp, Rattus norvegicus
cacttatctttctgtagcctggaag

SEQ ID NO: 226954 - DNA, 25 bp, Rattus norvegicus
cacttattcactaaccctcatttag

SEQ ID NO: 226955 - DNA, 25 bp, Rattus norvegicus
cacttattcacttaccctcatttag

SEQ ID NO: 226956 - DNA, 25 bp, Rattus norvegicus
cacttattcattacgtcctcttttt

SEQ ID NO: 226957 - DNA, 25 bp, Rattus norvegicus
cacttattcatttcgtcctcttttt

SEQ ID NO: 226958 - DNA, 25 bp, Rattus norvegicus
cacttcaacaagcacctgctgggtg

SEQ ID NO: 226959 - DNA, 25 bp, Rattus norvegicus
cacttcaacaaggacctgctgggtg

SEQ ID NO: 226960 - DNA, 25 bp, Rattus norvegicus
cacttcaaccgcagtcttatttatg

SEQ ID NO: 226961 - DNA, 25 bp, Rattus norvegicus
cacttcaaccgctgtcttatttatg

SEQ ID NO: 226962 - DNA, 25 bp, Rattus norvegicus
cacttcaagctactgtttcatggga

SEQ ID NO: 226963 - DNA, 25 bp, Rattus norvegicus
cacttcaagctagtgtttcatggga

SEQ ID NO: 226964 - DNA, 25 bp, Rattus norvegicus
cacttcacagtgatggctaaggtct

SEQ ID NO: 226965 - DNA, 25 bp, Rattus norvegicus
cacttcacagtgttggctaaggtct

SEQ ID NO: 226966 - DNA, 25 bp, Rattus norvegicus
cacttcagcccaacagaacttgagt

SEQ ID NO: 226967 - DNA, 25 bp, Rattus norvegicus
cacttcagcccatcagaacttgagt

SEQ ID NO: 226968 - DNA, 25 bp, Rattus norvegicus
cacttcagttccactcaagcattga

SEQ ID NO: 226969 - DNA, 25 bp, Rattus norvegicus
cacttcagttcctctcaagcattga

SEQ ID NO: 226970 - DNA, 25 bp, Rattus norvegicus
cacttcatcaccctgaatgggagta

SEQ ID NO: 226971 - DNA, 25 bp, Rattus norvegicus
cacttcatcaccgtgaatgggagta

SEQ ID NO: 226972 - DNA, 25 bp, Rattus norvegicus
cacttcatctgtactgacgtgacaa

SEQ ID NO: 226973 - DNA, 25 bp, Rattus norvegicus
cacttcatctgttctgacgtgacaa

SEQ ID NO: 226974 - DNA, 25 bp, Rattus norvegicus
cacttcatggagactgtttctttag

SEQ ID NO: 226975 - DNA, 25 bp, Rattus norvegicus
cacttcatggagtctgtttctttag

SEQ ID NO: 226976 - DNA, 25 bp, Rattus norvegicus
cacttccagctcatacgctatttta

SEQ ID NO: 226977 - DNA, 25 bp, Rattus norvegicus
cacttccagctcttacgctatttta

SEQ ID NO: 226978 - DNA, 25 bp, Rattus norvegicus
cacttccattgacataaaacccgtt

SEQ ID NO: 226979 - DNA, 25 bp, Rattus norvegicus
cacttccattgagataaaacccgtt

SEQ ID NO: 226980 - DNA, 25 bp, Rattus norvegicus
cacttcccactacttgtgtgtacaa

SEQ ID NO: 226981 - DNA, 25 bp, Rattus norvegicus
cacttcccactagttgtgtgtacaa

SEQ ID NO: 226982 - DNA, 25 bp, Rattus norvegicus
cacttcccatgtcgttgctacatga

SEQ ID NO: 226983 - DNA, 25 bp, Rattus norvegicus
cacttcccatgtggttgctacatga

SEQ ID NO: 226984 - DNA, 25 bp, Rattus norvegicus
cacttcccctggaccagagaattgg

SEQ ID NO: 226985 - DNA, 25 bp, Rattus norvegicus
cacttcccctggtccagagaattgg

SEQ ID NO: 226986 - DNA, 25 bp, Rattus norvegicus
cacttccccttactactgtttagat

SEQ ID NO: 226987 - DNA, 25 bp, Rattus norvegicus
cacttccccttagtactgtttagat

SEQ ID NO: 226988 - DNA, 25 bp, Rattus norvegicus
cacttccctggtatgcaaaggaaat

SEQ ID NO: 226989 - DNA, 25 bp, Rattus norvegicus
cacttccctggtttgcaaaggaaat

SEQ ID NO: 226990 - DNA, 25 bp, Rattus norvegicus
cacttccgctgcagcggcagcatat

SEQ ID NO: 226991 - DNA, 25 bp, Rattus norvegicus
cacttccgctgccagagcatagaaa

SEQ ID NO: 226992 - DNA, 25 bp, Rattus norvegicus
cacttccgctgcgagagcatagaaa

SEQ ID NO: 226993 - DNA, 25 bp, Rattus norvegicus
cacttccgctgctgcggcagcatat

SEQ ID NO: 226994 - DNA, 25 bp, Rattus norvegicus
cacttccgctttctgtactgaagaa

SEQ ID NO: 226995 - DNA, 25 bp, Rattus norvegicus
cacttccgctttgtgtactgaagaa

SEQ ID NO: 226996 - DNA, 25 bp, Rattus norvegicus
cacttccggcgacaagccgagcgtg

SEQ ID NO: 226997 - DNA, 25 bp, Rattus norvegicus
cacttccggcgagaagccgagcgtg

SEQ ID NO: 226998 - DNA, 25 bp, Rattus norvegicus
cacttccgggtacgctctgaggcag

SEQ ID NO: 226999 - DNA, 25 bp, Rattus norvegicus
cacttccgggtaggctctgaggcag

SEQ ID NO: 227000 - DNA, 25 bp, Rattus norvegicus
cacttcctatggaattcctccagta

SEQ ID NO: 227001 - DNA, 25 bp, Rattus norvegicus
cacttcctatggtattcctccagta

SEQ ID NO: 227002 - DNA, 25 bp, Rattus norvegicus
cacttcctcactaactttcgtgggt

SEQ ID NO: 227003 - DNA, 25 bp, Rattus norvegicus
cacttcctcacttactttcgtgggt

SEQ ID NO: 227004 - DNA, 25 bp, Rattus norvegicus
cacttcctctctctgtggattgctg

SEQ ID NO: 227005 - DNA, 25 bp, Rattus norvegicus
cacttcctctctgtgtggattgctg

SEQ ID NO: 227006 - DNA, 25 bp, Rattus norvegicus
cacttcctctttagatcctgttgta

SEQ ID NO: 227007 - DNA, 25 bp, Rattus norvegicus
cacttcctcttttgatcctgttgta

SEQ ID NO: 227008 - DNA, 25 bp, Rattus norvegicus
cacttcctgcacagcaaggcaaaaa

SEQ ID NO: 227009 - DNA, 25 bp, Rattus norvegicus
cacttcctgcactgcaaggcaaaaa

SEQ ID NO: 227010 - DNA, 25 bp, Rattus norvegicus
cacttcctgcttcctatatgtgaat

SEQ ID NO: 227011 - DNA, 25 bp, Rattus norvegicus
cacttcctgcttgctatatgtgaat

SEQ ID NO: 227012 - DNA, 25 bp, Rattus norvegicus
cacttcctggatccctaagactgtt

SEQ ID NO: 227013 - DNA, 25 bp, Rattus norvegicus
cacttcctggatgcctaagactgtt

SEQ ID NO: 227014 - DNA, 25 bp, Rattus norvegicus
cacttcctggtcattgctatttaac

SEQ ID NO: 227015 - DNA, 25 bp, Rattus norvegicus
cacttcctggtctttgctatttaac

SEQ ID NO: 227016 - DNA, 25 bp, Rattus norvegicus
cacttcgcagggatggaggacgatt

SEQ ID NO: 227017 - DNA, 25 bp, Rattus norvegicus
cacttcgcagggttggaggacgatt

SEQ ID NO: 227018 - DNA, 25 bp, Rattus norvegicus
cacttcgcggagagcacttgacagt

SEQ ID NO: 227019 - DNA, 25 bp, Rattus norvegicus
cacttcgcggagtgcacttgacagt

SEQ ID NO: 227020 - DNA, 25 bp, Rattus norvegicus
cacttcgcttgtagttgtcatttgg

SEQ ID NO: 227021 - DNA, 25 bp, Rattus norvegicus
cacttcgcttgttgttgtcatttgg

SEQ ID NO: 227022 - DNA, 25 bp, Rattus norvegicus
cacttcgggtgcaggtcaaggaaca

SEQ ID NO: 227023 - DNA, 25 bp, Rattus norvegicus
cacttcgggtgctggtcaaggaaca

SEQ ID NO: 227024 - DNA, 25 bp, Rattus norvegicus
cacttcggtttcctgtttctggact

SEQ ID NO: 227025 - DNA, 25 bp, Rattus norvegicus
cacttcggtttcgtgtttctggact

SEQ ID NO: 227026 - DNA, 25 bp, Rattus norvegicus
cacttcgtgagcattcttctgggaa

SEQ ID NO: 227027 - DNA, 25 bp, Rattus norvegicus
cacttcgtgagctttcttctgggaa

SEQ ID NO: 227028 - DNA, 25 bp, Rattus norvegicus
cacttctacaatctcctacgtggat

SEQ ID NO: 227029 - DNA, 25 bp, Rattus norvegicus
cacttctacaatgtcctacgtggat

SEQ ID NO: 227030 - DNA, 25 bp, Rattus norvegicus
cacttctacccaaactgcaaaaaca

SEQ ID NO: 227031 - DNA, 25 bp, Rattus norvegicus
cacttctacccatactgcaaaaaca

SEQ ID NO: 227032 - DNA, 25 bp, Rattus norvegicus
cacttctaccctataattgactctt

SEQ ID NO: 227033 - DNA, 25 bp, Rattus norvegicus
cacttctaccctttaattgactctt

SEQ ID NO: 227034 - DNA, 25 bp, Rattus norvegicus
cacttctactttctgggtgctggga

SEQ ID NO: 227035 - DNA, 25 bp, Rattus norvegicus
cacttctactttgtgggtgctggga

SEQ ID NO: 227036 - DNA, 25 bp, Rattus norvegicus
cacttctagaaaaagcagctgttcc

SEQ ID NO: 227037 - DNA, 25 bp, Rattus norvegicus
cacttctagaaatagcagctgttcc

SEQ ID NO: 227038 - DNA, 25 bp, Rattus norvegicus
cacttctagcatagtcttctcttgc

SEQ ID NO: 227039 - DNA, 25 bp, Rattus norvegicus
cacttctagcattgtcttctcttgc

SEQ ID NO: 227040 - DNA, 25 bp, Rattus norvegicus
cacttctaggtgcacatttaaactt

SEQ ID NO: 227041 - DNA, 25 bp, Rattus norvegicus
cacttctaggtggacatttaaactt

SEQ ID NO: 227042 - DNA, 25 bp, Rattus norvegicus
cacttctataggagcagatgcattc

SEQ ID NO: 227043 - DNA, 25 bp, Rattus norvegicus
cacttctataggtgcagatgcattc

SEQ ID NO: 227044 - DNA, 25 bp, Rattus norvegicus
cacttctcaaccctgatggagcaaa

SEQ ID NO: 227045 - DNA, 25 bp, Rattus norvegicus
cacttctcaaccgtgatggagcaaa

SEQ ID NO: 227046 - DNA, 25 bp, Rattus norvegicus
cacttctcaagtattcctttgtggg

SEQ ID NO: 227047 - DNA, 25 bp, Rattus norvegicus
cacttctcaagttttcctttgtggg

SEQ ID NO: 227048 - DNA, 25 bp, Rattus norvegicus
cacttctcagaacagcgctttcaat

SEQ ID NO: 227049 - DNA, 25 bp, Rattus norvegicus
cacttctcagaagagcgctttcaat

SEQ ID NO: 227050 - DNA, 25 bp, Rattus norvegicus
cacttctcagagcagcgctttcagc

SEQ ID NO: 227051 - DNA, 25 bp, Rattus norvegicus
cacttctcagaggagcgctttcagc

SEQ ID NO: 227052 - DNA, 25 bp, Rattus norvegicus
cacttctcagtgatttatgggcttt

SEQ ID NO: 227053 - DNA, 25 bp, Rattus norvegicus
cacttctcagtgcttcagatcgtga

SEQ ID NO: 227054 - DNA, 25 bp, Rattus norvegicus
cacttctcagtggttcagatcgtga

SEQ ID NO: 227055 - DNA, 25 bp, Rattus norvegicus
cacttctcagtgttttatgggcttt

SEQ ID NO: 227056 - DNA, 25 bp, Rattus norvegicus
cacttctccgtgaatcctgatagag

SEQ ID NO: 227057 - DNA, 25 bp, Rattus norvegicus
cacttctccgtgtatcctgatagag

SEQ ID NO: 227058 - DNA, 25 bp, Rattus norvegicus
cacttctcgcataccttgatgggaa

SEQ ID NO: 227059 - DNA, 25 bp, Rattus norvegicus
cacttctcgcattccttgatgggaa

SEQ ID NO: 227060 - DNA, 25 bp, Rattus norvegicus
cacttctctccacgctgtttctttt

SEQ ID NO: 227061 - DNA, 25 bp, Rattus norvegicus
cacttctctccaggctgtttctttt

SEQ ID NO: 227062 - DNA, 25 bp, Rattus norvegicus
cacttctctcctctaatttcttcaa

SEQ ID NO: 227063 - DNA, 25 bp, Rattus norvegicus
cacttctctcctgtaatttcttcaa

SEQ ID NO: 227064 - DNA, 25 bp, Rattus norvegicus
cacttctctcttaccatatgatgtt

SEQ ID NO: 227065 - DNA, 25 bp, Rattus norvegicus
cacttctctctttccatatgatgtt

SEQ ID NO: 227066 - DNA, 25 bp, Rattus norvegicus
cacttctctttgacttaatgctcta

SEQ ID NO: 227067 - DNA, 25 bp, Rattus norvegicus
cacttctctttgtcttaatgctcta

SEQ ID NO: 227068 - DNA, 25 bp, Rattus norvegicus
cacttctcttttaggccaatgtttt

SEQ ID NO: 227069 - DNA, 25 bp, Rattus norvegicus
cacttctctttttggccaatgtttt

SEQ ID NO: 227070 - DNA, 25 bp, Rattus norvegicus
cacttctgaaagatagttccctttg

SEQ ID NO: 227071 - DNA, 25 bp, Rattus norvegicus
cacttctgaaagttagttccctttg

SEQ ID NO: 227072 - DNA, 25 bp, Rattus norvegicus
cacttctgaaatcccatgttttgtt

SEQ ID NO: 227073 - DNA, 25 bp, Rattus norvegicus
cacttctgaaatgccatgttttgtt

SEQ ID NO: 227074 - DNA, 25 bp, Rattus norvegicus
cacttctgacataatctttctaagt

SEQ ID NO: 227075 - DNA, 25 bp, Rattus norvegicus
cacttctgacattatctttctaagt

SEQ ID NO: 227076 - DNA, 25 bp, Rattus norvegicus
cacttctgcctgatgacttcaaaac

SEQ ID NO: 227077 - DNA, 25 bp, Rattus norvegicus
cacttctgcctgttgacttcaaaac

SEQ ID NO: 227078 - DNA, 25 bp, Rattus norvegicus
cacttctgctcgctgttgaccaaaa

SEQ ID NO: 227079 - DNA, 25 bp, Rattus norvegicus
cacttctgctcggtgttgaccaaaa

SEQ ID NO: 227080 - DNA, 25 bp, Rattus norvegicus
cacttctgcttgacatgcatgtcta

SEQ ID NO: 227081 - DNA, 25 bp, Rattus norvegicus
cacttctgcttgtcatgcatgtcta

SEQ ID NO: 227082 - DNA, 25 bp, Rattus norvegicus
cacttctgctttatctccttaactt

SEQ ID NO: 227083 - DNA, 25 bp, Rattus norvegicus
cacttctgctttttctccttaactt

SEQ ID NO: 227084 - DNA, 25 bp, Rattus norvegicus
cacttctggaacactttctgaacac

SEQ ID NO: 227085 - DNA, 25 bp, Rattus norvegicus
cacttctggaactctttctgaacac

SEQ ID NO: 227086 - DNA, 25 bp, Rattus norvegicus
cacttctggcctctacttattttct

SEQ ID NO: 227087 - DNA, 25 bp, Rattus norvegicus
cacttctggcctgtacttattttct

SEQ ID NO: 227088 - DNA, 25 bp, Rattus norvegicus
cacttctgggtgagcacgttgttaa

SEQ ID NO: 227089 - DNA, 25 bp, Rattus norvegicus
cacttctgggtgtgcacgttgttaa

SEQ ID NO: 227090 - DNA, 25 bp, Rattus norvegicus
cacttctggtctctgaactctaata

SEQ ID NO: 227091 - DNA, 25 bp, Rattus norvegicus
cacttctggtctgtgaactctaata

SEQ ID NO: 227092 - DNA, 25 bp, Rattus norvegicus
cacttctgtgatattctttgtctgc

SEQ ID NO: 227093 - DNA, 25 bp, Rattus norvegicus
cacttctgtgattttctttgtctgc

SEQ ID NO: 227094 - DNA, 25 bp, Rattus norvegicus
cacttcttacagatgtggacactaa

SEQ ID NO: 227095 - DNA, 25 bp, Rattus norvegicus
cacttcttacagttgtggacactaa

SEQ ID NO: 227096 - DNA, 25 bp, Rattus norvegicus
cacttcttcctgcaatgttgccata

SEQ ID NO: 227097 - DNA, 25 bp, Rattus norvegicus
cacttcttcctggaatgttgccata

SEQ ID NO: 227098 - DNA, 25 bp, Rattus norvegicus
cacttcttggagactagggagcaga

SEQ ID NO: 227099 - DNA, 25 bp, Rattus norvegicus
cacttcttggagtctagggagcaga

SEQ ID NO: 227100 - DNA, 25 bp, Rattus norvegicus
cacttcttggtgatgactcttgagc

SEQ ID NO: 227101 - DNA, 25 bp, Rattus norvegicus
cacttcttggtgttgactcttgagc

SEQ ID NO: 227102 - DNA, 25 bp, Rattus norvegicus
cacttcttttctattcactattcac

SEQ ID NO: 227103 - DNA, 25 bp, Rattus norvegicus
cacttcttttcttttcactattcac

SEQ ID NO: 227104 - DNA, 25 bp, Rattus norvegicus
cacttgacaatgaggctcgtgtgaa

SEQ ID NO: 227105 - DNA, 25 bp, Rattus norvegicus
cacttgacaatgtggctcgtgtgaa

SEQ ID NO: 227106 - DNA, 25 bp, Rattus norvegicus
cacttgagagctacacctgtcggaa

SEQ ID NO: 227107 - DNA, 25 bp, Rattus norvegicus
cacttgagagcttcacctgtcggaa

SEQ ID NO: 227108 - DNA, 25 bp, Rattus norvegicus
cacttgagcgctcgtggtgatgtca

SEQ ID NO: 227109 - DNA, 25 bp, Rattus norvegicus
cacttgagcgctggtggtgatgtca

SEQ ID NO: 227110 - DNA, 25 bp, Rattus norvegicus
cacttgagtgagaaacgtgtttagt

SEQ ID NO: 227111 - DNA, 25 bp, Rattus norvegicus
cacttgagtgagtaacgtgtttagt

SEQ ID NO: 227112 - DNA, 25 bp, Rattus norvegicus
cacttgatggctatcctgtcagttg

SEQ ID NO: 227113 - DNA, 25 bp, Rattus norvegicus
cacttgatggctttcctgtcagttg

SEQ ID NO: 227114 - DNA, 25 bp, Rattus norvegicus
cacttgatgtgactggaacctccat

SEQ ID NO: 227115 - DNA, 25 bp, Rattus norvegicus
cacttgatgtgagtggaacctccat

SEQ ID NO: 227116 - DNA, 25 bp, Rattus norvegicus
cacttgattgaaatcgattcccggg

SEQ ID NO: 227117 - DNA, 25 bp, Rattus norvegicus
cacttgattgaattcgattcccggg

SEQ ID NO: 227118 - DNA, 25 bp, Rattus norvegicus
cacttgatttgcagggttttggaaa

SEQ ID NO: 227119 - DNA, 25 bp, Rattus norvegicus
cacttgatttgctgggttttggaaa

SEQ ID NO: 227120 - DNA, 25 bp, Rattus norvegicus
cacttgcacaagcactacactattt

SEQ ID NO: 227121 - DNA, 25 bp, Rattus norvegicus
cacttgcacaaggactacactattt

SEQ ID NO: 227122 - DNA, 25 bp, Rattus norvegicus
cacttgcacctcaggaatgttcaaa

SEQ ID NO: 227123 - DNA, 25 bp, Rattus norvegicus
cacttgcacctctggaatgttcaaa

SEQ ID NO: 227124 - DNA, 25 bp, Rattus norvegicus
cacttgcagatcaaggttgctcttc

SEQ ID NO: 227125 - DNA, 25 bp, Rattus norvegicus
cacttgcagatctaggttgctcttc

SEQ ID NO: 227126 - DNA, 25 bp, Rattus norvegicus
cacttgccacttcctactaaatgta

SEQ ID NO: 227127 - DNA, 25 bp, Rattus norvegicus
cacttgccacttgctactaaatgta

SEQ ID NO: 227128 - DNA, 25 bp, Rattus norvegicus
cacttgccatgtagctgccagataa

SEQ ID NO: 227129 - DNA, 25 bp, Rattus norvegicus
cacttgccatgttgctgccagataa

SEQ ID NO: 227130 - DNA, 25 bp, Rattus norvegicus
cacttgccctctcaggtagtgagga

SEQ ID NO: 227131 - DNA, 25 bp, Rattus norvegicus
cacttgccctctgaggtagtgagga

SEQ ID NO: 227132 - DNA, 25 bp, Rattus norvegicus
cacttgccggtgactgctgtggagt

SEQ ID NO: 227133 - DNA, 25 bp, Rattus norvegicus
cacttgccggtgtctgctgtggagt

SEQ ID NO: 227134 - DNA, 25 bp, Rattus norvegicus
cacttgcctggcctgtacaaacaag

SEQ ID NO: 227135 - DNA, 25 bp, Rattus norvegicus
cacttgcctggcgtgtacaaacaag

SEQ ID NO: 227136 - DNA, 25 bp, Rattus norvegicus
cacttgctacggacgttcttaacag

SEQ ID NO: 227137 - DNA, 25 bp, Rattus norvegicus
cacttgctacggtcgttcttaacag

SEQ ID NO: 227138 - DNA, 25 bp, Rattus norvegicus
cacttgctatccatgttttctatta

SEQ ID NO: 227139 - DNA, 25 bp, Rattus norvegicus
cacttgctatccttgttttctatta

SEQ ID NO: 227140 - DNA, 25 bp, Rattus norvegicus
cacttgctcgtccatccctcaagag

SEQ ID NO: 227141 - DNA, 25 bp, Rattus norvegicus
cacttgctcgtcgatccctcaagag

SEQ ID NO: 227142 - DNA, 25 bp, Rattus norvegicus
cacttggaaaagacctctcagtttt

SEQ ID NO: 227143 - DNA, 25 bp, Rattus norvegicus
cacttggaaaagtcctctcagtttt

SEQ ID NO: 227144 - DNA, 25 bp, Rattus norvegicus
cacttggagaccactgtgctagaga

SEQ ID NO: 227145 - DNA, 25 bp, Rattus norvegicus
cacttggagacctctgtgctagaga

SEQ ID NO: 227146 - DNA, 25 bp, Rattus norvegicus
cacttggagcgtatttgctggcttg

SEQ ID NO: 227147 - DNA, 25 bp, Rattus norvegicus
cacttggagcgtttttgctggcttg

SEQ ID NO: 227148 - DNA, 25 bp, Rattus norvegicus
cacttggagtttcggatgtacatac

SEQ ID NO: 227149 - DNA, 25 bp, Rattus norvegicus
cacttggagtttgggatgtacatac

SEQ ID NO: 227150 - DNA, 25 bp, Rattus norvegicus
cacttggatgagataaccagggcct

SEQ ID NO: 227151 - DNA, 25 bp, Rattus norvegicus
cacttggatgagttaaccagggcct

SEQ ID NO: 227152 - DNA, 25 bp, Rattus norvegicus
cacttggcatggatgggagactgac

SEQ ID NO: 227153 - DNA, 25 bp, Rattus norvegicus
cacttggcatggttgggagactgac

SEQ ID NO: 227154 - DNA, 25 bp, Rattus norvegicus
cacttggcctggagatacatgtaag

SEQ ID NO: 227155 - DNA, 25 bp, Rattus norvegicus
cacttggcctggtgatacatgtaag

SEQ ID NO: 227156 - DNA, 25 bp, Rattus norvegicus
cacttggctgacatgggtgtgttca

SEQ ID NO: 227157 - DNA, 25 bp, Rattus norvegicus
cacttggctgacttgggtgtgttca

SEQ ID NO: 227158 - DNA, 25 bp, Rattus norvegicus
cacttggctgtgacttgagggaaat

SEQ ID NO: 227159 - DNA, 25 bp, Rattus norvegicus
cacttggctgtgtcttgagggaaat

SEQ ID NO: 227160 - DNA, 25 bp, Rattus norvegicus
cacttggcttatatctaaaactggg

SEQ ID NO: 227161 - DNA, 25 bp, Rattus norvegicus
cacttggcttatttctaaaactggg

SEQ ID NO: 227162 - DNA, 25 bp, Rattus norvegicus
cacttgggacctccctgtgaggcca

SEQ ID NO: 227163 - DNA, 25 bp, Rattus norvegicus
cacttgggacctgcctgtgaggcca

SEQ ID NO: 227164 - DNA, 25 bp, Rattus norvegicus
cacttgggaggaagcgcagaagaca

SEQ ID NO: 227165 - DNA, 25 bp, Rattus norvegicus
cacttgggaggatgcgcagaagaca

SEQ ID NO: 227166 - DNA, 25 bp, Rattus norvegicus
cacttgggatctatgtatgccttca

SEQ ID NO: 227167 - DNA, 25 bp, Rattus norvegicus
cacttgggatctttgtatgccttca

SEQ ID NO: 227168 - DNA, 25 bp, Rattus norvegicus
cacttgggtggcactgctgctacag

SEQ ID NO: 227169 - DNA, 25 bp, Rattus norvegicus
cacttgggtggctctgctgctacag

SEQ ID NO: 227170 - DNA, 25 bp, Rattus norvegicus
cacttgggttcaatagaaggagcct

SEQ ID NO: 227171 - DNA, 25 bp, Rattus norvegicus
cacttgggttcattagaaggagcct

SEQ ID NO: 227172 - DNA, 25 bp, Rattus norvegicus
cacttggtcttgatcttttttaatg

SEQ ID NO: 227173 - DNA, 25 bp, Rattus norvegicus
cacttggtcttgttcttttttaatg

SEQ ID NO: 227174 - DNA, 25 bp, Rattus norvegicus
cacttggtgactactaatagggctc

SEQ ID NO: 227175 - DNA, 25 bp, Rattus norvegicus
cacttggtgacttctaatagggctc

SEQ ID NO: 227176 - DNA, 25 bp, Rattus norvegicus
cacttggtgccccattaatagggtt

SEQ ID NO: 227177 - DNA, 25 bp, Rattus norvegicus
cacttggtgcccgattaatagggtt

SEQ ID NO: 227178 - DNA, 25 bp, Rattus norvegicus
cacttggtggatctctacactgatt

SEQ ID NO: 227179 - DNA, 25 bp, Rattus norvegicus
cacttggtggatgtctacactgatt

SEQ ID NO: 227180 - DNA, 25 bp, Rattus norvegicus
cacttggtgtggatggatgtcttta

SEQ ID NO: 227181 - DNA, 25 bp, Rattus norvegicus
cacttggtgtggttggatgtcttta

SEQ ID NO: 227182 - DNA, 25 bp, Rattus norvegicus
cacttgtaatttcggtactgggaag

SEQ ID NO: 227183 - DNA, 25 bp, Rattus norvegicus
cacttgtaatttgggtactgggaag

SEQ ID NO: 227184 - DNA, 25 bp, Rattus norvegicus
cacttgtagcaaaagctgtggccac

SEQ ID NO: 227185 - DNA, 25 bp, Rattus norvegicus
cacttgtagcaatagctgtggccac

SEQ ID NO: 227186 - DNA, 25 bp, Rattus norvegicus
cacttgtagcggctgtcatgcacaa

SEQ ID NO: 227187 - DNA, 25 bp, Rattus norvegicus
cacttgtagcgggtgtcatgcacaa

SEQ ID NO: 227188 - DNA, 25 bp, Rattus norvegicus
cacttgtaggcgctaaccttgggaa

SEQ ID NO: 227189 - DNA, 25 bp, Rattus norvegicus
cacttgtaggcggtaaccttgggaa

SEQ ID NO: 227190 - DNA, 25 bp, Rattus norvegicus
cacttgtcctatctctgttcgtaga

SEQ ID NO: 227191 - DNA, 25 bp, Rattus norvegicus
cacttgtcctatgtctgttcgtaga

SEQ ID NO: 227192 - DNA, 25 bp, Rattus norvegicus
cacttgtccttgctgctctgaggag

SEQ ID NO: 227193 - DNA, 25 bp, Rattus norvegicus
cacttgtccttggtgctctgaggag

SEQ ID NO: 227194 - DNA, 25 bp, Rattus norvegicus
cacttgtctggaccagccagtgcaa

SEQ ID NO: 227195 - DNA, 25 bp, Rattus norvegicus
cacttgtctggagcagccagtgcaa

SEQ ID NO: 227196 - DNA, 25 bp, Rattus norvegicus
cacttgtctgggaggcagatggtcc

SEQ ID NO: 227197 - DNA, 25 bp, Rattus norvegicus
cacttgtctgggtggcagatggtcc

SEQ ID NO: 227198 - DNA, 25 bp, Rattus norvegicus
cacttgtgagtcagagcgatgggaa

SEQ ID NO: 227199 - DNA, 25 bp, Rattus norvegicus
cacttgtgagtctgagcgatgggaa

SEQ ID NO: 227200 - DNA, 25 bp, Rattus norvegicus
cacttgtgataacttctcagcactg

SEQ ID NO: 227201 - DNA, 25 bp, Rattus norvegicus
cacttgtgataagttctcagcactg

SEQ ID NO: 227202 - DNA, 25 bp, Rattus norvegicus
cacttgtgcagtccctttgaagaaa

SEQ ID NO: 227203 - DNA, 25 bp, Rattus norvegicus
cacttgtgcagtgcctttgaagaaa

SEQ ID NO: 227204 - DNA, 25 bp, Rattus norvegicus
cacttgtgccatagctgacttaggg

SEQ ID NO: 227205 - DNA, 25 bp, Rattus norvegicus
cacttgtgccattgctgacttaggg

SEQ ID NO: 227206 - DNA, 25 bp, Rattus norvegicus
cacttgtgtgagcttcgtggctaca

SEQ ID NO: 227207 - DNA, 25 bp, Rattus norvegicus
cacttgtgtgaggttcgtggctaca

SEQ ID NO: 227208 - DNA, 25 bp, Rattus norvegicus
cacttgttatttactggctcagctg

SEQ ID NO: 227209 - DNA, 25 bp, Rattus norvegicus
cacttgttattttctggctcagctg

SEQ ID NO: 227210 - DNA, 25 bp, Rattus norvegicus
cacttgttccttacgagctttgtaa

SEQ ID NO: 227211 - DNA, 25 bp, Rattus norvegicus
cacttgttcctttcgagctttgtaa

SEQ ID NO: 227212 - DNA, 25 bp, Rattus norvegicus
cacttgttcggccttttctgtaatt

SEQ ID NO: 227213 - DNA, 25 bp, Rattus norvegicus
cacttgttcggcgttttctgtaatt

SEQ ID NO: 227214 - DNA, 25 bp, Rattus norvegicus
cacttgttgagtcagtccattcctc

SEQ ID NO: 227215 - DNA, 25 bp, Rattus norvegicus
cacttgttgagtgagtccattcctc

SEQ ID NO: 227216 - DNA, 25 bp, Rattus norvegicus
cacttgttgccaaggtgagggacag

SEQ ID NO: 227217 - DNA, 25 bp, Rattus norvegicus
cacttgttgccatggtgagggacag

SEQ ID NO: 227218 - DNA, 25 bp, Rattus norvegicus
cactttaacattatccccacagtat

SEQ ID NO: 227219 - DNA, 25 bp, Rattus norvegicus
cactttaacattttccccacagtat

SEQ ID NO: 227220 - DNA, 25 bp, Rattus norvegicus
cactttaccagtccacagtttgttg

SEQ ID NO: 227221 - DNA, 25 bp, Rattus norvegicus
cactttaccagtgcacagtttgttg

SEQ ID NO: 227222 - DNA, 25 bp, Rattus norvegicus
cactttacccttagccttaatgttg

SEQ ID NO: 227223 - DNA, 25 bp, Rattus norvegicus
cactttaccctttgccttaatgttg

SEQ ID NO: 227224 - DNA, 25 bp, Rattus norvegicus
cactttacctgtaccgtctggaggc

SEQ ID NO: 227225 - DNA, 25 bp, Rattus norvegicus
cactttacctgttccgtctggaggc

SEQ ID NO: 227226 - DNA, 25 bp, Rattus norvegicus
cactttactgtacctcagaatgaca

SEQ ID NO: 227227 - DNA, 25 bp, Rattus norvegicus
cactttactgtagctcagaatgaca

SEQ ID NO: 227228 - DNA, 25 bp, Rattus norvegicus
cactttagatgactgacgcctttga

SEQ ID NO: 227229 - DNA, 25 bp, Rattus norvegicus
cactttagatgagtgacgcctttga

SEQ ID NO: 227230 - DNA, 25 bp, Rattus norvegicus
cactttagatttactgtggacgttt

SEQ ID NO: 227231 - DNA, 25 bp, Rattus norvegicus
cactttagattttctgtggacgttt

SEQ ID NO: 227232 - DNA, 25 bp, Rattus norvegicus
cactttagtttgcttctgatggaca

SEQ ID NO: 227233 - DNA, 25 bp, Rattus norvegicus
cactttagtttggttctgatggaca

SEQ ID NO: 227234 - DNA, 25 bp, Rattus norvegicus
cactttatatttccgtgttccggct

SEQ ID NO: 227235 - DNA, 25 bp, Rattus norvegicus
cactttatatttgcgtgttccggct

SEQ ID NO: 227236 - DNA, 25 bp, Rattus norvegicus
cactttatctcccatgactcagtaa

SEQ ID NO: 227237 - DNA, 25 bp, Rattus norvegicus
cactttatctccgatgactcagtaa

SEQ ID NO: 227238 - DNA, 25 bp, Rattus norvegicus
cactttatctggacgggctaatcta

SEQ ID NO: 227239 - DNA, 25 bp, Rattus norvegicus
cactttatctggtcgggctaatcta

SEQ ID NO: 227240 - DNA, 25 bp, Rattus norvegicus
cactttatgactatgctggccagga

SEQ ID NO: 227241 - DNA, 25 bp, Rattus norvegicus
cactttatgactttgctggccagga

SEQ ID NO: 227242 - DNA, 25 bp, Rattus norvegicus
cactttattcaaacattccactggg

SEQ ID NO: 227243 - DNA, 25 bp, Rattus norvegicus
cactttattcaatcattccactggg

SEQ ID NO: 227244 - DNA, 25 bp, Rattus norvegicus
cactttcacccaagtcaagctgtga

SEQ ID NO: 227245 - DNA, 25 bp, Rattus norvegicus
cactttcacccatgtcaagctgtga

SEQ ID NO: 227246 - DNA, 25 bp, Rattus norvegicus
cactttcactccatgattcacaggg

SEQ ID NO: 227247 - DNA, 25 bp, Rattus norvegicus
cactttcactccttgattcacaggg

SEQ ID NO: 227248 - DNA, 25 bp, Rattus norvegicus
cactttcagaacatcagggtgatat

SEQ ID NO: 227249 - DNA, 25 bp, Rattus norvegicus
cactttcagaacttcagggtgatat

SEQ ID NO: 227250 - DNA, 25 bp, Rattus norvegicus
cactttcagcaacctctgtgtgtgt

SEQ ID NO: 227251 - DNA, 25 bp, Rattus norvegicus
cactttcagcaagctctgtgtgtgt

SEQ ID NO: 227252 - DNA, 25 bp, Rattus norvegicus
cactttcatagcacttgcggtgtga

SEQ ID NO: 227253 - DNA, 25 bp, Rattus norvegicus
cactttcatagctcttgcggtgtga

SEQ ID NO: 227254 - DNA, 25 bp, Rattus norvegicus
cactttccatggctgccttagcagt

SEQ ID NO: 227255 - DNA, 25 bp, Rattus norvegicus
cactttccatgggtgccttagcagt

SEQ ID NO: 227256 - DNA, 25 bp, Rattus norvegicus
cactttcccaaaactttcaaagctt

SEQ ID NO: 227257 - DNA, 25 bp, Rattus norvegicus
cactttcccaaatctttcaaagctt

SEQ ID NO: 227258 - DNA, 25 bp, Rattus norvegicus
cactttcccactatgatgaaccaaa

SEQ ID NO: 227259 - DNA, 25 bp, Rattus norvegicus
cactttcccactttgatgaaccaaa

SEQ ID NO: 227260 - DNA, 25 bp, Rattus norvegicus
cactttcccattctttaccacagaa

SEQ ID NO: 227261 - DNA, 25 bp, Rattus norvegicus
cactttcccattgtttaccacagaa

SEQ ID NO: 227262 - DNA, 25 bp, Rattus norvegicus
cactttcctcttatcaaggtgtcgt

SEQ ID NO: 227263 - DNA, 25 bp, Rattus norvegicus
cactttcctcttttcaaggtgtcgt

SEQ ID NO: 227264 - DNA, 25 bp, Rattus norvegicus
cactttcctgagctccttagctgag

SEQ ID NO: 227265 - DNA, 25 bp, Rattus norvegicus
cactttcctgaggtccttagctgag

SEQ ID NO: 227266 - DNA, 25 bp, Rattus norvegicus
cactttcctgccatgagagtttaca

SEQ ID NO: 227267 - DNA, 25 bp, Rattus norvegicus
cactttcctgccttgagagtttaca

SEQ ID NO: 227268 - DNA, 25 bp, Rattus norvegicus
cactttcctgtcaccagtaagatga

SEQ ID NO: 227269 - DNA, 25 bp, Rattus norvegicus
cactttcctgtctccagtaagatga

SEQ ID NO: 227270 - DNA, 25 bp, Rattus norvegicus
cactttcctgtgcttgtgcaaacat

SEQ ID NO: 227271 - DNA, 25 bp, Rattus norvegicus
cactttcctgtggttgtgcaaacat

SEQ ID NO: 227272 - DNA, 25 bp, Rattus norvegicus
cactttcgagtacttgcagggcttc

SEQ ID NO: 227273 - DNA, 25 bp, Rattus norvegicus
cactttcgagtagttgcagggcttc

SEQ ID NO: 227274 - DNA, 25 bp, Rattus norvegicus
cactttcggttgattggatggcaga

SEQ ID NO: 227275 - DNA, 25 bp, Rattus norvegicus
cactttcggttgtttggatggcaga

SEQ ID NO: 227276 - DNA, 25 bp, Rattus norvegicus
cactttcgttctcggaactgtcagg

SEQ ID NO: 227277 - DNA, 25 bp, Rattus norvegicus
cactttcgttctgggaactgtcagg

SEQ ID NO: 227278 - DNA, 25 bp, Rattus norvegicus
cactttctaaatcatgcctcctgga

SEQ ID NO: 227279 - DNA, 25 bp, Rattus norvegicus
cactttctaaatgatgcctcctgga

SEQ ID NO: 227280 - DNA, 25 bp, Rattus norvegicus
cactttctacaaagagctgcgtgtg

SEQ ID NO: 227281 - DNA, 25 bp, Rattus norvegicus
cactttctacaatgagctgcgtgtg

SEQ ID NO: 227282 - DNA, 25 bp, Rattus norvegicus
cactttctcctgcttctatgaagat

SEQ ID NO: 227283 - DNA, 25 bp, Rattus norvegicus
cactttctcctggttctatgaagat

SEQ ID NO: 227284 - DNA, 25 bp, Rattus norvegicus
cactttctctgtcaaacgaagcgaa

SEQ ID NO: 227285 - DNA, 25 bp, Rattus norvegicus
cactttctctgtgaaacgaagcgaa

SEQ ID NO: 227286 - DNA, 25 bp, Rattus norvegicus
cactttctgtaacgccgactgttgg

SEQ ID NO: 227287 - DNA, 25 bp, Rattus norvegicus
cactttctgtaaggccgactgttgg

SEQ ID NO: 227288 - DNA, 25 bp, Rattus norvegicus
cactttcttgctatccgagttcaaa

SEQ ID NO: 227289 - DNA, 25 bp, Rattus norvegicus
cactttcttgctttccgagttcaaa

SEQ ID NO: 227290 - DNA, 25 bp, Rattus norvegicus
cactttcttggaaggttatctgcgt

SEQ ID NO: 227291 - DNA, 25 bp, Rattus norvegicus
cactttcttggatggttatctgcgt

SEQ ID NO: 227292 - DNA, 25 bp, Rattus norvegicus
cactttcttggtacctgatgctgga

SEQ ID NO: 227293 - DNA, 25 bp, Rattus norvegicus
cactttcttggttcctgatgctgga

SEQ ID NO: 227294 - DNA, 25 bp, Rattus norvegicus
cactttctttaaatgttcctcctga

SEQ ID NO: 227295 - DNA, 25 bp, Rattus norvegicus
cactttctttaattgttcctcctga

SEQ ID NO: 227296 - DNA, 25 bp, Rattus norvegicus
cactttctttacctttatcttcatc

SEQ ID NO: 227297 - DNA, 25 bp, Rattus norvegicus
cactttctttacgtttatcttcatc

SEQ ID NO: 227298 - DNA, 25 bp, Rattus norvegicus
cactttgaaaatctttattgcctta

SEQ ID NO: 227299 - DNA, 25 bp, Rattus norvegicus
cactttgaaaatgtttattgcctta

SEQ ID NO: 227300 - DNA, 25 bp, Rattus norvegicus
cactttgactaccagcctttattga

SEQ ID NO: 227301 - DNA, 25 bp, Rattus norvegicus
cactttgactacgagcctttattga

SEQ ID NO: 227302 - DNA, 25 bp, Rattus norvegicus
cactttgagcttacgtggtgacagc

SEQ ID NO: 227303 - DNA, 25 bp, Rattus norvegicus
cactttgagctttcgtggtgacagc

SEQ ID NO: 227304 - DNA, 25 bp, Rattus norvegicus
cactttgatgttctggagcatgtca

SEQ ID NO: 227305 - DNA, 25 bp, Rattus norvegicus
cactttgatgttgtggagcatgtca

SEQ ID NO: 227306 - DNA, 25 bp, Rattus norvegicus
cactttgccggtcctaaacaggaga

SEQ ID NO: 227307 - DNA, 25 bp, Rattus norvegicus
cactttgccggtgctaaacaggaga

SEQ ID NO: 227308 - DNA, 25 bp, Rattus norvegicus
cactttgctctgaacacagtggtga

SEQ ID NO: 227309 - DNA, 25 bp, Rattus norvegicus
cactttgctctgtacacagtggtga

SEQ ID NO: 227310 - DNA, 25 bp, Rattus norvegicus
cactttgctgctcttttacttttca

SEQ ID NO: 227311 - DNA, 25 bp, Rattus norvegicus
cactttgctgctgttttacttttca

SEQ ID NO: 227312 - DNA, 25 bp, Rattus norvegicus
cactttggaaatacagatgcccaca

SEQ ID NO: 227313 - DNA, 25 bp, Rattus norvegicus
cactttggaaattcagatgcccaca

SEQ ID NO: 227314 - DNA, 25 bp, Rattus norvegicus
cactttggaagaaaaggcccgggca

SEQ ID NO: 227315 - DNA, 25 bp, Rattus norvegicus
cactttggaagataaggcccgggca

SEQ ID NO: 227316 - DNA, 25 bp, Rattus norvegicus
cactttggaatgacgcggttcccac

SEQ ID NO: 227317 - DNA, 25 bp, Rattus norvegicus
cactttggaatgtcgcggttcccac

SEQ ID NO: 227318 - DNA, 25 bp, Rattus norvegicus
cactttggaattagactggttcaca

SEQ ID NO: 227319 - DNA, 25 bp, Rattus norvegicus
cactttggaatttgactggttcaca

SEQ ID NO: 227320 - DNA, 25 bp, Rattus norvegicus
cactttggacacatgctgagttgaa

SEQ ID NO: 227321 - DNA, 25 bp, Rattus norvegicus
cactttggacacttgctgagttgaa

SEQ ID NO: 227322 - DNA, 25 bp, Rattus norvegicus
cactttgggctgaggctgagtaaaa

SEQ ID NO: 227323 - DNA, 25 bp, Rattus norvegicus
cactttgggctgtggctgagtaaaa

SEQ ID NO: 227324 - DNA, 25 bp, Rattus norvegicus
cactttgggtggagtctagactctt

SEQ ID NO: 227325 - DNA, 25 bp, Rattus norvegicus
cactttgggtggtgtctagactctt

SEQ ID NO: 227326 - DNA, 25 bp, Rattus norvegicus
cactttggttatctcctaggttcta

SEQ ID NO: 227327 - DNA, 25 bp, Rattus norvegicus
cactttggttatgtcctaggttcta

SEQ ID NO: 227328 - DNA, 25 bp, Rattus norvegicus
cactttgtccttcccgtacatgtgg

SEQ ID NO: 227329 - DNA, 25 bp, Rattus norvegicus
cactttgtccttctttgctcttgag

SEQ ID NO: 227330 - DNA, 25 bp, Rattus norvegicus
cactttgtccttgccgtacatgtgg

SEQ ID NO: 227331 - DNA, 25 bp, Rattus norvegicus
cactttgtccttgtttgctcttgag

SEQ ID NO: 227332 - DNA, 25 bp, Rattus norvegicus
cactttgtcttcaccaacgagagca

SEQ ID NO: 227333 - DNA, 25 bp, Rattus norvegicus
cactttgtcttctccaacgagagca

SEQ ID NO: 227334 - DNA, 25 bp, Rattus norvegicus
cactttgtctttcgtttgtctgcag

SEQ ID NO: 227335 - DNA, 25 bp, Rattus norvegicus
cactttgtctttggtttgtctgcag

SEQ ID NO: 227336 - DNA, 25 bp, Rattus norvegicus
cactttgtgtgtctccttgatttaa

SEQ ID NO: 227337 - DNA, 25 bp, Rattus norvegicus
cactttgtgtgtgtccttgatttaa

SEQ ID NO: 227338 - DNA, 25 bp, Rattus norvegicus
cactttgtgttacttagatatgcag

SEQ ID NO: 227339 - DNA, 25 bp, Rattus norvegicus
cactttgtgttagttagatatgcag

SEQ ID NO: 227340 - DNA, 25 bp, Rattus norvegicus
cactttgtgttgacctcatccctgg

SEQ ID NO: 227341 - DNA, 25 bp, Rattus norvegicus
cactttgtgttgtcctcatccctgg

SEQ ID NO: 227342 - DNA, 25 bp, Rattus norvegicus
cactttgttactaactgggactggg

SEQ ID NO: 227343 - DNA, 25 bp, Rattus norvegicus
cactttgttacttactgggactggg

SEQ ID NO: 227344 - DNA, 25 bp, Rattus norvegicus
cactttgtttctagatgcatgggag

SEQ ID NO: 227345 - DNA, 25 bp, Rattus norvegicus
cactttgtttcttgatgcatgggag

SEQ ID NO: 227346 - DNA, 25 bp, Rattus norvegicus
cactttgttttgcttctgttatctt

SEQ ID NO: 227347 - DNA, 25 bp, Rattus norvegicus
cactttgttttggttctgttatctt

SEQ ID NO: 227348 - DNA, 25 bp, Rattus norvegicus
cacttttacaagccgcaaaggcagc

SEQ ID NO: 227349 - DNA, 25 bp, Rattus norvegicus
cacttttacaaggcgcaaaggcagc

SEQ ID NO: 227350 - DNA, 25 bp, Rattus norvegicus
cacttttccttgactttgggtcaca

SEQ ID NO: 227351 - DNA, 25 bp, Rattus norvegicus
cacttttccttgtctttgggtcaca

SEQ ID NO: 227352 - DNA, 25 bp, Rattus norvegicus
cacttttctgtcaaccttaggtctt

SEQ ID NO: 227353 - DNA, 25 bp, Rattus norvegicus
cacttttctgtctaccttaggtctt

SEQ ID NO: 227354 - DNA, 25 bp, Rattus norvegicus
cacttttcttaccatactctgctac

SEQ ID NO: 227355 - DNA, 25 bp, Rattus norvegicus
cacttttcttacgatactctgctac

SEQ ID NO: 227356 - DNA, 25 bp, Rattus norvegicus
cacttttgaggtcgccgaagccttg

SEQ ID NO: 227357 - DNA, 25 bp, Rattus norvegicus
cacttttgaggtggccgaagccttg

SEQ ID NO: 227358 - DNA, 25 bp, Rattus norvegicus
cacttttgcaggactgaccccttta

SEQ ID NO: 227359 - DNA, 25 bp, Rattus norvegicus
cacttttgcaggtctgaccccttta

SEQ ID NO: 227360 - DNA, 25 bp, Rattus norvegicus
cacttttgtcacagttggctggctg

SEQ ID NO: 227361 - DNA, 25 bp, Rattus norvegicus
cacttttgtcactgttggctggctg

SEQ ID NO: 227362 - DNA, 25 bp, Rattus norvegicus
cactttttcccaagtttaggatgag

SEQ ID NO: 227363 - DNA, 25 bp, Rattus norvegicus
cactttttcccatgtttaggatgag

SEQ ID NO: 227364 - DNA, 25 bp, Rattus norvegicus
cactttttcctgagctttagggtca

SEQ ID NO: 227365 - DNA, 25 bp, Rattus norvegicus
cactttttcctgtgctttagggtca

SEQ ID NO: 227366 - DNA, 25 bp, Rattus norvegicus
cactttttctgaactctgctgctta

SEQ ID NO: 227367 - DNA, 25 bp, Rattus norvegicus
cactttttctgatctctgctgctta

SEQ ID NO: 227368 - DNA, 25 bp, Rattus norvegicus
cactttttgaggatgctggctactt

SEQ ID NO: 227369 - DNA, 25 bp, Rattus norvegicus
cactttttgaggttgctggctactt

SEQ ID NO: 227370 - DNA, 25 bp, Rattus norvegicus
cactttttgtgccttgtattatcag

SEQ ID NO: 227371 - DNA, 25 bp, Rattus norvegicus
cactttttgtgcgttgtattatcag

SEQ ID NO: 227372 - DNA, 25 bp, Rattus norvegicus
cactttttgtgtatgcgtactgtac

SEQ ID NO: 227373 - DNA, 25 bp, Rattus norvegicus
cactttttgtgtttgcgtactgtac

SEQ ID NO: 227374 - DNA, 25 bp, Rattus norvegicus
cagaaaaagtgtaccagagatggat

SEQ ID NO: 227375 - DNA, 25 bp, Rattus norvegicus
cagaaaaagtgttccagagatggat

SEQ ID NO: 227376 - DNA, 25 bp, Rattus norvegicus
cagaaaaattccctttgacatgtag

SEQ ID NO: 227377 - DNA, 25 bp, Rattus norvegicus
cagaaaaattccgtttgacatgtag

SEQ ID NO: 227378 - DNA, 25 bp, Rattus norvegicus
cagaaaaccaccaaacacaactcga

SEQ ID NO: 227379 - DNA, 25 bp, Rattus norvegicus
cagaaaaccacctaacacaactcga

SEQ ID NO: 227380 - DNA, 25 bp, Rattus norvegicus
cagaaaaccatcatcctaagtgaac

SEQ ID NO: 227381 - DNA, 25 bp, Rattus norvegicus
cagaaaaccatcttcctaagtgaac

SEQ ID NO: 227382 - DNA, 25 bp, Rattus norvegicus
cagaaaacctcacactcagtcttga

SEQ ID NO: 227383 - DNA, 25 bp, Rattus norvegicus
cagaaaacctcagactcagtcttga

SEQ ID NO: 227384 - DNA, 25 bp, Rattus norvegicus
cagaaaactactctgctttgagcat

SEQ ID NO: 227385 - DNA, 25 bp, Rattus norvegicus
cagaaaactactgtgctttgagcat

SEQ ID NO: 227386 - DNA, 25 bp, Rattus norvegicus
cagaaaactatgacacaaagtctcc

SEQ ID NO: 227387 - DNA, 25 bp, Rattus norvegicus
cagaaaactatgtcacaaagtctcc

SEQ ID NO: 227388 - DNA, 25 bp, Rattus norvegicus
cagaaaagacttatcctgcagttta

SEQ ID NO: 227389 - DNA, 25 bp, Rattus norvegicus
cagaaaagacttttcctgcagttta

SEQ ID NO: 227390 - DNA, 25 bp, Rattus norvegicus
cagaaaagggccacttcttagtcct

SEQ ID NO: 227391 - DNA, 25 bp, Rattus norvegicus
cagaaaagggcctcttcttagtcct

SEQ ID NO: 227392 - DNA, 25 bp, Rattus norvegicus
cagaaaatgggtatccttggaatat

SEQ ID NO: 227393 - DNA, 25 bp, Rattus norvegicus
cagaaaatgggtttccttggaatat

SEQ ID NO: 227394 - DNA, 25 bp, Rattus norvegicus
cagaaaattgaaagccccagggcct

SEQ ID NO: 227395 - DNA, 25 bp, Rattus norvegicus
cagaaaattgaatgccccagggcct

SEQ ID NO: 227396 - DNA, 25 bp, Rattus norvegicus
cagaaacacctgattgaaagttcat

SEQ ID NO: 227397 - DNA, 25 bp, Rattus norvegicus
cagaaacacctgtttgaaagttcat

SEQ ID NO: 227398 - DNA, 25 bp, Rattus norvegicus
cagaaacagcatcccggagtactgc

SEQ ID NO: 227399 - DNA, 25 bp, Rattus norvegicus
cagaaacagcatgccggagtactgc

SEQ ID NO: 227400 - DNA, 25 bp, Rattus norvegicus
cagaaaccacttcaaccacggtgtt

SEQ ID NO: 227401 - DNA, 25 bp, Rattus norvegicus
cagaaaccacttgaaccacggtgtt

SEQ ID NO: 227402 - DNA, 25 bp, Rattus norvegicus
cagaaacccaagcacacattacaaa

SEQ ID NO: 227403 - DNA, 25 bp, Rattus norvegicus
cagaaacccaaggacacattacaaa

SEQ ID NO: 227404 - DNA, 25 bp, Rattus norvegicus
cagaaaccttttctgcagtgccagc

SEQ ID NO: 227405 - DNA, 25 bp, Rattus norvegicus
cagaaaccttttgtgcagtgccagc

SEQ ID NO: 227406 - DNA, 25 bp, Rattus norvegicus
cagaaacgcagaagttctccctacc

SEQ ID NO: 227407 - DNA, 25 bp, Rattus norvegicus
cagaaacgcagatgttctccctacc

SEQ ID NO: 227408 - DNA, 25 bp, Rattus norvegicus
cagaaacgtgttctacccatggctt

SEQ ID NO: 227409 - DNA, 25 bp, Rattus norvegicus
cagaaacgtgttgtacccatggctt

SEQ ID NO: 227410 - DNA, 25 bp, Rattus norvegicus
cagaaactcaggcatgaggaggcaa

SEQ ID NO: 227411 - DNA, 25 bp, Rattus norvegicus
cagaaactcagggatgaggaggcaa

SEQ ID NO: 227412 - DNA, 25 bp, Rattus norvegicus
cagaaactccggcagcggcggcaca

SEQ ID NO: 227413 - DNA, 25 bp, Rattus norvegicus
cagaaactccgggagcggcggcaca

SEQ ID NO: 227414 - DNA, 25 bp, Rattus norvegicus
cagaaactgattaggtatgaaccga

SEQ ID NO: 227415 - DNA, 25 bp, Rattus norvegicus
cagaaactgatttggtatgaaccga

SEQ ID NO: 227416 - DNA, 25 bp, Rattus norvegicus
cagaaactgcatccatggagacaca

SEQ ID NO: 227417 - DNA, 25 bp, Rattus norvegicus
cagaaactgcatgcatggagacaca

SEQ ID NO: 227418 - DNA, 25 bp, Rattus norvegicus
cagaaactgtggctccttaggatta

SEQ ID NO: 227419 - DNA, 25 bp, Rattus norvegicus
cagaaactgtgggtccttaggatta

SEQ ID NO: 227420 - DNA, 25 bp, Rattus norvegicus
cagaaacttctaagtggatggtcac

SEQ ID NO: 227421 - DNA, 25 bp, Rattus norvegicus
cagaaacttctatgtggatggtcac

SEQ ID NO: 227422 - DNA, 25 bp, Rattus norvegicus
cagaaacttctcatttcaaccttgg

SEQ ID NO: 227423 - DNA, 25 bp, Rattus norvegicus
cagaaacttctcttttcaaccttgg

SEQ ID NO: 227424 - DNA, 25 bp, Rattus norvegicus
cagaaacttgctattcctgcctttg

SEQ ID NO: 227425 - DNA, 25 bp, Rattus norvegicus
cagaaacttgcttttcctgcctttg

SEQ ID NO: 227426 - DNA, 25 bp, Rattus norvegicus
cagaaagaatcaccccacatggctt

SEQ ID NO: 227427 - DNA, 25 bp, Rattus norvegicus
cagaaagaatcagcccacatggctt

SEQ ID NO: 227428 - DNA, 25 bp, Rattus norvegicus
cagaaagacaagatttcccaaccca

SEQ ID NO: 227429 - DNA, 25 bp, Rattus norvegicus
cagaaagacaagttttcccaaccca

SEQ ID NO: 227430 - DNA, 25 bp, Rattus norvegicus
cagaaagaccccactcagatgagac

SEQ ID NO: 227431 - DNA, 25 bp, Rattus norvegicus
cagaaagacccctctcagatgagac

SEQ ID NO: 227432 - DNA, 25 bp, Rattus norvegicus
cagaaagagggcattaccaatacca

SEQ ID NO: 227433 - DNA, 25 bp, Rattus norvegicus
cagaaagagggctttaccaatacca

SEQ ID NO: 227434 - DNA, 25 bp, Rattus norvegicus
cagaaagagtttaccttggatgata

SEQ ID NO: 227435 - DNA, 25 bp, Rattus norvegicus
cagaaagagttttccttggatgata

SEQ ID NO: 227436 - DNA, 25 bp, Rattus norvegicus
cagaaagattgccttaccctagtaa

SEQ ID NO: 227437 - DNA, 25 bp, Rattus norvegicus
cagaaagattgcgttaccctagtaa

SEQ ID NO: 227438 - DNA, 25 bp, Rattus norvegicus
cagaaagcaaacagaactagcactg

SEQ ID NO: 227439 - DNA, 25 bp, Rattus norvegicus
cagaaagcaaactgaactagcactg

SEQ ID NO: 227440 - DNA, 25 bp, Rattus norvegicus
cagaaagcctctcccttgggttgga

SEQ ID NO: 227441 - DNA, 25 bp, Rattus norvegicus
cagaaagcctctgccttgggttgga

SEQ ID NO: 227442 - DNA, 25 bp, Rattus norvegicus
cagaaagcctgcactgtgtcaagag

SEQ ID NO: 227443 - DNA, 25 bp, Rattus norvegicus
cagaaagcctgctctgtgtcaagag

SEQ ID NO: 227444 - DNA, 25 bp, Rattus norvegicus
cagaaagcgaatatgttagcaggaa

SEQ ID NO: 227445 - DNA, 25 bp, Rattus norvegicus
cagaaagcgaatttgttagcaggaa

SEQ ID NO: 227446 - DNA, 25 bp, Rattus norvegicus
cagaaagctacaacatcgccggtgc
